United States Patent 7,250,496 (BIOINFORMATICALLY DETECTABLE GROUP OF NOVEL REGULATORY GENES AND USES THEREOF) - sequence listing, part 6

SEQ ID NO: 194796 - RNA, 24 nt, Human
ucaagacagaaugcuuguaccaca

SEQ ID NO: 194797 - RNA, 19 nt, Human
ucagaacaaggagagacca

SEQ ID NO: 194798 - RNA, 24 nt, Human
ucagcacccugggauuacaggcgu

SEQ ID NO: 194799 - RNA, 22 nt, Human
ucauacuacccacagauagcca

SEQ ID NO: 194800 - RNA, 19 nt, Human
ucaugagagacaguuccag

SEQ ID NO: 194801 - RNA, 21 nt, Human
ucauuuaaaaaagaaaugggg

SEQ ID NO: 194802 - RNA, 21 nt, Human
uccaaaaauaggaaaugaaau

SEQ ID NO: 194803 - RNA, 21 nt, Human
uccaggggagaggucacagcu

SEQ ID NO: 194804 - RNA, 23 nt, Human
ucccaggguucaaagcuuuucuc

SEQ ID NO: 194805 - RNA, 19 nt, Human
uccuacagcagaagguacc

SEQ ID NO: 194806 - RNA, 20 nt, Human
uccugaaacaugaagagcuc

SEQ ID NO: 194807 - RNA, 20 nt, Human
uccugaagcaccugcccuuc

SEQ ID NO: 194808 - RNA, 21 nt, Human
ucuaaccacaaaaaaagaaaa

SEQ ID NO: 194809 - RNA, 21 nt, Human
ucuaaccacaaaaaaagaaaa

SEQ ID NO: 194810 - RNA, 24 nt, Human
ucucagcacccugggauuacaggc

SEQ ID NO: 194811 - RNA, 18 nt, Human
ucuccuacagcagaaggu

SEQ ID NO: 194812 - RNA, 24 nt, Human
ucuccugaaacaugaagagcucau

SEQ ID NO: 194813 - RNA, 19 nt, Human
ugagauaucuuugcuaaaa

SEQ ID NO: 194814 - RNA, 19 nt, Human
ugaggaaaugaacagagaa

SEQ ID NO: 194815 - RNA, 20 nt, Human
ugaggugacggaggaaauga

SEQ ID NO: 194816 - RNA, 24 nt, Human
ugaguuacuggguaacacagagag

SEQ ID NO: 194817 - RNA, 18 nt, Human
ugcauagauacaugugua

SEQ ID NO: 194818 - RNA, 20 nt, Human
ugcaugcaguaaugcaugua

SEQ ID NO: 194819 - RNA, 24 nt, Human
ugccuccuaccugcuaaaaacacc

SEQ ID NO: 194820 - RNA, 18 nt, Human
uggcucacaccuguaauc

SEQ ID NO: 194821 - RNA, 21 nt, Human
uggcucacaccuguaaucuca

SEQ ID NO: 194822 - RNA, 22 nt, Human
uggcucacaccuguaaucucag

SEQ ID NO: 194823 - RNA, 24 nt, Human
uggcucacaccuguaaucucagca

SEQ ID NO: 194824 - RNA, 18 nt, Human
ugggacaggugccucuuc

SEQ ID NO: 194825 - RNA, 18 nt, Human
ugggauuacaggcgugag

SEQ ID NO: 194826 - RNA, 21 nt, Human
ugggauuacaggcgugagcca

SEQ ID NO: 194827 - RNA, 22 nt, Human
ugggauuacaggcgugagccac

SEQ ID NO: 194828 - RNA, 23 nt, Human
ugggauuacaggcgugagccacc

SEQ ID NO: 194829 - RNA, 23 nt, Human
ugggauuacaggcgugagccacc

SEQ ID NO: 194830 - RNA, 24 nt, Human
ugggauuacaggcgugagccaccg

SEQ ID NO: 194831 - RNA, 20 nt, Human
uggggggcggggaaacgggg

SEQ ID NO: 194832 - RNA, 20 nt, Human
uggggggcggggaaacgggg

SEQ ID NO: 194833 - RNA, 20 nt, Human
uggggggcggggaaacgggg

SEQ ID NO: 194834 - RNA, 20 nt, Human
uguaagaagugcaugcagua

SEQ ID NO: 194835 - RNA, 23 nt, Human
uguuuagguucaacucucuccug

SEQ ID NO: 194836 - RNA, 18 nt, Human
uuccaaaaauaggaaaug

SEQ ID NO: 194837 - RNA, 26 nt, Human
uucuucaggucuggaauacuagagua

SEQ ID NO: 194838 - RNA, 21 nt, Human
uuuaaugccuaaagaagaaac

SEQ ID NO: 194839 - RNA, 21 nt, Human
uuugccuccuaccugcuaaaa

SEQ ID NO: 194840 - RNA, 23 nt, Human
aaccaacccccuccuccaauacu

SEQ ID NO: 194841 - RNA, 20 nt, Human
aacccccuccuccaauacua

SEQ ID NO: 194842 - RNA, 24 nt, Human
aagaagaaucuucacaaaucuacu

SEQ ID NO: 194843 - RNA, 24 nt, Human
acucuuaauuaugguagcaauguu

SEQ ID NO: 194844 - RNA, 18 nt, Human
agaaagcaugagauucug

SEQ ID NO: 194845 - RNA, 22 nt, Human
agcaugagauucugaagaagaa

SEQ ID NO: 194846 - RNA, 21 nt, Human
aggaaacccaggcccagagga

SEQ ID NO: 194847 - RNA, 23 nt, Human
auuuuaaccaacccccuccucca

SEQ ID NO: 194848 - RNA, 21 nt, Human
caacccccuccuccaauacua

SEQ ID NO: 194849 - RNA, 26 nt, Human
caaguuuauugaguaauuaaggugac

SEQ ID NO: 194850 - RNA, 21 nt, Human
ccaacccccuccuccaauacu

SEQ ID NO: 194851 - RNA, 23 nt, Human
cccaggcccagaggauauaaagc

SEQ ID NO: 194852 - RNA, 24 nt, Human
ccucuauguguggugacuucagga

SEQ ID NO: 194853 - RNA, 18 nt, Human
cugaagaagaaucuucac

SEQ ID NO: 194854 - RNA, 22 nt, Human
cuucacuggucagugcgucacu

SEQ ID NO: 194855 - RNA, 29 nt, Human
gccacaaugcuucuuucuccuucaaaaaa

SEQ ID NO: 194856 - RNA, 19 nt, Human
gcguuuccauaaaaguucu

SEQ ID NO: 194857 - RNA, 19 nt, Human
uaaaaguucugaguuacuu

SEQ ID NO: 194858 - RNA, 21 nt, Human
uaaagccacaaugcuucuuuc

SEQ ID NO: 194859 - RNA, 20 nt, Human
uaccagaaagcaugagauuc

SEQ ID NO: 194860 - RNA, 21 nt, Human
uacuaccagaaagcaugaggg

SEQ ID NO: 194861 - RNA, 26 nt, Human
ugaagaagaaucuucacaaaucuacu

SEQ ID NO: 194862 - RNA, 22 nt, Human
ugacuucaggaaacccaggccu

SEQ ID NO: 194863 - RNA, 25 nt, Human
aaaaaucacucaagaaaacuaaguc

SEQ ID NO: 194864 - RNA, 30 nt, Human
aaaauagaucuacaaauaucuuguguaaaa

SEQ ID NO: 194865 - RNA, 23 nt, Human
aaacaaaacaacagaaaacaccc

SEQ ID NO: 194866 - RNA, 18 nt, Human
aaacaacagaaaacaccc

SEQ ID NO: 194867 - RNA, 24 nt, Human
aaacaacagaaaacacccauaaac

SEQ ID NO: 194868 - RNA, 18 nt, Human
aaacacccauaaacauua

SEQ ID NO: 194869 - RNA, 22 nt, Human
aaacacccauaaacauuaauga

SEQ ID NO: 194870 - RNA, 25 nt, Human
aaacacccauaaacauuaaugagaa

SEQ ID NO: 194871 - RNA, 24 nt, Human
aaacauuaaugagaauuucaacaa

SEQ ID NO: 194872 - RNA, 20 nt, Human
aaaccaacaucagaaagcag

SEQ ID NO: 194873 - RNA, 23 nt, Human
aaaccuucugauuuaaaagaucc

SEQ ID NO: 194874 - RNA, 20 nt, Human
aaauaacaacuuuauuaacu

SEQ ID NO: 194875 - RNA, 21 nt, Human
aacaaauuacacaaauagaac

SEQ ID NO: 194876 - RNA, 19 nt, Human
aagcagcuuagacagauua

SEQ ID NO: 194877 - RNA, 21 nt, Human
aagcucuccauaaacuuaaaa

SEQ ID NO: 194878 - RNA, 24 nt, Human
acaaaacaacagaaaacacccaua

SEQ ID NO: 194879 - RNA, 19 nt, Human
acauacaagacaaacaguc

SEQ ID NO: 194880 - RNA, 24 nt, Human
acccuguucuaccaccuaaaauaa

SEQ ID NO: 194881 - RNA, 24 nt, Human
acuaagcucuccauaaacuuaaaa

SEQ ID NO: 194882 - RNA, 25 nt, Human
acuaggauaaugaauacauguaaac

SEQ ID NO: 194883 - RNA, 22 nt, Human
acuucaaaaaagcuuuauuagg

SEQ ID NO: 194884 - RNA, 27 nt, Human
agaaacuacaugaaauaacuaggauaa

SEQ ID NO: 194885 - RNA, 22 nt, Human
agaccagcaacuaguuggaugu

SEQ ID NO: 194886 - RNA, 21 nt, Human
agacgugagaaaaugucuaca

SEQ ID NO: 194887 - RNA, 18 nt, Human
agaugccugggugaaaga

SEQ ID NO: 194888 - RNA, 24 nt, Human
agguguuuuguacaggaagauuuc

SEQ ID NO: 194889 - RNA, 18 nt, Human
agucauagcauccacagu

SEQ ID NO: 194890 - RNA, 23 nt, Human
aguuuuauuuuuuaaaugaguuu

SEQ ID NO: 194891 - RNA, 21 nt, Human
auaaaugaauacagaguugag

SEQ ID NO: 194892 - RNA, 19 nt, Human
augaauacauguaaacacc

SEQ ID NO: 194893 - RNA, 18 nt, Human
auggaaaugaaccuacuu

SEQ ID NO: 194894 - RNA, 19 nt, Human
augguccaaaaaauuuuaa

SEQ ID NO: 194895 - RNA, 19 nt, Human
auuguuggauuuuuaaaaa

SEQ ID NO: 194896 - RNA, 27 nt, Human
caaaacaacagaaaacacccauaaaca

SEQ ID NO: 194897 - RNA, 20 nt, Human
caaacaaaacaacagaaaac

SEQ ID NO: 194898 - RNA, 26 nt, Human
caaacaaaacaacagaaaacacccau

SEQ ID NO: 194899 - RNA, 19 nt, Human
caagacaaacagucauagc

SEQ ID NO: 194900 - RNA, 23 nt, Human
caagacaaacagucauagcaucc

SEQ ID NO: 194901 - RNA, 21 nt, Human
caagcaaaagccuguuaauac

SEQ ID NO: 194902 - RNA, 21 nt, Human
cacaguguucccuuuuuuggg

SEQ ID NO: 194903 - RNA, 20 nt, Human
caccugaaaugccaaccaaa

SEQ ID NO: 194904 - RNA, 21 nt, Human
cacuuuaaguuucuugaugcc

SEQ ID NO: 194905 - RNA, 20 nt, Human
caggagauauguuauuacac

SEQ ID NO: 194906 - RNA, 18 nt, Human
caugacucuacccuguuc

SEQ ID NO: 194907 - RNA, 18 nt, Human
cauucaaguaucuucagg

SEQ ID NO: 194908 - RNA, 20 nt, Human
ccacagcauauagguaaaag

SEQ ID NO: 194909 - RNA, 22 nt, Human
ccacccaugucccucuaucacg

SEQ ID NO: 194910 - RNA, 23 nt, Human
cccucuggaggagaugccugggu

SEQ ID NO: 194911 - RNA, 21 nt, Human
ccugcccacagcauauaggua

SEQ ID NO: 194912 - RNA, 19 nt, Human
cgcccuauauucuguggac

SEQ ID NO: 194913 - RNA, 22 nt, Human
cggaucccucuggaggagaugc

SEQ ID NO: 194914 - RNA, 23 nt, Human
cuaaaauaacauggaccuuguuc

SEQ ID NO: 194915 - RNA, 20 nt, Human
cuacccuguucuaccaccua

SEQ ID NO: 194916 - RNA, 19 nt, Human
cucuacuucaaaaaaaaaa

SEQ ID NO: 194917 - RNA, 23 nt, Human
cugaaaugccaaccaaagaagau

SEQ ID NO: 194918 - RNA, 23 nt, Human
gacaaacaaaacaacagaaaaca

SEQ ID NO: 194919 - RNA, 18 nt, Human
gacuuggaaauuuuccuc

SEQ ID NO: 194920 - RNA, 18 nt, Human
gagaauuucaacaaacau

SEQ ID NO: 194921 - RNA, 20 nt, Human
gagaugccugggugaaagaa

SEQ ID NO: 194922 - RNA, 18 nt, Human
gagccagucggcucugag

SEQ ID NO: 194923 - RNA, 19 nt, Human
gagcugguagggaauuguu

SEQ ID NO: 194924 - RNA, 23 nt, Human
gagucagugccuaaaagagccag

SEQ ID NO: 194925 - RNA, 24 nt, Human
gcaaaagccuguuaauacuagaaa

SEQ ID NO: 194926 - RNA, 23 nt, Human
gcauuaugaaaaauauuuuaguu

SEQ ID NO: 194927 - RNA, 24 nt, Human
ggcauuaugaaaaauauuuuaguu

SEQ ID NO: 194928 - RNA, 18 nt, Human
ggugcugcuggacgggcu

SEQ ID NO: 194929 - RNA, 19 nt, Human
guauaaauuguuuugguga

SEQ ID NO: 194930 - RNA, 19 nt, Human
uaaaaacaacaaugaaaug

SEQ ID NO: 194931 - RNA, 21 nt, Human
uaaaggcagugagcuagaagc

SEQ ID NO: 194932 - RNA, 23 nt, Human
uaaaggcagugagcuagaagcca

SEQ ID NO: 194933 - RNA, 24 nt, Human
uaaauagugucuuccaccagcaaa

SEQ ID NO: 194934 - RNA, 18 nt, Human
uaacacugacaaacaaaa

SEQ ID NO: 194935 - RNA, 24 nt, Human
uaacacugacaaacaaaacaacag

SEQ ID NO: 194936 - RNA, 21 nt, Human
uaaccauuauucaaacagcca

SEQ ID NO: 194937 - RNA, 20 nt, Human
uaagaaaugcuuuaggaaaa

SEQ ID NO: 194938 - RNA, 19 nt, Human
uaagaugauagagaccagc

SEQ ID NO: 194939 - RNA, 24 nt, Human
uacaguaccauugguaccaacaag

SEQ ID NO: 194940 - RNA, 24 nt, Human
uaccacaugaucucuauauugcaa

SEQ ID NO: 194941 - RNA, 19 nt, Human
uaccacucaauaggcagcu

SEQ ID NO: 194942 - RNA, 21 nt, Human
uacuuuguacgguuuguuuga

SEQ ID NO: 194943 - RNA, 21 nt, Human
uagcauccacaguauuucauu

SEQ ID NO: 194944 - RNA, 27 nt, Human
uauaacaguacauaaccauuauucaaa

SEQ ID NO: 194945 - RNA, 24 nt, Human
uauggcauuaggagugaacuuuuu

SEQ ID NO: 194946 - RNA, 20 nt, Human
uauuucuuuuaaaaaaguuu

SEQ ID NO: 194947 - RNA, 24 nt, Human
ucaaacagccaaaccaaaaauugc

SEQ ID NO: 194948 - RNA, 21 nt, Human
ucauuacacauuuuacaauaa

SEQ ID NO: 194949 - RNA, 21 nt, Human
uccaguaguugucuuaggauu

SEQ ID NO: 194950 - RNA, 18 nt, Human
uccagugucucacacuuc

SEQ ID NO: 194951 - RNA, 20 nt, Human
ucccucuggaggagaugccu

SEQ ID NO: 194952 - RNA, 21 nt, Human
ucccucuggaggagaugccug

SEQ ID NO: 194953 - RNA, 26 nt, Human
ucuaaaauauuuagggguuacauuag

SEQ ID NO: 194954 - RNA, 23 nt, Human
ucucacacuucccauaauuugaa

SEQ ID NO: 194955 - RNA, 21 nt, Human
ucuccaguaguugucuuagga

SEQ ID NO: 194956 - RNA, 23 nt, Human
ucuucauguaaaagacaguugua

SEQ ID NO: 194957 - RNA, 23 nt, Human
ugaaauaacuaggauaaugaaua

SEQ ID NO: 194958 - RNA, 18 nt, Human
ugaauacauguaaacacc

SEQ ID NO: 194959 - RNA, 23 nt, Human
ugacaaaauaacacugacaaaca

SEQ ID NO: 194960 - RNA, 19 nt, Human
ugacaaacaaaacaacaga

SEQ ID NO: 194961 - RNA, 23 nt, Human
ugacauuuuaaauuccacauucu

SEQ ID NO: 194962 - RNA, 20 nt, Human
ugagcuagaagccaaucaca

SEQ ID NO: 194963 - RNA, 23 nt, Human
uggcaauaugcucuugaaauuuc

SEQ ID NO: 194964 - RNA, 24 nt, Human
uggguaagcauacagcuauaccaa

SEQ ID NO: 194965 - RNA, 21 nt, Human
ugguaccaacaagaaauauuc

SEQ ID NO: 194966 - RNA, 23 nt, Human
uguaccuuaauucacuucaacau

SEQ ID NO: 194967 - RNA, 18 nt, Human
ugugcaaauggaaaugaa

SEQ ID NO: 194968 - RNA, 20 nt, Human
ugugcaaauggaaaugaacc

SEQ ID NO: 194969 - RNA, 19 nt, Human
ugugguuuuguaaaaagug

SEQ ID NO: 194970 - RNA, 23 nt, Human
uguguaccuaggcauguguacau

SEQ ID NO: 194971 - RNA, 18 nt, Human
uuagauacugaucugagc

SEQ ID NO: 194972 - RNA, 22 nt, Human
uucugauuuaaaagauccuuuu

SEQ ID NO: 194973 - RNA, 20 nt, Human
uugauaaaauaucugauuca

SEQ ID NO: 194974 - RNA, 20 nt, Human
uugcuuccacuuuaaguuuc

SEQ ID NO: 194975 - RNA, 24 nt, Human
uugucaauuccacccaugucccuc

SEQ ID NO: 194976 - RNA, 24 nt, Human
uuuaaacuucuucaauuagauacu

SEQ ID NO: 194977 - RNA, 27 nt, Human
uuuaauauuucuacuggucuuuagaga

SEQ ID NO: 194978 - RNA, 19 nt, Human
uuuacugaggaccugccca

SEQ ID NO: 194979 - RNA, 24 nt, Human
uuuuuguuauucuauuucucaaca

SEQ ID NO: 194980 - RNA, 22 nt, Human
aaggcagggaauggugggaacc

SEQ ID NO: 194981 - RNA, 23 nt, Human
agcaaggcagggaauggugggaa

SEQ ID NO: 194982 - RNA, 19 nt, Human
aggcagggaauggugggaa

SEQ ID NO: 194983 - RNA, 19 nt, Human
aaugucacuuuaucaaaac

SEQ ID NO: 194984 - RNA, 19 nt, Human
accccuuugccuuuccauu

SEQ ID NO: 194985 - RNA, 24 nt, Human
aguuacuuauuaaaaaaaaaacac

SEQ ID NO: 194986 - RNA, 22 nt, Human
auaaauagugaaaaccacuaac

SEQ ID NO: 194987 - RNA, 18 nt, Human
caaaacaaccuaagagca

SEQ ID NO: 194988 - RNA, 18 nt, Human
cacacaucucugagacaa

SEQ ID NO: 194989 - RNA, 24 nt, Human
cagcucuggauuugggguaccccu

SEQ ID NO: 194990 - RNA, 18 nt, Human
ccgccgcgcuccggcccc

SEQ ID NO: 194991 - RNA, 18 nt, Human
ccgccgcgcuccggcccc

SEQ ID NO: 194992 - RNA, 18 nt, Human
ccggccccucgcagagcu

SEQ ID NO: 194993 - RNA, 18 nt, Human
cuaguucaucugcgauua

SEQ ID NO: 194994 - RNA, 23 nt, Human
cucaucaaccauaucucugacaa

SEQ ID NO: 194995 - RNA, 26 nt, Human
cuguagcaaaacauuauuccuaaauc

SEQ ID NO: 194996 - RNA, 21 nt, Human
gaacacacaucucugagacaa

SEQ ID NO: 194997 - RNA, 20 nt, Human
gagaauugauucccuuucuu

SEQ ID NO: 194998 - RNA, 29 nt, Human
uaaucacuauaaugucacuuuaucaaaac

SEQ ID NO: 194999 - RNA, 22 nt, Human
uaauuaaccugugacuucuagu

SEQ ID NO: 195000 - RNA, 22 nt, Human
uacuaagugauagugcaaaaca

SEQ ID NO: 195001 - RNA, 18 nt, Human
ucucugagacaagagcuc

SEQ ID NO: 195002 - RNA, 23 nt, Human
ucugacaaaaagaacacacaucu

SEQ ID NO: 195003 - RNA, 19 nt, Human
ucugagacaagagcucuga

SEQ ID NO: 195004 - RNA, 19 nt, Human
ugaagauuuucuguagcaa

SEQ ID NO: 195005 - RNA, 22 nt, Human
ugacaaaaagaacacacaucuc

SEQ ID NO: 195006 - RNA, 22 nt, Human
ugagacaagagcucugaaaugu

SEQ ID NO: 195007 - RNA, 19 nt, Human
ugagcagugcaccaaauau

SEQ ID NO: 195008 - RNA, 22 nt, Human
ugcaccaaauauuuuuagguuu

SEQ ID NO: 195009 - RNA, 20 nt, Human
uuuuuuuuuuuuacgagguc

SEQ ID NO: 195010 - RNA, 23 nt, Human
uuuuuuuuuuuuuuuuuacgagg

SEQ ID NO: 195011 - RNA, 24 nt, Human
aaaaggagaggacagccacagaug

SEQ ID NO: 195012 - RNA, 24 nt, Human
aaauaugcuauuaugauuuaauua

SEQ ID NO: 195013 - RNA, 23 nt, Human
aacaugcugacauacacacagug

SEQ ID NO: 195014 - RNA, 24 nt, Human
acauacacacagaggaucugcaca

SEQ ID NO: 195015 - RNA, 21 nt, Human
acgcggcgauggguccaaugc

SEQ ID NO: 195016 - RNA, 26 nt, Human
agacagaaaauuccugggaagucaaa

SEQ ID NO: 195017 - RNA, 19 nt, Human
aggaacagaaacggcgacg

SEQ ID NO: 195018 - RNA, 21 nt, Human
aggaggaagaaaaggagagga

SEQ ID NO: 195019 - RNA, 22 nt, Human
aggaggaagaaaaggagaggac

SEQ ID NO: 195020 - RNA, 24 nt, Human
aggaguguguagcaggauaacagu

SEQ ID NO: 195021 - RNA, 18 nt, Human
agggagguggcggggaca

SEQ ID NO: 195022 - RNA, 26 nt, Human
aggggcugggcgcgggaggauggggg

SEQ ID NO: 195023 - RNA, 20 nt, Human
auaaggaaguauauauuuua

SEQ ID NO: 195024 - RNA, 21 nt, Human
augggggggaacgccacugcc

SEQ ID NO: 195025 - RNA, 23 nt, Human
cacuccagagacagagggaggug

SEQ ID NO: 195026 - RNA, 21 nt, Human
cacuuagaaauucaucaggga

SEQ ID NO: 195027 - RNA, 18 nt, Human
cagcaggggcacuagggc

SEQ ID NO: 195028 - RNA, 19 nt, Human
ccaaugccuuaggggagcc

SEQ ID NO: 195029 - RNA, 20 nt, Human
ccaggguggagggaagggga

SEQ ID NO: 195030 - RNA, 22 nt, Human
ccccuugacgucaccgcuucuc

SEQ ID NO: 195031 - RNA, 18 nt, Human
ccuugacgucaccgcuuc

SEQ ID NO: 195032 - RNA, 26 nt, Human
cgacggcggcggcggggcaggcggag

SEQ ID NO: 195033 - RNA, 20 nt, Human
cgcgcgcccccgcccagggu

SEQ ID NO: 195034 - RNA, 23 nt, Human
cggggcaggcggaggcagggcca

SEQ ID NO: 195035 - RNA, 19 nt, Human
cguucccucuuuucuucuu

SEQ ID NO: 195036 - RNA, 24 nt, Human
cguucccucuuuucuucuucuuuu

SEQ ID NO: 195037 - RNA, 24 nt, Human
cucgcgcgcccccgcccagggugg

SEQ ID NO: 195038 - RNA, 22 nt, Human
cugacaaaaaugaagauuacaa

SEQ ID NO: 195039 - RNA, 18 nt, Human
gaagaaaaggagaggaca

SEQ ID NO: 195040 - RNA, 19 nt, Human
gaagaggaggaagaaaagg

SEQ ID NO: 195041 - RNA, 20 nt, Human
gagaaggaguuggaagagga

SEQ ID NO: 195042 - RNA, 19 nt, Human
gagcagcaggggcugggcg

SEQ ID NO: 195043 - RNA, 25 nt, Human
gagcagcaggggcugggcgcgggag

SEQ ID NO: 195044 - RNA, 18 nt, Human
gagggaaggggagggggc

SEQ ID NO: 195045 - RNA, 18 nt, Human
gaggugcugccacagcgc

SEQ ID NO: 195046 - RNA, 20 nt, Human
gaguuguuuaggugggacag

SEQ ID NO: 195047 - RNA, 20 nt, Human
gaguuguuuaggugggacag

SEQ ID NO: 195048 - RNA, 18 nt, Human
gcccagagcagcaggggc

SEQ ID NO: 195049 - RNA, 26 nt, Human
gcgcagcuccaggaggaggggaacgc

SEQ ID NO: 195050 - RNA, 23 nt, Human
gcgcagcuccaggaggaguuugc

SEQ ID NO: 195051 - RNA, 22 nt, Human
gcggaggcagggccagcgcugg

SEQ ID NO: 195052 - RNA, 18 nt, Human
gcggcggcggggcaggcg

SEQ ID NO: 195053 - RNA, 18 nt, Human
gcugaggucuccucugcc

SEQ ID NO: 195054 - RNA, 22 nt, Human
gcugcagcuucucacacagccu

SEQ ID NO: 195055 - RNA, 18 nt, Human
ggaacgccacugcccagc

SEQ ID NO: 195056 - RNA, 19 nt, Human
ggaggaagaaaaggagagg

SEQ ID NO: 195057 - RNA, 23 nt, Human
ggcacuccagagacagagggagg

SEQ ID NO: 195058 - RNA, 20 nt, Human
ggcaggcggaggcagggcca

SEQ ID NO: 195059 - RNA, 20 nt, Human
gggaagucaaauaaucucuu

SEQ ID NO: 195060 - RNA, 22 nt, Human
ggggggaacgccacugcccagc

SEQ ID NO: 195061 - RNA, 18 nt, Human
guauguguaugugcauau

SEQ ID NO: 195062 - RNA, 24 nt, Human
gugggacaguagcaggaacagaag

SEQ ID NO: 195063 - RNA, 20 nt, Human
uaaaagcagaccuuuuagga

SEQ ID NO: 195064 - RNA, 21 nt, Human
uacacugacaaaaaugaagau

SEQ ID NO: 195065 - RNA, 20 nt, Human
uagaauauucaaacaguccc

SEQ ID NO: 195066 - RNA, 22 nt, Human
uagcaggaacagaaacggcgaa

SEQ ID NO: 195067 - RNA, 22 nt, Human
uagugauuacagacagaaaauu

SEQ ID NO: 195068 - RNA, 21 nt, Human
uauaaaacacuugaaaacaau

SEQ ID NO: 195069 - RNA, 23 nt, Human
uauaaauauguaacacaaaccca

SEQ ID NO: 195070 - RNA, 19 nt, Human
uauguguaugugcauaugu

SEQ ID NO: 195071 - RNA, 20 nt, Human
uauguguaugugcauaugug

SEQ ID NO: 195072 - RNA, 20 nt, Human
ucuguaacuggauacacuga

SEQ ID NO: 195073 - RNA, 19 nt, Human
ugaaaacaaucuugagauu

SEQ ID NO: 195074 - RNA, 24 nt, Human
ugaaauaaccagauuucucagcca

SEQ ID NO: 195075 - RNA, 18 nt, Human
ugaaaucacaggagugug

SEQ ID NO: 195076 - RNA, 18 nt, Human
ugacauacacacagagga

SEQ ID NO: 195077 - RNA, 24 nt, Human
ugagauuaagaugaaauaaccaga

SEQ ID NO: 195078 - RNA, 22 nt, Human
ugcaaaaaauaaaagacgcggc

SEQ ID NO: 195079 - RNA, 23 nt, Human
uggaagaggaggaagaaaaggag

SEQ ID NO: 195080 - RNA, 24 nt, Human
uggaauuucuguguaaauuacuuu

SEQ ID NO: 195081 - RNA, 23 nt, Human
ugggaagucaaauaaucucuucu

SEQ ID NO: 195082 - RNA, 18 nt, Human
ugggaagugggaggagga

SEQ ID NO: 195083 - RNA, 22 nt, Human
ugggacaguagcaggaacagaa

SEQ ID NO: 195084 - RNA, 22 nt, Human
ugggaggaggagaaggaguugg

SEQ ID NO: 195085 - RNA, 21 nt, Human
uguaacacaaacccagugccu

SEQ ID NO: 195086 - RNA, 24 nt, Human
uugggggcuuucugcugcggcugg

SEQ ID NO: 195087 - RNA, 18 nt, Human
uuucugcugcggcuggga

SEQ ID NO: 195088 - RNA, 19 nt, Human
aagagccaggguggauggc

SEQ ID NO: 195089 - RNA, 21 nt, Human
acagucaaaggggguuuguuc

SEQ ID NO: 195090 - RNA, 22 nt, Human
accugggugcaggcgggcugag

SEQ ID NO: 195091 - RNA, 20 nt, Human
acuucaagaguuaagaggga

SEQ ID NO: 195092 - RNA, 21 nt, Human
agagucagugaagggagauaa

SEQ ID NO: 195093 - RNA, 20 nt, Human
aggagaaaaacagguauaaa

SEQ ID NO: 195094 - RNA, 24 nt, Human
aggagaaaaacagguauaaaagga

SEQ ID NO: 195095 - RNA, 19 nt, Human
aggagagggaaaaaaaaug

SEQ ID NO: 195096 - RNA, 18 nt, Human
aggagauucagcauaguc

SEQ ID NO: 195097 - RNA, 18 nt, Human
aggcauauucacuucuuu

SEQ ID NO: 195098 - RNA, 19 nt, Human
aggggguuuguucucuggc

SEQ ID NO: 195099 - RNA, 20 nt, Human
aggggguuuguucucuggcg

SEQ ID NO: 195100 - RNA, 19 nt, Human
augccuuauggauacaacu

SEQ ID NO: 195101 - RNA, 18 nt, Human
auuucaccugggugcagg

SEQ ID NO: 195102 - RNA, 19 nt, Human
caagaaaacuucuaccuuc

SEQ ID NO: 195103 - RNA, 21 nt, Human
cagcgugggaaccuagagugg

SEQ ID NO: 195104 - RNA, 25 nt, Human
ccaagaauaaccacuuuaaauuaac

SEQ ID NO: 195105 - RNA, 19 nt, Human
cuaguguuauuuucaaggc

SEQ ID NO: 195106 - RNA, 21 nt, Human
gaagggagauaaggguggggc

SEQ ID NO: 195107 - RNA, 26 nt, Human
gcaaagauuauuuauuuacuucaaga

SEQ ID NO: 195108 - RNA, 18 nt, Human
ggacaagagccagggugg

SEQ ID NO: 195109 - RNA, 18 nt, Human
ggacuaagaauugggagg

SEQ ID NO: 195110 - RNA, 21 nt, Human
ggagauucagcauaguccugc

SEQ ID NO: 195111 - RNA, 22 nt, Human
ggagugggggucucaaggugcu

SEQ ID NO: 195112 - RNA, 22 nt, Human
ggcucagaggccugacaugccu

SEQ ID NO: 195113 - RNA, 21 nt, Human
gggcaggagugggggucucaa

SEQ ID NO: 195114 - RNA, 20 nt, Human
gggccguuuuauaggauuug

SEQ ID NO: 195115 - RNA, 20 nt, Human
gggugauauuguggggaugu

SEQ ID NO: 195116 - RNA, 19 nt, Human
ggugcuuuuugagccagga

SEQ ID NO: 195117 - RNA, 23 nt, Human
gguggggccguuuuauaggauuu

SEQ ID NO: 195118 - RNA, 25 nt, Human
uaaaaggacuaagaauugggaggac

SEQ ID NO: 195119 - RNA, 22 nt, Human
uaagagaaggagaaaaacaggu

SEQ ID NO: 195120 - RNA, 26 nt, Human
uagaaugauaggugauggccuggaua

SEQ ID NO: 195121 - RNA, 24 nt, Human
uagcccacuugggacaagagccag

SEQ ID NO: 195122 - RNA, 24 nt, Human
ucucuggcgggcaggagugggggu

SEQ ID NO: 195123 - RNA, 23 nt, Human
ucuucaguuacuucaggccaucu

SEQ ID NO: 195124 - RNA, 20 nt, Human
ugaaaaacuaaauggaauaa

SEQ ID NO: 195125 - RNA, 23 nt, Human
ugaaaaacuaaauggaauaagag

SEQ ID NO: 195126 - RNA, 22 nt, Human
ugaagggagauaaggguggggc

SEQ ID NO: 195127 - RNA, 18 nt, Human
uggaauaagagaaggaga

SEQ ID NO: 195128 - RNA, 19 nt, Human
uggaaugucaucaguuaag

SEQ ID NO: 195129 - RNA, 25 nt, Human
uggcuuggcuugggcucagaggccc

SEQ ID NO: 195130 - RNA, 21 nt, Human
uggggauguuagaagaaacau

SEQ ID NO: 195131 - RNA, 20 nt, Human
ugggguggcgaaaauuuuug

SEQ ID NO: 195132 - RNA, 20 nt, Human
ugggguggcgaaaauuuuug

SEQ ID NO: 195133 - RNA, 19 nt, Human
ugggugaauucuucaaaug

SEQ ID NO: 195134 - RNA, 26 nt, Human
ugugguggaaugucaucaguuaaggg

SEQ ID NO: 195135 - RNA, 24 nt, Human
uuaaggcaaggaccggccauuuac

SEQ ID NO: 195136 - RNA, 24 nt, Human
uuagaagaaacauuuguuguauag

SEQ ID NO: 195137 - RNA, 21 nt, Human
uuuaacaagaaaacuucuacc

SEQ ID NO: 195138 - RNA, 24 nt, Human
uuuauuuacuucaagaguuaagag

SEQ ID NO: 195139 - RNA, 20 nt, Human
acaaagaggggagcagcggc

SEQ ID NO: 195140 - RNA, 20 nt, Human
acagguccaggccacaaaga

SEQ ID NO: 195141 - RNA, 24 nt, Human
aggcggcggcggaggcccccgggg

SEQ ID NO: 195142 - RNA, 21 nt, Human
aggcggugcggccuccuccag

SEQ ID NO: 195143 - RNA, 22 nt, Human
agggcgagaggcggcuccuugu

SEQ ID NO: 195144 - RNA, 26 nt, Human
caggcggcggcggaggcccccgggcg

SEQ ID NO: 195145 - RNA, 20 nt, Human
cagugcguguugaccgcggc

SEQ ID NO: 195146 - RNA, 19 nt, Human
ccgcggagcccggcgggcu

SEQ ID NO: 195147 - RNA, 20 nt, Human
ccgggcugccgcugccgccg

SEQ ID NO: 195148 - RNA, 21 nt, Human
ccuccuccagcuucuggaagg

SEQ ID NO: 195149 - RNA, 21 nt, Human
cggcagcgacggcagggcgag

SEQ ID NO: 195150 - RNA, 19 nt, Human
cggcgcuccgaggcacaga

SEQ ID NO: 195151 - RNA, 19 nt, Human
cggcgcugggagggcuguc

SEQ ID NO: 195152 - RNA, 26 nt, Human
cggcggcagcgacggcagggcgagag

SEQ ID NO: 195153 - RNA, 25 nt, Human
cggcgggcucuucuuggacaggucc

SEQ ID NO: 195154 - RNA, 19 nt, Human
cugccgcugccgccgcgaa

SEQ ID NO: 195155 - RNA, 23 nt, Human
gagggcuguccgggcgcgggggc

SEQ ID NO: 195156 - RNA, 21 nt, Human
gccacaaagaggggagcagcg

SEQ ID NO: 195157 - RNA, 23 nt, Human
ggccggggggcucgggucccggg

SEQ ID NO: 195158 - RNA, 18 nt, Human
ggggagcagcggcgcucc

SEQ ID NO: 195159 - RNA, 21 nt, Human
gggucccgacgcguacagcuc

SEQ ID NO: 195160 - RNA, 20 nt, Human
uacagcucggcgcagugcgu

SEQ ID NO: 195161 - RNA, 24 nt, Human
uccuccagcuucuggaagggcagc

SEQ ID NO: 195162 - RNA, 21 nt, Human
ucuggcgccgcggagcccggc

SEQ ID NO: 195163 - RNA, 19 nt, Human
ucuuggacagguccaggcc

SEQ ID NO: 195164 - RNA, 23 nt, Human
uggacagguccaggccacaaaga

SEQ ID NO: 195165 - RNA, 19 nt, Human
ugggagggcuguccgggcg

SEQ ID NO: 195166 - RNA, 18 nt, Human
uguccgggcgcgggggca

SEQ ID NO: 195167 - RNA, 26 nt, Human
uuguaggcggcggggccggcgcuggg

SEQ ID NO: 195168 - RNA, 20 nt, Human
aaauaccaaaaaacugagaa

SEQ ID NO: 195169 - RNA, 20 nt, Human
aacugccuaugaucaugaug

SEQ ID NO: 195170 - RNA, 21 nt, Human
accacguacugcuggcaaagc

SEQ ID NO: 195171 - RNA, 20 nt, Human
acuaaaaaagagcauuaaug

SEQ ID NO: 195172 - RNA, 20 nt, Human
agaagagaaggaaaggcaag

SEQ ID NO: 195173 - RNA, 29 nt, Human
agaauuuuauccaaauaaaugccacauua

SEQ ID NO: 195174 - RNA, 23 nt, Human
agacugcuuuagguagugagcca

SEQ ID NO: 195175 - RNA, 24 nt, Human
agccaccaguguccaaaaaaagga

SEQ ID NO: 195176 - RNA, 18 nt, Human
aggaaaggcaaguccaga

SEQ ID NO: 195177 - RNA, 21 nt, Human
aggcaaguccagagguggggg

SEQ ID NO: 195178 - RNA, 19 nt, Human
agguggcuugucagggccc

SEQ ID NO: 195179 - RNA, 22 nt, Human
augcauaucuuucuauauuaug

SEQ ID NO: 195180 - RNA, 23 nt, Human
caaaaaacugagaaaaugagcug

SEQ ID NO: 195181 - RNA, 24 nt, Human
caaaaauaaauaaauaaaaaggug

SEQ ID NO: 195182 - RNA, 24 nt, Human
caaaacaauacaguuaguguuaga

SEQ ID NO: 195183 - RNA, 26 nt, Human
caaagugcauaaaaucaaacauugua

SEQ ID NO: 195184 - RNA, 18 nt, Human
caauguacauagaaaaaa

SEQ ID NO: 195185 - RNA, 18 nt, Human
cacaaagagcaaaaggaa

SEQ ID NO: 195186 - RNA, 20 nt, Human
cagaggugggggugcgaggc

SEQ ID NO: 195187 - RNA, 21 nt, Human
cagaggugggggugcgaggcg

SEQ ID NO: 195188 - RNA, 20 nt, Human
cauaggccaaaaaaaauuuc

SEQ ID NO: 195189 - RNA, 18 nt, Human
ccaaccacaaagagcaaa

SEQ ID NO: 195190 - RNA, 25 nt, Human
cccagcccgacacacuggccgaagc

SEQ ID NO: 195191 - RNA, 25 nt, Human
ccuaugaucaugaugaaagguuacu

SEQ ID NO: 195192 - RNA, 25 nt, Human
ccucgugagacuagagagaagcggg

SEQ ID NO: 195193 - RNA, 20 nt, Human
cgaagcgacgaagagagugc

SEQ ID NO: 195194 - RNA, 18 nt, Human
cggcuccgagccucuccu

SEQ ID NO: 195195 - RNA, 23 nt, Human
cucaaaauaucuuuauaccaaca

SEQ ID NO: 195196 - RNA, 22 nt, Human
cuggccgaagcgacgaagagag

SEQ ID NO: 195197 - RNA, 21 nt, Human
gagaaggaaaggcaaguccag

SEQ ID NO: 195198 - RNA, 18 nt, Human
gcaaguccagaggugggg

SEQ ID NO: 195199 - RNA, 20 nt, Human
gcuggcucccuccacacgcc

SEQ ID NO: 195200 - RNA, 21 nt, Human
ggagaagagaaggaaaggcaa

SEQ ID NO: 195201 - RNA, 20 nt, Human
ggcccccaggcucgcuccgg

SEQ ID NO: 195202 - RNA, 22 nt, Human
ggggaucaaaaauugaacuaac

SEQ ID NO: 195203 - RNA, 21 nt, Human
guccagaggugggggugcgag

SEQ ID NO: 195204 - RNA, 19 nt, Human
uaaaccauacagcauuuaa

SEQ ID NO: 195205 - RNA, 23 nt, Human
uaaagaacauacuaaaaaagagc

SEQ ID NO: 195206 - RNA, 21 nt, Human
uacuaaaaaagagcauuaaug

SEQ ID NO: 195207 - RNA, 18 nt, Human
uagccaggcuucuaaaau

SEQ ID NO: 195208 - RNA, 19 nt, Human
ucagguggcuugucagggc

SEQ ID NO: 195209 - RNA, 22 nt, Human
ucagguggcuugucagggccca

SEQ ID NO: 195210 - RNA, 26 nt, Human
uccaaaaaaaggaaugaaauuaagaa

SEQ ID NO: 195211 - RNA, 20 nt, Human
uccagaggugggggugcgag

SEQ ID NO: 195212 - RNA, 23 nt, Human
uccagaggugggggugcgaggcg

SEQ ID NO: 195213 - RNA, 20 nt, Human
uccaugaguaacugcuggua

SEQ ID NO: 195214 - RNA, 22 nt, Human
uccucagguggcuugucaggga

SEQ ID NO: 195215 - RNA, 19 nt, Human
ugagaaaaugagcugucug

SEQ ID NO: 195216 - RNA, 19 nt, Human
ugagcaaauuaacauacua

SEQ ID NO: 195217 - RNA, 22 nt, Human
ugcaaugguuuaaauaccaaaa

SEQ ID NO: 195218 - RNA, 22 nt, Human
uggcaaagugacuauagaaaca

SEQ ID NO: 195219 - RNA, 18 nt, Human
ugggggugcgaggcggga

SEQ ID NO: 195220 - RNA, 22 nt, Human
uguagaaaauauaaauagacug

SEQ ID NO: 195221 - RNA, 21 nt, Human
uuaacaaugucauguuccagg

SEQ ID NO: 195222 - RNA, 24 nt, Human
uuagauccaaccacaaagagcaaa

SEQ ID NO: 195223 - RNA, 28 nt, Human
uuccuaaaauaaugcuucuaaaauuacc

SEQ ID NO: 195224 - RNA, 21 nt, Human
uucuauauuauguaaauggcu

SEQ ID NO: 195225 - RNA, 22 nt, Human
uucucugaauugagaauuuuau

SEQ ID NO: 195226 - RNA, 24 nt, Human
uuuaacaauuucauaggccaaaaa

SEQ ID NO: 195227 - RNA, 24 nt, Human
uuuuuuuuccacagaagauguuua

SEQ ID NO: 195228 - RNA, 22 nt, Human
uuuuuuuuuuuuuuuuccacag

SEQ ID NO: 195229 - RNA, 24 nt, Human
aaaaaaaacaaaaccaaaaaaccc

SEQ ID NO: 195230 - RNA, 21 nt, Human
aaaaaacccaaccaaccacca

SEQ ID NO: 195231 - RNA, 21 nt, Human
aaaaacccaaccaaccaccau

SEQ ID NO: 195232 - RNA, 18 nt, Human
aaaagaaaaggcauaaga

SEQ ID NO: 195233 - RNA, 18 nt, Human
aaaagaacagagaugacc

SEQ ID NO: 195234 - RNA, 18 nt, Human
aaacagaagucucacaac

SEQ ID NO: 195235 - RNA, 23 nt, Human
aaacccaaccaaccaccauaaga

SEQ ID NO: 195236 - RNA, 21 nt, Human
aaagugcugggauuaaacgug

SEQ ID NO: 195237 - RNA, 22 nt, Human
aaagugcugggauuaaacgugu

SEQ ID NO: 195238 - RNA, 24 nt, Human
aaagugcugggauuaaacguguga

SEQ ID NO: 195239 - RNA, 24 nt, Human
aaagugcugggauuacaggcguga

SEQ ID NO: 195240 - RNA, 23 nt, Human
aaaguucugggauuacaggcaug

SEQ ID NO: 195241 - RNA, 24 nt, Human
aaaguucugggauuacaggcaugc

SEQ ID NO: 195242 - RNA, 22 nt, Human
aacagaaaagaaaaggcauaag

SEQ ID NO: 195243 - RNA, 24 nt, Human
aacuagcugagacuacaggcaugc

SEQ ID NO: 195244 - RNA, 20 nt, Human
aacugggcugugugaacccu

SEQ ID NO: 195245 - RNA, 19 nt, Human
aagaaggaagacgcuguuu

SEQ ID NO: 195246 - RNA, 21 nt, Human
aagagggggagaauggcuuug

SEQ ID NO: 195247 - RNA, 24 nt, Human
aagcaaucaucccgucuuggccuc

SEQ ID NO: 195248 - RNA, 24 nt, Human
aagcaauucucccaccuuagcucc

SEQ ID NO: 195249 - RNA, 20 nt, Human
aagcugucaacaaacaacaa

SEQ ID NO: 195250 - RNA, 21 nt, Human
aagugcugggauuaaacgugu

SEQ ID NO: 195251 - RNA, 19 nt, Human
aagugcugggauuacaggc

SEQ ID NO: 195252 - RNA, 19 nt, Human
aagugcugggauuacaggc

SEQ ID NO: 195253 - RNA, 21 nt, Human
aagugcuugauggcuaccacc

SEQ ID NO: 195254 - RNA, 18 nt, Human
acagccacuuccugcgua

SEQ ID NO: 195255 - RNA, 21 nt, Human
accacaguuggggggcccugg

SEQ ID NO: 195256 - RNA, 24 nt, Human
accauguuggacaggcuggucuug

SEQ ID NO: 195257 - RNA, 24 nt, Human
accauguuggccaggcuagucuug

SEQ ID NO: 195258 - RNA, 23 nt, Human
accucagccucucaaagugcugg

SEQ ID NO: 195259 - RNA, 23 nt, Human
accuuagcuccccaacuagcuga

SEQ ID NO: 195260 - RNA, 18 nt, Human
acgggguuucaccauguu

SEQ ID NO: 195261 - RNA, 23 nt, Human
acgggguuucaccauguuggcca

SEQ ID NO: 195262 - RNA, 24 nt, Human
acgggguuucaccauguuggccag

SEQ ID NO: 195263 - RNA, 18 nt, Human
acucugucacccaggccg

SEQ ID NO: 195264 - RNA, 27 nt, Human
acucugucacccaggccggagugcacu

SEQ ID NO: 195265 - RNA, 25 nt, Human
acuuaaaaaaaaaaaacaaaaccaa

SEQ ID NO: 195266 - RNA, 21 nt, Human
agaagaaaacagaaaagaaaa

SEQ ID NO: 195267 - RNA, 22 nt, Human
agaagaaaacagaaaagaaaag

SEQ ID NO: 195268 - RNA, 18 nt, Human
agacuacaggcaugcacc

SEQ ID NO: 195269 - RNA, 24 nt, Human
agacuacaggcaugcaccaucaug

SEQ ID NO: 195270 - RNA, 20 nt, Human
agacuguuugccccauuugu

SEQ ID NO: 195271 - RNA, 22 nt, Human
agagacaggaucauucagauaa

SEQ ID NO: 195272 - RNA, 22 nt, Human
agaucagaaggucacuuaaaug

SEQ ID NO: 195273 - RNA, 21 nt, Human
agauggggguugguucacagu

SEQ ID NO: 195274 - RNA, 26 nt, Human
aggcaggcgguugacaacagaccaga

SEQ ID NO: 195275 - RNA, 23 nt, Human
aggcaugcgccacugugcccggc

SEQ ID NO: 195276 - RNA, 22 nt, Human
aggcgccugccaccaugcccgg

SEQ ID NO: 195277 - RNA, 19 nt, Human
aggcggacagaggcuuucc

SEQ ID NO: 195278 - RNA, 23 nt, Human
aggcgugagccacugugcccggc

SEQ ID NO: 195279 - RNA, 21 nt, Human
agggaagccacgcaccauucc

SEQ ID NO: 195280 - RNA, 23 nt, Human
agggaagccacgcaccauuccuu

SEQ ID NO: 195281 - RNA, 24 nt, Human
aggugauccacccgccccugccuc

SEQ ID NO: 195282 - RNA, 19 nt, Human
aguagagaugaggucuugc

SEQ ID NO: 195283 - RNA, 18 nt, Human
aguagcugggauuacggg

SEQ ID NO: 195284 - RNA, 18 nt, Human
aguagcugggauuauagg

SEQ ID NO: 195285 - RNA, 22 nt, Human
agugcagugggaaaucauggcu

SEQ ID NO: 195286 - RNA, 19 nt, Human
auggggguugguucacagu

SEQ ID NO: 195287 - RNA, 22 nt, Human
auguggcugaaaggaguuggag

SEQ ID NO: 195288 - RNA, 24 nt, Human
auuuuuguauuuuuaguagagacg

SEQ ID NO: 195289 - RNA, 21 nt, Human
caaaaaacccaaccaaccacc

SEQ ID NO: 195290 - RNA, 22 nt, Human
caaagugcugggauuaaacgug

SEQ ID NO: 195291 - RNA, 21 nt, Human
caaagugcugggauuacaggc

SEQ ID NO: 195292 - RNA, 24 nt, Human
caaagugcugggauuacaggcgug

SEQ ID NO: 195293 - RNA, 24 nt, Human
caaaguucugggauuacaggcaug

SEQ ID NO: 195294 - RNA, 23 nt, Human
caagaucagaaggucacuuaaau

SEQ ID NO: 195295 - RNA, 28 nt, Human
caagcaauucucccaccuuagcucccca

SEQ ID NO: 195296 - RNA, 21 nt, Human
caagucaguaacaguccagca

SEQ ID NO: 195297 - RNA, 18 nt, Human
caauucauuucuguaucu

SEQ ID NO: 195298 - RNA, 21 nt, Human
cacaacugggacagggaagcc

SEQ ID NO: 195299 - RNA, 23 nt, Human
cacaacugggacagggaagccac

SEQ ID NO: 195300 - RNA, 20 nt, Human
cacagccaggacacuccugc

SEQ ID NO: 195301 - RNA, 23 nt, Human
cacaguuggggggcccuggagac

SEQ ID NO: 195302 - RNA, 24 nt, Human
caccaugcccggcuaauuuuugua

SEQ ID NO: 195303 - RNA, 23 nt, Human
caccauguuggacaggcuggucu

SEQ ID NO: 195304 - RNA, 24 nt, Human
caccauguuggacaggcuggucuu

SEQ ID NO: 195305 - RNA, 21 nt, Human
caccauguuggccaggcuagu

SEQ ID NO: 195306 - RNA, 24 nt, Human
caccauguuggccaggcuagucuu

SEQ ID NO: 195307 - RNA, 27 nt, Human
caccauguuggccaggcuagucuugaa

SEQ ID NO: 195308 - RNA, 23 nt, Human
cacccgccccugccucccaaagu

SEQ ID NO: 195309 - RNA, 21 nt, Human
caccgagaggccugggcagca

SEQ ID NO: 195310 - RNA, 18 nt, Human
caccucagccucucaaag

SEQ ID NO: 195311 - RNA, 21 nt, Human
caccuuagcuccccaacuagc

SEQ ID NO: 195312 - RNA, 22 nt, Human
caccuuagcuccccaacuagcu

SEQ ID NO: 195313 - RNA, 18 nt, Human
cacucacucuccuucugc

SEQ ID NO: 195314 - RNA, 23 nt, Human
cacucugucacccaggccggagu

SEQ ID NO: 195315 - RNA, 24 nt, Human
cacucugucacccaggccggagug

SEQ ID NO: 195316 - RNA, 22 nt, Human
cacugcaaccucugccucuggg

SEQ ID NO: 195317 - RNA, 19 nt, Human
cagagagggaguuggggag

SEQ ID NO: 195318 - RNA, 20 nt, Human
cagccucaaacuccugggcu

SEQ ID NO: 195319 - RNA, 21 nt, Human
cagccucaaacuccugggcug

SEQ ID NO: 195320 - RNA, 20 nt, Human
cagccuccugaguagcuggg

SEQ ID NO: 195321 - RNA, 24 nt, Human
cagccucgacuucccaagcucaag

SEQ ID NO: 195322 - RNA, 22 nt, Human
cagcuccauucaagcaugugau

SEQ ID NO: 195323 - RNA, 18 nt, Human
caggcuagucuugaacuc

SEQ ID NO: 195324 - RNA, 22 nt, Human
caggugauucuccugucucagc

SEQ ID NO: 195325 - RNA, 26 nt, Human
caguagcugggauuauaggcgccugc

SEQ ID NO: 195326 - RNA, 24 nt, Human
cagugguguggcugccccugggac

SEQ ID NO: 195327 - RNA, 23 nt, Human
caugcaccaucaugcccggcuaa

SEQ ID NO: 195328 - RNA, 24 nt, Human
cauguuggacaggcuggucuugaa

SEQ ID NO: 195329 - RNA, 24 nt, Human
cauguuggccaggcuagucuugaa

SEQ ID NO: 195330 - RNA, 20 nt, Human
cauuacacuagacuguuugc

SEQ ID NO: 195331 - RNA, 23 nt, Human
cauuacacuagacuguuugcccc

SEQ ID NO: 195332 - RNA, 23 nt, Human
ccaaaaaacccaaccaaccacca

SEQ ID NO: 195333 - RNA, 21 nt, Human
ccaaagugcugggauuaaacg

SEQ ID NO: 195334 - RNA, 22 nt, Human
ccaaagugcugggauuaaacgu

SEQ ID NO: 195335 - RNA, 24 nt, Human
ccaaaguucugggauuacaggcau

SEQ ID NO: 195336 - RNA, 21 nt, Human
ccacaacugggacagggaagc

SEQ ID NO: 195337 - RNA, 20 nt, Human
ccagcacuuggucagugugg

SEQ ID NO: 195338 - RNA, 23 nt, Human
ccaggccggagugcacuggcaca

SEQ ID NO: 195339 - RNA, 24 nt, Human
cccaaaguucugggauuacaggca

SEQ ID NO: 195340 - RNA, 23 nt, Human
cccaagcucaagcaauucuccca

SEQ ID NO: 195341 - RNA, 22 nt, Human
cccaguagcugggauuauaggc

SEQ ID NO: 195342 - RNA, 22 nt, Human
ccccaacuagcugagacuacag

SEQ ID NO: 195343 - RNA, 22 nt, Human
ccccaccaccccucuucguacc

SEQ ID NO: 195344 - RNA, 24 nt, Human
ccccaccaccccucuucguaccua

SEQ ID NO: 195345 - RNA, 19 nt, Human
ccccaguagcugggauuau

SEQ ID NO: 195346 - RNA, 20 nt, Human
cccccaccaccccucuucgu

SEQ ID NO: 195347 - RNA, 18 nt, Human
cccucuugucccucuuuc

SEQ ID NO: 195348 - RNA, 19 nt, Human
cccucuugucccucuuucu

SEQ ID NO: 195349 - RNA, 21 nt, Human
cccugccccccaccaccccuc

SEQ ID NO: 195350 - RNA, 24 nt, Human
ccgccccugccucccaaagugcug

SEQ ID NO: 195351 - RNA, 24 nt, Human
ccucugggguucaggugauucucc

SEQ ID NO: 195352 - RNA, 22 nt, Human
ccugaccucaggugauccaccc

SEQ ID NO: 195353 - RNA, 23 nt, Human
ccugaccucaggugauccacccg

SEQ ID NO: 195354 - RNA, 24 nt, Human
ccugaccucaggugauccuaccac

SEQ ID NO: 195355 - RNA, 23 nt, Human
ccugaguagcugggauuacgggc

SEQ ID NO: 195356 - RNA, 24 nt, Human
ccugaguagcugggauuacgggca

SEQ ID NO: 195357 - RNA, 24 nt, Human
ccugccucagccuccccaguagcu

SEQ ID NO: 195358 - RNA, 24 nt, Human
ccugucucagccuccugaguagcu

SEQ ID NO: 195359 - RNA, 28 nt, Human
ccuguggcuggggaaauaaccggggucc

SEQ ID NO: 195360 - RNA, 29 nt, Human
cgacuucccaagcucaagcaauucuuuuu

SEQ ID NO: 195361 - RNA, 24 nt, Human
cgcucugucacucaggcuggagug

SEQ ID NO: 195362 - RNA, 20 nt, Human
cucaagcaauucucccaccu

SEQ ID NO: 195363 - RNA, 24 nt, Human
cucaagcaauucucccaccuuagc

SEQ ID NO: 195364 - RNA, 23 nt, Human
cucacugcaaccucugccucugg

SEQ ID NO: 195365 - RNA, 24 nt, Human
cucagccuccccaguagcugggau

SEQ ID NO: 195366 - RNA, 24 nt, Human
cucagccuccugaguagcugggau

SEQ ID NO: 195367 - RNA, 21 nt, Human
cucauugcagccucaaacucc

SEQ ID NO: 195368 - RNA, 23 nt, Human
cuccugccucagccuccccagua

SEQ ID NO: 195369 - RNA, 24 nt, Human
cucgcucugucacucaggcuggag

SEQ ID NO: 195370 - RNA, 20 nt, Human
cucuuguugcccaggcugga

SEQ ID NO: 195371 - RNA, 19 nt, Human
cugacccuggagcauggac

SEQ ID NO: 195372 - RNA, 19 nt, Human
cugcaaccucugccucugg

SEQ ID NO: 195373 - RNA, 24 nt, Human
cugcaaccucugccucugggguuc

SEQ ID NO: 195374 - RNA, 23 nt, Human
cugcagccucgacuucccaagcu

SEQ ID NO: 195375 - RNA, 21 nt, Human
cugccccccaccaccccucuu

SEQ ID NO: 195376 - RNA, 20 nt, Human
cugcuucuguuuaagugcuu

SEQ ID NO: 195377 - RNA, 24 nt, Human
cuggaguacaauggcgugaucuca

SEQ ID NO: 195378 - RNA, 18 nt, Human
cuuaacccaguauggagg

SEQ ID NO: 195379 - RNA, 22 nt, Human
cuuccggguuugucaauugcgu

SEQ ID NO: 195380 - RNA, 20 nt, Human
cuucguaccuaggcuugcuc

SEQ ID NO: 195381 - RNA, 22 nt, Human
cuuuacagccacuuccugcgua

SEQ ID NO: 195382 - RNA, 18 nt, Human
gacccgcaucaagaacac

SEQ ID NO: 195383 - RNA, 27 nt, Human
gaccucaggugauccacccgccccugc

SEQ ID NO: 195384 - RNA, 24 nt, Human
gaccucaggugauccuaccaccuc

SEQ ID NO: 195385 - RNA, 21 nt, Human
gacuacaggcaugcaccauca

SEQ ID NO: 195386 - RNA, 24 nt, Human
gagacgggguuucaccauguuggc

SEQ ID NO: 195387 - RNA, 20 nt, Human
gagggagucuuugggaagug

SEQ ID NO: 195388 - RNA, 22 nt, Human
gaguagcugggauuacgggcac

SEQ ID NO: 195389 - RNA, 18 nt, Human
gauuacaggcaugcgcca

SEQ ID NO: 195390 - RNA, 21 nt, Human
gauuacaggcaugcgccacug

SEQ ID NO: 195391 - RNA, 24 nt, Human
gauuacaggcaugcgccacugugc

SEQ ID NO: 195392 - RNA, 18 nt, Human
gauuacaggcgugagcca

SEQ ID NO: 195393 - RNA, 21 nt, Human
gauuacaggcgugagccacug

SEQ ID NO: 195394 - RNA, 24 nt, Human
gauuacaggcgugagccacugugc

SEQ ID NO: 195395 - RNA, 22 nt, Human
gauuauaggcgccugccaccau

SEQ ID NO: 195396 - RNA, 21 nt, Human
gauucuccugucucagccucc

SEQ ID NO: 195397 - RNA, 20 nt, Human
gcagaaagcagcauucaaca

SEQ ID NO: 195398 - RNA, 20 nt, Human
gcagccucaaacuccugggc

SEQ ID NO: 195399 - RNA, 18 nt, Human
gccacugugcccggccac

SEQ ID NO: 195400 - RNA, 21 nt, Human
gccacugugcccggcugggca

SEQ ID NO: 195401 - RNA, 24 nt, Human
gcccaggcuggaguacaauggcgu

SEQ ID NO: 195402 - RNA, 19 nt, Human
gcccaguaugcacguucug

SEQ ID NO: 195403 - RNA, 23 nt, Human
gccccugccucccaaagugcugg

SEQ ID NO: 195404 - RNA, 22 nt, Human
gcccggcuaauuuuuguauuuu

SEQ ID NO: 195405 - RNA, 23 nt, Human
gccgcuggcucuguccuuucuca

SEQ ID NO: 195406 - RNA, 21 nt, Human
gccugacccuggagcauggac

SEQ ID NO: 195407 - RNA, 23 nt, Human
gcuagucuugaacuccugaccuc

SEQ ID NO: 195408 - RNA, 21 nt, Human
gcucuuguugcccaggcugga

SEQ ID NO: 195409 - RNA, 20 nt, Human
gcugccccugggacuccaag

SEQ ID NO: 195410 - RNA, 19 nt, Human
gcuggaguacaauggcgug

SEQ ID NO: 195411 - RNA, 23 nt, Human
gcuggucuugaacuccugaccuc

SEQ ID NO: 195412 - RNA, 20 nt, Human
gcuguugggcugcccauccc

SEQ ID NO: 195413 - RNA, 21 nt, Human
ggaaaggcacucacucuccuu

SEQ ID NO: 195414 - RNA, 19 nt, Human
ggaaauguugacccgcauc

SEQ ID NO: 195415 - RNA, 21 nt, Human
ggacagaggcuuuccgccggg

SEQ ID NO: 195416 - RNA, 18 nt, Human
ggagggagucuuugggaa

SEQ ID NO: 195417 - RNA, 25 nt, Human
ggaguuggggaggggggugggcuag

SEQ ID NO: 195418 - RNA, 24 nt, Human
ggauuacaggcaugcgccacugug

SEQ ID NO: 195419 - RNA, 22 nt, Human
ggcacuggguaauggcaguggu

SEQ ID NO: 195420 - RNA, 24 nt, Human
ggcuagucuugaacuccugaccuc

SEQ ID NO: 195421 - RNA, 22 nt, Human
ggcuggaguacaauggcgugau

SEQ ID NO: 195422 - RNA, 24 nt, Human
ggcuggucuugaacuccugaccuc

SEQ ID NO: 195423 - RNA, 19 nt, Human
gggagauggggguugguuc

SEQ ID NO: 195424 - RNA, 18 nt, Human
gggaggggggugggcuag

SEQ ID NO: 195425 - RNA, 19 nt, Human
gggcagagaaucuuaauuu

SEQ ID NO: 195426 - RNA, 19 nt, Human
ggggaggggggugggcuag

SEQ ID NO: 195427 - RNA, 19 nt, Human
ggggguuucaccauguugg

SEQ ID NO: 195428 - RNA, 24 nt, Human
gggguucaggugauucuccugucu

SEQ ID NO: 195429 - RNA, 18 nt, Human
gggguuucaccauguugg

SEQ ID NO: 195430 - RNA, 23 nt, Human
gggguuucaccauguuggccagg

SEQ ID NO: 195431 - RNA, 20 nt, Human
ggguucaggugauucuccug

SEQ ID NO: 195432 - RNA, 22 nt, Human
ggguuucaccauguuggccagg

SEQ ID NO: 195433 - RNA, 19 nt, Human
ggucuugaacuccugaccu

SEQ ID NO: 195434 - RNA, 18 nt, Human
ggugugcccuuugggaga

SEQ ID NO: 195435 - RNA, 19 nt, Human
gguucaggugauucuccug

SEQ ID NO: 195436 - RNA, 23 nt, Human
guagagacgggguuucaccaugu

SEQ ID NO: 195437 - RNA, 18 nt, Human
guagcugggauuacgggc

SEQ ID NO: 195438 - RNA, 18 nt, Human
guagcugggauuauaggc

SEQ ID NO: 195439 - RNA, 23 nt, Human
gugagacaccaugucuggccuuc

SEQ ID NO: 195440 - RNA, 24 nt, Human
gugauccacccgccccugccuccc

SEQ ID NO: 195441 - RNA, 22 nt, Human
gugauccuaccaccucagccuc

SEQ ID NO: 195442 - RNA, 23 nt, Human
gugauucuccugucucagccucc

SEQ ID NO: 195443 - RNA, 24 nt, Human
guggaacacauggcagaacuucca

SEQ ID NO: 195444 - RNA, 21 nt, Human
guugggcugcccaucccuggc

SEQ ID NO: 195445 - RNA, 20 nt, Human
uaacaguccagcaccuuggc

SEQ ID NO: 195446 - RNA, 20 nt, Human
uaagcagaaagcagcauuca

SEQ ID NO: 195447 - RNA, 24 nt, Human
uaagcagaaagcagcauucaacau

SEQ ID NO: 195448 - RNA, 23 nt, Human
uaagucgaugaaguuuuuaaaca

SEQ ID NO: 195449 - RNA, 24 nt, Human
uaauuuuugguauuuuuaguagag

SEQ ID NO: 195450 - RNA, 25 nt, Human
uaauuuuugguauuuuuaguagaga

SEQ ID NO: 195451 - RNA, 24 nt, Human
uaauuuuuguauuuuuaguagaga

SEQ ID NO: 195452 - RNA, 23 nt, Human
uacaggcaugcaccaucaugccc

SEQ ID NO: 195453 - RNA, 23 nt, Human
uacaggcaugcgccacugugccc

SEQ ID NO: 195454 - RNA, 23 nt, Human
uacaggcgugagccacugugccc

SEQ ID NO: 195455 - RNA, 23 nt, Human
uacaggcgugagccacugugccc

SEQ ID NO: 195456 - RNA, 24 nt, Human
uaccacaguuggggggcccuggag

SEQ ID NO: 195457 - RNA, 18 nt, Human
uacccauuguuguggggg

SEQ ID NO: 195458 - RNA, 22 nt, Human
uagagacgggguuucaccaugu

SEQ ID NO: 195459 - RNA, 20 nt, Human
uagagaugaggucuugcuau

SEQ ID NO: 195460 - RNA, 23 nt, Human
uagagucacaccugaaguucuga

SEQ ID NO: 195461 - RNA, 19 nt, Human
uaggcgccugccaccaugc

SEQ ID NO: 195462 - RNA, 24 nt, Human
uaguagagacgggguuucaccaug

SEQ ID NO: 195463 - RNA, 24 nt, Human
uaguagagaugaggucuugcuaug

SEQ ID NO: 195464 - RNA, 25 nt, Human
uaguagagauggggguuucaccaug

SEQ ID NO: 195465 - RNA, 23 nt, Human
uagucagcaggacuggauguugg

SEQ ID NO: 195466 - RNA, 24 nt, Human
uaugaugcccagccuggucucaaa

SEQ ID NO: 195467 - RNA, 25 nt, Human
ucaaaaaaauacuaagcagaaagca

SEQ ID NO: 195468 - RNA, 22 nt, Human
ucaaagugcugggauuacaggc

SEQ ID NO: 195469 - RNA, 24 nt, Human
ucaaagugcugggauuacaggcgu

SEQ ID NO: 195470 - RNA, 18 nt, Human
ucaagcaauucucccacc

SEQ ID NO: 195471 - RNA, 24 nt, Human
ucacucaauucauuucuguaucuc

SEQ ID NO: 195472 - RNA, 23 nt, Human
ucacucaggcuggagugcagugg

SEQ ID NO: 195473 - RNA, 19 nt, Human
ucacugcaaccucugccuc

SEQ ID NO: 195474 - RNA, 22 nt, Human
ucacugcaaccucugccucugg

SEQ ID NO: 195475 - RNA, 23 nt, Human
ucacugcaaccucugccucuggg

SEQ ID NO: 195476 - RNA, 20 nt, Human
ucagccccaggggugugccc

SEQ ID NO: 195477 - RNA, 18 nt, Human
ucagccuccccaguagcu

SEQ ID NO: 195478 - RNA, 20 nt, Human
ucagccuccugaguagcugg

SEQ ID NO: 195479 - RNA, 18 nt, Human
ucaggguaguguccuggu

SEQ ID NO: 195480 - RNA, 22 nt, Human
ucaugugcccucuguccucauc

SEQ ID NO: 195481 - RNA, 24 nt, Human
ucauugcagccucaaacuccuggg

SEQ ID NO: 195482 - RNA, 18 nt, Human
uccauggcacugcccaaa

SEQ ID NO: 195483 - RNA, 19 nt, Human
uccauggcacugcccaaag

SEQ ID NO: 195484 - RNA, 18 nt, Human
ucccaaagugcugggauu

SEQ ID NO: 195485 - RNA, 24 nt, Human
ucccaaaguucugggauuacaggc

SEQ ID NO: 195486 - RNA, 21 nt, Human
ucccaagaucagaaggucacu

SEQ ID NO: 195487 - RNA, 24 nt, Human
uccccaguagcugggauuauaggc

SEQ ID NO: 195488 - RNA, 24 nt, Human
uccugaguagcugggauuacgggc

SEQ ID NO: 195489 - RNA, 24 nt, Human
ucgcucugucacucaggcuggagu

SEQ ID NO: 195490 - RNA, 23 nt, Human
ucucaaacuccugagcucaagca

SEQ ID NO: 195491 - RNA, 24 nt, Human
ucucaaagugcugggauuacaggc

SEQ ID NO: 195492 - RNA, 19 nt, Human
ucucacucugucacccagg

SEQ ID NO: 195493 - RNA, 24 nt, Human
ucucacucugucacccaggccgga

SEQ ID NO: 195494 - RNA, 26 nt, Human
ucucacucugucacccaggccggagu

SEQ ID NO: 195495 - RNA, 27 nt, Human
ucucacucugucacccaggccggagug

SEQ ID NO: 195496 - RNA, 22 nt, Human
ucucaggguaguguccugguuu

SEQ ID NO: 195497 - RNA, 24 nt, Human
ucuccugucucagccuccugagua

SEQ ID NO: 195498 - RNA, 22 nt, Human
ucuccuugcuuugggauccaag

SEQ ID NO: 195499 - RNA, 19 nt, Human
ucucgcucugucacucagg

SEQ ID NO: 195500 - RNA, 23 nt, Human
ucucgcucugucacucaggcugg

SEQ ID NO: 195501 - RNA, 24 nt, Human
ucucgcucugucacucaggcugga

SEQ ID NO: 195502 - RNA, 18 nt, Human
ucuggccuucuuucucuu

SEQ ID NO: 195503 - RNA, 24 nt, Human
ucugucacucaggcuggagugcag

SEQ ID NO: 195504 - RNA, 21 nt, Human
ucuguccuuucucauuuucuc

SEQ ID NO: 195505 - RNA, 21 nt, Human
ucuguccuuucucauuuucuc

SEQ ID NO: 195506 - RNA, 23 nt, Human
ucuugaacuccugaccucaggug

SEQ ID NO: 195507 - RNA, 23 nt, Human
ucuugaacuccugaccucaggug

SEQ ID NO: 195508 - RNA, 23 nt, Human
ucuugcuaugaugcccagccugg

SEQ ID NO: 195509 - RNA, 19 nt, Human
ucuuugggaagugucaugc

SEQ ID NO: 195510 - RNA, 28 nt, Human
ugaaaagacugagaagaaaacagaaaag

SEQ ID NO: 195511 - RNA, 23 nt, Human
ugaaacuuaaaaaaaaaaaacaa

SEQ ID NO: 195512 - RNA, 21 nt, Human
ugacaacagaccagaaggucu

SEQ ID NO: 195513 - RNA, 19 nt, Human
ugacagcuacuuccucaug

SEQ ID NO: 195514 - RNA, 21 nt, Human
ugaccucaggugauccacccg

SEQ ID NO: 195515 - RNA, 24 nt, Human
ugaccucaggugauccacccgccc

SEQ ID NO: 195516 - RNA, 23 nt, Human
ugaccucaggugauccuaccacc

SEQ ID NO: 195517 - RNA, 24 nt, Human
ugaccucaggugauccuaccaccu

SEQ ID NO: 195518 - RNA, 25 nt, Human
ugaccucaggugauccuaccaccuc

SEQ ID NO: 195519 - RNA, 20 nt, Human
ugagacaccaugucuggccc

SEQ ID NO: 195520 - RNA, 21 nt, Human
ugagacuacaggcaugcacca

SEQ ID NO: 195521 - RNA, 31 nt, Human
ugagacuacaggcaugcaccaucaugcccgg

SEQ ID NO: 195522 - RNA, 22 nt, Human
ugagccucgucacgggaacugg

SEQ ID NO: 195523 - RNA, 24 nt, Human
ugaucucaccagcuccauucaagc

SEQ ID NO: 195524 - RNA, 20 nt, Human
ugauucuccugucucagccu

SEQ ID NO: 195525 - RNA, 21 nt, Human
ugcccaggcuggaguacaaug

SEQ ID NO: 195526 - RNA, 24 nt, Human
ugcccaggcuggaguacaauggcg

SEQ ID NO: 195527 - RNA, 18 nt, Human
ugccccuuucucauggug

SEQ ID NO: 195528 - RNA, 21 nt, Human
ugcccggcuaauuuuguuuuu

SEQ ID NO: 195529 - RNA, 24 nt, Human
ugcccggcuaauuuuuguauuuuu

SEQ ID NO: 195530 - RNA, 21 nt, Human
ugccucagccuccccaguagc

SEQ ID NO: 195531 - RNA, 24 nt, Human
ugccucagccuccccaguagcugg

SEQ ID NO: 195532 - RNA, 24 nt, Human
ugcucuuguugcccaggcuggagu

SEQ ID NO: 195533 - RNA, 24 nt, Human
ugcugggauuaaacgugugagaca

SEQ ID NO: 195534 - RNA, 24 nt, Human
ugcugggauuacaggcgugagcca

SEQ ID NO: 195535 - RNA, 24 nt, Human
uggaaauccauggcacugcccaaa

SEQ ID NO: 195536 - RNA, 24 nt, Human
uggacaggcuggucuugaacuccu

SEQ ID NO: 195537 - RNA, 20 nt, Human
uggagccgcuggcucugucc

SEQ ID NO: 195538 - RNA, 23 nt, Human
uggaggcggagauggagcaccga

SEQ ID NO: 195539 - RNA, 19 nt, Human
uggaguacaauggcgugau

SEQ ID NO: 195540 - RNA, 19 nt, Human
uggagugcagugggaaauc

SEQ ID NO: 195541 - RNA, 23 nt, Human
uggagugcagugggaaaucaugg

SEQ ID NO: 195542 - RNA, 19 nt, Human
uggcagaacuuccagcaga

SEQ ID NO: 195543 - RNA, 22 nt, Human
uggcagugguguggcugccccu

SEQ ID NO: 195544 - RNA, 24 nt, Human
uggccaggcuagucuugaacuccu

SEQ ID NO: 195545 - RNA, 22 nt, Human
uggcccugccccccaccacccc

SEQ ID NO: 195546 - RNA, 24 nt, Human
uggcgugaucucagcucacugcaa

SEQ ID NO: 195547 - RNA, 24 nt, Human
uggcucauugcagccucaaacucc

SEQ ID NO: 195548 - RNA, 18 nt, Human
uggcuuuggcauucacag

SEQ ID NO: 195549 - RNA, 18 nt, Human
ugggaagugcuugauggc

SEQ ID NO: 195550 - RNA, 18 nt, Human
ugggaagugcuugauggc

SEQ ID NO: 195551 - RNA, 22 nt, Human
ugggaagugcuugauggcuacc

SEQ ID NO: 195552 - RNA, 21 nt, Human
ugggauuacaggcaugcgcca

SEQ ID NO: 195553 - RNA, 22 nt, Human
ugggauuacaggcaugcgccac

SEQ ID NO: 195554 - RNA, 22 nt, Human
ugggauuacaggcaugcgccac

SEQ ID NO: 195555 - RNA, 24 nt, Human
ugggauuacaggcaugcgccacug

SEQ ID NO: 195556 - RNA, 26 nt, Human
ugggauuacaggcaugcgccacugug

SEQ ID NO: 195557 - RNA, 21 nt, Human
ugggauuacaggcgugagcca

SEQ ID NO: 195558 - RNA, 22 nt, Human
ugggauuacaggcgugagccac

SEQ ID NO: 195559 - RNA, 22 nt, Human
ugggauuacaggcgugagccac

SEQ ID NO: 195560 - RNA, 22 nt, Human
ugggauuacaggcgugagccac

SEQ ID NO: 195561 - RNA, 24 nt, Human
ugggauuacaggcgugagccacug

SEQ ID NO: 195562 - RNA, 26 nt, Human
ugggauuacaggcgugagccacugug

SEQ ID NO: 195563 - RNA, 20 nt, Human
ugggauuacgggcacccguc

SEQ ID NO: 195564 - RNA, 22 nt, Human
ugggauuacgggcacccgucac

SEQ ID NO: 195565 - RNA, 21 nt, Human
ugggauuauaggcgccugcca

SEQ ID NO: 195566 - RNA, 22 nt, Human
ugggauuauaggcgccugccac

SEQ ID NO: 195567 - RNA, 24 nt, Human
ugggauuauaggcgccugccacca

SEQ ID NO: 195568 - RNA, 25 nt, Human
ugggauuauaggcgccugccaccau

SEQ ID NO: 195569 - RNA, 19 nt, Human
ugggcagagaaucuuaauu

SEQ ID NO: 195570 - RNA, 22 nt, Human
uggggaggggggugggcuaggg

SEQ ID NO: 195571 - RNA, 24 nt, Human
uggugggugcccaguaugcacguu

SEQ ID NO: 195572 - RNA, 21 nt, Human
uguauuuuuaguagagacggg

SEQ ID NO: 195573 - RNA, 24 nt, Human
ugucucagccuccugaguagcugg

SEQ ID NO: 195574 - RNA, 19 nt, Human
ugugaucaaguuuuugagc

SEQ ID NO: 195575 - RNA, 22 nt, Human
uguggcugaaaggaguuggagc

SEQ ID NO: 195576 - RNA, 18 nt, Human
uguugugggggucaaaua

SEQ ID NO: 195577 - RNA, 26 nt, Human
uguuuguuuuuaaagagauggagucu

SEQ ID NO: 195578 - RNA, 24 nt, Human
uguuuuugaauuuuaguagagaug

SEQ ID NO: 195579 - RNA, 24 nt, Human
uuacacugacauaugggguguugg

SEQ ID NO: 195580 - RNA, 18 nt, Human
uuagccucugcuucuguu

SEQ ID NO: 195581 - RNA, 18 nt, Human
uuaguagagacgggguuu

SEQ ID NO: 195582 - RNA, 22 nt, Human
uuaguagagacgggguuucacc

SEQ ID NO: 195583 - RNA, 24 nt, Human
uuaguagagacgggguuucaccau

SEQ ID NO: 195584 - RNA, 18 nt, Human
uuaguagagaugaggucu

SEQ ID NO: 195585 - RNA, 18 nt, Human
uuaguagagaugaggucu

SEQ ID NO: 195586 - RNA, 25 nt, Human
uuaguagagauggggguuucaccau

SEQ ID NO: 195587 - RNA, 18 nt, Human
uuccagcagagcacugcg

SEQ ID NO: 195588 - RNA, 23 nt, Human
uugcucuuguugcccaggcugga

SEQ ID NO: 195589 - RNA, 20 nt, Human
uuggagcagauccugggaag

SEQ ID NO: 195590 - RNA, 21 nt, Human
uuggagccgcuggcucugucc

SEQ ID NO: 195591 - RNA, 19 nt, Human
uugguccucucuguugagu

SEQ ID NO: 195592 - RNA, 23 nt, Human
uuguuuuugaauuuuaguagaga

SEQ ID NO: 195593 - RNA, 21 nt, Human
uuucaccauguuggacaggcu

SEQ ID NO: 195594 - RNA, 24 nt, Human
uuucaccauguuggccaggcuagu

SEQ ID NO: 195595 - RNA, 20 nt, Human
uuucuucugauucuugaagg

SEQ ID NO: 195596 - RNA, 24 nt, Human
uuugcucuuguugcccaggcugga

SEQ ID NO: 195597 - RNA, 18 nt, Human
uuuggccuguggcugggg

SEQ ID NO: 195598 - RNA, 24 nt, Human
uuuugcucuuguugcccaggcugg

SEQ ID NO: 195599 - RNA, 23 nt, Human
uuuuguugcugucccaucuuguc

SEQ ID NO: 195600 - RNA, 24 nt, Human
uuuuuaguagagacgggguuucac

SEQ ID NO: 195601 - RNA, 25 nt, Human
uuuuuaguagagauggggguuucac

SEQ ID NO: 195602 - RNA, 19 nt, Human
uuuuugaauuuuaguagag

SEQ ID NO: 195603 - RNA, 20 nt, Human
uuuuugaauuuuaguagaga

SEQ ID NO: 195604 - RNA, 22 nt, Human
uuuuugaggaaagcugucacuc

SEQ ID NO: 195605 - RNA, 24 nt, Human
uuuuugguauuuuuaguagagaug

SEQ ID NO: 195606 - RNA, 20 nt, Human
uuuuuguauuuuuaguagag

SEQ ID NO: 195607 - RNA, 19 nt, Human
aaacaggaaaugggggugg

SEQ ID NO: 195608 - RNA, 23 nt, Human
aagagcucuagcucggaauauua

SEQ ID NO: 195609 - RNA, 19 nt, Human
accucacuccccagaaagc

SEQ ID NO: 195610 - RNA, 19 nt, Human
accuggguuucugggcuuu

SEQ ID NO: 195611 - RNA, 21 nt, Human
acgaccuucaggaguccagaa

SEQ ID NO: 195612 - RNA, 24 nt, Human
aggaaaugcuaacacaaagccaag

SEQ ID NO: 195613 - RNA, 21 nt, Human
aggaaauggggguggcugcag

SEQ ID NO: 195614 - RNA, 23 nt, Human
aggcagggagccccacgcuggcc

SEQ ID NO: 195615 - RNA, 18 nt, Human
agggccaggggccuugag

SEQ ID NO: 195616 - RNA, 24 nt, Human
agggcuagggcuggggugggggga

SEQ ID NO: 195617 - RNA, 21 nt, Human
auccagaagcaccacccacau

SEQ ID NO: 195618 - RNA, 21 nt, Human
caagggacacacauucguuca

SEQ ID NO: 195619 - RNA, 20 nt, Human
cacauccagaagcaccaccc

SEQ ID NO: 195620 - RNA, 22 nt, Human
caccagccacccugcuggaccc

SEQ ID NO: 195621 - RNA, 23 nt, Human
caccagccacccugcuggacccc

SEQ ID NO: 195622 - RNA, 21 nt, Human
caccagguggaggggcaaggc

SEQ ID NO: 195623 - RNA, 20 nt, Human
caccucacuccccagaaagc

SEQ ID NO: 195624 - RNA, 20 nt, Human
cagaaagcggccccuuccag

SEQ ID NO: 195625 - RNA, 24 nt, Human
cagcaucugaccccuccugggggg

SEQ ID NO: 195626 - RNA, 21 nt, Human
cagcugcuggcucuguccucc

SEQ ID NO: 195627 - RNA, 23 nt, Human
cagcugcuggcucuguccuccca

SEQ ID NO: 195628 - RNA, 20 nt, Human
cagggagccccacgcuggcc

SEQ ID NO: 195629 - RNA, 18 nt, Human
caggguccccucccugag

SEQ ID NO: 195630 - RNA, 19 nt, Human
ccacauggcccaggacccu

SEQ ID NO: 195631 - RNA, 23 nt, Human
ccagaaggcagggagccccacgg

SEQ ID NO: 195632 - RNA, 23 nt, Human
ccagcaccuggguuucugggcuu

SEQ ID NO: 195633 - RNA, 21 nt, Human
ccagccuggucccaccccucc

SEQ ID NO: 195634 - RNA, 24 nt, Human
cccagccuggucccaccccuccug

SEQ ID NO: 195635 - RNA, 26 nt, Human
ccccagaaagcggccccuuccagcau

SEQ ID NO: 195636 - RNA, 19 nt, Human
cccugcuggaccccugggg

SEQ ID NO: 195637 - RNA, 20 nt, Human
ccuaccggguccuggcugca

SEQ ID NO: 195638 - RNA, 24 nt, Human
ccuccugccgcucuccuugggcuc

SEQ ID NO: 195639 - RNA, 21 nt, Human
ccugcaggcucaguaagggcc

SEQ ID NO: 195640 - RNA, 21 nt, Human
ccuggucugcggagaccacgc

SEQ ID NO: 195641 - RNA, 21 nt, Human
cggcagccccagccuaggcac

SEQ ID NO: 195642 - RNA, 19 nt, Human
cgggcugugugccuuccau

SEQ ID NO: 195643 - RNA, 21 nt, Human
cucacauccagaagcaccacc

SEQ ID NO: 195644 - RNA, 19 nt, Human
cucgguccugucagggcag

SEQ ID NO: 195645 - RNA, 24 nt, Human
cugcagauaaauaagagacucaca

SEQ ID NO: 195646 - RNA, 21 nt, Human
cugcggagaccacgcagcugg

SEQ ID NO: 195647 - RNA, 19 nt, Human
gaggcccaggccugucacc

SEQ ID NO: 195648 - RNA, 20 nt, Human
gaggcccaggccugucaccc

SEQ ID NO: 195649 - RNA, 22 nt, Human
gaguccagaaggcagggagccc

SEQ ID NO: 195650 - RNA, 24 nt, Human
gcagaggcccaggccugucaccag

SEQ ID NO: 195651 - RNA, 21 nt, Human
gcaggguccccucccugaggg

SEQ ID NO: 195652 - RNA, 24 nt, Human
gccaacagaacacuucaggaggaa

SEQ ID NO: 195653 - RNA, 19 nt, Human
gcccaggccugucaccagc

SEQ ID NO: 195654 - RNA, 20 nt, Human
gcccgcuuuuguccggcucc

SEQ ID NO: 195655 - RNA, 19 nt, Human
gccgcaggguccccucccu

SEQ ID NO: 195656 - RNA, 21 nt, Human
gcugcuggcucuguccuccca

SEQ ID NO: 195657 - RNA, 21 nt, Human
ggaggcccgagggccaggccu

SEQ ID NO: 195658 - RNA, 20 nt, Human
ggcaaggccucucgguccug

SEQ ID NO: 195659 - RNA, 26 nt, Human
ggcucuguccucccagccugguccca

SEQ ID NO: 195660 - RNA, 19 nt, Human
ggggaauggaaaacaggaa

SEQ ID NO: 195661 - RNA, 24 nt, Human
gggguggcugcagauuccagcugg

SEQ ID NO: 195662 - RNA, 24 nt, Human
ggguggggggagcaggagggcaug

SEQ ID NO: 195663 - RNA, 18 nt, Human
gguccggcagccccagcc

SEQ ID NO: 195664 - RNA, 24 nt, Human
gugcauuuuauugccaacagaaca

SEQ ID NO: 195665 - RNA, 20 nt, Human
uaaagggcuagggcuggggu

SEQ ID NO: 195666 - RNA, 24 nt, Human
uaaagggcuagggcuggggugggg

SEQ ID NO: 195667 - RNA, 21 nt, Human
uagaaucggugccccagaagg

SEQ ID NO: 195668 - RNA, 19 nt, Human
uagggccaagcccacucuc

SEQ ID NO: 195669 - RNA, 20 nt, Human
uagggcugggguggggggag

SEQ ID NO: 195670 - RNA, 23 nt, Human
ucagggcaguugcagaggcccag

SEQ ID NO: 195671 - RNA, 20 nt, Human
ucccagccuggucccacccc

SEQ ID NO: 195672 - RNA, 23 nt, Human
ucccaucacggaggcccgagggc

SEQ ID NO: 195673 - RNA, 21 nt, Human
ucccugagggcccugguccag

SEQ ID NO: 195674 - RNA, 18 nt, Human
uccugccgcucuccuugg

SEQ ID NO: 195675 - RNA, 20 nt, Human
ucuccuugggcucaagggac

SEQ ID NO: 195676 - RNA, 21 nt, Human
ugaaaggcuaaagggcuaggg

SEQ ID NO: 195677 - RNA, 25 nt, Human
ugacuacaaacguaggaagaagagc

SEQ ID NO: 195678 - RNA, 20 nt, Human
ugagcuggagggccuagggc

SEQ ID NO: 195679 - RNA, 18 nt, Human
ugcauuuuauugccaaca

SEQ ID NO: 195680 - RNA, 19 nt, Human
ugcggagaccacgcagcug

SEQ ID NO: 195681 - RNA, 25 nt, Human
uggaaaacaggaaauggggguggcc

SEQ ID NO: 195682 - RNA, 23 nt, Human
uggagggccugguagaaucggug

SEQ ID NO: 195683 - RNA, 18 nt, Human
uggcccaggacccugcag

SEQ ID NO: 195684 - RNA, 24 nt, Human
uggcugagcuggagggccuagggc

SEQ ID NO: 195685 - RNA, 19 nt, Human
uggcugcaccccaaaguuc

SEQ ID NO: 195686 - RNA, 18 nt, Human
ugggcaccagguggaggg

SEQ ID NO: 195687 - RNA, 21 nt, Human
ugggcaguggggcgcggccag

SEQ ID NO: 195688 - RNA, 21 nt, Human
ugggcucaagggacacacauu

SEQ ID NO: 195689 - RNA, 21 nt, Human
uggggguggcugcagauucca

SEQ ID NO: 195690 - RNA, 27 nt, Human
uggggguggcugcagauuccagcugga

SEQ ID NO: 195691 - RNA, 21 nt, Human
ugggguggggggagcaggagg

SEQ ID NO: 195692 - RNA, 22 nt, Human
ugggguggggggagcaggaggg

SEQ ID NO: 195693 - RNA, 24 nt, Human
uggugcuggcucauuuuugcuccu

SEQ ID NO: 195694 - RNA, 22 nt, Human
uuccauccauccacgaccuuca

SEQ ID NO: 195695 - RNA, 21 nt, Human
uugcagaggcccaggccuguc

SEQ ID NO: 195696 - RNA, 20 nt, Human
uuuuucuggcugagcuggag

SEQ ID NO: 195697 - RNA, 19 nt, Human
aaaaacaguuaagguagcc

SEQ ID NO: 195698 - RNA, 23 nt, Human
aaauccacuucaaccuucauaaa

SEQ ID NO: 195699 - RNA, 18 nt, Human
aagaagaggcaagcuuga

SEQ ID NO: 195700 - RNA, 22 nt, Human
aagaauucucaaaugcuuaaaa

SEQ ID NO: 195701 - RNA, 21 nt, Human
aaguaaauucacaggcacaga

SEQ ID NO: 195702 - RNA, 21 nt, Human
aaugcuuaaaaugguggucuu

SEQ ID NO: 195703 - RNA, 23 nt, Human
acagagcagggauuuuuuuuuuu

SEQ ID NO: 195704 - RNA, 24 nt, Human
accccaaaaucaggcuaaaaacug

SEQ ID NO: 195705 - RNA, 19 nt, Human
accgccgccaccucuuccu

SEQ ID NO: 195706 - RNA, 19 nt, Human
acugcaaacagcugacugc

SEQ ID NO: 195707 - RNA, 21 nt, Human
agaauucucaaaugcuuaaaa

SEQ ID NO: 195708 - RNA, 21 nt, Human
agcaagaaugacuugaaguau

SEQ ID NO: 195709 - RNA, 18 nt, Human
aggcgggggugggggggg

SEQ ID NO: 195710 - RNA, 20 nt, Human
aggcggggguggggggggug

SEQ ID NO: 195711 - RNA, 20 nt, Human
aggugucaaauucacugaaa

SEQ ID NO: 195712 - RNA, 19 nt, Human
auagaccccaaaaucaggc

SEQ ID NO: 195713 - RNA, 19 nt, Human
auuucaucacuaaaaaaua

SEQ ID NO: 195714 - RNA, 20 nt, Human
caaaugaaguuaugcugacg

SEQ ID NO: 195715 - RNA, 23 nt, Human
caagaaugccaguuuaaaagaaa

SEQ ID NO: 195716 - RNA, 20 nt, Human
caagagaaauaaaauuggca

SEQ ID NO: 195717 - RNA, 22 nt, Human
caccgccaccgccgccaccucu

SEQ ID NO: 195718 - RNA, 20 nt, Human
caccgcuacgaccaccgcca

SEQ ID NO: 195719 - RNA, 24 nt, Human
cagaaacaucauaaagaaagcuag

SEQ ID NO: 195720 - RNA, 18 nt, Human
cagcugacugcauccuug

SEQ ID NO: 195721 - RNA, 23 nt, Human
cagcugauucguacccgccuccu

SEQ ID NO: 195722 - RNA, 19 nt, Human
caggcuaaaaacugcaaac

SEQ ID NO: 195723 - RNA, 20 nt, Human
ccaccgccaccgccgccacc

SEQ ID NO: 195724 - RNA, 19 nt, Human
cccgcagcugauucguacc

SEQ ID NO: 195725 - RNA, 22 nt, Human
ccgcagcugauucguacccgcc

SEQ ID NO: 195726 - RNA, 19 nt, Human
ccucaagaagaggcaagcu

SEQ ID NO: 195727 - RNA, 25 nt, Human
cuaaaaacugcaaacagcugacugc

SEQ ID NO: 195728 - RNA, 20 nt, Human
cuugaaguauccaauaaagc

SEQ ID NO: 195729 - RNA, 25 nt, Human
ggcaaggcgggggugggggggguga

SEQ ID NO: 195730 - RNA, 21 nt, Human
gggaagugcaagcaagaauga

SEQ ID NO: 195731 - RNA, 18 nt, Human
gggauacauacuguccuu

SEQ ID NO: 195732 - RNA, 19 nt, Human
ggggguggggggggugaag

SEQ ID NO: 195733 - RNA, 19 nt, Human
ggggguggggggggugaag

SEQ ID NO: 195734 - RNA, 21 nt, Human
uaaagcaaucucuauagaccc

SEQ ID NO: 195735 - RNA, 25 nt, Human
uaagaagucaaguacaagcaugcaa

SEQ ID NO: 195736 - RNA, 19 nt, Human
uacaauaaaacaccaacac

SEQ ID NO: 195737 - RNA, 21 nt, Human
uacaauaaaacaccaacacag

SEQ ID NO: 195738 - RNA, 26 nt, Human
uacaauaaaacaccaacacagcuuuc

SEQ ID NO: 195739 - RNA, 18 nt, Human
uacagccuuacuuuaauu

SEQ ID NO: 195740 - RNA, 19 nt, Human
uacgaccuaaaaaugaagc

SEQ ID NO: 195741 - RNA, 19 nt, Human
uagaccccaaaaucaggcu

SEQ ID NO: 195742 - RNA, 23 nt, Human
uagaccccaaaaucaggcuaaaa

SEQ ID NO: 195743 - RNA, 21 nt, Human
uaugugcaucugaaguaugua

SEQ ID NO: 195744 - RNA, 29 nt, Human
uccaaaccuacgaccuaaaaaugaagcaa

SEQ ID NO: 195745 - RNA, 22 nt, Human
uccuccgccaccgcuacgacca

SEQ ID NO: 195746 - RNA, 22 nt, Human
ucguauuaucagaaacaucaua

SEQ ID NO: 195747 - RNA, 22 nt, Human
ucuauagaccccaaaaucaggc

SEQ ID NO: 195748 - RNA, 19 nt, Human
ugaauggcccugacacacu

SEQ ID NO: 195749 - RNA, 20 nt, Human
ugacaaggacaaaaaggcuc

SEQ ID NO: 195750 - RNA, 21 nt, Human
ugacaaggacaaaaaggcucu

SEQ ID NO: 195751 - RNA, 20 nt, Human
ugacuauaucagcagcucuc

SEQ ID NO: 195752 - RNA, 19 nt, Human
ugacugcauccuugccagu

SEQ ID NO: 195753 - RNA, 23 nt, Human
ugacugcauccuugccaguucuc

SEQ ID NO: 195754 - RNA, 20 nt, Human
ugaugcaacaccaacaauuu

SEQ ID NO: 195755 - RNA, 20 nt, Human
ugauucguacccgccuccuc

SEQ ID NO: 195756 - RNA, 21 nt, Human
ugcaaaacuaauaauuuucaa

SEQ ID NO: 195757 - RNA, 20 nt, Human
ugggacaagacauuccaaac

SEQ ID NO: 195758 - RNA, 22 nt, Human
ugugcaucugaaguauguacaa

SEQ ID NO: 195759 - RNA, 18 nt, Human
uguguguggcaaggcggg

SEQ ID NO: 195760 - RNA, 19 nt, Human
uguguguggcaaggcgggg

SEQ ID NO: 195761 - RNA, 19 nt, Human
uucuuucauuaaaccuggg

SEQ ID NO: 195762 - RNA, 24 nt, Human
acccucuuuaaucccuuccuuuua

SEQ ID NO: 195763 - RNA, 20 nt, Human
aggccagcgcccacgguccc

SEQ ID NO: 195764 - RNA, 21 nt, Human
auggcaacggagaagggaacg

SEQ ID NO: 195765 - RNA, 21 nt, Human
cagccucagugggaaucugcc

SEQ ID NO: 195766 - RNA, 19 nt, Human
ccagcgcccacggucccag

SEQ ID NO: 195767 - RNA, 19 nt, Human
ccauagauuucccacccuc

SEQ ID NO: 195768 - RNA, 18 nt, Human
ccccccccccccccgccc

SEQ ID NO: 195769 - RNA, 19 nt, Human
ccccccccccccccgcccc

SEQ ID NO: 195770 - RNA, 23 nt, Human
ccccccgccccugccccguuugc

SEQ ID NO: 195771 - RNA, 18 nt, Human
cccccucagccucagugg

SEQ ID NO: 195772 - RNA, 21 nt, Human
ccccucagccucagugggaau

SEQ ID NO: 195773 - RNA, 23 nt, Human
ccccugcccucugcccccccccc

SEQ ID NO: 195774 - RNA, 24 nt, Human
cccgccccugccccgucggggccg

SEQ ID NO: 195775 - RNA, 24 nt, Human
cccucagccucagugggaaucugc

SEQ ID NO: 195776 - RNA, 22 nt, Human
cccucugccccccccccccccc

SEQ ID NO: 195777 - RNA, 18 nt, Human
cccugcccucugcccccc

SEQ ID NO: 195778 - RNA, 22 nt, Human
ccucccacuucccgguucaagu

SEQ ID NO: 195779 - RNA, 18 nt, Human
ccucccucccucccuccc

SEQ ID NO: 195780 - RNA, 23 nt, Human
ccucccucccucccuccccucca

SEQ ID NO: 195781 - RNA, 24 nt, Human
ccucccucgggccauucucucccu

SEQ ID NO: 195782 - RNA, 21 nt, Human
ccuccuucucucccuccuccc

SEQ ID NO: 195783 - RNA, 21 nt, Human
ccuccuucucucccuccuccc

SEQ ID NO: 195784 - RNA, 19 nt, Human
cgagcucggcccccucagc

SEQ ID NO: 195785 - RNA, 19 nt, Human
cggagaagggaacgcggcg

SEQ ID NO: 195786 - RNA, 20 nt, Human
cggucccaggagcgccuccc

SEQ ID NO: 195787 - RNA, 24 nt, Human
cucggcccccucagccucaguggg

SEQ ID NO: 195788 - RNA, 18 nt, Human
cugccccccccccccccg

SEQ ID NO: 195789 - RNA, 22 nt, Human
cugccccccccccccccgcccc

SEQ ID NO: 195790 - RNA, 19 nt, Human
gaacgcggcgcgcgagcuc

SEQ ID NO: 195791 - RNA, 21 nt, Human
gacccgucccccugcccucug

SEQ ID NO: 195792 - RNA, 24 nt, Human
gccgggguguccgcgguucauggc

SEQ ID NO: 195793 - RNA, 19 nt, Human
gcgcccacggucccaggag

SEQ ID NO: 195794 - RNA, 19 nt, Human
gcgccucccuccuucucuc

SEQ ID NO: 195795 - RNA, 21 nt, Human
gcggcgcgcgagcucggcccc

SEQ ID NO: 195796 - RNA, 20 nt, Human
uaaaaaccauagauuuccca

SEQ ID NO: 195797 - RNA, 20 nt, Human
uaaaaauguucucuucucuu

SEQ ID NO: 195798 - RNA, 24 nt, Human
ucccacccucuuuaaucccuuccu

SEQ ID NO: 195799 - RNA, 20 nt, Human
ucccaggagcgccucccucc

SEQ ID NO: 195800 - RNA, 24 nt, Human
ucccaggagcgccucccuccuucu

SEQ ID NO: 195801 - RNA, 30 nt, Human
ucccccugcccucugccccccccccccccu

SEQ ID NO: 195802 - RNA, 21 nt, Human
ucccucccucccuccccucca

SEQ ID NO: 195803 - RNA, 19 nt, Human
ucggcccccucagccucag

SEQ ID NO: 195804 - RNA, 21 nt, Human
ucugccaucuugagaaaaaag

SEQ ID NO: 195805 - RNA, 25 nt, Human
uuaaaauaaaaaccauagauuuccc

SEQ ID NO: 195806 - RNA, 18 nt, Human
uucccgguucaaguuuca

SEQ ID NO: 195807 - RNA, 25 nt, Human
uuuaaaaauguucucuucucugcuc

SEQ ID NO: 195808 - RNA, 24 nt, Human
aaacauuuaaaaauuaaaaccaaa

SEQ ID NO: 195809 - RNA, 19 nt, Human
aaagaaaucgcccaccccu

SEQ ID NO: 195810 - RNA, 21 nt, Human
aaauaguccguguguuggaac

SEQ ID NO: 195811 - RNA, 21 nt, Human
accccuuugccccauuccccc

SEQ ID NO: 195812 - RNA, 24 nt, Human
agaaaucgcccaccccuuugcccc

SEQ ID NO: 195813 - RNA, 21 nt, Human
agacggcaggccugggacugc

SEQ ID NO: 195814 - RNA, 21 nt, Human
agucucuuuuuacaaacauuu

SEQ ID NO: 195815 - RNA, 24 nt, Human
caccccuuugccccauucccccaa

SEQ ID NO: 195816 - RNA, 20 nt, Human
cacccgcgcucggccgccgc

SEQ ID NO: 195817 - RNA, 19 nt, Human
cacugcugaagcagcaugg

SEQ ID NO: 195818 - RNA, 20 nt, Human
cacugcugaagcagcauggu

SEQ ID NO: 195819 - RNA, 18 nt, Human
cagcagcaggggcuagug

SEQ ID NO: 195820 - RNA, 18 nt, Human
cagcggcgagaguguggc

SEQ ID NO: 195821 - RNA, 19 nt, Human
caggacacagggcacaucu

SEQ ID NO: 195822 - RNA, 20 nt, Human
cagggcaccugggcagagcu

SEQ ID NO: 195823 - RNA, 22 nt, Human
caucagcggcgagaguguggcc

SEQ ID NO: 195824 - RNA, 18 nt, Human
ccacccgcgcucggccgc

SEQ ID NO: 195825 - RNA, 21 nt, Human
cccaaaacagucucuuuuuac

SEQ ID NO: 195826 - RNA, 19 nt, Human
cccagggcaccugggcaga

SEQ ID NO: 195827 - RNA, 18 nt, Human
ccccaaaacagucucuuu

SEQ ID NO: 195828 - RNA, 21 nt, Human
ccccuccgccgccacagccgc

SEQ ID NO: 195829 - RNA, 23 nt, Human
cccgcccuccggccgccgcccgc

SEQ ID NO: 195830 - RNA, 22 nt, Human
cccgcgccccccuccgccgcca

SEQ ID NO: 195831 - RNA, 19 nt, Human
cccuccgccgccacagccg

SEQ ID NO: 195832 - RNA, 20 nt, Human
cccugcccuugcugcagcca

SEQ ID NO: 195833 - RNA, 28 nt, Human
ccgccgcccgccccgcgcccucagggcc

SEQ ID NO: 195834 - RNA, 20 nt, Human
ccgccgccgccaccacagcc

SEQ ID NO: 195835 - RNA, 20 nt, Human
ccgccgccgccaccacagcc

SEQ ID NO: 195836 - RNA, 21 nt, Human
ccgccgccgccaccacagccg

SEQ ID NO: 195837 - RNA, 23 nt, Human
ccgccgccgccaccacagccgca

SEQ ID NO: 195838 - RNA, 21 nt, Human
ccgccgccgccgccaccacag

SEQ ID NO: 195839 - RNA, 24 nt, Human
ccgccgccgccgccaccacagccg

SEQ ID NO: 195840 - RNA, 20 nt, Human
ccgccgccgcuuccucccgc

SEQ ID NO: 195841 - RNA, 21 nt, Human
ccgccgcgccaucgccggccc

SEQ ID NO: 195842 - RNA, 18 nt, Human
ccgcgccaucgccggccc

SEQ ID NO: 195843 - RNA, 24 nt, Human
ccucagggccgccgcgccaucgcc

SEQ ID NO: 195844 - RNA, 18 nt, Human
ccucccgcgccacccgcc

SEQ ID NO: 195845 - RNA, 24 nt, Human
ccuccgccgccacagccgccaccc

SEQ ID NO: 195846 - RNA, 24 nt, Human
ccuugcugcagccagggcaggcug

SEQ ID NO: 195847 - RNA, 23 nt, Human
cgccccccuccgccgccacagcc

SEQ ID NO: 195848 - RNA, 22 nt, Human
cgcgccaucgccggcccgcgcc

SEQ ID NO: 195849 - RNA, 18 nt, Human
cgcucggccgccgccgcc

SEQ ID NO: 195850 - RNA, 18 nt, Human
cggccgccgccgccgccg

SEQ ID NO: 195851 - RNA, 24 nt, Human
cgugcuggagacggcaggccuggg

SEQ ID NO: 195852 - RNA, 22 nt, Human
cuccucccccuacagccugguc

SEQ ID NO: 195853 - RNA, 23 nt, Human
cugcagccagggcaggcuggggc

SEQ ID NO: 195854 - RNA, 27 nt, Human
gccgccgccgccgccaccacagccgca

SEQ ID NO: 195855 - RNA, 18 nt, Human
gccgccgccgccgccggg

SEQ ID NO: 195856 - RNA, 22 nt, Human
gccggcccgcgccccccuccgc

SEQ ID NO: 195857 - RNA, 23 nt, Human
gcugcagccagggcaggcugggg

SEQ ID NO: 195858 - RNA, 21 nt, Human
guguagcugucauaauuagag

SEQ ID NO: 195859 - RNA, 21 nt, Human
guguccaccuuggggccgugc

SEQ ID NO: 195860 - RNA, 19 nt, Human
uaauaccuaacgcuuccgg

SEQ ID NO: 195861 - RNA, 23 nt, Human
uacaaguuagcaaauucuaguac

SEQ ID NO: 195862 - RNA, 21 nt, Human
uaccuaacgcuuccggauucu

SEQ ID NO: 195863 - RNA, 20 nt, Human
ucccccaaaacagucucuuu

SEQ ID NO: 195864 - RNA, 22 nt, Human
ucccgcgccacccgcccuccgg

SEQ ID NO: 195865 - RNA, 19 nt, Human
ugacuuauagggaaauccu

SEQ ID NO: 195866 - RNA, 22 nt, Human
ugaggcaaugucagacccagga

SEQ ID NO: 195867 - RNA, 18 nt, Human
ugaggcgagcgccggguc

SEQ ID NO: 195868 - RNA, 22 nt, Human
uggaacagcuuuccuuuuacau

SEQ ID NO: 195869 - RNA, 27 nt, Human
aaaaagaaaaaaaaaacaguccaacag

SEQ ID NO: 195870 - RNA, 20 nt, Human
aaaaaugcauuauaacuugg

SEQ ID NO: 195871 - RNA, 28 nt, Human
aaaagaaaaaaaaaacaguccaacagag

SEQ ID NO: 195872 - RNA, 20 nt, Human
aaacaagaaaagcaacucuu

SEQ ID NO: 195873 - RNA, 22 nt, Human
aaaccuccaagcggagcacccc

SEQ ID NO: 195874 - RNA, 18 nt, Human
aaaguccccuuugccccc

SEQ ID NO: 195875 - RNA, 21 nt, Human
aaccuccaagcggagcacccc

SEQ ID NO: 195876 - RNA, 22 nt, Human
aacuacucaagaaccuaagcag

SEQ ID NO: 195877 - RNA, 25 nt, Human
aagaaagaaaaccaaggcacuagaa

SEQ ID NO: 195878 - RNA, 24 nt, Human
aagaacaggagaaagcacgcaagc

SEQ ID NO: 195879 - RNA, 18 nt, Human
aagaaguuugccaagagc

SEQ ID NO: 195880 - RNA, 23 nt, Human
aagcaugcuuccuaaugggaggg

SEQ ID NO: 195881 - RNA, 18 nt, Human
aagcggagcaccccaaua

SEQ ID NO: 195882 - RNA, 19 nt, Human
aagcuuuacauuugaucug

SEQ ID NO: 195883 - RNA, 24 nt, Human
aaggaaaaaaacuucuaaaaagga

SEQ ID NO: 195884 - RNA, 18 nt, Human
aaggcccacaaugguuuc

SEQ ID NO: 195885 - RNA, 20 nt, Human
acagaguccucuucaguuug

SEQ ID NO: 195886 - RNA, 19 nt, Human
accaacucaguccagcuuu

SEQ ID NO: 195887 - RNA, 25 nt, Human
accccaaggcccacaaugguuucua

SEQ ID NO: 195888 - RNA, 25 nt, Human
accccuccccaaaaaugcagucaca

SEQ ID NO: 195889 - RNA, 18 nt, Human
acgaaaccaaccaaagcc

SEQ ID NO: 195890 - RNA, 18 nt, Human
acucaagaaccuaagcag

SEQ ID NO: 195891 - RNA, 25 nt, Human
agaaaaaaaaaacaguccaacagag

SEQ ID NO: 195892 - RNA, 18 nt, Human
agaaagaaaaccaaggca

SEQ ID NO: 195893 - RNA, 20 nt, Human
agacaaacucaucuccccuu

SEQ ID NO: 195894 - RNA, 21 nt, Human
agagagcacguagaauuggac

SEQ ID NO: 195895 - RNA, 19 nt, Human
agagauuacugaaaaccaa

SEQ ID NO: 195896 - RNA, 22 nt, Human
agcagaacuacucaagaaccua

SEQ ID NO: 195897 - RNA, 19 nt, Human
aggaaaaaaacuucuaaaa

SEQ ID NO: 195898 - RNA, 23 nt, Human
aggaaaaaaacuucuaaaaagga

SEQ ID NO: 195899 - RNA, 18 nt, Human
aggaaaacaagaaaagca

SEQ ID NO: 195900 - RNA, 25 nt, Human
aggcagaguuaaauuuaaaauuuug

SEQ ID NO: 195901 - RNA, 18 nt, Human
auaaaaagguccacuguc

SEQ ID NO: 195902 - RNA, 22 nt, Human
aucaccuccaccaucgccauuu

SEQ ID NO: 195903 - RNA, 21 nt, Human
aucucuugaaccuucucccca

SEQ ID NO: 195904 - RNA, 23 nt, Human
caaggcacuagaaagcaagcaca

SEQ ID NO: 195905 - RNA, 23 nt, Human
cacagugcggccagcuagcgggu

SEQ ID NO: 195906 - RNA, 21 nt, Human
caccuccucccacuuccacgg

SEQ ID NO: 195907 - RNA, 18 nt, Human
cacgcaagcuacauauag

SEQ ID NO: 195908 - RNA, 21 nt, Human
cagaacaggaccaacucaguc

SEQ ID NO: 195909 - RNA, 27 nt, Human
cagaggacagacaaacucaucuccccu

SEQ ID NO: 195910 - RNA, 28 nt, Human
cagcagaggacagacaaacucaucuccc

SEQ ID NO: 195911 - RNA, 22 nt, Human
cagcuccucuuccgcguccucc

SEQ ID NO: 195912 - RNA, 18 nt, Human
caggaccaacucagucca

SEQ ID NO: 195913 - RNA, 23 nt, Human
cagggcaggugaaggacuggguu

SEQ ID NO: 195914 - RNA, 20 nt, Human
caguccagcuuugaaggccc

SEQ ID NO: 195915 - RNA, 18 nt, Human
caucaagaaagaaaacca

SEQ ID NO: 195916 - RNA, 22 nt, Human
caucaagaaagaaaaccaaggc

SEQ ID NO: 195917 - RNA, 23 nt, Human
caucuccccuuuggcucgaugcu

SEQ ID NO: 195918 - RNA, 20 nt, Human
ccaaagaaaagcucaaucau

SEQ ID NO: 195919 - RNA, 21 nt, Human
ccaagcucccaguucccuagg

SEQ ID NO: 195920 - RNA, 23 nt, Human
ccaguggaccauaugugccagaa

SEQ ID NO: 195921 - RNA, 22 nt, Human
ccauaugugccagaacaggacc

SEQ ID NO: 195922 - RNA, 21 nt, Human
cccacaaugguuucuaaggcc

SEQ ID NO: 195923 - RNA, 19 nt, Human
cccacauggaaagguggau

SEQ ID NO: 195924 - RNA, 23 nt, Human
ccccaaaaaugcagucacauaaa

SEQ ID NO: 195925 - RNA, 24 nt, Human
ccccaaacagccauuugcuuuaua

SEQ ID NO: 195926 - RNA, 23 nt, Human
ccccagaaaaauguacauacaag

SEQ ID NO: 195927 - RNA, 22 nt, Human
cccccaaacagccauuugcuuu

SEQ ID NO: 195928 - RNA, 20 nt, Human
cccccgacuuucccucccaa

SEQ ID NO: 195929 - RNA, 22 nt, Human
ccccgaagggguuaaaacuacc

SEQ ID NO: 195930 - RNA, 21 nt, Human
ccccugccgcagagcccacaa

SEQ ID NO: 195931 - RNA, 22 nt, Human
ccccuuugcccccucccccaaa

SEQ ID NO: 195932 - RNA, 25 nt, Human
cccggccguagccucagcagaggac

SEQ ID NO: 195933 - RNA, 23 nt, Human
cccuaucaccuccaccaucgcca

SEQ ID NO: 195934 - RNA, 20 nt, Human
cccucccuccucccccuucc

SEQ ID NO: 195935 - RNA, 23 nt, Human
ccgaggcagaguuaaauuuaaaa

SEQ ID NO: 195936 - RNA, 24 nt, Human
ccucccccgacuuucccucccaac

SEQ ID NO: 195937 - RNA, 18 nt, Human
ccucccucccuccucccc

SEQ ID NO: 195938 - RNA, 21 nt, Human
ccuccgaggggccagauccac

SEQ ID NO: 195939 - RNA, 19 nt, Human
ccugcagugacgccuuuag

SEQ ID NO: 195940 - RNA, 22 nt, Human
cgaaaccaaccaaagccagggg

SEQ ID NO: 195941 - RNA, 21 nt, Human
cggcaggaacaguacguaaug

SEQ ID NO: 195942 - RNA, 23 nt, Human
cuaggcccggccguagccucagc

SEQ ID NO: 195943 - RNA, 19 nt, Human
cucaucuccccuuuggcuc

SEQ ID NO: 195944 - RNA, 24 nt, Human
cucccccgacuuucccucccaacc

SEQ ID NO: 195945 - RNA, 20 nt, Human
cugaacuguauauuguagca

SEQ ID NO: 195946 - RNA, 19 nt, Human
cugcagugacgccuuuagc

SEQ ID NO: 195947 - RNA, 18 nt, Human
cuugaagucccuaucacc

SEQ ID NO: 195948 - RNA, 18 nt, Human
gaaggcccugauucaguc

SEQ ID NO: 195949 - RNA, 25 nt, Human
gaauuagcucuagaaaucacacuga

SEQ ID NO: 195950 - RNA, 19 nt, Human
gauuucgguaccccucccc

SEQ ID NO: 195951 - RNA, 20 nt, Human
ggaaucccccaaacagccau

SEQ ID NO: 195952 - RNA, 19 nt, Human
ggcccggccguagccucaa

SEQ ID NO: 195953 - RNA, 19 nt, Human
gggacauuucuaauuuuag

SEQ ID NO: 195954 - RNA, 24 nt, Human
guccucccccgacuuucccuccca

SEQ ID NO: 195955 - RNA, 22 nt, Human
guuaaagucccggcgccaccuc

SEQ ID NO: 195956 - RNA, 21 nt, Human
uaaaaaguccccuuugccccc

SEQ ID NO: 195957 - RNA, 21 nt, Human
uaaaacuaccgaugacgcugc

SEQ ID NO: 195958 - RNA, 19 nt, Human
uaaaagaacaggagaaagc

SEQ ID NO: 195959 - RNA, 18 nt, Human
uaaaauuuuggauuguag

SEQ ID NO: 195960 - RNA, 22 nt, Human
uaaagagcugccucacaaauua

SEQ ID NO: 195961 - RNA, 18 nt, Human
uaacuuggucaaauuacu

SEQ ID NO: 195962 - RNA, 21 nt, Human
uaagcgcccacagugcggccg

SEQ ID NO: 195963 - RNA, 20 nt, Human
uaaggaaaaaaauggguuuu

SEQ ID NO: 195964 - RNA, 20 nt, Human
uaaggaaaaaaauggguuuu

SEQ ID NO: 195965 - RNA, 20 nt, Human
uaaguccagugcgugaaacc

SEQ ID NO: 195966 - RNA, 25 nt, Human
uacauuccaucacuguaaaaagucc

SEQ ID NO: 195967 - RNA, 24 nt, Human
uagacuuuugaauggccgaggcag

SEQ ID NO: 195968 - RNA, 18 nt, Human
ucacuguaaaaagucccc

SEQ ID NO: 195969 - RNA, 18 nt, Human
ucauggaccccaaggccc

SEQ ID NO: 195970 - RNA, 20 nt, Human
ucccggcgccaccuccuccc

SEQ ID NO: 195971 - RNA, 26 nt, Human
ucccuccucccccuucccacagcucc

SEQ ID NO: 195972 - RNA, 20 nt, Human
ucccugcagagguucugaac

SEQ ID NO: 195973 - RNA, 24 nt, Human
uccgucuccuccucuuuuccuccc

SEQ ID NO: 195974 - RNA, 24 nt, Human
uccucauucagcugaggaccucau

SEQ ID NO: 195975 - RNA, 22 nt, Human
uccuucuaucagcaaacuccaa

SEQ ID NO: 195976 - RNA, 19 nt, Human
ucuaaccuaacaaacugcc

SEQ ID NO: 195977 - RNA, 18 nt, Human
ucuguuuuuauuuugggg

SEQ ID NO: 195978 - RNA, 23 nt, Human
ucuuaaaaaaaagaaaaagaaaa

SEQ ID NO: 195979 - RNA, 26 nt, Human
ugagcaaggugaugaggguaagucca

SEQ ID NO: 195980 - RNA, 22 nt, Human
ugccagaacaggaccaacucag

SEQ ID NO: 195981 - RNA, 18 nt, Human
ugcccccucccccaaaaa

SEQ ID NO: 195982 - RNA, 19 nt, Human
ugccgcagagcccacaagg

SEQ ID NO: 195983 - RNA, 21 nt, Human
ugccgcagagcccacaagggg

SEQ ID NO: 195984 - RNA, 21 nt, Human
ugccgcagagcccacaagggg

SEQ ID NO: 195985 - RNA, 20 nt, Human
ugcucugcucaguucuccuc

SEQ ID NO: 195986 - RNA, 19 nt, Human
ugcuugcgcuaagaaguuu

SEQ ID NO: 195987 - RNA, 22 nt, Human
uggcaaauugaaaauucuccca

SEQ ID NO: 195988 - RNA, 24 nt, Human
ugggaggguuuucuucccccuucc

SEQ ID NO: 195989 - RNA, 25 nt, Human
uggggggaaggaagagauuacugaa

SEQ ID NO: 195990 - RNA, 20 nt, Human
uggguuuuucuuaaaaaaaa

SEQ ID NO: 195991 - RNA, 19 nt, Human
uuacgaaaccaaccaaagc

SEQ ID NO: 195992 - RNA, 20 nt, Human
uuacugaaaaccaacuugua

SEQ ID NO: 195993 - RNA, 20 nt, Human
uuaguucucagggccucccu

SEQ ID NO: 195994 - RNA, 22 nt, Human
uuauauacacauguauauaaug

SEQ ID NO: 195995 - RNA, 22 nt, Human
uucaaggaaaaaauuggcaaau

SEQ ID NO: 195996 - RNA, 20 nt, Human
uuccaucacuguaaaaaguc

SEQ ID NO: 195997 - RNA, 21 nt, Human
uucccuaggcccggccguagc

SEQ ID NO: 195998 - RNA, 25 nt, Human
uuuaauauaauuuuuagaccaaaga

SEQ ID NO: 195999 - RNA, 20 nt, Human
uuuccucccucccuccuccc

SEQ ID NO: 196000 - RNA, 26 nt, Human
uuucuuaaaaaaaagaaaaagaaaaa

SEQ ID NO: 196001 - RNA, 20 nt, Human
uuugccaagagccucuucca

SEQ ID NO: 196002 - RNA, 18 nt, Human
uuuucuuaaaaaaaagaa

SEQ ID NO: 196003 - RNA, 23 nt, Human
aaaaagcaaauaaaaaauaaaau

SEQ ID NO: 196004 - RNA, 20 nt, Human
aaaaggcagcuccauaaacu

SEQ ID NO: 196005 - RNA, 21 nt, Human
aacauguacaaaaauggcugg

SEQ ID NO: 196006 - RNA, 20 nt, Human
aagcaagccaccaaaaggca

SEQ ID NO: 196007 - RNA, 22 nt, Human
acauacuaauuuauacacagaa

SEQ ID NO: 196008 - RNA, 23 nt, Human
acuugacaaccccaaacacaaac

SEQ ID NO: 196009 - RNA, 21 nt, Human
aguaaacaauauuuuacugaa

SEQ ID NO: 196010 - RNA, 24 nt, Human
augugcuuuaaggaaaggaggguu

SEQ ID NO: 196011 - RNA, 23 nt, Human
caacauguacaaaaauggcugga

SEQ ID NO: 196012 - RNA, 25 nt, Human
caaccccaaacacaaacauaaccuc

SEQ ID NO: 196013 - RNA, 23 nt, Human
caaggaggacagacccauuuuca

SEQ ID NO: 196014 - RNA, 23 nt, Human
cagauaaagcaagccaccaaaag

SEQ ID NO: 196015 - RNA, 21 nt, Human
ccccaaacacaaacauaaccu

SEQ ID NO: 196016 - RNA, 24 nt, Human
cccgcggcggcggcggcggcgccu

SEQ ID NO: 196017 - RNA, 25 nt, Human
cccggcggagcugccgcugcagccg

SEQ ID NO: 196018 - RNA, 22 nt, Human
ccgcuccccggucccccgcucc

SEQ ID NO: 196019 - RNA, 30 nt, Human
ccgcuccguccgccacccugccgccgcccc

SEQ ID NO: 196020 - RNA, 25 nt, Human
ccguccgccacccugccgccgcccc

SEQ ID NO: 196021 - RNA, 23 nt, Human
ccuccuucacuugacaaccccaa

SEQ ID NO: 196022 - RNA, 20 nt, Human
ccuggacugcgcugcugaug

SEQ ID NO: 196023 - RNA, 21 nt, Human
ccuucuuuuucuucuuaaaaa

SEQ ID NO: 196024 - RNA, 21 nt, Human
cggcggcggcggcggcgccug

SEQ ID NO: 196025 - RNA, 25 nt, Human
cuccucgcggccgccgcuccccggu

SEQ ID NO: 196026 - RNA, 19 nt, Human
cuccuucacuugacaaccc

SEQ ID NO: 196027 - RNA, 19 nt, Human
cugcagauaaagcaagcca

SEQ ID NO: 196028 - RNA, 18 nt, Human
cugccgccgcccagcagc

SEQ ID NO: 196029 - RNA, 28 nt, Human
cugcugauggcggcggccgcggcucuuu

SEQ ID NO: 196030 - RNA, 21 nt, Human
cuuaaaaacugcagauaaagc

SEQ ID NO: 196031 - RNA, 20 nt, Human
gccugggaucccuccuucac

SEQ ID NO: 196032 - RNA, 18 nt, Human
gcggcggcggcggcggcg

SEQ ID NO: 196033 - RNA, 18 nt, Human
ggcggcggccgcggcucg

SEQ ID NO: 196034 - RNA, 21 nt, Human
uaaagcaagccaccaaaaggc

SEQ ID NO: 196035 - RNA, 22 nt, Human
uaaagcaagccaccaaaaggca

SEQ ID NO: 196036 - RNA, 18 nt, Human
uaaggaaaggaggguuuu

SEQ ID NO: 196037 - RNA, 22 nt, Human
uaaggaaaggaggguuuucaaa

SEQ ID NO: 196038 - RNA, 23 nt, Human
uacaacauguacaaaaauggcug

SEQ ID NO: 196039 - RNA, 21 nt, Human
uacacaaggaggacagaccca

SEQ ID NO: 196040 - RNA, 19 nt, Human
uacacagaaacucugcccc

SEQ ID NO: 196041 - RNA, 26 nt, Human
uagauauucaacaaucuguacaguuu

SEQ ID NO: 196042 - RNA, 21 nt, Human
ucagggccuucuuuuucuucu

SEQ ID NO: 196043 - RNA, 18 nt, Human
uccguccgccacccugcc

SEQ ID NO: 196044 - RNA, 19 nt, Human
ucuucuuaaaaacugcaga

SEQ ID NO: 196045 - RNA, 27 nt, Human
ugaauacauaaauauggaguuuacaua

SEQ ID NO: 196046 - RNA, 19 nt, Human
ugccccauagccauaaaau

SEQ ID NO: 196047 - RNA, 18 nt, Human
uuucuaaacauaaagcuc

SEQ ID NO: 196048 - RNA, 20 nt, Human
uuugacucagggccuucuuu

SEQ ID NO: 196049 - RNA, 23 nt, Human
aaaacaaaaacaaaaaaauggga

SEQ ID NO: 196050 - RNA, 22 nt, Human
aaaaugcuuauaagaauauaag

SEQ ID NO: 196051 - RNA, 22 nt, Human
aaacaaaaacaaaaaaauggga

SEQ ID NO: 196052 - RNA, 27 nt, Human
aaacaagagacaaaaaaauauacaaga

SEQ ID NO: 196053 - RNA, 24 nt, Human
aacaagagacaaaaaaauauacaa

SEQ ID NO: 196054 - RNA, 23 nt, Human
aacauuaagaaaaaauguacaau

SEQ ID NO: 196055 - RNA, 23 nt, Human
aacuacuguaacuuaggacaggc

SEQ ID NO: 196056 - RNA, 20 nt, Human
aagagacaaaaaaauauaca

SEQ ID NO: 196057 - RNA, 24 nt, Human
aagcagauacacaaauucuaaaau

SEQ ID NO: 196058 - RNA, 21 nt, Human
acauuaagaaaaaauguacaa

SEQ ID NO: 196059 - RNA, 24 nt, Human
agaaaagcaauccacaacauuaag

SEQ ID NO: 196060 - RNA, 22 nt, Human
agaaaaggcacaaacaucugua

SEQ ID NO: 196061 - RNA, 19 nt, Human
agcaaaguaaagaaaaggc

SEQ ID NO: 196062 - RNA, 25 nt, Human
agccaccgggccggccgauaaccaa

SEQ ID NO: 196063 - RNA, 19 nt, Human
agcuuugaaaaaacucaca

SEQ ID NO: 196064 - RNA, 19 nt, Human
aggcacaaacaucuguaca

SEQ ID NO: 196065 - RNA, 19 nt, Human
auaacugauuuauaaagcu

SEQ ID NO: 196066 - RNA, 20 nt, Human
auaagaccaaauacuuuuaa

SEQ ID NO: 196067 - RNA, 22 nt, Human
auaagaccaaauacuuuuaaua

SEQ ID NO: 196068 - RNA, 19 nt, Human
auacaacagacauccuccc

SEQ ID NO: 196069 - RNA, 18 nt, Human
auagcacaaagauaaccc

SEQ ID NO: 196070 - RNA, 27 nt, Human
auccccuuuucccccuuccacacccaa

SEQ ID NO: 196071 - RNA, 24 nt, Human
auccuguguagcaagaacuaagga

SEQ ID NO: 196072 - RNA, 18 nt, Human
auguacaauuuaugaaac

SEQ ID NO: 196073 - RNA, 18 nt, Human
caaaaacaaaaaaauggg

SEQ ID NO: 196074 - RNA, 22 nt, Human
caagagacaaaaaaauauacaa

SEQ ID NO: 196075 - RNA, 18 nt, Human
cacccaacccucagaguc

SEQ ID NO: 196076 - RNA, 18 nt, Human
caccccucccucucuuuc

SEQ ID NO: 196077 - RNA, 20 nt, Human
caccccucccucucuuucac

SEQ ID NO: 196078 - RNA, 19 nt, Human
caccuucaacacuaaccaa

SEQ ID NO: 196079 - RNA, 18 nt, Human
cacuauauagcacaaaga

SEQ ID NO: 196080 - RNA, 19 nt, Human
cacuauauagcacaaagau

SEQ ID NO: 196081 - RNA, 22 nt, Human
cacuauauagcacaaagauaac

SEQ ID NO: 196082 - RNA, 22 nt, Human
cagacauccucccacgaguucu

SEQ ID NO: 196083 - RNA, 24 nt, Human
cagcaaacaagagacaaaaaaaua

SEQ ID NO: 196084 - RNA, 25 nt, Human
caguaaaucccaugcuucacauaga

SEQ ID NO: 196085 - RNA, 22 nt, Human
caugugcgugccugugcacaug

SEQ ID NO: 196086 - RNA, 24 nt, Human
cauucccccugagauagccaggag

SEQ ID NO: 196087 - RNA, 25 nt, Human
ccaacugaguuacauaaaauuguac

SEQ ID NO: 196088 - RNA, 19 nt, Human
ccagcaaacaagagacaaa

SEQ ID NO: 196089 - RNA, 19 nt, Human
cccccuuccacacccaacc

SEQ ID NO: 196090 - RNA, 18 nt, Human
ccccugagauagccagga

SEQ ID NO: 196091 - RNA, 23 nt, Human
ccccuuuucccccuuccacaccc

SEQ ID NO: 196092 - RNA, 22 nt, Human
ccuccauuucuagaaaaacaaa

SEQ ID NO: 196093 - RNA, 19 nt, Human
ccuucaacacuaaccaaaa

SEQ ID NO: 196094 - RNA, 18 nt, Human
ccuuccacacccaacccu

SEQ ID NO: 196095 - RNA, 23 nt, Human
cuccauccccuuuucccccuucc

SEQ ID NO: 196096 - RNA, 23 nt, Human
cucccucucuuucacucuucugg

SEQ ID NO: 196097 - RNA, 19 nt, Human
cugcaccccucccucucuu

SEQ ID NO: 196098 - RNA, 20 nt, Human
cugcaccccucccucucuuu

SEQ ID NO: 196099 - RNA, 23 nt, Human
cuggaccuacaaaugcucuuccc

SEQ ID NO: 196100 - RNA, 23 nt, Human
cugugcacauguugcugcacccc

SEQ ID NO: 196101 - RNA, 19 nt, Human
cuguucccauguaaaccgg

SEQ ID NO: 196102 - RNA, 21 nt, Human
cuuccacacccaacccucaga

SEQ ID NO: 196103 - RNA, 18 nt, Human
cuuuuccccauucccccu

SEQ ID NO: 196104 - RNA, 20 nt, Human
gagcaggucuccauccccuu

SEQ ID NO: 196105 - RNA, 19 nt, Human
gagcuggggagcaggucuc

SEQ ID NO: 196106 - RNA, 22 nt, Human
gauucuuuuccccauucccccu

SEQ ID NO: 196107 - RNA, 23 nt, Human
gcaccccucccucucuuucacuc

SEQ ID NO: 196108 - RNA, 21 nt, Human
gccugugcacauguugcugca

SEQ ID NO: 196109 - RNA, 19 nt, Human
gcugcaccccucccucucu

SEQ ID NO: 196110 - RNA, 20 nt, Human
ggccgauaaccaagcucuac

SEQ ID NO: 196111 - RNA, 20 nt, Human
ggcugacaggaagagcuggg

SEQ ID NO: 196112 - RNA, 20 nt, Human
uaaaaguaccagacccaaua

SEQ ID NO: 196113 - RNA, 19 nt, Human
uaaagacaccuagcauagg

SEQ ID NO: 196114 - RNA, 21 nt, Human
uacauaaaagcuguucaguuu

SEQ ID NO: 196115 - RNA, 22 nt, Human
uacauuuuuguucuaguuacgc

SEQ ID NO: 196116 - RNA, 19 nt, Human
uagaaaagcaauccacaac

SEQ ID NO: 196117 - RNA, 19 nt, Human
uagcauaggucuguggcaa

SEQ ID NO: 196118 - RNA, 21 nt, Human
uagugcaaccucacauauaua

SEQ ID NO: 196119 - RNA, 24 nt, Human
uauaagcaaaguaaagaaaaggca

SEQ ID NO: 196120 - RNA, 22 nt, Human
uauauaauagcaaacuacugua

SEQ ID NO: 196121 - RNA, 23 nt, Human
uaucuuguuuacaauguacauuu

SEQ ID NO: 196122 - RNA, 22 nt, Human
uauuacauacaacagacauccu

SEQ ID NO: 196123 - RNA, 26 nt, Human
uauuacauacaacagacauccuccca

SEQ ID NO: 196124 - RNA, 19 nt, Human
ucaaauuuuguuuugguca

SEQ ID NO: 196125 - RNA, 18 nt, Human
ucaauccagcaaacaaga

SEQ ID NO: 196126 - RNA, 21 nt, Human
uccaaaaaaggaaagaaauua

SEQ ID NO: 196127 - RNA, 22 nt, Human
uccacuauauagcacaaagaua

SEQ ID NO: 196128 - RNA, 24 nt, Human
uccagcaaacaagagacaaaaaaa

SEQ ID NO: 196129 - RNA, 21 nt, Human
uccccuuuucccccuuccaca

SEQ ID NO: 196130 - RNA, 24 nt, Human
ucuagaaaaacaaaaacaaaaaaa

SEQ ID NO: 196131 - RNA, 26 nt, Human
ucuccaugagcagcgacagacugccu

SEQ ID NO: 196132 - RNA, 18 nt, Human
ucuggaccuacaaaugcu

SEQ ID NO: 196133 - RNA, 19 nt, Human
ucuucuggaccuacaaaug

SEQ ID NO: 196134 - RNA, 28 nt, Human
ugacaggaagagcuggggagcaggucuc

SEQ ID NO: 196135 - RNA, 24 nt, Human
ugcacacaugugcgugccugugca

SEQ ID NO: 196136 - RNA, 22 nt, Human
ugcagaauaagauacucuaguu

SEQ ID NO: 196137 - RNA, 22 nt, Human
ugccugugcacauguugcugca

SEQ ID NO: 196138 - RNA, 29 nt, Human
ugcgugcacacaugugcgugccugugcac

SEQ ID NO: 196139 - RNA, 22 nt, Human
ugcuaagcccaggucuucucca

SEQ ID NO: 196140 - RNA, 18 nt, Human
ugcuguuuugcuuuacau

SEQ ID NO: 196141 - RNA, 23 nt, Human
uggaccuacaaaugcucuuccca

SEQ ID NO: 196142 - RNA, 22 nt, Human
uggcaaccuaguguccaacuga

SEQ ID NO: 196143 - RNA, 21 nt, Human
ugguuucacagaauuauaauc

SEQ ID NO: 196144 - RNA, 18 nt, Human
uguaaaccggcugacagg

SEQ ID NO: 196145 - RNA, 23 nt, Human
uguacaauuuuaaaaguaccaga

SEQ ID NO: 196146 - RNA, 20 nt, Human
uguaugugugcgugcacaca

SEQ ID NO: 196147 - RNA, 21 nt, Human
uguccaaaaaaggaaagaaau

SEQ ID NO: 196148 - RNA, 25 nt, Human
ugugcgugccugugcacauguugcu

SEQ ID NO: 196149 - RNA, 25 nt, Human
ugugugcgugcacacaugugcgugg

SEQ ID NO: 196150 - RNA, 27 nt, Human
uguugcugcaccccucccucucuuuca

SEQ ID NO: 196151 - RNA, 20 nt, Human
uguuuucccauauuuuuaga

SEQ ID NO: 196152 - RNA, 23 nt, Human
uucccauguaaaccggcugacag

SEQ ID NO: 196153 - RNA, 21 nt, Human
uucccccugagauagccagga

SEQ ID NO: 196154 - RNA, 18 nt, Human
uuguauauuuauuucucu

SEQ ID NO: 196155 - RNA, 19 nt, Human
uuuuuuuuuuuuuuuuuaa

SEQ ID NO: 196156 - RNA, 21 nt, Human
aaaggcacagguaacugcaua

SEQ ID NO: 196157 - RNA, 18 nt, Human
aaagguguagaaaaaggc

SEQ ID NO: 196158 - RNA, 23 nt, Human
aaccauaaacuauucacagccuc

SEQ ID NO: 196159 - RNA, 18 nt, Human
aacuguguuggagggagg

SEQ ID NO: 196160 - RNA, 18 nt, Human
aagugucacuggcuguga

SEQ ID NO: 196161 - RNA, 21 nt, Human
aagugucacuggcugugagug

SEQ ID NO: 196162 - RNA, 22 nt, Human
accccgcgaggcuccuccauga

SEQ ID NO: 196163 - RNA, 18 nt, Human
accccuuucccucugcca

SEQ ID NO: 196164 - RNA, 23 nt, Human
agacagaaaacgcaccaaccccg

SEQ ID NO: 196165 - RNA, 19 nt, Human
agacagaaaacgcaccagc

SEQ ID NO: 196166 - RNA, 18 nt, Human
agccacccuccaccuagg

SEQ ID NO: 196167 - RNA, 20 nt, Human
agcggggagggucaggaggc

SEQ ID NO: 196168 - RNA, 18 nt, Human
agggagagucagggcggg

SEQ ID NO: 196169 - RNA, 18 nt, Human
auggggcugaggaagugg

SEQ ID NO: 196170 - RNA, 22 nt, Human
caaaaccauaaacuauucacag

SEQ ID NO: 196171 - RNA, 23 nt, Human
caaacccaagacggcuuugggag

SEQ ID NO: 196172 - RNA, 18 nt, Human
caaccacagcggggaggg

SEQ ID NO: 196173 - RNA, 19 nt, Human
cacgcucuucuucugugcu

SEQ ID NO: 196174 - RNA, 18 nt, Human
cagaaaacgcaccagcac

SEQ ID NO: 196175 - RNA, 21 nt, Human
cagagauuucuagagcuugga

SEQ ID NO: 196176 - RNA, 20 nt, Human
cagauggggcugaggaagug

SEQ ID NO: 196177 - RNA, 21 nt, Human
cagcacuuucugccugaaugu

SEQ ID NO: 196178 - RNA, 20 nt, Human
cagcauucauguccacuccu

SEQ ID NO: 196179 - RNA, 27 nt, Human
cagccacccuccaccuaggcgccgcuc

SEQ ID NO: 196180 - RNA, 19 nt, Human
caggaccccgcgaggcucc

SEQ ID NO: 196181 - RNA, 28 nt, Human
caguguaccccuuucccucugccagccu

SEQ ID NO: 196182 - RNA, 21 nt, Human
caucagccuuuccccaaaacc

SEQ ID NO: 196183 - RNA, 20 nt, Human
cauggcccagucaucccugg

SEQ ID NO: 196184 - RNA, 19 nt, Human
ccagccucuggggugggug

SEQ ID NO: 196185 - RNA, 19 nt, Human
cccucugccagccucuggg

SEQ ID NO: 196186 - RNA, 18 nt, Human
ccuugggauggcaaacug

SEQ ID NO: 196187 - RNA, 22 nt, Human
cuccaccuaggcgccgcucuuc

SEQ ID NO: 196188 - RNA, 24 nt, Human
cucugggguggguggcugccaacc

SEQ ID NO: 196189 - RNA, 20 nt, Human
cugaagcaguuggagagagg

SEQ ID NO: 196190 - RNA, 20 nt, Human
cuggaugcuggggguggcuc

SEQ ID NO: 196191 - RNA, 19 nt, Human
gacuucagaugcuauucag

SEQ ID NO: 196192 - RNA, 20 nt, Human
gagacaucuguguccauggc

SEQ ID NO: 196193 - RNA, 20 nt, Human
gagcuuggagaacuguguug

SEQ ID NO: 196194 - RNA, 23 nt, Human
gccuugggauggcaaacuggucc

SEQ ID NO: 196195 - RNA, 23 nt, Human
gcuggaugcuggggguggcucuu

SEQ ID NO: 196196 - RNA, 21 nt, Human
gugucagagauuucuagagcu

SEQ ID NO: 196197 - RNA, 18 nt, Human
uaaacuauucacagccuc

SEQ ID NO: 196198 - RNA, 18 nt, Human
uacggcagccacccucca

SEQ ID NO: 196199 - RNA, 18 nt, Human
uacggcagccacccucca

SEQ ID NO: 196200 - RNA, 22 nt, Human
uagagcuuggagaacuguguug

SEQ ID NO: 196201 - RNA, 25 nt, Human
uagagcuuggagaacuguguuggag

SEQ ID NO: 196202 - RNA, 19 nt, Human
ucagggagagucagggcgg

SEQ ID NO: 196203 - RNA, 19 nt, Human
uccccaaaaccauaaacua

SEQ ID NO: 196204 - RNA, 24 nt, Human
uccccaaaaccauaaacuauucac

SEQ ID NO: 196205 - RNA, 22 nt, Human
ucucauggucaagaugugucag

SEQ ID NO: 196206 - RNA, 30 nt, Human
ucuucugugcugaaggcaccacuuccgauu

SEQ ID NO: 196207 - RNA, 20 nt, Human
ugaauaaucccaguguccca

SEQ ID NO: 196208 - RNA, 22 nt, Human
ugacccacggauccagccccuu

SEQ ID NO: 196209 - RNA, 23 nt, Human
ugaggcugcuggguuugugccuc

SEQ ID NO: 196210 - RNA, 20 nt, Human
uggagggacagauggggcug

SEQ ID NO: 196211 - RNA, 20 nt, Human
uggauggagggacagauggg

SEQ ID NO: 196212 - RNA, 22 nt, Human
uggauggagggacagauggggc

SEQ ID NO: 196213 - RNA, 18 nt, Human
uggcaaacugguccugug

SEQ ID NO: 196214 - RNA, 25 nt, Human
uggcagguggcccccacgagucccc

SEQ ID NO: 196215 - RNA, 19 nt, Human
uggcccccacgaguccccc

SEQ ID NO: 196216 - RNA, 20 nt, Human
uggcugccaaccacagcggg

SEQ ID NO: 196217 - RNA, 22 nt, Human
uggcugccaaccacagcgggga

SEQ ID NO: 196218 - RNA, 21 nt, Human
uggguuggagaucaacggccu

SEQ ID NO: 196219 - RNA, 19 nt, Human
ugucaguauugccauugua

SEQ ID NO: 196220 - RNA, 18 nt, Human
ugugcuaugcaaacgguu

SEQ ID NO: 196221 - RNA, 20 nt, Human
ugugucagagauuucuagag

SEQ ID NO: 196222 - RNA, 22 nt, Human
ugugucagagauuucuagagcu

SEQ ID NO: 196223 - RNA, 18 nt, Human
uguguuggagggaggccu

SEQ ID NO: 196224 - RNA, 20 nt, Human
uucacaaagacuucagaugc

SEQ ID NO: 196225 - RNA, 18 nt, Human
uugcuggacacuggaagc

SEQ ID NO: 196226 - RNA, 19 nt, Human
uuuaagcaacaaaaggugu

SEQ ID NO: 196227 - RNA, 22 nt, Human
uuuccuuuuccuuucucccuca

SEQ ID NO: 196228 - RNA, 22 nt, Human
uuugaaguuuccuuuuccuuuc

SEQ ID NO: 196229 - RNA, 21 nt, Human
uuugcagacagaaaacgcacc

SEQ ID NO: 196230 - RNA, 23 nt, Human
uuugcagacagaaaacgcaccag

SEQ ID NO: 196231 - RNA, 19 nt, Human
uuuuuugcaagugucacug

SEQ ID NO: 196232 - RNA, 20 nt, Human
aaacagaaugcaagacuguc

SEQ ID NO: 196233 - RNA, 21 nt, Human
aaccaugcaaaguggcagggc

SEQ ID NO: 196234 - RNA, 19 nt, Human
aagacugucacacgcggcu

SEQ ID NO: 196235 - RNA, 26 nt, Human
aagagcaucaacaaugcucacuuuca

SEQ ID NO: 196236 - RNA, 20 nt, Human
accaugcaaaguggcagggc

SEQ ID NO: 196237 - RNA, 18 nt, Human
acgacacggcucacaaag

SEQ ID NO: 196238 - RNA, 19 nt, Human
acuacacuucacacguggg

SEQ ID NO: 196239 - RNA, 22 nt, Human
agaggcaguaggcuggggaucc

SEQ ID NO: 196240 - RNA, 22 nt, Human
aggacuguccaccuccccccac

SEQ ID NO: 196241 - RNA, 22 nt, Human
cacacagggagggggaacccca

SEQ ID NO: 196242 - RNA, 20 nt, Human
cacagggagggggaacccca

SEQ ID NO: 196243 - RNA, 18 nt, Human
cacagugggugccaggag

SEQ ID NO: 196244 - RNA, 21 nt, Human
cacauuuccgcaggacugucc

SEQ ID NO: 196245 - RNA, 22 nt, Human
caccuccccccacgagacaaac

SEQ ID NO: 196246 - RNA, 23 nt, Human
cacgagacaaacagaaugcaaga

SEQ ID NO: 196247 - RNA, 18 nt, Human
cacucgccuucaggcagu

SEQ ID NO: 196248 - RNA, 23 nt, Human
caggaaccugggaugccacagga

SEQ ID NO: 196249 - RNA, 18 nt, Human
cagggcaggaaccuggga

SEQ ID NO: 196250 - RNA, 20 nt, Human
cagggcaggaaccugggaug

SEQ ID NO: 196251 - RNA, 24 nt, Human
caggggcuggccugucccccccug

SEQ ID NO: 196252 - RNA, 27 nt, Human
caggucaaaaucaaaccaugcaaagug

SEQ ID NO: 196253 - RNA, 20 nt, Human
caggugggccaucuugccca

SEQ ID NO: 196254 - RNA, 21 nt, Human
caucuccagccaauaaauaac

SEQ ID NO: 196255 - RNA, 21 nt, Human
ccacgagacaaacagaaugca

SEQ ID NO: 196256 - RNA, 21 nt, Human
ccacuacacuucacacguggg

SEQ ID NO: 196257 - RNA, 25 nt, Human
ccacuacacuucacacgugggggac

SEQ ID NO: 196258 - RNA, 18 nt, Human
ccaggaggggaggaagca

SEQ ID NO: 196259 - RNA, 21 nt, Human
ccccccacgagacaaacagaa

SEQ ID NO: 196260 - RNA, 22 nt, Human
ccccccacgagacaaacagaau

SEQ ID NO: 196261 - RNA, 18 nt, Human
ccccgcgccggcaggccc

SEQ ID NO: 196262 - RNA, 18 nt, Human
ccccgcgccggcaggccc

SEQ ID NO: 196263 - RNA, 24 nt, Human
cccggcagugucugcuggggcgca

SEQ ID NO: 196264 - RNA, 20 nt, Human
cggcuaggacugguuccacg

SEQ ID NO: 196265 - RNA, 23 nt, Human
cucaagagcaucaacaaugcuca

SEQ ID NO: 196266 - RNA, 21 nt, Human
cuccagccuaguccugaugcc

SEQ ID NO: 196267 - RNA, 21 nt, Human
gaaccugggaugccacaggug

SEQ ID NO: 196268 - RNA, 19 nt, Human
gacacggcucacaaagcgg

SEQ ID NO: 196269 - RNA, 20 nt, Human
gagaagugcuggagaggcag

SEQ ID NO: 196270 - RNA, 21 nt, Human
gcaggacuguccaccuccccc

SEQ ID NO: 196271 - RNA, 22 nt, Human
gcaggacuguccaccucccccc

SEQ ID NO: 196272 - RNA, 20 nt, Human
gccacagugggugccaggag

SEQ ID NO: 196273 - RNA, 22 nt, Human
gccacagugggugccaggaggg

SEQ ID NO: 196274 - RNA, 23 nt, Human
gcgccggcaggcccuggcgccag

SEQ ID NO: 196275 - RNA, 19 nt, Human
ggacaacauacacuguccu

SEQ ID NO: 196276 - RNA, 20 nt, Human
ggagaggcaguaggcugggg

SEQ ID NO: 196277 - RNA, 18 nt, Human
ggagggcacuugcugacc

SEQ ID NO: 196278 - RNA, 18 nt, Human
ggagggcacuugcugacc

SEQ ID NO: 196279 - RNA, 19 nt, Human
ggcaggcccuggcgccagc

SEQ ID NO: 196280 - RNA, 23 nt, Human
ggcccagaaggccugucaggugg

SEQ ID NO: 196281 - RNA, 22 nt, Human
ggcggcaggcguggggacgguc

SEQ ID NO: 196282 - RNA, 19 nt, Human
ggcuaggacugguuccacg

SEQ ID NO: 196283 - RNA, 18 nt, Human
ggcuuuggaggcccagaa

SEQ ID NO: 196284 - RNA, 24 nt, Human
gggcaggaaccugggaugccacag

SEQ ID NO: 196285 - RNA, 19 nt, Human
gggcuuuggaggcccagaa

SEQ ID NO: 196286 - RNA, 20 nt, Human
ggggaggaagcagcuaaugc

SEQ ID NO: 196287 - RNA, 19 nt, Human
gggugccaggaggggagga

SEQ ID NO: 196288 - RNA, 24 nt, Human
gugggccaucuugcccagugucag

SEQ ID NO: 196289 - RNA, 23 nt, Human
guggguagguguuuggacucuuu

SEQ ID NO: 196290 - RNA, 22 nt, Human
uacacccagacuccucuuuaca

SEQ ID NO: 196291 - RNA, 20 nt, Human
uacagggcaggaaccuggga

SEQ ID NO: 196292 - RNA, 18 nt, Human
ucacacgcggcuaggacu

SEQ ID NO: 196293 - RNA, 19 nt, Human
ucagguggugugauuuucc

SEQ ID NO: 196294 - RNA, 18 nt, Human
uccaaacacagcaagaua

SEQ ID NO: 196295 - RNA, 21 nt, Human
uccaacuguggauucuuggca

SEQ ID NO: 196296 - RNA, 22 nt, Human
uccaccuccccccacgagacaa

SEQ ID NO: 196297 - RNA, 22 nt, Human
uccacgccaccacaguggugca

SEQ ID NO: 196298 - RNA, 20 nt, Human
uccauugcccaagauguuuu

SEQ ID NO: 196299 - RNA, 20 nt, Human
uccuccgcagcccuggcgag

SEQ ID NO: 196300 - RNA, 22 nt, Human
ucucaggaacaaugcucugggg

SEQ ID NO: 196301 - RNA, 18 nt, Human
ucugcuggugauaauaca

SEQ ID NO: 196302 - RNA, 21 nt, Human
ugaacgccuuugcuuguucuu

SEQ ID NO: 196303 - RNA, 18 nt, Human
ugaagagagaagugcugg

SEQ ID NO: 196304 - RNA, 19 nt, Human
ugaagagagaagugcugga

SEQ ID NO: 196305 - RNA, 21 nt, Human
ugaagagagaagugcuggaga

SEQ ID NO: 196306 - RNA, 18 nt, Human
ugagagauauuaucaaca

SEQ ID NO: 196307 - RNA, 21 nt, Human
ugaggagggauccgggugaga

SEQ ID NO: 196308 - RNA, 23 nt, Human
ugcuaugcccacacucgccuuca

SEQ ID NO: 196309 - RNA, 23 nt, Human
ugcuggagaggcaguaggcuggg

SEQ ID NO: 196310 - RNA, 23 nt, Human
ugcuuguucuucauuugggcuca

SEQ ID NO: 196311 - RNA, 19 nt, Human
ugcuuuccuccccgcgccg

SEQ ID NO: 196312 - RNA, 23 nt, Human
uggaagacaagacacauuuccgc

SEQ ID NO: 196313 - RNA, 19 nt, Human
uggagaggcaguaggcugg

SEQ ID NO: 196314 - RNA, 20 nt, Human
uggagaggcaguaggcuggg

SEQ ID NO: 196315 - RNA, 23 nt, Human
uggauucuuggcacaaagcaggu

SEQ ID NO: 196316 - RNA, 18 nt, Human
uggcacaaagcaggugug

SEQ ID NO: 196317 - RNA, 22 nt, Human
uggcacaaagcaggugugggua

SEQ ID NO: 196318 - RNA, 23 nt, Human
uggcagaucugccccauuguggg

SEQ ID NO: 196319 - RNA, 22 nt, Human
uggcagggcaagugaggaggga

SEQ ID NO: 196320 - RNA, 22 nt, Human
uggcagggcaagugaggggaac

SEQ ID NO: 196321 - RNA, 19 nt, Human
uggcggucggggucgcggg

SEQ ID NO: 196322 - RNA, 23 nt, Human
uggcugaugcucucaagagcauc

SEQ ID NO: 196323 - RNA, 19 nt, Human
ugggcuuuggaggcccaga

SEQ ID NO: 196324 - RNA, 19 nt, Human
uggguagguguuuggacuc

SEQ ID NO: 196325 - RNA, 23 nt, Human
ugguuaguugaaguccuuguugc

SEQ ID NO: 196326 - RNA, 20 nt, Human
ugucacacgcggcuaggacu

SEQ ID NO: 196327 - RNA, 19 nt, Human
uguccaaacacagcaagau

SEQ ID NO: 196328 - RNA, 23 nt, Human
uguggggagggcacuugcugacc

SEQ ID NO: 196329 - RNA, 23 nt, Human
uguggggagggcacuugcugacc

SEQ ID NO: 196330 - RNA, 23 nt, Human
uguuggaugaaugcauacauuag

SEQ ID NO: 196331 - RNA, 24 nt, Human
uuccgcaggacuguccaccucccc

SEQ ID NO: 196332 - RNA, 22 nt, Human
uuuuucagcugcuguagccgau

SEQ ID NO: 196333 - RNA, 22 nt, Human
aaaccgaggcggagacgcgaga

SEQ ID NO: 196334 - RNA, 21 nt, Human
aaaugcuggaauccacagggc

SEQ ID NO: 196335 - RNA, 24 nt, Human
aaauuucaaauauaaauuaaaaug

SEQ ID NO: 196336 - RNA, 19 nt, Human
aacagggaagaaggagaga

SEQ ID NO: 196337 - RNA, 20 nt, Human
aacagggaagaaggagagaa

SEQ ID NO: 196338 - RNA, 19 nt, Human
aagaagcagaucuacucaa

SEQ ID NO: 196339 - RNA, 18 nt, Human
aagaaggagagaaagagg

SEQ ID NO: 196340 - RNA, 22 nt, Human
aagaaucucagcccggcuccac

SEQ ID NO: 196341 - RNA, 18 nt, Human
aagcaaaagccaaggggu

SEQ ID NO: 196342 - RNA, 21 nt, Human
aagcaaaagccaaggggucug

SEQ ID NO: 196343 - RNA, 18 nt, Human
acaugucaagaugaagaa

SEQ ID NO: 196344 - RNA, 25 nt, Human
accggcgagggugcgcccggcuggc

SEQ ID NO: 196345 - RNA, 20 nt, Human
acuaaaaacucccccuuccc

SEQ ID NO: 196346 - RNA, 21 nt, Human
acuaaaaacucccccuucccc

SEQ ID NO: 196347 - RNA, 27 nt, Human
acuaaaaacucccccuuccccaaaggu

SEQ ID NO: 196348 - RNA, 21 nt, Human
acuccuggcuuugguuucauu

SEQ ID NO: 196349 - RNA, 25 nt, Human
acugucaccccuccacccuccccac

SEQ ID NO: 196350 - RNA, 19 nt, Human
agaacuaaauaaaauuuca

SEQ ID NO: 196351 - RNA, 18 nt, Human
aggaauggcaaaugcugg

SEQ ID NO: 196352 - RNA, 19 nt, Human
aggcuaccggcgagggugc

SEQ ID NO: 196353 - RNA, 21 nt, Human
agggaagaaggagagaaagag

SEQ ID NO: 196354 - RNA, 19 nt, Human
auccucaguggagaccucc

SEQ ID NO: 196355 - RNA, 25 nt, Human
augaagaagcagaucuacucaagaa

SEQ ID NO: 196356 - RNA, 18 nt, Human
augcgucaacuccuggcu

SEQ ID NO: 196357 - RNA, 18 nt, Human
augucaagaugaagaagc

SEQ ID NO: 196358 - RNA, 18 nt, Human
caaacuaaaaacuccccc

SEQ ID NO: 196359 - RNA, 26 nt, Human
caaacuaaaaacucccccuuccccaa

SEQ ID NO: 196360 - RNA, 18 nt, Human
caaaugcuggaauccaca

SEQ ID NO: 196361 - RNA, 27 nt, Human
caacaucagugcugggggaugcacccc

SEQ ID NO: 196362 - RNA, 18 nt, Human
caaugggaaugguuauga

SEQ ID NO: 196363 - RNA, 23 nt, Human
cagaguugggaaaccgaggcgga

SEQ ID NO: 196364 - RNA, 18 nt, Human
caggauuccuugauucca

SEQ ID NO: 196365 - RNA, 20 nt, Human
caggcuccaaggugaagcaa

SEQ ID NO: 196366 - RNA, 20 nt, Human
cagugggaccucuccgauuc

SEQ ID NO: 196367 - RNA, 18 nt, Human
cauggaauuuggcaaggg

SEQ ID NO: 196368 - RNA, 24 nt, Human
ccauggauuuuccuccacugucac

SEQ ID NO: 196369 - RNA, 18 nt, Human
cccacaggcgaaugaggu

SEQ ID NO: 196370 - RNA, 20 nt, Human
cccccuuccccaaaggucca

SEQ ID NO: 196371 - RNA, 24 nt, Human
ccccuccacccuccccacgucugg

SEQ ID NO: 196372 - RNA, 18 nt, Human
cccgggacuccugcgccg

SEQ ID NO: 196373 - RNA, 19 nt, Human
ccgcugagaugcgacagcu

SEQ ID NO: 196374 - RNA, 21 nt, Human
ccuccacccuccccacgucug

SEQ ID NO: 196375 - RNA, 21 nt, Human
ccucucugccaagcaaaagcc

SEQ ID NO: 196376 - RNA, 26 nt, Human
ccucucugccaagcaaaagccaaggg

SEQ ID NO: 196377 - RNA, 22 nt, Human
cggcgagggugcgcccggcugg

SEQ ID NO: 196378 - RNA, 18 nt, Human
cuaagggagauaauuuuc

SEQ ID NO: 196379 - RNA, 20 nt, Human
cuaagggagauaauuuucau

SEQ ID NO: 196380 - RNA, 19 nt, Human
cuccugcgccggaguuuca

SEQ ID NO: 196381 - RNA, 21 nt, Human
cucuacaaugagaugcagaga

SEQ ID NO: 196382 - RNA, 21 nt, Human
cucucugccaagcaaaagcca

SEQ ID NO: 196383 - RNA, 20 nt, Human
cuuugugcuggggcucggcu

SEQ ID NO: 196384 - RNA, 21 nt, Human
gaagaagcagaucuacucaag

SEQ ID NO: 196385 - RNA, 19 nt, Human
gaagaaggagagaaagagg

SEQ ID NO: 196386 - RNA, 19 nt, Human
gaagaaggagagaaagagg

SEQ ID NO: 196387 - RNA, 26 nt, Human
gagaaucaguaacaacaucagugcug

SEQ ID NO: 196388 - RNA, 20 nt, Human
gcacaucuauauacauaaca

SEQ ID NO: 196389 - RNA, 19 nt, Human
gccagcggcagcccgggac

SEQ ID NO: 196390 - RNA, 24 nt, Human
gcuggggcucggcugccgggccgg

SEQ ID NO: 196391 - RNA, 19 nt, Human
ggagauaauuuucauguuu

SEQ ID NO: 196392 - RNA, 21 nt, Human
gggcccgcggauuuucuuagc

SEQ ID NO: 196393 - RNA, 24 nt, Human
gggcgcgggucuccggagacguga

SEQ ID NO: 196394 - RNA, 22 nt, Human
uaaaacaaacuaaaaacucccc

SEQ ID NO: 196395 - RNA, 23 nt, Human
uaaauuaaaaugaaaauacagug

SEQ ID NO: 196396 - RNA, 27 nt, Human
uaccggcgagggugcgcccggcuggcg

SEQ ID NO: 196397 - RNA, 19 nt, Human
uagaaggcgccucaguucu

SEQ ID NO: 196398 - RNA, 25 nt, Human
uauauacauaacaaauuaacauaua

SEQ ID NO: 196399 - RNA, 18 nt, Human
ucaagaugaagaagcaga

SEQ ID NO: 196400 - RNA, 24 nt, Human
ucagccaccaagcucuacaaugag

SEQ ID NO: 196401 - RNA, 19 nt, Human
ucaguggagaccucccaga

SEQ ID NO: 196402 - RNA, 19 nt, Human
uccacucgggcagugggac

SEQ ID NO: 196403 - RNA, 18 nt, Human
uccacugucaccccucca

SEQ ID NO: 196404 - RNA, 18 nt, Human
uccaggaauggcaaaugc

SEQ ID NO: 196405 - RNA, 18 nt, Human
ucccccuuccccaaaggu

SEQ ID NO: 196406 - RNA, 22 nt, Human
ucccccuuccccaaagguccau

SEQ ID NO: 196407 - RNA, 23 nt, Human
ucccuucucuucccacaggcgaa

SEQ ID NO: 196408 - RNA, 22 nt, Human
uccucaguggagaccucccaga

SEQ ID NO: 196409 - RNA, 19 nt, Human
ucuacaaugagaugcagag

SEQ ID NO: 196410 - RNA, 21 nt, Human
ucuacaaugagaugcagagac

SEQ ID NO: 196411 - RNA, 20 nt, Human
ucuccuggcgacguguccgg

SEQ ID NO: 196412 - RNA, 18 nt, Human
ucucugccaagcaaaagc

SEQ ID NO: 196413 - RNA, 23 nt, Human
ucugacaggagaaucaguaacaa

SEQ ID NO: 196414 - RNA, 21 nt, Human
ugacacaaggggaugacaucu

SEQ ID NO: 196415 - RNA, 18 nt, Human
ugagaagaaucucagccc

SEQ ID NO: 196416 - RNA, 18 nt, Human
ugagguuaaagaggggcu

SEQ ID NO: 196417 - RNA, 22 nt, Human
ugcagagacaaaacccagucca

SEQ ID NO: 196418 - RNA, 22 nt, Human
uggagaccucccagaucucuga

SEQ ID NO: 196419 - RNA, 18 nt, Human
uggggcucggcugccggg

SEQ ID NO: 196420 - RNA, 26 nt, Human
ugucaagaugaagaagcagaucuacu

SEQ ID NO: 196421 - RNA, 22 nt, Human
uucauugcccagacucaggauu

SEQ ID NO: 196422 - RNA, 23 nt, Human
uuccuccacugucaccccuccac

SEQ ID NO: 196423 - RNA, 25 nt, Human
uugccagcggcagcccgggacuccu

SEQ ID NO: 196424 - RNA, 21 nt, Human
uuggcgucacaacugcuagaa

SEQ ID NO: 196425 - RNA, 22 nt, Human
aaacaggcagaccccgacccgg

SEQ ID NO: 196426 - RNA, 18 nt, Human
aaggccaaauggccgcag

SEQ ID NO: 196427 - RNA, 25 nt, Human
acagagaagcuagucacucuccuca

SEQ ID NO: 196428 - RNA, 20 nt, Human
agaccccgacccggcuccag

SEQ ID NO: 196429 - RNA, 25 nt, Human
agagaagcuagucacucuccucagg

SEQ ID NO: 196430 - RNA, 21 nt, Human
aguggaagguggccaccuggg

SEQ ID NO: 196431 - RNA, 19 nt, Human
cagcaaggcugcggcggag

SEQ ID NO: 196432 - RNA, 19 nt, Human
ccagcaaggcugcggcgga

SEQ ID NO: 196433 - RNA, 20 nt, Human
cgacccggcuccagcaaggc

SEQ ID NO: 196434 - RNA, 21 nt, Human
gcuccagcaaggcugcggcgg

SEQ ID NO: 196435 - RNA, 22 nt, Human
guggaagguggccaccugggac

SEQ ID NO: 196436 - RNA, 18 nt, Human
guggcugggccuggcugg

SEQ ID NO: 196437 - RNA, 24 nt, Human
ucccaggaguccuggguggcuggg

SEQ ID NO: 196438 - RNA, 23 nt, Human
uccuggguggcugggccuggcug

SEQ ID NO: 196439 - RNA, 25 nt, Human
ugggaaacaggcagaccccgacccg

SEQ ID NO: 196440 - RNA, 21 nt, Human
uggguggcugggccuggcugg

SEQ ID NO: 196441 - RNA, 25 nt, Human
uggguggcugggccuggcugggaaa

SEQ ID NO: 196442 - RNA, 22 nt, Human
aaaggaauagaaacaaaaaaaa

SEQ ID NO: 196443 - RNA, 19 nt, Human
aaucgcgcccuccguccac

SEQ ID NO: 196444 - RNA, 19 nt, Human
acagagaauucucaccggc

SEQ ID NO: 196445 - RNA, 18 nt, Human
acaguuccuuccuuuggc

SEQ ID NO: 196446 - RNA, 23 nt, Human
accagccacuuuacagacucucu

SEQ ID NO: 196447 - RNA, 22 nt, Human
accccauccccccaaucacucc

SEQ ID NO: 196448 - RNA, 24 nt, Human
accccauccccccaaucacuccca

SEQ ID NO: 196449 - RNA, 18 nt, Human
agcucgggcaacacagac

SEQ ID NO: 196450 - RNA, 23 nt, Human
caaaguaaccauugcucccaggc

SEQ ID NO: 196451 - RNA, 21 nt, Human
caaggugggcaaucagcaccc

SEQ ID NO: 196452 - RNA, 26 nt, Human
caccagguaggcugccaucacccccu

SEQ ID NO: 196453 - RNA, 18 nt, Human
caccccauccccccaauc

SEQ ID NO: 196454 - RNA, 23 nt, Human
caccccauccccccaaucacucc

SEQ ID NO: 196455 - RNA, 24 nt, Human
caccccauccccccaaucacuccc

SEQ ID NO: 196456 - RNA, 24 nt, Human
caccccauccccccaaucacuccc

SEQ ID NO: 196457 - RNA, 19 nt, Human
cacccccugucccuuccag

SEQ ID NO: 196458 - RNA, 21 nt, Human
cacccccugucccuuccagcc

SEQ ID NO: 196459 - RNA, 19 nt, Human
caccccucccccucgauuc

SEQ ID NO: 196460 - RNA, 23 nt, Human
caccccugaccuggaguuagggg

SEQ ID NO: 196461 - RNA, 25 nt, Human
cagccccagcaccuccagaagugau

SEQ ID NO: 196462 - RNA, 18 nt, Human
caggccaugagaauacca

SEQ ID NO: 196463 - RNA, 22 nt, Human
caggguaguuuauccaccccuc

SEQ ID NO: 196464 - RNA, 19 nt, Human
caucaugauaacucccccc

SEQ ID NO: 196465 - RNA, 30 nt, Human
caucaugauaacuccccccagcagccccaa

SEQ ID NO: 196466 - RNA, 19 nt, Human
ccaaccucuacgcaccccu

SEQ ID NO: 196467 - RNA, 24 nt, Human
ccaaccucuacgcaccccugaccu

SEQ ID NO: 196468 - RNA, 23 nt, Human
cccaaccucuacgcaccccugac

SEQ ID NO: 196469 - RNA, 22 nt, Human
cccaccccauccccccaaucac

SEQ ID NO: 196470 - RNA, 18 nt, Human
ccccaaucacucccaaau

SEQ ID NO: 196471 - RNA, 19 nt, Human
ccccagcagccccagcacc

SEQ ID NO: 196472 - RNA, 27 nt, Human
ccccauccccccaaucacucccaaauc

SEQ ID NO: 196473 - RNA, 23 nt, Human
ccccccagcagccccagcaccuc

SEQ ID NO: 196474 - RNA, 19 nt, Human
ccccugaccuggaguuagg

SEQ ID NO: 196475 - RNA, 19 nt, Human
cccugaagccuccaccaac

SEQ ID NO: 196476 - RNA, 21 nt, Human
ccuccuguuacccucucuguc

SEQ ID NO: 196477 - RNA, 20 nt, Human
ccucuacgcaccccugaccu

SEQ ID NO: 196478 - RNA, 19 nt, Human
cgagaacaggugggguagg

SEQ ID NO: 196479 - RNA, 19 nt, Human
cuauggucccucuggccuc

SEQ ID NO: 196480 - RNA, 23 nt, Human
cuccaaucgcgcccuccguccac

SEQ ID NO: 196481 - RNA, 22 nt, Human
cuccgagaacaggugggguagg

SEQ ID NO: 196482 - RNA, 22 nt, Human
cucucccaccccauccccccaa

SEQ ID NO: 196483 - RNA, 22 nt, Human
cuuuacuccaaucgcgcccucc

SEQ ID NO: 196484 - RNA, 21 nt, Human
gaacuuccuguguagcaacuu

SEQ ID NO: 196485 - RNA, 18 nt, Human
gaagccuccaccaacugg

SEQ ID NO: 196486 - RNA, 21 nt, Human
gaagccuccaccaacuggugg

SEQ ID NO: 196487 - RNA, 23 nt, Human
gaguuagggguagagguuugggg

SEQ ID NO: 196488 - RNA, 20 nt, Human
gccccagcaccuccagaagu

SEQ ID NO: 196489 - RNA, 25 nt, Human
gccccagcaccuccagaagugauug

SEQ ID NO: 196490 - RNA, 18 nt, Human
gcccugggacacuaaucu

SEQ ID NO: 196491 - RNA, 19 nt, Human
gcuacaguuccuuccuuug

SEQ ID NO: 196492 - RNA, 21 nt, Human
gcugaccagagggacagaggc

SEQ ID NO: 196493 - RNA, 23 nt, Human
ggccaugagaauaccaauuaacc

SEQ ID NO: 196494 - RNA, 18 nt, Human
ggccuggaaaggauggua

SEQ ID NO: 196495 - RNA, 23 nt, Human
gggcaaucagcaccaucaugaua

SEQ ID NO: 196496 - RNA, 19 nt, Human
gggcggaagaucggagguc

SEQ ID NO: 196497 - RNA, 22 nt, Human
gggguaggggacaccagguagg

SEQ ID NO: 196498 - RNA, 24 nt, Human
ggugaggaaaaggccuggaaagga

SEQ ID NO: 196499 - RNA, 18 nt, Human
gguuaccaccccuccccc

SEQ ID NO: 196500 - RNA, 23 nt, Human
uaaaaggaauagaaacaaaaaaa

SEQ ID NO: 196501 - RNA, 20 nt, Human
uaacuccccccagcagcccc

SEQ ID NO: 196502 - RNA, 21 nt, Human
uaccaauuaacccucucccac

SEQ ID NO: 196503 - RNA, 23 nt, Human
uaccaauuaacccucucccaccc

SEQ ID NO: 196504 - RNA, 21 nt, Human
uaucccgaaccaccucccgga

SEQ ID NO: 196505 - RNA, 21 nt, Human
ucagcaccaucaugauaacuc

SEQ ID NO: 196506 - RNA, 18 nt, Human
ucaggccaugagaauacc

SEQ ID NO: 196507 - RNA, 22 nt, Human
uccaccaacuggugggagaaag

SEQ ID NO: 196508 - RNA, 21 nt, Human
ucccaagacuaguucucuuua

SEQ ID NO: 196509 - RNA, 19 nt, Human
ucccaccccauccccccaa

SEQ ID NO: 196510 - RNA, 20 nt, Human
ucccaccccauccccccaaa

SEQ ID NO: 196511 - RNA, 23 nt, Human
uccccccagcagccccagcaccu

SEQ ID NO: 196512 - RNA, 22 nt, Human
uccccgacuccuccuguuaccc

SEQ ID NO: 196513 - RNA, 21 nt, Human
ucccucuggccucucauucuc

SEQ ID NO: 196514 - RNA, 18 nt, Human
ucccuggccagggccccc

SEQ ID NO: 196515 - RNA, 24 nt, Human
ucccuggccagggcccccaaccuu

SEQ ID NO: 196516 - RNA, 21 nt, Human
uccgcuuuacuccaaucgcgc

SEQ ID NO: 196517 - RNA, 21 nt, Human
uccuuuggcagaugucccugg

SEQ ID NO: 196518 - RNA, 21 nt, Human
ucuacgcaccccugaccugga

SEQ ID NO: 196519 - RNA, 22 nt, Human
ucucccauucccuuaaguuccc

SEQ ID NO: 196520 - RNA, 28 nt, Human
ucucugggcccucgucucuuccgaucgg

SEQ ID NO: 196521 - RNA, 18 nt, Human
ugacucaacucuauaccu

SEQ ID NO: 196522 - RNA, 21 nt, Human
ugaugccucccucagcagcuc

SEQ ID NO: 196523 - RNA, 23 nt, Human
ugccaaaguaaccauugcuccca

SEQ ID NO: 196524 - RNA, 24 nt, Human
ugccaucacccccugucccuucca

SEQ ID NO: 196525 - RNA, 23 nt, Human
uggggcaggguaguuuauccacc

SEQ ID NO: 196526 - RNA, 18 nt, Human
ugguucuccgagaacagg

SEQ ID NO: 196527 - RNA, 18 nt, Human
uguuacccucucugucca

SEQ ID NO: 196528 - RNA, 22 nt, Human
uuagggguagagguuuggggca

SEQ ID NO: 196529 - RNA, 19 nt, Human
uuaucccgaaccaccuccc

SEQ ID NO: 196530 - RNA, 24 nt, Human
uugacucaacucuauaccuacacu

SEQ ID NO: 196531 - RNA, 22 nt, Human
uugcucccaggcuacaguuccu

SEQ ID NO: 196532 - RNA, 18 nt, Human
uuuauccaccccucacuc

SEQ ID NO: 196533 - RNA, 19 nt, Human
uuuaucccgaaccaccucc

SEQ ID NO: 196534 - RNA, 21 nt, Human
acuggcccccugcuccgucgc

SEQ ID NO: 196535 - RNA, 21 nt, Human
agcgaggguaugcaagagaaa

SEQ ID NO: 196536 - RNA, 18 nt, Human
agcuggccccacuggccc

SEQ ID NO: 196537 - RNA, 19 nt, Human
aggcagaagugacaccccg

SEQ ID NO: 196538 - RNA, 24 nt, Human
aggcagguccucccugagcuggcc

SEQ ID NO: 196539 - RNA, 18 nt, Human
cacagcccacgaaccuag

SEQ ID NO: 196540 - RNA, 23 nt, Human
cacagcccacgaaccuagugccc

SEQ ID NO: 196541 - RNA, 18 nt, Human
cccccugcuccgucgccu

SEQ ID NO: 196542 - RNA, 26 nt, Human
cccccugcuccgucgccuccacagcc

SEQ ID NO: 196543 - RNA, 23 nt, Human
ccugcuccgucgccuccacagcc

SEQ ID NO: 196544 - RNA, 19 nt, Human
cuccgucgccuccacagcc

SEQ ID NO: 196545 - RNA, 22 nt, Human
ucccugagcuggccccacuggc

SEQ ID NO: 196546 - RNA, 24 nt, Human
ucccugagcuggccccacuggccc

SEQ ID NO: 196547 - RNA, 18 nt, Human
ugagcuggccccacuggc

SEQ ID NO: 196548 - RNA, 23 nt, Human
ugcuccgucgccuccacagccca

SEQ ID NO: 196549 - RNA, 20 nt, Human
uggagggcagggaggcagaa

SEQ ID NO: 196550 - RNA, 18 nt, Human
uggggccaagugggcucu

SEQ ID NO: 196551 - RNA, 22 nt, Human
aacucuugccucucagucccac

SEQ ID NO: 196552 - RNA, 22 nt, Human
aacucuugccucucagucccac

SEQ ID NO: 196553 - RNA, 23 nt, Human
acaaagggaagggcaggaacaac

SEQ ID NO: 196554 - RNA, 21 nt, Human
acacaugcaggugccuuugca

SEQ ID NO: 196555 - RNA, 21 nt, Human
accucagccccaccucucugg

SEQ ID NO: 196556 - RNA, 21 nt, Human
agaucagcguggggaagaggg

SEQ ID NO: 196557 - RNA, 20 nt, Human
aggaacacagacacauucag

SEQ ID NO: 196558 - RNA, 18 nt, Human
agggucaugguggacaug

SEQ ID NO: 196559 - RNA, 20 nt, Human
augguggacaugaggguggg

SEQ ID NO: 196560 - RNA, 24 nt, Human
caacucuugccucucagucccaca

SEQ ID NO: 196561 - RNA, 24 nt, Human
caacucuugccucucagucccaca

SEQ ID NO: 196562 - RNA, 20 nt, Human
caugcaggugccuuugcaga

SEQ ID NO: 196563 - RNA, 21 nt, Human
cauggcaagaauuugaaaaag

SEQ ID NO: 196564 - RNA, 18 nt, Human
cauggggguggggugcuc

SEQ ID NO: 196565 - RNA, 20 nt, Human
cauucaggugccuuuguaga

SEQ ID NO: 196566 - RNA, 24 nt, Human
ccccaccuccucacauuaugccua

SEQ ID NO: 196567 - RNA, 25 nt, Human
ccucucauggcaagaauuugaaaaa

SEQ ID NO: 196568 - RNA, 25 nt, Human
ccucucauggcaagaauuugagaaa

SEQ ID NO: 196569 - RNA, 20 nt, Human
cucagucccacacaaggcag

SEQ ID NO: 196570 - RNA, 21 nt, Human
cucauggcaagaauuugaaaa

SEQ ID NO: 196571 - RNA, 21 nt, Human
cucauggcaagaauuugagaa

SEQ ID NO: 196572 - RNA, 21 nt, Human
ggaaagaugauuggagaggga

SEQ ID NO: 196573 - RNA, 18 nt, Human
ggaagggcaggaacaacu

SEQ ID NO: 196574 - RNA, 19 nt, Human
ggaagggcaggaacaacuc

SEQ ID NO: 196575 - RNA, 19 nt, Human
gggaagggcaggaacaacu

SEQ ID NO: 196576 - RNA, 20 nt, Human
gggagggaacacagaucagc

SEQ ID NO: 196577 - RNA, 20 nt, Human
gggagggaacacagaucagc

SEQ ID NO: 196578 - RNA, 20 nt, Human
ggugcucuccccaccuccuc

SEQ ID NO: 196579 - RNA, 18 nt, Human
gguggacaugaggguggg

SEQ ID NO: 196580 - RNA, 23 nt, Human
gucaugguggacauggggguggg

SEQ ID NO: 196581 - RNA, 22 nt, Human
uacacgaacacagacacaugca

SEQ ID NO: 196582 - RNA, 25 nt, Human
ucaagucacaaagggaaggcaggaa

SEQ ID NO: 196583 - RNA, 22 nt, Human
ucacaaagggaaggcaggaaca

SEQ ID NO: 196584 - RNA, 19 nt, Human
ucaugguggacaugagggu

SEQ ID NO: 196585 - RNA, 22 nt, Human
ucaugguggacaugaggguggg

SEQ ID NO: 196586 - RNA, 21 nt, Human
ucucagucccacacaaggcag

SEQ ID NO: 196587 - RNA, 18 nt, Human
ucucauguguuccauuua

SEQ ID NO: 196588 - RNA, 19 nt, Human
ucuccuuuaauuaacucau

SEQ ID NO: 196589 - RNA, 20 nt, Human
ucuggaacaggaaagaugau

SEQ ID NO: 196590 - RNA, 20 nt, Human
ucuggaacaggaaagaugau

SEQ ID NO: 196591 - RNA, 23 nt, Human
ucuggaacaggaaagaugauugg

SEQ ID NO: 196592 - RNA, 23 nt, Human
ucuggaacaggaaagaugauugg

SEQ ID NO: 196593 - RNA, 24 nt, Human
ugagaaaaagauggagacaucuca

SEQ ID NO: 196594 - RNA, 22 nt, Human
ugauuggagagggagcacaggu

SEQ ID NO: 196595 - RNA, 18 nt, Human
ugcucuccccaccuccuc

SEQ ID NO: 196596 - RNA, 25 nt, Human
uggaacaggaaagaugauuggagag

SEQ ID NO: 196597 - RNA, 22 nt, Human
uggagagggagcacaggucagc

SEQ ID NO: 196598 - RNA, 19 nt, Human
ugggaagagggucauggug

SEQ ID NO: 196599 - RNA, 21 nt, Human
uggggaagagggucauggugg

SEQ ID NO: 196600 - RNA, 18 nt, Human
ugucucucaaauuuuagg

SEQ ID NO: 196601 - RNA, 23 nt, Human
uguuccauuuauuuugucucuca

SEQ ID NO: 196602 - RNA, 19 nt, Human
uuacagcucagugcaccau

SEQ ID NO: 196603 - RNA, 21 nt, Human
uuacagcucagugcaccauga

SEQ ID NO: 196604 - RNA, 20 nt, Human
uucuaauuuuaagagggaag

SEQ ID NO: 196605 - RNA, 18 nt, Human
uugcagaaacaaagucag

SEQ ID NO: 196606 - RNA, 23 nt, Human
aaauccugcaucucagucccaca

SEQ ID NO: 196607 - RNA, 20 nt, Human
aauccugcaucucaguccca

SEQ ID NO: 196608 - RNA, 21 nt, Human
aauccugcaucucagucccac

SEQ ID NO: 196609 - RNA, 19 nt, Human
agaaauccugcaucucagu

SEQ ID NO: 196610 - RNA, 23 nt, Human
aggaacgcagacacauucagacg

SEQ ID NO: 196611 - RNA, 24 nt, Human
augaucggggagggaacacagguc

SEQ ID NO: 196612 - RNA, 18 nt, Human
caggggucacgguggaca

SEQ ID NO: 196613 - RNA, 18 nt, Human
caguguggggacaggggu

SEQ ID NO: 196614 - RNA, 18 nt, Human
cuggaagguucucagguc

SEQ ID NO: 196615 - RNA, 18 nt, Human
gaacacaggucagugugg

SEQ ID NO: 196616 - RNA, 19 nt, Human
gaacacaggucaguguggg

SEQ ID NO: 196617 - RNA, 20 nt, Human
gacgccuuugcagaaagaga

SEQ ID NO: 196618 - RNA, 18 nt, Human
gagaacacaaauuuauau

SEQ ID NO: 196619 - RNA, 19 nt, Human
gcagaaagagaugccagag

SEQ ID NO: 196620 - RNA, 21 nt, Human
gggaacacaggucaguguggg

SEQ ID NO: 196621 - RNA, 19 nt, Human
gggagggaacacaggucag

SEQ ID NO: 196622 - RNA, 25 nt, Human
gggagggaacacaggucaguguggg

SEQ ID NO: 196623 - RNA, 21 nt, Human
ggggugggcugucucuccacc

SEQ ID NO: 196624 - RNA, 21 nt, Human
gguggacacgggggugggcug

SEQ ID NO: 196625 - RNA, 24 nt, Human
uaacuucauuagggaaguaagaag

SEQ ID NO: 196626 - RNA, 23 nt, Human
uaugcuaacaggaacgcagacac

SEQ ID NO: 196627 - RNA, 22 nt, Human
ucacgguggacacggggguggg

SEQ ID NO: 196628 - RNA, 21 nt, Human
ucuggaacaggaaagaugauc

SEQ ID NO: 196629 - RNA, 23 nt, Human
ucuggaacaggaaagaugaucgg

SEQ ID NO: 196630 - RNA, 21 nt, Human
ucuuuauuugcucucucaacu

SEQ ID NO: 196631 - RNA, 20 nt, Human
uuaacuucauuagggaaguu

SEQ ID NO: 196632 - RNA, 21 nt, Human
uugcagcucagugcaccauga

SEQ ID NO: 196633 - RNA, 18 nt, Human
uuugagaacacaaauuua

SEQ ID NO: 196634 - RNA, 18 nt, Human
uuugagacagagauggag

SEQ ID NO: 196635 - RNA, 21 nt, Human
accccagggaugucccagaga

SEQ ID NO: 196636 - RNA, 21 nt, Human
agcauccucuguuuggauggc

SEQ ID NO: 196637 - RNA, 18 nt, Human
aggcaggccacucuggga

SEQ ID NO: 196638 - RNA, 21 nt, Human
cacacaccccagggauguccc

SEQ ID NO: 196639 - RNA, 24 nt, Human
cacacaccccagggaugucccaga

SEQ ID NO: 196640 - RNA, 19 nt, Human
caccccagggaugucccag

SEQ ID NO: 196641 - RNA, 23 nt, Human
caccccagggaugucccagagac

SEQ ID NO: 196642 - RNA, 20 nt, Human
cccagagacuucuucuaccc

SEQ ID NO: 196643 - RNA, 18 nt, Human
ccugggcaggaugugaga

SEQ ID NO: 196644 - RNA, 19 nt, Human
gagacuucuucuacccuaa

SEQ ID NO: 196645 - RNA, 19 nt, Human
ggagauccugggcaggaug

SEQ ID NO: 196646 - RNA, 21 nt, Human
gggcaggaugugagaaaucug

SEQ ID NO: 196647 - RNA, 19 nt, Human
gugauaggcaggccacucu

SEQ ID NO: 196648 - RNA, 18 nt, Human
uaagaggagauccugggc

SEQ ID NO: 196649 - RNA, 19 nt, Human
uaagaggagauccugggca

SEQ ID NO: 196650 - RNA, 21 nt, Human
uaggagcuaccaacccagcuu

SEQ ID NO: 196651 - RNA, 19 nt, Human
ucccagagacuucuucuac

SEQ ID NO: 196652 - RNA, 18 nt, Human
uccccaggugggaaaucu

SEQ ID NO: 196653 - RNA, 22 nt, Human
uccucuguuuggauggccgaag

SEQ ID NO: 196654 - RNA, 18 nt, Human
uccugggcaggaugugag

SEQ ID NO: 196655 - RNA, 19 nt, Human
ucuacacacacaccccagg

SEQ ID NO: 196656 - RNA, 21 nt, Human
ucuacacacacaccccaggga

SEQ ID NO: 196657 - RNA, 27 nt, Human
ucuacacacacaccccagggauguccc

SEQ ID NO: 196658 - RNA, 18 nt, Human
uggauggccgaagcugcu

SEQ ID NO: 196659 - RNA, 20 nt, Human
uuuuuuuuuuuuaaagaaau

SEQ ID NO: 196660 - RNA, 19 nt, Human
uuuuuuuuuuuuuuuuuaa

SEQ ID NO: 196661 - RNA, 18 nt, Human
agccuggguagaugaucu

SEQ ID NO: 196662 - RNA, 18 nt, Human
caggggguugaagauguu

SEQ ID NO: 196663 - RNA, 23 nt, Human
ccaaaguuuauuucucugaaaca

SEQ ID NO: 196664 - RNA, 20 nt, Human
ccccuggaccagcucuucca

SEQ ID NO: 196665 - RNA, 23 nt, Human
cccgggucccuugaccccccaaa

SEQ ID NO: 196666 - RNA, 25 nt, Human
ccucgccugucccagaagccccagc

SEQ ID NO: 196667 - RNA, 23 nt, Human
ccucuauggcacacugagagccc

SEQ ID NO: 196668 - RNA, 22 nt, Human
ccuucucacuuggaguggaagu

SEQ ID NO: 196669 - RNA, 23 nt, Human
cgggucccuugaccccccaaaug

SEQ ID NO: 196670 - RNA, 20 nt, Human
gcauagucccaggaaugagg

SEQ ID NO: 196671 - RNA, 18 nt, Human
gcccgggucccuugaccc

SEQ ID NO: 196672 - RNA, 18 nt, Human
ggagacugggaaauucaa

SEQ ID NO: 196673 - RNA, 19 nt, Human
uacauaggggagacuggga

SEQ ID NO: 196674 - RNA, 23 nt, Human
uagcaucauugaguuugaaucuc

SEQ ID NO: 196675 - RNA, 19 nt, Human
uggaccagcucuuccaggg

SEQ ID NO: 196676 - RNA, 20 nt, Human
uucaguccccuggaccagcu

SEQ ID NO: 196677 - RNA, 26 nt, Human
aaaaacagugaaaaggaaacagugac

SEQ ID NO: 196678 - RNA, 23 nt, Human
aacauugaccucaugaauguccu

SEQ ID NO: 196679 - RNA, 19 nt, Human
aagcuuuggagaucaugac

SEQ ID NO: 196680 - RNA, 21 nt, Human
acugcaguuggaagacagaaa

SEQ ID NO: 196681 - RNA, 21 nt, Human
acuucaggcuccagagagaga

SEQ ID NO: 196682 - RNA, 22 nt, Human
agaaaggaaaaaaaugagacag

SEQ ID NO: 196683 - RNA, 20 nt, Human
agacagaaagcuuuggagau

SEQ ID NO: 196684 - RNA, 23 nt, Human
aggaaacagugacuaccugagca

SEQ ID NO: 196685 - RNA, 19 nt, Human
agggagaagggcagauggg

SEQ ID NO: 196686 - RNA, 19 nt, Human
caggcuccagagagagaag

SEQ ID NO: 196687 - RNA, 23 nt, Human
cagugaaaaggaaacagugacua

SEQ ID NO: 196688 - RNA, 24 nt, Human
cucagaacacagagcuccagaauc

SEQ ID NO: 196689 - RNA, 27 nt, Human
cugcaguuggaagacagaaagcuuugg

SEQ ID NO: 196690 - RNA, 19 nt, Human
uaaaaucgucagccucuuc

SEQ ID NO: 196691 - RNA, 21 nt, Human
uaccucacccagggcccagac

SEQ ID NO: 196692 - RNA, 18 nt, Human
ucacccagggcccagacu

SEQ ID NO: 196693 - RNA, 23 nt, Human
ucacccagggcccagacuacuca

SEQ ID NO: 196694 - RNA, 24 nt, Human
ucacccagggcccagacuacucau

SEQ ID NO: 196695 - RNA, 18 nt, Human
ucagaacacagagcucca

SEQ ID NO: 196696 - RNA, 20 nt, Human
uccagagagagaagcuucag

SEQ ID NO: 196697 - RNA, 26 nt, Human
uccagagagagaagcuucagugagga

SEQ ID NO: 196698 - RNA, 18 nt, Human
ucuucugaagacugugga

SEQ ID NO: 196699 - RNA, 21 nt, Human
ugaauguccuuuaccucaccc

SEQ ID NO: 196700 - RNA, 22 nt, Human
ugauuuggggcuggaaggagua

SEQ ID NO: 196701 - RNA, 24 nt, Human
uggaagacagaaagcuuuggagau

SEQ ID NO: 196702 - RNA, 26 nt, Human
uuuaaaaacagugaaaaggaaacagu

SEQ ID NO: 196703 - RNA, 20 nt, Human
uuuggagaucaugacuuaua

SEQ ID NO: 196704 - RNA, 31 nt, Human
aagaaagaaauauuaaugucagcuaagaaag

SEQ ID NO: 196705 - RNA, 32 nt, Human
aagaaagaaauauuaaugucagcuaagaaagg

SEQ ID NO: 196706 - RNA, 19 nt, Human
aagaagaaaaaaaucagga

SEQ ID NO: 196707 - RNA, 22 nt, Human
aggaagucagggaaauaauuuu

SEQ ID NO: 196708 - RNA, 25 nt, Human
aggagaaaagggauaugauaaaugg

SEQ ID NO: 196709 - RNA, 18 nt, Human
agggugggaacacaagga

SEQ ID NO: 196710 - RNA, 24 nt, Human
aguacagacuuacuuuuuuauuuu

SEQ ID NO: 196711 - RNA, 19 nt, Human
aguccacucuucugcuccu

SEQ ID NO: 196712 - RNA, 21 nt, Human
cucuucccaaggcagccuuag

SEQ ID NO: 196713 - RNA, 23 nt, Human
cuguagauggcgaugcaccuucc

SEQ ID NO: 196714 - RNA, 26 nt, Human
cuuaagaagaaaaaaaucaggaaguc

SEQ ID NO: 196715 - RNA, 20 nt, Human
gauguuaaauuggcuugaaa

SEQ ID NO: 196716 - RNA, 21 nt, Human
gcauuugugagcucugagcag

SEQ ID NO: 196717 - RNA, 22 nt, Human
ggcaacucuuaguagguaacac

SEQ ID NO: 196718 - RNA, 19 nt, Human
uaagaagaaaaaaaucagg

SEQ ID NO: 196719 - RNA, 20 nt, Human
uagauggcgaugcaccuucc

SEQ ID NO: 196720 - RNA, 22 nt, Human
uagcaaguccacucuucugcuc

SEQ ID NO: 196721 - RNA, 18 nt, Human
ucccaaggcagccuuagc

SEQ ID NO: 196722 - RNA, 24 nt, Human
ugagccaaaggcagaggguaucca

SEQ ID NO: 196723 - RNA, 26 nt, Human
ugagcucugagcagauauagcaauuu

SEQ ID NO: 196724 - RNA, 21 nt, Human
ugccaagggugggaacacaag

SEQ ID NO: 196725 - RNA, 21 nt, Human
uggagauuauagauggagguu

SEQ ID NO: 196726 - RNA, 18 nt, Human
uggguggcaaugccaagg

SEQ ID NO: 196727 - RNA, 20 nt, Human
aaacgcugaagaugacugcu

SEQ ID NO: 196728 - RNA, 18 nt, Human
aaaugcugaagaugacug

SEQ ID NO: 196729 - RNA, 20 nt, Human
aacaauaaguacacaagaga

SEQ ID NO: 196730 - RNA, 20 nt, Human
aaugauaggaaauagaggaa

SEQ ID NO: 196731 - RNA, 20 nt, Human
aaugauaggaaauagaggaa

SEQ ID NO: 196732 - RNA, 20 nt, Human
acaguuugaggaaaccuuaa

SEQ ID NO: 196733 - RNA, 25 nt, Human
agaggcauauccacacuuggggugg

SEQ ID NO: 196734 - RNA, 18 nt, Human
agcucgggagugaggcag

SEQ ID NO: 196735 - RNA, 21 nt, Human
aggaaaaggcaauagacaggg

SEQ ID NO: 196736 - RNA, 21 nt, Human
aggaaaaggcaauagacaggg

SEQ ID NO: 196737 - RNA, 21 nt, Human
agugaggcagaacagacaaga

SEQ ID NO: 196738 - RNA, 23 nt, Human
auaaguacacaagagagccccau

SEQ ID NO: 196739 - RNA, 22 nt, Human
caagagaugccccauggggcau

SEQ ID NO: 196740 - RNA, 21 nt, Human
cacaguuugaggaaaccuuaa

SEQ ID NO: 196741 - RNA, 25 nt, Human
cacccaagaucaucaaaauaguuua

SEQ ID NO: 196742 - RNA, 24 nt, Human
cagugaucuucucucuaagaaaca

SEQ ID NO: 196743 - RNA, 18 nt, Human
ccauagcagagacagacu

SEQ ID NO: 196744 - RNA, 18 nt, Human
ccauagcagagacagacu

SEQ ID NO: 196745 - RNA, 23 nt, Human
cuggaaaacgcugaagaugacug

SEQ ID NO: 196746 - RNA, 19 nt, Human
gagcucgggagugaggcag

SEQ ID NO: 196747 - RNA, 18 nt, Human
gaggcagaacagacaaga

SEQ ID NO: 196748 - RNA, 23 nt, Human
ggaaauagaggaaaauagauacc

SEQ ID NO: 196749 - RNA, 23 nt, Human
ggaaauagaggaaaauagauacc

SEQ ID NO: 196750 - RNA, 24 nt, Human
ggucaaggauuguaauauugccag

SEQ ID NO: 196751 - RNA, 19 nt, Human
uaaaaugauaggaaauaga

SEQ ID NO: 196752 - RNA, 19 nt, Human
uaaaaugauaggaaauaga

SEQ ID NO: 196753 - RNA, 23 nt, Human
uaaagccauuaaagcagaaguuu

SEQ ID NO: 196754 - RNA, 23 nt, Human
uaaagucauuaaagcagaaguuu

SEQ ID NO: 196755 - RNA, 18 nt, Human
uaagaaacaccaucaccu

SEQ ID NO: 196756 - RNA, 20 nt, Human
uaagaaacaccaucaccucc

SEQ ID NO: 196757 - RNA, 22 nt, Human
uaagaaacaccaucaccuccau

SEQ ID NO: 196758 - RNA, 20 nt, Human
uaagaaacaucaucaccucc

SEQ ID NO: 196759 - RNA, 25 nt, Human
uagauacaggaaaaggcaauagaca

SEQ ID NO: 196760 - RNA, 25 nt, Human
uagauacaggaaaaggcaauagaca

SEQ ID NO: 196761 - RNA, 18 nt, Human
uagcagagacagacuccu

SEQ ID NO: 196762 - RNA, 23 nt, Human
uagcagagacagacuccuguaug

SEQ ID NO: 196763 - RNA, 23 nt, Human
uagcagagacagacuccuguaug

SEQ ID NO: 196764 - RNA, 24 nt, Human
uccauagcagagacagaccggggc

SEQ ID NO: 196765 - RNA, 24 nt, Human
uccauagcagagacagaccggggc

SEQ ID NO: 196766 - RNA, 23 nt, Human
uccauagcagagacagacuccug

SEQ ID NO: 196767 - RNA, 23 nt, Human
uccauagcagagacagacuccug

SEQ ID NO: 196768 - RNA, 22 nt, Human
ucucuaagaaacaccaucaccu

SEQ ID NO: 196769 - RNA, 22 nt, Human
uggaaaaugcugaagaugacug

SEQ ID NO: 196770 - RNA, 26 nt, Human
uguuagaguacggagcaaucgaggag

SEQ ID NO: 196771 - RNA, 19 nt, Human
aacacaggucagugugagg

SEQ ID NO: 196772 - RNA, 18 nt, Human
aagugcugggauuacagg

SEQ ID NO: 196773 - RNA, 19 nt, Human
aagugcugggauuacaggc

SEQ ID NO: 196774 - RNA, 21 nt, Human
aagugcugggauuacaggcau

SEQ ID NO: 196775 - RNA, 22 nt, Human
aagugcugggauuacaggcaug

SEQ ID NO: 196776 - RNA, 23 nt, Human
aagugcugggauuacaggcauga

SEQ ID NO: 196777 - RNA, 26 nt, Human
aagugcugggauuacaggcaugagcu

SEQ ID NO: 196778 - RNA, 19 nt, Human
acagacagauucagaggcc

SEQ ID NO: 196779 - RNA, 19 nt, Human
acccaggcuggagugcagu

SEQ ID NO: 196780 - RNA, 18 nt, Human
acccugucacccaggcug

SEQ ID NO: 196781 - RNA, 25 nt, Human
acccugucacccaggcuggagugca

SEQ ID NO: 196782 - RNA, 18 nt, Human
acgggguuucaccguguu

SEQ ID NO: 196783 - RNA, 19 nt, Human
acgggguuucaccguguua

SEQ ID NO: 196784 - RNA, 20 nt, Human
acgggguuucaccguguuag

SEQ ID NO: 196785 - RNA, 24 nt, Human
acgggguuucaccguguuagccag

SEQ ID NO: 196786 - RNA, 19 nt, Human
agaaaagagaacagggaag

SEQ ID NO: 196787 - RNA, 21 nt, Human
agaaaagagaacagggaagga

SEQ ID NO: 196788 - RNA, 19 nt, Human
agagacgggguuucaccgu

SEQ ID NO: 196789 - RNA, 21 nt, Human
aggaacacaggucagugugag

SEQ ID NO: 196790 - RNA, 20 nt, Human
agggaaggaacacaggucag

SEQ ID NO: 196791 - RNA, 20 nt, Human
aguagagacgggguuucacc

SEQ ID NO: 196792 - RNA, 21 nt, Human
aguagagacgggguuucaccg

SEQ ID NO: 196793 - RNA, 23 nt, Human
aguagcugggacuacaggcccgu

SEQ ID NO: 196794 - RNA, 23 nt, Human
cacccugucacccaggcuggagu

SEQ ID NO: 196795 - RNA, 24 nt, Human
cacccugucacccaggcuggagug

SEQ ID NO: 196796 - RNA, 27 nt, Human
cacccugucacccaggcuggagugcag

SEQ ID NO: 196797 - RNA, 18 nt, Human
caccguguuagccaggau

SEQ ID NO: 196798 - RNA, 21 nt, Human
caccguguuagccaggauggu

SEQ ID NO: 196799 - RNA, 24 nt, Human
caccguguuagccaggaugguuuc

SEQ ID NO: 196800 - RNA, 21 nt, Human
cacugcaaccuccgccucccg

SEQ ID NO: 196801 - RNA, 23 nt, Human
cacugcaaccuccgccucccggg

SEQ ID NO: 196802 - RNA, 18 nt, Human
ccgcacucugcccagguu

SEQ ID NO: 196803 - RNA, 23 nt, Human
ccgccuccugaguagcugggacu

SEQ ID NO: 196804 - RNA, 19 nt, Human
ccuaagugcugggauuaca

SEQ ID NO: 196805 - RNA, 22 nt, Human
ccuaagugcugggauuacaggc

SEQ ID NO: 196806 - RNA, 23 nt, Human
ccuaagugcugggauuacaggca

SEQ ID NO: 196807 - RNA, 24 nt, Human
ccuaagugcugggauuacaggcau

SEQ ID NO: 196808 - RNA, 19 nt, Human
ccuccgccuccugaguagc

SEQ ID NO: 196809 - RNA, 18 nt, Human
ccucgugaucugcccucc

SEQ ID NO: 196810 - RNA, 21 nt, Human
ccucgugaucugcccuccucg

SEQ ID NO: 196811 - RNA, 20 nt, Human
ccucugcgcccagcuaauuu

SEQ ID NO: 196812 - RNA, 23 nt, Human
ccugaguagcugggacuacaggc

SEQ ID NO: 196813 - RNA, 24 nt, Human
ccugucacccaggcuggagugcag

SEQ ID NO: 196814 - RNA, 21 nt, Human
cgcacacaaggcagcugugca

SEQ ID NO: 196815 - RNA, 19 nt, Human
cgccucccggguugacgcc

SEQ ID NO: 196816 - RNA, 22 nt, Human
cuaagugcugggauuacaggca

SEQ ID NO: 196817 - RNA, 23 nt, Human
cucacauugugcuaacagggaca

SEQ ID NO: 196818 - RNA, 24 nt, Human
cucacugcaaccuccgccucccgg

SEQ ID NO: 196819 - RNA, 22 nt, Human
cuccugaccucgugaucugccc

SEQ ID NO: 196820 - RNA, 23 nt, Human
cugcaaccuccgccucccggguu

SEQ ID NO: 196821 - RNA, 23 nt, Human
cugccuccgccuccugaguagcu

SEQ ID NO: 196822 - RNA, 20 nt, Human
cuggagugcagucgcacaau

SEQ ID NO: 196823 - RNA, 18 nt, Human
gaacacaggucaguguga

SEQ ID NO: 196824 - RNA, 19 nt, Human
gaccucgugaucugcccuc

SEQ ID NO: 196825 - RNA, 22 nt, Human
gaccucgugaucugcccuccuc

SEQ ID NO: 196826 - RNA, 24 nt, Human
gaccucgugaucugcccuccucgg

SEQ ID NO: 196827 - RNA, 24 nt, Human
gagacgggguuucaccguguuagc

SEQ ID NO: 196828 - RNA, 20 nt, Human
gaguagcugggacuacaggc

SEQ ID NO: 196829 - RNA, 26 nt, Human
gaguagcugggacuacaggcccgugc

SEQ ID NO: 196830 - RNA, 19 nt, Human
gauuacaggcaugagcugc

SEQ ID NO: 196831 - RNA, 23 nt, Human
gauuacaggcaugagcugccgca

SEQ ID NO: 196832 - RNA, 23 nt, Human
gcccagcuaauuuuuuguauuuu

SEQ ID NO: 196833 - RNA, 19 nt, Human
ggaaauccugcaucucagu

SEQ ID NO: 196834 - RNA, 19 nt, Human
ggaaauccugcaucucagu

SEQ ID NO: 196835 - RNA, 19 nt, Human
ggauuacaggcaugagcug

SEQ ID NO: 196836 - RNA, 23 nt, Human
gggguuucaccguguuagccagg

SEQ ID NO: 196837 - RNA, 22 nt, Human
ggguuucaccguguuagccagg

SEQ ID NO: 196838 - RNA, 20 nt, Human
gguuucgaucuccugaccuc

SEQ ID NO: 196839 - RNA, 23 nt, Human
guagagacgggguuucaccgugu

SEQ ID NO: 196840 - RNA, 25 nt, Human
uaauuuuuuguauuuuuuaguagag

SEQ ID NO: 196841 - RNA, 26 nt, Human
uaauuuuuuguauuuuuuaguagaga

SEQ ID NO: 196842 - RNA, 21 nt, Human
uacaggcaugagcugccgcac

SEQ ID NO: 196843 - RNA, 21 nt, Human
uagaaaagagaacagggaagg

SEQ ID NO: 196844 - RNA, 21 nt, Human
uaguagagacgggguuucacc

SEQ ID NO: 196845 - RNA, 24 nt, Human
uaguagagacgggguuucaccgug

SEQ ID NO: 196846 - RNA, 26 nt, Human
uaguagagacgggguuucaccguguu

SEQ ID NO: 196847 - RNA, 21 nt, Human
ucacccaggcuggagugcagu

SEQ ID NO: 196848 - RNA, 22 nt, Human
ucacccugucacccaggcugga

SEQ ID NO: 196849 - RNA, 24 nt, Human
ucacccugucacccaggcuggagu

SEQ ID NO: 196850 - RNA, 24 nt, Human
ucaccguguuagccaggaugguuu

SEQ ID NO: 196851 - RNA, 23 nt, Human
ucacugcaaccuccgccucccgg

SEQ ID NO: 196852 - RNA, 24 nt, Human
ucacugcaaccuccgccucccggg

SEQ ID NO: 196853 - RNA, 25 nt, Human
ucacugcaaccuccgccucccgggu

SEQ ID NO: 196854 - RNA, 26 nt, Human
ucacugcaaccuccgccucccggguu

SEQ ID NO: 196855 - RNA, 24 nt, Human
ucccggguugacgccauucuccug

SEQ ID NO: 196856 - RNA, 24 nt, Human
ucccuaagugcugggauuacaggc

SEQ ID NO: 196857 - RNA, 24 nt, Human
uccugaguagcugggacuacaggc

SEQ ID NO: 196858 - RNA, 24 nt, Human
ucgcacaauccuggcucacugcaa

SEQ ID NO: 196859 - RNA, 20 nt, Human
ugcaaaaagagaagccagag

SEQ ID NO: 196860 - RNA, 24 nt, Human
ugcaaaaagagaagccagaguccc

SEQ ID NO: 196861 - RNA, 24 nt, Human
ugccuccgccuccugaguagcugg

SEQ ID NO: 196862 - RNA, 22 nt, Human
ugccucugcgcccagcuaauuu

SEQ ID NO: 196863 - RNA, 24 nt, Human
ugccucugcgcccagcuaauuuuu

SEQ ID NO: 196864 - RNA, 18 nt, Human
ugcugggauuacaggcau

SEQ ID NO: 196865 - RNA, 24 nt, Human
uggagugcagucgcacaauccugg

SEQ ID NO: 196866 - RNA, 18 nt, Human
ugggauuacaggcaugag

SEQ ID NO: 196867 - RNA, 19 nt, Human
ugggauuacaggcaugagc

SEQ ID NO: 196868 - RNA, 21 nt, Human
ugggauuacaggcaugagcug

SEQ ID NO: 196869 - RNA, 22 nt, Human
ugggauuacaggcaugagcugc

SEQ ID NO: 196870 - RNA, 23 nt, Human
ugggauuacaggcaugagcugcc

SEQ ID NO: 196871 - RNA, 24 nt, Human
ugggauuacaggcaugagcugccg

SEQ ID NO: 196872 - RNA, 24 nt, Human
ugggauuacaggcaugagcugccg

SEQ ID NO: 196873 - RNA, 25 nt, Human
ugggauuacaggcaugagcugccgc

SEQ ID NO: 196874 - RNA, 21 nt, Human
ugugaggaagggggucauggu

SEQ ID NO: 196875 - RNA, 18 nt, Human
uuaguagagacgggguuu

SEQ ID NO: 196876 - RNA, 22 nt, Human
uuaguagagacgggguuucacc

SEQ ID NO: 196877 - RNA, 24 nt, Human
uuaguagagacgggguuucaccgu

SEQ ID NO: 196878 - RNA, 24 nt, Human
uucacccugucacccaggcuggag

SEQ ID NO: 196879 - RNA, 18 nt, Human
uugcaaaaagagaagcca

SEQ ID NO: 196880 - RNA, 22 nt, Human
uuucacccugucacccaggcug

SEQ ID NO: 196881 - RNA, 24 nt, Human
uuucacccugucacccaggcugga

SEQ ID NO: 196882 - RNA, 19 nt, Human
uuucaccguguuagccagg

SEQ ID NO: 196883 - RNA, 24 nt, Human
uuuuuaguagagacgggguuucac

SEQ ID NO: 196884 - RNA, 27 nt, Human
uuuuuauuuuuuaauuuuuauuuuuug

SEQ ID NO: 196885 - RNA, 22 nt, Human
uuuuuguauuuuuuaguagaga

SEQ ID NO: 196886 - RNA, 23 nt, Human
uuuuuuaguagagacgggguuuc

SEQ ID NO: 196887 - RNA, 25 nt, Human
uuuuuuguauuuuuuaguagagacg

SEQ ID NO: 196888 - RNA, 19 nt, Human
uaucuugcuucucaguccc

SEQ ID NO: 196889 - RNA, 21 nt, Human
uaucuugcuucucagucccac

SEQ ID NO: 196890 - RNA, 21 nt, Human
ucagucccacacaaggaagcu

SEQ ID NO: 196891 - RNA, 19 nt, Human
aaacagcccaucacaugcu

SEQ ID NO: 196892 - RNA, 19 nt, Human
aagaucccaaggaucucag

SEQ ID NO: 196893 - RNA, 23 nt, Human
aaggaucucagggaucagccucc

SEQ ID NO: 196894 - RNA, 22 nt, Human
acuacagaaaaauauucaugaa

SEQ ID NO: 196895 - RNA, 21 nt, Human
acugccuagaguagaacaaaa

SEQ ID NO: 196896 - RNA, 19 nt, Human
agagggucauggugggcac

SEQ ID NO: 196897 - RNA, 21 nt, Human
agaucccaaggaucucaggga

SEQ ID NO: 196898 - RNA, 19 nt, Human
agccccuuuucuggaacag

SEQ ID NO: 196899 - RNA, 18 nt, Human
agggucauggugggcaca

SEQ ID NO: 196900 - RNA, 21 nt, Human
agucacagugaggggugacac

SEQ ID NO: 196901 - RNA, 20 nt, Human
cauagcacagcuaugucccc

SEQ ID NO: 196902 - RNA, 21 nt, Human
caucccagccccuuuucugga

SEQ ID NO: 196903 - RNA, 19 nt, Human
cccuguuccccucaacaac

SEQ ID NO: 196904 - RNA, 22 nt, Human
ccucaacaacccacacacauca

SEQ ID NO: 196905 - RNA, 31 nt, Human
cucaaauuucaggaaucuucuccuuuaauuu

SEQ ID NO: 196906 - RNA, 19 nt, Human
cucccccauggcucccaaa

SEQ ID NO: 196907 - RNA, 19 nt, Human
cugccuagaguagaacaaa

SEQ ID NO: 196908 - RNA, 23 nt, Human
gaaccaggaccgcggcgacguga

SEQ ID NO: 196909 - RNA, 25 nt, Human
gcucccccauggcucccaaacacaa

SEQ ID NO: 196910 - RNA, 18 nt, Human
ggagacaucccagccccu

SEQ ID NO: 196911 - RNA, 20 nt, Human
gggaaggaaugcaguucagc

SEQ ID NO: 196912 - RNA, 21 nt, Human
ggugggcacaggggugggcug

SEQ ID NO: 196913 - RNA, 23 nt, Human
gucaggguucuugaagucacaaa

SEQ ID NO: 196914 - RNA, 18 nt, Human
uaaaaaccugucaccuaa

SEQ ID NO: 196915 - RNA, 21 nt, Human
uagaaccaggaccgcggcgac

SEQ ID NO: 196916 - RNA, 18 nt, Human
uagcucaguggaccacaa

SEQ ID NO: 196917 - RNA, 24 nt, Human
ucacaugcucaauacauugaaguc

SEQ ID NO: 196918 - RNA, 22 nt, Human
ucauggugggcacagggguggg

SEQ ID NO: 196919 - RNA, 23 nt, Human
ucauggugggcacaggggugggc

SEQ ID NO: 196920 - RNA, 18 nt, Human
uccccuguuccccucaac

SEQ ID NO: 196921 - RNA, 21 nt, Human
ugaggaagagggucauggugg

SEQ ID NO: 196922 - RNA, 22 nt, Human
ugccuagaguagaacaaaaaca

SEQ ID NO: 196923 - RNA, 26 nt, Human
uggcucccaaacacaagaucccuccu

SEQ ID NO: 196924 - RNA, 24 nt, Human
uggcucccaaacacaagaucccuu

SEQ ID NO: 196925 - RNA, 19 nt, Human
uggugggcacagggguggg

SEQ ID NO: 196926 - RNA, 18 nt, Human
uuugagacagagacggag

SEQ ID NO: 196927 - RNA, 24 nt, Human
agagacugaaagcugacagucuuu

SEQ ID NO: 196928 - RNA, 24 nt, Human
agaggaaggagaacuggaaaagag

SEQ ID NO: 196929 - RNA, 21 nt, Human
aggaaggagaacuggaaaaga

SEQ ID NO: 196930 - RNA, 21 nt, Human
aggcuugacucuaugggggac

SEQ ID NO: 196931 - RNA, 19 nt, Human
auaaaacaguccaucaaaa

SEQ ID NO: 196932 - RNA, 21 nt, Human
cagucuuuuuggagccaaaga

SEQ ID NO: 196933 - RNA, 28 nt, Human
cuccucuguugcugccauaaaugcucaa

SEQ ID NO: 196934 - RNA, 18 nt, Human
cucuaugggggacagagg

SEQ ID NO: 196935 - RNA, 21 nt, Human
ggacagaggauaacauggcuc

SEQ ID NO: 196936 - RNA, 18 nt, Human
ggagccaaagaacaaaga

SEQ ID NO: 196937 - RNA, 19 nt, Human
ggauaacauggcuccuaga

SEQ ID NO: 196938 - RNA, 19 nt, Human
uaacauggcuccuagagga

SEQ ID NO: 196939 - RNA, 21 nt, Human
ugauaaaacaguccaucaaaa

SEQ ID NO: 196940 - RNA, 25 nt, Human
ugauaaaacaguccaucaaaagaga

SEQ ID NO: 196941 - RNA, 20 nt, Human
uuguggcuccucuguugcug

SEQ ID NO: 196942 - RNA, 22 nt, Human
aaaaacaaacagaaacacagaa

SEQ ID NO: 196943 - RNA, 28 nt, Human
aaacaaacagaaacacagaaaaagaaca

SEQ ID NO: 196944 - RNA, 29 nt, Human
aaacaaacagaaacacagaaaaagaacaa

SEQ ID NO: 196945 - RNA, 25 nt, Human
aaacagaaacacagaaaaagaacaa

SEQ ID NO: 196946 - RNA, 26 nt, Human
aaaccuaaaaacaaacagaaacacag

SEQ ID NO: 196947 - RNA, 19 nt, Human
aaacgacaacaaaacaaac

SEQ ID NO: 196948 - RNA, 19 nt, Human
aaacucacauccaagaagc

SEQ ID NO: 196949 - RNA, 18 nt, Human
aaagaaaacgacaacaaa

SEQ ID NO: 196950 - RNA, 23 nt, Human
aaagcucuugacuugauguuaca

SEQ ID NO: 196951 - RNA, 25 nt, Human
aaauccuuccuacuuccaccacucc

SEQ ID NO: 196952 - RNA, 18 nt, Human
aacaaugacuaagugucc

SEQ ID NO: 196953 - RNA, 25 nt, Human
aacggaagcccacccugccucccuu

SEQ ID NO: 196954 - RNA, 26 nt, Human
aacuggcuuaaaagcuccaaauccuc

SEQ ID NO: 196955 - RNA, 22 nt, Human
aagaaauagggcccacuuguuc

SEQ ID NO: 196956 - RNA, 23 nt, Human
aagagaagggaagucaagcaaaa

SEQ ID NO: 196957 - RNA, 26 nt, Human
aagagcaaacagaucuggagaacgga

SEQ ID NO: 196958 - RNA, 20 nt, Human
aagcuaauggcaaacaacag

SEQ ID NO: 196959 - RNA, 20 nt, Human
aaggcucacucccaaagauc

SEQ ID NO: 196960 - RNA, 24 nt, Human
aaucacuggaacccaguaggcaga

SEQ ID NO: 196961 - RNA, 24 nt, Human
aaucgcccaccuccucauccaagu

SEQ ID NO: 196962 - RNA, 21 nt, Human
aaugaacugauuuccucuaca

SEQ ID NO: 196963 - RNA, 22 nt, Human
aaugauaacauuuuuucccaaa

SEQ ID NO: 196964 - RNA, 24 nt, Human
acacacauaugcgggcacacacac

SEQ ID NO: 196965 - RNA, 21 nt, Human
acacacgcacgcacacacaua

SEQ ID NO: 196966 - RNA, 26 nt, Human
acaccaaagaaaacgacaacaaaaca

SEQ ID NO: 196967 - RNA, 20 nt, Human
acaccacugcacuccagccu

SEQ ID NO: 196968 - RNA, 24 nt, Human
acaccacugcacuccagccuggac

SEQ ID NO: 196969 - RNA, 25 nt, Human
acaccacugcacuccagccuggacu

SEQ ID NO: 196970 - RNA, 22 nt, Human
acauaugcgggcacacacacac

SEQ ID NO: 196971 - RNA, 23 nt, Human
accacucccuagcagaguuccca

SEQ ID NO: 196972 - RNA, 20 nt, Human
accacugcacuccagccugg

SEQ ID NO: 196973 - RNA, 22 nt, Human
accacugcacuccagccuggac

SEQ ID NO: 196974 - RNA, 25 nt, Human
accacugcacuccagccuggacgac

SEQ ID NO: 196975 - RNA, 22 nt, Human
accagcuagcucuaucucuaca

SEQ ID NO: 196976 - RNA, 21 nt, Human
accugugggagggcuuucccu

SEQ ID NO: 196977 - RNA, 24 nt, Human
acgcagcaucugcuucaaggccga

SEQ ID NO: 196978 - RNA, 24 nt, Human
acugcacuccagccuggacgacag

SEQ ID NO: 196979 - RNA, 22 nt, Human
acuuuguacccaaaugcucucc

SEQ ID NO: 196980 - RNA, 21 nt, Human
agaaaacgacaacaaaacaaa

SEQ ID NO: 196981 - RNA, 20 nt, Human
agaaacacagaaaaagaaca

SEQ ID NO: 196982 - RNA, 24 nt, Human
agacagguggaucacgaggucagg

SEQ ID NO: 196983 - RNA, 20 nt, Human
agaccuggauaaagauggug

SEQ ID NO: 196984 - RNA, 18 nt, Human
agagguuguggugagccg

SEQ ID NO: 196985 - RNA, 18 nt, Human
agcaaaaggcucacuccc

SEQ ID NO: 196986 - RNA, 19 nt, Human
agcacuuugggaggccgag

SEQ ID NO: 196987 - RNA, 20 nt, Human
agcaggcaaggcauaucuuc

SEQ ID NO: 196988 - RNA, 21 nt, Human
agccaaaucgcccaccuccuc

SEQ ID NO: 196989 - RNA, 22 nt, Human
agccuggauggcauggugaaac

SEQ ID NO: 196990 - RNA, 24 nt, Human
agccuggauggcauggugaaaccc

SEQ ID NO: 196991 - RNA, 19 nt, Human
aggaguucgaaaccagccu

SEQ ID NO: 196992 - RNA, 24 nt, Human
aggcagagguuguggugagccgag

SEQ ID NO: 196993 - RNA, 23 nt, Human
aggcaggagaaucacuggaaccc

SEQ ID NO: 196994 - RNA, 20 nt, Human
aggcauggaaaagagaaggg

SEQ ID NO: 196995 - RNA, 24 nt, Human
aggcgcgguggcucacaccuguaa

SEQ ID NO: 196996 - RNA, 24 nt, Human
agguggaucacgaggucaggaguu

SEQ ID NO: 196997 - RNA, 23 nt, Human
aguccgggagugaaagaccccag

SEQ ID NO: 196998 - RNA, 27 nt, Human
aguuauugcuguguucuuccuuuugag

SEQ ID NO: 196999 - RNA, 27 nt, Human
auacagggccaggcgcgguggcucaca

SEQ ID NO: 197000 - RNA, 19 nt, Human
aucacgaggucaggaguuc

SEQ ID NO: 197001 - RNA, 25 nt, Human
aucccagagccucuucaaacaccaa

SEQ ID NO: 197002 - RNA, 19 nt, Human
aucuggagaacggaagccc

SEQ ID NO: 197003 - RNA, 23 nt, Human
auggaccaugcaaacgccuucaa

SEQ ID NO: 197004 - RNA, 28 nt, Human
caaaacaaaccuaaaaacaaacagaaac

SEQ ID NO: 197005 - RNA, 22 nt, Human
caaagcagaaccgcgcugucac

SEQ ID NO: 197006 - RNA, 18 nt, Human
caaagcagaguguccaga

SEQ ID NO: 197007 - RNA, 23 nt, Human
caaaucgcccaccuccucaucca

SEQ ID NO: 197008 - RNA, 21 nt, Human
caacccacugguacccagagu

SEQ ID NO: 197009 - RNA, 18 nt, Human
caaggcuggaaacgcaga

SEQ ID NO: 197010 - RNA, 20 nt, Human
caaugcacagccucuaaaac

SEQ ID NO: 197011 - RNA, 26 nt, Human
cacacacauaugcgggcacacacaca

SEQ ID NO: 197012 - RNA, 22 nt, Human
cacacacgcacgcacacacaua

SEQ ID NO: 197013 - RNA, 30 nt, Human
cacacauaugcgggcacacacacacauccu

SEQ ID NO: 197014 - RNA, 21 nt, Human
cacaccacugcacuccagccu

SEQ ID NO: 197015 - RNA, 24 nt, Human
cacaccuguaaucccagcacuuug

SEQ ID NO: 197016 - RNA, 20 nt, Human
cacagaaaaagaacaaagac

SEQ ID NO: 197017 - RNA, 23 nt, Human
cacagccucuaaaacaagggcua

SEQ ID NO: 197018 - RNA, 18 nt, Human
caccaaagaaaacgacaa

SEQ ID NO: 197019 - RNA, 18 nt, Human
caccaaagaaaacgacaa

SEQ ID NO: 197020 - RNA, 23 nt, Human
caccaaagaaaacgacaacaaaa

SEQ ID NO: 197021 - RNA, 21 nt, Human
caccaaagaaaacgacaacua

SEQ ID NO: 197022 - RNA, 26 nt, Human
caccacugcacuccagccuggacgac

SEQ ID NO: 197023 - RNA, 19 nt, Human
caccuguaaucccagcacu

SEQ ID NO: 197024 - RNA, 24 nt, Human
caccuguaaucccagcacuuuggg

SEQ ID NO: 197025 - RNA, 23 nt, Human
caccuguagucccagcuacucgg

SEQ ID NO: 197026 - RNA, 24 nt, Human
caccuguagucccagcuacucggg

SEQ ID NO: 197027 - RNA, 25 nt, Human
cacucccaaagaucaaagcuaagga

SEQ ID NO: 197028 - RNA, 19 nt, Human
cacugcaaccacaccagcu

SEQ ID NO: 197029 - RNA, 18 nt, Human
cacugcacuccagccugg

SEQ ID NO: 197030 - RNA, 19 nt, Human
cacugcacuccagccugga

SEQ ID NO: 197031 - RNA, 21 nt, Human
cacugcacuccagccuggacg

SEQ ID NO: 197032 - RNA, 22 nt, Human
cacugcacuccagccuggacga

SEQ ID NO: 197033 - RNA, 25 nt, Human
cacugcacuccagccuggacgacaa

SEQ ID NO: 197034 - RNA, 25 nt, Human
cacugcacuccagccuggacgacag

SEQ ID NO: 197035 - RNA, 18 nt, Human
cacuugacaaucuaagug

SEQ ID NO: 197036 - RNA, 22 nt, Human
cagagccaaaucgcccaccucc

SEQ ID NO: 197037 - RNA, 19 nt, Human
cagagccucuucaaacacc

SEQ ID NO: 197038 - RNA, 20 nt, Human
cagaucacggaugcugcuaa

SEQ ID NO: 197039 - RNA, 24 nt, Human
cagcacuuugggaggccgagacag

SEQ ID NO: 197040 - RNA, 26 nt, Human
cagcacuuugggaggccgagacaggu

SEQ ID NO: 197041 - RNA, 19 nt, Human
cagcagcucugcagugagu

SEQ ID NO: 197042 - RNA, 29 nt, Human
cagccucuaaaacaagggcuacuccuuuu

SEQ ID NO: 197043 - RNA, 26 nt, Human
caggacacuuuaaauuugcacuucga

SEQ ID NO: 197044 - RNA, 19 nt, Human
cagucuugcaggaaugcuc

SEQ ID NO: 197045 - RNA, 26 nt, Human
cauccaagaagcaguccgggagugaa

SEQ ID NO: 197046 - RNA, 22 nt, Human
cauggugaaacccccgccucua

SEQ ID NO: 197047 - RNA, 25 nt, Human
cauuucagaguaaaucugaaacugg

SEQ ID NO: 197048 - RNA, 20 nt, Human
ccaaaugcucuccgucacaa

SEQ ID NO: 197049 - RNA, 27 nt, Human
ccaaaugcucuccgucacaaaugcuau

SEQ ID NO: 197050 - RNA, 23 nt, Human
ccacacuucauuaguuuuaauuu

SEQ ID NO: 197051 - RNA, 19 nt, Human
ccacugcacuccagccugg

SEQ ID NO: 197052 - RNA, 19 nt, Human
ccacugcacuccagccugg

SEQ ID NO: 197053 - RNA, 21 nt, Human
ccacugcacuccagccuggac

SEQ ID NO: 197054 - RNA, 23 nt, Human
ccacugguacccagagucagauc

SEQ ID NO: 197055 - RNA, 20 nt, Human
cccccaaagaaauucaaaaa

SEQ ID NO: 197056 - RNA, 22 nt, Human
ccccgaccugugcacccgcacc

SEQ ID NO: 197057 - RNA, 27 nt, Human
ccccuugacaauaaacguaaguccaag

SEQ ID NO: 197058 - RNA, 27 nt, Human
ccuccuauaauagcagccagcagaaau

SEQ ID NO: 197059 - RNA, 23 nt, Human
ccuggauggcauggugaaacccc

SEQ ID NO: 197060 - RNA, 21 nt, Human
ccuguagucccagcuacucgg

SEQ ID NO: 197061 - RNA, 23 nt, Human
cgacaacaaaacaaaccuaaaaa

SEQ ID NO: 197062 - RNA, 24 nt, Human
cgagacagguggaucacgagguca

SEQ ID NO: 197063 - RNA, 20 nt, Human
cgugguccaugagccaugga

SEQ ID NO: 197064 - RNA, 20 nt, Human
cuaaagguagacagacuaua

SEQ ID NO: 197065 - RNA, 22 nt, Human
cuauaauagcagccagcagaaa

SEQ ID NO: 197066 - RNA, 24 nt, Human
cucaacaacccacugguacccaga

SEQ ID NO: 197067 - RNA, 22 nt, Human
cucacaccuguaaucccagcac

SEQ ID NO: 197068 - RNA, 24 nt, Human
cucacaccuguaaucccagcacuu

SEQ ID NO: 197069 - RNA, 20 nt, Human
cucacuuuguacccaaaugc

SEQ ID NO: 197070 - RNA, 25 nt, Human
cucacuuuguacccaaaugcucucc

SEQ ID NO: 197071 - RNA, 19 nt, Human
cucccccgaccugugcacc

SEQ ID NO: 197072 - RNA, 20 nt, Human
cucuacuaaaaauacaaaaa

SEQ ID NO: 197073 - RNA, 27 nt, Human
cugcagugaaacucaaccacgauuuuc

SEQ ID NO: 197074 - RNA, 18 nt, Human
cuguggccugugcucccc

SEQ ID NO: 197075 - RNA, 23 nt, Human
cuuaaaagcuccaaauccucccu

SEQ ID NO: 197076 - RNA, 23 nt, Human
cuucaaggcugcuucaucucucu

SEQ ID NO: 197077 - RNA, 25 nt, Human
cuuccaguggauaaaggcaaacagg

SEQ ID NO: 197078 - RNA, 21 nt, Human
cuuguucaagucuucaaugga

SEQ ID NO: 197079 - RNA, 22 nt, Human
cuuuguucccagacuccagggc

SEQ ID NO: 197080 - RNA, 20 nt, Human
gaaaagaaaauucaccuaca

SEQ ID NO: 197081 - RNA, 19 nt, Human
gaaaauacagggccaggcg

SEQ ID NO: 197082 - RNA, 18 nt, Human
gaagggauuuuguucaaa

SEQ ID NO: 197083 - RNA, 20 nt, Human
gacaacaaaacaaaccuaaa

SEQ ID NO: 197084 - RNA, 21 nt, Human
gacaacugagucuccugcgug

SEQ ID NO: 197085 - RNA, 25 nt, Human
gaccacaccacugcacuccagccug

SEQ ID NO: 197086 - RNA, 20 nt, Human
gaccugugcacccgcacccc

SEQ ID NO: 197087 - RNA, 19 nt, Human
gagaacggaagcccacccu

SEQ ID NO: 197088 - RNA, 23 nt, Human
gagaccacaccacugcacuccag

SEQ ID NO: 197089 - RNA, 20 nt, Human
gaggagcgccugcuggaaag

SEQ ID NO: 197090 - RNA, 21 nt, Human
gaucaaagcuaaggaagcccc

SEQ ID NO: 197091 - RNA, 22 nt, Human
gaucacgaggucaggaguucga

SEQ ID NO: 197092 - RNA, 21 nt, Human
gcacagccucuaaaacaaggg

SEQ ID NO: 197093 - RNA, 19 nt, Human
gcacugcuggggugggggu

SEQ ID NO: 197094 - RNA, 22 nt, Human
gcacugcugggguggggguggg

SEQ ID NO: 197095 - RNA, 23 nt, Human
gcagagguaaagaauuugaaaau

SEQ ID NO: 197096 - RNA, 23 nt, Human
gcagcucugcagugaguggggaa

SEQ ID NO: 197097 - RNA, 22 nt, Human
gcaggagaaucacuggaaccca

SEQ ID NO: 197098 - RNA, 20 nt, Human
gccgagaccacaccacugca

SEQ ID NO: 197099 - RNA, 18 nt, Human
gccuucaucuccagcugu

SEQ ID NO: 197100 - RNA, 18 nt, Human
gcucuguggccugugcuc

SEQ ID NO: 197101 - RNA, 24 nt, Human
ggaaaagagaagggaagucaagca

SEQ ID NO: 197102 - RNA, 22 nt, Human
ggaaacaaaggcauggaaaaga

SEQ ID NO: 197103 - RNA, 23 nt, Human
ggaagagagaaaacuggacaaaa

SEQ ID NO: 197104 - RNA, 20 nt, Human
ggaagggaggauaucuugcc

SEQ ID NO: 197105 - RNA, 19 nt, Human
ggcauggaaaagagaaggg

SEQ ID NO: 197106 - RNA, 19 nt, Human
ggcauuuggagaagagugg

SEQ ID NO: 197107 - RNA, 23 nt, Human
gggaugcugaggcaggagaauca

SEQ ID NO: 197108 - RNA, 20 nt, Human
gggcaaggggcgaccaugcu

SEQ ID NO: 197109 - RNA, 22 nt, Human
gggcaaggggcgaccaugcugu

SEQ ID NO: 197110 - RNA, 24 nt, Human
gggcaugguagcgugcaccuguag

SEQ ID NO: 197111 - RNA, 24 nt, Human
gggcaugguagcgugcaccuguag

SEQ ID NO: 197112 - RNA, 18 nt, Human
ggggaggcuggcuccucu

SEQ ID NO: 197113 - RNA, 20 nt, Human
gggguggggguggggacagg

SEQ ID NO: 197114 - RNA, 21 nt, Human
ggguggggacaggaagcccag

SEQ ID NO: 197115 - RNA, 24 nt, Human
gguagcgugcaccuguagucccag

SEQ ID NO: 197116 - RNA, 23 nt, Human
gguggcucacaccuguaauccca

SEQ ID NO: 197117 - RNA, 24 nt, Human
gguggcucacaccuguaaucccag

SEQ ID NO: 197118 - RNA, 24 nt, Human
gugaaauuguuaaaaagcucuagu

SEQ ID NO: 197119 - RNA, 24 nt, Human
gugcacccgcaccccagucggcca

SEQ ID NO: 197120 - RNA, 23 nt, Human
guggaucacgaggucaggaguuc

SEQ ID NO: 197121 - RNA, 20 nt, Human
guucaugugaggcaaaauca

SEQ ID NO: 197122 - RNA, 19 nt, Human
uaaaaacacagaacaauga

SEQ ID NO: 197123 - RNA, 26 nt, Human
uaaaacaaaacauagcauguuuuuca

SEQ ID NO: 197124 - RNA, 21 nt, Human
uaaaacucacauccaagaagc

SEQ ID NO: 197125 - RNA, 18 nt, Human
uaaaagcacacgccaauc

SEQ ID NO: 197126 - RNA, 21 nt, Human
uaaaaggagacacaagaaaua

SEQ ID NO: 197127 - RNA, 21 nt, Human
uaaagaauuugaaaauacagg

SEQ ID NO: 197128 - RNA, 19 nt, Human
uaacccccaaagaaauuca

SEQ ID NO: 197129 - RNA, 22 nt, Human
uaagaaaauaucugaauuuucc

SEQ ID NO: 197130 - RNA, 24 nt, Human
uaagaaagucagucccuaacuaaa

SEQ ID NO: 197131 - RNA, 20 nt, Human
uaagagcaaacagaucugga

SEQ ID NO: 197132 - RNA, 22 nt, Human
uaauagcagccagcagaaaucu

SEQ ID NO: 197133 - RNA, 18 nt, Human
uacaaagucugagaaaug

SEQ ID NO: 197134 - RNA, 19 nt, Human
uacaaggucacugcaacca

SEQ ID NO: 197135 - RNA, 21 nt, Human
uagacagacuauacuaaaaac

SEQ ID NO: 197136 - RNA, 23 nt, Human
uagacagacuauacuaaaaacca

SEQ ID NO: 197137 - RNA, 22 nt, Human
uagcagccagcagaaaucuguu

SEQ ID NO: 197138 - RNA, 23 nt, Human
uagccugacuggguaagaccugg

SEQ ID NO: 197139 - RNA, 21 nt, Human
uaggcagagguuguggugagc

SEQ ID NO: 197140 - RNA, 23 nt, Human
uauggcagcaggcaaggcauauc

SEQ ID NO: 197141 - RNA, 20 nt, Human
uauuuugguuuguuuuuuca

SEQ ID NO: 197142 - RNA, 23 nt, Human
ucacaucaggcaacgucagccug

SEQ ID NO: 197143 - RNA, 24 nt, Human
ucacgaggucaggaguucgaaacc

SEQ ID NO: 197144 - RNA, 21 nt, Human
ucacuggaacccaguaggcag

SEQ ID NO: 197145 - RNA, 18 nt, Human
ucagcugggacuggaaga

SEQ ID NO: 197146 - RNA, 19 nt, Human
ucaggacaacugagucucc

SEQ ID NO: 197147 - RNA, 23 nt, Human
ucaucaggaaaaugccaaguucc

SEQ ID NO: 197148 - RNA, 22 nt, Human
uccacacuugcuucagcaauua

SEQ ID NO: 197149 - RNA, 23 nt, Human
uccagaauaggacuucagcuuaa

SEQ ID NO: 197150 - RNA, 18 nt, Human
uccagccuggacgacaga

SEQ ID NO: 197151 - RNA, 21 nt, Human
uccaguggauaaaggcaaaca

SEQ ID NO: 197152 - RNA, 26 nt, Human
ucccaaagaucaaagcuaaggaagcc

SEQ ID NO: 197153 - RNA, 18 nt, Human
ucccaaagcagagugucc

SEQ ID NO: 197154 - RNA, 19 nt, Human
ucccagagccucuucaaac

SEQ ID NO: 197155 - RNA, 19 nt, Human
uccccaggucugcaagcua

SEQ ID NO: 197156 - RNA, 24 nt, Human
ucccuuuucuucauuaauaaaaac

SEQ ID NO: 197157 - RNA, 20 nt, Human
uccuuaggaaaggagagcuc

SEQ ID NO: 197158 - RNA, 20 nt, Human
ucgcccaccuccucauccaa

SEQ ID NO: 197159 - RNA, 22 nt, Human
ucgcccaccuccucauccaagu

SEQ ID NO: 197160 - RNA, 22 nt, Human
ucugcucaacuuaaaacucaca

SEQ ID NO: 197161 - RNA, 22 nt, Human
ucuucaauggacuggcuguucg

SEQ ID NO: 197162 - RNA, 19 nt, Human
ugaaagaaggcuugggcau

SEQ ID NO: 197163 - RNA, 20 nt, Human
ugaagcagugcggggaggcu

SEQ ID NO: 197164 - RNA, 18 nt, Human
ugacuaaguguccaagca

SEQ ID NO: 197165 - RNA, 19 nt, Human
ugaggcaggagaaucacug

SEQ ID NO: 197166 - RNA, 21 nt, Human
ugaggcaggagaaucacugga

SEQ ID NO: 197167 - RNA, 24 nt, Human
ugaggcaggagaaucacuggaacc

SEQ ID NO: 197168 - RNA, 25 nt, Human
ugaggcaggagaaucacuggaaccc

SEQ ID NO: 197169 - RNA, 20 nt, Human
ugaguaugauucauaaguuu

SEQ ID NO: 197170 - RNA, 21 nt, Human
ugcaaccacaccagcuagcuc

SEQ ID NO: 197171 - RNA, 19 nt, Human
ugcaccuguagucccagcu

SEQ ID NO: 197172 - RNA, 23 nt, Human
ugcacuacuaagaaaauaucuga

SEQ ID NO: 197173 - RNA, 21 nt, Human
ugcaugggcacggacaggcag

SEQ ID NO: 197174 - RNA, 20 nt, Human
ugccagagagcacugcuggg

SEQ ID NO: 197175 - RNA, 18 nt, Human
ugccuggcuaaagguaga

SEQ ID NO: 197176 - RNA, 20 nt, Human
ugcgcacacacgcacgcaca

SEQ ID NO: 197177 - RNA, 18 nt, Human
uggaagagagaaaacugg

SEQ ID NO: 197178 - RNA, 20 nt, Human
uggauaaagauggugcuagu

SEQ ID NO: 197179 - RNA, 22 nt, Human
uggaucacgaggucaggaguuc

SEQ ID NO: 197180 - RNA, 24 nt, Human
uggaucacgaggucaggaguucga

SEQ ID NO: 197181 - RNA, 21 nt, Human
uggcaggcagcagcucugcag

SEQ ID NO: 197182 - RNA, 25 nt, Human
uggcauggugaaacccccgccucua

SEQ ID NO: 197183 - RNA, 21 nt, Human
uggcucacaccuguaauccca

SEQ ID NO: 197184 - RNA, 22 nt, Human
uggcucacaccuguaaucccag

SEQ ID NO: 197185 - RNA, 24 nt, Human
uggcucacaccuguaaucccagca

SEQ ID NO: 197186 - RNA, 24 nt, Human
ugggaggccgagacagguggauca

SEQ ID NO: 197187 - RNA, 28 nt, Human
uggggacaggaagcccagucgggauccc

SEQ ID NO: 197188 - RNA, 19 nt, Human
uggggccacaccaccgggu

SEQ ID NO: 197189 - RNA, 21 nt, Human
uggggguggggacaggaagcc

SEQ ID NO: 197190 - RNA, 22 nt, Human
uggggguggggacaggaagccc

SEQ ID NO: 197191 - RNA, 19 nt, Human
ugggguggggguggggaca

SEQ ID NO: 197192 - RNA, 19 nt, Human
ugggguggggguggggaca

SEQ ID NO: 197193 - RNA, 23 nt, Human
uggguauuuuuucauagggcugu

SEQ ID NO: 197194 - RNA, 22 nt, Human
ugggugcuccgaucaaagcaga

SEQ ID NO: 197195 - RNA, 24 nt, Human
ugguagcgugcaccuguaguccca

SEQ ID NO: 197196 - RNA, 18 nt, Human
ugguuuguuuuuucauag

SEQ ID NO: 197197 - RNA, 19 nt, Human
uguaaaaacuccccuugac

SEQ ID NO: 197198 - RNA, 26 nt, Human
uguaaauucucacuuuguacccaaau

SEQ ID NO: 197199 - RNA, 21 nt, Human
uguagcacaucaaauuuugaa

SEQ ID NO: 197200 - RNA, 20 nt, Human
uguccugugccuggcuaaag

SEQ ID NO: 197201 - RNA, 23 nt, Human
uguggccugugcucccccgaccu

SEQ ID NO: 197202 - RNA, 22 nt, Human
uguuaaaaagcucuaguaacaa

SEQ ID NO: 197203 - RNA, 21 nt, Human
uguuacaauguauggcagcag

SEQ ID NO: 197204 - RNA, 18 nt, Human
uguuucauuuccaaaaaa

SEQ ID NO: 197205 - RNA, 27 nt, Human
uuaaccaucuaucccagagccucuuca

SEQ ID NO: 197206 - RNA, 24 nt, Human
uuacaaaauacggucgauacucaa

SEQ ID NO: 197207 - RNA, 22 nt, Human
uuagccgggcaugguagcgugc

SEQ ID NO: 197208 - RNA, 24 nt, Human
uuaguuuuaauuugcagaaaggaa

SEQ ID NO: 197209 - RNA, 24 nt, Human
uucaaaaagugaugauggcagcuc

SEQ ID NO: 197210 - RNA, 23 nt, Human
uucagaguaaaucugaaacuggc

SEQ ID NO: 197211 - RNA, 23 nt, Human
uucaugugaggcaaaaucagguu

SEQ ID NO: 197212 - RNA, 21 nt, Human
uucgcuaacacgaacagcuau

SEQ ID NO: 197213 - RNA, 25 nt, Human
uugauccugucucuucacaauaugu

SEQ ID NO: 197214 - RNA, 19 nt, Human
uugcggggugcauaaaugg

SEQ ID NO: 197215 - RNA, 28 nt, Human
uuggagaagagugguuuuuuuuguguuu

SEQ ID NO: 197216 - RNA, 18 nt, Human
uuggauggagcaaggcug

SEQ ID NO: 197217 - RNA, 18 nt, Human
uuguggugagccgagacc

SEQ ID NO: 197218 - RNA, 19 nt, Human
uuguggugagccgagacca

SEQ ID NO: 197219 - RNA, 20 nt, Human
uuguggugagccgagaccac

SEQ ID NO: 197220 - RNA, 25 nt, Human
uuuccauguaaaaacuccccuugac

SEQ ID NO: 197221 - RNA, 23 nt, Human
uuucuaggagcgugguccaugag

SEQ ID NO: 197222 - RNA, 21 nt, Human
uuuuuuguuuguuuguuuuuu

SEQ ID NO: 197223 - RNA, 22 nt, Human
aaaaagaaauaagaaagaaaga

SEQ ID NO: 197224 - RNA, 20 nt, Human
aaaagacagugaaauucuua

SEQ ID NO: 197225 - RNA, 19 nt, Human
aaacaaccgcccccuaaaa

SEQ ID NO: 197226 - RNA, 23 nt, Human
aaacagaaacaagagcuuguacu

SEQ ID NO: 197227 - RNA, 23 nt, Human
aaacauuugagaugcucauuuga

SEQ ID NO: 197228 - RNA, 21 nt, Human
aaagaaacaaccgcccccuaa

SEQ ID NO: 197229 - RNA, 18 nt, Human
aaaggaacacgcacacgc

SEQ ID NO: 197230 - RNA, 18 nt, Human
aaauauauauauuaccaa

SEQ ID NO: 197231 - RNA, 22 nt, Human
aaauauccuacugguuggguuu

SEQ ID NO: 197232 - RNA, 23 nt, Human
aaauauuaaagacuucaaaaacc

SEQ ID NO: 197233 - RNA, 23 nt, Human
aacaaaaccgaacacaucaaugu

SEQ ID NO: 197234 - RNA, 18 nt, Human
aacacgcacacgcacaua

SEQ ID NO: 197235 - RNA, 23 nt, Human
aacugacuucuuucugaggccua

SEQ ID NO: 197236 - RNA, 19 nt, Human
aagaaagaaacaaccgccc

SEQ ID NO: 197237 - RNA, 18 nt, Human
aagcaaacagagaauaag

SEQ ID NO: 197238 - RNA, 19 nt, Human
aaggauauuuuaaucuagc

SEQ ID NO: 197239 - RNA, 24 nt, Human
acaaaaccgaacacaucaauguca

SEQ ID NO: 197240 - RNA, 25 nt, Human
acaauccuuccacaauucuccacuu

SEQ ID NO: 197241 - RNA, 19 nt, Human
acacagaugcacaccaaaa

SEQ ID NO: 197242 - RNA, 22 nt, Human
acagacagugcaaaaacacacu

SEQ ID NO: 197243 - RNA, 19 nt, Human
acaggaaacaaacugucca

SEQ ID NO: 197244 - RNA, 29 nt, Human
acauauacacgcacacacacacagaugca

SEQ ID NO: 197245 - RNA, 20 nt, Human
accacacacaugagcacaaa

SEQ ID NO: 197246 - RNA, 28 nt, Human
accacacacaugagcacaagcacauaua

SEQ ID NO: 197247 - RNA, 18 nt, Human
accgauaucaaccucaua

SEQ ID NO: 197248 - RNA, 22 nt, Human
accuuguagaaauauccuacug

SEQ ID NO: 197249 - RNA, 23 nt, Human
acugaaucuuaaguaacuguuuu

SEQ ID NO: 197250 - RNA, 21 nt, Human
agaaauaagaaagaaagaaac

SEQ ID NO: 197251 - RNA, 18 nt, Human
agaauuucgaagugaaca

SEQ ID NO: 197252 - RNA, 22 nt, Human
agacagugcaaaaacacacucu

SEQ ID NO: 197253 - RNA, 23 nt, Human
agaccucccauuucccucugcuu

SEQ ID NO: 197254 - RNA, 18 nt, Human
agagcgcgccaagugccc

SEQ ID NO: 197255 - RNA, 24 nt, Human
agcacauauacacgcacacacaca

SEQ ID NO: 197256 - RNA, 21 nt, Human
aggaggcaggagugaaggagg

SEQ ID NO: 197257 - RNA, 21 nt, Human
aggaggcaggagugaaggagg

SEQ ID NO: 197258 - RNA, 22 nt, Human
aggagugaaggagggaggggau

SEQ ID NO: 197259 - RNA, 19 nt, Human
aggauuauugcuuuaggua

SEQ ID NO: 197260 - RNA, 26 nt, Human
aggcaggagugaaggaggggggaccc

SEQ ID NO: 197261 - RNA, 19 nt, Human
aguaaguaaauaugggauc

SEQ ID NO: 197262 - RNA, 21 nt, Human
agugcagacggucccaggaga

SEQ ID NO: 197263 - RNA, 20 nt, Human
aguuaacuagaaaagugggg

SEQ ID NO: 197264 - RNA, 19 nt, Human
auaaauuaaccccucaucc

SEQ ID NO: 197265 - RNA, 23 nt, Human
caaaaacccccaagcacuucuuc

SEQ ID NO: 197266 - RNA, 21 nt, Human
caaaaguacucgcucucaagg

SEQ ID NO: 197267 - RNA, 25 nt, Human
caaagccagccugcaaaaaugccau

SEQ ID NO: 197268 - RNA, 19 nt, Human
caacaccauccccuucuga

SEQ ID NO: 197269 - RNA, 21 nt, Human
caauacacccccaucucuugc

SEQ ID NO: 197270 - RNA, 31 nt, Human
cacaagcacauauacacgcacacacacagug

SEQ ID NO: 197271 - RNA, 21 nt, Human
cacacacacagaugcacacca

SEQ ID NO: 197272 - RNA, 28 nt, Human
cacacacaugagcacaagcacauauaca

SEQ ID NO: 197273 - RNA, 22 nt, Human
cacagaugcacaccaaaauggg

SEQ ID NO: 197274 - RNA, 18 nt, Human
cacgcacacgcacauacc

SEQ ID NO: 197275 - RNA, 25 nt, Human
cagaaacaagagcuuguacucuuaa

SEQ ID NO: 197276 - RNA, 24 nt, Human
cagaugcacaccaaaaugggaguc

SEQ ID NO: 197277 - RNA, 24 nt, Human
caugagcacaagcacauauacacg

SEQ ID NO: 197278 - RNA, 18 nt, Human
ccaaaaguacucgcucuc

SEQ ID NO: 197279 - RNA, 19 nt, Human
cccaagcacuucuucucug

SEQ ID NO: 197280 - RNA, 22 nt, Human
ccccaucucuugcuguuaucua

SEQ ID NO: 197281 - RNA, 21 nt, Human
cccccaagcacuucuucucug

SEQ ID NO: 197282 - RNA, 18 nt, Human
cccucugcuuccuugucc

SEQ ID NO: 197283 - RNA, 23 nt, Human
ccuuaaaaaagaaauaagaaaga

SEQ ID NO: 197284 - RNA, 26 nt, Human
cgauaucaaccucauaaaacgugcgg

SEQ ID NO: 197285 - RNA, 19 nt, Human
cgaugagagggcuaccuua

SEQ ID NO: 197286 - RNA, 23 nt, Human
cgcacacacacacagaugcacac

SEQ ID NO: 197287 - RNA, 21 nt, Human
cuaacaauucuacaauucgcc

SEQ ID NO: 197288 - RNA, 24 nt, Human
cuaucaaauuauaaaccaaacaca

SEQ ID NO: 197289 - RNA, 26 nt, Human
cucaaggcgguggagaaaagggaaga

SEQ ID NO: 197290 - RNA, 28 nt, Human
cuuaaaauauuaaagacuucaaaaaccc

SEQ ID NO: 197291 - RNA, 18 nt, Human
gaaagaaagaaacaaccc

SEQ ID NO: 197292 - RNA, 20 nt, Human
gaaagcaacuuauaaaggac

SEQ ID NO: 197293 - RNA, 23 nt, Human
gacaaaaugaacaccuuguagaa

SEQ ID NO: 197294 - RNA, 20 nt, Human
gacccgcgagagggcuccuc

SEQ ID NO: 197295 - RNA, 19 nt, Human
gauauaaacaucuaauucc

SEQ ID NO: 197296 - RNA, 18 nt, Human
gaugagagggcuaccuua

SEQ ID NO: 197297 - RNA, 19 nt, Human
gcagggugugagggaaggg

SEQ ID NO: 197298 - RNA, 23 nt, Human
ggaaaaagggccuuagaaaacau

SEQ ID NO: 197299 - RNA, 25 nt, Human
ggagugaaggagggaggggaugggg

SEQ ID NO: 197300 - RNA, 22 nt, Human
ggcgguggagaaaagggaagaa

SEQ ID NO: 197301 - RNA, 21 nt, Human
gggaauagucuggccaugcuc

SEQ ID NO: 197302 - RNA, 20 nt, Human
ggggaugggagacccgcgag

SEQ ID NO: 197303 - RNA, 19 nt, Human
gggugugagggaaggggaa

SEQ ID NO: 197304 - RNA, 22 nt, Human
guaacuuacggacuaaacagaa

SEQ ID NO: 197305 - RNA, 21 nt, Human
uaaaauccauuuugugcuuuu

SEQ ID NO: 197306 - RNA, 24 nt, Human
uaacaauucuacaauucgccucuu

SEQ ID NO: 197307 - RNA, 22 nt, Human
uaaccccucauccuuagaccuc

SEQ ID NO: 197308 - RNA, 24 nt, Human
uaagaaacauaagcuucagaauca

SEQ ID NO: 197309 - RNA, 21 nt, Human
uaccaaaaagugggaaaacug

SEQ ID NO: 197310 - RNA, 22 nt, Human
uaccagggcccuuuuuagugaa

SEQ ID NO: 197311 - RNA, 24 nt, Human
uagcaccgauaucaaccucauaaa

SEQ ID NO: 197312 - RNA, 18 nt, Human
uagcaugguaacuuacgg

SEQ ID NO: 197313 - RNA, 26 nt, Human
uauaagagcacauacguucaaaagca

SEQ ID NO: 197314 - RNA, 18 nt, Human
uauaauucacaaaaauau

SEQ ID NO: 197315 - RNA, 25 nt, Human
uauuaaaaaaaaacuuucggguuuc

SEQ ID NO: 197316 - RNA, 23 nt, Human
uauuaaagacuucaaaaaccccc

SEQ ID NO: 197317 - RNA, 22 nt, Human
uauugcaauuccaauacacccc

SEQ ID NO: 197318 - RNA, 23 nt, Human
ucaaaagcaaacagagaauaaga

SEQ ID NO: 197319 - RNA, 21 nt, Human
ucauuugauauaaacaucuaa

SEQ ID NO: 197320 - RNA, 19 nt, Human
uccaucuauuccaaagcca

SEQ ID NO: 197321 - RNA, 19 nt, Human
ucccucugcuuccuugucc

SEQ ID NO: 197322 - RNA, 22 nt, Human
ucuaucaaauuauaaaccaaac

SEQ ID NO: 197323 - RNA, 21 nt, Human
ucugcagaaaacauuugagau

SEQ ID NO: 197324 - RNA, 18 nt, Human
ugaaaguaagaggaaagc

SEQ ID NO: 197325 - RNA, 23 nt, Human
ugaagcaaagcugaggaggcagg

SEQ ID NO: 197326 - RNA, 21 nt, Human
ugaaggagggaggggauggga

SEQ ID NO: 197327 - RNA, 18 nt, Human
ugaccacacacaugagca

SEQ ID NO: 197328 - RNA, 26 nt, Human
ugagaugcucauuugauauaaacauc

SEQ ID NO: 197329 - RNA, 24 nt, Human
ugcaaaauguucaaaauugaaaaa

SEQ ID NO: 197330 - RNA, 22 nt, Human
ugcugagcuuuuccuccguccu

SEQ ID NO: 197331 - RNA, 19 nt, Human
uggcaagagcaaaggaaca

SEQ ID NO: 197332 - RNA, 21 nt, Human
uggggcacuggcagcaacgug

SEQ ID NO: 197333 - RNA, 19 nt, Human
ugggugacguuaacugacu

SEQ ID NO: 197334 - RNA, 26 nt, Human
uguauaaacauuaaacgauuuaauaa

SEQ ID NO: 197335 - RNA, 23 nt, Human
ugucaguauuuauaucugaaaaa

SEQ ID NO: 197336 - RNA, 19 nt, Human
uguccaucuauuccaaagc

SEQ ID NO: 197337 - RNA, 18 nt, Human
ugugacaaaaugaacacc

SEQ ID NO: 197338 - RNA, 18 nt, Human
uguggcagaugcuuuucc

SEQ ID NO: 197339 - RNA, 21 nt, Human
uuaaaaacugagauccacuau

SEQ ID NO: 197340 - RNA, 23 nt, Human
uuacaauccuuccacaauucucc

SEQ ID NO: 197341 - RNA, 23 nt, Human
uuagaaucuuuuuauuuuuuucu

SEQ ID NO: 197342 - RNA, 18 nt, Human
uucaaaaacccccaagca

SEQ ID NO: 197343 - RNA, 23 nt, Human
uuccuccguccuuugccaaaagu

SEQ ID NO: 197344 - RNA, 21 nt, Human
uucgucaucacaagccucgau

SEQ ID NO: 197345 - RNA, 21 nt, Human
uuugauuuuauuauucaccug

SEQ ID NO: 197346 - RNA, 20 nt, Human
uuuuccuaaaaaacacugua

SEQ ID NO: 197347 - RNA, 26 nt, Human
aagaaaacccaaauagcuaagcccua

SEQ ID NO: 197348 - RNA, 23 nt, Human
aaggcccggauccccuccgcccu

SEQ ID NO: 197349 - RNA, 18 nt, Human
aagucgccaacauacagu

SEQ ID NO: 197350 - RNA, 18 nt, Human
accucacagucgaaccag

SEQ ID NO: 197351 - RNA, 25 nt, Human
agacgggagccggacaccgcaagaa

SEQ ID NO: 197352 - RNA, 24 nt, Human
agccggacaccgcaagaaaaccca

SEQ ID NO: 197353 - RNA, 23 nt, Human
agggggggggaaaaguaauagaa

SEQ ID NO: 197354 - RNA, 23 nt, Human
agguaggcuccacgcugcgucuc

SEQ ID NO: 197355 - RNA, 23 nt, Human
auagaaaaaaaaaaaaaacucgu

SEQ ID NO: 197356 - RNA, 21 nt, Human
caccucacagucgaaccagcc

SEQ ID NO: 197357 - RNA, 22 nt, Human
cagucggagcagcguggggcga

SEQ ID NO: 197358 - RNA, 24 nt, Human
caguguccgcugcagccagucgga

SEQ ID NO: 197359 - RNA, 24 nt, Human
caugguugggaggcugcacgcaag

SEQ ID NO: 197360 - RNA, 23 nt, Human
ccaaauagcuaagcccuaagagc

SEQ ID NO: 197361 - RNA, 20 nt, Human
ccaccgagggaggaggcgag

SEQ ID NO: 197362 - RNA, 21 nt, Human
ccacgcugcgucuccugcccu

SEQ ID NO: 197363 - RNA, 21 nt, Human
cccggauccccuccgcccuag

SEQ ID NO: 197364 - RNA, 23 nt, Human
ccucacagucgaaccagccugcu

SEQ ID NO: 197365 - RNA, 20 nt, Human
ccucuggggcgagucagaga

SEQ ID NO: 197366 - RNA, 23 nt, Human
cgaccucuggggcgagucagaga

SEQ ID NO: 197367 - RNA, 25 nt, Human
cgccucgcucccuggccucgcuuua

SEQ ID NO: 197368 - RNA, 24 nt, Human
cggccggucaccgccucgcucccu

SEQ ID NO: 197369 - RNA, 19 nt, Human
cggcgcggcgcccgcacuc

SEQ ID NO: 197370 - RNA, 18 nt, Human
cggucaccgccucgcucc

SEQ ID NO: 197371 - RNA, 19 nt, Human
cuaaauuuaaaacaacaac

SEQ ID NO: 197372 - RNA, 18 nt, Human
cuagcaggacacugagac

SEQ ID NO: 197373 - RNA, 28 nt, Human
cucacagucgaaccagccugcuuccgga

SEQ ID NO: 197374 - RNA, 21 nt, Human
cuccacgcugcgucuccugcc

SEQ ID NO: 197375 - RNA, 22 nt, Human
cucccuggccucgcuuuaaagg

SEQ ID NO: 197376 - RNA, 21 nt, Human
cugcacgcaaggcccggaucc

SEQ ID NO: 197377 - RNA, 18 nt, Human
cugccggggugagccgcg

SEQ ID NO: 197378 - RNA, 22 nt, Human
cugcgucuccugcccuaccaag

SEQ ID NO: 197379 - RNA, 22 nt, Human
gaaccagccugcuuccggagag

SEQ ID NO: 197380 - RNA, 18 nt, Human
gaagagaggccgggagcc

SEQ ID NO: 197381 - RNA, 25 nt, Human
gccaccgagggaggaggcgagggcc

SEQ ID NO: 197382 - RNA, 22 nt, Human
ggacaccgcaagaaaacccaaa

SEQ ID NO: 197383 - RNA, 24 nt, Human
ggacugggugggugggcgcgcggg

SEQ ID NO: 197384 - RNA, 20 nt, Human
ggagacgggagccggacacc

SEQ ID NO: 197385 - RNA, 23 nt, Human
ggagccagggagacgggagccgg

SEQ ID NO: 197386 - RNA, 21 nt, Human
ggccgcagggcgggcggggga

SEQ ID NO: 197387 - RNA, 22 nt, Human
gggccgcagggcgggcggggga

SEQ ID NO: 197388 - RNA, 19 nt, Human
gggcgcuggggccgcaggg

SEQ ID NO: 197389 - RNA, 21 nt, Human
gggcgcuggggccgcagggcg

SEQ ID NO: 197390 - RNA, 21 nt, Human
ggugggugggcgcgcggggag

SEQ ID NO: 197391 - RNA, 18 nt, Human
uagaaaaaaaaaaaaaac

SEQ ID NO: 197392 - RNA, 22 nt, Human
uagcuaagcccuaagagcuaaa

SEQ ID NO: 197393 - RNA, 24 nt, Human
uagcuaagcccuaagagcuaaauu

SEQ ID NO: 197394 - RNA, 22 nt, Human
ucaaacaccucacagucgaacc

SEQ ID NO: 197395 - RNA, 22 nt, Human
uccucgcgggcuggaugagagc

SEQ ID NO: 197396 - RNA, 21 nt, Human
ucggagcagcguggggcgaag

SEQ ID NO: 197397 - RNA, 22 nt, Human
ugaggaagagaggccgggagcc

SEQ ID NO: 197398 - RNA, 21 nt, Human
uuuacaaauuuaaggcguccu

SEQ ID NO: 197399 - RNA, 23 nt, Human
uuuuuuuuuuuuuuuuuuaaccg

SEQ ID NO: 197400 - RNA, 22 nt, Human
aaaucuaaaaaucacacccacu

SEQ ID NO: 197401 - RNA, 22 nt, Human
aggccacagaggccuggcugga

SEQ ID NO: 197402 - RNA, 22 nt, Human
cagaggagggccaagaaaggga

SEQ ID NO: 197403 - RNA, 23 nt, Human
ccaagaaagggagaaggaaacaa

SEQ ID NO: 197404 - RNA, 22 nt, Human
ccaccuggcucccggggagggg

SEQ ID NO: 197405 - RNA, 18 nt, Human
ccagcuccgguugcugca

SEQ ID NO: 197406 - RNA, 21 nt, Human
cccugagaggcucgggcacca

SEQ ID NO: 197407 - RNA, 20 nt, Human
ccuccugugcccucuaccgg

SEQ ID NO: 197408 - RNA, 24 nt, Human
ccuccugugcccucuaccggugca

SEQ ID NO: 197409 - RNA, 18 nt, Human
ccugcaggguguggggag

SEQ ID NO: 197410 - RNA, 21 nt, Human
ccuggagcugcccuuggccuc

SEQ ID NO: 197411 - RNA, 19 nt, Human
ccuggcucccggggagggg

SEQ ID NO: 197412 - RNA, 23 nt, Human
cguucgggauccgacuccagcuc

SEQ ID NO: 197413 - RNA, 20 nt, Human
cugcagcagggacgcaggcg

SEQ ID NO: 197414 - RNA, 18 nt, Human
cugcccccugcccugucc

SEQ ID NO: 197415 - RNA, 18 nt, Human
cugcccccugcccugucc

SEQ ID NO: 197416 - RNA, 26 nt, Human
cugcugcccccugcccuguccuggag

SEQ ID NO: 197417 - RNA, 22 nt, Human
cuggcccugagaggcucgggca

SEQ ID NO: 197418 - RNA, 23 nt, Human
cugucuggucuggcccugagagg

SEQ ID NO: 197419 - RNA, 18 nt, Human
gagcagaggagggccaag

SEQ ID NO: 197420 - RNA, 23 nt, Human
gagggccaagaaagggagaagga

SEQ ID NO: 197421 - RNA, 22 nt, Human
gccaagaaagggagaaggaaac

SEQ ID NO: 197422 - RNA, 18 nt, Human
ggagcugcccuuggccuc

SEQ ID NO: 197423 - RNA, 18 nt, Human
ggguguggggaggagcag

SEQ ID NO: 197424 - RNA, 22 nt, Human
gguauccugcugcccccugccc

SEQ ID NO: 197425 - RNA, 30 nt, Human
ucuaaaaaucacacccacuuuucccaccuu

SEQ ID NO: 197426 - RNA, 19 nt, Human
ugaggcaaaaucaguccac

SEQ ID NO: 197427 - RNA, 18 nt, Human
ugccugcagggugugggg

SEQ ID NO: 197428 - RNA, 21 nt, Human
ugcugcccccugcccuguccu

SEQ ID NO: 197429 - RNA, 22 nt, Human
gagaaacuuuaauguaugcuaa

SEQ ID NO: 197430 - RNA, 23 nt, Human
aaaaaacaaagaaaaucugaaag

SEQ ID NO: 197431 - RNA, 21 nt, Human
aaaaaucacuaaggaggggga

SEQ ID NO: 197432 - RNA, 19 nt, Human
aaaaaugcuccacaagaca

SEQ ID NO: 197433 - RNA, 19 nt, Human
aaaacaaaaacaaaaacaa

SEQ ID NO: 197434 - RNA, 25 nt, Human
aaaacaaaaacaaaaacaaaaacaa

SEQ ID NO: 197435 - RNA, 26 nt, Human
aaaacaaaaacaaaaacaaugaacaa

SEQ ID NO: 197436 - RNA, 23 nt, Human
aaaacaaaaacaaugaacaacca

SEQ ID NO: 197437 - RNA, 25 nt, Human
aaaacaaaacaaacaaaaaugaacc

SEQ ID NO: 197438 - RNA, 26 nt, Human
aaaacaaacaaaaaugaaccagaaag

SEQ ID NO: 197439 - RNA, 25 nt, Human
aaaacaaugaacaaccaaaaaaccc

SEQ ID NO: 197440 - RNA, 23 nt, Human
aaaaguacaguaauaucuacagg

SEQ ID NO: 197441 - RNA, 26 nt, Human
aaacaaaaacaaaaacaaaaacaaug

SEQ ID NO: 197442 - RNA, 23 nt, Human
aaacaaaaacaaugaacaaccaa

SEQ ID NO: 197443 - RNA, 22 nt, Human
aaacaaaacaaaacaaaacaaa

SEQ ID NO: 197444 - RNA, 22 nt, Human
aaacaaaacaaaacaaaacaaa

SEQ ID NO: 197445 - RNA, 21 nt, Human
aaacaaaacaaaacaaacaaa

SEQ ID NO: 197446 - RNA, 28 nt, Human
aaacaaaacaaacaaaaaugaaccagaa

SEQ ID NO: 197447 - RNA, 21 nt, Human
aaacaagcacaucaacuucuu

SEQ ID NO: 197448 - RNA, 21 nt, Human
aaacaggcaaggagaugcuga

SEQ ID NO: 197449 - RNA, 18 nt, Human
aaagaaaacaggcaagga

SEQ ID NO: 197450 - RNA, 27 nt, Human
aacaaaacaaaacaaaacaaacaaaaa

SEQ ID NO: 197451 - RNA, 19 nt, Human
aacacagcaagaccucauc

SEQ ID NO: 197452 - RNA, 20 nt, Human
aacacagcaagaccucaucu

SEQ ID NO: 197453 - RNA, 21 nt, Human
aagaagacaggaauucccuca

SEQ ID NO: 197454 - RNA, 19 nt, Human
aagaaugaugauccuggac

SEQ ID NO: 197455 - RNA, 21 nt, Human
aagcaaaaauaacccccagag

SEQ ID NO: 197456 - RNA, 18 nt, Human
aagcuccuuucuuuggag

SEQ ID NO: 197457 - RNA, 23 nt, Human
aaggaaaaaacaaaacuccagaa

SEQ ID NO: 197458 - RNA, 20 nt, Human
aagugauguguagcuuugcu

SEQ ID NO: 197459 - RNA, 20 nt, Human
aaugaacaaccaaaaaaccc

SEQ ID NO: 197460 - RNA, 28 nt, Human
acaaaacaaaacaaaacaaacaaaaaag

SEQ ID NO: 197461 - RNA, 27 nt, Human
acaaaacaaacaaaaaugaaccagaaa

SEQ ID NO: 197462 - RNA, 18 nt, Human
acaaaacuccagaauggg

SEQ ID NO: 197463 - RNA, 21 nt, Human
acaaagcaucuggcagaagga

SEQ ID NO: 197464 - RNA, 18 nt, Human
accgcacuccagccuggg

SEQ ID NO: 197465 - RNA, 23 nt, Human
accgcacuccagccugggcaaca

SEQ ID NO: 197466 - RNA, 23 nt, Human
acuucauuuacugccuccucacu

SEQ ID NO: 197467 - RNA, 19 nt, Human
agaaacucuccuucagaac

SEQ ID NO: 197468 - RNA, 19 nt, Human
agacaaaugucaaacaagc

SEQ ID NO: 197469 - RNA, 22 nt, Human
agagaggagguggcacagaccu

SEQ ID NO: 197470 - RNA, 19 nt, Human
agaugcugagaagacagga

SEQ ID NO: 197471 - RNA, 18 nt, Human
agcaaaaauaacccccag

SEQ ID NO: 197472 - RNA, 23 nt, Human
agcaaaaaugcuccacaagacau

SEQ ID NO: 197473 - RNA, 26 nt, Human
agcaagaagcuccuuuccuccccugg

SEQ ID NO: 197474 - RNA, 23 nt, Human
agcagugcuagcaaugcugcaca

SEQ ID NO: 197475 - RNA, 24 nt, Human
agccaccgcacuccagccugggca

SEQ ID NO: 197476 - RNA, 23 nt, Human
agccugggcaacacagcaagacc

SEQ ID NO: 197477 - RNA, 24 nt, Human
agccugggcaacacagcaagaccu

SEQ ID NO: 197478 - RNA, 19 nt, Human
aggaaaauacagaagagca

SEQ ID NO: 197479 - RNA, 19 nt, Human
aggagggggaaggaaggga

SEQ ID NO: 197480 - RNA, 18 nt, Human
agggggaaggaagggaag

SEQ ID NO: 197481 - RNA, 19 nt, Human
agggggaaggaagggaagc

SEQ ID NO: 197482 - RNA, 21 nt, Human
agguauugugcuagccuguaa

SEQ ID NO: 197483 - RNA, 24 nt, Human
auacagaaaacuuggcauuucaac

SEQ ID NO: 197484 - RNA, 24 nt, Human
auagcaauagauaauaaugggguc

SEQ ID NO: 197485 - RNA, 22 nt, Human
auagccaccgcacuccagccug

SEQ ID NO: 197486 - RNA, 23 nt, Human
augagaaacagaaauaugaggag

SEQ ID NO: 197487 - RNA, 21 nt, Human
auggggucuuauucuaaaaaa

SEQ ID NO: 197488 - RNA, 20 nt, Human
caaaaauaacccccagaggc

SEQ ID NO: 197489 - RNA, 23 nt, Human
caaaacaaaaacaaaaacaaaaa

SEQ ID NO: 197490 - RNA, 23 nt, Human
caaaacaaaacaaaacaaaacaa

SEQ ID NO: 197491 - RNA, 24 nt, Human
caaaacaaaacaaaacaaaacaaa

SEQ ID NO: 197492 - RNA, 21 nt, Human
caaaacaaaacaaaacaaaca

SEQ ID NO: 197493 - RNA, 24 nt, Human
caaaacaaaacaaaacaaacaaaa

SEQ ID NO: 197494 - RNA, 21 nt, Human
caaggaaagcaaaaauaaccc

SEQ ID NO: 197495 - RNA, 20 nt, Human
caaguaaaaacacuuaugga

SEQ ID NO: 197496 - RNA, 23 nt, Human
caagugacuauuuugaaugauau

SEQ ID NO: 197497 - RNA, 21 nt, Human
caaugcugcacaaaacugaac

SEQ ID NO: 197498 - RNA, 18 nt, Human
cacaaaacugaacacaaa

SEQ ID NO: 197499 - RNA, 22 nt, Human
cacaagcaaagggaucugcacu

SEQ ID NO: 197500 - RNA, 25 nt, Human
caccgcacuccagccugggcaacac

SEQ ID NO: 197501 - RNA, 21 nt, Human
caccuaucuagaucuaugaau

SEQ ID NO: 197502 - RNA, 22 nt, Human
cacuuauacagaaaacuuggca

SEQ ID NO: 197503 - RNA, 23 nt, Human
cagaaccucucuuuccuuuugcu

SEQ ID NO: 197504 - RNA, 19 nt, Human
cagaaggaaaaaacaaaac

SEQ ID NO: 197505 - RNA, 19 nt, Human
cagcuagguaagaaaacug

SEQ ID NO: 197506 - RNA, 18 nt, Human
caggacacaaagcaucug

SEQ ID NO: 197507 - RNA, 23 nt, Human
cagugcuagcaaugcugcacaaa

SEQ ID NO: 197508 - RNA, 24 nt, Human
cagugucaaaacaaaaacaaaaac

SEQ ID NO: 197509 - RNA, 25 nt, Human
cauccgggucaccuaguaagcugaa

SEQ ID NO: 197510 - RNA, 28 nt, Human
ccaaaaaacccugagguaagaaucagaa

SEQ ID NO: 197511 - RNA, 20 nt, Human
ccaccgcacuccagccuggg

SEQ ID NO: 197512 - RNA, 20 nt, Human
ccaccgcacuccagccuggg

SEQ ID NO: 197513 - RNA, 21 nt, Human
ccaccgcacuccagccugggc

SEQ ID NO: 197514 - RNA, 24 nt, Human
ccaccgcacuccagccugggcaac

SEQ ID NO: 197515 - RNA, 19 nt, Human
cccuuuccucagcugcuuc

SEQ ID NO: 197516 - RNA, 20 nt, Human
ccucacauggauucagcagu

SEQ ID NO: 197517 - RNA, 21 nt, Human
ccucuguuuacaagugaccuu

SEQ ID NO: 197518 - RNA, 22 nt, Human
ccugcagugguguggggcccag

SEQ ID NO: 197519 - RNA, 21 nt, Human
ccugccugcaguggugugggg

SEQ ID NO: 197520 - RNA, 24 nt, Human
ccugggcaacacagcaagaccuca

SEQ ID NO: 197521 - RNA, 19 nt, Human
cuaaaaaauugccaaguga

SEQ ID NO: 197522 - RNA, 19 nt, Human
cucacaaguaaaaacacuu

SEQ ID NO: 197523 - RNA, 24 nt, Human
cucacugagcacagaggagagagg

SEQ ID NO: 197524 - RNA, 23 nt, Human
cucagccccucucaaucgccuuc

SEQ ID NO: 197525 - RNA, 25 nt, Human
cucaucuguaaacaaaacaaaacaa

SEQ ID NO: 197526 - RNA, 21 nt, Human
cugcucccucauuuggcuucc

SEQ ID NO: 197527 - RNA, 18 nt, Human
cuggcagaaggaaaaaac

SEQ ID NO: 197528 - RNA, 20 nt, Human
cuggucacaaaagcagugcu

SEQ ID NO: 197529 - RNA, 22 nt, Human
cuguuuacaagugaccuuuucc

SEQ ID NO: 197530 - RNA, 20 nt, Human
cuucugccauagacagugag

SEQ ID NO: 197531 - RNA, 20 nt, Human
gacaaggagucuaagagaag

SEQ ID NO: 197532 - RNA, 20 nt, Human
gacacaaagcaucuggcaga

SEQ ID NO: 197533 - RNA, 23 nt, Human
gauguguagcuuugcuuuauaga

SEQ ID NO: 197534 - RNA, 24 nt, Human
gcacaucaacuucuuaaaaaacaa

SEQ ID NO: 197535 - RNA, 23 nt, Human
gcaggaaggggccuagggccaaa

SEQ ID NO: 197536 - RNA, 20 nt, Human
gcagugucaaaacaaaaaca

SEQ ID NO: 197537 - RNA, 22 nt, Human
gccaccgcacuccagccugggc

SEQ ID NO: 197538 - RNA, 18 nt, Human
ggaaagacagcauuucag

SEQ ID NO: 197539 - RNA, 19 nt, Human
ggaaagcaaaaauaacccc

SEQ ID NO: 197540 - RNA, 21 nt, Human
ggaaagcaaaaauaaccccca

SEQ ID NO: 197541 - RNA, 29 nt, Human
ggaagcucauauacauguugcugcuccac

SEQ ID NO: 197542 - RNA, 22 nt, Human
ggaauucccucaguuuucacuu

SEQ ID NO: 197543 - RNA, 27 nt, Human
ggagagaggagguggcacagaccuggu

SEQ ID NO: 197544 - RNA, 21 nt, Human
gggcaggaaggggccuagggc

SEQ ID NO: 197545 - RNA, 23 nt, Human
gggcaggaaggggccuagggcca

SEQ ID NO: 197546 - RNA, 31 nt, Human
gugucaaaacaaaaacaaaaacaaaaacaaa

SEQ ID NO: 197547 - RNA, 22 nt, Human
guugcuguuguuuuccuuugga

SEQ ID NO: 197548 - RNA, 21 nt, Human
uaaaaagaaacaaagaaaucu

SEQ ID NO: 197549 - RNA, 25 nt, Human
uaaaaucagucagaaauaaaauacc

SEQ ID NO: 197550 - RNA, 23 nt, Human
uaaacaaaacaaaacaaaacaaa

SEQ ID NO: 197551 - RNA, 21 nt, Human
uacagaagagcaagagaacug

SEQ ID NO: 197552 - RNA, 22 nt, Human
uacaguaauaucuacaggugua

SEQ ID NO: 197553 - RNA, 21 nt, Human
uaccuugucucccuuuccuca

SEQ ID NO: 197554 - RNA, 23 nt, Human
uaccuugucucccuuuccucagc

SEQ ID NO: 197555 - RNA, 22 nt, Human
uagcaacaugacagguaguucu

SEQ ID NO: 197556 - RNA, 21 nt, Human
uagccaccgcacuccagccug

SEQ ID NO: 197557 - RNA, 22 nt, Human
uaggaaacacagccuugcucca

SEQ ID NO: 197558 - RNA, 23 nt, Human
uaggaaacacagccuugcuccac

SEQ ID NO: 197559 - RNA, 22 nt, Human
uagggcagcaaucacaaagcca

SEQ ID NO: 197560 - RNA, 21 nt, Human
uaugcagauccacuuuaacag

SEQ ID NO: 197561 - RNA, 24 nt, Human
ucaaaacaaaaacaaaaacaaaaa

SEQ ID NO: 197562 - RNA, 25 nt, Human
ucaaaacaaaaacaaaaacaaaaac

SEQ ID NO: 197563 - RNA, 22 nt, Human
ucaacuucuuaaaaaacaaaga

SEQ ID NO: 197564 - RNA, 24 nt, Human
ucacaagcaaagggaucugcacuc

SEQ ID NO: 197565 - RNA, 23 nt, Human
ucacaaguaaaaacacuuauggg

SEQ ID NO: 197566 - RNA, 24 nt, Human
ucacauggauucagcaguuaaugg

SEQ ID NO: 197567 - RNA, 22 nt, Human
ucacuaaggagggggaaggaag

SEQ ID NO: 197568 - RNA, 18 nt, Human
ucacugagcacagaggag

SEQ ID NO: 197569 - RNA, 20 nt, Human
ucagaaccucucuuuccuuu

SEQ ID NO: 197570 - RNA, 22 nt, Human
ucagaaccucucuuuccuuuug

SEQ ID NO: 197571 - RNA, 18 nt, Human
ucauauacauguugcugc

SEQ ID NO: 197572 - RNA, 20 nt, Human
uccaaacacauguacacaag

SEQ ID NO: 197573 - RNA, 18 nt, Human
uccacaagacauugucaa

SEQ ID NO: 197574 - RNA, 19 nt, Human
uccacagaggacaauuccc

SEQ ID NO: 197575 - RNA, 27 nt, Human
uccacagaggacaauucccucagcccc

SEQ ID NO: 197576 - RNA, 18 nt, Human
uccauggauggcuucuca

SEQ ID NO: 197577 - RNA, 22 nt, Human
uccuggaccauguuauggccuu

SEQ ID NO: 197578 - RNA, 18 nt, Human
ucuagcuugggcuuugca

SEQ ID NO: 197579 - RNA, 24 nt, Human
ucuguaaacaaaacaaaacaaaac

SEQ ID NO: 197580 - RNA, 26 nt, Human
ucuguaaacaaaacaaaacaaaacaa

SEQ ID NO: 197581 - RNA, 28 nt, Human
ucugugaauagccaccgcacuccagccu

SEQ ID NO: 197582 - RNA, 21 nt, Human
ucuugaaaucucaugcauucc

SEQ ID NO: 197583 - RNA, 20 nt, Human
ugaauagccaccgcacucca

SEQ ID NO: 197584 - RNA, 26 nt, Human
ugagcacagaggagagaggagguggc

SEQ ID NO: 197585 - RNA, 20 nt, Human
ugagggcuggcacccacuga

SEQ ID NO: 197586 - RNA, 22 nt, Human
ugccaagugaugguaugugggu

SEQ ID NO: 197587 - RNA, 18 nt, Human
ugcucugcagugucaaaa

SEQ ID NO: 197588 - RNA, 25 nt, Human
ugcugagcaaccaguuaguccagag

SEQ ID NO: 197589 - RNA, 19 nt, Human
ugcugcucccucauuuggc

SEQ ID NO: 197590 - RNA, 21 nt, Human
uggcacccacugagcaccgug

SEQ ID NO: 197591 - RNA, 24 nt, Human
uggcacccacugagcaccgugugg

SEQ ID NO: 197592 - RNA, 19 nt, Human
uggcagaaauagcagauga

SEQ ID NO: 197593 - RNA, 19 nt, Human
uggcaucugaaucccagcc

SEQ ID NO: 197594 - RNA, 18 nt, Human
uggcauuucaacaguucc

SEQ ID NO: 197595 - RNA, 18 nt, Human
uggcuacagaaggaagac

SEQ ID NO: 197596 - RNA, 19 nt, Human
uuagggcagcaaucacaaa

SEQ ID NO: 197597 - RNA, 22 nt, Human
uuccucacaaguaaaaacacuu

SEQ ID NO: 197598 - RNA, 22 nt, Human
uugugaaaaugauuucauacug

SEQ ID NO: 197599 - RNA, 21 nt, Human
uugugcucugcagugucaaaa

SEQ ID NO: 197600 - RNA, 24 nt, Human
uuguugcuguuguuuuccuuugga

SEQ ID NO: 197601 - RNA, 18 nt, Human
uuucagaagcaagcugcu

SEQ ID NO: 197602 - RNA, 19 nt, Human
agcagugagaaggagccac

SEQ ID NO: 197603 - RNA, 20 nt, Human
caccccagguaaguccccac

SEQ ID NO: 197604 - RNA, 20 nt, Human
cacccccaccagggucccuc

SEQ ID NO: 197605 - RNA, 21 nt, Human
ccaccagggucccucggcugg

SEQ ID NO: 197606 - RNA, 18 nt, Human
cccagguaaguccccaca

SEQ ID NO: 197607 - RNA, 18 nt, Human
cccucggcuggaggagag

SEQ ID NO: 197608 - RNA, 19 nt, Human
gagaaggagccacccccac

SEQ ID NO: 197609 - RNA, 21 nt, Human
uaaguccccacaaggcagcuu

SEQ ID NO: 197610 - RNA, 19 nt, Human
ugagaaggagccaccccca

SEQ ID NO: 197611 - RNA, 19 nt, Human
ugcgggggacaccccaggu

SEQ ID NO: 197612 - RNA, 20 nt, Human
uuuaaaaaguccggauccag

SEQ ID NO: 197613 - RNA, 21 nt, Human
agagagcaauguccccaccac

SEQ ID NO: 197614 - RNA, 24 nt, Human
agagagggcgcccccaaaccaaaa

SEQ ID NO: 197615 - RNA, 20 nt, Human
agagcaauguccccaccacc

SEQ ID NO: 197616 - RNA, 20 nt, Human
agauggggcuugggccccuu

SEQ ID NO: 197617 - RNA, 25 nt, Human
agcaccccccuccauuggccacacc

SEQ ID NO: 197618 - RNA, 27 nt, Human
agggaacagugaaggagcagagagggc

SEQ ID NO: 197619 - RNA, 19 nt, Human
agugaaggagcagagaggg

SEQ ID NO: 197620 - RNA, 20 nt, Human
caccccccuccauuggccac

SEQ ID NO: 197621 - RNA, 22 nt, Human
caccccccuccauuggccacac

SEQ ID NO: 197622 - RNA, 26 nt, Human
caggccccacuaugggaagccagagg

SEQ ID NO: 197623 - RNA, 19 nt, Human
cagggcaguggaguagggc

SEQ ID NO: 197624 - RNA, 23 nt, Human
caggggaacccucccaggcccca

SEQ ID NO: 197625 - RNA, 21 nt, Human
ccaaccuaguacggggacuag

SEQ ID NO: 197626 - RNA, 20 nt, Human
ccacaccugcugcugccagg

SEQ ID NO: 197627 - RNA, 21 nt, Human
cccaaaccaaaagcccagaga

SEQ ID NO: 197628 - RNA, 19 nt, Human
cccagagagcaaugucccc

SEQ ID NO: 197629 - RNA, 22 nt, Human
cccagagagcaauguccccacc

SEQ ID NO: 197630 - RNA, 23 nt, Human
ccccaccaccaagggagugggga

SEQ ID NO: 197631 - RNA, 21 nt, Human
ccccacguggugacaaagacu

SEQ ID NO: 197632 - RNA, 24 nt, Human
cccccaaaccaaaagcccagagag

SEQ ID NO: 197633 - RNA, 23 nt, Human
ccugggggccagcaccccccucc

SEQ ID NO: 197634 - RNA, 23 nt, Human
cgcccccaaaccaaaagcccaga

SEQ ID NO: 197635 - RNA, 24 nt, Human
cucccaggccccacuaugggaagc

SEQ ID NO: 197636 - RNA, 22 nt, Human
cucuaaggagcagguggaagag

SEQ ID NO: 197637 - RNA, 20 nt, Human
gcaccccccuccauuggcca

SEQ ID NO: 197638 - RNA, 20 nt, Human
gcagagagggcgcccccaaa

SEQ ID NO: 197639 - RNA, 23 nt, Human
gccaggaugagauggggcuuggg

SEQ ID NO: 197640 - RNA, 19 nt, Human
gggaagccagagggaacag

SEQ ID NO: 197641 - RNA, 21 nt, Human
gggcaguggaguagggcgugc

SEQ ID NO: 197642 - RNA, 23 nt, Human
gggcuugggccccuuuuaaggcc

SEQ ID NO: 197643 - RNA, 22 nt, Human
ggggacuagggaaguuggggaa

SEQ ID NO: 197644 - RNA, 22 nt, Human
guggugacaaagacaguuuggc

SEQ ID NO: 197645 - RNA, 19 nt, Human
uaaggagcagguggaagag

SEQ ID NO: 197646 - RNA, 23 nt, Human
ugaaaagugagccccacguggug

SEQ ID NO: 197647 - RNA, 21 nt, Human
ugaaggagcagagagggcgcc

SEQ ID NO: 197648 - RNA, 21 nt, Human
ugcagggugcggcuaaguggg

SEQ ID NO: 197649 - RNA, 20 nt, Human
ugccaggaugagauggggcu

SEQ ID NO: 197650 - RNA, 18 nt, Human
ugcugccagggcagugga

SEQ ID NO: 197651 - RNA, 22 nt, Human
ugcugcugccagggcaguggag

SEQ ID NO: 197652 - RNA, 20 nt, Human
uggcugggauggccuucuug

SEQ ID NO: 197653 - RNA, 22 nt, Human
uggcugggggaauccugggggc

SEQ ID NO: 197654 - RNA, 22 nt, Human
uggggaaggaugaaaagugagc

SEQ ID NO: 197655 - RNA, 18 nt, Human
uuggagccgcgccagcgc

SEQ ID NO: 197656 - RNA, 23 nt, Human
uuggcugggggaauccugggggc

SEQ ID NO: 197657 - RNA, 23 nt, Human
aaaaaagaaaacaguaauuaaaa

SEQ ID NO: 197658 - RNA, 21 nt, Human
aaaaacguguuccuuucuauc

SEQ ID NO: 197659 - RNA, 20 nt, Human
aaaagaaaacaguaauuaaa

SEQ ID NO: 197660 - RNA, 23 nt, Human
aaacuaccuccuggcccaguuga

SEQ ID NO: 197661 - RNA, 19 nt, Human
aaagaauuccuccuccucu

SEQ ID NO: 197662 - RNA, 22 nt, Human
aaagacacagagagagauugcc

SEQ ID NO: 197663 - RNA, 23 nt, Human
aaagagaagaggggaggaggagg

SEQ ID NO: 197664 - RNA, 19 nt, Human
aacaccggacguccagcgg

SEQ ID NO: 197665 - RNA, 18 nt, Human
aacagcaaagaacagucc

SEQ ID NO: 197666 - RNA, 18 nt, Human
aacagugagcgaucugcc

SEQ ID NO: 197667 - RNA, 21 nt, Human
aacugcugcugagguagaaau

SEQ ID NO: 197668 - RNA, 22 nt, Human
aacuugcagaaaugguagaaaa

SEQ ID NO: 197669 - RNA, 22 nt, Human
aagaaccuaggagcgacuuggu

SEQ ID NO: 197670 - RNA, 20 nt, Human
aagaagcguuuaaaauaaaa

SEQ ID NO: 197671 - RNA, 22 nt, Human
aagagaagaggggaggaggagg

SEQ ID NO: 197672 - RNA, 19 nt, Human
aagaggaggagggaagcga

SEQ ID NO: 197673 - RNA, 20 nt, Human
aaggaagagaggcuuugagg

SEQ ID NO: 197674 - RNA, 18 nt, Human
aaguaguaucuaguccuu

SEQ ID NO: 197675 - RNA, 19 nt, Human
aauugugucccuugaaaug

SEQ ID NO: 197676 - RNA, 20 nt, Human
acacucaaaggaacagggag

SEQ ID NO: 197677 - RNA, 22 nt, Human
acagagagagauugcccccccc

SEQ ID NO: 197678 - RNA, 24 nt, Human
acagcaauucuacauaaagaacaa

SEQ ID NO: 197679 - RNA, 18 nt, Human
acccaauucgguuuuucu

SEQ ID NO: 197680 - RNA, 20 nt, Human
accccaccccaccccacccc

SEQ ID NO: 197681 - RNA, 22 nt, Human
accccaccccaccccaccccag

SEQ ID NO: 197682 - RNA, 21 nt, Human
accccaccccccccuccccca

SEQ ID NO: 197683 - RNA, 22 nt, Human
accccaccccccccucccccac

SEQ ID NO: 197684 - RNA, 20 nt, Human
accccccccucccccacccc

SEQ ID NO: 197685 - RNA, 21 nt, Human
acccugcgagagagagagaga

SEQ ID NO: 197686 - RNA, 21 nt, Human
acggagcacaggcagaggaca

SEQ ID NO: 197687 - RNA, 25 nt, Human
acuucggaagcggcuuggaaaggga

SEQ ID NO: 197688 - RNA, 20 nt, Human
acuugcagaaaugguagaaa

SEQ ID NO: 197689 - RNA, 20 nt, Human
agaaaugguagaaaaguuaa

SEQ ID NO: 197690 - RNA, 29 nt, Human
agaagaggggaggaggaggaggagaggag

SEQ ID NO: 197691 - RNA, 20 nt, Human
agaaggaagagaggcuuuga

SEQ ID NO: 197692 - RNA, 28 nt, Human
agaauuccuccuccucuuccccccaccc

SEQ ID NO: 197693 - RNA, 25 nt, Human
agacagcaauucuacauaaagaaca

SEQ ID NO: 197694 - RNA, 18 nt, Human
agagacagagagagagag

SEQ ID NO: 197695 - RNA, 22 nt, Human
agagagagaaagacacagagag

SEQ ID NO: 197696 - RNA, 23 nt, Human
agagagagagagacagagagaga

SEQ ID NO: 197697 - RNA, 18 nt, Human
agaggaggagggaagcga

SEQ ID NO: 197698 - RNA, 24 nt, Human
agagggagagagagagagaaagac

SEQ ID NO: 197699 - RNA, 28 nt, Human
agaggggaggaggaggaggagaggagga

SEQ ID NO: 197700 - RNA, 20 nt, Human
agaugaggugauagggcugg

SEQ ID NO: 197701 - RNA, 20 nt, Human
agccauacugacaaaagccc

SEQ ID NO: 197702 - RNA, 19 nt, Human
agcgagggagaaggaagag

SEQ ID NO: 197703 - RNA, 20 nt, Human
aggaacagggagaaagucaa

SEQ ID NO: 197704 - RNA, 18 nt, Human
aggaggaggagaggagga

SEQ ID NO: 197705 - RNA, 20 nt, Human
aggaggaggaggagaggagg

SEQ ID NO: 197706 - RNA, 20 nt, Human
aggaggaggcgcugccggug

SEQ ID NO: 197707 - RNA, 18 nt, Human
aggaggagggaagcgagg

SEQ ID NO: 197708 - RNA, 31 nt, Human
aggaggcgcugccgguggcggcggcggcggg

SEQ ID NO: 197709 - RNA, 19 nt, Human
aggcgcugccgguggcggc

SEQ ID NO: 197710 - RNA, 26 nt, Human
agggaagcgagggagaaggaagagag

SEQ ID NO: 197711 - RNA, 18 nt, Human
agguagcaagaggaggag

SEQ ID NO: 197712 - RNA, 19 nt, Human
aggucuuucauggaaacug

SEQ ID NO: 197713 - RNA, 18 nt, Human
agguggagguagcaagag

SEQ ID NO: 197714 - RNA, 21 nt, Human
aguacuaaaagccauacugac

SEQ ID NO: 197715 - RNA, 21 nt, Human
aguggguggcaccgcgccucc

SEQ ID NO: 197716 - RNA, 20 nt, Human
aguggucacugcagugucuu

SEQ ID NO: 197717 - RNA, 23 nt, Human
aguguuauuuauugcuaaauggc

SEQ ID NO: 197718 - RNA, 19 nt, Human
auuccuccuccucuucccc

SEQ ID NO: 197719 - RNA, 18 nt, Human
caaaagccgucaugagaa

SEQ ID NO: 197720 - RNA, 20 nt, Human
caaaagccgucaugagaaac

SEQ ID NO: 197721 - RNA, 19 nt, Human
caaaaguauguaaaaacgu

SEQ ID NO: 197722 - RNA, 20 nt, Human
caaacauugaaaaaacaaau

SEQ ID NO: 197723 - RNA, 21 nt, Human
caacaacagcaaagaacaguc

SEQ ID NO: 197724 - RNA, 27 nt, Human
caacaacagcaaagaacaguccuauaa

SEQ ID NO: 197725 - RNA, 22 nt, Human
caacagcaaagaacaguccuau

SEQ ID NO: 197726 - RNA, 21 nt, Human
caccccaccccaccccacccc

SEQ ID NO: 197727 - RNA, 21 nt, Human
caccccaccccaccccagaug

SEQ ID NO: 197728 - RNA, 26 nt, Human
caccccaccccccccucccccacccc

SEQ ID NO: 197729 - RNA, 18 nt, Human
caccccccccucccccac

SEQ ID NO: 197730 - RNA, 20 nt, Human
caccccccccucccccaccc

SEQ ID NO: 197731 - RNA, 24 nt, Human
caccccccccucccccaccccacc

SEQ ID NO: 197732 - RNA, 22 nt, Human
cagucggaaagcaaaggaggau

SEQ ID NO: 197733 - RNA, 24 nt, Human
cauggaaacugauaccgucagaga

SEQ ID NO: 197734 - RNA, 24 nt, Human
cauguuaaaaagucagcacacuca

SEQ ID NO: 197735 - RNA, 19 nt, Human
cauuaugcaaaagcagggc

SEQ ID NO: 197736 - RNA, 25 nt, Human
ccaacaacagcaaagaacaguccua

SEQ ID NO: 197737 - RNA, 24 nt, Human
ccaccaucaacaccggacguccag

SEQ ID NO: 197738 - RNA, 18 nt, Human
ccaccccaccccacccca

SEQ ID NO: 197739 - RNA, 18 nt, Human
ccaccccaccccacccca

SEQ ID NO: 197740 - RNA, 22 nt, Human
ccaccccaccccaccccagaug

SEQ ID NO: 197741 - RNA, 19 nt, Human
ccaccccaccccccccucc

SEQ ID NO: 197742 - RNA, 18 nt, Human
cccaccccaccccacccc

SEQ ID NO: 197743 - RNA, 20 nt, Human
cccaccccaccccaccccac

SEQ ID NO: 197744 - RNA, 22 nt, Human
cccaccccaccccaccccagau

SEQ ID NO: 197745 - RNA, 24 nt, Human
cccaccccaccccaccccagauga

SEQ ID NO: 197746 - RNA, 25 nt, Human
cccaccccaccccaccccagaugaa

SEQ ID NO: 197747 - RNA, 27 nt, Human
cccaccccaccccccccucccccaccc

SEQ ID NO: 197748 - RNA, 25 nt, Human
cccaccccccccucccccaccccac

SEQ ID NO: 197749 - RNA, 22 nt, Human
ccccaccccaccccaccccaga

SEQ ID NO: 197750 - RNA, 24 nt, Human
ccccaccccaccccaccccagaug

SEQ ID NO: 197751 - RNA, 18 nt, Human
ccccaccccccccucccc

SEQ ID NO: 197752 - RNA, 21 nt, Human
ccccaccccccccucccccac

SEQ ID NO: 197753 - RNA, 23 nt, Human
ccccagaugaaaguggaaagacc

SEQ ID NO: 197754 - RNA, 22 nt, Human
cccccaccccaccccaccccac

SEQ ID NO: 197755 - RNA, 25 nt, Human
cccccaccccaccccaccccacccc

SEQ ID NO: 197756 - RNA, 24 nt, Human
ccccccccucccccaccccacccc

SEQ ID NO: 197757 - RNA, 22 nt, Human
cccccccuuuuuuuuuuugcuu

SEQ ID NO: 197758 - RNA, 26 nt, Human
ccccccucccccaccccaccccaccc

SEQ ID NO: 197759 - RNA, 19 nt, Human
ccccccuuuuuuuuuuugc

SEQ ID NO: 197760 - RNA, 18 nt, Human
cccccuuuuuuuuuuugc

SEQ ID NO: 197761 - RNA, 22 nt, Human
ccccucccccaccccaccccac

SEQ ID NO: 197762 - RNA, 22 nt, Human
ccccuuuuuuuuuuugcuuuuu

SEQ ID NO: 197763 - RNA, 19 nt, Human
ccgccgcuaccgccgcugc

SEQ ID NO: 197764 - RNA, 19 nt, Human
ccgccgcuaccgccgcugc

SEQ ID NO: 197765 - RNA, 24 nt, Human
ccgccgcuaccgccgcugcagccg

SEQ ID NO: 197766 - RNA, 21 nt, Human
ccgccgcugcagccgcuucgg

SEQ ID NO: 197767 - RNA, 20 nt, Human
ccgcugccaccaucaacacc

SEQ ID NO: 197768 - RNA, 27 nt, Human
ccggagguggagguggcgguggaggug

SEQ ID NO: 197769 - RNA, 19 nt, Human
ccuacaaagcuucaaguuc

SEQ ID NO: 197770 - RNA, 25 nt, Human
ccucccccaccccaccccaccccac

SEQ ID NO: 197771 - RNA, 23 nt, Human
ccucccgccgccgcuaccgccgc

SEQ ID NO: 197772 - RNA, 19 nt, Human
ccuccuaggguggcgggag

SEQ ID NO: 197773 - RNA, 23 nt, Human
ccuccuaggguggcgggagcagg

SEQ ID NO: 197774 - RNA, 22 nt, Human
ccuccucuuccccccacccugc

SEQ ID NO: 197775 - RNA, 22 nt, Human
ccucucgcggguugggaucagg

SEQ ID NO: 197776 - RNA, 19 nt, Human
cgcgcugcccgggcuggaa

SEQ ID NO: 197777 - RNA, 19 nt, Human
cgcugccaccaucaacacc

SEQ ID NO: 197778 - RNA, 23 nt, Human
cggagguggagguggcgguggag

SEQ ID NO: 197779 - RNA, 22 nt, Human
cgggcaccgggagcacuucgga

SEQ ID NO: 197780 - RNA, 18 nt, Human
cggguugggaucaggagu

SEQ ID NO: 197781 - RNA, 19 nt, Human
cuaccgccgcugcagccgc

SEQ ID NO: 197782 - RNA, 19 nt, Human
cucccccaccccaccccac

SEQ ID NO: 197783 - RNA, 26 nt, Human
cucccccaccccaccccaccccaccc

SEQ ID NO: 197784 - RNA, 20 nt, Human
cuccuccucuuccccccacc

SEQ ID NO: 197785 - RNA, 21 nt, Human
cugagucuugcaccaagcgcg

SEQ ID NO: 197786 - RNA, 26 nt, Human
cugccaaaaagagaagaggggaggag

SEQ ID NO: 197787 - RNA, 18 nt, Human
cugccaccaucaacaccg

SEQ ID NO: 197788 - RNA, 23 nt, Human
cugcccgggcuggaaguuuucug

SEQ ID NO: 197789 - RNA, 20 nt, Human
cuggcccaguugauaauacc

SEQ ID NO: 197790 - RNA, 23 nt, Human
gaaaaaacaaaugaaugcugcaa

SEQ ID NO: 197791 - RNA, 19 nt, Human
gaaagcaaaggaggauggg

SEQ ID NO: 197792 - RNA, 21 nt, Human
gacagugauaauacacuagag

SEQ ID NO: 197793 - RNA, 25 nt, Human
gaccaacaacagcaaagaacagucc

SEQ ID NO: 197794 - RNA, 18 nt, Human
gagaagaggggaggagga

SEQ ID NO: 197795 - RNA, 18 nt, Human
gagagauugccccccccu

SEQ ID NO: 197796 - RNA, 21 nt, Human
gaggacagaguaguggguggc

SEQ ID NO: 197797 - RNA, 26 nt, Human
gaggaggaggcgcugccgguggcggc

SEQ ID NO: 197798 - RNA, 18 nt, Human
gaggagggaagcgaggga

SEQ ID NO: 197799 - RNA, 22 nt, Human
gaggauggggagacuccgccgg

SEQ ID NO: 197800 - RNA, 22 nt, Human
gaggggaggaggaggaggagag

SEQ ID NO: 197801 - RNA, 18 nt, Human
gagguagcaagaggagga

SEQ ID NO: 197802 - RNA, 19 nt, Human
gaguugcgggcaccgggag

SEQ ID NO: 197803 - RNA, 20 nt, Human
gauuucgcuccucccaccuc

SEQ ID NO: 197804 - RNA, 20 nt, Human
gcaauauuuguuugcuuacu

SEQ ID NO: 197805 - RNA, 25 nt, Human
gcaauucuacauaaagaacaaagaa

SEQ ID NO: 197806 - RNA, 22 nt, Human
gcagugucuucucccuucaaaa

SEQ ID NO: 197807 - RNA, 23 nt, Human
gccccaagauucaaggggaugag

SEQ ID NO: 197808 - RNA, 20 nt, Human
gccccggagcugcccagcac

SEQ ID NO: 197809 - RNA, 21 nt, Human
gccucccgccgccgcuaccgc

SEQ ID NO: 197810 - RNA, 21 nt, Human
gcgaccaacaacagcaaagaa

SEQ ID NO: 197811 - RNA, 21 nt, Human
gcgcgcugcccgggcuggaag

SEQ ID NO: 197812 - RNA, 22 nt, Human
gcugcccagcaccuuucgggag

SEQ ID NO: 197813 - RNA, 19 nt, Human
ggaagagacuuggagugaa

SEQ ID NO: 197814 - RNA, 20 nt, Human
ggagaggaggaggcgcugcc

SEQ ID NO: 197815 - RNA, 18 nt, Human
ggagagucggagggggac

SEQ ID NO: 197816 - RNA, 21 nt, Human
gggaggaggaggaggagagga

SEQ ID NO: 197817 - RNA, 23 nt, Human
gggcacggagcacaggcagagga

SEQ ID NO: 197818 - RNA, 25 nt, Human
gggcagucggaaagcaaaggaggau

SEQ ID NO: 197819 - RNA, 23 nt, Human
gggcgagcgcgagcuggcgggcu

SEQ ID NO: 197820 - RNA, 22 nt, Human
ggggaggaggaggaggagagga

SEQ ID NO: 197821 - RNA, 19 nt, Human
gguggcggcggcggcggug

SEQ ID NO: 197822 - RNA, 20 nt, Human
gguggcggcggcggcggugg

SEQ ID NO: 197823 - RNA, 23 nt, Human
guaguauugaguaguggggauau

SEQ ID NO: 197824 - RNA, 22 nt, Human
guggcggcggcggcggugggug

SEQ ID NO: 197825 - RNA, 19 nt, Human
gugugugugagugugugug

SEQ ID NO: 197826 - RNA, 21 nt, Human
uaacuguaauuaaguguacaa

SEQ ID NO: 197827 - RNA, 19 nt, Human
uaauuugagguaaguggua

SEQ ID NO: 197828 - RNA, 18 nt, Human
uacaaagcuucaaguucu

SEQ ID NO: 197829 - RNA, 21 nt, Human
uacauagucaugcugaaacac

SEQ ID NO: 197830 - RNA, 21 nt, Human
uaccgccgcugcagccgcuuc

SEQ ID NO: 197831 - RNA, 19 nt, Human
uaccuaacuugcagaaaug

SEQ ID NO: 197832 - RNA, 22 nt, Human
uacuugucuaguuuccuuaaau

SEQ ID NO: 197833 - RNA, 20 nt, Human
uagaagacacucaaaggaac

SEQ ID NO: 197834 - RNA, 21 nt, Human
uagcagagaagcugaaacaag

SEQ ID NO: 197835 - RNA, 20 nt, Human
uagcuccugagucuugcacc

SEQ ID NO: 197836 - RNA, 19 nt, Human
uagcugcgaccaacaacag

SEQ ID NO: 197837 - RNA, 19 nt, Human
uaggguggcgggagcaggc

SEQ ID NO: 197838 - RNA, 22 nt, Human
uaguauugaguaguggggauau

SEQ ID NO: 197839 - RNA, 19 nt, Human
uaguccuuaucuuuggugu

SEQ ID NO: 197840 - RNA, 23 nt, Human
uaguggguggcaccgcgccuccu

SEQ ID NO: 197841 - RNA, 18 nt, Human
uagugugauugaggaaaa

SEQ ID NO: 197842 - RNA, 18 nt, Human
ucaaaagauccaacugcu

SEQ ID NO: 197843 - RNA, 20 nt, Human
ucaaaagauccaacugcugc

SEQ ID NO: 197844 - RNA, 19 nt, Human
ucaaacauugaaaaaacaa

SEQ ID NO: 197845 - RNA, 24 nt, Human
ucaggaguugcgggcaccgggagc

SEQ ID NO: 197846 - RNA, 18 nt, Human
ucaguacuaaaagccaua

SEQ ID NO: 197847 - RNA, 18 nt, Human
uccaaagauauggaaugc

SEQ ID NO: 197848 - RNA, 22 nt, Human
uccauaaauagaagaguuggca

SEQ ID NO: 197849 - RNA, 23 nt, Human
ucccacaaaaauaaacuauauau

SEQ ID NO: 197850 - RNA, 19 nt, Human
uccccaccccacccccccc

SEQ ID NO: 197851 - RNA, 21 nt, Human
uccccaccccaccccccccuc

SEQ ID NO: 197852 - RNA, 31 nt, Human
uccccaccccaccccccccucccccaccccc

SEQ ID NO: 197853 - RNA, 23 nt, Human
ucccgccgccgcuaccgccgcug

SEQ ID NO: 197854 - RNA, 20 nt, Human
uccuccuccucuucccccca

SEQ ID NO: 197855 - RNA, 20 nt, Human
ucucccacaaaaauaaacua

SEQ ID NO: 197856 - RNA, 19 nt, Human
ucuccccaccccacccccc

SEQ ID NO: 197857 - RNA, 23 nt, Human
ucuccugcaaacauaccuaacuu

SEQ ID NO: 197858 - RNA, 23 nt, Human
ugaaaaaacaaaugaaugcugca

SEQ ID NO: 197859 - RNA, 22 nt, Human
ugaaaagagagagggagaggga

SEQ ID NO: 197860 - RNA, 19 nt, Human
ugaaaaugaaguguugucc

SEQ ID NO: 197861 - RNA, 23 nt, Human
ugaaauguuaggcggggaaagaa

SEQ ID NO: 197862 - RNA, 20 nt, Human
ugaagucuggagguaggucu

SEQ ID NO: 197863 - RNA, 18 nt, Human
ugaaguguuguccugaaa

SEQ ID NO: 197864 - RNA, 22 nt, Human
ugagaaacuaccuccuggccca

SEQ ID NO: 197865 - RNA, 25 nt, Human
ugagguaagugguauucaggucuuu

SEQ ID NO: 197866 - RNA, 20 nt, Human
ugagguauacugggacuuaa

SEQ ID NO: 197867 - RNA, 22 nt, Human
ugagugugugugagugugugug

SEQ ID NO: 197868 - RNA, 23 nt, Human
ugauguauaacuauagcaaaaga

SEQ ID NO: 197869 - RNA, 22 nt, Human
ugauuucuccccaccccacccc

SEQ ID NO: 197870 - RNA, 23 nt, Human
ugcccgggcuggaaguuuucuga

SEQ ID NO: 197871 - RNA, 18 nt, Human
ugccgguggcggcggcgg

SEQ ID NO: 197872 - RNA, 22 nt, Human
ugcgggcaccgggagcacuucg

SEQ ID NO: 197873 - RNA, 24 nt, Human
uggagguggagguagcaagaggag

SEQ ID NO: 197874 - RNA, 19 nt, Human
uggcggcggcggcgguggg

SEQ ID NO: 197875 - RNA, 21 nt, Human
uggcggcggcggcggugggug

SEQ ID NO: 197876 - RNA, 22 nt, Human
uggcggcggcggcggugggugg

SEQ ID NO: 197877 - RNA, 24 nt, Human
uggcgggcugcgagggcugcuguu

SEQ ID NO: 197878 - RNA, 27 nt, Human
uguagcugcgaccaacaacagcaaaga

SEQ ID NO: 197879 - RNA, 22 nt, Human
uguccccuguguuuacagcagu

SEQ ID NO: 197880 - RNA, 24 nt, Human
ugugacacguuucuuguuugcaug

SEQ ID NO: 197881 - RNA, 19 nt, Human
ugugaguguguguggugug

SEQ ID NO: 197882 - RNA, 20 nt, Human
ugugaguguguguggugugu

SEQ ID NO: 197883 - RNA, 20 nt, Human
ugugugagugugagugugug

SEQ ID NO: 197884 - RNA, 21 nt, Human
ugugugagugugagugugugu

SEQ ID NO: 197885 - RNA, 20 nt, Human
ugugugagugugugugagug

SEQ ID NO: 197886 - RNA, 21 nt, Human
ugugugagugugugugagugu

SEQ ID NO: 197887 - RNA, 21 nt, Human
uguuuacagcaguuuuucacu

SEQ ID NO: 197888 - RNA, 19 nt, Human
uucaaguuaauguagaaau

SEQ ID NO: 197889 - RNA, 20 nt, Human
uucaguaugaaaaaugaggu

SEQ ID NO: 197890 - RNA, 18 nt, Human
uucuccccaccccacccc

SEQ ID NO: 197891 - RNA, 20 nt, Human
uuggggugguauuugaggug

SEQ ID NO: 197892 - RNA, 22 nt, Human
uugucaagcauuuucuuauauu

SEQ ID NO: 197893 - RNA, 25 nt, Human
uuuaauuaaaaaaacauagaaaaau

SEQ ID NO: 197894 - RNA, 24 nt, Human
uuuaauucucuccauagcuccuuu

SEQ ID NO: 197895 - RNA, 22 nt, Human
aaaacaaaucuuacacagccuu

SEQ ID NO: 197896 - RNA, 23 nt, Human
aagaaaaaaaaacugcgcuagaa

SEQ ID NO: 197897 - RNA, 27 nt, Human
aagaaccugcuuuaaauuuccaugcca

SEQ ID NO: 197898 - RNA, 18 nt, Human
aagcugcaucagagacaa

SEQ ID NO: 197899 - RNA, 20 nt, Human
acacuguacaguuuaaaaac

SEQ ID NO: 197900 - RNA, 23 nt, Human
accaggcaagguuaguggcuauu

SEQ ID NO: 197901 - RNA, 25 nt, Human
acuaccauccccauauauaacuaau

SEQ ID NO: 197902 - RNA, 19 nt, Human
acuuuuuuuuuuuuugcaa

SEQ ID NO: 197903 - RNA, 19 nt, Human
agacaagaaaaaaaaacug

SEQ ID NO: 197904 - RNA, 25 nt, Human
agacaagaaaaaaaaacugcgcuag

SEQ ID NO: 197905 - RNA, 26 nt, Human
agacaagaaaaaaaaacugcgcuaga

SEQ ID NO: 197906 - RNA, 26 nt, Human
aucagagacaacugaagaugaaaaaa

SEQ ID NO: 197907 - RNA, 19 nt, Human
caagaaaaaaaaacugcgc

SEQ ID NO: 197908 - RNA, 18 nt, Human
cacuguacaguuuaaaaa

SEQ ID NO: 197909 - RNA, 21 nt, Human
caugccaauuuacaaccccca

SEQ ID NO: 197910 - RNA, 21 nt, Human
ccaacaagaaccugcuuuaaa

SEQ ID NO: 197911 - RNA, 22 nt, Human
ccaggacagggcuaucuaaaga

SEQ ID NO: 197912 - RNA, 20 nt, Human
ccauccccauauauaacuaa

SEQ ID NO: 197913 - RNA, 23 nt, Human
ccguccggcucucacuugccccc

SEQ ID NO: 197914 - RNA, 23 nt, Human
cugugcaccaacaagaaccugcu

SEQ ID NO: 197915 - RNA, 26 nt, Human
gaaccugcuuuaaauuuccaugccaa

SEQ ID NO: 197916 - RNA, 19 nt, Human
gacacauucgguagugugu

SEQ ID NO: 197917 - RNA, 23 nt, Human
gcauucagaaugucaacaaaaca

SEQ ID NO: 197918 - RNA, 20 nt, Human
gugcccguccggcucucacu

SEQ ID NO: 197919 - RNA, 18 nt, Human
uaaaaggagugaguugug

SEQ ID NO: 197920 - RNA, 23 nt, Human
uacaaaaaaagacacuguacagu

SEQ ID NO: 197921 - RNA, 18 nt, Human
uacuguaccaggcaaggu

SEQ ID NO: 197922 - RNA, 21 nt, Human
uauacaaaaaaagacacugua

SEQ ID NO: 197923 - RNA, 26 nt, Human
uauacaaaaaaagacacuguacaguu

SEQ ID NO: 197924 - RNA, 20 nt, Human
uauagacaagaaaaaaaaac

SEQ ID NO: 197925 - RNA, 23 nt, Human
uccccauauauaacuaauuugug

SEQ ID NO: 197926 - RNA, 23 nt, Human
ugcugugcaccaacaagaaccug

SEQ ID NO: 197927 - RNA, 24 nt, Human
aaacgaaaugcaacauccuaaaaa

SEQ ID NO: 197928 - RNA, 18 nt, Human
acacauuccacacgcauc

SEQ ID NO: 197929 - RNA, 22 nt, Human
agcccaucaaaaagcuacaacc

SEQ ID NO: 197930 - RNA, 20 nt, Human
caaaauaauugccugagcaa

SEQ ID NO: 197931 - RNA, 21 nt, Human
caacauccuaaaaaacccaaa

SEQ ID NO: 197932 - RNA, 23 nt, Human
cacacagaaauuaaaaaaaccau

SEQ ID NO: 197933 - RNA, 19 nt, Human
cagaagcuguaaaaucuaa

SEQ ID NO: 197934 - RNA, 22 nt, Human
ccacacgcaucauuaaaggaua

SEQ ID NO: 197935 - RNA, 27 nt, Human
ccggacccaacggagacgguggaccuc

SEQ ID NO: 197936 - RNA, 23 nt, Human
ccuaaaaaacccaaaauuuacua

SEQ ID NO: 197937 - RNA, 21 nt, Human
cuccggcgugaacugguuuau

SEQ ID NO: 197938 - RNA, 25 nt, Human
gaaaugcaacauccuaaaaaaccca

SEQ ID NO: 197939 - RNA, 21 nt, Human
uaagacaaagacaauagaaau

SEQ ID NO: 197940 - RNA, 22 nt, Human
uacacacagaaauuaaaaaaac

SEQ ID NO: 197941 - RNA, 22 nt, Human
uaguauugagcugcacuugaau

SEQ ID NO: 197942 - RNA, 19 nt, Human
uauuuaggaacauucaaca

SEQ ID NO: 197943 - RNA, 22 nt, Human
ucagccucuuguuuugcagagu

SEQ ID NO: 197944 - RNA, 28 nt, Human
uccacacgcaucauuaaaggauagccag

SEQ ID NO: 197945 - RNA, 24 nt, Human
uccgcgccacggcaacuugacgag

SEQ ID NO: 197946 - RNA, 23 nt, Human
uccuacaaguuugcugugcuacc

SEQ ID NO: 197947 - RNA, 22 nt, Human
ucucuaacgcaauccucagccu

SEQ ID NO: 197948 - RNA, 27 nt, Human
ugagcacacacacacauuccacacgca

SEQ ID NO: 197949 - RNA, 22 nt, Human
ugcgagcuuuuccucagagucc

SEQ ID NO: 197950 - RNA, 22 nt, Human
uggugcgagcuuuuccucagag

SEQ ID NO: 197951 - RNA, 20 nt, Human
uguuuugcagaguucuccga

SEQ ID NO: 197952 - RNA, 24 nt, Human
uucuccgcgccacggcaacuugac

SEQ ID NO: 197953 - RNA, 19 nt, Human
uucucuacagagaaucuua

SEQ ID NO: 197954 - RNA, 21 nt, Human
aaaaacaaacaguuuaaaaac

SEQ ID NO: 197955 - RNA, 21 nt, Human
aaaaagaaaaugccagaaaca

SEQ ID NO: 197956 - RNA, 20 nt, Human
aaaacauuucagcauucuaa

SEQ ID NO: 197957 - RNA, 20 nt, Human
aaaaugccagaaacaucuuu

SEQ ID NO: 197958 - RNA, 22 nt, Human
aaacaagacaaccugaagcuaa

SEQ ID NO: 197959 - RNA, 23 nt, Human
aaacaagacaaccugaagcuaaa

SEQ ID NO: 197960 - RNA, 22 nt, Human
aaccauaguuaccaccaccuua

SEQ ID NO: 197961 - RNA, 21 nt, Human
acaaggagacagauaaacagu

SEQ ID NO: 197962 - RNA, 23 nt, Human
acagaaacaagacaaccugaagc

SEQ ID NO: 197963 - RNA, 21 nt, Human
acaguuucagggugcuccaga

SEQ ID NO: 197964 - RNA, 20 nt, Human
acauacaaaaaaaauaacag

SEQ ID NO: 197965 - RNA, 25 nt, Human
agacacccauggccacuucauguaa

SEQ ID NO: 197966 - RNA, 25 nt, Human
agagaagaguucuaaaaauguaaua

SEQ ID NO: 197967 - RNA, 21 nt, Human
agcaaggagcaucaaggguuu

SEQ ID NO: 197968 - RNA, 19 nt, Human
aguagagaagaguucuaaa

SEQ ID NO: 197969 - RNA, 24 nt, Human
auacaaaaaaaauaacagaacguu

SEQ ID NO: 197970 - RNA, 24 nt, Human
aucuuccccacagccucaacgccg

SEQ ID NO: 197971 - RNA, 19 nt, Human
caaacuauagauauauaca

SEQ ID NO: 197972 - RNA, 24 nt, Human
caaauaaaaagaaaaugccagaaa

SEQ ID NO: 197973 - RNA, 23 nt, Human
caccaacagcaaagugcacagag

SEQ ID NO: 197974 - RNA, 18 nt, Human
cacuauauacagaaacaa

SEQ ID NO: 197975 - RNA, 24 nt, Human
cagaaacaagacaaccugaagcua

SEQ ID NO: 197976 - RNA, 20 nt, Human
cagcaaagugcacagaguga

SEQ ID NO: 197977 - RNA, 21 nt, Human
ccaacagcaaagugcacagag

SEQ ID NO: 197978 - RNA, 25 nt, Human
ccacagccucaacgccgagcaagga

SEQ ID NO: 197979 - RNA, 18 nt, Human
ccagacacccauggccac

SEQ ID NO: 197980 - RNA, 20 nt, Human
ccccacagccucaacgccga

SEQ ID NO: 197981 - RNA, 21 nt, Human
ccccacagccucaacgccgag

SEQ ID NO: 197982 - RNA, 22 nt, Human
ccccuacucuaaguauucacaa

SEQ ID NO: 197983 - RNA, 25 nt, Human
ccugagcuacagccucucccaaaag

SEQ ID NO: 197984 - RNA, 19 nt, Human
ccugcagagucaacagguc

SEQ ID NO: 197985 - RNA, 27 nt, Human
ccuuuucauuuuaaaaauguuuggaaa

SEQ ID NO: 197986 - RNA, 19 nt, Human
cugagcuacagccucuccc

SEQ ID NO: 197987 - RNA, 25 nt, Human
cuuacaaauaaaaagaaaaugccag

SEQ ID NO: 197988 - RNA, 18 nt, Human
gacucuuugcuuugcuga

SEQ ID NO: 197989 - RNA, 20 nt, Human
gagaagaguucuaaaaaugu

SEQ ID NO: 197990 - RNA, 22 nt, Human
gaugcagugacucuuugcuuug

SEQ ID NO: 197991 - RNA, 18 nt, Human
ggagacagauaaacaguu

SEQ ID NO: 197992 - RNA, 23 nt, Human
uaacuucaaaaacauuucagcau

SEQ ID NO: 197993 - RNA, 26 nt, Human
uacaaauaaaaagaaaaugccagaaa

SEQ ID NO: 197994 - RNA, 20 nt, Human
uacaauaugaucgugaucaa

SEQ ID NO: 197995 - RNA, 24 nt, Human
uacagaaacaagacaaccugaagc

SEQ ID NO: 197996 - RNA, 22 nt, Human
uacaguuucagggugcuccaga

SEQ ID NO: 197997 - RNA, 23 nt, Human
uaguagagaagaguucuaaaaau

SEQ ID NO: 197998 - RNA, 22 nt, Human
uaguuaccaccaccuuacaaau

SEQ ID NO: 197999 - RNA, 23 nt, Human
uauacagaaacaagacaaccuga

SEQ ID NO: 198000 - RNA, 21 nt, Human
ucucaugccagcugacccccc

SEQ ID NO: 198001 - RNA, 24 nt, Human
ucucaugccagcugaccccccuuu

SEQ ID NO: 198002 - RNA, 22 nt, Human
ucucccaaaaggcaucuucccc

SEQ ID NO: 198003 - RNA, 21 nt, Human
ugacuguuauaguagagaaga

SEQ ID NO: 198004 - RNA, 19 nt, Human
ugaggagaacacgagagug

SEQ ID NO: 198005 - RNA, 25 nt, Human
ugcacagagugaggagaacacgaga

SEQ ID NO: 198006 - RNA, 22 nt, Human
uggaaauauguacaacuuugau

SEQ ID NO: 198007 - RNA, 21 nt, Human
uguuauaguagagaagaguuc

SEQ ID NO: 198008 - RNA, 23 nt, Human
uguuuuguucuuuuuacaaacua

SEQ ID NO: 198009 - RNA, 23 nt, Human
uuaaaugccuugucacaccaaca

SEQ ID NO: 198010 - RNA, 23 nt, Human
uugucacaccaacagcaaagugc

SEQ ID NO: 198011 - RNA, 24 nt, Human
uuguuuuguucuuuuuacaaacua

SEQ ID NO: 198012 - RNA, 21 nt, Human
aagcagcuccuccugcccuuc

SEQ ID NO: 198013 - RNA, 20 nt, Human
caacuccugggccagggucc

SEQ ID NO: 198014 - RNA, 19 nt, Human
ccaagcagcuccuccugcc

SEQ ID NO: 198015 - RNA, 24 nt, Human
cccacggccauggcaggguggagc

SEQ ID NO: 198016 - RNA, 20 nt, Human
ccccacggccauggcagggu

SEQ ID NO: 198017 - RNA, 19 nt, Human
ccccagggcuucagguggg

SEQ ID NO: 198018 - RNA, 24 nt, Human
ccuauucucauuuccaugucccca

SEQ ID NO: 198019 - RNA, 20 nt, Human
ccucaggucugggcaggagg

SEQ ID NO: 198020 - RNA, 21 nt, Human
ccuucugccaagcagcuccuc

SEQ ID NO: 198021 - RNA, 18 nt, Human
cucaaagccucucacucc

SEQ ID NO: 198022 - RNA, 18 nt, Human
gguccguaacaaagggag

SEQ ID NO: 198023 - RNA, 21 nt, Human
uccacaaauggccucugccag

SEQ ID NO: 198024 - RNA, 24 nt, Human
uccacaaauggccucugccagcuu

SEQ ID NO: 198025 - RNA, 21 nt, Human
uccagagaggagacucaagga

SEQ ID NO: 198026 - RNA, 21 nt, Human
uccucaggucugggcaggagg

SEQ ID NO: 198027 - RNA, 23 nt, Human
ugaugugccauucaaccuuuaau

SEQ ID NO: 198028 - RNA, 23 nt, Human
ugccaagcagcuccuccugcccu

SEQ ID NO: 198029 - RNA, 18 nt, Human
uggagauuuuccagagau

SEQ ID NO: 198030 - RNA, 23 nt, Human
uggagauuuuccagagaugcugg

SEQ ID NO: 198031 - RNA, 20 nt, Human
uggcagacggccaccacgua

SEQ ID NO: 198032 - RNA, 23 nt, Human
uggccagguggccagcucgcgga

SEQ ID NO: 198033 - RNA, 19 nt, Human
ugggcaggagguccuucug

SEQ ID NO: 198034 - RNA, 21 nt, Human
uguguagagcuggcuaugagg

SEQ ID NO: 198035 - RNA, 19 nt, Human
aaaagccuaaugcugaaag

SEQ ID NO: 198036 - RNA, 20 nt, Human
aaaauagaccagcaccaaau

SEQ ID NO: 198037 - RNA, 22 nt, Human
aaaaucaaaauagaccagcacc

SEQ ID NO: 198038 - RNA, 21 nt, Human
aaacaaaaggccucucugaac

SEQ ID NO: 198039 - RNA, 22 nt, Human
aaacaaaaggccucucugaaca

SEQ ID NO: 198040 - RNA, 22 nt, Human
aaacuagaaaaaaguauucuau

SEQ ID NO: 198041 - RNA, 22 nt, Human
aaagagcacagcauguaaagca

SEQ ID NO: 198042 - RNA, 22 nt, Human
aaccugagaccucucugaaaga

SEQ ID NO: 198043 - RNA, 24 nt, Human
aagcuaagagcguucgugggucca

SEQ ID NO: 198044 - RNA, 21 nt, Human
acaaugcagacacaaucaccg

SEQ ID NO: 198045 - RNA, 20 nt, Human
agaaaacagguccccuucug

SEQ ID NO: 198046 - RNA, 20 nt, Human
aggaguuucaucagcuacag

SEQ ID NO: 198047 - RNA, 25 nt, Human
auuauuuauacaaaacuuguacauu

SEQ ID NO: 198048 - RNA, 19 nt, Human
caaaauagaccagcaccaa

SEQ ID NO: 198049 - RNA, 22 nt, Human
caaaauagaccagcaccaaaug

SEQ ID NO: 198050 - RNA, 23 nt, Human
cagaaaaagucacuggcuaaaaa

SEQ ID NO: 198051 - RNA, 19 nt, Human
caucagcuuuccaagagca

SEQ ID NO: 198052 - RNA, 20 nt, Human
ccaaaaucaaaauagaccag

SEQ ID NO: 198053 - RNA, 19 nt, Human
ccaagagcaacacuuaagc

SEQ ID NO: 198054 - RNA, 22 nt, Human
ccagcaccaaaugaaguauuaa

SEQ ID NO: 198055 - RNA, 23 nt, Human
cccaaaaucaaaauagaccagca

SEQ ID NO: 198056 - RNA, 22 nt, Human
ccccaaaaucaaaauagaccag

SEQ ID NO: 198057 - RNA, 24 nt, Human
ccccaaaaucaaaauagaccagca

SEQ ID NO: 198058 - RNA, 24 nt, Human
cccccaaaaucaaaauagaccagc

SEQ ID NO: 198059 - RNA, 23 nt, Human
ccccccaaaaucaaaauagaagc

SEQ ID NO: 198060 - RNA, 19 nt, Human
cccuguguuucuuaaaagc

SEQ ID NO: 198061 - RNA, 23 nt, Human
cccuugaagaaaacagguccccu

SEQ ID NO: 198062 - RNA, 18 nt, Human
ccucucugaaagagccaa

SEQ ID NO: 198063 - RNA, 18 nt, Human
ccuuuagaacccaaugcc

SEQ ID NO: 198064 - RNA, 20 nt, Human
cugccacuuccaugaaaagc

SEQ ID NO: 198065 - RNA, 21 nt, Human
cugccaugguuuccuggaaug

SEQ ID NO: 198066 - RNA, 24 nt, Human
cuucccuugaagaaaacagguccc

SEQ ID NO: 198067 - RNA, 23 nt, Human
cuuucagaggugagcuguagauu

SEQ ID NO: 198068 - RNA, 22 nt, Human
gagaccucucugaaagagccaa

SEQ ID NO: 198069 - RNA, 19 nt, Human
gcaagauauuaauuacagu

SEQ ID NO: 198070 - RNA, 18 nt, Human
ggaauaagaguguuucuu

SEQ ID NO: 198071 - RNA, 21 nt, Human
ggcaagcaagccaggguuucc

SEQ ID NO: 198072 - RNA, 25 nt, Human
guggcugucucagugaucacauuua

SEQ ID NO: 198073 - RNA, 22 nt, Human
uaaauuaacuacaaaaucagga

SEQ ID NO: 198074 - RNA, 19 nt, Human
uaacaaugcagacacaauc

SEQ ID NO: 198075 - RNA, 27 nt, Human
uacaaaacuuguacauuaaaggacauc

SEQ ID NO: 198076 - RNA, 25 nt, Human
uacaacagaaaagguaaaucuucca

SEQ ID NO: 198077 - RNA, 22 nt, Human
uacaguuuacaaaaaaaacuag

SEQ ID NO: 198078 - RNA, 18 nt, Human
uacguacaacagaaaagg

SEQ ID NO: 198079 - RNA, 22 nt, Human
uagaaaaaaguauucuauaaca

SEQ ID NO: 198080 - RNA, 18 nt, Human
uaguaaagaauacaaaac

SEQ ID NO: 198081 - RNA, 21 nt, Human
uauagccaauccagacaaaca

SEQ ID NO: 198082 - RNA, 22 nt, Human
uauagccaauccagacaaacau

SEQ ID NO: 198083 - RNA, 22 nt, Human
ucaaaauagaccagcaccaaau

SEQ ID NO: 198084 - RNA, 22 nt, Human
ucacguggcuccuucacuggcu

SEQ ID NO: 198085 - RNA, 23 nt, Human
ucccuugaagaaaacaggucccc

SEQ ID NO: 198086 - RNA, 24 nt, Human
uccuccagaucucacuagaggcca

SEQ ID NO: 198087 - RNA, 21 nt, Human
ucuaagcaacauuaagagcuc

SEQ ID NO: 198088 - RNA, 19 nt, Human
ucuaaggucccagucuugc

SEQ ID NO: 198089 - RNA, 22 nt, Human
ucuccaugcugccaugguuucc

SEQ ID NO: 198090 - RNA, 19 nt, Human
ucuguaguuugggaauaag

SEQ ID NO: 198091 - RNA, 18 nt, Human
ugaaagacauguuauagc

SEQ ID NO: 198092 - RNA, 29 nt, Human
ugaaagacauguuauagccaauccagcuu

SEQ ID NO: 198093 - RNA, 26 nt, Human
ugaacaaauagccugcggagauaaau

SEQ ID NO: 198094 - RNA, 18 nt, Human
ugaagaaaacaggucccc

SEQ ID NO: 198095 - RNA, 25 nt, Human
ugaagaaaacagguccccuucugaa

SEQ ID NO: 198096 - RNA, 20 nt, Human
ugaaguauuaauuuacaaaa

SEQ ID NO: 198097 - RNA, 22 nt, Human
ugauuaccccccaaaaucaaaa

SEQ ID NO: 198098 - RNA, 21 nt, Human
ugcauggaaagaaccugagac

SEQ ID NO: 198099 - RNA, 20 nt, Human
ugcccauguuccaguucaga

SEQ ID NO: 198100 - RNA, 19 nt, Human
uggauccuccagaucucac

SEQ ID NO: 198101 - RNA, 25 nt, Human
uguaguuugggaauaagaguguuuc

SEQ ID NO: 198102 - RNA, 22 nt, Human
uuaaaaauccauuuucaacugg

SEQ ID NO: 198103 - RNA, 22 nt, Human
uuaacuacaaaaucaggaguuu

SEQ ID NO: 198104 - RNA, 19 nt, Human
uuacuucuugaaguucuac

SEQ ID NO: 198105 - RNA, 22 nt, Human
uugguacaguuuacaaaaaaaa

SEQ ID NO: 198106 - RNA, 21 nt, Human
uuuaagcaauuaaaguuggcu

SEQ ID NO: 198107 - RNA, 22 nt, Human
uuuacaaacaugaacuuagaac

SEQ ID NO: 198108 - RNA, 19 nt, Human
accccaugcccaccccacc

SEQ ID NO: 198109 - RNA, 22 nt, Human
accccaugcccaccccacccug

SEQ ID NO: 198110 - RNA, 23 nt, Human
accccaugcccaccccacccuga

SEQ ID NO: 198111 - RNA, 22 nt, Human
acccccaccccaugcccacccc

SEQ ID NO: 198112 - RNA, 19 nt, Human
acccugaagucuugcaccu

SEQ ID NO: 198113 - RNA, 22 nt, Human
acccugaagucuugcaccucac

SEQ ID NO: 198114 - RNA, 24 nt, Human
caacuguucccauacccccacccc

SEQ ID NO: 198115 - RNA, 20 nt, Human
caccccaugcccaccccacc

SEQ ID NO: 198116 - RNA, 27 nt, Human
cacccugaagucuugcaccucacagag

SEQ ID NO: 198117 - RNA, 24 nt, Human
cccaccccacccugaagucuugca

SEQ ID NO: 198118 - RNA, 23 nt, Human
cccauacccccaccccaugccca

SEQ ID NO: 198119 - RNA, 21 nt, Human
ccccaccccaugcccacccca

SEQ ID NO: 198120 - RNA, 21 nt, Human
cccccaccccaugcccacccc

SEQ ID NO: 198121 - RNA, 24 nt, Human
aacagcacagaaguuuaacaauua

SEQ ID NO: 198122 - RNA, 23 nt, Human
aagcagaaacccagcaaccccgg

SEQ ID NO: 198123 - RNA, 23 nt, Human
aagcagaaacccagcaguucaga

SEQ ID NO: 198124 - RNA, 22 nt, Human
aagcccaggacagugauugcag

SEQ ID NO: 198125 - RNA, 18 nt, Human
acagcugaucugcaugca

SEQ ID NO: 198126 - RNA, 23 nt, Human
acccagcaguucagaaacccagc

SEQ ID NO: 198127 - RNA, 18 nt, Human
agagugggaucuuaaaaa

SEQ ID NO: 198128 - RNA, 22 nt, Human
aggaacagcacagaaguuuaac

SEQ ID NO: 198129 - RNA, 25 nt, Human
aggcaccauaagcccaggacaguga

SEQ ID NO: 198130 - RNA, 25 nt, Human
caaaggaccccuaguccauaggcac

SEQ ID NO: 198131 - RNA, 21 nt, Human
cagcaguucagaaacccagca

SEQ ID NO: 198132 - RNA, 19 nt, Human
cccaggaagcuuuccaugg

SEQ ID NO: 198133 - RNA, 19 nt, Human
cuaugucgauucaaauuca

SEQ ID NO: 198134 - RNA, 18 nt, Human
gcuccaucuugcucuuuc

SEQ ID NO: 198135 - RNA, 20 nt, Human
ggggagaagcucugcuagca

SEQ ID NO: 198136 - RNA, 18 nt, Human
gugauucaggaagagguc

SEQ ID NO: 198137 - RNA, 24 nt, Human
uaagcccaggacagugauugcagc

SEQ ID NO: 198138 - RNA, 23 nt, Human
uacaaaauuuggagauucacagg

SEQ ID NO: 198139 - RNA, 20 nt, Human
uagcuuagaacaagguacaa

SEQ ID NO: 198140 - RNA, 19 nt, Human
ucuuucucucuuuuuaauu

SEQ ID NO: 198141 - RNA, 21 nt, Human
uucacaaaggaccccuagucc

SEQ ID NO: 198142 - RNA, 21 nt, Human
uugcuccaucuugcucuuuca

SEQ ID NO: 198143 - RNA, 23 nt, Human
uuucccaggaagcuuuccaugga

SEQ ID NO: 198144 - RNA, 28 nt, Human
uuuuuuuuuuuuucucuuucucucuuuu

SEQ ID NO: 198145 - RNA, 20 nt, Human
aaaaacacccaccccaucaa

SEQ ID NO: 198146 - RNA, 20 nt, Human
aaaagggaacagacucccga

SEQ ID NO: 198147 - RNA, 24 nt, Human
aaacgaacucacuauguucuucac

SEQ ID NO: 198148 - RNA, 20 nt, Human
aacucacuauguucuucacu

SEQ ID NO: 198149 - RNA, 19 nt, Human
aacuugaggucauuaguaa

SEQ ID NO: 198150 - RNA, 23 nt, Human
aagaccuuuuauuuguuuaaaau

SEQ ID NO: 198151 - RNA, 25 nt, Human
agacaaacgaacucacuauguucuu

SEQ ID NO: 198152 - RNA, 21 nt, Human
aggcagggcccugcugagcuc

SEQ ID NO: 198153 - RNA, 18 nt, Human
agggaauacaacuugagg

SEQ ID NO: 198154 - RNA, 22 nt, Human
aggucauuaguaacuaguugaa

SEQ ID NO: 198155 - RNA, 19 nt, Human
cacccaccccaucaacagc

SEQ ID NO: 198156 - RNA, 19 nt, Human
cacuauguucuucacaaag

SEQ ID NO: 198157 - RNA, 23 nt, Human
cacuauguucuucacaaagauca

SEQ ID NO: 198158 - RNA, 20 nt, Human
cagaauuccccaagaccuuu

SEQ ID NO: 198159 - RNA, 21 nt, Human
cagcagagucugagcagacac

SEQ ID NO: 198160 - RNA, 20 nt, Human
cagugcccacacccauuucu

SEQ ID NO: 198161 - RNA, 22 nt, Human
ccaaacagaauuccccaagacc

SEQ ID NO: 198162 - RNA, 22 nt, Human
ccacacccauuucucagugguc

SEQ ID NO: 198163 - RNA, 20 nt, Human
ccagccuugagaguuacauc

SEQ ID NO: 198164 - RNA, 22 nt, Human
cccagguagccaaacagaauuc

SEQ ID NO: 198165 - RNA, 22 nt, Human
cgucgcagucgccgcgcacgca

SEQ ID NO: 198166 - RNA, 24 nt, Human
cucauagaugagaaacaaugaacc

SEQ ID NO: 198167 - RNA, 21 nt, Human
cucgggagaccaggcagggcc

SEQ ID NO: 198168 - RNA, 18 nt, Human
cucuugccuuuccuucag

SEQ ID NO: 198169 - RNA, 23 nt, Human
gagaccaggcagggcccugcuga

SEQ ID NO: 198170 - RNA, 18 nt, Human
ggugcagacuggcgugcc

SEQ ID NO: 198171 - RNA, 21 nt, Human
guaaaaggaacuuugccaagc

SEQ ID NO: 198172 - RNA, 22 nt, Human
guagccaaacagaauuccccaa

SEQ ID NO: 198173 - RNA, 21 nt, Human
gucacucaugcgccgcaggga

SEQ ID NO: 198174 - RNA, 19 nt, Human
gugcagacuggcgugccca

SEQ ID NO: 198175 - RNA, 22 nt, Human
uaaaguacaccaagcgugcagu

SEQ ID NO: 198176 - RNA, 19 nt, Human
uagaugaacagaacagggu

SEQ ID NO: 198177 - RNA, 23 nt, Human
ugaacagaacaggguaaaaggaa

SEQ ID NO: 198178 - RNA, 23 nt, Human
ugauuuaaauaugucugcauuua

SEQ ID NO: 198179 - RNA, 21 nt, Human
ugcauuuagaugaacagaaca

SEQ ID NO: 198180 - RNA, 22 nt, Human
ugccagggaauacaacuugagg

SEQ ID NO: 198181 - RNA, 19 nt, Human
ugcucgggagaccaggcag

SEQ ID NO: 198182 - RNA, 18 nt, Human
uggcacuaaaagggaaca

SEQ ID NO: 198183 - RNA, 22 nt, Human
ugucagugcccacacccauuuc

SEQ ID NO: 198184 - RNA, 24 nt, Human
uuaagguuuccaauaagguuuggg

SEQ ID NO: 198185 - RNA, 18 nt, Human
uugccagggaauacaacu

SEQ ID NO: 198186 - RNA, 22 nt, Human
aaacaacaugguaauagaagua

SEQ ID NO: 198187 - RNA, 21 nt, Human
aaagagugguuuucuuuagga

SEQ ID NO: 198188 - RNA, 22 nt, Human
aagcauuuacacuuaaaaaaug

SEQ ID NO: 198189 - RNA, 23 nt, Human
acaaccagcaaaugauuucaccu

SEQ ID NO: 198190 - RNA, 18 nt, Human
acuuuccagcuuaaaauu

SEQ ID NO: 198191 - RNA, 20 nt, Human
agcuacuaaaaaacuugcau

SEQ ID NO: 198192 - RNA, 22 nt, Human
aggaaaacaggacuaccacaac

SEQ ID NO: 198193 - RNA, 24 nt, Human
aggacugacuccauauugccauuu

SEQ ID NO: 198194 - RNA, 18 nt, Human
auaaaaacuaacccccca

SEQ ID NO: 198195 - RNA, 25 nt, Human
caaaaaauaaacaaccagcaaauga

SEQ ID NO: 198196 - RNA, 24 nt, Human
caauaucccacacuauuuucuggu

SEQ ID NO: 198197 - RNA, 19 nt, Human
cacagcacaguaacaaagu

SEQ ID NO: 198198 - RNA, 20 nt, Human
cacagcacaguaacaaaguu

SEQ ID NO: 198199 - RNA, 21 nt, Human
cagcaaaugauuucaccucuu

SEQ ID NO: 198200 - RNA, 19 nt, Human
cagccuucgcgaaacuggg

SEQ ID NO: 198201 - RNA, 19 nt, Human
ccgcugccacuccucccgc

SEQ ID NO: 198202 - RNA, 20 nt, Human
ccgcugccacuccucccgcc

SEQ ID NO: 198203 - RNA, 23 nt, Human
ccgcugccacuccucccgcccuc

SEQ ID NO: 198204 - RNA, 21 nt, Human
ccuugccgcugccacuccucc

SEQ ID NO: 198205 - RNA, 22 nt, Human
ccuugccgcugccacuccuccc

SEQ ID NO: 198206 - RNA, 23 nt, Human
ccuugccgcugccacuccucccg

SEQ ID NO: 198207 - RNA, 25 nt, Human
cuaccacaaccaaagauguuacaga

SEQ ID NO: 198208 - RNA, 23 nt, Human
cugccuugccgcugccacuccuc

SEQ ID NO: 198209 - RNA, 18 nt, Human
cugcggggaaggcgcgug

SEQ ID NO: 198210 - RNA, 22 nt, Human
gcgcgugccgggugccugcggg

SEQ ID NO: 198211 - RNA, 22 nt, Human
gcgcgugccgggugccugcggg

SEQ ID NO: 198212 - RNA, 18 nt, Human
ggcagagagagccaugau

SEQ ID NO: 198213 - RNA, 21 nt, Human
ggccgcggcgcgccgacagcc

SEQ ID NO: 198214 - RNA, 22 nt, Human
guaacgaaauucuaaaaagcca

SEQ ID NO: 198215 - RNA, 22 nt, Human
guggcggcggggaaggcgcgug

SEQ ID NO: 198216 - RNA, 26 nt, Human
uaaaaaaaagcauuuacacuuaaaaa

SEQ ID NO: 198217 - RNA, 23 nt, Human
uaagaggcuaucaaguaccagua

SEQ ID NO: 198218 - RNA, 19 nt, Human
uacacuuaaaaaaugggau

SEQ ID NO: 198219 - RNA, 26 nt, Human
uaccaaaaaauaaacaaccagcaaau

SEQ ID NO: 198220 - RNA, 27 nt, Human
uaccaaaaaauaaacaaccagcaaaug

SEQ ID NO: 198221 - RNA, 21 nt, Human
uaccaguaucuucacguuggu

SEQ ID NO: 198222 - RNA, 24 nt, Human
uaccaguaucuucacguuggucag

SEQ ID NO: 198223 - RNA, 20 nt, Human
uagaaguaauuuaaaauguu

SEQ ID NO: 198224 - RNA, 22 nt, Human
uaggaaacaauucuacuaaaaa

SEQ ID NO: 198225 - RNA, 24 nt, Human
uaggaaacaauucuacuaaaaaac

SEQ ID NO: 198226 - RNA, 19 nt, Human
uauaaaaacuaacccccca

SEQ ID NO: 198227 - RNA, 19 nt, Human
uaucaaguaccaguaucuu

SEQ ID NO: 198228 - RNA, 23 nt, Human
uauuccagugacuuuccagcuua

SEQ ID NO: 198229 - RNA, 18 nt, Human
ucaagacauuaaaugcag

SEQ ID NO: 198230 - RNA, 21 nt, Human
ucuagagcuacuaaaaaacuu

SEQ ID NO: 198231 - RNA, 24 nt, Human
ucuuucacagcacaguaacaaagu

SEQ ID NO: 198232 - RNA, 25 nt, Human
ugacacccgagacagucagagccuc

SEQ ID NO: 198233 - RNA, 24 nt, Human
ugacuccauauugccauuuaauau

SEQ ID NO: 198234 - RNA, 23 nt, Human
ugccgggugccugcggggaaggc

SEQ ID NO: 198235 - RNA, 19 nt, Human
uggcggcggggaaggcgcg

SEQ ID NO: 198236 - RNA, 24 nt, Human
uuauuccagugacuuuccagcuua

SEQ ID NO: 198237 - RNA, 27 nt, Human
uucaauaucccacacuauuuucugguu

SEQ ID NO: 198238 - RNA, 22 nt, Human
uuguaccaaaaaauaaacaacc

SEQ ID NO: 198239 - RNA, 20 nt, Human
uuuacacuuaaaaaauggga

SEQ ID NO: 198240 - RNA, 24 nt, Human
uuuuuuuuuuuuuuuuuuuauuuu

SEQ ID NO: 198241 - RNA, 19 nt, Human
aaacuagaagggaaaggug

SEQ ID NO: 198242 - RNA, 19 nt, Human
aaacuguacagucaccaga

SEQ ID NO: 198243 - RNA, 20 nt, Human
aacaacuuuucacaagccga

SEQ ID NO: 198244 - RNA, 22 nt, Human
aacucccuucuucaauggacua

SEQ ID NO: 198245 - RNA, 18 nt, Human
aagggaaagguguuuucu

SEQ ID NO: 198246 - RNA, 21 nt, Human
aagggaaagguguuuucucca

SEQ ID NO: 198247 - RNA, 20 nt, Human
aauuuguuuuucuauaccac

SEQ ID NO: 198248 - RNA, 24 nt, Human
agaaagccacuauaaaacccaaug

SEQ ID NO: 198249 - RNA, 22 nt, Human
agagugaggguugacauuucac

SEQ ID NO: 198250 - RNA, 20 nt, Human
caaacuguauccagcuuuau

SEQ ID NO: 198251 - RNA, 25 nt, Human
caacauagcuuuuaaaaaaaaaaaa

SEQ ID NO: 198252 - RNA, 19 nt, Human
caagaggaagucucucaaa

SEQ ID NO: 198253 - RNA, 18 nt, Human
cagcuuuauuaaagauac

SEQ ID NO: 198254 - RNA, 21 nt, Human
ccaagguggccauguguguca

SEQ ID NO: 198255 - RNA, 21 nt, Human
ccacaaggcuuuugugccaag

SEQ ID NO: 198256 - RNA, 20 nt, Human
ccacaaucuagaaauggaac

SEQ ID NO: 198257 - RNA, 26 nt, Human
cccuccuccugggagccaagaggaag

SEQ ID NO: 198258 - RNA, 20 nt, Human
ccuucccccaaaaacaacaa

SEQ ID NO: 198259 - RNA, 18 nt, Human
cuuuugugccaagguggc

SEQ ID NO: 198260 - RNA, 23 nt, Human
gccccuucccccaaaaacaacaa

SEQ ID NO: 198261 - RNA, 20 nt, Human
ggaaagguguuuucuccaca

SEQ ID NO: 198262 - RNA, 21 nt, Human
ggcaucacuggaaaguccaga

SEQ ID NO: 198263 - RNA, 22 nt, Human
gguggcggcggcgacggcagcg

SEQ ID NO: 198264 - RNA, 21 nt, Human
gugcuggacgcgggaugcagc

SEQ ID NO: 198265 - RNA, 22 nt, Human
uacaacaacuuucaaacucccu

SEQ ID NO: 198266 - RNA, 20 nt, Human
uaccaaaaaucagaaagcca

SEQ ID NO: 198267 - RNA, 22 nt, Human
uaccaaaaaucagaaagccacu

SEQ ID NO: 198268 - RNA, 24 nt, Human
uaccaaaaaucagaaagccacuau

SEQ ID NO: 198269 - RNA, 25 nt, Human
uagaaauggaaccacugcucuuuug

SEQ ID NO: 198270 - RNA, 18 nt, Human
uauaaaacuugauaaaaa

SEQ ID NO: 198271 - RNA, 22 nt, Human
ucaggcaggacaugggcagaca

SEQ ID NO: 198272 - RNA, 23 nt, Human
ucccccaaaaacaacaaugaagu

SEQ ID NO: 198273 - RNA, 21 nt, Human
ucucaaaacuagaagggaaag

SEQ ID NO: 198274 - RNA, 20 nt, Human
ugaaaauggcagaauuuauc

SEQ ID NO: 198275 - RNA, 21 nt, Human
ugaaaauggcagaauuuaucu

SEQ ID NO: 198276 - RNA, 20 nt, Human
ugaaagauggaaagggagaa

SEQ ID NO: 198277 - RNA, 18 nt, Human
ugccaagguggccaugug

SEQ ID NO: 198278 - RNA, 19 nt, Human
ugccccuucccccaaaaac

SEQ ID NO: 198279 - RNA, 21 nt, Human
ugccccuucccccaaaaacaa

SEQ ID NO: 198280 - RNA, 23 nt, Human
uggaaccacugcucuuuugacag

SEQ ID NO: 198281 - RNA, 18 nt, Human
uggcaucacuggaaaguc

SEQ ID NO: 198282 - RNA, 19 nt, Human
uguucugugugcuaacaac

SEQ ID NO: 198283 - RNA, 20 nt, Human
uuaucugaagauccacaauc

SEQ ID NO: 198284 - RNA, 19 nt, Human
uucuccacaucaauccagc

SEQ ID NO: 198285 - RNA, 20 nt, Human
uuuaaaaaaaaaaaaaaagu

SEQ ID NO: 198286 - RNA, 26 nt, Human
uuucaaacucccuucuucaauggacu

SEQ ID NO: 198287 - RNA, 18 nt, Human
uuucuauaccacaaggcu

SEQ ID NO: 198288 - RNA, 22 nt, Human
aaaagcaccacugauuauugcu

SEQ ID NO: 198289 - RNA, 23 nt, Human
aaacaccacaguaugcacaggac

SEQ ID NO: 198290 - RNA, 23 nt, Human
aaaccuagguacaaaagcaccac

SEQ ID NO: 198291 - RNA, 24 nt, Human
aaaccuagguacaaaagcaccacu

SEQ ID NO: 198292 - RNA, 26 nt, Human
aagcaaaaaguaaagcaacggacugg

SEQ ID NO: 198293 - RNA, 20 nt, Human
acaccacaguaugcacagga

SEQ ID NO: 198294 - RNA, 25 nt, Human
aucaaccccaauuuuucaugacaau

SEQ ID NO: 198295 - RNA, 20 nt, Human
auugcucuagaaaaacugca

SEQ ID NO: 198296 - RNA, 21 nt, Human
caaaaaguaaagcaacggacu

SEQ ID NO: 198297 - RNA, 21 nt, Human
cacacagcuuccaauauuuaa

SEQ ID NO: 198298 - RNA, 22 nt, Human
cacaguaugcacaggacuaaag

SEQ ID NO: 198299 - RNA, 24 nt, Human
cccaagagauacauaaaaucaacc

SEQ ID NO: 198300 - RNA, 21 nt, Human
cgaccugccucgugccgaauu

SEQ ID NO: 198301 - RNA, 18 nt, Human
cugccucugccgcugcag

SEQ ID NO: 198302 - RNA, 20 nt, Human
cuggaugcugccucugccgc

SEQ ID NO: 198303 - RNA, 23 nt, Human
cuggcgccgccgcuggaugcugc

SEQ ID NO: 198304 - RNA, 20 nt, Human
gcaccacugauuauugcucu

SEQ ID NO: 198305 - RNA, 19 nt, Human
gcagggcacgacguagccc

SEQ ID NO: 198306 - RNA, 20 nt, Human
gcgccgccgcuggaugcugc

SEQ ID NO: 198307 - RNA, 22 nt, Human
gcucuagaaaaacugcaugaaa

SEQ ID NO: 198308 - RNA, 18 nt, Human
ggacuaaauuuuaaagca

SEQ ID NO: 198309 - RNA, 18 nt, Human
guacaaaagcaccacuga

SEQ ID NO: 198310 - RNA, 19 nt, Human
gugaagcaaaaaguaaagc

SEQ ID NO: 198311 - RNA, 21 nt, Human
guuuuuuuuuuuuuuuucugg

SEQ ID NO: 198312 - RNA, 21 nt, Human
uaaaaacaccacaguaugcac

SEQ ID NO: 198313 - RNA, 30 nt, Human
uaaaaacaccacaguaugcacaggacuaaa

SEQ ID NO: 198314 - RNA, 19 nt, Human
uaaaaguugucccaagaga

SEQ ID NO: 198315 - RNA, 19 nt, Human
uaaagcaacggacuggaac

SEQ ID NO: 198316 - RNA, 21 nt, Human
uagguacaaaagcaccacuga

SEQ ID NO: 198317 - RNA, 22 nt, Human
uaugcacaguaaaaacaccaca

SEQ ID NO: 198318 - RNA, 23 nt, Human
ucaaucuuacacacagcuuccaa

SEQ ID NO: 198319 - RNA, 19 nt, Human
ucggugaagcaaaaaguaa

SEQ ID NO: 198320 - RNA, 18 nt, Human
ucugcagacaaguaaacc

SEQ ID NO: 198321 - RNA, 19 nt, Human
ugaagcaaaaaguaaagca

SEQ ID NO: 198322 - RNA, 22 nt, Human
ugcucuagaaaaacugcaugaa

SEQ ID NO: 198323 - RNA, 19 nt, Human
uggccacaacuauccaugu

SEQ ID NO: 198324 - RNA, 18 nt, Human
uggcgccgccgcuggaug

SEQ ID NO: 198325 - RNA, 22 nt, Human
uggcgccgccgcuggaugcugc

SEQ ID NO: 198326 - RNA, 25 nt, Human
uuagcauuuacaaaauacuugguaa

SEQ ID NO: 198327 - RNA, 22 nt, Human
uuuaaaccacaaauagucagca

SEQ ID NO: 198328 - RNA, 20 nt, Human
uuuccaaaaagcaugacuau

SEQ ID NO: 198329 - RNA, 21 nt, Human
uuuccaaaaagcaugacuaug

SEQ ID NO: 198330 - RNA, 21 nt, Human
aacagcaacaucaauaacaac

SEQ ID NO: 198331 - RNA, 20 nt, Human
acaagcaguauaugacaaac

SEQ ID NO: 198332 - RNA, 22 nt, Human
acagcaacaucaauaacaacaa

SEQ ID NO: 198333 - RNA, 23 nt, Human
agguuucagaacaggaggauaau

SEQ ID NO: 198334 - RNA, 23 nt, Human
auuaaauacaacauuauaaaaua

SEQ ID NO: 198335 - RNA, 19 nt, Human
caacaagacgaaugaaaua

SEQ ID NO: 198336 - RNA, 20 nt, Human
caacaagacgaaugaaauaa

SEQ ID NO: 198337 - RNA, 18 nt, Human
caacagguuucucagaug

SEQ ID NO: 198338 - RNA, 21 nt, Human
caggaggauaauaauaugaua

SEQ ID NO: 198339 - RNA, 26 nt, Human
caggauggagccuaagaaccuguaaa

SEQ ID NO: 198340 - RNA, 19 nt, Human
ccagaaacugaaggugacu

SEQ ID NO: 198341 - RNA, 20 nt, Human
ccagaaacugaaggugacug

SEQ ID NO: 198342 - RNA, 23 nt, Human
cuaaagaagcucagacuagaaaa

SEQ ID NO: 198343 - RNA, 18 nt, Human
cucagauuuuuaguguau

SEQ ID NO: 198344 - RNA, 21 nt, Human
cuccagaaacugaaggugacu

SEQ ID NO: 198345 - RNA, 22 nt, Human
gaacuggacaaguagaaggaua

SEQ ID NO: 198346 - RNA, 22 nt, Human
gaccaagugagcauuaucagaa

SEQ ID NO: 198347 - RNA, 18 nt, Human
gcaguuaaaauuaaauac

SEQ ID NO: 198348 - RNA, 21 nt, Human
gccagcuccagaaacugaagg

SEQ ID NO: 198349 - RNA, 23 nt, Human
ggaaagccagcgaaaggguucag

SEQ ID NO: 198350 - RNA, 22 nt, Human
ggauggagccuaagaaccugua

SEQ ID NO: 198351 - RNA, 23 nt, Human
uaaagaagcucagacuagaaaag

SEQ ID NO: 198352 - RNA, 18 nt, Human
uaacaacaagacgaauga

SEQ ID NO: 198353 - RNA, 20 nt, Human
uaacaacaagacgaaugaaa

SEQ ID NO: 198354 - RNA, 22 nt, Human
uaauaacagcaacaucaauaac

SEQ ID NO: 198355 - RNA, 25 nt, Human
uacacaaauguuaaucaaaugcuga

SEQ ID NO: 198356 - RNA, 25 nt, Human
uacauguagaguuucucagauuuuu

SEQ ID NO: 198357 - RNA, 18 nt, Human
uagaaaagaccuccagga

SEQ ID NO: 198358 - RNA, 21 nt, Human
uagaggcaauaacaagccaag

SEQ ID NO: 198359 - RNA, 20 nt, Human
uaugacaaacucugaagaaa

SEQ ID NO: 198360 - RNA, 19 nt, Human
ucaaaagacacuuugguaa

SEQ ID NO: 198361 - RNA, 23 nt, Human
ucaaaagacacuuugguaaaaaa

SEQ ID NO: 198362 - RNA, 18 nt, Human
uccaggaucaagcugaag

SEQ ID NO: 198363 - RNA, 22 nt, Human
uccaggaucaagcugaagaauc

SEQ ID NO: 198364 - RNA, 23 nt, Human
ugaacuggacaaguagaaggaua

SEQ ID NO: 198365 - RNA, 19 nt, Human
ugacaagcaguauaugaca

SEQ ID NO: 198366 - RNA, 24 nt, Human
ugacaagcaguauaugacaaacuu

SEQ ID NO: 198367 - RNA, 21 nt, Human
ugcaagaaaaaauaaaauguc

SEQ ID NO: 198368 - RNA, 20 nt, Human
uggcaguuaaaauuaaauac

SEQ ID NO: 198369 - RNA, 18 nt, Human
uguagaguuucucagauu

SEQ ID NO: 198370 - RNA, 18 nt, Human
ugucaaaagacacuuugg

SEQ ID NO: 198371 - RNA, 18 nt, Human
aaaaacacaagacacaac

SEQ ID NO: 198372 - RNA, 21 nt, Human
aaaaaccaccccaacccugcu

SEQ ID NO: 198373 - RNA, 18 nt, Human
aaaccaccccaacccugc

SEQ ID NO: 198374 - RNA, 19 nt, Human
aacaccucccuccccaccc

SEQ ID NO: 198375 - RNA, 22 nt, Human
acagaacacaacaaaaauacug

SEQ ID NO: 198376 - RNA, 23 nt, Human
accccaacccugcuauaaaaaca

SEQ ID NO: 198377 - RNA, 22 nt, Human
accccuucgcccccucugaagu

SEQ ID NO: 198378 - RNA, 18 nt, Human
accucccuccccacccac

SEQ ID NO: 198379 - RNA, 20 nt, Human
agaacacaacaaaaauacug

SEQ ID NO: 198380 - RNA, 22 nt, Human
agaacacaacaaaaauacugca

SEQ ID NO: 198381 - RNA, 18 nt, Human
agacaaaaacacaagaca

SEQ ID NO: 198382 - RNA, 22 nt, Human
agacaaaaacacaagacacaac

SEQ ID NO: 198383 - RNA, 23 nt, Human
agacaaaaacacaagacacaaca

SEQ ID NO: 198384 - RNA, 26 nt, Human
agagggcuggaggcccugaaagccuu

SEQ ID NO: 198385 - RNA, 19 nt, Human
aggaagccagccaagagaa

SEQ ID NO: 198386 - RNA, 22 nt, Human
agggcuggaggcccugaaagcc

SEQ ID NO: 198387 - RNA, 23 nt, Human
caaaaauacugcauuugaggcug

SEQ ID NO: 198388 - RNA, 22 nt, Human
caacaaggauacuugaaacuca

SEQ ID NO: 198389 - RNA, 18 nt, Human
caacagaacacaacaaaa

SEQ ID NO: 198390 - RNA, 23 nt, Human
cacacaaaaguuagaccaaggcc

SEQ ID NO: 198391 - RNA, 22 nt, Human
cacccacgcauggcucaaaaac

SEQ ID NO: 198392 - RNA, 25 nt, Human
caccccaacccugcuauaaaaacaa

SEQ ID NO: 198393 - RNA, 18 nt, Human
caccucccuccccaccca

SEQ ID NO: 198394 - RNA, 24 nt, Human
cagugccguuaaacaccucccucc

SEQ ID NO: 198395 - RNA, 18 nt, Human
ccacggggaaagugguca

SEQ ID NO: 198396 - RNA, 24 nt, Human
ccacgguaaggaagccagccaaga

SEQ ID NO: 198397 - RNA, 19 nt, Human
ccauaggcuccuuccuccu

SEQ ID NO: 198398 - RNA, 23 nt, Human
cccaacccugcuauaaaaacaac

SEQ ID NO: 198399 - RNA, 19 nt, Human
ccccaacccugcuauaaaa

SEQ ID NO: 198400 - RNA, 27 nt, Human
cccuccccacccacgcauggcucaaaa

SEQ ID NO: 198401 - RNA, 21 nt, Human
cccugaaagccuucagugccc

SEQ ID NO: 198402 - RNA, 21 nt, Human
cgcauggcucaaaaaccaccc

SEQ ID NO: 198403 - RNA, 20 nt, Human
cucaaaaaccaccccaaccc

SEQ ID NO: 198404 - RNA, 21 nt, Human
cucaaaaaccaccccaacccu

SEQ ID NO: 198405 - RNA, 22 nt, Human
cucaaaaaccaccccaacccug

SEQ ID NO: 198406 - RNA, 21 nt, Human
cuccuuccuccuuuccagaga

SEQ ID NO: 198407 - RNA, 20 nt, Human
cugcuauaaaaacaacagaa

SEQ ID NO: 198408 - RNA, 21 nt, Human
gaacacaacaaaaauacugca

SEQ ID NO: 198409 - RNA, 24 nt, Human
gagggcuggaggcccugaaagccu

SEQ ID NO: 198410 - RNA, 21 nt, Human
gaugugcuuuucguuggggaa

SEQ ID NO: 198411 - RNA, 22 nt, Human
gcccugaaagccuucagugccc

SEQ ID NO: 198412 - RNA, 25 nt, Human
gggacacagugagagggcuggaggc

SEQ ID NO: 198413 - RNA, 21 nt, Human
gggcuggaggcccugaaagcc

SEQ ID NO: 198414 - RNA, 22 nt, Human
gguaaggaagccagccaagaga

SEQ ID NO: 198415 - RNA, 22 nt, Human
guuaaacaccucccuccccacc

SEQ ID NO: 198416 - RNA, 19 nt, Human
guucauggcccugggagcc

SEQ ID NO: 198417 - RNA, 23 nt, Human
uaaaaacaacagaacacaacaaa

SEQ ID NO: 198418 - RNA, 24 nt, Human
uaaaaacaacagaacacaacaaaa

SEQ ID NO: 198419 - RNA, 27 nt, Human
uaagacaaaaacacaagacacaacauc

SEQ ID NO: 198420 - RNA, 24 nt, Human
uauaaaaacaacagaacacaacaa

SEQ ID NO: 198421 - RNA, 21 nt, Human
ucuuccaggcucugcugcagg

SEQ ID NO: 198422 - RNA, 21 nt, Human
ugagccaggaacagaguggcc

SEQ ID NO: 198423 - RNA, 18 nt, Human
ugaggaugcugaagggca

SEQ ID NO: 198424 - RNA, 18 nt, Human
ugcugaagggcagggcug

SEQ ID NO: 198425 - RNA, 22 nt, Human
ugcuggcuccgcgggcggcggc

SEQ ID NO: 198426 - RNA, 18 nt, Human
ugcugggcucguucgugc

SEQ ID NO: 198427 - RNA, 21 nt, Human
aaaaacagggacuaccggaag

SEQ ID NO: 198428 - RNA, 21 nt, Human
aaaacagggacuaccggaagc

SEQ ID NO: 198429 - RNA, 20 nt, Human
aagcagccuagggcccagaa

SEQ ID NO: 198430 - RNA, 20 nt, Human
acccauguacugcaaaaaca

SEQ ID NO: 198431 - RNA, 19 nt, Human
accggaagcagccuagggc

SEQ ID NO: 198432 - RNA, 21 nt, Human
acucccaggguccaagagagg

SEQ ID NO: 198433 - RNA, 22 nt, Human
agagggauucugggugagaggg

SEQ ID NO: 198434 - RNA, 22 nt, Human
agcauccagcaaggcccccucg

SEQ ID NO: 198435 - RNA, 19 nt, Human
aggaggagauaagcugggg

SEQ ID NO: 198436 - RNA, 23 nt, Human
aggccaguggucagucgggagga

SEQ ID NO: 198437 - RNA, 22 nt, Human
aggcccagaaguuguacagcag

SEQ ID NO: 198438 - RNA, 23 nt, Human
agggauucugggugagagggaug

SEQ ID NO: 198439 - RNA, 20 nt, Human
cacacccacccucacuccca

SEQ ID NO: 198440 - RNA, 19 nt, Human
cacccacccucacucccag

SEQ ID NO: 198441 - RNA, 25 nt, Human
cacccucacucccaggguccaagag

SEQ ID NO: 198442 - RNA, 24 nt, Human
cacugugccgacugcucccagggu

SEQ ID NO: 198443 - RNA, 22 nt, Human
cagcagcauccagcaaggcccc

SEQ ID NO: 198444 - RNA, 18 nt, Human
cagggcuggagaaagggg

SEQ ID NO: 198445 - RNA, 21 nt, Human
cauguacugcaaaaacaggga

SEQ ID NO: 198446 - RNA, 23 nt, Human
ccacacccacccucacucccagg

SEQ ID NO: 198447 - RNA, 19 nt, Human
cccacacccacccucacuc

SEQ ID NO: 198448 - RNA, 21 nt, Human
cccacacccacccucacuccc

SEQ ID NO: 198449 - RNA, 27 nt, Human
cccacccucacucccaggguccaagag

SEQ ID NO: 198450 - RNA, 24 nt, Human
cccauguacugcaaaaacagggac

SEQ ID NO: 198451 - RNA, 21 nt, Human
ccgcaggucgcugucgccugu

SEQ ID NO: 198452 - RNA, 25 nt, Human
ccugaggugguaguuuagucagggc

SEQ ID NO: 198453 - RNA, 18 nt, Human
ccugugcccagugcggaa

SEQ ID NO: 198454 - RNA, 22 nt, Human
cggaagcagccuagggcccaga

SEQ ID NO: 198455 - RNA, 22 nt, Human
cugaggcuuccacccacaccca

SEQ ID NO: 198456 - RNA, 19 nt, Human
gaagccuggaguagagcug

SEQ ID NO: 198457 - RNA, 20 nt, Human
gaggaugcugucaggcagag

SEQ ID NO: 198458 - RNA, 18 nt, Human
gccaguggucagucggga

SEQ ID NO: 198459 - RNA, 24 nt, Human
gccucugaggcuuccacccacacc

SEQ ID NO: 198460 - RNA, 18 nt, Human
gcugggugugguucuugc

SEQ ID NO: 198461 - RNA, 18 nt, Human
ggccucugaggcuuccac

SEQ ID NO: 198462 - RNA, 23 nt, Human
gggggccaggcuugcugcacugu

SEQ ID NO: 198463 - RNA, 22 nt, Human
ucagucgggaggaggguaccgg

SEQ ID NO: 198464 - RNA, 22 nt, Human
uccaacaggggagauagucacc

SEQ ID NO: 198465 - RNA, 23 nt, Human
ucccaaggccucugaggcuucca

SEQ ID NO: 198466 - RNA, 20 nt, Human
uccgccagccuccagucagc

SEQ ID NO: 198467 - RNA, 18 nt, Human
ugagcaaaccgcacccaa

SEQ ID NO: 198468 - RNA, 21 nt, Human
ugucaggcagaggcucuagca

SEQ ID NO: 198469 - RNA, 20 nt, Human
ugucgccuguccgccagccu

SEQ ID NO: 198470 - RNA, 22 nt, Human
ugugcccagugcggaauauggc

SEQ ID NO: 198471 - RNA, 18 nt, Human
ugugccgacugcucccag

SEQ ID NO: 198472 - RNA, 19 nt, Human
uugcugcucucgcuccucu

SEQ ID NO: 198473 - RNA, 21 nt, Human
aaaaaaacaacaacccggagg

SEQ ID NO: 198474 - RNA, 22 nt, Human
aaacaacaacccggaggcugca

SEQ ID NO: 198475 - RNA, 20 nt, Human
agcacaccguccgggccggc

SEQ ID NO: 198476 - RNA, 18 nt, Human
aggaggccgcaggagcga

SEQ ID NO: 198477 - RNA, 19 nt, Human
aggcggcggccuccgcgcc

SEQ ID NO: 198478 - RNA, 21 nt, Human
agggacguuuaguguuggggg

SEQ ID NO: 198479 - RNA, 21 nt, Human
caggagcugaggcccgccggc

SEQ ID NO: 198480 - RNA, 19 nt, Human
caggguccuuucuccacca

SEQ ID NO: 198481 - RNA, 24 nt, Human
cauggccgaccgcuccucgcugag

SEQ ID NO: 198482 - RNA, 24 nt, Human
cauuuaaaaaaacaacaacccgga

SEQ ID NO: 198483 - RNA, 19 nt, Human
ccagccugccugcuccugg

SEQ ID NO: 198484 - RNA, 20 nt, Human
cccccuguucgaguggggau

SEQ ID NO: 198485 - RNA, 18 nt, Human
ccccggguggccauggcc

SEQ ID NO: 198486 - RNA, 21 nt, Human
cccuggagcugcuacccggac

SEQ ID NO: 198487 - RNA, 23 nt, Human
cccuguucgaguggggauccagc

SEQ ID NO: 198488 - RNA, 19 nt, Human
ccggccugcugucuggguc

SEQ ID NO: 198489 - RNA, 26 nt, Human
cgauggacccacagguccaggguccu

SEQ ID NO: 198490 - RNA, 20 nt, Human
cgcgccgggcugggcugggc

SEQ ID NO: 198491 - RNA, 21 nt, Human
cgcgccgggcugggcugggcc

SEQ ID NO: 198492 - RNA, 21 nt, Human
cgcgccgggcugggcugggcc

SEQ ID NO: 198493 - RNA, 21 nt, Human
cgcucagccuuggacagccgg

SEQ ID NO: 198494 - RNA, 24 nt, Human
cguccgggccggccugcugucugg

SEQ ID NO: 198495 - RNA, 18 nt, Human
cuccgcgccgggcugggc

SEQ ID NO: 198496 - RNA, 19 nt, Human
cuccucgcugaggccgggg

SEQ ID NO: 198497 - RNA, 20 nt, Human
gaggcccgccggccgcggcc

SEQ ID NO: 198498 - RNA, 20 nt, Human
gcccagagucucugcauggc

SEQ ID NO: 198499 - RNA, 21 nt, Human
gcccagagucucugcauggcc

SEQ ID NO: 198500 - RNA, 23 nt, Human
gcccuggagcugcuacccggacc

SEQ ID NO: 198501 - RNA, 18 nt, Human
gccggccgcggccugcgc

SEQ ID NO: 198502 - RNA, 23 nt, Human
ggaacggacgauggacccacagg

SEQ ID NO: 198503 - RNA, 18 nt, Human
ggccgggccgggagcgag

SEQ ID NO: 198504 - RNA, 19 nt, Human
ggccuccgcgccgggcugg

SEQ ID NO: 198505 - RNA, 21 nt, Human
ggcugagggcagcugccccgg

SEQ ID NO: 198506 - RNA, 21 nt, Human
gggcugggccgggccgggagc

SEQ ID NO: 198507 - RNA, 19 nt, Human
gggcuuggcugagggcagc

SEQ ID NO: 198508 - RNA, 24 nt, Human
gggggguggccguggcgccggggg

SEQ ID NO: 198509 - RNA, 24 nt, Human
ggguagcacaccguccgggccggc

SEQ ID NO: 198510 - RNA, 20 nt, Human
ggguggccauggccgaccgc

SEQ ID NO: 198511 - RNA, 22 nt, Human
gucucugcauggcccccuguuc

SEQ ID NO: 198512 - RNA, 21 nt, Human
guugggggcagucugugggga

SEQ ID NO: 198513 - RNA, 18 nt, Human
uccaccagcacccgcgag

SEQ ID NO: 198514 - RNA, 22 nt, Human
uccaccagcacccgcgagaggg

SEQ ID NO: 198515 - RNA, 21 nt, Human
ucgguccgcuggggauggugg

SEQ ID NO: 198516 - RNA, 24 nt, Human
ucgguccgcuggggauggugggcc

SEQ ID NO: 198517 - RNA, 18 nt, Human
ucucgggcucggccgggc

SEQ ID NO: 198518 - RNA, 21 nt, Human
ucugggucccaggaaagggac

SEQ ID NO: 198519 - RNA, 19 nt, Human
ugagggcagcugccccggg

SEQ ID NO: 198520 - RNA, 22 nt, Human
ugcgcugggcuuggcugagggc

SEQ ID NO: 198521 - RNA, 23 nt, Human
ugggcuuggcugagggcagcugc

SEQ ID NO: 198522 - RNA, 27 nt, Human
uguugcgcugggcuuggcugagggcag

SEQ ID NO: 198523 - RNA, 25 nt, Human
uugcgcugggcuuggcugagggcag

SEQ ID NO: 198524 - RNA, 20 nt, Human
aaaaaaaauucuuuaaaugg

SEQ ID NO: 198525 - RNA, 23 nt, Human
aacauugagaaagcaaagagaaa

SEQ ID NO: 198526 - RNA, 18 nt, Human
aacuuaucucuccuccaa

SEQ ID NO: 198527 - RNA, 23 nt, Human
aagaagcagaguucuugagggca

SEQ ID NO: 198528 - RNA, 24 nt, Human
aaguccauacacaauauacauguu

SEQ ID NO: 198529 - RNA, 25 nt, Human
acuuuuaagagccucuaguguauac

SEQ ID NO: 198530 - RNA, 26 nt, Human
agaaauaauaaugaaacccgucuggc

SEQ ID NO: 198531 - RNA, 21 nt, Human
agagaggggggcaaggaagga

SEQ ID NO: 198532 - RNA, 21 nt, Human
agagggaagaaagagaggggg

SEQ ID NO: 198533 - RNA, 24 nt, Human
auuacaaucacauugauaaaaauu

SEQ ID NO: 198534 - RNA, 21 nt, Human
caaagcaagaagcagaguucu

SEQ ID NO: 198535 - RNA, 24 nt, Human
caauaaauuaacauugagaaagca

SEQ ID NO: 198536 - RNA, 21 nt, Human
cacacgauggcaaugauuaaa

SEQ ID NO: 198537 - RNA, 18 nt, Human
cacccugcccaauacaac

SEQ ID NO: 198538 - RNA, 22 nt, Human
cagaaauguaaacugagaagca

SEQ ID NO: 198539 - RNA, 23 nt, Human
cagcucccuauaacuuaucucuc

SEQ ID NO: 198540 - RNA, 25 nt, Human
cagcuguaaagaaaaagaauaaacc

SEQ ID NO: 198541 - RNA, 29 nt, Human
cauggcacucugcaaagcaagaagcagag

SEQ ID NO: 198542 - RNA, 21 nt, Human
ccugaggaauugauucccagg

SEQ ID NO: 198543 - RNA, 19 nt, Human
ccuggagccacccugccca

SEQ ID NO: 198544 - RNA, 25 nt, Human
ccuuuuuuguuuuuuuaaauaaccc

SEQ ID NO: 198545 - RNA, 19 nt, Human
cuaucugcauguaucagaa

SEQ ID NO: 198546 - RNA, 19 nt, Human
cucagaaugacaugaccau

SEQ ID NO: 198547 - RNA, 19 nt, Human
cuggaugaaacaagcacac

SEQ ID NO: 198548 - RNA, 20 nt, Human
gaaacaagcacacgauggca

SEQ ID NO: 198549 - RNA, 20 nt, Human
gagggaagaaagagaggggg

SEQ ID NO: 198550 - RNA, 18 nt, Human
gaguucuugagggcaauu

SEQ ID NO: 198551 - RNA, 19 nt, Human
gcaaagcaagaagcagagu

SEQ ID NO: 198552 - RNA, 19 nt, Human
gcaagaagcagaguucuug

SEQ ID NO: 198553 - RNA, 22 nt, Human
gcauaauuaaguccauacacaa

SEQ ID NO: 198554 - RNA, 20 nt, Human
ggaaaaagcacaaacaaaua

SEQ ID NO: 198555 - RNA, 19 nt, Human
ggaaggaggagaauuucau

SEQ ID NO: 198556 - RNA, 28 nt, Human
ggaggggaaagagggaagaaagagaggg

SEQ ID NO: 198557 - RNA, 19 nt, Human
gggaaaaagcacaaacaaa

SEQ ID NO: 198558 - RNA, 19 nt, Human
ggguagagaggacaaaggg

SEQ ID NO: 198559 - RNA, 19 nt, Human
gguagagaggacaaagggg

SEQ ID NO: 198560 - RNA, 18 nt, Human
gucagguaaggaggggga

SEQ ID NO: 198561 - RNA, 20 nt, Human
uaaacuucgcaggaaaaaaa

SEQ ID NO: 198562 - RNA, 25 nt, Human
uaaauaacccuccacaaacuagaau

SEQ ID NO: 198563 - RNA, 21 nt, Human
uagagaggacaaagggguugg

SEQ ID NO: 198564 - RNA, 21 nt, Human
uaggauuuuugaaucuuggag

SEQ ID NO: 198565 - RNA, 25 nt, Human
uauacuuguuucuucaccauuucaa

SEQ ID NO: 198566 - RNA, 21 nt, Human
uaugccagacaaaccccccag

SEQ ID NO: 198567 - RNA, 24 nt, Human
uaugccagacaaaccccccagucc

SEQ ID NO: 198568 - RNA, 21 nt, Human
uauugccacagaccuguaaac

SEQ ID NO: 198569 - RNA, 19 nt, Human
ucaagaacauuuuccacgg

SEQ ID NO: 198570 - RNA, 23 nt, Human
ucauuuaaagcaauuucagcugu

SEQ ID NO: 198571 - RNA, 27 nt, Human
uccacaaacuagaaugucuggagggga

SEQ ID NO: 198572 - RNA, 22 nt, Human
ucccuauaacuuaucucuccuc

SEQ ID NO: 198573 - RNA, 19 nt, Human
ucugcaaagcaagaagcag

SEQ ID NO: 198574 - RNA, 24 nt, Human
ucugcuaucugcauguaucagaaa

SEQ ID NO: 198575 - RNA, 22 nt, Human
ucuuaugguuaagaguauugcc

SEQ ID NO: 198576 - RNA, 18 nt, Human
ugaccaucuuccuuuuuu

SEQ ID NO: 198577 - RNA, 24 nt, Human
ugaccauggcacucugcaaagcaa

SEQ ID NO: 198578 - RNA, 22 nt, Human
ugaccucagaaugacaugacca

SEQ ID NO: 198579 - RNA, 18 nt, Human
ugagaaagcaaagagaaa

SEQ ID NO: 198580 - RNA, 20 nt, Human
ugagaaagcaaagagaaaua

SEQ ID NO: 198581 - RNA, 20 nt, Human
ugagaagcaaauggcucuga

SEQ ID NO: 198582 - RNA, 21 nt, Human
ugaggaauugauucccagggc

SEQ ID NO: 198583 - RNA, 23 nt, Human
ugccagacaaaccccccaguccc

SEQ ID NO: 198584 - RNA, 19 nt, Human
ugcgaagcgacgggcggcc

SEQ ID NO: 198585 - RNA, 22 nt, Human
ugcgaagcgacgggcggccgcg

SEQ ID NO: 198586 - RNA, 18 nt, Human
uggagccacccugcccaa

SEQ ID NO: 198587 - RNA, 22 nt, Human
uggcuauacuaacaccaugucc

SEQ ID NO: 198588 - RNA, 23 nt, Human
ugggauuuuauuaugcuguugac

SEQ ID NO: 198589 - RNA, 24 nt, Human
uguaauuuuaaccaucauuuaaag

SEQ ID NO: 198590 - RNA, 23 nt, Human
uguauaucaccuaucuauuaccu

SEQ ID NO: 198591 - RNA, 27 nt, Human
uguaucagaaauguaaacugagaagca

SEQ ID NO: 198592 - RNA, 26 nt, Human
ugucuacacaucugagcaugugcaua

SEQ ID NO: 198593 - RNA, 22 nt, Human
ugugcauaauuaaguccauaca

SEQ ID NO: 198594 - RNA, 24 nt, Human
uuaacauugagaaagcaaagagaa

SEQ ID NO: 198595 - RNA, 21 nt, Human
uucagcuguaaagaaaaagaa

SEQ ID NO: 198596 - RNA, 19 nt, Human
uucgcaggaaaaaaauugg

SEQ ID NO: 198597 - RNA, 19 nt, Human
uugauuuuuucucucuugc

SEQ ID NO: 198598 - RNA, 22 nt, Human
uugugcaugaaaaaugaaauaa

SEQ ID NO: 198599 - RNA, 21 nt, Human
uuuauaaucuguuuaugucuu

SEQ ID NO: 198600 - RNA, 18 nt, Human
aaagucucgacccccacu

SEQ ID NO: 198601 - RNA, 24 nt, Human
agcugcagcgggugaaggaagacu

SEQ ID NO: 198602 - RNA, 21 nt, Human
aggagaacaacaacaacaaaa

SEQ ID NO: 198603 - RNA, 18 nt, Human
aguuagccgggccugaag

SEQ ID NO: 198604 - RNA, 19 nt, Human
caacaacagcaauggagga

SEQ ID NO: 198605 - RNA, 23 nt, Human
caacaccgucuccccaaagucuc

SEQ ID NO: 198606 - RNA, 22 nt, Human
cccaaagucucgacccccacuu

SEQ ID NO: 198607 - RNA, 23 nt, Human
ccgucuccccaaagucucgaccc

SEQ ID NO: 198608 - RNA, 18 nt, Human
cucccuugcgucucugca

SEQ ID NO: 198609 - RNA, 24 nt, Human
cuguuaaaacuacaugguuuuaca

SEQ ID NO: 198610 - RNA, 22 nt, Human
cuugcgucucugcaacaccguc

SEQ ID NO: 198611 - RNA, 18 nt, Human
cuuucccguuuuccuccu

SEQ ID NO: 198612 - RNA, 26 nt, Human
gaacaacaacaacaaaaaaaucagaa

SEQ ID NO: 198613 - RNA, 23 nt, Human
gacuucccugcaacaacagcaau

SEQ ID NO: 198614 - RNA, 19 nt, Human
ggagaacaacaacaacaaa

SEQ ID NO: 198615 - RNA, 22 nt, Human
gggacggaacagcugcagcggg

SEQ ID NO: 198616 - RNA, 20 nt, Human
gggguguuggggugggggug

SEQ ID NO: 198617 - RNA, 23 nt, Human
uaaaacuacaugguuuuacaccg

SEQ ID NO: 198618 - RNA, 24 nt, Human
uacaugguuuuacaccgagucacu

SEQ ID NO: 198619 - RNA, 27 nt, Human
ucacaaaaguuuuuuuuuuuuuuuaag

SEQ ID NO: 198620 - RNA, 18 nt, Human
uccccaaagucucgaccc

SEQ ID NO: 198621 - RNA, 23 nt, Human
uccccaaagucucgacccccacu

SEQ ID NO: 198622 - RNA, 25 nt, Human
ucccugcaacaacagcaauggagga

SEQ ID NO: 198623 - RNA, 19 nt, Human
uccucgauccggggugcca

SEQ ID NO: 198624 - RNA, 20 nt, Human
ucugcaacaccgucucccca

SEQ ID NO: 198625 - RNA, 21 nt, Human
ucuguuaaaacuacaugguuu

SEQ ID NO: 198626 - RNA, 19 nt, Human
ugaagaagcaggagucuac

SEQ ID NO: 198627 - RNA, 19 nt, Human
ugcaacaacagcaauggag

SEQ ID NO: 198628 - RNA, 24 nt, Human
uggaagccgagugcauggcaguuu

SEQ ID NO: 198629 - RNA, 22 nt, Human
uggggguguuggggugggggug

SEQ ID NO: 198630 - RNA, 21 nt, Human
ugguucuguuaaaacuacaug

SEQ ID NO: 198631 - RNA, 19 nt, Human
ugucuuggggguguugggg

SEQ ID NO: 198632 - RNA, 25 nt, Human
uuauggauuucuucucccuugcguc

SEQ ID NO: 198633 - RNA, 18 nt, Human
uugcucucucacuuaucc

SEQ ID NO: 198634 - RNA, 18 nt, Human
uuuuuuuuuuuuuucuug

SEQ ID NO: 198635 - RNA, 21 nt, Human
uuuuuuuuuuuuuucuugguc

SEQ ID NO: 198636 - RNA, 19 nt, Human
aaagcacccaaugggccaa

SEQ ID NO: 198637 - RNA, 20 nt, Human
aaauuccccacacccuaacc

SEQ ID NO: 198638 - RNA, 22 nt, Human
aagcacccaaugggccaaaaaa

SEQ ID NO: 198639 - RNA, 25 nt, Human
acagcaccuaauggggggggccaaa

SEQ ID NO: 198640 - RNA, 22 nt, Human
accaaaaaagaagugggcacag

SEQ ID NO: 198641 - RNA, 24 nt, Human
accuccauccccuacccaacccau

SEQ ID NO: 198642 - RNA, 18 nt, Human
agaguugggggaaagggu

SEQ ID NO: 198643 - RNA, 20 nt, Human
agcaguccucacaguaccca

SEQ ID NO: 198644 - RNA, 24 nt, Human
agcuucguggugugagcuccagcc

SEQ ID NO: 198645 - RNA, 23 nt, Human
aucacacccaaagggccaaccgg

SEQ ID NO: 198646 - RNA, 24 nt, Human
aucacaguaccccguggaucaaca

SEQ ID NO: 198647 - RNA, 20 nt, Human
auccaucaauguagcagucc

SEQ ID NO: 198648 - RNA, 24 nt, Human
auguagcaguccucacaguaccca

SEQ ID NO: 198649 - RNA, 18 nt, Human
caaaaaagaagugggcac

SEQ ID NO: 198650 - RNA, 20 nt, Human
caaaaaagguguuacacagg

SEQ ID NO: 198651 - RNA, 23 nt, Human
caaagcacccaaugggccaaaaa

SEQ ID NO: 198652 - RNA, 22 nt, Human
caaagggccaaccgagauggug

SEQ ID NO: 198653 - RNA, 24 nt, Human
cacacccaaagggccaaccgagau

SEQ ID NO: 198654 - RNA, 18 nt, Human
cacaguacccagugggcc

SEQ ID NO: 198655 - RNA, 19 nt, Human
cacccccgcccucgcccgc

SEQ ID NO: 198656 - RNA, 21 nt, Human
cacccgcccccgcuccggccc

SEQ ID NO: 198657 - RNA, 21 nt, Human
cagaguugggggaaagggugg

SEQ ID NO: 198658 - RNA, 19 nt, Human
cagccaguaccccgcuucc

SEQ ID NO: 198659 - RNA, 19 nt, Human
caguaccccgcuucccggg

SEQ ID NO: 198660 - RNA, 20 nt, Human
ccaaaaaagguguuacacag

SEQ ID NO: 198661 - RNA, 26 nt, Human
ccauacccaccaccauguucccaacc

SEQ ID NO: 198662 - RNA, 25 nt, Human
cccccacccgcccccgcuccggccc

SEQ ID NO: 198663 - RNA, 27 nt, Human
cccgcccccgcuccggccccgggggaa

SEQ ID NO: 198664 - RNA, 21 nt, Human
ccuccauccccuacccaaccc

SEQ ID NO: 198665 - RNA, 20 nt, Human
ccucgcccgccccgggcucc

SEQ ID NO: 198666 - RNA, 20 nt, Human
cgacauggccaacacggggc

SEQ ID NO: 198667 - RNA, 20 nt, Human
cgcccgggguacggcugucc

SEQ ID NO: 198668 - RNA, 20 nt, Human
cucacaguacccagugggcc

SEQ ID NO: 198669 - RNA, 22 nt, Human
cuccagccauacccaccaccau

SEQ ID NO: 198670 - RNA, 20 nt, Human
gaaagaaucagacuucagua

SEQ ID NO: 198671 - RNA, 26 nt, Human
gaaauuccccacacccuaaccagccu

SEQ ID NO: 198672 - RNA, 18 nt, Human
gcccgcccguccgaccgc

SEQ ID NO: 198673 - RNA, 19 nt, Human
gcuccagccauacccacca

SEQ ID NO: 198674 - RNA, 21 nt, Human
ggccccaagagcuucguggug

SEQ ID NO: 198675 - RNA, 23 nt, Human
ggggaaagggugggcuucagaga

SEQ ID NO: 198676 - RNA, 19 nt, Human
uaaguaauagacccaccca

SEQ ID NO: 198677 - RNA, 25 nt, Human
uaaguaauagacccacccccugaag

SEQ ID NO: 198678 - RNA, 18 nt, Human
uaauagacccacccagau

SEQ ID NO: 198679 - RNA, 24 nt, Human
uacccaccaccauguucccaaccc

SEQ ID NO: 198680 - RNA, 25 nt, Human
uagaaauuccccacacccuaaccag

SEQ ID NO: 198681 - RNA, 21 nt, Human
uauagccgggacacccccgcc

SEQ ID NO: 198682 - RNA, 23 nt, Human
uaucacaguaccccguggaucaa

SEQ ID NO: 198683 - RNA, 22 nt, Human
ucacaguaaguaauagacccac

SEQ ID NO: 198684 - RNA, 22 nt, Human
uccccacacccuaaccagccuu

SEQ ID NO: 198685 - RNA, 20 nt, Human
ucccgggaaagaaucagacu

SEQ ID NO: 198686 - RNA, 21 nt, Human
uggaucaacaccaugcccacu

SEQ ID NO: 198687 - RNA, 27 nt, Human
uggaucaacaccaugcccacugagaca

SEQ ID NO: 198688 - RNA, 20 nt, Human
uggccaacacggggcugcag

SEQ ID NO: 198689 - RNA, 21 nt, Human
ugggacaagugaagugucacc

SEQ ID NO: 198690 - RNA, 21 nt, Human
uggggggggccaaagaagaug

SEQ ID NO: 198691 - RNA, 20 nt, Human
ugguuucuccuggaccagag

SEQ ID NO: 198692 - RNA, 22 nt, Human
uguauccauggugguuaucaca

SEQ ID NO: 198693 - RNA, 18 nt, Human
aagacgggauggcugagc

SEQ ID NO: 198694 - RNA, 21 nt, Human
aaggcccccgcccuccgcccu

SEQ ID NO: 198695 - RNA, 19 nt, Human
acaugagaaaguuguccaa

SEQ ID NO: 198696 - RNA, 23 nt, Human
accacagccuucuagacccugcc

SEQ ID NO: 198697 - RNA, 20 nt, Human
accccgaaggcccccgcccu

SEQ ID NO: 198698 - RNA, 21 nt, Human
accccgaaggcccccgcccuc

SEQ ID NO: 198699 - RNA, 24 nt, Human
agaggugggggcagcagcagaagg

SEQ ID NO: 198700 - RNA, 20 nt, Human
aggcaguggcuucaacauga

SEQ ID NO: 198701 - RNA, 21 nt, Human
agggaagaagggagcuggguu

SEQ ID NO: 198702 - RNA, 20 nt, Human
agggaggcagcagagguggg

SEQ ID NO: 198703 - RNA, 21 nt, Human
aggugggggcagcagcagaag

SEQ ID NO: 198704 - RNA, 22 nt, Human
aguggcuucaacaugagaaagu

SEQ ID NO: 198705 - RNA, 18 nt, Human
cagaggugggggcagcag

SEQ ID NO: 198706 - RNA, 19 nt, Human
cagccuucuagacccugcc

SEQ ID NO: 198707 - RNA, 18 nt, Human
caguggagcccccaagcc

SEQ ID NO: 198708 - RNA, 18 nt, Human
ccacgugaucaccaggug

SEQ ID NO: 198709 - RNA, 19 nt, Human
ccacugccuccucccagug

SEQ ID NO: 198710 - RNA, 23 nt, Human
ccccaagugccacaauuggaccc

SEQ ID NO: 198711 - RNA, 18 nt, Human
ccccgaaggcccccgccc

SEQ ID NO: 198712 - RNA, 24 nt, Human
ccccgaaggcccccgcccuccgcc

SEQ ID NO: 198713 - RNA, 18 nt, Human
ccccgcccuccgcccucc

SEQ ID NO: 198714 - RNA, 19 nt, Human
cccuacccugggcgcccac

SEQ ID NO: 198715 - RNA, 22 nt, Human
cccugccuccacgccgcggcca

SEQ ID NO: 198716 - RNA, 19 nt, Human
cccugggcgcccaccccga

SEQ ID NO: 198717 - RNA, 25 nt, Human
cccugggcgcccaccccgaaggccc

SEQ ID NO: 198718 - RNA, 22 nt, Human
ccuccacgccgcggccaccugc

SEQ ID NO: 198719 - RNA, 19 nt, Human
ccucccacugccuccuccc

SEQ ID NO: 198720 - RNA, 25 nt, Human
ccucccacugccuccucccagugcc

SEQ ID NO: 198721 - RNA, 22 nt, Human
ccuccuuggccucuguagaggu

SEQ ID NO: 198722 - RNA, 24 nt, Human
ccuuaggccauguucucgggcccu

SEQ ID NO: 198723 - RNA, 19 nt, Human
cgaaggcccccgcccuccg

SEQ ID NO: 198724 - RNA, 19 nt, Human
cgcccuccgcccucccacu

SEQ ID NO: 198725 - RNA, 18 nt, Human
cgggauggcugagcaagg

SEQ ID NO: 198726 - RNA, 28 nt, Human
cgucagggugcagugggauggcaggggc

SEQ ID NO: 198727 - RNA, 18 nt, Human
cucaccacagccuucuag

SEQ ID NO: 198728 - RNA, 24 nt, Human
cuccacgccgcggccaccugcccc

SEQ ID NO: 198729 - RNA, 24 nt, Human
cuucccucaccacagccuucuaga

SEQ ID NO: 198730 - RNA, 22 nt, Human
cuucuagacccugccuggugcc

SEQ ID NO: 198731 - RNA, 21 nt, Human
gaaggcccccgcccuccgccc

SEQ ID NO: 198732 - RNA, 25 nt, Human
gacugguccuggcaucacgucuucc

SEQ ID NO: 198733 - RNA, 22 nt, Human
gaggcagcagaggugggggcag

SEQ ID NO: 198734 - RNA, 22 nt, Human
gcccccaagccccagcggcuug

SEQ ID NO: 198735 - RNA, 18 nt, Human
gcuggggggagccagugg

SEQ ID NO: 198736 - RNA, 24 nt, Human
ggcuagggaagaagggagcugggu

SEQ ID NO: 198737 - RNA, 24 nt, Human
ggcuggggggagccaguggagccc

SEQ ID NO: 198738 - RNA, 20 nt, Human
ggcuggggggagccaguggg

SEQ ID NO: 198739 - RNA, 20 nt, Human
gggaagaagggagcuggguu

SEQ ID NO: 198740 - RNA, 24 nt, Human
gggaggcagcagaggugggggcag

SEQ ID NO: 198741 - RNA, 20 nt, Human
ggggcuggggggagccagug

SEQ ID NO: 198742 - RNA, 21 nt, Human
guccuuugggaugaagucggg

SEQ ID NO: 198743 - RNA, 25 nt, Human
uacccugggcgcccaccccgaaggc

SEQ ID NO: 198744 - RNA, 26 nt, Human
uagagggucuccccaagucaaagucu

SEQ ID NO: 198745 - RNA, 18 nt, Human
uagggaagaagggagcug

SEQ ID NO: 198746 - RNA, 24 nt, Human
ucagagcagggcgucagggugcag

SEQ ID NO: 198747 - RNA, 19 nt, Human
uccccaagucaaagucuug

SEQ ID NO: 198748 - RNA, 18 nt, Human
ucuuguuaucagagcagg

SEQ ID NO: 198749 - RNA, 23 nt, Human
ugaagucggggguuggacaugga

SEQ ID NO: 198750 - RNA, 24 nt, Human
ugacagcagagggaggcagcagag

SEQ ID NO: 198751 - RNA, 23 nt, Human
uggaugaaggugaaggugaaggc

SEQ ID NO: 198752 - RNA, 18 nt, Human
uggcaucacgucuuccuu

SEQ ID NO: 198753 - RNA, 21 nt, Human
uggcugagcaaggugacagca

SEQ ID NO: 198754 - RNA, 22 nt, Human
ugggaugugccuuaggccaugu

SEQ ID NO: 198755 - RNA, 18 nt, Human
ugggggcagcagcagaag

SEQ ID NO: 198756 - RNA, 22 nt, Human
ugggggcagcagcagaaggagg

SEQ ID NO: 198757 - RNA, 20 nt, Human
ugggggcagcagcagaaggg

SEQ ID NO: 198758 - RNA, 19 nt, Human
uggguuggaggagaaaggc

SEQ ID NO: 198759 - RNA, 25 nt, Human
acuggcugcuuucgcuggugcuccu

SEQ ID NO: 198760 - RNA, 21 nt, Human
auaaacauccuucaaacucag

SEQ ID NO: 198761 - RNA, 18 nt, Human
caauaacaaauagaauga

SEQ ID NO: 198762 - RNA, 18 nt, Human
cauaguagcaauaacaaa

SEQ ID NO: 198763 - RNA, 18 nt, Human
ccuccagcgcaggcuggg

SEQ ID NO: 198764 - RNA, 20 nt, Human
ccuccagcgccuucuucccg

SEQ ID NO: 198765 - RNA, 23 nt, Human
ccugaggcucagccccuccuuca

SEQ ID NO: 198766 - RNA, 23 nt, Human
ccuuggcuaagaguuugccaaaa

SEQ ID NO: 198767 - RNA, 21 nt, Human
cgcuggugcuccuccagcgcc

SEQ ID NO: 198768 - RNA, 21 nt, Human
cguauaaacaagaaaauagga

SEQ ID NO: 198769 - RNA, 18 nt, Human
cuccagcgcaggcugggc

SEQ ID NO: 198770 - RNA, 19 nt, Human
cuggggcagaacuauaagg

SEQ ID NO: 198771 - RNA, 20 nt, Human
cuggggcagaacuauaaggc

SEQ ID NO: 198772 - RNA, 24 nt, Human
cuuggcuaagaguuugccaaaagu

SEQ ID NO: 198773 - RNA, 22 nt, Human
gcaccaaugaagaagccuuggc

SEQ ID NO: 198774 - RNA, 24 nt, Human
ggccuggccuagggguccugaggc

SEQ ID NO: 198775 - RNA, 18 nt, Human
ggugcuccuccagcgccu

SEQ ID NO: 198776 - RNA, 21 nt, Human
uaacagcaccaaugaagaagc

SEQ ID NO: 198777 - RNA, 22 nt, Human
uaacagcaccaaugaagaagcc

SEQ ID NO: 198778 - RNA, 21 nt, Human
uaguagcaauaacaaauagaa

SEQ ID NO: 198779 - RNA, 24 nt, Human
uauaaacaagaaaauaggauacca

SEQ ID NO: 198780 - RNA, 22 nt, Human
uauaacagcaccaaugaagaag

SEQ ID NO: 198781 - RNA, 19 nt, Human
uaucugcuuucaacacggc

SEQ ID NO: 198782 - RNA, 19 nt, Human
ucccuccagcgcaggcugg

SEQ ID NO: 198783 - RNA, 18 nt, Human
ugaaaguuucacauagua

SEQ ID NO: 198784 - RNA, 22 nt, Human
ugaagaagccuuggcuaagagu

SEQ ID NO: 198785 - RNA, 22 nt, Human
uggcuaagaguuugccaaaagu

SEQ ID NO: 198786 - RNA, 20 nt, Human
uggcugcuuucgcuggugcu

SEQ ID NO: 198787 - RNA, 26 nt, Human
uggggcagaacuauaaggcugugggg

SEQ ID NO: 198788 - RNA, 21 nt, Human
uucacauaguagcaauaacaa

SEQ ID NO: 198789 - RNA, 18 nt, Human
uucgcuggugcuccucca

SEQ ID NO: 198790 - RNA, 20 nt, Human
uuucacauaguagcaauaac

SEQ ID NO: 198791 - RNA, 22 nt, Human
aaaaaaaaaaaaaaaugcuaag

SEQ ID NO: 198792 - RNA, 19 nt, Human
aaacagugcuuuaucuaca

SEQ ID NO: 198793 - RNA, 21 nt, Human
aagcacaauagaagaacguac

SEQ ID NO: 198794 - RNA, 18 nt, Human
acaauagaagaacguaca

SEQ ID NO: 198795 - RNA, 23 nt, Human
agaaagacagagcaggaagcaag

SEQ ID NO: 198796 - RNA, 22 nt, Human
agauagaaagcacaauagaaga

SEQ ID NO: 198797 - RNA, 18 nt, Human
aggauaagaccagcagua

SEQ ID NO: 198798 - RNA, 24 nt, Human
cagcaguaucccauaugauuccaa

SEQ ID NO: 198799 - RNA, 22 nt, Human
caguucccucuuucuuucccca

SEQ ID NO: 198800 - RNA, 24 nt, Human
cccacccccaccaguuucuaucca

SEQ ID NO: 198801 - RNA, 21 nt, Human
ccccacccccaccacccgagg

SEQ ID NO: 198802 - RNA, 24 nt, Human
cccccaccaguuucuauccaaaaa

SEQ ID NO: 198803 - RNA, 18 nt, Human
ccccuccuucucuuccca

SEQ ID NO: 198804 - RNA, 23 nt, Human
ccccuccuucucuucccaguucc

SEQ ID NO: 198805 - RNA, 23 nt, Human
cuauccaaaaaaaaaaaaaaaug

SEQ ID NO: 198806 - RNA, 21 nt, Human
cugcauguggucucucuaccu

SEQ ID NO: 198807 - RNA, 25 nt, Human
cuuuccccacccccaccaguuucua

SEQ ID NO: 198808 - RNA, 23 nt, Human
cuuugcacugauacuuuaacccc

SEQ ID NO: 198809 - RNA, 19 nt, Human
gagaaagacagagcaggaa

SEQ ID NO: 198810 - RNA, 20 nt, Human
uaacaugccacaaaggcugg

SEQ ID NO: 198811 - RNA, 18 nt, Human
uaagaccagcaguauccc

SEQ ID NO: 198812 - RNA, 18 nt, Human
uaccuggaggagggacag

SEQ ID NO: 198813 - RNA, 24 nt, Human
ucccauaugauuccaaauggaagu

SEQ ID NO: 198814 - RNA, 24 nt, Human
ucccucuuucuuuccccaccccca

SEQ ID NO: 198815 - RNA, 22 nt, Human
ucuauccaaaaaaaaaaaaaaa

SEQ ID NO: 198816 - RNA, 18 nt, Human
ucugagaaagacagagca

SEQ ID NO: 198817 - RNA, 18 nt, Human
ugagaaagacagagcagg

SEQ ID NO: 198818 - RNA, 25 nt, Human
ugagaaagacagagcaggaagcugg

SEQ ID NO: 198819 - RNA, 19 nt, Human
uguaagaaauagaaguauu

SEQ ID NO: 198820 - RNA, 26 nt, Human
uucacaaaacggccaaaucaguaaca

SEQ ID NO: 198821 - RNA, 20 nt, Human
uucccaguucccucuuucuu

SEQ ID NO: 198822 - RNA, 21 nt, Human
uugaacgggacuuugcacuga

SEQ ID NO: 198823 - RNA, 19 nt, Human
uugagccugcauguggucu

SEQ ID NO: 198824 - RNA, 21 nt, Human
aacccuuuguuggaaugcuuu

SEQ ID NO: 198825 - RNA, 22 nt, Human
aacccuuuguuggaaugcuuuc

SEQ ID NO: 198826 - RNA, 19 nt, Human
aagagagacuuuaacgaug

SEQ ID NO: 198827 - RNA, 20 nt, Human
accaagguuuccgaagacaa

SEQ ID NO: 198828 - RNA, 25 nt, Human
agcuucauucccaucuauaauuuua

SEQ ID NO: 198829 - RNA, 23 nt, Human
auagaaccuggcaucacccugaa

SEQ ID NO: 198830 - RNA, 22 nt, Human
aucugccagccuaccuucgccc

SEQ ID NO: 198831 - RNA, 20 nt, Human
auggggugcaaaaaaaaaaa

SEQ ID NO: 198832 - RNA, 26 nt, Human
auuuugcuuggguaaucccuuuuaau

SEQ ID NO: 198833 - RNA, 19 nt, Human
caacagcauggggugcaaa

SEQ ID NO: 198834 - RNA, 23 nt, Human
caacuacaccaagguuuccgaag

SEQ ID NO: 198835 - RNA, 28 nt, Human
caacuacaccaagguuuccgaagacaau

SEQ ID NO: 198836 - RNA, 21 nt, Human
caauggcuucuccacccaagc

SEQ ID NO: 198837 - RNA, 24 nt, Human
cagcauggggugcaaaaaaaaaaa

SEQ ID NO: 198838 - RNA, 19 nt, Human
cagccuaccuucgcccucu

SEQ ID NO: 198839 - RNA, 21 nt, Human
cagggugaagagagacuuuaa

SEQ ID NO: 198840 - RNA, 20 nt, Human
ccugcuaagcuuuguuuccu

SEQ ID NO: 198841 - RNA, 18 nt, Human
cugcuaagcuuuguuucc

SEQ ID NO: 198842 - RNA, 21 nt, Human
cuuuccacagaacagaaacua

SEQ ID NO: 198843 - RNA, 24 nt, Human
guuuuuugcccauacacaugaguc

SEQ ID NO: 198844 - RNA, 19 nt, Human
uacacaagcuucauuccca

SEQ ID NO: 198845 - RNA, 21 nt, Human
uacaccaagguuuccgaagac

SEQ ID NO: 198846 - RNA, 21 nt, Human
uccacgggcagaaaggagcaa

SEQ ID NO: 198847 - RNA, 25 nt, Human
uccgaagacaauggcuucuccaccc

SEQ ID NO: 198848 - RNA, 20 nt, Human
ucucuggcucuccucuccug

SEQ ID NO: 198849 - RNA, 19 nt, Human
uguuguaaccuguagcuuc

SEQ ID NO: 198850 - RNA, 18 nt, Human
aacacgaaccggacucgu

SEQ ID NO: 198851 - RNA, 25 nt, Human
acuuugagaaaaaucuuaaaaaagg

SEQ ID NO: 198852 - RNA, 19 nt, Human
auggcaaauaggaagaagc

SEQ ID NO: 198853 - RNA, 21 nt, Human
caccugaaacuuacaaauuua

SEQ ID NO: 198854 - RNA, 19 nt, Human
caucugcucuggugucuuc

SEQ ID NO: 198855 - RNA, 18 nt, Human
cauggcaaauaggaagaa

SEQ ID NO: 198856 - RNA, 19 nt, Human
cauuguuauuucgauaacc

SEQ ID NO: 198857 - RNA, 23 nt, Human
ccugaagcuguucuguuaccucu

SEQ ID NO: 198858 - RNA, 24 nt, Human
cgagaaacaacucugcgaggagca

SEQ ID NO: 198859 - RNA, 20 nt, Human
gagaaacaacucugcgagga

SEQ ID NO: 198860 - RNA, 22 nt, Human
gagaaacaacucugcgaggagc

SEQ ID NO: 198861 - RNA, 20 nt, Human
gagcaccuccgcacgggacc

SEQ ID NO: 198862 - RNA, 18 nt, Human
gcggacucagucgcuuca

SEQ ID NO: 198863 - RNA, 23 nt, Human
uaaaaagcuaagaaacugucuca

SEQ ID NO: 198864 - RNA, 27 nt, Human
uaacauuaucaaagaaggaaugcuucu

SEQ ID NO: 198865 - RNA, 23 nt, Human
uacaaagaccacuagaaagaaac

SEQ ID NO: 198866 - RNA, 24 nt, Human
uacacacgcacuuaaauuuuuuua

SEQ ID NO: 198867 - RNA, 19 nt, Human
uaucaaagaaggaaugcuu

SEQ ID NO: 198868 - RNA, 18 nt, Human
ucucugcaucugcucugg

SEQ ID NO: 198869 - RNA, 21 nt, Human
ucucugcaucugcucuggugu

SEQ ID NO: 198870 - RNA, 23 nt, Human
ugccgcugcucgagaaacaacuc

SEQ ID NO: 198871 - RNA, 19 nt, Human
uguagugagaacugccgcu

SEQ ID NO: 198872 - RNA, 22 nt, Human
uguucuguuaccucugggcucu

SEQ ID NO: 198873 - RNA, 23 nt, Human
uguucuguuaccucugggcucuc

SEQ ID NO: 198874 - RNA, 24 nt, Human
uguucuguuaccucugggcucuca

SEQ ID NO: 198875 - RNA, 18 nt, Human
uuacaaagaccacuagaa

SEQ ID NO: 198876 - RNA, 21 nt, Human
uuaccucugggcucucauccu

SEQ ID NO: 198877 - RNA, 21 nt, Human
uuuaacauuaucaaagaagga

SEQ ID NO: 198878 - RNA, 22 nt, Human
uuuuuuuuuuccuuuagaauua

SEQ ID NO: 198879 - RNA, 22 nt, Human
uuuuuuuuuuuuuuuuuccuuu

SEQ ID NO: 198880 - RNA, 26 nt, Human
uuuuuuuuuuuuuuuuuuuccuuuag

SEQ ID NO: 198881 - RNA, 24 nt, Human
aaaaaaccaguaagacacuacuac

SEQ ID NO: 198882 - RNA, 24 nt, Human
aaaaagcacaauacauauuaagca

SEQ ID NO: 198883 - RNA, 24 nt, Human
aaaaucucucugaacuagccgcau

SEQ ID NO: 198884 - RNA, 22 nt, Human
aaacaaccaacaaacaaauuga

SEQ ID NO: 198885 - RNA, 26 nt, Human
aagcaaauuucuuuuaaugagaacuc

SEQ ID NO: 198886 - RNA, 24 nt, Human
aagcauagcaauuaagaaauaaaa

SEQ ID NO: 198887 - RNA, 23 nt, Human
aaggauuuauuaaaaaaccagua

SEQ ID NO: 198888 - RNA, 18 nt, Human
acacucccgcucucuccc

SEQ ID NO: 198889 - RNA, 24 nt, Human
acacugggcuuuuaacacaagacu

SEQ ID NO: 198890 - RNA, 18 nt, Human
acagggaaggcgcgcgcg

SEQ ID NO: 198891 - RNA, 18 nt, Human
acagggaggacacauuau

SEQ ID NO: 198892 - RNA, 27 nt, Human
acugcaauuuuaaucauguccucaauu

SEQ ID NO: 198893 - RNA, 24 nt, Human
agcaaauuucuuuuaaugagaacu

SEQ ID NO: 198894 - RNA, 23 nt, Human
agcggcggccgcucucgccuccu

SEQ ID NO: 198895 - RNA, 22 nt, Human
aggagccaccuucaaaugaauc

SEQ ID NO: 198896 - RNA, 21 nt, Human
augaaucuucaaauuggaaaa

SEQ ID NO: 198897 - RNA, 24 nt, Human
auugacauuaagucauucccaauu

SEQ ID NO: 198898 - RNA, 20 nt, Human
caaaggcuccugcgccucuc

SEQ ID NO: 198899 - RNA, 26 nt, Human
caccacagcucuaaaaaucucucuga

SEQ ID NO: 198900 - RNA, 18 nt, Human
caccagcggcggccgcuc

SEQ ID NO: 198901 - RNA, 19 nt, Human
caccuguuggggauaaguu

SEQ ID NO: 198902 - RNA, 24 nt, Human
cacugggcuuuuaacacaagacuu

SEQ ID NO: 198903 - RNA, 24 nt, Human
cagcggcggccgcucucgccuccu

SEQ ID NO: 198904 - RNA, 27 nt, Human
ccagcggcggccgcucucgccuccucc

SEQ ID NO: 198905 - RNA, 18 nt, Human
ccauucagggacuugaua

SEQ ID NO: 198906 - RNA, 20 nt, Human
cccgcgcugccgcgcgcccg

SEQ ID NO: 198907 - RNA, 23 nt, Human
cccgcucuaccucgcgaagcaca

SEQ ID NO: 198908 - RNA, 26 nt, Human
ccgcugccgccgagacuacacccgcc

SEQ ID NO: 198909 - RNA, 19 nt, Human
ccugcgccucucccuggcc

SEQ ID NO: 198910 - RNA, 20 nt, Human
ccugcgccucucccuggccu

SEQ ID NO: 198911 - RNA, 23 nt, Human
cgaagcacacaagacagggaagg

SEQ ID NO: 198912 - RNA, 24 nt, Human
cuagcagcaaaguaauccccgcgc

SEQ ID NO: 198913 - RNA, 24 nt, Human
cugcaaaggcuccugcgccucucc

SEQ ID NO: 198914 - RNA, 26 nt, Human
cugcaauuuuaaucauguccucaauu

SEQ ID NO: 198915 - RNA, 22 nt, Human
gaaauaaaacaaugaaagcaaa

SEQ ID NO: 198916 - RNA, 18 nt, Human
gaaccgaaacuagcagca

SEQ ID NO: 198917 - RNA, 24 nt, Human
gaaccgaaacuagcagcaaaguaa

SEQ ID NO: 198918 - RNA, 22 nt, Human
gaagcacacaagacagggaagg

SEQ ID NO: 198919 - RNA, 19 nt, Human
gaugauaaaagagccaaua

SEQ ID NO: 198920 - RNA, 20 nt, Human
gcccccuucgccucccacuc

SEQ ID NO: 198921 - RNA, 22 nt, Human
gcgaagcacacaagacagggaa

SEQ ID NO: 198922 - RNA, 24 nt, Human
gcugcacuaaaaaagaauaagcac

SEQ ID NO: 198923 - RNA, 24 nt, Human
uaaaaaaccaguaagacacuacua

SEQ ID NO: 198924 - RNA, 19 nt, Human
uaaaacaaccaacaaacaa

SEQ ID NO: 198925 - RNA, 22 nt, Human
uaaaacaaccaacaaacaaauu

SEQ ID NO: 198926 - RNA, 24 nt, Human
uaagaaauaaaacaaugaaagcaa

SEQ ID NO: 198927 - RNA, 27 nt, Human
uaagacacuacuacaucaugacacugu

SEQ ID NO: 198928 - RNA, 19 nt, Human
uaccucgcgaagcacacaa

SEQ ID NO: 198929 - RNA, 23 nt, Human
uauccagauuuguucuaaaaagc

SEQ ID NO: 198930 - RNA, 18 nt, Human
ucccaauuuggacaggga

SEQ ID NO: 198931 - RNA, 19 nt, Human
ucccuggccugcccccuuc

SEQ ID NO: 198932 - RNA, 22 nt, Human
ucccuggccugcccccuucgcc

SEQ ID NO: 198933 - RNA, 18 nt, Human
uccugcgccucucccugg

SEQ ID NO: 198934 - RNA, 20 nt, Human
ugaaagcaaauuucuuuuaa

SEQ ID NO: 198935 - RNA, 20 nt, Human
ugauaaaagagccaauacau

SEQ ID NO: 198936 - RNA, 21 nt, Human
uggaaaauacugcuucaccac

SEQ ID NO: 198937 - RNA, 18 nt, Human
uggacagggaggacacau

SEQ ID NO: 198938 - RNA, 21 nt, Human
ugggaaaauauucauauaaau

SEQ ID NO: 198939 - RNA, 25 nt, Human
ugggcuuuuaacacaagacuugcuc

SEQ ID NO: 198940 - RNA, 24 nt, Human
ugucuccgccgcugccgccgagac

SEQ ID NO: 198941 - RNA, 22 nt, Human
uguucuaaaaagcacaauacau

SEQ ID NO: 198942 - RNA, 18 nt, Human
uuaauccucccucaacac

SEQ ID NO: 198943 - RNA, 25 nt, Human
uucaaacuucacugcaauuuuaauc

SEQ ID NO: 198944 - RNA, 25 nt, Human
uucaaaugaaucuucaaauuggaaa

SEQ ID NO: 198945 - RNA, 20 nt, Human
aaaaaagggagggcucaugg

SEQ ID NO: 198946 - RNA, 18 nt, Human
aaaaagaggccaagagca

SEQ ID NO: 198947 - RNA, 19 nt, Human
aaaacagcagcaaaaaaga

SEQ ID NO: 198948 - RNA, 21 nt, Human
aaagcuuauuauuauuccagg

SEQ ID NO: 198949 - RNA, 23 nt, Human
aaauacaccuacaaauuggagaa

SEQ ID NO: 198950 - RNA, 21 nt, Human
aagaaaacuaauuggcagcua

SEQ ID NO: 198951 - RNA, 19 nt, Human
aagaauagcaaaacagcag

SEQ ID NO: 198952 - RNA, 23 nt, Human
aagacuuuucucuaaacucacag

SEQ ID NO: 198953 - RNA, 23 nt, Human
aagagcauaaaauacaccuacaa

SEQ ID NO: 198954 - RNA, 20 nt, Human
aagagcauuauaaugugaua

SEQ ID NO: 198955 - RNA, 23 nt, Human
aagaggccaagagcauuauaaug

SEQ ID NO: 198956 - RNA, 20 nt, Human
aaucaucuuagaucaacaga

SEQ ID NO: 198957 - RNA, 26 nt, Human
acacaacuuaaaaaugaagggaacgc

SEQ ID NO: 198958 - RNA, 24 nt, Human
acagagcauuaacagcuaauacaa

SEQ ID NO: 198959 - RNA, 19 nt, Human
acagagcuauguaguaccu

SEQ ID NO: 198960 - RNA, 19 nt, Human
acagcagcaaaaaagaggc

SEQ ID NO: 198961 - RNA, 20 nt, Human
acaugaaaugauacaaauaa

SEQ ID NO: 198962 - RNA, 20 nt, Human
accaaaaagccgucaacccc

SEQ ID NO: 198963 - RNA, 24 nt, Human
accgacuagcaccgcggccagucu

SEQ ID NO: 198964 - RNA, 21 nt, Human
accgcaccuacugaccacaca

SEQ ID NO: 198965 - RNA, 23 nt, Human
agaagagaagaaucagaagagaa

SEQ ID NO: 198966 - RNA, 22 nt, Human
agaauagcaaaacagcagcaaa

SEQ ID NO: 198967 - RNA, 22 nt, Human
agauaaccagaagggaaagaac

SEQ ID NO: 198968 - RNA, 22 nt, Human
agcaaaacagcagcaaaaaaga

SEQ ID NO: 198969 - RNA, 24 nt, Human
aggacaaaguaaaaacaaagaaaa

SEQ ID NO: 198970 - RNA, 18 nt, Human
agggggcgcggcggggcc

SEQ ID NO: 198971 - RNA, 20 nt, Human
auucauuuuuuugaucaggg

SEQ ID NO: 198972 - RNA, 23 nt, Human
auuuauaaaggaccacaguuucu

SEQ ID NO: 198973 - RNA, 19 nt, Human
caaaaaagaggccaagagc

SEQ ID NO: 198974 - RNA, 25 nt, Human
caaaaagccgucaaccccgccuuuu

SEQ ID NO: 198975 - RNA, 24 nt, Human
caaaguaaaaacaaagaaaacuaa

SEQ ID NO: 198976 - RNA, 21 nt, Human
caacgugcgacccccagagau

SEQ ID NO: 198977 - RNA, 18 nt, Human
caagacuuuucucuaaac

SEQ ID NO: 198978 - RNA, 23 nt, Human
cacaauggugucuuguacacuag

SEQ ID NO: 198979 - RNA, 21 nt, Human
cacacaacuuaaaaaugaacu

SEQ ID NO: 198980 - RNA, 25 nt, Human
caccuaaucauaaauuugaacuuac

SEQ ID NO: 198981 - RNA, 19 nt, Human
cacuacccuagacaccgca

SEQ ID NO: 198982 - RNA, 18 nt, Human
cagagcuauguaguaccu

SEQ ID NO: 198983 - RNA, 19 nt, Human
cagcaaaaaagaggccaag

SEQ ID NO: 198984 - RNA, 21 nt, Human
cagcaaaaaagaggccaagag

SEQ ID NO: 198985 - RNA, 22 nt, Human
caggaugcccaaacagaaaaca

SEQ ID NO: 198986 - RNA, 21 nt, Human
cagggagaagaugaagccuua

SEQ ID NO: 198987 - RNA, 20 nt, Human
cagugcggagccgcugcggc

SEQ ID NO: 198988 - RNA, 22 nt, Human
ccaaaaagccgucaaccccgcc

SEQ ID NO: 198989 - RNA, 23 nt, Human
cccacuccuaccaaaaagccguc

SEQ ID NO: 198990 - RNA, 19 nt, Human
ccgacuagcaccgcggcca

SEQ ID NO: 198991 - RNA, 20 nt, Human
ccgcgcggccucuggcgggc

SEQ ID NO: 198992 - RNA, 19 nt, Human
ccuccgggcagcgcagcgc

SEQ ID NO: 198993 - RNA, 21 nt, Human
ccugcaaugaaguucccgcug

SEQ ID NO: 198994 - RNA, 23 nt, Human
ccuggggucagcaguuucggucc

SEQ ID NO: 198995 - RNA, 20 nt, Human
cgcgcgggccaagggggcgc

SEQ ID NO: 198996 - RNA, 19 nt, Human
cgcgggccaagggggcgcg

SEQ ID NO: 198997 - RNA, 23 nt, Human
cgcucgcccgccgcgcgcacgcg

SEQ ID NO: 198998 - RNA, 25 nt, Human
cgggccccgcgcggccucuggcggg

SEQ ID NO: 198999 - RNA, 18 nt, Human
cgggcugaucggccgaag

SEQ ID NO: 199000 - RNA, 23 nt, Human
cugugaacacguaugccaauccc

SEQ ID NO: 199001 - RNA, 18 nt, Human
cugugccuuaauuauugc

SEQ ID NO: 199002 - RNA, 23 nt, Human
cuuacaggauucacuacccuaga

SEQ ID NO: 199003 - RNA, 24 nt, Human
cuucagauaaccagaagggaaaga

SEQ ID NO: 199004 - RNA, 18 nt, Human
gacuagcaccgcggccag

SEQ ID NO: 199005 - RNA, 19 nt, Human
gagaagagaagaaucagaa

SEQ ID NO: 199006 - RNA, 26 nt, Human
gcaaaacagcagcaaaaaagaggcca

SEQ ID NO: 199007 - RNA, 21 nt, Human
gcagaaaagcaaucacauaag

SEQ ID NO: 199008 - RNA, 20 nt, Human
ggaaagaacauuguucaaag

SEQ ID NO: 199009 - RNA, 23 nt, Human
ggacaaaguaaaaacaaagaaaa

SEQ ID NO: 199010 - RNA, 18 nt, Human
ggagaagagggugacgcu

SEQ ID NO: 199011 - RNA, 18 nt, Human
ggaggaggggcgggggcu

SEQ ID NO: 199012 - RNA, 22 nt, Human
gggaaagaacauuguucaaagg

SEQ ID NO: 199013 - RNA, 18 nt, Human
uaaaaaaaaaaagggagg

SEQ ID NO: 199014 - RNA, 26 nt, Human
uaaaaaaaaaaagggagggcucaugg

SEQ ID NO: 199015 - RNA, 24 nt, Human
uaaaaacaaagaaaacuaauuggc

SEQ ID NO: 199016 - RNA, 24 nt, Human
uaaacucacagagcauuaacagcu

SEQ ID NO: 199017 - RNA, 23 nt, Human
uaaauuccuggggucagcaguuc

SEQ ID NO: 199018 - RNA, 18 nt, Human
uaagaaaguugcaggcac

SEQ ID NO: 199019 - RNA, 21 nt, Human
uaagaauagcaaaacagcagc

SEQ ID NO: 199020 - RNA, 22 nt, Human
uaauuuuucgaccaaacucaua

SEQ ID NO: 199021 - RNA, 21 nt, Human
uacaaaauaaucaucuuagau

SEQ ID NO: 199022 - RNA, 23 nt, Human
uacagugcuccuuuuguaucuga

SEQ ID NO: 199023 - RNA, 22 nt, Human
uaccaaaaagccgucaaccccg

SEQ ID NO: 199024 - RNA, 23 nt, Human
uagacaccgcaccuacugaccac

SEQ ID NO: 199025 - RNA, 23 nt, Human
uagcaaaacagcagcaaaaaaga

SEQ ID NO: 199026 - RNA, 24 nt, Human
uagcaaaggacaaaguaaaaacaa

SEQ ID NO: 199027 - RNA, 21 nt, Human
uaucugaacuuuuauacaaga

SEQ ID NO: 199028 - RNA, 20 nt, Human
ucaacucgucaccuaaucau

SEQ ID NO: 199029 - RNA, 21 nt, Human
ucauaccuuucuaccaaaauc

SEQ ID NO: 199030 - RNA, 22 nt, Human
uccagcccacuccuaccaaaaa

SEQ ID NO: 199031 - RNA, 22 nt, Human
ucucaaugucaacucgucaccu

SEQ ID NO: 199032 - RNA, 28 nt, Human
ucugcccgcaacgugcgacccccagaga

SEQ ID NO: 199033 - RNA, 21 nt, Human
ucuuuucaaugcacccagagg

SEQ ID NO: 199034 - RNA, 23 nt, Human
ugaacuuacuuccauucccuaaa

SEQ ID NO: 199035 - RNA, 21 nt, Human
ugacucagucacauuuguaau

SEQ ID NO: 199036 - RNA, 21 nt, Human
ugacuuagucacauuuguaau

SEQ ID NO: 199037 - RNA, 23 nt, Human
ugagaaaacacaacuaaaucuua

SEQ ID NO: 199038 - RNA, 21 nt, Human
ugcaaaauccaaagcuuauua

SEQ ID NO: 199039 - RNA, 21 nt, Human
uggaccaauacucuacaaaau

SEQ ID NO: 199040 - RNA, 21 nt, Human
uggagaagagggugacgcugg

SEQ ID NO: 199041 - RNA, 22 nt, Human
uggcaggaaccagccgaacagu

SEQ ID NO: 199042 - RNA, 24 nt, Human
ugucaaaaacuagauuuacuauca

SEQ ID NO: 199043 - RNA, 21 nt, Human
uuacaggauucacuacccuag

SEQ ID NO: 199044 - RNA, 24 nt, Human
uucucuaaacucacagagcauuaa

SEQ ID NO: 199045 - RNA, 22 nt, Human
uugcuuauuuuaaauuacauuu

SEQ ID NO: 199046 - RNA, 24 nt, Human
uuggagaagagggugacgcuggcu

SEQ ID NO: 199047 - RNA, 21 nt, Human
uuuuacagugcuccuuuugua

SEQ ID NO: 199048 - RNA, 24 nt, Human
aaaaugauugaaguaacucaaaug

SEQ ID NO: 199049 - RNA, 18 nt, Human
aaagcacgucuccccagg

SEQ ID NO: 199050 - RNA, 24 nt, Human
aaauauuucuuugaaucagggagc

SEQ ID NO: 199051 - RNA, 23 nt, Human
aaauguuaauugagaaaagcuga

SEQ ID NO: 199052 - RNA, 21 nt, Human
aacauacuuaaacuacuuaaa

SEQ ID NO: 199053 - RNA, 26 nt, Human
aagaaaaaaauuuaguuaacaaaaaa

SEQ ID NO: 199054 - RNA, 22 nt, Human
aagagccccgaaauuccaccga

SEQ ID NO: 199055 - RNA, 21 nt, Human
aagcgcggcuggcagccaaga

SEQ ID NO: 199056 - RNA, 22 nt, Human
aauugcuuucacaauguaguac

SEQ ID NO: 199057 - RNA, 20 nt, Human
acagcgauucgguggccccc

SEQ ID NO: 199058 - RNA, 18 nt, Human
acccaaaaggaaaucaca

SEQ ID NO: 199059 - RNA, 18 nt, Human
agaugugacuccagcauc

SEQ ID NO: 199060 - RNA, 22 nt, Human
agcaaaauacacccaaaaggaa

SEQ ID NO: 199061 - RNA, 26 nt, Human
augggucccccagcuucccccuaggg

SEQ ID NO: 199062 - RNA, 25 nt, Human
caauucucaaaacuaacuuuuaaaa

SEQ ID NO: 199063 - RNA, 21 nt, Human
cagcuaucaacagaugugacu

SEQ ID NO: 199064 - RNA, 19 nt, Human
ccaaaauguuaauugagaa

SEQ ID NO: 199065 - RNA, 18 nt, Human
cccaaaaggaaaucacag

SEQ ID NO: 199066 - RNA, 21 nt, Human
cccccagcuuccucuauuaua

SEQ ID NO: 199067 - RNA, 20 nt, Human
cccccgaaccccaccuugag

SEQ ID NO: 199068 - RNA, 19 nt, Human
ccgaaauuccaccgaagcu

SEQ ID NO: 199069 - RNA, 32 nt, Human
ccggcgugacagcgauucgguggccccccuuu

SEQ ID NO: 199070 - RNA, 21 nt, Human
cgaaccccaccuugaggaaga

SEQ ID NO: 199071 - RNA, 21 nt, Human
cgagaaacaaaauaauugcuu

SEQ ID NO: 199072 - RNA, 25 nt, Human
cgugugucuauuugaugcuucccuc

SEQ ID NO: 199073 - RNA, 20 nt, Human
cuuagcaaaauacacccaaa

SEQ ID NO: 199074 - RNA, 22 nt, Human
gccaagagccccgaaauuccac

SEQ ID NO: 199075 - RNA, 19 nt, Human
gccccgaaauuccaccgaa

SEQ ID NO: 199076 - RNA, 21 nt, Human
gcuuaaaaacaaccacggaug

SEQ ID NO: 199077 - RNA, 18 nt, Human
guggcuuuuuuguggcuu

SEQ ID NO: 199078 - RNA, 24 nt, Human
uaaaugaaaauauaaacuagaaug

SEQ ID NO: 199079 - RNA, 23 nt, Human
uaacaaaaaauuuaacaaguuuc

SEQ ID NO: 199080 - RNA, 21 nt, Human
uagaaugaacaaacaugagaa

SEQ ID NO: 199081 - RNA, 24 nt, Human
uagcaaaauacacccaaaaggaaa

SEQ ID NO: 199082 - RNA, 20 nt, Human
uagccucaucauaagaauau

SEQ ID NO: 199083 - RNA, 22 nt, Human
uaucaacagaugugacuccagc

SEQ ID NO: 199084 - RNA, 25 nt, Human
ucacauauuuaacauuuuuauuaga

SEQ ID NO: 199085 - RNA, 22 nt, Human
uccacauuuaacauacuuaaac

SEQ ID NO: 199086 - RNA, 24 nt, Human
uccucuauuauaacugcucuuaau

SEQ ID NO: 199087 - RNA, 19 nt, Human
ucugaaguauacuaccaaa

SEQ ID NO: 199088 - RNA, 21 nt, Human
ugaaguauacuaccaaaaugu

SEQ ID NO: 199089 - RNA, 24 nt, Human
ugaaguauacuaccaaaauguuaa

SEQ ID NO: 199090 - RNA, 20 nt, Human
ugagaaaacacugaagaggu

SEQ ID NO: 199091 - RNA, 21 nt, Human
ugagaaaacacugaagaggua

SEQ ID NO: 199092 - RNA, 23 nt, Human
ugagaaaagcugaaaauaguuuu

SEQ ID NO: 199093 - RNA, 19 nt, Human
ugcacauaaguugcaggug

SEQ ID NO: 199094 - RNA, 21 nt, Human
ugcauguuuuuguucucaacc

SEQ ID NO: 199095 - RNA, 22 nt, Human
ugccuucagugggagacacuuc

SEQ ID NO: 199096 - RNA, 21 nt, Human
uggaugguaaugaaaugucca

SEQ ID NO: 199097 - RNA, 20 nt, Human
uggccccccgaaccccaccu

SEQ ID NO: 199098 - RNA, 18 nt, Human
uggcuuaaaaacaaccac

SEQ ID NO: 199099 - RNA, 24 nt, Human
ugguguaaaagauccacauuuaac

SEQ ID NO: 199100 - RNA, 19 nt, Human
ugucagggugggugucagg

SEQ ID NO: 199101 - RNA, 19 nt, Human
uguggcuuuuuuguggcuu

SEQ ID NO: 199102 - RNA, 19 nt, Human
uuagauaacaucacucuga

SEQ ID NO: 199103 - RNA, 19 nt, Human
uuugaaucagggagcuagc

SEQ ID NO: 199104 - RNA, 26 nt, Human
uuuuaaaaagcuuaaacuuaaccuaa

SEQ ID NO: 199105 - RNA, 28 nt, Human
aaaaaaaaaaaaaaagguugaccaagag

SEQ ID NO: 199106 - RNA, 23 nt, Human
aaaaaaaaaaaaagguugaccaa

SEQ ID NO: 199107 - RNA, 23 nt, Human
aaaaaaaaaaaagcuuaaacuua

SEQ ID NO: 199108 - RNA, 20 nt, Human
aaacaaacuagacacgcgac

SEQ ID NO: 199109 - RNA, 18 nt, Human
aaaggaggauuuauuuga

SEQ ID NO: 199110 - RNA, 22 nt, Human
aacaugccaaaauguuucacuu

SEQ ID NO: 199111 - RNA, 18 nt, Human
aacuuaaaaaaaaaaaaa

SEQ ID NO: 199112 - RNA, 18 nt, Human
aagauuuaaaucaaggcc

SEQ ID NO: 199113 - RNA, 18 nt, Human
acaaacaccaagaccaaa

SEQ ID NO: 199114 - RNA, 18 nt, Human
accaagaccaaaauccua

SEQ ID NO: 199115 - RNA, 22 nt, Human
acccucccauuccguucacgcc

SEQ ID NO: 199116 - RNA, 22 nt, Human
agaaaaaaaaaaaaaaaaaaag

SEQ ID NO: 199117 - RNA, 23 nt, Human
agacaacccucccauuccguuca

SEQ ID NO: 199118 - RNA, 24 nt, Human
auacuggacaugcuagacaacccu

SEQ ID NO: 199119 - RNA, 23 nt, Human
caaaacaguguucaauuuaacgu

SEQ ID NO: 199120 - RNA, 23 nt, Human
caaaauccuaaguauugguauug

SEQ ID NO: 199121 - RNA, 19 nt, Human
caagaccaaaauccuaagg

SEQ ID NO: 199122 - RNA, 22 nt, Human
caccaagaccaaaauccuaagu

SEQ ID NO: 199123 - RNA, 23 nt, Human
ccccauccaccacucauacugga

SEQ ID NO: 199124 - RNA, 20 nt, Human
ccuaaauacgcuuacugcuu

SEQ ID NO: 199125 - RNA, 22 nt, Human
cguggcuaagacgaaaaaaaaa

SEQ ID NO: 199126 - RNA, 20 nt, Human
cuagaauuaacaaacaugcc

SEQ ID NO: 199127 - RNA, 23 nt, Human
cuagaauuaacaaacaugccaaa

SEQ ID NO: 199128 - RNA, 20 nt, Human
cucccauuccguucacgcca

SEQ ID NO: 199129 - RNA, 22 nt, Human
cuuaaaaaaaaaaaaagcuuaa

SEQ ID NO: 199130 - RNA, 23 nt, Human
cuuaaagaaaaaaaaaaaaaaaa

SEQ ID NO: 199131 - RNA, 19 nt, Human
gacacgcgacuucugcgug

SEQ ID NO: 199132 - RNA, 29 nt, Human
gucuucauaacaauccugauuuccaccac

SEQ ID NO: 199133 - RNA, 24 nt, Human
uaacauaauucaacugcuuuuacc

SEQ ID NO: 199134 - RNA, 22 nt, Human
uacaaaaaaaauaaaagcaugu

SEQ ID NO: 199135 - RNA, 20 nt, Human
uagaauuaacaaacaugcca

SEQ ID NO: 199136 - RNA, 26 nt, Human
ugggccuuaagucuucauaacaaucc

SEQ ID NO: 199137 - RNA, 20 nt, Human
uuagaguaagcauaaaucac

SEQ ID NO: 199138 - RNA, 22 nt, Human
aaagagaagcugaccaagagug

SEQ ID NO: 199139 - RNA, 21 nt, Human
aacucccacaaauguacagcu

SEQ ID NO: 199140 - RNA, 24 nt, Human
agaaagaaagauaaagaaagagaa

SEQ ID NO: 199141 - RNA, 21 nt, Human
aguaagcaugaaucacaagcc

SEQ ID NO: 199142 - RNA, 24 nt, Human
auacuggauauacuaaacaucccu

SEQ ID NO: 199143 - RNA, 25 nt, Human
caaaaagcuagaauuaacaaacaug

SEQ ID NO: 199144 - RNA, 24 nt, Human
caggauauuaaaccaaaaagcuag

SEQ ID NO: 199145 - RNA, 21 nt, Human
caugaaucacaagccuguaau

SEQ ID NO: 199146 - RNA, 23 nt, Human
ccaaacuucuaaaguauugguau

SEQ ID NO: 199147 - RNA, 18 nt, Human
cccucccauucuauucaa

SEQ ID NO: 199148 - RNA, 23 nt, Human
cuaacgauaccggguaauuuucc

SEQ ID NO: 199149 - RNA, 20 nt, Human
cuagaauuaacaaacaugcc

SEQ ID NO: 199150 - RNA, 23 nt, Human
cuagaauuaacaaacaugccaaa

SEQ ID NO: 199151 - RNA, 22 nt, Human
gacacgaccaaacuucuaaagu

SEQ ID NO: 199152 - RNA, 23 nt, Human
gcucuugguggcaaguuuggcuc

SEQ ID NO: 199153 - RNA, 18 nt, Human
guacacuccuacaacaua

SEQ ID NO: 199154 - RNA, 23 nt, Human
uaacuaacuugaggaaagcuaaa

SEQ ID NO: 199155 - RNA, 27 nt, Human
uaacuugaggaaagcuaaaaauuguuu

SEQ ID NO: 199156 - RNA, 19 nt, Human
uacaggauauuaaaccaaa

SEQ ID NO: 199157 - RNA, 20 nt, Human
uagaauuaacaaacaugcca

SEQ ID NO: 199158 - RNA, 23 nt, Human
uagcucuaacgauaccggguaau

SEQ ID NO: 199159 - RNA, 22 nt, Human
ucaacucccacaaauguacagc

SEQ ID NO: 199160 - RNA, 22 nt, Human
ucacaagccuguaaugcaaaac

SEQ ID NO: 199161 - RNA, 18 nt, Human
uccuacaacauaacuaac

SEQ ID NO: 199162 - RNA, 23 nt, Human
uccuuaaaaaaaaaaaaagugua

SEQ ID NO: 199163 - RNA, 19 nt, Human
ugaaucguagacacagcuc

SEQ ID NO: 199164 - RNA, 22 nt, Human
ugggcucuugguggcaaguuug

SEQ ID NO: 199165 - RNA, 20 nt, Human
uugggcucuugguggcaagu

SEQ ID NO: 199166 - RNA, 23 nt, Human
aaaagaaauuaaaucuguaagaa

SEQ ID NO: 199167 - RNA, 20 nt, Human
aaaccuacagaaaacauuuu

SEQ ID NO: 199168 - RNA, 21 nt, Human
agaucaucaauguuucagagc

SEQ ID NO: 199169 - RNA, 19 nt, Human
aguaaaauacaucaaccca

SEQ ID NO: 199170 - RNA, 21 nt, Human
auugaucaaagggauuaaaau

SEQ ID NO: 199171 - RNA, 22 nt, Human
cauuagccaauuuggaaaaaag

SEQ ID NO: 199172 - RNA, 18 nt, Human
ccacacuacuucuuguag

SEQ ID NO: 199173 - RNA, 18 nt, Human
cucaauaccguuugauuu

SEQ ID NO: 199174 - RNA, 25 nt, Human
cuggcaaaaacaaguaacaaguuca

SEQ ID NO: 199175 - RNA, 19 nt, Human
gcaacaaauaaaccuacag

SEQ ID NO: 199176 - RNA, 19 nt, Human
guccaguucaaagaaggga

SEQ ID NO: 199177 - RNA, 18 nt, Human
uaaaacuccaagcaggga

SEQ ID NO: 199178 - RNA, 18 nt, Human
uaaaacuccaagcaggga

SEQ ID NO: 199179 - RNA, 19 nt, Human
uaaaauacaucaacccaaa

SEQ ID NO: 199180 - RNA, 18 nt, Human
uaacugaauucacaucaa

SEQ ID NO: 199181 - RNA, 18 nt, Human
uaggaguaacuaguauau

SEQ ID NO: 199182 - RNA, 22 nt, Human
uauagaaauaauuagcugaauu

SEQ ID NO: 199183 - RNA, 24 nt, Human
uauagauucuuuaaacuaaaacuc

SEQ ID NO: 199184 - RNA, 20 nt, Human
uauugggcagaaaacugaaa

SEQ ID NO: 199185 - RNA, 21 nt, Human
ucagcuuccaacacucucaua

SEQ ID NO: 199186 - RNA, 19 nt, Human
uccaggaggaacuaaagaa

SEQ ID NO: 199187 - RNA, 23 nt, Human
ucuagggcuagaauucagcuucc

SEQ ID NO: 199188 - RNA, 20 nt, Human
ucuauugggcagaaaacuga

SEQ ID NO: 199189 - RNA, 23 nt, Human
ugaaaaauaauaauauagaaaua

SEQ ID NO: 199190 - RNA, 22 nt, Human
ugacauggacuuguugcuuaca

SEQ ID NO: 199191 - RNA, 23 nt, Human
ugagaaccuuaacccuacucuaa

SEQ ID NO: 199192 - RNA, 19 nt, Human
uggcaaaaacaaguaacaa

SEQ ID NO: 199193 - RNA, 19 nt, Human
uuaaacuaaaacuccaagc

SEQ ID NO: 199194 - RNA, 20 nt, Human
uuaacccuacucuaagacau

SEQ ID NO: 199195 - RNA, 19 nt, Human
uucaaagaagggagaaguc

SEQ ID NO: 199196 - RNA, 19 nt, Human
uucaaagaagggagaaguc

SEQ ID NO: 199197 - RNA, 22 nt, Human
uucaaagaagggagaagucguu

SEQ ID NO: 199198 - RNA, 22 nt, Human
uucggucaagugcugaaggggu

SEQ ID NO: 199199 - RNA, 22 nt, Human
uugggcagaaaacugaaaauac

SEQ ID NO: 199200 - RNA, 21 nt, Human
uuuaaacuaaaacuccaagca

SEQ ID NO: 199201 - RNA, 30 nt, Human
uuuggagacauuuuugguauuucggucaaa

SEQ ID NO: 199202 - RNA, 27 nt, Human
aaaaacaaacaaaaaauccccagcuua

SEQ ID NO: 199203 - RNA, 27 nt, Human
aaaaacaaacaaaaaauccccagcuua

SEQ ID NO: 199204 - RNA, 25 nt, Human
aaaaauaaaauccacucacucugcu

SEQ ID NO: 199205 - RNA, 25 nt, Human
aaaaauaaaauccacucacucugcu

SEQ ID NO: 199206 - RNA, 18 nt, Human
aaaacaaacaaaaaaucc

SEQ ID NO: 199207 - RNA, 18 nt, Human
aaaacaaacaaaaaaucc

SEQ ID NO: 199208 - RNA, 23 nt, Human
aaaacaaacaaaaaauccccagc

SEQ ID NO: 199209 - RNA, 20 nt, Human
aaaauuguugaaaaguaggg

SEQ ID NO: 199210 - RNA, 20 nt, Human
aaaauuguugaaaaguaggg

SEQ ID NO: 199211 - RNA, 19 nt, Human
aaacaaacaaaaaaucccc

SEQ ID NO: 199212 - RNA, 19 nt, Human
aaacaaacaaaaaaucccc

SEQ ID NO: 199213 - RNA, 22 nt, Human
aaacaaacaaaaaauccccagc

SEQ ID NO: 199214 - RNA, 22 nt, Human
aaacagaagcagauaaaaaaaa

SEQ ID NO: 199215 - RNA, 19 nt, Human
aaacauuccuacauaaucc

SEQ ID NO: 199216 - RNA, 19 nt, Human
aaacauuccuacauaaucc

SEQ ID NO: 199217 - RNA, 18 nt, Human
aaauguuacagugaccac

SEQ ID NO: 199218 - RNA, 20 nt, Human
aacuuguaguacugcucccc

SEQ ID NO: 199219 - RNA, 20 nt, Human
aacuuguaguacugcucccc

SEQ ID NO: 199220 - RNA, 21 nt, Human
aagaacuaaaacauuacaucu

SEQ ID NO: 199221 - RNA, 19 nt, Human
acacaaacauuccuacaua

SEQ ID NO: 199222 - RNA, 19 nt, Human
acacaaacauuccuacaua

SEQ ID NO: 199223 - RNA, 18 nt, Human
accuuaguucuucacaac

SEQ ID NO: 199224 - RNA, 19 nt, Human
acuacaccucaaaugcaga

SEQ ID NO: 199225 - RNA, 21 nt, Human
acugcuccccaccuuaguucu

SEQ ID NO: 199226 - RNA, 21 nt, Human
acugcuccccaccuuaguucu

SEQ ID NO: 199227 - RNA, 18 nt, Human
agaagcagauaaaaaaaa

SEQ ID NO: 199228 - RNA, 19 nt, Human
agaugccagggacaugugg

SEQ ID NO: 199229 - RNA, 19 nt, Human
agaugccagggacaugugg

SEQ ID NO: 199230 - RNA, 18 nt, Human
agcagagaaacagaggaa

SEQ ID NO: 199231 - RNA, 19 nt, Human
aggagcugaaaauuaaacu

SEQ ID NO: 199232 - RNA, 19 nt, Human
aggagcugaaaauuaaacu

SEQ ID NO: 199233 - RNA, 18 nt, Human
aggucggugcagcagaga

SEQ ID NO: 199234 - RNA, 20 nt, Human
auacuacacaaaacauccac

SEQ ID NO: 199235 - RNA, 20 nt, Human
auacuacacaaaacauccac

SEQ ID NO: 199236 - RNA, 23 nt, Human
augccaagauacuacacaaaaca

SEQ ID NO: 199237 - RNA, 22 nt, Human
caaaugccaagauacuacacag

SEQ ID NO: 199238 - RNA, 22 nt, Human
caaaugccaagauacuacacag

SEQ ID NO: 199239 - RNA, 18 nt, Human
caacagaggagcugaaaa

SEQ ID NO: 199240 - RNA, 19 nt, Human
caagaaaucaccagaacua

SEQ ID NO: 199241 - RNA, 19 nt, Human
caagaaaucaccagaacua

SEQ ID NO: 199242 - RNA, 22 nt, Human
caagagaugcacuuauaugucc

SEQ ID NO: 199243 - RNA, 22 nt, Human
caagagaugcacuuauaugucc

SEQ ID NO: 199244 - RNA, 24 nt, Human
caccaacaauaacgaaaaauaaaa

SEQ ID NO: 199245 - RNA, 26 nt, Human
caccaacaauaacgaaaaauaaaauc

SEQ ID NO: 199246 - RNA, 19 nt, Human
caccacaauaacgaaaaau

SEQ ID NO: 199247 - RNA, 21 nt, Human
caccagaacuaaguuugccaa

SEQ ID NO: 199248 - RNA, 21 nt, Human
caccagaacuaaguuugccaa

SEQ ID NO: 199249 - RNA, 19 nt, Human
caccuuaguucuucacaac

SEQ ID NO: 199250 - RNA, 20 nt, Human
cacgcccuucccccccccaa

SEQ ID NO: 199251 - RNA, 20 nt, Human
cacgcccuucccccccccaa

SEQ ID NO: 199252 - RNA, 23 nt, Human
cacgcccuucccccccccaaccc

SEQ ID NO: 199253 - RNA, 23 nt, Human
cacgcccuucccccccccaaccc

SEQ ID NO: 199254 - RNA, 21 nt, Human
cagaacaccuaugaagcagag

SEQ ID NO: 199255 - RNA, 18 nt, Human
cagaagcagauaaaaaaa

SEQ ID NO: 199256 - RNA, 24 nt, Human
cagaagcagauaaaaaaaaaaaga

SEQ ID NO: 199257 - RNA, 20 nt, Human
ccaaauguuacagugaccac

SEQ ID NO: 199258 - RNA, 22 nt, Human
ccaagauacuacacaaaacauc

SEQ ID NO: 199259 - RNA, 22 nt, Human
ccaagauacuacacaaaacauc

SEQ ID NO: 199260 - RNA, 22 nt, Human
ccagaauacugcuucacacuau

SEQ ID NO: 199261 - RNA, 25 nt, Human
cccaacccuguuuguaagaacuaaa

SEQ ID NO: 199262 - RNA, 25 nt, Human
cccaccccccaaauguuacagugac

SEQ ID NO: 199263 - RNA, 25 nt, Human
cccaccccccaaauguuacagugac

SEQ ID NO: 199264 - RNA, 24 nt, Human
ccucccuggcccaccccccaaaug

SEQ ID NO: 199265 - RNA, 22 nt, Human
ccucccugucccaccccccaaa

SEQ ID NO: 199266 - RNA, 18 nt, Human
ccuggcccaccccccaaa

SEQ ID NO: 199267 - RNA, 20 nt, Human
cgaaaaauaaaauccacuca

SEQ ID NO: 199268 - RNA, 21 nt, Human
cgcccuucccccccccaaccc

SEQ ID NO: 199269 - RNA, 21 nt, Human
cgcccuucccccccccaaccc

SEQ ID NO: 199270 - RNA, 19 nt, Human
cggaccaacaacugacacc

SEQ ID NO: 199271 - RNA, 19 nt, Human
cggaccaacaacugacacc

SEQ ID NO: 199272 - RNA, 24 nt, Human
cuauuguuacuuuuccucccuggc

SEQ ID NO: 199273 - RNA, 18 nt, Human
cucccugucccacccccc

SEQ ID NO: 199274 - RNA, 23 nt, Human
cucccugucccaccccccaaaug

SEQ ID NO: 199275 - RNA, 26 nt, Human
cugaagcguucugggucggaccaaca

SEQ ID NO: 199276 - RNA, 26 nt, Human
cugaagcguucugggucggaccaaca

SEQ ID NO: 199277 - RNA, 23 nt, Human
cuuaaaaaaaaaaugaccaccaa

SEQ ID NO: 199278 - RNA, 23 nt, Human
cuuaaaaaaaaaaugaccaccaa

SEQ ID NO: 199279 - RNA, 22 nt, Human
cuucccagcaauagacuuccaa

SEQ ID NO: 199280 - RNA, 22 nt, Human
cuucccagcaauagacuuccaa

SEQ ID NO: 199281 - RNA, 21 nt, Human
gcacgcccuucccccccccaa

SEQ ID NO: 199282 - RNA, 21 nt, Human
gcacgcccuucccccccccaa

SEQ ID NO: 199283 - RNA, 25 nt, Human
gcacgcccuucccccccccaacccu

SEQ ID NO: 199284 - RNA, 25 nt, Human
gcacgcccuucccccccccaacccu

SEQ ID NO: 199285 - RNA, 18 nt, Human
gcagaacaccuaugaagc

SEQ ID NO: 199286 - RNA, 22 nt, Human
gcagaacaccuaugaagcagag

SEQ ID NO: 199287 - RNA, 23 nt, Human
gcagaacaccuaugaagcagagg

SEQ ID NO: 199288 - RNA, 20 nt, Human
gcccaccccccaaauguuac

SEQ ID NO: 199289 - RNA, 20 nt, Human
ggguggguugggaaauucag

SEQ ID NO: 199290 - RNA, 20 nt, Human
ggguggguugggaaauucag

SEQ ID NO: 199291 - RNA, 23 nt, Human
ggguguuuuauuuauuuggaagu

SEQ ID NO: 199292 - RNA, 23 nt, Human
ggguguuuuauuuauuuggaagu

SEQ ID NO: 199293 - RNA, 23 nt, Human
uaaaaaaaaaaugaccaccaaaa

SEQ ID NO: 199294 - RNA, 23 nt, Human
uaaaaaaaaaaugaccaccaaaa

SEQ ID NO: 199295 - RNA, 25 nt, Human
uaaaccaccaacaauaacgaaaaau

SEQ ID NO: 199296 - RNA, 18 nt, Human
uacacaaaacauccacag

SEQ ID NO: 199297 - RNA, 22 nt, Human
uacacaaaacauccacaggaac

SEQ ID NO: 199298 - RNA, 23 nt, Human
uacacaaacauuccuacauaauc

SEQ ID NO: 199299 - RNA, 23 nt, Human
uacacaaacauuccuacauaauc

SEQ ID NO: 199300 - RNA, 20 nt, Human
uacagugaccacaaagcaag

SEQ ID NO: 199301 - RNA, 20 nt, Human
uacagugaccacaaagcaag

SEQ ID NO: 199302 - RNA, 18 nt, Human
uacuacacaaaacaucca

SEQ ID NO: 199303 - RNA, 18 nt, Human
uacuacacaaaacaucca

SEQ ID NO: 199304 - RNA, 28 nt, Human
uagaaaauuguugaaaaguaggggcaag

SEQ ID NO: 199305 - RNA, 28 nt, Human
uagaaaauuguugaaaaguaggggcaag

SEQ ID NO: 199306 - RNA, 23 nt, Human
uaggggcaagcauuugcaaaaac

SEQ ID NO: 199307 - RNA, 23 nt, Human
uaggggcaagcauuugcaaaaac

SEQ ID NO: 199308 - RNA, 25 nt, Human
uauaaaaaagaaaaaauaucuugca

SEQ ID NO: 199309 - RNA, 18 nt, Human
uaugaagcagaggaaugu

SEQ ID NO: 199310 - RNA, 23 nt, Human
uauuaaacgggcacaccaaucag

SEQ ID NO: 199311 - RNA, 23 nt, Human
uauuaaacgggcacaccaaucag

SEQ ID NO: 199312 - RNA, 19 nt, Human
ucacacuauaaaaaagaaa

SEQ ID NO: 199313 - RNA, 22 nt, Human
uccaacauacaacagagaaaug

SEQ ID NO: 199314 - RNA, 22 nt, Human
uccaacauacaacagagaaaug

SEQ ID NO: 199315 - RNA, 21 nt, Human
uccccaccuuaguucuucaca

SEQ ID NO: 199316 - RNA, 21 nt, Human
uccccaccuuaguucuucaca

SEQ ID NO: 199317 - RNA, 23 nt, Human
ucugcaaugcugucgccuggagc

SEQ ID NO: 199318 - RNA, 18 nt, Human
ugaacagaugccagggac

SEQ ID NO: 199319 - RNA, 18 nt, Human
ugaacagaugccagggac

SEQ ID NO: 199320 - RNA, 21 nt, Human
ugaacagaugccagggacaug

SEQ ID NO: 199321 - RNA, 21 nt, Human
ugaacagaugccagggacaug

SEQ ID NO: 199322 - RNA, 25 nt, Human
ugaacagaugccagggacaugugga

SEQ ID NO: 199323 - RNA, 25 nt, Human
ugaacagaugccagggacaugugga

SEQ ID NO: 199324 - RNA, 19 nt, Human
ugauuaauaaacuugcugc

SEQ ID NO: 199325 - RNA, 19 nt, Human
ugauuaauaaacuugcugc

SEQ ID NO: 199326 - RNA, 23 nt, Human
ugcacgcccuucccccccccaac

SEQ ID NO: 199327 - RNA, 23 nt, Human
ugcacgcccuucccccccccaac

SEQ ID NO: 199328 - RNA, 21 nt, Human
ugcagcagagaaacagaggau

SEQ ID NO: 199329 - RNA, 22 nt, Human
ugccaagauacuacacaaaaca

SEQ ID NO: 199330 - RNA, 24 nt, Human
ugggucggaccaacaacugacacc

SEQ ID NO: 199331 - RNA, 24 nt, Human
ugggucggaccaacaacugacacc

SEQ ID NO: 199332 - RNA, 22 nt, Human
uguacacaaacauuccuacaua

SEQ ID NO: 199333 - RNA, 20 nt, Human
uguuacuuuuccucccuggc

SEQ ID NO: 199334 - RNA, 20 nt, Human
uuaaacgggcacaccaauca

SEQ ID NO: 199335 - RNA, 20 nt, Human
uuaaacgggcacaccaauca

SEQ ID NO: 199336 - RNA, 26 nt, Human
uuaauaaacuugcugccaaucagaau

SEQ ID NO: 199337 - RNA, 26 nt, Human
uuaauaaacuugcugccaaucagaau

SEQ ID NO: 199338 - RNA, 20 nt, Human
uucccagcaauagacuucca

SEQ ID NO: 199339 - RNA, 20 nt, Human
uucccagcaauagacuucca

SEQ ID NO: 199340 - RNA, 24 nt, Human
uuccucccuggcccaccccccaaa

SEQ ID NO: 199341 - RNA, 25 nt, Human
uucuucccagcaauagacuuccaaa

SEQ ID NO: 199342 - RNA, 25 nt, Human
uucuucccagcaauagacuuccaaa

SEQ ID NO: 199343 - RNA, 23 nt, Human
uugccaaguuauuuugccuaugu

SEQ ID NO: 199344 - RNA, 23 nt, Human
uugccaaguuauuuugccuaugu

SEQ ID NO: 199345 - RNA, 23 nt, Human
uuguacacaaacauuccuacaua

SEQ ID NO: 199346 - RNA, 20 nt, Human
uuugcacgcccuuccccccc

SEQ ID NO: 199347 - RNA, 21 nt, Human
uuugcacgcccuucccccccc

SEQ ID NO: 199348 - RNA, 18 nt, Human
aagaugccacaacuacaa

SEQ ID NO: 199349 - RNA, 24 nt, Human
aauuaccccaaaaagcaacugaau

SEQ ID NO: 199350 - RNA, 20 nt, Human
acaagaaaaaauacaaauuc

SEQ ID NO: 199351 - RNA, 26 nt, Human
accccaaaaagcaacugaauuuuuua

SEQ ID NO: 199352 - RNA, 20 nt, Human
agaaaaaauacaaauucaga

SEQ ID NO: 199353 - RNA, 18 nt, Human
caaccaguaacaccugcg

SEQ ID NO: 199354 - RNA, 19 nt, Human
caaccaguaacaccugcgc

SEQ ID NO: 199355 - RNA, 23 nt, Human
caagaugccacaacuacaaaaaa

SEQ ID NO: 199356 - RNA, 19 nt, Human
caguaacaccugcgccccc

SEQ ID NO: 199357 - RNA, 21 nt, Human
ccaacaaauuaaaaugguuaa

SEQ ID NO: 199358 - RNA, 22 nt, Human
ccacgccccgucgccgcgcagg

SEQ ID NO: 199359 - RNA, 18 nt, Human
cccacucgcccgcggcca

SEQ ID NO: 199360 - RNA, 20 nt, Human
cccacucgcccgcggccacg

SEQ ID NO: 199361 - RNA, 23 nt, Human
cccccgcucccggcugccuccuu

SEQ ID NO: 199362 - RNA, 19 nt, Human
cccgacgcaaccaguaaca

SEQ ID NO: 199363 - RNA, 25 nt, Human
ccggcagcuguugaucgcuucucuc

SEQ ID NO: 199364 - RNA, 23 nt, Human
cgccgcgcaggcgcagaccggca

SEQ ID NO: 199365 - RNA, 18 nt, Human
cugcgcccccgcucccgg

SEQ ID NO: 199366 - RNA, 23 nt, Human
gcagaccggcagcuguugaucgc

SEQ ID NO: 199367 - RNA, 24 nt, Human
gcagaccggcagcuguugaucgcu

SEQ ID NO: 199368 - RNA, 27 nt, Human
gccacaacuacaaaaaaaauugcgcac

SEQ ID NO: 199369 - RNA, 18 nt, Human
gcugccuccuuggcccca

SEQ ID NO: 199370 - RNA, 25 nt, Human
uaaaaaaguaauucaaauuacccca

SEQ ID NO: 199371 - RNA, 23 nt, Human
uaauucaaauuaccccaaaaagc

SEQ ID NO: 199372 - RNA, 23 nt, Human
ucaaagucauauucgaugucaac

SEQ ID NO: 199373 - RNA, 27 nt, Human
ugccacaacuacaaaaaaaauugcgca

SEQ ID NO: 199374 - RNA, 21 nt, Human
ugcgcgcccacgugacccgac

SEQ ID NO: 199375 - RNA, 19 nt, Human
ugucaacaagaugccacaa

SEQ ID NO: 199376 - RNA, 20 nt, Human
uuuuuuuuuuuucaggaacc

SEQ ID NO: 199377 - RNA, 23 nt, Human
uuuuuuuuuuuuuuuuuuucagg

SEQ ID NO: 199378 - RNA, 26 nt, Human
aaaaaaaaaaaaaaaagcaaccaaag

SEQ ID NO: 199379 - RNA, 24 nt, Human
aaaaaaaaaaaaaaagcaaccaaa

SEQ ID NO: 199380 - RNA, 23 nt, Human
aaaaaaaaaaagcaaccaaagaa

SEQ ID NO: 199381 - RNA, 18 nt, Human
aaaaaaaaaaagcaaccc

SEQ ID NO: 199382 - RNA, 18 nt, Human
aaaaaaaagcaaccaaag

SEQ ID NO: 199383 - RNA, 18 nt, Human
aaaaagcaaccaaagaaa

SEQ ID NO: 199384 - RNA, 19 nt, Human
aaaaggcccaagaacccuu

SEQ ID NO: 199385 - RNA, 24 nt, Human
aaaaggcccaagaacccuucugaa

SEQ ID NO: 199386 - RNA, 20 nt, Human
aacaaauucacauugaaaac

SEQ ID NO: 199387 - RNA, 22 nt, Human
aaccccuucuuaacacggauau

SEQ ID NO: 199388 - RNA, 22 nt, Human
aaccgggcagcccagcuggccc

SEQ ID NO: 199389 - RNA, 25 nt, Human
aaggagaggaaauaaauucagagaa

SEQ ID NO: 199390 - RNA, 18 nt, Human
acccacgucuucggccaa

SEQ ID NO: 199391 - RNA, 19 nt, Human
accuaaaaaaaaaaaaaaa

SEQ ID NO: 199392 - RNA, 23 nt, Human
acuucugagagugcucugaggcu

SEQ ID NO: 199393 - RNA, 18 nt, Human
agaaaaaagguggguggg

SEQ ID NO: 199394 - RNA, 26 nt, Human
agaacccuucugaaccaucaggguac

SEQ ID NO: 199395 - RNA, 19 nt, Human
agagagaaaaggaaggaag

SEQ ID NO: 199396 - RNA, 19 nt, Human
agaggaaauaaauucagag

SEQ ID NO: 199397 - RNA, 18 nt, Human
agagugcucugaggcuag

SEQ ID NO: 199398 - RNA, 26 nt, Human
agcaaggaaugaagaacucucaaaac

SEQ ID NO: 199399 - RNA, 24 nt, Human
agccagagggcugcugcguccggc

SEQ ID NO: 199400 - RNA, 23 nt, Human
agccccuguuucaaagcgccuuu

SEQ ID NO: 199401 - RNA, 21 nt, Human
aggaagagcauggagcagaag

SEQ ID NO: 199402 - RNA, 18 nt, Human
aggaagcuaaugcuggga

SEQ ID NO: 199403 - RNA, 23 nt, Human
agggugcagggccaguggccuau

SEQ ID NO: 199404 - RNA, 18 nt, Human
agguggguggggggagac

SEQ ID NO: 199405 - RNA, 20 nt, Human
agguggguggggggagacuc

SEQ ID NO: 199406 - RNA, 22 nt, Human
agucauccuugcacagagagcc

SEQ ID NO: 199407 - RNA, 19 nt, Human
agugcggggcggagaagag

SEQ ID NO: 199408 - RNA, 21 nt, Human
caaggaaugaagaacucucaa

SEQ ID NO: 199409 - RNA, 19 nt, Human
cagaccgcgaagcaucccc

SEQ ID NO: 199410 - RNA, 18 nt, Human
cagaccguuucaugagcu

SEQ ID NO: 199411 - RNA, 18 nt, Human
cagagaaugccaaauacu

SEQ ID NO: 199412 - RNA, 18 nt, Human
cagagggcugcugcgucc

SEQ ID NO: 199413 - RNA, 27 nt, Human
cagcauacacacacggaaagacguaca

SEQ ID NO: 199414 - RNA, 21 nt, Human
cagccccugcgcccucagccu

SEQ ID NO: 199415 - RNA, 18 nt, Human
cagccgccuggagcccca

SEQ ID NO: 199416 - RNA, 18 nt, Human
cagcugggaaccgggcag

SEQ ID NO: 199417 - RNA, 24 nt, Human
caggaagagauaaauaucgcuaug

SEQ ID NO: 199418 - RNA, 24 nt, Human
caggccccaugcuggagccagagg

SEQ ID NO: 199419 - RNA, 22 nt, Human
caguggccuaucgaggagcagg

SEQ ID NO: 199420 - RNA, 18 nt, Human
cauggagcagaagaccgc

SEQ ID NO: 199421 - RNA, 23 nt, Human
ccaauacacaauugaacaaaagg

SEQ ID NO: 199422 - RNA, 18 nt, Human
cccaugcuggagccagag

SEQ ID NO: 199423 - RNA, 21 nt, Human
cccaugcuggagccagagggc

SEQ ID NO: 199424 - RNA, 21 nt, Human
cccccggcugggccgcggggc

SEQ ID NO: 199425 - RNA, 25 nt, Human
ccccgcggucacgugacacuccgcc

SEQ ID NO: 199426 - RNA, 20 nt, Human
ccgccuggagccccagccgc

SEQ ID NO: 199427 - RNA, 24 nt, Human
cgaacggauggggauaaauaauau

SEQ ID NO: 199428 - RNA, 24 nt, Human
cgccuggagccccagccgccaucc

SEQ ID NO: 199429 - RNA, 26 nt, Human
cuaaaaaaaaaaaaaaaagcaaccaa

SEQ ID NO: 199430 - RNA, 24 nt, Human
cuggggccauaaaaagaaagcugg

SEQ ID NO: 199431 - RNA, 28 nt, Human
cuguuucaaagcgccuuugauuuuuuuu

SEQ ID NO: 199432 - RNA, 21 nt, Human
gaaccuaaaaaaaaaaaaaaa

SEQ ID NO: 199433 - RNA, 21 nt, Human
gagccccagccgccauccuga

SEQ ID NO: 199434 - RNA, 21 nt, Human
gcagacccacgucuucggcca

SEQ ID NO: 199435 - RNA, 21 nt, Human
gcccaagaacccuucugaacc

SEQ ID NO: 199436 - RNA, 24 nt, Human
gcccugcguuaucccccggcuggg

SEQ ID NO: 199437 - RNA, 18 nt, Human
gcuggagccagagggcug

SEQ ID NO: 199438 - RNA, 26 nt, Human
ggaaagacguacacuuagucauccuu

SEQ ID NO: 199439 - RNA, 20 nt, Human
ggaaagugcucggcauccuc

SEQ ID NO: 199440 - RNA, 21 nt, Human
ggaagcuaaugcugggauucc

SEQ ID NO: 199441 - RNA, 26 nt, Human
ggcaggaagaaccuaaaaaaaaaaaa

SEQ ID NO: 199442 - RNA, 25 nt, Human
gggagacucuccuggcgcguagccc

SEQ ID NO: 199443 - RNA, 18 nt, Human
gucuucggccaaagaacc

SEQ ID NO: 199444 - RNA, 19 nt, Human
gugcgcucccgcugcgccu

SEQ ID NO: 199445 - RNA, 19 nt, Human
uaaacuauaaaaacgccuu

SEQ ID NO: 199446 - RNA, 21 nt, Human
uacacacacggaaagacguac

SEQ ID NO: 199447 - RNA, 24 nt, Human
uaccagagcugccgcagccgccug

SEQ ID NO: 199448 - RNA, 21 nt, Human
uaugauacagccauuccagca

SEQ ID NO: 199449 - RNA, 25 nt, Human
ucaaaagcuggaucuucucugguca

SEQ ID NO: 199450 - RNA, 23 nt, Human
ucaaagaguggagaagguaaagg

SEQ ID NO: 199451 - RNA, 21 nt, Human
ucagucccuuucaaacuguuu

SEQ ID NO: 199452 - RNA, 19 nt, Human
uccgugcacagcacucggc

SEQ ID NO: 199453 - RNA, 20 nt, Human
uccgugcacagcacucggca

SEQ ID NO: 199454 - RNA, 26 nt, Human
uccguuugcuggagaccugggugagc

SEQ ID NO: 199455 - RNA, 18 nt, Human
uccuugcacagagagccc

SEQ ID NO: 199456 - RNA, 24 nt, Human
uccuugcacagagagccccuguuu

SEQ ID NO: 199457 - RNA, 26 nt, Human
ucuaaaaaucuucucuuuucuggucu

SEQ ID NO: 199458 - RNA, 19 nt, Human
ucuucucuuuucuggucuu

SEQ ID NO: 199459 - RNA, 20 nt, Human
ugaagaacucucaaaacaaa

SEQ ID NO: 199460 - RNA, 20 nt, Human
ugagccucagucccuuucaa

SEQ ID NO: 199461 - RNA, 20 nt, Human
ugaucgcacacucugacagg

SEQ ID NO: 199462 - RNA, 23 nt, Human
uggccaggccccaugcuggagcc

SEQ ID NO: 199463 - RNA, 22 nt, Human
uggcuaauaccgagguuuagga

SEQ ID NO: 199464 - RNA, 24 nt, Human
uguucaccagcauacacacacgga

SEQ ID NO: 199465 - RNA, 18 nt, Human
uucuuccgugcacagcac

SEQ ID NO: 199466 - RNA, 23 nt, Human
uugaacaaaaggcccaagaaccc

SEQ ID NO: 199467 - RNA, 20 nt, Human
uugcaguuuuauuacaaaga

SEQ ID NO: 199468 - RNA, 20 nt, Human
uuucucagaaugugagcaac

SEQ ID NO: 199469 - RNA, 26 nt, Human
aaacaagaucauuuauuaccuuccaa

SEQ ID NO: 199470 - RNA, 19 nt, Human
aaauguuggaggucagccu

SEQ ID NO: 199471 - RNA, 23 nt, Human
aagacaaggcaccuguccucaac

SEQ ID NO: 199472 - RNA, 18 nt, Human
aagcaagagcaagaagug

SEQ ID NO: 199473 - RNA, 19 nt, Human
aagcaagagcaagaaguga

SEQ ID NO: 199474 - RNA, 19 nt, Human
aaugugaugaauacaacgu

SEQ ID NO: 199475 - RNA, 22 nt, Human
acuacugguccccuccuccccc

SEQ ID NO: 199476 - RNA, 23 nt, Human
acuacugguccccuccucccccu

SEQ ID NO: 199477 - RNA, 18 nt, Human
agagaagcaagcaagagc

SEQ ID NO: 199478 - RNA, 23 nt, Human
agagaagcaagcaagagcaagaa

SEQ ID NO: 199479 - RNA, 24 nt, Human
agcaagaagugagcagaagggacc

SEQ ID NO: 199480 - RNA, 21 nt, Human
agcagaauuuccaagcuggga

SEQ ID NO: 199481 - RNA, 19 nt, Human
auggagacagggacaccag

SEQ ID NO: 199482 - RNA, 23 nt, Human
augggacaguaaaaacagauaag

SEQ ID NO: 199483 - RNA, 20 nt, Human
caacguguuaaagacaaggc

SEQ ID NO: 199484 - RNA, 23 nt, Human
caccuguccucaacggagcuuua

SEQ ID NO: 199485 - RNA, 20 nt, Human
cagcccuuccuucuuuuuuu

SEQ ID NO: 199486 - RNA, 22 nt, Human
cagggacaccagcuagggaggc

SEQ ID NO: 199487 - RNA, 24 nt, Human
cagugcccuuagcagcaaaauuuu

SEQ ID NO: 199488 - RNA, 19 nt, Human
caucccucagcaauuacuc

SEQ ID NO: 199489 - RNA, 21 nt, Human
ccaccagagaagcaagcaaga

SEQ ID NO: 199490 - RNA, 21 nt, Human
ccagagaagcaagcaagagca

SEQ ID NO: 199491 - RNA, 25 nt, Human
ccaggaaaagaggaaaacaagauca

SEQ ID NO: 199492 - RNA, 19 nt, Human
ccccuccucccccuaguuu

SEQ ID NO: 199493 - RNA, 18 nt, Human
ccggugcagagagggccc

SEQ ID NO: 199494 - RNA, 23 nt, Human
cgcaccuccaccaugaccagccc

SEQ ID NO: 199495 - RNA, 21 nt, Human
cggugcagagagggccccgga

SEQ ID NO: 199496 - RNA, 19 nt, Human
cuacugguccccuccuccc

SEQ ID NO: 199497 - RNA, 26 nt, Human
cuuuuuuuuuuuuuuuuuccauuuuu

SEQ ID NO: 199498 - RNA, 24 nt, Human
gaagcccaccagagaagcaagcaa

SEQ ID NO: 199499 - RNA, 22 nt, Human
gcaccuccaccaugaccagccc

SEQ ID NO: 199500 - RNA, 22 nt, Human
gccaaagauucaguauuguuag

SEQ ID NO: 199501 - RNA, 24 nt, Human
ggagcccuuccagggagagcgcuu

SEQ ID NO: 199502 - RNA, 21 nt, Human
ggccagcggacaauaguggaa

SEQ ID NO: 199503 - RNA, 19 nt, Human
guccaguuuacaggcugga

SEQ ID NO: 199504 - RNA, 23 nt, Human
gugaaacacaggagcccuuccag

SEQ ID NO: 199505 - RNA, 19 nt, Human
guggaagguggauucagga

SEQ ID NO: 199506 - RNA, 23 nt, Human
uaaguaaaaccagugagucucuu

SEQ ID NO: 199507 - RNA, 19 nt, Human
uacaagaugccugggaaga

SEQ ID NO: 199508 - RNA, 21 nt, Human
uacacccccagauuuacacca

SEQ ID NO: 199509 - RNA, 21 nt, Human
uacacccccagauuuacacca

SEQ ID NO: 199510 - RNA, 20 nt, Human
uaguaagucauuaguacuac

SEQ ID NO: 199511 - RNA, 18 nt, Human
uauuccagaugggcagug

SEQ ID NO: 199512 - RNA, 19 nt, Human
ucagccaagagcgccaggc

SEQ ID NO: 199513 - RNA, 21 nt, Human
ucaucccucagcaauuacucc

SEQ ID NO: 199514 - RNA, 19 nt, Human
uccggugcagagagggccc

SEQ ID NO: 199515 - RNA, 21 nt, Human
uccuugcgcaccuccaccaug

SEQ ID NO: 199516 - RNA, 23 nt, Human
ucuccuugcgcaccuccaccaug

SEQ ID NO: 199517 - RNA, 21 nt, Human
ucugugaucacuuucuggaac

SEQ ID NO: 199518 - RNA, 18 nt, Human
ucuuuuuuuuuuuuuuuu

SEQ ID NO: 199519 - RNA, 23 nt, Human
ugaaacacaggagcccuuccagg

SEQ ID NO: 199520 - RNA, 18 nt, Human
ugauaaauguaacgacgu

SEQ ID NO: 199521 - RNA, 18 nt, Human
ugauuuguuguccggcag

SEQ ID NO: 199522 - RNA, 18 nt, Human
ugauuuguuguccggcag

SEQ ID NO: 199523 - RNA, 20 nt, Human
ugcgcaccuccaccaugacc

SEQ ID NO: 199524 - RNA, 19 nt, Human
uggaaagggccagcggaca

SEQ ID NO: 199525 - RNA, 24 nt, Human
ugucccggccacuuagauuaaaau

SEQ ID NO: 199526 - RNA, 20 nt, Human
uguuucuccuugcgcaccuc

SEQ ID NO: 199527 - RNA, 24 nt, Human
uuaauauuaaccauaugaucugau

SEQ ID NO: 199528 - RNA, 19 nt, Human
uuagauuaaaauguuggag

SEQ ID NO: 199529 - RNA, 23 nt, Human
uuaguacuacugguccccuccuc

SEQ ID NO: 199530 - RNA, 22 nt, Human
uuccagggagagcgcuugguuu

SEQ ID NO: 199531 - RNA, 20 nt, Human
agccugggauagggcuggac

SEQ ID NO: 199532 - RNA, 19 nt, Human
aggcagugaagccaggccu

SEQ ID NO: 199533 - RNA, 22 nt, Human
cuccagugccuggaagccccau

SEQ ID NO: 199534 - RNA, 22 nt, Human
gccuggguugggagagccuggg

SEQ ID NO: 199535 - RNA, 23 nt, Human
gccuggguugggagagccuggga

SEQ ID NO: 199536 - RNA, 21 nt, Human
gggauagggcuggacuggggc

SEQ ID NO: 199537 - RNA, 18 nt, Human
gggcuggacuggggcgcu

SEQ ID NO: 199538 - RNA, 19 nt, Human
acaugggguuccgucuccc

SEQ ID NO: 199539 - RNA, 23 nt, Human
agccugggcuuggcagguuucug

SEQ ID NO: 199540 - RNA, 23 nt, Human
auccaaagcguuuuaaaucgcuc

SEQ ID NO: 199541 - RNA, 19 nt, Human
caguggccugggaagggug

SEQ ID NO: 199542 - RNA, 23 nt, Human
ccacccaggccgggggaauccaa

SEQ ID NO: 199543 - RNA, 19 nt, Human
ccagcucgcucuccccacc

SEQ ID NO: 199544 - RNA, 23 nt, Human
cccaggccgggggaauccaaagc

SEQ ID NO: 199545 - RNA, 20 nt, Human
ccccacuuucgcuccuccca

SEQ ID NO: 199546 - RNA, 22 nt, Human
ccccacuuucgcuccucccacc

SEQ ID NO: 199547 - RNA, 23 nt, Human
ccucucagcagaguccuuggccc

SEQ ID NO: 199548 - RNA, 25 nt, Human
cgcuccugaggaacaguccagcagc

SEQ ID NO: 199549 - RNA, 24 nt, Human
cucagcagaguccuuggccccagc

SEQ ID NO: 199550 - RNA, 19 nt, Human
cugggcuuggcagguuucu

SEQ ID NO: 199551 - RNA, 23 nt, Human
cuuggccccagccugggcuuggc

SEQ ID NO: 199552 - RNA, 19 nt, Human
gccccagccugggcuuggc

SEQ ID NO: 199553 - RNA, 20 nt, Human
ggaacaguccagcagccagu

SEQ ID NO: 199554 - RNA, 23 nt, Human
uaggggccucucagcagaguccu

SEQ ID NO: 199555 - RNA, 19 nt, Human
ucagcagaguccuuggccc

SEQ ID NO: 199556 - RNA, 20 nt, Human
uccccacccaggccggggga

SEQ ID NO: 199557 - RNA, 18 nt, Human
ugacugggccagguucuu

SEQ ID NO: 199558 - RNA, 21 nt, Human
ugaggaacaguccagcagcca

SEQ ID NO: 199559 - RNA, 27 nt, Human
ugcgggggcggggaaucuagggggcac

SEQ ID NO: 199560 - RNA, 18 nt, Human
ugggaaggguguugucuc

SEQ ID NO: 199561 - RNA, 22 nt, Human
ugggcuuggcagguuucugguc

SEQ ID NO: 199562 - RNA, 27 nt, Human
ugguggagugggccugucacauggggu

SEQ ID NO: 199563 - RNA, 21 nt, Human
uuaaaucgcucccagcucgca

SEQ ID NO: 199564 - RNA, 23 nt, Human
uucuuugggaacccugguggagu

SEQ ID NO: 199565 - RNA, 24 nt, Human
uugucucuaggggccucucagcag

SEQ ID NO: 199566 - RNA, 19 nt, Human
aaaacacauaagucuaugc

SEQ ID NO: 199567 - RNA, 21 nt, Human
aaauaaucuacagucuaaaac

SEQ ID NO: 199568 - RNA, 22 nt, Human
aagaagaaaggaaguggauuaa

SEQ ID NO: 199569 - RNA, 20 nt, Human
aagaagaagaaaggaagugg

SEQ ID NO: 199570 - RNA, 22 nt, Human
aagaagaagaaaggaaguggaa

SEQ ID NO: 199571 - RNA, 22 nt, Human
aaggaccgggaggaggaaacag

SEQ ID NO: 199572 - RNA, 19 nt, Human
acuuuccccuuuuccuauu

SEQ ID NO: 199573 - RNA, 19 nt, Human
agaagaagaagaaaggaag

SEQ ID NO: 199574 - RNA, 22 nt, Human
agaggaaaauaggucccucuag

SEQ ID NO: 199575 - RNA, 19 nt, Human
agcgcgggggucgaaagga

SEQ ID NO: 199576 - RNA, 20 nt, Human
aggaaaauaggucccucuag

SEQ ID NO: 199577 - RNA, 20 nt, Human
aguuauuuuuaagaaagucc

SEQ ID NO: 199578 - RNA, 24 nt, Human
auaaaaaagaggaaaauagguccc

SEQ ID NO: 199579 - RNA, 27 nt, Human
auacuuuccccuuuuccuauuauuaaa

SEQ ID NO: 199580 - RNA, 22 nt, Human
caaaacacauaagucuaugcga

SEQ ID NO: 199581 - RNA, 24 nt, Human
cccaauauuuuagaagaagaagaa

SEQ ID NO: 199582 - RNA, 24 nt, Human
ccccuuuuccuauuauuaaagaau

SEQ ID NO: 199583 - RNA, 21 nt, Human
cgaaaggaccgggaggaggaa

SEQ ID NO: 199584 - RNA, 18 nt, Human
cggaagggaccccccccc

SEQ ID NO: 199585 - RNA, 19 nt, Human
ggaagggacccccccccgg

SEQ ID NO: 199586 - RNA, 21 nt, Human
ggagggggcugcugggggggg

SEQ ID NO: 199587 - RNA, 18 nt, Human
ggccaaggagcgcggggg

SEQ ID NO: 199588 - RNA, 23 nt, Human
ggggagggggcugcugggggggg

SEQ ID NO: 199589 - RNA, 20 nt, Human
gucuaaaacauaaaaaagag

SEQ ID NO: 199590 - RNA, 25 nt, Human
uaaauaaucuacagucuaaaacaua

SEQ ID NO: 199591 - RNA, 20 nt, Human
uaccugaauuuuagcaaaac

SEQ ID NO: 199592 - RNA, 19 nt, Human
ugggggagggggcugcugg

SEQ ID NO: 199593 - RNA, 24 nt, Human
ugugugaauuuuaaaagauaaccg

SEQ ID NO: 199594 - RNA, 20 nt, Human
uuccugagauuucauuggaa

SEQ ID NO: 199595 - RNA, 20 nt, Human
aaaaagcccaccaguuuuca

SEQ ID NO: 199596 - RNA, 20 nt, Human
aacaucuccaaagcagaugc

SEQ ID NO: 199597 - RNA, 19 nt, Human
aacuuggaaaggccugaua

SEQ ID NO: 199598 - RNA, 19 nt, Human
aagcaaccucucaggccag

SEQ ID NO: 199599 - RNA, 18 nt, Human
aagcaaguucagcagaga

SEQ ID NO: 199600 - RNA, 23 nt, Human
acacgccggaccccccccccccc

SEQ ID NO: 199601 - RNA, 24 nt, Human
acacuaggagacuccaaaauaaaa

SEQ ID NO: 199602 - RNA, 19 nt, Human
accaccaccuccagcccuu

SEQ ID NO: 199603 - RNA, 22 nt, Human
acccuccucugagcccagaggc

SEQ ID NO: 199604 - RNA, 22 nt, Human
acuagccccugagccuccccua

SEQ ID NO: 199605 - RNA, 22 nt, Human
agaccuccagguugccccccag

SEQ ID NO: 199606 - RNA, 30 nt, Human
agagaagagacacaagggggagaagaggaa

SEQ ID NO: 199607 - RNA, 24 nt, Human
agccccugagccuccccuaguccc

SEQ ID NO: 199608 - RNA, 22 nt, Human
agccuggguaccaccuucucug

SEQ ID NO: 199609 - RNA, 22 nt, Human
aggagaagcaaguucagcagag

SEQ ID NO: 199610 - RNA, 20 nt, Human
aggcaaaaaaaaaaaaauca

SEQ ID NO: 199611 - RNA, 21 nt, Human
aggccgguucugaccaggaag

SEQ ID NO: 199612 - RNA, 23 nt, Human
agggggaagggaaggagcuccag

SEQ ID NO: 199613 - RNA, 21 nt, Human
agguauuccuguugacugagg

SEQ ID NO: 199614 - RNA, 24 nt, Human
agugcuuuccaaaagagaaaauua

SEQ ID NO: 199615 - RNA, 24 nt, Human
auaaaaaaauaaauaaagacuaua

SEQ ID NO: 199616 - RNA, 25 nt, Human
caaaauaaaagcaucaucaacaccc

SEQ ID NO: 199617 - RNA, 18 nt, Human
caacucuucaccaucacu

SEQ ID NO: 199618 - RNA, 20 nt, Human
caccacucucccaccaggaa

SEQ ID NO: 199619 - RNA, 21 nt, Human
caccuccccucucugcccccc

SEQ ID NO: 199620 - RNA, 22 nt, Human
cacgccggaccccccccccccc

SEQ ID NO: 199621 - RNA, 18 nt, Human
cagagcuccacagucucu

SEQ ID NO: 199622 - RNA, 19 nt, Human
cagagcuccacagucucuc

SEQ ID NO: 199623 - RNA, 23 nt, Human
cagaugcugagaaaaaaaagccc

SEQ ID NO: 199624 - RNA, 23 nt, Human
caggcagauggaacaaggggugg

SEQ ID NO: 199625 - RNA, 18 nt, Human
cagguaccaccaccucca

SEQ ID NO: 199626 - RNA, 18 nt, Human
caguggcccuguggggcc

SEQ ID NO: 199627 - RNA, 24 nt, Human
caucacuuuucauaaaaccuccau

SEQ ID NO: 199628 - RNA, 21 nt, Human
cauucagccucgugccgaauu

SEQ ID NO: 199629 - RNA, 20 nt, Human
ccaaagcagaugcugagaaa

SEQ ID NO: 199630 - RNA, 23 nt, Human
ccaauaugauguggauuccuuuc

SEQ ID NO: 199631 - RNA, 20 nt, Human
ccacuucccaccacucuccc

SEQ ID NO: 199632 - RNA, 21 nt, Human
ccacuucccaccacucuccca

SEQ ID NO: 199633 - RNA, 23 nt, Human
ccacuucccaccacucucccacc

SEQ ID NO: 199634 - RNA, 22 nt, Human
ccagaggcuucuaugcuuccag

SEQ ID NO: 199635 - RNA, 20 nt, Human
ccagggggaagggaaggagc

SEQ ID NO: 199636 - RNA, 20 nt, Human
ccaggucucucccggaccug

SEQ ID NO: 199637 - RNA, 23 nt, Human
cccaagcaaagucuagccugaag

SEQ ID NO: 199638 - RNA, 23 nt, Human
cccaccaggaagacaacaacagc

SEQ ID NO: 199639 - RNA, 23 nt, Human
cccacccuuccuucaccgucugu

SEQ ID NO: 199640 - RNA, 20 nt, Human
ccccaaagcaaauaagaaac

SEQ ID NO: 199641 - RNA, 21 nt, Human
ccccaaagcaaauaagaaaca

SEQ ID NO: 199642 - RNA, 24 nt, Human
ccccacauggagcaggauuguguc

SEQ ID NO: 199643 - RNA, 23 nt, Human
cccccaccuccccucucugcccc

SEQ ID NO: 199644 - RNA, 25 nt, Human
ccccccagagcuccacagucucucu

SEQ ID NO: 199645 - RNA, 20 nt, Human
ccccccccaccuccccucuc

SEQ ID NO: 199646 - RNA, 26 nt, Human
cccccccccaccuccccucucugccc

SEQ ID NO: 199647 - RNA, 20 nt, Human
ccccccccccccaccucccc

SEQ ID NO: 199648 - RNA, 18 nt, Human
cccccccccccccaccuc

SEQ ID NO: 199649 - RNA, 24 nt, Human
ccccccuccuccggggucuguucc

SEQ ID NO: 199650 - RNA, 23 nt, Human
cccucaggaccggacauuggcaa

SEQ ID NO: 199651 - RNA, 24 nt, Human
cccugaggcaaaaaaaaaaaaauc

SEQ ID NO: 199652 - RNA, 19 nt, Human
ccggaccccccccccccca

SEQ ID NO: 199653 - RNA, 27 nt, Human
ccuagucccucucguccaucucucccc

SEQ ID NO: 199654 - RNA, 24 nt, Human
ccucguccugucucgucuuccucu

SEQ ID NO: 199655 - RNA, 21 nt, Human
ccucuacccccacucccgggc

SEQ ID NO: 199656 - RNA, 21 nt, Human
ccuggguaccaccuucucugg

SEQ ID NO: 199657 - RNA, 25 nt, Human
cggacccccccccccccaccucccc

SEQ ID NO: 199658 - RNA, 24 nt, Human
cguccaucucuccuccccaacucu

SEQ ID NO: 199659 - RNA, 25 nt, Human
cuaaaagcaacaggcaggagaagca

SEQ ID NO: 199660 - RNA, 21 nt, Human
cuagccccugagccuccccua

SEQ ID NO: 199661 - RNA, 18 nt, Human
cuagccugaaggaaaacc

SEQ ID NO: 199662 - RNA, 24 nt, Human
cuaggagacuccaaaauaaaagca

SEQ ID NO: 199663 - RNA, 19 nt, Human
cuaugcuuccagccuuugc

SEQ ID NO: 199664 - RNA, 22 nt, Human
cuccggggucuguuccaagcgg

SEQ ID NO: 199665 - RNA, 21 nt, Human
cucguccaucucuccucccca

SEQ ID NO: 199666 - RNA, 18 nt, Human
cucuuccuccccaucccc

SEQ ID NO: 199667 - RNA, 23 nt, Human
cugagaaaaaaaagcccaccagu

SEQ ID NO: 199668 - RNA, 18 nt, Human
cugccccccuccuccggg

SEQ ID NO: 199669 - RNA, 26 nt, Human
cugccucguccugucucgucuuccuc

SEQ ID NO: 199670 - RNA, 23 nt, Human
cuggcuccucuuuucagaccucc

SEQ ID NO: 199671 - RNA, 19 nt, Human
cuguccauggcccugcugc

SEQ ID NO: 199672 - RNA, 21 nt, Human
cuucccaccacucucccacca

SEQ ID NO: 199673 - RNA, 22 nt, Human
cuugguagugcuggagcccugg

SEQ ID NO: 199674 - RNA, 20 nt, Human
cuugugagguauccucucca

SEQ ID NO: 199675 - RNA, 23 nt, Human
cuuucaagacugccuagauguag

SEQ ID NO: 199676 - RNA, 19 nt, Human
gaagacaacaacagccuga

SEQ ID NO: 199677 - RNA, 21 nt, Human
gagaagcaaguucagcagaga

SEQ ID NO: 199678 - RNA, 22 nt, Human
gcagaugcugagaaaaaaaagc

SEQ ID NO: 199679 - RNA, 19 nt, Human
gccggaccccccccccccc

SEQ ID NO: 199680 - RNA, 22 nt, Human
gccugggcaguggguggcaacu

SEQ ID NO: 199681 - RNA, 23 nt, Human
gcucaagggaggggacacuagga

SEQ ID NO: 199682 - RNA, 18 nt, Human
ggaaaaccaaaggucucc

SEQ ID NO: 199683 - RNA, 19 nt, Human
ggagaagaggacuggggcu

SEQ ID NO: 199684 - RNA, 19 nt, Human
ggaggggacacuaggagac

SEQ ID NO: 199685 - RNA, 20 nt, Human
ggcagccaguggcccugugg

SEQ ID NO: 199686 - RNA, 19 nt, Human
ggccccacauggagcagga

SEQ ID NO: 199687 - RNA, 24 nt, Human
ggccugggcaguggguggcaacuu

SEQ ID NO: 199688 - RNA, 24 nt, Human
gggagaagaggacuggggcucgaa

SEQ ID NO: 199689 - RNA, 18 nt, Human
gggguggaagacuuaaaa

SEQ ID NO: 199690 - RNA, 23 nt, Human
guuuuuucuuuuccccuccccaa

SEQ ID NO: 199691 - RNA, 21 nt, Human
uaaaaaaauaaauaaagacua

SEQ ID NO: 199692 - RNA, 23 nt, Human
uaaaagcaacaggcaggagaagc

SEQ ID NO: 199693 - RNA, 18 nt, Human
uaaccucaagagccagcu

SEQ ID NO: 199694 - RNA, 20 nt, Human
uagauguagaaucuaguggc

SEQ ID NO: 199695 - RNA, 25 nt, Human
uagccccugagccuccccuaguccc

SEQ ID NO: 199696 - RNA, 21 nt, Human
uaggauuuuguguauuuguuc

SEQ ID NO: 199697 - RNA, 23 nt, Human
uaggucucuugcccaagcaaagu

SEQ ID NO: 199698 - RNA, 19 nt, Human
ucaccgucuguuuucuuug

SEQ ID NO: 199699 - RNA, 18 nt, Human
ucauuuccacuaaaaaau

SEQ ID NO: 199700 - RNA, 22 nt, Human
uccacuucccaccacucuccca

SEQ ID NO: 199701 - RNA, 19 nt, Human
uccagguugccccccagag

SEQ ID NO: 199702 - RNA, 20 nt, Human
ucccaccacucucccaccag

SEQ ID NO: 199703 - RNA, 20 nt, Human
ucccccaaagcaaauaagaa

SEQ ID NO: 199704 - RNA, 19 nt, Human
uccccucucugccccccuc

SEQ ID NO: 199705 - RNA, 21 nt, Human
ucccuccaucucucccaacuc

SEQ ID NO: 199706 - RNA, 23 nt, Human
uccucugagcccagaggcuucua

SEQ ID NO: 199707 - RNA, 18 nt, Human
ucucccaacucuucacca

SEQ ID NO: 199708 - RNA, 19 nt, Human
ucuccuaaaagcaacaggc

SEQ ID NO: 199709 - RNA, 20 nt, Human
ucucguccaucucuccuccc

SEQ ID NO: 199710 - RNA, 20 nt, Human
ucucguccaucucuccuccc

SEQ ID NO: 199711 - RNA, 25 nt, Human
ucucguccaucucuccuccccaacu

SEQ ID NO: 199712 - RNA, 22 nt, Human
ucucgucuuccucuacccccac

SEQ ID NO: 199713 - RNA, 22 nt, Human
ucucuagguuagaaacagaggu

SEQ ID NO: 199714 - RNA, 22 nt, Human
ucucucucuuccuccccauccc

SEQ ID NO: 199715 - RNA, 19 nt, Human
ucucucuuccuccccaucc

SEQ ID NO: 199716 - RNA, 20 nt, Human
ucucuugcccaagcaaaguc

SEQ ID NO: 199717 - RNA, 18 nt, Human
ugaaaagggaacugacau

SEQ ID NO: 199718 - RNA, 20 nt, Human
ugaaaagggaacugacauca

SEQ ID NO: 199719 - RNA, 20 nt, Human
ugacacgccggacccccccc

SEQ ID NO: 199720 - RNA, 19 nt, Human
ugagaaaaaaaagcccacc

SEQ ID NO: 199721 - RNA, 21 nt, Human
ugagaaaaaaaagcccaccag

SEQ ID NO: 199722 - RNA, 22 nt, Human
ugaggcaaaaaaaaaaaaauca

SEQ ID NO: 199723 - RNA, 21 nt, Human
ugagguauccucuccacuucc

SEQ ID NO: 199724 - RNA, 23 nt, Human
ugauguggauuccuuuccgaugg

SEQ ID NO: 199725 - RNA, 20 nt, Human
ugccagaaaaauaaagauuc

SEQ ID NO: 199726 - RNA, 19 nt, Human
ugcugagaaaaaaaagccc

SEQ ID NO: 199727 - RNA, 21 nt, Human
uggggucaucuccaauaugau

SEQ ID NO: 199728 - RNA, 23 nt, Human
ugucucgucuuccucuaccccca

SEQ ID NO: 199729 - RNA, 24 nt, Human
ugucucgucuuccucuacccccac

SEQ ID NO: 199730 - RNA, 22 nt, Human
ugugccagaaaaauaaagauuc

SEQ ID NO: 199731 - RNA, 20 nt, Human
uucaagacugccuagaugua

SEQ ID NO: 199732 - RNA, 25 nt, Human
uucaagacugccuagauguagaauc

SEQ ID NO: 199733 - RNA, 25 nt, Human
uuccacuaaaaaauaaaaaaauaaa

SEQ ID NO: 199734 - RNA, 18 nt, Human
uucucgugccugccugug

SEQ ID NO: 199735 - RNA, 19 nt, Human
uugccuccuuccaagucgg

SEQ ID NO: 199736 - RNA, 20 nt, Human
uuggaaaacuuuaaucucau

SEQ ID NO: 199737 - RNA, 21 nt, Human
uugguagugcuggagcccugg

SEQ ID NO: 199738 - RNA, 24 nt, Human
uuucugggcacgcaguuggugcug

SEQ ID NO: 199739 - RNA, 21 nt, Human
uuuuucccuccaucucuccca

SEQ ID NO: 199740 - RNA, 27 nt, Human
uuuuuucuuuuccccuccccaacaucu

SEQ ID NO: 199741 - RNA, 18 nt, Human
aaacaaauaccaaaagcg

SEQ ID NO: 199742 - RNA, 18 nt, Human
aaacucaaaauacagcga

SEQ ID NO: 199743 - RNA, 19 nt, Human
aaagacugcaaccacagaa

SEQ ID NO: 199744 - RNA, 20 nt, Human
aacacagauggggaggggag

SEQ ID NO: 199745 - RNA, 23 nt, Human
aagcuacaaacaaauaccaaaag

SEQ ID NO: 199746 - RNA, 28 nt, Human
aauaacaagauaaccaguccaggagaga

SEQ ID NO: 199747 - RNA, 21 nt, Human
aauacacaagacauuuugcac

SEQ ID NO: 199748 - RNA, 21 nt, Human
acacuggcggauuugggacaa

SEQ ID NO: 199749 - RNA, 18 nt, Human
accucaacugcugccccu

SEQ ID NO: 199750 - RNA, 21 nt, Human
agauggguaagggagagaugg

SEQ ID NO: 199751 - RNA, 22 nt, Human
agcggggaggauuggaggggcc

SEQ ID NO: 199752 - RNA, 20 nt, Human
aguccaggagagagggagcc

SEQ ID NO: 199753 - RNA, 19 nt, Human
aguugggagcauggaaggg

SEQ ID NO: 199754 - RNA, 21 nt, Human
auaauaacaagauaaccaguc

SEQ ID NO: 199755 - RNA, 24 nt, Human
augcacuguacuucguuuugcuau

SEQ ID NO: 199756 - RNA, 21 nt, Human
augggggggggguuggggggg

SEQ ID NO: 199757 - RNA, 22 nt, Human
caaaagcgaaucacugagacag

SEQ ID NO: 199758 - RNA, 23 nt, Human
cacaggaagaccuaagaccaaac

SEQ ID NO: 199759 - RNA, 21 nt, Human
cacccuaggaccaagccccua

SEQ ID NO: 199760 - RNA, 18 nt, Human
caccuaaugacgauccga

SEQ ID NO: 199761 - RNA, 19 nt, Human
caccucaacugcugccccu

SEQ ID NO: 199762 - RNA, 20 nt, Human
cacuaccccaccucaacugc

SEQ ID NO: 199763 - RNA, 21 nt, Human
cagcaggaacuuaaaucucac

SEQ ID NO: 199764 - RNA, 18 nt, Human
cagcucagcuugacccca

SEQ ID NO: 199765 - RNA, 23 nt, Human
ccacagacacaaacauucagaaa

SEQ ID NO: 199766 - RNA, 23 nt, Human
ccagaccaggccuuguggggccu

SEQ ID NO: 199767 - RNA, 19 nt, Human
ccaggagagagggagccac

SEQ ID NO: 199768 - RNA, 22 nt, Human
ccaguccaggagagagggagcc

SEQ ID NO: 199769 - RNA, 24 nt, Human
cccauggauucacagagaaauaca

SEQ ID NO: 199770 - RNA, 24 nt, Human
ccccaccucaacugcugccccuua

SEQ ID NO: 199771 - RNA, 22 nt, Human
cccuuugguccucccuagcccc

SEQ ID NO: 199772 - RNA, 22 nt, Human
ccucccuagccccuucccaccc

SEQ ID NO: 199773 - RNA, 18 nt, Human
ccuucccacccuaggacc

SEQ ID NO: 199774 - RNA, 22 nt, Human
ccuucccacccuaggaccaagc

SEQ ID NO: 199775 - RNA, 23 nt, Human
cgaagccagcucagcuugacccc

SEQ ID NO: 199776 - RNA, 20 nt, Human
cgaaucacugagacaggccc

SEQ ID NO: 199777 - RNA, 20 nt, Human
cggcacuaccccaccucaac

SEQ ID NO: 199778 - RNA, 24 nt, Human
cuagccagacccauggauucacag

SEQ ID NO: 199779 - RNA, 19 nt, Human
cucaaaauacagcgaucau

SEQ ID NO: 199780 - RNA, 22 nt, Human
cucagcuugaccccacugcggc

SEQ ID NO: 199781 - RNA, 21 nt, Human
cucuugggccgcugggcuccu

SEQ ID NO: 199782 - RNA, 21 nt, Human
cugaaacucaaaauacagcga

SEQ ID NO: 199783 - RNA, 20 nt, Human
cugcaaccacagacacaaac

SEQ ID NO: 199784 - RNA, 19 nt, Human
cugcugccccuuacagaag

SEQ ID NO: 199785 - RNA, 18 nt, Human
cuuuuuuuuuuuuuuucc

SEQ ID NO: 199786 - RNA, 24 nt, Human
gaauuucuuuuuuuuuuuuuuucc

SEQ ID NO: 199787 - RNA, 23 nt, Human
gacaagcagaagggaguugggag

SEQ ID NO: 199788 - RNA, 23 nt, Human
gagcggggaggauuggaggggcc

SEQ ID NO: 199789 - RNA, 18 nt, Human
gcagagcggggaggauug

SEQ ID NO: 199790 - RNA, 24 nt, Human
gcgaauuucuuuuuuuuuuuuuuu

SEQ ID NO: 199791 - RNA, 22 nt, Human
gcggcagagcggggaggauugg

SEQ ID NO: 199792 - RNA, 19 nt, Human
gcggcggcagagcggggag

SEQ ID NO: 199793 - RNA, 23 nt, Human
ggaaagcuacaaacaaauaccaa

SEQ ID NO: 199794 - RNA, 24 nt, Human
ggaggggccagggcuggggguggc

SEQ ID NO: 199795 - RNA, 19 nt, Human
ggccuacccaggcagcagg

SEQ ID NO: 199796 - RNA, 24 nt, Human
gggaggauuggaggggccagggcc

SEQ ID NO: 199797 - RNA, 18 nt, Human
gggccagggcugggggug

SEQ ID NO: 199798 - RNA, 25 nt, Human
gggcguuagggaaucacgugcuuuu

SEQ ID NO: 199799 - RNA, 22 nt, Human
ggggguuggggggguggggggc

SEQ ID NO: 199800 - RNA, 20 nt, Human
gggguggggggcguuaggga

SEQ ID NO: 199801 - RNA, 19 nt, Human
gggguuggggggguggggg

SEQ ID NO: 199802 - RNA, 24 nt, Human
uaacaauaauaacaagauaaccag

SEQ ID NO: 199803 - RNA, 19 nt, Human
uaugcggccaaauaugggg

SEQ ID NO: 199804 - RNA, 23 nt, Human
uauguaugcggccaaauaugggg

SEQ ID NO: 199805 - RNA, 23 nt, Human
ucaauaccaucccuuugguccuc

SEQ ID NO: 199806 - RNA, 22 nt, Human
uccaggaaagcuacaaacaaau

SEQ ID NO: 199807 - RNA, 20 nt, Human
ucccuagccccuucccaccc

SEQ ID NO: 199808 - RNA, 21 nt, Human
ucuccgaagccagcucagcuu

SEQ ID NO: 199809 - RNA, 18 nt, Human
ucuucuuucucucuucuc

SEQ ID NO: 199810 - RNA, 22 nt, Human
ucuuuuuuuuuuuuuuuccugg

SEQ ID NO: 199811 - RNA, 21 nt, Human
ugaaaagggacuccaucuccg

SEQ ID NO: 199812 - RNA, 18 nt, Human
ugaaacucaaaauacagc

SEQ ID NO: 199813 - RNA, 22 nt, Human
ugaggagggaggaggaggagaa

SEQ ID NO: 199814 - RNA, 29 nt, Human
ugaggagggaggaggaggagaaugaagua

SEQ ID NO: 199815 - RNA, 19 nt, Human
ugauuuguggaucgugguc

SEQ ID NO: 199816 - RNA, 24 nt, Human
ugcaaccacagacacaaacauuca

SEQ ID NO: 199817 - RNA, 18 nt, Human
ugcacugaggaucauuuu

SEQ ID NO: 199818 - RNA, 19 nt, Human
uggaagcaagauggguaag

SEQ ID NO: 199819 - RNA, 22 nt, Human
uggaagcaagauggguaaggga

SEQ ID NO: 199820 - RNA, 22 nt, Human
uggaggggccagggcugggggu

SEQ ID NO: 199821 - RNA, 19 nt, Human
uggcacgggcucuugggcc

SEQ ID NO: 199822 - RNA, 19 nt, Human
ugggcuccucugggcgggc

SEQ ID NO: 199823 - RNA, 21 nt, Human
ugggggaaagacugcaaccac

SEQ ID NO: 199824 - RNA, 19 nt, Human
ugggggggggguugggggg

SEQ ID NO: 199825 - RNA, 22 nt, Human
ugguccucccuagccccuuccc

SEQ ID NO: 199826 - RNA, 24 nt, Human
uguggggccuacccaggcagcagg

SEQ ID NO: 199827 - RNA, 21 nt, Human
uuaaacaugcgaauuucuuuu

SEQ ID NO: 199828 - RNA, 22 nt, Human
uuguggggccuacccaggcagc

SEQ ID NO: 199829 - RNA, 23 nt, Human
uuguggggccuacccaggcagca

SEQ ID NO: 199830 - RNA, 26 nt, Human
uuucuuuuuuuuuuuuuuuccugggg

SEQ ID NO: 199831 - RNA, 20 nt, Human
uuuuuuuuuuuccugggggg

SEQ ID NO: 199832 - RNA, 19 nt, Human
aagacuacaaacacaacac

SEQ ID NO: 199833 - RNA, 24 nt, Human
aaggaguauucaguuucuucuuca

SEQ ID NO: 199834 - RNA, 19 nt, Human
acaaacacaacacauagaa

SEQ ID NO: 199835 - RNA, 27 nt, Human
acccgagagccuuccuucccgggucuc

SEQ ID NO: 199836 - RNA, 22 nt, Human
acgcccguggcuccccacaggc

SEQ ID NO: 199837 - RNA, 20 nt, Human
acugaaguacaaaaauauca

SEQ ID NO: 199838 - RNA, 21 nt, Human
agcuaagacaagacuacaaac

SEQ ID NO: 199839 - RNA, 20 nt, Human
aggaaggaaggaguauucag

SEQ ID NO: 199840 - RNA, 20 nt, Human
aggccuuuccccucgcgucc

SEQ ID NO: 199841 - RNA, 18 nt, Human
aguggcuuuggggagggg

SEQ ID NO: 199842 - RNA, 23 nt, Human
aucaucaucaucaucaucgaagu

SEQ ID NO: 199843 - RNA, 20 nt, Human
cacccgccgggagcugugcg

SEQ ID NO: 199844 - RNA, 21 nt, Human
cacguccagagcuaagacaag

SEQ ID NO: 199845 - RNA, 22 nt, Human
cagagcuaagacaagacuacaa

SEQ ID NO: 199846 - RNA, 20 nt, Human
cagcgaaucuaccauugaac

SEQ ID NO: 199847 - RNA, 25 nt, Human
cagcuuccagauaauauugucccuu

SEQ ID NO: 199848 - RNA, 19 nt, Human
caggccuuuccccucgcgu

SEQ ID NO: 199849 - RNA, 21 nt, Human
caucuuuauuauuguuguugu

SEQ ID NO: 199850 - RNA, 24 nt, Human
ccacaggccuuuccccucgcgucc

SEQ ID NO: 199851 - RNA, 19 nt, Human
ccccacccgagagccuucc

SEQ ID NO: 199852 - RNA, 19 nt, Human
ccccgccugucugcgccgg

SEQ ID NO: 199853 - RNA, 22 nt, Human
cccgagagccuuccuucccggg

SEQ ID NO: 199854 - RNA, 25 nt, Human
ccgccggguuuaugauuuguugugu

SEQ ID NO: 199855 - RNA, 22 nt, Human
ccuccggauuuaaaggaauggg

SEQ ID NO: 199856 - RNA, 21 nt, Human
ccucucucguccucucucucu

SEQ ID NO: 199857 - RNA, 20 nt, Human
cgacagggacaagagcauuu

SEQ ID NO: 199858 - RNA, 23 nt, Human
cgaguagugaggccucagagcac

SEQ ID NO: 199859 - RNA, 22 nt, Human
cggccgcugcugcuccgccggg

SEQ ID NO: 199860 - RNA, 23 nt, Human
cgggaaggaagggcgcgcgggau

SEQ ID NO: 199861 - RNA, 23 nt, Human
cgggggcguccaggagagcgcug

SEQ ID NO: 199862 - RNA, 24 nt, Human
cgggggcguccaggagagcgcugg

SEQ ID NO: 199863 - RNA, 22 nt, Human
cuaagacaagacuacaaacaca

SEQ ID NO: 199864 - RNA, 21 nt, Human
cucuuuugcucuaucgagcug

SEQ ID NO: 199865 - RNA, 22 nt, Human
cugaaggacgacagugcuccga

SEQ ID NO: 199866 - RNA, 21 nt, Human
cuuuauuauuguuguuguugu

SEQ ID NO: 199867 - RNA, 22 nt, Human
gagacgacaggucugggaucaa

SEQ ID NO: 199868 - RNA, 22 nt, Human
gagccguugcuuccccuucucu

SEQ ID NO: 199869 - RNA, 18 nt, Human
gagcgcugggccccgccu

SEQ ID NO: 199870 - RNA, 20 nt, Human
gagcugauacugaaguacaa

SEQ ID NO: 199871 - RNA, 18 nt, Human
gagcugugcgggcggggg

SEQ ID NO: 199872 - RNA, 18 nt, Human
ggaaggaagggcgcgcgg

SEQ ID NO: 199873 - RNA, 19 nt, Human
ggcuuuggggagggggugg

SEQ ID NO: 199874 - RNA, 19 nt, Human
ucagagcacccgccgggag

SEQ ID NO: 199875 - RNA, 20 nt, Human
ucuccuggcucccccacccg

SEQ ID NO: 199876 - RNA, 19 nt, Human
ucucucguccucucucucu

SEQ ID NO: 199877 - RNA, 19 nt, Human
ucucucguccucucucucu

SEQ ID NO: 199878 - RNA, 22 nt, Human
ucucuuuugcucuaucgagcug

SEQ ID NO: 199879 - RNA, 25 nt, Human
ucugggaucagggagucuucaaggc

SEQ ID NO: 199880 - RNA, 23 nt, Human
ugaucaggcugaggcgaguuccu

SEQ ID NO: 199881 - RNA, 21 nt, Human
ugcuccuuccaguggcuuugg

SEQ ID NO: 199882 - RNA, 20 nt, Human
ugcuuccaggaaacaucaag

SEQ ID NO: 199883 - RNA, 21 nt, Human
uggacaaaaugagacgcgaca

SEQ ID NO: 199884 - RNA, 19 nt, Human
ugggaggggaggcgcgcgc

SEQ ID NO: 199885 - RNA, 18 nt, Human
uggggagggggugggaga

SEQ ID NO: 199886 - RNA, 19 nt, Human
uggggagggggugggagag

SEQ ID NO: 199887 - RNA, 21 nt, Human
uggguggggaggaaggaagga

SEQ ID NO: 199888 - RNA, 20 nt, Human
uugcucugcuuccaggaaac

SEQ ID NO: 199889 - RNA, 18 nt, Human
aaaaaaaccaaaccugac

SEQ ID NO: 199890 - RNA, 21 nt, Human
aaaaaaccaaaccugacagac

SEQ ID NO: 199891 - RNA, 21 nt, Human
aagcaagcagcagcagcaagg

SEQ ID NO: 199892 - RNA, 18 nt, Human
aagcagcagcagcaaggc

SEQ ID NO: 199893 - RNA, 27 nt, Human
aagcagcagcagcaaggcgcuugggaa

SEQ ID NO: 199894 - RNA, 21 nt, Human
agaaaaggggagguaaauucc

SEQ ID NO: 199895 - RNA, 18 nt, Human
agcauggggcugggggac

SEQ ID NO: 199896 - RNA, 28 nt, Human
aggcggaggcacaggagggcaggcaacc

SEQ ID NO: 199897 - RNA, 21 nt, Human
auuccagaaagcuacagaaca

SEQ ID NO: 199898 - RNA, 20 nt, Human
cagaauguaaagggagcaug

SEQ ID NO: 199899 - RNA, 24 nt, Human
ccaaaauuucuccuuucucccucc

SEQ ID NO: 199900 - RNA, 18 nt, Human
cccagagcugggcuucuc

SEQ ID NO: 199901 - RNA, 18 nt, Human
ccccuuggugccgcugcu

SEQ ID NO: 199902 - RNA, 24 nt, Human
cccuccuuaaaaaauguuuuuaaa

SEQ ID NO: 199903 - RNA, 20 nt, Human
cccuuucucaugucucuucc

SEQ ID NO: 199904 - RNA, 19 nt, Human
ccuuggugccgcugcuggg

SEQ ID NO: 199905 - RNA, 19 nt, Human
cggaggcacaggagggcag

SEQ ID NO: 199906 - RNA, 18 nt, Human
cgggaagcaagcagcagc

SEQ ID NO: 199907 - RNA, 22 nt, Human
cucccuuucucaugucucuucc

SEQ ID NO: 199908 - RNA, 21 nt, Human
cuccuuucucccuccuuaaaa

SEQ ID NO: 199909 - RNA, 21 nt, Human
gaacagguagauaauguccuu

SEQ ID NO: 199910 - RNA, 19 nt, Human
gauucaguucccagagcug

SEQ ID NO: 199911 - RNA, 18 nt, Human
gccgcugcugggaaggcg

SEQ ID NO: 199912 - RNA, 22 nt, Human
ggaagcaagcagcagcagcaag

SEQ ID NO: 199913 - RNA, 20 nt, Human
ggacgggaagcaagcagcag

SEQ ID NO: 199914 - RNA, 18 nt, Human
gggaaggcggaggcacag

SEQ ID NO: 199915 - RNA, 23 nt, Human
guaaauuccagaaagcuacagaa

SEQ ID NO: 199916 - RNA, 26 nt, Human
uaaacuccuuucauuuaaauaggguu

SEQ ID NO: 199917 - RNA, 24 nt, Human
uaaauuccagaaagcuacagaaca

SEQ ID NO: 199918 - RNA, 18 nt, Human
uacaaaaaaaccaaaccu

SEQ ID NO: 199919 - RNA, 26 nt, Human
uacaaaaaaaccaaaccugacagacu

SEQ ID NO: 199920 - RNA, 22 nt, Human
ucaugucucuuccucugccccc

SEQ ID NO: 199921 - RNA, 23 nt, Human
uccagacccacaguccacaaaga

SEQ ID NO: 199922 - RNA, 22 nt, Human
ucccagagcugggcuucucuuc

SEQ ID NO: 199923 - RNA, 22 nt, Human
ucugcccuuucuccaucccccc

SEQ ID NO: 199924 - RNA, 28 nt, Human
ugguagguuuuggggcucccuaaggccc

SEQ ID NO: 199925 - RNA, 21 nt, Human
uguaaagggagcauggggcug

SEQ ID NO: 199926 - RNA, 21 nt, Human
uguuuuguuuuuuuacuuccc

SEQ ID NO: 199927 - RNA, 18 nt, Human
uuccucugcccuuucucc

SEQ ID NO: 199928 - RNA, 18 nt, Human
uuggugccgcugcuggga

SEQ ID NO: 199929 - RNA, 22 nt, Human
uuguuuuuuguuuuguuuuuuu

SEQ ID NO: 199930 - RNA, 22 nt, Human
uuuacaaagaccuuacaauagc

SEQ ID NO: 199931 - RNA, 24 nt, Human
uuuuuuuuguuuuuuuuuguuuuu

SEQ ID NO: 199932 - RNA, 21 nt, Human
uuuuuuuuuguuuuuuguuuu

SEQ ID NO: 199933 - RNA, 22 nt, Human
aaaacaagcgagacaaucaccc

SEQ ID NO: 199934 - RNA, 18 nt, Human
aaacauuuccugcaacaa

SEQ ID NO: 199935 - RNA, 22 nt, Human
aaagcaaaaaacuucuacugga

SEQ ID NO: 199936 - RNA, 21 nt, Human
aacugaaaacaagcgagacaa

SEQ ID NO: 199937 - RNA, 18 nt, Human
aagcaggagcaagagucu

SEQ ID NO: 199938 - RNA, 18 nt, Human
aagcaggaggccaagccc

SEQ ID NO: 199939 - RNA, 19 nt, Human
aagcuuccaucugaugcuu

SEQ ID NO: 199940 - RNA, 19 nt, Human
aaggcucuacgacccacag

SEQ ID NO: 199941 - RNA, 19 nt, Human
acgacagccaccgacaaag

SEQ ID NO: 199942 - RNA, 21 nt, Human
acgacagccaccgacaaagca

SEQ ID NO: 199943 - RNA, 19 nt, Human
agaacccgggcuugccucc

SEQ ID NO: 199944 - RNA, 18 nt, Human
agaaguaggggagcaggg

SEQ ID NO: 199945 - RNA, 19 nt, Human
agacagcacuggcuuugca

SEQ ID NO: 199946 - RNA, 18 nt, Human
agcucuaggccccucgcc

SEQ ID NO: 199947 - RNA, 19 nt, Human
agggagcuugggaaucgau

SEQ ID NO: 199948 - RNA, 24 nt, Human
aucuuccccauggcccuuggccug

SEQ ID NO: 199949 - RNA, 18 nt, Human
augaagcaggaggccaag

SEQ ID NO: 199950 - RNA, 27 nt, Human
augaagcaggaggccaagcccggcccu

SEQ ID NO: 199951 - RNA, 25 nt, Human
caaagaaaucacgaaacacaagcac

SEQ ID NO: 199952 - RNA, 26 nt, Human
caacuccaugggaaugguauggcaau

SEQ ID NO: 199953 - RNA, 18 nt, Human
caagcccggcccuggggc

SEQ ID NO: 199954 - RNA, 21 nt, Human
caccuaagauaccuucauaaa

SEQ ID NO: 199955 - RNA, 19 nt, Human
cacuugucccggaagggag

SEQ ID NO: 199956 - RNA, 22 nt, Human
ccaaagaaaucacgaaacacaa

SEQ ID NO: 199957 - RNA, 26 nt, Human
ccacccagaacccucccauauaaucg

SEQ ID NO: 199958 - RNA, 23 nt, Human
ccagccacgcagaucugcaucca

SEQ ID NO: 199959 - RNA, 25 nt, Human
ccaggcccaugaagcaggaggccaa

SEQ ID NO: 199960 - RNA, 21 nt, Human
cccaaagaaaucacgaaacac

SEQ ID NO: 199961 - RNA, 20 nt, Human
cccacccagaacccucccau

SEQ ID NO: 199962 - RNA, 25 nt, Human
cccacucccacccagaacccuccca

SEQ ID NO: 199963 - RNA, 21 nt, Human
ccccaaagaaaucacgaaaca

SEQ ID NO: 199964 - RNA, 21 nt, Human
ccccauggcccuuggccugag

SEQ ID NO: 199965 - RNA, 20 nt, Human
cccccaaagaaaucacgaaa

SEQ ID NO: 199966 - RNA, 19 nt, Human
ccccucgcccuccccacuc

SEQ ID NO: 199967 - RNA, 30 nt, Human
ccccuugcaggaucaggagaagcaggagcu

SEQ ID NO: 199968 - RNA, 23 nt, Human
ccucccauauaaucgacaacuga

SEQ ID NO: 199969 - RNA, 24 nt, Human
ccuccccacucccacccagaaccc

SEQ ID NO: 199970 - RNA, 20 nt, Human
cgagagcaagagaagcuacc

SEQ ID NO: 199971 - RNA, 20 nt, Human
cgcccuccccacucccaccc

SEQ ID NO: 199972 - RNA, 21 nt, Human
cgcgcgcacgcaccagccacg

SEQ ID NO: 199973 - RNA, 20 nt, Human
cggggaacggaagguggagg

SEQ ID NO: 199974 - RNA, 18 nt, Human
cuaggccccucgcccucc

SEQ ID NO: 199975 - RNA, 20 nt, Human
cugcaacaccucacucagga

SEQ ID NO: 199976 - RNA, 19 nt, Human
cugccucuagacaucuccc

SEQ ID NO: 199977 - RNA, 27 nt, Human
cugguggguauuugcauuagggguaga

SEQ ID NO: 199978 - RNA, 22 nt, Human
cuucauaaaaccacgugcugcc

SEQ ID NO: 199979 - RNA, 24 nt, Human
cuuggaagagagacucccuucccc

SEQ ID NO: 199980 - RNA, 22 nt, Human
gaacggaagcagagaguaagcu

SEQ ID NO: 199981 - RNA, 23 nt, Human
gaagcaggagcaagagucuacaa

SEQ ID NO: 199982 - RNA, 18 nt, Human
gaaggggacugagaagua

SEQ ID NO: 199983 - RNA, 20 nt, Human
gagagcaagagaagcuacag

SEQ ID NO: 199984 - RNA, 22 nt, Human
gagagcaagagaagcuacaguc

SEQ ID NO: 199985 - RNA, 22 nt, Human
gagccgccaagcccggggcuuc

SEQ ID NO: 199986 - RNA, 19 nt, Human
gagcguugcgcgcuggggc

SEQ ID NO: 199987 - RNA, 19 nt, Human
gauaaaggacuuggaagag

SEQ ID NO: 199988 - RNA, 22 nt, Human
gcagggagagguggcacccgga

SEQ ID NO: 199989 - RNA, 24 nt, Human
gccauuuugccccuuuccuuugca

SEQ ID NO: 199990 - RNA, 18 nt, Human
gcccaccggcuugggggc

SEQ ID NO: 199991 - RNA, 18 nt, Human
gcgcgcacgcaccagcca

SEQ ID NO: 199992 - RNA, 20 nt, Human
gcgcgcacgcaccagccacg

SEQ ID NO: 199993 - RNA, 24 nt, Human
gcgcgcacgcaccagccacgcagu

SEQ ID NO: 199994 - RNA, 20 nt, Human
gcugcaacaccucacucagg

SEQ ID NO: 199995 - RNA, 27 nt, Human
ggacugagaaguaggggagcaggggga

SEQ ID NO: 199996 - RNA, 22 nt, Human
ggcaaugcugcagccuuugggc

SEQ ID NO: 199997 - RNA, 19 nt, Human
gggaaacaucaugcggaau

SEQ ID NO: 199998 - RNA, 19 nt, Human
gggaacggaagguggaggg

SEQ ID NO: 199999 - RNA, 20 nt, Human
gggaacggaagguggaggga

SEQ ID NO: 200000 - RNA, 18 nt, Human
gggguugaccuagcgggg

SEQ ID NO: 200001 - RNA, 19 nt, Human
ggguauuugcauuaggggu

SEQ ID NO: 200002 - RNA, 23 nt, Human
guaagcuuccaucugaugcuuag

SEQ ID NO: 200003 - RNA, 19 nt, Human
guuggugggagguggggag

SEQ ID NO: 200004 - RNA, 26 nt, Human
uagagcucuaggccccucgcccuccu

SEQ ID NO: 200005 - RNA, 21 nt, Human
uagcccaccggcuugggggcu

SEQ ID NO: 200006 - RNA, 25 nt, Human
uaggccccucgcccuccccacuccc

SEQ ID NO: 200007 - RNA, 18 nt, Human
uauggcaaugcugcagcc

SEQ ID NO: 200008 - RNA, 19 nt, Human
uauggcaaugcugcagccu

SEQ ID NO: 200009 - RNA, 23 nt, Human
uccaaaacaaacaauuagagcuc

SEQ ID NO: 200010 - RNA, 18 nt, Human
ucccacccagaacccucc

SEQ ID NO: 200011 - RNA, 21 nt, Human
uccccacucccacccagaacc

SEQ ID NO: 200012 - RNA, 24 nt, Human
uccccacucccacccagaacccuc

SEQ ID NO: 200013 - RNA, 25 nt, Human
uccccacucccacccagaacccucc

SEQ ID NO: 200014 - RNA, 19 nt, Human
ucccggaagggagcuuggg

SEQ ID NO: 200015 - RNA, 25 nt, Human
ucgcccuccccacucccacccagaa

SEQ ID NO: 200016 - RNA, 22 nt, Human
ucuacuggaauguccccuugca

SEQ ID NO: 200017 - RNA, 18 nt, Human
ucugcgugggucgagaag

SEQ ID NO: 200018 - RNA, 21 nt, Human
ucuuuuucuuuuuuucuucca

SEQ ID NO: 200019 - RNA, 18 nt, Human
ugaaaacaagcgagacaa

SEQ ID NO: 200020 - RNA, 24 nt, Human
ugaaaacaagcgagacaaucaccc

SEQ ID NO: 200021 - RNA, 18 nt, Human
ugaaggggacugagaagu

SEQ ID NO: 200022 - RNA, 21 nt, Human
ugaaggggacugagaaguagg

SEQ ID NO: 200023 - RNA, 19 nt, Human
ugagauggggaagagcuag

SEQ ID NO: 200024 - RNA, 23 nt, Human
ugagauggggaagagcuagggag

SEQ ID NO: 200025 - RNA, 20 nt, Human
ugcggaagaaugcagggccg

SEQ ID NO: 200026 - RNA, 18 nt, Human
uggcacccggaccggccu

SEQ ID NO: 200027 - RNA, 20 nt, Human
uggggcgggucuccuuuggc

SEQ ID NO: 200028 - RNA, 21 nt, Human
uggugggagguggggaguagc

SEQ ID NO: 200029 - RNA, 20 nt, Human
uuaaacauuuccugcaacaa

SEQ ID NO: 200030 - RNA, 24 nt, Human
uucccagaagcgcgcgcacgcacc

SEQ ID NO: 200031 - RNA, 20 nt, Human
uucucauucggacucuccug

SEQ ID NO: 200032 - RNA, 20 nt, Human
uugccccuuuccuuugcacg

SEQ ID NO: 200033 - RNA, 22 nt, Human
uugccugacagucugagggcug

SEQ ID NO: 200034 - RNA, 20 nt, Human
uuggugggagguggggagua

SEQ ID NO: 200035 - RNA, 21 nt, Human
uuggugggagguggggaguaa

SEQ ID NO: 200036 - RNA, 20 nt, Human
uuguacuuucuagcccaccg

SEQ ID NO: 200037 - RNA, 18 nt, Human
uuuccugucuacaguggg

SEQ ID NO: 200038 - RNA, 24 nt, Human
uuuuuuuuuuuuuuuuuuuauuuu

SEQ ID NO: 200039 - RNA, 22 nt, Human
aacacaacucccagacagggac

SEQ ID NO: 200040 - RNA, 20 nt, Human
aagauacaacauacagaaua

SEQ ID NO: 200041 - RNA, 25 nt, Human
aagcaguacaaauacgagacuucaa

SEQ ID NO: 200042 - RNA, 25 nt, Human
acaacucccagacagggacaggaca

SEQ ID NO: 200043 - RNA, 28 nt, Human
acacaacucccagacaggggggaacgcc

SEQ ID NO: 200044 - RNA, 21 nt, Human
acacaccacaccccacauccc

SEQ ID NO: 200045 - RNA, 24 nt, Human
acaccccacaucccggccgggugc

SEQ ID NO: 200046 - RNA, 18 nt, Human
acucccacccccaucuau

SEQ ID NO: 200047 - RNA, 22 nt, Human
agaaagcaguacaaauacgaga

SEQ ID NO: 200048 - RNA, 18 nt, Human
agaggaaggagcgggaag

SEQ ID NO: 200049 - RNA, 24 nt, Human
agggaggaggggcggggagaggaa

SEQ ID NO: 200050 - RNA, 21 nt, Human
agggcacacaccacaccccac

SEQ ID NO: 200051 - RNA, 18 nt, Human
aggggcggggagaggaag

SEQ ID NO: 200052 - RNA, 21 nt, Human
agguuuuuuuuucuccauuaa

SEQ ID NO: 200053 - RNA, 19 nt, Human
auaacacaacucccagaca

SEQ ID NO: 200054 - RNA, 23 nt, Human
cacaacucccagacagggacagg

SEQ ID NO: 200055 - RNA, 18 nt, Human
cacaccacaccccacauc

SEQ ID NO: 200056 - RNA, 25 nt, Human
cacaccacaccccacaucccggcac

SEQ ID NO: 200057 - RNA, 23 nt, Human
cacaccagccacacucccacccc

SEQ ID NO: 200058 - RNA, 21 nt, Human
cacaccccacaucccggcacc

SEQ ID NO: 200059 - RNA, 19 nt, Human
caccacaccccacaucccg

SEQ ID NO: 200060 - RNA, 21 nt, Human
caccacaccccacaucccggc

SEQ ID NO: 200061 - RNA, 19 nt, Human
cacgaaccacaggucccuu

SEQ ID NO: 200062 - RNA, 24 nt, Human
cacucccacccccaucuaugaggg

SEQ ID NO: 200063 - RNA, 19 nt, Human
cagcacgaaccacaggucc

SEQ ID NO: 200064 - RNA, 20 nt, Human
cagcacgaaccacagguccc

SEQ ID NO: 200065 - RNA, 21 nt, Human
caggcacaaagggaggagggg

SEQ ID NO: 200066 - RNA, 24 nt, Human
ccagccacacucccacccccaucu

SEQ ID NO: 200067 - RNA, 18 nt, Human
gaagggaggaggagaggc

SEQ ID NO: 200068 - RNA, 18 nt, Human
gagaaaagcagaaagcag

SEQ ID NO: 200069 - RNA, 21 nt, Human
gcacaaagggaggaggggcgg

SEQ ID NO: 200070 - RNA, 19 nt, Human
gccgaacuuuccaaaacgu

SEQ ID NO: 200071 - RNA, 20 nt, Human
ggaagggaggaggagaggcc

SEQ ID NO: 200072 - RNA, 24 nt, Human
ggagaggaaggagcgggaagggag

SEQ ID NO: 200073 - RNA, 20 nt, Human
ggaggaggggcggggagagg

SEQ ID NO: 200074 - RNA, 24 nt, Human
ggaggggugggagaaaagcagaaa

SEQ ID NO: 200075 - RNA, 18 nt, Human
gggaagggaggaggagag

SEQ ID NO: 200076 - RNA, 24 nt, Human
gggaggaggggcggggagaggaag

SEQ ID NO: 200077 - RNA, 21 nt, Human
ggggagaggaaggagcgggaa

SEQ ID NO: 200078 - RNA, 19 nt, Human
ggggcggggagaggaagga

SEQ ID NO: 200079 - RNA, 23 nt, Human
ggugcuaggaggggugggagaaa

SEQ ID NO: 200080 - RNA, 21 nt, Human
gugagugagggcuugacacac

SEQ ID NO: 200081 - RNA, 22 nt, Human
uaaagacauggagaggguuugg

SEQ ID NO: 200082 - RNA, 19 nt, Human
uacgacaaacacacgaaca

SEQ ID NO: 200083 - RNA, 25 nt, Human
uccaaaacgucuauuagucuaagga

SEQ ID NO: 200084 - RNA, 20 nt, Human
uccccuacaagcggauggau

SEQ ID NO: 200085 - RNA, 20 nt, Human
uccucuggaugaaauuucug

SEQ ID NO: 200086 - RNA, 18 nt, Human
ucuaugagggcacacacc

SEQ ID NO: 200087 - RNA, 21 nt, Human
ucucaugcuuuaaguggaagc

SEQ ID NO: 200088 - RNA, 20 nt, Human
ugaaauuucugagauguuac

SEQ ID NO: 200089 - RNA, 25 nt, Human
ugacacacacaccagccacacuccc

SEQ ID NO: 200090 - RNA, 21 nt, Human
ugauucuggaaauuuauuagg

SEQ ID NO: 200091 - RNA, 19 nt, Human
ugcagcaaggaaggaacga

SEQ ID NO: 200092 - RNA, 19 nt, Human
uggaggcucugggugcuac

SEQ ID NO: 200093 - RNA, 19 nt, Human
ugugggggugcuaggaggg

SEQ ID NO: 200094 - RNA, 22 nt, Human
ugugggggugcuaggaggggug

SEQ ID NO: 200095 - RNA, 22 nt, Human
uugacacacacaccagccacaa

SEQ ID NO: 200096 - RNA, 26 nt, Human
uugcuuugcuauguucuauuuuuaau

SEQ ID NO: 200097 - RNA, 24 nt, Human
uuugcuuugcuauguucuauuuuu

SEQ ID NO: 200098 - RNA, 20 nt, Human
aaaaaaaaaagagguaacga

SEQ ID NO: 200099 - RNA, 26 nt, Human
aaauaauuuuccccuccccccgcccc

SEQ ID NO: 200100 - RNA, 25 nt, Human
aaucccaucucccuacugccuccac

SEQ ID NO: 200101 - RNA, 23 nt, Human
acauguacacacgcacucacgca

SEQ ID NO: 200102 - RNA, 23 nt, Human
agcaggguggggagugcacaugg

SEQ ID NO: 200103 - RNA, 19 nt, Human
agcggugggggccagcccu

SEQ ID NO: 200104 - RNA, 18 nt, Human
aggagguuccggaaugga

SEQ ID NO: 200105 - RNA, 21 nt, Human
agugcacauguacacacgcag

SEQ ID NO: 200106 - RNA, 27 nt, Human
cacauguacacacgcacucacgcagug

SEQ ID NO: 200107 - RNA, 22 nt, Human
cacccccuuuccaggcccgguc

SEQ ID NO: 200108 - RNA, 18 nt, Human
caccgauuaagaaauuuc

SEQ ID NO: 200109 - RNA, 19 nt, Human
cacugcuuggaaaaagaug

SEQ ID NO: 200110 - RNA, 19 nt, Human
cagcaagacauugucgccg

SEQ ID NO: 200111 - RNA, 22 nt, Human
caggcgcucacuacugucgccc

SEQ ID NO: 200112 - RNA, 22 nt, Human
ccaccaccccaaucuucaauuu

SEQ ID NO: 200113 - RNA, 19 nt, Human
cccccaaaagggcccgguc

SEQ ID NO: 200114 - RNA, 18 nt, Human
ccccccuuucccuccagg

SEQ ID NO: 200115 - RNA, 20 nt, Human
ccccgcccccaaaagggccc

SEQ ID NO: 200116 - RNA, 19 nt, Human
ccucugggaagggagcagg

SEQ ID NO: 200117 - RNA, 22 nt, Human
cgccccucccccaccuaauccg

SEQ ID NO: 200118 - RNA, 24 nt, Human
cggccacagcggugggggccagcc

SEQ ID NO: 200119 - RNA, 18 nt, Human
cggcggaaagaagacgag

SEQ ID NO: 200120 - RNA, 21 nt, Human
cuccaccaccccaaucuucaa

SEQ ID NO: 200121 - RNA, 19 nt, Human
cuccucuccugccggcucc

SEQ ID NO: 200122 - RNA, 21 nt, Human
cugccuccaccaccccaaucu

SEQ ID NO: 200123 - RNA, 22 nt, Human
cugccuccaccaccccaaucuu

SEQ ID NO: 200124 - RNA, 18 nt, Human
cuuaaaaaaaaaaaaaaa

SEQ ID NO: 200125 - RNA, 18 nt, Human
cuuaaaaaaaaaaaaaaa

SEQ ID NO: 200126 - RNA, 24 nt, Human
cuuaaaaaaaaaaaaaaaagaggu

SEQ ID NO: 200127 - RNA, 22 nt, Human
cuuggccucggcgccaacggug

SEQ ID NO: 200128 - RNA, 18 nt, Human
cuuggcgaagacggaggu

SEQ ID NO: 200129 - RNA, 19 nt, Human
gaaagaagacgaguuagaa

SEQ ID NO: 200130 - RNA, 20 nt, Human
gaagggagcaggguggggag

SEQ ID NO: 200131 - RNA, 24 nt, Human
gccaccaaaaaaauuucacagcaa

SEQ ID NO: 200132 - RNA, 19 nt, Human
gcgucccccccuuucccuc

SEQ ID NO: 200133 - RNA, 22 nt, Human
ggaaaaagauguggaaaccuca

SEQ ID NO: 200134 - RNA, 21 nt, Human
ggggagcucgagaaguuuccg

SEQ ID NO: 200135 - RNA, 18 nt, Human
ggguagaggggggagcuc

SEQ ID NO: 200136 - RNA, 22 nt, Human
gguggaaagaaacgcuugggaa

SEQ ID NO: 200137 - RNA, 25 nt, Human
uaaaauaaaauaauuuuccccuccc

SEQ ID NO: 200138 - RNA, 20 nt, Human
uaggcucgggcggggccuug

SEQ ID NO: 200139 - RNA, 23 nt, Human
uauaaauccaugaaguggggcca

SEQ ID NO: 200140 - RNA, 25 nt, Human
ucacucgccgugcaucagacacuuc

SEQ ID NO: 200141 - RNA, 21 nt, Human
uccaccaccccaaucuucaau

SEQ ID NO: 200142 - RNA, 23 nt, Human
uccaccaccccaaucuucaauuu

SEQ ID NO: 200143 - RNA, 23 nt, Human
ucccaucucccuacugccuccac

SEQ ID NO: 200144 - RNA, 22 nt, Human
ucccuacugccuccaccacccc

SEQ ID NO: 200145 - RNA, 18 nt, Human
uccucuccugccggcucc

SEQ ID NO: 200146 - RNA, 20 nt, Human
ucgccccucccccaccuaau

SEQ ID NO: 200147 - RNA, 25 nt, Human
ucuccugccggcuccggauggaggu

SEQ ID NO: 200148 - RNA, 19 nt, Human
ugcaucagacacuucccuu

SEQ ID NO: 200149 - RNA, 25 nt, Human
ugccaccaaaaaaauuucacagcaa

SEQ ID NO: 200150 - RNA, 24 nt, Human
uggaaaccucaaugcaccgauuaa

SEQ ID NO: 200151 - RNA, 20 nt, Human
uggggcacugcuuggaaaaa

SEQ ID NO: 200152 - RNA, 28 nt, Human
uguacacacgcacucacgcagaggagua

SEQ ID NO: 200153 - RNA, 26 nt, Human
ugucgccccucccccaccuaauccga

SEQ ID NO: 200154 - RNA, 20 nt, Human
uuuacaaaaauccaggcccc

SEQ ID NO: 200155 - RNA, 21 nt, Human
uuuccaggcccggucccuguc

SEQ ID NO: 200156 - RNA, 18 nt, Human
uuuuccccuccccccgcc

SEQ ID NO: 200157 - RNA, 22 nt, Human
aaaaagccuauuccugaugaac

SEQ ID NO: 200158 - RNA, 21 nt, Human
aaacauccauacuccaaucac

SEQ ID NO: 200159 - RNA, 25 nt, Human
accucgcuccuguuuccccuccccc

SEQ ID NO: 200160 - RNA, 21 nt, Human
acuguuuuguaaugcaccagu

SEQ ID NO: 200161 - RNA, 23 nt, Human
agagaggagcccuauuuagcagc

SEQ ID NO: 200162 - RNA, 22 nt, Human
agcagcacggccauggagccuc

SEQ ID NO: 200163 - RNA, 22 nt, Human
aggaaaguaugagcuggacaga

SEQ ID NO: 200164 - RNA, 20 nt, Human
aggagcccuauuuagcagcg

SEQ ID NO: 200165 - RNA, 20 nt, Human
aggcagcaucuacaucuagc

SEQ ID NO: 200166 - RNA, 27 nt, Human
aggcagcucccaccuggccccaggaaa

SEQ ID NO: 200167 - RNA, 18 nt, Human
augcaguuucuugguugg

SEQ ID NO: 200168 - RNA, 21 nt, Human
caaggggcccccacagcacca

SEQ ID NO: 200169 - RNA, 24 nt, Human
caucuacaucuagcuaauugaggg

SEQ ID NO: 200170 - RNA, 19 nt, Human
cauucgggauuccccaacc

SEQ ID NO: 200171 - RNA, 18 nt, Human
ccaccagacuuucuggca

SEQ ID NO: 200172 - RNA, 21 nt, Human
cccacucuccauccccuugga

SEQ ID NO: 200173 - RNA, 23 nt, Human
cccccacagcaccaagguggccu

SEQ ID NO: 200174 - RNA, 19 nt, Human
cccccaucccuccccucuu

SEQ ID NO: 200175 - RNA, 20 nt, Human
cccuccccucuuuucucucc

SEQ ID NO: 200176 - RNA, 21 nt, Human
ccuccccucuuuucucuccac

SEQ ID NO: 200177 - RNA, 21 nt, Human
ccucgcuccuguuuccccucc

SEQ ID NO: 200178 - RNA, 25 nt, Human
ccucuaaaagccuggucauaggaug

SEQ ID NO: 200179 - RNA, 24 nt, Human
ccucuggaaaucaguaaaggugaa

SEQ ID NO: 200180 - RNA, 19 nt, Human
ccucuuuucucuccacccc

SEQ ID NO: 200181 - RNA, 22 nt, Human
ccuuagaaaaaaguucugcuuc

SEQ ID NO: 200182 - RNA, 19 nt, Human
ccuuugaggagggaacugu

SEQ ID NO: 200183 - RNA, 20 nt, Human
cuccccccaucccuccccuc

SEQ ID NO: 200184 - RNA, 22 nt, Human
cuggauggggguggaggcuggg

SEQ ID NO: 200185 - RNA, 24 nt, Human
gaaacauccauacuccaaucacgc

SEQ ID NO: 200186 - RNA, 19 nt, Human
gaaggaaaguaugagcugg

SEQ ID NO: 200187 - RNA, 20 nt, Human
gaagggaagaggcaaggggc

SEQ ID NO: 200188 - RNA, 20 nt, Human
gagaggagcccuauuuagca

SEQ ID NO: 200189 - RNA, 20 nt, Human
gaggcaguggggcaaaggca

SEQ ID NO: 200190 - RNA, 25 nt, Human
gcaaggaggaguagaggucgacagc

SEQ ID NO: 200191 - RNA, 19 nt, Human
gccuuugaggagggaacug

SEQ ID NO: 200192 - RNA, 21 nt, Human
gcgaaggaaaguaugagcugg

SEQ ID NO: 200193 - RNA, 18 nt, Human
ggauuccccaacccugcu

SEQ ID NO: 200194 - RNA, 20 nt, Human
ggcagcucccaccuggcccc

SEQ ID NO: 200195 - RNA, 24 nt, Human
gggacagcgaaggaaaguaugagc

SEQ ID NO: 200196 - RNA, 20 nt, Human
gggcaagcagcgggugggug

SEQ ID NO: 200197 - RNA, 18 nt, Human
guugggauggaguguagg

SEQ ID NO: 200198 - RNA, 23 nt, Human
uaaaaacuccacuugccagaggc

SEQ ID NO: 200199 - RNA, 24 nt, Human
uaaauagauggggcaagcagcggg

SEQ ID NO: 200200 - RNA, 20 nt, Human
uccacauguugacugagaga

SEQ ID NO: 200201 - RNA, 18 nt, Human
uccccccaucccuccccu

SEQ ID NO: 200202 - RNA, 20 nt, Human
uccccucuuuucucuccacc

SEQ ID NO: 200203 - RNA, 20 nt, Human
ucccuccccucuuuucucuc

SEQ ID NO: 200204 - RNA, 19 nt, Human
uccucuagcuuuccucugg

SEQ ID NO: 200205 - RNA, 24 nt, Human
ucuggauggggguggaggcugggg

SEQ ID NO: 200206 - RNA, 23 nt, Human
ucuuuguccuccuuggauuucca

SEQ ID NO: 200207 - RNA, 22 nt, Human
ugagagagcagaacaggggagg

SEQ ID NO: 200208 - RNA, 18 nt, Human
ugccuaaggagugcggga

SEQ ID NO: 200209 - RNA, 19 nt, Human
uggaaaggugacuggacag

SEQ ID NO: 200210 - RNA, 22 nt, Human
uggcaaggugagcgcaaggagg

SEQ ID NO: 200211 - RNA, 18 nt, Human
uggcuggagucuuugucc

SEQ ID NO: 200212 - RNA, 21 nt, Human
ugggaagggaagaggcaaggg

SEQ ID NO: 200213 - RNA, 25 nt, Human
ugggaagggaagaggcaaggggccc

SEQ ID NO: 200214 - RNA, 18 nt, Human
uggggaugggauagggag

SEQ ID NO: 200215 - RNA, 22 nt, Human
uggggcaaaggcagcucccacc

SEQ ID NO: 200216 - RNA, 19 nt, Human
uggggcaagcagcgggugg

SEQ ID NO: 200217 - RNA, 19 nt, Human
uggggguggaggcugggga

SEQ ID NO: 200218 - RNA, 20 nt, Human
ugugaggagucauuccuggg

SEQ ID NO: 200219 - RNA, 20 nt, Human
uguugaagccacgugagucc

SEQ ID NO: 200220 - RNA, 21 nt, Human
uguugagggacccacucucca

SEQ ID NO: 200221 - RNA, 20 nt, Human
uguuuccccuccccccaucc

SEQ ID NO: 200222 - RNA, 19 nt, Human
uguuuguggguuuuuuucc

SEQ ID NO: 200223 - RNA, 21 nt, Human
uguuuguggguuuuuuuccuu

SEQ ID NO: 200224 - RNA, 19 nt, Human
uuaaauacucuucugcacc

SEQ ID NO: 200225 - RNA, 24 nt, Human
uuccucuggaaaucaguaaaggug

SEQ ID NO: 200226 - RNA, 20 nt, Human
uugaagccacgugaguccca

SEQ ID NO: 200227 - RNA, 22 nt, Human
uuuacggaaacauccauacucc

SEQ ID NO: 200228 - RNA, 23 nt, Human
uuugcauucaguacauugucauu

SEQ ID NO: 200229 - RNA, 21 nt, Human
uuuguggguuuuuuuccuuuu

SEQ ID NO: 200230 - RNA, 22 nt, Human
uuuguugagggacccacucucc

SEQ ID NO: 200231 - RNA, 23 nt, Human
uuuuuccuuuuugcauucaguac

SEQ ID NO: 200232 - RNA, 26 nt, Human
aaaaauaauuauaaucauccaaaagc

SEQ ID NO: 200233 - RNA, 19 nt, Human
aacucaacuccugcuccug

SEQ ID NO: 200234 - RNA, 21 nt, Human
aacuccugcuccugcauuccu

SEQ ID NO: 200235 - RNA, 21 nt, Human
aagagccugggagagaggagg

SEQ ID NO: 200236 - RNA, 26 nt, Human
aaucauccaaaagccaaacaaaauua

SEQ ID NO: 200237 - RNA, 21 nt, Human
accuauauauauauauauaua

SEQ ID NO: 200238 - RNA, 19 nt, Human
agcucccaaacucaacucc

SEQ ID NO: 200239 - RNA, 19 nt, Human
agggggcaggaggaagagc

SEQ ID NO: 200240 - RNA, 19 nt, Human
auauauauauauauauaua

SEQ ID NO: 200241 - RNA, 19 nt, Human
auauauauauauauauaua

SEQ ID NO: 200242 - RNA, 19 nt, Human
auauauauauauauauaua

SEQ ID NO: 200243 - RNA, 19 nt, Human
auauauauauauauauaua

SEQ ID NO: 200244 - RNA, 19 nt, Human
auauauauauauauauaua

SEQ ID NO: 200245 - RNA, 19 nt, Human
auauauauauauauauaua

SEQ ID NO: 200246 - RNA, 19 nt, Human
auggggugggggcaggggu

SEQ ID NO: 200247 - RNA, 23 nt, Human
auuaaggagaguugcaagaaggg

SEQ ID NO: 200248 - RNA, 25 nt, Human
caacuccaccugggaggaaaaaaaa

SEQ ID NO: 200249 - RNA, 18 nt, Human
cacccuccccagcugccc

SEQ ID NO: 200250 - RNA, 19 nt, Human
cacucucccucucucccuc

SEQ ID NO: 200251 - RNA, 21 nt, Human
cagcucccaaacucaacuccu

SEQ ID NO: 200252 - RNA, 18 nt, Human
ccacacacacacacauau

SEQ ID NO: 200253 - RNA, 23 nt, Human
cccacccuccccagcugccccca

SEQ ID NO: 200254 - RNA, 25 nt, Human
ccccacccuccccagcugcccccag

SEQ ID NO: 200255 - RNA, 26 nt, Human
ccccacccuccccagcugcccccagc

SEQ ID NO: 200256 - RNA, 23 nt, Human
cccccagcuucggcaacuccacc

SEQ ID NO: 200257 - RNA, 24 nt, Human
cccccgcgagcgcugcugucacuc

SEQ ID NO: 200258 - RNA, 19 nt, Human
ccccuugggggccagaggg

SEQ ID NO: 200259 - RNA, 19 nt, Human
cccgcgagcgcugcuguca

SEQ ID NO: 200260 - RNA, 23 nt, Human
cccucccauccccacccucccca

SEQ ID NO: 200261 - RNA, 20 nt, Human
cccucuggccaugcggccgg

SEQ ID NO: 200262 - RNA, 19 nt, Human
ccucccauccccacccucc

SEQ ID NO: 200263 - RNA, 24 nt, Human
ccucccauccccacccuccccagc

SEQ ID NO: 200264 - RNA, 26 nt, Human
ccucucugccucucucucucccacuc

SEQ ID NO: 200265 - RNA, 19 nt, Human
ccugggagagaggaggggc

SEQ ID NO: 200266 - RNA, 21 nt, Human
cgaggcagggucccagcugga

SEQ ID NO: 200267 - RNA, 20 nt, Human
cggcaacuccaccugggagg

SEQ ID NO: 200268 - RNA, 21 nt, Human
cuccacacacacacacauaua

SEQ ID NO: 200269 - RNA, 20 nt, Human
cucccaaacucaacuccugc

SEQ ID NO: 200270 - RNA, 19 nt, Human
cucccauccccacccuccc

SEQ ID NO: 200271 - RNA, 22 nt, Human
cucccauccccacccuccccag

SEQ ID NO: 200272 - RNA, 21 nt, Human
cuccugcuccugcauuccucc

SEQ ID NO: 200273 - RNA, 18 nt, Human
cucuccccucccaucccc

SEQ ID NO: 200274 - RNA, 21 nt, Human
cucucucucucccacucucuu

SEQ ID NO: 200275 - RNA, 20 nt, Human
cucugccucucucucuccca

SEQ ID NO: 200276 - RNA, 22 nt, Human
cugcccccagcuucggcaacuc

SEQ ID NO: 200277 - RNA, 18 nt, Human
cugccucucucucuccca

SEQ ID NO: 200278 - RNA, 25 nt, Human
cugccucucucucucccacucucuu

SEQ ID NO: 200279 - RNA, 27 nt, Human
cugccucucucucucccacucucuuuc

SEQ ID NO: 200280 - RNA, 19 nt, Human
gaggcagggucccagcugg

SEQ ID NO: 200281 - RNA, 18 nt, Human
gcaggaggaagagccugg

SEQ ID NO: 200282 - RNA, 20 nt, Human
gcauggggugggggcagggg

SEQ ID NO: 200283 - RNA, 24 nt, Human
gccugucucagcuccacacacaca

SEQ ID NO: 200284 - RNA, 18 nt, Human
ggagaguugcaagaaggg

SEQ ID NO: 200285 - RNA, 18 nt, Human
ggcaggaggaagagccug

SEQ ID NO: 200286 - RNA, 21 nt, Human
ggcaggaggaagagccuggga

SEQ ID NO: 200287 - RNA, 23 nt, Human
ggcauggggugggggcaggggug

SEQ ID NO: 200288 - RNA, 21 nt, Human
gggcauggggugggggcaggg

SEQ ID NO: 200289 - RNA, 20 nt, Human
ggggagggugggggcauggg

SEQ ID NO: 200290 - RNA, 19 nt, Human
ggggcauggggugggggca

SEQ ID NO: 200291 - RNA, 23 nt, Human
gggugggggcauggggugggggc

SEQ ID NO: 200292 - RNA, 19 nt, Human
uauauauauauauauauau

SEQ ID NO: 200293 - RNA, 19 nt, Human
uauauauauauauauauau

SEQ ID NO: 200294 - RNA, 19 nt, Human
uauauauauauauauauau

SEQ ID NO: 200295 - RNA, 19 nt, Human
uauauauauauauauauau

SEQ ID NO: 200296 - RNA, 24 nt, Human
ucaacuucugucucuccccuccca

SEQ ID NO: 200297 - RNA, 19 nt, Human
ucacucucccucucucccu

SEQ ID NO: 200298 - RNA, 18 nt, Human
ucagcuccacacacacac

SEQ ID NO: 200299 - RNA, 20 nt, Human
uccacacacacacacauaua

SEQ ID NO: 200300 - RNA, 21 nt, Human
uccacacacacacacauauac

SEQ ID NO: 200301 - RNA, 22 nt, Human
uccacacacacacacauauacu

SEQ ID NO: 200302 - RNA, 19 nt, Human
ucccauccccacccucccc

SEQ ID NO: 200303 - RNA, 22 nt, Human
ucccauccccacccuccccagc

SEQ ID NO: 200304 - RNA, 18 nt, Human
ucugccucucucucuccc

SEQ ID NO: 200305 - RNA, 20 nt, Human
ucuggggguugagcccccgc

SEQ ID NO: 200306 - RNA, 23 nt, Human
ugaagggagcgcccagggcaggu

SEQ ID NO: 200307 - RNA, 21 nt, Human
ugacgucauuucuggaggucu

SEQ ID NO: 200308 - RNA, 23 nt, Human
ugcccccagcuucggcaacucca

SEQ ID NO: 200309 - RNA, 24 nt, Human
ugcccccagcuucggcaacuccac

SEQ ID NO: 200310 - RNA, 19 nt, Human
ugccgagccugucucagcu

SEQ ID NO: 200311 - RNA, 23 nt, Human
ugggagagaggaggggcggaggc

SEQ ID NO: 200312 - RNA, 19 nt, Human
ugggggcaggggugugagu

SEQ ID NO: 200313 - RNA, 18 nt, Human
ugggggccagagggucgg

SEQ ID NO: 200314 - RNA, 32 nt, Human
ugucucagcuccacacacacacacauauagug

SEQ ID NO: 200315 - RNA, 22 nt, Human
ugugaggggagggugggggcau

SEQ ID NO: 200316 - RNA, 21 nt, Human
uuaauuuaaaaaaaauacugc

SEQ ID NO: 200317 - RNA, 22 nt, Human
uucugucucuccccucccaucc

SEQ ID NO: 200318 - RNA, 19 nt, Human
uuugugugugaggggaggg

SEQ ID NO: 200319 - RNA, 23 nt, Human
aaaaggaaaggcgcagggacagg

SEQ ID NO: 200320 - RNA, 18 nt, Human
aacagcaaugggucagga

SEQ ID NO: 200321 - RNA, 22 nt, Human
aagcgcuuuugucuguggggcc

SEQ ID NO: 200322 - RNA, 18 nt, Human
acagcaaagggccucuag

SEQ ID NO: 200323 - RNA, 21 nt, Human
agagaggaaaggcgaaaagga

SEQ ID NO: 200324 - RNA, 23 nt, Human
agagucaauaaauaguuggacaa

SEQ ID NO: 200325 - RNA, 19 nt, Human
aggaacaaaggagagggcc

SEQ ID NO: 200326 - RNA, 18 nt, Human
aguccuguucucucuuua

SEQ ID NO: 200327 - RNA, 22 nt, Human
cagcaaagggccucuaggacca

SEQ ID NO: 200328 - RNA, 22 nt, Human
cagcccuccggggaaguccuac

SEQ ID NO: 200329 - RNA, 20 nt, Human
cagccuguacgccgcagccc

SEQ ID NO: 200330 - RNA, 19 nt, Human
ccagccaggaacaaaggag

SEQ ID NO: 200331 - RNA, 18 nt, Human
ccagccuguacgccgcag

SEQ ID NO: 200332 - RNA, 22 nt, Human
cccaccuuaacucgggagggcc

SEQ ID NO: 200333 - RNA, 23 nt, Human
cccaccuuaacucgggagggccg

SEQ ID NO: 200334 - RNA, 19 nt, Human
ccugggccccggguaccga

SEQ ID NO: 200335 - RNA, 18 nt, Human
cgggccucccccgcugcc

SEQ ID NO: 200336 - RNA, 21 nt, Human
cggggagggcccaaaaaaauu

SEQ ID NO: 200337 - RNA, 18 nt, Human
cuacggagcuucccuggg

SEQ ID NO: 200338 - RNA, 23 nt, Human
cuaggaccacuugcuggggucca

SEQ ID NO: 200339 - RNA, 18 nt, Human
cugagagggcaugcagca

SEQ ID NO: 200340 - RNA, 22 nt, Human
cugcgggccucccccgcugccu

SEQ ID NO: 200341 - RNA, 19 nt, Human
cuguacgccgcagcccucc

SEQ ID NO: 200342 - RNA, 20 nt, Human
cuugcugggguccagugcca

SEQ ID NO: 200343 - RNA, 23 nt, Human
gauuugugacucuuugaaguuga

SEQ ID NO: 200344 - RNA, 19 nt, Human
gccagccuguacgccgcag

SEQ ID NO: 200345 - RNA, 18 nt, Human
gcccgggagcccagugcu

SEQ ID NO: 200346 - RNA, 23 nt, Human
gcuaggggcgcgcucugcgggcc

SEQ ID NO: 200347 - RNA, 18 nt, Human
gcugggguccagugccag

SEQ ID NO: 200348 - RNA, 21 nt, Human
ggaagagguuguggagauaag

SEQ ID NO: 200349 - RNA, 24 nt, Human
ggggaagagguuguggagauaagg

SEQ ID NO: 200350 - RNA, 23 nt, Human
ggggcugccggccugagagggca

SEQ ID NO: 200351 - RNA, 19 nt, Human
uaggaccacuugcuggggu

SEQ ID NO: 200352 - RNA, 22 nt, Human
uagggccagacucucgccagcc

SEQ ID NO: 200353 - RNA, 23 nt, Human
ucauaagugaaaaucuaguuuag

SEQ ID NO: 200354 - RNA, 18 nt, Human
uccagcaccugcccccga

SEQ ID NO: 200355 - RNA, 24 nt, Human
ucguucugcgccagccuguacgcc

SEQ ID NO: 200356 - RNA, 18 nt, Human
ugagagggcaugcagcag

SEQ ID NO: 200357 - RNA, 20 nt, Human
uggcagggacuaugggacag

SEQ ID NO: 200358 - RNA, 22 nt, Human
uggcugucuaacccguccagcc

SEQ ID NO: 200359 - RNA, 18 nt, Human
uggggagguucccggguu

SEQ ID NO: 200360 - RNA, 20 nt, Human
ugucuguggggcccgggagc

SEQ ID NO: 200361 - RNA, 22 nt, Human
uuguggagauaagguuuggaaa

SEQ ID NO: 200362 - RNA, 25 nt, Human
aagccgagaacgagcuagcaaggga

SEQ ID NO: 200363 - RNA, 23 nt, Human
aauccaggacagacaaaaaaaaa

SEQ ID NO: 200364 - RNA, 21 nt, Human
agcgagggagaaagggagaga

SEQ ID NO: 200365 - RNA, 18 nt, Human
aggacagacaaaaaaaaa

SEQ ID NO: 200366 - RNA, 19 nt, Human
aggaggcgcguggagaaag

SEQ ID NO: 200367 - RNA, 23 nt, Human
aggcccuggagcagaggccccag

SEQ ID NO: 200368 - RNA, 22 nt, Human
aggccuggacggggaaaagggc

SEQ ID NO: 200369 - RNA, 21 nt, Human
agggagagagggguggcaggg

SEQ ID NO: 200370 - RNA, 21 nt, Human
agggagcgaggaggaggaggc

SEQ ID NO: 200371 - RNA, 21 nt, Human
agggaggggguccagagcuga

SEQ ID NO: 200372 - RNA, 22 nt, Human
aggguccgagcccccaaggccu

SEQ ID NO: 200373 - RNA, 21 nt, Human
caaguccucacuuggagggca

SEQ ID NO: 200374 - RNA, 21 nt, Human
caggagccggcucucugcacg

SEQ ID NO: 200375 - RNA, 19 nt, Human
cauucacuuuuuuucucuc

SEQ ID NO: 200376 - RNA, 24 nt, Human
ccaauccaggacagacaaaaaaaa

SEQ ID NO: 200377 - RNA, 22 nt, Human
ccagcaggcccaggagccggcu

SEQ ID NO: 200378 - RNA, 19 nt, Human
ccaggacagacaaaaaaaa

SEQ ID NO: 200379 - RNA, 23 nt, Human
ccagugauaaauacaggguaccc

SEQ ID NO: 200380 - RNA, 22 nt, Human
cccuccgcuccggcccuccccg

SEQ ID NO: 200381 - RNA, 23 nt, Human
cccugaggcccuggagcagaggc

SEQ ID NO: 200382 - RNA, 19 nt, Human
cccuggggguugguguggg

SEQ ID NO: 200383 - RNA, 20 nt, Human
cccuggggguuggugugggg

SEQ ID NO: 200384 - RNA, 23 nt, Human
ccgcuccggcccuccccggcugc

SEQ ID NO: 200385 - RNA, 24 nt, Human
ccggcccugaggcccuggagcaga

SEQ ID NO: 200386 - RNA, 19 nt, Human
cgaggaggaggaggcgcgu

SEQ ID NO: 200387 - RNA, 20 nt, Human
cggggaaaagggccuguaga

SEQ ID NO: 200388 - RNA, 20 nt, Human
cuggggcagaggggcuaggc

SEQ ID NO: 200389 - RNA, 24 nt, Human
gaccacaaauacagcuaaaaaucu

SEQ ID NO: 200390 - RNA, 20 nt, Human
gagaccacaaauacagcuaa

SEQ ID NO: 200391 - RNA, 24 nt, Human
gagcgagggagaaagggagagagg

SEQ ID NO: 200392 - RNA, 24 nt, Human
gaguugugcggugagggagggggu

SEQ ID NO: 200393 - RNA, 19 nt, Human
gccaaggcgcgcccuccgc

SEQ ID NO: 200394 - RNA, 21 nt, Human
ggagaaagggagagaggggug

SEQ ID NO: 200395 - RNA, 19 nt, Human
ggagcgaggaggaggaggc

SEQ ID NO: 200396 - RNA, 28 nt, Human
ggagcgagggagaaagggagagaggggu

SEQ ID NO: 200397 - RNA, 20 nt, Human
gggaggggguccagagcuga

SEQ ID NO: 200398 - RNA, 19 nt, Human
gggcgggggugggggcguc

SEQ ID NO: 200399 - RNA, 21 nt, Human
gggcuaggcagggacugcggg

SEQ ID NO: 200400 - RNA, 18 nt, Human
ggggcgggggugggggcg

SEQ ID NO: 200401 - RNA, 18 nt, Human
ggugagggagggggucca

SEQ ID NO: 200402 - RNA, 22 nt, Human
gguugguguggggccaaggcgc

SEQ ID NO: 200403 - RNA, 21 nt, Human
guaaaaugccauaaugacccc

SEQ ID NO: 200404 - RNA, 20 nt, Human
uaaaaugccauaaugacccc

SEQ ID NO: 200405 - RNA, 23 nt, Human
uaaaaugccauaaugacccccag

SEQ ID NO: 200406 - RNA, 21 nt, Human
uacagagaccacaaauacagc

SEQ ID NO: 200407 - RNA, 23 nt, Human
uacagagaccacaaauacagcua

SEQ ID NO: 200408 - RNA, 19 nt, Human
uagcaagggagcgaggagg

SEQ ID NO: 200409 - RNA, 18 nt, Human
uauaaauacagagaccac

SEQ ID NO: 200410 - RNA, 20 nt, Human
ucaaaacacaucaauugugc

SEQ ID NO: 200411 - RNA, 18 nt, Human
ucacacagaaacggucac

SEQ ID NO: 200412 - RNA, 21 nt, Human
uccaauccaggacagacaaaa

SEQ ID NO: 200413 - RNA, 19 nt, Human
uccaggacagacaaaaaaa

SEQ ID NO: 200414 - RNA, 23 nt, Human
uccccggcugccaggccggcccu

SEQ ID NO: 200415 - RNA, 24 nt, Human
uccccggcugccaggccggcccug

SEQ ID NO: 200416 - RNA, 31 nt, Human
uccccggcugccaggccggcccugaggcccc

SEQ ID NO: 200417 - RNA, 28 nt, Human
ucucugcacggggggcgggggugggggc

SEQ ID NO: 200418 - RNA, 21 nt, Human
ucugcacggggggcgggggug

SEQ ID NO: 200419 - RNA, 25 nt, Human
ugaggcccuggagcagaggccccag

SEQ ID NO: 200420 - RNA, 20 nt, Human
ugagggaggggguccagagc

SEQ ID NO: 200421 - RNA, 27 nt, Human
ugccugggcugggcauuugcuggggca

SEQ ID NO: 200422 - RNA, 19 nt, Human
ugccuuuaccuggucgguc

SEQ ID NO: 200423 - RNA, 18 nt, Human
ugcuggggcagaggggcu

SEQ ID NO: 200424 - RNA, 21 nt, Human
uggggcagaggggcuaggcag

SEQ ID NO: 200425 - RNA, 24 nt, Human
uguaaaaugccauaaugaccccca

SEQ ID NO: 200426 - RNA, 19 nt, Human
ugugcggugagggaggggg

SEQ ID NO: 200427 - RNA, 20 nt, Human
uuucccucuuuuuuuuccuu

SEQ ID NO: 200428 - RNA, 22 nt, Human
uuucccucuuuuuuuuccuuuu

SEQ ID NO: 200429 - RNA, 25 nt, Human
uuuguaaaaugccauaaugaccccc

SEQ ID NO: 200430 - RNA, 19 nt, Human
aaaaauagaaauauagcga

SEQ ID NO: 200431 - RNA, 24 nt, Human
aaaaauagaaauauagcgauucaa

SEQ ID NO: 200432 - RNA, 23 nt, Human
aaaauagaaauauagcgauucaa

SEQ ID NO: 200433 - RNA, 20 nt, Human
aacccucccaaaucgcaaga

SEQ ID NO: 200434 - RNA, 22 nt, Human
aacgcaguuucucuccccgccu

SEQ ID NO: 200435 - RNA, 23 nt, Human
acacugaacccucccaaaucgca

SEQ ID NO: 200436 - RNA, 24 nt, Human
accauaacaaacagaagcacguua

SEQ ID NO: 200437 - RNA, 19 nt, Human
acgcaguuucucuccccgc

SEQ ID NO: 200438 - RNA, 24 nt, Human
acgggguuuuacauacauaagauu

SEQ ID NO: 200439 - RNA, 27 nt, Human
acguuacaggacggacgcuggggacca

SEQ ID NO: 200440 - RNA, 20 nt, Human
agaacuaacucuaaaacacc

SEQ ID NO: 200441 - RNA, 24 nt, Human
aggcccggggagggaugaccugga

SEQ ID NO: 200442 - RNA, 27 nt, Human
agggaugaccuggaccaaauacgauag

SEQ ID NO: 200443 - RNA, 22 nt, Human
caacacugaacccucccaaauc

SEQ ID NO: 200444 - RNA, 20 nt, Human
caauaucucaacacugaacc

SEQ ID NO: 200445 - RNA, 20 nt, Human
cacuauguacagcccaaggc

SEQ ID NO: 200446 - RNA, 19 nt, Human
cauaagauuauuguaugaa

SEQ ID NO: 200447 - RNA, 20 nt, Human
cauguaugugugugugucuu

SEQ ID NO: 200448 - RNA, 18 nt, Human
ccauaacaaacagaagca

SEQ ID NO: 200449 - RNA, 23 nt, Human
ccccaggcccggggagggaugac

SEQ ID NO: 200450 - RNA, 18 nt, Human
cccgaccuagcccgcggc

SEQ ID NO: 200451 - RNA, 19 nt, Human
cccucagcuccugggcugg

SEQ ID NO: 200452 - RNA, 25 nt, Human
ccuagcccgcggcaugguccccagc

SEQ ID NO: 200453 - RNA, 20 nt, Human
ccucccaaaucgcaagaguu

SEQ ID NO: 200454 - RNA, 19 nt, Human
ccuggaccaaauacgauac

SEQ ID NO: 200455 - RNA, 19 nt, Human
cgcuggggacgaacccugg

SEQ ID NO: 200456 - RNA, 22 nt, Human
cgguugcgcuggggaaagagaa

SEQ ID NO: 200457 - RNA, 22 nt, Human
cucaacacugaacccucccaaa

SEQ ID NO: 200458 - RNA, 21 nt, Human
cucuccccgccuccuccucgc

SEQ ID NO: 200459 - RNA, 23 nt, Human
cucuccccgccuccuccucgcug

SEQ ID NO: 200460 - RNA, 23 nt, Human
cucugaagaaaggaggaaaaaaa

SEQ ID NO: 200461 - RNA, 18 nt, Human
cugaggcagcaggcuggg

SEQ ID NO: 200462 - RNA, 18 nt, Human
cugcacgcagagcgcccc

SEQ ID NO: 200463 - RNA, 23 nt, Human
cuuuccuuuucuuuuucgucucu

SEQ ID NO: 200464 - RNA, 26 nt, Human
cuuuuuuuuuuuuguacaaaaucugc

SEQ ID NO: 200465 - RNA, 19 nt, Human
gaccuagcccgcggcaugg

SEQ ID NO: 200466 - RNA, 24 nt, Human
gcccgcggcaugguccccagcccu

SEQ ID NO: 200467 - RNA, 21 nt, Human
gcugauuggcuuuugucuauc

SEQ ID NO: 200468 - RNA, 22 nt, Human
ggaccaaauacgauacagggaa

SEQ ID NO: 200469 - RNA, 25 nt, Human
gggaaaaaaaaauagaaauauagcg

SEQ ID NO: 200470 - RNA, 18 nt, Human
ggggacgaacccugggga

SEQ ID NO: 200471 - RNA, 24 nt, Human
gggguuuuuguuuuucccuuggcu

SEQ ID NO: 200472 - RNA, 20 nt, Human
ggguauuuugugggguuuuu

SEQ ID NO: 200473 - RNA, 20 nt, Human
ggguuuuuguuuuucccuug

SEQ ID NO: 200474 - RNA, 20 nt, Human
gguauuuugugggguuuuug

SEQ ID NO: 200475 - RNA, 18 nt, Human
guacaaaaucugcacgca

SEQ ID NO: 200476 - RNA, 19 nt, Human
uaaaacaccaauaucucaa

SEQ ID NO: 200477 - RNA, 24 nt, Human
uaagugacuucaauauauuaacac

SEQ ID NO: 200478 - RNA, 19 nt, Human
uacaaaaucugcacgcaga

SEQ ID NO: 200479 - RNA, 23 nt, Human
uacauacauaagauuauuguaug

SEQ ID NO: 200480 - RNA, 21 nt, Human
uacgauacagggaaaaaaaaa

SEQ ID NO: 200481 - RNA, 18 nt, Human
ucaacacugaacccuccc

SEQ ID NO: 200482 - RNA, 20 nt, Human
ucaauauauuaacacagggc

SEQ ID NO: 200483 - RNA, 22 nt, Human
uccccagcccucaccccucagc

SEQ ID NO: 200484 - RNA, 24 nt, Human
uccccagcccucaccccucagcuc

SEQ ID NO: 200485 - RNA, 25 nt, Human
uccccagcccucaccccucagcucc

SEQ ID NO: 200486 - RNA, 23 nt, Human
ucuaccauaacaaacagaagcug

SEQ ID NO: 200487 - RNA, 18 nt, Human
ucucugaagaaaggagga

SEQ ID NO: 200488 - RNA, 18 nt, Human
ugcgcuggggaaagagaa

SEQ ID NO: 200489 - RNA, 20 nt, Human
ugugugugugucuuuuuuuu

SEQ ID NO: 200490 - RNA, 20 nt, Human
uguguugggguauuuugugg

SEQ ID NO: 200491 - RNA, 20 nt, Human
uucucuccccgccuccuccu

SEQ ID NO: 200492 - RNA, 24 nt, Human
uuuccccuuccuuguuuuucuuuu

SEQ ID NO: 200493 - RNA, 20 nt, Human
uuuuucgucucucccccgcc

SEQ ID NO: 200494 - RNA, 22 nt, Human
aaagcugaauauauguagccuu

SEQ ID NO: 200495 - RNA, 23 nt, Human
aaaugugaagaucacugaagcag

SEQ ID NO: 200496 - RNA, 18 nt, Human
aaucauaaccaaacaagu

SEQ ID NO: 200497 - RNA, 18 nt, Human
acccauggcgagugagcc

SEQ ID NO: 200498 - RNA, 18 nt, Human
acccgagcugcccucucc

SEQ ID NO: 200499 - RNA, 21 nt, Human
aggccggggccggaguacgga

SEQ ID NO: 200500 - RNA, 22 nt, Human
aguacggagccgggcagaggcu

SEQ ID NO: 200501 - RNA, 20 nt, Human
cauagagagguagaaaccgc

SEQ ID NO: 200502 - RNA, 24 nt, Human
caucagagugcugacagaacucag

SEQ ID NO: 200503 - RNA, 20 nt, Human
caucucaaaaagcugaauau

SEQ ID NO: 200504 - RNA, 19 nt, Human
caugcuaugacauuaaaug

SEQ ID NO: 200505 - RNA, 22 nt, Human
cauuuuuguucucccaccucca

SEQ ID NO: 200506 - RNA, 18 nt, Human
ccuccaucccaaacugag

SEQ ID NO: 200507 - RNA, 18 nt, Human
cgccugggacuucugcag

SEQ ID NO: 200508 - RNA, 20 nt, Human
cggagcugggcuggcagcug

SEQ ID NO: 200509 - RNA, 19 nt, Human
cgggggcggccacguggcg

SEQ ID NO: 200510 - RNA, 24 nt, Human
cgucugcgccgcuccgccagcccu

SEQ ID NO: 200511 - RNA, 20 nt, Human
cucccaccuccaucccaaac

SEQ ID NO: 200512 - RNA, 19 nt, Human
cugcaggccacaguuuuuc

SEQ ID NO: 200513 - RNA, 18 nt, Human
cugggcuggcagcugggc

SEQ ID NO: 200514 - RNA, 21 nt, Human
cuuuaaauuaaaaccagaaaa

SEQ ID NO: 200515 - RNA, 19 nt, Human
gagcacaucagagugcuga

SEQ ID NO: 200516 - RNA, 20 nt, Human
gagcugcccucuccaaccca

SEQ ID NO: 200517 - RNA, 20 nt, Human
gccgccgucugcgccgcucc

SEQ ID NO: 200518 - RNA, 21 nt, Human
gccggaguacggagccgggca

SEQ ID NO: 200519 - RNA, 22 nt, Human
gccugggacuucugcaggccac

SEQ ID NO: 200520 - RNA, 23 nt, Human
ggacauauagucuggaacucgga

SEQ ID NO: 200521 - RNA, 18 nt, Human
ggagcugggcuggcagcu

SEQ ID NO: 200522 - RNA, 20 nt, Human
gggcggccucuccgcucggc

SEQ ID NO: 200523 - RNA, 19 nt, Human
guccuuuaaauuaaaaccg

SEQ ID NO: 200524 - RNA, 21 nt, Human
gucgccugggacuucugcagg

SEQ ID NO: 200525 - RNA, 25 nt, Human
uaagacacaaaucauaaccaaacaa

SEQ ID NO: 200526 - RNA, 18 nt, Human
uacuucauuucccaagug

SEQ ID NO: 200527 - RNA, 21 nt, Human
ucccaccuccaucccaaacug

SEQ ID NO: 200528 - RNA, 22 nt, Human
ucuacccgagcugcccucucca

SEQ ID NO: 200529 - RNA, 22 nt, Human
ucuaguaacuaaacagcgauug

SEQ ID NO: 200530 - RNA, 20 nt, Human
ucucccaccuccaucccaaa

SEQ ID NO: 200531 - RNA, 22 nt, Human
ucugagcacaucagagugcuga

SEQ ID NO: 200532 - RNA, 19 nt, Human
ucuguggauuuguucaucu

SEQ ID NO: 200533 - RNA, 23 nt, Human
ugagcacaucagagugcugacag

SEQ ID NO: 200534 - RNA, 22 nt, Human
ugaggcaaagauagcagcggag

SEQ ID NO: 200535 - RNA, 25 nt, Human
ugcaagcaaaucuuuuuaaaaaaua

SEQ ID NO: 200536 - RNA, 20 nt, Human
ugcacaugacuaagugaggc

SEQ ID NO: 200537 - RNA, 25 nt, Human
ugccacucugcaacgcgaauugcac

SEQ ID NO: 200538 - RNA, 19 nt, Human
uggccuaauauaccggcgg

SEQ ID NO: 200539 - RNA, 20 nt, Human
uggccuaauauaccggcggg

SEQ ID NO: 200540 - RNA, 21 nt, Human
uggccuaauauaccggcgggg

SEQ ID NO: 200541 - RNA, 22 nt, Human
uggcuuacaagacagucaauua

SEQ ID NO: 200542 - RNA, 23 nt, Human
ugggcuggcagcugggcaccuuu

SEQ ID NO: 200543 - RNA, 20 nt, Human
uguucucccaccuccauccc

SEQ ID NO: 200544 - RNA, 22 nt, Human
uuaaaaccagaaaaacuuuggg

SEQ ID NO: 200545 - RNA, 20 nt, Human
uuguaucaucacucaggcac

SEQ ID NO: 200546 - RNA, 21 nt, Human
uuuaaagaaaaaaaaacugga

SEQ ID NO: 200547 - RNA, 26 nt, Human
uuuaaagaaaaaaaaacuggagugca

SEQ ID NO: 200548 - RNA, 20 nt, Human
uuuuuuuuuuuuuuuugcag

SEQ ID NO: 200549 - RNA, 22 nt, Human
uuuuuuuuuuuuuuuugcagau

SEQ ID NO: 200550 - RNA, 24 nt, Human
acgcggugcccccucuccaauccu

SEQ ID NO: 200551 - RNA, 18 nt, Human
cgcggugcccccucucca

SEQ ID NO: 200552 - RNA, 18 nt, Human
cuggaacgcggugccccc

SEQ ID NO: 200553 - RNA, 21 nt, Human
cuggaacgcggugcccccucu

SEQ ID NO: 200554 - RNA, 18 nt, Human
ggaaagaauuugaagaag

SEQ ID NO: 200555 - RNA, 20 nt, Human
ggccucugauccggccucag

SEQ ID NO: 200556 - RNA, 19 nt, Human
gggaaagaauuugaagaag

SEQ ID NO: 200557 - RNA, 20 nt, Human
ggugcccccucuccaauccu

SEQ ID NO: 200558 - RNA, 18 nt, Human
uccaauccuggccucuga

SEQ ID NO: 200559 - RNA, 18 nt, Human
uggccucugauccggccu

SEQ ID NO: 200560 - RNA, 21 nt, Human
ugggcccuggaacgcggugcc

SEQ ID NO: 200561 - RNA, 18 nt, Human
cagcucccggcgcggcuc

SEQ ID NO: 200562 - RNA, 30 nt, Human
ccccggcccuggcccuggccccgcgcagga

SEQ ID NO: 200563 - RNA, 22 nt, Human
cccggccccggcccuggcccug

SEQ ID NO: 200564 - RNA, 25 nt, Human
cccggccccggcccuggcccuggcc

SEQ ID NO: 200565 - RNA, 27 nt, Human
cccggccccggcccuggcccuggcccc

SEQ ID NO: 200566 - RNA, 19 nt, Human
cccggccuggcccggcccc

SEQ ID NO: 200567 - RNA, 22 nt, Human
ccggcgcggcucauggcccggc

SEQ ID NO: 200568 - RNA, 19 nt, Human
ccuggcccggccccggccc

SEQ ID NO: 200569 - RNA, 18 nt, Human
cgccuccucccuccucuc

SEQ ID NO: 200570 - RNA, 18 nt, Human
cggccccggcccuggccc

SEQ ID NO: 200571 - RNA, 24 nt, Human
cggccccggcccuggcccuggccc

SEQ ID NO: 200572 - RNA, 18 nt, Human
ucccuccucuccuuucuc

SEQ ID NO: 200573 - RNA, 19 nt, Human
uggcccggccuggcccggc

SEQ ID NO: 200574 - RNA, 20 nt, Human
aaacaccagccacgguuacc

SEQ ID NO: 200575 - RNA, 19 nt, Human
aacugccccgcgggcccca

SEQ ID NO: 200576 - RNA, 20 nt, Human
aagcucuggucccucugcag

SEQ ID NO: 200577 - RNA, 23 nt, Human
acaccauuaccagauuggagucc

SEQ ID NO: 200578 - RNA, 23 nt, Human
acagcaagagagguaauuuugcc

SEQ ID NO: 200579 - RNA, 19 nt, Human
acuacaaacaccagccacg

SEQ ID NO: 200580 - RNA, 18 nt, Human
agacccgggaggcggcgg

SEQ ID NO: 200581 - RNA, 20 nt, Human
agacgcgggccaggcccaag

SEQ ID NO: 200582 - RNA, 21 nt, Human
aggcggcggcagggcaagagc

SEQ ID NO: 200583 - RNA, 19 nt, Human
cacccucuaccccaccacu

SEQ ID NO: 200584 - RNA, 22 nt, Human
caggcccaagacucuccaagcu

SEQ ID NO: 200585 - RNA, 19 nt, Human
cagggggacuaaggaggug

SEQ ID NO: 200586 - RNA, 24 nt, Human
ccaagacucuccaagcucuggucc

SEQ ID NO: 200587 - RNA, 19 nt, Human
ccaggcuccaggugaccac

SEQ ID NO: 200588 - RNA, 21 nt, Human
cccaccacuacagcaagagag

SEQ ID NO: 200589 - RNA, 21 nt, Human
cccccacggccuggaagcgaa

SEQ ID NO: 200590 - RNA, 22 nt, Human
ccccgcgggccccacccucuac

SEQ ID NO: 200591 - RNA, 22 nt, Human
cccgaacugccccgcgggcccc

SEQ ID NO: 200592 - RNA, 23 nt, Human
cccgcgggccccacccucuaccc

SEQ ID NO: 200593 - RNA, 19 nt, Human
ccgcuggaggccugagacc

SEQ ID NO: 200594 - RNA, 21 nt, Human
ccggcccccaggcuccaggug

SEQ ID NO: 200595 - RNA, 23 nt, Human
ccuucacugccaccuccaauguc

SEQ ID NO: 200596 - RNA, 21 nt, Human
cgaacugccccgcgggccccu

SEQ ID NO: 200597 - RNA, 21 nt, Human
cgagucacccaaaggacgccc

SEQ ID NO: 200598 - RNA, 28 nt, Human
cgaugggucucagacuuaccuuugggac

SEQ ID NO: 200599 - RNA, 21 nt, Human
cgccugcgccuccgccgcugg

SEQ ID NO: 200600 - RNA, 23 nt, Human
cggcccccaggcuccaggugacc

SEQ ID NO: 200601 - RNA, 18 nt, Human
cucuaccccaccacuaca

SEQ ID NO: 200602 - RNA, 19 nt, Human
cucuucagguuucuuuuga

SEQ ID NO: 200603 - RNA, 22 nt, Human
cugcagggcgcgccgccgaugg

SEQ ID NO: 200604 - RNA, 19 nt, Human
gacaauuugaaaucaauaa

SEQ ID NO: 200605 - RNA, 24 nt, Human
gacaccauuaccagauuggagucc

SEQ ID NO: 200606 - RNA, 24 nt, Human
gauuggagucccuugguccgcagu

SEQ ID NO: 200607 - RNA, 19 nt, Human
ggaggccugagacccggga

SEQ ID NO: 200608 - RNA, 19 nt, Human
ggcacugucaaauuuacag

SEQ ID NO: 200609 - RNA, 18 nt, Human
ggcagggcaagagcgggg

SEQ ID NO: 200610 - RNA, 23 nt, Human
uaagcuagacgcgggccaggccc

SEQ ID NO: 200611 - RNA, 24 nt, Human
uaaggaggugaaauguggccccca

SEQ ID NO: 200612 - RNA, 22 nt, Human
uauggcgagucacccaaaggac

SEQ ID NO: 200613 - RNA, 22 nt, Human
uauggcgagucacccaaaggac

SEQ ID NO: 200614 - RNA, 23 nt, Human
uauggcgagucacccaaaggacg

SEQ ID NO: 200615 - RNA, 20 nt, Human
ucuguggaggcccucgugcc

SEQ ID NO: 200616 - RNA, 22 nt, Human
ugaaacuaagcuagacgcgggc

SEQ ID NO: 200617 - RNA, 18 nt, Human
ugaaaucaauaaacugug

SEQ ID NO: 200618 - RNA, 19 nt, Human
ugaaaucaauaaacugugg

SEQ ID NO: 200619 - RNA, 20 nt, Human
ugacucgcuucaaauaauaa

SEQ ID NO: 200620 - RNA, 23 nt, Human
ugagagagcugggccggccccca

SEQ ID NO: 200621 - RNA, 25 nt, Human
uggaggccugagacccgggaggcgg

SEQ ID NO: 200622 - RNA, 23 nt, Human
ugggacaccauuaccagauugga

SEQ ID NO: 200623 - RNA, 24 nt, Human
uggugaggacugugguuuuugaga

SEQ ID NO: 200624 - RNA, 25 nt, Human
uuaccagauuggagucccuuggucc

SEQ ID NO: 200625 - RNA, 20 nt, Human
uuaugucaacuacaaacacc

SEQ ID NO: 200626 - RNA, 23 nt, Human
uucaaaacuacucucucaacuag

SEQ ID NO: 200627 - RNA, 24 nt, Human
uucccgaacugccccgcgggcccc

SEQ ID NO: 200628 - RNA, 19 nt, Human
uugugccacgccaccgggc

SEQ ID NO: 200629 - RNA, 21 nt, Human
uuuauggcgagucacccaaag

SEQ ID NO: 200630 - RNA, 21 nt, Human
uuuuuuuuuuuuuuugacugg

SEQ ID NO: 200631 - RNA, 18 nt, Human
uuuuuuuuuuuuuuuuug

SEQ ID NO: 200632 - RNA, 24 nt, Human
uuuuuuuuuuuuuuuuugacuggg

SEQ ID NO: 200633 - RNA, 22 nt, Human
aaaacacugcuauaugagggua

SEQ ID NO: 200634 - RNA, 20 nt, Human
aaaagaccaaggcuuggaag

SEQ ID NO: 200635 - RNA, 22 nt, Human
aaacaaagagcaguccccaggg

SEQ ID NO: 200636 - RNA, 23 nt, Human
aaaugcacccuagagcuccccac

SEQ ID NO: 200637 - RNA, 24 nt, Human
aacauguuucuuggcuuuccucug

SEQ ID NO: 200638 - RNA, 23 nt, Human
aacccauuuccuucccugcccua

SEQ ID NO: 200639 - RNA, 20 nt, Human
aacccccgccccccgacacc

SEQ ID NO: 200640 - RNA, 19 nt, Human
aaccuagcccuuuggcccu

SEQ ID NO: 200641 - RNA, 21 nt, Human
aacugguuguaagcacagugc

SEQ ID NO: 200642 - RNA, 19 nt, Human
aagaguuccucaccuuccc

SEQ ID NO: 200643 - RNA, 18 nt, Human
aaggagaaacaaagagca

SEQ ID NO: 200644 - RNA, 24 nt, Human
aauccaguuggaacagaaaauuca

SEQ ID NO: 200645 - RNA, 26 nt, Human
aaucccgcccccccucccauccccau

SEQ ID NO: 200646 - RNA, 23 nt, Human
acaaacuggaaacaaauaauagc

SEQ ID NO: 200647 - RNA, 24 nt, Human
acaaagagcaguccccagggucua

SEQ ID NO: 200648 - RNA, 18 nt, Human
acaacagaaaccuucuaa

SEQ ID NO: 200649 - RNA, 19 nt, Human
acagccccuccccuacacg

SEQ ID NO: 200650 - RNA, 20 nt, Human
acauguggaaauauauuuuc

SEQ ID NO: 200651 - RNA, 22 nt, Human
accccaaggagaaacaaagagc

SEQ ID NO: 200652 - RNA, 18 nt, Human
acccccgccccccgacac

SEQ ID NO: 200653 - RNA, 22 nt, Human
acccuggagggguggagugggg

SEQ ID NO: 200654 - RNA, 22 nt, Human
accucacucccuaguaccccaa

SEQ ID NO: 200655 - RNA, 19 nt, Human
accuuuuuaagauuuuugg

SEQ ID NO: 200656 - RNA, 21 nt, Human
acuuuuguggacuucuagauu

SEQ ID NO: 200657 - RNA, 24 nt, Human
agaaugaauccuccuauuggggua

SEQ ID NO: 200658 - RNA, 18 nt, Human
agacaacccagaaagucc

SEQ ID NO: 200659 - RNA, 19 nt, Human
agaccaaggcuuggaagac

SEQ ID NO: 200660 - RNA, 22 nt, Human
agagaagcggaauuucagccua

SEQ ID NO: 200661 - RNA, 18 nt, Human
agagaguggggaggggug

SEQ ID NO: 200662 - RNA, 22 nt, Human
agagcugagacuuauaaacaaa

SEQ ID NO: 200663 - RNA, 25 nt, Human
agaggaaaaaagaagagaaggguag

SEQ ID NO: 200664 - RNA, 22 nt, Human
agaguuccucaccuucccacuu

SEQ ID NO: 200665 - RNA, 22 nt, Human
agcaagaguuccucaccuuccc

SEQ ID NO: 200666 - RNA, 22 nt, Human
agccaaagaacaagccuacaga

SEQ ID NO: 200667 - RNA, 24 nt, Human
agcuacaaccuuuuuuggagccug

SEQ ID NO: 200668 - RNA, 18 nt, Human
aggaaaagcugcucuaug

SEQ ID NO: 200669 - RNA, 26 nt, Human
aggaaagcagcuuagcaacuuuccaa

SEQ ID NO: 200670 - RNA, 18 nt, Human
aggagaaacaaagagcag

SEQ ID NO: 200671 - RNA, 21 nt, Human
aggagacacagccaaagaaca

SEQ ID NO: 200672 - RNA, 23 nt, Human
aggcaaagacgagugcuugaaaa

SEQ ID NO: 200673 - RNA, 18 nt, Human
aggcagaagaaaaacgac

SEQ ID NO: 200674 - RNA, 23 nt, Human
aggcagaagaaaaacgacuagag

SEQ ID NO: 200675 - RNA, 20 nt, Human
agggagagaugggcccaggg

SEQ ID NO: 200676 - RNA, 25 nt, Human
agggagggggcugcccucgggcagg

SEQ ID NO: 200677 - RNA, 20 nt, Human
agggcgucagaaaaagacgu

SEQ ID NO: 200678 - RNA, 22 nt, Human
aggguuccugccugcccgcccu

SEQ ID NO: 200679 - RNA, 24 nt, Human
auaauauacuuagagagagaaucc

SEQ ID NO: 200680 - RNA, 22 nt, Human
auagaaacaaugaugugaauaa

SEQ ID NO: 200681 - RNA, 21 nt, Human
auguaugaacucugugcuuuu

SEQ ID NO: 200682 - RNA, 20 nt, Human
augucaccaggcgcagcuga

SEQ ID NO: 200683 - RNA, 19 nt, Human
caaaagaaucccuccaagc

SEQ ID NO: 200684 - RNA, 24 nt, Human
caaaagaaucccuccaagcugaga

SEQ ID NO: 200685 - RNA, 21 nt, Human
caaacacuucuggcucauauu

SEQ ID NO: 200686 - RNA, 22 nt, Human
caaagcacguucucagauggaa

SEQ ID NO: 200687 - RNA, 23 nt, Human
caacagaaaccuucuaaaguguu

SEQ ID NO: 200688 - RNA, 19 nt, Human
caaccaauuaggcuugcau

SEQ ID NO: 200689 - RNA, 24 nt, Human
caacuugccuaaggauagcggcuc

SEQ ID NO: 200690 - RNA, 19 nt, Human
caagcccccauuuggguac

SEQ ID NO: 200691 - RNA, 25 nt, Human
caagggcaccuccaccuugucaaaa

SEQ ID NO: 200692 - RNA, 24 nt, Human
cacaguaccuuagagcccagcgag

SEQ ID NO: 200693 - RNA, 20 nt, Human
cacccaaaaguuaccagaau

SEQ ID NO: 200694 - RNA, 23 nt, Human
cacccagaacugguuguaagcac

SEQ ID NO: 200695 - RNA, 26 nt, Human
caccccauuccccucagguaauccca

SEQ ID NO: 200696 - RNA, 21 nt, Human
cacccccagcugaaugcaacc

SEQ ID NO: 200697 - RNA, 23 nt, Human
caccuucccacuuucuccccacu

SEQ ID NO: 200698 - RNA, 21 nt, Human
caccuugucaaaaugcacccu

SEQ ID NO: 200699 - RNA, 19 nt, Human
cacugauuuugccaaccuu

SEQ ID NO: 200700 - RNA, 23 nt, Human
cacugcuauaugaggguauuuag

SEQ ID NO: 200701 - RNA, 23 nt, Human
cacuucacucucccccuccccca

SEQ ID NO: 200702 - RNA, 21 nt, Human
cagacaucaugggcugacuga

SEQ ID NO: 200703 - RNA, 23 nt, Human
cagagcaaugaaagguggguggg

SEQ ID NO: 200704 - RNA, 24 nt, Human
cagccuggugcgcagggagagaug

SEQ ID NO: 200705 - RNA, 20 nt, Human
caggaccccaacacgguuuu

SEQ ID NO: 200706 - RNA, 21 nt, Human
caggccccaaauacaagcaag

SEQ ID NO: 200707 - RNA, 19 nt, Human
caucaaaacuacaagcaac

SEQ ID NO: 200708 - RNA, 19 nt, Human
cauuggagcuuuuccacaa

SEQ ID NO: 200709 - RNA, 19 nt, Human
ccaaaaguuaccagaaucu

SEQ ID NO: 200710 - RNA, 18 nt, Human
ccaacacaaacacuucug

SEQ ID NO: 200711 - RNA, 19 nt, Human
ccaaccuucugccucaacu

SEQ ID NO: 200712 - RNA, 19 nt, Human
ccaagguaauaaaacagaa

SEQ ID NO: 200713 - RNA, 22 nt, Human
ccacaguaccuuagagcccagc

SEQ ID NO: 200714 - RNA, 22 nt, Human
ccaggagaggcagaagaaaaac

SEQ ID NO: 200715 - RNA, 27 nt, Human
cccacaggccccaaauacaagcaagcc

SEQ ID NO: 200716 - RNA, 22 nt, Human
cccacaguaccuuagagcccag

SEQ ID NO: 200717 - RNA, 18 nt, Human
cccagaaaguccagaaau

SEQ ID NO: 200718 - RNA, 22 nt, Human
cccagaaggaaaauguuggacc

SEQ ID NO: 200719 - RNA, 23 nt, Human
cccagcaccccauuccccucagg

SEQ ID NO: 200720 - RNA, 18 nt, Human
cccaucccgcucuaggga

SEQ ID NO: 200721 - RNA, 20 nt, Human
cccauguagcuggggguggg

SEQ ID NO: 200722 - RNA, 22 nt, Human
cccauguagcugggggugggcu

SEQ ID NO: 200723 - RNA, 18 nt, Human
ccccaaaaccuagcccuu

SEQ ID NO: 200724 - RNA, 23 nt, Human
ccccaaauacaagcaagccccca

SEQ ID NO: 200725 - RNA, 24 nt, Human
ccccaaauacaagcaagcccccau

SEQ ID NO: 200726 - RNA, 18 nt, Human
ccccagcaccccauuccc

SEQ ID NO: 200727 - RNA, 21 nt, Human
ccccagcaccccauuccccuc

SEQ ID NO: 200728 - RNA, 23 nt, Human
ccccagcugaaugcaacccccgc

SEQ ID NO: 200729 - RNA, 26 nt, Human
ccccagggucuaauacaaaagacccc

SEQ ID NO: 200730 - RNA, 23 nt, Human
cccccacauuauuaagccacaaa

SEQ ID NO: 200731 - RNA, 22 nt, Human
cccccagcugaaugcaaccccc

SEQ ID NO: 200732 - RNA, 18 nt, Human
cccccccucccaucccca

SEQ ID NO: 200733 - RNA, 21 nt, Human
cccccccucccauccccaucc

SEQ ID NO: 200734 - RNA, 18 nt, Human
cccccgccccccgacacc

SEQ ID NO: 200735 - RNA, 20 nt, Human
cccccuauauacauuuccag

SEQ ID NO: 200736 - RNA, 24 nt, Human
ccccgcagcuucggcucagccugg

SEQ ID NO: 200737 - RNA, 20 nt, Human
ccccgccccccgacaccaag

SEQ ID NO: 200738 - RNA, 21 nt, Human
ccccucagguaaucccagcuu

SEQ ID NO: 200739 - RNA, 19 nt, Human
ccccuuucaccuuuuuaag

SEQ ID NO: 200740 - RNA, 20 nt, Human
cccuggagggguggaguggg

SEQ ID NO: 200741 - RNA, 18 nt, Human
cccuuucccacuuugguc

SEQ ID NO: 200742 - RNA, 18 nt, Human
cccuuucccacuuugguc

SEQ ID NO: 200743 - RNA, 22 nt, Human
ccgacaccaaguaggcacagcu

SEQ ID NO: 200744 - RNA, 19 nt, Human
ccgcagcuucggcucagcc

SEQ ID NO: 200745 - RNA, 20 nt, Human
ccgcagcuucggcucagccu

SEQ ID NO: 200746 - RNA, 21 nt, Human
ccgcccccccucccaucccca

SEQ ID NO: 200747 - RNA, 19 nt, Human
ccuauauacauuuccagag

SEQ ID NO: 200748 - RNA, 22 nt, Human
ccuccaagcugagaaggagagc

SEQ ID NO: 200749 - RNA, 18 nt, Human
ccucccauccccaucccg

SEQ ID NO: 200750 - RNA, 22 nt, Human
ccucuggggcagggaugcaguc

SEQ ID NO: 200751 - RNA, 21 nt, Human
ccugcccucagcucucaggag

SEQ ID NO: 200752 - RNA, 28 nt, Human
ccugccugcagccggcgggagcagggau

SEQ ID NO: 200753 - RNA, 19 nt, Human
ccugccugcccgcccugcc

SEQ ID NO: 200754 - RNA, 22 nt, Human
cgccaagauuuuauguucucag

SEQ ID NO: 200755 - RNA, 22 nt, Human
cgccaugcuuucuaccagugcc

SEQ ID NO: 200756 - RNA, 21 nt, Human
cgcugcccuugcccauguagc

SEQ ID NO: 200757 - RNA, 18 nt, Human
cucaagggagaaugaauc

SEQ ID NO: 200758 - RNA, 19 nt, Human
cucaagggagaaugaaucc

SEQ ID NO: 200759 - RNA, 23 nt, Human
cucaccuucccacuuucucccca

SEQ ID NO: 200760 - RNA, 22 nt, Human
cucacucccuaguaccccaaaa

SEQ ID NO: 200761 - RNA, 19 nt, Human
cucccccagucaggacccc

SEQ ID NO: 200762 - RNA, 23 nt, Human
cucccuaguaccccaaaaccuag

SEQ ID NO: 200763 - RNA, 20 nt, Human
cucccuuucccacuuugguc

SEQ ID NO: 200764 - RNA, 21 nt, Human
cuucacucucccccuccccca

SEQ ID NO: 200765 - RNA, 25 nt, Human
cuuccacugaaagcaccuagcacag

SEQ ID NO: 200766 - RNA, 23 nt, Human
cuucccacuuucuccccacugca

SEQ ID NO: 200767 - RNA, 20 nt, Human
cuugucccagguccaccccc

SEQ ID NO: 200768 - RNA, 22 nt, Human
cuuucucucuuucugucuuucu

SEQ ID NO: 200769 - RNA, 23 nt, Human
gaaaacauguuucuuggcuuucc

SEQ ID NO: 200770 - RNA, 25 nt, Human
gaaaauauauaccuuuuuccccuuc

SEQ ID NO: 200771 - RNA, 23 nt, Human
gaaacccauuuccuucccugccc

SEQ ID NO: 200772 - RNA, 24 nt, Human
gaacaagccuacagagaaacucuu

SEQ ID NO: 200773 - RNA, 25 nt, Human
gaacagaaaauucagucauuaucua

SEQ ID NO: 200774 - RNA, 18 nt, Human
gaagaaaaacgacuagag

SEQ ID NO: 200775 - RNA, 22 nt, Human
gaaguuuuugcaucgaccauau

SEQ ID NO: 200776 - RNA, 26 nt, Human
gaauaaaguugggcagccaugugacc

SEQ ID NO: 200777 - RNA, 20 nt, Human
gacuagaggacaucuccccu

SEQ ID NO: 200778 - RNA, 24 nt, Human
gagcaaugaaagguggguggguga

SEQ ID NO: 200779 - RNA, 24 nt, Human
gagcugagacuuauaaacaaagaa

SEQ ID NO: 200780 - RNA, 18 nt, Human
gaggcggcugaccagcgc

SEQ ID NO: 200781 - RNA, 19 nt, Human
gagggcgucagaaaaagac

SEQ ID NO: 200782 - RNA, 20 nt, Human
gagguggggccacugggagc

SEQ ID NO: 200783 - RNA, 20 nt, Human
gcagaagaaaaacgacuaga

SEQ ID NO: 200784 - RNA, 19 nt, Human
gcagccaugugaccaggcc

SEQ ID NO: 200785 - RNA, 21 nt, Human
gccaugcuuucuaccagugcc

SEQ ID NO: 200786 - RNA, 23 nt, Human
gcccacuccugugggcccaaaug

SEQ ID NO: 200787 - RNA, 23 nt, Human
gccccaggcgaggaggguuccug

SEQ ID NO: 200788 - RNA, 19 nt, Human
gcccccccucccaucccca

SEQ ID NO: 200789 - RNA, 20 nt, Human
gccgccguccuggcuuuguc

SEQ ID NO: 200790 - RNA, 21 nt, Human
gcgccggcugcuucuagucuc

SEQ ID NO: 200791 - RNA, 19 nt, Human
gcucagccuggugcgcagg

SEQ ID NO: 200792 - RNA, 20 nt, Human
gcucccugaaguucagcccc

SEQ ID NO: 200793 - RNA, 22 nt, Human
ggaaaaaagaagagaaggguag

SEQ ID NO: 200794 - RNA, 21 nt, Human
ggagacacagccaaagaacaa

SEQ ID NO: 200795 - RNA, 22 nt, Human
ggagcuuuuccacaccuagcuu

SEQ ID NO: 200796 - RNA, 20 nt, Human
ggaugcugggguccgacugg

SEQ ID NO: 200797 - RNA, 22 nt, Human
gggcaccuccaccuugucaaaa

SEQ ID NO: 200798 - RNA, 19 nt, Human
gggcagagcugggacuggg

SEQ ID NO: 200799 - RNA, 23 nt, Human
ggugaggagcuucuggagaggaa

SEQ ID NO: 200800 - RNA, 18 nt, Human
guuccaguccccagcacc

SEQ ID NO: 200801 - RNA, 24 nt, Human
uaaaaaaccacuauucucaaggca

SEQ ID NO: 200802 - RNA, 24 nt, Human
uaaaacaccaacacaaacacuucu

SEQ ID NO: 200803 - RNA, 21 nt, Human
uaaaggaacaaacuggaaaca

SEQ ID NO: 200804 - RNA, 23 nt, Human
uaaccgccaugcuuucuaccagu

SEQ ID NO: 200805 - RNA, 19 nt, Human
uaaccuaguccgagggcgg

SEQ ID NO: 200806 - RNA, 19 nt, Human
uaacuuugacuucuuccuc

SEQ ID NO: 200807 - RNA, 20 nt, Human
uaagccacaaagcacccugg

SEQ ID NO: 200808 - RNA, 18 nt, Human
uaagugguuacggggccc

SEQ ID NO: 200809 - RNA, 18 nt, Human
uaauuuuucucguguugu

SEQ ID NO: 200810 - RNA, 21 nt, Human
uacaacagaaaccuucuaaag

SEQ ID NO: 200811 - RNA, 22 nt, Human
uacaagcaagcccccauuuggg

SEQ ID NO: 200812 - RNA, 24 nt, Human
uacaagcaagcccccauuugggua

SEQ ID NO: 200813 - RNA, 22 nt, Human
uaccucacucccuaguacccca

SEQ ID NO: 200814 - RNA, 21 nt, Human
uaccuuagagcccagcgaggu

SEQ ID NO: 200815 - RNA, 20 nt, Human
uacggggcccuaccccuucc

SEQ ID NO: 200816 - RNA, 18 nt, Human
uagacaacccagaaaguc

SEQ ID NO: 200817 - RNA, 21 nt, Human
uagagcuccccacugggcuuc

SEQ ID NO: 200818 - RNA, 24 nt, Human
uagagcuccccacugggcuucuuu

SEQ ID NO: 200819 - RNA, 18 nt, Human
uaguuccaguccccagca

SEQ ID NO: 200820 - RNA, 20 nt, Human
uaucuaaacauaaaauaacc

SEQ ID NO: 200821 - RNA, 22 nt, Human
uauguaugaacucugugcuuuu

SEQ ID NO: 200822 - RNA, 20 nt, Human
ucacucucccccucccccag

SEQ ID NO: 200823 - RNA, 21 nt, Human
ucacucucccccucccccagu

SEQ ID NO: 200824 - RNA, 18 nt, Human
ucagcaaacacuucacuc

SEQ ID NO: 200825 - RNA, 25 nt, Human
ucagcaaacacuucacucucccccu

SEQ ID NO: 200826 - RNA, 22 nt, Human
ucaguagcuccugccauauaau

SEQ ID NO: 200827 - RNA, 19 nt, Human
uccaagcugagaaggagag

SEQ ID NO: 200828 - RNA, 20 nt, Human
uccaagguaauaaaacagaa

SEQ ID NO: 200829 - RNA, 22 nt, Human
uccaccccacaguaccuuagag

SEQ ID NO: 200830 - RNA, 23 nt, Human
uccauagacaacccagaaagucc

SEQ ID NO: 200831 - RNA, 26 nt, Human
uccauagacaacccagaaaguccaga

SEQ ID NO: 200832 - RNA, 23 nt, Human
ucccacaggccccaaauacaagc

SEQ ID NO: 200833 - RNA, 21 nt, Human
ucccagccaaagcugggcccu

SEQ ID NO: 200834 - RNA, 19 nt, Human
uccccagggucuaauacaa

SEQ ID NO: 200835 - RNA, 23 nt, Human
ucccccacauuauuaagccacaa

SEQ ID NO: 200836 - RNA, 20 nt, Human
uccccuucucaaagagaagg

SEQ ID NO: 200837 - RNA, 27 nt, Human
ucccgcccccccucccauccccauccc

SEQ ID NO: 200838 - RNA, 25 nt, Human
ucccugaaguucagccccuuucacc

SEQ ID NO: 200839 - RNA, 24 nt, Human
uccguggcccuuccacucaccccc

SEQ ID NO: 200840 - RNA, 21 nt, Human
ucucccuuucccacuuugguc

SEQ ID NO: 200841 - RNA, 23 nt, Human
ucucuuucucucuuucugucuuu

SEQ ID NO: 200842 - RNA, 19 nt, Human
ucugccauacaaaggccgc

SEQ ID NO: 200843 - RNA, 19 nt, Human
ucuuucucucucucucucc

SEQ ID NO: 200844 - RNA, 21 nt, Human
ucuuucucucuuucugucuuu

SEQ ID NO: 200845 - RNA, 18 nt, Human
ucuuuuuucccucccacu

SEQ ID NO: 200846 - RNA, 21 nt, Human
ugaaaaaaacacauguggaaa

SEQ ID NO: 200847 - RNA, 23 nt, Human
ugaaaaaaacacauguggaaaua

SEQ ID NO: 200848 - RNA, 22 nt, Human
ugaaaaaaauaccccccuucug

SEQ ID NO: 200849 - RNA, 23 nt, Human
ugaaaaaaauaccccccuucugg

SEQ ID NO: 200850 - RNA, 23 nt, Human
ugaaagcaccuagcacaggggug

SEQ ID NO: 200851 - RNA, 19 nt, Human
ugaccaggccagccaaugg

SEQ ID NO: 200852 - RNA, 20 nt, Human
ugacccagcucucuggcuuc

SEQ ID NO: 200853 - RNA, 21 nt, Human
ugagaaggagagcugagacuu

SEQ ID NO: 200854 - RNA, 20 nt, Human
ugagaaggagcuuggguuuu

SEQ ID NO: 200855 - RNA, 23 nt, Human
ugagugaauccuuugcuuccuuc

SEQ ID NO: 200856 - RNA, 25 nt, Human
ugcaacccccgccccccgacaccaa

SEQ ID NO: 200857 - RNA, 22 nt, Human
ugcccaggcccggggguuccca

SEQ ID NO: 200858 - RNA, 24 nt, Human
ugccucaacucccccacauuauua

SEQ ID NO: 200859 - RNA, 19 nt, Human
ugcugggguccgacuggga

SEQ ID NO: 200860 - RNA, 20 nt, Human
ugcugggguccgacugggac

SEQ ID NO: 200861 - RNA, 23 nt, Human
ugcuugagggucagcauuuuaga

SEQ ID NO: 200862 - RNA, 24 nt, Human
uggagggcagagcugggacugggc

SEQ ID NO: 200863 - RNA, 19 nt, Human
uggagugggggagaauguc

SEQ ID NO: 200864 - RNA, 20 nt, Human
uggcccuuccacucaccccc

SEQ ID NO: 200865 - RNA, 23 nt, Human
uggcgagggagcaaguuuaucac

SEQ ID NO: 200866 - RNA, 19 nt, Human
uggcuuugucuucaucagg

SEQ ID NO: 200867 - RNA, 20 nt, Human
uggcuuugucuucaucaggg

SEQ ID NO: 200868 - RNA, 25 nt, Human
uggguaccuuugcaccucauguucc

SEQ ID NO: 200869 - RNA, 21 nt, Human
uggugcgcagggagagauggg

SEQ ID NO: 200870 - RNA, 24 nt, Human
uguaaucaaguagcuugcuauggc

SEQ ID NO: 200871 - RNA, 19 nt, Human
uguauagacagauuugggu

SEQ ID NO: 200872 - RNA, 18 nt, Human
uguuucuuggcuuuccuc

SEQ ID NO: 200873 - RNA, 28 nt, Human
uuaaaacaccaacacaaacuggagaccc

SEQ ID NO: 200874 - RNA, 25 nt, Human
uuaaggccccccuauauacauuucc

SEQ ID NO: 200875 - RNA, 18 nt, Human
uuaaucaguggcagcaaa

SEQ ID NO: 200876 - RNA, 21 nt, Human
uuaaucaguggcagcaaaacu

SEQ ID NO: 200877 - RNA, 24 nt, Human
uuacaucaaaacuacaagcaacaa

SEQ ID NO: 200878 - RNA, 24 nt, Human
uuagaaaaaugaacuuugaacccu

SEQ ID NO: 200879 - RNA, 20 nt, Human
uuagacccauuucuuuggag

SEQ ID NO: 200880 - RNA, 25 nt, Human
uucagcacccagaggauacucuguu

SEQ ID NO: 200881 - RNA, 23 nt, Human
uuccacaccuagcuuucuccaaa

SEQ ID NO: 200882 - RNA, 18 nt, Human
uuccauagacaacccaga

SEQ ID NO: 200883 - RNA, 19 nt, Human
uucccacuuucuccccacu

SEQ ID NO: 200884 - RNA, 25 nt, Human
uucccacuuuggucacuuuuugaua

SEQ ID NO: 200885 - RNA, 19 nt, Human
uucccagccaaagcugggc

SEQ ID NO: 200886 - RNA, 22 nt, Human
uuccguggcccuuccacucacc

SEQ ID NO: 200887 - RNA, 20 nt, Human
uucuucccacaggccccaaa

SEQ ID NO: 200888 - RNA, 23 nt, Human
uucuuuggagguggggccacugg

SEQ ID NO: 200889 - RNA, 22 nt, Human
uugaagcuugcuuucuucccac

SEQ ID NO: 200890 - RNA, 19 nt, Human
uuucuuggcuuuccucugg

SEQ ID NO: 200891 - RNA, 24 nt, Human
uuucuuggcuuuccucuggggcag

SEQ ID NO: 200892 - RNA, 20 nt, Human
uuugagaaggagcuuggguu

SEQ ID NO: 200893 - RNA, 20 nt, Human
uuuuucucguguugucuuuu

SEQ ID NO: 200894 - RNA, 19 nt, Human
aaacagcaacaacaacaaa

SEQ ID NO: 200895 - RNA, 23 nt, Human
aaacagcaacaacaacaaauccg

SEQ ID NO: 200896 - RNA, 22 nt, Human
caacaacaacaaauccgcugcc

SEQ ID NO: 200897 - RNA, 22 nt, Human
cacucccacccaacauuacacu

SEQ ID NO: 200898 - RNA, 20 nt, Human
cagcaacaacaacaaauccg

SEQ ID NO: 200899 - RNA, 27 nt, Human
cagcaacaacaacaaauccgcugcccu

SEQ ID NO: 200900 - RNA, 23 nt, Human
cccacaaaggaaacagcaacaac

SEQ ID NO: 200901 - RNA, 23 nt, Human
ccuugagcgcucccgccagcacc

SEQ ID NO: 200902 - RNA, 18 nt, Human
gcucccgccagcaccgcg

SEQ ID NO: 200903 - RNA, 23 nt, Human
ugaggcgucccgcacucccaccc

SEQ ID NO: 200904 - RNA, 24 nt, Human
aggcaagggcuuccggccagccuu

SEQ ID NO: 200905 - RNA, 19 nt, Human
caaaagaaagcucuuuauu

SEQ ID NO: 200906 - RNA, 25 nt, Human
cccguccacuuugcccucuuccagg

SEQ ID NO: 200907 - RNA, 22 nt, Human
gggcuggcacccaucagcuuca

SEQ ID NO: 200908 - RNA, 22 nt, Human
uaucgcauccacuccuguccac

SEQ ID NO: 200909 - RNA, 23 nt, Human
ucaaaccacaucuuaucgcaucc

SEQ ID NO: 200910 - RNA, 24 nt, Human
ucccguccacuuugcccucuucca

SEQ ID NO: 200911 - RNA, 22 nt, Human
ucuugcuuucaggcaagggcuu

SEQ ID NO: 200912 - RNA, 25 nt, Human
ugcccucuuccaggcugaaaucuug

SEQ ID NO: 200913 - RNA, 20 nt, Human
aacuccacaccccuagaauc

SEQ ID NO: 200914 - RNA, 18 nt, Human
aagugcuaaaaggcaggc

SEQ ID NO: 200915 - RNA, 18 nt, Human
acuugcuuuggccugggg

SEQ ID NO: 200916 - RNA, 18 nt, Human
agccucuuucuccaacuc

SEQ ID NO: 200917 - RNA, 20 nt, Human
agggaccagcaagggcuggg

SEQ ID NO: 200918 - RNA, 18 nt, Human
agggcuggggugggaagg

SEQ ID NO: 200919 - RNA, 23 nt, Human
aggggcagaccaacccagccugu

SEQ ID NO: 200920 - RNA, 21 nt, Human
augacuccccccaccccgcaa

SEQ ID NO: 200921 - RNA, 19 nt, Human
caacccagccugugucucu

SEQ ID NO: 200922 - RNA, 21 nt, Human
cacccagcgacgcggagacac

SEQ ID NO: 200923 - RNA, 21 nt, Human
cacugugcauggggcucuggg

SEQ ID NO: 200924 - RNA, 25 nt, Human
cagaauacacacaagggaguggaag

SEQ ID NO: 200925 - RNA, 21 nt, Human
cagaccaacccagccuguguc

SEQ ID NO: 200926 - RNA, 22 nt, Human
caugacuccccccaccccgcaa

SEQ ID NO: 200927 - RNA, 20 nt, Human
ccccacagggcagacccggg

SEQ ID NO: 200928 - RNA, 19 nt, Human
ccccccaccccgcaagcug

SEQ ID NO: 200929 - RNA, 23 nt, Human
ccccccaccccgcaagcugagac

SEQ ID NO: 200930 - RNA, 23 nt, Human
ccccuagaauccuucucuccccu

SEQ ID NO: 200931 - RNA, 24 nt, Human
ccccuagaauccuucucuccccuc

SEQ ID NO: 200932 - RNA, 21 nt, Human
ccccugggcaugacucccccc

SEQ ID NO: 200933 - RNA, 21 nt, Human
ccgagccaagucccacccagc

SEQ ID NO: 200934 - RNA, 23 nt, Human
ccgagccaagucccacccagcga

SEQ ID NO: 200935 - RNA, 24 nt, Human
ccgccgagccaagucccacccagc

SEQ ID NO: 200936 - RNA, 19 nt, Human
cgagccaagucccacccag

SEQ ID NO: 200937 - RNA, 18 nt, Human
cuagaauccuucucuccc

SEQ ID NO: 200938 - RNA, 19 nt, Human
cuagggaccagcaagggcu

SEQ ID NO: 200939 - RNA, 22 nt, Human
cugaaaugagacuuuauucuga

SEQ ID NO: 200940 - RNA, 21 nt, Human
gaagguuucacuugguggcuu

SEQ ID NO: 200941 - RNA, 20 nt, Human
gacagaggggaggacagggg

SEQ ID NO: 200942 - RNA, 23 nt, Human
gacagaggggaggacaggggcuc

SEQ ID NO: 200943 - RNA, 18 nt, Human
gagccgggagggggccgg

SEQ ID NO: 200944 - RNA, 22 nt, Human
gcaggacacugugcauggggcu

SEQ ID NO: 200945 - RNA, 20 nt, Human
gccaaacacagagagcuccg

SEQ ID NO: 200946 - RNA, 21 nt, Human
gccaaacacagagagcuccgu

SEQ ID NO: 200947 - RNA, 18 nt, Human
gccccuuugggggagggg

SEQ ID NO: 200948 - RNA, 22 nt, Human
gcgguuggggggacagagggga

SEQ ID NO: 200949 - RNA, 24 nt, Human
ggacagaggggaggacaggggcuc

SEQ ID NO: 200950 - RNA, 22 nt, Human
ggacaggggcucagccaggggg

SEQ ID NO: 200951 - RNA, 21 nt, Human
ggacugccccuuugggggagg

SEQ ID NO: 200952 - RNA, 21 nt, Human
ggacugccccuuugggggagg

SEQ ID NO: 200953 - RNA, 18 nt, Human
ggagggaggaaggggaac

SEQ ID NO: 200954 - RNA, 19 nt, Human
ggagggaggaaggggaacc

SEQ ID NO: 200955 - RNA, 22 nt, Human
ggagggggccggugaagggagg

SEQ ID NO: 200956 - RNA, 22 nt, Human
ggggcucugggugcaucugccc

SEQ ID NO: 200957 - RNA, 24 nt, Human
uagggaccagcaagggcuggggug

SEQ ID NO: 200958 - RNA, 19 nt, Human
uaugggccugugugugugu

SEQ ID NO: 200959 - RNA, 20 nt, Human
uaugggccugugugugugug

SEQ ID NO: 200960 - RNA, 21 nt, Human
uaugggccuguguguguguga

SEQ ID NO: 200961 - RNA, 24 nt, Human
uccaagugcuaaaaggcaggcugg

SEQ ID NO: 200962 - RNA, 23 nt, Human
ucccacccagcgacgcggagaca

SEQ ID NO: 200963 - RNA, 19 nt, Human
ucccacgcaggacacugug

SEQ ID NO: 200964 - RNA, 23 nt, Human
uccccugggcaugacucccccca

SEQ ID NO: 200965 - RNA, 22 nt, Human
ugaagggagggaggaaggggaa

SEQ ID NO: 200966 - RNA, 18 nt, Human
ugagaggccaaacacaga

SEQ ID NO: 200967 - RNA, 18 nt, Human
ugcaagaaggggacugcc

SEQ ID NO: 200968 - RNA, 22 nt, Human
ugcccaucugucuaugggccug

SEQ ID NO: 200969 - RNA, 21 nt, Human
ugggaaggguggcucaaggaa

SEQ ID NO: 200970 - RNA, 21 nt, Human
uggggugggaaggguggcuca

SEQ ID NO: 200971 - RNA, 19 nt, Human
ugguggguggguaaggggg

SEQ ID NO: 200972 - RNA, 20 nt, Human
ugugagaggccaaacacaga

SEQ ID NO: 200973 - RNA, 20 nt, Human
uucccacgcaggacacugug

SEQ ID NO: 200974 - RNA, 19 nt, Human
uuccggaagccccccacag

SEQ ID NO: 200975 - RNA, 21 nt, Human
uuuggcugcaugcaggggggg

SEQ ID NO: 200976 - RNA, 23 nt, Human
uuuuccggaagccccccacaggg

SEQ ID NO: 200977 - RNA, 24 nt, Human
uuuuugcacugaaaugagacuuua

SEQ ID NO: 200978 - RNA, 20 nt, Human
uuuuuuuuuugcacugaaau

SEQ ID NO: 200979 - RNA, 18 nt, Human
uuuuuuuuuuuuuuuuug

SEQ ID NO: 200980 - RNA, 19 nt, Human
uuuuuuuuuuuuuuuuugc

SEQ ID NO: 200981 - RNA, 18 nt, Human
aaaaggaagccggcagcc

SEQ ID NO: 200982 - RNA, 26 nt, Human
aaacaggcagacaaagagaggggacc

SEQ ID NO: 200983 - RNA, 27 nt, Human
aaacaggcagacaaagagaggggaccc

SEQ ID NO: 200984 - RNA, 20 nt, Human
aagagaagcaaaccgcgacc

SEQ ID NO: 200985 - RNA, 21 nt, Human
aagcgcgccgaggccgggagg

SEQ ID NO: 200986 - RNA, 18 nt, Human
accacacaacagccaggc

SEQ ID NO: 200987 - RNA, 19 nt, Human
acuacaccagagaccaggc

SEQ ID NO: 200988 - RNA, 22 nt, Human
acuacaccugugagucccacac

SEQ ID NO: 200989 - RNA, 20 nt, Human
acugggccacuagaccaugc

SEQ ID NO: 200990 - RNA, 23 nt, Human
aggagggaggcgcagccaccggg

SEQ ID NO: 200991 - RNA, 21 nt, Human
aggggcugcagaaggaaaagg

SEQ ID NO: 200992 - RNA, 22 nt, Human
aguaucuauacgugcaagcggc

SEQ ID NO: 200993 - RNA, 20 nt, Human
agugggucagaaccuccagg

SEQ ID NO: 200994 - RNA, 20 nt, Human
agugggucagaaccuccagg

SEQ ID NO: 200995 - RNA, 22 nt, Human
auggagcugguggggaggggcu

SEQ ID NO: 200996 - RNA, 18 nt, Human
caaaacgcaugggccggc

SEQ ID NO: 200997 - RNA, 19 nt, Human
caacccagagaccaggcgg

SEQ ID NO: 200998 - RNA, 19 nt, Human
caacgcaugccccaggccc

SEQ ID NO: 200999 - RNA, 18 nt, Human
caagguggaggcgcccgu

SEQ ID NO: 201000 - RNA, 22 nt, Human
cacuagaccaugcccugugugc

SEQ ID NO: 201001 - RNA, 22 nt, Human
cagacaaagagagcauaaauac

SEQ ID NO: 201002 - RNA, 19 nt, Human
caggcggaggcugagaggg

SEQ ID NO: 201003 - RNA, 19 nt, Human
caggcggaggcugagaggg

SEQ ID NO: 201004 - RNA, 23 nt, Human
caggugcaacgcaugccccaguu

SEQ ID NO: 201005 - RNA, 21 nt, Human
cauuucaccugucaccacaac

SEQ ID NO: 201006 - RNA, 23 nt, Human
ccacagagggcugcgcuucaaag

SEQ ID NO: 201007 - RNA, 24 nt, Human
ccacagagucacuugggaucacaa

SEQ ID NO: 201008 - RNA, 21 nt, Human
ccacaguaucuauacgugcaa

SEQ ID NO: 201009 - RNA, 19 nt, Human
ccacccuucccacagaguc

SEQ ID NO: 201010 - RNA, 23 nt, Human
ccacuagaccaugcccugugugc

SEQ ID NO: 201011 - RNA, 25 nt, Human
ccagacacaaaugccugugcucaca

SEQ ID NO: 201012 - RNA, 21 nt, Human
cccaggcccggggcccgggag

SEQ ID NO: 201013 - RNA, 23 nt, Human
ccccaagggaggagcuguccucu

SEQ ID NO: 201014 - RNA, 19 nt, Human
ccccagcuaaggaauggag

SEQ ID NO: 201015 - RNA, 19 nt, Human
cccgggccgcugcccggga

SEQ ID NO: 201016 - RNA, 20 nt, Human
cccugcgcucaucgccgccc

SEQ ID NO: 201017 - RNA, 22 nt, Human
ccgagcccaaguucggcgccgg

SEQ ID NO: 201018 - RNA, 18 nt, Human
ccgcugcccgccgccgcc

SEQ ID NO: 201019 - RNA, 19 nt, Human
ccgcugcccgccgccgccg

SEQ ID NO: 201020 - RNA, 18 nt, Human
ccgggacaagcgcgccga

SEQ ID NO: 201021 - RNA, 22 nt, Human
ccgggaggagugacuagcagcg

SEQ ID NO: 201022 - RNA, 19 nt, Human
ccucguccccacccuuccc

SEQ ID NO: 201023 - RNA, 19 nt, Human
ccucugagcuccccgugag

SEQ ID NO: 201024 - RNA, 20 nt, Human
ccugcaugucaccacauccc

SEQ ID NO: 201025 - RNA, 19 nt, Human
ccugcgcucaucgccgccc

SEQ ID NO: 201026 - RNA, 24 nt, Human
ccugcgcucaucgccgcccagaaa

SEQ ID NO: 201027 - RNA, 23 nt, Human
ccugucaccacagcccccaaggg

SEQ ID NO: 201028 - RNA, 24 nt, Human
ccugugcucacaacacggauggga

SEQ ID NO: 201029 - RNA, 20 nt, Human
cgcccguccgcugcccgccg

SEQ ID NO: 201030 - RNA, 25 nt, Human
cgccgcccagaaagacaaaaggaag

SEQ ID NO: 201031 - RNA, 22 nt, Human
cgccggcggcggcugcagcggg

SEQ ID NO: 201032 - RNA, 21 nt, Human
cggcggcugcagcgggcccgg

SEQ ID NO: 201033 - RNA, 22 nt, Human
cgggaccuacacaauacacucc

SEQ ID NO: 201034 - RNA, 21 nt, Human
cgggaggagugacuagcagcg

SEQ ID NO: 201035 - RNA, 21 nt, Human
cuacaccugugagucccacac

SEQ ID NO: 201036 - RNA, 20 nt, Human
cuccccgugagccgggaggu

SEQ ID NO: 201037 - RNA, 21 nt, Human
cuccucggcauggaccucuga

SEQ ID NO: 201038 - RNA, 27 nt, Human
cugcagugaggaccccaggucugaccc

SEQ ID NO: 201039 - RNA, 22 nt, Human
cugcccgggacaagcgcgccga

SEQ ID NO: 201040 - RNA, 23 nt, Human
cugcgggccacagagggcugcgc

SEQ ID NO: 201041 - RNA, 22 nt, Human
cuugcaagcaaagcuuaaacgg

SEQ ID NO: 201042 - RNA, 19 nt, Human
gaagggaccgggccaggcg

SEQ ID NO: 201043 - RNA, 21 nt, Human
gagguccugccuggucuccuc

SEQ ID NO: 201044 - RNA, 21 nt, Human
gcccccaagggaggagcuguc

SEQ ID NO: 201045 - RNA, 21 nt, Human
gcuaaggaauggagcuggugg

SEQ ID NO: 201046 - RNA, 21 nt, Human
gcuggcggcggcgacuacacc

SEQ ID NO: 201047 - RNA, 24 nt, Human
gcugguggggaggggcugcagaag

SEQ ID NO: 201048 - RNA, 18 nt, Human
ggaacagccaacccagag

SEQ ID NO: 201049 - RNA, 24 nt, Human
ggaacagccaacccagagaccagg

SEQ ID NO: 201050 - RNA, 20 nt, Human
ggaagggaccgggccaggcg

SEQ ID NO: 201051 - RNA, 23 nt, Human
ggaccgggccaggcgugagggga

SEQ ID NO: 201052 - RNA, 22 nt, Human
ggagcugguggggaggggcugc

SEQ ID NO: 201053 - RNA, 21 nt, Human
ggaggcugagagggagugggu

SEQ ID NO: 201054 - RNA, 21 nt, Human
ggaggcugagagggagugggu

SEQ ID NO: 201055 - RNA, 24 nt, Human
ggaggugccuggaaccaagaacac

SEQ ID NO: 201056 - RNA, 22 nt, Human
ggcuggcggcggcgacuacacc

SEQ ID NO: 201057 - RNA, 22 nt, Human
gggaggacagaccagacacaaa

SEQ ID NO: 201058 - RNA, 21 nt, Human
gguggaggagggaggcgcagc

SEQ ID NO: 201059 - RNA, 22 nt, Human
guugcccuggaagggaccgggc

SEQ ID NO: 201060 - RNA, 24 nt, Human
uaaaagaaaggggaccacaguauc

SEQ ID NO: 201061 - RNA, 22 nt, Human
uaaauaccacacaacagccagg

SEQ ID NO: 201062 - RNA, 25 nt, Human
uaaauaccacacaacagccaggcuc

SEQ ID NO: 201063 - RNA, 19 nt, Human
uacacuccacuucaccaua

SEQ ID NO: 201064 - RNA, 21 nt, Human
uacgugcaagcggcuguggug

SEQ ID NO: 201065 - RNA, 22 nt, Human
ucaccugucaccacagccccca

SEQ ID NO: 201066 - RNA, 22 nt, Human
ucagaaaaugccauuuauuuua

SEQ ID NO: 201067 - RNA, 22 nt, Human
ucagcagggagggcuagccuga

SEQ ID NO: 201068 - RNA, 18 nt, Human
uccccgugagccgggagg

SEQ ID NO: 201069 - RNA, 23 nt, Human
ucccgacgccucguccccacccu

SEQ ID NO: 201070 - RNA, 18 nt, Human
ucccugggaguugcccug

SEQ ID NO: 201071 - RNA, 21 nt, Human
ucgccuccgcgugggccccca

SEQ ID NO: 201072 - RNA, 20 nt, Human
ucggcgccggcggcggcugc

SEQ ID NO: 201073 - RNA, 21 nt, Human
ucuccucggcauggaccucug

SEQ ID NO: 201074 - RNA, 26 nt, Human
ucucugcaacuguccaggggccgcuc

SEQ ID NO: 201075 - RNA, 24 nt, Human
ucugagcuccccgugagccgggag

SEQ ID NO: 201076 - RNA, 25 nt, Human
ugaacccugcaugucaccacauccc

SEQ ID NO: 201077 - RNA, 18 nt, Human
ugaacgggggggcagcca

SEQ ID NO: 201078 - RNA, 22 nt, Human
ugacugggccacuagaccaugc

SEQ ID NO: 201079 - RNA, 26 nt, Human
ugagaacgcugccagaggccagcugc

SEQ ID NO: 201080 - RNA, 22 nt, Human
ugaggaccccaggucugacccc

SEQ ID NO: 201081 - RNA, 20 nt, Human
ugccccaggcccggggcccg

SEQ ID NO: 201082 - RNA, 20 nt, Human
ugcgggccacagagggcugc

SEQ ID NO: 201083 - RNA, 21 nt, Human
uggaagggaccgggccaggcg

SEQ ID NO: 201084 - RNA, 20 nt, Human
uggaccaagagcugucuuca

SEQ ID NO: 201085 - RNA, 18 nt, Human
uggagaaaaugaacgggg

SEQ ID NO: 201086 - RNA, 20 nt, Human
uggcccaggucgcggugcgg

SEQ ID NO: 201087 - RNA, 24 nt, Human
ugggaucacaaaacgcaugggccg

SEQ ID NO: 201088 - RNA, 23 nt, Human
uggggaggggcugcagaaggaaa

SEQ ID NO: 201089 - RNA, 21 nt, Human
uuuuuuuuuuuuuuuuuucag

SEQ ID NO: 201090 - RNA, 20 nt, Human
gcagagggcggccccgccga

SEQ ID NO: 201091 - RNA, 20 nt, Human
gcuggagcagagggcggccc

SEQ ID NO: 201092 - RNA, 24 nt, Human
ggacccaaggggagcagccaguag

SEQ ID NO: 201093 - RNA, 18 nt, Human
ggagcagccaguagggaa

SEQ ID NO: 201094 - RNA, 18 nt, Human
ggcguggcuguguggcug

SEQ ID NO: 201095 - RNA, 19 nt, Human
guguggcuguggccuccgu

SEQ ID NO: 201096 - RNA, 23 nt, Human
uggagcagagggcggccccgccg

SEQ ID NO: 201097 - RNA, 21 nt, Human
ugggggccgaguccgcuggug

SEQ ID NO: 201098 - RNA, 22 nt, Human
ugggggccgaguccgcuggugg

SEQ ID NO: 201099 - RNA, 24 nt, Human
uggucagugugggcggagccuugg

SEQ ID NO: 201100 - RNA, 23 nt, Human
uugggggccgaguccgcuggugg

SEQ ID NO: 201101 - RNA, 21 nt, Human
aaagaaguaauuugaaaaaaa

SEQ ID NO: 201102 - RNA, 20 nt, Human
aagaagcucuuggaagaacu

SEQ ID NO: 201103 - RNA, 22 nt, Human
aagauuacaaccuagccuuugg

SEQ ID NO: 201104 - RNA, 23 nt, Human
aagcacagauauaaauacacuuu

SEQ ID NO: 201105 - RNA, 24 nt, Human
aauaaagaaguaauuugaaaaaaa

SEQ ID NO: 201106 - RNA, 21 nt, Human
acaaaaaaagcaaaaccucac

SEQ ID NO: 201107 - RNA, 24 nt, Human
acaaccuagccuuugguccacauc

SEQ ID NO: 201108 - RNA, 18 nt, Human
acaucauuuacugauuag

SEQ ID NO: 201109 - RNA, 18 nt, Human
agauaggaucugaauaua

SEQ ID NO: 201110 - RNA, 21 nt, Human
agcugacaacaaaaaaagcaa

SEQ ID NO: 201111 - RNA, 21 nt, Human
aguccaaaaaauuguccauaa

SEQ ID NO: 201112 - RNA, 24 nt, Human
auagcugacaacaaaaaaagcaaa

SEQ ID NO: 201113 - RNA, 20 nt, Human
auaugacaacauuccaguac

SEQ ID NO: 201114 - RNA, 21 nt, Human
auugcuguaacuguuaaaagu

SEQ ID NO: 201115 - RNA, 18 nt, Human
caaaaaaagcaaaaccuc

SEQ ID NO: 201116 - RNA, 19 nt, Human
caaagaguuuuacccaaag

SEQ ID NO: 201117 - RNA, 24 nt, Human
caacaaaaaaagcaaaaccucaca

SEQ ID NO: 201118 - RNA, 19 nt, Human
cacugccagaacauacaaa

SEQ ID NO: 201119 - RNA, 22 nt, Human
cacugccagaacauacaaacaa

SEQ ID NO: 201120 - RNA, 19 nt, Human
cagcaguuuucaucuggga

SEQ ID NO: 201121 - RNA, 23 nt, Human
cauggguacaaaaacauuuacag

SEQ ID NO: 201122 - RNA, 25 nt, Human
ccauauacuuaacuaaaaauuuaga

SEQ ID NO: 201123 - RNA, 19 nt, Human
cguuuaucaccaagugcau

SEQ ID NO: 201124 - RNA, 18 nt, Human
cuguaacuguuaaaaguu

SEQ ID NO: 201125 - RNA, 23 nt, Human
gaagaacugaaauguucaguuga

SEQ ID NO: 201126 - RNA, 20 nt, Human
ggaaaaauacagaagauaag

SEQ ID NO: 201127 - RNA, 23 nt, Human
gucaaucaguuacuuucugucau

SEQ ID NO: 201128 - RNA, 24 nt, Human
gugagcagaggaaagaaaugucuu

SEQ ID NO: 201129 - RNA, 21 nt, Human
gugucaaucaguuacuuucug

SEQ ID NO: 201130 - RNA, 20 nt, Human
uaaagugagcagaggaaaga

SEQ ID NO: 201131 - RNA, 22 nt, Human
uaacuuauguaacucacauuuu

SEQ ID NO: 201132 - RNA, 23 nt, Human
uaaguaauuuauggagaucagaa

SEQ ID NO: 201133 - RNA, 23 nt, Human
uaaguuuuuaacuuauguaacuc

SEQ ID NO: 201134 - RNA, 26 nt, Human
uaaguuuuuaacuuauguaacucaca

SEQ ID NO: 201135 - RNA, 20 nt, Human
uacaaccuagccuuuggucc

SEQ ID NO: 201136 - RNA, 22 nt, Human
uaccuauagaagguaagauuua

SEQ ID NO: 201137 - RNA, 20 nt, Human
uagcugacaacaaaaaaagc

SEQ ID NO: 201138 - RNA, 22 nt, Human
uaggaggcugaacugugaauca

SEQ ID NO: 201139 - RNA, 26 nt, Human
uauagcagaauuaaaauagggcaaga

SEQ ID NO: 201140 - RNA, 25 nt, Human
uauuuacacgacagaggaaaaauac

SEQ ID NO: 201141 - RNA, 19 nt, Human
ucaucugggauauguuuac

SEQ ID NO: 201142 - RNA, 18 nt, Human
ugaaggaaaacuucaaac

SEQ ID NO: 201143 - RNA, 18 nt, Human
ugacaacaaaaaaagcaa

SEQ ID NO: 201144 - RNA, 24 nt, Human
ugagauuuuuggagucgguaaaag

SEQ ID NO: 201145 - RNA, 18 nt, Human
ugaguuucagcaugggua

SEQ ID NO: 201146 - RNA, 18 nt, Human
ugccagaacauacaaaca

SEQ ID NO: 201147 - RNA, 21 nt, Human
uguauuuaaugauucuuaaga

SEQ ID NO: 201148 - RNA, 20 nt, Human
uuacuaguguuaauuacugc

SEQ ID NO: 201149 - RNA, 25 nt, Human
uugagcaucuuaaauauaauauuuu

SEQ ID NO: 201150 - RNA, 24 nt, Human
uuuauugaaggguaggcacuuuug

SEQ ID NO: 201151 - RNA, 22 nt, Human
aaaacgucccauccucggccca

SEQ ID NO: 201152 - RNA, 22 nt, Human
aagaagaaaaacgucccauccc

SEQ ID NO: 201153 - RNA, 24 nt, Human
acagcagaacaauauuuacauggg

SEQ ID NO: 201154 - RNA, 20 nt, Human
agacaggagucccagacagc

SEQ ID NO: 201155 - RNA, 18 nt, Human
aggcagaggcgguggcgu

SEQ ID NO: 201156 - RNA, 21 nt, Human
aggcagaggcgguggcguggg

SEQ ID NO: 201157 - RNA, 20 nt, Human
aggcgguggcguggggccug

SEQ ID NO: 201158 - RNA, 20 nt, Human
agguagggucccuggaaagc

SEQ ID NO: 201159 - RNA, 18 nt, Human
caccucgggcccuggagg

SEQ ID NO: 201160 - RNA, 20 nt, Human
caccucgggcccuggaggcu

SEQ ID NO: 201161 - RNA, 19 nt, Human
cagggugggacccuggggu

SEQ ID NO: 201162 - RNA, 21 nt, Human
ccacuguggaagagaggaccc

SEQ ID NO: 201163 - RNA, 23 nt, Human
cccaucaucaggggcaccuagac

SEQ ID NO: 201164 - RNA, 24 nt, Human
cccaucaucaggggcaccuagaca

SEQ ID NO: 201165 - RNA, 21 nt, Human
ccccgcagcagcgggcggccu

SEQ ID NO: 201166 - RNA, 19 nt, Human
ccgggcccaagaagaaaaa

SEQ ID NO: 201167 - RNA, 21 nt, Human
ccugcuaggccaggcugccuc

SEQ ID NO: 201168 - RNA, 22 nt, Human
cguggggccugcuaggccaggc

SEQ ID NO: 201169 - RNA, 21 nt, Human
cugaccuccugggccagggug

SEQ ID NO: 201170 - RNA, 23 nt, Human
cugaccuccugggccaggguggg

SEQ ID NO: 201171 - RNA, 22 nt, Human
cuggagggaggguguccuugga

SEQ ID NO: 201172 - RNA, 24 nt, Human
cugggccagggugggacccugggg

SEQ ID NO: 201173 - RNA, 20 nt, Human
gagcaucccaucaucagggg

SEQ ID NO: 201174 - RNA, 21 nt, Human
gccagggugggacccuggggu

SEQ ID NO: 201175 - RNA, 22 nt, Human
gcccgccacuguggaagagagg

SEQ ID NO: 201176 - RNA, 18 nt, Human
ggaccgggcccaagaaga

SEQ ID NO: 201177 - RNA, 22 nt, Human
ggagggaggguguccuuggaaa

SEQ ID NO: 201178 - RNA, 20 nt, Human
gggccagggugggacccugg

SEQ ID NO: 201179 - RNA, 20 nt, Human
ggggucgggucagucuccag

SEQ ID NO: 201180 - RNA, 24 nt, Human
gguccagcaggugggggcggagcc

SEQ ID NO: 201181 - RNA, 20 nt, Human
guggaagagaggacccugga

SEQ ID NO: 201182 - RNA, 25 nt, Human
uaaagagcaucccaucaucaggggc

SEQ ID NO: 201183 - RNA, 24 nt, Human
uggaagagaggacccuggagggaa

SEQ ID NO: 201184 - RNA, 18 nt, Human
uggaggcagaggcggugg

SEQ ID NO: 201185 - RNA, 26 nt, Human
uggguggucucggggcugagugggcc

SEQ ID NO: 201186 - RNA, 20 nt, Human
uucccuggcugaccuccugg

SEQ ID NO: 201187 - RNA, 23 nt, Human
uggucuugccucuggaagagcag

SEQ ID NO: 201188 - RNA, 22 nt, Human
aaacaacaauccgcccaaaggg

SEQ ID NO: 201189 - RNA, 23 nt, Human
acuucuuagaugcugucuuugau

SEQ ID NO: 201190 - RNA, 21 nt, Human
agauggccacagaacuagaac

SEQ ID NO: 201191 - RNA, 19 nt, Human
agcucuacuaagcagaugg

SEQ ID NO: 201192 - RNA, 18 nt, Human
aggaggaggaagccggug

SEQ ID NO: 201193 - RNA, 25 nt, Human
caacugacauuucuaaaguacaaaa

SEQ ID NO: 201194 - RNA, 23 nt, Human
caaguuaaacaacaauccgccca

SEQ ID NO: 201195 - RNA, 21 nt, Human
cuacuaaaauaauuccaggac

SEQ ID NO: 201196 - RNA, 22 nt, Human
cucauagugcaaauaaacaguu

SEQ ID NO: 201197 - RNA, 20 nt, Human
gaagccgguggcggagcaga

SEQ ID NO: 201198 - RNA, 19 nt, Human
gaggaggaagccgguggcg

SEQ ID NO: 201199 - RNA, 19 nt, Human
gcggagcagaggaggaggc

SEQ ID NO: 201200 - RNA, 23 nt, Human
gcggagcagaggaggaggcggag

SEQ ID NO: 201201 - RNA, 20 nt, Human
gcucaggaggaggaagccgg

SEQ ID NO: 201202 - RNA, 24 nt, Human
uaaaauaauuccaggacagaacaa

SEQ ID NO: 201203 - RNA, 20 nt, Human
uaaacaacaauccgcccaaa

SEQ ID NO: 201204 - RNA, 19 nt, Human
uaaaguacaaaacagauaa

SEQ ID NO: 201205 - RNA, 22 nt, Human
uaagcagauggccacagaacua

SEQ ID NO: 201206 - RNA, 23 nt, Human
uaagcagauggccacagaacuag

SEQ ID NO: 201207 - RNA, 22 nt, Human
uacaaaacagauaaaauucuua

SEQ ID NO: 201208 - RNA, 19 nt, Human
uacagauaugaguucaaug

SEQ ID NO: 201209 - RNA, 23 nt, Human
uacagucaacauuacugaaacac

SEQ ID NO: 201210 - RNA, 23 nt, Human
ucacugguaauaauuugaacaag

SEQ ID NO: 201211 - RNA, 26 nt, Human
uccaggacagaacaaaacuucuuaga

SEQ ID NO: 201212 - RNA, 18 nt, Human
ucuaaaguacaaaacaga

SEQ ID NO: 201213 - RNA, 22 nt, Human
ugacauuucuaaaguacaaaac

SEQ ID NO: 201214 - RNA, 19 nt, Human
uucucuuuauuucuuacag

SEQ ID NO: 201215 - RNA, 18 nt, Human
aaagacaucaaagccugg

SEQ ID NO: 201216 - RNA, 22 nt, Human
aagacuaaagacacagaaggcg

SEQ ID NO: 201217 - RNA, 23 nt, Human
aagggaauccaaaucucugggcc

SEQ ID NO: 201218 - RNA, 21 nt, Human
accacagaagcuuugaaagac

SEQ ID NO: 201219 - RNA, 20 nt, Human
accugacauggagggugguc

SEQ ID NO: 201220 - RNA, 18 nt, Human
acuaaagacacagaaggc

SEQ ID NO: 201221 - RNA, 22 nt, Human
agcucuggaagaggagcuguug

SEQ ID NO: 201222 - RNA, 26 nt, Human
agcuuugaaagacaucaaagccuggg

SEQ ID NO: 201223 - RNA, 21 nt, Human
aggaacacagauccagucacc

SEQ ID NO: 201224 - RNA, 22 nt, Human
aggaggaacacagauccaguca

SEQ ID NO: 201225 - RNA, 24 nt, Human
aggauaaaggcagaggcagcucug

SEQ ID NO: 201226 - RNA, 22 nt, Human
aggcucucgucauggggaacag

SEQ ID NO: 201227 - RNA, 21 nt, Human
agucccagggcucucaggguc

SEQ ID NO: 201228 - RNA, 18 nt, Human
aucagcacugacagaagg

SEQ ID NO: 201229 - RNA, 24 nt, Human
auccaaaucucugggccagggcca

SEQ ID NO: 201230 - RNA, 21 nt, Human
caaaucucugggccagggcca

SEQ ID NO: 201231 - RNA, 23 nt, Human
caagcacaguggagcauccagac

SEQ ID NO: 201232 - RNA, 21 nt, Human
cagacgccagccaagcaugaa

SEQ ID NO: 201233 - RNA, 20 nt, Human
cagagagaaggaucuggggc

SEQ ID NO: 201234 - RNA, 26 nt, Human
cagcacugacagaagggucggagucc

SEQ ID NO: 201235 - RNA, 22 nt, Human
cagcagaccgacucggugacug

SEQ ID NO: 201236 - RNA, 25 nt, Human
cagcagagauggggcuuccucccca

SEQ ID NO: 201237 - RNA, 24 nt, Human
cagucccagggcucucagggucuc

SEQ ID NO: 201238 - RNA, 18 nt, Human
cauccagacggccagagg

SEQ ID NO: 201239 - RNA, 25 nt, Human
caucccugguccucacuuccgggag

SEQ ID NO: 201240 - RNA, 19 nt, Human
caugcacagcacacggcca

SEQ ID NO: 201241 - RNA, 26 nt, Human
ccacaauccacgcuuuucauugccau

SEQ ID NO: 201242 - RNA, 22 nt, Human
ccacgccguccucucuggccca

SEQ ID NO: 201243 - RNA, 25 nt, Human
ccacgccguccucucuggcccagca

SEQ ID NO: 201244 - RNA, 19 nt, Human
cccccagccccaaagcugu

SEQ ID NO: 201245 - RNA, 19 nt, Human
ccggaggcccacguaccgg

SEQ ID NO: 201246 - RNA, 23 nt, Human
ccuccuggcucagaggagcagac

SEQ ID NO: 201247 - RNA, 23 nt, Human
ccucggguggugguucucaaucc

SEQ ID NO: 201248 - RNA, 22 nt, Human
ccugugcugcaguggacgcuga

SEQ ID NO: 201249 - RNA, 18 nt, Human
cgcugcuaaaaacuaaag

SEQ ID NO: 201250 - RNA, 18 nt, Human
cgcuggaauucaaaccca

SEQ ID NO: 201251 - RNA, 18 nt, Human
cuggcccagcaccggccu

SEQ ID NO: 201252 - RNA, 19 nt, Human
cuggguccauucuggacag

SEQ ID NO: 201253 - RNA, 25 nt, Human
cuguaccccucggguggugguucuc

SEQ ID NO: 201254 - RNA, 22 nt, Human
cuugcugggugggcuuccucca

SEQ ID NO: 201255 - RNA, 27 nt, Human
cuuggcaagcacaguggagcauccaga

SEQ ID NO: 201256 - RNA, 18 nt, Human
gacaggaugcaaaggcag

SEQ ID NO: 201257 - RNA, 18 nt, Human
gaccccugggcuucccuc

SEQ ID NO: 201258 - RNA, 22 nt, Human
gcagggguccugaacaguggug

SEQ ID NO: 201259 - RNA, 18 nt, Human
gccagagguucagaaagg

SEQ ID NO: 201260 - RNA, 21 nt, Human
gcccuagggcagacgccagcc

SEQ ID NO: 201261 - RNA, 18 nt, Human
gcugcuaaaaacuaaagg

SEQ ID NO: 201262 - RNA, 22 nt, Human
ggaaauaguaggugacaaaagc

SEQ ID NO: 201263 - RNA, 23 nt, Human
ggagcagacacucccagucccag

SEQ ID NO: 201264 - RNA, 19 nt, Human
ggcagacgccagccaagca

SEQ ID NO: 201265 - RNA, 22 nt, Human
gggaacagcagagauggggccg

SEQ ID NO: 201266 - RNA, 21 nt, Human
gggcuccacggccgccaaggg

SEQ ID NO: 201267 - RNA, 20 nt, Human
gggcugcagcagaccgacuc

SEQ ID NO: 201268 - RNA, 22 nt, Human
gggcuuccuccccaucucccag

SEQ ID NO: 201269 - RNA, 24 nt, Human
ggguaggagagagcuugcuggguc

SEQ ID NO: 201270 - RNA, 18 nt, Human
gguccugaacaguggugg

SEQ ID NO: 201271 - RNA, 22 nt, Human
gugggcuuccuccacgcaggga

SEQ ID NO: 201272 - RNA, 23 nt, Human
guggugggcucaggggauuggag

SEQ ID NO: 201273 - RNA, 25 nt, Human
guggugggcucaggggauuggaguu

SEQ ID NO: 201274 - RNA, 19 nt, Human
uaaagggaaauaguaggug

SEQ ID NO: 201275 - RNA, 25 nt, Human
uaccacacuggguaauccucacacc

SEQ ID NO: 201276 - RNA, 20 nt, Human
uagaaagaucaaggggacug

SEQ ID NO: 201277 - RNA, 19 nt, Human
uagcaagggcuuaucagca

SEQ ID NO: 201278 - RNA, 21 nt, Human
uaggagagagcuugcugggug

SEQ ID NO: 201279 - RNA, 25 nt, Human
uaggugacaaaagcagggguccuga

SEQ ID NO: 201280 - RNA, 18 nt, Human
ucagcacugacagaaggg

SEQ ID NO: 201281 - RNA, 20 nt, Human
ucaggauguucacuccugug

SEQ ID NO: 201282 - RNA, 20 nt, Human
ucagugauaacaaugaccaa

SEQ ID NO: 201283 - RNA, 19 nt, Human
uccagggcgcaccacagaa

SEQ ID NO: 201284 - RNA, 21 nt, Human
ucccagggcucucagggucuc

SEQ ID NO: 201285 - RNA, 23 nt, Human
uccccaucucccaggauaaaggc

SEQ ID NO: 201286 - RNA, 21 nt, Human
uccuuuauguuuuucuguauu

SEQ ID NO: 201287 - RNA, 25 nt, Human
ucggguggugguucucaauccaggg

SEQ ID NO: 201288 - RNA, 18 nt, Human
ucgguuggaagagagggg

SEQ ID NO: 201289 - RNA, 24 nt, Human
ucucagggucucuugucccugggu

SEQ ID NO: 201290 - RNA, 24 nt, Human
ucucaggguuuagaccaacaugug

SEQ ID NO: 201291 - RNA, 23 nt, Human
ucucccaggauaaaggcagaggc

SEQ ID NO: 201292 - RNA, 21 nt, Human
ucucgguuggaagagaggggc

SEQ ID NO: 201293 - RNA, 23 nt, Human
ucucuugucccuggguccauucu

SEQ ID NO: 201294 - RNA, 19 nt, Human
ucuggaagaggagcuguug

SEQ ID NO: 201295 - RNA, 19 nt, Human
ucugggccagggccagggg

SEQ ID NO: 201296 - RNA, 24 nt, Human
ugaacaguggugggcucaggggau

SEQ ID NO: 201297 - RNA, 21 nt, Human
ugaaggggcugggacuuagca

SEQ ID NO: 201298 - RNA, 25 nt, Human
ugacauggaggguggucuagguggc

SEQ ID NO: 201299 - RNA, 22 nt, Human
ugacuggcucaugggagagcag

SEQ ID NO: 201300 - RNA, 24 nt, Human
ugcaaggaagagaucagucuuuug

SEQ ID NO: 201301 - RNA, 21 nt, Human
ugcaugcacagcacacggcca

SEQ ID NO: 201302 - RNA, 18 nt, Human
ugccaggaggugcagaga

SEQ ID NO: 201303 - RNA, 19 nt, Human
ugcuaaaaacuaaagggaa

SEQ ID NO: 201304 - RNA, 29 nt, Human
uggaggacaggaugcaaaggcagacugcg

SEQ ID NO: 201305 - RNA, 20 nt, Human
uggaggguggucuagguggg

SEQ ID NO: 201306 - RNA, 19 nt, Human
uggaguuuuuuccuuuaug

SEQ ID NO: 201307 - RNA, 20 nt, Human
uggcucaagacuaaagacac

SEQ ID NO: 201308 - RNA, 21 nt, Human
uggcucaagacuaaagacaca

SEQ ID NO: 201309 - RNA, 18 nt, Human
uggcucaugggagagcag

SEQ ID NO: 201310 - RNA, 21 nt, Human
uggcucaugggagagcagcac

SEQ ID NO: 201311 - RNA, 18 nt, Human
ugggccagggccaggggc

SEQ ID NO: 201312 - RNA, 20 nt, Human
ugggccagggccaggggcuu

SEQ ID NO: 201313 - RNA, 25 nt, Human
ugggccagggccaggggcuugagaa

SEQ ID NO: 201314 - RNA, 22 nt, Human
uguuuuacaaacaggaccccug

SEQ ID NO: 201315 - RNA, 23 nt, Human
uucccccagccccaaagcuguuc

SEQ ID NO: 201316 - RNA, 18 nt, Human
accuuaaaaaauguaugg

SEQ ID NO: 201317 - RNA, 19 nt, Human
acuuguaaaauguuuccuu

SEQ ID NO: 201318 - RNA, 21 nt, Human
aggcuuuggcugaaaaaaaca

SEQ ID NO: 201319 - RNA, 18 nt, Human
aucuggaaaaaucaagaa

SEQ ID NO: 201320 - RNA, 18 nt, Human
auggaaacaaggcuuugg

SEQ ID NO: 201321 - RNA, 21 nt, Human
augugugugugugugugugug

SEQ ID NO: 201322 - RNA, 22 nt, Human
augugugugugugugugugugu

SEQ ID NO: 201323 - RNA, 24 nt, Human
auguguguguguguguguguguug

SEQ ID NO: 201324 - RNA, 18 nt, Human
caaaaaaaaugagguuug

SEQ ID NO: 201325 - RNA, 21 nt, Human
caaaaaaaaugagguuugaaa

SEQ ID NO: 201326 - RNA, 18 nt, Human
caacaaaaauggaaacaa

SEQ ID NO: 201327 - RNA, 21 nt, Human
cacaucaacaaaaauggaaac

SEQ ID NO: 201328 - RNA, 21 nt, Human
cagccugaaagcauuuguauc

SEQ ID NO: 201329 - RNA, 23 nt, Human
cauauaugugugugugugugugu

SEQ ID NO: 201330 - RNA, 23 nt, Human
caugucuccaacaacagugaacu

SEQ ID NO: 201331 - RNA, 20 nt, Human
cgagccaaugacgccggguc

SEQ ID NO: 201332 - RNA, 21 nt, Human
gcgcugaccgcgaauguagga

SEQ ID NO: 201333 - RNA, 21 nt, Human
gugugugugugugugugugug

SEQ ID NO: 201334 - RNA, 21 nt, Human
gugugugugugugugugugug

SEQ ID NO: 201335 - RNA, 19 nt, Human
uaacaagaaaaggaacaaa

SEQ ID NO: 201336 - RNA, 21 nt, Human
uaacaucuuucucaaaaacau

SEQ ID NO: 201337 - RNA, 19 nt, Human
uaagguaagcagccugaaa

SEQ ID NO: 201338 - RNA, 19 nt, Human
uacacaucaacaaaaaugg

SEQ ID NO: 201339 - RNA, 18 nt, Human
uaccauggcaaaacauua

SEQ ID NO: 201340 - RNA, 23 nt, Human
uaccauggcaaaacauuaacauc

SEQ ID NO: 201341 - RNA, 21 nt, Human
uagcuaaaagagcaagaguac

SEQ ID NO: 201342 - RNA, 19 nt, Human
uauaugugugugugugugu

SEQ ID NO: 201343 - RNA, 23 nt, Human
uauaugugugugugugugugugu

SEQ ID NO: 201344 - RNA, 18 nt, Human
uaugugugugugugugug

SEQ ID NO: 201345 - RNA, 23 nt, Human
uaugugugugugugugugugugu

SEQ ID NO: 201346 - RNA, 24 nt, Human
uaugugugugugugugugugugug

SEQ ID NO: 201347 - RNA, 22 nt, Human
ucaacaaaaauggaaacaaggc

SEQ ID NO: 201348 - RNA, 19 nt, Human
ucuugggaugaaaaugauu

SEQ ID NO: 201349 - RNA, 20 nt, Human
ugaacugauguuguuccuug

SEQ ID NO: 201350 - RNA, 19 nt, Human
uggcugaaaaaaacaugca

SEQ ID NO: 201351 - RNA, 18 nt, Human
uguaucauauaugugugu

SEQ ID NO: 201352 - RNA, 18 nt, Human
uguaucauauaugugugu

SEQ ID NO: 201353 - RNA, 18 nt, Human
uguguguguguguguaua

SEQ ID NO: 201354 - RNA, 20 nt, Human
uguguguguguguguauaua

SEQ ID NO: 201355 - RNA, 18 nt, Human
ugugugugugugugugug

SEQ ID NO: 201356 - RNA, 18 nt, Human
ugugugugugugugugug

SEQ ID NO: 201357 - RNA, 18 nt, Human
ugugugugugugugugug

SEQ ID NO: 201358 - RNA, 18 nt, Human
ugugugugugugugugug

SEQ ID NO: 201359 - RNA, 18 nt, Human
ugugugugugugugugug

SEQ ID NO: 201360 - RNA, 18 nt, Human
ugugugugugugugugug

SEQ ID NO: 201361 - RNA, 18 nt, Human
ugugugugugugugugug

SEQ ID NO: 201362 - RNA, 18 nt, Human
ugugugugugugugugug

SEQ ID NO: 201363 - RNA, 18 nt, Human
ugugugugugugugugug

SEQ ID NO: 201364 - RNA, 18 nt, Human
ugugugugugugugugug

SEQ ID NO: 201365 - RNA, 24 nt, Human
uguguguguguguguguguauaua

SEQ ID NO: 201366 - RNA, 21 nt, Human
ugugugugugugugugugugu

SEQ ID NO: 201367 - RNA, 21 nt, Human
ugugugugugugugugugugu

SEQ ID NO: 201368 - RNA, 21 nt, Human
ugugugugugugugugugugu

SEQ ID NO: 201369 - RNA, 21 nt, Human
ugugugugugugugugugugu

SEQ ID NO: 201370 - RNA, 21 nt, Human
ugugugugugugugugugugu

SEQ ID NO: 201371 - RNA, 21 nt, Human
ugugugugugugugugugugu

SEQ ID NO: 201372 - RNA, 21 nt, Human
ugugugugugugugugugugu

SEQ ID NO: 201373 - RNA, 21 nt, Human
ugugugugugugugugugugu

SEQ ID NO: 201374 - RNA, 21 nt, Human
ugugugugugugugugugugu

SEQ ID NO: 201375 - RNA, 21 nt, Human
ugugugugugugugugugugu

SEQ ID NO: 201376 - RNA, 21 nt, Human
ugugugugugugugugugugu

SEQ ID NO: 201377 - RNA, 21 nt, Human
ugugugugugugugugugugu

SEQ ID NO: 201378 - RNA, 21 nt, Human
ugugugugugugugugugugu

SEQ ID NO: 201379 - RNA, 21 nt, Human
ugugugugugugugugugugu

SEQ ID NO: 201380 - RNA, 22 nt, Human
ugugugugugugugugugugua

SEQ ID NO: 201381 - RNA, 22 nt, Human
ugugugugugugugugugugug

SEQ ID NO: 201382 - RNA, 22 nt, Human
ugugugugugugugugugugug

SEQ ID NO: 201383 - RNA, 22 nt, Human
ugugugugugugugugugugug

SEQ ID NO: 201384 - RNA, 22 nt, Human
ugugugugugugugugugugug

SEQ ID NO: 201385 - RNA, 22 nt, Human
ugugugugugugugugugugug

SEQ ID NO: 201386 - RNA, 22 nt, Human
uuaacaucuuucucaaaaacau

SEQ ID NO: 201387 - RNA, 23 nt, Human
uuggaauaaaagucaauccccac

SEQ ID NO: 201388 - RNA, 25 nt, Human
uuguaucauauaugugugugugugu

SEQ ID NO: 201389 - RNA, 18 nt, Human
uuuuuuuuuuuuuuuuug

SEQ ID NO: 201390 - RNA, 19 nt, Human
uuuuuuuuuuuuuuuuugu

SEQ ID NO: 201391 - RNA, 19 nt, Human
aaaauaaaauagaggggcc

SEQ ID NO: 201392 - RNA, 18 nt, Human
aaauaaaauagaggggcc

SEQ ID NO: 201393 - RNA, 22 nt, Human
aaauaucauuugguuccuaaaa

SEQ ID NO: 201394 - RNA, 20 nt, Human
aagaaaaauaaaauagaggg

SEQ ID NO: 201395 - RNA, 24 nt, Human
aagcugggauggaacagcaggaga

SEQ ID NO: 201396 - RNA, 23 nt, Human
aauacaacucucaaauggaaucu

SEQ ID NO: 201397 - RNA, 21 nt, Human
acacaagcccaggaacacaca

SEQ ID NO: 201398 - RNA, 19 nt, Human
acacacagcugagugucgc

SEQ ID NO: 201399 - RNA, 18 nt, Human
acaccgccuaccaccacc

SEQ ID NO: 201400 - RNA, 21 nt, Human
acagugcuuuuacccccagac

SEQ ID NO: 201401 - RNA, 18 nt, Human
accgauuaaauacaguuc

SEQ ID NO: 201402 - RNA, 19 nt, Human
accugcgacuucugccccg

SEQ ID NO: 201403 - RNA, 19 nt, Human
agaacuaaccccugccccc

SEQ ID NO: 201404 - RNA, 19 nt, Human
agucaaaggcagcgcaggu

SEQ ID NO: 201405 - RNA, 18 nt, Human
aguucaaacaucagugcc

SEQ ID NO: 201406 - RNA, 19 nt, Human
auacaguucuuuaucaagu

SEQ ID NO: 201407 - RNA, 19 nt, Human
augccucuuacaacucagg

SEQ ID NO: 201408 - RNA, 23 nt, Human
auggaacagcaggagauaugaaa

SEQ ID NO: 201409 - RNA, 18 nt, Human
auguauauuuccaugccu

SEQ ID NO: 201410 - RNA, 26 nt, Human
caaacucccuuccauauuauuaaggc

SEQ ID NO: 201411 - RNA, 23 nt, Human
caaauccauuccucugguuuccu

SEQ ID NO: 201412 - RNA, 24 nt, Human
caagaaaaagacaccauaucauaa

SEQ ID NO: 201413 - RNA, 24 nt, Human
cacacaagcccaggaacacacagc

SEQ ID NO: 201414 - RNA, 25 nt, Human
cacacaagcccaggaacacacagcu

SEQ ID NO: 201415 - RNA, 20 nt, Human
cacaccgccuaccaccaccu

SEQ ID NO: 201416 - RNA, 21 nt, Human
caccauaucauaaacaucaga

SEQ ID NO: 201417 - RNA, 24 nt, Human
cacgcagccaccacugaaaagcac

SEQ ID NO: 201418 - RNA, 19 nt, Human
cagcaagagcgcacuggag

SEQ ID NO: 201419 - RNA, 23 nt, Human
caggaaagccaaaagugggagau

SEQ ID NO: 201420 - RNA, 20 nt, Human
cagggagaaacuauaacaaa

SEQ ID NO: 201421 - RNA, 22 nt, Human
cagucacaccgccuaccaccac

SEQ ID NO: 201422 - RNA, 23 nt, Human
cauuugguuccuaaaaaagggaa

SEQ ID NO: 201423 - RNA, 20 nt, Human
ccaaaacacaucccaaucug

SEQ ID NO: 201424 - RNA, 23 nt, Human
ccaaaacacaucccaaucugcaa

SEQ ID NO: 201425 - RNA, 18 nt, Human
ccaacagaauucaaccaa

SEQ ID NO: 201426 - RNA, 22 nt, Human
ccaagcccgucccggccccaac

SEQ ID NO: 201427 - RNA, 23 nt, Human
ccaaucugcaaaaggaauaacaa

SEQ ID NO: 201428 - RNA, 18 nt, Human
ccacacaagcccaggaac

SEQ ID NO: 201429 - RNA, 21 nt, Human
ccaccucuucaagcuccucuc

SEQ ID NO: 201430 - RNA, 21 nt, Human
ccaugccucuuacaacucagg

SEQ ID NO: 201431 - RNA, 22 nt, Human
cccaaaacacaucccaaucugc

SEQ ID NO: 201432 - RNA, 18 nt, Human
cccccaaaacacauccca

SEQ ID NO: 201433 - RNA, 22 nt, Human
cccccaaaacacaucccaaucu

SEQ ID NO: 201434 - RNA, 20 nt, Human
cccccaauccagugaaucug

SEQ ID NO: 201435 - RNA, 25 nt, Human
cccccagacaucuuguaaacuccua

SEQ ID NO: 201436 - RNA, 23 nt, Human
ccccugcccccaaaacacauccc

SEQ ID NO: 201437 - RNA, 19 nt, Human
cccgucccggccccaacac

SEQ ID NO: 201438 - RNA, 18 nt, Human
cccugcccccaaaacaca

SEQ ID NO: 201439 - RNA, 19 nt, Human
cccugcccccaaaacacau

SEQ ID NO: 201440 - RNA, 21 nt, Human
ccugcccccaaaacacauccc

SEQ ID NO: 201441 - RNA, 21 nt, Human
ccugcgcgcgcggcagagagg

SEQ ID NO: 201442 - RNA, 22 nt, Human
cgaccugaagaacuaaccccug

SEQ ID NO: 201443 - RNA, 21 nt, Human
cgcagccaccacugaaaagca

SEQ ID NO: 201444 - RNA, 24 nt, Human
cgccccuagauuugaguagaguuc

SEQ ID NO: 201445 - RNA, 18 nt, Human
cuaaccccugcccccaaa

SEQ ID NO: 201446 - RNA, 23 nt, Human
cuuaggucacgcgccgccccgcc

SEQ ID NO: 201447 - RNA, 19 nt, Human
gaaauuucuagcuugucua

SEQ ID NO: 201448 - RNA, 18 nt, Human
gaacugagguucuaagua

SEQ ID NO: 201449 - RNA, 18 nt, Human
gaagcuuguggcaccaau

SEQ ID NO: 201450 - RNA, 24 nt, Human
gagaggaaccagcugcacggccca

SEQ ID NO: 201451 - RNA, 23 nt, Human
gaguagccaggcaucccagugcu

SEQ ID NO: 201452 - RNA, 27 nt, Human
gcagaaccaccucuucaagcuccucuc

SEQ ID NO: 201453 - RNA, 21 nt, Human
gcagcagcuggguaccugcga

SEQ ID NO: 201454 - RNA, 19 nt, Human
gcagcgcagguugguccug

SEQ ID NO: 201455 - RNA, 22 nt, Human
gccgaccugaagaacuaacccc

SEQ ID NO: 201456 - RNA, 18 nt, Human
ggacucuggaccagaaac

SEQ ID NO: 201457 - RNA, 19 nt, Human
ggcagagagggagccaagc

SEQ ID NO: 201458 - RNA, 22 nt, Human
gggcagcagcuggguaccugcg

SEQ ID NO: 201459 - RNA, 26 nt, Human
gguguucuaaagaaauuucuagcuug

SEQ ID NO: 201460 - RNA, 20 nt, Human
gugggcagcagcuggguacc

SEQ ID NO: 201461 - RNA, 21 nt, Human
guuccucuaucccccaaucca

SEQ ID NO: 201462 - RNA, 22 nt, Human
uaaacuccuauuuagggacacu

SEQ ID NO: 201463 - RNA, 27 nt, Human
uaaccccugcccccaaaacacaucccc

SEQ ID NO: 201464 - RNA, 28 nt, Human
uaauagaacugagguucuaaguaccaca

SEQ ID NO: 201465 - RNA, 23 nt, Human
uacaacucucaaauggaaucuca

SEQ ID NO: 201466 - RNA, 24 nt, Human
uacaacucucaaauggaaucucaa

SEQ ID NO: 201467 - RNA, 22 nt, Human
uagaguuccaacagaauucaac

SEQ ID NO: 201468 - RNA, 25 nt, Human
uaucauaaacaucagauaucaguuc

SEQ ID NO: 201469 - RNA, 22 nt, Human
ucaaaaaaaugucugacuauaa

SEQ ID NO: 201470 - RNA, 24 nt, Human
ucacaccgccuaccaccaccuggu

SEQ ID NO: 201471 - RNA, 21 nt, Human
ucagauaucaguucacugaca

SEQ ID NO: 201472 - RNA, 27 nt, Human
ucagugccuuggcucggaguagccagg

SEQ ID NO: 201473 - RNA, 24 nt, Human
uccaacagaauucaaccaaguggu

SEQ ID NO: 201474 - RNA, 19 nt, Human
uccggaccucccagcaaga

SEQ ID NO: 201475 - RNA, 24 nt, Human
ucgcucgagaggaaccagcugcac

SEQ ID NO: 201476 - RNA, 20 nt, Human
ucugucucauacugucaaaa

SEQ ID NO: 201477 - RNA, 22 nt, Human
ucuucaguuucauguauauuuc

SEQ ID NO: 201478 - RNA, 19 nt, Human
ugaaucuggacgugguagg

SEQ ID NO: 201479 - RNA, 21 nt, Human
ugccgcuucccugcaggaacg

SEQ ID NO: 201480 - RNA, 19 nt, Human
ugccuuggcucggaguagc

SEQ ID NO: 201481 - RNA, 20 nt, Human
ugcugguuuucuccuuccca

SEQ ID NO: 201482 - RNA, 23 nt, Human
uggaagcuuguggcaccaauuca

SEQ ID NO: 201483 - RNA, 22 nt, Human
uggaccagaaacgugggcagca

SEQ ID NO: 201484 - RNA, 19 nt, Human
uggcagagagggagccaag

SEQ ID NO: 201485 - RNA, 27 nt, Human
uguggcugucugcagaaccaccucuuc

SEQ ID NO: 201486 - RNA, 23 nt, Human
uuggaagcuuguggcaccaauuc

SEQ ID NO: 201487 - RNA, 21 nt, Human
uuuccaguucaaacaucagug

SEQ ID NO: 201488 - RNA, 23 nt, Human
uuuccaguucaaacaucagugcc

SEQ ID NO: 201489 - RNA, 18 nt, Human
uuugaaguuuccaguuca

SEQ ID NO: 201490 - RNA, 23 nt, Human
uuuuuuggcuauuuuauuucuag

SEQ ID NO: 201491 - RNA, 22 nt, Human
uuuuuuuuuuuuuuuuuuccag

SEQ ID NO: 201492 - RNA, 22 nt, Human
aaaccaaauacugcauguucuc

SEQ ID NO: 201493 - RNA, 19 nt, Human
aaagaaaaccgaaagaaga

SEQ ID NO: 201494 - RNA, 18 nt, Human
aaagaagaaaaucagcaa

SEQ ID NO: 201495 - RNA, 25 nt, Human
aaagaucuaaaauuuaauuuucagc

SEQ ID NO: 201496 - RNA, 19 nt, Human
aacacccucuccauuccaa

SEQ ID NO: 201497 - RNA, 19 nt, Human
aaccaaauacugcauguuc

SEQ ID NO: 201498 - RNA, 21 nt, Human
aagaagaaaaucagcaaaauc

SEQ ID NO: 201499 - RNA, 22 nt, Human
aagaagaaaaucagcaaaaucu

SEQ ID NO: 201500 - RNA, 23 nt, Human
aagaagaaaaucagcaaaaucua

SEQ ID NO: 201501 - RNA, 24 nt, Human
aagcaagcauuaacagacaguuau

SEQ ID NO: 201502 - RNA, 23 nt, Human
aagcuucccaacugaaacaagga

SEQ ID NO: 201503 - RNA, 23 nt, Human
aaggagacucaaaaaauggcuca

SEQ ID NO: 201504 - RNA, 20 nt, Human
aagguagagaaaaagcaagc

SEQ ID NO: 201505 - RNA, 21 nt, Human
aaguguccaucaacugauaag

SEQ ID NO: 201506 - RNA, 25 nt, Human
aauggcucauuuucuuccucugguu

SEQ ID NO: 201507 - RNA, 21 nt, Human
aauguacaucacucaggugac

SEQ ID NO: 201508 - RNA, 19 nt, Human
aaugugguauauauguacc

SEQ ID NO: 201509 - RNA, 21 nt, Human
acaaagaaaaccgaaagaaga

SEQ ID NO: 201510 - RNA, 24 nt, Human
acugaagugcuggagccuggccug

SEQ ID NO: 201511 - RNA, 19 nt, Human
acugaccaacacccucucc

SEQ ID NO: 201512 - RNA, 23 nt, Human
agaaaaccgaaagaagaaaauca

SEQ ID NO: 201513 - RNA, 21 nt, Human
agaaaaucagcaaaaucuagc

SEQ ID NO: 201514 - RNA, 22 nt, Human
agagagcugggaagaacccaga

SEQ ID NO: 201515 - RNA, 19 nt, Human
agcaaaaaguguguacccc

SEQ ID NO: 201516 - RNA, 21 nt, Human
agcagagagcugggaagaacc

SEQ ID NO: 201517 - RNA, 18 nt, Human
agcauucauauacauuuu

SEQ ID NO: 201518 - RNA, 19 nt, Human
agccagcgcuaaagauggc

SEQ ID NO: 201519 - RNA, 22 nt, Human
agcuacagccaucaugcuacca

SEQ ID NO: 201520 - RNA, 19 nt, Human
aggaaaucacccacaccca

SEQ ID NO: 201521 - RNA, 18 nt, Human
agugcuggagccuggccu

SEQ ID NO: 201522 - RNA, 19 nt, Human
auaaaacaaaacaaaacuu

SEQ ID NO: 201523 - RNA, 20 nt, Human
augaaggaaagaauucuaaa

SEQ ID NO: 201524 - RNA, 23 nt, Human
caaaagcuucccaacugaaacaa

SEQ ID NO: 201525 - RNA, 23 nt, Human
caaaauacugugcuaaaucuagc

SEQ ID NO: 201526 - RNA, 18 nt, Human
cacccucuccauuccaaa

SEQ ID NO: 201527 - RNA, 26 nt, Human
cacuacacaauucaccccuguaagcc

SEQ ID NO: 201528 - RNA, 18 nt, Human
cagccauaaagaagaaua

SEQ ID NO: 201529 - RNA, 18 nt, Human
cagcgcuaaagauggcag

SEQ ID NO: 201530 - RNA, 20 nt, Human
caugcaaaaugcuaagcagu

SEQ ID NO: 201531 - RNA, 21 nt, Human
ccaucaacugauaaguggaua

SEQ ID NO: 201532 - RNA, 21 nt, Human
cccaugaaacagcuacagcca

SEQ ID NO: 201533 - RNA, 19 nt, Human
ccccuaaagcuauuaaaau

SEQ ID NO: 201534 - RNA, 24 nt, Human
ccccuaaagcuauuaaaauaaaaa

SEQ ID NO: 201535 - RNA, 21 nt, Human
cccucuccauuccaaaggguu

SEQ ID NO: 201536 - RNA, 22 nt, Human
cgagaucaaaauacugugcuaa

SEQ ID NO: 201537 - RNA, 21 nt, Human
cggcaguaugcuuuuucugau

SEQ ID NO: 201538 - RNA, 20 nt, Human
cucaggaauggaaaaccaaa

SEQ ID NO: 201539 - RNA, 21 nt, Human
cucaggaauggaaaaccaaau

SEQ ID NO: 201540 - RNA, 18 nt, Human
cucauuuucuuccucugg

SEQ ID NO: 201541 - RNA, 22 nt, Human
cuccuuacaaauauacuuaaau

SEQ ID NO: 201542 - RNA, 23 nt, Human
cuguaagcaaaaaguguguaccc

SEQ ID NO: 201543 - RNA, 19 nt, Human
cuuuuacaaccaguuucac

SEQ ID NO: 201544 - RNA, 23 nt, Human
gaaaaccgaaagaagaaaaucag

SEQ ID NO: 201545 - RNA, 22 nt, Human
gaaacagcuacagccaucaugc

SEQ ID NO: 201546 - RNA, 18 nt, Human
gaaaucacccacacccac

SEQ ID NO: 201547 - RNA, 20 nt, Human
gaauggaauuaaccuaagug

SEQ ID NO: 201548 - RNA, 21 nt, Human
gacaaagaaaaccgaaagaag

SEQ ID NO: 201549 - RNA, 22 nt, Human
gagcagagagcugggaagaacc

SEQ ID NO: 201550 - RNA, 22 nt, Human
gauguuggagacucagaaggga

SEQ ID NO: 201551 - RNA, 22 nt, Human
gccuggggaggagcgcccgggg

SEQ ID NO: 201552 - RNA, 19 nt, Human
gcgcccggggagcagcgcu

SEQ ID NO: 201553 - RNA, 18 nt, Human
gcuacagccaucaugcua

SEQ ID NO: 201554 - RNA, 20 nt, Human
gcugcuccccccgccaggaa

SEQ ID NO: 201555 - RNA, 19 nt, Human
gcugucuuuuaaggugcaa

SEQ ID NO: 201556 - RNA, 20 nt, Human
ggaaaaccaaauacugcaug

SEQ ID NO: 201557 - RNA, 22 nt, Human
ggcccaugaaacagcuacagcc

SEQ ID NO: 201558 - RNA, 21 nt, Human
ggcucauuuucuuccucuggu

SEQ ID NO: 201559 - RNA, 19 nt, Human
gggauguuggagacucaga

SEQ ID NO: 201560 - RNA, 20 nt, Human
guagagauggcacaugaagg

SEQ ID NO: 201561 - RNA, 20 nt, Human
gugaaauggccacauuaccc

SEQ ID NO: 201562 - RNA, 23 nt, Human
guugcuaugagguuugaaggggc

SEQ ID NO: 201563 - RNA, 21 nt, Human
uauauccauaacaggcauaca

SEQ ID NO: 201564 - RNA, 23 nt, Human
uauuggguacaauguacaucacu

SEQ ID NO: 201565 - RNA, 22 nt, Human
ucaccuggcugcuccccccgcc

SEQ ID NO: 201566 - RNA, 22 nt, Human
ucuaaaaucuucuaauacauuu

SEQ ID NO: 201567 - RNA, 21 nt, Human
ucugaacaauaagacaugagg

SEQ ID NO: 201568 - RNA, 24 nt, Human
ugaaagaucuaaaauuuaauuuuc

SEQ ID NO: 201569 - RNA, 18 nt, Human
ugaaggaaagaauucuaa

SEQ ID NO: 201570 - RNA, 26 nt, Human
ugacaaagaaaaccgaaagaagaaaa

SEQ ID NO: 201571 - RNA, 22 nt, Human
ugacaaguacauuaaaagccga

SEQ ID NO: 201572 - RNA, 19 nt, Human
ugagaaugaagccagcgcu

SEQ ID NO: 201573 - RNA, 22 nt, Human
ugagauggaaucucucuccguc

SEQ ID NO: 201574 - RNA, 27 nt, Human
ugagauggaaucucucuccgucacaaa

SEQ ID NO: 201575 - RNA, 18 nt, Human
ugcuaugagguuugaagg

SEQ ID NO: 201576 - RNA, 20 nt, Human
uggauaaagaaaauguggua

SEQ ID NO: 201577 - RNA, 18 nt, Human
uggcagagcagagagcug

SEQ ID NO: 201578 - RNA, 20 nt, Human
uggcagagcagagagcuggg

SEQ ID NO: 201579 - RNA, 22 nt, Human
uggcagagcagagagcugggaa

SEQ ID NO: 201580 - RNA, 23 nt, Human
uggcucauuuucuuccucugguu

SEQ ID NO: 201581 - RNA, 22 nt, Human
ugggaauauacauuuccuuauu

SEQ ID NO: 201582 - RNA, 23 nt, Human
ugggugccuguagagauggcaca

SEQ ID NO: 201583 - RNA, 21 nt, Human
ugugguauauauguaccaugg

SEQ ID NO: 201584 - RNA, 19 nt, Human
uuaaagauacuauauccau

SEQ ID NO: 201585 - RNA, 24 nt, Human
uuagauaaaaguaaaacaugcaaa

SEQ ID NO: 201586 - RNA, 23 nt, Human
uuauugcugacaaagaaaaccga

SEQ ID NO: 201587 - RNA, 23 nt, Human
uucaccacuacacaauucacccc

SEQ ID NO: 201588 - RNA, 19 nt, Human
uucacugguaaaaagcgca

SEQ ID NO: 201589 - RNA, 21 nt, Human
uugcagccaaaagcuucccaa

SEQ ID NO: 201590 - RNA, 24 nt, Human
uuuguagacugaccaacacccucu

SEQ ID NO: 201591 - RNA, 25 nt, Human
uuuuuuuuuuuuuuuuuuuucaagg

SEQ ID NO: 201592 - RNA, 19 nt, Human
aaaccucuuccauagcccu

SEQ ID NO: 201593 - RNA, 20 nt, Human
aagcccgggaacuggagcaa

SEQ ID NO: 201594 - RNA, 23 nt, Human
aagccguucccaaaccucuucca

SEQ ID NO: 201595 - RNA, 24 nt, Human
accccaaagccguucccaaaccuc

SEQ ID NO: 201596 - RNA, 21 nt, Human
acuggccugugucugcccugc

SEQ ID NO: 201597 - RNA, 19 nt, Human
agaaggacaggugugagcu

SEQ ID NO: 201598 - RNA, 25 nt, Human
agccgccccacccucccgugggccc

SEQ ID NO: 201599 - RNA, 21 nt, Human
aggaguggggauuggaggaag

SEQ ID NO: 201600 - RNA, 21 nt, Human
aggcaccggcgagggcgcagc

SEQ ID NO: 201601 - RNA, 18 nt, Human
aggccguagguugcgcca

SEQ ID NO: 201602 - RNA, 22 nt, Human
aguggugcuugugggguugacc

SEQ ID NO: 201603 - RNA, 23 nt, Human
aucggccgcaccagcuucugggc

SEQ ID NO: 201604 - RNA, 27 nt, Human
augccacccucuccucacacuccccag

SEQ ID NO: 201605 - RNA, 21 nt, Human
caaaccucuuccauagcccaa

SEQ ID NO: 201606 - RNA, 21 nt, Human
caacagacuuuaauggaaauc

SEQ ID NO: 201607 - RNA, 18 nt, Human
caaccgggcugugccugc

SEQ ID NO: 201608 - RNA, 21 nt, Human
caccccaaagccguucccaaa

SEQ ID NO: 201609 - RNA, 22 nt, Human
caccccaaagccguucccaaac

SEQ ID NO: 201610 - RNA, 26 nt, Human
caccgcgcagcgcggcuaauggaggu

SEQ ID NO: 201611 - RNA, 19 nt, Human
caccgggcgccugcucccc

SEQ ID NO: 201612 - RNA, 19 nt, Human
cagaaauccccaagucccc

SEQ ID NO: 201613 - RNA, 19 nt, Human
cagaaauccccaagucccc

SEQ ID NO: 201614 - RNA, 19 nt, Human
cagaccccgggcugugagg

SEQ ID NO: 201615 - RNA, 18 nt, Human
cagcacgaccucugaucg

SEQ ID NO: 201616 - RNA, 19 nt, Human
cagcgcggcuaauggaggu

SEQ ID NO: 201617 - RNA, 24 nt, Human
cagcuccugaugccacccucuccu

SEQ ID NO: 201618 - RNA, 18 nt, Human
cagcuucccagccgcccc

SEQ ID NO: 201619 - RNA, 19 nt, Human
ccaccccgaucccagacac

SEQ ID NO: 201620 - RNA, 20 nt, Human
ccacccucuccucacacucc

SEQ ID NO: 201621 - RNA, 20 nt, Human
ccagaccccgggcugugagg

SEQ ID NO: 201622 - RNA, 20 nt, Human
ccagaggggggucccugggc

SEQ ID NO: 201623 - RNA, 19 nt, Human
ccaugaaaaggggcacagg

SEQ ID NO: 201624 - RNA, 20 nt, Human
ccaugccgcucccuccgcca

SEQ ID NO: 201625 - RNA, 20 nt, Human
cccagaggggggucccuggg

SEQ ID NO: 201626 - RNA, 19 nt, Human
cccagccgccccacccucc

SEQ ID NO: 201627 - RNA, 20 nt, Human
cccagccgccccacccuccc

SEQ ID NO: 201628 - RNA, 19 nt, Human
cccaggagagaggcaccgg

SEQ ID NO: 201629 - RNA, 20 nt, Human
cccagugaggaugcgguggu

SEQ ID NO: 201630 - RNA, 20 nt, Human
cccaugccgcucccuccgcc

SEQ ID NO: 201631 - RNA, 18 nt, Human
ccccacuggccugugucu

SEQ ID NO: 201632 - RNA, 20 nt, Human
ccccagugcgggccugguac

SEQ ID NO: 201633 - RNA, 20 nt, Human
ccccaugggccagcuccggg

SEQ ID NO: 201634 - RNA, 21 nt, Human
cccccagggugcuagggcggg

SEQ ID NO: 201635 - RNA, 18 nt, Human
ccccccgcggcacccggg

SEQ ID NO: 201636 - RNA, 22 nt, Human
cccccgcggcacccgggcgccu

SEQ ID NO: 201637 - RNA, 18 nt, Human
cccccggggcagcgugcc

SEQ ID NO: 201638 - RNA, 22 nt, Human
ccccggggcagcgugccagcuu

SEQ ID NO: 201639 - RNA, 19 nt, Human
ccccugcugaaguugugcc

SEQ ID NO: 201640 - RNA, 19 nt, Human
ccccugcugaaguugugcc

SEQ ID NO: 201641 - RNA, 19 nt, Human
cccgugggcccggccccgg

SEQ ID NO: 201642 - RNA, 23 nt, Human
cccucccgugggcccggccccgg

SEQ ID NO: 201643 - RNA, 26 nt, Human
cccuccgccaagccugagcagcuccc

SEQ ID NO: 201644 - RNA, 19 nt, Human
cccugcgggaaacaggagc

SEQ ID NO: 201645 - RNA, 22 nt, Human
cccugcuugugcccagaguggu

SEQ ID NO: 201646 - RNA, 22 nt, Human
cccugggcuucaccggccgguc

SEQ ID NO: 201647 - RNA, 18 nt, Human
cccuggucuaagggccuu

SEQ ID NO: 201648 - RNA, 23 nt, Human
ccgcggcacccgggcgccugcca

SEQ ID NO: 201649 - RNA, 18 nt, Human
ccggccccggagccuggc

SEQ ID NO: 201650 - RNA, 23 nt, Human
ccgggccggggggaacacgcgcc

SEQ ID NO: 201651 - RNA, 21 nt, Human
ccggggccucccggccggcgg

SEQ ID NO: 201652 - RNA, 23 nt, Human
ccucccggccggcgggcgaggac

SEQ ID NO: 201653 - RNA, 24 nt, Human
ccucccgggccccgggggcuuccg

SEQ ID NO: 201654 - RNA, 25 nt, Human
ccugccgggccacuggcuccugguc

SEQ ID NO: 201655 - RNA, 20 nt, Human
ccugggacccaggagagagg

SEQ ID NO: 201656 - RNA, 22 nt, Human
ccugggccggcccccucccggg

SEQ ID NO: 201657 - RNA, 21 nt, Human
ccugggcugagcaccuggucu

SEQ ID NO: 201658 - RNA, 18 nt, Human
ccugugucugcccugccu

SEQ ID NO: 201659 - RNA, 22 nt, Human
cggcacccccacuauaggugcc

SEQ ID NO: 201660 - RNA, 23 nt, Human
cggccggucgcggcgcgggcggu

SEQ ID NO: 201661 - RNA, 18 nt, Human
cggcgagggcgcagcacc

SEQ ID NO: 201662 - RNA, 21 nt, Human
cggcgggggcgcucuagggcc

SEQ ID NO: 201663 - RNA, 20 nt, Human
cgggaagggcaugagugaca

SEQ ID NO: 201664 - RNA, 19 nt, Human
cgggaggggccggaccagg

SEQ ID NO: 201665 - RNA, 23 nt, Human
cgggaggggccggaccaggccac

SEQ ID NO: 201666 - RNA, 23 nt, Human
cgugccuggauggugggggccga

SEQ ID NO: 201667 - RNA, 19 nt, Human
cguggccggcaccgggcgc

SEQ ID NO: 201668 - RNA, 24 nt, Human
cuagggcggggcggcugggagggg

SEQ ID NO: 201669 - RNA, 18 nt, Human
cucauccucaccuggcca

SEQ ID NO: 201670 - RNA, 24 nt, Human
cucauccucaccuggccaagcugc

SEQ ID NO: 201671 - RNA, 18 nt, Human
cuccccagaucuuuuggc

SEQ ID NO: 201672 - RNA, 20 nt, Human
cucccgggccccgggggcuu

SEQ ID NO: 201673 - RNA, 24 nt, Human
cucuuccauagcccaagggcacaa

SEQ ID NO: 201674 - RNA, 19 nt, Human
cugcuccgccgguuuccuc

SEQ ID NO: 201675 - RNA, 22 nt, Human
cugcuccuuuggccaucuucca

SEQ ID NO: 201676 - RNA, 21 nt, Human
cuggagcaaagggcgggaggg

SEQ ID NO: 201677 - RNA, 20 nt, Human
cuggcccacgccaaccgggc

SEQ ID NO: 201678 - RNA, 20 nt, Human
cugggccgaggccguagguu

SEQ ID NO: 201679 - RNA, 23 nt, Human
cuuccagcccaggggcuggagag

SEQ ID NO: 201680 - RNA, 22 nt, Human
cuucccagccgccccacccucc

SEQ ID NO: 201681 - RNA, 19 nt, Human
gacccaggagagaggcacc

SEQ ID NO: 201682 - RNA, 20 nt, Human
gagcagcaggaggagguguu

SEQ ID NO: 201683 - RNA, 20 nt, Human
gagccuggcaggcgggcggc

SEQ ID NO: 201684 - RNA, 18 nt, Human
gaguugggggaaaggccg

SEQ ID NO: 201685 - RNA, 22 nt, Human
gaugccacccucuccucacacu

SEQ ID NO: 201686 - RNA, 22 nt, Human
gcagugccagagcuggcagggg

SEQ ID NO: 201687 - RNA, 20 nt, Human
gccaagcccgggaacuggag

SEQ ID NO: 201688 - RNA, 21 nt, Human
gccagaaugauucccaaguuu

SEQ ID NO: 201689 - RNA, 19 nt, Human
gccagagcuggcaggggca

SEQ ID NO: 201690 - RNA, 20 nt, Human
gcgaggacgcguucucccgc

SEQ ID NO: 201691 - RNA, 20 nt, Human
gcgcagcgcggcuaauggag

SEQ ID NO: 201692 - RNA, 20 nt, Human
gcggcacccgggcgccugcc

SEQ ID NO: 201693 - RNA, 18 nt, Human
gcggcugggagggggcag

SEQ ID NO: 201694 - RNA, 18 nt, Human
gcgggaaacaggagcccg

SEQ ID NO: 201695 - RNA, 22 nt, Human
gcgguggcggucgucguggccg

SEQ ID NO: 201696 - RNA, 18 nt, Human
gcugggagggggcagugc

SEQ ID NO: 201697 - RNA, 22 nt, Human
ggaaaucaugaaggagggaagc

SEQ ID NO: 201698 - RNA, 26 nt, Human
ggagaugccagccugagaaggacagg

SEQ ID NO: 201699 - RNA, 21 nt, Human
ggagauggccgaguuggggga

SEQ ID NO: 201700 - RNA, 24 nt, Human
ggagcaaagggcgggaggggccgg

SEQ ID NO: 201701 - RNA, 19 nt, Human
ggaggaguggggauuggag

SEQ ID NO: 201702 - RNA, 20 nt, Human
ggcgagggcgcagcaccgcg

SEQ ID NO: 201703 - RNA, 18 nt, Human
ggcgcagcaccgcgcagc

SEQ ID NO: 201704 - RNA, 18 nt, Human
ggcggggugccccccagg

SEQ ID NO: 201705 - RNA, 23 nt, Human
ggcgguggcggucgucguggccg

SEQ ID NO: 201706 - RNA, 18 nt, Human
ggcuggagaggcgcccag

SEQ ID NO: 201707 - RNA, 21 nt, Human
ggcugggagggggcagugcca

SEQ ID NO: 201708 - RNA, 27 nt, Human
gggcacagggugggggagaugccagcc

SEQ ID NO: 201709 - RNA, 20 nt, Human
gggcagaagguuggaggccc

SEQ ID NO: 201710 - RNA, 22 nt, Human
gggcagaagguuggaggccccu

SEQ ID NO: 201711 - RNA, 21 nt, Human
gggccgggccggggcuaggga

SEQ ID NO: 201712 - RNA, 21 nt, Human
gggccggggggaacacgcgcc

SEQ ID NO: 201713 - RNA, 18 nt, Human
ggggaagggggucgugcc

SEQ ID NO: 201714 - RNA, 18 nt, Human
ggggagggccgggccggg

SEQ ID NO: 201715 - RNA, 19 nt, Human
ggggaguggcucccgggag

SEQ ID NO: 201716 - RNA, 21 nt, Human
ggggcggcugggagggggcag

SEQ ID NO: 201717 - RNA, 20 nt, Human
ggggcuuccgccaacgcccc

SEQ ID NO: 201718 - RNA, 18 nt, Human
gguagaaacggagcuggg

SEQ ID NO: 201719 - RNA, 21 nt, Human
ggucaugggcccaugugagcu

SEQ ID NO: 201720 - RNA, 20 nt, Human
ggucggacuccgggaucugc

SEQ ID NO: 201721 - RNA, 19 nt, Human
guagagcgcggcggagagc

SEQ ID NO: 201722 - RNA, 18 nt, Human
gugagcagcaggaggagg

SEQ ID NO: 201723 - RNA, 21 nt, Human
guggcacauggcacgccccac

SEQ ID NO: 201724 - RNA, 18 nt, Human
gugggggagaugccagcc

SEQ ID NO: 201725 - RNA, 20 nt, Human
gugguagaaacggagcuggg

SEQ ID NO: 201726 - RNA, 20 nt, Human
gugugagcuugguggcacug

SEQ ID NO: 201727 - RNA, 19 nt, Human
uaccaugaaaaggggcaca

SEQ ID NO: 201728 - RNA, 19 nt, Human
uccauagcccaagggcaca

SEQ ID NO: 201729 - RNA, 24 nt, Human
ucccaaaccucuuccauagcccaa

SEQ ID NO: 201730 - RNA, 23 nt, Human
ucccagaggggggucccugggcu

SEQ ID NO: 201731 - RNA, 21 nt, Human
ucccagccgccccacccuccc

SEQ ID NO: 201732 - RNA, 18 nt, Human
uccccaugggccagcucc

SEQ ID NO: 201733 - RNA, 23 nt, Human
ucccccucccccccgcggcaccc

SEQ ID NO: 201734 - RNA, 18 nt, Human
ucccgugggcccggcccc

SEQ ID NO: 201735 - RNA, 19 nt, Human
uccgacaccggcuccagac

SEQ ID NO: 201736 - RNA, 18 nt, Human
uccgccaagccugagcag

SEQ ID NO: 201737 - RNA, 19 nt, Human
uccgugcugcgccgcgggg

SEQ ID NO: 201738 - RNA, 25 nt, Human
uccugggacccaggagagaggcacc

SEQ ID NO: 201739 - RNA, 22 nt, Human
ucuagggccgcagguuggaggg

SEQ ID NO: 201740 - RNA, 20 nt, Human
ugaaguugugccugggcuga

SEQ ID NO: 201741 - RNA, 21 nt, Human
ugaaguugugccugggcuuga

SEQ ID NO: 201742 - RNA, 18 nt, Human
ugaccagaaauccccaag

SEQ ID NO: 201743 - RNA, 18 nt, Human
ugaccagaaauccccaag

SEQ ID NO: 201744 - RNA, 20 nt, Human
ugagcagcuccugaugccaa

SEQ ID NO: 201745 - RNA, 22 nt, Human
ugaucgccaucgccagacgcgc

SEQ ID NO: 201746 - RNA, 18 nt, Human
ugcagugagcccagugag

SEQ ID NO: 201747 - RNA, 24 nt, Human
ugcccugcuugugcccagaguggu

SEQ ID NO: 201748 - RNA, 25 nt, Human
ugccuggauggugggggccgauccu

SEQ ID NO: 201749 - RNA, 25 nt, Human
ugccugggcugagcaccuggucuac

SEQ ID NO: 201750 - RNA, 19 nt, Human
ugcggugguagaaacggag

SEQ ID NO: 201751 - RNA, 20 nt, Human
ugcggugguagaaacggagc

SEQ ID NO: 201752 - RNA, 21 nt, Human
ugcuccgccgguuuccuccuc

SEQ ID NO: 201753 - RNA, 23 nt, Human
ugcuccgccgguuuccuccucca

SEQ ID NO: 201754 - RNA, 23 nt, Human
ugcugcgccgcggggagggccgg

SEQ ID NO: 201755 - RNA, 18 nt, Human
uggcaggagggcagaagg

SEQ ID NO: 201756 - RNA, 24 nt, Human
uggcaggcgggcggcacccccucu

SEQ ID NO: 201757 - RNA, 18 nt, Human
uggccggcaccgggcgcc

SEQ ID NO: 201758 - RNA, 22 nt, Human
ugggagggggcagugccagagc

SEQ ID NO: 201759 - RNA, 24 nt, Human
ugggagggggcagugccagagcug

SEQ ID NO: 201760 - RNA, 25 nt, Human
ugggagggggcagugccagagcugg

SEQ ID NO: 201761 - RNA, 21 nt, Human
ugggcucagcgggagugagca

SEQ ID NO: 201762 - RNA, 18 nt, Human
uggggaagcugcuccgcc

SEQ ID NO: 201763 - RNA, 20 nt, Human
uggggcucucccagaggggg

SEQ ID NO: 201764 - RNA, 20 nt, Human
uggggcucucccagaggggg

SEQ ID NO: 201765 - RNA, 24 nt, Human
uggggcucucccagaggggggucc

SEQ ID NO: 201766 - RNA, 24 nt, Human
uggggcucucccagaggggggucc

SEQ ID NO: 201767 - RNA, 23 nt, Human
ugggggaaaggccgaggggccgg

SEQ ID NO: 201768 - RNA, 24 nt, Human
uggugcuuccagcccaggggcugg

SEQ ID NO: 201769 - RNA, 22 nt, Human
uggugggggccgauccugggac

SEQ ID NO: 201770 - RNA, 24 nt, Human
uuccaccccaaagccguucccaaa

SEQ ID NO: 201771 - RNA, 18 nt, Human
uuggaggccccuuguuca

SEQ ID NO: 201772 - RNA, 23 nt, Human
uuugucuccugggucucggagga

SEQ ID NO: 201773 - RNA, 18 nt, Human
acaaaaugguucuggauc

SEQ ID NO: 201774 - RNA, 22 nt, Human
cagcgcacucuugcccacaccg

SEQ ID NO: 201775 - RNA, 19 nt, Human
ccaacaggcacaaucccca

SEQ ID NO: 201776 - RNA, 21 nt, Human
ccaccaccaccagcuuauauu

SEQ ID NO: 201777 - RNA, 23 nt, Human
ccaccaccaccagcuuauauucc

SEQ ID NO: 201778 - RNA, 19 nt, Human
cccacaccgccggcgccca

SEQ ID NO: 201779 - RNA, 25 nt, Human
cccaccaccaccagcuuauauuccg

SEQ ID NO: 201780 - RNA, 25 nt, Human
gcacaauccccaucaaugaccaccu

SEQ ID NO: 201781 - RNA, 21 nt, Human
gcuguacuccuccuggccggc

SEQ ID NO: 201782 - RNA, 21 nt, Human
guggggucguauucguccaca

SEQ ID NO: 201783 - RNA, 21 nt, Human
uccaacaggcacaauccccau

SEQ ID NO: 201784 - RNA, 20 nt, Human
uucuggaucagcuggauggu

SEQ ID NO: 201785 - RNA, 23 nt, Human
aaucuggaacaguaaugaugcac

SEQ ID NO: 201786 - RNA, 21 nt, Human
aauuccuucaauaucaauauc

SEQ ID NO: 201787 - RNA, 24 nt, Human
agcugccgaccuugccgccggcgg

SEQ ID NO: 201788 - RNA, 23 nt, Human
aggcaggcgccagccaucacucg

SEQ ID NO: 201789 - RNA, 18 nt, Human
caggcgccagccaucacu

SEQ ID NO: 201790 - RNA, 24 nt, Human
cagggccaacgccagcaccagcgc

SEQ ID NO: 201791 - RNA, 20 nt, Human
caucacucggggccguccuc

SEQ ID NO: 201792 - RNA, 21 nt, Human
ccucgcagcugccgaccuugc

SEQ ID NO: 201793 - RNA, 19 nt, Human
cgggaggcaggcgccagcc

SEQ ID NO: 201794 - RNA, 18 nt, Human
cuuuuccuccucccaaau

SEQ ID NO: 201795 - RNA, 23 nt, Human
gaaaauaaguauucaccccaggu

SEQ ID NO: 201796 - RNA, 23 nt, Human
ucuuuuccuccucccaaauuccu

SEQ ID NO: 201797 - RNA, 21 nt, Human
aagaucagugaaacaagacaa

SEQ ID NO: 201798 - RNA, 23 nt, Human
acaagacaacagugcaagaggug

SEQ ID NO: 201799 - RNA, 19 nt, Human
acuuuccaguagcaauggu

SEQ ID NO: 201800 - RNA, 19 nt, Human
agaaaggaaaaauucaaga

SEQ ID NO: 201801 - RNA, 24 nt, Human
agcuaagaucagugaaacaagaca

SEQ ID NO: 201802 - RNA, 18 nt, Human
agggaggaggccggcagg

SEQ ID NO: 201803 - RNA, 18 nt, Human
agugcaagagguggagag

SEQ ID NO: 201804 - RNA, 24 nt, Human
caaaacaugaucagcuuuauuaug

SEQ ID NO: 201805 - RNA, 21 nt, Human
cagcggcuuggcuguacuggg

SEQ ID NO: 201806 - RNA, 19 nt, Human
cccgcgccggacccggccg

SEQ ID NO: 201807 - RNA, 21 nt, Human
cccgcgccggacccggccgca

SEQ ID NO: 201808 - RNA, 20 nt, Human
cccucgguuuugcacauauu

SEQ ID NO: 201809 - RNA, 23 nt, Human
cccucgguuuugcacauauuacc

SEQ ID NO: 201810 - RNA, 23 nt, Human
ccgcagcggcuuggcuguacugg

SEQ ID NO: 201811 - RNA, 20 nt, Human
ccgcgccggacccggccgca

SEQ ID NO: 201812 - RNA, 24 nt, Human
ccgggacaaccgccgccgccgccg

SEQ ID NO: 201813 - RNA, 21 nt, Human
cgcggucccacgggccgcccu

SEQ ID NO: 201814 - RNA, 23 nt, Human
cugaucuauuuccccaguaacau

SEQ ID NO: 201815 - RNA, 21 nt, Human
cuggagcccucgguuuugcac

SEQ ID NO: 201816 - RNA, 22 nt, Human
cuuaauauuagccaauuuuaau

SEQ ID NO: 201817 - RNA, 18 nt, Human
gaggaggccggcagggcc

SEQ ID NO: 201818 - RNA, 19 nt, Human
gcccgcgccggacccggcc

SEQ ID NO: 201819 - RNA, 20 nt, Human
gcgccggacccggccgcagc

SEQ ID NO: 201820 - RNA, 19 nt, Human
gcgcgcgccgcccgcgccg

SEQ ID NO: 201821 - RNA, 18 nt, Human
gcucgacgcggcccgggc

SEQ ID NO: 201822 - RNA, 24 nt, Human
gcugaucuauuuccccaguaacau

SEQ ID NO: 201823 - RNA, 18 nt, Human
ggagccgggcagcgcugc

SEQ ID NO: 201824 - RNA, 26 nt, Human
ggccgcagcggcuuggcuguacuggg

SEQ ID NO: 201825 - RNA, 21 nt, Human
gggccgggagccgggcagcgc

SEQ ID NO: 201826 - RNA, 18 nt, Human
gugaaacaagacaacagu

SEQ ID NO: 201827 - RNA, 23 nt, Human
uagaagagcucuuuagaaaggaa

SEQ ID NO: 201828 - RNA, 22 nt, Human
ucaccugcaaacuguagcaaaa

SEQ ID NO: 201829 - RNA, 25 nt, Human
ucagugaaacaagacaacagugcaa

SEQ ID NO: 201830 - RNA, 20 nt, Human
ucugcgcgcgccgcccgcgg

SEQ ID NO: 201831 - RNA, 22 nt, Human
ugacagcaccuuaaaaguggcu

SEQ ID NO: 201832 - RNA, 20 nt, Human
uuaaagcuaagaucagugaa

SEQ ID NO: 201833 - RNA, 19 nt, Human
uuccccaguaacauuucuc

SEQ ID NO: 201834 - RNA, 23 nt, Human
uucuuuuuuuuuuuuuuuauuuu

SEQ ID NO: 201835 - RNA, 22 nt, Human
uuuaaagacuucucuuguguuu

SEQ ID NO: 201836 - RNA, 21 nt, Human
accuuccucugguccuugcug

SEQ ID NO: 201837 - RNA, 20 nt, Human
agcugccucugcggcaaugu

SEQ ID NO: 201838 - RNA, 19 nt, Human
aggcagggggagguacacc

SEQ ID NO: 201839 - RNA, 18 nt, Human
ccucugguccuugcugcc

SEQ ID NO: 201840 - RNA, 24 nt, Human
ccucugguccuugcugccuggcuc

SEQ ID NO: 201841 - RNA, 21 nt, Human
cggacaggcagcacuggcucc

SEQ ID NO: 201842 - RNA, 18 nt, Human
cucuguccaccuuccucu

SEQ ID NO: 201843 - RNA, 19 nt, Human
cucuguccaccuuccucug

SEQ ID NO: 201844 - RNA, 23 nt, Human
cuuccucugguccuugcugccug

SEQ ID NO: 201845 - RNA, 21 nt, Human
cuuucggucucuguccaccuu

SEQ ID NO: 201846 - RNA, 20 nt, Human
gggguuggaaggcaggggga

SEQ ID NO: 201847 - RNA, 21 nt, Human
gucccuuugggguuggucucu

SEQ ID NO: 201848 - RNA, 19 nt, Human
guuggucucuuuuuuucuc

SEQ ID NO: 201849 - RNA, 18 nt, Human
uccaccuuccucuggucc

SEQ ID NO: 201850 - RNA, 19 nt, Human
ucccuuugggguuggucuc

SEQ ID NO: 201851 - RNA, 25 nt, Human
uccuuuguccuuucggucucugucc

SEQ ID NO: 201852 - RNA, 18 nt, Human
ucucuguccaccuuccuc

SEQ ID NO: 201853 - RNA, 23 nt, Human
ucucuuuuuuucucugugucucu

SEQ ID NO: 201854 - RNA, 24 nt, Human
ucuuuuuuucucugugucucuccu

SEQ ID NO: 201855 - RNA, 19 nt, Human
ugccuggcucuggacaccc

SEQ ID NO: 201856 - RNA, 20 nt, Human
ugcugccuggcucuggacac

SEQ ID NO: 201857 - RNA, 20 nt, Human
uggaaagggguuggaaggca

SEQ ID NO: 201858 - RNA, 28 nt, Human
uggaaagggguuggaaggcagggggagg

SEQ ID NO: 201859 - RNA, 18 nt, Human
ugucucuccuuuguccuu

SEQ ID NO: 201860 - RNA, 22 nt, Human
uuuucucugugucucuccuuug

SEQ ID NO: 201861 - RNA, 19 nt, Human
aggaaagaaggagauucug

SEQ ID NO: 201862 - RNA, 23 nt, Human
auuuuauuuauguuucuaauuca

SEQ ID NO: 201863 - RNA, 23 nt, Human
gaaggagauucugaguggcauag

SEQ ID NO: 201864 - RNA, 20 nt, Human
gagauucugaguggcauaga

SEQ ID NO: 201865 - RNA, 23 nt, Human
gcccagguauagcccaagcagua

SEQ ID NO: 201866 - RNA, 20 nt, Human
guucuuuccucuccuuucca

SEQ ID NO: 201867 - RNA, 23 nt, Human
guucuuuccucuccuuuccauuu

SEQ ID NO: 201868 - RNA, 25 nt, Human
uaauaggcagcacugaguucuuucc

SEQ ID NO: 201869 - RNA, 19 nt, Human
uagaguuaaguccaggaaa

SEQ ID NO: 201870 - RNA, 22 nt, Human
uaggcagcacugaguucuuucc

SEQ ID NO: 201871 - RNA, 21 nt, Human
uauagcccaagcaguaacaga

SEQ ID NO: 201872 - RNA, 22 nt, Human
ugaaaagaacuguaauuuucac

SEQ ID NO: 201873 - RNA, 19 nt, Human
ugacagaauuaacuacuaa

SEQ ID NO: 201874 - RNA, 22 nt, Human
uggcauagauuugucucaagug

SEQ ID NO: 201875 - RNA, 24 nt, Human
uggugagugacagaauuaacuacc

SEQ ID NO: 201876 - RNA, 22 nt, Human
uuuuuaguuucaauaccauacu

SEQ ID NO: 201877 - RNA, 21 nt, Human
aaaaaguaaauccuuuugaaa

SEQ ID NO: 201878 - RNA, 21 nt, Human
aaaaauauggcauucugcccc

SEQ ID NO: 201879 - RNA, 21 nt, Human
aaaaaugcacuugguuccuuc

SEQ ID NO: 201880 - RNA, 21 nt, Human
aaaauacaaaacaucagcuug

SEQ ID NO: 201881 - RNA, 20 nt, Human
aaacacaacagaacucacag

SEQ ID NO: 201882 - RNA, 24 nt, Human
aaacaucuucuuaguccaagagac

SEQ ID NO: 201883 - RNA, 23 nt, Human
aaaccaaagagaaagcccauauc

SEQ ID NO: 201884 - RNA, 19 nt, Human
aacaaugguuucugaccug

SEQ ID NO: 201885 - RNA, 22 nt, Human
aacacaacagaacucacagaua

SEQ ID NO: 201886 - RNA, 18 nt, Human
aagaggaacacaaaauac

SEQ ID NO: 201887 - RNA, 22 nt, Human
aagaggaacacaaaauacaaaa

SEQ ID NO: 201888 - RNA, 24 nt, Human
aaguaagugggacuacaggcaugc

SEQ ID NO: 201889 - RNA, 22 nt, Human
aauaagcugaaaccccagagga

SEQ ID NO: 201890 - RNA, 21 nt, Human
acaaccagauugcaacauaaa

SEQ ID NO: 201891 - RNA, 23 nt, Human
acagcaacuauuggcauggauaa

SEQ ID NO: 201892 - RNA, 22 nt, Human
accagauugcaacauaaacacc

SEQ ID NO: 201893 - RNA, 18 nt, Human
accgccaucugcuguucu

SEQ ID NO: 201894 - RNA, 23 nt, Human
accucagccucucaacaugcugg

SEQ ID NO: 201895 - RNA, 20 nt, Human
acuccaugugcuauacauau

SEQ ID NO: 201896 - RNA, 23 nt, Human
acuggucuugaacuccuggccuc

SEQ ID NO: 201897 - RNA, 20 nt, Human
agaacuuuccaaacuaccaa

SEQ ID NO: 201898 - RNA, 18 nt, Human
agacaagguuucuccaua

SEQ ID NO: 201899 - RNA, 19 nt, Human
agcaggagaguuccaccca

SEQ ID NO: 201900 - RNA, 23 nt, Human
agcgauucucgugccucggccuc

SEQ ID NO: 201901 - RNA, 24 nt, Human
agcgauucucgugccucggccucc

SEQ ID NO: 201902 - RNA, 19 nt, Human
aggaacacaaaauacaaaa

SEQ ID NO: 201903 - RNA, 21 nt, Human
aggaacacaaaauacaaaaca

SEQ ID NO: 201904 - RNA, 21 nt, Human
aggaugccuuuugccaccacu

SEQ ID NO: 201905 - RNA, 25 nt, Human
aggcuggagugcaguggcgugaucu

SEQ ID NO: 201906 - RNA, 18 nt, Human
aguacagcccucaaaaau

SEQ ID NO: 201907 - RNA, 23 nt, Human
agugcaguggcgugaucuuggcu

SEQ ID NO: 201908 - RNA, 24 nt, Human
agugcaguggcgugaucuuggcuc

SEQ ID NO: 201909 - RNA, 24 nt, Human
augaucugcccaccucagccucuc

SEQ ID NO: 201910 - RNA, 24 nt, Human
augugaugagaaaccaaagagaaa

SEQ ID NO: 201911 - RNA, 22 nt, Human
auucucucucucuuuucgggcc

SEQ ID NO: 201912 - RNA, 18 nt, Human
auuuuguugcauccccuc

SEQ ID NO: 201913 - RNA, 24 nt, Human
auuuuuguguuuuuaguagagaca

SEQ ID NO: 201914 - RNA, 20 nt, Human
caaacacaacagaacucacc

SEQ ID NO: 201915 - RNA, 18 nt, Human
caacaugcugggauuaua

SEQ ID NO: 201916 - RNA, 23 nt, Human
caaccuccaccucccggguucaa

SEQ ID NO: 201917 - RNA, 28 nt, Human
caagcgauucucgugccucggccuccca

SEQ ID NO: 201918 - RNA, 21 nt, Human
caccuugcugaaccucaauuu

SEQ ID NO: 201919 - RNA, 26 nt, Human
cacucccuuuuuaaucgagucagaag

SEQ ID NO: 201920 - RNA, 24 nt, Human
cagagucuugcucuguugcccagg

SEQ ID NO: 201921 - RNA, 20 nt, Human
cagauugcaacauaaacacc

SEQ ID NO: 201922 - RNA, 22 nt, Human
cagauugcaacauaaacaccaa

SEQ ID NO: 201923 - RNA, 24 nt, Human
cauauuggccagacuggucuugaa

SEQ ID NO: 201924 - RNA, 24 nt, Human
caugcugggauuauaggcuugagc

SEQ ID NO: 201925 - RNA, 20 nt, Human
caugugcuauacauauugug

SEQ ID NO: 201926 - RNA, 24 nt, Human
ccaccucccggguucaagcgauuc

SEQ ID NO: 201927 - RNA, 24 nt, Human
cccaaguaagugggacuacaggca

SEQ ID NO: 201928 - RNA, 19 nt, Human
cccaccucagccucucaac

SEQ ID NO: 201929 - RNA, 21 nt, Human
cccggccaaaagggcacauuu

SEQ ID NO: 201930 - RNA, 20 nt, Human
cccggguucaagcgauucuc

SEQ ID NO: 201931 - RNA, 20 nt, Human
cccggguucaagcgauucuc

SEQ ID NO: 201932 - RNA, 20 nt, Human
ccggccaaaagggcacauuu

SEQ ID NO: 201933 - RNA, 22 nt, Human
ccuaaacuccccccguuuugaa

SEQ ID NO: 201934 - RNA, 18 nt, Human
ccuaugucuuuacuaguu

SEQ ID NO: 201935 - RNA, 21 nt, Human
ccucagucuguuaucugccau

SEQ ID NO: 201936 - RNA, 22 nt, Human
ccucccggguucaagcgauucu

SEQ ID NO: 201937 - RNA, 24 nt, Human
ccuggccucaaaugaucugcccac

SEQ ID NO: 201938 - RNA, 27 nt, Human
ccuuuugccaccacuuuuuuaauagcc

SEQ ID NO: 201939 - RNA, 24 nt, Human
cggcaaccuccaccucccggguuc

SEQ ID NO: 201940 - RNA, 24 nt, Human
cgggauuaaagucuccuaaacucc

SEQ ID NO: 201941 - RNA, 18 nt, Human
cuacaauaagcugaaacc

SEQ ID NO: 201942 - RNA, 24 nt, Human
cucaaaugaucugcccaccucagc

SEQ ID NO: 201943 - RNA, 24 nt, Human
cucaacaugcugggauuauaggcu

SEQ ID NO: 201944 - RNA, 19 nt, Human
cucacagauaaaaaugcac

SEQ ID NO: 201945 - RNA, 22 nt, Human
cucacggcaaccuccaccuccc

SEQ ID NO: 201946 - RNA, 24 nt, Human
cucacggcaaccuccaccucccgg

SEQ ID NO: 201947 - RNA, 27 nt, Human
cuccuggccucaaaugaucugcccacc

SEQ ID NO: 201948 - RNA, 19 nt, Human
cucucucucuuuuauuuuu

SEQ ID NO: 201949 - RNA, 23 nt, Human
cugaaaccccagaggaucuguac

SEQ ID NO: 201950 - RNA, 23 nt, Human
cuuuuuaucucuguaauugaagg

SEQ ID NO: 201951 - RNA, 24 nt, Human
gacuacaggcaugccccaccaugc

SEQ ID NO: 201952 - RNA, 24 nt, Human
gacuggucuugaacuccuggccuc

SEQ ID NO: 201953 - RNA, 27 nt, Human
gaucaccgccaucugcuguucuucuau

SEQ ID NO: 201954 - RNA, 18 nt, Human
gccaaaggaaauuugggg

SEQ ID NO: 201955 - RNA, 24 nt, Human
gcccaggcuggagugcaguggcgu

SEQ ID NO: 201956 - RNA, 25 nt, Human
gcucuguugcccaggcuggagugca

SEQ ID NO: 201957 - RNA, 19 nt, Human
gcuggagugcaguggcgug

SEQ ID NO: 201958 - RNA, 24 nt, Human
ggccucaaaugaucugcccaccuc

SEQ ID NO: 201959 - RNA, 22 nt, Human
ggcuggagugcaguggcgugau

SEQ ID NO: 201960 - RNA, 18 nt, Human
gugcuauacauauugugg

SEQ ID NO: 201961 - RNA, 23 nt, Human
uaaacaccaaguaaaacuacaug

SEQ ID NO: 201962 - RNA, 19 nt, Human
uaaaccuaguacagcccuc

SEQ ID NO: 201963 - RNA, 28 nt, Human
uaaaugagauaaaccuaguacagcccuc

SEQ ID NO: 201964 - RNA, 23 nt, Human
uaagagggcacauuguuaaaaua

SEQ ID NO: 201965 - RNA, 24 nt, Human
uaauuuuuguguuuuuaguagaga

SEQ ID NO: 201966 - RNA, 24 nt, Human
uacaggcaugccccaccaugccca

SEQ ID NO: 201967 - RNA, 24 nt, Human
uagcuaugugaccuuggguaccuc

SEQ ID NO: 201968 - RNA, 24 nt, Human
uaguagagacaagguuucuccaua

SEQ ID NO: 201969 - RNA, 18 nt, Human
uauuucauuucucuuucu

SEQ ID NO: 201970 - RNA, 25 nt, Human
uauuuuuuuuuuugagacagagucu

SEQ ID NO: 201971 - RNA, 23 nt, Human
ucaagaguccuuuucaauucucc

SEQ ID NO: 201972 - RNA, 22 nt, Human
ucaaucacuugacucggaaagc

SEQ ID NO: 201973 - RNA, 19 nt, Human
ucaaucucucugcugauca

SEQ ID NO: 201974 - RNA, 24 nt, Human
ucacggcaaccuccaccucccggg

SEQ ID NO: 201975 - RNA, 22 nt, Human
uccauauuggccagacuggucu

SEQ ID NO: 201976 - RNA, 18 nt, Human
uccauuccaggagggcuc

SEQ ID NO: 201977 - RNA, 24 nt, Human
ucccaaguaagugggacuacaggc

SEQ ID NO: 201978 - RNA, 21 nt, Human
ucccggguucaagcgauucuc

SEQ ID NO: 201979 - RNA, 21 nt, Human
ucccggguucaagcgauucuc

SEQ ID NO: 201980 - RNA, 18 nt, Human
uccuuguuggacaucaua

SEQ ID NO: 201981 - RNA, 24 nt, Human
ucucaacaugcugggauuauaggc

SEQ ID NO: 201982 - RNA, 21 nt, Human
ucucaaggugaccccuggaag

SEQ ID NO: 201983 - RNA, 28 nt, Human
ucuccuaaacuccccccguuuugaacaa

SEQ ID NO: 201984 - RNA, 21 nt, Human
ucugcuuccuccucaaaguuc

SEQ ID NO: 201985 - RNA, 18 nt, Human
ucuguugcccaggcugga

SEQ ID NO: 201986 - RNA, 24 nt, Human
ucuguugcccaggcuggagugcag

SEQ ID NO: 201987 - RNA, 22 nt, Human
ucuucugaacaaugguuucuga

SEQ ID NO: 201988 - RNA, 19 nt, Human
ucuugaacuccuggccuca

SEQ ID NO: 201989 - RNA, 22 nt, Human
ucuugcucuguugcccaggcug

SEQ ID NO: 201990 - RNA, 23 nt, Human
ucuugcucuguugcccaggcugg

SEQ ID NO: 201991 - RNA, 24 nt, Human
ucuugcucuguugcccaggcugga

SEQ ID NO: 201992 - RNA, 22 nt, Human
ugaaaagacauuuacaaaugug

SEQ ID NO: 201993 - RNA, 23 nt, Human
ugaccuggaaacagaccagcugc

SEQ ID NO: 201994 - RNA, 19 nt, Human
ugagaagggauagccccug

SEQ ID NO: 201995 - RNA, 18 nt, Human
ugagacagagucuugcuc

SEQ ID NO: 201996 - RNA, 22 nt, Human
ugagacagagucuugcucuguu

SEQ ID NO: 201997 - RNA, 24 nt, Human
ugaggcucccauaguuccugagga

SEQ ID NO: 201998 - RNA, 24 nt, Human
ugaucugcccaccucagccucuca

SEQ ID NO: 201999 - RNA, 19 nt, Human
ugcaaagaggaacacaaaa

SEQ ID NO: 202000 - RNA, 18 nt, Human
ugcccaggcuggagugca

SEQ ID NO: 202001 - RNA, 21 nt, Human
ugcccaggcuggagugcagug

SEQ ID NO: 202002 - RNA, 22 nt, Human
ugcccaggcuggagugcagugg

SEQ ID NO: 202003 - RNA, 24 nt, Human
ugcccaggcuggagugcaguggcg

SEQ ID NO: 202004 - RNA, 22 nt, Human
ugcuacaauaagcugaaacccc

SEQ ID NO: 202005 - RNA, 24 nt, Human
ugcucuguugcccaggcuggagug

SEQ ID NO: 202006 - RNA, 19 nt, Human
ugcugaaccucaauuugcu

SEQ ID NO: 202007 - RNA, 19 nt, Human
uggagugcaguggcgugau

SEQ ID NO: 202008 - RNA, 23 nt, Human
uggagugcaguggcgugaucuug

SEQ ID NO: 202009 - RNA, 24 nt, Human
uggagugcaguggcgugaucuugg

SEQ ID NO: 202010 - RNA, 24 nt, Human
uggccagacuggucuugaacuccu

SEQ ID NO: 202011 - RNA, 18 nt, Human
uggccucaaaugaucugc

SEQ ID NO: 202012 - RNA, 24 nt, Human
ugggacuacaggcaugccccacca

SEQ ID NO: 202013 - RNA, 25 nt, Human
ugggacuacaggcaugccccaccau

SEQ ID NO: 202014 - RNA, 18 nt, Human
ugggauuauaggcuugag

SEQ ID NO: 202015 - RNA, 22 nt, Human
ugggauuauaggcuugagcuac

SEQ ID NO: 202016 - RNA, 24 nt, Human
ugggauuauaggcuugagcuacca

SEQ ID NO: 202017 - RNA, 25 nt, Human
ugggauuauaggcuugagcuaccau

SEQ ID NO: 202018 - RNA, 21 nt, Human
uggguaccucucucaccuuuu

SEQ ID NO: 202019 - RNA, 23 nt, Human
ugugaccuuggguaccucucuca

SEQ ID NO: 202020 - RNA, 22 nt, Human
ugugggguguuguggggcuuaa

SEQ ID NO: 202021 - RNA, 23 nt, Human
uguguuuuuaguagagacaaggu

SEQ ID NO: 202022 - RNA, 18 nt, Human
uuagaaaauuacccuccu

SEQ ID NO: 202023 - RNA, 24 nt, Human
uuaguagagacaagguuucuccau

SEQ ID NO: 202024 - RNA, 21 nt, Human
uucaagcgauucucgugccuc

SEQ ID NO: 202025 - RNA, 24 nt, Human
uugcccaggcuggagugcaguggc

SEQ ID NO: 202026 - RNA, 24 nt, Human
uugcucuguugcccaggcuggagu

SEQ ID NO: 202027 - RNA, 22 nt, Human
uuggacaucauaaggaucauuu

SEQ ID NO: 202028 - RNA, 18 nt, Human
uuucaaaacaucuucuua

SEQ ID NO: 202029 - RNA, 23 nt, Human
uuuccagggugguucagacacug

SEQ ID NO: 202030 - RNA, 24 nt, Human
uuuugaaaagacauuuacaaaugu

SEQ ID NO: 202031 - RNA, 20 nt, Human
uuuuuguguuuuuaguagag

SEQ ID NO: 202032 - RNA, 20 nt, Human
uuuuuuuuuuugagacagag

SEQ ID NO: 202033 - RNA, 23 nt, Human
uuuuuuuuuuugagacagagucu

SEQ ID NO: 202034 - RNA, 21 nt, Human
aagcaaggccucgaagccagg

SEQ ID NO: 202035 - RNA, 23 nt, Human
accagcaccaccuaaacagcagc

SEQ ID NO: 202036 - RNA, 25 nt, Human
agauccaaaauguguccaguuuuuu

SEQ ID NO: 202037 - RNA, 21 nt, Human
agcugugcggcccuugccaag

SEQ ID NO: 202038 - RNA, 20 nt, Human
aguuuuuuuuuuuuuuuuuu

SEQ ID NO: 202039 - RNA, 20 nt, Human
auucccaucaguagcauccc

SEQ ID NO: 202040 - RNA, 23 nt, Human
caaccacuggacuccaagcuccc

SEQ ID NO: 202041 - RNA, 24 nt, Human
caacuaugccaaccacuggacucc

SEQ ID NO: 202042 - RNA, 20 nt, Human
cagcaccaccuaaacagcag

SEQ ID NO: 202043 - RNA, 24 nt, Human
caguagcauccccucccauugccc

SEQ ID NO: 202044 - RNA, 19 nt, Human
ccaccuaaacagcagcucc

SEQ ID NO: 202045 - RNA, 21 nt, Human
ccacuggacuccaagcuccca

SEQ ID NO: 202046 - RNA, 18 nt, Human
ccccugaagagcuagcuu

SEQ ID NO: 202047 - RNA, 18 nt, Human
ccccugaagagcuagcuu

SEQ ID NO: 202048 - RNA, 21 nt, Human
ccccugaagagcuagcuuccu

SEQ ID NO: 202049 - RNA, 22 nt, Human
cccggggcugggguaggucucc

SEQ ID NO: 202050 - RNA, 23 nt, Human
ccuucuaagguguugggaaugaa

SEQ ID NO: 202051 - RNA, 19 nt, Human
cuagaaauaaauuaagcaa

SEQ ID NO: 202052 - RNA, 19 nt, Human
cuccauagcuggugccugc

SEQ ID NO: 202053 - RNA, 19 nt, Human
cuggugccugcucccaucu

SEQ ID NO: 202054 - RNA, 24 nt, Human
cuucccagguuuugcauagaaucc

SEQ ID NO: 202055 - RNA, 21 nt, Human
cuuccucccggggcuggggua

SEQ ID NO: 202056 - RNA, 24 nt, Human
cuucuaagguguugggaaugaaua

SEQ ID NO: 202057 - RNA, 20 nt, Human
gaaaagcaaggccucgaagc

SEQ ID NO: 202058 - RNA, 23 nt, Human
gcuccuuuuaaaagggagcuaag

SEQ ID NO: 202059 - RNA, 18 nt, Human
ggccaggggguggggaag

SEQ ID NO: 202060 - RNA, 20 nt, Human
gugauggagucaaguacugg

SEQ ID NO: 202061 - RNA, 25 nt, Human
guuuuuuuuuuuuuuuuuuuuuggc

SEQ ID NO: 202062 - RNA, 23 nt, Human
uagcauccccucccauugccccc

SEQ ID NO: 202063 - RNA, 24 nt, Human
uccaagcucccaacagauccaaaa

SEQ ID NO: 202064 - RNA, 18 nt, Human
uccccucccauugccccc

SEQ ID NO: 202065 - RNA, 21 nt, Human
uccccugaagagcuagcuucc

SEQ ID NO: 202066 - RNA, 20 nt, Human
uccccugaucagggccccug

SEQ ID NO: 202067 - RNA, 21 nt, Human
ucuccauagcuggugccugcu

SEQ ID NO: 202068 - RNA, 19 nt, Human
ucucuggagucaguggagg

SEQ ID NO: 202069 - RNA, 20 nt, Human
ugcgugauggagucaaguac

SEQ ID NO: 202070 - RNA, 23 nt, Human
ugggacucuacggcucagucccc

SEQ ID NO: 202071 - RNA, 26 nt, Human
uguguccaguuuuuuuuuuuuuuuuu

SEQ ID NO: 202072 - RNA, 26 nt, Human
uuccuagaacauaaaccagcaccacc

SEQ ID NO: 202073 - RNA, 18 nt, Human
uugcuucuucucugcucc

SEQ ID NO: 202074 - RNA, 21 nt, Human
uugcuucuucucugcucccaa

SEQ ID NO: 202075 - RNA, 20 nt, Human
uuuuuuuuggccagggggug

SEQ ID NO: 202076 - RNA, 18 nt, Human
uuuuuuuuuuuuuuuuug

SEQ ID NO: 202077 - RNA, 25 nt, Human
uuuuuuuuuuuuuuuuuggccaggg

SEQ ID NO: 202078 - RNA, 18 nt, Human
aacccgugaccacgucuc

SEQ ID NO: 202079 - RNA, 19 nt, Human
acaccuggaaacacagccu

SEQ ID NO: 202080 - RNA, 18 nt, Human
accacuaacauaggaggu

SEQ ID NO: 202081 - RNA, 18 nt, Human
acuggcacagcccugugc

SEQ ID NO: 202082 - RNA, 18 nt, Human
agagggcagacacugggc

SEQ ID NO: 202083 - RNA, 19 nt, Human
agguggggacagucacugu

SEQ ID NO: 202084 - RNA, 24 nt, Human
cacaacuguacuaucccaugcaga

SEQ ID NO: 202085 - RNA, 22 nt, Human
caccuuagcucgcacgcugagc

SEQ ID NO: 202086 - RNA, 18 nt, Human
cagcccagcucagagcca

SEQ ID NO: 202087 - RNA, 19 nt, Human
cagcggggguggccacggc

SEQ ID NO: 202088 - RNA, 22 nt, Human
caggagccugagccaccgcccu

SEQ ID NO: 202089 - RNA, 23 nt, Human
ccacgggucggcacugugggcac

SEQ ID NO: 202090 - RNA, 20 nt, Human
ccacuaacauaggagguggg

SEQ ID NO: 202091 - RNA, 21 nt, Human
ccaggugcaacuugguuugcu

SEQ ID NO: 202092 - RNA, 22 nt, Human
cccucaacccgcgcaagcgcag

SEQ ID NO: 202093 - RNA, 22 nt, Human
ccuacacgccacuggcacagcc

SEQ ID NO: 202094 - RNA, 21 nt, Human
cggcagcuccugccgagccca

SEQ ID NO: 202095 - RNA, 22 nt, Human
cucauaacugcugauuuauuuc

SEQ ID NO: 202096 - RNA, 24 nt, Human
cugaacccgugaccacgucuccug

SEQ ID NO: 202097 - RNA, 21 nt, Human
cugagccagggcaguguuccc

SEQ ID NO: 202098 - RNA, 18 nt, Human
gaacauggagcuccgacc

SEQ ID NO: 202099 - RNA, 22 nt, Human
gaccuagaccuagcuuaggaac

SEQ ID NO: 202100 - RNA, 18 nt, Human
gagauguggggucuuguc

SEQ ID NO: 202101 - RNA, 21 nt, Human
gaguuccgcguccacaccgcc

SEQ ID NO: 202102 - RNA, 27 nt, Human
gcauacaucaccaccuuagcucgcacg

SEQ ID NO: 202103 - RNA, 21 nt, Human
gccugagccaccgcccucaac

SEQ ID NO: 202104 - RNA, 20 nt, Human
gcuuguguucaucaccccuc

SEQ ID NO: 202105 - RNA, 22 nt, Human
gggugaacaccuggaaacacag

SEQ ID NO: 202106 - RNA, 23 nt, Human
gucuccuguauggacagggacug

SEQ ID NO: 202107 - RNA, 24 nt, Human
uaucccaugcagagucccaucgca

SEQ ID NO: 202108 - RNA, 23 nt, Human
ucaucaccccucaagauaugcac

SEQ ID NO: 202109 - RNA, 23 nt, Human
uccacaccgccagcgcggagggg

SEQ ID NO: 202110 - RNA, 21 nt, Human
uccaggagccugagccaccgc

SEQ ID NO: 202111 - RNA, 18 nt, Human
ucccuacacgccacuggc

SEQ ID NO: 202112 - RNA, 19 nt, Human
ucccuacacgccacuggca

SEQ ID NO: 202113 - RNA, 21 nt, Human
ucccuacacgccacuggcaca

SEQ ID NO: 202114 - RNA, 20 nt, Human
uccgcguccacaccgccagc

SEQ ID NO: 202115 - RNA, 20 nt, Human
uccgcugaguuccgcgucca

SEQ ID NO: 202116 - RNA, 21 nt, Human
ucuacacaacuguacuauccc

SEQ ID NO: 202117 - RNA, 27 nt, Human
ugcagagucccaucgcauacaucacca

SEQ ID NO: 202118 - RNA, 20 nt, Human
ugccgagcccaagcguguuu

SEQ ID NO: 202119 - RNA, 23 nt, Human
uggaagugacagcccagcucaga

SEQ ID NO: 202120 - RNA, 25 nt, Human
uucaucaccccucaagauaugcaca

SEQ ID NO: 202121 - RNA, 20 nt, Human
aaaacacagucacgaugugc

SEQ ID NO: 202122 - RNA, 27 nt, Human
aaacacagucacgaugugcccucccca

SEQ ID NO: 202123 - RNA, 19 nt, Human
aacacagucacgaugugcc

SEQ ID NO: 202124 - RNA, 21 nt, Human
aguuaugaaaaacacagucac

SEQ ID NO: 202125 - RNA, 21 nt, Human
cacagucacgaugugcccucc

SEQ ID NO: 202126 - RNA, 21 nt, Human
ccagcccaggccccuaaaacc

SEQ ID NO: 202127 - RNA, 22 nt, Human
cccagcccaggccccuaaaacc

SEQ ID NO: 202128 - RNA, 18 nt, Human
ccccauccccccagccca

SEQ ID NO: 202129 - RNA, 22 nt, Human
ccccauccccccagcccaggcc

SEQ ID NO: 202130 - RNA, 25 nt, Human
cccccagcccaggccccuaaaaccc

SEQ ID NO: 202131 - RNA, 19 nt, Human
ccccccagcccaggccccu

SEQ ID NO: 202132 - RNA, 20 nt, Human
ccccccagcccaggccccua

SEQ ID NO: 202133 - RNA, 18 nt, Human
ccccugggcucgugcagg

SEQ ID NO: 202134 - RNA, 18 nt, Human
ccuaggaacgcucagccc

SEQ ID NO: 202135 - RNA, 21 nt, Human
cgggagggagggagaggaagg

SEQ ID NO: 202136 - RNA, 24 nt, Human
gagggagggagaggaagggggagc

SEQ ID NO: 202137 - RNA, 24 nt, Human
gccccuaaaacccccuucugcggg

SEQ ID NO: 202138 - RNA, 23 nt, Human
ggagaggaagggggagccccgaa

SEQ ID NO: 202139 - RNA, 23 nt, Human
uaaaugcaaccauauaaaaacau

SEQ ID NO: 202140 - RNA, 19 nt, Human
uccccccagcccaggcccc

SEQ ID NO: 202141 - RNA, 27 nt, Human
uccccccagcccaggccccuaaaaccc

SEQ ID NO: 202142 - RNA, 23 nt, Human
ugcccuccccauccccccagccc

SEQ ID NO: 202143 - RNA, 24 nt, Human
ugcccuccccauccccccagccca

SEQ ID NO: 202144 - RNA, 19 nt, Human
ugggcucgugcagggcggg

SEQ ID NO: 202145 - RNA, 24 nt, Human
aaaaaagaaaucucguguaaaaaa

SEQ ID NO: 202146 - RNA, 21 nt, Human
aaaacgaaaugucaucugagc

SEQ ID NO: 202147 - RNA, 21 nt, Human
aaaguaaccacuuaaucaaaa

SEQ ID NO: 202148 - RNA, 20 nt, Human
aaauaaacuuccccaaagga

SEQ ID NO: 202149 - RNA, 18 nt, Human
agagguagacgggggauu

SEQ ID NO: 202150 - RNA, 23 nt, Human
agcauuuucaaacaucuuuggca

SEQ ID NO: 202151 - RNA, 18 nt, Human
aggagagagguagacggg

SEQ ID NO: 202152 - RNA, 22 nt, Human
aggaggagggguggccugagcc

SEQ ID NO: 202153 - RNA, 24 nt, Human
agguagacgggggauuccgcuguu

SEQ ID NO: 202154 - RNA, 26 nt, Human
augaacauauaaaauauauacaaaua

SEQ ID NO: 202155 - RNA, 23 nt, Human
cagcucucucuacaaaaaguaac

SEQ ID NO: 202156 - RNA, 23 nt, Human
cugagcaagugcugaggguuuau

SEQ ID NO: 202157 - RNA, 22 nt, Human
gggaguuuaggaggaggggugg

SEQ ID NO: 202158 - RNA, 20 nt, Human
ggggaguuuaggaggagggg

SEQ ID NO: 202159 - RNA, 22 nt, Human
uaaaaaaacacaaaguaaccac

SEQ ID NO: 202160 - RNA, 23 nt, Human
uaaccacuuaaucaaaaaagucc

SEQ ID NO: 202161 - RNA, 20 nt, Human
uacagcucucucuacaaaaa

SEQ ID NO: 202162 - RNA, 20 nt, Human
uacuuuuuucuuuuauuaua

SEQ ID NO: 202163 - RNA, 21 nt, Human
uauacaaauauagugcauggu

SEQ ID NO: 202164 - RNA, 20 nt, Human
uccaggaccaaggagagagg

SEQ ID NO: 202165 - RNA, 18 nt, Human
uccuuuuuuuuuuuuuuu

SEQ ID NO: 202166 - RNA, 22 nt, Human
ucucccaguauucaaguuccug

SEQ ID NO: 202167 - RNA, 21 nt, Human
uguuaucagcaccagcuccgg

SEQ ID NO: 202168 - RNA, 24 nt, Human
uuggugaucaguagcgcuguuccu

SEQ ID NO: 202169 - RNA, 22 nt, Human
uuuccuuuuuuuuuuuuuuuuu

SEQ ID NO: 202170 - RNA, 19 nt, Human
uuuuauuuuuggaguucuu

SEQ ID NO: 202171 - RNA, 24 nt, Human
uuuucucaaauaaacuuccccaaa

SEQ ID NO: 202172 - RNA, 23 nt, Human
uuuuuuuuugccuuuacuuuuuu

SEQ ID NO: 202173 - RNA, 19 nt, Human
uuuuuuuuuuuuuuuugcc

SEQ ID NO: 202174 - RNA, 24 nt, Human
uuuuuuuuuuuuuuuuuugccuuu

SEQ ID NO: 202175 - RNA, 20 nt, Human
uuuuuuuuuuuuuuuuuugg

SEQ ID NO: 202176 - RNA, 21 nt, Human
aaaaaagaaaaccacauuugc

SEQ ID NO: 202177 - RNA, 18 nt, Human
aaaaagccaaauuuaaaa

SEQ ID NO: 202178 - RNA, 18 nt, Human
aaaaucauuagaaaccaa

SEQ ID NO: 202179 - RNA, 23 nt, Human
aaacaaaguacacacugccaaac

SEQ ID NO: 202180 - RNA, 21 nt, Human
aaagcuacaaaaacugucuaa

SEQ ID NO: 202181 - RNA, 22 nt, Human
aacagcaacuucucugcuuccu

SEQ ID NO: 202182 - RNA, 21 nt, Human
aacuucagacaaucucaauau

SEQ ID NO: 202183 - RNA, 19 nt, Human
aagaagauuugagcaugug

SEQ ID NO: 202184 - RNA, 18 nt, Human
aagaucacacagcuguaa

SEQ ID NO: 202185 - RNA, 24 nt, Human
aagaugaggaaauugaggcaaaga

SEQ ID NO: 202186 - RNA, 23 nt, Human
aagcacccaauauguuugaaguu

SEQ ID NO: 202187 - RNA, 23 nt, Human
aagcaccuuaguaaaaauagucu

SEQ ID NO: 202188 - RNA, 22 nt, Human
aagccauaaaaucauuagaaac

SEQ ID NO: 202189 - RNA, 18 nt, Human
aagggggaaaaaaaaaaa

SEQ ID NO: 202190 - RNA, 18 nt, Human
aagucaaaauacacaauc

SEQ ID NO: 202191 - RNA, 21 nt, Human
aagucauaaaaguuuaugaau

SEQ ID NO: 202192 - RNA, 20 nt, Human
acaaagcaaaagcagcagag

SEQ ID NO: 202193 - RNA, 20 nt, Human
acaaagcaaaagcagcagag

SEQ ID NO: 202194 - RNA, 22 nt, Human
acaaagcaaaagcagcagaggc

SEQ ID NO: 202195 - RNA, 21 nt, Human
acaaaguacacacugccaaac

SEQ ID NO: 202196 - RNA, 26 nt, Human
acaguaaugcguucuaaagaguucau

SEQ ID NO: 202197 - RNA, 22 nt, Human
accacagcucacuaauggaguc

SEQ ID NO: 202198 - RNA, 22 nt, Human
accccccuucucgccucuccag

SEQ ID NO: 202199 - RNA, 18 nt, Human
acugccucaguccccgac

SEQ ID NO: 202200 - RNA, 18 nt, Human
agaaaccaaugauguugc

SEQ ID NO: 202201 - RNA, 23 nt, Human
agaaagcuacaaaaacugucuaa

SEQ ID NO: 202202 - RNA, 21 nt, Human
agaaagcuccacuccagagga

SEQ ID NO: 202203 - RNA, 26 nt, Human
agaaaggauacuccuaacccacccua

SEQ ID NO: 202204 - RNA, 19 nt, Human
agacuguggagcugagaac

SEQ ID NO: 202205 - RNA, 18 nt, Human
agagagaaaguagugagc

SEQ ID NO: 202206 - RNA, 24 nt, Human
agaugaggaaauugaggcaaagag

SEQ ID NO: 202207 - RNA, 22 nt, Human
agcgaggcaaagagagagcgac

SEQ ID NO: 202208 - RNA, 20 nt, Human
agcuaugcauuugggaacca

SEQ ID NO: 202209 - RNA, 19 nt, Human
agcuggcagaauguuaagg

SEQ ID NO: 202210 - RNA, 22 nt, Human
aggaauuuccaauaggacacau

SEQ ID NO: 202211 - RNA, 19 nt, Human
aggagcugaauuggcagug

SEQ ID NO: 202212 - RNA, 20 nt, Human
aggcaaagagagagcgacag

SEQ ID NO: 202213 - RNA, 21 nt, Human
agggggaaaaaaaaaaucaga

SEQ ID NO: 202214 - RNA, 20 nt, Human
aguugaaaaaaugcuuuauc

SEQ ID NO: 202215 - RNA, 24 nt, Human
aucaaucaagcauugcucaaagca

SEQ ID NO: 202216 - RNA, 18 nt, Human
auuuacagcauuuuccuu

SEQ ID NO: 202217 - RNA, 21 nt, Human
caaagcaaaagcagcagaggc

SEQ ID NO: 202218 - RNA, 23 nt, Human
caaaggcugaaaaaagaaaacca

SEQ ID NO: 202219 - RNA, 20 nt, Human
caaagugcuuucacaugcca

SEQ ID NO: 202220 - RNA, 23 nt, Human
caacacaggcuuaacaguaaugc

SEQ ID NO: 202221 - RNA, 19 nt, Human
caagaacaguaggucugau

SEQ ID NO: 202222 - RNA, 22 nt, Human
caagucaucugcaauaucaaaa

SEQ ID NO: 202223 - RNA, 23 nt, Human
caccccuuucucagucuccagaa

SEQ ID NO: 202224 - RNA, 18 nt, Human
cagcgcgaagcggcugcc

SEQ ID NO: 202225 - RNA, 20 nt, Human
cagcgcgaagcggcugccgg

SEQ ID NO: 202226 - RNA, 18 nt, Human
caggauaaaucugacuaa

SEQ ID NO: 202227 - RNA, 24 nt, Human
caguaaugcguucuaaagaguuca

SEQ ID NO: 202228 - RNA, 24 nt, Human
cauaaaaucauuagaaaccaauga

SEQ ID NO: 202229 - RNA, 24 nt, Human
caucaggaauucagaagcacccaa

SEQ ID NO: 202230 - RNA, 19 nt, Human
cauggagaaacaaauacua

SEQ ID NO: 202231 - RNA, 25 nt, Human
ccaaucaucaggaauucagaagcac

SEQ ID NO: 202232 - RNA, 23 nt, Human
ccagcaaugaaguacaaagcaaa

SEQ ID NO: 202233 - RNA, 21 nt, Human
cccauaaccuuuaaggcaauc

SEQ ID NO: 202234 - RNA, 21 nt, Human
cccccaggcgcuaucaccaac

SEQ ID NO: 202235 - RNA, 25 nt, Human
ccccccuucucgccucuccaguccc

SEQ ID NO: 202236 - RNA, 19 nt, Human
cccccgcgcccgccugcuu

SEQ ID NO: 202237 - RNA, 18 nt, Human
cccccuccaaaagcccgc

SEQ ID NO: 202238 - RNA, 23 nt, Human
ccccuucucgccucuccaguccc

SEQ ID NO: 202239 - RNA, 25 nt, Human
cccgccucccucucuuccuuccuuc

SEQ ID NO: 202240 - RNA, 24 nt, Human
cccucuacugccucaguccccgac

SEQ ID NO: 202241 - RNA, 23 nt, Human
ccgcgcccgccugcuugcccgcc

SEQ ID NO: 202242 - RNA, 21 nt, Human
ccgcugguguccgcuucuccu

SEQ ID NO: 202243 - RNA, 22 nt, Human
ccgcugguguccgcuucuccuc

SEQ ID NO: 202244 - RNA, 21 nt, Human
ccgcuucuccucagccgacua

SEQ ID NO: 202245 - RNA, 19 nt, Human
ccgggcucucgccucccuc

SEQ ID NO: 202246 - RNA, 21 nt, Human
ccucccucuacugccucaguc

SEQ ID NO: 202247 - RNA, 18 nt, Human
ccucccucucuuccuucc

SEQ ID NO: 202248 - RNA, 25 nt, Human
cgccucuccagucccccucccccaa

SEQ ID NO: 202249 - RNA, 24 nt, Human
cgccugcuugcccgccucccucuc

SEQ ID NO: 202250 - RNA, 23 nt, Human
cggcugccgggcucucgccuccc

SEQ ID NO: 202251 - RNA, 21 nt, Human
cgggagcgaggcaaagagaga

SEQ ID NO: 202252 - RNA, 20 nt, Human
cuaaaaaaugagauagacag

SEQ ID NO: 202253 - RNA, 24 nt, Human
cuagaguagagacacaaagaggau

SEQ ID NO: 202254 - RNA, 19 nt, Human
cucaagccaugcucuuugu

SEQ ID NO: 202255 - RNA, 20 nt, Human
cucacaaaaacaaaguacac

SEQ ID NO: 202256 - RNA, 21 nt, Human
cugaaacuuagaacacugaca

SEQ ID NO: 202257 - RNA, 22 nt, Human
cugaaacuuagaacacugacaa

SEQ ID NO: 202258 - RNA, 21 nt, Human
cugaacucaagcagcugcuca

SEQ ID NO: 202259 - RNA, 18 nt, Human
cugaaguucauuucagug

SEQ ID NO: 202260 - RNA, 23 nt, Human
cugguguccgcuucuccucagcc

SEQ ID NO: 202261 - RNA, 22 nt, Human
cuuaacaguaaugcguucuaaa

SEQ ID NO: 202262 - RNA, 23 nt, Human
cuugcccgccucccucucuuccu

SEQ ID NO: 202263 - RNA, 23 nt, Human
gagccgggagcgaggcaaagaga

SEQ ID NO: 202264 - RNA, 24 nt, Human
gagcgggaccccggaggcgagaga

SEQ ID NO: 202265 - RNA, 18 nt, Human
gagcugagaacaaaggug

SEQ ID NO: 202266 - RNA, 20 nt, Human
gaggaaauugaggcaaagag

SEQ ID NO: 202267 - RNA, 18 nt, Human
gagggcagggagagagaa

SEQ ID NO: 202268 - RNA, 19 nt, Human
gcaaaaacauaacagcaac

SEQ ID NO: 202269 - RNA, 18 nt, Human
gcaaagagagagcgacag

SEQ ID NO: 202270 - RNA, 19 nt, Human
gcaaagagagagcgacagc

SEQ ID NO: 202271 - RNA, 19 nt, Human
gcaaaggccacaaagcugc

SEQ ID NO: 202272 - RNA, 26 nt, Human
gcagcgaccccccuucucgccucucc

SEQ ID NO: 202273 - RNA, 20 nt, Human
gccucaguccccgacccccg

SEQ ID NO: 202274 - RNA, 19 nt, Human
gccucuccagucccccucc

SEQ ID NO: 202275 - RNA, 19 nt, Human
gcgggaccccggaggcgag

SEQ ID NO: 202276 - RNA, 21 nt, Human
gcucgggaucaagacauaccg

SEQ ID NO: 202277 - RNA, 20 nt, Human
gggaccccggaggcgagaga

SEQ ID NO: 202278 - RNA, 26 nt, Human
gggaugucaucuguuuuucguccacg

SEQ ID NO: 202279 - RNA, 19 nt, Human
guuguugaaacauggaaga

SEQ ID NO: 202280 - RNA, 19 nt, Human
uaaaauauuuacucucugg

SEQ ID NO: 202281 - RNA, 18 nt, Human
uaaaaugcuuacaguaug

SEQ ID NO: 202282 - RNA, 25 nt, Human
uaaauacaccccuuucucagucucc

SEQ ID NO: 202283 - RNA, 22 nt, Human
uaaauccaaucaucaggaauuc

SEQ ID NO: 202284 - RNA, 21 nt, Human
uaacagcaacuucucugcuuc

SEQ ID NO: 202285 - RNA, 19 nt, Human
uaacuaaaacuucagacaa

SEQ ID NO: 202286 - RNA, 23 nt, Human
uaacuaaaacuucagacaaucuc

SEQ ID NO: 202287 - RNA, 21 nt, Human
uaagcaagucaucugcaauau

SEQ ID NO: 202288 - RNA, 24 nt, Human
uaagugacuugcccaagaucacac

SEQ ID NO: 202289 - RNA, 19 nt, Human
uaaguugacacugaacacu

SEQ ID NO: 202290 - RNA, 19 nt, Human
uacaaauugucauauacac

SEQ ID NO: 202291 - RNA, 21 nt, Human
uaccagcaaugaaguacaaag

SEQ ID NO: 202292 - RNA, 25 nt, Human
uaccuauaaaagucaauuugaaaaa

SEQ ID NO: 202293 - RNA, 18 nt, Human
uacuggguuuguucauua

SEQ ID NO: 202294 - RNA, 19 nt, Human
uacuugacauaaaauuggu

SEQ ID NO: 202295 - RNA, 22 nt, Human
uagaacacugacaaugccagcc

SEQ ID NO: 202296 - RNA, 23 nt, Human
uagaacacugacaaugccagcca

SEQ ID NO: 202297 - RNA, 19 nt, Human
uagaaguauauaaacucuu

SEQ ID NO: 202298 - RNA, 21 nt, Human
uagaauagcuaccauuucuga

SEQ ID NO: 202299 - RNA, 23 nt, Human
uagaaucaaucaagcauugcuca

SEQ ID NO: 202300 - RNA, 19 nt, Human
uagaccugccauaaguuca

SEQ ID NO: 202301 - RNA, 18 nt, Human
uauauauauguauauaua

SEQ ID NO: 202302 - RNA, 21 nt, Human
uauauguauauauauuucaca

SEQ ID NO: 202303 - RNA, 22 nt, Human
uaucaaaaacaagaguaucaga

SEQ ID NO: 202304 - RNA, 21 nt, Human
uaugaauaaugaacuguguau

SEQ ID NO: 202305 - RNA, 22 nt, Human
uauggucaaaauacugaaaaag

SEQ ID NO: 202306 - RNA, 20 nt, Human
uauugugaggaaagggugcu

SEQ ID NO: 202307 - RNA, 18 nt, Human
uauuuuuauauuauugug

SEQ ID NO: 202308 - RNA, 21 nt, Human
ucaagcagcugcucaugaagc

SEQ ID NO: 202309 - RNA, 18 nt, Human
ucagaaauauuuacuuaa

SEQ ID NO: 202310 - RNA, 18 nt, Human
ucaguagagguguauaac

SEQ ID NO: 202311 - RNA, 21 nt, Human
ucaguccagauaaaauauugu

SEQ ID NO: 202312 - RNA, 23 nt, Human
uccaaaagcccgcgcagcaaaca

SEQ ID NO: 202313 - RNA, 20 nt, Human
uccaagaaaucagaaagcuc

SEQ ID NO: 202314 - RNA, 21 nt, Human
uccaagaaaucagaaagcucc

SEQ ID NO: 202315 - RNA, 22 nt, Human
uccccaugcaauaucuuaagug

SEQ ID NO: 202316 - RNA, 20 nt, Human
ucccucucuuccuuccuucc

SEQ ID NO: 202317 - RNA, 18 nt, Human
uccuuguccaguacucau

SEQ ID NO: 202318 - RNA, 21 nt, Human
ucuccagucccccucccccag

SEQ ID NO: 202319 - RNA, 21 nt, Human
ucucuggcccuuccacagaaa

SEQ ID NO: 202320 - RNA, 19 nt, Human
ugaaaaaagaaaaccacau

SEQ ID NO: 202321 - RNA, 23 nt, Human
ugaaaaaagaaaaccacauuugc

SEQ ID NO: 202322 - RNA, 24 nt, Human
ugaaaaaagaaaaccacauuugcc

SEQ ID NO: 202323 - RNA, 25 nt, Human
ugaaaaaaggaaagaaaaaagccaa

SEQ ID NO: 202324 - RNA, 26 nt, Human
ugaaaaaaggaaagaaaaaagccaaa

SEQ ID NO: 202325 - RNA, 19 nt, Human
ugaaaaagcgcaaaggcug

SEQ ID NO: 202326 - RNA, 20 nt, Human
ugaaaacagaaacagcuuuc

SEQ ID NO: 202327 - RNA, 22 nt, Human
ugaaaugacaaaaccaguauuc

SEQ ID NO: 202328 - RNA, 23 nt, Human
ugaaaugacaaaaccaguauucu

SEQ ID NO: 202329 - RNA, 21 nt, Human
ugaaauuacaggauaaaucug

SEQ ID NO: 202330 - RNA, 21 nt, Human
ugaaauuacaggauaaaucug

SEQ ID NO: 202331 - RNA, 24 nt, Human
ugaaguggugcuuuauuuugggcg

SEQ ID NO: 202332 - RNA, 23 nt, Human
ugacaaaaccaguauucugcagg

SEQ ID NO: 202333 - RNA, 24 nt, Human
ugacuagcugugacagagaccgua

SEQ ID NO: 202334 - RNA, 19 nt, Human
ugacucacaaaaacaaagu

SEQ ID NO: 202335 - RNA, 20 nt, Human
ugacuccuuguccaguacuc

SEQ ID NO: 202336 - RNA, 19 nt, Human
ugagaacaaaggugaagac

SEQ ID NO: 202337 - RNA, 20 nt, Human
ugagaacaaaggugaagaca

SEQ ID NO: 202338 - RNA, 21 nt, Human
ugagacaugacucacaaaaac

SEQ ID NO: 202339 - RNA, 24 nt, Human
ugaggaaauugaggcaaagagagg

SEQ ID NO: 202340 - RNA, 21 nt, Human
ugaggcaaagagagguuaagu

SEQ ID NO: 202341 - RNA, 21 nt, Human
ugauggaauuaaauacacccc

SEQ ID NO: 202342 - RNA, 19 nt, Human
ugcccauggucugcaucug

SEQ ID NO: 202343 - RNA, 18 nt, Human
uggagcugagaacaaagg

SEQ ID NO: 202344 - RNA, 22 nt, Human
uggagcugagaacaaaggugaa

SEQ ID NO: 202345 - RNA, 23 nt, Human
uggagugggggagggcagggaga

SEQ ID NO: 202346 - RNA, 30 nt, Human
uguaaaaugaaaacagaaacagcuuucaaa

SEQ ID NO: 202347 - RNA, 20 nt, Human
ugucacaagccauaaaauca

SEQ ID NO: 202348 - RNA, 21 nt, Human
uguccaaacugugccauaaau

SEQ ID NO: 202349 - RNA, 24 nt, Human
uuauaaaguauuaugacuccuagu

SEQ ID NO: 202350 - RNA, 19 nt, Human
uucaaucucuaaaauuccu

SEQ ID NO: 202351 - RNA, 20 nt, Human
uucaucaccaucagggucca

SEQ ID NO: 202352 - RNA, 22 nt, Human
uucuaacagugaacuuccugaa

SEQ ID NO: 202353 - RNA, 26 nt, Human
uucucagucuccagaaaggauacucc

SEQ ID NO: 202354 - RNA, 23 nt, Human
uugacacugaacacugagucagc

SEQ ID NO: 202355 - RNA, 19 nt, Human
uugacuccuuguccaguac

SEQ ID NO: 202356 - RNA, 18 nt, Human
uuuaagggggaaaaaaaa

SEQ ID NO: 202357 - RNA, 25 nt, Human
uuuaggaaauauauauauauaugua

SEQ ID NO: 202358 - RNA, 23 nt, Human
uuucacaugccaucucauuuaau

SEQ ID NO: 202359 - RNA, 22 nt, Human
aaagcaauucuccaaggcccuu

SEQ ID NO: 202360 - RNA, 20 nt, Human
aaaguuguuuucagagacag

SEQ ID NO: 202361 - RNA, 21 nt, Human
aagcaugauuccauugcaugc

SEQ ID NO: 202362 - RNA, 20 nt, Human
acaguguuuuucaagcacag

SEQ ID NO: 202363 - RNA, 18 nt, Human
acccagagcaucuugaag

SEQ ID NO: 202364 - RNA, 19 nt, Human
agaaaggagaaugauucug

SEQ ID NO: 202365 - RNA, 19 nt, Human
agacugaugaaaacuagug

SEQ ID NO: 202366 - RNA, 22 nt, Human
cacaaaguuguuuucagagaca

SEQ ID NO: 202367 - RNA, 18 nt, Human
cagcagaauuaugugcuu

SEQ ID NO: 202368 - RNA, 19 nt, Human
cagggaccgacugcugugu

SEQ ID NO: 202369 - RNA, 23 nt, Human
caucccaccacccagagcaucuu

SEQ ID NO: 202370 - RNA, 19 nt, Human
cccaccacccagagcauua

SEQ ID NO: 202371 - RNA, 20 nt, Human
cccaucccaccacccagagc

SEQ ID NO: 202372 - RNA, 23 nt, Human
cccuuuaugggcagaaaggagaa

SEQ ID NO: 202373 - RNA, 24 nt, Human
cucaaguugggaaagggggcugga

SEQ ID NO: 202374 - RNA, 20 nt, Human
cucccaggaguggccggagg

SEQ ID NO: 202375 - RNA, 22 nt, Human
gaacaugaaagcucguaugagc

SEQ ID NO: 202376 - RNA, 18 nt, Human
gagcugcuguggcccugc

SEQ ID NO: 202377 - RNA, 23 nt, Human
gcagaaaggagaaugauucugga

SEQ ID NO: 202378 - RNA, 20 nt, Human
gcccuugagagcccuuuccu

SEQ ID NO: 202379 - RNA, 23 nt, Human
ggcagaaaggagaaugauucugg

SEQ ID NO: 202380 - RNA, 21 nt, Human
uaaagcaauucuccaaggccc

SEQ ID NO: 202381 - RNA, 19 nt, Human
uacuggacgugccaggagc

SEQ ID NO: 202382 - RNA, 25 nt, Human
ucaaugaauugauaaggucugagga

SEQ ID NO: 202383 - RNA, 22 nt, Human
ucccaggaguggccggaggugc

SEQ ID NO: 202384 - RNA, 23 nt, Human
ucccaggaguggccggaggugcu

SEQ ID NO: 202385 - RNA, 28 nt, Human
ucccaucccaccacccagagcaucuuga

SEQ ID NO: 202386 - RNA, 21 nt, Human
ucucccaucccaccacccaga

SEQ ID NO: 202387 - RNA, 20 nt, Human
ugaagaaaugaagcucagag

SEQ ID NO: 202388 - RNA, 20 nt, Human
ugaagaaaugaagcucagag

SEQ ID NO: 202389 - RNA, 21 nt, Human
ugacagggaccgacugcugug

SEQ ID NO: 202390 - RNA, 21 nt, Human
ugagagcccuuuccuuucgug

SEQ ID NO: 202391 - RNA, 20 nt, Human
ugcuuuuguccacagggagc

SEQ ID NO: 202392 - RNA, 21 nt, Human
uggaauuaacaaggccacucc

SEQ ID NO: 202393 - RNA, 18 nt, Human
uggacaagcaugauucca

SEQ ID NO: 202394 - RNA, 19 nt, Human
ugggaaagggggcuggagc

SEQ ID NO: 202395 - RNA, 22 nt, Human
ugggcagaaaggagaaugauuc

SEQ ID NO: 202396 - RNA, 23 nt, Human
ugggcagaaaggagaaugauucu

SEQ ID NO: 202397 - RNA, 21 nt, Human
uggguggacaaugacagggac

SEQ ID NO: 202398 - RNA, 21 nt, Human
ugguuuauuucaucaccaaag

SEQ ID NO: 202399 - RNA, 21 nt, Human
uuaaagcaauucuccaaggcc

SEQ ID NO: 202400 - RNA, 21 nt, Human
uucaucaccaaagggucuguc

SEQ ID NO: 202401 - RNA, 18 nt, Human
uugcuugaacagacugau

SEQ ID NO: 202402 - RNA, 19 nt, Human
uuggaacauucacucuucu

SEQ ID NO: 202403 - RNA, 20 nt, Human
uuuaugggcagaaaggagaa

SEQ ID NO: 202404 - RNA, 27 nt, Human
uuuucagagacaguguuucgggucacc

SEQ ID NO: 202405 - RNA, 23 nt, Human
uuuuguccacagggagcagggag

SEQ ID NO: 202406 - RNA, 22 nt, Human
uuuuuuuuuuuuuuuuuuaagg

SEQ ID NO: 202407 - RNA, 24 nt, Human
aaaagggagaaaaauauaaggaua

SEQ ID NO: 202408 - RNA, 20 nt, Human
aacugugacggguacaaaca

SEQ ID NO: 202409 - RNA, 21 nt, Human
aaggcgugcgucucagccccg

SEQ ID NO: 202410 - RNA, 23 nt, Human
aaguccugagcuuggggcagccu

SEQ ID NO: 202411 - RNA, 19 nt, Human
accccgacaggugccagag

SEQ ID NO: 202412 - RNA, 19 nt, Human
agagagagauguuuaaccu

SEQ ID NO: 202413 - RNA, 21 nt, Human
agcacaaauauuaaacugucu

SEQ ID NO: 202414 - RNA, 18 nt, Human
agcgacagugacuuccag

SEQ ID NO: 202415 - RNA, 18 nt, Human
aggcagcggccggggcuc

SEQ ID NO: 202416 - RNA, 23 nt, Human
agguccccccgagucccucugcc

SEQ ID NO: 202417 - RNA, 22 nt, Human
aucccgggggccccgcgcagga

SEQ ID NO: 202418 - RNA, 18 nt, Human
cacgcgcggcugccgggc

SEQ ID NO: 202419 - RNA, 20 nt, Human
cagacaguggcgagcgacag

SEQ ID NO: 202420 - RNA, 22 nt, Human
cagccccggccccgagagacuu

SEQ ID NO: 202421 - RNA, 22 nt, Human
cagccccggcuuucucuggucc

SEQ ID NO: 202422 - RNA, 19 nt, Human
cagccuuggccccucgguu

SEQ ID NO: 202423 - RNA, 19 nt, Human
cauugaaaaaaauacugaa

SEQ ID NO: 202424 - RNA, 24 nt, Human
ccccccgagucccucugcccgagc

SEQ ID NO: 202425 - RNA, 26 nt, Human
cccccgagucccucugcccgagcggg

SEQ ID NO: 202426 - RNA, 18 nt, Human
ccccgagucccucugccc

SEQ ID NO: 202427 - RNA, 20 nt, Human
ccccggccccgagagacuuc

SEQ ID NO: 202428 - RNA, 21 nt, Human
ccggcgggccagcgcgcugga

SEQ ID NO: 202429 - RNA, 19 nt, Human
ccgugcgccccuguggccg

SEQ ID NO: 202430 - RNA, 20 nt, Human
ccgugcgccccuguggccgu

SEQ ID NO: 202431 - RNA, 21 nt, Human
ccgugcgccccuguggccgug

SEQ ID NO: 202432 - RNA, 20 nt, Human
ccuccagucgagggggcggg

SEQ ID NO: 202433 - RNA, 23 nt, Human
ccugagcuuggggcagccuuggc

SEQ ID NO: 202434 - RNA, 21 nt, Human
cgccugggcgcguucucuccg

SEQ ID NO: 202435 - RNA, 24 nt, Human
cgcgggaccugucagcggcccccg

SEQ ID NO: 202436 - RNA, 22 nt, Human
cggccaugcuaggccuggaccc

SEQ ID NO: 202437 - RNA, 21 nt, Human
cucaagauuuucugaaaacuu

SEQ ID NO: 202438 - RNA, 24 nt, Human
cucaagauuuucugaaaacuuuua

SEQ ID NO: 202439 - RNA, 21 nt, Human
cucagccccggccccgagaga

SEQ ID NO: 202440 - RNA, 31 nt, Human
cucagccccggccccgagagacuucucggcc

SEQ ID NO: 202441 - RNA, 22 nt, Human
cuccaaacugcucuuggacccc

SEQ ID NO: 202442 - RNA, 20 nt, Human
cucugguccccuugcccgcc

SEQ ID NO: 202443 - RNA, 24 nt, Human
cugaaaacuuuuaaugacaacuga

SEQ ID NO: 202444 - RNA, 21 nt, Human
cuggaccccgacaggugccag

SEQ ID NO: 202445 - RNA, 20 nt, Human
cugguccccuugcccgccug

SEQ ID NO: 202446 - RNA, 23 nt, Human
cuuuaugacuggguauauagaac

SEQ ID NO: 202447 - RNA, 19 nt, Human
gacagugacuuccagcccc

SEQ ID NO: 202448 - RNA, 22 nt, Human
gagccgcguggcugggcugggc

SEQ ID NO: 202449 - RNA, 25 nt, Human
gagguccccccgagucccucugccc

SEQ ID NO: 202450 - RNA, 22 nt, Human
gaucccugccuccagucgaggg

SEQ ID NO: 202451 - RNA, 18 nt, Human
gccgugcgccccuguggc

SEQ ID NO: 202452 - RNA, 20 nt, Human
gccgugcgccccuguggccg

SEQ ID NO: 202453 - RNA, 21 nt, Human
gccgugcgccccuguggccgu

SEQ ID NO: 202454 - RNA, 22 nt, Human
gccgugcgccccuguggccgug

SEQ ID NO: 202455 - RNA, 21 nt, Human
gcgcggcugccgggccucugc

SEQ ID NO: 202456 - RNA, 22 nt, Human
gcggccggggcuccgcggggaa

SEQ ID NO: 202457 - RNA, 20 nt, Human
ggaaaaagggagaaaaauau

SEQ ID NO: 202458 - RNA, 19 nt, Human
ggaccccaccugugagccg

SEQ ID NO: 202459 - RNA, 21 nt, Human
ggcacgggaaaaagggagaaa

SEQ ID NO: 202460 - RNA, 23 nt, Human
ggccaaggagcgagguccccccg

SEQ ID NO: 202461 - RNA, 23 nt, Human
ggcgcguucucuccgcccgaguu

SEQ ID NO: 202462 - RNA, 20 nt, Human
ggcgggaaggggaacgcggg

SEQ ID NO: 202463 - RNA, 18 nt, Human
ggcugggcugggcugggc

SEQ ID NO: 202464 - RNA, 18 nt, Human
guccccuugcccgccugg

SEQ ID NO: 202465 - RNA, 23 nt, Human
gucccgggaggcagcggccgggg

SEQ ID NO: 202466 - RNA, 22 nt, Human
guggcacgggaaaaagggagaa

SEQ ID NO: 202467 - RNA, 18 nt, Human
uaaaaaaagagagagaga

SEQ ID NO: 202468 - RNA, 24 nt, Human
uaaaauaaaaacugaaaauugaaa

SEQ ID NO: 202469 - RNA, 28 nt, Human
uaacauucauugaaaaaaauacugaaac

SEQ ID NO: 202470 - RNA, 20 nt, Human
uaagaaaaaguggcacggga

SEQ ID NO: 202471 - RNA, 23 nt, Human
uacuuuaugacuggguauauaga

SEQ ID NO: 202472 - RNA, 20 nt, Human
uauagaacauaaaauaaaaa

SEQ ID NO: 202473 - RNA, 24 nt, Human
uauagaacauaaaauaaaaacuga

SEQ ID NO: 202474 - RNA, 18 nt, Human
ucaccggcugccuccugg

SEQ ID NO: 202475 - RNA, 19 nt, Human
ucagcggcccccgccacuc

SEQ ID NO: 202476 - RNA, 18 nt, Human
uccacguguuugguguug

SEQ ID NO: 202477 - RNA, 21 nt, Human
uccccuugcccgccugggcgc

SEQ ID NO: 202478 - RNA, 24 nt, Human
uccguagcgccggguugcuccaaa

SEQ ID NO: 202479 - RNA, 19 nt, Human
uccugagcuuggggcagcc

SEQ ID NO: 202480 - RNA, 23 nt, Human
ucgccgugcgccccuguggccuc

SEQ ID NO: 202481 - RNA, 22 nt, Human
ucuccguagcgccggguugcuc

SEQ ID NO: 202482 - RNA, 24 nt, Human
ucugcgcuccgugcgcuccagaca

SEQ ID NO: 202483 - RNA, 20 nt, Human
ugaaaaaaauacugaaacau

SEQ ID NO: 202484 - RNA, 23 nt, Human
ugacuuccagccccggcuuucuc

SEQ ID NO: 202485 - RNA, 24 nt, Human
ugcuccaaacugcucuuggacccc

SEQ ID NO: 202486 - RNA, 20 nt, Human
uggcugggcugggcugggcc

SEQ ID NO: 202487 - RNA, 26 nt, Human
uggcugggcugggcugggcugcgcgg

SEQ ID NO: 202488 - RNA, 18 nt, Human
ugggcugggcugggcugc

SEQ ID NO: 202489 - RNA, 23 nt, Human
ugguaaaaaaauauauuauauuu

SEQ ID NO: 202490 - RNA, 25 nt, Human
ugucccgggaggcagcggccggggc

SEQ ID NO: 202491 - RNA, 22 nt, Human
uuaaaaaaagagagagagaugu

SEQ ID NO: 202492 - RNA, 24 nt, Human
uuauauuuugauuuuuuuuuucuu

SEQ ID NO: 202493 - RNA, 19 nt, Human
uucauugaaaaaaauacug

SEQ ID NO: 202494 - RNA, 20 nt, Human
uuccagccccggcuuucucu

SEQ ID NO: 202495 - RNA, 21 nt, Human
uuggaccccaccugugagccg

SEQ ID NO: 202496 - RNA, 25 nt, Human
uuuaagaaaaaguggcacgggaaaa

SEQ ID NO: 202497 - RNA, 22 nt, Human
uuuugauuuuuuuuuucuuuuu

SEQ ID NO: 202498 - RNA, 24 nt, Human
uuuuuauuuuaaugaucaaaaagg

SEQ ID NO: 202499 - RNA, 26 nt, Human
uuuuuauuuuaaugaucaaaaaggug

SEQ ID NO: 202500 - RNA, 24 nt, Human
uuuuuuuuuuuuuuuccaagauuu

SEQ ID NO: 202501 - RNA, 23 nt, Human
uuuuuuuuuuuuuuuuuuccaag

SEQ ID NO: 202502 - RNA, 20 nt, Human
aaauacuagaguuaaacacu

SEQ ID NO: 202503 - RNA, 20 nt, Human
aagaaaaaauagaagcacca

SEQ ID NO: 202504 - RNA, 20 nt, Human
aagaaaaaauagaagcacca

SEQ ID NO: 202505 - RNA, 22 nt, Human
aagaagaaaacgaaauacuaga

SEQ ID NO: 202506 - RNA, 22 nt, Human
agaagaaaacgaaauacuagag

SEQ ID NO: 202507 - RNA, 23 nt, Human
agacaagacaaggaggcagcaac

SEQ ID NO: 202508 - RNA, 18 nt, Human
agacccaagacaagacaa

SEQ ID NO: 202509 - RNA, 19 nt, Human
agcgcagagaggguucccc

SEQ ID NO: 202510 - RNA, 18 nt, Human
agcuggaaugggagaccc

SEQ ID NO: 202511 - RNA, 22 nt, Human
aggaagagacagggaagcugga

SEQ ID NO: 202512 - RNA, 23 nt, Human
aggaggcugcugcaugaggccug

SEQ ID NO: 202513 - RNA, 21 nt, Human
aggcagcaacuggagaacuca

SEQ ID NO: 202514 - RNA, 19 nt, Human
caacuggagaacucagacg

SEQ ID NO: 202515 - RNA, 20 nt, Human
cccggcacgcuggacgcccg

SEQ ID NO: 202516 - RNA, 23 nt, Human
cccguaacaacaaaaaucucaag

SEQ ID NO: 202517 - RNA, 18 nt, Human
cccgugugcccgcggccg

SEQ ID NO: 202518 - RNA, 24 nt, Human
cccuucagaauacagcccuguuga

SEQ ID NO: 202519 - RNA, 19 nt, Human
ccgccgcugcugcugcugc

SEQ ID NO: 202520 - RNA, 22 nt, Human
ccgccgcugcugcugcugcucu

SEQ ID NO: 202521 - RNA, 22 nt, Human
ccgcggccgccgcugcugcugc

SEQ ID NO: 202522 - RNA, 22 nt, Human
cggccagggacauggcucagca

SEQ ID NO: 202523 - RNA, 24 nt, Human
cggccgccgcugcugcugcugcuc

SEQ ID NO: 202524 - RNA, 21 nt, Human
cugcccuucagaauacagccc

SEQ ID NO: 202525 - RNA, 22 nt, Human
cugcugcucuuccccagguggc

SEQ ID NO: 202526 - RNA, 18 nt, Human
cugcugcugcugcucuuc

SEQ ID NO: 202527 - RNA, 25 nt, Human
cuguagcggcggcggcucuugacau

SEQ ID NO: 202528 - RNA, 23 nt, Human
gaagaaaaaauagaagcaccauc

SEQ ID NO: 202529 - RNA, 23 nt, Human
gacaaggaggcagcaacuggaga

SEQ ID NO: 202530 - RNA, 21 nt, Human
gacgcgcucggggccaggagg

SEQ ID NO: 202531 - RNA, 23 nt, Human
gagaagaaaaaauagaagcacca

SEQ ID NO: 202532 - RNA, 21 nt, Human
gcccgcggccgccgcugcugc

SEQ ID NO: 202533 - RNA, 20 nt, Human
gccgccgcugcugcugcugc

SEQ ID NO: 202534 - RNA, 21 nt, Human
gcugcaugaggccugcccuuc

SEQ ID NO: 202535 - RNA, 24 nt, Human
gcugcucuuccccagguggcggcg

SEQ ID NO: 202536 - RNA, 19 nt, Human
ggaagagacagggaagcug

SEQ ID NO: 202537 - RNA, 23 nt, Human
ggaaugggagacccaagacaaga

SEQ ID NO: 202538 - RNA, 18 nt, Human
ggccagggacauggcuca

SEQ ID NO: 202539 - RNA, 19 nt, Human
ggcgugggucccgccgggc

SEQ ID NO: 202540 - RNA, 20 nt, Human
uaacagguaggggagaagaa

SEQ ID NO: 202541 - RNA, 25 nt, Human
uagcggcggcggcucuugacauguu

SEQ ID NO: 202542 - RNA, 18 nt, Human
uauaacagguaggggaga

SEQ ID NO: 202543 - RNA, 25 nt, Human
ucuguacauuuuacauacauauaau

SEQ ID NO: 202544 - RNA, 24 nt, Human
ucuguacauuuuacauacauauag

SEQ ID NO: 202545 - RNA, 19 nt, Human
ugacauguugcccggcagg

SEQ ID NO: 202546 - RNA, 19 nt, Human
ugagcgcagagaggguucc

SEQ ID NO: 202547 - RNA, 20 nt, Human
ugcugcugcucuuccccagg

SEQ ID NO: 202548 - RNA, 18 nt, Human
uggaaugggagacccaag

SEQ ID NO: 202549 - RNA, 25 nt, Human
ugggagacccaagacaagacaagga

SEQ ID NO: 202550 - RNA, 19 nt, Human
ugggcgagggucugcuccc

SEQ ID NO: 202551 - RNA, 20 nt, Human
uuccccggcacgcuggacgc

SEQ ID NO: 202552 - RNA, 19 nt, Human
aaccccuuuucguaguucc

SEQ ID NO: 202553 - RNA, 22 nt, Human
aaccccuuuucguaguuccugu

SEQ ID NO: 202554 - RNA, 22 nt, Human
aagagugagacccaaccccauu

SEQ ID NO: 202555 - RNA, 24 nt, Human
aagcagagguuuagacagcaggug

SEQ ID NO: 202556 - RNA, 23 nt, Human
aagcuagagugagaaccccuaua

SEQ ID NO: 202557 - RNA, 18 nt, Human
acagcacuggaggcaauc

SEQ ID NO: 202558 - RNA, 26 nt, Human
acagcacuggaggcaauccuggcugc

SEQ ID NO: 202559 - RNA, 20 nt, Human
acauauacauuaauagcacu

SEQ ID NO: 202560 - RNA, 22 nt, Human
accccaaaaacaugcucagaac

SEQ ID NO: 202561 - RNA, 24 nt, Human
agacuagaaacaccuuagagggag

SEQ ID NO: 202562 - RNA, 18 nt, Human
agagaaaaugaagcccga

SEQ ID NO: 202563 - RNA, 22 nt, Human
agcccgaggagguggugguggg

SEQ ID NO: 202564 - RNA, 18 nt, Human
agguggugguggggcaaa

SEQ ID NO: 202565 - RNA, 22 nt, Human
caaacugaugggaagggacaac

SEQ ID NO: 202566 - RNA, 22 nt, Human
caagcuagagugagaaccccua

SEQ ID NO: 202567 - RNA, 19 nt, Human
caccaagaggacaggauuu

SEQ ID NO: 202568 - RNA, 21 nt, Human
caccccaaaaacaugcucaga

SEQ ID NO: 202569 - RNA, 18 nt, Human
cacuaccucacucucugc

SEQ ID NO: 202570 - RNA, 25 nt, Human
cacucauacaaauuuccaguuuuac

SEQ ID NO: 202571 - RNA, 22 nt, Human
cagagguuuagacagcaggugc

SEQ ID NO: 202572 - RNA, 25 nt, Human
caguggguucugguggccaucuggu

SEQ ID NO: 202573 - RNA, 21 nt, Human
cauucuggggagaagcccaag

SEQ ID NO: 202574 - RNA, 21 nt, Human
ccaaccccagagcucugaccu

SEQ ID NO: 202575 - RNA, 23 nt, Human
ccagcagcgcgcgggucccuccu

SEQ ID NO: 202576 - RNA, 25 nt, Human
cccaaaaacaugcucagaacuacag

SEQ ID NO: 202577 - RNA, 19 nt, Human
cccaccgcccgcacguccg

SEQ ID NO: 202578 - RNA, 22 nt, Human
ccccaagcuagagugagaaccc

SEQ ID NO: 202579 - RNA, 19 nt, Human
ccccagagcucugaccucg

SEQ ID NO: 202580 - RNA, 24 nt, Human
cccccacucauacaaauuuccagu

SEQ ID NO: 202581 - RNA, 21 nt, Human
cccccagauauggccacucau

SEQ ID NO: 202582 - RNA, 23 nt, Human
ccccccacucauacaaauuucca

SEQ ID NO: 202583 - RNA, 18 nt, Human
ccccuauaaagcagaccu

SEQ ID NO: 202584 - RNA, 23 nt, Human
ccucacucucugccaucucuaaa

SEQ ID NO: 202585 - RNA, 18 nt, Human
ccugguuccuccaugggg

SEQ ID NO: 202586 - RNA, 21 nt, Human
ccuucaugauguggggaggga

SEQ ID NO: 202587 - RNA, 22 nt, Human
ccuugcucacccccaacccuca

SEQ ID NO: 202588 - RNA, 24 nt, Human
cgcccgcacguccgggugcacgcg

SEQ ID NO: 202589 - RNA, 21 nt, Human
cuaacagcacuggaggcaauc

SEQ ID NO: 202590 - RNA, 21 nt, Human
cuagggacccuaggggacaga

SEQ ID NO: 202591 - RNA, 23 nt, Human
cuagggacccuaggggacagagu

SEQ ID NO: 202592 - RNA, 22 nt, Human
cucacccccaacccucauaaac

SEQ ID NO: 202593 - RNA, 19 nt, Human
cucaucucugccaacccca

SEQ ID NO: 202594 - RNA, 19 nt, Human
cugacugcuccuuucucca

SEQ ID NO: 202595 - RNA, 20 nt, Human
cuggcugcaugaaggaggag

SEQ ID NO: 202596 - RNA, 22 nt, Human
gaacagauuuaacuccccccac

SEQ ID NO: 202597 - RNA, 27 nt, Human
gaugggccugguuccuccauggggaug

SEQ ID NO: 202598 - RNA, 23 nt, Human
gccacuaccucacucucugccau

SEQ ID NO: 202599 - RNA, 23 nt, Human
gccacucaucucugccaacccca

SEQ ID NO: 202600 - RNA, 19 nt, Human
gccaucuggucaaccagau

SEQ ID NO: 202601 - RNA, 19 nt, Human
gcccaugacagauacaggg

SEQ ID NO: 202602 - RNA, 22 nt, Human
gccugguuccuccauggggaug

SEQ ID NO: 202603 - RNA, 19 nt, Human
gcuagagugagaaccccua

SEQ ID NO: 202604 - RNA, 19 nt, Human
gcugcccagaugggccugg

SEQ ID NO: 202605 - RNA, 22 nt, Human
ggagaucuacuuggcacuccag

SEQ ID NO: 202606 - RNA, 22 nt, Human
ggagaucugugaacaagugcuu

SEQ ID NO: 202607 - RNA, 25 nt, Human
gggacagaguccaccccaaaaacau

SEQ ID NO: 202608 - RNA, 18 nt, Human
gggagggaggaagucagg

SEQ ID NO: 202609 - RNA, 18 nt, Human
gugaagcugcagaagcug

SEQ ID NO: 202610 - RNA, 24 nt, Human
uacucuacucuuugagcagcccug

SEQ ID NO: 202611 - RNA, 23 nt, Human
uagagugagaaccccuauaaagc

SEQ ID NO: 202612 - RNA, 18 nt, Human
uagcgggagaaaugacag

SEQ ID NO: 202613 - RNA, 18 nt, Human
uagggacccuaggggaca

SEQ ID NO: 202614 - RNA, 19 nt, Human
uagggacccuaggggacag

SEQ ID NO: 202615 - RNA, 21 nt, Human
uccccaagcuagagugagaac

SEQ ID NO: 202616 - RNA, 26 nt, Human
uccccaagcuagagugagaaccccua

SEQ ID NO: 202617 - RNA, 21 nt, Human
ucgccacuaccucacucucug

SEQ ID NO: 202618 - RNA, 26 nt, Human
ucugcagacagcccuugcucaccccc

SEQ ID NO: 202619 - RNA, 30 nt, Human
ucuguguguguguguguggguggguguguu

SEQ ID NO: 202620 - RNA, 26 nt, Human
ucuugauggggguuucugcagacagc

SEQ ID NO: 202621 - RNA, 28 nt, Human
ucuuugagcagcccugugggccugaucc

SEQ ID NO: 202622 - RNA, 23 nt, Human
ucuuugcccuucuagggacccua

SEQ ID NO: 202623 - RNA, 22 nt, Human
ugacuagccuuccucugccucu

SEQ ID NO: 202624 - RNA, 22 nt, Human
ugccaucucuaaauagagaaaa

SEQ ID NO: 202625 - RNA, 21 nt, Human
ugcccuucuagggacccuagg

SEQ ID NO: 202626 - RNA, 25 nt, Human
ugccuaagcuaacagcacuggaggc

SEQ ID NO: 202627 - RNA, 18 nt, Human
ugcucagaacuacagugc

SEQ ID NO: 202628 - RNA, 24 nt, Human
ugcuugggagagauggucuucagg

SEQ ID NO: 202629 - RNA, 23 nt, Human
ugggaagggacacuucauucagc

SEQ ID NO: 202630 - RNA, 18 nt, Human
ugggagagauggucuuca

SEQ ID NO: 202631 - RNA, 23 nt, Human
uggggagaagcccaagcagaggu

SEQ ID NO: 202632 - RNA, 24 nt, Human
uggggagaagcccaagcagagguu

SEQ ID NO: 202633 - RNA, 20 nt, Human
uggggagggaggaagucagg

SEQ ID NO: 202634 - RNA, 21 nt, Human
uggggagggaggaagucaggg

SEQ ID NO: 202635 - RNA, 19 nt, Human
uggguggguguguguuuuc

SEQ ID NO: 202636 - RNA, 20 nt, Human
uggguucugguggccaucug

SEQ ID NO: 202637 - RNA, 23 nt, Human
ugguggggcaaauuggaagaaug

SEQ ID NO: 202638 - RNA, 19 nt, Human
ugucaaaugaugcauuuua

SEQ ID NO: 202639 - RNA, 24 nt, Human
ugugaacaagugcuuuaugucaaa

SEQ ID NO: 202640 - RNA, 23 nt, Human
ugugugugugggugggugugugu

SEQ ID NO: 202641 - RNA, 23 nt, Human
ugugugugugugugggugggugu

SEQ ID NO: 202642 - RNA, 25 nt, Human
ugugugugugugugggugggugugu

SEQ ID NO: 202643 - RNA, 19 nt, Human
ugugugugugugugugggu

SEQ ID NO: 202644 - RNA, 20 nt, Human
ugugugugugugugugggug

SEQ ID NO: 202645 - RNA, 22 nt, Human
uuaaagagaagacuagaaacac

SEQ ID NO: 202646 - RNA, 20 nt, Human
uuaacuccccccacucauac

SEQ ID NO: 202647 - RNA, 19 nt, Human
uuaauagcacugucucuga

SEQ ID NO: 202648 - RNA, 20 nt, Human
uuccugguuuuggagaucug

SEQ ID NO: 202649 - RNA, 23 nt, Human
uuucucgccacuaccucacucuc

SEQ ID NO: 202650 - RNA, 26 nt, Human
aaacaugagacagaacagucccaaaa

SEQ ID NO: 202651 - RNA, 21 nt, Human
aacaugagacagaacaguccc

SEQ ID NO: 202652 - RNA, 23 nt, Human
aaccuacagagcuuucuacaacc

SEQ ID NO: 202653 - RNA, 24 nt, Human
aaccuccuaagcaggcagcagccu

SEQ ID NO: 202654 - RNA, 18 nt, Human
acaacugcuggcugcagc

SEQ ID NO: 202655 - RNA, 23 nt, Human
agagagaaccuacagagcuuucu

SEQ ID NO: 202656 - RNA, 21 nt, Human
agauaaacaugagacagaaca

SEQ ID NO: 202657 - RNA, 25 nt, Human
agcuggccugaagacuccuguagga

SEQ ID NO: 202658 - RNA, 18 nt, Human
auaaaguuuaugugaccu

SEQ ID NO: 202659 - RNA, 20 nt, Human
cagaacagucccaaaauccc

SEQ ID NO: 202660 - RNA, 24 nt, Human
cagagcuuucuacaaccuccuaag

SEQ ID NO: 202661 - RNA, 24 nt, Human
cagcaugcccagcccucagggagu

SEQ ID NO: 202662 - RNA, 22 nt, Human
ccaaaaucccucagcaugccca

SEQ ID NO: 202663 - RNA, 25 nt, Human
cccaaaaucccucagcaugcccugu

SEQ ID NO: 202664 - RNA, 24 nt, Human
cuccuaagcaggcagcagccucug

SEQ ID NO: 202665 - RNA, 19 nt, Human
cucuggggacacucuggga

SEQ ID NO: 202666 - RNA, 21 nt, Human
gaacagucccaaaaucccuca

SEQ ID NO: 202667 - RNA, 21 nt, Human
ggaacuccuuccauuugucag

SEQ ID NO: 202668 - RNA, 21 nt, Human
gggacacucugggaagauguc

SEQ ID NO: 202669 - RNA, 22 nt, Human
ucccaaaaucccucagcaugcc

SEQ ID NO: 202670 - RNA, 19 nt, Human
ucccucagcaugcccagcc

SEQ ID NO: 202671 - RNA, 21 nt, Human
ucuacaaccuccuaagcaggc

SEQ ID NO: 202672 - RNA, 20 nt, Human
ugagacagaacagucccaaa

SEQ ID NO: 202673 - RNA, 24 nt, Human
ugagacagaacagucccaaaaucc

SEQ ID NO: 202674 - RNA, 18 nt, Human
uugcaugucucuggggac

SEQ ID NO: 202675 - RNA, 24 nt, Human
agagacacuugggauuuagcccuc

SEQ ID NO: 202676 - RNA, 23 nt, Human
agaggcucacugggaaaccuugg

SEQ ID NO: 202677 - RNA, 21 nt, Human
aggaaccaaggcucacggagc

SEQ ID NO: 202678 - RNA, 21 nt, Human
aggcacuaucugcagaguccu

SEQ ID NO: 202679 - RNA, 27 nt, Human
aggccaggguccaggacacuuggggga

SEQ ID NO: 202680 - RNA, 21 nt, Human
aggcugcagugaagucuugca

SEQ ID NO: 202681 - RNA, 23 nt, Human
cagugaagucuugcaugagacuc

SEQ ID NO: 202682 - RNA, 23 nt, Human
ccccaacccaccuagucacuccu

SEQ ID NO: 202683 - RNA, 20 nt, Human
ccuggauugggcaucggcag

SEQ ID NO: 202684 - RNA, 20 nt, Human
ccugugaaaggcugcaguga

SEQ ID NO: 202685 - RNA, 20 nt, Human
ccugugcugcaguggcuggg

SEQ ID NO: 202686 - RNA, 23 nt, Human
cggagccuccugugcugcagugg

SEQ ID NO: 202687 - RNA, 19 nt, Human
cggcagugggcaugaagug

SEQ ID NO: 202688 - RNA, 21 nt, Human
cggcccagcgggcuggggcgg

SEQ ID NO: 202689 - RNA, 22 nt, Human
cggcccagcgggcuggggcggg

SEQ ID NO: 202690 - RNA, 18 nt, Human
cugcagugaagucuugca

SEQ ID NO: 202691 - RNA, 22 nt, Human
cuggggcggggcggggcggggg

SEQ ID NO: 202692 - RNA, 19 nt, Human
cuucccuguggcuuggggg

SEQ ID NO: 202693 - RNA, 24 nt, Human
gaaacaguggagaggcgcagaggc

SEQ ID NO: 202694 - RNA, 22 nt, Human
gaggaaccaaggcucacggagc

SEQ ID NO: 202695 - RNA, 21 nt, Human
gcagcacugaggcacuggugc

SEQ ID NO: 202696 - RNA, 25 nt, Human
gccaggguccaggacacuuggggga

SEQ ID NO: 202697 - RNA, 22 nt, Human
gcgggcuggggcggggcggggc

SEQ ID NO: 202698 - RNA, 18 nt, Human
ggcagugggcaugaagug

SEQ ID NO: 202699 - RNA, 23 nt, Human
ggcggcccagcgggcuggggcgg

SEQ ID NO: 202700 - RNA, 18 nt, Human
ggcggggcggggcggggg

SEQ ID NO: 202701 - RNA, 22 nt, Human
gggccgggccggggagcgggga

SEQ ID NO: 202702 - RNA, 19 nt, Human
gggcuggggcggggcgggg

SEQ ID NO: 202703 - RNA, 19 nt, Human
ggggcggggcggggcgggg

SEQ ID NO: 202704 - RNA, 18 nt, Human
gguacaccggccuggggc

SEQ ID NO: 202705 - RNA, 21 nt, Human
uaggccaggguccaggacacu

SEQ ID NO: 202706 - RNA, 21 nt, Human
uccugugcugcaguggcuggc

SEQ ID NO: 202707 - RNA, 19 nt, Human
ucggggaggaaccaaggcu

SEQ ID NO: 202708 - RNA, 20 nt, Human
ucuccaagcugcaggguaga

SEQ ID NO: 202709 - RNA, 24 nt, Human
uguggcaauugggaaguacaguac

SEQ ID NO: 202710 - RNA, 22 nt, Human
aaacagccuuucgucucucuga

SEQ ID NO: 202711 - RNA, 28 nt, Human
aaaggcguugggaggugggagaugauug

SEQ ID NO: 202712 - RNA, 20 nt, Human
aagcagguguggguucccac

SEQ ID NO: 202713 - RNA, 22 nt, Human
acaaagaagggcgcgggagaca

SEQ ID NO: 202714 - RNA, 24 nt, Human
acaaagaagggcgcgggagacagc

SEQ ID NO: 202715 - RNA, 19 nt, Human
accugcuucgccccgcccc

SEQ ID NO: 202716 - RNA, 28 nt, Human
acgcaaucucaaggauaaggggaacgcc

SEQ ID NO: 202717 - RNA, 20 nt, Human
agaggcuggggcucugggcc

SEQ ID NO: 202718 - RNA, 23 nt, Human
agccaauggaguucuccauaaaa

SEQ ID NO: 202719 - RNA, 22 nt, Human
agcugcuaccgccgccccaucc

SEQ ID NO: 202720 - RNA, 21 nt, Human
aggagcgauuauagugaccgc

SEQ ID NO: 202721 - RNA, 18 nt, Human
aggcaggacucuaaucug

SEQ ID NO: 202722 - RNA, 19 nt, Human
aggggaggcuuuacaagca

SEQ ID NO: 202723 - RNA, 27 nt, Human
auggaguucuccauaaaaggcccaaag

SEQ ID NO: 202724 - RNA, 22 nt, Human
caaagcgcuggcauuacaggcg

SEQ ID NO: 202725 - RNA, 18 nt, Human
caccccuuguugugucuc

SEQ ID NO: 202726 - RNA, 19 nt, Human
cacccuguucugagccaaa

SEQ ID NO: 202727 - RNA, 23 nt, Human
cacccuguucugagccaaaacag

SEQ ID NO: 202728 - RNA, 21 nt, Human
cacuguguugcucuggcuggu

SEQ ID NO: 202729 - RNA, 24 nt, Human
cacuguguugcucuggcuggucuc

SEQ ID NO: 202730 - RNA, 22 nt, Human
caggguuccuagcucauaacuc

SEQ ID NO: 202731 - RNA, 24 nt, Human
caugccucuaaucccagcacuuug

SEQ ID NO: 202732 - RNA, 19 nt, Human
ccaauggaguucuccauaa

SEQ ID NO: 202733 - RNA, 23 nt, Human
ccacagcugcuaccgccgcccca

SEQ ID NO: 202734 - RNA, 20 nt, Human
ccaggggacaaagaagggcg

SEQ ID NO: 202735 - RNA, 22 nt, Human
cccacagcugcuaccgccgccc

SEQ ID NO: 202736 - RNA, 23 nt, Human
cccacagcugcuaccgccgcccc

SEQ ID NO: 202737 - RNA, 23 nt, Human
cccacugcuuggaacaacaaacu

SEQ ID NO: 202738 - RNA, 22 nt, Human
ccccacccuguucugagccaaa

SEQ ID NO: 202739 - RNA, 21 nt, Human
ccccagggaccacacagaccc

SEQ ID NO: 202740 - RNA, 23 nt, Human
ccccagggaccacacagacccag

SEQ ID NO: 202741 - RNA, 27 nt, Human
cccccugggcagauuccccuggguaug

SEQ ID NO: 202742 - RNA, 21 nt, Human
ccccgccugcgggcccccacc

SEQ ID NO: 202743 - RNA, 18 nt, Human
cccgccccgccugcgggc

SEQ ID NO: 202744 - RNA, 18 nt, Human
ccgccgccccauccccag

SEQ ID NO: 202745 - RNA, 20 nt, Human
ccggggcuugagcgauccuc

SEQ ID NO: 202746 - RNA, 22 nt, Human
ccuccugccuccgccucccaaa

SEQ ID NO: 202747 - RNA, 24 nt, Human
ccuccugccuccgccucccaaagc

SEQ ID NO: 202748 - RNA, 19 nt, Human
ccugcuucgccccgccccg

SEQ ID NO: 202749 - RNA, 23 nt, Human
ccuggcccgcucuccccacccug

SEQ ID NO: 202750 - RNA, 23 nt, Human
ccuguccucuuuucagcugccca

SEQ ID NO: 202751 - RNA, 20 nt, Human
ccuucuccuguccucuuuuc

SEQ ID NO: 202752 - RNA, 21 nt, Human
cgccccgccugcgggccccca

SEQ ID NO: 202753 - RNA, 22 nt, Human
cgcuggcauuacaggcgacagc

SEQ ID NO: 202754 - RNA, 24 nt, Human
cucaugccucuaaucccagcacuu

SEQ ID NO: 202755 - RNA, 21 nt, Human
cuccugccuccgccucccaaa

SEQ ID NO: 202756 - RNA, 19 nt, Human
cuccugcucuggacccuuc

SEQ ID NO: 202757 - RNA, 26 nt, Human
cucuccccacccuguucugagccaaa

SEQ ID NO: 202758 - RNA, 21 nt, Human
cucuggcuggucuccaacucc

SEQ ID NO: 202759 - RNA, 21 nt, Human
cugaacguguggaggcugaca

SEQ ID NO: 202760 - RNA, 22 nt, Human
cugcacaaaggcccaaagaauc

SEQ ID NO: 202761 - RNA, 19 nt, Human
cuggguaugccucugugcc

SEQ ID NO: 202762 - RNA, 20 nt, Human
cuugagcgauccuccugccu

SEQ ID NO: 202763 - RNA, 20 nt, Human
gagaggcuggggcucugggc

SEQ ID NO: 202764 - RNA, 18 nt, Human
gagccaaaacagacauga

SEQ ID NO: 202765 - RNA, 21 nt, Human
gaggggaggcuuuacaagcag

SEQ ID NO: 202766 - RNA, 24 nt, Human
gaguucuccauaaaaggcccaaag

SEQ ID NO: 202767 - RNA, 24 nt, Human
gaucuaucuuaauuagccacccac

SEQ ID NO: 202768 - RNA, 19 nt, Human
gccaaaacagacaugagcc

SEQ ID NO: 202769 - RNA, 19 nt, Human
gccccauccccagggacca

SEQ ID NO: 202770 - RNA, 23 nt, Human
gccccauccccagggaccacaca

SEQ ID NO: 202771 - RNA, 19 nt, Human
gcccgcucuccccacccug

SEQ ID NO: 202772 - RNA, 22 nt, Human
gcugacagaaugugcccagagg

SEQ ID NO: 202773 - RNA, 22 nt, Human
gcugggcacgguggcucaugcc

SEQ ID NO: 202774 - RNA, 21 nt, Human
gcuuggaacaacaaacugucc

SEQ ID NO: 202775 - RNA, 24 nt, Human
gcuuugaggcugggcacgguggcu

SEQ ID NO: 202776 - RNA, 18 nt, Human
ggacaaagaagggcgcgg

SEQ ID NO: 202777 - RNA, 21 nt, Human
ggacccuuccagaccgcccuu

SEQ ID NO: 202778 - RNA, 24 nt, Human
ggaguucuccauaaaaggcccuuc

SEQ ID NO: 202779 - RNA, 23 nt, Human
ggcacgguggcucaugccucuaa

SEQ ID NO: 202780 - RNA, 21 nt, Human
ggcucaugccucuaaucccag

SEQ ID NO: 202781 - RNA, 23 nt, Human
ggcugggcacgguggcucaugcc

SEQ ID NO: 202782 - RNA, 23 nt, Human
gggcuugagcgauccuccugccu

SEQ ID NO: 202783 - RNA, 23 nt, Human
ggggcuugagcgauccuccugcc

SEQ ID NO: 202784 - RNA, 23 nt, Human
gguggcucaugccucuaauccca

SEQ ID NO: 202785 - RNA, 24 nt, Human
gguggcucaugccucuaaucccag

SEQ ID NO: 202786 - RNA, 19 nt, Human
guagagaugggggucucac

SEQ ID NO: 202787 - RNA, 23 nt, Human
guggaggcugacagaaugugccc

SEQ ID NO: 202788 - RNA, 18 nt, Human
guggggagaggcuggggc

SEQ ID NO: 202789 - RNA, 21 nt, Human
uaaaaggcccaaaggacaggg

SEQ ID NO: 202790 - RNA, 18 nt, Human
uagccacccacagcugcu

SEQ ID NO: 202791 - RNA, 25 nt, Human
uaugcuuugaggcugggcacggugg

SEQ ID NO: 202792 - RNA, 22 nt, Human
ucaugccucuaaucccagcacu

SEQ ID NO: 202793 - RNA, 24 nt, Human
ucccaaagcgcuggcauuacaggc

SEQ ID NO: 202794 - RNA, 20 nt, Human
ucccacgugggcacagaguu

SEQ ID NO: 202795 - RNA, 22 nt, Human
uccccagggaccacacagaccc

SEQ ID NO: 202796 - RNA, 20 nt, Human
ucccuggcccgcucucccca

SEQ ID NO: 202797 - RNA, 23 nt, Human
ucccuggcccgcucuccccaccc

SEQ ID NO: 202798 - RNA, 18 nt, Human
ucgccccgccccgccugc

SEQ ID NO: 202799 - RNA, 19 nt, Human
ucucacuguguugcucugg

SEQ ID NO: 202800 - RNA, 22 nt, Human
ucucccacgcaaucucaaggau

SEQ ID NO: 202801 - RNA, 24 nt, Human
ucugaccuucuccuguccucuuuu

SEQ ID NO: 202802 - RNA, 25 nt, Human
ucugaccuucuccuguccucuuuuc

SEQ ID NO: 202803 - RNA, 23 nt, Human
ucugagccaaaacagacaugagc

SEQ ID NO: 202804 - RNA, 23 nt, Human
ucuggacuggccuugcugggcuu

SEQ ID NO: 202805 - RNA, 23 nt, Human
ugaccuucuccuguccucuuuuc

SEQ ID NO: 202806 - RNA, 22 nt, Human
ugagacuguggggagaggcugg

SEQ ID NO: 202807 - RNA, 19 nt, Human
ugagccaaaacagacauga

SEQ ID NO: 202808 - RNA, 26 nt, Human
ugagcgauccuccugccuccgccucc

SEQ ID NO: 202809 - RNA, 27 nt, Human
ugagcgauccuccugccuccgccuccc

SEQ ID NO: 202810 - RNA, 24 nt, Human
ugaggcugggcacgguggcucaug

SEQ ID NO: 202811 - RNA, 24 nt, Human
ugccacaggagcgauuauagugac

SEQ ID NO: 202812 - RNA, 26 nt, Human
ugcccaaggcaggacucuaaucugau

SEQ ID NO: 202813 - RNA, 20 nt, Human
ugcccagagggugacguaac

SEQ ID NO: 202814 - RNA, 22 nt, Human
ugccucaggccucaaaaaacag

SEQ ID NO: 202815 - RNA, 23 nt, Human
ugccucaggccucaaaaaacagc

SEQ ID NO: 202816 - RNA, 25 nt, Human
ugccucaggccucaaaaaacagccu

SEQ ID NO: 202817 - RNA, 24 nt, Human
ugccuccgccucccaaagcgcugg

SEQ ID NO: 202818 - RNA, 24 nt, Human
ugccucuaaucccagcacuuuggg

SEQ ID NO: 202819 - RNA, 22 nt, Human
ugcuggucagagggaggggagg

SEQ ID NO: 202820 - RNA, 18 nt, Human
ugcuucagucauggacag

SEQ ID NO: 202821 - RNA, 19 nt, Human
uggacuggccuugcugggc

SEQ ID NO: 202822 - RNA, 19 nt, Human
uggcauuacaggcgacagc

SEQ ID NO: 202823 - RNA, 22 nt, Human
uggcauuacaggcgacagccau

SEQ ID NO: 202824 - RNA, 24 nt, Human
uggcauuacaggcgacagccaucg

SEQ ID NO: 202825 - RNA, 23 nt, Human
uggcccccugggcagauuccccu

SEQ ID NO: 202826 - RNA, 23 nt, Human
uggcccgcucuccccacccuguu

SEQ ID NO: 202827 - RNA, 21 nt, Human
uggcucaugccucuaauccca

SEQ ID NO: 202828 - RNA, 22 nt, Human
uggcucaugccucuaaucccag

SEQ ID NO: 202829 - RNA, 24 nt, Human
uggcucaugccucuaaucccagca

SEQ ID NO: 202830 - RNA, 22 nt, Human
ugggaggugggagaugauugua

SEQ ID NO: 202831 - RNA, 21 nt, Human
uggggugccucaggccucaaa

SEQ ID NO: 202832 - RNA, 18 nt, Human
uggucagagggaggggag

SEQ ID NO: 202833 - RNA, 21 nt, Human
ugguugcuggucagagggagg

SEQ ID NO: 202834 - RNA, 24 nt, Human
uguagagaugggggucucacugug

SEQ ID NO: 202835 - RNA, 25 nt, Human
uguagagaugggggucucacugugu

SEQ ID NO: 202836 - RNA, 21 nt, Human
ugucauguuggggugccucag

SEQ ID NO: 202837 - RNA, 18 nt, Human
uguccugguugcugguca

SEQ ID NO: 202838 - RNA, 19 nt, Human
uguuggggugccucaggcc

SEQ ID NO: 202839 - RNA, 24 nt, Human
uuguagagaugggggucucacugu

SEQ ID NO: 202840 - RNA, 25 nt, Human
uuguagagaugggggucucacugug

SEQ ID NO: 202841 - RNA, 25 nt, Human
uuuguagagaugggggucucacugu

SEQ ID NO: 202842 - RNA, 21 nt, Human
agcgggcaaaggcuggcugga

SEQ ID NO: 202843 - RNA, 25 nt, Human
agucaagaagggaggggagaaagca

SEQ ID NO: 202844 - RNA, 22 nt, Human
cgacugagcauagauuaagcau

SEQ ID NO: 202845 - RNA, 24 nt, Human
gacuugcugcaccuucaagugcuc

SEQ ID NO: 202846 - RNA, 22 nt, Human
ugaacagagagucaagaaggga

SEQ ID NO: 202847 - RNA, 23 nt, Human
ugagucuagcgggcaaaggcugg

SEQ ID NO: 202848 - RNA, 20 nt, Human
uggaggcagccugaguucug

SEQ ID NO: 202849 - RNA, 22 nt, Human
uucccaguuucccuuucauuuc

SEQ ID NO: 202850 - RNA, 22 nt, Human
uuuaaugagaaacccaguuucc

SEQ ID NO: 202851 - RNA, 22 nt, Human
aaaaauguguauucuaugccuc

SEQ ID NO: 202852 - RNA, 18 nt, Human
acuagguugaagugcugg

SEQ ID NO: 202853 - RNA, 23 nt, Human
agccagcaugggacuggugagga

SEQ ID NO: 202854 - RNA, 18 nt, Human
cagccagcaugggacugg

SEQ ID NO: 202855 - RNA, 18 nt, Human
cagcccuggccguggcuc

SEQ ID NO: 202856 - RNA, 24 nt, Human
cucugugaccccagcccccuccau

SEQ ID NO: 202857 - RNA, 22 nt, Human
gcacucaacagacuguuucagc

SEQ ID NO: 202858 - RNA, 25 nt, Human
uggucugcuccucugguccucuuca

SEQ ID NO: 202859 - RNA, 23 nt, Human
acacacacgaacaagcagacgcg

SEQ ID NO: 202860 - RNA, 18 nt, Human
agcauauuugggugaaga

SEQ ID NO: 202861 - RNA, 23 nt, Human
augaagauacagaucuaagaaca

SEQ ID NO: 202862 - RNA, 25 nt, Human
cagaauaaucaagcauauuugggug

SEQ ID NO: 202863 - RNA, 19 nt, Human
caugugcuagcuuauauau

SEQ ID NO: 202864 - RNA, 21 nt, Human
cuaaggaaacaggacuugggc

SEQ ID NO: 202865 - RNA, 21 nt, Human
cuuguaaaaauaaugauacau

SEQ ID NO: 202866 - RNA, 19 nt, Human
gaacagaaggauaaucaug

SEQ ID NO: 202867 - RNA, 28 nt, Human
gggcaaaauuuuuuauuaugaagauaca

SEQ ID NO: 202868 - RNA, 19 nt, Human
uagaaaaugaaaaucugca

SEQ ID NO: 202869 - RNA, 19 nt, Human
uaucaaugcuaucacaaau

SEQ ID NO: 202870 - RNA, 19 nt, Human
uauuugggugaagagagua

SEQ ID NO: 202871 - RNA, 20 nt, Human
ugaaaauuaguagaaaauga

SEQ ID NO: 202872 - RNA, 18 nt, Human
ugauacaugaaaauuagu

SEQ ID NO: 202873 - RNA, 20 nt, Human
ugcaacgacacacacacgaa

SEQ ID NO: 202874 - RNA, 21 nt, Human
uguaaaaauaaugauacauga

SEQ ID NO: 202875 - RNA, 20 nt, Human
uuaauaguguagugugcccu

SEQ ID NO: 202876 - RNA, 19 nt, Human
uuccccugcaucuuaguuc

SEQ ID NO: 202877 - RNA, 20 nt, Human
aggcagaguggugggggggu

SEQ ID NO: 202878 - RNA, 22 nt, Human
aguggugggggggugagcagag

SEQ ID NO: 202879 - RNA, 21 nt, Human
cacaagcaccccugcuuccca

SEQ ID NO: 202880 - RNA, 22 nt, Human
caccccugcuucccauauucag

SEQ ID NO: 202881 - RNA, 26 nt, Human
ccccugcuucccauauucagcauucc

SEQ ID NO: 202882 - RNA, 18 nt, Human
cugaaccauacacugcca

SEQ ID NO: 202883 - RNA, 21 nt, Human
cugaaccauacacugccaccc

SEQ ID NO: 202884 - RNA, 27 nt, Human
ggaggccaggcagaguggugggggggu

SEQ ID NO: 202885 - RNA, 19 nt, Human
ggcugugggugggugggaa

SEQ ID NO: 202886 - RNA, 24 nt, Human
uacacugccaccccuuuuguaucc

SEQ ID NO: 202887 - RNA, 19 nt, Human
aaccacauggucuuuccuc

SEQ ID NO: 202888 - RNA, 26 nt, Human
accuucuuguugggccaaugacugcg

SEQ ID NO: 202889 - RNA, 20 nt, Human
auuugguaacagcaaaccac

SEQ ID NO: 202890 - RNA, 19 nt, Human
caaguuaaaagagucccua

SEQ ID NO: 202891 - RNA, 21 nt, Human
caccaggaaacagaagaugcu

SEQ ID NO: 202892 - RNA, 20 nt, Human
ccaaaguagcaggaaucacu

SEQ ID NO: 202893 - RNA, 24 nt, Human
ccacaugcacaucucugucauccu

SEQ ID NO: 202894 - RNA, 26 nt, Human
cucaccaggaaacagaagaugcuggg

SEQ ID NO: 202895 - RNA, 19 nt, Human
gaguagaaauggagcucua

SEQ ID NO: 202896 - RNA, 22 nt, Human
gauucuagggugacccuagggu

SEQ ID NO: 202897 - RNA, 21 nt, Human
gcaggaccugagcuugugccc

SEQ ID NO: 202898 - RNA, 21 nt, Human
ggaauggaagauuaaaaagaa

SEQ ID NO: 202899 - RNA, 20 nt, Human
gggccaaugacugcgcaggu

SEQ ID NO: 202900 - RNA, 26 nt, Human
uaacaauacccacaugcacaucucug

SEQ ID NO: 202901 - RNA, 26 nt, Human
uaugauuaggacagaaaccggggucc

SEQ ID NO: 202902 - RNA, 18 nt, Human
ucuccuaacaauacccac

SEQ ID NO: 202903 - RNA, 20 nt, Human
ugaaggaauggaagauuaaa

SEQ ID NO: 202904 - RNA, 22 nt, Human
uggaagauuaaaaagaaaggaa

SEQ ID NO: 202905 - RNA, 23 nt, Human
uguucagaaucagcuacugagau

SEQ ID NO: 202906 - RNA, 21 nt, Human
uuguugggccaaugacugcgc

SEQ ID NO: 202907 - RNA, 33 nt, Human
uuugguaacagcaaaccacauggucuuuccuuu

SEQ ID NO: 202908 - RNA, 18 nt, Human
aaacacuugccaggaaac

SEQ ID NO: 202909 - RNA, 21 nt, Human
agagaggcagcaggaccuggg

SEQ ID NO: 202910 - RNA, 18 nt, Human
agaggcagcaggaccugg

SEQ ID NO: 202911 - RNA, 24 nt, Human
auggagcucuauuagucaaaagag

SEQ ID NO: 202912 - RNA, 19 nt, Human
caaguuaagagagaccaca

SEQ ID NO: 202913 - RNA, 21 nt, Human
cacuugccaggaaacagaaga

SEQ ID NO: 202914 - RNA, 18 nt, Human
cagaagaggguaaccgua

SEQ ID NO: 202915 - RNA, 22 nt, Human
cagaagaugcuggagagcagau

SEQ ID NO: 202916 - RNA, 21 nt, Human
caggaccugggcuugugcccc

SEQ ID NO: 202917 - RNA, 24 nt, Human
ccacaugcacaucucugucauccu

SEQ ID NO: 202918 - RNA, 23 nt, Human
ccacugagauuugguaacagcaa

SEQ ID NO: 202919 - RNA, 19 nt, Human
ccagaagaggguaaccgua

SEQ ID NO: 202920 - RNA, 24 nt, Human
cuugccaggaaacagaagaugcug

SEQ ID NO: 202921 - RNA, 20 nt, Human
gaaaagaaaugcuuucucau

SEQ ID NO: 202922 - RNA, 21 nt, Human
gcaggaccugggcuugugccc

SEQ ID NO: 202923 - RNA, 21 nt, Human
ggaaacagaagaugcuggaga

SEQ ID NO: 202924 - RNA, 22 nt, Human
ggaauaggagauuaaagagaaa

SEQ ID NO: 202925 - RNA, 19 nt, Human
ggcuugugccccuguugcc

SEQ ID NO: 202926 - RNA, 26 nt, Human
uaacaauacccacaugcacaucucug

SEQ ID NO: 202927 - RNA, 24 nt, Human
uagcaggaaacacuugccaggaaa

SEQ ID NO: 202928 - RNA, 23 nt, Human
ugaagaagacaguaaguugggca

SEQ ID NO: 202929 - RNA, 20 nt, Human
ugaaggaauaggagauuaaa

SEQ ID NO: 202930 - RNA, 18 nt, Human
ugacccagaagaggguaa

SEQ ID NO: 202931 - RNA, 20 nt, Human
ugccaggaaacagaagaugc

SEQ ID NO: 202932 - RNA, 22 nt, Human
uguaugaagccaggugggugga

SEQ ID NO: 202933 - RNA, 23 nt, Human
uguucagaaucagccacugagau

SEQ ID NO: 202934 - RNA, 21 nt, Human
uuaaaacauuuauugcucuuu

SEQ ID NO: 202935 - RNA, 24 nt, Human
uuaagcauuaaaacauuuauugcu

SEQ ID NO: 202936 - RNA, 22 nt, Human
aaccaccuacaagcacucucac

SEQ ID NO: 202937 - RNA, 20 nt, Human
aacuuguuaucucgccgucu

SEQ ID NO: 202938 - RNA, 20 nt, Human
aagcugcccuaagcaagccc

SEQ ID NO: 202939 - RNA, 23 nt, Human
aauaaaagaggcacaaaaaauau

SEQ ID NO: 202940 - RNA, 23 nt, Human
aauugcuuuucaaagaaauguau

SEQ ID NO: 202941 - RNA, 18 nt, Human
agaagggacaccggcauu

SEQ ID NO: 202942 - RNA, 19 nt, Human
agcugccagggccacugcc

SEQ ID NO: 202943 - RNA, 21 nt, Human
agcuuaaccaaccaccuacaa

SEQ ID NO: 202944 - RNA, 19 nt, Human
aggaguggccuuggcgagg

SEQ ID NO: 202945 - RNA, 18 nt, Human
aucaauucauguccaucu

SEQ ID NO: 202946 - RNA, 24 nt, Human
caaccaccuacaagcacucucagu

SEQ ID NO: 202947 - RNA, 20 nt, Human
caagaaaaugcugacuaaug

SEQ ID NO: 202948 - RNA, 18 nt, Human
caagaagcugcccuaagc

SEQ ID NO: 202949 - RNA, 18 nt, Human
caagacaaaguuaugugg

SEQ ID NO: 202950 - RNA, 19 nt, Human
cauccgaaauagcagguuc

SEQ ID NO: 202951 - RNA, 20 nt, Human
cauuuucaccaaaacccugg

SEQ ID NO: 202952 - RNA, 23 nt, Human
ccagaaagcgcgggaacgaaucc

SEQ ID NO: 202953 - RNA, 19 nt, Human
cccuaagcaagcccucuuc

SEQ ID NO: 202954 - RNA, 23 nt, Human
ccgaaauagcagguucaccaaaa

SEQ ID NO: 202955 - RNA, 18 nt, Human
ccgcuccgccagcugcca

SEQ ID NO: 202956 - RNA, 24 nt, Human
ccggcgccacgugcacacgggcug

SEQ ID NO: 202957 - RNA, 20 nt, Human
ccuacaagcacucucacuuc

SEQ ID NO: 202958 - RNA, 24 nt, Human
cgaaauagcagguucaccaaaaga

SEQ ID NO: 202959 - RNA, 21 nt, Human
cucuagucaaucacauuuugc

SEQ ID NO: 202960 - RNA, 23 nt, Human
gaaauagcagguucaccaaaagg

SEQ ID NO: 202961 - RNA, 23 nt, Human
gaacgaauccacgccgggggucg

SEQ ID NO: 202962 - RNA, 22 nt, Human
gcauuuucaccaaaacccuggu

SEQ ID NO: 202963 - RNA, 19 nt, Human
gccacugccgcgcucacuc

SEQ ID NO: 202964 - RNA, 21 nt, Human
gccgcugccgccuccgcuccg

SEQ ID NO: 202965 - RNA, 19 nt, Human
ggagagccgccaggcccaa

SEQ ID NO: 202966 - RNA, 26 nt, Human
ggcaaccgaaaggcagcgccggcgcc

SEQ ID NO: 202967 - RNA, 23 nt, Human
ggcauuuucaccaaaacccuggu

SEQ ID NO: 202968 - RNA, 18 nt, Human
ggcugggccgcuccgcca

SEQ ID NO: 202969 - RNA, 20 nt, Human
ggcugggccgcuccgccagc

SEQ ID NO: 202970 - RNA, 20 nt, Human
gggccgcuccgccagcugcc

SEQ ID NO: 202971 - RNA, 24 nt, Human
gggcugggccgcuccgccagcugc

SEQ ID NO: 202972 - RNA, 22 nt, Human
uaagcaagcccucuuccagcca

SEQ ID NO: 202973 - RNA, 23 nt, Human
uagaacuaaaaugcccaauguca

SEQ ID NO: 202974 - RNA, 23 nt, Human
ugcccuaagcaagcccucuucca

SEQ ID NO: 202975 - RNA, 19 nt, Human
uggcaaccgaaaggcagcg

SEQ ID NO: 202976 - RNA, 18 nt, Human
uggucugcugagcagcaa

SEQ ID NO: 202977 - RNA, 22 nt, Human
uucaaaaauaaaagaggcacaa

SEQ ID NO: 202978 - RNA, 24 nt, Human
aaaaaaaaacggaguuuaugugca

SEQ ID NO: 202979 - RNA, 24 nt, Human
aaaaaaacggaguuuaugugcagg

SEQ ID NO: 202980 - RNA, 23 nt, Human
aagugcugcguuugccgcccgcu

SEQ ID NO: 202981 - RNA, 23 nt, Human
acuuggguucgagucccaccccu

SEQ ID NO: 202982 - RNA, 22 nt, Human
agagaggggggcagugugucca

SEQ ID NO: 202983 - RNA, 20 nt, Human
agcugcagaguccgcagagg

SEQ ID NO: 202984 - RNA, 21 nt, Human
aggcaagagaggggggcagug

SEQ ID NO: 202985 - RNA, 18 nt, Human
aggggugggguggggugg

SEQ ID NO: 202986 - RNA, 20 nt, Human
agggguggggugggguggag

SEQ ID NO: 202987 - RNA, 26 nt, Human
agggguggggugggguggaguggggu

SEQ ID NO: 202988 - RNA, 24 nt, Human
caccacgcagaaacaaugcaccuc

SEQ ID NO: 202989 - RNA, 22 nt, Human
cacgagcguaggccuccaggga

SEQ ID NO: 202990 - RNA, 20 nt, Human
cagaaaaggcuggcuggaug

SEQ ID NO: 202991 - RNA, 19 nt, Human
ccaagaaggaugugcagcg

SEQ ID NO: 202992 - RNA, 26 nt, Human
ccacgcagaaacaaugcaccucgcgc

SEQ ID NO: 202993 - RNA, 20 nt, Human
cccucuauuuccuucuuugu

SEQ ID NO: 202994 - RNA, 22 nt, Human
cccugcgccggggccgcggagc

SEQ ID NO: 202995 - RNA, 19 nt, Human
ccgcuccgcccuacuccgc

SEQ ID NO: 202996 - RNA, 21 nt, Human
ccucuauuuccuucuuuguuc

SEQ ID NO: 202997 - RNA, 21 nt, Human
ccugcgccggggccgcggagc

SEQ ID NO: 202998 - RNA, 24 nt, Human
cgcccgugcccucccucucccugc

SEQ ID NO: 202999 - RNA, 18 nt, Human
cgccggggccgcggagcu

SEQ ID NO: 203000 - RNA, 20 nt, Human
cgcgaccuggugugggcugg

SEQ ID NO: 203001 - RNA, 19 nt, Human
cggaaagugcugcguuugc

SEQ ID NO: 203002 - RNA, 23 nt, Human
cggcggacugguuccaagccccu

SEQ ID NO: 203003 - RNA, 20 nt, Human
cgggguaguggagagaggcc

SEQ ID NO: 203004 - RNA, 20 nt, Human
cucugcgcucgggcccggcc

SEQ ID NO: 203005 - RNA, 19 nt, Human
cuucuuuguucuacaggag

SEQ ID NO: 203006 - RNA, 24 nt, Human
gacagcggccgaggcaccagcagg

SEQ ID NO: 203007 - RNA, 20 nt, Human
gaggcaagagaggggggcag

SEQ ID NO: 203008 - RNA, 24 nt, Human
gaggcaccagcaggcagaaaaggc

SEQ ID NO: 203009 - RNA, 18 nt, Human
gccgaggcaccagcaggc

SEQ ID NO: 203010 - RNA, 18 nt, Human
gccgcccgcuccgcccua

SEQ ID NO: 203011 - RNA, 21 nt, Human
gcgcagcgcgccgccagcucc

SEQ ID NO: 203012 - RNA, 19 nt, Human
gcgccaggaagccaagaag

SEQ ID NO: 203013 - RNA, 18 nt, Human
gcgcucgggcccggccgc

SEQ ID NO: 203014 - RNA, 27 nt, Human
gcggacugguuccaagccccuucagag

SEQ ID NO: 203015 - RNA, 23 nt, Human
gcggcguucagcucggccgaagc

SEQ ID NO: 203016 - RNA, 22 nt, Human
ggagagaggccauuuaguagug

SEQ ID NO: 203017 - RNA, 24 nt, Human
ggcccggccgcugcgggcucguca

SEQ ID NO: 203018 - RNA, 22 nt, Human
ggcgccaggaagccaagaagga

SEQ ID NO: 203019 - RNA, 22 nt, Human
ggggcggggcucggacagcggc

SEQ ID NO: 203020 - RNA, 21 nt, Human
gggggcuucgcucacccccga

SEQ ID NO: 203021 - RNA, 19 nt, Human
gggguggaguggggugggg

SEQ ID NO: 203022 - RNA, 25 nt, Human
ggguggggugagaugagugggagac

SEQ ID NO: 203023 - RNA, 18 nt, Human
gguaguggagagaggcca

SEQ ID NO: 203024 - RNA, 24 nt, Human
ucccucuauuuccuucuuuguucu

SEQ ID NO: 203025 - RNA, 20 nt, Human
ugagaugagugggagacuug

SEQ ID NO: 203026 - RNA, 18 nt, Human
ugcaagcccgcggggcgg

SEQ ID NO: 203027 - RNA, 20 nt, Human
uggaggggugggguggggug

SEQ ID NO: 203028 - RNA, 21 nt, Human
uggaguggagggguggggugg

SEQ ID NO: 203029 - RNA, 24 nt, Human
uggaguggaguggagggguggggu

SEQ ID NO: 203030 - RNA, 20 nt, Human
uggagugggguggggugggg

SEQ ID NO: 203031 - RNA, 25 nt, Human
ugggguggggugagaugagugggag

SEQ ID NO: 203032 - RNA, 21 nt, Human
uggggugggguggggugagau

SEQ ID NO: 203033 - RNA, 25 nt, Human
uggguucgagucccaccccucucgg

SEQ ID NO: 203034 - RNA, 18 nt, Human
ugugcagcggcggacugg

SEQ ID NO: 203035 - RNA, 19 nt, Human
ugugcagcggcggacuggu

SEQ ID NO: 203036 - RNA, 20 nt, Human
ugugcagcggcggacugguu

SEQ ID NO: 203037 - RNA, 21 nt, Human
uuggguucgagucccaccccu

SEQ ID NO: 203038 - RNA, 23 nt, Human
aaaaagaagaaauagucguaaga

SEQ ID NO: 203039 - RNA, 21 nt, Human
aaacacaggaaauugagaacu

SEQ ID NO: 203040 - RNA, 18 nt, Human
aaacggaacacuggaucc

SEQ ID NO: 203041 - RNA, 23 nt, Human
agaacugacaaacagaaauacua

SEQ ID NO: 203042 - RNA, 18 nt, Human
agcaaucuuggaaaggcc

SEQ ID NO: 203043 - RNA, 23 nt, Human
agucuugaagcuccaaaacaaaa

SEQ ID NO: 203044 - RNA, 24 nt, Human
caguacuucaccaaaaaauuucaa

SEQ ID NO: 203045 - RNA, 25 nt, Human
caucucugcauguagaaaccggaaa

SEQ ID NO: 203046 - RNA, 23 nt, Human
ccgcacagguucgcucugggaag

SEQ ID NO: 203047 - RNA, 19 nt, Human
cgccggugccugcagccgc

SEQ ID NO: 203048 - RNA, 20 nt, Human
cgcgccggugccugcagccg

SEQ ID NO: 203049 - RNA, 22 nt, Human
cgcgccggugccugcagccgca

SEQ ID NO: 203050 - RNA, 21 nt, Human
cggcucggcucugagauuggg

SEQ ID NO: 203051 - RNA, 20 nt, Human
cucggcucugagauuggggg

SEQ ID NO: 203052 - RNA, 23 nt, Human
cucugcauguagaaaccggaaaa

SEQ ID NO: 203053 - RNA, 21 nt, Human
cuggauccgcgagaagagcuc

SEQ ID NO: 203054 - RNA, 25 nt, Human
gacaacgggagucacucucgaaaaa

SEQ ID NO: 203055 - RNA, 24 nt, Human
gcucugagauugggggcuggaaac

SEQ ID NO: 203056 - RNA, 21 nt, Human
ggaacacuggauccgcgagaa

SEQ ID NO: 203057 - RNA, 25 nt, Human
guuaaguguauuaaaaagaagaaau

SEQ ID NO: 203058 - RNA, 20 nt, Human
uauaaauucaucucugcaug

SEQ ID NO: 203059 - RNA, 18 nt, Human
ucccugcucucugucggc

SEQ ID NO: 203060 - RNA, 26 nt, Human
ucgacgcgccggugccugcagccgca

SEQ ID NO: 203061 - RNA, 20 nt, Human
ucugagauugggggcuggaa

SEQ ID NO: 203062 - RNA, 19 nt, Human
ugaaguaaccaacuuaaaa

SEQ ID NO: 203063 - RNA, 18 nt, Human
ugagaacugacaaacaga

SEQ ID NO: 203064 - RNA, 21 nt, Human
ugggacaacgggagucacucu

SEQ ID NO: 203065 - RNA, 20 nt, Human
uguagaaaccggaaaaaaag

SEQ ID NO: 203066 - RNA, 20 nt, Human
uuaaaaaauggccugaguua

SEQ ID NO: 203067 - RNA, 23 nt, Human
uugaagcuccaaaacaaaaacag

SEQ ID NO: 203068 - RNA, 26 nt, Human
uuucaacauugcaaacacaggaaauu

SEQ ID NO: 203069 - RNA, 21 nt, Human
aaaaaaaaaaaaaaaaacaaa

SEQ ID NO: 203070 - RNA, 25 nt, Human
aaaaaaaaaaaaaaaaacaaacucg

SEQ ID NO: 203071 - RNA, 24 nt, Human
aaaaaaaaacaaacucguacagaa

SEQ ID NO: 203072 - RNA, 21 nt, Human
aaaaaaaacaaacucguacag

SEQ ID NO: 203073 - RNA, 20 nt, Human
aaaaaaacaaacucguacag

SEQ ID NO: 203074 - RNA, 21 nt, Human
aaaaaaacaaacucguacaga

SEQ ID NO: 203075 - RNA, 22 nt, Human
aaaaacauacauucccagccuu

SEQ ID NO: 203076 - RNA, 22 nt, Human
aaaacauacauucccagccuuu

SEQ ID NO: 203077 - RNA, 18 nt, Human
aaacauacauucccagcc

SEQ ID NO: 203078 - RNA, 21 nt, Human
aaacauacuaaagaacaaagg

SEQ ID NO: 203079 - RNA, 23 nt, Human
aaguccuugagucccaacagucc

SEQ ID NO: 203080 - RNA, 18 nt, Human
acuaaagaacaaaggccc

SEQ ID NO: 203081 - RNA, 19 nt, Human
agaagugaagcagcaaaga

SEQ ID NO: 203082 - RNA, 19 nt, Human
agacaaacauacuaaagaa

SEQ ID NO: 203083 - RNA, 21 nt, Human
agacaaacauacuaaagaaca

SEQ ID NO: 203084 - RNA, 25 nt, Human
auuaccaucagguuacaacuuaacu

SEQ ID NO: 203085 - RNA, 22 nt, Human
caaaaaaaaaaaaaaaaaaaaa

SEQ ID NO: 203086 - RNA, 19 nt, Human
cagcaaagagcugaagcag

SEQ ID NO: 203087 - RNA, 25 nt, Human
cagcagcaaaguccuugagucccaa

SEQ ID NO: 203088 - RNA, 21 nt, Human
caguaucaacauuaaaugcaa

SEQ ID NO: 203089 - RNA, 24 nt, Human
ccaagcaaaaaaaaaaaaaaaaaa

SEQ ID NO: 203090 - RNA, 22 nt, Human
ccuugagucccaacaguccacc

SEQ ID NO: 203091 - RNA, 20 nt, Human
cgaaacacccuuacaguauc

SEQ ID NO: 203092 - RNA, 19 nt, Human
cgccggugccugcagccgc

SEQ ID NO: 203093 - RNA, 18 nt, Human
cgcucuggaaagccuugg

SEQ ID NO: 203094 - RNA, 23 nt, Human
cugugggcuccgcucugagacug

SEQ ID NO: 203095 - RNA, 19 nt, Human
gaacgccggaaacucaaca

SEQ ID NO: 203096 - RNA, 23 nt, Human
ggaacgccggaaacucaacacgc

SEQ ID NO: 203097 - RNA, 27 nt, Human
gugaagcagcaaagagcugaagcagaa

SEQ ID NO: 203098 - RNA, 21 nt, Human
uaaaaacauacauucccagcc

SEQ ID NO: 203099 - RNA, 22 nt, Human
ucaaagacaaacauacuaaaga

SEQ ID NO: 203100 - RNA, 24 nt, Human
ucaacacgccggugccugcagccg

SEQ ID NO: 203101 - RNA, 26 nt, Human
ucaacacgccggugccugcagccgca

SEQ ID NO: 203102 - RNA, 21 nt, Human
uccaccucaaagacaaacaua

SEQ ID NO: 203103 - RNA, 22 nt, Human
uccuugagucccaacaguccac

SEQ ID NO: 203104 - RNA, 21 nt, Human
ucgccaagcaaaaaaaaaaaa

SEQ ID NO: 203105 - RNA, 25 nt, Human
ucgccaagcaaaaaaaaaaaaaaaa

SEQ ID NO: 203106 - RNA, 23 nt, Human
ucgguuguacuacaaaaauaaug

SEQ ID NO: 203107 - RNA, 20 nt, Human
ucugagacugggggcuggaa

SEQ ID NO: 203108 - RNA, 18 nt, Human
ugaagcagcaaagagcug

SEQ ID NO: 203109 - RNA, 21 nt, Human
ugaagccagcuaauuaccauc

SEQ ID NO: 203110 - RNA, 24 nt, Human
aaauaacagacauucaaauacauc

SEQ ID NO: 203111 - RNA, 20 nt, Human
acaaccgggguccccccacc

SEQ ID NO: 203112 - RNA, 24 nt, Human
acaggaugugagggagugugauag

SEQ ID NO: 203113 - RNA, 20 nt, Human
agggagugugauagguggug

SEQ ID NO: 203114 - RNA, 21 nt, Human
caaauaagcauccacacagga

SEQ ID NO: 203115 - RNA, 21 nt, Human
caaccgggguccccccacccc

SEQ ID NO: 203116 - RNA, 23 nt, Human
caaccgggguccccccacccccc

SEQ ID NO: 203117 - RNA, 21 nt, Human
cacaaccgggguccccccacc

SEQ ID NO: 203118 - RNA, 20 nt, Human
cacacaggaagaagaauguu

SEQ ID NO: 203119 - RNA, 23 nt, Human
caccccccaccccgucccucccu

SEQ ID NO: 203120 - RNA, 24 nt, Human
cagaauuuccaagggaugguaacu

SEQ ID NO: 203121 - RNA, 25 nt, Human
caguaaucuuuuuccaaacuggccc

SEQ ID NO: 203122 - RNA, 19 nt, Human
ccaccccgucccucccugc

SEQ ID NO: 203123 - RNA, 25 nt, Human
ccccaccccccaccccgucccuccc

SEQ ID NO: 203124 - RNA, 18 nt, Human
ccccaccccgucccuccc

SEQ ID NO: 203125 - RNA, 19 nt, Human
ccccaccccgucccucccu

SEQ ID NO: 203126 - RNA, 20 nt, Human
ccccaccccgucccucccug

SEQ ID NO: 203127 - RNA, 24 nt, Human
ccccaccccgucccucccugcaaa

SEQ ID NO: 203128 - RNA, 22 nt, Human
cccccaccccccaccccguccc

SEQ ID NO: 203129 - RNA, 18 nt, Human
cccccaccccgucccucc

SEQ ID NO: 203130 - RNA, 18 nt, Human
ccccccaccccccacccc

SEQ ID NO: 203131 - RNA, 22 nt, Human
cgccuucgcuucaguuuggaaa

SEQ ID NO: 203132 - RNA, 23 nt, Human
cugaguccauuccaaagucagaa

SEQ ID NO: 203133 - RNA, 19 nt, Human
gaaacguccagauuacgca

SEQ ID NO: 203134 - RNA, 23 nt, Human
gacaaauaagcauccacacagga

SEQ ID NO: 203135 - RNA, 20 nt, Human
gccuaguuuuccugagucca

SEQ ID NO: 203136 - RNA, 21 nt, Human
ggguccccccaccccccaccc

SEQ ID NO: 203137 - RNA, 18 nt, Human
uacauguagaggcauccu

SEQ ID NO: 203138 - RNA, 24 nt, Human
uagguggugcaugagacuccuucu

SEQ ID NO: 203139 - RNA, 20 nt, Human
uccaaagucagaaacaggau

SEQ ID NO: 203140 - RNA, 19 nt, Human
uccacacaggaagaagaau

SEQ ID NO: 203141 - RNA, 19 nt, Human
uccccccaccccccacccc

SEQ ID NO: 203142 - RNA, 18 nt, Human
ugagggagugugauaggu

SEQ ID NO: 203143 - RNA, 22 nt, Human
ugagggagugugauagguggug

SEQ ID NO: 203144 - RNA, 22 nt, Human
ugaguccauuccaaagucagaa

SEQ ID NO: 203145 - RNA, 20 nt, Human
ugcuucaguucuaaaaagaa

SEQ ID NO: 203146 - RNA, 19 nt, Human
uuaaagaggggccuaguuu

SEQ ID NO: 203147 - RNA, 20 nt, Human
aaagagagagagagaaaggc

SEQ ID NO: 203148 - RNA, 21 nt, Human
aagacuuccaacaauagaucu

SEQ ID NO: 203149 - RNA, 24 nt, Human
accucgaauaauguuuuuaaaaaa

SEQ ID NO: 203150 - RNA, 19 nt, Human
acuuuuauaauuaaacuaa

SEQ ID NO: 203151 - RNA, 24 nt, Human
agagagagagagaaaggcaaagag

SEQ ID NO: 203152 - RNA, 22 nt, Human
aggcgaaaggcacauggcggca

SEQ ID NO: 203153 - RNA, 24 nt, Human
caaaaaaaaagagagagagagaaa

SEQ ID NO: 203154 - RNA, 23 nt, Human
caaaaaguauaccuguccuuaac

SEQ ID NO: 203155 - RNA, 19 nt, Human
cacauggcggcaggcaaga

SEQ ID NO: 203156 - RNA, 18 nt, Human
gaacaggugugcaaacuu

SEQ ID NO: 203157 - RNA, 23 nt, Human
ggcacaaggacauuucaaagaaa

SEQ ID NO: 203158 - RNA, 24 nt, Human
uacagaacaggugugcaaacuuaa

SEQ ID NO: 203159 - RNA, 23 nt, Human
ucaaaaaugcucaagucagcaaa

SEQ ID NO: 203160 - RNA, 28 nt, Human
ucaaacaaaucuccaugcacgaacuaaa

SEQ ID NO: 203161 - RNA, 22 nt, Human
ucaaagaaacaaacaaaaaaaa

SEQ ID NO: 203162 - RNA, 23 nt, Human
ucaagucagcaaacacgcaaaau

SEQ ID NO: 203163 - RNA, 24 nt, Human
ucauuugcauauaccaaagacuuc

SEQ ID NO: 203164 - RNA, 24 nt, Human
ugcauuuaugcauuuguuugcaaa

SEQ ID NO: 203165 - RNA, 22 nt, Human
uucaaagaaacaaacaaaaaaa

SEQ ID NO: 203166 - RNA, 25 nt, Human
uugcaccucuccuuucauuugcaua

SEQ ID NO: 203167 - RNA, 20 nt, Human
uuuccaagcuucuacagaac

SEQ ID NO: 203168 - RNA, 18 nt, Human
uuuuuuuuuuuuuuuuug

SEQ ID NO: 203169 - RNA, 22 nt, Human
aaaaauuuuuuuuuuuuuaaga

SEQ ID NO: 203170 - RNA, 21 nt, Human
aaaauccccuaaaaacugacu

SEQ ID NO: 203171 - RNA, 19 nt, Human
aaaauuaacaaggauuuaa

SEQ ID NO: 203172 - RNA, 19 nt, Human
aaagcauaauuagagcucc

SEQ ID NO: 203173 - RNA, 19 nt, Human
aagaaaucuucaguauuca

SEQ ID NO: 203174 - RNA, 23 nt, Human
aagcagagagcaagcagaccaca

SEQ ID NO: 203175 - RNA, 21 nt, Human
aagcauaauuagagcuccugc

SEQ ID NO: 203176 - RNA, 18 nt, Human
aagcucaguaagacuaac

SEQ ID NO: 203177 - RNA, 24 nt, Human
acaaacgcuuaauucuaacuaugc

SEQ ID NO: 203178 - RNA, 21 nt, Human
acaccaaaaaaaaaaaaaaaa

SEQ ID NO: 203179 - RNA, 24 nt, Human
accccauccccacaccaggcaggg

SEQ ID NO: 203180 - RNA, 18 nt, Human
acccccaucccagcaccc

SEQ ID NO: 203181 - RNA, 19 nt, Human
acccccaucccagcaccca

SEQ ID NO: 203182 - RNA, 21 nt, Human
acccuuccccacacacacaca

SEQ ID NO: 203183 - RNA, 21 nt, Human
acuuucaggaagagccuccag

SEQ ID NO: 203184 - RNA, 23 nt, Human
agagagcaagcagaccacaucau

SEQ ID NO: 203185 - RNA, 19 nt, Human
agagagggaagagaacaca

SEQ ID NO: 203186 - RNA, 23 nt, Human
agagagggaagagaacacaggug

SEQ ID NO: 203187 - RNA, 24 nt, Human
agcacccacacccuuccccacaca

SEQ ID NO: 203188 - RNA, 23 nt, Human
aggaagagccuccagguuuaaag

SEQ ID NO: 203189 - RNA, 20 nt, Human
aggcacucuguuauacagaa

SEQ ID NO: 203190 - RNA, 21 nt, Human
agggaagagaacacaggugag

SEQ ID NO: 203191 - RNA, 24 nt, Human
augaaaaagauacaaugcacuuaa

SEQ ID NO: 203192 - RNA, 24 nt, Human
auuggccacacaguuaagaaugag

SEQ ID NO: 203193 - RNA, 22 nt, Human
caacauaaguauacuuuccccu

SEQ ID NO: 203194 - RNA, 27 nt, Human
cacacacacacacacaccaaaaaaaaa

SEQ ID NO: 203195 - RNA, 24 nt, Human
cacacccuuccccacacacacaca

SEQ ID NO: 203196 - RNA, 18 nt, Human
caccacacuucuuuaaca

SEQ ID NO: 203197 - RNA, 19 nt, Human
cacucucuguccuggccuc

SEQ ID NO: 203198 - RNA, 21 nt, Human
cacucuguuauacagaauauc

SEQ ID NO: 203199 - RNA, 20 nt, Human
cagagcacaccuuuguuccu

SEQ ID NO: 203200 - RNA, 19 nt, Human
cagaggaugugcuaagaac

SEQ ID NO: 203201 - RNA, 24 nt, Human
caggauacaaaucuuuacaccaaa

SEQ ID NO: 203202 - RNA, 23 nt, Human
caggccaggauacaaaucuuuac

SEQ ID NO: 203203 - RNA, 18 nt, Human
caucccagcacccacacc

SEQ ID NO: 203204 - RNA, 23 nt, Human
cauugcacuuuagagccuguaac

SEQ ID NO: 203205 - RNA, 24 nt, Human
cauugcacuuuagagccuguaaca

SEQ ID NO: 203206 - RNA, 22 nt, Human
ccaaaaaaaaaaaaaaaaaaaa

SEQ ID NO: 203207 - RNA, 23 nt, Human
ccaaaaaaaaaaaaaaaaaaaaa

SEQ ID NO: 203208 - RNA, 21 nt, Human
ccaacucuggccucaaacacu

SEQ ID NO: 203209 - RNA, 21 nt, Human
ccacacacacacacacacaca

SEQ ID NO: 203210 - RNA, 20 nt, Human
ccagcacccacacccuuccc

SEQ ID NO: 203211 - RNA, 22 nt, Human
cccaaaaagcagucagaggaau

SEQ ID NO: 203212 - RNA, 20 nt, Human
cccacacacacacacacaca

SEQ ID NO: 203213 - RNA, 22 nt, Human
cccacacacacacacacacaca

SEQ ID NO: 203214 - RNA, 25 nt, Human
cccacacacacacacacacacacca

SEQ ID NO: 203215 - RNA, 23 nt, Human
cccagcacccacacccuucccca

SEQ ID NO: 203216 - RNA, 24 nt, Human
ccccaaaaagcagucagaggaaug

SEQ ID NO: 203217 - RNA, 25 nt, Human
ccccacacacacacacacacacacc

SEQ ID NO: 203218 - RNA, 21 nt, Human
ccccggcggggcuagcgagug

SEQ ID NO: 203219 - RNA, 22 nt, Human
cccuaaaaacugacuaagaaau

SEQ ID NO: 203220 - RNA, 26 nt, Human
cccuaaaaacugacuaagaaaucuuc

SEQ ID NO: 203221 - RNA, 22 nt, Human
cccuccccgaaaauccccuaaa

SEQ ID NO: 203222 - RNA, 18 nt, Human
cccuuccuccuccuaagc

SEQ ID NO: 203223 - RNA, 23 nt, Human
cccuuccuccuccuaagcaauug

SEQ ID NO: 203224 - RNA, 19 nt, Human
ccgugccaugcuccagccc

SEQ ID NO: 203225 - RNA, 18 nt, Human
ccuaagcaauuguucucc

SEQ ID NO: 203226 - RNA, 21 nt, Human
ccuccuccuaagcaauuguuc

SEQ ID NO: 203227 - RNA, 20 nt, Human
ccugucaacacugccccaaa

SEQ ID NO: 203228 - RNA, 21 nt, Human
cgaaaauccccuaaaaacuga

SEQ ID NO: 203229 - RNA, 19 nt, Human
cgggcucgggcccgggucc

SEQ ID NO: 203230 - RNA, 19 nt, Human
cuccaugaaaauccaauug

SEQ ID NO: 203231 - RNA, 22 nt, Human
cuccauugcacuuuagagccug

SEQ ID NO: 203232 - RNA, 25 nt, Human
cucucuguccuggccuccaugaaaa

SEQ ID NO: 203233 - RNA, 21 nt, Human
cugaauaaacaggccaggaua

SEQ ID NO: 203234 - RNA, 24 nt, Human
cugccguguuaauccaugccgugc

SEQ ID NO: 203235 - RNA, 24 nt, Human
cuuaacacacaagugauugugaau

SEQ ID NO: 203236 - RNA, 20 nt, Human
gaaagcaggccucuugggcc

SEQ ID NO: 203237 - RNA, 22 nt, Human
gaacaucucccaccugaauaaa

SEQ ID NO: 203238 - RNA, 23 nt, Human
gaagaagcucagagcacaccuuu

SEQ ID NO: 203239 - RNA, 22 nt, Human
gacagauauuaacacuuaacac

SEQ ID NO: 203240 - RNA, 19 nt, Human
gcacccacacccuucccca

SEQ ID NO: 203241 - RNA, 21 nt, Human
gcagagagcaagcagaccaca

SEQ ID NO: 203242 - RNA, 27 nt, Human
gcccucacaaagagggggaccgguuuc

SEQ ID NO: 203243 - RNA, 26 nt, Human
gggagagagggaagagaacacaggug

SEQ ID NO: 203244 - RNA, 23 nt, Human
guauaccugacauuggccacaca

SEQ ID NO: 203245 - RNA, 18 nt, Human
uaaaggagugaagcauaa

SEQ ID NO: 203246 - RNA, 22 nt, Human
uaacacguacaaauuggcaggu

SEQ ID NO: 203247 - RNA, 26 nt, Human
uaaguauacuuuccccuuccuccucc

SEQ ID NO: 203248 - RNA, 23 nt, Human
uacaaagauucaaaacauuacca

SEQ ID NO: 203249 - RNA, 18 nt, Human
uacaaaucuuuacaccaa

SEQ ID NO: 203250 - RNA, 19 nt, Human
uaccauggcuauauccaac

SEQ ID NO: 203251 - RNA, 19 nt, Human
uagaacaaaguugacaacu

SEQ ID NO: 203252 - RNA, 20 nt, Human
uagacacaugguuaaacaua

SEQ ID NO: 203253 - RNA, 19 nt, Human
uagcgaguggaaagcaggc

SEQ ID NO: 203254 - RNA, 21 nt, Human
uauugggagagagggaagaga

SEQ ID NO: 203255 - RNA, 24 nt, Human
ucacuccugucaacacugccccag

SEQ ID NO: 203256 - RNA, 19 nt, Human
ucagcugcuuaacacguac

SEQ ID NO: 203257 - RNA, 18 nt, Human
ucaggaagagccuccagg

SEQ ID NO: 203258 - RNA, 26 nt, Human
uccaaaaugccucacuccugucaaca

SEQ ID NO: 203259 - RNA, 20 nt, Human
uccaguggguacugcaaccg

SEQ ID NO: 203260 - RNA, 18 nt, Human
uccauacauuaccuauuu

SEQ ID NO: 203261 - RNA, 21 nt, Human
uccaugcaugcuuacacacca

SEQ ID NO: 203262 - RNA, 20 nt, Human
ucccaagagaaguacauggc

SEQ ID NO: 203263 - RNA, 27 nt, Human
uccccacacacacacacacacacacca

SEQ ID NO: 203264 - RNA, 19 nt, Human
uccccacaccaggcaggga

SEQ ID NO: 203265 - RNA, 22 nt, Human
uccccacaccaggcagggagca

SEQ ID NO: 203266 - RNA, 25 nt, Human
uccccuccccgaaaauccccuaaaa

SEQ ID NO: 203267 - RNA, 21 nt, Human
ucuaacuaugcaagauagcau

SEQ ID NO: 203268 - RNA, 19 nt, Human
ucugccguguuaauccaug

SEQ ID NO: 203269 - RNA, 21 nt, Human
ucugggccaguuguaaagggu

SEQ ID NO: 203270 - RNA, 18 nt, Human
ugaagcaugacagguaga

SEQ ID NO: 203271 - RNA, 19 nt, Human
ugccucgaggccuccaugc

SEQ ID NO: 203272 - RNA, 21 nt, Human
ugcucaggccggcuccggcuc

SEQ ID NO: 203273 - RNA, 20 nt, Human
uggaacucuugaagcaugac

SEQ ID NO: 203274 - RNA, 20 nt, Human
uggaguuuccaaaaugccuc

SEQ ID NO: 203275 - RNA, 22 nt, Human
uggaguuuccaaaaugccucac

SEQ ID NO: 203276 - RNA, 19 nt, Human
uggauaacgcaaccuggau

SEQ ID NO: 203277 - RNA, 19 nt, Human
uggauagcuagagcuguag

SEQ ID NO: 203278 - RNA, 21 nt, Human
ugggguauucaugaacauacu

SEQ ID NO: 203279 - RNA, 22 nt, Human
uguacacaagccaucaauuacc

SEQ ID NO: 203280 - RNA, 19 nt, Human
uguggugccucgaggccuc

SEQ ID NO: 203281 - RNA, 22 nt, Human
uuaacacuuaacacacaaguga

SEQ ID NO: 203282 - RNA, 22 nt, Human
uucacccccaucccagcaccca

SEQ ID NO: 203283 - RNA, 21 nt, Human
uugguauaccugacauuggcc

SEQ ID NO: 203284 - RNA, 27 nt, Human
uuuaaaauagcuacuggcuucacagca

SEQ ID NO: 203285 - RNA, 22 nt, Human
uuuagaccuugaugcuuggggu

SEQ ID NO: 203286 - RNA, 18 nt, Human
aaaaaaaaaaaaucccug

SEQ ID NO: 203287 - RNA, 23 nt, Human
aaagugcuaggauuacaauauug

SEQ ID NO: 203288 - RNA, 24 nt, Human
aaagugcuaggauuacaauauugg

SEQ ID NO: 203289 - RNA, 25 nt, Human
aaagugcuaggauuacaauauugga

SEQ ID NO: 203290 - RNA, 20 nt, Human
aacaaaaguuccugagucca

SEQ ID NO: 203291 - RNA, 22 nt, Human
aaggcgccacgaaccaggcgaa

SEQ ID NO: 203292 - RNA, 21 nt, Human
aagggcaggucuagaaauaca

SEQ ID NO: 203293 - RNA, 22 nt, Human
aaugaaaagcaguaaacagccc

SEQ ID NO: 203294 - RNA, 23 nt, Human
acaccagaugcacaugacccagu

SEQ ID NO: 203295 - RNA, 19 nt, Human
acaggccgcggcgcuuccc

SEQ ID NO: 203296 - RNA, 23 nt, Human
acauccuaaaguuacaaaugaaa

SEQ ID NO: 203297 - RNA, 23 nt, Human
accaaauacucccuccccucacc

SEQ ID NO: 203298 - RNA, 23 nt, Human
accacgcccagcuaauuuuugua

SEQ ID NO: 203299 - RNA, 25 nt, Human
acccgccuuggccucccaaagugcu

SEQ ID NO: 203300 - RNA, 24 nt, Human
acccuauugccccaggguacacag

SEQ ID NO: 203301 - RNA, 24 nt, Human
accuugugauccacccgccuuggc

SEQ ID NO: 203302 - RNA, 19 nt, Human
acucccuccccucacccca

SEQ ID NO: 203303 - RNA, 19 nt, Human
agaguuacagacuaggugg

SEQ ID NO: 203304 - RNA, 23 nt, Human
agaguuugguguugggauccagu

SEQ ID NO: 203305 - RNA, 24 nt, Human
agcaggcaguccagccacaggccg

SEQ ID NO: 203306 - RNA, 24 nt, Human
agccgagcauggugguaacaagcc

SEQ ID NO: 203307 - RNA, 25 nt, Human
agccuguggucucaauuagcuggga

SEQ ID NO: 203308 - RNA, 22 nt, Human
aggaggguuaaaaaaaaaaaaa

SEQ ID NO: 203309 - RNA, 19 nt, Human
aggcggcaggggcccgggg

SEQ ID NO: 203310 - RNA, 18 nt, Human
agguggaaggaucacuug

SEQ ID NO: 203311 - RNA, 23 nt, Human
agguggaaggaucacuugggccc

SEQ ID NO: 203312 - RNA, 20 nt, Human
aguacaguggugugaucucg

SEQ ID NO: 203313 - RNA, 24 nt, Human
aguacaguggugugaucucggcuc

SEQ ID NO: 203314 - RNA, 20 nt, Human
agugauucuccugccucagc

SEQ ID NO: 203315 - RNA, 21 nt, Human
aguuugguguugggauccagu

SEQ ID NO: 203316 - RNA, 27 nt, Human
auaccaaauacucccuccccucacccc

SEQ ID NO: 203317 - RNA, 19 nt, Human
auccacccgccuuggccuc

SEQ ID NO: 203318 - RNA, 25 nt, Human
auggaguuucaccauguuggcaaag

SEQ ID NO: 203319 - RNA, 18 nt, Human
auucaguaacagcuccuc

SEQ ID NO: 203320 - RNA, 18 nt, Human
auucuccugccucagccu

SEQ ID NO: 203321 - RNA, 21 nt, Human
auucuucuucucccccccacc

SEQ ID NO: 203322 - RNA, 23 nt, Human
caaagugcuaggauuacaauauu

SEQ ID NO: 203323 - RNA, 22 nt, Human
caacauaccaaauacucccucc

SEQ ID NO: 203324 - RNA, 20 nt, Human
caaccucugccucccggguu

SEQ ID NO: 203325 - RNA, 21 nt, Human
caaguauguucaagaaaaccc

SEQ ID NO: 203326 - RNA, 24 nt, Human
cacagcuaggguucacaauauacc

SEQ ID NO: 203327 - RNA, 22 nt, Human
caccauccaagaucccacccca

SEQ ID NO: 203328 - RNA, 24 nt, Human
caccauguuggcaaagauggucuc

SEQ ID NO: 203329 - RNA, 23 nt, Human
cacccgccuuggccucccaaagu

SEQ ID NO: 203330 - RNA, 24 nt, Human
cacccgccuuggccucccaaagug

SEQ ID NO: 203331 - RNA, 22 nt, Human
cacgaaccaggcgaagggcagg

SEQ ID NO: 203332 - RNA, 25 nt, Human
cacgguagugagagccuuugaggua

SEQ ID NO: 203333 - RNA, 22 nt, Human
cacuaccacgcccagcuaauuu

SEQ ID NO: 203334 - RNA, 21 nt, Human
cacugcaaccucugccucccg

SEQ ID NO: 203335 - RNA, 23 nt, Human
cacugcaaccucugccucccggg

SEQ ID NO: 203336 - RNA, 18 nt, Human
cagaaagaguuacagacu

SEQ ID NO: 203337 - RNA, 22 nt, Human
caggaggguuaaaaaaaaaaaa

SEQ ID NO: 203338 - RNA, 24 nt, Human
caguagagauggaguuucaccaug

SEQ ID NO: 203339 - RNA, 26 nt, Human
caguagagauggaguuucaccauguu

SEQ ID NO: 203340 - RNA, 20 nt, Human
cagugcagcugaggccuagg

SEQ ID NO: 203341 - RNA, 23 nt, Human
cauaccaaauacucccuccccuc

SEQ ID NO: 203342 - RNA, 23 nt, Human
cauugccuuuaacaacccauuca

SEQ ID NO: 203343 - RNA, 20 nt, Human
ccaaagugcuaggauuacaa

SEQ ID NO: 203344 - RNA, 23 nt, Human
ccaaagugcuaggauuacaauau

SEQ ID NO: 203345 - RNA, 18 nt, Human
ccaagcagcuauaaaagc

SEQ ID NO: 203346 - RNA, 23 nt, Human
ccaauaggucaaucugucugugc

SEQ ID NO: 203347 - RNA, 26 nt, Human
ccacccaaagacaugugagcaacugc

SEQ ID NO: 203348 - RNA, 18 nt, Human
ccaguguaaauaacaaac

SEQ ID NO: 203349 - RNA, 19 nt, Human
ccaguugggcagcagcagg

SEQ ID NO: 203350 - RNA, 18 nt, Human
ccauccaagaucccaccc

SEQ ID NO: 203351 - RNA, 23 nt, Human
cccggguucgagugauucuccug

SEQ ID NO: 203352 - RNA, 20 nt, Human
cccuccccucaccccacaca

SEQ ID NO: 203353 - RNA, 22 nt, Human
ccuccccucaccccacacacga

SEQ ID NO: 203354 - RNA, 24 nt, Human
ccucccggguucgagugauucucc

SEQ ID NO: 203355 - RNA, 22 nt, Human
ccucucacacucgcgaaacacc

SEQ ID NO: 203356 - RNA, 20 nt, Human
cgagugauucuccugccuca

SEQ ID NO: 203357 - RNA, 22 nt, Human
cgccaggcuggagugccgggcu

SEQ ID NO: 203358 - RNA, 19 nt, Human
cuaaaauaaguaauugauc

SEQ ID NO: 203359 - RNA, 24 nt, Human
cucacugcaaccucugccucccgg

SEQ ID NO: 203360 - RNA, 19 nt, Human
cucagagaauccaagcagc

SEQ ID NO: 203361 - RNA, 19 nt, Human
cucccggguucgagugauu

SEQ ID NO: 203362 - RNA, 18 nt, Human
cucccuccccucacccca

SEQ ID NO: 203363 - RNA, 21 nt, Human
cuccugccucagccuucagcu

SEQ ID NO: 203364 - RNA, 24 nt, Human
cucuugaccuugugauccacccgc

SEQ ID NO: 203365 - RNA, 21 nt, Human
cucuugucgccaggcuggagu

SEQ ID NO: 203366 - RNA, 24 nt, Human
cugcaaccucugccucccggguuc

SEQ ID NO: 203367 - RNA, 25 nt, Human
cuggaguacaguggugugaucucgg

SEQ ID NO: 203368 - RNA, 30 nt, Human
cuggagugccgggcuggaguacaguggugu

SEQ ID NO: 203369 - RNA, 20 nt, Human
gaaaagcaguaaacagccgc

SEQ ID NO: 203370 - RNA, 20 nt, Human
gaccuugugauccacccgcc

SEQ ID NO: 203371 - RNA, 21 nt, Human
gaccuugugauccacccgccu

SEQ ID NO: 203372 - RNA, 21 nt, Human
gaccuugugauccacccgccu

SEQ ID NO: 203373 - RNA, 24 nt, Human
gaccuugugauccacccgccuugg

SEQ ID NO: 203374 - RNA, 19 nt, Human
gagcauggugguaacaagc

SEQ ID NO: 203375 - RNA, 21 nt, Human
gagucucacucuugucgccag

SEQ ID NO: 203376 - RNA, 19 nt, Human
gauccaguucuacuagccc

SEQ ID NO: 203377 - RNA, 19 nt, Human
gauucuccugccucagccu

SEQ ID NO: 203378 - RNA, 22 nt, Human
gcaaccucugccucccggguuc

SEQ ID NO: 203379 - RNA, 18 nt, Human
gcagcagcaggcagucca

SEQ ID NO: 203380 - RNA, 23 nt, Human
gccaggcuggagugccgggcugg

SEQ ID NO: 203381 - RNA, 22 nt, Human
gcccagcuaauuuuuguauuuu

SEQ ID NO: 203382 - RNA, 24 nt, Human
gcccuaguugcuaacuaccauuua

SEQ ID NO: 203383 - RNA, 19 nt, Human
gccguagcacaggagcaca

SEQ ID NO: 203384 - RNA, 18 nt, Human
gcgaagggcaggucuaga

SEQ ID NO: 203385 - RNA, 18 nt, Human
ggaguuucaccauguugg

SEQ ID NO: 203386 - RNA, 19 nt, Human
ggaguuucaccauguuggc

SEQ ID NO: 203387 - RNA, 22 nt, Human
ggcuggaguacaguggugugau

SEQ ID NO: 203388 - RNA, 22 nt, Human
gggcacugugaaaugccccuug

SEQ ID NO: 203389 - RNA, 25 nt, Human
gggcagugcagcugaggccgggccc

SEQ ID NO: 203390 - RNA, 18 nt, Human
gguguugggauccaguuc

SEQ ID NO: 203391 - RNA, 20 nt, Human
guccacgguagugagagccc

SEQ ID NO: 203392 - RNA, 20 nt, Human
gugaacacacacccuaaccc

SEQ ID NO: 203393 - RNA, 24 nt, Human
gugauccacccgccuuggccuccc

SEQ ID NO: 203394 - RNA, 21 nt, Human
gugauucuccugccucagccu

SEQ ID NO: 203395 - RNA, 18 nt, Human
uaaaaaaagccaccagaa

SEQ ID NO: 203396 - RNA, 24 nt, Human
uaaaaaaagccaccagaaaggcaa

SEQ ID NO: 203397 - RNA, 21 nt, Human
uaaaauaccuauccuugggca

SEQ ID NO: 203398 - RNA, 19 nt, Human
uaacuucucuccccuuuuc

SEQ ID NO: 203399 - RNA, 24 nt, Human
uaauuuuuguauuuucaguagaga

SEQ ID NO: 203400 - RNA, 23 nt, Human
uacaauauuacagcacuagcaga

SEQ ID NO: 203401 - RNA, 20 nt, Human
uacagcacuagcagaucagu

SEQ ID NO: 203402 - RNA, 22 nt, Human
uacaguggugugaucucggcuc

SEQ ID NO: 203403 - RNA, 23 nt, Human
uagaaaaaacuuccuacaccaga

SEQ ID NO: 203404 - RNA, 20 nt, Human
uagaaguguuuccuuauccc

SEQ ID NO: 203405 - RNA, 22 nt, Human
uagagauggaguuucaccaugu

SEQ ID NO: 203406 - RNA, 20 nt, Human
ucaccauccaagaucccacc

SEQ ID NO: 203407 - RNA, 23 nt, Human
ucacugcaaccucugccucccgg

SEQ ID NO: 203408 - RNA, 24 nt, Human
ucacugcaaccucugccucccggg

SEQ ID NO: 203409 - RNA, 18 nt, Human
ucaguagagauggaguuu

SEQ ID NO: 203410 - RNA, 24 nt, Human
ucaguagagauggaguuucaccau

SEQ ID NO: 203411 - RNA, 21 nt, Human
ucauaccauuuaccuggacuc

SEQ ID NO: 203412 - RNA, 18 nt, Human
ucccaaagugcuaggauu

SEQ ID NO: 203413 - RNA, 21 nt, Human
ucccggguucgagugauucuc

SEQ ID NO: 203414 - RNA, 24 nt, Human
ucccggguucgagugauucuccug

SEQ ID NO: 203415 - RNA, 25 nt, Human
ucucaauuagcugggagacugaggu

SEQ ID NO: 203416 - RNA, 19 nt, Human
ucucacaaacauuagacca

SEQ ID NO: 203417 - RNA, 20 nt, Human
ucucacacucgcgaaacacc

SEQ ID NO: 203418 - RNA, 23 nt, Human
ucucacucuugucgccaggcugg

SEQ ID NO: 203419 - RNA, 24 nt, Human
ucucacucuugucgccaggcugga

SEQ ID NO: 203420 - RNA, 24 nt, Human
ugaaaagcaguaaacagccgcuua

SEQ ID NO: 203421 - RNA, 24 nt, Human
ugaaggugaacacacacccuaacc

SEQ ID NO: 203422 - RNA, 18 nt, Human
ugaccuugugauccaccc

SEQ ID NO: 203423 - RNA, 21 nt, Human
ugagagccuuugagguaaggg

SEQ ID NO: 203424 - RNA, 24 nt, Human
ugagguggaaggaucacuugggcc

SEQ ID NO: 203425 - RNA, 23 nt, Human
ugagguggagucucacucuuguc

SEQ ID NO: 203426 - RNA, 20 nt, Human
ugccccaggguacacagcac

SEQ ID NO: 203427 - RNA, 23 nt, Human
ugccgggcuggaguacaguggug

SEQ ID NO: 203428 - RNA, 19 nt, Human
uggaguacaguggugugau

SEQ ID NO: 203429 - RNA, 23 nt, Human
uggaguacaguggugugaucucg

SEQ ID NO: 203430 - RNA, 24 nt, Human
uggaguacaguggugugaucucgg

SEQ ID NO: 203431 - RNA, 19 nt, Human
uggaguuucaccauguugg

SEQ ID NO: 203432 - RNA, 21 nt, Human
uggauucuuuuuuuuuuuuuu

SEQ ID NO: 203433 - RNA, 24 nt, Human
ugggagacugagguggaaggauca

SEQ ID NO: 203434 - RNA, 23 nt, Human
ugggauccaguucuacuagcccu

SEQ ID NO: 203435 - RNA, 25 nt, Human
uggugguaacaagccuguggucuca

SEQ ID NO: 203436 - RNA, 22 nt, Human
uucaaugucaccauccaagauc

SEQ ID NO: 203437 - RNA, 18 nt, Human
uucgagugauucuccugc

SEQ ID NO: 203438 - RNA, 23 nt, Human
uucgagugauucuccugccucag

SEQ ID NO: 203439 - RNA, 24 nt, Human
uucgagugauucuccugccucagc

SEQ ID NO: 203440 - RNA, 21 nt, Human
uucuuuuuuuuuuuuuugagg

SEQ ID NO: 203441 - RNA, 18 nt, Human
uuggccucccaaagugcu

SEQ ID NO: 203442 - RNA, 19 nt, Human
uuuagaaagauaaggggaa

SEQ ID NO: 203443 - RNA, 19 nt, Human
uuucaccauguuggcaaag

SEQ ID NO: 203444 - RNA, 22 nt, Human
uuucucagagaauccaagcagc

SEQ ID NO: 203445 - RNA, 23 nt, Human
uuugaaggugaacacacacccua

SEQ ID NO: 203446 - RNA, 24 nt, Human
uuuucaguagagauggaguuucac

SEQ ID NO: 203447 - RNA, 24 nt, Human
uuuugaaggugaacacacacccua

SEQ ID NO: 203448 - RNA, 20 nt, Human
uuuuuguauuuucaguagag

SEQ ID NO: 203449 - RNA, 23 nt, Human
uuuuuguauuuucaguagagaug

SEQ ID NO: 203450 - RNA, 19 nt, Human
uuuuuuuuuuuugaagucu

SEQ ID NO: 203451 - RNA, 26 nt, Human
uuuuuuuuuuuugagguggagucuca

SEQ ID NO: 203452 - RNA, 22 nt, Human
uuuuuuuuuuuuuugaggugga

SEQ ID NO: 203453 - RNA, 20 nt, Human
uuuuuuuuuuuuuuuuuugg

SEQ ID NO: 203454 - RNA, 26 nt, Human
agaagacagucuagaaggcccauagc

SEQ ID NO: 203455 - RNA, 21 nt, Human
agaaggcccauagcauagccc

SEQ ID NO: 203456 - RNA, 25 nt, Human
caaaauauaggugaaagcaauguua

SEQ ID NO: 203457 - RNA, 20 nt, Human
caguuauccugggaagaaag

SEQ ID NO: 203458 - RNA, 21 nt, Human
cggccgccugcacagcagccc

SEQ ID NO: 203459 - RNA, 28 nt, Human
cuauauuuuacauaacaaaauucauaca

SEQ ID NO: 203460 - RNA, 23 nt, Human
cugacagucacagcugacuuauc

SEQ ID NO: 203461 - RNA, 24 nt, Human
gacuucaguuauccugggaagaaa

SEQ ID NO: 203462 - RNA, 24 nt, Human
gaggaugaaccgcccuccccgcaa

SEQ ID NO: 203463 - RNA, 20 nt, Human
gcaauguuaaagugccacac

SEQ ID NO: 203464 - RNA, 22 nt, Human
gcagaagaggaugaaccgcccu

SEQ ID NO: 203465 - RNA, 20 nt, Human
gcccauagcauagcccugac

SEQ ID NO: 203466 - RNA, 26 nt, Human
gccugcacagcagccccauaggccac

SEQ ID NO: 203467 - RNA, 22 nt, Human
uagaaggcccauagcauagccc

SEQ ID NO: 203468 - RNA, 21 nt, Human
uccccgcaaaaagucaaaaga

SEQ ID NO: 203469 - RNA, 21 nt, Human
ucuagcuuuggagggaaaguu

SEQ ID NO: 203470 - RNA, 21 nt, Human
ugaagcagaagaggaugaacc

SEQ ID NO: 203471 - RNA, 22 nt, Human
ugaagcagaagaggaugaaccg

SEQ ID NO: 203472 - RNA, 21 nt, Human
ugcaaguaacaaaguacacaa

SEQ ID NO: 203473 - RNA, 23 nt, Human
ugggaagaaaguucuagcuuugg

SEQ ID NO: 203474 - RNA, 19 nt, Human
uuguucagcuccuugccgu

SEQ ID NO: 203475 - RNA, 23 nt, Human
aaaaaaaaaaaaaaaaacucgag

SEQ ID NO: 203476 - RNA, 26 nt, Human
acaaaaaaaaaaaaaaaaacucgaga

SEQ ID NO: 203477 - RNA, 18 nt, Human
agcaccccuagcaugaac

SEQ ID NO: 203478 - RNA, 24 nt, Human
aggggcugcuccagugggcagggg

SEQ ID NO: 203479 - RNA, 22 nt, Human
auccuccccaggaccccugucc

SEQ ID NO: 203480 - RNA, 18 nt, Human
caaaaagagacugaucau

SEQ ID NO: 203481 - RNA, 22 nt, Human
caaaaagagacugaucauccag

SEQ ID NO: 203482 - RNA, 24 nt, Human
caaaaagagacugaucauccaggc

SEQ ID NO: 203483 - RNA, 21 nt, Human
caauaauaaagacauuuccua

SEQ ID NO: 203484 - RNA, 21 nt, Human
caggcagauccucuggacacg

SEQ ID NO: 203485 - RNA, 20 nt, Human
cagugggcagggguagcuag

SEQ ID NO: 203486 - RNA, 21 nt, Human
cagugggcagggguagcuagc

SEQ ID NO: 203487 - RNA, 23 nt, Human
cauauucaaguauugagaaugcc

SEQ ID NO: 203488 - RNA, 23 nt, Human
caugaacuugugggauggugggg

SEQ ID NO: 203489 - RNA, 23 nt, Human
ccaaaaagagacugaucauccag

SEQ ID NO: 203490 - RNA, 27 nt, Human
cccaggacucuggcuucucuccucaga

SEQ ID NO: 203491 - RNA, 18 nt, Human
ccccaggaccccugucca

SEQ ID NO: 203492 - RNA, 28 nt, Human
ccuaccugcacaaaaaaaaaaaaaaaaa

SEQ ID NO: 203493 - RNA, 20 nt, Human
ccucagccucauccucccca

SEQ ID NO: 203494 - RNA, 22 nt, Human
ccugcacaaaaaaaaaaaaaaa

SEQ ID NO: 203495 - RNA, 22 nt, Human
ccugcacaaaaaaaaaaaaaaa

SEQ ID NO: 203496 - RNA, 19 nt, Human
cucagccucauccucccca

SEQ ID NO: 203497 - RNA, 20 nt, Human
cuccccaggaccccugucca

SEQ ID NO: 203498 - RNA, 20 nt, Human
cuccucagacuucuauuuuu

SEQ ID NO: 203499 - RNA, 26 nt, Human
cucuccucagacuucuauuuuuuaaa

SEQ ID NO: 203500 - RNA, 19 nt, Human
cugcacaaaaaaaaaaaaa

SEQ ID NO: 203501 - RNA, 26 nt, Human
cugcacaaaaaaaaaaaaaaaaacuc

SEQ ID NO: 203502 - RNA, 21 nt, Human
cuugugggauggugggguugg

SEQ ID NO: 203503 - RNA, 21 nt, Human
gaucaugaaaccaaaaagaga

SEQ ID NO: 203504 - RNA, 18 nt, Human
gggccucccggggcccag

SEQ ID NO: 203505 - RNA, 22 nt, Human
guggaacaaugcuacaucuaca

SEQ ID NO: 203506 - RNA, 22 nt, Human
uaaagacugugaaauguuuguc

SEQ ID NO: 203507 - RNA, 21 nt, Human
uaaaugaucaugaaaccaaaa

SEQ ID NO: 203508 - RNA, 19 nt, Human
uacaguguuuauaaagugc

SEQ ID NO: 203509 - RNA, 21 nt, Human
uacaguguuuauaaagugcaa

SEQ ID NO: 203510 - RNA, 20 nt, Human
uagcuagcgugugccaggca

SEQ ID NO: 203511 - RNA, 21 nt, Human
uccaggccucagccucauccu

SEQ ID NO: 203512 - RNA, 26 nt, Human
ucccuggcaugauggacaaaggcugg

SEQ ID NO: 203513 - RNA, 21 nt, Human
uccuaggacagccuuguuccu

SEQ ID NO: 203514 - RNA, 19 nt, Human
ugaaaccaaaaagagacug

SEQ ID NO: 203515 - RNA, 26 nt, Human
ugaucaugaaaccaaaaagagacuga

SEQ ID NO: 203516 - RNA, 25 nt, Human
ugcacaaaaaaaaaaaaaaaaacuc

SEQ ID NO: 203517 - RNA, 21 nt, Human
uggaacaaugcuacaucuaca

SEQ ID NO: 203518 - RNA, 23 nt, Human
uggccaggccugcagacagaccu

SEQ ID NO: 203519 - RNA, 19 nt, Human
ugggguguaggccuggcuc

SEQ ID NO: 203520 - RNA, 19 nt, Human
ugggguuggcuucccuggc

SEQ ID NO: 203521 - RNA, 18 nt, Human
uggugggguuggcuuccc

SEQ ID NO: 203522 - RNA, 22 nt, Human
uggugggguuggcuucccuggc

SEQ ID NO: 203523 - RNA, 21 nt, Human
ugugcuguggccaggccugca

SEQ ID NO: 203524 - RNA, 24 nt, Human
uuaaagacugugaaauguuugucu

SEQ ID NO: 203525 - RNA, 25 nt, Human
uuuuuuuuuuuuuuuuuuuuuaugg

SEQ ID NO: 203526 - RNA, 18 nt, Human
acuguccauuaaaugauc

SEQ ID NO: 203527 - RNA, 21 nt, Human
agcaaacaagcgcuccccucg

SEQ ID NO: 203528 - RNA, 20 nt, Human
auacaggccaguacagcagu

SEQ ID NO: 203529 - RNA, 24 nt, Human
aucacuguccauuaaaugaucacu

SEQ ID NO: 203530 - RNA, 20 nt, Human
cagcaaacaagcgcuccccu

SEQ ID NO: 203531 - RNA, 21 nt, Human
cagcaaacaagcgcuccccuc

SEQ ID NO: 203532 - RNA, 22 nt, Human
cagcauaaaauaguuaaaucuu

SEQ ID NO: 203533 - RNA, 22 nt, Human
cauauguggucucauuucaagu

SEQ ID NO: 203534 - RNA, 21 nt, Human
cauguacauacaggccaguac

SEQ ID NO: 203535 - RNA, 20 nt, Human
cccuugaaaauauggucacu

SEQ ID NO: 203536 - RNA, 20 nt, Human
cuguauuuauuuaaaaaaaa

SEQ ID NO: 203537 - RNA, 23 nt, Human
gccccaucuacaaacauggcaca

SEQ ID NO: 203538 - RNA, 23 nt, Human
gguaagagaacaaucaucaagga

SEQ ID NO: 203539 - RNA, 19 nt, Human
uaccuaauauaaauagcua

SEQ ID NO: 203540 - RNA, 19 nt, Human
uagggacauagaauauugu

SEQ ID NO: 203541 - RNA, 21 nt, Human
uauguuguccuucuggcuuca

SEQ ID NO: 203542 - RNA, 20 nt, Human
ucaauucauccuaccuccuu

SEQ ID NO: 203543 - RNA, 19 nt, Human
ucacuagcuaauggucacu

SEQ ID NO: 203544 - RNA, 18 nt, Human
ucaucaaggauguagguu

SEQ ID NO: 203545 - RNA, 19 nt, Human
uccagaauggguaagagaa

SEQ ID NO: 203546 - RNA, 18 nt, Human
uccccauauguggucuca

SEQ ID NO: 203547 - RNA, 24 nt, Human
uucauccuaccuccuuuuacaugc

SEQ ID NO: 203548 - RNA, 24 nt, Human
uucccauuguucuagauuccucug

SEQ ID NO: 203549 - RNA, 19 nt, Human
uugcaaggccucaguugaa

SEQ ID NO: 203550 - RNA, 26 nt, Human
uuuaaaaaaaaaaaaaauuccagaau

SEQ ID NO: 203551 - RNA, 22 nt, Human
uuuuuuuuuuuuuuuuuucaag

SEQ ID NO: 203552 - RNA, 19 nt, Human
aaaagaacacacagguggc

SEQ ID NO: 203553 - RNA, 25 nt, Human
agccaguggcggcagcagggguggg

SEQ ID NO: 203554 - RNA, 19 nt, Human
aggcacagccaguggcggc

SEQ ID NO: 203555 - RNA, 24 nt, Human
aggugguugcuuugaacuuuauuu

SEQ ID NO: 203556 - RNA, 22 nt, Human
cagcaggggugggcauccaggc

SEQ ID NO: 203557 - RNA, 24 nt, Human
caggugguugcuuugaacuuuauu

SEQ ID NO: 203558 - RNA, 18 nt, Human
ccaguggcggcagcaggg

SEQ ID NO: 203559 - RNA, 24 nt, Human
cucugcucuggacgucugcucaga

SEQ ID NO: 203560 - RNA, 18 nt, Human
cugcucagaaaagugcgg

SEQ ID NO: 203561 - RNA, 18 nt, Human
cugcucagaaaagugcgg

SEQ ID NO: 203562 - RNA, 30 nt, Human
gagaaaaacagaagauaaauguaucaaaag

SEQ ID NO: 203563 - RNA, 24 nt, Human
ggcacagccaguggcggcagcagg

SEQ ID NO: 203564 - RNA, 24 nt, Human
uaaauguaucaaaagaacacacag

SEQ ID NO: 203565 - RNA, 23 nt, Human
uccuccagucggguauuuuuagc

SEQ ID NO: 203566 - RNA, 24 nt, Human
ugagaaaaacagaagauaaaugua

SEQ ID NO: 203567 - RNA, 20 nt, Human
ugcggggcgcugggcucggc

SEQ ID NO: 203568 - RNA, 19 nt, Human
ugcucagaaaagugcgggg

SEQ ID NO: 203569 - RNA, 18 nt, Human
uggcggcagcaggggugg

SEQ ID NO: 203570 - RNA, 21 nt, Human
uggcggcagcaggggugggca

SEQ ID NO: 203571 - RNA, 21 nt, Human
uggcgggggaggcacagccag

SEQ ID NO: 203572 - RNA, 19 nt, Human
uugagaaaaacagaagaua

SEQ ID NO: 203573 - RNA, 24 nt, Human
uuugagaaaaacagaagauaaaug

SEQ ID NO: 203574 - RNA, 21 nt, Human
uuuuuuuuuuuuacagguggu

SEQ ID NO: 203575 - RNA, 21 nt, Human
uuuuuuuuuuuuuuuuacagg

SEQ ID NO: 203576 - RNA, 23 nt, Human
uuuuuuuuuuuuuuuuuuacagg

SEQ ID NO: 203577 - RNA, 19 nt, Human
acuaaaccaaggcuaugac

SEQ ID NO: 203578 - RNA, 22 nt, Human
acuuuuuuuuuuuuuuuuuuuu

SEQ ID NO: 203579 - RNA, 22 nt, Human
agagagggauuugcugggugcu

SEQ ID NO: 203580 - RNA, 18 nt, Human
cagcagaagcccuggucc

SEQ ID NO: 203581 - RNA, 22 nt, Human
ccccaaggaugcugcuaccucu

SEQ ID NO: 203582 - RNA, 23 nt, Human
ccuugggagguagagagggauuu

SEQ ID NO: 203583 - RNA, 20 nt, Human
cgacuuuuuuuuuuuuuuuu

SEQ ID NO: 203584 - RNA, 23 nt, Human
cuaccucuggaguggugggcagc

SEQ ID NO: 203585 - RNA, 26 nt, Human
gaccaugcaccuuucccuucccccaa

SEQ ID NO: 203586 - RNA, 24 nt, Human
gcgucgacuuuuuuuuuuuuuuuu

SEQ ID NO: 203587 - RNA, 25 nt, Human
gcgucgacuuuuuuuuuuuuuuuuu

SEQ ID NO: 203588 - RNA, 18 nt, Human
gcugcagaugcagcagaa

SEQ ID NO: 203589 - RNA, 19 nt, Human
ggcugcagaugcagcagaa

SEQ ID NO: 203590 - RNA, 20 nt, Human
gguagagagggauuugcugg

SEQ ID NO: 203591 - RNA, 18 nt, Human
guggugggcagcugccca

SEQ ID NO: 203592 - RNA, 19 nt, Human
guggugggcagcugcccau

SEQ ID NO: 203593 - RNA, 24 nt, Human
ucaccuugggagguagagagggau

SEQ ID NO: 203594 - RNA, 24 nt, Human
ucagcuccacccaaaacuaaacca

SEQ ID NO: 203595 - RNA, 18 nt, Human
ucuuuuuuuuuuuuuuuu

SEQ ID NO: 203596 - RNA, 20 nt, Human
ugcugggugcugggucugug

SEQ ID NO: 203597 - RNA, 23 nt, Human
uugggagguagagagggauuugc

SEQ ID NO: 203598 - RNA, 21 nt, Human
uuuuuuuuuuuuuugcccuga

SEQ ID NO: 203599 - RNA, 18 nt, Human
uuuuuuuuuuuuuuuuug

SEQ ID NO: 203600 - RNA, 22 nt, Human
uuuuuuuuuuuuuuuuugcccu

SEQ ID NO: 203601 - RNA, 25 nt, Human
uuuuuuuuuuuuuuuuuugcccuga

SEQ ID NO: 203602 - RNA, 25 nt, Human
uuuuuuuuuuuuuuuuuuucuuuuu

SEQ ID NO: 203603 - RNA, 26 nt, Human
agccuccuucugccaaccuuccacug

SEQ ID NO: 203604 - RNA, 18 nt, Human
cauagcaaaucauuucaa

SEQ ID NO: 203605 - RNA, 19 nt, Human
cauagcaaaucauuucaaa

SEQ ID NO: 203606 - RNA, 21 nt, Human
ccacugccuucagucaguggc

SEQ ID NO: 203607 - RNA, 26 nt, Human
ccaguggcugaaccaucaucuucccc

SEQ ID NO: 203608 - RNA, 18 nt, Human
ccuuccacugccuucagu

SEQ ID NO: 203609 - RNA, 22 nt, Human
gagccccugcaguugccuacug

SEQ ID NO: 203610 - RNA, 19 nt, Human
gugaaggcaaaaacagccu

SEQ ID NO: 203611 - RNA, 23 nt, Human
uauuuuuauucuucauaaaaauc

SEQ ID NO: 203612 - RNA, 27 nt, Human
uccccaugucaucugaacaggaacugg

SEQ ID NO: 203613 - RNA, 18 nt, Human
uucugccaaccuuccacu

SEQ ID NO: 203614 - RNA, 20 nt, Human
uugaacagccuccuucugcc

SEQ ID NO: 203615 - RNA, 22 nt, Human
aacugcuuuuucaacaguaaau

SEQ ID NO: 203616 - RNA, 21 nt, Human
accuguaguuuacauuucccu

SEQ ID NO: 203617 - RNA, 24 nt, Human
agaacaggguaagaaagcacauag

SEQ ID NO: 203618 - RNA, 20 nt, Human
agccaguguuuaccugggua

SEQ ID NO: 203619 - RNA, 24 nt, Human
agucaaaaaauuuugacuuuuaau

SEQ ID NO: 203620 - RNA, 22 nt, Human
ccaaagccaguguuuaccuggg

SEQ ID NO: 203621 - RNA, 19 nt, Human
ccaacagaagccaagagcc

SEQ ID NO: 203622 - RNA, 25 nt, Human
ccagcaaaacuggaacagaacaggg

SEQ ID NO: 203623 - RNA, 19 nt, Human
ccuccaacagaagccaaga

SEQ ID NO: 203624 - RNA, 23 nt, Human
cuaaauaucuaccuaguggcuua

SEQ ID NO: 203625 - RNA, 21 nt, Human
cuauguacaaauccagcaaaa

SEQ ID NO: 203626 - RNA, 21 nt, Human
ggucuuuggcuuuaaaaagaa

SEQ ID NO: 203627 - RNA, 21 nt, Human
uaagaaagcacauagcaacug

SEQ ID NO: 203628 - RNA, 23 nt, Human
ucccaugccuccaacagaagcug

SEQ ID NO: 203629 - RNA, 21 nt, Human
uggcuauguacaaauccagca

SEQ ID NO: 203630 - RNA, 20 nt, Human
uuggcuuuaaaaagaaaguc

SEQ ID NO: 203631 - RNA, 19 nt, Human
uuuuuuuuuuuuuuuucaa

SEQ ID NO: 203632 - RNA, 23 nt, Human
aaagaaaaggauuauacguaaua

SEQ ID NO: 203633 - RNA, 22 nt, Human
aacacaaggacaggagagggaa

SEQ ID NO: 203634 - RNA, 24 nt, Human
acaggagagggaaaaaaacacuag

SEQ ID NO: 203635 - RNA, 18 nt, Human
acccagacagucccaaca

SEQ ID NO: 203636 - RNA, 19 nt, Human
acugccuucaacacaagga

SEQ ID NO: 203637 - RNA, 19 nt, Human
agaguagagagggaauggg

SEQ ID NO: 203638 - RNA, 21 nt, Human
aggacaggagagggaaaaaaa

SEQ ID NO: 203639 - RNA, 24 nt, Human
aggacaggagagggaaaaaaacac

SEQ ID NO: 203640 - RNA, 18 nt, Human
agggggagccagguggga

SEQ ID NO: 203641 - RNA, 18 nt, Human
aguagagagggaaugggg

SEQ ID NO: 203642 - RNA, 23 nt, Human
caagggcacaaguuuuccaacua

SEQ ID NO: 203643 - RNA, 22 nt, Human
caauacacaacauccaauccug

SEQ ID NO: 203644 - RNA, 21 nt, Human
ggacaggagagggaaaaaaac

SEQ ID NO: 203645 - RNA, 20 nt, Human
ggggcuugacacccuuaguu

SEQ ID NO: 203646 - RNA, 26 nt, Human
uacacaacauccaauccugcugucaa

SEQ ID NO: 203647 - RNA, 21 nt, Human
uauacaagggcacaaguuuuc

SEQ ID NO: 203648 - RNA, 23 nt, Human
uccgauacccagacagucccaac

SEQ ID NO: 203649 - RNA, 23 nt, Human
ucgaggcugcagugggagcccau

SEQ ID NO: 203650 - RNA, 19 nt, Human
ugaagaaaauaaaauaaaa

SEQ ID NO: 203651 - RNA, 19 nt, Human
uucagaacaaaaugaagaa

SEQ ID NO: 203652 - RNA, 21 nt, Human
uuuuccaacuaugaacuccua

SEQ ID NO: 203653 - RNA, 21 nt, Human
uuuuuuuuuuuuuuaaaacgg

SEQ ID NO: 203654 - RNA, 22 nt, Human
aaaccauuauauauuuugucaa

SEQ ID NO: 203655 - RNA, 25 nt, Human
aacaugccacuucccauaccaccuc

SEQ ID NO: 203656 - RNA, 25 nt, Human
acaugccacuucccauaccaccucc

SEQ ID NO: 203657 - RNA, 18 nt, Human
acuacaacuucugcugua

SEQ ID NO: 203658 - RNA, 22 nt, Human
auaaagcaguucucacaaccuu

SEQ ID NO: 203659 - RNA, 29 nt, Human
auccaauaaagcaguucucacaaccuuuu

SEQ ID NO: 203660 - RNA, 22 nt, Human
caacugaaaccaguaacugaug

SEQ ID NO: 203661 - RNA, 20 nt, Human
cagccagccuuuuucuucau

SEQ ID NO: 203662 - RNA, 19 nt, Human
caugccacuucccauacca

SEQ ID NO: 203663 - RNA, 22 nt, Human
ccaacugacuucucugaaguua

SEQ ID NO: 203664 - RNA, 22 nt, Human
ccacuucccauaccaccuccca

SEQ ID NO: 203665 - RNA, 19 nt, Human
cccaguaucaggaauguac

SEQ ID NO: 203666 - RNA, 23 nt, Human
ccucccauucuacccauugcacc

SEQ ID NO: 203667 - RNA, 21 nt, Human
ccuugggcuuccugucacagu

SEQ ID NO: 203668 - RNA, 21 nt, Human
cggcagggcgugcacgcagcg

SEQ ID NO: 203669 - RNA, 23 nt, Human
cugaaaccaguaacugaugguua

SEQ ID NO: 203670 - RNA, 21 nt, Human
cuuuuacccaguaucaggaau

SEQ ID NO: 203671 - RNA, 18 nt, Human
gggcggcggcagggcgug

SEQ ID NO: 203672 - RNA, 21 nt, Human
uaaguugaaagccauacauug

SEQ ID NO: 203673 - RNA, 25 nt, Human
ucaacaccugcauucuuagcaaaau

SEQ ID NO: 203674 - RNA, 21 nt, Human
ucacaccagcggcauccaaua

SEQ ID NO: 203675 - RNA, 19 nt, Human
ucuccacagaaaggcugcu

SEQ ID NO: 203676 - RNA, 19 nt, Human
ucucugaaguuauugguga

SEQ ID NO: 203677 - RNA, 19 nt, Human
ucugaaguuauuggugagg

SEQ ID NO: 203678 - RNA, 19 nt, Human
ucuucauuagcuggaguca

SEQ ID NO: 203679 - RNA, 20 nt, Human
uggaauuuugaguguucuuu

SEQ ID NO: 203680 - RNA, 19 nt, Human
uggcaagcacuaaaaaucc

SEQ ID NO: 203681 - RNA, 19 nt, Human
ugggcuuccugucacaguu

SEQ ID NO: 203682 - RNA, 19 nt, Human
uucacaaaaucuccaacca

SEQ ID NO: 203683 - RNA, 22 nt, Human
uucacaaaaucuccaaccauag

SEQ ID NO: 203684 - RNA, 22 nt, Human
uuuccaccauauucacaaaauc

SEQ ID NO: 203685 - RNA, 22 nt, Human
ucaguggaaugggcagcaucau

SEQ ID NO: 203686 - RNA, 24 nt, Human
uggaaguguuuauaucaguacaag

SEQ ID NO: 203687 - RNA, 24 nt, Human
aacaggccacccagcucuaucugg

SEQ ID NO: 203688 - RNA, 18 nt, Human
aagggcugcagaaacagg

SEQ ID NO: 203689 - RNA, 20 nt, Human
acucgacauugucgggcugg

SEQ ID NO: 203690 - RNA, 18 nt, Human
agcugugugugugagggu

SEQ ID NO: 203691 - RNA, 22 nt, Human
agcugugugugugaggguggca

SEQ ID NO: 203692 - RNA, 26 nt, Human
aggggcuggguggagguggguggggg

SEQ ID NO: 203693 - RNA, 20 nt, Human
aguggguggcagagacuccu

SEQ ID NO: 203694 - RNA, 21 nt, Human
caaguccuggugacuuucuga

SEQ ID NO: 203695 - RNA, 21 nt, Human
cacccagcucuaucugggggc

SEQ ID NO: 203696 - RNA, 18 nt, Human
cacuaaagacaauuccca

SEQ ID NO: 203697 - RNA, 21 nt, Human
cacuaaagacaauucccaauc

SEQ ID NO: 203698 - RNA, 22 nt, Human
cagcccagggcgguacgagcaa

SEQ ID NO: 203699 - RNA, 22 nt, Human
cagccggcacuaaagacaauuc

SEQ ID NO: 203700 - RNA, 22 nt, Human
ccagcucuaucugggggcucca

SEQ ID NO: 203701 - RNA, 24 nt, Human
cccacccagccacuguuccugacc

SEQ ID NO: 203702 - RNA, 20 nt, Human
cccaggggugagcugccuuu

SEQ ID NO: 203703 - RNA, 19 nt, Human
ccgccugcccaggggugag

SEQ ID NO: 203704 - RNA, 19 nt, Human
ccuccaguccagcccaggg

SEQ ID NO: 203705 - RNA, 19 nt, Human
cuaaagacaauucccaauc

SEQ ID NO: 203706 - RNA, 23 nt, Human
cuggguggaggugggugggggug

SEQ ID NO: 203707 - RNA, 22 nt, Human
gauggggaccgccugcccaggg

SEQ ID NO: 203708 - RNA, 24 nt, Human
gcacuaaagacaauucccaauccu

SEQ ID NO: 203709 - RNA, 24 nt, Human
gcccagcugugugugugagggugg

SEQ ID NO: 203710 - RNA, 20 nt, Human
gcuggggcguggcccgggag

SEQ ID NO: 203711 - RNA, 19 nt, Human
ggaggugggugggggugcu

SEQ ID NO: 203712 - RNA, 19 nt, Human
ggaggugggugggggugcu

SEQ ID NO: 203713 - RNA, 19 nt, Human
ggagugagaacugcccaag

SEQ ID NO: 203714 - RNA, 24 nt, Human
gggacagugggggcaguucugggc

SEQ ID NO: 203715 - RNA, 25 nt, Human
gggcuggggcguggcccgggagucc

SEQ ID NO: 203716 - RNA, 22 nt, Human
gggcuggguggagguggguggg

SEQ ID NO: 203717 - RNA, 24 nt, Human
gggugggggugcugaaaaacgagc

SEQ ID NO: 203718 - RNA, 20 nt, Human
ggugggggugcugaaaaacg

SEQ ID NO: 203719 - RNA, 25 nt, Human
guucugggcccacccagccacuguu

SEQ ID NO: 203720 - RNA, 19 nt, Human
uagggggacagugggggca

SEQ ID NO: 203721 - RNA, 21 nt, Human
uccacagccggcacuaaagac

SEQ ID NO: 203722 - RNA, 23 nt, Human
ucgacauugucgggcuggggcgu

SEQ ID NO: 203723 - RNA, 25 nt, Human
ucgguggguagggggacaguggggg

SEQ ID NO: 203724 - RNA, 19 nt, Human
ucucagguagcuguggggc

SEQ ID NO: 203725 - RNA, 24 nt, Human
ugagaacugcccaagggcugcaga

SEQ ID NO: 203726 - RNA, 27 nt, Human
ugagaacugcccaagggcugcagaaaa

SEQ ID NO: 203727 - RNA, 22 nt, Human
ugcuggccagccuuguggcuuu

SEQ ID NO: 203728 - RNA, 20 nt, Human
uggcccgggaguccgugugg

SEQ ID NO: 203729 - RNA, 18 nt, Human
ugggggugcugaaaaacg

SEQ ID NO: 203730 - RNA, 26 nt, Human
ugggggugcugaaaaacgagcuggug

SEQ ID NO: 203731 - RNA, 21 nt, Human
uggguggaggugggugggggu

SEQ ID NO: 203732 - RNA, 24 nt, Human
aaaacuaaugaaguccauuauggc

SEQ ID NO: 203733 - RNA, 22 nt, Human
aggcugaaguuuguuagaagau

SEQ ID NO: 203734 - RNA, 19 nt, Human
cccucacuucccaggcuga

SEQ ID NO: 203735 - RNA, 18 nt, Human
ccucacuucccaggcuga

SEQ ID NO: 203736 - RNA, 21 nt, Human
ccugcaaucuuuucagcuccu

SEQ ID NO: 203737 - RNA, 22 nt, Human
ggccuggcagcaucaacagcuu

SEQ ID NO: 203738 - RNA, 20 nt, Human
uaauccugcaaucuuuucag

SEQ ID NO: 203739 - RNA, 27 nt, Human
ucagcuccugggguuucagcucucuua

SEQ ID NO: 203740 - RNA, 18 nt, Human
ucccucuaugucauacaa

SEQ ID NO: 203741 - RNA, 19 nt, Human
ucccuuguaaagaauuaag

SEQ ID NO: 203742 - RNA, 22 nt, Human
ugaaagaaauaaguaauuagua

SEQ ID NO: 203743 - RNA, 19 nt, Human
ugacucacuguccacuaga

SEQ ID NO: 203744 - RNA, 19 nt, Human
uucagcucucuuaucugga

SEQ ID NO: 203745 - RNA, 23 nt, Human
aaaaagugaauuugccagucaaa

SEQ ID NO: 203746 - RNA, 22 nt, Human
acagcagugaaaacagcuuaac

SEQ ID NO: 203747 - RNA, 22 nt, Human
agaaacagcagugaaaacagcu

SEQ ID NO: 203748 - RNA, 25 nt, Human
agugguagugugaugcgguaugaug

SEQ ID NO: 203749 - RNA, 24 nt, Human
cuauaaucaugccccaugauuacu

SEQ ID NO: 203750 - RNA, 19 nt, Human
cucaagaggagagucaaga

SEQ ID NO: 203751 - RNA, 26 nt, Human
cucuauaaucaugccccaugauuacu

SEQ ID NO: 203752 - RNA, 20 nt, Human
uaucaugaaacacagaauuc

SEQ ID NO: 203753 - RNA, 26 nt, Human
uauuacucagaaacagcagugaaaag

SEQ ID NO: 203754 - RNA, 23 nt, Human
ucauggucuuucuuuuauucucc

SEQ ID NO: 203755 - RNA, 25 nt, Human
ucuauaaucaugccccaugauuacu

SEQ ID NO: 203756 - RNA, 21 nt, Human
ugccccaugauuacuaaggau

SEQ ID NO: 203757 - RNA, 19 nt, Human
uuuuuuuuuuuuuuugugc

SEQ ID NO: 203758 - RNA, 19 nt, Human
uuuuuuuuuuuuuuuuugu

SEQ ID NO: 203759 - RNA, 27 nt, Human
uuuuuuuuuuuuuuuuuuuuuuugggg

SEQ ID NO: 203760 - RNA, 22 nt, Human
acagcagugaaaacagcuuaac

SEQ ID NO: 203761 - RNA, 22 nt, Human
agaaacagcagugaaaacagcu

SEQ ID NO: 203762 - RNA, 24 nt, Human
ccauaaucaugccccaugauuacu

SEQ ID NO: 203763 - RNA, 19 nt, Human
cucaagaggagaauccaga

SEQ ID NO: 203764 - RNA, 26 nt, Human
cuccauaaucaugccccaugauuacu

SEQ ID NO: 203765 - RNA, 26 nt, Human
uauuacucagaaacagcagugaaaag

SEQ ID NO: 203766 - RNA, 23 nt, Human
ucaagaggagaauccagaaguca

SEQ ID NO: 203767 - RNA, 25 nt, Human
uccauaaucaugccccaugauuacu

SEQ ID NO: 203768 - RNA, 21 nt, Human
ugaagugaagucucaagagau

SEQ ID NO: 203769 - RNA, 19 nt, Human
ugaugcgguaugacaaaug

SEQ ID NO: 203770 - RNA, 18 nt, Human
ugccagucaaaccuccau

SEQ ID NO: 203771 - RNA, 26 nt, Human
uuaacauuuaaauugcaaguaucuaa

SEQ ID NO: 203772 - RNA, 22 nt, Human
aaaaaaaagacaaucccgauga

SEQ ID NO: 203773 - RNA, 25 nt, Human
aaacaagaccggacuauuugaagaa

SEQ ID NO: 203774 - RNA, 24 nt, Human
aaagagauguuaaaaaaaaauuca

SEQ ID NO: 203775 - RNA, 24 nt, Human
aaagcuugcgguggguggggggug

SEQ ID NO: 203776 - RNA, 19 nt, Human
aacaugaugaaaccccguc

SEQ ID NO: 203777 - RNA, 20 nt, Human
aacaugaugaaaccccgucu

SEQ ID NO: 203778 - RNA, 21 nt, Human
aacaugaugaaaccccgucuu

SEQ ID NO: 203779 - RNA, 18 nt, Human
aagaaaacaacaggaaaa

SEQ ID NO: 203780 - RNA, 21 nt, Human
aagaaaacaacaggaaaaaga

SEQ ID NO: 203781 - RNA, 24 nt, Human
aagaaaacaacaggaaaaagaaca

SEQ ID NO: 203782 - RNA, 21 nt, Human
aagaacaauucuguugauuga

SEQ ID NO: 203783 - RNA, 23 nt, Human
aagagauguuaaaaaaaaauuca

SEQ ID NO: 203784 - RNA, 20 nt, Human
aauacugucuuucucuucac

SEQ ID NO: 203785 - RNA, 18 nt, Human
aaucccaagaugucucag

SEQ ID NO: 203786 - RNA, 22 nt, Human
aauuaaaaaaaaaagacaaucc

SEQ ID NO: 203787 - RNA, 20 nt, Human
acaaaaauuagcugggccug

SEQ ID NO: 203788 - RNA, 24 nt, Human
acagagcaaagucauccuucugcu

SEQ ID NO: 203789 - RNA, 21 nt, Human
acaggacacaaaagauaacaa

SEQ ID NO: 203790 - RNA, 25 nt, Human
acagugaaaaggucucaagaccaga

SEQ ID NO: 203791 - RNA, 24 nt, Human
accccgucuuuauuaaaaauacaa

SEQ ID NO: 203792 - RNA, 21 nt, Human
acuacacuccagccuggcgag

SEQ ID NO: 203793 - RNA, 23 nt, Human
acuacacuccagccuggcgagag

SEQ ID NO: 203794 - RNA, 28 nt, Human
acuccgucucaaaaaaaaaaaaaaagaa

SEQ ID NO: 203795 - RNA, 22 nt, Human
acucuggaggcugaggcagaau

SEQ ID NO: 203796 - RNA, 22 nt, Human
agaaaacaacaggaaaaagaac

SEQ ID NO: 203797 - RNA, 21 nt, Human
agaaagaaaauauuaugcuaa

SEQ ID NO: 203798 - RNA, 21 nt, Human
agaaagagauguuaaaaaaaa

SEQ ID NO: 203799 - RNA, 24 nt, Human
agaacuucagaauuccccucacag

SEQ ID NO: 203800 - RNA, 22 nt, Human
agaauggugucccacucaaagc

SEQ ID NO: 203801 - RNA, 20 nt, Human
agcacuuugggaugcugagg

SEQ ID NO: 203802 - RNA, 24 nt, Human
aggcacaguggcucaugccuguaa

SEQ ID NO: 203803 - RNA, 21 nt, Human
aggcagaaucucuugaacccg

SEQ ID NO: 203804 - RNA, 24 nt, Human
aggcgggcggaucacgaggucaag

SEQ ID NO: 203805 - RNA, 21 nt, Human
aggcugaggcagaaucucuug

SEQ ID NO: 203806 - RNA, 22 nt, Human
agggcaagacuccgucucaaaa

SEQ ID NO: 203807 - RNA, 18 nt, Human
aggguagucaaucugguc

SEQ ID NO: 203808 - RNA, 30 nt, Human
aguccugccccccgccccccaccacccacc

SEQ ID NO: 203809 - RNA, 23 nt, Human
aguggcucaugccuguaauccca

SEQ ID NO: 203810 - RNA, 24 nt, Human
aguggcucaugccuguaaucccag

SEQ ID NO: 203811 - RNA, 24 nt, Human
auccuggcuccaaauucucuuuca

SEQ ID NO: 203812 - RNA, 19 nt, Human
augccuguaaucccagcac

SEQ ID NO: 203813 - RNA, 21 nt, Human
augcugaggcgggcggaucac

SEQ ID NO: 203814 - RNA, 18 nt, Human
auggugucccacucaaag

SEQ ID NO: 203815 - RNA, 22 nt, Human
auuauguuggccaggcacagug

SEQ ID NO: 203816 - RNA, 24 nt, Human
auugugccacuacacuccagccug

SEQ ID NO: 203817 - RNA, 23 nt, Human
caaaaaaaaaaaaaaagaaagaa

SEQ ID NO: 203818 - RNA, 18 nt, Human
caaagcuugcggugggug

SEQ ID NO: 203819 - RNA, 21 nt, Human
caacaggaaaaagaacaauuc

SEQ ID NO: 203820 - RNA, 21 nt, Human
caacaugaugaaaccccgucu

SEQ ID NO: 203821 - RNA, 21 nt, Human
caagacuccgucucaaaaaaa

SEQ ID NO: 203822 - RNA, 22 nt, Human
caaucuaccucaaaggggugau

SEQ ID NO: 203823 - RNA, 20 nt, Human
cacacagaauggagacccau

SEQ ID NO: 203824 - RNA, 23 nt, Human
cacagaccuccacacauuuggcu

SEQ ID NO: 203825 - RNA, 21 nt, Human
cacccuccuuuaagcuccaua

SEQ ID NO: 203826 - RNA, 25 nt, Human
cacuacacuccagccuggcgagagg

SEQ ID NO: 203827 - RNA, 22 nt, Human
cacuccagccuggcgagagggc

SEQ ID NO: 203828 - RNA, 20 nt, Human
cagaauggugucccacucaa

SEQ ID NO: 203829 - RNA, 27 nt, Human
cagagagccuucccucugagucugggg

SEQ ID NO: 203830 - RNA, 24 nt, Human
cagcacuuugggaugcugaggcgg

SEQ ID NO: 203831 - RNA, 18 nt, Human
caggaaaaagaacaauuc

SEQ ID NO: 203832 - RNA, 19 nt, Human
caggacacaaaagauaaca

SEQ ID NO: 203833 - RNA, 22 nt, Human
caggacacaaaagauaacaaga

SEQ ID NO: 203834 - RNA, 21 nt, Human
caguccugccccccgcccccc

SEQ ID NO: 203835 - RNA, 20 nt, Human
cauccuggcuccaaauucuc

SEQ ID NO: 203836 - RNA, 20 nt, Human
caugccuguaaucccagcac

SEQ ID NO: 203837 - RNA, 19 nt, Human
ccaaucaaggugccacaca

SEQ ID NO: 203838 - RNA, 20 nt, Human
ccaccacccacagcucuuuc

SEQ ID NO: 203839 - RNA, 19 nt, Human
ccacuacacuccagccugg

SEQ ID NO: 203840 - RNA, 19 nt, Human
ccacuacacuccagccugg

SEQ ID NO: 203841 - RNA, 20 nt, Human
ccacuacacuccagccuggc

SEQ ID NO: 203842 - RNA, 26 nt, Human
ccagcugguaguuaaaggucuuuccu

SEQ ID NO: 203843 - RNA, 22 nt, Human
ccauccuacccccgcuaccccu

SEQ ID NO: 203844 - RNA, 20 nt, Human
cccaagaugucucagggucc

SEQ ID NO: 203845 - RNA, 20 nt, Human
ccccccgccccccaccaccc

SEQ ID NO: 203846 - RNA, 22 nt, Human
ccccccgccccccaccacccac

SEQ ID NO: 203847 - RNA, 19 nt, Human
cccccgccccccaccaccc

SEQ ID NO: 203848 - RNA, 22 nt, Human
ccccgccccccaccacccacag

SEQ ID NO: 203849 - RNA, 21 nt, Human
ccccgcuaccccuaacuucug

SEQ ID NO: 203850 - RNA, 21 nt, Human
cccgggaugcggagguugcag

SEQ ID NO: 203851 - RNA, 23 nt, Human
ccuggccaacaugaugaaacccc

SEQ ID NO: 203852 - RNA, 24 nt, Human
ccuggccaacaugaugaaaccccg

SEQ ID NO: 203853 - RNA, 21 nt, Human
ccuggcgagagggcaagacuc

SEQ ID NO: 203854 - RNA, 20 nt, Human
ccuguaaucccagcacuuug

SEQ ID NO: 203855 - RNA, 21 nt, Human
cgagaccacccuggccaacau

SEQ ID NO: 203856 - RNA, 24 nt, Human
cgggaugcggagguugcagugagc

SEQ ID NO: 203857 - RNA, 24 nt, Human
cguuuguagucccagcuacucugg

SEQ ID NO: 203858 - RNA, 21 nt, Human
cuaccccuaacuucugaaucu

SEQ ID NO: 203859 - RNA, 25 nt, Human
cucaaaaaaaaaaaaaaagaaagaa

SEQ ID NO: 203860 - RNA, 24 nt, Human
cucaacaucucuaaugaguuuuca

SEQ ID NO: 203861 - RNA, 24 nt, Human
cucaugccuguaaucccagcacuu

SEQ ID NO: 203862 - RNA, 19 nt, Human
cuccgucucaaaaaaaaaa

SEQ ID NO: 203863 - RNA, 23 nt, Human
cugaggcagaaucucuugaaccc

SEQ ID NO: 203864 - RNA, 24 nt, Human
cugccccccgccccccaccaccca

SEQ ID NO: 203865 - RNA, 18 nt, Human
cuugccuuuggcaucugg

SEQ ID NO: 203866 - RNA, 20 nt, Human
gaaaacauuauguuggccag

SEQ ID NO: 203867 - RNA, 21 nt, Human
gaaaacauuauguuggccagg

SEQ ID NO: 203868 - RNA, 22 nt, Human
gagaaagagauguuaaaaaaaa

SEQ ID NO: 203869 - RNA, 21 nt, Human
gagguugcagugagcugagau

SEQ ID NO: 203870 - RNA, 23 nt, Human
gagguugcagugagcugagauug

SEQ ID NO: 203871 - RNA, 23 nt, Human
gccaacaugaugaaaccccgucu

SEQ ID NO: 203872 - RNA, 18 nt, Human
gcggagguugcagugagc

SEQ ID NO: 203873 - RNA, 20 nt, Human
gcggagguugcagugagcug

SEQ ID NO: 203874 - RNA, 22 nt, Human
gcggagguugcagugagcugag

SEQ ID NO: 203875 - RNA, 22 nt, Human
ggagguugcagugagcugagau

SEQ ID NO: 203876 - RNA, 24 nt, Human
ggagguugcagugagcugagauug

SEQ ID NO: 203877 - RNA, 18 nt, Human
ggcaagacuccgucucaa

SEQ ID NO: 203878 - RNA, 18 nt, Human
ggcggaucacgaggucaa

SEQ ID NO: 203879 - RNA, 24 nt, Human
gggagagauuuaaucuaagaaaga

SEQ ID NO: 203880 - RNA, 18 nt, Human
gguggcucucucuuccca

SEQ ID NO: 203881 - RNA, 20 nt, Human
gucaagagaucgagaccacc

SEQ ID NO: 203882 - RNA, 21 nt, Human
gucucaaaaaaaaaaaaaaag

SEQ ID NO: 203883 - RNA, 24 nt, Human
guugcagugagcugagauugugcc

SEQ ID NO: 203884 - RNA, 24 nt, Human
guuggccaggcacaguggcucaug

SEQ ID NO: 203885 - RNA, 18 nt, Human
uaacuucugaaucucucu

SEQ ID NO: 203886 - RNA, 24 nt, Human
uaagaaagacucaguggaagaaac

SEQ ID NO: 203887 - RNA, 19 nt, Human
uaaugaguuuucagaucuu

SEQ ID NO: 203888 - RNA, 19 nt, Human
uacaaaaauuagcugggcc

SEQ ID NO: 203889 - RNA, 23 nt, Human
uacaggacacaaaagauaacaag

SEQ ID NO: 203890 - RNA, 19 nt, Human
uacucuggaggcugaggca

SEQ ID NO: 203891 - RNA, 21 nt, Human
uaucaggggaucacacccagg

SEQ ID NO: 203892 - RNA, 25 nt, Human
uauuaaacaagaccggacuauuuga

SEQ ID NO: 203893 - RNA, 19 nt, Human
ucaaaaaaaaaaaaaaaga

SEQ ID NO: 203894 - RNA, 19 nt, Human
ucaagagaucgagaccacc

SEQ ID NO: 203895 - RNA, 24 nt, Human
ucacgaggucaagagaucgagacc

SEQ ID NO: 203896 - RNA, 18 nt, Human
ucagaauggugucccacu

SEQ ID NO: 203897 - RNA, 22 nt, Human
ucaugccuguaaucccagcacu

SEQ ID NO: 203898 - RNA, 19 nt, Human
ucauuaaucuuauucaccc

SEQ ID NO: 203899 - RNA, 23 nt, Human
uccaacaaagaggaacugugaaa

SEQ ID NO: 203900 - RNA, 21 nt, Human
ucccaaccauccuacccccgc

SEQ ID NO: 203901 - RNA, 23 nt, Human
uccgucucaaaaaaaaaaaaaaa

SEQ ID NO: 203902 - RNA, 20 nt, Human
uccuaaaccacaggaauccc

SEQ ID NO: 203903 - RNA, 22 nt, Human
ucgagaccacccuggccaacau

SEQ ID NO: 203904 - RNA, 24 nt, Human
ucucaaaaaaaaaaaaaaagaaag

SEQ ID NO: 203905 - RNA, 18 nt, Human
ucucaggguccuggaacu

SEQ ID NO: 203906 - RNA, 25 nt, Human
ucucaggguccuggaacuuuuccca

SEQ ID NO: 203907 - RNA, 19 nt, Human
ucucucuccaagucacucu

SEQ ID NO: 203908 - RNA, 24 nt, Human
ucuucacggacaacugggagagau

SEQ ID NO: 203909 - RNA, 20 nt, Human
ucuuguaggucacacacuuc

SEQ ID NO: 203910 - RNA, 22 nt, Human
ucuuguaggucacacacuucuu

SEQ ID NO: 203911 - RNA, 18 nt, Human
ugaaaacauuauguuggc

SEQ ID NO: 203912 - RNA, 20 nt, Human
ugaauuaauccaagucucag

SEQ ID NO: 203913 - RNA, 24 nt, Human
ugagauugugccacuacacuccag

SEQ ID NO: 203914 - RNA, 19 nt, Human
ugagcugagauugugccac

SEQ ID NO: 203915 - RNA, 21 nt, Human
ugaggcagaaucucuugaacc

SEQ ID NO: 203916 - RNA, 24 nt, Human
ugaggcgggcggaucacgagguca

SEQ ID NO: 203917 - RNA, 19 nt, Human
ugagucuggggucuuuucu

SEQ ID NO: 203918 - RNA, 21 nt, Human
ugccccccgccccccaccacc

SEQ ID NO: 203919 - RNA, 24 nt, Human
ugcccugggauucuugccuuuggc

SEQ ID NO: 203920 - RNA, 23 nt, Human
ugccuguaaucccagcacuuugg

SEQ ID NO: 203921 - RNA, 23 nt, Human
ugccuguaaucccagcacuuugg

SEQ ID NO: 203922 - RNA, 24 nt, Human
ugccuguaaucccagcacuuuggg

SEQ ID NO: 203923 - RNA, 20 nt, Human
ugccuuuggcaucuggcucu

SEQ ID NO: 203924 - RNA, 21 nt, Human
ugcggagguugcagugagcug

SEQ ID NO: 203925 - RNA, 19 nt, Human
uggaagaaacgcauggaua

SEQ ID NO: 203926 - RNA, 24 nt, Human
uggccaggcacaguggcucaugcc

SEQ ID NO: 203927 - RNA, 24 nt, Human
uggcucaugccuguaaucccagca

SEQ ID NO: 203928 - RNA, 24 nt, Human
ugggaugcugaggcgggcggauca

SEQ ID NO: 203929 - RNA, 20 nt, Human
uggggggugggcgucuaaag

SEQ ID NO: 203930 - RNA, 24 nt, Human
uggugacacacguuuguaguccca

SEQ ID NO: 203931 - RNA, 21 nt, Human
ugucucaggguccuggaacuu

SEQ ID NO: 203932 - RNA, 24 nt, Human
ugugaaaacauuauguuggccagg

SEQ ID NO: 203933 - RNA, 23 nt, Human
uuagcugggccuggugacacacg

SEQ ID NO: 203934 - RNA, 24 nt, Human
uuagcugggccuggugacacacgu

SEQ ID NO: 203935 - RNA, 19 nt, Human
uucaguccugccccccgcc

SEQ ID NO: 203936 - RNA, 19 nt, Human
uugcagugagcugagauug

SEQ ID NO: 203937 - RNA, 22 nt, Human
uugcagugagcugagauugugc

SEQ ID NO: 203938 - RNA, 21 nt, Human
uugcggugggugggggguggg

SEQ ID NO: 203939 - RNA, 18 nt, Human
uuggcaucuggcucuuuu

SEQ ID NO: 203940 - RNA, 25 nt, Human
uugggaugcugaggcgggcggauca

SEQ ID NO: 203941 - RNA, 18 nt, Human
uuuuuuuuuuuuuuuuug

SEQ ID NO: 203942 - RNA, 23 nt, Human
uuuuuuuuuuuuuuuuuggccau

SEQ ID NO: 203943 - RNA, 22 nt, Human
uuuuuuuuuuuuuuuuuuuggc

SEQ ID NO: 203944 - RNA, 20 nt, Human
aaaaauucaaaaaauuagcc

SEQ ID NO: 203945 - RNA, 23 nt, Human
aaacaaacaaggaaacaagacca

SEQ ID NO: 203946 - RNA, 19 nt, Human
aaacaagaccacacauacu

SEQ ID NO: 203947 - RNA, 20 nt, Human
aaacagaacaaaacaaacaa

SEQ ID NO: 203948 - RNA, 21 nt, Human
aaacagaacaaaacaaacaaa

SEQ ID NO: 203949 - RNA, 19 nt, Human
aacaaaacagaacaaaaca

SEQ ID NO: 203950 - RNA, 20 nt, Human
aacauggugaaaucccgucu

SEQ ID NO: 203951 - RNA, 21 nt, Human
aacauggugaaaucccgucuc

SEQ ID NO: 203952 - RNA, 21 nt, Human
aacccgcuccuuuuucuccug

SEQ ID NO: 203953 - RNA, 20 nt, Human
aacuauguagccucgaaggu

SEQ ID NO: 203954 - RNA, 25 nt, Human
aacuauguagccucgaagguuucuc

SEQ ID NO: 203955 - RNA, 22 nt, Human
aagaauuaauaaguugcacccc

SEQ ID NO: 203956 - RNA, 24 nt, Human
aaucauccgaggucggggguucaa

SEQ ID NO: 203957 - RNA, 18 nt, Human
aauccucaaacaaaacag

SEQ ID NO: 203958 - RNA, 25 nt, Human
acaaacaaggaaacaagaccacaca

SEQ ID NO: 203959 - RNA, 22 nt, Human
acaauccucaaacaaaacagaa

SEQ ID NO: 203960 - RNA, 27 nt, Human
acaauccucaaacaaaacagaacaaaa

SEQ ID NO: 203961 - RNA, 25 nt, Human
acagaacaaaacaaacaaacaaacc

SEQ ID NO: 203962 - RNA, 24 nt, Human
acugugcugcugcacuccagccug

SEQ ID NO: 203963 - RNA, 20 nt, Human
agaccagagguagaaaacag

SEQ ID NO: 203964 - RNA, 19 nt, Human
agcacugcuucucucaaca

SEQ ID NO: 203965 - RNA, 24 nt, Human
agcacuuugggaggccgaggcggg

SEQ ID NO: 203966 - RNA, 24 nt, Human
agcauggccaacauggugaaaucc

SEQ ID NO: 203967 - RNA, 23 nt, Human
agccgggcaugguggugagugcc

SEQ ID NO: 203968 - RNA, 20 nt, Human
agcuacuaggaagcugaggc

SEQ ID NO: 203969 - RNA, 20 nt, Human
aggccgaggcgggcgaauca

SEQ ID NO: 203970 - RNA, 19 nt, Human
aggcggagguugcaaugag

SEQ ID NO: 203971 - RNA, 24 nt, Human
auccgaggucggggguucaagacc

SEQ ID NO: 203972 - RNA, 22 nt, Human
caaaacaaacaaacaaacaagg

SEQ ID NO: 203973 - RNA, 22 nt, Human
caaacaaaacagaacaaaacaa

SEQ ID NO: 203974 - RNA, 26 nt, Human
caaacaaacaaacaaggaaacaagac

SEQ ID NO: 203975 - RNA, 23 nt, Human
caaacaaacaaggaaacaagacc

SEQ ID NO: 203976 - RNA, 25 nt, Human
caaauaacaauccucaaacaaaaca

SEQ ID NO: 203977 - RNA, 24 nt, Human
caacauggugaaaucccgucucca

SEQ ID NO: 203978 - RNA, 24 nt, Human
caagaccagcauggccaacauggu

SEQ ID NO: 203979 - RNA, 19 nt, Human
caccccuuacccccaucca

SEQ ID NO: 203980 - RNA, 26 nt, Human
cacucggaacccgcuccuuuuucucc

SEQ ID NO: 203981 - RNA, 22 nt, Human
cagcacuuugggaggccgaggc

SEQ ID NO: 203982 - RNA, 24 nt, Human
cagcacuuugggaggccgaggcgg

SEQ ID NO: 203983 - RNA, 21 nt, Human
cagccugggcgacugagacuc

SEQ ID NO: 203984 - RNA, 23 nt, Human
cauccgaggucggggguucaaga

SEQ ID NO: 203985 - RNA, 24 nt, Human
cauggccaacauggugaaaucccg

SEQ ID NO: 203986 - RNA, 21 nt, Human
cccgucuccacuaaaaauuca

SEQ ID NO: 203987 - RNA, 22 nt, Human
ccgcgaacccgggaggcggagg

SEQ ID NO: 203988 - RNA, 18 nt, Human
ccugcaaucccagcuacu

SEQ ID NO: 203989 - RNA, 21 nt, Human
ccugcaaucccagcuacuagg

SEQ ID NO: 203990 - RNA, 24 nt, Human
ccugcaaucccagcuacuaggaag

SEQ ID NO: 203991 - RNA, 24 nt, Human
cgaaucauccgaggucggggguuc

SEQ ID NO: 203992 - RNA, 21 nt, Human
cgaggcgggcgaaucauccga

SEQ ID NO: 203993 - RNA, 22 nt, Human
cgccgcacugggcaaaccggca

SEQ ID NO: 203994 - RNA, 20 nt, Human
cgccuguaauuccagcacuu

SEQ ID NO: 203995 - RNA, 23 nt, Human
cgccuguaauuccagcacuuugg

SEQ ID NO: 203996 - RNA, 24 nt, Human
cgccuguaauuccagcacuuuggg

SEQ ID NO: 203997 - RNA, 21 nt, Human
cgggcgaaucauccgaggucg

SEQ ID NO: 203998 - RNA, 21 nt, Human
cguccagcuggcuccagaagu

SEQ ID NO: 203999 - RNA, 18 nt, Human
cugcacuccagccugggc

SEQ ID NO: 204000 - RNA, 18 nt, Human
cugcacuccagccugggc

SEQ ID NO: 204001 - RNA, 18 nt, Human
cugcacuccagccugggc

SEQ ID NO: 204002 - RNA, 20 nt, Human
cugcacuccagccugggcga

SEQ ID NO: 204003 - RNA, 21 nt, Human
cugcacuccagccugggcgac

SEQ ID NO: 204004 - RNA, 21 nt, Human
cugcacuccagccugggcgac

SEQ ID NO: 204005 - RNA, 20 nt, Human
cugcugcacuccagccuggg

SEQ ID NO: 204006 - RNA, 24 nt, Human
cugcugcacuccagccugggcgac

SEQ ID NO: 204007 - RNA, 24 nt, Human
gaagguucgccuguaauuccagca

SEQ ID NO: 204008 - RNA, 22 nt, Human
gaagguuucucacuuguaagga

SEQ ID NO: 204009 - RNA, 24 nt, Human
gccaacauggugaaaucccgucuc

SEQ ID NO: 204010 - RNA, 22 nt, Human
gccgcgccgcacugggcaaacc

SEQ ID NO: 204011 - RNA, 24 nt, Human
gcugcugcacuccagccugggcga

SEQ ID NO: 204012 - RNA, 19 nt, Human
ggagaacccgcgaacccgg

SEQ ID NO: 204013 - RNA, 19 nt, Human
gggguucaagaccagcaug

SEQ ID NO: 204014 - RNA, 18 nt, Human
guccagcuggcuccagaa

SEQ ID NO: 204015 - RNA, 20 nt, Human
guccagcuggcuccagaagu

SEQ ID NO: 204016 - RNA, 24 nt, Human
gugaagguucgccuguaauuccag

SEQ ID NO: 204017 - RNA, 21 nt, Human
uauguggucucuuguguucca

SEQ ID NO: 204018 - RNA, 20 nt, Human
uccagccugggcgacugaga

SEQ ID NO: 204019 - RNA, 22 nt, Human
uccgaggucggggguucaagac

SEQ ID NO: 204020 - RNA, 23 nt, Human
uccgaggucggggguucaagacc

SEQ ID NO: 204021 - RNA, 21 nt, Human
uccucaaacaaaacagaacaa

SEQ ID NO: 204022 - RNA, 24 nt, Human
ugagacugugcugcugcacuccag

SEQ ID NO: 204023 - RNA, 22 nt, Human
ugaggcggagaacccgcgaacc

SEQ ID NO: 204024 - RNA, 21 nt, Human
ugaggugagacugugcugcug

SEQ ID NO: 204025 - RNA, 18 nt, Human
ugagugaagguucgccug

SEQ ID NO: 204026 - RNA, 22 nt, Human
ugcaccccuuacccccauccac

SEQ ID NO: 204027 - RNA, 20 nt, Human
ugcugcacuccagccugggc

SEQ ID NO: 204028 - RNA, 23 nt, Human
ugcugcacuccagccugggcgac

SEQ ID NO: 204029 - RNA, 21 nt, Human
uggccaacauggugaaauccc

SEQ ID NO: 204030 - RNA, 24 nt, Human
uggccaacauggugaaaucccguc

SEQ ID NO: 204031 - RNA, 19 nt, Human
ugggaggccgaggcgggcg

SEQ ID NO: 204032 - RNA, 24 nt, Human
ugggaggccgaggcgggcgaauca

SEQ ID NO: 204033 - RNA, 24 nt, Human
uggugagugccugcaaucccagcu

SEQ ID NO: 204034 - RNA, 24 nt, Human
ugguggugagugccugcaauccca

SEQ ID NO: 204035 - RNA, 24 nt, Human
uuagccgggcaugguggugagugc

SEQ ID NO: 204036 - RNA, 21 nt, Human
uuccuuuggcugaaaacuaug

SEQ ID NO: 204037 - RNA, 24 nt, Human
uucgccuguaauuccagcacuuug

SEQ ID NO: 204038 - RNA, 25 nt, Human
uugggaggccgaggcgggcgaauca

SEQ ID NO: 204039 - RNA, 21 nt, Human
uuguucagcuauguggucucu

SEQ ID NO: 204040 - RNA, 24 nt, Human
uuguucagcuauguggucucuugu

SEQ ID NO: 204041 - RNA, 24 nt, Human
uuuuuguuuuuguaugauaauguu

SEQ ID NO: 204042 - RNA, 18 nt, Human
uuuuuuuuuuuuuuuuug

SEQ ID NO: 204043 - RNA, 24 nt, Human
uuuuuuuuuuuuuuuuuuguuuuu

SEQ ID NO: 204044 - RNA, 24 nt, Human
aaacaagaccacacuggaaauuca

SEQ ID NO: 204045 - RNA, 19 nt, Human
aaagugcuaggauuacaug

SEQ ID NO: 204046 - RNA, 24 nt, Human
aaagugcuaggauuacaugcacga

SEQ ID NO: 204047 - RNA, 22 nt, Human
aaaugcugucagaacauuuucc

SEQ ID NO: 204048 - RNA, 20 nt, Human
aaccccgcuuuucauugacc

SEQ ID NO: 204049 - RNA, 26 nt, Human
aacucaaucccaugucaucaaugagg

SEQ ID NO: 204050 - RNA, 22 nt, Human
aagcaauugcuagaaaggcauu

SEQ ID NO: 204051 - RNA, 25 nt, Human
aagugauccucccaucucagccucc

SEQ ID NO: 204052 - RNA, 20 nt, Human
aauugcuagaaaggcauuug

SEQ ID NO: 204053 - RNA, 20 nt, Human
acagagauguccuaggacuc

SEQ ID NO: 204054 - RNA, 19 nt, Human
acucuguaacacugaggcu

SEQ ID NO: 204055 - RNA, 24 nt, Human
acucuguugcccaggaggaaaugg

SEQ ID NO: 204056 - RNA, 19 nt, Human
acuuuguuacccagguugg

SEQ ID NO: 204057 - RNA, 21 nt, Human
agaauaaaaugaggcauacag

SEQ ID NO: 204058 - RNA, 18 nt, Human
agcaaguuaccaaauacc

SEQ ID NO: 204059 - RNA, 20 nt, Human
aggaaauggcagugguguga

SEQ ID NO: 204060 - RNA, 23 nt, Human
agggucucacucuguugcccagg

SEQ ID NO: 204061 - RNA, 23 nt, Human
agguaaccaacucaaucccaugu

SEQ ID NO: 204062 - RNA, 18 nt, Human
aguagccggaaaccugag

SEQ ID NO: 204063 - RNA, 24 nt, Human
aguggcuuuuuuuuuuucuccuuu

SEQ ID NO: 204064 - RNA, 24 nt, Human
aucccaugucaucaaugaacagca

SEQ ID NO: 204065 - RNA, 22 nt, Human
aucucauauuuuuuuuuuccag

SEQ ID NO: 204066 - RNA, 23 nt, Human
augcagcaaaugccagcaaccuu

SEQ ID NO: 204067 - RNA, 24 nt, Human
caaagugcuaggauuacaugcacg

SEQ ID NO: 204068 - RNA, 25 nt, Human
caagaaguagaagagaaagcagcaa

SEQ ID NO: 204069 - RNA, 27 nt, Human
caagugauccucccaucucagccuccc

SEQ ID NO: 204070 - RNA, 23 nt, Human
cacaagaaguagaagagaaagca

SEQ ID NO: 204071 - RNA, 23 nt, Human
cacuugaaaauagaaguuaauuu

SEQ ID NO: 204072 - RNA, 24 nt, Human
cacuuuguuacccagguuggucuc

SEQ ID NO: 204073 - RNA, 20 nt, Human
cagaguaaagcacaagaagu

SEQ ID NO: 204074 - RNA, 19 nt, Human
cagcaaaugccagcaaccu

SEQ ID NO: 204075 - RNA, 21 nt, Human
cauaucuagaaauuugcuuca

SEQ ID NO: 204076 - RNA, 24 nt, Human
caucucagccucccaaagugcuag

SEQ ID NO: 204077 - RNA, 19 nt, Human
ccaaagugcuaggauuaca

SEQ ID NO: 204078 - RNA, 21 nt, Human
ccacaguugccacggcaacua

SEQ ID NO: 204079 - RNA, 21 nt, Human
cccacacucuguaacacugag

SEQ ID NO: 204080 - RNA, 18 nt, Human
cccaggaggaaauggcag

SEQ ID NO: 204081 - RNA, 20 nt, Human
ccccuguagcugggaccaca

SEQ ID NO: 204082 - RNA, 22 nt, Human
ccucaagugauccucccaucuc

SEQ ID NO: 204083 - RNA, 22 nt, Human
ccuugagcuucugggcucaagu

SEQ ID NO: 204084 - RNA, 19 nt, Human
cgagccuccgugccuggcc

SEQ ID NO: 204085 - RNA, 21 nt, Human
cuaauuuuuuccaaucucaua

SEQ ID NO: 204086 - RNA, 24 nt, Human
cucaagugauccucccaucucagc

SEQ ID NO: 204087 - RNA, 25 nt, Human
cucaccauucaccuugauguaccca

SEQ ID NO: 204088 - RNA, 24 nt, Human
cucacugcagccuugagcuucugg

SEQ ID NO: 204089 - RNA, 21 nt, Human
cucagccuccccuguagcugg

SEQ ID NO: 204090 - RNA, 23 nt, Human
cuccccuguagcugggaccacag

SEQ ID NO: 204091 - RNA, 19 nt, Human
cuccgugccuggccgagcc

SEQ ID NO: 204092 - RNA, 23 nt, Human
cucuguugcccaggaggaaaugg

SEQ ID NO: 204093 - RNA, 26 nt, Human
cuguagcugggaccacaguugugugc

SEQ ID NO: 204094 - RNA, 22 nt, Human
cuuggccucaagugauccuccc

SEQ ID NO: 204095 - RNA, 24 nt, Human
gagcuucugggcucaagugauccu

SEQ ID NO: 204096 - RNA, 21 nt, Human
gcaguggugugaacuuggcuc

SEQ ID NO: 204097 - RNA, 23 nt, Human
gcgucucagccuccccuguagcu

SEQ ID NO: 204098 - RNA, 19 nt, Human
gcuuuuuuuuuuucuccuu

SEQ ID NO: 204099 - RNA, 19 nt, Human
ggaggaaauggcaguggug

SEQ ID NO: 204100 - RNA, 24 nt, Human
gugauccucccaucucagccuccc

SEQ ID NO: 204101 - RNA, 24 nt, Human
gugauccuugcgucucagccuccc

SEQ ID NO: 204102 - RNA, 19 nt, Human
guggcuuuuuuuuuuucuc

SEQ ID NO: 204103 - RNA, 18 nt, Human
uaaacaagaccacacugg

SEQ ID NO: 204104 - RNA, 21 nt, Human
uaaacaagaccacacuggaaa

SEQ ID NO: 204105 - RNA, 22 nt, Human
uaaaccgauggaucugaaagca

SEQ ID NO: 204106 - RNA, 25 nt, Human
uaaauaguauaaaccgauggaucug

SEQ ID NO: 204107 - RNA, 25 nt, Human
uaauuuuuugauuuuuuuuguagag

SEQ ID NO: 204108 - RNA, 22 nt, Human
uaccaaauaccucgauagugcu

SEQ ID NO: 204109 - RNA, 24 nt, Human
uaggauuacaugcacgagccuccg

SEQ ID NO: 204110 - RNA, 24 nt, Human
uagggucucacucuguugcccagg

SEQ ID NO: 204111 - RNA, 22 nt, Human
uaguggcuuuuuuuuuuucucc

SEQ ID NO: 204112 - RNA, 22 nt, Human
uauuaaacaagaccacacugga

SEQ ID NO: 204113 - RNA, 24 nt, Human
ucacugcagccuugagcuucuggg

SEQ ID NO: 204114 - RNA, 18 nt, Human
ucccaaagugcuaggauu

SEQ ID NO: 204115 - RNA, 25 nt, Human
uccucaauccugacacaguuacauc

SEQ ID NO: 204116 - RNA, 27 nt, Human
uccucccaucucagccucccaaagugc

SEQ ID NO: 204117 - RNA, 19 nt, Human
ucucacucuguugcccagg

SEQ ID NO: 204118 - RNA, 20 nt, Human
ucucacucuguugcccagga

SEQ ID NO: 204119 - RNA, 21 nt, Human
ucucacucuguugcccaggag

SEQ ID NO: 204120 - RNA, 23 nt, Human
ucucacucuguugcccaggagga

SEQ ID NO: 204121 - RNA, 19 nt, Human
ucucacuuuguuacccagg

SEQ ID NO: 204122 - RNA, 19 nt, Human
ucucacuuuguuacccagg

SEQ ID NO: 204123 - RNA, 19 nt, Human
ucucacuuuguuacccagg

SEQ ID NO: 204124 - RNA, 20 nt, Human
ucucacuuuguuacccaggu

SEQ ID NO: 204125 - RNA, 23 nt, Human
ucucacuuuguuacccagguugg

SEQ ID NO: 204126 - RNA, 21 nt, Human
ucucagccucccaaagugcua

SEQ ID NO: 204127 - RNA, 19 nt, Human
ucugggcucaagugauccu

SEQ ID NO: 204128 - RNA, 20 nt, Human
ucugggcucaagugauccuu

SEQ ID NO: 204129 - RNA, 18 nt, Human
ugaaaugcagcaaaugcc

SEQ ID NO: 204130 - RNA, 23 nt, Human
ugaaaugcugucagaacauuuuc

SEQ ID NO: 204131 - RNA, 19 nt, Human
ugcaugcaugaugcaguca

SEQ ID NO: 204132 - RNA, 19 nt, Human
ugcccaggaggaaauggca

SEQ ID NO: 204133 - RNA, 20 nt, Human
ugcuaggauuacaugcacga

SEQ ID NO: 204134 - RNA, 24 nt, Human
ugcucagugugccuuccacaguug

SEQ ID NO: 204135 - RNA, 21 nt, Human
ugcuguucucccggagcuggc

SEQ ID NO: 204136 - RNA, 19 nt, Human
uggaaccaagcagaauggu

SEQ ID NO: 204137 - RNA, 18 nt, Human
uggccucaagugauccuc

SEQ ID NO: 204138 - RNA, 21 nt, Human
uggccucaagugauccuccca

SEQ ID NO: 204139 - RNA, 24 nt, Human
uggccucaagugauccucccaucu

SEQ ID NO: 204140 - RNA, 25 nt, Human
uggcucacugcagccuugagcuucu

SEQ ID NO: 204141 - RNA, 24 nt, Human
ugggcucaagugauccuugcgucu

SEQ ID NO: 204142 - RNA, 24 nt, Human
uggugugaacuuggcucacugcag

SEQ ID NO: 204143 - RNA, 21 nt, Human
uguccuaggacucuaccacug

SEQ ID NO: 204144 - RNA, 21 nt, Human
uuaguggcuuuuuuuuuuucu

SEQ ID NO: 204145 - RNA, 21 nt, Human
uucauugacagaauaaaauga

SEQ ID NO: 204146 - RNA, 22 nt, Human
uuccacaguugccacggcaacu

SEQ ID NO: 204147 - RNA, 20 nt, Human
uugaaggcaaggauuuuguu

SEQ ID NO: 204148 - RNA, 21 nt, Human
uugcccaggaggaaauggcag

SEQ ID NO: 204149 - RNA, 26 nt, Human
uuguagcagaugagguguagaaggac

SEQ ID NO: 204150 - RNA, 18 nt, Human
uuucugcucaccauucac

SEQ ID NO: 204151 - RNA, 18 nt, Human
uuuuuuuguagagacagg

SEQ ID NO: 204152 - RNA, 21 nt, Human
auauaauauauucugggcaca

SEQ ID NO: 204153 - RNA, 23 nt, Human
auauucugggcacauuuacaucu

SEQ ID NO: 204154 - RNA, 21 nt, Human
auauucuuaauacuuacaucu

SEQ ID NO: 204155 - RNA, 22 nt, Human
aucucauucaucaucuuacuca

SEQ ID NO: 204156 - RNA, 18 nt, Human
cagagugcuggauuguuu

SEQ ID NO: 204157 - RNA, 19 nt, Human
gagaugauuugauauauga

SEQ ID NO: 204158 - RNA, 22 nt, Human
uauucugggcacauuuacaucu

SEQ ID NO: 204159 - RNA, 20 nt, Human
uauucuuaauacuuacaucu

SEQ ID NO: 204160 - RNA, 18 nt, Human
uccaaauuaggaaaauua

SEQ ID NO: 204161 - RNA, 22 nt, Human
uccgaacaguggucagcauggu

SEQ ID NO: 204162 - RNA, 21 nt, Human
uuaaagccugaaauuuauuga

SEQ ID NO: 204163 - RNA, 21 nt, Human
uucugugauucaaucccguuc

SEQ ID NO: 204164 - RNA, 21 nt, Human
uugaugacaacugccaguucu

SEQ ID NO: 204165 - RNA, 24 nt, Human
aaaauuuauccacaguugugugaa

SEQ ID NO: 204166 - RNA, 26 nt, Human
aaacaguaaauauagaacccuaaauc

SEQ ID NO: 204167 - RNA, 23 nt, Human
aaacggacgaaggccaucacacg

SEQ ID NO: 204168 - RNA, 19 nt, Human
aaacugcacagaacuuacg

SEQ ID NO: 204169 - RNA, 23 nt, Human
aaauauagaacccuaaaucucac

SEQ ID NO: 204170 - RNA, 27 nt, Human
aacaguaaauauagaacccuaaaucuc

SEQ ID NO: 204171 - RNA, 20 nt, Human
aagcguccuccgcaagcacc

SEQ ID NO: 204172 - RNA, 19 nt, Human
aaggaccagaaugaaaaca

SEQ ID NO: 204173 - RNA, 22 nt, Human
aauuaagaaaauauuuuaauaa

SEQ ID NO: 204174 - RNA, 18 nt, Human
acgacgaucgcgacgacu

SEQ ID NO: 204175 - RNA, 23 nt, Human
acuacuacuugaugacacaagaa

SEQ ID NO: 204176 - RNA, 26 nt, Human
agaaaauauuuuaauaaggcucaaaa

SEQ ID NO: 204177 - RNA, 21 nt, Human
agaaaggaaggaagaaaggaa

SEQ ID NO: 204178 - RNA, 24 nt, Human
agaaaucagauguuuccaguuuuu

SEQ ID NO: 204179 - RNA, 19 nt, Human
agaccuaacaggcaaggca

SEQ ID NO: 204180 - RNA, 24 nt, Human
agcaaaaauaaacauuuuauucau

SEQ ID NO: 204181 - RNA, 20 nt, Human
aggaagaaaggaaaaaagga

SEQ ID NO: 204182 - RNA, 24 nt, Human
aggaagaaaggaaaaaaggaaggg

SEQ ID NO: 204183 - RNA, 21 nt, Human
aggaagaccaggcagcggucg

SEQ ID NO: 204184 - RNA, 23 nt, Human
aggaagcgccggcgagucgaccu

SEQ ID NO: 204185 - RNA, 21 nt, Human
aggaaggaaagaagggaggga

SEQ ID NO: 204186 - RNA, 22 nt, Human
aggaccagaaugaaaacacuaa

SEQ ID NO: 204187 - RNA, 24 nt, Human
aggcaggccaauggagcagccaag

SEQ ID NO: 204188 - RNA, 22 nt, Human
aguucagaaaucagauguuucc

SEQ ID NO: 204189 - RNA, 22 nt, Human
auauuuuguuucuuuguaaaac

SEQ ID NO: 204190 - RNA, 20 nt, Human
aucacacgagcgccacgacg

SEQ ID NO: 204191 - RNA, 19 nt, Human
aucagauguuuccaguuuu

SEQ ID NO: 204192 - RNA, 25 nt, Human
augcaacauacauggcauacaugca

SEQ ID NO: 204193 - RNA, 20 nt, Human
auucaucaaacaaucaaaau

SEQ ID NO: 204194 - RNA, 23 nt, Human
caaccauucacaaaaaauaccau

SEQ ID NO: 204195 - RNA, 24 nt, Human
caacgauguacagacagaagaaga

SEQ ID NO: 204196 - RNA, 26 nt, Human
caagcaaaugacugauguuguaauga

SEQ ID NO: 204197 - RNA, 24 nt, Human
caaggcaggccaauggagcagcca

SEQ ID NO: 204198 - RNA, 20 nt, Human
caccaucuguaugugcagaa

SEQ ID NO: 204199 - RNA, 24 nt, Human
cacuuucacaaauuagcugcagcc

SEQ ID NO: 204200 - RNA, 21 nt, Human
cagaacuuacgaauagcacac

SEQ ID NO: 204201 - RNA, 21 nt, Human
caggccaauggagcagccaag

SEQ ID NO: 204202 - RNA, 23 nt, Human
caguaaauaccaacacaacauuc

SEQ ID NO: 204203 - RNA, 20 nt, Human
caucucauuauccuuccacu

SEQ ID NO: 204204 - RNA, 20 nt, Human
ccaaaguuuaaaauugagaa

SEQ ID NO: 204205 - RNA, 21 nt, Human
ccaacagaaaaauuaaagaag

SEQ ID NO: 204206 - RNA, 19 nt, Human
cccccggcuagguuuggcu

SEQ ID NO: 204207 - RNA, 19 nt, Human
cccuuguggcagacuauug

SEQ ID NO: 204208 - RNA, 19 nt, Human
ccgcaaccucgcgccucgg

SEQ ID NO: 204209 - RNA, 19 nt, Human
ccuccgcaagcaccagagc

SEQ ID NO: 204210 - RNA, 19 nt, Human
ccuggguugggaaauaacu

SEQ ID NO: 204211 - RNA, 22 nt, Human
cgacgacaacgauguacagaca

SEQ ID NO: 204212 - RNA, 23 nt, Human
cgcugagcugcgcugcgcugcgc

SEQ ID NO: 204213 - RNA, 22 nt, Human
cggcugcaaucgcccagcggag

SEQ ID NO: 204214 - RNA, 24 nt, Human
cuaucuuacuguguuuauaugugu

SEQ ID NO: 204215 - RNA, 21 nt, Human
cuccgcaagcaccagagcgcc

SEQ ID NO: 204216 - RNA, 21 nt, Human
cucugcacuaaucgcgucuuc

SEQ ID NO: 204217 - RNA, 23 nt, Human
cugcuaaauuaaguccuauagac

SEQ ID NO: 204218 - RNA, 21 nt, Human
cuuagagagcagcaggcccac

SEQ ID NO: 204219 - RNA, 21 nt, Human
cuuccaaaauuuauccacagu

SEQ ID NO: 204220 - RNA, 23 nt, Human
cuuccacuucuguagucccgguu

SEQ ID NO: 204221 - RNA, 20 nt, Human
cuuucuucuucguuggcccc

SEQ ID NO: 204222 - RNA, 21 nt, Human
cuuuucgcuccgcuaucuuac

SEQ ID NO: 204223 - RNA, 18 nt, Human
gaaagagagaaaggaagg

SEQ ID NO: 204224 - RNA, 23 nt, Human
gacgacuccgacgacaacgaugu

SEQ ID NO: 204225 - RNA, 24 nt, Human
gauugcuucagucuuaagcaacca

SEQ ID NO: 204226 - RNA, 20 nt, Human
gcaaggcagguagacuugac

SEQ ID NO: 204227 - RNA, 19 nt, Human
gcagcucuuccacugcccu

SEQ ID NO: 204228 - RNA, 22 nt, Human
gccaucacacgagcgccacgac

SEQ ID NO: 204229 - RNA, 21 nt, Human
gcccugauaguucagaaauca

SEQ ID NO: 204230 - RNA, 23 nt, Human
gccucggcggagggagaggaaug

SEQ ID NO: 204231 - RNA, 18 nt, Human
gcugagcugcgcugcgcu

SEQ ID NO: 204232 - RNA, 19 nt, Human
gcuugaaaacuuuucaugg

SEQ ID NO: 204233 - RNA, 22 nt, Human
ggaaggaagcguccuccgcaag

SEQ ID NO: 204234 - RNA, 18 nt, Human
ggaauggagggagcucgg

SEQ ID NO: 204235 - RNA, 20 nt, Human
ggagcccgcggcagucggug

SEQ ID NO: 204236 - RNA, 19 nt, Human
ggccccuaacuaacuacac

SEQ ID NO: 204237 - RNA, 18 nt, Human
gugcgccccccggcuagg

SEQ ID NO: 204238 - RNA, 24 nt, Human
uaaaacuuccaaaguuucuaccau

SEQ ID NO: 204239 - RNA, 25 nt, Human
uaaaauaccacuauguuuagggaca

SEQ ID NO: 204240 - RNA, 21 nt, Human
uaacaaaugugcugugagcua

SEQ ID NO: 204241 - RNA, 26 nt, Human
uaacaggcuagguucaucauaucauc

SEQ ID NO: 204242 - RNA, 20 nt, Human
uaacccacuagcguccggga

SEQ ID NO: 204243 - RNA, 27 nt, Human
uaagaacuagcaucaugaauucuucca

SEQ ID NO: 204244 - RNA, 22 nt, Human
uaagacaacacuuugcaaccau

SEQ ID NO: 204245 - RNA, 23 nt, Human
uaaggaccagaaugaaaacacua

SEQ ID NO: 204246 - RNA, 24 nt, Human
uaaguaacugucaagcguaagaac

SEQ ID NO: 204247 - RNA, 21 nt, Human
uaauaaucagaauuugaacac

SEQ ID NO: 204248 - RNA, 19 nt, Human
uacaauuaucacauggacu

SEQ ID NO: 204249 - RNA, 22 nt, Human
uacaggaauuaggaauaagaca

SEQ ID NO: 204250 - RNA, 18 nt, Human
uauuaaguacuacuacuu

SEQ ID NO: 204251 - RNA, 24 nt, Human
uauuuacauuaguuaagaccaaca

SEQ ID NO: 204252 - RNA, 19 nt, Human
ucaaaacccaauugauguu

SEQ ID NO: 204253 - RNA, 19 nt, Human
ucaagcaaaugacugaugu

SEQ ID NO: 204254 - RNA, 22 nt, Human
ucacauggacuucuuuaaaaca

SEQ ID NO: 204255 - RNA, 23 nt, Human
ucagucuuaagcaaccaaaguuu

SEQ ID NO: 204256 - RNA, 23 nt, Human
ucaucaccuuuacaauuaucaca

SEQ ID NO: 204257 - RNA, 23 nt, Human
ucaucauaucauccuuuaguugu

SEQ ID NO: 204258 - RNA, 18 nt, Human
uccuccgcaagcaccaga

SEQ ID NO: 204259 - RNA, 18 nt, Human
ucuucuuucuucuucguu

SEQ ID NO: 204260 - RNA, 19 nt, Human
ugaaauauaaccacuguca

SEQ ID NO: 204261 - RNA, 23 nt, Human
ugaaaugggcacguauggaaaua

SEQ ID NO: 204262 - RNA, 18 nt, Human
ugaacacuguccuuaaga

SEQ ID NO: 204263 - RNA, 21 nt, Human
ugaagcacacaaauuuccagg

SEQ ID NO: 204264 - RNA, 23 nt, Human
ugacaaugucaaauuuuugcccc

SEQ ID NO: 204265 - RNA, 24 nt, Human
ugacacaagaaucauuaacaaaug

SEQ ID NO: 204266 - RNA, 22 nt, Human
ugagaacacagaccaaggguuu

SEQ ID NO: 204267 - RNA, 19 nt, Human
ugccaccugagaugaacau

SEQ ID NO: 204268 - RNA, 19 nt, Human
ugcgcugagcugcgcugcg

SEQ ID NO: 204269 - RNA, 22 nt, Human
ugcuguguuucuucagccauuu

SEQ ID NO: 204270 - RNA, 21 nt, Human
uggagggagcucggcgcgaua

SEQ ID NO: 204271 - RNA, 22 nt, Human
uggccaacacuuauuguaacac

SEQ ID NO: 204272 - RNA, 20 nt, Human
uggccccuaacuaacuacac

SEQ ID NO: 204273 - RNA, 25 nt, Human
uggccccuaacuaacuacacuacuc

SEQ ID NO: 204274 - RNA, 19 nt, Human
uggccugacuuuagcaaug

SEQ ID NO: 204275 - RNA, 23 nt, Human
uguaauaaucagaauuugaacac

SEQ ID NO: 204276 - RNA, 19 nt, Human
uguguugagaacacagacc

SEQ ID NO: 204277 - RNA, 21 nt, Human
uguugagaacacagaccaagg

SEQ ID NO: 204278 - RNA, 21 nt, Human
uuagcaaugcuugaaaacuuu

SEQ ID NO: 204279 - RNA, 19 nt, Human
uucaacagaccuaacaggc

SEQ ID NO: 204280 - RNA, 24 nt, Human
uucacaaaaaauaccauuugacaa

SEQ ID NO: 204281 - RNA, 22 nt, Human
uucauguaauauuugggcaugc

SEQ ID NO: 204282 - RNA, 18 nt, Human
uucugccucugacucacu

SEQ ID NO: 204283 - RNA, 22 nt, Human
uucuguagucccgguuaaccag

SEQ ID NO: 204284 - RNA, 20 nt, Human
uuggccccuaacuaacuaca

SEQ ID NO: 204285 - RNA, 22 nt, Human
uuuaacaugcacuucaacagac

SEQ ID NO: 204286 - RNA, 24 nt, Human
uuugcaaccauucacaaaaaauac

SEQ ID NO: 204287 - RNA, 19 nt, Human
aaccaccacacccgaccca

SEQ ID NO: 204288 - RNA, 22 nt, Human
aagugccagcacaauuacugaa

SEQ ID NO: 204289 - RNA, 23 nt, Human
agcuuuuuaacccacuauuauuc

SEQ ID NO: 204290 - RNA, 22 nt, Human
aggagaaaugcaaacuugccua

SEQ ID NO: 204291 - RNA, 23 nt, Human
caagaaccaccacacccgaccca

SEQ ID NO: 204292 - RNA, 19 nt, Human
caccacacccgacccagaa

SEQ ID NO: 204293 - RNA, 21 nt, Human
cacccgacccagaaagcuuuu

SEQ ID NO: 204294 - RNA, 22 nt, Human
cacccgacccagaaagcuuuuu

SEQ ID NO: 204295 - RNA, 19 nt, Human
cagaucccaaaaaggagaa

SEQ ID NO: 204296 - RNA, 20 nt, Human
ccaaaaaggagaaaugcaaa

SEQ ID NO: 204297 - RNA, 18 nt, Human
ccaccacacccgacccag

SEQ ID NO: 204298 - RNA, 20 nt, Human
gaaccaccacacccgaccca

SEQ ID NO: 204299 - RNA, 21 nt, Human
uaagugccagcacaauuacug

SEQ ID NO: 204300 - RNA, 18 nt, Human
uggaaugccgcucaauuu

SEQ ID NO: 204301 - RNA, 24 nt, Human
ugggcagaucccaaaaaggagaaa

SEQ ID NO: 204302 - RNA, 19 nt, Human
aaacagaaagaaaacuuaa

SEQ ID NO: 204303 - RNA, 24 nt, Human
aaagacauccagauuaaucugaag

SEQ ID NO: 204304 - RNA, 24 nt, Human
aacagaaagaaaacuuaaaggucc

SEQ ID NO: 204305 - RNA, 26 nt, Human
aagcaagacaggagcgacgccucugg

SEQ ID NO: 204306 - RNA, 18 nt, Human
aagcccacacagcaaaga

SEQ ID NO: 204307 - RNA, 18 nt, Human
aaggaagagcaaguggac

SEQ ID NO: 204308 - RNA, 19 nt, Human
aagucagaaucucacaugg

SEQ ID NO: 204309 - RNA, 23 nt, Human
aaguggacgucugggacugacaa

SEQ ID NO: 204310 - RNA, 19 nt, Human
acaaagccaaaaggcaggc

SEQ ID NO: 204311 - RNA, 26 nt, Human
acaacaauggaaacaauaacugacac

SEQ ID NO: 204312 - RNA, 23 nt, Human
acagcaaagaaggcguauuugga

SEQ ID NO: 204313 - RNA, 18 nt, Human
acccugugucuuccaugg

SEQ ID NO: 204314 - RNA, 22 nt, Human
accgggugcagucgcgcacaag

SEQ ID NO: 204315 - RNA, 21 nt, Human
accuucccgggacuucugcua

SEQ ID NO: 204316 - RNA, 25 nt, Human
agaaaaaaagagaauaugauaaaua

SEQ ID NO: 204317 - RNA, 27 nt, Human
agaaagaaaacuuaaagguccucuagu

SEQ ID NO: 204318 - RNA, 21 nt, Human
agaaucugggaagagggagug

SEQ ID NO: 204319 - RNA, 20 nt, Human
agcaauaagaaaaaaagaga

SEQ ID NO: 204320 - RNA, 25 nt, Human
agcggccacccccagccgcugagcc

SEQ ID NO: 204321 - RNA, 24 nt, Human
agcuuugaauaaaagacauccaga

SEQ ID NO: 204322 - RNA, 19 nt, Human
aggcaggcaggccauggcu

SEQ ID NO: 204323 - RNA, 19 nt, Human
aggcaggcaggccauggcu

SEQ ID NO: 204324 - RNA, 20 nt, Human
agggcgaagaagaggcaggg

SEQ ID NO: 204325 - RNA, 20 nt, Human
aggucaggggucuaaaaggc

SEQ ID NO: 204326 - RNA, 22 nt, Human
agugacgggaacaugucagaga

SEQ ID NO: 204327 - RNA, 20 nt, Human
aucugucuucagcuucccuc

SEQ ID NO: 204328 - RNA, 21 nt, Human
auggcugucuucugggucauu

SEQ ID NO: 204329 - RNA, 24 nt, Human
caacaauggaaacaauaacugaca

SEQ ID NO: 204330 - RNA, 22 nt, Human
caagaggaugcacguuuggacc

SEQ ID NO: 204331 - RNA, 18 nt, Human
caaguggacgucugggac

SEQ ID NO: 204332 - RNA, 21 nt, Human
cacagaacagggcgaagaaga

SEQ ID NO: 204333 - RNA, 21 nt, Human
cacagauguggaaaguggggu

SEQ ID NO: 204334 - RNA, 20 nt, Human
caccuugggggagcugcagg

SEQ ID NO: 204335 - RNA, 18 nt, Human
cacuauucaagaucucac

SEQ ID NO: 204336 - RNA, 26 nt, Human
cagcggccgcuuuuuuuuuuuuuuuu

SEQ ID NO: 204337 - RNA, 19 nt, Human
caggagcgacgccucuggc

SEQ ID NO: 204338 - RNA, 19 nt, Human
cagucgcgcacaagcagca

SEQ ID NO: 204339 - RNA, 20 nt, Human
cagucgcgcacaagcagcag

SEQ ID NO: 204340 - RNA, 22 nt, Human
cauaaggaagagcaaguggacg

SEQ ID NO: 204341 - RNA, 18 nt, Human
caucagugaccgagauag

SEQ ID NO: 204342 - RNA, 19 nt, Human
cauguccugaagaggagga

SEQ ID NO: 204343 - RNA, 20 nt, Human
cauguccugaagaggaggaa

SEQ ID NO: 204344 - RNA, 19 nt, Human
cauuuaccuucccgggacu

SEQ ID NO: 204345 - RNA, 20 nt, Human
ccaagcaaguaagcaagaca

SEQ ID NO: 204346 - RNA, 19 nt, Human
ccaaggcuuuuuagaagac

SEQ ID NO: 204347 - RNA, 19 nt, Human
ccagcggccaggacaccag

SEQ ID NO: 204348 - RNA, 19 nt, Human
cccacacagcaaagaaggc

SEQ ID NO: 204349 - RNA, 21 nt, Human
cccacagggucccgcugccag

SEQ ID NO: 204350 - RNA, 20 nt, Human
cccgggacuucugcuauggg

SEQ ID NO: 204351 - RNA, 25 nt, Human
cccuccagcgccaccugcuggaauc

SEQ ID NO: 204352 - RNA, 20 nt, Human
ccgcugccagaggcgaggga

SEQ ID NO: 204353 - RNA, 22 nt, Human
ccucaggugaagagaauaccgg

SEQ ID NO: 204354 - RNA, 20 nt, Human
ccucuggcuaagacaggaac

SEQ ID NO: 204355 - RNA, 19 nt, Human
ccuggcagauucgagcggc

SEQ ID NO: 204356 - RNA, 20 nt, Human
ccuggcagauucgagcggcc

SEQ ID NO: 204357 - RNA, 20 nt, Human
ccuugggggagcugcagggg

SEQ ID NO: 204358 - RNA, 24 nt, Human
cgagauaggacgcagcaagcuauc

SEQ ID NO: 204359 - RNA, 20 nt, Human
cgcagcaagcuaucgugcuu

SEQ ID NO: 204360 - RNA, 23 nt, Human
cguuccuuugaaacaaagccaaa

SEQ ID NO: 204361 - RNA, 25 nt, Human
cuggcacagaacagggcgaagaaga

SEQ ID NO: 204362 - RNA, 23 nt, Human
cugugucuuccauggaaaauaaa

SEQ ID NO: 204363 - RNA, 19 nt, Human
gaacauggcugugacggac

SEQ ID NO: 204364 - RNA, 18 nt, Human
gaaucugggaagagggag

SEQ ID NO: 204365 - RNA, 18 nt, Human
gacacagugagugacggg

SEQ ID NO: 204366 - RNA, 19 nt, Human
gacaccagagaccacgcgg

SEQ ID NO: 204367 - RNA, 25 nt, Human
gaccaagcaaguaagcaagacagga

SEQ ID NO: 204368 - RNA, 21 nt, Human
gauaucuggaagcccacacag

SEQ ID NO: 204369 - RNA, 18 nt, Human
gauccugcccuccugcac

SEQ ID NO: 204370 - RNA, 20 nt, Human
gcaauuuggguccucuggcu

SEQ ID NO: 204371 - RNA, 19 nt, Human
gcaccggguuccugcacug

SEQ ID NO: 204372 - RNA, 23 nt, Human
gcagauucgagcggccaccccca

SEQ ID NO: 204373 - RNA, 23 nt, Human
gcagcaacaaagccagauugaag

SEQ ID NO: 204374 - RNA, 20 nt, Human
gcagcacagccagggcggca

SEQ ID NO: 204375 - RNA, 22 nt, Human
gcgaagaagaggcagggauagc

SEQ ID NO: 204376 - RNA, 20 nt, Human
gcgagcaucucagggcagac

SEQ ID NO: 204377 - RNA, 18 nt, Human
ggaaagccucaggugaag

SEQ ID NO: 204378 - RNA, 19 nt, Human
ggagcugcaggggaaaaug

SEQ ID NO: 204379 - RNA, 18 nt, Human
ggcaaaagcagagaaucu

SEQ ID NO: 204380 - RNA, 22 nt, Human
ggcaauuuggguccucuggcuu

SEQ ID NO: 204381 - RNA, 20 nt, Human
ggcaggcaggccauggcuuc

SEQ ID NO: 204382 - RNA, 22 nt, Human
ggccgcuuuuuuuuuuuuuuuu

SEQ ID NO: 204383 - RNA, 18 nt, Human
gugcuuagaacgugagug

SEQ ID NO: 204384 - RNA, 21 nt, Human
uaaaaagugaacaaggaggcc

SEQ ID NO: 204385 - RNA, 23 nt, Human
uaagaaaaaaagagaauaugaua

SEQ ID NO: 204386 - RNA, 25 nt, Human
uaagaaaaaaagagaauaugauaaa

SEQ ID NO: 204387 - RNA, 22 nt, Human
uaagcaauaagaaaaaaagaga

SEQ ID NO: 204388 - RNA, 21 nt, Human
uacgauguugcuagcccugcc

SEQ ID NO: 204389 - RNA, 19 nt, Human
uagcccagcaggagagcga

SEQ ID NO: 204390 - RNA, 20 nt, Human
uauuccaaaguuucuuccug

SEQ ID NO: 204391 - RNA, 20 nt, Human
ucagagacaccagagaccac

SEQ ID NO: 204392 - RNA, 18 nt, Human
ucaugggaaagauccuga

SEQ ID NO: 204393 - RNA, 23 nt, Human
ucccgcugccagaggcgagggag

SEQ ID NO: 204394 - RNA, 19 nt, Human
uccucugacagaucucuga

SEQ ID NO: 204395 - RNA, 21 nt, Human
ucucagggcagacacgccagc

SEQ ID NO: 204396 - RNA, 22 nt, Human
ucuggaagcccacacagcaaag

SEQ ID NO: 204397 - RNA, 21 nt, Human
ucugucuucagcuucccucca

SEQ ID NO: 204398 - RNA, 21 nt, Human
ucuucugggucauugucccag

SEQ ID NO: 204399 - RNA, 20 nt, Human
ugaaagaacacuauucaaga

SEQ ID NO: 204400 - RNA, 19 nt, Human
ugacaagggggccaaccaa

SEQ ID NO: 204401 - RNA, 21 nt, Human
ugacaagggggccaaccaaga

SEQ ID NO: 204402 - RNA, 24 nt, Human
ugaccaagcaaguaagcaagacag

SEQ ID NO: 204403 - RNA, 21 nt, Human
ugagaugcuauuaaaccacag

SEQ ID NO: 204404 - RNA, 19 nt, Human
ugagugcacagauguggaa

SEQ ID NO: 204405 - RNA, 22 nt, Human
ugcaggggaaaaugaguuuccc

SEQ ID NO: 204406 - RNA, 20 nt, Human
ugcuguggagaccauuuucc

SEQ ID NO: 204407 - RNA, 18 nt, Human
uggacauaaggaagagca

SEQ ID NO: 204408 - RNA, 19 nt, Human
ugggaaagauccugaagcc

SEQ ID NO: 204409 - RNA, 18 nt, Human
ugguuuggucaaucuucu

SEQ ID NO: 204410 - RNA, 19 nt, Human
ugucuuagaaacagaaaga

SEQ ID NO: 204411 - RNA, 21 nt, Human
ugucuuagaaacagaaagaaa

SEQ ID NO: 204412 - RNA, 21 nt, Human
ugucuucugggucauuguccc

SEQ ID NO: 204413 - RNA, 18 nt, Human
uuaaagguccucuagucc

SEQ ID NO: 204414 - RNA, 25 nt, Human
uuaaagguccucuaguccaagcuug

SEQ ID NO: 204415 - RNA, 23 nt, Human
uucaguuccagaacuaaaguaaa

SEQ ID NO: 204416 - RNA, 24 nt, Human
aagagcuggcccaaggacucaggg

SEQ ID NO: 204417 - RNA, 18 nt, Human
aaggacucagggucuggg

SEQ ID NO: 204418 - RNA, 24 nt, Human
aaggggccuggagauggcagcagg

SEQ ID NO: 204419 - RNA, 18 nt, Human
accgcgacucaccacgcc

SEQ ID NO: 204420 - RNA, 21 nt, Human
aggaagcggcgggaagucaag

SEQ ID NO: 204421 - RNA, 22 nt, Human
aggacacaguguggcuauuugg

SEQ ID NO: 204422 - RNA, 25 nt, Human
aggaccgaggguggacggcaaggga

SEQ ID NO: 204423 - RNA, 20 nt, Human
caagcagaggucggaugggc

SEQ ID NO: 204424 - RNA, 21 nt, Human
cagagggcuucuaggagacuu

SEQ ID NO: 204425 - RNA, 23 nt, Human
cagaggucggaugggcucccugg

SEQ ID NO: 204426 - RNA, 18 nt, Human
cagcagggggucagcucu

SEQ ID NO: 204427 - RNA, 22 nt, Human
ccacgccccccgggggagguga

SEQ ID NO: 204428 - RNA, 19 nt, Human
cccccuggagggggcgggc

SEQ ID NO: 204429 - RNA, 23 nt, Human
ccccgggggaggugagugggggg

SEQ ID NO: 204430 - RNA, 21 nt, Human
ccccugaaggaagcggcggga

SEQ ID NO: 204431 - RNA, 22 nt, Human
ccuccuggucuuagccaagagc

SEQ ID NO: 204432 - RNA, 20 nt, Human
ccugcagguaaggggccugg

SEQ ID NO: 204433 - RNA, 18 nt, Human
ccuggagggggcgggcgg

SEQ ID NO: 204434 - RNA, 23 nt, Human
cgggaagucaagcagaggucgga

SEQ ID NO: 204435 - RNA, 21 nt, Human
cuacaggaggacacagugugg

SEQ ID NO: 204436 - RNA, 19 nt, Human
cuccccauuggccagcccc

SEQ ID NO: 204437 - RNA, 21 nt, Human
cuccccauuggccagccccaa

SEQ ID NO: 204438 - RNA, 24 nt, Human
cuugcagccuccuggucuuagcca

SEQ ID NO: 204439 - RNA, 24 nt, Human
gaccgcgacucaccacgccccccg

SEQ ID NO: 204440 - RNA, 26 nt, Human
gccgaggccccugaaggaagcggcgg

SEQ ID NO: 204441 - RNA, 21 nt, Human
ggaacgcggggagguggguga

SEQ ID NO: 204442 - RNA, 19 nt, Human
ggaacuccuggagcaaacg

SEQ ID NO: 204443 - RNA, 19 nt, Human
ggaagugggaacgcgggga

SEQ ID NO: 204444 - RNA, 18 nt, Human
ggagauggcagcaggggg

SEQ ID NO: 204445 - RNA, 18 nt, Human
ggaggugggugagggggg

SEQ ID NO: 204446 - RNA, 25 nt, Human
ggaggugggugaggggggugaaugg

SEQ ID NO: 204447 - RNA, 20 nt, Human
gggaagugggaacgcgggga

SEQ ID NO: 204448 - RNA, 18 nt, Human
gggauggggcaggaacuc

SEQ ID NO: 204449 - RNA, 18 nt, Human
gggcggcgacuacaggag

SEQ ID NO: 204450 - RNA, 18 nt, Human
ggggacaugggcgggggc

SEQ ID NO: 204451 - RNA, 21 nt, Human
ggggaggugggugaggggggu

SEQ ID NO: 204452 - RNA, 21 nt, Human
ggguuggaaguuuggggaggg

SEQ ID NO: 204453 - RNA, 25 nt, Human
ggugggagcagagcccccuggaggg

SEQ ID NO: 204454 - RNA, 19 nt, Human
gucagagugcggggaagug

SEQ ID NO: 204455 - RNA, 21 nt, Human
gucagcucugcgcaccccucu

SEQ ID NO: 204456 - RNA, 23 nt, Human
gucagcucugcgcaccccucugg

SEQ ID NO: 204457 - RNA, 20 nt, Human
guguggcuauuugggcgccc

SEQ ID NO: 204458 - RNA, 25 nt, Human
uaaggggccuggagauggcagcagg

SEQ ID NO: 204459 - RNA, 18 nt, Human
uaggguggcgggaaagca

SEQ ID NO: 204460 - RNA, 21 nt, Human
ucccugcagguaaggggccug

SEQ ID NO: 204461 - RNA, 21 nt, Human
ugaguggggggacaugggcga

SEQ ID NO: 204462 - RNA, 24 nt, Human
ugaguggggggacaugggcggggg

SEQ ID NO: 204463 - RNA, 20 nt, Human
ugcagguaaggggccuggaa

SEQ ID NO: 204464 - RNA, 23 nt, Human
uggacggggaccguccgugagaa

SEQ ID NO: 204465 - RNA, 22 nt, Human
ugggagcagagcccccuggagg

SEQ ID NO: 204466 - RNA, 22 nt, Human
uggggugggagcagagcccccu

SEQ ID NO: 204467 - RNA, 18 nt, Human
uguggcuauuugggcgcc

SEQ ID NO: 204468 - RNA, 23 nt, Human
cgcgccgccgugugccgcugccc

SEQ ID NO: 204469 - RNA, 22 nt, Human
ucuccauuguucugcuuucaau

SEQ ID NO: 204470 - RNA, 21 nt, Human
ugccuuguuuauuucaucucc

SEQ ID NO: 204471 - RNA, 21 nt, Human
ugccuuguuuauuucaucucc

SEQ ID NO: 204472 - RNA, 21 nt, Human
aagaagcuuggcagcccagac

SEQ ID NO: 204473 - RNA, 18 nt, Human
aagcaacacugggaaucc

SEQ ID NO: 204474 - RNA, 21 nt, Human
aagcucacaaaugccccuuga

SEQ ID NO: 204475 - RNA, 23 nt, Human
acaaaugccccuugagacacacu

SEQ ID NO: 204476 - RNA, 22 nt, Human
acaguagagaaacauacaguac

SEQ ID NO: 204477 - RNA, 22 nt, Human
accccaaagggaucagauguga

SEQ ID NO: 204478 - RNA, 19 nt, Human
accccacccccgcacccca

SEQ ID NO: 204479 - RNA, 18 nt, Human
agcaaagcucacaaaugc

SEQ ID NO: 204480 - RNA, 19 nt, Human
agcagccaacuuuccacgu

SEQ ID NO: 204481 - RNA, 25 nt, Human
aggaaaaccucauggcagggcgggg

SEQ ID NO: 204482 - RNA, 21 nt, Human
aggaggaggcugccgcccugc

SEQ ID NO: 204483 - RNA, 21 nt, Human
aggcaguuuugugaauauccg

SEQ ID NO: 204484 - RNA, 19 nt, Human
aggcggaaauucgggcccc

SEQ ID NO: 204485 - RNA, 21 nt, Human
aggcuggcaggcagcagcccu

SEQ ID NO: 204486 - RNA, 19 nt, Human
agggaagcuggggccucag

SEQ ID NO: 204487 - RNA, 22 nt, Human
caagcccagccuccgcucugcc

SEQ ID NO: 204488 - RNA, 21 nt, Human
cacaaaugccccuugagacac

SEQ ID NO: 204489 - RNA, 23 nt, Human
cacccccgcaccccaaagggauc

SEQ ID NO: 204490 - RNA, 23 nt, Human
caccccgcagcuccacguccacu

SEQ ID NO: 204491 - RNA, 19 nt, Human
cagggggcauucacucagu

SEQ ID NO: 204492 - RNA, 23 nt, Human
ccaagcccagccuccgcucugcc

SEQ ID NO: 204493 - RNA, 19 nt, Human
ccccuggccaagcccagcc

SEQ ID NO: 204494 - RNA, 23 nt, Human
ccccuggccaagcccagccuccg

SEQ ID NO: 204495 - RNA, 21 nt, Human
cccuggccaagcccagccucc

SEQ ID NO: 204496 - RNA, 21 nt, Human
ccgccuuggggaggagaagcu

SEQ ID NO: 204497 - RNA, 25 nt, Human
ccuacagcuugguaaguccuagggc

SEQ ID NO: 204498 - RNA, 24 nt, Human
ccuccguugucugcaggcucugac

SEQ ID NO: 204499 - RNA, 18 nt, Human
ccuccugccugccugggg

SEQ ID NO: 204500 - RNA, 21 nt, Human
ccugcaugccucugggcggca

SEQ ID NO: 204501 - RNA, 21 nt, Human
cgggagaccgggcgggggccg

SEQ ID NO: 204502 - RNA, 21 nt, Human
cggggccgggcgccgggcgcc

SEQ ID NO: 204503 - RNA, 19 nt, Human
cgugggaaggggaagccgg

SEQ ID NO: 204504 - RNA, 20 nt, Human
cucacaccccgcagcuccac

SEQ ID NO: 204505 - RNA, 18 nt, Human
cuccccgcggccuccugc

SEQ ID NO: 204506 - RNA, 22 nt, Human
cucugggcuggaccccaccccc

SEQ ID NO: 204507 - RNA, 22 nt, Human
cugcugcaucccagagcugcgu

SEQ ID NO: 204508 - RNA, 22 nt, Human
cuggaccccacccccgcacccc

SEQ ID NO: 204509 - RNA, 23 nt, Human
cuuccaugcgagcggcugcugca

SEQ ID NO: 204510 - RNA, 19 nt, Human
gaaggcaguuuugugaaua

SEQ ID NO: 204511 - RNA, 19 nt, Human
gagcggcugcugcauccca

SEQ ID NO: 204512 - RNA, 19 nt, Human
gccccauggccgccuuggg

SEQ ID NO: 204513 - RNA, 23 nt, Human
gccccuggccaagcccagccucc

SEQ ID NO: 204514 - RNA, 21 nt, Human
gccgcccugcugaggaccgag

SEQ ID NO: 204515 - RNA, 22 nt, Human
gcguuugucaggggggaagaag

SEQ ID NO: 204516 - RNA, 23 nt, Human
gcucugggcuggaccccaccccc

SEQ ID NO: 204517 - RNA, 19 nt, Human
ggaaggggaagccggcuca

SEQ ID NO: 204518 - RNA, 18 nt, Human
ggacaacgaggccgcugc

SEQ ID NO: 204519 - RNA, 23 nt, Human
ggacuggggcggacgcgcgguca

SEQ ID NO: 204520 - RNA, 22 nt, Human
ggcaggagcaggggggaggucc

SEQ ID NO: 204521 - RNA, 19 nt, Human
gggaagcuaggagaggagg

SEQ ID NO: 204522 - RNA, 22 nt, Human
gggaagcuaggagaggagggga

SEQ ID NO: 204523 - RNA, 20 nt, Human
gggccccuggccaagcccag

SEQ ID NO: 204524 - RNA, 23 nt, Human
gggccccuggccaagcccagccu

SEQ ID NO: 204525 - RNA, 26 nt, Human
gggccgggcgccgggcgccuacggaa

SEQ ID NO: 204526 - RNA, 18 nt, Human
gggcgcagggagcgcagg

SEQ ID NO: 204527 - RNA, 20 nt, Human
gggcuucccuccccggcacc

SEQ ID NO: 204528 - RNA, 21 nt, Human
ggggaggaaaaccucauggca

SEQ ID NO: 204529 - RNA, 21 nt, Human
ggggaggagaagcuuccccag

SEQ ID NO: 204530 - RNA, 18 nt, Human
gugcuccccgcggccucc

SEQ ID NO: 204531 - RNA, 24 nt, Human
gugcuccccgcggccuccugccug

SEQ ID NO: 204532 - RNA, 24 nt, Human
uacagcaaagcucacaaaugcccc

SEQ ID NO: 204533 - RNA, 19 nt, Human
uagggcagagggaagcugg

SEQ ID NO: 204534 - RNA, 25 nt, Human
uagggcagagggaagcuggggccuc

SEQ ID NO: 204535 - RNA, 24 nt, Human
uauuuuccauacaguagagaaaca

SEQ ID NO: 204536 - RNA, 21 nt, Human
uccaacacuccccaggcggaa

SEQ ID NO: 204537 - RNA, 22 nt, Human
uccccaggcagcagccaacuuu

SEQ ID NO: 204538 - RNA, 25 nt, Human
uccccaggcagcagccaacuuucca

SEQ ID NO: 204539 - RNA, 20 nt, Human
uccccaggcggaaauucggg

SEQ ID NO: 204540 - RNA, 26 nt, Human
uccccaggcggaaauucgggccccug

SEQ ID NO: 204541 - RNA, 18 nt, Human
uccccagggcgcagggag

SEQ ID NO: 204542 - RNA, 23 nt, Human
ucccuggaugaggggguggugcc

SEQ ID NO: 204543 - RNA, 21 nt, Human
uccguugucugcaggcucuga

SEQ ID NO: 204544 - RNA, 18 nt, Human
uccuagggcagagggaag

SEQ ID NO: 204545 - RNA, 19 nt, Human
uccuagggcagagggaagc

SEQ ID NO: 204546 - RNA, 19 nt, Human
ucugcaggcugccccaugg

SEQ ID NO: 204547 - RNA, 22 nt, Human
ugccccggacagccaggaggag

SEQ ID NO: 204548 - RNA, 21 nt, Human
ugccugcucugggcuggaccc

SEQ ID NO: 204549 - RNA, 21 nt, Human
uggaccccacccccgcacccc

SEQ ID NO: 204550 - RNA, 18 nt, Human
uggcugagaaccgugugc

SEQ ID NO: 204551 - RNA, 21 nt, Human
ugggaaggggaagccggcuca

SEQ ID NO: 204552 - RNA, 19 nt, Human
ugggacuggggcggacgcg

SEQ ID NO: 204553 - RNA, 19 nt, Human
ugggcuggaccccaccccc

SEQ ID NO: 204554 - RNA, 22 nt, Human
ugugcuuguaaacuuuauuuuc

SEQ ID NO: 204555 - RNA, 24 nt, Human
uuacagcaaagcucacaaaugccc

SEQ ID NO: 204556 - RNA, 25 nt, Human
uucaggaucaucuguacaaggggau

SEQ ID NO: 204557 - RNA, 26 nt, Human
aaaagaaaaagaacuucacauaaaag

SEQ ID NO: 204558 - RNA, 24 nt, Human
aaagaaaauaaauacacuaaccaa

SEQ ID NO: 204559 - RNA, 24 nt, Human
aaagugcugggauuacagguguga

SEQ ID NO: 204560 - RNA, 19 nt, Human
aaauccugaaaugcuccuc

SEQ ID NO: 204561 - RNA, 18 nt, Human
aacaggaugaacacaggg

SEQ ID NO: 204562 - RNA, 21 nt, Human
aacaggaugaacacagggcca

SEQ ID NO: 204563 - RNA, 19 nt, Human
aacauggcgaaaccccauu

SEQ ID NO: 204564 - RNA, 20 nt, Human
aacauggcgaaaccccauuu

SEQ ID NO: 204565 - RNA, 21 nt, Human
aacauggcgaaaccccauuuc

SEQ ID NO: 204566 - RNA, 21 nt, Human
aacauggcgaaaccccauuuc

SEQ ID NO: 204567 - RNA, 23 nt, Human
aagaaaacauugucaucaaaacu

SEQ ID NO: 204568 - RNA, 24 nt, Human
aagcgauccaccugccucggccuc

SEQ ID NO: 204569 - RNA, 23 nt, Human
aagcuccucuccaucuuccucug

SEQ ID NO: 204570 - RNA, 24 nt, Human
aaggugggcagaucguuggagccc

SEQ ID NO: 204571 - RNA, 20 nt, Human
aaguagcugggacuacaggc

SEQ ID NO: 204572 - RNA, 24 nt, Human
aaguagcugggacuacaggcacgu

SEQ ID NO: 204573 - RNA, 23 nt, Human
aagugauccucccaccucagucc

SEQ ID NO: 204574 - RNA, 18 nt, Human
aagugcugggauuacagg

SEQ ID NO: 204575 - RNA, 19 nt, Human
aagugcugggauuacaggu

SEQ ID NO: 204576 - RNA, 18 nt, Human
aaugauacagcuuccugu

SEQ ID NO: 204577 - RNA, 21 nt, Human
aaugcgcagguauacacccug

SEQ ID NO: 204578 - RNA, 26 nt, Human
acaacaacaacaaaaaucuaucaaaa

SEQ ID NO: 204579 - RNA, 26 nt, Human
acaacaacaacaacaaaaaucuauca

SEQ ID NO: 204580 - RNA, 26 nt, Human
acaauacuggagacacaucuuugguu

SEQ ID NO: 204581 - RNA, 20 nt, Human
acagagcaagacccugucuc

SEQ ID NO: 204582 - RNA, 24 nt, Human
acagagcaagacccugucucaaaa

SEQ ID NO: 204583 - RNA, 21 nt, Human
accguguucuaugccuuccag

SEQ ID NO: 204584 - RNA, 23 nt, Human
accucaguccccgaaguagcugg

SEQ ID NO: 204585 - RNA, 20 nt, Human
accugugcugaugggucuuc

SEQ ID NO: 204586 - RNA, 21 nt, Human
accugugcugaugggucuucu

SEQ ID NO: 204587 - RNA, 18 nt, Human
acgggcuuucaccauguu

SEQ ID NO: 204588 - RNA, 19 nt, Human
acgggcuuucaccauguug

SEQ ID NO: 204589 - RNA, 24 nt, Human
acgggcuuucaccauguugcccag

SEQ ID NO: 204590 - RNA, 24 nt, Human
acugcacuccagccugggugacag

SEQ ID NO: 204591 - RNA, 26 nt, Human
acugcacuccagccugggugacagag

SEQ ID NO: 204592 - RNA, 19 nt, Human
acugcagccucgaccuccu

SEQ ID NO: 204593 - RNA, 21 nt, Human
acuguagucccagcuacuugg

SEQ ID NO: 204594 - RNA, 18 nt, Human
agaacuucacauaaaaga

SEQ ID NO: 204595 - RNA, 24 nt, Human
agaugggaggaucacuugaaucug

SEQ ID NO: 204596 - RNA, 24 nt, Human
agcaaaucaccacagucagcuuuu

SEQ ID NO: 204597 - RNA, 24 nt, Human
agcacuuugggaggccaagguggg

SEQ ID NO: 204598 - RNA, 25 nt, Human
agcauguuucaacaacaacaacaac

SEQ ID NO: 204599 - RNA, 19 nt, Human
agccaccacaccuggccua

SEQ ID NO: 204600 - RNA, 18 nt, Human
agcccggggccgccgcga

SEQ ID NO: 204601 - RNA, 22 nt, Human
agccgcaccaguucugugggca

SEQ ID NO: 204602 - RNA, 23 nt, Human
agccgcaccaguucugugggcag

SEQ ID NO: 204603 - RNA, 20 nt, Human
agcggcugcccaggggacgc

SEQ ID NO: 204604 - RNA, 18 nt, Human
agcuaggcauuguggugc

SEQ ID NO: 204605 - RNA, 18 nt, Human
agcuccaggucucaccaa

SEQ ID NO: 204606 - RNA, 24 nt, Human
aggcacaguggcucacgccuguaa

SEQ ID NO: 204607 - RNA, 20 nt, Human
aggcacguaccaccacaccc

SEQ ID NO: 204608 - RNA, 23 nt, Human
aggcagcuccaggucucaccaag

SEQ ID NO: 204609 - RNA, 21 nt, Human
aggccaaggugggcagaucgu

SEQ ID NO: 204610 - RNA, 24 nt, Human
aggcugagaugggaggaucacuug

SEQ ID NO: 204611 - RNA, 21 nt, Human
agggagagucgagcuuuccau

SEQ ID NO: 204612 - RNA, 26 nt, Human
aggugggcagaucguuggagcccagg

SEQ ID NO: 204613 - RNA, 20 nt, Human
agguucaagugauccuccca

SEQ ID NO: 204614 - RNA, 22 nt, Human
agguugaggcugcagugaacug

SEQ ID NO: 204615 - RNA, 24 nt, Human
agugcaguagcaugaucuuggcuc

SEQ ID NO: 204616 - RNA, 24 nt, Human
aguggcucacgccuguaaucucag

SEQ ID NO: 204617 - RNA, 18 nt, Human
agugggaaguggaagggg

SEQ ID NO: 204618 - RNA, 21 nt, Human
augcgcagguauacacccugc

SEQ ID NO: 204619 - RNA, 24 nt, Human
auugugccacugcacuccagccug

SEQ ID NO: 204620 - RNA, 19 nt, Human
caaaccccgcuggcccaag

SEQ ID NO: 204621 - RNA, 28 nt, Human
caaaugccagcucaucuggggacuccuc

SEQ ID NO: 204622 - RNA, 21 nt, Human
caacaacaacaaaaaucuauc

SEQ ID NO: 204623 - RNA, 18 nt, Human
caacaacaacaacaacaa

SEQ ID NO: 204624 - RNA, 20 nt, Human
caacaacaacaacaacaaaa

SEQ ID NO: 204625 - RNA, 18 nt, Human
caacaggaugaacacagg

SEQ ID NO: 204626 - RNA, 23 nt, Human
caacuguagucccagcuacuugg

SEQ ID NO: 204627 - RNA, 24 nt, Human
caacuguagucccagcuacuuggg

SEQ ID NO: 204628 - RNA, 23 nt, Human
cacaaaacacacacaggggcaca

SEQ ID NO: 204629 - RNA, 18 nt, Human
cacacacacacacacaca

SEQ ID NO: 204630 - RNA, 20 nt, Human
cacacacacacacacacaca

SEQ ID NO: 204631 - RNA, 18 nt, Human
cacacacaggggcacaga

SEQ ID NO: 204632 - RNA, 18 nt, Human
cacagacacaauacugga

SEQ ID NO: 204633 - RNA, 24 nt, Human
caccauguugcccaggcugcucuc

SEQ ID NO: 204634 - RNA, 27 nt, Human
caccauguugcccaggcugcucucgaa

SEQ ID NO: 204635 - RNA, 20 nt, Human
cacccucccauuccauccca

SEQ ID NO: 204636 - RNA, 26 nt, Human
cacccucccauuccaucccaucaucc

SEQ ID NO: 204637 - RNA, 21 nt, Human
caccucaguccccgaaguagc

SEQ ID NO: 204638 - RNA, 20 nt, Human
caccuggccuaaaagcucug

SEQ ID NO: 204639 - RNA, 19 nt, Human
cacgccccccgcgccgccc

SEQ ID NO: 204640 - RNA, 24 nt, Human
cacgccuguaaucucagcacuuug

SEQ ID NO: 204641 - RNA, 19 nt, Human
cacucagcaaaucaccaca

SEQ ID NO: 204642 - RNA, 22 nt, Human
cacuccagccugggugacagag

SEQ ID NO: 204643 - RNA, 23 nt, Human
cacuccagccugggugacagagc

SEQ ID NO: 204644 - RNA, 19 nt, Human
cacucccccucaccucuca

SEQ ID NO: 204645 - RNA, 19 nt, Human
cacugcacuccagccuggg

SEQ ID NO: 204646 - RNA, 21 nt, Human
cacugcacuccagccugggug

SEQ ID NO: 204647 - RNA, 22 nt, Human
cacugcacuccagccuggguga

SEQ ID NO: 204648 - RNA, 23 nt, Human
cacugcacuccagccugggugac

SEQ ID NO: 204649 - RNA, 24 nt, Human
cacugcacuccagccugggugaca

SEQ ID NO: 204650 - RNA, 25 nt, Human
cacugcacuccagccugggugacag

SEQ ID NO: 204651 - RNA, 19 nt, Human
cacugcagccucgaccucc

SEQ ID NO: 204652 - RNA, 24 nt, Human
cagcacuuugggaggccaaggugg

SEQ ID NO: 204653 - RNA, 20 nt, Human
cagccucgaccuccuagguu

SEQ ID NO: 204654 - RNA, 23 nt, Human
cagccucgaccuccuagguucaa

SEQ ID NO: 204655 - RNA, 24 nt, Human
cagcuggauacagucagacaacac

SEQ ID NO: 204656 - RNA, 19 nt, Human
cagcuuucucccccaaccu

SEQ ID NO: 204657 - RNA, 22 nt, Human
caggcuuugggucuguggauuc

SEQ ID NO: 204658 - RNA, 20 nt, Human
caucacucccccucaccucu

SEQ ID NO: 204659 - RNA, 21 nt, Human
caucagggguuccagcaaguu

SEQ ID NO: 204660 - RNA, 20 nt, Human
caucccaucaucccucuucc

SEQ ID NO: 204661 - RNA, 24 nt, Human
caucccccucugaccauggcagcc

SEQ ID NO: 204662 - RNA, 24 nt, Human
cauguugcccaggcugcucucgaa

SEQ ID NO: 204663 - RNA, 23 nt, Human
ccaaagccuccucagcuuucucc

SEQ ID NO: 204664 - RNA, 20 nt, Human
ccaaagugcugggauuacag

SEQ ID NO: 204665 - RNA, 21 nt, Human
ccaaagugcugggauuacagg

SEQ ID NO: 204666 - RNA, 21 nt, Human
ccaaagugcugggauuacagg

SEQ ID NO: 204667 - RNA, 24 nt, Human
ccaaagugcugggauuacaggugu

SEQ ID NO: 204668 - RNA, 20 nt, Human
ccaaauauccauucuguccc

SEQ ID NO: 204669 - RNA, 25 nt, Human
ccaaaugccucauuauuggaacacc

SEQ ID NO: 204670 - RNA, 20 nt, Human
ccacugcacuccagccuggg

SEQ ID NO: 204671 - RNA, 20 nt, Human
ccacugcacuccagccuggg

SEQ ID NO: 204672 - RNA, 21 nt, Human
ccacugcacuccagccugggu

SEQ ID NO: 204673 - RNA, 21 nt, Human
ccacugcacuccagccugggu

SEQ ID NO: 204674 - RNA, 23 nt, Human
ccacugcacuccagccuggguga

SEQ ID NO: 204675 - RNA, 24 nt, Human
ccacugcacuccagccugggugac

SEQ ID NO: 204676 - RNA, 21 nt, Human
ccagccccgccugggucuccg

SEQ ID NO: 204677 - RNA, 18 nt, Human
cccaaagaaagcugucuu

SEQ ID NO: 204678 - RNA, 22 nt, Human
cccagcaaacucgccgagcucu

SEQ ID NO: 204679 - RNA, 26 nt, Human
cccaggaguuugagaucagccugagc

SEQ ID NO: 204680 - RNA, 21 nt, Human
cccauuccaucccaucauccc

SEQ ID NO: 204681 - RNA, 22 nt, Human
ccccaaaccccgcuggcccaag

SEQ ID NO: 204682 - RNA, 24 nt, Human
cccccaaaaguucuuccucuuagg

SEQ ID NO: 204683 - RNA, 25 nt, Human
cccccaaccucagucccuuagugcc

SEQ ID NO: 204684 - RNA, 23 nt, Human
ccccgcccccaaaaguucuuccu

SEQ ID NO: 204685 - RNA, 24 nt, Human
ccccggcuucucccgccgccgccc

SEQ ID NO: 204686 - RNA, 25 nt, Human
ccccggcuucucccgccgccgcccu

SEQ ID NO: 204687 - RNA, 23 nt, Human
ccccucacuucccaggggaaaca

SEQ ID NO: 204688 - RNA, 18 nt, Human
ccccuuucaucacucccc

SEQ ID NO: 204689 - RNA, 24 nt, Human
cccgaaguagcugggacuacaggc

SEQ ID NO: 204690 - RNA, 23 nt, Human
cccgcccccaaaaguucuuccuc

SEQ ID NO: 204691 - RNA, 24 nt, Human
cccgccccgggucccguccaggaa

SEQ ID NO: 204692 - RNA, 18 nt, Human
cccgggucccguccagga

SEQ ID NO: 204693 - RNA, 19 nt, Human
cccugggcccagccccgcc

SEQ ID NO: 204694 - RNA, 24 nt, Human
ccgaaguagcugggacuacaggca

SEQ ID NO: 204695 - RNA, 19 nt, Human
ccgcccagcgaggcgcgua

SEQ ID NO: 204696 - RNA, 21 nt, Human
ccgcccccaaaaguucuuccu

SEQ ID NO: 204697 - RNA, 21 nt, Human
ccgcgccgcccagcgaggcgc

SEQ ID NO: 204698 - RNA, 22 nt, Human
ccgcgcucgcagcuccuccucc

SEQ ID NO: 204699 - RNA, 20 nt, Human
ccggggaccccgcccccaaa

SEQ ID NO: 204700 - RNA, 22 nt, Human
ccguguucuaugccuuccagaa

SEQ ID NO: 204701 - RNA, 23 nt, Human
ccuaagcuggagugcaguagcau

SEQ ID NO: 204702 - RNA, 20 nt, Human
ccuagacuucacacaaugac

SEQ ID NO: 204703 - RNA, 22 nt, Human
ccuagguucaagugauccuccc

SEQ ID NO: 204704 - RNA, 22 nt, Human
ccucccauuccaucccaucauc

SEQ ID NO: 204705 - RNA, 24 nt, Human
ccucccauuccaucccaucauccc

SEQ ID NO: 204706 - RNA, 24 nt, Human
ccuccuagguucaagugauccucc

SEQ ID NO: 204707 - RNA, 21 nt, Human
ccuccuccccaggcucuucgg

SEQ ID NO: 204708 - RNA, 21 nt, Human
ccucgaccuccuagguucaag

SEQ ID NO: 204709 - RNA, 20 nt, Human
ccucugaggauccugggccu

SEQ ID NO: 204710 - RNA, 23 nt, Human
ccugaaaugcuccucaccuucuc

SEQ ID NO: 204711 - RNA, 21 nt, Human
ccugagcucaagcgauccacc

SEQ ID NO: 204712 - RNA, 24 nt, Human
ccugccucggccucccaaagugcu

SEQ ID NO: 204713 - RNA, 22 nt, Human
ccugggucuccgcacccagagc

SEQ ID NO: 204714 - RNA, 20 nt, Human
ccugggugacagagcaagac

SEQ ID NO: 204715 - RNA, 22 nt, Human
ccuucagguaaucccugcuaug

SEQ ID NO: 204716 - RNA, 21 nt, Human
cgcccgggccccuuucaggac

SEQ ID NO: 204717 - RNA, 20 nt, Human
cgccgcccugggcccagccc

SEQ ID NO: 204718 - RNA, 23 nt, Human
cgccuguaaucucagcacuuugg

SEQ ID NO: 204719 - RNA, 24 nt, Human
cgccuguaaucucagcacuuuggg

SEQ ID NO: 204720 - RNA, 23 nt, Human
cggcccgcgcggcuccugcucgu

SEQ ID NO: 204721 - RNA, 24 nt, Human
cgggcuuucaccauguugcccagg

SEQ ID NO: 204722 - RNA, 23 nt, Human
cgguagagacgggcuuucaccau

SEQ ID NO: 204723 - RNA, 24 nt, Human
cgguagagacgggcuuucaccaug

SEQ ID NO: 204724 - RNA, 22 nt, Human
cuaaaagcucuguuuucaaugg

SEQ ID NO: 204725 - RNA, 20 nt, Human
cuaacauuucuccuuucacu

SEQ ID NO: 204726 - RNA, 19 nt, Human
cuagaagucacguucauaa

SEQ ID NO: 204727 - RNA, 23 nt, Human
cuagaagucacguucauaacugc

SEQ ID NO: 204728 - RNA, 19 nt, Human
cuauucuaaaguguuggga

SEQ ID NO: 204729 - RNA, 26 nt, Human
cucaaggaaaaugcaucagggguuuc

SEQ ID NO: 204730 - RNA, 21 nt, Human
cucacacacacacacacacac

SEQ ID NO: 204731 - RNA, 24 nt, Human
cucacacacacacacacacacaaa

SEQ ID NO: 204732 - RNA, 22 nt, Human
cucacgccuguaaucucagcac

SEQ ID NO: 204733 - RNA, 24 nt, Human
cucacgccuguaaucucagcacuu

SEQ ID NO: 204734 - RNA, 21 nt, Human
cucacugcagccucgaccucc

SEQ ID NO: 204735 - RNA, 24 nt, Human
cucaguccccgaaguagcugggac

SEQ ID NO: 204736 - RNA, 19 nt, Human
cuccagaccagcucaaaug

SEQ ID NO: 204737 - RNA, 24 nt, Human
cucccaccucaguccccgaaguag

SEQ ID NO: 204738 - RNA, 18 nt, Human
cucccccaaccucagucc

SEQ ID NO: 204739 - RNA, 22 nt, Human
cuccgcacccagagcccggggc

SEQ ID NO: 204740 - RNA, 18 nt, Human
cucgcagcuccuccuccc

SEQ ID NO: 204741 - RNA, 22 nt, Human
cugcaagccugcaaaguggagc

SEQ ID NO: 204742 - RNA, 22 nt, Human
cugccccuggagccaacccucc

SEQ ID NO: 204743 - RNA, 24 nt, Human
cuggaacccagucugaagcuauac

SEQ ID NO: 204744 - RNA, 23 nt, Human
cuggagagguugaggcugcagug

SEQ ID NO: 204745 - RNA, 24 nt, Human
cuggagugcaguagcaugaucuug

SEQ ID NO: 204746 - RNA, 18 nt, Human
cuggcccagaaaaugccc

SEQ ID NO: 204747 - RNA, 23 nt, Human
cuucucccgccgccgcccugggc

SEQ ID NO: 204748 - RNA, 22 nt, Human
gaacuucagaaauaccuguugu

SEQ ID NO: 204749 - RNA, 22 nt, Human
gacugaacccuguuugaggagc

SEQ ID NO: 204750 - RNA, 22 nt, Human
gagacuugcccugccugugggc

SEQ ID NO: 204751 - RNA, 24 nt, Human
gagcccaggaguuugagaucagcc

SEQ ID NO: 204752 - RNA, 24 nt, Human
gagcucaagcgauccaccugccuc

SEQ ID NO: 204753 - RNA, 24 nt, Human
gaucguuggagcccaggaguuuga

SEQ ID NO: 204754 - RNA, 26 nt, Human
gaucguuggagcccaggaguuugaga

SEQ ID NO: 204755 - RNA, 22 nt, Human
gaucuguuguugacaucccccu

SEQ ID NO: 204756 - RNA, 18 nt, Human
gauuacaggugugagcca

SEQ ID NO: 204757 - RNA, 21 nt, Human
gauuacaggugugagccacca

SEQ ID NO: 204758 - RNA, 22 nt, Human
gauuacaggugugagccaccac

SEQ ID NO: 204759 - RNA, 21 nt, Human
gauugugccacugcacuccag

SEQ ID NO: 204760 - RNA, 19 nt, Human
gcacagugaacagugagcu

SEQ ID NO: 204761 - RNA, 19 nt, Human
gcacccagagcccggggcc

SEQ ID NO: 204762 - RNA, 24 nt, Human
gcacuccagccugggugacagagc

SEQ ID NO: 204763 - RNA, 20 nt, Human
gcacuuugggaggccaaggu

SEQ ID NO: 204764 - RNA, 19 nt, Human
gccacugcacuccagccug

SEQ ID NO: 204765 - RNA, 24 nt, Human
gccacugcacuccagccuggguga

SEQ ID NO: 204766 - RNA, 21 nt, Human
gccagcuggauacagucagac

SEQ ID NO: 204767 - RNA, 18 nt, Human
gcccagccccgccugggu

SEQ ID NO: 204768 - RNA, 18 nt, Human
gccccccgcgccgcccag

SEQ ID NO: 204769 - RNA, 23 nt, Human
gccccgggucccguccaggaagc

SEQ ID NO: 204770 - RNA, 23 nt, Human
gcccgggccccuuucaggacacc

SEQ ID NO: 204771 - RNA, 24 nt, Human
gcgauccaccugccucggccuccc

SEQ ID NO: 204772 - RNA, 24 nt, Human
gcucaagcgauccaccugccucgg

SEQ ID NO: 204773 - RNA, 21 nt, Human
gcucacugcagccucgaccuc

SEQ ID NO: 204774 - RNA, 22 nt, Human
gcucacugcagccucgaccucc

SEQ ID NO: 204775 - RNA, 21 nt, Human
gcucgcagcuccuccucccca

SEQ ID NO: 204776 - RNA, 18 nt, Human
gcuuucucccccaaccuc

SEQ ID NO: 204777 - RNA, 21 nt, Human
ggcagaucguuggagcccagg

SEQ ID NO: 204778 - RNA, 25 nt, Human
ggcagaucguuggagcccaggaguu

SEQ ID NO: 204779 - RNA, 22 nt, Human
ggcuuucaccauguugcccagg

SEQ ID NO: 204780 - RNA, 20 nt, Human
gggaagugggaaguggaagg

SEQ ID NO: 204781 - RNA, 19 nt, Human
gggcccagccccgccuggg

SEQ ID NO: 204782 - RNA, 24 nt, Human
gggguguccuuaaaccaucugggu

SEQ ID NO: 204783 - RNA, 18 nt, Human
ggguugugcaggcuuugg

SEQ ID NO: 204784 - RNA, 22 nt, Human
guagagacgggcuuucaccaug

SEQ ID NO: 204785 - RNA, 22 nt, Human
gucaagagcuuuacauaaggcc

SEQ ID NO: 204786 - RNA, 19 nt, Human
gucucaaaaaaagaaaaag

SEQ ID NO: 204787 - RNA, 22 nt, Human
guggugcacaacuguaguccca

SEQ ID NO: 204788 - RNA, 22 nt, Human
guucaagugauccucccaccuc

SEQ ID NO: 204789 - RNA, 19 nt, Human
guugcuguuuucuagagau

SEQ ID NO: 204790 - RNA, 20 nt, Human
guuggguugugcaggcuuug

SEQ ID NO: 204791 - RNA, 19 nt, Human
uaaauacacuaaccaacag

SEQ ID NO: 204792 - RNA, 23 nt, Human
uaauaaaauaauaaagaaucuaa

SEQ ID NO: 204793 - RNA, 22 nt, Human
uacaggugugagccaccacacc

SEQ ID NO: 204794 - RNA, 22 nt, Human
uacaggugugagccaccacacc

SEQ ID NO: 204795 - RNA, 23 nt, Human
uacaggugugagccaccacaccu

SEQ ID NO: 204796 - RNA, 19 nt, Human
uaccaccacacccagcuau

SEQ ID NO: 204797 - RNA, 22 nt, Human
uacuggggcuuugcacagugaa

SEQ ID NO: 204798 - RNA, 19 nt, Human
uacuuguucuuuuccccgg

SEQ ID NO: 204799 - RNA, 22 nt, Human
uagagacgggcuuucaccaugu

SEQ ID NO: 204800 - RNA, 23 nt, Human
uagagauaccccaaaccccgcug

SEQ ID NO: 204801 - RNA, 25 nt, Human
uauacacccugcaagccugcaaagu

SEQ ID NO: 204802 - RNA, 20 nt, Human
uaugaaggaagcaguaacug

SEQ ID NO: 204803 - RNA, 20 nt, Human
uaugccuuaaacaacaggau

SEQ ID NO: 204804 - RNA, 21 nt, Human
ucaacaacaacaacaacaaaa

SEQ ID NO: 204805 - RNA, 18 nt, Human
ucacaaucaucuuuuccc

SEQ ID NO: 204806 - RNA, 23 nt, Human
ucacacacacacacacacacaaa

SEQ ID NO: 204807 - RNA, 19 nt, Human
ucacagaagaccccacaaa

SEQ ID NO: 204808 - RNA, 19 nt, Human
ucacugcagccucgaccuc

SEQ ID NO: 204809 - RNA, 23 nt, Human
ucacugcagccucgaccuccuag

SEQ ID NO: 204810 - RNA, 24 nt, Human
ucacugcagccucgaccuccuagg

SEQ ID NO: 204811 - RNA, 24 nt, Human
ucacuggguuuagaauaaaccuga

SEQ ID NO: 204812 - RNA, 22 nt, Human
ucagaugcuaggucaagagcuu

SEQ ID NO: 204813 - RNA, 21 nt, Human
ucaguaacuacagggugacug

SEQ ID NO: 204814 - RNA, 22 nt, Human
ucaguccccgaaguagcuggga

SEQ ID NO: 204815 - RNA, 22 nt, Human
uccacaaaacacacacaggggc

SEQ ID NO: 204816 - RNA, 20 nt, Human
uccacagagaagaaguacaa

SEQ ID NO: 204817 - RNA, 20 nt, Human
uccacuuucuagcuauguca

SEQ ID NO: 204818 - RNA, 24 nt, Human
uccagccugggugacagagcaaga

SEQ ID NO: 204819 - RNA, 22 nt, Human
uccauaaucugagugccccaga

SEQ ID NO: 204820 - RNA, 23 nt, Human
ucccaaagugcugggauuacagg

SEQ ID NO: 204821 - RNA, 21 nt, Human
uccccaaaugaaaaagguuga

SEQ ID NO: 204822 - RNA, 19 nt, Human
ucccccaaccucagucccu

SEQ ID NO: 204823 - RNA, 25 nt, Human
uccccgaaguagcugggacuacagg

SEQ ID NO: 204824 - RNA, 22 nt, Human
ucccuaagcgagguuggguuga

SEQ ID NO: 204825 - RNA, 18 nt, Human
ucccuucuucagaaaggc

SEQ ID NO: 204826 - RNA, 19 nt, Human
ucccuucuucagaaaggcu

SEQ ID NO: 204827 - RNA, 21 nt, Human
uccgcacccagagcccggggc

SEQ ID NO: 204828 - RNA, 21 nt, Human
uccuagguucaagugauccuc

SEQ ID NO: 204829 - RNA, 24 nt, Human
uccuagguucaagugauccuccca

SEQ ID NO: 204830 - RNA, 21 nt, Human
uccugggccugcccccggcuc

SEQ ID NO: 204831 - RNA, 19 nt, Human
ucgcacagagauaaugcug

SEQ ID NO: 204832 - RNA, 18 nt, Human
ucggccucccaaagugcu

SEQ ID NO: 204833 - RNA, 21 nt, Human
ucggcuuccccggcuucuccc

SEQ ID NO: 204834 - RNA, 24 nt, Human
ucgguagagacgggcuuucaccau

SEQ ID NO: 204835 - RNA, 29 nt, Human
ucguuggagcccaggaguuugagaucagg

SEQ ID NO: 204836 - RNA, 26 nt, Human
ucuagagauaccccaaaccccgcugg

SEQ ID NO: 204837 - RNA, 23 nt, Human
ucuagaucccacccucccauucc

SEQ ID NO: 204838 - RNA, 24 nt, Human
ucucacuuugccaccuaagcugga

SEQ ID NO: 204839 - RNA, 22 nt, Human
ucucgaacuccugagcucaagc

SEQ ID NO: 204840 - RNA, 21 nt, Human
ucugaggauccugggccugcc

SEQ ID NO: 204841 - RNA, 18 nt, Human
ucugccuucuggcaaggc

SEQ ID NO: 204842 - RNA, 23 nt, Human
ucugcuccagaccagcucaaaug

SEQ ID NO: 204843 - RNA, 24 nt, Human
ucugucagagaugugagggacuga

SEQ ID NO: 204844 - RNA, 18 nt, Human
ucuucuguuggggucccc

SEQ ID NO: 204845 - RNA, 19 nt, Human
ucuuugguucgauccuugg

SEQ ID NO: 204846 - RNA, 23 nt, Human
ugaagacuccaggccauucugua

SEQ ID NO: 204847 - RNA, 22 nt, Human
ugacagagcaagacccugucuc

SEQ ID NO: 204848 - RNA, 20 nt, Human
ugacagauguguggagcucu

SEQ ID NO: 204849 - RNA, 19 nt, Human
ugacaucccccucugacca

SEQ ID NO: 204850 - RNA, 22 nt, Human
ugagaaagacagaguucccaaa

SEQ ID NO: 204851 - RNA, 22 nt, Human
ugagcaacauggcgaaacccca

SEQ ID NO: 204852 - RNA, 23 nt, Human
ugaggcugcagugaacugugauu

SEQ ID NO: 204853 - RNA, 21 nt, Human
ugagggaaaaguguauuucac

SEQ ID NO: 204854 - RNA, 23 nt, Human
ugagggaaaaguguauuucacag

SEQ ID NO: 204855 - RNA, 23 nt, Human
ugaucuguuguugacaucccccu

SEQ ID NO: 204856 - RNA, 24 nt, Human
ugaucuguuguugacaucccccuc

SEQ ID NO: 204857 - RNA, 22 nt, Human
ugcaguagcaugaucuuggcuc

SEQ ID NO: 204858 - RNA, 20 nt, Human
ugccaggaauaagaagcacg

SEQ ID NO: 204859 - RNA, 19 nt, Human
ugccaggcaagccugcucc

SEQ ID NO: 204860 - RNA, 19 nt, Human
ugcccacagacgucaacuc

SEQ ID NO: 204861 - RNA, 24 nt, Human
ugcccaggcugcucucgaacuccu

SEQ ID NO: 204862 - RNA, 18 nt, Human
ugcccaggggacgcggga

SEQ ID NO: 204863 - RNA, 21 nt, Human
ugccucggccucccaaagugc

SEQ ID NO: 204864 - RNA, 24 nt, Human
ugccucggccucccaaagugcugg

SEQ ID NO: 204865 - RNA, 18 nt, Human
ugccuuaaacaacaggau

SEQ ID NO: 204866 - RNA, 23 nt, Human
ugcuaugaaaggcagggcugcua

SEQ ID NO: 204867 - RNA, 23 nt, Human
ugcuccucaccuucucuuccaaa

SEQ ID NO: 204868 - RNA, 24 nt, Human
ugcugggauuacaggugugagcca

SEQ ID NO: 204869 - RNA, 19 nt, Human
uggaaagcucccuuaacag

SEQ ID NO: 204870 - RNA, 19 nt, Human
uggaaucacaggcacagac

SEQ ID NO: 204871 - RNA, 21 nt, Human
uggagccaacccuccuagcga

SEQ ID NO: 204872 - RNA, 19 nt, Human
uggagugcaguagcaugau

SEQ ID NO: 204873 - RNA, 24 nt, Human
uggagugcaguagcaugaucuugg

SEQ ID NO: 204874 - RNA, 25 nt, Human
uggcagccacucucugauuucucug

SEQ ID NO: 204875 - RNA, 21 nt, Human
uggccacagagguggucucug

SEQ ID NO: 204876 - RNA, 24 nt, Human
uggccacagagguggucucugguc

SEQ ID NO: 204877 - RNA, 22 nt, Human
uggcucacgccuguaaucucag

SEQ ID NO: 204878 - RNA, 24 nt, Human
uggcucacgccuguaaucucagca

SEQ ID NO: 204879 - RNA, 20 nt, Human
ugggacaaacagcauaaggu

SEQ ID NO: 204880 - RNA, 21 nt, Human
ugggacuacaggcacguacca

SEQ ID NO: 204881 - RNA, 24 nt, Human
ugggacuacaggcacguaccacca

SEQ ID NO: 204882 - RNA, 21 nt, Human
ugggaggaaggaagaucugaa

SEQ ID NO: 204883 - RNA, 20 nt, Human
ugggaggccaaggugggcag

SEQ ID NO: 204884 - RNA, 23 nt, Human
ugggaggccaaggugggcagauc

SEQ ID NO: 204885 - RNA, 19 nt, Human
ugggaggcugagaugggag

SEQ ID NO: 204886 - RNA, 24 nt, Human
ugggaggcugagaugggaggauca

SEQ ID NO: 204887 - RNA, 18 nt, Human
ugggauuacaggugugag

SEQ ID NO: 204888 - RNA, 19 nt, Human
ugggauuacaggugugagc

SEQ ID NO: 204889 - RNA, 22 nt, Human
ugggauuacaggugugagccac

SEQ ID NO: 204890 - RNA, 23 nt, Human
ugggauuacaggugugagccacc

SEQ ID NO: 204891 - RNA, 24 nt, Human
ugggauuacaggugugagccacca

SEQ ID NO: 204892 - RNA, 19 nt, Human
ugggucccuaguuuucccu

SEQ ID NO: 204893 - RNA, 22 nt, Human
ugggucuccgcacccagagccc

SEQ ID NO: 204894 - RNA, 18 nt, Human
uggugcacaacuguaguc

SEQ ID NO: 204895 - RNA, 21 nt, Human
uggugcacaacuguaguccca

SEQ ID NO: 204896 - RNA, 20 nt, Human
ugucacaaaaacauguccac

SEQ ID NO: 204897 - RNA, 27 nt, Human
ugugaugacggcuugaucuggcauggg

SEQ ID NO: 204898 - RNA, 25 nt, Human
uguuugaggagcuuggcuuuccucg

SEQ ID NO: 204899 - RNA, 18 nt, Human
uuacugugccuguagcuc

SEQ ID NO: 204900 - RNA, 23 nt, Human
uucaacaacaacaacaacaaaaa

SEQ ID NO: 204901 - RNA, 23 nt, Human
uucaagugauccucccaccucag

SEQ ID NO: 204902 - RNA, 24 nt, Human
uucaagugauccucccaccucagu

SEQ ID NO: 204903 - RNA, 23 nt, Human
uuccaaagccuccucagcuuucu

SEQ ID NO: 204904 - RNA, 18 nt, Human
uuccccggaauccgacua

SEQ ID NO: 204905 - RNA, 26 nt, Human
uuccccggcuucucccgccgccgccc

SEQ ID NO: 204906 - RNA, 22 nt, Human
uuccucugaggauccugggccu

SEQ ID NO: 204907 - RNA, 18 nt, Human
uucuagcuaugucacccu

SEQ ID NO: 204908 - RNA, 24 nt, Human
uugcauucuuucugaauuugcuuc

SEQ ID NO: 204909 - RNA, 25 nt, Human
uugggaggcugagaugggaggauca

SEQ ID NO: 204910 - RNA, 23 nt, Human
uugugccacugcacuccagccug

SEQ ID NO: 204911 - RNA, 21 nt, Human
uuucaccauguugcccaggcu

SEQ ID NO: 204912 - RNA, 20 nt, Human
uuucaucacucccccucacc

SEQ ID NO: 204913 - RNA, 19 nt, Human
uuucgguagagacgggcuu

SEQ ID NO: 204914 - RNA, 20 nt, Human
uuucuacaaaauacaaaaaa

SEQ ID NO: 204915 - RNA, 18 nt, Human
uuuuucgguagagacggg

SEQ ID NO: 204916 - RNA, 25 nt, Human
uuuuuuguauuuuucgguagagacg

SEQ ID NO: 204917 - RNA, 23 nt, Human
aaaaacaaagcaaaacagacaug

SEQ ID NO: 204918 - RNA, 22 nt, Human
aaaacaaaacaagaaaacaaaa

SEQ ID NO: 204919 - RNA, 23 nt, Human
aaacaaaacaaaacaagaaaaca

SEQ ID NO: 204920 - RNA, 24 nt, Human
aaacaaaacaaaacaagaaaacaa

SEQ ID NO: 204921 - RNA, 25 nt, Human
aaacaaaacaaaacaagaaaacaaa

SEQ ID NO: 204922 - RNA, 18 nt, Human
aaacaaagcaaaacagac

SEQ ID NO: 204923 - RNA, 20 nt, Human
aaacagacaugagcaacauu

SEQ ID NO: 204924 - RNA, 18 nt, Human
aaacccaaaacuggcccc

SEQ ID NO: 204925 - RNA, 19 nt, Human
aaagucucugcaugccaac

SEQ ID NO: 204926 - RNA, 21 nt, Human
aaauauaaggaauuacaaccu

SEQ ID NO: 204927 - RNA, 20 nt, Human
aacacagugagacccugucu

SEQ ID NO: 204928 - RNA, 21 nt, Human
aacacagugagacccugucuc

SEQ ID NO: 204929 - RNA, 23 nt, Human
aacuggccccaggaagaaacuag

SEQ ID NO: 204930 - RNA, 18 nt, Human
aagaaacuaguuggaaug

SEQ ID NO: 204931 - RNA, 23 nt, Human
aagaaagaaauauaaggaauuac

SEQ ID NO: 204932 - RNA, 24 nt, Human
aagaaagaaauauaaggaauuaca

SEQ ID NO: 204933 - RNA, 25 nt, Human
aagaaagaaauauaaggaauuacaa

SEQ ID NO: 204934 - RNA, 20 nt, Human
aagcaaaacagacaugagca

SEQ ID NO: 204935 - RNA, 20 nt, Human
aagcaaaacagacaugagca

SEQ ID NO: 204936 - RNA, 21 nt, Human
aagcaaaacagacaugagcaa

SEQ ID NO: 204937 - RNA, 20 nt, Human
aagcucccaggcaacagcuu

SEQ ID NO: 204938 - RNA, 23 nt, Human
aagcugaggugggaggaugccuu

SEQ ID NO: 204939 - RNA, 21 nt, Human
aagucucugcaugccaacucc

SEQ ID NO: 204940 - RNA, 20 nt, Human
aaugcaagacugacugugcg

SEQ ID NO: 204941 - RNA, 25 nt, Human
acaaaacaaaacaagaaaacaaaag

SEQ ID NO: 204942 - RNA, 26 nt, Human
acaaaacaaaacaagaaaacaaaaga

SEQ ID NO: 204943 - RNA, 22 nt, Human
acaaagcaaaacagacaugagc

SEQ ID NO: 204944 - RNA, 24 nt, Human
acaaccuaaacccaaaacuggccc

SEQ ID NO: 204945 - RNA, 19 nt, Human
acacaacaccugcggccuc

SEQ ID NO: 204946 - RNA, 21 nt, Human
acugaaaugcaagacugacug

SEQ ID NO: 204947 - RNA, 18 nt, Human
acugcacuccagucuggg

SEQ ID NO: 204948 - RNA, 21 nt, Human
acugcacuccagucuggguga

SEQ ID NO: 204949 - RNA, 24 nt, Human
acugcacuccagucugggugacag

SEQ ID NO: 204950 - RNA, 24 nt, Human
agaaugagaccgucucaaacaaaa

SEQ ID NO: 204951 - RNA, 19 nt, Human
agagagagacuccaaaugg

SEQ ID NO: 204952 - RNA, 22 nt, Human
agccaaggaggucaaugcggug

SEQ ID NO: 204953 - RNA, 18 nt, Human
agcugggugugguggugc

SEQ ID NO: 204954 - RNA, 19 nt, Human
aggaagaaacuaguuggaa

SEQ ID NO: 204955 - RNA, 24 nt, Human
aggcaguggcggcggggugacaga

SEQ ID NO: 204956 - RNA, 21 nt, Human
aggggaguggacucagguggg

SEQ ID NO: 204957 - RNA, 21 nt, Human
aguaccaagcucccaggcaac

SEQ ID NO: 204958 - RNA, 19 nt, Human
aucaaugagaaauuguucu

SEQ ID NO: 204959 - RNA, 21 nt, Human
augcugcagcugugacacccc

SEQ ID NO: 204960 - RNA, 23 nt, Human
augcugcagcugugacaccccac

SEQ ID NO: 204961 - RNA, 24 nt, Human
auuguggcacugcacuccagucug

SEQ ID NO: 204962 - RNA, 19 nt, Human
caaaacaaaacaagaaaac

SEQ ID NO: 204963 - RNA, 22 nt, Human
caacacagugagacccugucuc

SEQ ID NO: 204964 - RNA, 24 nt, Human
caacacagugagacccugucucua

SEQ ID NO: 204965 - RNA, 22 nt, Human
caacaucaaugagaaauuguuc

SEQ ID NO: 204966 - RNA, 19 nt, Human
caaggaggucaaugcggug

SEQ ID NO: 204967 - RNA, 23 nt, Human
cacaacaccugcggccucuccca

SEQ ID NO: 204968 - RNA, 18 nt, Human
caccaguagucccagcua

SEQ ID NO: 204969 - RNA, 19 nt, Human
caccaguagucccagcuag

SEQ ID NO: 204970 - RNA, 18 nt, Human
cacuccagucugggugac

SEQ ID NO: 204971 - RNA, 22 nt, Human
cacuccagucugggugacagaa

SEQ ID NO: 204972 - RNA, 24 nt, Human
cacuccagucugggugacagaaug

SEQ ID NO: 204973 - RNA, 19 nt, Human
cacugcacuccagucuggg

SEQ ID NO: 204974 - RNA, 19 nt, Human
cacugcacuccagucuggg

SEQ ID NO: 204975 - RNA, 19 nt, Human
cacugcacuccagucuggg

SEQ ID NO: 204976 - RNA, 20 nt, Human
cacugcacuccagucugggu

SEQ ID NO: 204977 - RNA, 21 nt, Human
cacugcacuccagucugggug

SEQ ID NO: 204978 - RNA, 22 nt, Human
cacugcacuccagucuggguga

SEQ ID NO: 204979 - RNA, 23 nt, Human
cacugcacuccagucugggugac

SEQ ID NO: 204980 - RNA, 24 nt, Human
cacugcacuccagucugggugaca

SEQ ID NO: 204981 - RNA, 25 nt, Human
cacugcacuccagucugggugacag

SEQ ID NO: 204982 - RNA, 20 nt, Human
cagaacacaacaccugcggc

SEQ ID NO: 204983 - RNA, 18 nt, Human
cagcugugacaccccaca

SEQ ID NO: 204984 - RNA, 22 nt, Human
cagcuuugauguucagaaacau

SEQ ID NO: 204985 - RNA, 22 nt, Human
caggaagaaacuaguuggaaug

SEQ ID NO: 204986 - RNA, 25 nt, Human
caggaagaaacuaguuggaauggca

SEQ ID NO: 204987 - RNA, 20 nt, Human
cauccugacaaagucucugc

SEQ ID NO: 204988 - RNA, 20 nt, Human
ccaaggggcaggagcagcgg

SEQ ID NO: 204989 - RNA, 21 nt, Human
ccaguagucccagcuagucag

SEQ ID NO: 204990 - RNA, 20 nt, Human
cccacagugcucugaguaac

SEQ ID NO: 204991 - RNA, 23 nt, Human
cccacagugcucugaguaaccaa

SEQ ID NO: 204992 - RNA, 20 nt, Human
cgauacacuguggaagaaag

SEQ ID NO: 204993 - RNA, 21 nt, Human
cgcagccgcggcgggccucug

SEQ ID NO: 204994 - RNA, 24 nt, Human
cucaaacaaaacaaaacaagaaaa

SEQ ID NO: 204995 - RNA, 26 nt, Human
cucaaacaaaacaaaacaagaaaaca

SEQ ID NO: 204996 - RNA, 20 nt, Human
cucccauccugacaaagucu

SEQ ID NO: 204997 - RNA, 19 nt, Human
cugagcuagagccucugcc

SEQ ID NO: 204998 - RNA, 18 nt, Human
cugcagcugugacacccc

SEQ ID NO: 204999 - RNA, 18 nt, Human
cuuuucuuuucagugucu

SEQ ID NO: 205000 - RNA, 18 nt, Human
gcaagagagagacuccaa

SEQ ID NO: 205001 - RNA, 20 nt, Human
gcacagaccagugaucagaa

SEQ ID NO: 205002 - RNA, 18 nt, Human
gcacugcacuccagucug

SEQ ID NO: 205003 - RNA, 21 nt, Human
gcacugcacuccagucugggu

SEQ ID NO: 205004 - RNA, 24 nt, Human
gcacugcacuccagucugggugac

SEQ ID NO: 205005 - RNA, 22 nt, Human
gcuccaaggggcaggagcagcg

SEQ ID NO: 205006 - RNA, 21 nt, Human
ggagcagcggggugaacacac

SEQ ID NO: 205007 - RNA, 20 nt, Human
ggccgcggauggcgcagccc

SEQ ID NO: 205008 - RNA, 20 nt, Human
ggcggggugacagaggcugu

SEQ ID NO: 205009 - RNA, 21 nt, Human
ggcuacuacaccaagucuaaa

SEQ ID NO: 205010 - RNA, 22 nt, Human
gggaggaugccuugagccaagg

SEQ ID NO: 205011 - RNA, 20 nt, Human
gggaguggacucaggugggc

SEQ ID NO: 205012 - RNA, 21 nt, Human
ggggaguggacucaggugggc

SEQ ID NO: 205013 - RNA, 21 nt, Human
gguauguuucagggagaauga

SEQ ID NO: 205014 - RNA, 18 nt, Human
gucucaaacaaaacaaaa

SEQ ID NO: 205015 - RNA, 25 nt, Human
gucuucuuuccagaacgacagaucc

SEQ ID NO: 205016 - RNA, 19 nt, Human
gugauauguuuauccaacu

SEQ ID NO: 205017 - RNA, 22 nt, Human
uaaaaacaaagcaaaacagaca

SEQ ID NO: 205018 - RNA, 24 nt, Human
uaaacccaaaacuggccccaggaa

SEQ ID NO: 205019 - RNA, 21 nt, Human
uaaccaaggcaguggcggcgg

SEQ ID NO: 205020 - RNA, 27 nt, Human
uaaggaauuacaaccuaaacccaaaac

SEQ ID NO: 205021 - RNA, 20 nt, Human
uacaaccuaaacccaaaacu

SEQ ID NO: 205022 - RNA, 22 nt, Human
uacaaccuaaacccaaaacugg

SEQ ID NO: 205023 - RNA, 27 nt, Human
uacaaccuaaacccaaaacuggcccca

SEQ ID NO: 205024 - RNA, 19 nt, Human
uagucccagcuagucagga

SEQ ID NO: 205025 - RNA, 19 nt, Human
ucaaagaaauauggucuca

SEQ ID NO: 205026 - RNA, 18 nt, Human
ucacugggcuccaagggg

SEQ ID NO: 205027 - RNA, 20 nt, Human
ucagaacacaacaccugcgg

SEQ ID NO: 205028 - RNA, 18 nt, Human
uccacaggacaaugagau

SEQ ID NO: 205029 - RNA, 20 nt, Human
uccagaacgacagauccgau

SEQ ID NO: 205030 - RNA, 24 nt, Human
uccagucugggugacagaaugaga

SEQ ID NO: 205031 - RNA, 20 nt, Human
ucucccauccugacaaaguc

SEQ ID NO: 205032 - RNA, 24 nt, Human
ugaacacacugaaaugcaagacug

SEQ ID NO: 205033 - RNA, 18 nt, Human
ugacaaagucucugcaug

SEQ ID NO: 205034 - RNA, 20 nt, Human
ugaggugggaggaugccuug

SEQ ID NO: 205035 - RNA, 24 nt, Human
ugaggugggaggaugccuugagcc

SEQ ID NO: 205036 - RNA, 25 nt, Human
ugaggugggaggaugccuugagcca

SEQ ID NO: 205037 - RNA, 21 nt, Human
ugauggguauguuucagggag

SEQ ID NO: 205038 - RNA, 24 nt, Human
uggacaacacagugagacccuguc

SEQ ID NO: 205039 - RNA, 18 nt, Human
uggcacugcacuccaguc

SEQ ID NO: 205040 - RNA, 24 nt, Human
uggcugggccagcucucuaggcau

SEQ ID NO: 205041 - RNA, 19 nt, Human
ugggaggaugccuugagcc

SEQ ID NO: 205042 - RNA, 23 nt, Human
ugucuuaaaaacaaagcaaaaca

SEQ ID NO: 205043 - RNA, 19 nt, Human
ugugcgcuacaggccgugc

SEQ ID NO: 205044 - RNA, 22 nt, Human
ugugcgcuacaggccgugcuga

SEQ ID NO: 205045 - RNA, 18 nt, Human
ugugguggugcacaccag

SEQ ID NO: 205046 - RNA, 20 nt, Human
uuagcugggugugguggugc

SEQ ID NO: 205047 - RNA, 22 nt, Human
uuagcugggugugguggugcac

SEQ ID NO: 205048 - RNA, 23 nt, Human
uucagggagaaugagcacaucua

SEQ ID NO: 205049 - RNA, 18 nt, Human
uuggaauggcagaaggag

SEQ ID NO: 205050 - RNA, 21 nt, Human
aacuucucccuuuucuugcug

SEQ ID NO: 205051 - RNA, 18 nt, Human
aagcucgcccaccccugc

SEQ ID NO: 205052 - RNA, 22 nt, Human
aagcucgcccaccccugcuucc

SEQ ID NO: 205053 - RNA, 22 nt, Human
aaguaugcaugugugugcaggg

SEQ ID NO: 205054 - RNA, 21 nt, Human
aauggccucagugaccaagga

SEQ ID NO: 205055 - RNA, 19 nt, Human
accuuggggcugaagggcc

SEQ ID NO: 205056 - RNA, 20 nt, Human
acuugcucuagccuaagcuc

SEQ ID NO: 205057 - RNA, 21 nt, Human
agcaggaaugaauggugucug

SEQ ID NO: 205058 - RNA, 18 nt, Human
agcuagacagccuggguu

SEQ ID NO: 205059 - RNA, 18 nt, Human
aggaagcccuggccagac

SEQ ID NO: 205060 - RNA, 22 nt, Human
aggagugcaagggcuguacccc

SEQ ID NO: 205061 - RNA, 22 nt, Human
aggggagcauggccacuggagg

SEQ ID NO: 205062 - RNA, 21 nt, Human
aguugccucucagaccaggcc

SEQ ID NO: 205063 - RNA, 23 nt, Human
aucucaacuucucccuuuucuug

SEQ ID NO: 205064 - RNA, 21 nt, Human
caccccagcugcaccagagac

SEQ ID NO: 205065 - RNA, 19 nt, Human
caccccugcuuccccauga

SEQ ID NO: 205066 - RNA, 21 nt, Human
caccccugcuuccccaugagc

SEQ ID NO: 205067 - RNA, 19 nt, Human
caggaaugaauggugucug

SEQ ID NO: 205068 - RNA, 22 nt, Human
cagggcuggggggcugagcccu

SEQ ID NO: 205069 - RNA, 19 nt, Human
cagguugcaaagucuccga

SEQ ID NO: 205070 - RNA, 21 nt, Human
ccaauggccucagugaccaag

SEQ ID NO: 205071 - RNA, 21 nt, Human
cccccaggcugacccgaccaa

SEQ ID NO: 205072 - RNA, 18 nt, Human
cccucagcccccaggcug

SEQ ID NO: 205073 - RNA, 18 nt, Human
cccuccuguacacccgcc

SEQ ID NO: 205074 - RNA, 21 nt, Human
cccugcuuccccaugagccac

SEQ ID NO: 205075 - RNA, 21 nt, Human
cccuugcgcauuaauccaccg

SEQ ID NO: 205076 - RNA, 19 nt, Human
ccuggccagauuccacccc

SEQ ID NO: 205077 - RNA, 27 nt, Human
ccuggccagauuccaccccagcugcac

SEQ ID NO: 205078 - RNA, 21 nt, Human
cuaagcucgcccaccccugcu

SEQ ID NO: 205079 - RNA, 22 nt, Human
cucaacuucucccuuuucuugc

SEQ ID NO: 205080 - RNA, 23 nt, Human
cucaacuucucccuuuucuugcu

SEQ ID NO: 205081 - RNA, 21 nt, Human
cucuuccaccagaaauccugg

SEQ ID NO: 205082 - RNA, 21 nt, Human
cugaccccaggaugggggccu

SEQ ID NO: 205083 - RNA, 23 nt, Human
cuggcucagugucucuggaggaa

SEQ ID NO: 205084 - RNA, 23 nt, Human
cuugcugugcaaccuugggcaac

SEQ ID NO: 205085 - RNA, 23 nt, Human
cuuguaugacugugcauguauuu

SEQ ID NO: 205086 - RNA, 23 nt, Human
gacagccaggcccucagcccccc

SEQ ID NO: 205087 - RNA, 22 nt, Human
gagcauggccacuggagggcac

SEQ ID NO: 205088 - RNA, 21 nt, Human
gcaaagucuccgauuccccca

SEQ ID NO: 205089 - RNA, 21 nt, Human
gcaccagagacuccuggagga

SEQ ID NO: 205090 - RNA, 21 nt, Human
gcugcaguucaaagacuggcu

SEQ ID NO: 205091 - RNA, 18 nt, Human
ggagcauggccacuggag

SEQ ID NO: 205092 - RNA, 18 nt, Human
ggaggcagagcugagaac

SEQ ID NO: 205093 - RNA, 21 nt, Human
ggaggccuuccugucucuucc

SEQ ID NO: 205094 - RNA, 22 nt, Human
ggcaggggagacgcauggaggg

SEQ ID NO: 205095 - RNA, 19 nt, Human
ggcucagugucucuggagg

SEQ ID NO: 205096 - RNA, 22 nt, Human
ggcuggggggcugagcccuugc

SEQ ID NO: 205097 - RNA, 24 nt, Human
ggugccucucagcagauucagggg

SEQ ID NO: 205098 - RNA, 23 nt, Human
guacccccggagcuagacagccu

SEQ ID NO: 205099 - RNA, 19 nt, Human
gucgaggacaaccuggcca

SEQ ID NO: 205100 - RNA, 20 nt, Human
gucgaggacaaccuuggggc

SEQ ID NO: 205101 - RNA, 23 nt, Human
gucgaggacaaccuuggggcuga

SEQ ID NO: 205102 - RNA, 23 nt, Human
uagguucucaauaugugcaacuc

SEQ ID NO: 205103 - RNA, 24 nt, Human
uauggagcaggaaugaaugguguc

SEQ ID NO: 205104 - RNA, 20 nt, Human
uaugugcaacucagugugug

SEQ ID NO: 205105 - RNA, 24 nt, Human
ucaacccagcccuccuguacaccc

SEQ ID NO: 205106 - RNA, 26 nt, Human
ucaaugugagugacucaguuuccuca

SEQ ID NO: 205107 - RNA, 21 nt, Human
uccugaccccaggaugggggc

SEQ ID NO: 205108 - RNA, 22 nt, Human
ucuguaaguaugcaugugugug

SEQ ID NO: 205109 - RNA, 23 nt, Human
ugagaacagguugcaaagucucc

SEQ ID NO: 205110 - RNA, 22 nt, Human
ugaggaagcccuggccagaccc

SEQ ID NO: 205111 - RNA, 19 nt, Human
ugaguguacucuuuacugu

SEQ ID NO: 205112 - RNA, 22 nt, Human
ugccucucagcagauucagggg

SEQ ID NO: 205113 - RNA, 21 nt, Human
ugcugugcaaccuugggcaac

SEQ ID NO: 205114 - RNA, 21 nt, Human
ugcugugcaaccuugggcaac

SEQ ID NO: 205115 - RNA, 20 nt, Human
uggaggaauugucuaugacc

SEQ ID NO: 205116 - RNA, 25 nt, Human
uggccagauuccaccccagcugcac

SEQ ID NO: 205117 - RNA, 18 nt, Human
uguaugacugugcaugua

SEQ ID NO: 205118 - RNA, 21 nt, Human
ugugaggaaugaauaaguccc

SEQ ID NO: 205119 - RNA, 21 nt, Human
ugugcagggaauaugccugug

SEQ ID NO: 205120 - RNA, 23 nt, Human
uuagcacggggauuggcaaagag

SEQ ID NO: 205121 - RNA, 26 nt, Human
uuccaccagaaauccuggcagccacu

SEQ ID NO: 205122 - RNA, 23 nt, Human
uuuccugaccccaggaugggggc

SEQ ID NO: 205123 - RNA, 19 nt, Human
agcucaggaacucgcgcgg

SEQ ID NO: 205124 - RNA, 21 nt, Human
auaauaauaauaaacuaucua

SEQ ID NO: 205125 - RNA, 23 nt, Human
caccgccaucccgggcccagccc

SEQ ID NO: 205126 - RNA, 25 nt, Human
caccugccuggcaccagcucaggaa

SEQ ID NO: 205127 - RNA, 25 nt, Human
caccugccuggcaccagcucaggaa

SEQ ID NO: 205128 - RNA, 23 nt, Human
cagacuccaguuuguccaccccc

SEQ ID NO: 205129 - RNA, 20 nt, Human
caucccgggcccagcccagc

SEQ ID NO: 205130 - RNA, 24 nt, Human
ccaccgccaucccgggcccagccc

SEQ ID NO: 205131 - RNA, 18 nt, Human
ccaccgggaccggcgcca

SEQ ID NO: 205132 - RNA, 23 nt, Human
ccagggacuuccccucccccuua

SEQ ID NO: 205133 - RNA, 23 nt, Human
ccaguaggucgguggccucccuc

SEQ ID NO: 205134 - RNA, 21 nt, Human
cccagcccagcccgcuccggc

SEQ ID NO: 205135 - RNA, 25 nt, Human
cccagcccagcuguacccuccuucc

SEQ ID NO: 205136 - RNA, 19 nt, Human
cccaggcgcggcccggcuc

SEQ ID NO: 205137 - RNA, 21 nt, Human
cccagggacuuccccuccccc

SEQ ID NO: 205138 - RNA, 25 nt, Human
ccccuuagaacaggggggugcgagc

SEQ ID NO: 205139 - RNA, 18 nt, Human
cccgggcccagcccagcc

SEQ ID NO: 205140 - RNA, 18 nt, Human
cccgggcccagcccagcc

SEQ ID NO: 205141 - RNA, 19 nt, Human
ccggccguucgcccaggcg

SEQ ID NO: 205142 - RNA, 20 nt, Human
ccggccguucgcccaggcgc

SEQ ID NO: 205143 - RNA, 24 nt, Human
ccuggcaccagcucaggaacucgc

SEQ ID NO: 205144 - RNA, 23 nt, Human
ccuggcaccagcucaggaacugu

SEQ ID NO: 205145 - RNA, 24 nt, Human
ccugggggcucugcccacuccaga

SEQ ID NO: 205146 - RNA, 23 nt, Human
cgcggcccggcucagcgccuccu

SEQ ID NO: 205147 - RNA, 20 nt, Human
cuaucuagggcaagggagua

SEQ ID NO: 205148 - RNA, 21 nt, Human
cuccccagcccagcuguaccc

SEQ ID NO: 205149 - RNA, 22 nt, Human
cuccugggcuuccugggggcuc

SEQ ID NO: 205150 - RNA, 25 nt, Human
cuguacccuccuuccccucuggcag

SEQ ID NO: 205151 - RNA, 23 nt, Human
ggccaccgccaucccgggcccag

SEQ ID NO: 205152 - RNA, 29 nt, Human
guacccuccuuccccucuggcagggagaa

SEQ ID NO: 205153 - RNA, 19 nt, Human
uaagagagcccuuguggua

SEQ ID NO: 205154 - RNA, 24 nt, Human
uaagagagcccuugugguagaggc

SEQ ID NO: 205155 - RNA, 24 nt, Human
uaauaauaauaaacuaucuagggc

SEQ ID NO: 205156 - RNA, 25 nt, Human
uaauaauaauaaacuaucuagggca

SEQ ID NO: 205157 - RNA, 20 nt, Human
uauggaugcccuccugggcu

SEQ ID NO: 205158 - RNA, 23 nt, Human
ucaggaacugugugggaguccgu

SEQ ID NO: 205159 - RNA, 24 nt, Human
uccagacuccaguuuguccacccc

SEQ ID NO: 205160 - RNA, 22 nt, Human
ucccagggacuuccccuccccc

SEQ ID NO: 205161 - RNA, 18 nt, Human
uccccagcccagcuguac

SEQ ID NO: 205162 - RNA, 19 nt, Human
ucccgggcccagcccagcc

SEQ ID NO: 205163 - RNA, 20 nt, Human
ucccgggcccagcccagccc

SEQ ID NO: 205164 - RNA, 21 nt, Human
uccugggcuuccugggggcuc

SEQ ID NO: 205165 - RNA, 20 nt, Human
ucugcccacuccagacucca

SEQ ID NO: 205166 - RNA, 22 nt, Human
ucuggcagggagagaaggggcc

SEQ ID NO: 205167 - RNA, 22 nt, Human
ugccuggcaccagcucaggaac

SEQ ID NO: 205168 - RNA, 22 nt, Human
ugccuggcaccagcucaggaac

SEQ ID NO: 205169 - RNA, 22 nt, Human
ugcgagcugguauggaugcccu

SEQ ID NO: 205170 - RNA, 20 nt, Human
uggcaccagcucaggaacuc

SEQ ID NO: 205171 - RNA, 24 nt, Human
ugguauggaugcccuccugggcuu

SEQ ID NO: 205172 - RNA, 21 nt, Human
uuuuuuuuuuuuuuuuugcaa

SEQ ID NO: 205173 - RNA, 23 nt, Human
uuuuuuuuuuuuuuuuugcaauu

SEQ ID NO: 205174 - RNA, 20 nt, Human
uuuuuuuuuuuuuuuuuugg

SEQ ID NO: 205175 - RNA, 21 nt, Human
aaagcccuaggcuggcagccc

SEQ ID NO: 205176 - RNA, 18 nt, Human
aacuagcuggaaccugac

SEQ ID NO: 205177 - RNA, 21 nt, Human
agcccuaggcuggcagcccua

SEQ ID NO: 205178 - RNA, 21 nt, Human
aggcaguggcaggggcccugg

SEQ ID NO: 205179 - RNA, 22 nt, Human
auagagcaagagugggacagag

SEQ ID NO: 205180 - RNA, 22 nt, Human
caacacccgccaggcgccgacu

SEQ ID NO: 205181 - RNA, 18 nt, Human
cacagcuggguaucucac

SEQ ID NO: 205182 - RNA, 23 nt, Human
cacccgccaggcgccgacucagu

SEQ ID NO: 205183 - RNA, 19 nt, Human
caccucggacuccucgguc

SEQ ID NO: 205184 - RNA, 19 nt, Human
cacuuuaccgaccuucgcc

SEQ ID NO: 205185 - RNA, 25 nt, Human
cagcacccgcgcgucgccgcuuaga

SEQ ID NO: 205186 - RNA, 22 nt, Human
ccgccaggcgccgacucagucu

SEQ ID NO: 205187 - RNA, 29 nt, Human
ccgcgcgucgccgcuuagaacccgccccu

SEQ ID NO: 205188 - RNA, 22 nt, Human
ccuaacuagcuggaaccggggc

SEQ ID NO: 205189 - RNA, 22 nt, Human
cuggcagcccuaacuagcugga

SEQ ID NO: 205190 - RNA, 18 nt, Human
gaguaguuccaggacugg

SEQ ID NO: 205191 - RNA, 18 nt, Human
gcccuaggcuggcagccc

SEQ ID NO: 205192 - RNA, 19 nt, Human
ggccucugguuuuauaagc

SEQ ID NO: 205193 - RNA, 23 nt, Human
gggaagcggggugugugcuugga

SEQ ID NO: 205194 - RNA, 24 nt, Human
guggcagcagggaaaagaagaggc

SEQ ID NO: 205195 - RNA, 23 nt, Human
guuuuuucuggccccuucuaccc

SEQ ID NO: 205196 - RNA, 22 nt, Human
uaaacugaauagagcaagagug

SEQ ID NO: 205197 - RNA, 18 nt, Human
ucacaugaucucagaggg

SEQ ID NO: 205198 - RNA, 18 nt, Human
ucagucucuacccuggcu

SEQ ID NO: 205199 - RNA, 23 nt, Human
ucucacucagucgccaccucgga

SEQ ID NO: 205200 - RNA, 24 nt, Human
ucucacucagucgccaccucggaa

SEQ ID NO: 205201 - RNA, 21 nt, Human
ugcggcggauguucugcagcc

SEQ ID NO: 205202 - RNA, 18 nt, Human
uggaaaaaagugacuuua

SEQ ID NO: 205203 - RNA, 23 nt, Human
uggaaaaaagugacuuuaugaug

SEQ ID NO: 205204 - RNA, 18 nt, Human
uggccucugggauguucc

SEQ ID NO: 205205 - RNA, 26 nt, Human
ugguuugcgcgucacaacacccgcca

SEQ ID NO: 205206 - RNA, 28 nt, Human
aaaaaaaaaaaaaaaaaaaggaaaagaa

SEQ ID NO: 205207 - RNA, 21 nt, Human
aaaaaaaaaaaaaaaaggaaa

SEQ ID NO: 205208 - RNA, 22 nt, Human
aaaaaaaaaaaaaaaggaaaag

SEQ ID NO: 205209 - RNA, 19 nt, Human
aaaaaaaaaaaaaaggaaa

SEQ ID NO: 205210 - RNA, 22 nt, Human
aaaaaaaaaaaaaggaaaagaa

SEQ ID NO: 205211 - RNA, 21 nt, Human
aaaaaaaaaaaaggaaaagaa

SEQ ID NO: 205212 - RNA, 25 nt, Human
aaaaaaaaugacucaagaaaugaga

SEQ ID NO: 205213 - RNA, 21 nt, Human
aaaaggaaaagaaauagauag

SEQ ID NO: 205214 - RNA, 18 nt, Human
aaaggaaaagaaauagau

SEQ ID NO: 205215 - RNA, 21 nt, Human
aaauaaaauaaagaccugccc

SEQ ID NO: 205216 - RNA, 20 nt, Human
aaauguuauaaguuacaucc

SEQ ID NO: 205217 - RNA, 19 nt, Human
aacaaggaggcaucagaaa

SEQ ID NO: 205218 - RNA, 19 nt, Human
aacacggugaaaccccauc

SEQ ID NO: 205219 - RNA, 20 nt, Human
aacacggugaaaccccaucu

SEQ ID NO: 205220 - RNA, 21 nt, Human
aacacggugaaaccccaucuc

SEQ ID NO: 205221 - RNA, 21 nt, Human
aacacggugaaaccccaucuc

SEQ ID NO: 205222 - RNA, 18 nt, Human
aacauuuugggaggcuga

SEQ ID NO: 205223 - RNA, 22 nt, Human
aacauuuugggaggcugaggca

SEQ ID NO: 205224 - RNA, 24 nt, Human
aacauuuugggaggcugaggcagg

SEQ ID NO: 205225 - RNA, 18 nt, Human
aaucaccugaacccagga

SEQ ID NO: 205226 - RNA, 24 nt, Human
aaucaccugaacccaggaggcagu

SEQ ID NO: 205227 - RNA, 24 nt, Human
acaccacuacacuccagccugggc

SEQ ID NO: 205228 - RNA, 24 nt, Human
acacuccagccugggcaacagagu

SEQ ID NO: 205229 - RNA, 24 nt, Human
acagaguaagacuucaucucaaaa

SEQ ID NO: 205230 - RNA, 24 nt, Human
accccaucucuacuaaaaauacaa

SEQ ID NO: 205231 - RNA, 18 nt, Human
acuacacuccagccuggg

SEQ ID NO: 205232 - RNA, 24 nt, Human
acuacacuccagccugggcaacag

SEQ ID NO: 205233 - RNA, 20 nt, Human
agaaauagauagcauaaaua

SEQ ID NO: 205234 - RNA, 20 nt, Human
agagaaaaaaaauguuauaa

SEQ ID NO: 205235 - RNA, 25 nt, Human
agcaauggcuccaaaccaagaagaa

SEQ ID NO: 205236 - RNA, 23 nt, Human
agccugggcaacagaguaagacu

SEQ ID NO: 205237 - RNA, 24 nt, Human
agccugggcaacagaguaagacuu

SEQ ID NO: 205238 - RNA, 20 nt, Human
agcugggcaugauggcaugc

SEQ ID NO: 205239 - RNA, 23 nt, Human
aggcacgguggcucaccccugua

SEQ ID NO: 205240 - RNA, 22 nt, Human
aggcaggcagaucacuugaggu

SEQ ID NO: 205241 - RNA, 26 nt, Human
aggcaggcagaucacuugaggucagg

SEQ ID NO: 205242 - RNA, 24 nt, Human
aggcugaggcaggcagaucacuug

SEQ ID NO: 205243 - RNA, 18 nt, Human
agucaggagaaucaccug

SEQ ID NO: 205244 - RNA, 24 nt, Human
agucaggagaaucaccugaaccca

SEQ ID NO: 205245 - RNA, 20 nt, Human
auaaauaaaauaaagaccug

SEQ ID NO: 205246 - RNA, 24 nt, Human
aucacaccacuacacuccagccug

SEQ ID NO: 205247 - RNA, 24 nt, Human
caacauuuugggaggcugaggcag

SEQ ID NO: 205248 - RNA, 25 nt, Human
caacauuuugggaggcugaggcagg

SEQ ID NO: 205249 - RNA, 23 nt, Human
cacaauucccuuuaaacucaauu

SEQ ID NO: 205250 - RNA, 26 nt, Human
caccccuguacccaacauuuugggag

SEQ ID NO: 205251 - RNA, 25 nt, Human
cacuacacuccagccugggcaacaa

SEQ ID NO: 205252 - RNA, 27 nt, Human
cacuacacuccagccugggcaacagag

SEQ ID NO: 205253 - RNA, 27 nt, Human
cagaucacuugaggucaggaaugcaaa

SEQ ID NO: 205254 - RNA, 20 nt, Human
cagcaauggcuccaaaccaa

SEQ ID NO: 205255 - RNA, 19 nt, Human
caggaaugcaaaccauucu

SEQ ID NO: 205256 - RNA, 24 nt, Human
caggaggcuaagucaggagaauca

SEQ ID NO: 205257 - RNA, 24 nt, Human
caggcagaucacuugaggucagga

SEQ ID NO: 205258 - RNA, 21 nt, Human
ccacuacacuccagccugggc

SEQ ID NO: 205259 - RNA, 22 nt, Human
ccacuacacuccagccugggca

SEQ ID NO: 205260 - RNA, 23 nt, Human
ccacuacacuccagccugggcaa

SEQ ID NO: 205261 - RNA, 24 nt, Human
ccacuacacuccagccugggcaac

SEQ ID NO: 205262 - RNA, 21 nt, Human
ccugggcaacagaguaagacu

SEQ ID NO: 205263 - RNA, 21 nt, Human
ccuguacccaacauuuuggga

SEQ ID NO: 205264 - RNA, 23 nt, Human
cgagccgagaucacaccacuaca

SEQ ID NO: 205265 - RNA, 18 nt, Human
cucaaaaaaaaaaaaaaa

SEQ ID NO: 205266 - RNA, 18 nt, Human
cucaaaaaaaaaaaaaaa

SEQ ID NO: 205267 - RNA, 22 nt, Human
cucucaauagaauucauaagag

SEQ ID NO: 205268 - RNA, 20 nt, Human
cugcagcgagccgagaucac

SEQ ID NO: 205269 - RNA, 23 nt, Human
cuggccaacacggugaaacccca

SEQ ID NO: 205270 - RNA, 23 nt, Human
cugggcaugauggcaugcuccug

SEQ ID NO: 205271 - RNA, 19 nt, Human
gauaaaaauguuacguauc

SEQ ID NO: 205272 - RNA, 18 nt, Human
gaucacuugaggucagga

SEQ ID NO: 205273 - RNA, 23 nt, Human
gaucacuugaggucaggaaugca

SEQ ID NO: 205274 - RNA, 24 nt, Human
gccaacacggugaaaccccaucuc

SEQ ID NO: 205275 - RNA, 25 nt, Human
gguggcucaccccuguacccaacau

SEQ ID NO: 205276 - RNA, 21 nt, Human
gugcaaaucagagguugaaug

SEQ ID NO: 205277 - RNA, 19 nt, Human
uaaaaaagaauucagaagg

SEQ ID NO: 205278 - RNA, 23 nt, Human
uaaaauaaagaccugcccgggcg

SEQ ID NO: 205279 - RNA, 19 nt, Human
uaaaugacuaggcuagagg

SEQ ID NO: 205280 - RNA, 21 nt, Human
uaagacuucaucucaaaaaaa

SEQ ID NO: 205281 - RNA, 20 nt, Human
uaagucaggagaaucaccug

SEQ ID NO: 205282 - RNA, 24 nt, Human
uaagucaggagaaucaccugaacc

SEQ ID NO: 205283 - RNA, 23 nt, Human
uagauggcauuaauagcaaggca

SEQ ID NO: 205284 - RNA, 22 nt, Human
uagcauaaauaaaauaaagacc

SEQ ID NO: 205285 - RNA, 21 nt, Human
ucaaaaaaaaaaaaaaaaaaa

SEQ ID NO: 205286 - RNA, 21 nt, Human
ucagaaggucaguuauuaagc

SEQ ID NO: 205287 - RNA, 24 nt, Human
ucagagguugaauggcaaaggaug

SEQ ID NO: 205288 - RNA, 22 nt, Human
ucaucucaaaaaaaaaaaaaaa

SEQ ID NO: 205289 - RNA, 25 nt, Human
ucaucucaaaaaaaaaaaaaaaaaa

SEQ ID NO: 205290 - RNA, 22 nt, Human
uccaauuuaaggaaauuuaaaa

SEQ ID NO: 205291 - RNA, 22 nt, Human
ucucuacuaaaaauacaaaaau

SEQ ID NO: 205292 - RNA, 24 nt, Human
ucuggccaacacggugaaacccca

SEQ ID NO: 205293 - RNA, 19 nt, Human
ugaaaccccaucucuacua

SEQ ID NO: 205294 - RNA, 19 nt, Human
ugaacccaggaggcagugg

SEQ ID NO: 205295 - RNA, 22 nt, Human
ugacucaagaaaugagaggcgg

SEQ ID NO: 205296 - RNA, 26 nt, Human
ugaggcaggcagaucacuugagguca

SEQ ID NO: 205297 - RNA, 26 nt, Human
ugcuuuagugcacucuagaagaccaa

SEQ ID NO: 205298 - RNA, 23 nt, Human
uggcaaaggauguccagcaaugg

SEQ ID NO: 205299 - RNA, 20 nt, Human
uggcauuaauagcaaggcac

SEQ ID NO: 205300 - RNA, 20 nt, Human
ugggaggcugaggcaggcag

SEQ ID NO: 205301 - RNA, 24 nt, Human
ugggaggcugaggcaggcagauca

SEQ ID NO: 205302 - RNA, 18 nt, Human
uuccaauaaggaggaagu

SEQ ID NO: 205303 - RNA, 25 nt, Human
uugggaggcugaggcaggcagauca

SEQ ID NO: 205304 - RNA, 22 nt, Human
aaaaaaaaaaaaaaaggaaaag

SEQ ID NO: 205305 - RNA, 24 nt, Human
aaaaaaaaaaaggaaaagacaaaa

SEQ ID NO: 205306 - RNA, 21 nt, Human
aaaccuguccaaccagcauca

SEQ ID NO: 205307 - RNA, 19 nt, Human
aacccagggggaaaggagc

SEQ ID NO: 205308 - RNA, 19 nt, Human
aaccccucccccaacccuc

SEQ ID NO: 205309 - RNA, 19 nt, Human
aauagugauuuuucccaaa

SEQ ID NO: 205310 - RNA, 21 nt, Human
aaucacaggggugagaaagga

SEQ ID NO: 205311 - RNA, 19 nt, Human
aauggggaagggaggcuca

SEQ ID NO: 205312 - RNA, 19 nt, Human
acaaggcaaaggauucaga

SEQ ID NO: 205313 - RNA, 21 nt, Human
accaaccccucccccaacccu

SEQ ID NO: 205314 - RNA, 22 nt, Human
accuccaaaucacaggggugag

SEQ ID NO: 205315 - RNA, 24 nt, Human
accugguaacugaggcucugcaga

SEQ ID NO: 205316 - RNA, 22 nt, Human
acuccccagcaaccugauaccc

SEQ ID NO: 205317 - RNA, 22 nt, Human
agaacagcagaagagaggagga

SEQ ID NO: 205318 - RNA, 21 nt, Human
agaaguggugggggaaggggg

SEQ ID NO: 205319 - RNA, 21 nt, Human
agaauccuuccagauuuacuu

SEQ ID NO: 205320 - RNA, 20 nt, Human
agagaggaggaggcagggag

SEQ ID NO: 205321 - RNA, 21 nt, Human
agagaggaggaggcagggagu

SEQ ID NO: 205322 - RNA, 21 nt, Human
agaggaagggagggaaggaac

SEQ ID NO: 205323 - RNA, 23 nt, Human
agagguggggguggggugagggg

SEQ ID NO: 205324 - RNA, 22 nt, Human
agauaggcacucagaaaccaaa

SEQ ID NO: 205325 - RNA, 23 nt, Human
agcaagagaagcccgcagaggga

SEQ ID NO: 205326 - RNA, 24 nt, Human
agcuacugaaagaauucaaacaua

SEQ ID NO: 205327 - RNA, 21 nt, Human
aggaaacccagggggaaagga

SEQ ID NO: 205328 - RNA, 21 nt, Human
aggaagccaaggaaacccagg

SEQ ID NO: 205329 - RNA, 22 nt, Human
aggagcagaacagcagaagaga

SEQ ID NO: 205330 - RNA, 21 nt, Human
aggcagggaguuacaggaacc

SEQ ID NO: 205331 - RNA, 23 nt, Human
aggcagggaguuacaggaaccug

SEQ ID NO: 205332 - RNA, 19 nt, Human
aggcuuuuaggcaaggggc

SEQ ID NO: 205333 - RNA, 22 nt, Human
agguggggguggggugaggggu

SEQ ID NO: 205334 - RNA, 18 nt, Human
aguggugggggaaggggg

SEQ ID NO: 205335 - RNA, 21 nt, Human
aucaccgggacccaucagcca

SEQ ID NO: 205336 - RNA, 24 nt, Human
augccaaccacucuacguggcuuu

SEQ ID NO: 205337 - RNA, 21 nt, Human
caaaguacaauuugacucaaa

SEQ ID NO: 205338 - RNA, 24 nt, Human
caccagagaagaguggaaacuccc

SEQ ID NO: 205339 - RNA, 24 nt, Human
caccauggucucuccuuuccccag

SEQ ID NO: 205340 - RNA, 21 nt, Human
cagaagagguggggguggggu

SEQ ID NO: 205341 - RNA, 20 nt, Human
cagaaggaaccagugagcug

SEQ ID NO: 205342 - RNA, 23 nt, Human
cagagcaagagaagcccgcagag

SEQ ID NO: 205343 - RNA, 18 nt, Human
cagagguacugcagaagg

SEQ ID NO: 205344 - RNA, 21 nt, Human
cagauaggcacucagaaacca

SEQ ID NO: 205345 - RNA, 19 nt, Human
cagcaaccugauacccuuc

SEQ ID NO: 205346 - RNA, 24 nt, Human
cagcuacugaaagaauucaaacau

SEQ ID NO: 205347 - RNA, 20 nt, Human
caggaaccugggguaccagg

SEQ ID NO: 205348 - RNA, 24 nt, Human
caggaccaaccccucccccaaccc

SEQ ID NO: 205349 - RNA, 23 nt, Human
caggcuuuuaggcaaggggcaga

SEQ ID NO: 205350 - RNA, 20 nt, Human
caugccaaccacucuacgug

SEQ ID NO: 205351 - RNA, 22 nt, Human
caugccaaccacucuacguggc

SEQ ID NO: 205352 - RNA, 20 nt, Human
ccacagagguacugcagaag

SEQ ID NO: 205353 - RNA, 22 nt, Human
ccaucagccacuggcagccauu

SEQ ID NO: 205354 - RNA, 18 nt, Human
ccccagggggucaggggg

SEQ ID NO: 205355 - RNA, 20 nt, Human
ccccucccuccucuggccac

SEQ ID NO: 205356 - RNA, 18 nt, Human
cccucccuuccccuucuc

SEQ ID NO: 205357 - RNA, 20 nt, Human
cccucccuuccccuucucca

SEQ ID NO: 205358 - RNA, 20 nt, Human
cccuucuccacaccuccaaa

SEQ ID NO: 205359 - RNA, 21 nt, Human
ccucuggccacuagggguggg

SEQ ID NO: 205360 - RNA, 25 nt, Human
cuacccacaaggcaaaggauucaga

SEQ ID NO: 205361 - RNA, 23 nt, Human
cuccugcuacagacggaauacug

SEQ ID NO: 205362 - RNA, 23 nt, Human
cucugccaauguggcaaaaaaaa

SEQ ID NO: 205363 - RNA, 24 nt, Human
cugccucagagagagggagguggc

SEQ ID NO: 205364 - RNA, 23 nt, Human
cuggaggacgggcucccuaggcg

SEQ ID NO: 205365 - RNA, 20 nt, Human
cugggaggagcagaacagca

SEQ ID NO: 205366 - RNA, 18 nt, Human
cuucacugugccccuccc

SEQ ID NO: 205367 - RNA, 22 nt, Human
cuuuccucuucggagagguggu

SEQ ID NO: 205368 - RNA, 19 nt, Human
gaaaagacaaaaugacuga

SEQ ID NO: 205369 - RNA, 19 nt, Human
gacccuccuccuucaucca

SEQ ID NO: 205370 - RNA, 18 nt, Human
gagaggaggaggcaggga

SEQ ID NO: 205371 - RNA, 21 nt, Human
gagcaagagaagcccgcagag

SEQ ID NO: 205372 - RNA, 22 nt, Human
gaggagcagaacagcagaagag

SEQ ID NO: 205373 - RNA, 20 nt, Human
gauacccuucccaucaccgg

SEQ ID NO: 205374 - RNA, 21 nt, Human
gcaaaggauucagaaauuaau

SEQ ID NO: 205375 - RNA, 24 nt, Human
gcacucagaaaccaaaccugguag

SEQ ID NO: 205376 - RNA, 24 nt, Human
gcagauuaugacagagcuugcacg

SEQ ID NO: 205377 - RNA, 19 nt, Human
gcaggaccaaccccucccc

SEQ ID NO: 205378 - RNA, 18 nt, Human
gcucagagcaagagaagc

SEQ ID NO: 205379 - RNA, 24 nt, Human
gcugucccucccuuccccuucucc

SEQ ID NO: 205380 - RNA, 18 nt, Human
ggagcagaacagcagaag

SEQ ID NO: 205381 - RNA, 20 nt, Human
ggagguggcaucucuacauu

SEQ ID NO: 205382 - RNA, 20 nt, Human
ggaguuacaggaaccugggg

SEQ ID NO: 205383 - RNA, 22 nt, Human
gggcaacaggaguggggcuggg

SEQ ID NO: 205384 - RNA, 19 nt, Human
gggcuggggaggagaacag

SEQ ID NO: 205385 - RNA, 18 nt, Human
guagggcaacaggagugg

SEQ ID NO: 205386 - RNA, 20 nt, Human
guggcaaaaaaaaaaaaaaa

SEQ ID NO: 205387 - RNA, 19 nt, Human
guggggguggggugagggg

SEQ ID NO: 205388 - RNA, 23 nt, Human
ucaaaccuguccaaccagcauca

SEQ ID NO: 205389 - RNA, 24 nt, Human
ucagagcaagagaagcccgcagag

SEQ ID NO: 205390 - RNA, 25 nt, Human
ucagagcaagagaagcccgcagagg

SEQ ID NO: 205391 - RNA, 20 nt, Human
ucagggggugagggaaaggc

SEQ ID NO: 205392 - RNA, 19 nt, Human
uccacaccuccaaaucaca

SEQ ID NO: 205393 - RNA, 21 nt, Human
ucccuaggcguagguauggug

SEQ ID NO: 205394 - RNA, 22 nt, Human
ucccuaggcguagguauggugg

SEQ ID NO: 205395 - RNA, 19 nt, Human
ucccuuccccuucuccaca

SEQ ID NO: 205396 - RNA, 21 nt, Human
ucuacauucacaccauggucu

SEQ ID NO: 205397 - RNA, 21 nt, Human
ugaaagaauucaaacauacag

SEQ ID NO: 205398 - RNA, 24 nt, Human
ugaaaggaugcucaucgcauggug

SEQ ID NO: 205399 - RNA, 18 nt, Human
ugacagagcuugcacgau

SEQ ID NO: 205400 - RNA, 18 nt, Human
ugacugacacagccaggu

SEQ ID NO: 205401 - RNA, 21 nt, Human
ugagaauccuuccagauuuac

SEQ ID NO: 205402 - RNA, 19 nt, Human
ugcagacacuggccugaaa

SEQ ID NO: 205403 - RNA, 20 nt, Human
ugccaaccacucuacguggc

SEQ ID NO: 205404 - RNA, 25 nt, Human
ugccaaccacucuacguggcuuucc

SEQ ID NO: 205405 - RNA, 20 nt, Human
ugccaauguggcaaaaaaaa

SEQ ID NO: 205406 - RNA, 24 nt, Human
ugccaauguggcaaaaaaaaaaaa

SEQ ID NO: 205407 - RNA, 22 nt, Human
ugcuacagacggaauacuggag

SEQ ID NO: 205408 - RNA, 19 nt, Human
uggaggacgggcucccuag

SEQ ID NO: 205409 - RNA, 21 nt, Human
uggaugggaauggggaaggga

SEQ ID NO: 205410 - RNA, 23 nt, Human
uggcaaaaaaaaaaaaaaaagga

SEQ ID NO: 205411 - RNA, 19 nt, Human
uggcaccccaugccaacca

SEQ ID NO: 205412 - RNA, 18 nt, Human
uggcagccauucucuucc

SEQ ID NO: 205413 - RNA, 22 nt, Human
ugggaagaugcagauuaugaca

SEQ ID NO: 205414 - RNA, 24 nt, Human
ugggaauggggaagggaggcucag

SEQ ID NO: 205415 - RNA, 18 nt, Human
ugggagaggaagggaggg

SEQ ID NO: 205416 - RNA, 24 nt, Human
ugggagaggaagggagggaaggaa

SEQ ID NO: 205417 - RNA, 19 nt, Human
uggggaggagaacaguucc

SEQ ID NO: 205418 - RNA, 23 nt, Human
uggggcuggggaggagaacaguu

SEQ ID NO: 205419 - RNA, 21 nt, Human
ugggggaaggggguggagaug

SEQ ID NO: 205420 - RNA, 18 nt, Human
uggugggcucccuucuuc

SEQ ID NO: 205421 - RNA, 20 nt, Human
ugucugggaggagcagaaca

SEQ ID NO: 205422 - RNA, 22 nt, Human
ugucuuggagcugaggcagcag

SEQ ID NO: 205423 - RNA, 18 nt, Human
uucagaaauuaauaguga

SEQ ID NO: 205424 - RNA, 24 nt, Human
aaagugccgggacuacaggcaaga

SEQ ID NO: 205425 - RNA, 22 nt, Human
aacagcauucugucauuucaga

SEQ ID NO: 205426 - RNA, 26 nt, Human
aagugccgggacuacaggcaagagcc

SEQ ID NO: 205427 - RNA, 24 nt, Human
acaaacaucagacacacagaccau

SEQ ID NO: 205428 - RNA, 20 nt, Human
acacaaguuguuucgcaaua

SEQ ID NO: 205429 - RNA, 20 nt, Human
acaggguuucaccacguugg

SEQ ID NO: 205430 - RNA, 21 nt, Human
acaggguuucaccacguuggu

SEQ ID NO: 205431 - RNA, 24 nt, Human
acaggguuucaccacguuggucag

SEQ ID NO: 205432 - RNA, 24 nt, Human
accacguuggucaggcuggucucg

SEQ ID NO: 205433 - RNA, 19 nt, Human
acccaggcuggagugcagu

SEQ ID NO: 205434 - RNA, 23 nt, Human
acccaggcuggagugcaguggug

SEQ ID NO: 205435 - RNA, 24 nt, Human
accuugugaucugccugccucggc

SEQ ID NO: 205436 - RNA, 18 nt, Human
acucugccacccaggcug

SEQ ID NO: 205437 - RNA, 24 nt, Human
acucugccacccaggcuggagugc

SEQ ID NO: 205438 - RNA, 18 nt, Human
agccuccugaguagcugg

SEQ ID NO: 205439 - RNA, 22 nt, Human
aggaaaucacuagaacauaaaa

SEQ ID NO: 205440 - RNA, 25 nt, Human
aggcuggagugcaguggugcaaucu

SEQ ID NO: 205441 - RNA, 23 nt, Human
aguagcugggauuacaggcacau

SEQ ID NO: 205442 - RNA, 20 nt, Human
agugcaguggugcaaucucg

SEQ ID NO: 205443 - RNA, 24 nt, Human
agugcaguggugcaaucucggcuc

SEQ ID NO: 205444 - RNA, 22 nt, Human
auauguccuagcaacaaacauc

SEQ ID NO: 205445 - RNA, 27 nt, Human
caaagugccgggacuacaggcaagagc

SEQ ID NO: 205446 - RNA, 24 nt, Human
caacaaacaucagacacacagacc

SEQ ID NO: 205447 - RNA, 23 nt, Human
caagagccaccgcgccuggucca

SEQ ID NO: 205448 - RNA, 20 nt, Human
caagcgauucuccugccuua

SEQ ID NO: 205449 - RNA, 22 nt, Human
caagcgauucuccugccuuagc

SEQ ID NO: 205450 - RNA, 23 nt, Human
cacaacaaacaauagacuuuaaa

SEQ ID NO: 205451 - RNA, 21 nt, Human
caccacguuggucaggcuggu

SEQ ID NO: 205452 - RNA, 24 nt, Human
caccacguuggucaggcuggucuc

SEQ ID NO: 205453 - RNA, 24 nt, Human
cacccaggcuggagugcaguggug

SEQ ID NO: 205454 - RNA, 22 nt, Human
cacuagaacauaaaacaauaac

SEQ ID NO: 205455 - RNA, 23 nt, Human
cacucugccacccaggcuggagu

SEQ ID NO: 205456 - RNA, 24 nt, Human
cacucugccacccaggcuggagug

SEQ ID NO: 205457 - RNA, 21 nt, Human
cacugcaaccuccgccuccug

SEQ ID NO: 205458 - RNA, 23 nt, Human
cacugcaaccuccgccuccuggg

SEQ ID NO: 205459 - RNA, 25 nt, Human
cagcaagcacaacaaacaauagacu

SEQ ID NO: 205460 - RNA, 22 nt, Human
cagcaauaucagcaaaugcuuc

SEQ ID NO: 205461 - RNA, 22 nt, Human
caggcacaugucaccacccccg

SEQ ID NO: 205462 - RNA, 24 nt, Human
caggguuucaccacguuggucagg

SEQ ID NO: 205463 - RNA, 26 nt, Human
caguagagacaggguuucaccacguu

SEQ ID NO: 205464 - RNA, 19 nt, Human
ccaaagugccgggacuaca

SEQ ID NO: 205465 - RNA, 26 nt, Human
ccagcaagcacaacaaacaauagacu

SEQ ID NO: 205466 - RNA, 18 nt, Human
ccaguagagacaggguuu

SEQ ID NO: 205467 - RNA, 24 nt, Human
ccgccuccuggguucaagcgauuc

SEQ ID NO: 205468 - RNA, 19 nt, Human
ccuccgccuccuggguuca

SEQ ID NO: 205469 - RNA, 24 nt, Human
ccuccuggguucaagcgauucucc

SEQ ID NO: 205470 - RNA, 21 nt, Human
ccugaccuugugaucugccug

SEQ ID NO: 205471 - RNA, 23 nt, Human
ccugaguagcugggauuacaggc

SEQ ID NO: 205472 - RNA, 24 nt, Human
ccugaguagcugggauuacaggca

SEQ ID NO: 205473 - RNA, 24 nt, Human
ccugccuuagccuccugaguagcu

SEQ ID NO: 205474 - RNA, 23 nt, Human
ccuggguucaagcgauucuccug

SEQ ID NO: 205475 - RNA, 19 nt, Human
cgccugguccaauuacuga

SEQ ID NO: 205476 - RNA, 24 nt, Human
cucacugcaaccuccgccuccugg

SEQ ID NO: 205477 - RNA, 24 nt, Human
cuccugaccuugugaucugccugc

SEQ ID NO: 205478 - RNA, 22 nt, Human
cuccugccuuagccuccugagu

SEQ ID NO: 205479 - RNA, 21 nt, Human
cuccuggguucaagcgauucu

SEQ ID NO: 205480 - RNA, 23 nt, Human
cugaguagcugggauuacaggca

SEQ ID NO: 205481 - RNA, 23 nt, Human
cugcaaccuccgccuccuggguu

SEQ ID NO: 205482 - RNA, 24 nt, Human
cugcaaccuccgccuccuggguuc

SEQ ID NO: 205483 - RNA, 24 nt, Human
cuuagccuccugaguagcugggau

SEQ ID NO: 205484 - RNA, 22 nt, Human
gaccuugugaucugccugccuc

SEQ ID NO: 205485 - RNA, 24 nt, Human
gaccuugugaucugccugccucgg

SEQ ID NO: 205486 - RNA, 27 nt, Human
gaguagcugggauuacaggcacauguc

SEQ ID NO: 205487 - RNA, 20 nt, Human
gccuuagccuccugaguagc

SEQ ID NO: 205488 - RNA, 21 nt, Human
ggacuacaggcaagagccacc

SEQ ID NO: 205489 - RNA, 22 nt, Human
ggacuacaggcaagagccaccg

SEQ ID NO: 205490 - RNA, 20 nt, Human
ggcacuguuaaauuauacag

SEQ ID NO: 205491 - RNA, 24 nt, Human
ggcacuguuaaauuauacaggaaa

SEQ ID NO: 205492 - RNA, 23 nt, Human
ggcuggucucgaacuccugaccu

SEQ ID NO: 205493 - RNA, 23 nt, Human
gggacuacaggcaagagccaccg

SEQ ID NO: 205494 - RNA, 20 nt, Human
ggucucgaacuccugaccuu

SEQ ID NO: 205495 - RNA, 18 nt, Human
guagcugggauuacaggc

SEQ ID NO: 205496 - RNA, 20 nt, Human
guccaagcuuguauccacug

SEQ ID NO: 205497 - RNA, 23 nt, Human
uaaaacagcauucugucauuuca

SEQ ID NO: 205498 - RNA, 24 nt, Human
uaaaauacaaaucuauagcaaaaa

SEQ ID NO: 205499 - RNA, 25 nt, Human
uaacacacaaugaaacccucaugga

SEQ ID NO: 205500 - RNA, 22 nt, Human
uaacuucauuauuagcuguuua

SEQ ID NO: 205501 - RNA, 20 nt, Human
uacaggaaaucacuagaaca

SEQ ID NO: 205502 - RNA, 21 nt, Human
uacaggaaaucacuagaacau

SEQ ID NO: 205503 - RNA, 22 nt, Human
uacaggcaagagccaccgcgcc

SEQ ID NO: 205504 - RNA, 21 nt, Human
uaccagcaagcacaacaaaca

SEQ ID NO: 205505 - RNA, 22 nt, Human
uaccagcaagcacaacaaacaa

SEQ ID NO: 205506 - RNA, 22 nt, Human
uagagacaggguuucaccacgu

SEQ ID NO: 205507 - RNA, 22 nt, Human
uagcaacaaacaucagacacac

SEQ ID NO: 205508 - RNA, 24 nt, Human
uagcaacaaacaucagacacacag

SEQ ID NO: 205509 - RNA, 20 nt, Human
uagccuccugaguagcuggg

SEQ ID NO: 205510 - RNA, 23 nt, Human
uaggucccaaaaugacguucuua

SEQ ID NO: 205511 - RNA, 23 nt, Human
uauaaaacaaucuuuugagaagg

SEQ ID NO: 205512 - RNA, 19 nt, Human
ucaagcgauucuccugccu

SEQ ID NO: 205513 - RNA, 23 nt, Human
ucacacuggagaugaaaagggca

SEQ ID NO: 205514 - RNA, 24 nt, Human
ucacucugccacccaggcuggagu

SEQ ID NO: 205515 - RNA, 23 nt, Human
ucacugcaaccuccgccuccugg

SEQ ID NO: 205516 - RNA, 24 nt, Human
ucacugcaaccuccgccuccuggg

SEQ ID NO: 205517 - RNA, 25 nt, Human
ucacugcaaccuccgccuccugggu

SEQ ID NO: 205518 - RNA, 27 nt, Human
ucacugcaaccuccgccuccuggguuc

SEQ ID NO: 205519 - RNA, 24 nt, Human
ucccaaagugccgggacuacaggc

SEQ ID NO: 205520 - RNA, 24 nt, Human
uccugaguagcugggauuacaggc

SEQ ID NO: 205521 - RNA, 21 nt, Human
uccuggguucaagcgauucuc

SEQ ID NO: 205522 - RNA, 24 nt, Human
uccuggguucaagcgauucuccug

SEQ ID NO: 205523 - RNA, 30 nt, Human
ucgcaauacccugcauaagaauaugacugg

SEQ ID NO: 205524 - RNA, 23 nt, Human
ucucacucugccacccaggcugg

SEQ ID NO: 205525 - RNA, 24 nt, Human
ucucacucugccacccaggcugga

SEQ ID NO: 205526 - RNA, 26 nt, Human
ucucacucugccacccaggcuggagu

SEQ ID NO: 205527 - RNA, 27 nt, Human
ucucacucugccacccaggcuggagug

SEQ ID NO: 205528 - RNA, 24 nt, Human
ucugccacccaggcuggagugcag

SEQ ID NO: 205529 - RNA, 21 nt, Human
ucuuuguuuuuaaaacagcau

SEQ ID NO: 205530 - RNA, 18 nt, Human
ucuuuuuuuugagacgag

SEQ ID NO: 205531 - RNA, 19 nt, Human
ugaaagccacuuaaacaaa

SEQ ID NO: 205532 - RNA, 22 nt, Human
ugacugagguuugcugaaagcc

SEQ ID NO: 205533 - RNA, 22 nt, Human
ugcaguggugcaaucucggcuc

SEQ ID NO: 205534 - RNA, 22 nt, Human
ugccgggacuacaggcaagagc

SEQ ID NO: 205535 - RNA, 22 nt, Human
ugccucggccucccaaagugcc

SEQ ID NO: 205536 - RNA, 24 nt, Human
ugccucggccucccaaagugccgg

SEQ ID NO: 205537 - RNA, 20 nt, Human
ugccuuagccuccugaguaa

SEQ ID NO: 205538 - RNA, 24 nt, Human
ugccuuagccuccugaguagcugg

SEQ ID NO: 205539 - RNA, 23 nt, Human
uggagugcaguggugcaaucucg

SEQ ID NO: 205540 - RNA, 24 nt, Human
uggagugcaguggugcaaucucgg

SEQ ID NO: 205541 - RNA, 19 nt, Human
ugggaccuuaguuaguacu

SEQ ID NO: 205542 - RNA, 22 nt, Human
ugggauuacaggcacaugucac

SEQ ID NO: 205543 - RNA, 24 nt, Human
ugggauuacaggcacaugucacca

SEQ ID NO: 205544 - RNA, 23 nt, Human
uggguucaagcgauucuccugcc

SEQ ID NO: 205545 - RNA, 24 nt, Human
uggguucaagcgauucuccugccu

SEQ ID NO: 205546 - RNA, 24 nt, Human
uggucaggcuggucucgaacuccu

SEQ ID NO: 205547 - RNA, 23 nt, Human
uuaguaccagcaagcacaacaaa

SEQ ID NO: 205548 - RNA, 20 nt, Human
uucaagcgauucuccugccu

SEQ ID NO: 205549 - RNA, 24 nt, Human
uucaagcgauucuccugccuuagc

SEQ ID NO: 205550 - RNA, 21 nt, Human
uucacacuggagaugaaaagg

SEQ ID NO: 205551 - RNA, 22 nt, Human
uucguucuuaaaccugugccac

SEQ ID NO: 205552 - RNA, 24 nt, Human
uucucaugucaagaauaacuucau

SEQ ID NO: 205553 - RNA, 21 nt, Human
uuucaccacguuggucaggcu

SEQ ID NO: 205554 - RNA, 25 nt, Human
uuucuuuuuuuugagacgagucuca

SEQ ID NO: 205555 - RNA, 18 nt, Human
aaaucuugugcuacuguu

SEQ ID NO: 205556 - RNA, 18 nt, Human
aaguaacauuguaaccug

SEQ ID NO: 205557 - RNA, 20 nt, Human
acccucgucuuugagggccg

SEQ ID NO: 205558 - RNA, 20 nt, Human
agccccgaagaaacacgcuc

SEQ ID NO: 205559 - RNA, 23 nt, Human
aggaaauaucuucaguguguuca

SEQ ID NO: 205560 - RNA, 23 nt, Human
aggcuggaaacgaacgaacggca

SEQ ID NO: 205561 - RNA, 28 nt, Human
agggaagagagggcguaccugaggggcc

SEQ ID NO: 205562 - RNA, 24 nt, Human
auauguccauuucaucaagagguc

SEQ ID NO: 205563 - RNA, 20 nt, Human
auguauguguaggggauagg

SEQ ID NO: 205564 - RNA, 24 nt, Human
caaauaaauuuuaaaaggccagaa

SEQ ID NO: 205565 - RNA, 21 nt, Human
caccugaaggaaauaucuuca

SEQ ID NO: 205566 - RNA, 24 nt, Human
caccugaaggaaauaucuucagug

SEQ ID NO: 205567 - RNA, 20 nt, Human
cauguauguguaggggauag

SEQ ID NO: 205568 - RNA, 20 nt, Human
ccaggaaaauccagguggca

SEQ ID NO: 205569 - RNA, 21 nt, Human
cgcgggccagcaagccuaaaa

SEQ ID NO: 205570 - RNA, 19 nt, Human
cgggccagcaagccuaaaa

SEQ ID NO: 205571 - RNA, 19 nt, Human
gaacucaagaauagaaaua

SEQ ID NO: 205572 - RNA, 20 nt, Human
gagggccggauccugcaggg

SEQ ID NO: 205573 - RNA, 24 nt, Human
gcgggccagcaagccuaaaagcaa

SEQ ID NO: 205574 - RNA, 23 nt, Human
gcgugacccucgucuuugagggc

SEQ ID NO: 205575 - RNA, 22 nt, Human
gggaagagagggcguaccugag

SEQ ID NO: 205576 - RNA, 19 nt, Human
gggccggauccugcaggga

SEQ ID NO: 205577 - RNA, 20 nt, Human
gugaagauuacugugagguc

SEQ ID NO: 205578 - RNA, 21 nt, Human
guguaauuagggaagggcuga

SEQ ID NO: 205579 - RNA, 23 nt, Human
uaaaagcaacucauccggggucc

SEQ ID NO: 205580 - RNA, 18 nt, Human
uaagugugaagauuacug

SEQ ID NO: 205581 - RNA, 18 nt, Human
uacacacaccugaaggaa

SEQ ID NO: 205582 - RNA, 24 nt, Human
uagguguaauuagggaagggcuga

SEQ ID NO: 205583 - RNA, 18 nt, Human
uaugugcauguaugugua

SEQ ID NO: 205584 - RNA, 18 nt, Human
uaugugcauguaugugua

SEQ ID NO: 205585 - RNA, 18 nt, Human
uaugugcauguaugugua

SEQ ID NO: 205586 - RNA, 24 nt, Human
uaugugcauguauguguaggggau

SEQ ID NO: 205587 - RNA, 20 nt, Human
uauuuuacacacaccugaag

SEQ ID NO: 205588 - RNA, 20 nt, Human
ucaguguguucaugugugug

SEQ ID NO: 205589 - RNA, 19 nt, Human
ugaagauuacugugagguc

SEQ ID NO: 205590 - RNA, 22 nt, Human
ugaaguaacauuguaaccugcu

SEQ ID NO: 205591 - RNA, 24 nt, Human
ugaccgaacaacauugauaaguac

SEQ ID NO: 205592 - RNA, 19 nt, Human
ugauauauauacuaugcca

SEQ ID NO: 205593 - RNA, 24 nt, Human
ugcauguauguguaggggauaggu

SEQ ID NO: 205594 - RNA, 20 nt, Human
ugccuggacagccccgcggg

SEQ ID NO: 205595 - RNA, 22 nt, Human
uguauguguaggggauaggugu

SEQ ID NO: 205596 - RNA, 21 nt, Human
ugugugucuaugugcauguau

SEQ ID NO: 205597 - RNA, 24 nt, Human
ugugugucuaugugcauguaugug

SEQ ID NO: 205598 - RNA, 21 nt, Human
uguguucaugugugugucuau

SEQ ID NO: 205599 - RNA, 24 nt, Human
uguguucaugugugugucuaugug

SEQ ID NO: 205600 - RNA, 23 nt, Human
uuuacugaaacuuaaaauauucc

SEQ ID NO: 205601 - RNA, 21 nt, Human
aaacagcauacugaucacuuu

SEQ ID NO: 205602 - RNA, 18 nt, Human
aacagcauacugaucacu

SEQ ID NO: 205603 - RNA, 18 nt, Human
aacagcauacugaucacu

SEQ ID NO: 205604 - RNA, 24 nt, Human
aagacuucugucgcccaggcugga

SEQ ID NO: 205605 - RNA, 21 nt, Human
aagcagagggccuuuccuguc

SEQ ID NO: 205606 - RNA, 18 nt, Human
aagcauugaagaucucac

SEQ ID NO: 205607 - RNA, 20 nt, Human
aagcauugaagaucucacuc

SEQ ID NO: 205608 - RNA, 24 nt, Human
aagugauccuccugccuuggccuc

SEQ ID NO: 205609 - RNA, 20 nt, Human
aauacuuuuuccaucuucag

SEQ ID NO: 205610 - RNA, 26 nt, Human
accuaccaucaaaguaggcuucugaa

SEQ ID NO: 205611 - RNA, 19 nt, Human
accucggagccccggcccc

SEQ ID NO: 205612 - RNA, 21 nt, Human
acuucugucgcccaggcugga

SEQ ID NO: 205613 - RNA, 25 nt, Human
acuuuguugcccaggcuggucucaa

SEQ ID NO: 205614 - RNA, 18 nt, Human
agaaggaaggcauuuaaa

SEQ ID NO: 205615 - RNA, 19 nt, Human
agaguaaauaauuauacca

SEQ ID NO: 205616 - RNA, 22 nt, Human
agauucaugcauugagcaauuc

SEQ ID NO: 205617 - RNA, 22 nt, Human
agauucaugcauugagcaauuc

SEQ ID NO: 205618 - RNA, 24 nt, Human
agcccagugacaccgcaagcagcc

SEQ ID NO: 205619 - RNA, 19 nt, Human
aggaaaaaagcaugagagg

SEQ ID NO: 205620 - RNA, 19 nt, Human
aggaaaaaagcaugagagg

SEQ ID NO: 205621 - RNA, 19 nt, Human
aggaaggaaaccugagccu

SEQ ID NO: 205622 - RNA, 19 nt, Human
aggaaggaaaccugagccu

SEQ ID NO: 205623 - RNA, 21 nt, Human
aggcaggagaacgguggccug

SEQ ID NO: 205624 - RNA, 19 nt, Human
aggcagucaggucugaggc

SEQ ID NO: 205625 - RNA, 21 nt, Human
aggcagucaggucugaggcaa

SEQ ID NO: 205626 - RNA, 19 nt, Human
aggcugggggcagagaagg

SEQ ID NO: 205627 - RNA, 22 nt, Human
aggcugggggcagagaaggaag

SEQ ID NO: 205628 - RNA, 20 nt, Human
auuuucuucuucucuucuuu

SEQ ID NO: 205629 - RNA, 21 nt, Human
caaacuccuggcuccaaguga

SEQ ID NO: 205630 - RNA, 22 nt, Human
caacagcagcaggucaucuuug

SEQ ID NO: 205631 - RNA, 19 nt, Human
caagugauccuccugccuu

SEQ ID NO: 205632 - RNA, 22 nt, Human
caagugauccuccugccuuggc

SEQ ID NO: 205633 - RNA, 20 nt, Human
caauauaaacagggccguug

SEQ ID NO: 205634 - RNA, 20 nt, Human
caauauaaacagggccguug

SEQ ID NO: 205635 - RNA, 25 nt, Human
cacuuuauacuucugcuagccccca

SEQ ID NO: 205636 - RNA, 25 nt, Human
cacuuuauacuucugcuagccccca

SEQ ID NO: 205637 - RNA, 19 nt, Human
cacuuuguugcccaggcug

SEQ ID NO: 205638 - RNA, 24 nt, Human
cacuuuguugcccaggcuggucuc

SEQ ID NO: 205639 - RNA, 20 nt, Human
cagccuccugaguagcuggg

SEQ ID NO: 205640 - RNA, 27 nt, Human
cagcuccuccaccagugugagaacacu

SEQ ID NO: 205641 - RNA, 21 nt, Human
caggagccucccggccgaggu

SEQ ID NO: 205642 - RNA, 20 nt, Human
caucugcucgcuccaagaag

SEQ ID NO: 205643 - RNA, 21 nt, Human
caucuuugucagcaccuucag

SEQ ID NO: 205644 - RNA, 19 nt, Human
ccaagugauccuccugccu

SEQ ID NO: 205645 - RNA, 20 nt, Human
cccaccaggcaccugcugug

SEQ ID NO: 205646 - RNA, 25 nt, Human
cccaggcuggagcacaaccgggguc

SEQ ID NO: 205647 - RNA, 19 nt, Human
cccaguucguuuucuucuu

SEQ ID NO: 205648 - RNA, 21 nt, Human
ccccaggggagcugcuggggg

SEQ ID NO: 205649 - RNA, 21 nt, Human
ccccaggggagcugcuggggg

SEQ ID NO: 205650 - RNA, 21 nt, Human
ccccaggggagcugcuggggg

SEQ ID NO: 205651 - RNA, 19 nt, Human
ccccggccccaggagccuc

SEQ ID NO: 205652 - RNA, 21 nt, Human
cccuuuauaccaaauaagagu

SEQ ID NO: 205653 - RNA, 21 nt, Human
ccgaggucggagccggggucc

SEQ ID NO: 205654 - RNA, 19 nt, Human
ccggggucccugccacugg

SEQ ID NO: 205655 - RNA, 24 nt, Human
ccuccugccucagccuccugagua

SEQ ID NO: 205656 - RNA, 25 nt, Human
ccucggagccccggccccaggagcc

SEQ ID NO: 205657 - RNA, 23 nt, Human
ccugaguagcugggacugcacau

SEQ ID NO: 205658 - RNA, 18 nt, Human
ccuggcuccaagugaucc

SEQ ID NO: 205659 - RNA, 21 nt, Human
ccuggcuccaagugauccucc

SEQ ID NO: 205660 - RNA, 23 nt, Human
ccuggcuccaagugauccuccug

SEQ ID NO: 205661 - RNA, 19 nt, Human
ccuugcgcugguuuucuuc

SEQ ID NO: 205662 - RNA, 20 nt, Human
cgaagaggcugaaccaggca

SEQ ID NO: 205663 - RNA, 20 nt, Human
cgaagaggcugaaccaggca

SEQ ID NO: 205664 - RNA, 24 nt, Human
cggagccccggccccaggagccuc

SEQ ID NO: 205665 - RNA, 18 nt, Human
cggcaugugagugcccuc

SEQ ID NO: 205666 - RNA, 18 nt, Human
cggcaugugagugcccuc

SEQ ID NO: 205667 - RNA, 21 nt, Human
cggcaugugagugcccucccg

SEQ ID NO: 205668 - RNA, 21 nt, Human
cggcaugugagugcccucccg

SEQ ID NO: 205669 - RNA, 21 nt, Human
cggcaugugagugcccucccg

SEQ ID NO: 205670 - RNA, 25 nt, Human
cggcugcaucuguacuuuccugcug

SEQ ID NO: 205671 - RNA, 24 nt, Human
cucagccuccugaguagcugggac

SEQ ID NO: 205672 - RNA, 18 nt, Human
cuccccggggucucuccu

SEQ ID NO: 205673 - RNA, 19 nt, Human
cuccucgacccccaucucc

SEQ ID NO: 205674 - RNA, 24 nt, Human
cucugaggcuguaggacacgucau

SEQ ID NO: 205675 - RNA, 23 nt, Human
cucuuugcugaacucgcccucuu

SEQ ID NO: 205676 - RNA, 23 nt, Human
cucuuugcugaacucgcccucuu

SEQ ID NO: 205677 - RNA, 21 nt, Human
cugcacggcugcaucuguacu

SEQ ID NO: 205678 - RNA, 23 nt, Human
cugccucagccuccugaguagcu

SEQ ID NO: 205679 - RNA, 21 nt, Human
cugggggcagagaaggaaggc

SEQ ID NO: 205680 - RNA, 26 nt, Human
cugugauccuccugccucagccuccu

SEQ ID NO: 205681 - RNA, 22 nt, Human
cuuccuacagcccuccuccaag

SEQ ID NO: 205682 - RNA, 21 nt, Human
cuucugucgcccaggcuggag

SEQ ID NO: 205683 - RNA, 22 nt, Human
cuuuauacuucugcuagccccc

SEQ ID NO: 205684 - RNA, 21 nt, Human
gagcugcugggggcggcaugu

SEQ ID NO: 205685 - RNA, 21 nt, Human
gagcugcugggggcggcaugu

SEQ ID NO: 205686 - RNA, 21 nt, Human
gagcugcugggggcggcaugu

SEQ ID NO: 205687 - RNA, 22 nt, Human
gaguagcugggacugcacaugc

SEQ ID NO: 205688 - RNA, 24 nt, Human
gagugaguuucucucucucuacuc

SEQ ID NO: 205689 - RNA, 18 nt, Human
gcaggucaucuuugucag

SEQ ID NO: 205690 - RNA, 18 nt, Human
gcaucuguacuuuccugc

SEQ ID NO: 205691 - RNA, 24 nt, Human
gcccaggcuggagcacaacggcuc

SEQ ID NO: 205692 - RNA, 20 nt, Human
gccucagccuccugaguagc

SEQ ID NO: 205693 - RNA, 18 nt, Human
gcucugguuuuaucuugg

SEQ ID NO: 205694 - RNA, 23 nt, Human
gcugcaucuguacuuuccugcug

SEQ ID NO: 205695 - RNA, 22 nt, Human
gcuggagcacaacggcucauua

SEQ ID NO: 205696 - RNA, 23 nt, Human
ggcaggaaaaaagcaugagagga

SEQ ID NO: 205697 - RNA, 23 nt, Human
ggcaggaaaaaagcaugagagga

SEQ ID NO: 205698 - RNA, 19 nt, Human
ggcuccaagugauccuccu

SEQ ID NO: 205699 - RNA, 22 nt, Human
ggcuccaagugauccuccugcc

SEQ ID NO: 205700 - RNA, 20 nt, Human
gggaagaaaagcagagggcc

SEQ ID NO: 205701 - RNA, 20 nt, Human
ggggagaaggggcaggaaaa

SEQ ID NO: 205702 - RNA, 20 nt, Human
ggggagaaggggcaggaaaa

SEQ ID NO: 205703 - RNA, 24 nt, Human
gggggucucacuuuguugcccagg

SEQ ID NO: 205704 - RNA, 22 nt, Human
gggucucacuuuguugcccagg

SEQ ID NO: 205705 - RNA, 21 nt, Human
ggucuggcucucccagggcca

SEQ ID NO: 205706 - RNA, 21 nt, Human
ggucuggcucucccagggcca

SEQ ID NO: 205707 - RNA, 19 nt, Human
guagagaugggggucucac

SEQ ID NO: 205708 - RNA, 19 nt, Human
gugagaacacuggcccacc

SEQ ID NO: 205709 - RNA, 19 nt, Human
gugauccuccugccucagc

SEQ ID NO: 205710 - RNA, 24 nt, Human
gugauccuccugccucagccuccu

SEQ ID NO: 205711 - RNA, 23 nt, Human
uaaaacagcauacugaucacuuu

SEQ ID NO: 205712 - RNA, 23 nt, Human
uaaaacagcauacugaucacuuu

SEQ ID NO: 205713 - RNA, 23 nt, Human
uaaaacagcauacugaucacuuu

SEQ ID NO: 205714 - RNA, 19 nt, Human
uaaccuuugaaacucucau

SEQ ID NO: 205715 - RNA, 20 nt, Human
uaccaucaaaguaggcuucu

SEQ ID NO: 205716 - RNA, 24 nt, Human
uagcagguucuuguagcgaggccu

SEQ ID NO: 205717 - RNA, 23 nt, Human
uagcccagugacaccgcaagcag

SEQ ID NO: 205718 - RNA, 19 nt, Human
uaggcuucugaauuucaac

SEQ ID NO: 205719 - RNA, 24 nt, Human
uaggucacugugauccuccugccu

SEQ ID NO: 205720 - RNA, 26 nt, Human
uaguaaguuuguccuuggagagaagc

SEQ ID NO: 205721 - RNA, 22 nt, Human
uauuuuuuguagagaugggggu

SEQ ID NO: 205722 - RNA, 25 nt, Human
ucacuggaagguggcuuggcaggaa

SEQ ID NO: 205723 - RNA, 20 nt, Human
ucacugugauccuccugccu

SEQ ID NO: 205724 - RNA, 23 nt, Human
ucagccaaguaucugagauggcc

SEQ ID NO: 205725 - RNA, 23 nt, Human
ucagccuccugaguagcugggac

SEQ ID NO: 205726 - RNA, 24 nt, Human
ucauccagagcucacuggccuaag

SEQ ID NO: 205727 - RNA, 23 nt, Human
ucauggauggcugccauagugug

SEQ ID NO: 205728 - RNA, 23 nt, Human
uccaaacacagcggcccacucuu

SEQ ID NO: 205729 - RNA, 23 nt, Human
uccaaacacagcggcccacucuu

SEQ ID NO: 205730 - RNA, 22 nt, Human
uccaaggaggaagcauugaaga

SEQ ID NO: 205731 - RNA, 24 nt, Human
uccaagugauccuccugccuuggc

SEQ ID NO: 205732 - RNA, 22 nt, Human
uccacauagagauacacgaaaa

SEQ ID NO: 205733 - RNA, 22 nt, Human
uccaccagugugagaacacugg

SEQ ID NO: 205734 - RNA, 18 nt, Human
uccagagcucacuggaag

SEQ ID NO: 205735 - RNA, 23 nt, Human
uccaugcgguucaccgucagcca

SEQ ID NO: 205736 - RNA, 18 nt, Human
ucccagggccauaguggg

SEQ ID NO: 205737 - RNA, 18 nt, Human
ucccagggccauaguggg

SEQ ID NO: 205738 - RNA, 19 nt, Human
uccccgaccgucccggcug

SEQ ID NO: 205739 - RNA, 20 nt, Human
uccugaguagcugggacugc

SEQ ID NO: 205740 - RNA, 18 nt, Human
ucgaagaaauuuucccag

SEQ ID NO: 205741 - RNA, 19 nt, Human
ucucacuuuguugcccagg

SEQ ID NO: 205742 - RNA, 22 nt, Human
ucucacuuuguugcccaggcug

SEQ ID NO: 205743 - RNA, 23 nt, Human
ucucacuuuguugcccaggcugg

SEQ ID NO: 205744 - RNA, 26 nt, Human
ucucacuuuguugcccaggcuggucu

SEQ ID NO: 205745 - RNA, 27 nt, Human
ucucacuuuguugcccaggcuggucuc

SEQ ID NO: 205746 - RNA, 21 nt, Human
ucuccaaacacagcggcccac

SEQ ID NO: 205747 - RNA, 21 nt, Human
ucuccaaacacagcggcccac

SEQ ID NO: 205748 - RNA, 22 nt, Human
ucuccauuugcuuguagagguc

SEQ ID NO: 205749 - RNA, 21 nt, Human
ucucuacuccccggggucucu

SEQ ID NO: 205750 - RNA, 21 nt, Human
ucugcuagcccccaggggagc

SEQ ID NO: 205751 - RNA, 22 nt, Human
ucugcuagcccccaggggagcc

SEQ ID NO: 205752 - RNA, 22 nt, Human
ucugcuagcccccaggggagcc

SEQ ID NO: 205753 - RNA, 21 nt, Human
ucugcucgcuccaagaagauc

SEQ ID NO: 205754 - RNA, 21 nt, Human
ucuggaucaagcuccugagac

SEQ ID NO: 205755 - RNA, 18 nt, Human
ucugucgcccaggcugga

SEQ ID NO: 205756 - RNA, 23 nt, Human
ucuucuucuauuguugaugauua

SEQ ID NO: 205757 - RNA, 19 nt, Human
ugaacucgcccucuuccaa

SEQ ID NO: 205758 - RNA, 19 nt, Human
ugaacucgcccucuuccaa

SEQ ID NO: 205759 - RNA, 18 nt, Human
ugagaacacuggcccacc

SEQ ID NO: 205760 - RNA, 20 nt, Human
ugagacaagacuucugucgc

SEQ ID NO: 205761 - RNA, 21 nt, Human
ugagauggcccgaugccgaaa

SEQ ID NO: 205762 - RNA, 20 nt, Human
ugccauagugugagaaguuu

SEQ ID NO: 205763 - RNA, 24 nt, Human
ugcccaggcuggucucaaacuccu

SEQ ID NO: 205764 - RNA, 24 nt, Human
ugccucagccuccugaguagcugg

SEQ ID NO: 205765 - RNA, 23 nt, Human
ugcucugguuuuaucuuggaaac

SEQ ID NO: 205766 - RNA, 23 nt, Human
ugcugggggcggcaugugagugc

SEQ ID NO: 205767 - RNA, 23 nt, Human
ugcugggggcggcaugugagugc

SEQ ID NO: 205768 - RNA, 23 nt, Human
ugcugggggcggcaugugagugc

SEQ ID NO: 205769 - RNA, 24 nt, Human
ugcugggggcggcaugugagugcc

SEQ ID NO: 205770 - RNA, 24 nt, Human
ugcugggggcggcaugugagugcc

SEQ ID NO: 205771 - RNA, 24 nt, Human
ugcugggggcggcaugugagugcc

SEQ ID NO: 205772 - RNA, 25 nt, Human
uggagagaagcccagcuccuccacc

SEQ ID NO: 205773 - RNA, 20 nt, Human
uggccgucuccaaacacagc

SEQ ID NO: 205774 - RNA, 20 nt, Human
uggccgucuccaaacacagc

SEQ ID NO: 205775 - RNA, 24 nt, Human
uggcuccaagugauccuccugccu

SEQ ID NO: 205776 - RNA, 22 nt, Human
uggggagggucggggacucggg

SEQ ID NO: 205777 - RNA, 18 nt, Human
uggguccugagcaugcag

SEQ ID NO: 205778 - RNA, 23 nt, Human
ugucaaaguuuuuuuuugcaagg

SEQ ID NO: 205779 - RNA, 24 nt, Human
ugugauccuccugccucagccucc

SEQ ID NO: 205780 - RNA, 22 nt, Human
uguugcccaggcuggucucaaa

SEQ ID NO: 205781 - RNA, 24 nt, Human
uuaaagcuuugcuagccuccugcu

SEQ ID NO: 205782 - RNA, 22 nt, Human
uuaauuggcucggcuccugcac

SEQ ID NO: 205783 - RNA, 20 nt, Human
uuccucagauuucaugucua

SEQ ID NO: 205784 - RNA, 18 nt, Human
uucugucgcccaggcugg

SEQ ID NO: 205785 - RNA, 20 nt, Human
uugcaucaucuuuccugcuc

SEQ ID NO: 205786 - RNA, 25 nt, Human
uuggaucucacgguagcccagugac

SEQ ID NO: 205787 - RNA, 24 nt, Human
uuggucuaaaagcugcgaaggaag

SEQ ID NO: 205788 - RNA, 24 nt, Human
uuggucuaaaagcugcgaaggaag

SEQ ID NO: 205789 - RNA, 22 nt, Human
uuuauuuuuuguagagaugggg

SEQ ID NO: 205790 - RNA, 23 nt, Human
uuuccugucgcuugcaucaucuu

SEQ ID NO: 205791 - RNA, 25 nt, Human
uuuccugucgcuugcaucaucuuuc

SEQ ID NO: 205792 - RNA, 19 nt, Human
uuucuucuucucuucuuuc

SEQ ID NO: 205793 - RNA, 18 nt, Human
uuuggggagaaggggcag

SEQ ID NO: 205794 - RNA, 18 nt, Human
uuuggggagaaggggcag

SEQ ID NO: 205795 - RNA, 23 nt, Human
uuuguugcccaggcuggucucaa

SEQ ID NO: 205796 - RNA, 24 nt, Human
uuuguugcccaggcuggucucaaa

SEQ ID NO: 205797 - RNA, 22 nt, Human
uuuuaucuuggaaaccuuggga

SEQ ID NO: 205798 - RNA, 18 nt, Human
uuuuuuguagagaugggg

SEQ ID NO: 205799 - RNA, 18 nt, Human
aaacaggacaagaggaca

SEQ ID NO: 205800 - RNA, 23 nt, Human
aaaugcuguuguaucugacugag

SEQ ID NO: 205801 - RNA, 25 nt, Human
aagaggacaaggcauagcuugggca

SEQ ID NO: 205802 - RNA, 20 nt, Human
aagucccagccccauuugau

SEQ ID NO: 205803 - RNA, 21 nt, Human
acacauacacacacacacaca

SEQ ID NO: 205804 - RNA, 22 nt, Human
acagagcgagagcuugucuaca

SEQ ID NO: 205805 - RNA, 19 nt, Human
accacugcacuccagccug

SEQ ID NO: 205806 - RNA, 24 nt, Human
accacugcacuccagccuggguga

SEQ ID NO: 205807 - RNA, 20 nt, Human
acccaauaggcagcaaguuu

SEQ ID NO: 205808 - RNA, 23 nt, Human
accuggugaccuugaaugugauu

SEQ ID NO: 205809 - RNA, 18 nt, Human
accuugaaugugauuagg

SEQ ID NO: 205810 - RNA, 18 nt, Human
acucugaguagcagagga

SEQ ID NO: 205811 - RNA, 24 nt, Human
acugcacuccagccugggugacag

SEQ ID NO: 205812 - RNA, 26 nt, Human
acugcacuccagccugggugacagag

SEQ ID NO: 205813 - RNA, 24 nt, Human
agccuauggucccagcuacucagg

SEQ ID NO: 205814 - RNA, 24 nt, Human
agccugggugacagagcgagagcu

SEQ ID NO: 205815 - RNA, 24 nt, Human
agcuacucaggaggcugagguggg

SEQ ID NO: 205816 - RNA, 31 nt, Human
agcuugucuacacauacacacacacacacag

SEQ ID NO: 205817 - RNA, 23 nt, Human
aggacccugaucacugcaggaaa

SEQ ID NO: 205818 - RNA, 24 nt, Human
aggcugaggugggaggaucacuug

SEQ ID NO: 205819 - RNA, 22 nt, Human
aggcugagguugcaacucugag

SEQ ID NO: 205820 - RNA, 23 nt, Human
aggcugagguugcaacucugagg

SEQ ID NO: 205821 - RNA, 22 nt, Human
agggccacuucuucuguaaguc

SEQ ID NO: 205822 - RNA, 18 nt, Human
aggugggaggaucacuug

SEQ ID NO: 205823 - RNA, 23 nt, Human
aggugggaggaucacuugagccc

SEQ ID NO: 205824 - RNA, 23 nt, Human
auacacacacacacacacgcggg

SEQ ID NO: 205825 - RNA, 24 nt, Human
aucaggcuagacuuuaacauccau

SEQ ID NO: 205826 - RNA, 20 nt, Human
aucuuuuugccaggcacucu

SEQ ID NO: 205827 - RNA, 20 nt, Human
auguauguggguggggaggu

SEQ ID NO: 205828 - RNA, 21 nt, Human
auguggguggggagguggcua

SEQ ID NO: 205829 - RNA, 24 nt, Human
auugcaccacugcacuccagccug

SEQ ID NO: 205830 - RNA, 22 nt, Human
caacuguaccuggugaccuuga

SEQ ID NO: 205831 - RNA, 24 nt, Human
caauguugcgagaccccgucucug

SEQ ID NO: 205832 - RNA, 28 nt, Human
cacauacacacacacacacacgcggaug

SEQ ID NO: 205833 - RNA, 20 nt, Human
caccacugcacuccagccug

SEQ ID NO: 205834 - RNA, 26 nt, Human
caccacugcacuccagccugggugac

SEQ ID NO: 205835 - RNA, 22 nt, Human
cacuccagccugggugacagag

SEQ ID NO: 205836 - RNA, 24 nt, Human
cacuccagccugggugacagagcg

SEQ ID NO: 205837 - RNA, 19 nt, Human
cacugcacuccagccuggg

SEQ ID NO: 205838 - RNA, 19 nt, Human
cacugcacuccagccuggg

SEQ ID NO: 205839 - RNA, 19 nt, Human
cacugcacuccagccuggg

SEQ ID NO: 205840 - RNA, 22 nt, Human
cacugcacuccagccuggguga

SEQ ID NO: 205841 - RNA, 24 nt, Human
cacugcacuccagccugggugaca

SEQ ID NO: 205842 - RNA, 25 nt, Human
cacugcacuccagccugggugacag

SEQ ID NO: 205843 - RNA, 22 nt, Human
cagaucagaugggccccaaaug

SEQ ID NO: 205844 - RNA, 24 nt, Human
cagcuacucaggaggcugaggugg

SEQ ID NO: 205845 - RNA, 20 nt, Human
cauaaaagacacucaauaaa

SEQ ID NO: 205846 - RNA, 20 nt, Human
ccacugcacuccagccuggg

SEQ ID NO: 205847 - RNA, 20 nt, Human
ccacugcacuccagccuggg

SEQ ID NO: 205848 - RNA, 20 nt, Human
ccacugcacuccagccuggg

SEQ ID NO: 205849 - RNA, 21 nt, Human
ccacugcacuccagccugggu

SEQ ID NO: 205850 - RNA, 21 nt, Human
ccacugcacuccagccugggu

SEQ ID NO: 205851 - RNA, 24 nt, Human
ccacugcacuccagccugggugac

SEQ ID NO: 205852 - RNA, 25 nt, Human
ccacugcacuccagccugggugaca

SEQ ID NO: 205853 - RNA, 19 nt, Human
ccaggcacucuccugcagu

SEQ ID NO: 205854 - RNA, 22 nt, Human
ccaguccauauagugcuuuugu

SEQ ID NO: 205855 - RNA, 21 nt, Human
ccuauggucccagcuacucag

SEQ ID NO: 205856 - RNA, 22 nt, Human
ccugggugacagagcgagagcu

SEQ ID NO: 205857 - RNA, 18 nt, Human
cucaggaggcugaggugg

SEQ ID NO: 205858 - RNA, 22 nt, Human
cucauguccagacaugaccgcu

SEQ ID NO: 205859 - RNA, 20 nt, Human
cugaaccuguaaccauuacc

SEQ ID NO: 205860 - RNA, 24 nt, Human
cuuccaaagcugggagggaguccu

SEQ ID NO: 205861 - RNA, 20 nt, Human
cuuuuugccaggcacucucc

SEQ ID NO: 205862 - RNA, 24 nt, Human
gaucacuugagcccaaaaggucaa

SEQ ID NO: 205863 - RNA, 24 nt, Human
gcacuccagccugggugacagagc

SEQ ID NO: 205864 - RNA, 22 nt, Human
gccaggcacucuccugcagugu

SEQ ID NO: 205865 - RNA, 18 nt, Human
ggaaggccgaggaagagg

SEQ ID NO: 205866 - RNA, 23 nt, Human
ggaguccuccaauaccuuggccc

SEQ ID NO: 205867 - RNA, 23 nt, Human
ggcagaaauguaugugggugggg

SEQ ID NO: 205868 - RNA, 18 nt, Human
ggccgguagguguagcug

SEQ ID NO: 205869 - RNA, 20 nt, Human
ggggaaaggcagguuggcca

SEQ ID NO: 205870 - RNA, 18 nt, Human
ggggaagggaggaauaag

SEQ ID NO: 205871 - RNA, 19 nt, Human
gguuggggucaguagacag

SEQ ID NO: 205872 - RNA, 26 nt, Human
gguuggggucaguagacagcagugcc

SEQ ID NO: 205873 - RNA, 28 nt, Human
gucucccccaccacuuccccucucauca

SEQ ID NO: 205874 - RNA, 20 nt, Human
gugagccuauggucccagcu

SEQ ID NO: 205875 - RNA, 21 nt, Human
guggggagguggcuaacaaag

SEQ ID NO: 205876 - RNA, 20 nt, Human
gugguguugugagccuaugg

SEQ ID NO: 205877 - RNA, 21 nt, Human
uaccuuggcccccuuccccac

SEQ ID NO: 205878 - RNA, 23 nt, Human
uccagccugggugacagagcgag

SEQ ID NO: 205879 - RNA, 24 nt, Human
uccagccugggugacagagcgaga

SEQ ID NO: 205880 - RNA, 19 nt, Human
uccccucucaucaggcuag

SEQ ID NO: 205881 - RNA, 20 nt, Human
ucuacacauacacacacaca

SEQ ID NO: 205882 - RNA, 20 nt, Human
ucucuggaaaaaaaaaaaaa

SEQ ID NO: 205883 - RNA, 21 nt, Human
ucucuggaaaaaaaaaaaaaa

SEQ ID NO: 205884 - RNA, 18 nt, Human
ugaaugugauuaggacug

SEQ ID NO: 205885 - RNA, 23 nt, Human
ugagccuauggucccagcuacuc

SEQ ID NO: 205886 - RNA, 21 nt, Human
ugaggacaaugcccuguccuc

SEQ ID NO: 205887 - RNA, 20 nt, Human
ugaggcuuccaaagcuggga

SEQ ID NO: 205888 - RNA, 22 nt, Human
ugaggcuuccaaagcugggagg

SEQ ID NO: 205889 - RNA, 19 nt, Human
ugaggugggaggaucacuu

SEQ ID NO: 205890 - RNA, 20 nt, Human
ugaggugggaggaucacuug

SEQ ID NO: 205891 - RNA, 21 nt, Human
ugaggugggaggaucacuuga

SEQ ID NO: 205892 - RNA, 23 nt, Human
ugaggugggaggaucacuugagc

SEQ ID NO: 205893 - RNA, 24 nt, Human
ugaggugggaggaucacuugagcc

SEQ ID NO: 205894 - RNA, 21 nt, Human
ugcaccacugcacuccagccu

SEQ ID NO: 205895 - RNA, 22 nt, Human
ugcagugaaccaugauugcacc

SEQ ID NO: 205896 - RNA, 20 nt, Human
ugcuccuuccucuuggcuua

SEQ ID NO: 205897 - RNA, 19 nt, Human
uggaaaaaaaaaaaaaauc

SEQ ID NO: 205898 - RNA, 21 nt, Human
uggaaaaaaaaaaaaaaucaa

SEQ ID NO: 205899 - RNA, 23 nt, Human
uggagggccacuucuucuguaag

SEQ ID NO: 205900 - RNA, 20 nt, Human
uguauguggguggggaggug

SEQ ID NO: 205901 - RNA, 26 nt, Human
ugucucccccaccacuuccccucuca

SEQ ID NO: 205902 - RNA, 18 nt, Human
uugugccgauagaaaaau

SEQ ID NO: 205903 - RNA, 22 nt, Human
caagucucugcugccugucaca

SEQ ID NO: 205904 - RNA, 19 nt, Human
cagggcuggaccucaaccc

SEQ ID NO: 205905 - RNA, 18 nt, Human
ccuucagccagggcugga

SEQ ID NO: 205906 - RNA, 22 nt, Human
ccuucagccagggcuggaccuc

SEQ ID NO: 205907 - RNA, 19 nt, Human
cgggcucgcagggaccagc

SEQ ID NO: 205908 - RNA, 23 nt, Human
cugcugccugucacaguccuuca

SEQ ID NO: 205909 - RNA, 22 nt, Human
gggaccagccaagggcugccug

SEQ ID NO: 205910 - RNA, 22 nt, Human
gucacacugaguuccagugacc

SEQ ID NO: 205911 - RNA, 19 nt, Human
uggccaugccacucauggu

SEQ ID NO: 205912 - RNA, 21 nt, Human
acagccaagcccccgccaacu

SEQ ID NO: 205913 - RNA, 25 nt, Human
acagccaagcccccgccaacuuuga

SEQ ID NO: 205914 - RNA, 24 nt, Human
cacagccaagcccccgccaacuuu

SEQ ID NO: 205915 - RNA, 27 nt, Human
cacagccaagcccccgccaacuuugau

SEQ ID NO: 205916 - RNA, 22 nt, Human
ccaacuuugaucccggauccca

SEQ ID NO: 205917 - RNA, 18 nt, Human
cccccgccaacuuugauc

SEQ ID NO: 205918 - RNA, 19 nt, Human
ggaaucugagggcacagcc

SEQ ID NO: 205919 - RNA, 19 nt, Human
ggugcggaaucugagggca

SEQ ID NO: 205920 - RNA, 20 nt, Human
ugagggcacagccaagcccc

SEQ ID NO: 205921 - RNA, 19 nt, Human
uuuuuuuuuuuuagggagu

SEQ ID NO: 205922 - RNA, 25 nt, Human
uuuuuuuuuuuuuuuuuuuuagggg

SEQ ID NO: 205923 - RNA, 22 nt, Human
auaaagcaauaaauaagccccc

SEQ ID NO: 205924 - RNA, 24 nt, Human
caauaaauaagcccccgugugagu

SEQ ID NO: 205925 - RNA, 18 nt, Human
ccgugugagucugggggg

SEQ ID NO: 205926 - RNA, 18 nt, Human
gccgcggcggggaaagca

SEQ ID NO: 205927 - RNA, 20 nt, Human
ggauggguagaaaauggggg

SEQ ID NO: 205928 - RNA, 20 nt, Human
ggauggguagaaaauggggg

SEQ ID NO: 205929 - RNA, 19 nt, Human
ggcgaggagagcgcgagcc

SEQ ID NO: 205930 - RNA, 21 nt, Human
gggaaagcacaggaggcgagg

SEQ ID NO: 205931 - RNA, 18 nt, Human
ggggauggguagaaaaug

SEQ ID NO: 205932 - RNA, 20 nt, Human
ggggauggguagaaaauggg

SEQ ID NO: 205933 - RNA, 22 nt, Human
uaaaugaauaaguaaauaaaua

SEQ ID NO: 205934 - RNA, 24 nt, Human
ugaauaaguaaauaaauaaagcaa

SEQ ID NO: 205935 - RNA, 20 nt, Human
aaaaccugcaauggaaaaau

SEQ ID NO: 205936 - RNA, 21 nt, Human
aaacaaacauacugacugaau

SEQ ID NO: 205937 - RNA, 24 nt, Human
aaacaaacauacugacugaaucuu

SEQ ID NO: 205938 - RNA, 22 nt, Human
aaacugccacucagcagcggcc

SEQ ID NO: 205939 - RNA, 21 nt, Human
aaagccaacuuacucucccaa

SEQ ID NO: 205940 - RNA, 22 nt, Human
aaagccaacuuacucucccaaa

SEQ ID NO: 205941 - RNA, 20 nt, Human
aacacagaaaacaagaguuc

SEQ ID NO: 205942 - RNA, 20 nt, Human
aacuuacucucccaaacuug

SEQ ID NO: 205943 - RNA, 19 nt, Human
aagcacuucuuggaucaaa

SEQ ID NO: 205944 - RNA, 24 nt, Human
aagcacuucuuggaucaaaagaaa

SEQ ID NO: 205945 - RNA, 21 nt, Human
aaggagcagcucgugaagggg

SEQ ID NO: 205946 - RNA, 24 nt, Human
aagggguggcaggugcgcugcugc

SEQ ID NO: 205947 - RNA, 28 nt, Human
aaugacauaaaacgauuaagaaaauccc

SEQ ID NO: 205948 - RNA, 21 nt, Human
acaagaguucugagacuggca

SEQ ID NO: 205949 - RNA, 18 nt, Human
acagaacacagaaaacaa

SEQ ID NO: 205950 - RNA, 21 nt, Human
acagaacacagaaaacaagag

SEQ ID NO: 205951 - RNA, 24 nt, Human
acagaacacagaaaacaagaguuc

SEQ ID NO: 205952 - RNA, 25 nt, Human
accccgcgaccucuucuguaaacug

SEQ ID NO: 205953 - RNA, 19 nt, Human
accgcugauaagaaggggu

SEQ ID NO: 205954 - RNA, 19 nt, Human
acgcacagggcaggcauuc

SEQ ID NO: 205955 - RNA, 22 nt, Human
acucaaagccaacuuacucucc

SEQ ID NO: 205956 - RNA, 23 nt, Human
agaagucaaucacuuaccaaauc

SEQ ID NO: 205957 - RNA, 22 nt, Human
agcacuuugggauuacaggcgu

SEQ ID NO: 205958 - RNA, 22 nt, Human
agccuuuaccucauuaaccuga

SEQ ID NO: 205959 - RNA, 23 nt, Human
agcgucucaccucuuaaagcuuc

SEQ ID NO: 205960 - RNA, 23 nt, Human
agugggggacagaaauaaagagg

SEQ ID NO: 205961 - RNA, 24 nt, Human
aucuuggcugggcgugguggcuca

SEQ ID NO: 205962 - RNA, 25 nt, Human
augagaaucaaaucccaaauaaacg

SEQ ID NO: 205963 - RNA, 21 nt, Human
auggaacuaaaaagaagucaa

SEQ ID NO: 205964 - RNA, 21 nt, Human
caaagcauccuaugaggaagu

SEQ ID NO: 205965 - RNA, 30 nt, Human
caaaugucugcccauuuuuguguagcuuuu

SEQ ID NO: 205966 - RNA, 24 nt, Human
caacuuacucucccaaacuugcaa

SEQ ID NO: 205967 - RNA, 22 nt, Human
caagcauugagcuaggaauacc

SEQ ID NO: 205968 - RNA, 24 nt, Human
caaucaaugaacccguaagccucu

SEQ ID NO: 205969 - RNA, 22 nt, Human
cacaacaccccugugagguagg

SEQ ID NO: 205970 - RNA, 20 nt, Human
caccccugugagguaggugg

SEQ ID NO: 205971 - RNA, 22 nt, Human
cacgcacagggcaggcauucag

SEQ ID NO: 205972 - RNA, 21 nt, Human
cacugacaacaggagcugaga

SEQ ID NO: 205973 - RNA, 20 nt, Human
cagaguggugcucuggcccc

SEQ ID NO: 205974 - RNA, 20 nt, Human
caguggcguguggccucggu

SEQ ID NO: 205975 - RNA, 21 nt, Human
ccaaucaaugaacccguaagc

SEQ ID NO: 205976 - RNA, 24 nt, Human
ccagcacuuugggauuacaggcgu

SEQ ID NO: 205977 - RNA, 22 nt, Human
ccagggccaugguccccuuggc

SEQ ID NO: 205978 - RNA, 21 nt, Human
ccaugguccccuuggccuggg

SEQ ID NO: 205979 - RNA, 23 nt, Human
ccaugguccccuuggccuggggc

SEQ ID NO: 205980 - RNA, 20 nt, Human
cccccgggggaaagccagcc

SEQ ID NO: 205981 - RNA, 21 nt, Human
ccccgcgccgacgccgccuuc

SEQ ID NO: 205982 - RNA, 23 nt, Human
ccccgggggaaagccagccaggg

SEQ ID NO: 205983 - RNA, 18 nt, Human
ccucugcagcaguggccc

SEQ ID NO: 205984 - RNA, 25 nt, Human
ccucugcagcaguggcccagagagu

SEQ ID NO: 205985 - RNA, 22 nt, Human
ccuugauucggcauaaggacag

SEQ ID NO: 205986 - RNA, 23 nt, Human
ccuuuacuuacacucuggccucc

SEQ ID NO: 205987 - RNA, 18 nt, Human
cgccgacgccgccuucac

SEQ ID NO: 205988 - RNA, 23 nt, Human
cgcgugguggggcagcagagugg

SEQ ID NO: 205989 - RNA, 20 nt, Human
cggaaagguuuaguggcucc

SEQ ID NO: 205990 - RNA, 25 nt, Human
cgugguggggcagcagaguggugcu

SEQ ID NO: 205991 - RNA, 23 nt, Human
cuagaacaccaagcauugagcua

SEQ ID NO: 205992 - RNA, 21 nt, Human
cucacgcugcaaucccagcac

SEQ ID NO: 205993 - RNA, 23 nt, Human
cucacgcugcaaucccagcacuu

SEQ ID NO: 205994 - RNA, 22 nt, Human
cucccaaacuugcaaaacaaac

SEQ ID NO: 205995 - RNA, 20 nt, Human
cucuucuguaaacugccacu

SEQ ID NO: 205996 - RNA, 18 nt, Human
cugcagcaguggcccaga

SEQ ID NO: 205997 - RNA, 19 nt, Human
cugcugccuuguuuucugu

SEQ ID NO: 205998 - RNA, 22 nt, Human
cugcuuggauuuguaguuguau

SEQ ID NO: 205999 - RNA, 21 nt, Human
cuguaaacugccacucagcag

SEQ ID NO: 206000 - RNA, 20 nt, Human
cuuggcagcaaauacccaga

SEQ ID NO: 206001 - RNA, 22 nt, Human
gaaagguuguaaaugcauuuuu

SEQ ID NO: 206002 - RNA, 22 nt, Human
gacauuguucuucucaguccuc

SEQ ID NO: 206003 - RNA, 22 nt, Human
gagacccccgggggaaagccag

SEQ ID NO: 206004 - RNA, 19 nt, Human
gagcugagacccccggggg

SEQ ID NO: 206005 - RNA, 20 nt, Human
gagggcgcuguggaauauug

SEQ ID NO: 206006 - RNA, 20 nt, Human
gaguugauaaaaugcuuuuc

SEQ ID NO: 206007 - RNA, 20 nt, Human
gaugucgcucccacaucuga

SEQ ID NO: 206008 - RNA, 20 nt, Human
gcaaaacaaacauacugacu

SEQ ID NO: 206009 - RNA, 21 nt, Human
gcagaguggugcucuggcccc

SEQ ID NO: 206010 - RNA, 19 nt, Human
gcauugaaauugagaauau

SEQ ID NO: 206011 - RNA, 18 nt, Human
gccaugguccccuuggcc

SEQ ID NO: 206012 - RNA, 18 nt, Human
gccuuggcagcaaauacc

SEQ ID NO: 206013 - RNA, 21 nt, Human
gcucaaggagcagcucgugaa

SEQ ID NO: 206014 - RNA, 18 nt, Human
gcugccucugcugcagau

SEQ ID NO: 206015 - RNA, 19 nt, Human
gcugccucugcugcagaug

SEQ ID NO: 206016 - RNA, 21 nt, Human
gcugggcgugguggcucacgc

SEQ ID NO: 206017 - RNA, 19 nt, Human
ggaucaaaagaaacugaug

SEQ ID NO: 206018 - RNA, 25 nt, Human
ggaugaauaaagccuacuuuuuagg

SEQ ID NO: 206019 - RNA, 18 nt, Human
ggccuuggguccucaggc

SEQ ID NO: 206020 - RNA, 20 nt, Human
ggcucacgcugcaaucccag

SEQ ID NO: 206021 - RNA, 21 nt, Human
ggcugggcgugguggcucacg

SEQ ID NO: 206022 - RNA, 19 nt, Human
gggcagcagaguggugcuc

SEQ ID NO: 206023 - RNA, 20 nt, Human
gggcaguggcguguggccuc

SEQ ID NO: 206024 - RNA, 25 nt, Human
gggccaugguccccuuggccugggg

SEQ ID NO: 206025 - RNA, 23 nt, Human
gguggcucacgcugcaaucccag

SEQ ID NO: 206026 - RNA, 19 nt, Human
ggugggcaagcccaacuac

SEQ ID NO: 206027 - RNA, 23 nt, Human
guccuuaaggaguucaucuuggc

SEQ ID NO: 206028 - RNA, 26 nt, Human
guggaauauugcugugauuugccccc

SEQ ID NO: 206029 - RNA, 23 nt, Human
guggcucacgcugcaaucccagc

SEQ ID NO: 206030 - RNA, 21 nt, Human
guggggguacuccuaagcagc

SEQ ID NO: 206031 - RNA, 19 nt, Human
uaaaaugagaaucaaaucc

SEQ ID NO: 206032 - RNA, 20 nt, Human
uaaaucgagaaaauugguga

SEQ ID NO: 206033 - RNA, 19 nt, Human
uaaaugaacagaagggaug

SEQ ID NO: 206034 - RNA, 18 nt, Human
uaaccugauucuccacgg

SEQ ID NO: 206035 - RNA, 18 nt, Human
uaauuuugagaacagaac

SEQ ID NO: 206036 - RNA, 23 nt, Human
uaccccuuucugcuguggagugu

SEQ ID NO: 206037 - RNA, 22 nt, Human
uacuugcugcaggauaaaaguu

SEQ ID NO: 206038 - RNA, 21 nt, Human
uaggugguauugaccccauuc

SEQ ID NO: 206039 - RNA, 25 nt, Human
ucaaucacuuaccaaauccuguccu

SEQ ID NO: 206040 - RNA, 21 nt, Human
ucacacuucuucagugccacc

SEQ ID NO: 206041 - RNA, 18 nt, Human
ucaccggggccacugccc

SEQ ID NO: 206042 - RNA, 24 nt, Human
ucacgcugcaaucccagcacuuug

SEQ ID NO: 206043 - RNA, 23 nt, Human
ucacugacaacaggagcugagac

SEQ ID NO: 206044 - RNA, 23 nt, Human
ucaguaucugugaaugaaaaucc

SEQ ID NO: 206045 - RNA, 21 nt, Human
ucagugccaccgcaacacugc

SEQ ID NO: 206046 - RNA, 24 nt, Human
ucagugccaccgcaacacugcaug

SEQ ID NO: 206047 - RNA, 24 nt, Human
uccacgggcccugccacugcuaaa

SEQ ID NO: 206048 - RNA, 21 nt, Human
ucccaaacuugcaaaacaaac

SEQ ID NO: 206049 - RNA, 24 nt, Human
ucccagcacuuugggauuacaggc

SEQ ID NO: 206050 - RNA, 25 nt, Human
ucccagcacuuugggauuacaggcg

SEQ ID NO: 206051 - RNA, 18 nt, Human
ucucccagcgaguccugg

SEQ ID NO: 206052 - RNA, 18 nt, Human
ucugcccauuuuugugua

SEQ ID NO: 206053 - RNA, 24 nt, Human
ucugcuguggaguguugcugagga

SEQ ID NO: 206054 - RNA, 19 nt, Human
ucuucuguaaacugccacu

SEQ ID NO: 206055 - RNA, 21 nt, Human
ugaagggguggcaggugcgcu

SEQ ID NO: 206056 - RNA, 24 nt, Human
ugaccgcuuggucuugagugacau

SEQ ID NO: 206057 - RNA, 18 nt, Human
ugagaauauaagcuaugg

SEQ ID NO: 206058 - RNA, 23 nt, Human
ugcaaaacaaacauacugacuga

SEQ ID NO: 206059 - RNA, 21 nt, Human
ugccaaaccacuacaaaagca

SEQ ID NO: 206060 - RNA, 25 nt, Human
uggaaaacaguuugaaaugacauga

SEQ ID NO: 206061 - RNA, 22 nt, Human
uggcaggaucucacgcugaggc

SEQ ID NO: 206062 - RNA, 21 nt, Human
uggcauugaaauugagaauau

SEQ ID NO: 206063 - RNA, 21 nt, Human
uggcucacgcugcaaucccag

SEQ ID NO: 206064 - RNA, 23 nt, Human
uggcucacgcugcaaucccagca

SEQ ID NO: 206065 - RNA, 19 nt, Human
uggcugggcgugguggcuc

SEQ ID NO: 206066 - RNA, 23 nt, Human
uggcugggcgugguggcucacgc

SEQ ID NO: 206067 - RNA, 20 nt, Human
ugggauaggcugccucugcu

SEQ ID NO: 206068 - RNA, 18 nt, Human
ugggauuacaggcgugcc

SEQ ID NO: 206069 - RNA, 19 nt, Human
ugggauuacaggcgugccc

SEQ ID NO: 206070 - RNA, 20 nt, Human
ugggauuacaggcgugcccg

SEQ ID NO: 206071 - RNA, 23 nt, Human
ugggauuacaggcgugcccggcc

SEQ ID NO: 206072 - RNA, 25 nt, Human
ugggauuacaggcgugcccggccgu

SEQ ID NO: 206073 - RNA, 24 nt, Human
uggggccuuggguccucaggccuu

SEQ ID NO: 206074 - RNA, 23 nt, Human
ugguggcucacgcugcaauccca

SEQ ID NO: 206075 - RNA, 21 nt, Human
ugguuuaggaacauuuucccc

SEQ ID NO: 206076 - RNA, 19 nt, Human
uuaggaacauuuuccccgg

SEQ ID NO: 206077 - RNA, 19 nt, Human
uuaguggcuccucacaggc

SEQ ID NO: 206078 - RNA, 21 nt, Human
uucagugccaccgcaacacug

SEQ ID NO: 206079 - RNA, 18 nt, Human
uucaucuuggcugggcgu

SEQ ID NO: 206080 - RNA, 21 nt, Human
uuccagaagagugacuaauga

SEQ ID NO: 206081 - RNA, 19 nt, Human
uucucaguccucacaacac

SEQ ID NO: 206082 - RNA, 26 nt, Human
uucucaguccucacaacacccccuuu

SEQ ID NO: 206083 - RNA, 22 nt, Human
uuggcugggcgugguggcucac

SEQ ID NO: 206084 - RNA, 23 nt, Human
uuggucuugagugacauuccaga

SEQ ID NO: 206085 - RNA, 21 nt, Human
uuggugauguggccuuggcag

SEQ ID NO: 206086 - RNA, 18 nt, Human
uuguauaugcucaaaucc

SEQ ID NO: 206087 - RNA, 23 nt, Human
uuuuugagagucaaucugcuugg

SEQ ID NO: 206088 - RNA, 19 nt, Human
aaaaagaaaauugagggca

SEQ ID NO: 206089 - RNA, 18 nt, Human
aaauguguuuguuuuacu

SEQ ID NO: 206090 - RNA, 20 nt, Human
aaauguguuuguuuuacugg

SEQ ID NO: 206091 - RNA, 19 nt, Human
acagaaaccugcaaacaac

SEQ ID NO: 206092 - RNA, 20 nt, Human
accaugaaaacauagauaau

SEQ ID NO: 206093 - RNA, 19 nt, Human
accccaccccacacacaga

SEQ ID NO: 206094 - RNA, 23 nt, Human
agaaaccugcaaacaacucaggg

SEQ ID NO: 206095 - RNA, 25 nt, Human
agaauaccuaguggccucuggcucc

SEQ ID NO: 206096 - RNA, 25 nt, Human
agacaggaaguagagaaaagggacc

SEQ ID NO: 206097 - RNA, 24 nt, Human
auauguguguauauauguaugcau

SEQ ID NO: 206098 - RNA, 23 nt, Human
aucuaaagucuugguaaaauggu

SEQ ID NO: 206099 - RNA, 20 nt, Human
auggggaccauuuugaccug

SEQ ID NO: 206100 - RNA, 18 nt, Human
auguacuaauguacaguu

SEQ ID NO: 206101 - RNA, 23 nt, Human
caaacaacucagggaacaccugu

SEQ ID NO: 206102 - RNA, 23 nt, Human
caacccuggaauuccacccaggu

SEQ ID NO: 206103 - RNA, 18 nt, Human
caaccuauaguaacugca

SEQ ID NO: 206104 - RNA, 20 nt, Human
cacacacagaaaccugcaaa

SEQ ID NO: 206105 - RNA, 19 nt, Human
cacagaaaccugcaaacaa

SEQ ID NO: 206106 - RNA, 20 nt, Human
cacagaaaccugcaaacaac

SEQ ID NO: 206107 - RNA, 18 nt, Human
cagacucuccgugguccc

SEQ ID NO: 206108 - RNA, 19 nt, Human
caggcugauggggaccauu

SEQ ID NO: 206109 - RNA, 19 nt, Human
cauuuuucuuguaaaugug

SEQ ID NO: 206110 - RNA, 23 nt, Human
ccagauugaacaaaacaccagca

SEQ ID NO: 206111 - RNA, 22 nt, Human
ccaggccaggugggccaccaug

SEQ ID NO: 206112 - RNA, 24 nt, Human
cccacacacagaaaccugcaaaca

SEQ ID NO: 206113 - RNA, 21 nt, Human
cccaccccacacacagaaacc

SEQ ID NO: 206114 - RNA, 25 nt, Human
cccaccccacacacagaaaccugca

SEQ ID NO: 206115 - RNA, 18 nt, Human
ccccaccccacacacaga

SEQ ID NO: 206116 - RNA, 23 nt, Human
ccccauaccccaccccacacaca

SEQ ID NO: 206117 - RNA, 21 nt, Human
ccuccccauaccccaccccac

SEQ ID NO: 206118 - RNA, 20 nt, Human
cggacagaugcugguccuug

SEQ ID NO: 206119 - RNA, 21 nt, Human
cuaaacuuguaauuaauagca

SEQ ID NO: 206120 - RNA, 21 nt, Human
cucggcaguaccaaggcaguc

SEQ ID NO: 206121 - RNA, 19 nt, Human
cuguacuguacacauccag

SEQ ID NO: 206122 - RNA, 24 nt, Human
cuugguaaaauggucaacuggggu

SEQ ID NO: 206123 - RNA, 20 nt, Human
gagcaagaauaccuaguggc

SEQ ID NO: 206124 - RNA, 19 nt, Human
gaggugucccaugcuuggg

SEQ ID NO: 206125 - RNA, 18 nt, Human
gcaguaccaaggcagucu

SEQ ID NO: 206126 - RNA, 21 nt, Human
ggagacagggauuccacuccc

SEQ ID NO: 206127 - RNA, 20 nt, Human
ggagucucucaacccuggaa

SEQ ID NO: 206128 - RNA, 22 nt, Human
gucaagcccagaggcaccaugg

SEQ ID NO: 206129 - RNA, 23 nt, Human
uaaaauagcuccagcuuugaagc

SEQ ID NO: 206130 - RNA, 19 nt, Human
uaaaauggucaacuggggu

SEQ ID NO: 206131 - RNA, 22 nt, Human
uaacugcagcuuucaggcuaaa

SEQ ID NO: 206132 - RNA, 20 nt, Human
uaacugcagcuuucaggcuc

SEQ ID NO: 206133 - RNA, 21 nt, Human
uaccccaccccacacacagaa

SEQ ID NO: 206134 - RNA, 19 nt, Human
uauacauauguguguauau

SEQ ID NO: 206135 - RNA, 21 nt, Human
uauacauauguguguauauau

SEQ ID NO: 206136 - RNA, 26 nt, Human
uauauacauauguguguauauaugua

SEQ ID NO: 206137 - RNA, 22 nt, Human
uauauguaugcauagauauaua

SEQ ID NO: 206138 - RNA, 22 nt, Human
uauguguguauauauguaugca

SEQ ID NO: 206139 - RNA, 23 nt, Human
uauucugcucuaccccaugagaa

SEQ ID NO: 206140 - RNA, 23 nt, Human
ucuaaagucuugguaaaaugguc

SEQ ID NO: 206141 - RNA, 19 nt, Human
ucuacaaaaagaacuaaac

SEQ ID NO: 206142 - RNA, 23 nt, Human
ucuggcucaggggagucucucaa

SEQ ID NO: 206143 - RNA, 24 nt, Human
ucuuugccuucuuacuacuguuaa

SEQ ID NO: 206144 - RNA, 21 nt, Human
ugaacaaaacaccagcagaag

SEQ ID NO: 206145 - RNA, 21 nt, Human
ugaaggagaguacugaguaug

SEQ ID NO: 206146 - RNA, 19 nt, Human
ugauacagucauucuucca

SEQ ID NO: 206147 - RNA, 22 nt, Human
ugcagacaggaaguagagaaaa

SEQ ID NO: 206148 - RNA, 18 nt, Human
ugcuaggagcagaugugg

SEQ ID NO: 206149 - RNA, 20 nt, Human
ugcuucagaagccuugggca

SEQ ID NO: 206150 - RNA, 24 nt, Human
ugcuucaugccugggugccagagu

SEQ ID NO: 206151 - RNA, 19 nt, Human
ugcuugggaugaggaugug

SEQ ID NO: 206152 - RNA, 19 nt, Human
uggacaaccaggccaggug

SEQ ID NO: 206153 - RNA, 19 nt, Human
uggcccauuaaagaugauu

SEQ ID NO: 206154 - RNA, 19 nt, Human
uggccucuggcucagggga

SEQ ID NO: 206155 - RNA, 21 nt, Human
uggcucaggggagucucucaa

SEQ ID NO: 206156 - RNA, 18 nt, Human
uggcugcucauuugcuuu

SEQ ID NO: 206157 - RNA, 24 nt, Human
ugggcuuucuccaaagcugguugc

SEQ ID NO: 206158 - RNA, 24 nt, Human
uguacacauccagcauuacacaug

SEQ ID NO: 206159 - RNA, 20 nt, Human
uguguauauauguaugcaua

SEQ ID NO: 206160 - RNA, 20 nt, Human
uguguauauauguaugcaua

SEQ ID NO: 206161 - RNA, 21 nt, Human
uguguauauauguaugcauag

SEQ ID NO: 206162 - RNA, 22 nt, Human
uguguauauauguaugcauaga

SEQ ID NO: 206163 - RNA, 18 nt, Human
uguguguauauauguaug

SEQ ID NO: 206164 - RNA, 22 nt, Human
uguuaaaaucucuuugauaagu

SEQ ID NO: 206165 - RNA, 22 nt, Human
uuaaaacuggauuugauuucac

SEQ ID NO: 206166 - RNA, 21 nt, Human
uuauauacauauguguguaua

SEQ ID NO: 206167 - RNA, 20 nt, Human
uuccuaccacuaacuugaac

SEQ ID NO: 206168 - RNA, 21 nt, Human
uugugcccugacacauaugug

SEQ ID NO: 206169 - RNA, 20 nt, Human
uuuccaggcugugugguuuu

SEQ ID NO: 206170 - RNA, 22 nt, Human
uuuuacuggcugaugcacugcu

SEQ ID NO: 206171 - RNA, 21 nt, Human
aaaaaaacagccccacagaac

SEQ ID NO: 206172 - RNA, 22 nt, Human
aaaaaaacagccccacagaacu

SEQ ID NO: 206173 - RNA, 21 nt, Human
aaaaaaaugagguggaagccc

SEQ ID NO: 206174 - RNA, 22 nt, Human
aaaaaacagccccacagaacua

SEQ ID NO: 206175 - RNA, 22 nt, Human
aacaaaaaaacagccccacaga

SEQ ID NO: 206176 - RNA, 22 nt, Human
aagcagauacggaaaauggaac

SEQ ID NO: 206177 - RNA, 19 nt, Human
aagcccgaagcagauacgg

SEQ ID NO: 206178 - RNA, 22 nt, Human
acaauacaaagcaauuuccuca

SEQ ID NO: 206179 - RNA, 22 nt, Human
agaaugggcaaagcgaaaaaaa

SEQ ID NO: 206180 - RNA, 18 nt, Human
agauacggaaaauggaac

SEQ ID NO: 206181 - RNA, 19 nt, Human
caaaaaaacagccccacag

SEQ ID NO: 206182 - RNA, 22 nt, Human
caaaaaaacagccccacagaac

SEQ ID NO: 206183 - RNA, 24 nt, Human
caaaaaaacagccccacagaacua

SEQ ID NO: 206184 - RNA, 21 nt, Human
cacgaguggaaucccaccccc

SEQ ID NO: 206185 - RNA, 22 nt, Human
cacguaauuccucuugcccccu

SEQ ID NO: 206186 - RNA, 27 nt, Human
cagccccacagaacuauuguaaaacaa

SEQ ID NO: 206187 - RNA, 21 nt, Human
ccaggcuggaugcaguuaagg

SEQ ID NO: 206188 - RNA, 19 nt, Human
ccccuggauggcugggguc

SEQ ID NO: 206189 - RNA, 19 nt, Human
cccuaaagucucuggugac

SEQ ID NO: 206190 - RNA, 24 nt, Human
ccucagaaaucugagaagcaccaa

SEQ ID NO: 206191 - RNA, 24 nt, Human
ccucagccucagccccaggcugga

SEQ ID NO: 206192 - RNA, 24 nt, Human
ccucgccagugccucagccucagc

SEQ ID NO: 206193 - RNA, 24 nt, Human
cgccagugccucagccucagcccc

SEQ ID NO: 206194 - RNA, 24 nt, Human
cgcccucuccucgccagugccuca

SEQ ID NO: 206195 - RNA, 24 nt, Human
cucagccucagccccaggcuggau

SEQ ID NO: 206196 - RNA, 20 nt, Human
cucgccagugccucagccuc

SEQ ID NO: 206197 - RNA, 21 nt, Human
cugggguccgccggucccugg

SEQ ID NO: 206198 - RNA, 19 nt, Human
gaucggucuuguucucccu

SEQ ID NO: 206199 - RNA, 18 nt, Human
gccccaggcuggaugcag

SEQ ID NO: 206200 - RNA, 19 nt, Human
gcccgaagcagauacggaa

SEQ ID NO: 206201 - RNA, 18 nt, Human
gccucagccucagcccca

SEQ ID NO: 206202 - RNA, 21 nt, Human
gccucagccucagccccaggc

SEQ ID NO: 206203 - RNA, 21 nt, Human
gggagacccacagagcacgua

SEQ ID NO: 206204 - RNA, 23 nt, Human
uaacaaaaaaacagccccacaga

SEQ ID NO: 206205 - RNA, 26 nt, Human
uaacaaaaaaacagccccacagaacu

SEQ ID NO: 206206 - RNA, 24 nt, Human
uccucgccagugccucagccucag

SEQ ID NO: 206207 - RNA, 21 nt, Human
ugagaagcaccaaacgugacc

SEQ ID NO: 206208 - RNA, 24 nt, Human
uggaaucccacccccuaaagucuc

SEQ ID NO: 206209 - RNA, 20 nt, Human
uggcugaaacagaaugggca

SEQ ID NO: 206210 - RNA, 20 nt, Human
uucaaaaaauagaaacacac

SEQ ID NO: 206211 - RNA, 18 nt, Human
ccauucaacuuguccucc

SEQ ID NO: 206212 - RNA, 19 nt, Human
ccauucaacuuguccuccu

SEQ ID NO: 206213 - RNA, 18 nt, Human
cccugaagcucaggccgc

SEQ ID NO: 206214 - RNA, 20 nt, Human
gagcuggcugcccugaagcu

SEQ ID NO: 206215 - RNA, 23 nt, Human
ggaaggcgagaccgggagggagc

SEQ ID NO: 206216 - RNA, 20 nt, Human
uaaaagaaaucaugaacacc

SEQ ID NO: 206217 - RNA, 24 nt, Human
ugccgccugcugagcuagcugcgc

SEQ ID NO: 206218 - RNA, 23 nt, Human
ugcgcuuggcaccgggcucggcu

SEQ ID NO: 206219 - RNA, 19 nt, Human
uuuguuguuguuguuguug

SEQ ID NO: 206220 - RNA, 21 nt, Human
aaagaaaaccaaaagaagucc

SEQ ID NO: 206221 - RNA, 21 nt, Human
aacuccgcgccccacgcugcc

SEQ ID NO: 206222 - RNA, 18 nt, Human
aagaccgcggagccgcgg

SEQ ID NO: 206223 - RNA, 19 nt, Human
aaggagaccagaagaccag

SEQ ID NO: 206224 - RNA, 21 nt, Human
acagaaccuuucuccaaggag

SEQ ID NO: 206225 - RNA, 24 nt, Human
acagaaccuuucuccaaggagacc

SEQ ID NO: 206226 - RNA, 22 nt, Human
agaaaaccaaaagaagucccgc

SEQ ID NO: 206227 - RNA, 19 nt, Human
agaaagaaaaccaaaagaa

SEQ ID NO: 206228 - RNA, 23 nt, Human
agaaagucaccuuccuguaaaaa

SEQ ID NO: 206229 - RNA, 22 nt, Human
agaccagaagaccagcucugcc

SEQ ID NO: 206230 - RNA, 18 nt, Human
agcaccugcguucugggc

SEQ ID NO: 206231 - RNA, 24 nt, Human
aggagaccagaagaccagcucugc

SEQ ID NO: 206232 - RNA, 23 nt, Human
aggcacgccucuuuauucaaaau

SEQ ID NO: 206233 - RNA, 20 nt, Human
agggggcugccgaagacagc

SEQ ID NO: 206234 - RNA, 19 nt, Human
aggugccccaaagagaaag

SEQ ID NO: 206235 - RNA, 22 nt, Human
auggcccgccucggcccugccc

SEQ ID NO: 206236 - RNA, 19 nt, Human
auguuaacuuuuauaaaaa

SEQ ID NO: 206237 - RNA, 25 nt, Human
caaacaggcuuccuccggcuggucu

SEQ ID NO: 206238 - RNA, 25 nt, Human
caacagaaccuuucuccaaggagac

SEQ ID NO: 206239 - RNA, 24 nt, Human
caccuccacgcucugaagagaccu

SEQ ID NO: 206240 - RNA, 22 nt, Human
caggacuugccguuuaaaccuc

SEQ ID NO: 206241 - RNA, 18 nt, Human
cauggaaacugacucugc

SEQ ID NO: 206242 - RNA, 22 nt, Human
ccaaagagaaagaaaaccaaaa

SEQ ID NO: 206243 - RNA, 22 nt, Human
ccaaagagaaagaaaaccaaaa

SEQ ID NO: 206244 - RNA, 20 nt, Human
ccacugcgggagggcagggc

SEQ ID NO: 206245 - RNA, 18 nt, Human
ccagacccucggccacug

SEQ ID NO: 206246 - RNA, 20 nt, Human
cccacgcugcccccacccag

SEQ ID NO: 206247 - RNA, 21 nt, Human
ccccacccaguuggcgccaaa

SEQ ID NO: 206248 - RNA, 22 nt, Human
ccccacccaguuggcgccaaaa

SEQ ID NO: 206249 - RNA, 20 nt, Human
ccucuccgccagcaaggauu

SEQ ID NO: 206250 - RNA, 21 nt, Human
ccugcccccgccggcccuggg

SEQ ID NO: 206251 - RNA, 23 nt, Human
cgaaguuggggcccaucccugcc

SEQ ID NO: 206252 - RNA, 20 nt, Human
cgcgcgcacgcucgccgcgg

SEQ ID NO: 206253 - RNA, 22 nt, Human
cggcgccagggaggaaacuugg

SEQ ID NO: 206254 - RNA, 21 nt, Human
cuccaaggagaccagaagacc

SEQ ID NO: 206255 - RNA, 20 nt, Human
cuccgcgccccacgcugccc

SEQ ID NO: 206256 - RNA, 21 nt, Human
cucggcccugcccccgccggc

SEQ ID NO: 206257 - RNA, 19 nt, Human
cuuauagagccugccugga

SEQ ID NO: 206258 - RNA, 23 nt, Human
cuuccacaccuccacgcucugaa

SEQ ID NO: 206259 - RNA, 24 nt, Human
cuugccguuuaaaccucccucucc

SEQ ID NO: 206260 - RNA, 18 nt, Human
gaacuuggggguggggug

SEQ ID NO: 206261 - RNA, 18 nt, Human
gaacuuggggguggggug

SEQ ID NO: 206262 - RNA, 21 nt, Human
gaagagaccuuagaacuuggg

SEQ ID NO: 206263 - RNA, 21 nt, Human
gacgccgaagaccgcggagcc

SEQ ID NO: 206264 - RNA, 19 nt, Human
gacuugccguuuaaaccuc

SEQ ID NO: 206265 - RNA, 20 nt, Human
gagaaagaaaaccaaaagaa

SEQ ID NO: 206266 - RNA, 20 nt, Human
gaggugccccaaagagaaag

SEQ ID NO: 206267 - RNA, 28 nt, Human
gcaacagaaccuuucuccaaggagacca

SEQ ID NO: 206268 - RNA, 19 nt, Human
gcccaucccugccguccgg

SEQ ID NO: 206269 - RNA, 22 nt, Human
gccgaagacagcucccuauaca

SEQ ID NO: 206270 - RNA, 18 nt, Human
gcgcgcacgcucgccgcg

SEQ ID NO: 206271 - RNA, 25 nt, Human
ggcgccaaagaccacaggcggagcu

SEQ ID NO: 206272 - RNA, 19 nt, Human
gggaggaaagaagaccaag

SEQ ID NO: 206273 - RNA, 19 nt, Human
gggcgggggaggaaagaag

SEQ ID NO: 206274 - RNA, 22 nt, Human
ggggcccaucccugccguccgg

SEQ ID NO: 206275 - RNA, 20 nt, Human
gggguggggugggagcaggg

SEQ ID NO: 206276 - RNA, 22 nt, Human
uaaauugcaaacaggcuuccuc

SEQ ID NO: 206277 - RNA, 22 nt, Human
uauuauagaguucauaaaucag

SEQ ID NO: 206278 - RNA, 24 nt, Human
uauuauagaguucauaaaucaggg

SEQ ID NO: 206279 - RNA, 21 nt, Human
ucacucaaaaccauuaacuuc

SEQ ID NO: 206280 - RNA, 18 nt, Human
ucacuugucccucucugg

SEQ ID NO: 206281 - RNA, 22 nt, Human
uccaagagaggagauacucacc

SEQ ID NO: 206282 - RNA, 21 nt, Human
uccaaggagaccagaagacca

SEQ ID NO: 206283 - RNA, 22 nt, Human
uccaggaagggauuuggugaag

SEQ ID NO: 206284 - RNA, 26 nt, Human
uccggcaggagagguucccggggucc

SEQ ID NO: 206285 - RNA, 23 nt, Human
uccugagcaccagguuuagucuc

SEQ ID NO: 206286 - RNA, 21 nt, Human
ucggcccugcccccgccggcc

SEQ ID NO: 206287 - RNA, 23 nt, Human
ucuccaaggagaccagaagacca

SEQ ID NO: 206288 - RNA, 24 nt, Human
ugcacaucacauggaaacugacuc

SEQ ID NO: 206289 - RNA, 22 nt, Human
ugccagacccucggccacugcg

SEQ ID NO: 206290 - RNA, 25 nt, Human
uggccagagcuagcucuggcucuuc

SEQ ID NO: 206291 - RNA, 23 nt, Human
ugggcagggcgaaguuggggccc

SEQ ID NO: 206292 - RNA, 18 nt, Human
ugucaggacacggccgag

SEQ ID NO: 206293 - RNA, 19 nt, Human
ugucuacuuugccagaccc

SEQ ID NO: 206294 - RNA, 18 nt, Human
uucaaaacgucugccaac

SEQ ID NO: 206295 - RNA, 23 nt, Human
uuccuggcagcaccccagaucuu

SEQ ID NO: 206296 - RNA, 21 nt, Human
uucugggcgggggaggaaaga

SEQ ID NO: 206297 - RNA, 18 nt, Human
uuggggguggggugggag

SEQ ID NO: 206298 - RNA, 19 nt, Human
uuuccuggcagcaccccag

SEQ ID NO: 206299 - RNA, 19 nt, Human
uuugccagacccucggcca

SEQ ID NO: 206300 - RNA, 21 nt, Human
uuugccagacccucggccacu

SEQ ID NO: 206301 - RNA, 22 nt, Human
aaaaaaaaaauaucuacaaugc

SEQ ID NO: 206302 - RNA, 19 nt, Human
aaaaaaaacacacacauaa

SEQ ID NO: 206303 - RNA, 19 nt, Human
aaaaaaaagcaaaagcacc

SEQ ID NO: 206304 - RNA, 24 nt, Human
aaaaaaaagcaaaagcaccggaag

SEQ ID NO: 206305 - RNA, 25 nt, Human
aaaaaaacacacacauaauauuuac

SEQ ID NO: 206306 - RNA, 26 nt, Human
aaaaaagcaaaagcaccggaagaaaa

SEQ ID NO: 206307 - RNA, 19 nt, Human
aaaaagcaaaagcaccgga

SEQ ID NO: 206308 - RNA, 22 nt, Human
aaagaaauauucccauagauua

SEQ ID NO: 206309 - RNA, 18 nt, Human
aaaggaaaaaaaaagcaa

SEQ ID NO: 206310 - RNA, 21 nt, Human
aaaggaaaaaaaaagcaaaag

SEQ ID NO: 206311 - RNA, 24 nt, Human
aacguuucuagguuggccgauguu

SEQ ID NO: 206312 - RNA, 21 nt, Human
aacugcaccuccaaaaaacac

SEQ ID NO: 206313 - RNA, 25 nt, Human
aagacagagaaaucuacuuuaauau

SEQ ID NO: 206314 - RNA, 24 nt, Human
aagcaaauuaagagccaggccaaa

SEQ ID NO: 206315 - RNA, 21 nt, Human
aagcccgaucgcggccgccgc

SEQ ID NO: 206316 - RNA, 19 nt, Human
aaguagcccacccgggugu

SEQ ID NO: 206317 - RNA, 19 nt, Human
aaguuuaacugcaccucca

SEQ ID NO: 206318 - RNA, 22 nt, Human
aaucauucagaauccauuuuga

SEQ ID NO: 206319 - RNA, 22 nt, Human
acauguaugcuucaaauacaaa

SEQ ID NO: 206320 - RNA, 22 nt, Human
agaaaucuacuuuaauauucac

SEQ ID NO: 206321 - RNA, 23 nt, Human
agacaaaagagaauacguaugua

SEQ ID NO: 206322 - RNA, 18 nt, Human
agcaaaagcaccggaaga

SEQ ID NO: 206323 - RNA, 19 nt, Human
agcaagcagagaacauuuu

SEQ ID NO: 206324 - RNA, 19 nt, Human
agugggcgacacucagccc

SEQ ID NO: 206325 - RNA, 21 nt, Human
caaaagcaccggaagaaaagu

SEQ ID NO: 206326 - RNA, 23 nt, Human
caacauguaugcuucaaauacaa

SEQ ID NO: 206327 - RNA, 21 nt, Human
caagcauuuccucaucccaua

SEQ ID NO: 206328 - RNA, 19 nt, Human
caagcuccgggccccgucc

SEQ ID NO: 206329 - RNA, 28 nt, Human
cacagcaguuauaaaugaagagacaaaa

SEQ ID NO: 206330 - RNA, 22 nt, Human
cacccggguguccuagucacuc

SEQ ID NO: 206331 - RNA, 20 nt, Human
caccggaagaaaaguagccc

SEQ ID NO: 206332 - RNA, 19 nt, Human
caccuccaaaaaacacaga

SEQ ID NO: 206333 - RNA, 21 nt, Human
caccuccaaaaaacacagaaa

SEQ ID NO: 206334 - RNA, 20 nt, Human
cacuuugauaaaacagcaga

SEQ ID NO: 206335 - RNA, 19 nt, Human
caugguaugaaaugucacu

SEQ ID NO: 206336 - RNA, 20 nt, Human
cauucagaauccauuuugac

SEQ ID NO: 206337 - RNA, 23 nt, Human
cauucagaauccauuuugaccuc

SEQ ID NO: 206338 - RNA, 27 nt, Human
ccaaaaaacacagaaauguacaauuca

SEQ ID NO: 206339 - RNA, 23 nt, Human
cccaaaggaaaaaaaaagcaaaa

SEQ ID NO: 206340 - RNA, 21 nt, Human
ccccucccucucuagugcucc

SEQ ID NO: 206341 - RNA, 24 nt, Human
cccgagcccaaaggaaaaaaaaag

SEQ ID NO: 206342 - RNA, 19 nt, Human
ccgccgcgcuccccuagcc

SEQ ID NO: 206343 - RNA, 18 nt, Human
ccgcgcccggcgcgcucg

SEQ ID NO: 206344 - RNA, 23 nt, Human
ccgcgcccggcgcgcucggggca

SEQ ID NO: 206345 - RNA, 20 nt, Human
ccggaagaaaaguagcccac

SEQ ID NO: 206346 - RNA, 23 nt, Human
ccgggccccguccgcggccggcu

SEQ ID NO: 206347 - RNA, 18 nt, Human
ccucaguugaaaaacaaa

SEQ ID NO: 206348 - RNA, 20 nt, Human
ccuccaaaaaacacagaaau

SEQ ID NO: 206349 - RNA, 22 nt, Human
cgcucggggcaccgcgacacuc

SEQ ID NO: 206350 - RNA, 22 nt, Human
cggccgcacaccuggacagcgc

SEQ ID NO: 206351 - RNA, 23 nt, Human
cggcgcgcucggggcaccgcgac

SEQ ID NO: 206352 - RNA, 18 nt, Human
cgggaucaccccacuccc

SEQ ID NO: 206353 - RNA, 18 nt, Human
cguaaacuccuuaaggau

SEQ ID NO: 206354 - RNA, 22 nt, Human
cuccccuagcccgggaucaccc

SEQ ID NO: 206355 - RNA, 18 nt, Human
cuccgacuaagcccgauc

SEQ ID NO: 206356 - RNA, 19 nt, Human
cuccgcgcccggcgcgcuc

SEQ ID NO: 206357 - RNA, 23 nt, Human
cuccuggcucgggcucaggcggc

SEQ ID NO: 206358 - RNA, 25 nt, Human
cuccuggcucgggcucaggcggccg

SEQ ID NO: 206359 - RNA, 18 nt, Human
cucuacgcgagcgaaccc

SEQ ID NO: 206360 - RNA, 21 nt, Human
cuguugccuauuaauucuuug

SEQ ID NO: 206361 - RNA, 18 nt, Human
cuuuccuccgguggcuuu

SEQ ID NO: 206362 - RNA, 22 nt, Human
gagccaggccaaacagaaaaga

SEQ ID NO: 206363 - RNA, 21 nt, Human
gccgccgcgcuccccuagccc

SEQ ID NO: 206364 - RNA, 20 nt, Human
gcuuuuuuucucuaacuucu

SEQ ID NO: 206365 - RNA, 23 nt, Human
ggcucaggcggccgcacaccugg

SEQ ID NO: 206366 - RNA, 24 nt, Human
gguggcuuuuuuucucuaacuucu

SEQ ID NO: 206367 - RNA, 27 nt, Human
uaaagcuucaaaacaaaaauugagcuc

SEQ ID NO: 206368 - RNA, 23 nt, Human
uaagcaauuuuuuuucacuuuga

SEQ ID NO: 206369 - RNA, 19 nt, Human
uacacaucacaagagaugg

SEQ ID NO: 206370 - RNA, 21 nt, Human
uauauauuacacuauaaaacc

SEQ ID NO: 206371 - RNA, 22 nt, Human
uaugcaaaaucauucagaaucc

SEQ ID NO: 206372 - RNA, 23 nt, Human
ucauuuaucuauacaauauguaa

SEQ ID NO: 206373 - RNA, 22 nt, Human
uccgcgcccggcgcgcucgggg

SEQ ID NO: 206374 - RNA, 21 nt, Human
uccgggccccguccgcggccg

SEQ ID NO: 206375 - RNA, 20 nt, Human
ucuacuuuaauauucacaug

SEQ ID NO: 206376 - RNA, 22 nt, Human
ucuauacugggcaaaacaaaag

SEQ ID NO: 206377 - RNA, 18 nt, Human
ucucuagugcuccuggcu

SEQ ID NO: 206378 - RNA, 24 nt, Human
ucucuuggaaugacgaaugaaaac

SEQ ID NO: 206379 - RNA, 18 nt, Human
ucugcucuucccccuccc

SEQ ID NO: 206380 - RNA, 18 nt, Human
ucuuuccucucucucucu

SEQ ID NO: 206381 - RNA, 24 nt, Human
ugaaaaaugauuuuccaaaagaaa

SEQ ID NO: 206382 - RNA, 22 nt, Human
ugaagagacaaaagagaauacg

SEQ ID NO: 206383 - RNA, 19 nt, Human
ugcaaagaaagaaugaaag

SEQ ID NO: 206384 - RNA, 23 nt, Human
ugcaaagaaagaaugaaaguugu

SEQ ID NO: 206385 - RNA, 20 nt, Human
ugcagagaaaagaaaguucu

SEQ ID NO: 206386 - RNA, 18 nt, Human
ugguaugaaaugucacuc

SEQ ID NO: 206387 - RNA, 22 nt, Human
uguauuuucaacauguaugcuu

SEQ ID NO: 206388 - RNA, 19 nt, Human
uguucauuuccaagaguuu

SEQ ID NO: 206389 - RNA, 28 nt, Human
uuaaaaaaacacauuugaauggacucag

SEQ ID NO: 206390 - RNA, 21 nt, Human
uucaaaacaaaaauugagcuc

SEQ ID NO: 206391 - RNA, 21 nt, Human
uucguaaacuccuuaaggauc

SEQ ID NO: 206392 - RNA, 19 nt, Human
uugaauggacucagaacaa

SEQ ID NO: 206393 - RNA, 21 nt, Human
uugcagagaaaagaaaguucu

SEQ ID NO: 206394 - RNA, 21 nt, Human
uugcucagugggcgacacuca

SEQ ID NO: 206395 - RNA, 19 nt, Human
uuggucugcuuaaguuaau

SEQ ID NO: 206396 - RNA, 25 nt, Human
uuuuuuuuuuuuuuuuuuuuacaag

SEQ ID NO: 206397 - RNA, 23 nt, Human
cagucgccgggaucaccgcaaac

SEQ ID NO: 206398 - RNA, 24 nt, Human
ucagaaacuauuaaaguggccaag

SEQ ID NO: 206399 - RNA, 20 nt, Human
ucuuaggcucuggaagacuc

SEQ ID NO: 206400 - RNA, 21 nt, Human
aaaaagugacagugaauacaa

SEQ ID NO: 206401 - RNA, 21 nt, Human
aaaagacaauuauccuucuua

SEQ ID NO: 206402 - RNA, 18 nt, Human
aaccgaauuccuaggcug

SEQ ID NO: 206403 - RNA, 19 nt, Human
aaccggacucccagugccu

SEQ ID NO: 206404 - RNA, 19 nt, Human
aagcucagacucacaacca

SEQ ID NO: 206405 - RNA, 22 nt, Human
aaguagacucugcagaaacccg

SEQ ID NO: 206406 - RNA, 22 nt, Human
aauuagaacaugagaaaaagug

SEQ ID NO: 206407 - RNA, 22 nt, Human
acaggccagcagaaguccaaaa

SEQ ID NO: 206408 - RNA, 20 nt, Human
accaaaagacaauuauccuu

SEQ ID NO: 206409 - RNA, 23 nt, Human
acccuuuugagcaaucuugauuu

SEQ ID NO: 206410 - RNA, 24 nt, Human
acgggauaucuaugacaccagaac

SEQ ID NO: 206411 - RNA, 23 nt, Human
acuucguuccagucaugugcaag

SEQ ID NO: 206412 - RNA, 23 nt, Human
agaaauaaaacaggccagcagaa

SEQ ID NO: 206413 - RNA, 18 nt, Human
agacucugcagaaacccg

SEQ ID NO: 206414 - RNA, 18 nt, Human
aggccagcagaaguccaa

SEQ ID NO: 206415 - RNA, 19 nt, Human
agucuugcagacucaacug

SEQ ID NO: 206416 - RNA, 20 nt, Human
aguuggggcgccacagccgc

SEQ ID NO: 206417 - RNA, 20 nt, Human
caaaacgggauaucuaugac

SEQ ID NO: 206418 - RNA, 27 nt, Human
caaaagacaauuauccuucuuagcuca

SEQ ID NO: 206419 - RNA, 23 nt, Human
caaucccaaaccggacucccagu

SEQ ID NO: 206420 - RNA, 22 nt, Human
caccccaguuccucccagucuu

SEQ ID NO: 206421 - RNA, 21 nt, Human
cagacucaacugaauguaguu

SEQ ID NO: 206422 - RNA, 20 nt, Human
caggagaagauaagauagug

SEQ ID NO: 206423 - RNA, 26 nt, Human
ccacagccuggcaaucccaaaccuug

SEQ ID NO: 206424 - RNA, 19 nt, Human
ccagaacuucccugugccc

SEQ ID NO: 206425 - RNA, 21 nt, Human
ccagaacuucccugugcccaa

SEQ ID NO: 206426 - RNA, 23 nt, Human
cuaggcugguacuagaaaauaaa

SEQ ID NO: 206427 - RNA, 25 nt, Human
gaaaagauaaacucuggcuucuaau

SEQ ID NO: 206428 - RNA, 24 nt, Human
gagcaaucuugauuuuggucauuu

SEQ ID NO: 206429 - RNA, 23 nt, Human
gcaaucccaaaccggacucccag

SEQ ID NO: 206430 - RNA, 21 nt, Human
gcaaucuugauuuuggucauu

SEQ ID NO: 206431 - RNA, 21 nt, Human
gcagaaguccaaaaaagauuc

SEQ ID NO: 206432 - RNA, 20 nt, Human
gcggccuaaacaguauuuag

SEQ ID NO: 206433 - RNA, 21 nt, Human
ggacucccagugccuccgcuu

SEQ ID NO: 206434 - RNA, 19 nt, Human
gggaaggcagugaauuucu

SEQ ID NO: 206435 - RNA, 24 nt, Human
gugacagugaauacaaaugaguac

SEQ ID NO: 206436 - RNA, 22 nt, Human
uaaaacaggccagcagaagucc

SEQ ID NO: 206437 - RNA, 23 nt, Human
uaaaccuguagaccuaguuacca

SEQ ID NO: 206438 - RNA, 21 nt, Human
uaacacagaaaaauguaaacc

SEQ ID NO: 206439 - RNA, 25 nt, Human
uaacacagaaaaauguaaaccugua

SEQ ID NO: 206440 - RNA, 18 nt, Human
uaccucacaaaacgggau

SEQ ID NO: 206441 - RNA, 24 nt, Human
uaguuuaucgccugccgggaugau

SEQ ID NO: 206442 - RNA, 24 nt, Human
uauauaaaagaaauaaaacaggcc

SEQ ID NO: 206443 - RNA, 23 nt, Human
uauauaagaaaaaggcuguaaac

SEQ ID NO: 206444 - RNA, 18 nt, Human
uauuuuagggagcaauac

SEQ ID NO: 206445 - RNA, 24 nt, Human
ucacaaagguggcaauaacuguau

SEQ ID NO: 206446 - RNA, 18 nt, Human
ucacaaccacagccuggc

SEQ ID NO: 206447 - RNA, 19 nt, Human
ucaggccaggccaggagga

SEQ ID NO: 206448 - RNA, 19 nt, Human
ucccaaaccggacucccag

SEQ ID NO: 206449 - RNA, 21 nt, Human
ucccugugcccaaggucaugg

SEQ ID NO: 206450 - RNA, 26 nt, Human
ucccuugccauguucacaaagguugg

SEQ ID NO: 206451 - RNA, 18 nt, Human
uccggauuccaaacucuc

SEQ ID NO: 206452 - RNA, 19 nt, Human
ugacagugaauacaaauga

SEQ ID NO: 206453 - RNA, 26 nt, Human
ugacagugaauacaaaugaguacuaa

SEQ ID NO: 206454 - RNA, 24 nt, Human
ugacagugaauagauuucuuauca

SEQ ID NO: 206455 - RNA, 22 nt, Human
ugagaaaucacauuuauauaaa

SEQ ID NO: 206456 - RNA, 23 nt, Human
ugcacagcucuaccucacaaaac

SEQ ID NO: 206457 - RNA, 19 nt, Human
ugcccaaggucauggacag

SEQ ID NO: 206458 - RNA, 21 nt, Human
uggcaaucccaaaccggacuc

SEQ ID NO: 206459 - RNA, 23 nt, Human
uggggcgccacagccgcucacaa

SEQ ID NO: 206460 - RNA, 24 nt, Human
ugguacuagaaaauaaaauaaaaa

SEQ ID NO: 206461 - RNA, 19 nt, Human
uguaaaaaagucccuugcc

SEQ ID NO: 206462 - RNA, 22 nt, Human
uuaaugcacagcucuaccucac

SEQ ID NO: 206463 - RNA, 20 nt, Human
uuagaguaguauaauauuca

SEQ ID NO: 206464 - RNA, 21 nt, Human
uugacagugaauagauuucuu

SEQ ID NO: 206465 - RNA, 24 nt, Human
aaaaaaacauccccuagaaaggcc

SEQ ID NO: 206466 - RNA, 27 nt, Human
aaaaacauccccuagaaaggccuccuu

SEQ ID NO: 206467 - RNA, 22 nt, Human
aaacaucuggcuuauaaaaaaa

SEQ ID NO: 206468 - RNA, 20 nt, Human
acugcuccugccucacguca

SEQ ID NO: 206469 - RNA, 23 nt, Human
caauauaaauuacaguaugcaaa

SEQ ID NO: 206470 - RNA, 19 nt, Human
caccauguguuccaagggc

SEQ ID NO: 206471 - RNA, 19 nt, Human
cccuagaaaggccuccaga

SEQ ID NO: 206472 - RNA, 20 nt, Human
ccgcuccucccggcugccug

SEQ ID NO: 206473 - RNA, 21 nt, Human
ccuggccccuccacugcagcc

SEQ ID NO: 206474 - RNA, 25 nt, Human
ccuggccccuccacugguccccugg

SEQ ID NO: 206475 - RNA, 20 nt, Human
cgcacugcuccugccucacg

SEQ ID NO: 206476 - RNA, 18 nt, Human
cgccgcuccucccggcug

SEQ ID NO: 206477 - RNA, 24 nt, Human
cucagcccuggccccuccacugca

SEQ ID NO: 206478 - RNA, 21 nt, Human
cuccucccggcugccuggccg

SEQ ID NO: 206479 - RNA, 21 nt, Human
cugcuccugccucacgucacu

SEQ ID NO: 206480 - RNA, 22 nt, Human
gagcgcgcgccgcuccucccgg

SEQ ID NO: 206481 - RNA, 20 nt, Human
gccggcucagcccuggcccc

SEQ ID NO: 206482 - RNA, 19 nt, Human
gggcgggagagguccgagc

SEQ ID NO: 206483 - RNA, 21 nt, Human
guaaaacgcacugcuccugcc

SEQ ID NO: 206484 - RNA, 19 nt, Human
uaaaaaaacauccccuaga

SEQ ID NO: 206485 - RNA, 21 nt, Human
uaaaaaaacauccccuagaaa

SEQ ID NO: 206486 - RNA, 18 nt, Human
uagaaaggccuccagaga

SEQ ID NO: 206487 - RNA, 23 nt, Human
uauaaaaaaacauccccuagaaa

SEQ ID NO: 206488 - RNA, 19 nt, Human
uaugcaaaacauacugacu

SEQ ID NO: 206489 - RNA, 18 nt, Human
uccacugcagccaugggu

SEQ ID NO: 206490 - RNA, 18 nt, Human
uccccuagaaaggccucc

SEQ ID NO: 206491 - RNA, 18 nt, Human
ugaggggaaacacacaua

SEQ ID NO: 206492 - RNA, 25 nt, Human
ugagguaaaacgcacugcuccugcc

SEQ ID NO: 206493 - RNA, 23 nt, Human
ugcaaaacauacugacuggcuga

SEQ ID NO: 206494 - RNA, 20 nt, Human
ugccgcgcucaggaggaccc

SEQ ID NO: 206495 - RNA, 20 nt, Human
uggcuuauaaaaaaacaucc

SEQ ID NO: 206496 - RNA, 19 nt, Human
uuaguagcuaaauauggca

SEQ ID NO: 206497 - RNA, 21 nt, Human
uuuuuuuuuuugugaagagcu

SEQ ID NO: 206498 - RNA, 22 nt, Human
aaaaaguucuuugaaaacagac

SEQ ID NO: 206499 - RNA, 20 nt, Human
aagaaaaggccagaucuaaa

SEQ ID NO: 206500 - RNA, 25 nt, Human
aagaaaaggccagaucuaaaaaugu

SEQ ID NO: 206501 - RNA, 18 nt, Human
aagaaaauaagguuuuuc

SEQ ID NO: 206502 - RNA, 18 nt, Human
aaggaaaaggagaugccu

SEQ ID NO: 206503 - RNA, 19 nt, Human
acaaaggaaaauacauuua

SEQ ID NO: 206504 - RNA, 22 nt, Human
acucaggcugaguugccuccag

SEQ ID NO: 206505 - RNA, 22 nt, Human
agagaaacuauuuuaacuuaag

SEQ ID NO: 206506 - RNA, 22 nt, Human
agaggaagacaggaaggaaaag

SEQ ID NO: 206507 - RNA, 22 nt, Human
agaggguaacuguucaugaaaa

SEQ ID NO: 206508 - RNA, 22 nt, Human
agccaaaauacauguguucggg

SEQ ID NO: 206509 - RNA, 23 nt, Human
aggaagcagcagcuuaaacaaag

SEQ ID NO: 206510 - RNA, 23 nt, Human
aggaaggaaaaggagaugccuga

SEQ ID NO: 206511 - RNA, 19 nt, Human
aggagaaggggcaguugcu

SEQ ID NO: 206512 - RNA, 24 nt, Human
agggucaaaagcugagcccaagcc

SEQ ID NO: 206513 - RNA, 23 nt, Human
agugugguccauucccagacagc

SEQ ID NO: 206514 - RNA, 22 nt, Human
auccaccugcaucuuuugcaca

SEQ ID NO: 206515 - RNA, 23 nt, Human
aucgcccccagaacuaccugcug

SEQ ID NO: 206516 - RNA, 20 nt, Human
caaaaaaaacauuuaccagg

SEQ ID NO: 206517 - RNA, 19 nt, Human
caaaaaccgaagaaaauaa

SEQ ID NO: 206518 - RNA, 19 nt, Human
caaaagcugagcccaagcc

SEQ ID NO: 206519 - RNA, 21 nt, Human
caaaauacauguguucgggcc

SEQ ID NO: 206520 - RNA, 23 nt, Human
caacaaaauaauugaacacacaa

SEQ ID NO: 206521 - RNA, 18 nt, Human
caagccuaagcccaagcu

SEQ ID NO: 206522 - RNA, 21 nt, Human
caaugcauacauacguaggua

SEQ ID NO: 206523 - RNA, 18 nt, Human
cacucagaguuuacaaaa

SEQ ID NO: 206524 - RNA, 23 nt, Human
cacucagaguuuacaaaaaaaac

SEQ ID NO: 206525 - RNA, 23 nt, Human
cagcaacaugcaagaauaaguuu

SEQ ID NO: 206526 - RNA, 22 nt, Human
cagcagcuuaaacaaaggaaaa

SEQ ID NO: 206527 - RNA, 24 nt, Human
caugaugcugaaaauguauccagu

SEQ ID NO: 206528 - RNA, 21 nt, Human
cauuauguuuuucaaaaaccg

SEQ ID NO: 206529 - RNA, 25 nt, Human
cauuauguuuuucaaaaaccgaaga

SEQ ID NO: 206530 - RNA, 25 nt, Human
cccaagagccacugauaacuggcac

SEQ ID NO: 206531 - RNA, 21 nt, Human
cuaaaaaaaaaaaaauccccu

SEQ ID NO: 206532 - RNA, 19 nt, Human
gaagacaggaaggaaaagg

SEQ ID NO: 206533 - RNA, 18 nt, Human
gaggaagcagcagcuuaa

SEQ ID NO: 206534 - RNA, 23 nt, Human
gaguugccuccagucuuuggaau

SEQ ID NO: 206535 - RNA, 19 nt, Human
gcaguaauuggugcuuugg

SEQ ID NO: 206536 - RNA, 21 nt, Human
ggcucagaggcugugacaacu

SEQ ID NO: 206537 - RNA, 18 nt, Human
gggauaucauugcuaaaa

SEQ ID NO: 206538 - RNA, 20 nt, Human
gggcucagaggcugugacaa

SEQ ID NO: 206539 - RNA, 21 nt, Human
ggggcgguuacaagcuuaaaa

SEQ ID NO: 206540 - RNA, 18 nt, Human
gguacugcugaggcagag

SEQ ID NO: 206541 - RNA, 21 nt, Human
guaaaggacaaaucugucucu

SEQ ID NO: 206542 - RNA, 20 nt, Human
gucuuugguuguggggacag

SEQ ID NO: 206543 - RNA, 23 nt, Human
uaagcccaagcucaagcucaagc

SEQ ID NO: 206544 - RNA, 22 nt, Human
uacaaaauuaauagcaucccaa

SEQ ID NO: 206545 - RNA, 18 nt, Human
uacacucagcccuucugg

SEQ ID NO: 206546 - RNA, 21 nt, Human
uacacucagcccuucuggcuu

SEQ ID NO: 206547 - RNA, 23 nt, Human
uaccugcuguagugugguccauu

SEQ ID NO: 206548 - RNA, 25 nt, Human
uaucauugcuaaaaaaaaaaaaauc

SEQ ID NO: 206549 - RNA, 18 nt, Human
uauccagugaaaaugaag

SEQ ID NO: 206550 - RNA, 22 nt, Human
ucagaggcugugacaacucaug

SEQ ID NO: 206551 - RNA, 21 nt, Human
ucauugcuaaaaaaaaaaaaa

SEQ ID NO: 206552 - RNA, 22 nt, Human
ucauugcuaaaaaaaaaaaaau

SEQ ID NO: 206553 - RNA, 23 nt, Human
uccacucagaguuuacaaaaaaa

SEQ ID NO: 206554 - RNA, 21 nt, Human
uccauucccagacagcaacau

SEQ ID NO: 206555 - RNA, 20 nt, Human
ucuggcuucagaucaggggg

SEQ ID NO: 206556 - RNA, 23 nt, Human
ugaaaaugaaguacuagcucucu

SEQ ID NO: 206557 - RNA, 23 nt, Human
ugaaauacaaaauuaauagcauc

SEQ ID NO: 206558 - RNA, 19 nt, Human
ugaacccaagagccacuga

SEQ ID NO: 206559 - RNA, 20 nt, Human
ugaaguacuagcucucugcu

SEQ ID NO: 206560 - RNA, 21 nt, Human
ugagcccaagccuaagcccaa

SEQ ID NO: 206561 - RNA, 23 nt, Human
ugagcccaagccuaagcccaagc

SEQ ID NO: 206562 - RNA, 20 nt, Human
ugaguugucuuugguugugg

SEQ ID NO: 206563 - RNA, 25 nt, Human
ugccuccagucuuuggaaugucauc

SEQ ID NO: 206564 - RNA, 18 nt, Human
ugcugaggcagagggcag

SEQ ID NO: 206565 - RNA, 21 nt, Human
uggaaaaaguucuuugaaaac

SEQ ID NO: 206566 - RNA, 24 nt, Human
uggaaagaauauuaaaucucaaga

SEQ ID NO: 206567 - RNA, 19 nt, Human
ugggauaggagaaggggca

SEQ ID NO: 206568 - RNA, 22 nt, Human
ugggauaggagaaggggcaguu

SEQ ID NO: 206569 - RNA, 21 nt, Human
uggggacagaggguaacuguu

SEQ ID NO: 206570 - RNA, 23 nt, Human
ugucaucuuauacugguacugcu

SEQ ID NO: 206571 - RNA, 23 nt, Human
ugugacaacucaugaugcugaaa

SEQ ID NO: 206572 - RNA, 19 nt, Human
uugaacccaagagccacug

SEQ ID NO: 206573 - RNA, 22 nt, Human
uuggaaagaauauuaaaucuca

SEQ ID NO: 206574 - RNA, 21 nt, Human
aacaauccccaucaccaccca

SEQ ID NO: 206575 - RNA, 23 nt, Human
aacaauccccaucaccacccaac

SEQ ID NO: 206576 - RNA, 20 nt, Human
aaggaagccggcccaaggac

SEQ ID NO: 206577 - RNA, 25 nt, Human
acccagcaaggggugaccauggucc

SEQ ID NO: 206578 - RNA, 18 nt, Human
accuaggcucuacccagc

SEQ ID NO: 206579 - RNA, 22 nt, Human
agaaucaucaucauccaugugg

SEQ ID NO: 206580 - RNA, 21 nt, Human
aggcagcaaugacagccucag

SEQ ID NO: 206581 - RNA, 23 nt, Human
aggggugaccaugguccacugcc

SEQ ID NO: 206582 - RNA, 19 nt, Human
agugugguccuugcaaggu

SEQ ID NO: 206583 - RNA, 21 nt, Human
caugaaaagacccgaagcaag

SEQ ID NO: 206584 - RNA, 18 nt, Human
ccacccaacagucugucc

SEQ ID NO: 206585 - RNA, 20 nt, Human
ccaucaccacccaacagucu

SEQ ID NO: 206586 - RNA, 22 nt, Human
cccaacagucuguccccuaagg

SEQ ID NO: 206587 - RNA, 21 nt, Human
cccaucaccacccaacagucu

SEQ ID NO: 206588 - RNA, 23 nt, Human
ccccaucaccacccaacagucug

SEQ ID NO: 206589 - RNA, 19 nt, Human
ccccuaaggaagccggccc

SEQ ID NO: 206590 - RNA, 21 nt, Human
ccuaacaauccccaucaccac

SEQ ID NO: 206591 - RNA, 18 nt, Human
cuauggguggggcaaggc

SEQ ID NO: 206592 - RNA, 19 nt, Human
gcagcaaugacagccucag

SEQ ID NO: 206593 - RNA, 21 nt, Human
guacacugcacugaaggguau

SEQ ID NO: 206594 - RNA, 18 nt, Human
uccauccuaacaaucccc

SEQ ID NO: 206595 - RNA, 18 nt, Human
ugacagccucagugaagu

SEQ ID NO: 206596 - RNA, 19 nt, Human
ugcacugaaggguaugggg

SEQ ID NO: 206597 - RNA, 21 nt, Human
ugggcuccauccuaacaaucc

SEQ ID NO: 206598 - RNA, 20 nt, Human
ugucagagguucgaaccugu

SEQ ID NO: 206599 - RNA, 23 nt, Human
uuacauggguauggacagggccu

SEQ ID NO: 206600 - RNA, 22 nt, Human
uuagaggcacaaggucucuucc

SEQ ID NO: 206601 - RNA, 18 nt, Human
cgguacugcgcacgcgcg

SEQ ID NO: 206602 - RNA, 24 nt, Human
gcaccgcugccgccauguugaggg

SEQ ID NO: 206603 - RNA, 18 nt, Human
gcuggcuggggugcugga

SEQ ID NO: 206604 - RNA, 20 nt, Human
ucacgcccccuuccggcgcc

SEQ ID NO: 206605 - RNA, 19 nt, Human
uccaaggagcaaaccaaga

SEQ ID NO: 206606 - RNA, 21 nt, Human
uccaaggagcaaaccaagaag

SEQ ID NO: 206607 - RNA, 22 nt, Human
ucgcaccgauucacgcccccuu

SEQ ID NO: 206608 - RNA, 20 nt, Human
uggcuggggugcuggagugg

SEQ ID NO: 206609 - RNA, 25 nt, Human
uuuuuuuuuuuuuuuuuucuagggg

SEQ ID NO: 206610 - RNA, 24 nt, Human
uuuuuuuuuuuuuuuuuuuuucuu

SEQ ID NO: 206611 - RNA, 25 nt, Human
aaaaaaaaacugguccaauuaccaa

SEQ ID NO: 206612 - RNA, 19 nt, Human
aaaaaacugguccaauuac

SEQ ID NO: 206613 - RNA, 22 nt, Human
aaauuaaaaaaaaaacuggucc

SEQ ID NO: 206614 - RNA, 18 nt, Human
aaguagaaacucaucacc

SEQ ID NO: 206615 - RNA, 21 nt, Human
acuguuuuaaaaagagggaaa

SEQ ID NO: 206616 - RNA, 21 nt, Human
aguagaaacucaucaccuaga

SEQ ID NO: 206617 - RNA, 24 nt, Human
caaaacgaccagcucuaacuccuc

SEQ ID NO: 206618 - RNA, 18 nt, Human
caacacagccgccgcccg

SEQ ID NO: 206619 - RNA, 21 nt, Human
caacacagccgccgcccgggc

SEQ ID NO: 206620 - RNA, 24 nt, Human
caacacagccgccgcccgggcccg

SEQ ID NO: 206621 - RNA, 24 nt, Human
caauuaccaauuauaaauuuuaau

SEQ ID NO: 206622 - RNA, 19 nt, Human
caccagcuggaagggagca

SEQ ID NO: 206623 - RNA, 19 nt, Human
cacguuagagacuuggcua

SEQ ID NO: 206624 - RNA, 19 nt, Human
caggcgcagacgggcggcc

SEQ ID NO: 206625 - RNA, 25 nt, Human
cauuuccuguuguaaaaaccagagg

SEQ ID NO: 206626 - RNA, 19 nt, Human
ccacagaaaggguuauuuc

SEQ ID NO: 206627 - RNA, 21 nt, Human
ccagcuggaagggagcacauc

SEQ ID NO: 206628 - RNA, 24 nt, Human
ccaugaagacugcgcaacacagcc

SEQ ID NO: 206629 - RNA, 24 nt, Human
ccaugaagacugcgcaacacagcc

SEQ ID NO: 206630 - RNA, 23 nt, Human
ccgccgcccgggcccgcagcugg

SEQ ID NO: 206631 - RNA, 20 nt, Human
cggccgcuucagagcggcgg

SEQ ID NO: 206632 - RNA, 20 nt, Human
cggccgcuucagagcggcgg

SEQ ID NO: 206633 - RNA, 21 nt, Human
cucacaccucacggcggguuc

SEQ ID NO: 206634 - RNA, 24 nt, Human
gagaccuccucgucgggaacccau

SEQ ID NO: 206635 - RNA, 24 nt, Human
gagaccuccucgucgggaacccau

SEQ ID NO: 206636 - RNA, 19 nt, Human
gagcacaucacauuugcca

SEQ ID NO: 206637 - RNA, 23 nt, Human
gcaacacagccgccgcccgggcc

SEQ ID NO: 206638 - RNA, 21 nt, Human
gccgcagccacagagaccucc

SEQ ID NO: 206639 - RNA, 21 nt, Human
gccgcagccacagagaccucc

SEQ ID NO: 206640 - RNA, 18 nt, Human
ggcccgcagcuggccgca

SEQ ID NO: 206641 - RNA, 23 nt, Human
uaaaaaaaaaacugguccaauua

SEQ ID NO: 206642 - RNA, 22 nt, Human
uaccacagaaaggguuauuuca

SEQ ID NO: 206643 - RNA, 21 nt, Human
uagcagccgccgcagccacag

SEQ ID NO: 206644 - RNA, 19 nt, Human
uaggcguggcgagagacag

SEQ ID NO: 206645 - RNA, 24 nt, Human
uauauuauuaaauuauaaacaaaa

SEQ ID NO: 206646 - RNA, 20 nt, Human
uauuauggguaaucacaaaa

SEQ ID NO: 206647 - RNA, 24 nt, Human
ucacaccucacggcggguucauag

SEQ ID NO: 206648 - RNA, 20 nt, Human
ucacaccucacggggugcuc

SEQ ID NO: 206649 - RNA, 22 nt, Human
ucacuuggaauuaccacagaaa

SEQ ID NO: 206650 - RNA, 18 nt, Human
uccgugcgacucuucccu

SEQ ID NO: 206651 - RNA, 20 nt, Human
ucucaccagcuggaagggag

SEQ ID NO: 206652 - RNA, 20 nt, Human
uggaauuaccacagaaaggg

SEQ ID NO: 206653 - RNA, 22 nt, Human
uggccgcagcgcgagugcgucc

SEQ ID NO: 206654 - RNA, 20 nt, Human
cccacuggggcucagcacag

SEQ ID NO: 206655 - RNA, 24 nt, Human
ggacugcggggcuucgggcugcaa

SEQ ID NO: 206656 - RNA, 18 nt, Human
ggugcaacccacuggggc

SEQ ID NO: 206657 - RNA, 21 nt, Human
aaacuuacgacccaccaccag

SEQ ID NO: 206658 - RNA, 21 nt, Human
aaacuuacgacccaccaccag

SEQ ID NO: 206659 - RNA, 20 nt, Human
aacccccaacccucuaccuc

SEQ ID NO: 206660 - RNA, 22 nt, Human
aauauuaauuaggagcaauaag

SEQ ID NO: 206661 - RNA, 24 nt, Human
acagcccaccaacccccaccccuc

SEQ ID NO: 206662 - RNA, 25 nt, Human
accaacccccaacccucuaccucgc

SEQ ID NO: 206663 - RNA, 19 nt, Human
accaccagacuucauccca

SEQ ID NO: 206664 - RNA, 19 nt, Human
accaccagacuucauccca

SEQ ID NO: 206665 - RNA, 20 nt, Human
accagguacgccugguguuu

SEQ ID NO: 206666 - RNA, 22 nt, Human
acccccaccccucuaccucgua

SEQ ID NO: 206667 - RNA, 23 nt, Human
acccuaaaggcgacuucaagaag

SEQ ID NO: 206668 - RNA, 23 nt, Human
acccuaaaggcgacuucaagaag

SEQ ID NO: 206669 - RNA, 18 nt, Human
accgggccuagccccagc

SEQ ID NO: 206670 - RNA, 23 nt, Human
accuccuaaacuuacgacccacc

SEQ ID NO: 206671 - RNA, 23 nt, Human
accuccuaaacuuacgacccacc

SEQ ID NO: 206672 - RNA, 18 nt, Human
acuucaagaagauggaag

SEQ ID NO: 206673 - RNA, 18 nt, Human
acuucaagaagauggaag

SEQ ID NO: 206674 - RNA, 20 nt, Human
acuucaagaagauggaagga

SEQ ID NO: 206675 - RNA, 20 nt, Human
acuucaagaagauggaagga

SEQ ID NO: 206676 - RNA, 23 nt, Human
agaugcuggaggaugcagucacc

SEQ ID NO: 206677 - RNA, 23 nt, Human
agaugcuggaggaugcagucacc

SEQ ID NO: 206678 - RNA, 23 nt, Human
agcccagcugggcugugccucgg

SEQ ID NO: 206679 - RNA, 24 nt, Human
auuacguacacaucuccaucaccu

SEQ ID NO: 206680 - RNA, 24 nt, Human
auuacguacacaucuccaucaccu

SEQ ID NO: 206681 - RNA, 18 nt, Human
caacccccaacccucuac

SEQ ID NO: 206682 - RNA, 20 nt, Human
caacccccaacccucuaccu

SEQ ID NO: 206683 - RNA, 18 nt, Human
caagagaccugcauuuac

SEQ ID NO: 206684 - RNA, 18 nt, Human
caagagaccugcauuuac

SEQ ID NO: 206685 - RNA, 20 nt, Human
caccaacccccaccccucua

SEQ ID NO: 206686 - RNA, 22 nt, Human
caccagguacgccugguguuuc

SEQ ID NO: 206687 - RNA, 21 nt, Human
caccuccuaaacuuacgaccc

SEQ ID NO: 206688 - RNA, 27 nt, Human
cagcccaccaacccccaacccucuacc

SEQ ID NO: 206689 - RNA, 20 nt, Human
cagccgggacguccuccccc

SEQ ID NO: 206690 - RNA, 20 nt, Human
cagccgggacguccuccccc

SEQ ID NO: 206691 - RNA, 20 nt, Human
ccaacccccaacccucuacc

SEQ ID NO: 206692 - RNA, 23 nt, Human
ccaccaccagacuucaucccagc

SEQ ID NO: 206693 - RNA, 23 nt, Human
ccaccaccagacuucaucccagc

SEQ ID NO: 206694 - RNA, 19 nt, Human
ccaccagucccacaaagcu

SEQ ID NO: 206695 - RNA, 19 nt, Human
ccaccagucccacaaagcu

SEQ ID NO: 206696 - RNA, 30 nt, Human
ccagucccacaaagcucaauaaauaccaag

SEQ ID NO: 206697 - RNA, 30 nt, Human; identical to SEQ ID NO: 206696

SEQ ID NO: 206698 - RNA, 24 nt, Human
cccacaaagcucaauaaauaccaa

SEQ ID NO: 206699 - RNA, 24 nt, Human
cccacaaagcucaauaaauaccaa

SEQ ID NO: 206700 - RNA, 23 nt, Human
cccacaaagcucaauaaauaccu

SEQ ID NO: 206701 - RNA, 23 nt, Human
cccacaaagcucaauaaauaccu

SEQ ID NO: 206702 - RNA, 25 nt, Human
cccaccaacccccaacccucuaccu

SEQ ID NO: 206703 - RNA, 25 nt, Human
cccaccaacccccaccccucuaccu

SEQ ID NO: 206704 - RNA, 24 nt, Human
ccccaacccucuaccucgcagcca

SEQ ID NO: 206705 - RNA, 22 nt, Human
cccccacccgaguccuccccau

SEQ ID NO: 206706 - RNA, 22 nt, Human
cccccacccgaguccuccccau

SEQ ID NO: 206707 - RNA, 19 nt, Human
ccggguggcgucuccgcug

SEQ ID NO: 206708 - RNA, 24 nt, Human
ccucccccacccgaguccucccca

SEQ ID NO: 206709 - RNA, 24 nt, Human
ccucccccacccgaguccucccca

SEQ ID NO: 206710 - RNA, 19 nt, Human
ccucggucucugugcgccu

SEQ ID NO: 206711 - RNA, 19 nt, Human
ccugguguuucuuuguggu

SEQ ID NO: 206712 - RNA, 18 nt, Human
cgacccaccaccagacuu

SEQ ID NO: 206713 - RNA, 21 nt, Human
cgccgaagucucacacaguag

SEQ ID NO: 206714 - RNA, 21 nt, Human
cgccgaagucucacacaguag

SEQ ID NO: 206715 - RNA, 23 nt, Human
cgcuccgugacagcccaccaacc

SEQ ID NO: 206716 - RNA, 18 nt, Human
cguacauaaauacauaua

SEQ ID NO: 206717 - RNA, 21 nt, Human
cuaaacuuacgacccaccacc

SEQ ID NO: 206718 - RNA, 21 nt, Human
cuaaacuuacgacccaccacc

SEQ ID NO: 206719 - RNA, 23 nt, Human
cuagcccagcugggcugugccuc

SEQ ID NO: 206720 - RNA, 18 nt, Human
cucacggaucucauuccu

SEQ ID NO: 206721 - RNA, 18 nt, Human
cucacggaucucauuccu

SEQ ID NO: 206722 - RNA, 21 nt, Human
cuccgugacagcccaccaacc

SEQ ID NO: 206723 - RNA, 21 nt, Human
cuccgugacagcccaccaacc

SEQ ID NO: 206724 - RNA, 23 nt, Human
cucgcagccacccuaaaggcgac

SEQ ID NO: 206725 - RNA, 23 nt, Human
cucguagccacccuaaaggcgac

SEQ ID NO: 206726 - RNA, 20 nt, Human
cugaguucaaguugccucgg

SEQ ID NO: 206727 - RNA, 19 nt, Human
cugggcugugccucggucu

SEQ ID NO: 206728 - RNA, 23 nt, Human
cuguaguguucugaguucaaguu

SEQ ID NO: 206729 - RNA, 26 nt, Human
cuuacgacccaccaccagacuucauc

SEQ ID NO: 206730 - RNA, 26 nt, Human
cuuacgacccaccaccagacuucauc

SEQ ID NO: 206731 - RNA, 18 nt, Human
cuucaagaagauggaagg

SEQ ID NO: 206732 - RNA, 18 nt, Human
cuucaagaagauggaagg

SEQ ID NO: 206733 - RNA, 21 nt, Human
cuucccaccgggccuagcccc

SEQ ID NO: 206734 - RNA, 20 nt, Human
gacguacauaaauacauaua

SEQ ID NO: 206735 - RNA, 19 nt, Human
gaguccuccccauuucuuc

SEQ ID NO: 206736 - RNA, 19 nt, Human
gaguccuccccauuucuuc

SEQ ID NO: 206737 - RNA, 20 nt, Human
gccugguguuucuuuguggu

SEQ ID NO: 206738 - RNA, 22 nt, Human
gggauacgcucucgcgcaccag

SEQ ID NO: 206739 - RNA, 21 nt, Human
guaguguucugaguucaaguu

SEQ ID NO: 206740 - RNA, 20 nt, Human
uaaaauaaauauuacguaca

SEQ ID NO: 206741 - RNA, 20 nt, Human
uaaaauaaauauuacguaca

SEQ ID NO: 206742 - RNA, 24 nt, Human
uaaauauuaauuaggagcaauaag

SEQ ID NO: 206743 - RNA, 27 nt, Human
uaacgacgcucuccuucccaccggccu

SEQ ID NO: 206744 - RNA, 18 nt, Human
uaaugguccgccgaaguc

SEQ ID NO: 206745 - RNA, 18 nt, Human
uaaugguccgccgaaguc

SEQ ID NO: 206746 - RNA, 24 nt, Human
uaggagcaauaagaaauaaauuaa

SEQ ID NO: 206747 - RNA, 25 nt, Human
uaggagcaauaagaaauaaauuaac

SEQ ID NO: 206748 - RNA, 22 nt, Human
ucaccuccuaaacuuacgaccc

SEQ ID NO: 206749 - RNA, 18 nt, Human
uccaccagucccacaaag

SEQ ID NO: 206750 - RNA, 18 nt, Human
uccaccagucccacaaag

SEQ ID NO: 206751 - RNA, 18 nt, Human
uccccauuucuucuccua

SEQ ID NO: 206752 - RNA, 18 nt, Human
uccccauuucuucuccua

SEQ ID NO: 206753 - RNA, 24 nt, Human
ugagccgagcggaguguaaggcca

SEQ ID NO: 206754 - RNA, 19 nt, Human
ugccucggucucuaugcgc

SEQ ID NO: 206755 - RNA, 22 nt, Human
uggggagugcggggagucacag

SEQ ID NO: 206756 - RNA, 22 nt, Human
uguccugcuuccaccaguccca

SEQ ID NO: 206757 - RNA, 22 nt, Human
uguccugcuuccaccaguccca

SEQ ID NO: 206758 - RNA, 20 nt, Human
uucaagaagauggaaggauc

SEQ ID NO: 206759 - RNA, 20 nt, Human
uucaagaagauggaaggauc

SEQ ID NO: 206760 - RNA, 25 nt, Human
aaaauagucuuaaugccacaagaca

SEQ ID NO: 206761 - RNA, 21 nt, Human
aaccuuuuagccgcuuccuuc

SEQ ID NO: 206762 - RNA, 22 nt, Human
aaccuuuuagccgcuuccuucu

SEQ ID NO: 206763 - RNA, 18 nt, Human
aagcucccaggucuccag

SEQ ID NO: 206764 - RNA, 23 nt, Human
aagggccuggcccucacuucggg

SEQ ID NO: 206765 - RNA, 21 nt, Human
accuuaucagcucccccaacc

SEQ ID NO: 206766 - RNA, 23 nt, Human
accuuaucagcucccccaaccuu

SEQ ID NO: 206767 - RNA, 21 nt, Human
accuuuauacaacaaagacug

SEQ ID NO: 206768 - RNA, 19 nt, Human
acucuggugacgcgcgcgc

SEQ ID NO: 206769 - RNA, 24 nt, Human
agaaagguggggagggacagaagg

SEQ ID NO: 206770 - RNA, 20 nt, Human
agacacguagaaguuacauu

SEQ ID NO: 206771 - RNA, 26 nt, Human
agacauacacaaacacaaaaguuaac

SEQ ID NO: 206772 - RNA, 21 nt, Human
caaacaagacaacuuccccgu

SEQ ID NO: 206773 - RNA, 23 nt, Human
caacaaagacuggagucaccaua

SEQ ID NO: 206774 - RNA, 24 nt, Human
caaccuuuauacaacaaagacugg

SEQ ID NO: 206775 - RNA, 23 nt, Human
caagacaaacuuacauacacaga

SEQ ID NO: 206776 - RNA, 20 nt, Human
caagacaacuuccccguuuc

SEQ ID NO: 206777 - RNA, 21 nt, Human
caccuaagacuccgaagagaa

SEQ ID NO: 206778 - RNA, 23 nt, Human
caccuccuccccgcagggggacc

SEQ ID NO: 206779 - RNA, 27 nt, Human
cacuccuggcccugaagcgggucuagc

SEQ ID NO: 206780 - RNA, 21 nt, Human
cagaaggaauccaagucugug

SEQ ID NO: 206781 - RNA, 22 nt, Human
ccacgcagccggcagaggaaag

SEQ ID NO: 206782 - RNA, 20 nt, Human
ccccaaccuuuauacaacaa

SEQ ID NO: 206783 - RNA, 24 nt, Human
cccccugggcacacccucgaucac

SEQ ID NO: 206784 - RNA, 19 nt, Human
ccccggagaacgaaugggg

SEQ ID NO: 206785 - RNA, 20 nt, Human
cccucgaucaccuaagacuc

SEQ ID NO: 206786 - RNA, 22 nt, Human
ccggcccaaaccuuuuagccgc

SEQ ID NO: 206787 - RNA, 19 nt, Human
ccuaagacuccgaagagaa

SEQ ID NO: 206788 - RNA, 18 nt, Human
ccuggcccugaagcgggu

SEQ ID NO: 206789 - RNA, 18 nt, Human
ccuucuccacgcagccgg

SEQ ID NO: 206790 - RNA, 19 nt, Human
cgccacuccuggcccugaa

SEQ ID NO: 206791 - RNA, 19 nt, Human
cgcccccugggcacacccu

SEQ ID NO: 206792 - RNA, 22 nt, Human
cggaaacgccacuccuggcccu

SEQ ID NO: 206793 - RNA, 22 nt, Human
cguccucuuccaaugagccuca

SEQ ID NO: 206794 - RNA, 23 nt, Human
cucucauuaaacacuuuuuaaaa

SEQ ID NO: 206795 - RNA, 18 nt, Human
cucuuccaaugagccuca

SEQ ID NO: 206796 - RNA, 19 nt, Human
cucuuccaaugagccucaa

SEQ ID NO: 206797 - RNA, 21 nt, Human
cugaagcgggucuagcuuucc

SEQ ID NO: 206798 - RNA, 19 nt, Human
cuguguaguacuucugacc

SEQ ID NO: 206799 - RNA, 21 nt, Human
cuucugucuguaaacucucau

SEQ ID NO: 206800 - RNA, 19 nt, Human
gcagccgggaagggccugg

SEQ ID NO: 206801 - RNA, 19 nt, Human
gcguccucgcagccgggaa

SEQ ID NO: 206802 - RNA, 22 nt, Human
ggcgcaaacaaguccgcccccu

SEQ ID NO: 206803 - RNA, 23 nt, Human
ggcuucugucuguaaacucucau

SEQ ID NO: 206804 - RNA, 18 nt, Human
gucuccagauaagccaga

SEQ ID NO: 206805 - RNA, 20 nt, Human
uaaacuccauuauuuccaag

SEQ ID NO: 206806 - RNA, 20 nt, Human
uaaccucuccaaacaagaca

SEQ ID NO: 206807 - RNA, 22 nt, Human
uaaggucuuuccacuucgggcu

SEQ ID NO: 206808 - RNA, 22 nt, Human
uaauacgccccuuuccuagagu

SEQ ID NO: 206809 - RNA, 25 nt, Human
uacaacgaaggagaaaauacuguac

SEQ ID NO: 206810 - RNA, 20 nt, Human
uacauacacagacauacaca

SEQ ID NO: 206811 - RNA, 18 nt, Human
uacuguacaaaaaccuua

SEQ ID NO: 206812 - RNA, 26 nt, Human
uccaccuccuccccgcagggggacca

SEQ ID NO: 206813 - RNA, 22 nt, Human
uccccugcggggaagcaaagga

SEQ ID NO: 206814 - RNA, 18 nt, Human
ugagccucaagcucccag

SEQ ID NO: 206815 - RNA, 19 nt, Human
ugccacaagacaaacuuac

SEQ ID NO: 206816 - RNA, 21 nt, Human
ugcccccaaucucuuaaaccc

SEQ ID NO: 206817 - RNA, 23 nt, Human
ugcucuacuaaccucuccaaaca

SEQ ID NO: 206818 - RNA, 20 nt, Human
ugcuuccccugcacagggcc

SEQ ID NO: 206819 - RNA, 22 nt, Human
ugggagagaaagguggggaggg

SEQ ID NO: 206820 - RNA, 18 nt, Human
uggggaacuccccggccc

SEQ ID NO: 206821 - RNA, 23 nt, Human
uuaaacacuuuuuaaaagcacug

SEQ ID NO: 206822 - RNA, 26 nt, Human
uuuccaagcuugaacucuucugugaa

SEQ ID NO: 206823 - RNA, 23 nt, Human
uuuuuuuuuuuuuuuugcuucaa

SEQ ID NO: 206824 - RNA, 18 nt, Human
uuuuuuuuuuuuuuuuug

SEQ ID NO: 206825 - RNA, 21 nt, Human
uuuuuuuuuuuuuuuuugcuu

SEQ ID NO: 206826 - RNA, 24 nt, Human
agagaaaaagaauagaaugaagag

SEQ ID NO: 206827 - RNA, 23 nt, Human
cccccuagagaauuauuaauuau

SEQ ID NO: 206828 - RNA, 20 nt, Human
gauuugcuucauuuuucccc

SEQ ID NO: 206829 - RNA, 21 nt, Human
ucauuuuuccccccuagagaa

SEQ ID NO: 206830 - RNA, 23 nt, Human
ucuguggagaccuuuaaaaauau

SEQ ID NO: 206831 - RNA, 18 nt, Human
aaaaaaaacuaugaaaaa

SEQ ID NO: 206832 - RNA, 18 nt, Human
aaaagcacucccaauacc

SEQ ID NO: 206833 - RNA, 23 nt, Human
aaacauuaucgucaaugacaucc

SEQ ID NO: 206834 - RNA, 18 nt, Human
aaacggaaccgcaggaug

SEQ ID NO: 206835 - RNA, 26 nt, Human
aaacggaaccgcaggauguuguaauc

SEQ ID NO: 206836 - RNA, 19 nt, Human
aaagcacucccaauacccc

SEQ ID NO: 206837 - RNA, 27 nt, Human
aaccagguauauguacauuucccaugg

SEQ ID NO: 206838 - RNA, 23 nt, Human
agaaaaugaaguaucugcaaaga

SEQ ID NO: 206839 - RNA, 21 nt, Human
caacaguaguccagaucuuga

SEQ ID NO: 206840 - RNA, 23 nt, Human
cacucccaauaccccauuccaua

SEQ ID NO: 206841 - RNA, 18 nt, Human
ccccagagaaaauggagu

SEQ ID NO: 206842 - RNA, 21 nt, Human
ccccagagaaaauggaguagg

SEQ ID NO: 206843 - RNA, 18 nt, Human
gaaaaauuaaaaaagcac

SEQ ID NO: 206844 - RNA, 25 nt, Human
gcacucccaauaccccauuccauag

SEQ ID NO: 206845 - RNA, 30 nt, Human
uaaaaaaaaacuaugaaaaauuaaaaaagg

SEQ ID NO: 206846 - RNA, 19 nt, Human
uaaaaaagcacucccaaua

SEQ ID NO: 206847 - RNA, 21 nt, Human
uaaaaaagcacucccaauacc

SEQ ID NO: 206848 - RNA, 19 nt, Human
uaacaaggaaaaaaggccu

SEQ ID NO: 206849 - RNA, 18 nt, Human
uaccccauuccauaggau

SEQ ID NO: 206850 - RNA, 18 nt, Human
uauaguguuguauuucaa

SEQ ID NO: 206851 - RNA, 20 nt, Human
uauauggugguguguaugua

SEQ ID NO: 206852 - RNA, 20 nt, Human
uaucugcaaagauaacaagg

SEQ ID NO: 206853 - RNA, 22 nt, Human
ucccagaaacggaaccgcagga

SEQ ID NO: 206854 - RNA, 20 nt, Human
ucuccagaaacgcuaagaaa

SEQ ID NO: 206855 - RNA, 23 nt, Human
ugguguguauguauaguguugua

SEQ ID NO: 206856 - RNA, 20 nt, Human
uguguauguauaguguugua

SEQ ID NO: 206857 - RNA, 25 nt, Human
uuuuucaaauuauagaaguuguagg

SEQ ID NO: 206858 - RNA, 21 nt, Human
cucugcagggcgaggggcagg

SEQ ID NO: 206859 - RNA, 20 nt, Human
gguucucuucucugcagggc

SEQ ID NO: 206860 - RNA, 19 nt, Human
guucucuucucugcagggc

SEQ ID NO: 206861 - RNA, 24 nt, Human
ucaggauggcugggugccuucucc

SEQ ID NO: 206862 - RNA, 20 nt, Human
uccccuggcaugguucucuu

SEQ ID NO: 206863 - RNA, 18 nt, Human
uuggcuccucgcuggguc

SEQ ID NO: 206864 - RNA, 20 nt, Human
uugguauauuucacccaggu

SEQ ID NO: 206865 - RNA, 21 nt, Human
aaauuggaaacuaaagacuua

SEQ ID NO: 206866 - RNA, 20 nt, Human
accuuggcgggggggugggg

SEQ ID NO: 206867 - RNA, 20 nt, Human
augcaggcucuuuuuacugu

SEQ ID NO: 206868 - RNA, 27 nt, Human
cacccaagcccaggccagugugagaac

SEQ ID NO: 206869 - RNA, 19 nt, Human
ccggguccugcugggugug

SEQ ID NO: 206870 - RNA, 21 nt, Human
ccuccgcacuguuggugaaca

SEQ ID NO: 206871 - RNA, 20 nt, Human
cucacucccaccuaggagga

SEQ ID NO: 206872 - RNA, 18 nt, Human
gagaaccuuggcgggggg

SEQ ID NO: 206873 - RNA, 18 nt, Human
gagcagagcccgcaagca

SEQ ID NO: 206874 - RNA, 20 nt, Human
gagcagagcccgcaagcaga

SEQ ID NO: 206875 - RNA, 23 nt, Human
ggcaugcaggcucuuuuuacugu

SEQ ID NO: 206876 - RNA, 19 nt, Human
gggcacugaaaaugggacc

SEQ ID NO: 206877 - RNA, 20 nt, Human
gggcacugaaaaugggaccu

SEQ ID NO: 206878 - RNA, 18 nt, Human
gggcaguguuuugcaaug

SEQ ID NO: 206879 - RNA, 23 nt, Human
ggggggguggggaggaugagaag

SEQ ID NO: 206880 - RNA, 23 nt, Human
gggguggggaggaugagaagggg

SEQ ID NO: 206881 - RNA, 22 nt, Human
uaccagggggaucuugggcacu

SEQ ID NO: 206882 - RNA, 21 nt, Human
uaggaguguuccucacuccca

SEQ ID NO: 206883 - RNA, 19 nt, Human
ucagagcagagcccgcaag

SEQ ID NO: 206884 - RNA, 27 nt, Human
ucagagcagagcccgcaagcagagggc

SEQ ID NO: 206885 - RNA, 19 nt, Human
uccuauaugggcacccaag

SEQ ID NO: 206886 - RNA, 22 nt, Human
ugagaaccuuggcgggggggug

SEQ ID NO: 206887 - RNA, 20 nt, Human
uggcggggggguggggagga

SEQ ID NO: 206888 - RNA, 21 nt, Human
uggcggggggguggggaggau

SEQ ID NO: 206889 - RNA, 20 nt, Human
ugggaccuggaaguagggga

SEQ ID NO: 206890 - RNA, 23 nt, Human
ugggcaguguuuugcaaugugug

SEQ ID NO: 206891 - RNA, 22 nt, Human
uguguccucggaauaccagggg

SEQ ID NO: 206892 - RNA, 23 nt, Human
uguucugggcaguguuuugcaau

SEQ ID NO: 206893 - RNA, 18 nt, Human
uugaucgugugcuccuuu

SEQ ID NO: 206894 - RNA, 26 nt, Human
aaacaguaagcagaaaagagggaccc

SEQ ID NO: 206895 - RNA, 20 nt, Human
aagcagaaaagaugauuagg

SEQ ID NO: 206896 - RNA, 21 nt, Human
aggcagccguucugcaggguu

SEQ ID NO: 206897 - RNA, 22 nt, Human
auguuagcauaaaaugaaauga

SEQ ID NO: 206898 - RNA, 20 nt, Human
caggguuuugcuuagccagg

SEQ ID NO: 206899 - RNA, 23 nt, Human
cugcaggguuuugcuuagccagg

SEQ ID NO: 206900 - RNA, 19 nt, Human
gcaggguuuugcuuagcca

SEQ ID NO: 206901 - RNA, 21 nt, Human
uagccaggcuccucugagauc

SEQ ID NO: 206902 - RNA, 24 nt, Human
ucugcaggguuuugcuuagccagg

SEQ ID NO: 206903 - RNA, 24 nt, Human
ugaaaacaguaagcagaaaagaug

SEQ ID NO: 206904 - RNA, 20 nt, Human
ugaaaguggcugauaucugg

SEQ ID NO: 206905 - RNA, 24 nt, Human
aaagugcugggauuacaggcauga

SEQ ID NO: 206906 - RNA, 18 nt, Human
aacaugcaaagcuucccu

SEQ ID NO: 206907 - RNA, 19 nt, Human
aagcaaaugcugaagaggu

SEQ ID NO: 206908 - RNA, 19 nt, Human
aagcaaaugcugaagaggu

SEQ ID NO: 206909 - RNA, 25 nt, Human
aagcaaaugcugaagagguuuccac

SEQ ID NO: 206910 - RNA, 22 nt, Human
aagcuucccugcucagcaaucc

SEQ ID NO: 206911 - RNA, 19 nt, Human
aaguagcugggacuacagg

SEQ ID NO: 206912 - RNA, 20 nt, Human
aaguagcugggacuacaggu

SEQ ID NO: 206913 - RNA, 19 nt, Human
aagugcugggauuacaggc

SEQ ID NO: 206914 - RNA, 21 nt, Human
aagugcugggauuacaggcau

SEQ ID NO: 206915 - RNA, 26 nt, Human
aagugcugggauuacaggcaugagcc

SEQ ID NO: 206916 - RNA, 18 nt, Human
acgggauuucacuguguu

SEQ ID NO: 206917 - RNA, 20 nt, Human
acgggauuucacuguguuag

SEQ ID NO: 206918 - RNA, 25 nt, Human
agagcaacaugcaaagcuucccugc

SEQ ID NO: 206919 - RNA, 21 nt, Human
agcaaucccagguuggggccc

SEQ ID NO: 206920 - RNA, 19 nt, Human
agcuuacugauuccaagca

SEQ ID NO: 206921 - RNA, 20 nt, Human
agugcaggggcgcaaucuug

SEQ ID NO: 206922 - RNA, 24 nt, Human
agugcaggggcgcaaucuuggcuc

SEQ ID NO: 206923 - RNA, 23 nt, Human
caaaaaacaacucuuuaaaaaug

SEQ ID NO: 206924 - RNA, 24 nt, Human
caaagugcugggauuacaggcaug

SEQ ID NO: 206925 - RNA, 24 nt, Human
caccucggccucccaaagugcugg

SEQ ID NO: 206926 - RNA, 22 nt, Human
cacgccauucuccugccucagc

SEQ ID NO: 206927 - RNA, 18 nt, Human
cacuguguuagccaggau

SEQ ID NO: 206928 - RNA, 19 nt, Human
cacuguguuagccaggaug

SEQ ID NO: 206929 - RNA, 24 nt, Human
cacuguguuagccaggauggucuc

SEQ ID NO: 206930 - RNA, 23 nt, Human
ccaaagugcugggauuacaggca

SEQ ID NO: 206931 - RNA, 24 nt, Human
ccaaagugcugggauuacaggcau

SEQ ID NO: 206932 - RNA, 20 nt, Human
ccaccacgccuggcuaauuu

SEQ ID NO: 206933 - RNA, 22 nt, Human
ccacugcgcccggccaaaaaac

SEQ ID NO: 206934 - RNA, 19 nt, Human
ccagguucacgccauucuc

SEQ ID NO: 206935 - RNA, 22 nt, Human
ccagguucacgccauucuccug

SEQ ID NO: 206936 - RNA, 24 nt, Human
cccaaagugcugggauuacaggca

SEQ ID NO: 206937 - RNA, 22 nt, Human
cccaaguagcugggacuacagg

SEQ ID NO: 206938 - RNA, 23 nt, Human
cccaaguagcugggacuacaggu

SEQ ID NO: 206939 - RNA, 21 nt, Human
cccaggcuggagugcaggggc

SEQ ID NO: 206940 - RNA, 21 nt, Human
cccccugucuuccuaucgucc

SEQ ID NO: 206941 - RNA, 23 nt, Human
cccccugucuuccuaucguccua

SEQ ID NO: 206942 - RNA, 19 nt, Human
cccugcucagcaaucccag

SEQ ID NO: 206943 - RNA, 19 nt, Human
ccgucacaaccaccacugc

SEQ ID NO: 206944 - RNA, 23 nt, Human
ccugccucagccucccaaguagc

SEQ ID NO: 206945 - RNA, 24 nt, Human
ccugccucagccucccaaguagcu

SEQ ID NO: 206946 - RNA, 24 nt, Human
ccuuccagguucacgccauucucc

SEQ ID NO: 206947 - RNA, 19 nt, Human
cggccaaaaaacaacucuu

SEQ ID NO: 206948 - RNA, 24 nt, Human
cgggauuucacuguguuagccagg

SEQ ID NO: 206949 - RNA, 24 nt, Human
cucagccucccaaguagcugggac

SEQ ID NO: 206950 - RNA, 22 nt, Human
cuccagaccucgugauccgccc

SEQ ID NO: 206951 - RNA, 18 nt, Human
cucuguuuuccuccucug

SEQ ID NO: 206952 - RNA, 22 nt, Human
cugauuccaagcaaaugcugaa

SEQ ID NO: 206953 - RNA, 24 nt, Human
cugcaaccucuuccuuccagguuc

SEQ ID NO: 206954 - RNA, 24 nt, Human
cugcgcccggccaaaaaacaacuc

SEQ ID NO: 206955 - RNA, 21 nt, Human
cuugcucuguugcccaggcug

SEQ ID NO: 206956 - RNA, 22 nt, Human
gaccucgugauccgcccaccuc

SEQ ID NO: 206957 - RNA, 22 nt, Human
gaccucgugauccgcccaccuc

SEQ ID NO: 206958 - RNA, 24 nt, Human
gaccucgugauccgcccaccucgg

SEQ ID NO: 206959 - RNA, 21 nt, Human
gagauggagucuugcucuguu

SEQ ID NO: 206960 - RNA, 18 nt, Human
gauuacaggcaugagcca

SEQ ID NO: 206961 - RNA, 22 nt, Human
gauuacaggcaugagccacugc

SEQ ID NO: 206962 - RNA, 22 nt, Human
gauuacaggcaugagccacugc

SEQ ID NO: 206963 - RNA, 22 nt, Human
gcaggggcgcaaucuuggcuca

SEQ ID NO: 206964 - RNA, 18 nt, Human
gccagccaccacgccugg

SEQ ID NO: 206965 - RNA, 19 nt, Human
gcccaggcuggagugcagg

SEQ ID NO: 206966 - RNA, 23 nt, Human
gccuggcuaauuuuuuguauuuu

SEQ ID NO: 206967 - RNA, 19 nt, Human
gcucacugcaaccucuucc

SEQ ID NO: 206968 - RNA, 25 nt, Human
gcucuguugcccaggcuggagugca

SEQ ID NO: 206969 - RNA, 24 nt, Human
gcuggagugcaggggcgcaaucuu

SEQ ID NO: 206970 - RNA, 22 nt, Human
ggauuacaggcaugagccacug

SEQ ID NO: 206971 - RNA, 23 nt, Human
gggauuucacuguguuagccagg

SEQ ID NO: 206972 - RNA, 24 nt, Human
gucuugcucuguugcccaggcugg

SEQ ID NO: 206973 - RNA, 24 nt, Human
gugauccgcccaccucggccuccc

SEQ ID NO: 206974 - RNA, 24 nt, Human
uaauuuuuuguauuuuuaguagag

SEQ ID NO: 206975 - RNA, 25 nt, Human
uaauuuuuuguauuuuuaguagaga

SEQ ID NO: 206976 - RNA, 23 nt, Human
uacaggcaugagccacugcgccc

SEQ ID NO: 206977 - RNA, 22 nt, Human
uacaggugccagccaccacgcc

SEQ ID NO: 206978 - RNA, 20 nt, Human
uaguagagacgggauuucac

SEQ ID NO: 206979 - RNA, 24 nt, Human
uaguagagacgggauuucacugug

SEQ ID NO: 206980 - RNA, 24 nt, Human
ucacugcaaccucuuccuuccagg

SEQ ID NO: 206981 - RNA, 24 nt, Human
ucacuguguuagccaggauggucu

SEQ ID NO: 206982 - RNA, 18 nt, Human
ucagccucccaaguagcu

SEQ ID NO: 206983 - RNA, 20 nt, Human
ucagccucccaaguagcugg

SEQ ID NO: 206984 - RNA, 20 nt, Human
uccagguucacgccauucuc

SEQ ID NO: 206985 - RNA, 24 nt, Human
ucccaaagugcugggauuacaggc

SEQ ID NO: 206986 - RNA, 24 nt, Human
ucccaaguagcugggacuacaggu

SEQ ID NO: 206987 - RNA, 19 nt, Human
ucccagguuggggcccccu

SEQ ID NO: 206988 - RNA, 23 nt, Human
uccuuccagguucacgccauucu

SEQ ID NO: 206989 - RNA, 18 nt, Human
ucggccucccaaagugcu

SEQ ID NO: 206990 - RNA, 26 nt, Human
ucuccugccucagccucccaaguagc

SEQ ID NO: 206991 - RNA, 24 nt, Human
ucuguugcccaggcuggagugcag

SEQ ID NO: 206992 - RNA, 23 nt, Human
ucuugcucuguugcccaggcugg

SEQ ID NO: 206993 - RNA, 24 nt, Human
ucuugcucuguugcccaggcugga

SEQ ID NO: 206994 - RNA, 24 nt, Human
ugauccgcccaccucggccuccca

SEQ ID NO: 206995 - RNA, 22 nt, Human
ugcaggggcgcaaucuuggcuc

SEQ ID NO: 206996 - RNA, 23 nt, Human
ugcaggggcgcaaucuuggcuca

SEQ ID NO: 206997 - RNA, 18 nt, Human
ugcccaggcuggagugca

SEQ ID NO: 206998 - RNA, 19 nt, Human
ugcccaggcuggagugcag

SEQ ID NO: 206999 - RNA, 23 nt, Human
ugcccaggcuggagugcaggggc

SEQ ID NO: 207000 - RNA, 24 nt, Human
ugcccaggcuggagugcaggggcg

SEQ ID NO: 207001 - RNA, 24 nt, Human
ugccucagccucccaaguagcugg

SEQ ID NO: 207002 - RNA, 23 nt, Human
ugcgcccggccaaaaaacaacuc

SEQ ID NO: 207003 - RNA, 24 nt, Human
ugcucuguugcccaggcuggagug

SEQ ID NO: 207004 - RNA, 19 nt, Human
ugcucuguuuuccuccucu

SEQ ID NO: 207005 - RNA, 22 nt, Human
ugcuuuuaugaaaggggaaagg

SEQ ID NO: 207006 - RNA, 24 nt, Human
uggagucuugcucuguugcccagg

SEQ ID NO: 207007 - RNA, 23 nt, Human
uggagugcaggggcgcaaucuug

SEQ ID NO: 207008 - RNA, 24 nt, Human
uggagugcaggggcgcaaucuugg

SEQ ID NO: 207009 - RNA, 22 nt, Human
ugggacuacaggugccagccac

SEQ ID NO: 207010 - RNA, 24 nt, Human
ugggacuacaggugccagccacca

SEQ ID NO: 207011 - RNA, 18 nt, Human
ugggauuacaggcaugag

SEQ ID NO: 207012 - RNA, 19 nt, Human
ugggauuacaggcaugagc

SEQ ID NO: 207013 - RNA, 21 nt, Human
ugggauuacaggcaugagcca

SEQ ID NO: 207014 - RNA, 22 nt, Human
ugggauuacaggcaugagccac

SEQ ID NO: 207015 - RNA, 22 nt, Human
ugggauuacaggcaugagccac

SEQ ID NO: 207016 - RNA, 23 nt, Human
ugggauuacaggcaugagccacu

SEQ ID NO: 207017 - RNA, 24 nt, Human
ugggauuacaggcaugagccacug

SEQ ID NO: 207018 - RNA, 26 nt, Human
ugggauuacaggcaugagccacugcg

SEQ ID NO: 207019 - RNA, 20 nt, Human
uggggcccccugucuuccua

SEQ ID NO: 207020 - RNA, 21 nt, Human
uguugcccaggcuggagugca

SEQ ID NO: 207021 - RNA, 18 nt, Human
uuaguagagacgggauuu

SEQ ID NO: 207022 - RNA, 21 nt, Human
uuaguagagacgggauuucac

SEQ ID NO: 207023 - RNA, 24 nt, Human
uuaguagagacgggauuucacugu

SEQ ID NO: 207024 - RNA, 21 nt, Human
uucacuguguuagccaggaug

SEQ ID NO: 207025 - RNA, 24 nt, Human
uuccagguucacgccauucuccug

SEQ ID NO: 207026 - RNA, 18 nt, Human
uugcccaggcuggagugc

SEQ ID NO: 207027 - RNA, 24 nt, Human
uugcucuguugcccaggcuggagu

SEQ ID NO: 207028 - RNA, 21 nt, Human
uuggggcccccugucuuccua

SEQ ID NO: 207029 - RNA, 19 nt, Human
uuucacuguguuagccagg

SEQ ID NO: 207030 - RNA, 21 nt, Human
uuuuguauuuuuaguagagac

SEQ ID NO: 207031 - RNA, 24 nt, Human
uuuuuaguagagacgggauuucac

SEQ ID NO: 207032 - RNA, 21 nt, Human
uuuuuguauuuuuaguagaga

SEQ ID NO: 207033 - RNA, 23 nt, Human
aaugguguggagguccuggagac

SEQ ID NO: 207034 - RNA, 24 nt, Human
acuuuaggagagggaggaaagagg

SEQ ID NO: 207035 - RNA, 19 nt, Human
agaaacauauacacuuuau

SEQ ID NO: 207036 - RNA, 20 nt, Human
aggaaagaggggcugagggc

SEQ ID NO: 207037 - RNA, 24 nt, Human
aggaaagaggggcugagggcucag

SEQ ID NO: 207038 - RNA, 20 nt, Human
agggaggaaagaggggcuga

SEQ ID NO: 207039 - RNA, 18 nt, Human
agguccuggagacugccc

SEQ ID NO: 207040 - RNA, 21 nt, Human
augguguggagguccuggaga

SEQ ID NO: 207041 - RNA, 24 nt, Human
caacaguuuccucuuccuggcauu

SEQ ID NO: 207042 - RNA, 23 nt, Human
cagaacaaauuccugaggaucaa

SEQ ID NO: 207043 - RNA, 19 nt, Human
cagagcuggccagggccag

SEQ ID NO: 207044 - RNA, 21 nt, Human
cagugagcccucccuuuccuu

SEQ ID NO: 207045 - RNA, 21 nt, Human
ccaagggagcacaaggcucau

SEQ ID NO: 207046 - RNA, 19 nt, Human
ccccaguaguuccguuuuc

SEQ ID NO: 207047 - RNA, 20 nt, Human
cgugugaggauaaagggcug

SEQ ID NO: 207048 - RNA, 18 nt, Human
cugggggcagggcgagga

SEQ ID NO: 207049 - RNA, 22 nt, Human
gcuccuggccucugggggcagg

SEQ ID NO: 207050 - RNA, 22 nt, Human
gcugagggcucagaggggcuuc

SEQ ID NO: 207051 - RNA, 20 nt, Human
gggaggaaagaggggcugag

SEQ ID NO: 207052 - RNA, 18 nt, Human
uaccgggaugguucucag

SEQ ID NO: 207053 - RNA, 23 nt, Human
uaggagagggaggaaagaggggc

SEQ ID NO: 207054 - RNA, 18 nt, Human
ucagaggggcuuccucuc

SEQ ID NO: 207055 - RNA, 20 nt, Human
ucagugagcccucccuuucu

SEQ ID NO: 207056 - RNA, 26 nt, Human
ucucagugagcccucccuuuccccag

SEQ ID NO: 207057 - RNA, 25 nt, Human
ugagggcagaacaaauuccugagga

SEQ ID NO: 207058 - RNA, 18 nt, Human
ugagggcucagaggggcu

SEQ ID NO: 207059 - RNA, 19 nt, Human
uggagacugccccuguguu

SEQ ID NO: 207060 - RNA, 23 nt, Human
uggaguaaguggaauacagguca

SEQ ID NO: 207061 - RNA, 21 nt, Human
uggccagggccagaugagggc

SEQ ID NO: 207062 - RNA, 20 nt, Human
uggccucaaugaugccuccu

SEQ ID NO: 207063 - RNA, 25 nt, Human
ugggauacaggucacgggcagagcu

SEQ ID NO: 207064 - RNA, 18 nt, Human
ugugaggauaaagggcug

SEQ ID NO: 207065 - RNA, 20 nt, Human
uguggagguccuggagacug

SEQ ID NO: 207066 - RNA, 21 nt, Human
uuccccaguaguuccguuuuc

SEQ ID NO: 207067 - RNA, 19 nt, Human
uuccugaggaucaaauuac

SEQ ID NO: 207068 - RNA, 22 nt, Human
aaauagauaaaucaguuuauca

SEQ ID NO: 207069 - RNA, 21 nt, Human
cugggcuugcugagaugggug

SEQ ID NO: 207070 - RNA, 18 nt, Human
ggugacucugaaccuugg

SEQ ID NO: 207071 - RNA, 19 nt, Human
ggugcacaugacguuauau

SEQ ID NO: 207072 - RNA, 23 nt, Human
ugaccugguguaugagucaauaa

SEQ ID NO: 207073 - RNA, 24 nt, Human
ugagaugggugacucugaaccuug

SEQ ID NO: 207074 - RNA, 22 nt, Human
ugagucaauaagaauuguuuuc

SEQ ID NO: 207075 - RNA, 18 nt, Human
accacaauguaaagcgac

SEQ ID NO: 207076 - RNA, 24 nt, Human
acgacacuucuuuacacugcugaa

SEQ ID NO: 207077 - RNA, 18 nt, Human
gaaauggaagaacucaug

SEQ ID NO: 207078 - RNA, 24 nt, Human
gcacagguauacacgacacuucuu

SEQ ID NO: 207079 - RNA, 21 nt, Human
ggacuagugccugcacaggua

SEQ ID NO: 207080 - RNA, 18 nt, Human
gugagucuuugaaaugga

SEQ ID NO: 207081 - RNA, 24 nt, Human
uaaauaugaagaacauauauuguu

SEQ ID NO: 207082 - RNA, 24 nt, Human
uauaguaaaaauuuaaugaaaaag

SEQ ID NO: 207083 - RNA, 18 nt, Human
ugaaauggaagaacucau

SEQ ID NO: 207084 - RNA, 19 nt, Human
ugaaauggaagaacucaug

SEQ ID NO: 207085 - RNA, 24 nt, Human
ugagucuuugaaauggaagaacuc

SEQ ID NO: 207086 - RNA, 19 nt, Human
ugccugcacagguauacac

SEQ ID NO: 207087 - RNA, 21 nt, Human
cugggcuugcugagaugggug

SEQ ID NO: 207088 - RNA, 18 nt, Human
ggugacucugaaccuugg

SEQ ID NO: 207089 - RNA, 24 nt, Human
ugagaugggugacucugaaccuug

SEQ ID NO: 207090 - RNA, 18 nt, Human
cugaaaacauuuggaaau

SEQ ID NO: 207091 - RNA, 18 nt, Human
gugagucuuugaaaugga

SEQ ID NO: 207092 - RNA, 21 nt, Human
uacauuaaccacaauguaaag

SEQ ID NO: 207093 - RNA, 25 nt, Human
ucccgaagaugcugcugaccauugg

SEQ ID NO: 207094 - RNA, 24 nt, Human
ugauucaacuuguggugguuauag

SEQ ID NO: 207095 - RNA, 23 nt, Human
ugcugggcugguugaugaggggu

SEQ ID NO: 207096 - RNA, 19 nt, Human
ugguugaugagggguaaca

SEQ ID NO: 207097 - RNA, 18 nt, Human
uuccaugaugaaccaggg

SEQ ID NO: 207098 - RNA, 19 nt, Human
aaaaauuuaaugaaaagga

SEQ ID NO: 207099 - RNA, 22 nt, Human
aaacauuuugaaauuuugauuc

SEQ ID NO: 207100 - RNA, 22 nt, Human
aguaaaaauuuaaugaaaagga

SEQ ID NO: 207101 - RNA, 21 nt, Human
auaaaacaugauuuaaaccuu

SEQ ID NO: 207102 - RNA, 18 nt, Human
gaaauggaagaacucaug

SEQ ID NO: 207103 - RNA, 18 nt, Human
gugagucuuugaaaugga

SEQ ID NO: 207104 - RNA, 24 nt, Human
guuacauuaagcaaaauguaaagg

SEQ ID NO: 207105 - RNA, 24 nt, Human
uaaauaugaagaacauauauuguu

SEQ ID NO: 207106 - RNA, 21 nt, Human
uacauaaaacaugauuuaaac

SEQ ID NO: 207107 - RNA, 18 nt, Human
ugaaauggaagaacucau

SEQ ID NO: 207108 - RNA, 19 nt, Human
ugaaauggaagaacucaug

SEQ ID NO: 207109 - RNA, 18 nt, Human
ugaaauuuugauucaacu

SEQ ID NO: 207110 - RNA, 21 nt, Human
ugaauagagacaucagcaugg

SEQ ID NO: 207111 - RNA, 24 nt, Human
ugauucaacuuguggugguuauag

SEQ ID NO: 207112 - RNA, 18 nt, Human
uggaagaacucaugaaag

SEQ ID NO: 207113 - RNA, 24 nt, Human
gcacagguauacacgacgcuucuu

SEQ ID NO: 207114 - RNA, 18 nt, Human
gugagucuuugaaauuga

SEQ ID NO: 207115 - RNA, 18 nt, Human
gugagucuuugaaauuga

SEQ ID NO: 207116 - RNA, 24 nt, Human
uaaauaugaagaacauauauuguu

SEQ ID NO: 207117 - RNA, 18 nt, Human
uacacgacgcuucuuuac

SEQ ID NO: 207118 - RNA, 18 nt, Human
uacuagugccugcacagg

SEQ ID NO: 207119 - RNA, 24 nt, Human
uauaguaaaaauuuaaugaaaaag

SEQ ID NO: 207120 - RNA, 19 nt, Human
ugagauggguaaccuugaa

SEQ ID NO: 207121 - RNA, 21 nt, Human
ugagucuuugaaauugaggaa

SEQ ID NO: 207122 - RNA, 24 nt, Human
ugauucaacucguggugguuauag

SEQ ID NO: 207123 - RNA, 19 nt, Human
ugccugcacagguauacac

SEQ ID NO: 207124 - RNA, 21 nt, Human
uguuacauucaccacaaugua

SEQ ID NO: 207125 - RNA, 24 nt, Human
uugaaauugaggaacucaugaaaa

SEQ ID NO: 207126 - RNA, 23 nt, Human
aaaauaaauuuaccaaauacaaa

SEQ ID NO: 207127 - RNA, 21 nt, Human
aaacaaguacaaaaguuccau

SEQ ID NO: 207128 - RNA, 23 nt, Human
aaaucauuuccauguugaaccag

SEQ ID NO: 207129 - RNA, 18 nt, Human
aaaucgugucauggucau

SEQ ID NO: 207130 - RNA, 21 nt, Human
aacaugagucuuugaaauggc

SEQ ID NO: 207131 - RNA, 20 nt, Human
acaaaauaaauuuaccaaau

SEQ ID NO: 207132 - RNA, 20 nt, Human
acaugacauaauaugaacaa

SEQ ID NO: 207133 - RNA, 22 nt, Human
acuccuaaaaacauuugaaaag

SEQ ID NO: 207134 - RNA, 27 nt, Human
caaaauaaauuuaccaaauacaaagaa

SEQ ID NO: 207135 - RNA, 23 nt, Human
caacacaaaauaaauuuaccaaa

SEQ ID NO: 207136 - RNA, 18 nt, Human
cagcaugguccucuguaa

SEQ ID NO: 207137 - RNA, 28 nt, Human
cuagugccuuaagagcugaauacaaugg

SEQ ID NO: 207138 - RNA, 22 nt, Human
gaacaaaaauaaguuguuuuau

SEQ ID NO: 207139 - RNA, 20 nt, Human
ggugcacaugacauaauaug

SEQ ID NO: 207140 - RNA, 22 nt, Human
uaaacaaguacaaaaguuccau

SEQ ID NO: 207141 - RNA, 22 nt, Human
uaaguuguuuuauaaauaguuu

SEQ ID NO: 207142 - RNA, 21 nt, Human
uacauuaaccacugugcaaag

SEQ ID NO: 207143 - RNA, 21 nt, Human
uaccaguuauucuguaaucag

SEQ ID NO: 207144 - RNA, 26 nt, Human
uagcagaaacaugagucuuugaaaug

SEQ ID NO: 207145 - RNA, 20 nt, Human
uauuacauuaaccacugugc

SEQ ID NO: 207146 - RNA, 20 nt, Human
ugauuaauacuccuaaaaac

SEQ ID NO: 207147 - RNA, 21 nt, Human
uuaaagaauaaacaaguacaa

SEQ ID NO: 207148 - RNA, 22 nt, Human
accaaauaauauaagaaguuuu

SEQ ID NO: 207149 - RNA, 18 nt, Human
agauagauaauuagaucu

SEQ ID NO: 207150 - RNA, 20 nt, Human
cuccugaaaagaucugaaaa

SEQ ID NO: 207151 - RNA, 21 nt, Human
gacaaaaauaauuuaaaucua

SEQ ID NO: 207152 - RNA, 19 nt, Human
uacacuccugaaaagaucu

SEQ ID NO: 207153 - RNA, 19 nt, Human
uacauggacaaaaauaauu

SEQ ID NO: 207154 - RNA, 19 nt, Human
acuaauuuccauuuucuaa

SEQ ID NO: 207155 - RNA, 23 nt, Human
caucagcauugucaucuguaaag

SEQ ID NO: 207156 - RNA, 18 nt, Human
gaaauggaagaacucaug

SEQ ID NO: 207157 - RNA, 20 nt, Human
gaacagagacaucagcauug

SEQ ID NO: 207158 - RNA, 18 nt, Human
gugagucuuugaaaugga

SEQ ID NO: 207159 - RNA, 18 nt, Human
ugaaauggaagaacucau

SEQ ID NO: 207160 - RNA, 19 nt, Human
ugaaauggaagaacucaug

SEQ ID NO: 207161 - RNA, 21 nt, Human
ugaacagagacaucagcauug

SEQ ID NO: 207162 - RNA, 21 nt, Human
ugagauggauaaccuugaacu

SEQ ID NO: 207163 - RNA, 24 nt, Human
ugauucaacucguggugguuauag

SEQ ID NO: 207164 - RNA, 18 nt, Human
uggaagaacucaugaaag

SEQ ID NO: 207165 - RNA, 18 nt, Human
uucuaaauucccuaguug

SEQ ID NO: 207166 - RNA, 18 nt, Human
gaaauggaagaacucaug

SEQ ID NO: 207167 - RNA, 18 nt, Human
gugagucuuugaaaugga

SEQ ID NO: 207168 - RNA, 18 nt, Human
ugaaauggaagaacucau

SEQ ID NO: 207169 - RNA, 19 nt, Human
ugaaauggaagaacucaug

SEQ ID NO: 207170 - RNA, 24 nt, Human
ugauucaacuuguggugguuauag

SEQ ID NO: 207171 - RNA, 18 nt, Human
uggaagaacucaugaaag

SEQ ID NO: 207172 - RNA, 18 nt, Human
uuccaugaugaaccaggg

SEQ ID NO: 207173 - RNA, 18 nt, Human
aaacacuugacacauuug

SEQ ID NO: 207174 - RNA, 22 nt, Human
aacaggauguugcuuaacacuc

SEQ ID NO: 207175 - RNA, 22 nt, Human
aacuaaauaaagauuuaaauaa

SEQ ID NO: 207176 - RNA, 22 nt, Human
caaaauaauaaauauaaagaac

SEQ ID NO: 207177 - RNA, 26 nt, Human
caauucacaauguaaaaguucacaua

SEQ ID NO: 207178 - RNA, 24 nt, Human
cacuccugaaaacacuugacacau

SEQ ID NO: 207179 - RNA, 19 nt, Human
ccauacagcugaacaggau

SEQ ID NO: 207180 - RNA, 25 nt, Human
ccauacagcugaacaggauguugcu

SEQ ID NO: 207181 - RNA, 19 nt, Human
gaacaaaacuaauuuaagc

SEQ ID NO: 207182 - RNA, 19 nt, Human
gucuuugaaagagcacaac

SEQ ID NO: 207183 - RNA, 25 nt, Human
uaauaugaacaaaacuaauuuaagc

SEQ ID NO: 207184 - RNA, 19 nt, Human
ugaaagagcacaacuuguc

SEQ ID NO: 207185 - RNA, 21 nt, Human
ugaauagauccaucagcaugg

SEQ ID NO: 207186 - RNA, 22 nt, Human
ugcccauacagcugaacaggau

SEQ ID NO: 207187 - RNA, 20 nt, Human
uggcagaaacaagggucuuu

SEQ ID NO: 207188 - RNA, 23 nt, Human
uuaaucaguuugcacaaucaggg

SEQ ID NO: 207189 - RNA, 24 nt, Human
aaagugcugggauuacagguguga

SEQ ID NO: 207190 - RNA, 18 nt, Human
aagugcugggauuacagg

SEQ ID NO: 207191 - RNA, 19 nt, Human
aagugcugggauuacaggu

SEQ ID NO: 207192 - RNA, 26 nt, Human
aagugcugggauuacaggugugagcc

SEQ ID NO: 207193 - RNA, 24 nt, Human
accacguuggccaggcuggucucg

SEQ ID NO: 207194 - RNA, 20 nt, Human
accauguaaggguagauacu

SEQ ID NO: 207195 - RNA, 24 nt, Human
acugcaaccuccaccuccuguuuu

SEQ ID NO: 207196 - RNA, 23 nt, Human
agaggaaggugaggaccucaggc

SEQ ID NO: 207197 - RNA, 18 nt, Human
agccaccgugcccgggcc

SEQ ID NO: 207198 - RNA, 19 nt, Human
agccuccugaguagcuaag

SEQ ID NO: 207199 - RNA, 19 nt, Human
aggaagacggguggccacu

SEQ ID NO: 207200 - RNA, 25 nt, Human
aggcuggagugcaguggcgugaucu

SEQ ID NO: 207201 - RNA, 19 nt, Human
agugcaguggcgugaucuc

SEQ ID NO: 207202 - RNA, 20 nt, Human
agugcaguggcgugaucucg

SEQ ID NO: 207203 - RNA, 23 nt, Human
agugcaguggcgugaucucggcu

SEQ ID NO: 207204 - RNA, 24 nt, Human
agugcaguggcgugaucucggcuc

SEQ ID NO: 207205 - RNA, 24 nt, Human
augaucugccugccucagccuccc

SEQ ID NO: 207206 - RNA, 18 nt, Human
augggguuucaccacguu

SEQ ID NO: 207207 - RNA, 20 nt, Human
augggguuucaccacguugg

SEQ ID NO: 207208 - RNA, 24 nt, Human
augggguuucaccacguuggccag

SEQ ID NO: 207209 - RNA, 18 nt, Human
auguuaggaauggcgaac

SEQ ID NO: 207210 - RNA, 24 nt, Human
auuuuuguauuuuuaguagagaug

SEQ ID NO: 207211 - RNA, 24 nt, Human
caaagugcugggauuacaggugug

SEQ ID NO: 207212 - RNA, 20 nt, Human
caagcgauucuccugccuca

SEQ ID NO: 207213 - RNA, 22 nt, Human
caagcgauucuccugccucagc

SEQ ID NO: 207214 - RNA, 21 nt, Human
caccacguuggccaggcuggu

SEQ ID NO: 207215 - RNA, 24 nt, Human
caccacguuggccaggcuggucuc

SEQ ID NO: 207216 - RNA, 24 nt, Human
caccaggcuggagugcaguggcgu

SEQ ID NO: 207217 - RNA, 23 nt, Human
cacgcugucaccaggcuggagug

SEQ ID NO: 207218 - RNA, 24 nt, Human
cacgcugucaccaggcuggagugc

SEQ ID NO: 207219 - RNA, 23 nt, Human
cacguuggccaggcuggucucga

SEQ ID NO: 207220 - RNA, 21 nt, Human
cacugcaaccuccaccuccug

SEQ ID NO: 207221 - RNA, 22 nt, Human
cacuguuuuggucugacucauc

SEQ ID NO: 207222 - RNA, 21 nt, Human
cagacagguguggcacaugca

SEQ ID NO: 207223 - RNA, 22 nt, Human
cagccgccaucgccccguccua

SEQ ID NO: 207224 - RNA, 20 nt, Human
cagccuccugaguagcuaag

SEQ ID NO: 207225 - RNA, 23 nt, Human
caggcgcgcgccuaccuacuacc

SEQ ID NO: 207226 - RNA, 21 nt, Human
caggcucccaguguaacuccu

SEQ ID NO: 207227 - RNA, 23 nt, Human
caguguuaaaagaaaagaccaaa

SEQ ID NO: 207228 - RNA, 23 nt, Human
cauccaaugcaaguccggugaca

SEQ ID NO: 207229 - RNA, 24 nt, Human
caugaucugccugccucagccucc

SEQ ID NO: 207230 - RNA, 21 nt, Human
ccaaagugcugggauuacagg

SEQ ID NO: 207231 - RNA, 21 nt, Human
ccaaagugcugggauuacagg

SEQ ID NO: 207232 - RNA, 24 nt, Human
ccaaagugcugggauuacaggugu

SEQ ID NO: 207233 - RNA, 22 nt, Human
ccgcagaucccaccaguuacau

SEQ ID NO: 207234 - RNA, 20 nt, Human
ccuaaaccauguaaggguag

SEQ ID NO: 207235 - RNA, 19 nt, Human
ccuacccucaguguuaaaa

SEQ ID NO: 207236 - RNA, 23 nt, Human
ccucucagccgccaucgccccgu

SEQ ID NO: 207237 - RNA, 23 nt, Human
ccugccucagccuccugaguagc

SEQ ID NO: 207238 - RNA, 24 nt, Human
ccugccucagccuccugaguagcu

SEQ ID NO: 207239 - RNA, 18 nt, Human
cgaacagacagguguggc

SEQ ID NO: 207240 - RNA, 21 nt, Human
cuacccggcuaauuuuuguau

SEQ ID NO: 207241 - RNA, 21 nt, Human
cuacuacccggcuaauuuuug

SEQ ID NO: 207242 - RNA, 26 nt, Human
cucacugcaaccuccaccuccuguuu

SEQ ID NO: 207243 - RNA, 18 nt, Human
cucaugaucugccugccu

SEQ ID NO: 207244 - RNA, 24 nt, Human
cuccugaguagcuaagacaacagg

SEQ ID NO: 207245 - RNA, 19 nt, Human
cucucuguaguuacugaga

SEQ ID NO: 207246 - RNA, 24 nt, Human
cucuugaccucaugaucugccugc

SEQ ID NO: 207247 - RNA, 21 nt, Human
cugcaaccuccaccuccuguu

SEQ ID NO: 207248 - RNA, 23 nt, Human
cugccucagccucccaaagugcu

SEQ ID NO: 207249 - RNA, 24 nt, Human
cugccucagccucccaaagugcug

SEQ ID NO: 207250 - RNA, 21 nt, Human
cuugaccucaugaucugccug

SEQ ID NO: 207251 - RNA, 21 nt, Human
cuugcccguauuuuuaggacc

SEQ ID NO: 207252 - RNA, 20 nt, Human
gaacagaagucccucaacau

SEQ ID NO: 207253 - RNA, 24 nt, Human
gaccucaugaucugccugccucag

SEQ ID NO: 207254 - RNA, 18 nt, Human
gagaugggguuucaccac

SEQ ID NO: 207255 - RNA, 24 nt, Human
gagaugggguuucaccacguuggc

SEQ ID NO: 207256 - RNA, 18 nt, Human
gauuacaggugugagcca

SEQ ID NO: 207257 - RNA, 21 nt, Human
gauuacaggugugagccaccg

SEQ ID NO: 207258 - RNA, 24 nt, Human
gauuacaggugugagccaccgugc

SEQ ID NO: 207259 - RNA, 21 nt, Human
gauucuccugccucagccucc

SEQ ID NO: 207260 - RNA, 20 nt, Human
gcaaccuccaccuccuguuu

SEQ ID NO: 207261 - RNA, 23 nt, Human
gcgauucuccugccucagccucc

SEQ ID NO: 207262 - RNA, 19 nt, Human
gcgccuaccuacuacccgg

SEQ ID NO: 207263 - RNA, 19 nt, Human
gcuggagugcaguggcgug

SEQ ID NO: 207264 - RNA, 25 nt, Human
ggacaggaacacagacgucauccuu

SEQ ID NO: 207265 - RNA, 22 nt, Human
ggcuggagugcaguggcgugau

SEQ ID NO: 207266 - RNA, 22 nt, Human
gggguuucaccacguuggccag

SEQ ID NO: 207267 - RNA, 22 nt, Human
ggguuucaccacguuggccagg

SEQ ID NO: 207268 - RNA, 21 nt, Human
uaagagcuugcccguauuuuu

SEQ ID NO: 207269 - RNA, 24 nt, Human
uaauuuuuguauuuuuaguagaga

SEQ ID NO: 207270 - RNA, 23 nt, Human
uacaggugugagccaccgugccc

SEQ ID NO: 207271 - RNA, 20 nt, Human
uacauguucgcgcacgcgca

SEQ ID NO: 207272 - RNA, 22 nt, Human
uagagaugggguuucaccacgu

SEQ ID NO: 207273 - RNA, 21 nt, Human
uaggguaagcuacuuuccaga

SEQ ID NO: 207274 - RNA, 19 nt, Human
uaguagagaugggguuuca

SEQ ID NO: 207275 - RNA, 24 nt, Human
uaguagagaugggguuucaccacg

SEQ ID NO: 207276 - RNA, 26 nt, Human
uaguagagaugggguuucaccacguu

SEQ ID NO: 207277 - RNA, 19 nt, Human
ucaagcgauucuccugccu

SEQ ID NO: 207278 - RNA, 21 nt, Human
ucacaggaggaagacgggugg

SEQ ID NO: 207279 - RNA, 24 nt, Human
ucacaggaggaagacggguggcca

SEQ ID NO: 207280 - RNA, 24 nt, Human
ucaccaggcuggagugcaguggcg

SEQ ID NO: 207281 - RNA, 23 nt, Human
ucacgcugucaccaggcuggagu

SEQ ID NO: 207282 - RNA, 19 nt, Human
ucacugcaaccuccaccuc

SEQ ID NO: 207283 - RNA, 20 nt, Human
ucacugcaaccuccaccucc

SEQ ID NO: 207284 - RNA, 22 nt, Human
ucacugcaaccuccaccuccug

SEQ ID NO: 207285 - RNA, 23 nt, Human
ucacugcaaccuccaccuccugu

SEQ ID NO: 207286 - RNA, 27 nt, Human
ucacugcaaccuccaccuccuguuuuc

SEQ ID NO: 207287 - RNA, 23 nt, Human
ucaguguuaaaagaaaagaccaa

SEQ ID NO: 207288 - RNA, 23 nt, Human
ucccaaagugcugggauuacagg

SEQ ID NO: 207289 - RNA, 21 nt, Human
uccuguuuucaagcgauucuc

SEQ ID NO: 207290 - RNA, 24 nt, Human
uccuguuuucaagcgauucuccug

SEQ ID NO: 207291 - RNA, 21 nt, Human
ucucacgcugucaccaggcug

SEQ ID NO: 207292 - RNA, 23 nt, Human
ucucacgcugucaccaggcugga

SEQ ID NO: 207293 - RNA, 24 nt, Human
ucuccugccucagccuccugagua

SEQ ID NO: 207294 - RNA, 19 nt, Human
ugacacaguucauuucugg

SEQ ID NO: 207295 - RNA, 22 nt, Human
ugcaguggcgugaucucggcuc

SEQ ID NO: 207296 - RNA, 24 nt, Human
ugccucagccucccaaagugcugg

SEQ ID NO: 207297 - RNA, 23 nt, Human
ugccucagccuccugaguagcua

SEQ ID NO: 207298 - RNA, 24 nt, Human
ugccucagccuccugaguagcuaa

SEQ ID NO: 207299 - RNA, 24 nt, Human
ugcugggauuacaggugugagcca

SEQ ID NO: 207300 - RNA, 19 nt, Human
uggagugcaguggcgugau

SEQ ID NO: 207301 - RNA, 23 nt, Human
uggagugcaguggcgugaucucg

SEQ ID NO: 207302 - RNA, 24 nt, Human
uggagugcaguggcgugaucucgg

SEQ ID NO: 207303 - RNA, 19 nt, Human
uggcauuugcagcuguuuu

SEQ ID NO: 207304 - RNA, 22 nt, Human
uggccaggcuggucucgaucuc

SEQ ID NO: 207305 - RNA, 20 nt, Human
uggcgugaucucggcucacu

SEQ ID NO: 207306 - RNA, 18 nt, Human
ugggauuacaggugugag

SEQ ID NO: 207307 - RNA, 21 nt, Human
ugggauuacaggugugagcca

SEQ ID NO: 207308 - RNA, 22 nt, Human
ugggauuacaggugugagccac

SEQ ID NO: 207309 - RNA, 23 nt, Human
ugggauuacaggugugagccacc

SEQ ID NO: 207310 - RNA, 23 nt, Human
ugggauuacaggugugagccacc

SEQ ID NO: 207311 - RNA, 24 nt, Human
ugggauuacaggugugagccaccg

SEQ ID NO: 207312 - RNA, 24 nt, Human
ugggguuucaccacguuggccagg

SEQ ID NO: 207313 - RNA, 20 nt, Human
ugucaccaggcuggagugca

SEQ ID NO: 207314 - RNA, 24 nt, Human
uguuuucaagcgauucuccugccu

SEQ ID NO: 207315 - RNA, 19 nt, Human
uuaauccuaaaccauguaa

SEQ ID NO: 207316 - RNA, 18 nt, Human
uuaguagagaugggguuu

SEQ ID NO: 207317 - RNA, 22 nt, Human
uuaguagagaugggguuucacc

SEQ ID NO: 207318 - RNA, 24 nt, Human
uuaguagagaugggguuucaccac

SEQ ID NO: 207319 - RNA, 25 nt, Human
uuaguagagaugggguuucaccacg

SEQ ID NO: 207320 - RNA, 21 nt, Human
uucaagcgauucuccugccuc

SEQ ID NO: 207321 - RNA, 23 nt, Human
uucaagcgauucuccugccucag

SEQ ID NO: 207322 - RNA, 24 nt, Human
uucaagcgauucuccugccucagc

SEQ ID NO: 207323 - RNA, 19 nt, Human
uucucgggaugaaugaaca

SEQ ID NO: 207324 - RNA, 23 nt, Human
uuguauuuuuaguagagaugggg

SEQ ID NO: 207325 - RNA, 21 nt, Human
uuucaccacguuggccaggcu

SEQ ID NO: 207326 - RNA, 20 nt, Human
uuucaugauuuuacacaugg

SEQ ID NO: 207327 - RNA, 18 nt, Human
uuugaaauaucucccgag

SEQ ID NO: 207328 - RNA, 24 nt, Human
uuuuuaguagagaugggguuucac

SEQ ID NO: 207329 - RNA, 22 nt, Human
uuuuucaugauuuuacacaugg

SEQ ID NO: 207330 - RNA, 20 nt, Human
uuuuuguauuuuuaguagag

SEQ ID NO: 207331 - RNA, 27 nt, Human
aaaaaaaaaaaaaaaagaacgaaagaa

SEQ ID NO: 207332 - RNA, 24 nt, Human
aaaaaaaaaagaacgaaagaagag

SEQ ID NO: 207333 - RNA, 19 nt, Human
aaaaacacagaguuuaagu

SEQ ID NO: 207334 - RNA, 20 nt, Human
aaaaacacagaguuuaaguc

SEQ ID NO: 207335 - RNA, 20 nt, Human
aacaugguaaaauccugucu

SEQ ID NO: 207336 - RNA, 22 nt, Human
aagaacucucaaaaacacagag

SEQ ID NO: 207337 - RNA, 20 nt, Human
aaggaaaggugcacaugugc

SEQ ID NO: 207338 - RNA, 18 nt, Human
aagguaauucugccccca

SEQ ID NO: 207339 - RNA, 24 nt, Human
aaucaccugaacccgggaggcgga

SEQ ID NO: 207340 - RNA, 22 nt, Human
acagaacgagacucugucucaa

SEQ ID NO: 207341 - RNA, 23 nt, Human
acagaacgagacucugucucaaa

SEQ ID NO: 207342 - RNA, 24 nt, Human
acagaacgagacucugucucaaaa

SEQ ID NO: 207343 - RNA, 19 nt, Human
acgccauguuuccuuucug

SEQ ID NO: 207344 - RNA, 19 nt, Human
agacaggaugugacauggg

SEQ ID NO: 207345 - RNA, 23 nt, Human
agaucacuugaggucaggaguuc

SEQ ID NO: 207346 - RNA, 22 nt, Human
agccaggcacagcggcucaccc

SEQ ID NO: 207347 - RNA, 24 nt, Human
agccuggccaacaugguaaaaucc

SEQ ID NO: 207348 - RNA, 24 nt, Human
agcggcucaccccuguaaucccag

SEQ ID NO: 207349 - RNA, 24 nt, Human
agcuugggcgacagaacgagacuc

SEQ ID NO: 207350 - RNA, 19 nt, Human
aggaacaccacaguuuccu

SEQ ID NO: 207351 - RNA, 22 nt, Human
aggagggcagaucacuugaggu

SEQ ID NO: 207352 - RNA, 26 nt, Human
aggagggcagaucacuugaggucagg

SEQ ID NO: 207353 - RNA, 24 nt, Human
aggcacagcggcucaccccuguaa

SEQ ID NO: 207354 - RNA, 19 nt, Human
aggcagcaaguuaggaugc

SEQ ID NO: 207355 - RNA, 18 nt, Human
aggcaggagaaucaccug

SEQ ID NO: 207356 - RNA, 18 nt, Human
aggcaggagaaucaccug

SEQ ID NO: 207357 - RNA, 24 nt, Human
aggcaggagaaucaccugaacccg

SEQ ID NO: 207358 - RNA, 24 nt, Human
aggcaugguggcaggcgccuguaa

SEQ ID NO: 207359 - RNA, 19 nt, Human
aggcggauguugcagugag

SEQ ID NO: 207360 - RNA, 22 nt, Human
aggcggauguugcagugagcca

SEQ ID NO: 207361 - RNA, 24 nt, Human
aggcggauguugcagugagccaag

SEQ ID NO: 207362 - RNA, 21 nt, Human
aggcugaggagggcagaucac

SEQ ID NO: 207363 - RNA, 24 nt, Human
aggcugaggcaggagaaucaccug

SEQ ID NO: 207364 - RNA, 19 nt, Human
aggucaggaguucgagacc

SEQ ID NO: 207365 - RNA, 22 nt, Human
agguggcagaggccugacccag

SEQ ID NO: 207366 - RNA, 23 nt, Human
agguggcagaggccugacccaga

SEQ ID NO: 207367 - RNA, 25 nt, Human
aucaagaacucucaaaaacacagag

SEQ ID NO: 207368 - RNA, 24 nt, Human
aucacaccauugcgcuccagcuug

SEQ ID NO: 207369 - RNA, 24 nt, Human
auccucugggucaaccaucucuuc

SEQ ID NO: 207370 - RNA, 18 nt, Human
auugcgcuccagcuuggg

SEQ ID NO: 207371 - RNA, 20 nt, Human
caaagugcaccacuuugaau

SEQ ID NO: 207372 - RNA, 18 nt, Human
caagaacucucaaaaaca

SEQ ID NO: 207373 - RNA, 22 nt, Human
caagaguuccaacugcugaggg

SEQ ID NO: 207374 - RNA, 18 nt, Human
cacacuuucuucuuucug

SEQ ID NO: 207375 - RNA, 23 nt, Human
caccccuguaaucccagcacuuu

SEQ ID NO: 207376 - RNA, 23 nt, Human
cacuugaggucaggaguucgaga

SEQ ID NO: 207377 - RNA, 19 nt, Human
cagaggccugacccagagg

SEQ ID NO: 207378 - RNA, 24 nt, Human
cagaucacuugaggucaggaguuc

SEQ ID NO: 207379 - RNA, 27 nt, Human
cagaucacuugaggucaggaguucgag

SEQ ID NO: 207380 - RNA, 20 nt, Human
caggcuaaaaaguuaugaaa

SEQ ID NO: 207381 - RNA, 18 nt, Human
cauccccaaggucaacau

SEQ ID NO: 207382 - RNA, 22 nt, Human
cauuaggugaucaaaauucuga

SEQ ID NO: 207383 - RNA, 23 nt, Human
cauuauauaaccauccccaaggu

SEQ ID NO: 207384 - RNA, 19 nt, Human
cauugcgcuccagcuuggg

SEQ ID NO: 207385 - RNA, 20 nt, Human
cauugcgcuccagcuugggc

SEQ ID NO: 207386 - RNA, 22 nt, Human
cauugcgcuccagcuugggcga

SEQ ID NO: 207387 - RNA, 24 nt, Human
cauugcgcuccagcuugggcgaca

SEQ ID NO: 207388 - RNA, 18 nt, Human
ccaacugcugagggcugu

SEQ ID NO: 207389 - RNA, 21 nt, Human
ccauugcgcuccagcuugggc

SEQ ID NO: 207390 - RNA, 24 nt, Human
ccauugcgcuccagcuugggcgac

SEQ ID NO: 207391 - RNA, 25 nt, Human
ccauugcgcuccagcuugggcgaca

SEQ ID NO: 207392 - RNA, 26 nt, Human
cccaauuuauuucacagaaauaucac

SEQ ID NO: 207393 - RNA, 22 nt, Human
cccccagaccccuccguggagc

SEQ ID NO: 207394 - RNA, 21 nt, Human
ccccccuucucuccacugcuc

SEQ ID NO: 207395 - RNA, 19 nt, Human
ccccuguaaucccagcacu

SEQ ID NO: 207396 - RNA, 18 nt, Human
cccgugcggccggguggu

SEQ ID NO: 207397 - RNA, 18 nt, Human
ccuccucccuuccugccu

SEQ ID NO: 207398 - RNA, 21 nt, Human
ccucgggccccagccgcgccc

SEQ ID NO: 207399 - RNA, 19 nt, Human
ccucugggucaaccaucuc

SEQ ID NO: 207400 - RNA, 22 nt, Human
ccuggccaacaugguaaaaucc

SEQ ID NO: 207401 - RNA, 24 nt, Human
ccuggccaacaugguaaaauccug

SEQ ID NO: 207402 - RNA, 20 nt, Human
ccuguaaucccagcuacuug

SEQ ID NO: 207403 - RNA, 23 nt, Human
ccuguaaucccagcuacuugcga

SEQ ID NO: 207404 - RNA, 22 nt, Human
ccugucuccacuaaaaauacaa

SEQ ID NO: 207405 - RNA, 23 nt, Human
ccuugugcagggccccccuucuc

SEQ ID NO: 207406 - RNA, 19 nt, Human
ccuuuucuuucccugcucc

SEQ ID NO: 207407 - RNA, 21 nt, Human
ccuuuucuuucccugcuccca

SEQ ID NO: 207408 - RNA, 20 nt, Human
cgaaagaagagaaauaucau

SEQ ID NO: 207409 - RNA, 21 nt, Human
cgacugaaacuucgauggcuc

SEQ ID NO: 207410 - RNA, 24 nt, Human
cgagaccagccuggccaacauggu

SEQ ID NO: 207411 - RNA, 21 nt, Human
cgauaaggcagcaaguuagga

SEQ ID NO: 207412 - RNA, 22 nt, Human
cgccuguaaucccagcuacuug

SEQ ID NO: 207413 - RNA, 20 nt, Human
cgcgcccggcucugggaccc

SEQ ID NO: 207414 - RNA, 24 nt, Human
cggcucaccccuguaaucccagca

SEQ ID NO: 207415 - RNA, 20 nt, Human
cgggaaaaggguccuggagu

SEQ ID NO: 207416 - RNA, 18 nt, Human
cucaaaaaaaaaaaaaaa

SEQ ID NO: 207417 - RNA, 24 nt, Human
cucaaaaaaaaaaaaaaaagaacg

SEQ ID NO: 207418 - RNA, 24 nt, Human
cucaccccuguaaucccagcacuu

SEQ ID NO: 207419 - RNA, 21 nt, Human
cucauuauauaaccaucccca

SEQ ID NO: 207420 - RNA, 20 nt, Human
cuccccgacgccauguuucc

SEQ ID NO: 207421 - RNA, 25 nt, Human
cucccuuccugccugcuuugcagcu

SEQ ID NO: 207422 - RNA, 23 nt, Human
cucgggccccagccgcgcccggc

SEQ ID NO: 207423 - RNA, 23 nt, Human
cucgucaucaagaacucucaaaa

SEQ ID NO: 207424 - RNA, 19 nt, Human
cucugucucaaaaaaaaaa

SEQ ID NO: 207425 - RNA, 23 nt, Human
cugaaacuucgauggcucuuccc

SEQ ID NO: 207426 - RNA, 22 nt, Human
cugcucaccuggcucuccuccu

SEQ ID NO: 207427 - RNA, 18 nt, Human
cuggacaagguggaauuc

SEQ ID NO: 207428 - RNA, 18 nt, Human
cuuaaaaaaaaaaaaaaa

SEQ ID NO: 207429 - RNA, 20 nt, Human
cuuaaaaaaaaaaaaaaaga

SEQ ID NO: 207430 - RNA, 23 nt, Human
cuuaaaaaaaaaaaaaaagagag

SEQ ID NO: 207431 - RNA, 18 nt, Human
cuugucuguccaaguuca

SEQ ID NO: 207432 - RNA, 22 nt, Human
gaacaccacaguuuccuccucc

SEQ ID NO: 207433 - RNA, 18 nt, Human
gaacccgggaggcggaug

SEQ ID NO: 207434 - RNA, 18 nt, Human
gacccagaggccugacag

SEQ ID NO: 207435 - RNA, 23 nt, Human
gaggagggcagaucacuugaggu

SEQ ID NO: 207436 - RNA, 24 nt, Human
gaucacuugaggucaggaguucga

SEQ ID NO: 207437 - RNA, 19 nt, Human
gaugcagagacaaagaacc

SEQ ID NO: 207438 - RNA, 19 nt, Human
gauguugcagugagccaag

SEQ ID NO: 207439 - RNA, 21 nt, Human
gauucuguagagguggcagag

SEQ ID NO: 207440 - RNA, 23 nt, Human
gcaggagaaucaccugaacccgg

SEQ ID NO: 207441 - RNA, 24 nt, Human
gccaacaugguaaaauccugucuc

SEQ ID NO: 207442 - RNA, 19 nt, Human
gccauguuuccuuucugua

SEQ ID NO: 207443 - RNA, 20 nt, Human
gccucgggccccagccgcgc

SEQ ID NO: 207444 - RNA, 20 nt, Human
gcggccucucggacagaagc

SEQ ID NO: 207445 - RNA, 19 nt, Human
gcgggcgggggacaaaagc

SEQ ID NO: 207446 - RNA, 20 nt, Human
gcuagccucgggccccagcc

SEQ ID NO: 207447 - RNA, 22 nt, Human
gcuaggcaugguggcaggcgcc

SEQ ID NO: 207448 - RNA, 23 nt, Human
ggaaaggugcacaugugcuuccu

SEQ ID NO: 207449 - RNA, 23 nt, Human
ggacagaagcggcgggcggggga

SEQ ID NO: 207450 - RNA, 20 nt, Human
ggauguugcagugagccaag

SEQ ID NO: 207451 - RNA, 24 nt, Human
ggauguugcagugagccaagauca

SEQ ID NO: 207452 - RNA, 25 nt, Human
ggcagaucacuugaggucaggaguu

SEQ ID NO: 207453 - RNA, 21 nt, Human
ggcaggcgccuguaaucccag

SEQ ID NO: 207454 - RNA, 19 nt, Human
ggcccgugcggccgggugg

SEQ ID NO: 207455 - RNA, 24 nt, Human
ggcgccuguaaucccagcuacuug

SEQ ID NO: 207456 - RNA, 21 nt, Human
ggcggccucucggacagaagc

SEQ ID NO: 207457 - RNA, 22 nt, Human
gggaacuguucggcucgccggc

SEQ ID NO: 207458 - RNA, 23 nt, Human
gggaggcugaggcaggagaauca

SEQ ID NO: 207459 - RNA, 19 nt, Human
gggcuucuaagucgucacu

SEQ ID NO: 207460 - RNA, 24 nt, Human
gguggcaggcgccuguaaucccag

SEQ ID NO: 207461 - RNA, 18 nt, Human
ggugguccgcgggcugcg

SEQ ID NO: 207462 - RNA, 24 nt, Human
gucaucucauuauauaaccauccc

SEQ ID NO: 207463 - RNA, 23 nt, Human
guggcaggcgccuguaaucccag

SEQ ID NO: 207464 - RNA, 21 nt, Human
guggggaacccugcucccugg

SEQ ID NO: 207465 - RNA, 19 nt, Human
guuugcucuuuauuuucua

SEQ ID NO: 207466 - RNA, 22 nt, Human
uaaaauccugucuccacuaaaa

SEQ ID NO: 207467 - RNA, 19 nt, Human
uacaucugaaaucaacauu

SEQ ID NO: 207468 - RNA, 19 nt, Human
uacuugcgagggaggcuga

SEQ ID NO: 207469 - RNA, 21 nt, Human
uagccaccgccacuuguccug

SEQ ID NO: 207470 - RNA, 24 nt, Human
uagccucgggccccagccgcgccc

SEQ ID NO: 207471 - RNA, 19 nt, Human
uaggugaugucaccuggaa

SEQ ID NO: 207472 - RNA, 23 nt, Human
uauguaaacaaugcacugaauga

SEQ ID NO: 207473 - RNA, 24 nt, Human
uauuuuccuuuucuuucccugcuc

SEQ ID NO: 207474 - RNA, 20 nt, Human
ucaagaguuccaacugcuga

SEQ ID NO: 207475 - RNA, 21 nt, Human
ucacacacgugauccuaaagu

SEQ ID NO: 207476 - RNA, 23 nt, Human
ucacaccauugcgcuccagcuug

SEQ ID NO: 207477 - RNA, 20 nt, Human
ucacuugaggucaggaguuc

SEQ ID NO: 207478 - RNA, 21 nt, Human
ucagcuguacuguuugcucuu

SEQ ID NO: 207479 - RNA, 18 nt, Human
uccagcuugggcgacaga

SEQ ID NO: 207480 - RNA, 24 nt, Human
uccagcuugggcgacagaacgaga

SEQ ID NO: 207481 - RNA, 22 nt, Human
ucccugcucccacccuggcccc

SEQ ID NO: 207482 - RNA, 20 nt, Human
ucgauggcucuucccuguuu

SEQ ID NO: 207483 - RNA, 22 nt, Human
ucgauggcucuucccuguuucc

SEQ ID NO: 207484 - RNA, 19 nt, Human
ucgggaaaaggguccugga

SEQ ID NO: 207485 - RNA, 18 nt, Human
ucucaaaaaaaaaaaaaa

SEQ ID NO: 207486 - RNA, 27 nt, Human
ucucaaaaacacagaguuuaaguccac

SEQ ID NO: 207487 - RNA, 26 nt, Human
ucugaagugucuaauuaaacuuugca

SEQ ID NO: 207488 - RNA, 23 nt, Human
ucugucucaaaaaaaaaaaaaaa

SEQ ID NO: 207489 - RNA, 29 nt, Human
ucugucucaaaaaaaaaaaaaaaagaaaa

SEQ ID NO: 207490 - RNA, 18 nt, Human
ucuucggaccacaggccc

SEQ ID NO: 207491 - RNA, 20 nt, Human
ugaaacuguggggaacccug

SEQ ID NO: 207492 - RNA, 24 nt, Human
ugaggagggcagaucacuugaggu

SEQ ID NO: 207493 - RNA, 26 nt, Human
ugaggagggcagaucacuugagguca

SEQ ID NO: 207494 - RNA, 20 nt, Human
ugaggcaggagaaucaccug

SEQ ID NO: 207495 - RNA, 24 nt, Human
ugaggcaggagaaucaccugaacc

SEQ ID NO: 207496 - RNA, 25 nt, Human
ugaggcaggagaaucaccugaaccc

SEQ ID NO: 207497 - RNA, 19 nt, Human
ugauugcacauuaucagga

SEQ ID NO: 207498 - RNA, 19 nt, Human
ugcgagggaggcugaggca

SEQ ID NO: 207499 - RNA, 22 nt, Human
ugcgcuccagcuugggcgacag

SEQ ID NO: 207500 - RNA, 25 nt, Human
ugcuagccucgggccccagccgcgc

SEQ ID NO: 207501 - RNA, 22 nt, Human
uggaagaaaggaacaccacagu

SEQ ID NO: 207502 - RNA, 23 nt, Human
uggaagaaaggaacaccacaguu

SEQ ID NO: 207503 - RNA, 21 nt, Human
uggaauuccaauugcaggaga

SEQ ID NO: 207504 - RNA, 24 nt, Human
uggccaacaugguaaaauccuguc

SEQ ID NO: 207505 - RNA, 29 nt, Human
uggccaggcuaaaaaguuaugaaaauucu

SEQ ID NO: 207506 - RNA, 20 nt, Human
uggcucuccuccucccuucc

SEQ ID NO: 207507 - RNA, 24 nt, Human
ugguggcaggcgccuguaauccca

SEQ ID NO: 207508 - RNA, 23 nt, Human
uguccugggcgcugccucaguua

SEQ ID NO: 207509 - RNA, 22 nt, Human
ugugcagggccccccuucucuc

SEQ ID NO: 207510 - RNA, 21 nt, Human
uuaaguccacauugaagguaa

SEQ ID NO: 207511 - RNA, 18 nt, Human
uuagagucuucucuugac

SEQ ID NO: 207512 - RNA, 24 nt, Human
uugcagcucucgccuugcggcucc

SEQ ID NO: 207513 - RNA, 20 nt, Human
uugcagugagccaagaucac

SEQ ID NO: 207514 - RNA, 18 nt, Human
gucacuuaaacagcaucu

SEQ ID NO: 207515 - RNA, 23 nt, Human
aaaauauauuccccauauaaaua

SEQ ID NO: 207516 - RNA, 18 nt, Human
aaauaaacacacaaccca

SEQ ID NO: 207517 - RNA, 22 nt, Human
acacauucaaguucugucugac

SEQ ID NO: 207518 - RNA, 22 nt, Human
aggcauauuuucaaaccggcag

SEQ ID NO: 207519 - RNA, 23 nt, Human
caagugaaauaaacacacaaccc

SEQ ID NO: 207520 - RNA, 19 nt, Human
caccaggcaugaaaucucc

SEQ ID NO: 207521 - RNA, 23 nt, Human
ccuuguaaucacauagccuugcc

SEQ ID NO: 207522 - RNA, 19 nt, Human
gaaauaaacacacaaccca

SEQ ID NO: 207523 - RNA, 18 nt, Human
gaagcaccaggcaugaaa

SEQ ID NO: 207524 - RNA, 23 nt, Human
gcaugaaaucuccugagaugcua

SEQ ID NO: 207525 - RNA, 19 nt, Human
uaguuggccccugagauaa

SEQ ID NO: 207526 - RNA, 24 nt, Human
ucacaguugucaacaauauuugga

SEQ ID NO: 207527 - RNA, 24 nt, Human
uccccauauaaauaauguuaaaua

SEQ ID NO: 207528 - RNA, 22 nt, Human
ugaaauaaacacacaacccaug

SEQ ID NO: 207529 - RNA, 18 nt, Human
ugcuauguuuucaucagg

SEQ ID NO: 207530 - RNA, 23 nt, Human
uggaagcaccaggcaugaaaucu

SEQ ID NO: 207531 - RNA, 23 nt, Human
uggcugccuaguuggccccugag

SEQ ID NO: 207532 - RNA, 23 nt, Human
uucauuacacaaaaguugcuauu

SEQ ID NO: 207533 - RNA, 18 nt, Human
aaaaugccacacauccuc

SEQ ID NO: 207534 - RNA, 20 nt, Human
aaaauucuuuauuuaaaaau

SEQ ID NO: 207535 - RNA, 24 nt, Human
aauauacacguuucuauuuacaua

SEQ ID NO: 207536 - RNA, 20 nt, Human
aaugccacacauccucuuua

SEQ ID NO: 207537 - RNA, 21 nt, Human
accaaggcagagaaaagaaaa

SEQ ID NO: 207538 - RNA, 21 nt, Human
acgcuuucauguacacuaagu

SEQ ID NO: 207539 - RNA, 19 nt, Human
agccaaaagugaaaaugcc

SEQ ID NO: 207540 - RNA, 19 nt, Human
aggaaaaucagacuucaaa

SEQ ID NO: 207541 - RNA, 18 nt, Human
aggaaccaggaguacugg

SEQ ID NO: 207542 - RNA, 26 nt, Human
ccacacauccucuuuacgcuuucaug

SEQ ID NO: 207543 - RNA, 19 nt, Human
cuucaaaguuggugcaacu

SEQ ID NO: 207544 - RNA, 28 nt, Human
gcagaauuucuucugaaauuacuuaaaa

SEQ ID NO: 207545 - RNA, 19 nt, Human
gugaaaaugccacacaucc

SEQ ID NO: 207546 - RNA, 24 nt, Human
gugaaaaugccacacauccucuuu

SEQ ID NO: 207547 - RNA, 25 nt, Human
uaccaaggcagagaaaagaaaaaaa

SEQ ID NO: 207548 - RNA, 22 nt, Human
uauaccaaggcagagaaaagaa

SEQ ID NO: 207549 - RNA, 23 nt, Human
uccaggaaaaucagacuucaaag

SEQ ID NO: 207550 - RNA, 23 nt, Human
ugaaauuaaagcagaaaacuguc

SEQ ID NO: 207551 - RNA, 23 nt, Human
uggggcaucaccugcucaccuag

SEQ ID NO: 207552 - RNA, 21 nt, Human
ugguugauaccaacuaagaua

SEQ ID NO: 207553 - RNA, 21 nt, Human
ugguugauaccaacuaagaua

SEQ ID NO: 207554 - RNA, 21 nt, Human
uguccaggaaaaucagacuuc

SEQ ID NO: 207555 - RNA, 20 nt, Human
uugaaaagcuugcagaauuu

SEQ ID NO: 207556 - RNA, 20 nt, Human
uuuaaaaaaaaaaaaaaguu

SEQ ID NO: 207557 - RNA, 25 nt, Human
aaaaaaaaaagcuugucacccccau

SEQ ID NO: 207558 - RNA, 20 nt, Human
acaccauggauguacaugaa

SEQ ID NO: 207559 - RNA, 19 nt, Human
accccuccugacccccccc

SEQ ID NO: 207560 - RNA, 19 nt, Human
accccuccugacccccccc

SEQ ID NO: 207561 - RNA, 18 nt, Human
agaaaaaaaaaaaaaagc

SEQ ID NO: 207562 - RNA, 18 nt, Human
agacagaacucuagcagc

SEQ ID NO: 207563 - RNA, 20 nt, Human
agacagaacucuagcagcuc

SEQ ID NO: 207564 - RNA, 25 nt, Human
aggcuggagugcaguggggcgaucu

SEQ ID NO: 207565 - RNA, 20 nt, Human
agggagccagugggcuaggc

SEQ ID NO: 207566 - RNA, 22 nt, Human
aggucuucugacugcucagccc

SEQ ID NO: 207567 - RNA, 19 nt, Human
agugcaguggggcgaucuc

SEQ ID NO: 207568 - RNA, 20 nt, Human
agugcaguggggcgaucucg

SEQ ID NO: 207569 - RNA, 24 nt, Human
agugcaguggggcgaucucggcuc

SEQ ID NO: 207570 - RNA, 18 nt, Human
auccuuccggaagggccc

SEQ ID NO: 207571 - RNA, 19 nt, Human
caacucucccccgcccccc

SEQ ID NO: 207572 - RNA, 19 nt, Human
caacucucccccgcccccc

SEQ ID NO: 207573 - RNA, 19 nt, Human
caccauggauguacaugaa

SEQ ID NO: 207574 - RNA, 22 nt, Human
cagcacaccauggauguacaug

SEQ ID NO: 207575 - RNA, 23 nt, Human
ccaaaguacauauuaagcuuuca

SEQ ID NO: 207576 - RNA, 24 nt, Human
ccacgcagccggccucccagagcu

SEQ ID NO: 207577 - RNA, 21 nt, Human
ccauuuugcuaacaagcaauu

SEQ ID NO: 207578 - RNA, 20 nt, Human
cccaccccuccugacccccc

SEQ ID NO: 207579 - RNA, 21 nt, Human
ccccaccccuccugacccccc

SEQ ID NO: 207580 - RNA, 24 nt, Human
ccccaccccuccugacccccccca

SEQ ID NO: 207581 - RNA, 26 nt, Human
cccccaccccuccugaccccccccaa

SEQ ID NO: 207582 - RNA, 18 nt, Human
cccccgaggccaccgccc

SEQ ID NO: 207583 - RNA, 21 nt, Human
cccccgaggccaccgcccccg

SEQ ID NO: 207584 - RNA, 22 nt, Human
cccccgcccccgccccgucccc

SEQ ID NO: 207585 - RNA, 19 nt, Human
ccccgaggccaccgccccc

SEQ ID NO: 207586 - RNA, 23 nt, Human
ccccuccugaccccccccaacuc

SEQ ID NO: 207587 - RNA, 20 nt, Human
cccgccccccuccccuuuuu

SEQ ID NO: 207588 - RNA, 19 nt, Human
cccgccccgucccgccccc

SEQ ID NO: 207589 - RNA, 18 nt, Human
cccgcgagaccccggccc

SEQ ID NO: 207590 - RNA, 19 nt, Human
cccgcgagaccccggccca

SEQ ID NO: 207591 - RNA, 20 nt, Human
cccgcgagaccccggcccag

SEQ ID NO: 207592 - RNA, 21 nt, Human
cccgcgagaccccggcccagg

SEQ ID NO: 207593 - RNA, 20 nt, Human
cccggaacguccuggagacu

SEQ ID NO: 207594 - RNA, 19 nt, Human
cccggcccaggcccccggg

SEQ ID NO: 207595 - RNA, 24 nt, Human
ccgcccccgccccgucccgccccc

SEQ ID NO: 207596 - RNA, 22 nt, Human
ccgcgauccuuccggaagggcc

SEQ ID NO: 207597 - RNA, 26 nt, Human
ccgucccgcccccgaggccaccgccc

SEQ ID NO: 207598 - RNA, 22 nt, Human
ccucccagagcgcggagccucc

SEQ ID NO: 207599 - RNA, 19 nt, Human
ccuggagcccccaccccuc

SEQ ID NO: 207600 - RNA, 24 nt, Human
ccuucgggggccgcgauccuuccg

SEQ ID NO: 207601 - RNA, 19 nt, Human
ccuuuuuuuugagacggag

SEQ ID NO: 207602 - RNA, 20 nt, Human
cgcagggcgcgcagggcccg

SEQ ID NO: 207603 - RNA, 19 nt, Human
cgccauggcgagcgcaggg

SEQ ID NO: 207604 - RNA, 25 nt, Human
cgccccccuccccuuuuuuuugaga

SEQ ID NO: 207605 - RNA, 20 nt, Human
cgccucuucccgagcggcag

SEQ ID NO: 207606 - RNA, 27 nt, Human
cgcgagaccccggcccaggcccccggg

SEQ ID NO: 207607 - RNA, 18 nt, Human
cgcgcagggcccgccucu

SEQ ID NO: 207608 - RNA, 22 nt, Human
cgcggggaccccacgcagccgg

SEQ ID NO: 207609 - RNA, 22 nt, Human
cggagucaccaggcuggagugc

SEQ ID NO: 207610 - RNA, 21 nt, Human
cucccggaacguccuggagac

SEQ ID NO: 207611 - RNA, 21 nt, Human
cugcaaccuccgccuccaguc

SEQ ID NO: 207612 - RNA, 18 nt, Human
cuggagcccccaccccuc

SEQ ID NO: 207613 - RNA, 22 nt, Human
cuggagccccgcgggacgccca

SEQ ID NO: 207614 - RNA, 19 nt, Human
gagccgcucacgucgccgc

SEQ ID NO: 207615 - RNA, 21 nt, Human
gagucaccaggcuggagugca

SEQ ID NO: 207616 - RNA, 18 nt, Human
gcccaaaccgccauggcg

SEQ ID NO: 207617 - RNA, 23 nt, Human
gcccccgcgcgggacuuucccgc

SEQ ID NO: 207618 - RNA, 22 nt, Human
gcccuggggggccucugcggcu

SEQ ID NO: 207619 - RNA, 18 nt, Human
gccucccagagcgcggag

SEQ ID NO: 207620 - RNA, 21 nt, Human
gcgucccgguggaggggauuc

SEQ ID NO: 207621 - RNA, 20 nt, Human
gcucauuugccaaagucaag

SEQ ID NO: 207622 - RNA, 24 nt, Human
ggcgagcgcagggcgcgcagggcc

SEQ ID NO: 207623 - RNA, 23 nt, Human
ggcguucccuggagcccccaccc

SEQ ID NO: 207624 - RNA, 24 nt, Human
gggacgcccaccuucgggggccgc

SEQ ID NO: 207625 - RNA, 23 nt, Human
gggcgucccgguggaggggauuc

SEQ ID NO: 207626 - RNA, 26 nt, Human
gucgcggccggggccccgcucggggu

SEQ ID NO: 207627 - RNA, 19 nt, Human
gugugaccugcccaagggg

SEQ ID NO: 207628 - RNA, 23 nt, Human
guuuaagagaagccuuaauuuuc

SEQ ID NO: 207629 - RNA, 23 nt, Human
uagaggcagcaaaagggaauacu

SEQ ID NO: 207630 - RNA, 22 nt, Human
uauacaaucuuuuauuuccagu

SEQ ID NO: 207631 - RNA, 19 nt, Human
ucaacucucccccgccccc

SEQ ID NO: 207632 - RNA, 19 nt, Human
ucacugcaaccuccgccuc

SEQ ID NO: 207633 - RNA, 20 nt, Human
ucacugcaaccuccgccucc

SEQ ID NO: 207634 - RNA, 22 nt, Human
ucacugcaaccuccgccuccag

SEQ ID NO: 207635 - RNA, 23 nt, Human
ucacugcaaccuccgccuccagu

SEQ ID NO: 207636 - RNA, 24 nt, Human
ucacugcaaccuccgccuccaguc

SEQ ID NO: 207637 - RNA, 22 nt, Human
ucaggucgcggccggggccccg

SEQ ID NO: 207638 - RNA, 18 nt, Human
ucccccgccccccucccc

SEQ ID NO: 207639 - RNA, 19 nt, Human
ucccccgccccccuccccu

SEQ ID NO: 207640 - RNA, 19 nt, Human
ucccccgccccccuccccu

SEQ ID NO: 207641 - RNA, 19 nt, Human
ucccuggagcccccacccc

SEQ ID NO: 207642 - RNA, 21 nt, Human
uccgauggcuugaucucuucc

SEQ ID NO: 207643 - RNA, 21 nt, Human
ucggcucggccgcccgcgccc

SEQ ID NO: 207644 - RNA, 18 nt, Human
ucucccccgccccccucc

SEQ ID NO: 207645 - RNA, 18 nt, Human
ucucccccgccccccucc

SEQ ID NO: 207646 - RNA, 22 nt, Human
ucugcggcugcagcgcggggac

SEQ ID NO: 207647 - RNA, 18 nt, Human
ugaccccccccaacucuc

SEQ ID NO: 207648 - RNA, 23 nt, Human
uggagugcaguggggcgaucucg

SEQ ID NO: 207649 - RNA, 24 nt, Human
uggagugcaguggggcgaucucgg

SEQ ID NO: 207650 - RNA, 23 nt, Human
ugggacagguugugugaccugcc

SEQ ID NO: 207651 - RNA, 22 nt, Human
ugucauauccauuuugcuaaca

SEQ ID NO: 207652 - RNA, 25 nt, Human
uuuaagaaaaaaaaaaaaaagcuug

SEQ ID NO: 207653 - RNA, 24 nt, Human
acaaaauacaauauuuaaccaaau

SEQ ID NO: 207654 - RNA, 24 nt, Human
acaacaaucuauuaauuuugcauu

SEQ ID NO: 207655 - RNA, 18 nt, Human
acuguuuucauuugugug

SEQ ID NO: 207656 - RNA, 25 nt, Human
agacacacacuacacuaacaauaua

SEQ ID NO: 207657 - RNA, 24 nt, Human
agucaauucugugauuaaagccga

SEQ ID NO: 207658 - RNA, 19 nt, Human
auaaucagacacacacuac

SEQ ID NO: 207659 - RNA, 26 nt, Human
auagugaauauauguauauaugugua

SEQ ID NO: 207660 - RNA, 23 nt, Human
auauauguauauauguguauaua

SEQ ID NO: 207661 - RNA, 24 nt, Human
auucugugauuaaagccgaaauaa

SEQ ID NO: 207662 - RNA, 21 nt, Human
auuugcuucagguuuaccaga

SEQ ID NO: 207663 - RNA, 25 nt, Human
caauauauauauuauauauuuaugu

SEQ ID NO: 207664 - RNA, 24 nt, Human
cauauauauaugaaaaaaaucauu

SEQ ID NO: 207665 - RNA, 21 nt, Human
ccuggcuuuacugagcuggga

SEQ ID NO: 207666 - RNA, 18 nt, Human
cgaaauaagagucuuuug

SEQ ID NO: 207667 - RNA, 22 nt, Human
cuccauuuuuacccuccuuacu

SEQ ID NO: 207668 - RNA, 22 nt, Human
cuuaauacaauguaaaggcaaa

SEQ ID NO: 207669 - RNA, 18 nt, Human
gaagcaaaauuuuaaccc

SEQ ID NO: 207670 - RNA, 21 nt, Human
guaaauaaucagacacacacu

SEQ ID NO: 207671 - RNA, 20 nt, Human
gugaauauauguauauaugu

SEQ ID NO: 207672 - RNA, 25 nt, Human
uaaaauguaagaauaaauaaaugag

SEQ ID NO: 207673 - RNA, 20 nt, Human
uaaagccgaaauaagagucu

SEQ ID NO: 207674 - RNA, 18 nt, Human
uaaauaacaucuuaggga

SEQ ID NO: 207675 - RNA, 19 nt, Human
uaaccaaauggaaagcuga

SEQ ID NO: 207676 - RNA, 19 nt, Human
uaagaauaaauaaaugagu

SEQ ID NO: 207677 - RNA, 28 nt, Human
uaauauaccgacaaaguauuugcagaac

SEQ ID NO: 207678 - RNA, 20 nt, Human
uacuguuuucauuugugugu

SEQ ID NO: 207679 - RNA, 19 nt, Human
uauauacuauaugcaugua

SEQ ID NO: 207680 - RNA, 18 nt, Human
uauauauguguauauaua

SEQ ID NO: 207681 - RNA, 19 nt, Human
uauauguauauauguguau

SEQ ID NO: 207682 - RNA, 18 nt, Human
uauauuuauguauacaca

SEQ ID NO: 207683 - RNA, 25 nt, Human
uauguauacacacuauagugaauau

SEQ ID NO: 207684 - RNA, 20 nt, Human
uauguauauauguguauaua

SEQ ID NO: 207685 - RNA, 22 nt, Human
uauguauauauguguauauaua

SEQ ID NO: 207686 - RNA, 22 nt, Human
uauguauauauguguauauaua

SEQ ID NO: 207687 - RNA, 21 nt, Human
uauguguauauauaauauaua

SEQ ID NO: 207688 - RNA, 24 nt, Human
ucagcuaaacuccaguaaacuuca

SEQ ID NO: 207689 - RNA, 19 nt, Human
ucucuguucuagaagcaaa

SEQ ID NO: 207690 - RNA, 21 nt, Human
ucucuguucuagaagcaaaau

SEQ ID NO: 207691 - RNA, 24 nt, Human
ucuuuugaauugaccagagucaca

SEQ ID NO: 207692 - RNA, 21 nt, Human
ugaaaaacgucuggguacuaa

SEQ ID NO: 207693 - RNA, 19 nt, Human
ugaauugaccagagucaca

SEQ ID NO: 207694 - RNA, 21 nt, Human
ugaauugaccagagucacaug

SEQ ID NO: 207695 - RNA, 18 nt, Human
ugagcugggauauggcuu

SEQ ID NO: 207696 - RNA, 18 nt, Human
ugagcugggauauggcuu

SEQ ID NO: 207697 - RNA, 20 nt, Human
ugcaaguguuauauggcaaa

SEQ ID NO: 207698 - RNA, 18 nt, Human
ugcuucagguuuaccaga

SEQ ID NO: 207699 - RNA, 28 nt, Human
uguauacacacuauagugaauauaugua

SEQ ID NO: 207700 - RNA, 19 nt, Human
uguauauauguguauauau

SEQ ID NO: 207701 - RNA, 19 nt, Human
uguguauauauaauauaua

SEQ ID NO: 207702 - RNA, 20 nt, Human
uguuuuguuaucuuaauaca

SEQ ID NO: 207703 - RNA, 26 nt, Human
uuaacccuuauucuagccuccauuuu

SEQ ID NO: 207704 - RNA, 18 nt, Human
uuugcagaacuaauucag

SEQ ID NO: 207705 - RNA, 26 nt, Human
aaauagaaaaaaaaauagaaauuaga

SEQ ID NO: 207706 - RNA, 21 nt, Human
aagcaauauaaccacugcuac

SEQ ID NO: 207707 - RNA, 23 nt, Human
aauacauugaaauagaaaaaaaa

SEQ ID NO: 207708 - RNA, 19 nt, Human
aauuccuuuuguugaugcc

SEQ ID NO: 207709 - RNA, 20 nt, Human
accuuucuggcauaugcuaa

SEQ ID NO: 207710 - RNA, 18 nt, Human
agacagggucucgcuaug

SEQ ID NO: 207711 - RNA, 23 nt, Human
agacagggucucgcuauguugcc

SEQ ID NO: 207712 - RNA, 20 nt, Human
agauguuaagguuagcaacc

SEQ ID NO: 207713 - RNA, 19 nt, Human
agucauuuuggacucugua

SEQ ID NO: 207714 - RNA, 20 nt, Human
agugcugauuauaggcauga

SEQ ID NO: 207715 - RNA, 21 nt, Human
auccucccgccucagccuccc

SEQ ID NO: 207716 - RNA, 20 nt, Human
auguugcccaggcuggucuc

SEQ ID NO: 207717 - RNA, 24 nt, Human
cagaaaccuuaaucccaauuaugu

SEQ ID NO: 207718 - RNA, 19 nt, Human
cagagucgagaagcggcgg

SEQ ID NO: 207719 - RNA, 23 nt, Human
cagagugcugauuauaggcauga

SEQ ID NO: 207720 - RNA, 24 nt, Human
cagggucucgcuauguugcccagg

SEQ ID NO: 207721 - RNA, 23 nt, Human
ccagagucggagcuuagcgagga

SEQ ID NO: 207722 - RNA, 22 nt, Human
ccagagugcugauuauaggcau

SEQ ID NO: 207723 - RNA, 25 nt, Human
ccauccucccgccucagccucccca

SEQ ID NO: 207724 - RNA, 22 nt, Human
ccccagagugcugauuauaggc

SEQ ID NO: 207725 - RNA, 26 nt, Human
ccucccgccucagccuccccagagug

SEQ ID NO: 207726 - RNA, 25 nt, Human
cgccucagccuccccagagugcuga

SEQ ID NO: 207727 - RNA, 24 nt, Human
cgcuauguugcccaggcuggucuc

SEQ ID NO: 207728 - RNA, 21 nt, Human
cuaauucaucaugaacuccca

SEQ ID NO: 207729 - RNA, 24 nt, Human
cugguagagacagggucucgcuau

SEQ ID NO: 207730 - RNA, 19 nt, Human
gagaagcacuuucagugug

SEQ ID NO: 207731 - RNA, 23 nt, Human
gagaagcggcggggguaagagug

SEQ ID NO: 207732 - RNA, 19 nt, Human
gauuauaggcaugagccac

SEQ ID NO: 207733 - RNA, 25 nt, Human
gauuauaggcaugagccacacugca

SEQ ID NO: 207734 - RNA, 21 nt, Human
gugcgucugugcggcgggcgg

SEQ ID NO: 207735 - RNA, 19 nt, Human
gugggcgguggcggcagca

SEQ ID NO: 207736 - RNA, 18 nt, Human
guuuguaaauauacacau

SEQ ID NO: 207737 - RNA, 23 nt, Human
uaaauacauugaaauagaaaaaa

SEQ ID NO: 207738 - RNA, 22 nt, Human
uacacauaaagcuuugucuccc

SEQ ID NO: 207739 - RNA, 21 nt, Human
uaccucaaagccauaaauaau

SEQ ID NO: 207740 - RNA, 22 nt, Human
uagagacagggucucgcuaugu

SEQ ID NO: 207741 - RNA, 22 nt, Human
uagaucccaaaauuguacccag

SEQ ID NO: 207742 - RNA, 19 nt, Human
uauaaccacugcuacaaaa

SEQ ID NO: 207743 - RNA, 23 nt, Human
uauguugcccaggcuggucucaa

SEQ ID NO: 207744 - RNA, 24 nt, Human
uauguugcccaggcuggucucaaa

SEQ ID NO: 207745 - RNA, 22 nt, Human
ucaaaguaaaaugcacaaaguc

SEQ ID NO: 207746 - RNA, 23 nt, Human
ucggcuaacaacagagucgagaa

SEQ ID NO: 207747 - RNA, 22 nt, Human
ucucaugguauaauuccuuuug

SEQ ID NO: 207748 - RNA, 18 nt, Human
ucucgcuauguugcccag

SEQ ID NO: 207749 - RNA, 19 nt, Human
ucucgcuauguugcccagg

SEQ ID NO: 207750 - RNA, 23 nt, Human
ucucgcuauguugcccaggcugg

SEQ ID NO: 207751 - RNA, 24 nt, Human
ucucgcuauguugcccaggcuggu

SEQ ID NO: 207752 - RNA, 26 nt, Human
ucucgcuauguugcccaggcuggucu

SEQ ID NO: 207753 - RNA, 27 nt, Human
ucucgcuauguugcccaggcuggucuc

SEQ ID NO: 207754 - RNA, 23 nt, Human
ugaaauagaaaaaaaaauagaaa

SEQ ID NO: 207755 - RNA, 20 nt, Human
ugcauguauauaucauuaua

SEQ ID NO: 207756 - RNA, 18 nt, Human
ugccaagcagaaauauuc

SEQ ID NO: 207757 - RNA, 21 nt, Human
ugcccaggcuggucucaaacu

SEQ ID NO: 207758 - RNA, 28 nt, Human
ugcccaggcuggucucaaacuggggcca

SEQ ID NO: 207759 - RNA, 24 nt, Human
ugggcucaugccauccucccgccu

SEQ ID NO: 207760 - RNA, 24 nt, Human
ugguagagacagggucucgcuaug

SEQ ID NO: 207761 - RNA, 19 nt, Human
uguugaugccagugacagg

SEQ ID NO: 207762 - RNA, 23 nt, Human
uuaaaagcuacauuccauuaaaa

SEQ ID NO: 207763 - RNA, 22 nt, Human
uuaaucccaauuauguauugcu

SEQ ID NO: 207764 - RNA, 23 nt, Human
uucaguguggaaaaaaaucuuua

SEQ ID NO: 207765 - RNA, 22 nt, Human
uugaaagucagaaaccuuaauc

SEQ ID NO: 207766 - RNA, 21 nt, Human
uuguuuuccccaucaugaaau

SEQ ID NO: 207767 - RNA, 22 nt, Human
uuuuuuaaauuucugguagaga

SEQ ID NO: 207768 - RNA, 22 nt, Human
aaggaaaggaagggaaaggccc

SEQ ID NO: 207769 - RNA, 26 nt, Human
aaguguccgggcccccagcuacccac

SEQ ID NO: 207770 - RNA, 23 nt, Human
acaggaaggggccacagggcuga

SEQ ID NO: 207771 - RNA, 21 nt, Human
acaggacaggaaggggccaca

SEQ ID NO: 207772 - RNA, 19 nt, Human
agaaaggaaaggaagggaa

SEQ ID NO: 207773 - RNA, 19 nt, Human
agggaaaggcccccuagug

SEQ ID NO: 207774 - RNA, 22 nt, Human
agggucccaaguguccgggccc

SEQ ID NO: 207775 - RNA, 20 nt, Human
agugcagggacaaagggguc

SEQ ID NO: 207776 - RNA, 22 nt, Human
augccaccaccccccuaagagu

SEQ ID NO: 207777 - RNA, 25 nt, Human
cagaugccaccaccccccuaagagu

SEQ ID NO: 207778 - RNA, 18 nt, Human
cagggacaaaggggucag

SEQ ID NO: 207779 - RNA, 20 nt, Human
cauccugggggagcaaggcc

SEQ ID NO: 207780 - RNA, 22 nt, Human
ccaccaccccccuaagaguggg

SEQ ID NO: 207781 - RNA, 22 nt, Human
cccacagcccugaggaaggcac

SEQ ID NO: 207782 - RNA, 22 nt, Human
ccccagcuacccaccccauguc

SEQ ID NO: 207783 - RNA, 24 nt, Human
ccccagcuacccaccccaugucug

SEQ ID NO: 207784 - RNA, 26 nt, Human
ccgcaggaauuuuuuuuuuuuuuuuu

SEQ ID NO: 207785 - RNA, 21 nt, Human
gacaggaaggggccacagggc

SEQ ID NO: 207786 - RNA, 21 nt, Human
gagcaaggccugagaaaggaa

SEQ ID NO: 207787 - RNA, 21 nt, Human
gcuuugccaccccaccugcug

SEQ ID NO: 207788 - RNA, 20 nt, Human
ggucccaaguguccgggccc

SEQ ID NO: 207789 - RNA, 21 nt, Human
gucauccugggggagcaaggc

SEQ ID NO: 207790 - RNA, 20 nt, Human
uaaaaauacggaccaagggc

SEQ ID NO: 207791 - RNA, 23 nt, Human
uaaaaauacggaccaagggcaua

SEQ ID NO: 207792 - RNA, 18 nt, Human
ugaaggcugaccguucug

SEQ ID NO: 207793 - RNA, 19 nt, Human
ugagaaaggaaaggaaggg

SEQ ID NO: 207794 - RNA, 19 nt, Human
ugggucauccugggggagc

SEQ ID NO: 207795 - RNA, 21 nt, Human
uugaaggcugaccguucuguu

SEQ ID NO: 207796 - RNA, 19 nt, Human
uuuuuuuuuuuugaaggcu

SEQ ID NO: 207797 - RNA, 21 nt, Human
uuuuuuuuuuuuuuuugaagg

SEQ ID NO: 207798 - RNA, 18 nt, Human
uuuuuuuuuuuuuuuuug

SEQ ID NO: 207799 - RNA, 24 nt, Human
acccugcaguccugugguguugug

SEQ ID NO: 207800 - RNA, 21 nt, Human
agcugaagcaggagaccaggg

SEQ ID NO: 207801 - RNA, 21 nt, Human
auacagagccauuucucagca

SEQ ID NO: 207802 - RNA, 18 nt, Human
augaugccaaaacaagac

SEQ ID NO: 207803 - RNA, 23 nt, Human
ccaaaacaagacugcugguucau

SEQ ID NO: 207804 - RNA, 20 nt, Human
cugaagcaggagaccaggga

SEQ ID NO: 207805 - RNA, 18 nt, Human
gaggggaggacugcaugg

SEQ ID NO: 207806 - RNA, 22 nt, Human
gcaaagcaagauuuagcaucuu

SEQ ID NO: 207807 - RNA, 24 nt, Human
gcacucuuuuccuuccacuuaaga

SEQ ID NO: 207808 - RNA, 20 nt, Human
ggaggggaggacugcauggu

SEQ ID NO: 207809 - RNA, 22 nt, Human
ggaguugugcacccugcagucc

SEQ ID NO: 207810 - RNA, 24 nt, Human
guacagagcugaagcaggagacca

SEQ ID NO: 207811 - RNA, 19 nt, Human
uacacacuuaaucacuuga

SEQ ID NO: 207812 - RNA, 24 nt, Human
ugacacuuuacugaaugcaaagca

SEQ ID NO: 207813 - RNA, 21 nt, Human
uuaagaagcuggaauacaaca

SEQ ID NO: 207814 - RNA, 27 nt, Human
aaaaaaaaaaaaaaaaacaaaaccaag

SEQ ID NO: 207815 - RNA, 24 nt, Human
aaaaaaaaaaaacaaaaccaagaa

SEQ ID NO: 207816 - RNA, 25 nt, Human
aaaaaaaaacaaaaccaagaaacaa

SEQ ID NO: 207817 - RNA, 22 nt, Human
aaaaaaacaaaaccaagaaaca

SEQ ID NO: 207818 - RNA, 23 nt, Human
aaaaaaagaagaaaagaaccaag

SEQ ID NO: 207819 - RNA, 23 nt, Human
aaaaaaaggcagauucuaaggaa

SEQ ID NO: 207820 - RNA, 22 nt, Human
aaaaaagagagggaacacguga

SEQ ID NO: 207821 - RNA, 25 nt, Human
aaaaaauuuccaacuccugccccuu

SEQ ID NO: 207822 - RNA, 19 nt, Human
aaaaagaucugacauggua

SEQ ID NO: 207823 - RNA, 19 nt, Human
aaaaaguugaaagguggug

SEQ ID NO: 207824 - RNA, 24 nt, Human
aaaaaucaauaaggaacuuacuua

SEQ ID NO: 207825 - RNA, 20 nt, Human
aaaaauccaaaaaauuagcc

SEQ ID NO: 207826 - RNA, 23 nt, Human
aaaacaaaaccaagaaacaaaaa

SEQ ID NO: 207827 - RNA, 21 nt, Human
aaaacaaacagcccgaguugu

SEQ ID NO: 207828 - RNA, 27 nt, Human
aaaauagcaccauuauacuaaaaaaca

SEQ ID NO: 207829 - RNA, 25 nt, Human
aaacaaaacaaaauccaaaaccaag

SEQ ID NO: 207830 - RNA, 18 nt, Human
aaacaaaauccaaaacca

SEQ ID NO: 207831 - RNA, 25 nt, Human
aaacaauucauaaaccacuuagaca

SEQ ID NO: 207832 - RNA, 23 nt, Human
aaacaggcagagggcaaaaauga

SEQ ID NO: 207833 - RNA, 22 nt, Human
aaacauacauuucuaucuagcc

SEQ ID NO: 207834 - RNA, 19 nt, Human
aaagaagaaaagaaccaag

SEQ ID NO: 207835 - RNA, 22 nt, Human
aaagaucaacagcaaucuacca

SEQ ID NO: 207836 - RNA, 21 nt, Human
aaaggaaaaaaaagagaggga

SEQ ID NO: 207837 - RNA, 19 nt, Human
aaauagugaauugguauaa

SEQ ID NO: 207838 - RNA, 19 nt, Human
aacaugguaaaaccccguc

SEQ ID NO: 207839 - RNA, 20 nt, Human
aacaugguaaaaccccgucu

SEQ ID NO: 207840 - RNA, 21 nt, Human
aacaugguaaaaccccgucuc

SEQ ID NO: 207841 - RNA, 19 nt, Human
aacccaggguaaaaaaauc

SEQ ID NO: 207842 - RNA, 21 nt, Human
aacuccugccccugcaccccc

SEQ ID NO: 207843 - RNA, 21 nt, Human
aacuccugccccugcaccccc

SEQ ID NO: 207844 - RNA, 20 nt, Human
aagaaaccaggacugcuagu

SEQ ID NO: 207845 - RNA, 19 nt, Human
aagaaauaaaaagaagugc

SEQ ID NO: 207846 - RNA, 23 nt, Human
aagagagggaacacgugaaauau

SEQ ID NO: 207847 - RNA, 19 nt, Human
aagcaaaaggaaauccaga

SEQ ID NO: 207848 - RNA, 21 nt, Human
aagcaaaaggaaauccagaga

SEQ ID NO: 207849 - RNA, 22 nt, Human
aagcaaauauguacuacaggau

SEQ ID NO: 207850 - RNA, 18 nt, Human
aaggagaggaaggauucu

SEQ ID NO: 207851 - RNA, 22 nt, Human
aagucauagacacucuuagaau

SEQ ID NO: 207852 - RNA, 22 nt, Human
aaucacaaggucaggaguuuga

SEQ ID NO: 207853 - RNA, 24 nt, Human
aaucgcuuaaacccaggaggugga

SEQ ID NO: 207854 - RNA, 23 nt, Human
aaugugugugugugugugugugu

SEQ ID NO: 207855 - RNA, 30 nt, Human
acaaaacaaaauccaaaaccaagaaucuug

SEQ ID NO: 207856 - RNA, 26 nt, Human
acaagauaaauauccaaacaaaauca

SEQ ID NO: 207857 - RNA, 19 nt, Human
acacuguaaaacaaacagc

SEQ ID NO: 207858 - RNA, 20 nt, Human
acagugcgagaccccaucuc

SEQ ID NO: 207859 - RNA, 24 nt, Human
acccaggagguggagguugcagug

SEQ ID NO: 207860 - RNA, 18 nt, Human
accccgucucuauuaaaa

SEQ ID NO: 207861 - RNA, 22 nt, Human
accguuuuggccagacucuuuc

SEQ ID NO: 207862 - RNA, 18 nt, Human
acuccagccugggggaca

SEQ ID NO: 207863 - RNA, 18 nt, Human
acugcacuccagccuggg

SEQ ID NO: 207864 - RNA, 24 nt, Human
acugcacuccagccugggggacag

SEQ ID NO: 207865 - RNA, 21 nt, Human
acugcucuuugagaugucugg

SEQ ID NO: 207866 - RNA, 23 nt, Human
agaaaacauguuaagucugcaga

SEQ ID NO: 207867 - RNA, 23 nt, Human
agaaauucauaaagacuguauaa

SEQ ID NO: 207868 - RNA, 18 nt, Human
agaccccaucaaagauag

SEQ ID NO: 207869 - RNA, 24 nt, Human
agagccaacaaaacaauggagccu

SEQ ID NO: 207870 - RNA, 25 nt, Human
agauaaauauccaaacaaaaucaga

SEQ ID NO: 207871 - RNA, 20 nt, Human
agcaaaaggaaauccagaga

SEQ ID NO: 207872 - RNA, 22 nt, Human
agcaaaaggaaauccagagaga

SEQ ID NO: 207873 - RNA, 23 nt, Human
agcaaugucacauuucaauuuug

SEQ ID NO: 207874 - RNA, 20 nt, Human
agcaauuugggaggcugagg

SEQ ID NO: 207875 - RNA, 23 nt, Human
agccgggcauaguggugggugcc

SEQ ID NO: 207876 - RNA, 18 nt, Human
aggcaaaauacaugaugu

SEQ ID NO: 207877 - RNA, 22 nt, Human
aggcaaaauacaugauguaauc

SEQ ID NO: 207878 - RNA, 26 nt, Human
aggcagagggcaaaaaugagggaccc

SEQ ID NO: 207879 - RNA, 23 nt, Human
aggcaggagaaucgcuuaaaccc

SEQ ID NO: 207880 - RNA, 19 nt, Human
aggcagggacuaagauaua

SEQ ID NO: 207881 - RNA, 24 nt, Human
aggcgggcaaaucacaaggucagg

SEQ ID NO: 207882 - RNA, 20 nt, Human
aggcugaggcaggagaaucg

SEQ ID NO: 207883 - RNA, 20 nt, Human
aggcugaggcaggagaaucg

SEQ ID NO: 207884 - RNA, 24 nt, Human
agguggagguugcagugagccgag

SEQ ID NO: 207885 - RNA, 23 nt, Human
aguaaaugccaaagaauacccaa

SEQ ID NO: 207886 - RNA, 24 nt, Human
aguggugggugccuguaaucccag

SEQ ID NO: 207887 - RNA, 23 nt, Human
auaaaaaaaagaagaaaagaaga

SEQ ID NO: 207888 - RNA, 18 nt, Human
aucacaaggucaggaguu

SEQ ID NO: 207889 - RNA, 24 nt, Human
aucaugccacugcacuccagccug

SEQ ID NO: 207890 - RNA, 20 nt, Human
aucccuagaagaguggauuc

SEQ ID NO: 207891 - RNA, 23 nt, Human
augaagcaaaaggaaauccagag

SEQ ID NO: 207892 - RNA, 24 nt, Human
augaagcaaaaggaaauccagaga

SEQ ID NO: 207893 - RNA, 25 nt, Human
augaggcaaaauacaugauguaauc

SEQ ID NO: 207894 - RNA, 20 nt, Human
augucugggugaagggagaa

SEQ ID NO: 207895 - RNA, 23 nt, Human
augugugugugugugugugugag

SEQ ID NO: 207896 - RNA, 22 nt, Human
augugugugugugugugugugu

SEQ ID NO: 207897 - RNA, 22 nt, Human
augugugugugugugugugugu

SEQ ID NO: 207898 - RNA, 22 nt, Human
caaaacaaaauccaaaaccaag

SEQ ID NO: 207899 - RNA, 23 nt, Human
caaaacaaaauccaaaaccaaga

SEQ ID NO: 207900 - RNA, 27 nt, Human
caaaaccaagaaacaaaaaaucuucac

SEQ ID NO: 207901 - RNA, 18 nt, Human
caaaaggaaauccagaga

SEQ ID NO: 207902 - RNA, 25 nt, Human
caaaaggaaauccagagagauggga

SEQ ID NO: 207903 - RNA, 24 nt, Human
caaaauagcaccauuauacuaaaa

SEQ ID NO: 207904 - RNA, 19 nt, Human
caacaaaacaauggagccu

SEQ ID NO: 207905 - RNA, 24 nt, Human
caacaaaacaauggagccuucuaa

SEQ ID NO: 207906 - RNA, 24 nt, Human
caacaugguaaaaccccgucucua

SEQ ID NO: 207907 - RNA, 21 nt, Human
caacugaaacucuagucaagc

SEQ ID NO: 207908 - RNA, 20 nt, Human
caacuggaucuauacaacac

SEQ ID NO: 207909 - RNA, 25 nt, Human
caagauaaauauccaaacaaaauca

SEQ ID NO: 207910 - RNA, 23 nt, Human
cacaauuuggugaacaguacacu

SEQ ID NO: 207911 - RNA, 20 nt, Human
cacuccagccugggggacag

SEQ ID NO: 207912 - RNA, 18 nt, Human
cacugcacuccagccugg

SEQ ID NO: 207913 - RNA, 19 nt, Human
cacugcacuccagccuggg

SEQ ID NO: 207914 - RNA, 22 nt, Human
cacugcacuccagccuggggga

SEQ ID NO: 207915 - RNA, 24 nt, Human
cacugcacuccagccugggggaca

SEQ ID NO: 207916 - RNA, 25 nt, Human
cacugcacuccagccugggggacag

SEQ ID NO: 207917 - RNA, 20 nt, Human
cagaagacugccuauaaagu

SEQ ID NO: 207918 - RNA, 21 nt, Human
cagcaacucaagcgcccugau

SEQ ID NO: 207919 - RNA, 24 nt, Human
cagcaauuugggaggcugaggcgg

SEQ ID NO: 207920 - RNA, 19 nt, Human
cagcagccaagauucagag

SEQ ID NO: 207921 - RNA, 24 nt, Human
cagcuacucaggaggcugaggcag

SEQ ID NO: 207922 - RNA, 29 nt, Human
caggagguggagguugcagugacaacggu

SEQ ID NO: 207923 - RNA, 24 nt, Human
caggagguggagguugcagugagc

SEQ ID NO: 207924 - RNA, 20 nt, Human
caguagauaacccccaucuu

SEQ ID NO: 207925 - RNA, 23 nt, Human
cagugcgagaccccaucucacaa

SEQ ID NO: 207926 - RNA, 24 nt, Human
cauaaggaaauacuuuccaacauu

SEQ ID NO: 207927 - RNA, 24 nt, Human
cauagaagagucagugagugcuag

SEQ ID NO: 207928 - RNA, 21 nt, Human
cauauauucagagauccaggg

SEQ ID NO: 207929 - RNA, 19 nt, Human
caucuuucagcuuuccucc

SEQ ID NO: 207930 - RNA, 23 nt, Human
caugagaaaaagaaaccaggacu

SEQ ID NO: 207931 - RNA, 19 nt, Human
caugaggcaaaauacauga

SEQ ID NO: 207932 - RNA, 24 nt, Human
caugccuguaaucccagcaauuug

SEQ ID NO: 207933 - RNA, 21 nt, Human
caugucacucuucacuccuca

SEQ ID NO: 207934 - RNA, 18 nt, Human
ccaaaaccaagaaucaac

SEQ ID NO: 207935 - RNA, 19 nt, Human
ccacugcacuccagccugg

SEQ ID NO: 207936 - RNA, 20 nt, Human
ccacugcacuccagccuggg

SEQ ID NO: 207937 - RNA, 22 nt, Human
ccacugcacuccagccuggggg

SEQ ID NO: 207938 - RNA, 24 nt, Human
ccacugcacuccagccugggggac

SEQ ID NO: 207939 - RNA, 20 nt, Human
ccauagugauuagaacauug

SEQ ID NO: 207940 - RNA, 21 nt, Human
cccaggagguggagguugcag

SEQ ID NO: 207941 - RNA, 25 nt, Human
cccccaaauucacaauuuggugaac

SEQ ID NO: 207942 - RNA, 21 nt, Human
cccgucucuauuaaaaaucca

SEQ ID NO: 207943 - RNA, 18 nt, Human
ccugcacccccaaauuca

SEQ ID NO: 207944 - RNA, 23 nt, Human
ccugccccugcacccccaaauuc

SEQ ID NO: 207945 - RNA, 23 nt, Human
ccuggccaacaugguaaaacccc

SEQ ID NO: 207946 - RNA, 24 nt, Human
ccuggccaacaugguaaaaccccg

SEQ ID NO: 207947 - RNA, 22 nt, Human
ccuguaaucccagcaauuuggg

SEQ ID NO: 207948 - RNA, 19 nt, Human
ccuguaaucccagcuacuc

SEQ ID NO: 207949 - RNA, 21 nt, Human
ccuguaaucccagcuacucag

SEQ ID NO: 207950 - RNA, 22 nt, Human
ccuguaaucccagcuacucagg

SEQ ID NO: 207951 - RNA, 19 nt, Human
ccuucugagcaggcauggg

SEQ ID NO: 207952 - RNA, 22 nt, Human
cgggcaaaucacaaggucagga

SEQ ID NO: 207953 - RNA, 18 nt, Human
cgugcagagcaaaggauc

SEQ ID NO: 207954 - RNA, 23 nt, Human
cuaagauauauauauauauauau

SEQ ID NO: 207955 - RNA, 19 nt, Human
cuaugaguuggugaguggg

SEQ ID NO: 207956 - RNA, 20 nt, Human
cuauguauuuuuucucuuug

SEQ ID NO: 207957 - RNA, 25 nt, Human
cucaugccuguaaucccagcaauuu

SEQ ID NO: 207958 - RNA, 24 nt, Human
cuccugccccugcacccccaaauu

SEQ ID NO: 207959 - RNA, 24 nt, Human
cucuauuaaaaauccaaaaaauua

SEQ ID NO: 207960 - RNA, 26 nt, Human
cucuucacuccucaggaggggaccuc

SEQ ID NO: 207961 - RNA, 19 nt, Human
cugggccucugucuuaucu

SEQ ID NO: 207962 - RNA, 21 nt, Human
cuuggaaggcauaacuggggg

SEQ ID NO: 207963 - RNA, 22 nt, Human
gaaacccuggagccacagagca

SEQ ID NO: 207964 - RNA, 23 nt, Human
gaaagggauuuuagagcucuguu

SEQ ID NO: 207965 - RNA, 19 nt, Human
gaagggagaaugucuucua

SEQ ID NO: 207966 - RNA, 18 nt, Human
gaaguacaaagucugaaa

SEQ ID NO: 207967 - RNA, 24 nt, Human
gaaugugugugugugugugugugu

SEQ ID NO: 207968 - RNA, 21 nt, Human
gacuuuauggucuuugcaagg

SEQ ID NO: 207969 - RNA, 21 nt, Human
gagaaaaucuugaucugcaga

SEQ ID NO: 207970 - RNA, 23 nt, Human
gagaucaugccacugcacuccag

SEQ ID NO: 207971 - RNA, 23 nt, Human
gagcaaugucacauuucaauuuu

SEQ ID NO: 207972 - RNA, 19 nt, Human
gagccaacaaaacaaugga

SEQ ID NO: 207973 - RNA, 19 nt, Human
gaggaaacugaggcacaga

SEQ ID NO: 207974 - RNA, 27 nt, Human
gaggaaggauucucaaggguggacagg

SEQ ID NO: 207975 - RNA, 22 nt, Human
gagguugcagugagccgagauc

SEQ ID NO: 207976 - RNA, 20 nt, Human
gauggaaucuuguggguuag

SEQ ID NO: 207977 - RNA, 18 nt, Human
gauucugauggagagcug

SEQ ID NO: 207978 - RNA, 18 nt, Human
gauucuuucuucugagga

SEQ ID NO: 207979 - RNA, 22 nt, Human
gauugcuuuucaugagagcuac

SEQ ID NO: 207980 - RNA, 19 nt, Human
gauuuuagagcucuguuuu

SEQ ID NO: 207981 - RNA, 19 nt, Human
gcagagggcaaaaaugaug

SEQ ID NO: 207982 - RNA, 18 nt, Human
gcagauucuaaggauugu

SEQ ID NO: 207983 - RNA, 22 nt, Human
gcaggagaaucgcuuaaaccca

SEQ ID NO: 207984 - RNA, 18 nt, Human
gcaggcucuaaucugcuc

SEQ ID NO: 207985 - RNA, 19 nt, Human
gcagggugugguggcucau

SEQ ID NO: 207986 - RNA, 24 nt, Human
gcaguaacauuugguuuugugucc

SEQ ID NO: 207987 - RNA, 21 nt, Human
gcauuuugggcaaaauaaaau

SEQ ID NO: 207988 - RNA, 24 nt, Human
gccaacaugguaaaaccccgucuc

SEQ ID NO: 207989 - RNA, 20 nt, Human
gcccaaggucacacaguggu

SEQ ID NO: 207990 - RNA, 20 nt, Human
gcccccauuuugcagaugag

SEQ ID NO: 207991 - RNA, 20 nt, Human
gccgagaucaugccacugca

SEQ ID NO: 207992 - RNA, 23 nt, Human
gcuaaguuugagagccaacaaaa

SEQ ID NO: 207993 - RNA, 25 nt, Human
gcucaauucaaauaauguuggacug

SEQ ID NO: 207994 - RNA, 20 nt, Human
ggaaaaaauaaaaagaggaa

SEQ ID NO: 207995 - RNA, 21 nt, Human
ggaaaacaggcagagggcaaa

SEQ ID NO: 207996 - RNA, 21 nt, Human
ggaaggauucucaagggugga

SEQ ID NO: 207997 - RNA, 26 nt, Human
ggacaagaaauaaaaagaagggaccc

SEQ ID NO: 207998 - RNA, 20 nt, Human
ggagguugcagugagccgag

SEQ ID NO: 207999 - RNA, 22 nt, Human
ggagguugcagugagccgagau

SEQ ID NO: 208000 - RNA, 23 nt, Human
ggagguugcagugagccgagauc

SEQ ID NO: 208001 - RNA, 24 nt, Human
ggagguugcagugagccgagauca

SEQ ID NO: 208002 - RNA, 23 nt, Human
ggcaaaucacaaggucaggaguu

SEQ ID NO: 208003 - RNA, 22 nt, Human
ggcagaauaaagacagcuucaa

SEQ ID NO: 208004 - RNA, 18 nt, Human
ggcagggugugguggcuc

SEQ ID NO: 208005 - RNA, 19 nt, Human
ggcagggugugguggcuca

SEQ ID NO: 208006 - RNA, 23 nt, Human
ggcagggugugguggcucaugcc

SEQ ID NO: 208007 - RNA, 21 nt, Human
ggcucaugccuguaaucccag

SEQ ID NO: 208008 - RNA, 20 nt, Human
gggcagggugugguggcuca

SEQ ID NO: 208009 - RNA, 24 nt, Human
gggcauaguggugggugccuguaa

SEQ ID NO: 208010 - RNA, 25 nt, Human
gggugaaugugugugugugugugug

SEQ ID NO: 208011 - RNA, 19 nt, Human
ggugaaugugugugugugu

SEQ ID NO: 208012 - RNA, 26 nt, Human
ggugaaugugugugugugugugugug

SEQ ID NO: 208013 - RNA, 24 nt, Human
gguggcucaugccuguaaucccag

SEQ ID NO: 208014 - RNA, 23 nt, Human
ggugugguggcucaugccuguaa

SEQ ID NO: 208015 - RNA, 26 nt, Human
gguuuuguguccucucuuuuuuuuuu

SEQ ID NO: 208016 - RNA, 26 nt, Human
guaaaaaaaaaaaaaaaaacaaaacc

SEQ ID NO: 208017 - RNA, 19 nt, Human
guaaaugccaaagaauacc

SEQ ID NO: 208018 - RNA, 19 nt, Human
guggugguggcuagauaga

SEQ ID NO: 208019 - RNA, 21 nt, Human
gugugugugugugugucugug

SEQ ID NO: 208020 - RNA, 21 nt, Human
gugugugugugugugugugug

SEQ ID NO: 208021 - RNA, 21 nt, Human
gugugugugugugugugugug

SEQ ID NO: 208022 - RNA, 21 nt, Human
gugugugugugugugugugug

SEQ ID NO: 208023 - RNA, 21 nt, Human
gugugugugugugugugugug

SEQ ID NO: 208024 - RNA, 20 nt, Human
guugagcaguaacauuuggu

SEQ ID NO: 208025 - RNA, 24 nt, Human
guugcagugagccgagaucaugcc

SEQ ID NO: 208026 - RNA, 20 nt, Human
guuuuggccagacucuuuca

SEQ ID NO: 208027 - RNA, 25 nt, Human
uaaaaaacaaaagcauuguuccaga

SEQ ID NO: 208028 - RNA, 18 nt, Human
uaaaaauagcaaaacauu

SEQ ID NO: 208029 - RNA, 21 nt, Human
uaaaacaaacagcccgaguug

SEQ ID NO: 208030 - RNA, 20 nt, Human
uaaaaccaaaugcagaauuc

SEQ ID NO: 208031 - RNA, 22 nt, Human
uaaaagguacacacuggggaca

SEQ ID NO: 208032 - RNA, 23 nt, Human
uaaaauaaaaugcauccaacuua

SEQ ID NO: 208033 - RNA, 19 nt, Human
uaaaauaauaagggcuggg

SEQ ID NO: 208034 - RNA, 23 nt, Human
uaaaauauagaauuugcaugaaa

SEQ ID NO: 208035 - RNA, 18 nt, Human
uaaagaagauaacuuugu

SEQ ID NO: 208036 - RNA, 22 nt, Human
uaaagcaaucuaauucugaagc

SEQ ID NO: 208037 - RNA, 20 nt, Human
uaaauuggaaauaagccuaa

SEQ ID NO: 208038 - RNA, 19 nt, Human
uaacagaagugacuuugcu

SEQ ID NO: 208039 - RNA, 23 nt, Human
uaaccaaaaaguucuaaggugac

SEQ ID NO: 208040 - RNA, 20 nt, Human
uaacuggggggacuuugccu

SEQ ID NO: 208041 - RNA, 24 nt, Human
uaacuuuaaaaaauuuccaacucc

SEQ ID NO: 208042 - RNA, 21 nt, Human
uaagagauugagcuguuagcu

SEQ ID NO: 208043 - RNA, 20 nt, Human
uaagauuaaaaauagcaaaa

SEQ ID NO: 208044 - RNA, 21 nt, Human
uaaggaaacaauucauaaacc

SEQ ID NO: 208045 - RNA, 21 nt, Human
uaauugauaugcuaaauuuac

SEQ ID NO: 208046 - RNA, 19 nt, Human
uacaagauaaauauccaaa

SEQ ID NO: 208047 - RNA, 18 nt, Human
uacaggauuaaacacuag

SEQ ID NO: 208048 - RNA, 19 nt, Human
uaccaauguuuacuguucu

SEQ ID NO: 208049 - RNA, 18 nt, Human
uaccguuuuggccagacu

SEQ ID NO: 208050 - RNA, 18 nt, Human
uacuuuaaaaaagcuugg

SEQ ID NO: 208051 - RNA, 24 nt, Human
uagagcucuguuuuuauuuuuccu

SEQ ID NO: 208052 - RNA, 24 nt, Human
uagaugacauauugcccccugaag

SEQ ID NO: 208053 - RNA, 19 nt, Human
uagcaggaauaaugaagca

SEQ ID NO: 208054 - RNA, 21 nt, Human
uagccgggcauaguggugggu

SEQ ID NO: 208055 - RNA, 28 nt, Human
uaggagaaacucugucuccccucggaag

SEQ ID NO: 208056 - RNA, 27 nt, Human
uagugauuagaacauugcuaagcaugc

SEQ ID NO: 208057 - RNA, 23 nt, Human
uauaaaccaguaaaugccaaaga

SEQ ID NO: 208058 - RNA, 21 nt, Human
uauaaagguuaugaagggagg

SEQ ID NO: 208059 - RNA, 24 nt, Human
uauaacaaacuacaaaauagcacc

SEQ ID NO: 208060 - RNA, 22 nt, Human
uaucagacacuguaaaacaaac

SEQ ID NO: 208061 - RNA, 21 nt, Human
ucacaaggucaggaguuugag

SEQ ID NO: 208062 - RNA, 23 nt, Human
ucacaaggucaggaguuugaguc

SEQ ID NO: 208063 - RNA, 25 nt, Human
ucacagagagcuaggggcuaccccg

SEQ ID NO: 208064 - RNA, 20 nt, Human
ucauaaaaccaaaugcagaa

SEQ ID NO: 208065 - RNA, 23 nt, Human
ucaugccacugcacuccagccug

SEQ ID NO: 208066 - RNA, 22 nt, Human
ucaugccuguaaucccagcaau

SEQ ID NO: 208067 - RNA, 22 nt, Human
uccaaacaaaaucagauuaagg

SEQ ID NO: 208068 - RNA, 23 nt, Human
uccacagaaccuguaugucugga

SEQ ID NO: 208069 - RNA, 24 nt, Human
ucgcuuaaacccaggagguggagg

SEQ ID NO: 208070 - RNA, 23 nt, Human
ucuauaaaauucugaggcagaua

SEQ ID NO: 208071 - RNA, 18 nt, Human
ucuccuuuuucuuuuccu

SEQ ID NO: 208072 - RNA, 24 nt, Human
ucuccuuuuucuuuuccuuucucu

SEQ ID NO: 208073 - RNA, 19 nt, Human
ucucuggacucgccagucc

SEQ ID NO: 208074 - RNA, 23 nt, Human
ucugaagcaaagcuuguaaaguu

SEQ ID NO: 208075 - RNA, 18 nt, Human
ucugaaguacaaagucug

SEQ ID NO: 208076 - RNA, 23 nt, Human
ucuuaaagaaacaauagcaccac

SEQ ID NO: 208077 - RNA, 22 nt, Human
ugaaaacaaaacaaaauccaaa

SEQ ID NO: 208078 - RNA, 21 nt, Human
ugaaauaaucaagccugggua

SEQ ID NO: 208079 - RNA, 24 nt, Human
ugaaaucugagucauucugcugua

SEQ ID NO: 208080 - RNA, 19 nt, Human
ugaagugacuugcccaagg

SEQ ID NO: 208081 - RNA, 22 nt, Human
ugaaugaauggcuccagcagcc

SEQ ID NO: 208082 - RNA, 20 nt, Human
ugaauggcuccagcagccaa

SEQ ID NO: 208083 - RNA, 22 nt, Human
ugaauggcuccagcagccaaga

SEQ ID NO: 208084 - RNA, 19 nt, Human
ugacaagaacugagauguc

SEQ ID NO: 208085 - RNA, 18 nt, Human
ugaccuaaguauccagua

SEQ ID NO: 208086 - RNA, 23 nt, Human
ugagaguuaaaauacuuguugac

SEQ ID NO: 208087 - RNA, 21 nt, Human
ugagaugucaggagcauucaa

SEQ ID NO: 208088 - RNA, 22 nt, Human
ugagccgagaucaugccacugc

SEQ ID NO: 208089 - RNA, 23 nt, Human
ugaggaggccaaauucggcaaau

SEQ ID NO: 208090 - RNA, 23 nt, Human
ugaggcaaaauacaugauguaau

SEQ ID NO: 208091 - RNA, 19 nt, Human
ugaggcaggagaaucgcuu

SEQ ID NO: 208092 - RNA, 24 nt, Human
ugaggcaggagaaucgcuuaaacc

SEQ ID NO: 208093 - RNA, 26 nt, Human
ugaggcgggcaaaucacaaggucagg

SEQ ID NO: 208094 - RNA, 20 nt, Human
ugagguagguagaugacaua

SEQ ID NO: 208095 - RNA, 20 nt, Human
ugagguagguagaugacaua

SEQ ID NO: 208096 - RNA, 24 nt, Human
ugaguccaaccuggccaacauggu

SEQ ID NO: 208097 - RNA, 18 nt, Human
ugaguugaaagcucauuc

SEQ ID NO: 208098 - RNA, 19 nt, Human
ugauacacagacacagaua

SEQ ID NO: 208099 - RNA, 18 nt, Human
ugauauaaaaaaaagaag

SEQ ID NO: 208100 - RNA, 19 nt, Human
ugcagagcaaaggauccug

SEQ ID NO: 208101 - RNA, 21 nt, Human
ugcauccaacuuauauuuggu

SEQ ID NO: 208102 - RNA, 22 nt, Human
ugccaaagaauacccaaggggg

SEQ ID NO: 208103 - RNA, 24 nt, Human
ugccuguaaucccagcaauuuggg

SEQ ID NO: 208104 - RNA, 24 nt, Human
ugccuguaaucccagcuacucagg

SEQ ID NO: 208105 - RNA, 19 nt, Human
uggaaaacaggcagagggc

SEQ ID NO: 208106 - RNA, 19 nt, Human
uggaaaacaggcagagggc

SEQ ID NO: 208107 - RNA, 23 nt, Human
uggaaggcauaacuggggggacu

SEQ ID NO: 208108 - RNA, 22 nt, Human
uggagccacagagcaugagaug

SEQ ID NO: 208109 - RNA, 21 nt, Human
uggauaaaacacauucacaga

SEQ ID NO: 208110 - RNA, 18 nt, Human
uggauagaauuaagugaa

SEQ ID NO: 208111 - RNA, 20 nt, Human
uggccaguuauuuggauagc

SEQ ID NO: 208112 - RNA, 22 nt, Human
uggcucaugccuguaaucccag

SEQ ID NO: 208113 - RNA, 24 nt, Human
uggcucaugccuguaaucccagca

SEQ ID NO: 208114 - RNA, 18 nt, Human
uggcuccaggcuuccccu

SEQ ID NO: 208115 - RNA, 19 nt, Human
ugggaaagcaaaaugugcu

SEQ ID NO: 208116 - RNA, 26 nt, Human
ugggaagaggaguccaguaucuuauu

SEQ ID NO: 208117 - RNA, 24 nt, Human
ugggaggcugaggcgggcaaauca

SEQ ID NO: 208118 - RNA, 24 nt, Human
ugggcaaaauaaaaugaguaaugu

SEQ ID NO: 208119 - RNA, 22 nt, Human
ugggggcagaauaaagacagcu

SEQ ID NO: 208120 - RNA, 20 nt, Human
uggguuagaauuggugugcu

SEQ ID NO: 208121 - RNA, 22 nt, Human
uggguugggaugggggcagaau

SEQ ID NO: 208122 - RNA, 19 nt, Human
ugguacaaaugccacagau

SEQ ID NO: 208123 - RNA, 20 nt, Human
uggucagcccucuauaaaau

SEQ ID NO: 208124 - RNA, 20 nt, Human
uggugaguggggucaauggg

SEQ ID NO: 208125 - RNA, 20 nt, Human
uggugaguggggucaauggg

SEQ ID NO: 208126 - RNA, 21 nt, Human
uggugaguggggucaaugggu

SEQ ID NO: 208127 - RNA, 22 nt, Human
uggugaguggggucaaugggug

SEQ ID NO: 208128 - RNA, 24 nt, Human
ugguggcucaugccuguaauccca

SEQ ID NO: 208129 - RNA, 21 nt, Human
uggugggugccuguaauccca

SEQ ID NO: 208130 - RNA, 24 nt, Human
uggugggugccuguaaucccagcu

SEQ ID NO: 208131 - RNA, 22 nt, Human
uguaaaauauagaauuugcaug

SEQ ID NO: 208132 - RNA, 22 nt, Human
ugugauuugaauggaaagauuc

SEQ ID NO: 208133 - RNA, 20 nt, Human
ugugucaucuuuggcuccag

SEQ ID NO: 208134 - RNA, 22 nt, Human
ugugucuaaaauaaaaugcauc

SEQ ID NO: 208135 - RNA, 19 nt, Human
ugugugugucuguguaugu

SEQ ID NO: 208136 - RNA, 19 nt, Human
ugugugugucuguguaugu

SEQ ID NO: 208137 - RNA, 20 nt, Human
ugugugugucuguguaugua

SEQ ID NO: 208138 - RNA, 22 nt, Human
ugugugugugugugucugugua

SEQ ID NO: 208139 - RNA, 18 nt, Human
ugugugugugugugugug

SEQ ID NO: 208140 - RNA, 18 nt, Human
ugugugugugugugugug

SEQ ID NO: 208141 - RNA, 18 nt, Human
ugugugugugugugugug

SEQ ID NO: 208142 - RNA, 18 nt, Human
ugugugugugugugugug

SEQ ID NO: 208143 - RNA, 18 nt, Human
ugugugugugugugugug

SEQ ID NO: 208144 - RNA, 18 nt, Human
ugugugugugugugugug

SEQ ID NO: 208145 - RNA, 18 nt, Human
ugugugugugugugugug

SEQ ID NO: 208146 - RNA, 18 nt, Human
ugugugugugugugugug

SEQ ID NO: 208147 - RNA, 18 nt, Human
ugugugugugugugugug

SEQ ID NO: 208148 - RNA, 18 nt, Human
ugugugugugugugugug

SEQ ID NO: 208149 - RNA, 18 nt, Human
ugugugugugugugugug

SEQ ID NO: 208150 - RNA, 18 nt, Human
ugugugugugugugugug

SEQ ID NO: 208151 - RNA, 22 nt, Human
ugugugugugugugugugucug

SEQ ID NO: 208152 - RNA, 21 nt, Human
ugugugugugugugugugugu

SEQ ID NO: 208153 - RNA, 21 nt, Human
ugugugugugugugugugugu

SEQ ID NO: 208154 - RNA, 21 nt, Human
ugugugugugugugugugugu

SEQ ID NO: 208155 - RNA, 21 nt, Human
ugugugugugugugugugugu

SEQ ID NO: 208156 - RNA, 21 nt, Human
ugugugugugugugugugugu

SEQ ID NO: 208157 - RNA, 21 nt, Human
ugugugugugugugugugugu

SEQ ID NO: 208158 - RNA, 21 nt, Human
ugugugugugugugugugugu

SEQ ID NO: 208159 - RNA, 21 nt, Human
ugugugugugugugugugugu

SEQ ID NO: 208160 - RNA, 21 nt, Human
ugugugugugugugugugugu

SEQ ID NO: 208161 - RNA, 21 nt, Human
ugugugugugugugugugugu

SEQ ID NO: 208162 - RNA, 21 nt, Human
ugugugugugugugugugugu

SEQ ID NO: 208163 - RNA, 21 nt, Human
ugugugugugugugugugugu

SEQ ID NO: 208164 - RNA, 21 nt, Human
ugugugugugugugugugugu

SEQ ID NO: 208165 - RNA, 21 nt, Human
ugugugugugugugugugugu

SEQ ID NO: 208166 - RNA, 21 nt, Human
ugugugugugugugugugugu

SEQ ID NO: 208167 - RNA, 21 nt, Human
ugugugugugugugugugugu

SEQ ID NO: 208168 - RNA, 21 nt, Human
ugugugugugugugugugugu

SEQ ID NO: 208169 - RNA, 21 nt, Human
ugugugugugugugugugugu

SEQ ID NO: 208170 - RNA, 21 nt, Human
ugugugugugugugugugugu

SEQ ID NO: 208171 - RNA, 22 nt, Human
ugugugugugugugugugugug

SEQ ID NO: 208172 - RNA, 22 nt, Human
ugugugugugugugugugugug

SEQ ID NO: 208173 - RNA, 22 nt, Human
ugugugugugugugugugugug

SEQ ID NO: 208174 - RNA, 22 nt, Human
ugugugugugugugugugugug

SEQ ID NO: 208175 - RNA, 22 nt, Human
ugugugugugugugugugugug

SEQ ID NO: 208176 - RNA, 24 nt, Human
uuaaacccaggagguggagguugc

SEQ ID NO: 208177 - RNA, 20 nt, Human
uuaaauuggaaauaagccua

SEQ ID NO: 208178 - RNA, 20 nt, Human
uuaagagggaacacaugggc

SEQ ID NO: 208179 - RNA, 20 nt, Human
uuauuccucauucugauaua

SEQ ID NO: 208180 - RNA, 22 nt, Human
uucaaaaauccccugggccucu

SEQ ID NO: 208181 - RNA, 19 nt, Human
uucaaaaucaaauugaaaa

SEQ ID NO: 208182 - RNA, 19 nt, Human
uucacagagagcuaggggc

SEQ ID NO: 208183 - RNA, 23 nt, Human
uucaugauacacagacacagaua

SEQ ID NO: 208184 - RNA, 21 nt, Human
uucuugacgacuugcugcugc

SEQ ID NO: 208185 - RNA, 18 nt, Human
uugaaagaccccaucaaa

SEQ ID NO: 208186 - RNA, 22 nt, Human
uugaaagugaaagguaauucag

SEQ ID NO: 208187 - RNA, 19 nt, Human
uugaagaaacuuucuaugu

SEQ ID NO: 208188 - RNA, 19 nt, Human
uugaagaaugaggagagaa

SEQ ID NO: 208189 - RNA, 18 nt, Human
uugaccuaaguauccagu

SEQ ID NO: 208190 - RNA, 18 nt, Human
uugcagugagccgagauc

SEQ ID NO: 208191 - RNA, 20 nt, Human
uugcagugagccgagaucau

SEQ ID NO: 208192 - RNA, 21 nt, Human
uugcagugagccgagaucaug

SEQ ID NO: 208193 - RNA, 19 nt, Human
uugcauaaaucagauuuau

SEQ ID NO: 208194 - RNA, 21 nt, Human
uugcuaagcaugcuugaggug

SEQ ID NO: 208195 - RNA, 23 nt, Human
uugcuaauuuugcuaaguuugag

SEQ ID NO: 208196 - RNA, 22 nt, Human
uugcugcugcuuuugaggaggc

SEQ ID NO: 208197 - RNA, 24 nt, Human
uuggccaguuauuuggauagcuuc

SEQ ID NO: 208198 - RNA, 25 nt, Human
uugggaggcugaggcgggcaaauca

SEQ ID NO: 208199 - RNA, 21 nt, Human
uuuaaaaaauuuccaacuccu

SEQ ID NO: 208200 - RNA, 23 nt, Human
uuuaaauagucugauuauagcuu

SEQ ID NO: 208201 - RNA, 23 nt, Human
uuuaauauuauuugggcaagaga

SEQ ID NO: 208202 - RNA, 22 nt, Human
uuuacaaauaucuugaaauugc

SEQ ID NO: 208203 - RNA, 25 nt, Human
uuuccaacuccugccccugcacccc

SEQ ID NO: 208204 - RNA, 22 nt, Human
uuucuuuuccuuucucucuuuu

SEQ ID NO: 208205 - RNA, 18 nt, Human
uuuuaaauguuaucaaac

SEQ ID NO: 208206 - RNA, 23 nt, Human
uuuugugucugaaguuccucuug

SEQ ID NO: 208207 - RNA, 21 nt, Human
uuuuguuguugccccccuacc

SEQ ID NO: 208208 - RNA, 18 nt, Human
uuuuuccuggccucugau

SEQ ID NO: 208209 - RNA, 21 nt, Human
uuuuuuguaagcaugaugugg

SEQ ID NO: 208210 - RNA, 24 nt, Human
aaaacucucucuccccccccaccc

SEQ ID NO: 208211 - RNA, 18 nt, Human
aacucucucucccccccc

SEQ ID NO: 208212 - RNA, 23 nt, Human
aacucucucuccccccccacccc

SEQ ID NO: 208213 - RNA, 21 nt, Human
aaggaacaucccaaauguguu

SEQ ID NO: 208214 - RNA, 21 nt, Human
acagggaaggacagggacaga

SEQ ID NO: 208215 - RNA, 18 nt, Human
accugugugccuguggcc

SEQ ID NO: 208216 - RNA, 21 nt, Human
aggacagggacagagugagga

SEQ ID NO: 208217 - RNA, 21 nt, Human
agucagaagcaaugagaccug

SEQ ID NO: 208218 - RNA, 22 nt, Human
caaugagaccugugugccugug

SEQ ID NO: 208219 - RNA, 19 nt, Human
cagaacugaagauccacug

SEQ ID NO: 208220 - RNA, 22 nt, Human
cagcacagcaggggcagucgga

SEQ ID NO: 208221 - RNA, 21 nt, Human
cauauugaaaaaaggaacauc

SEQ ID NO: 208222 - RNA, 24 nt, Human
cccaaauguguuuuacugcagaga

SEQ ID NO: 208223 - RNA, 18 nt, Human
ccccccccaccccgcugc

SEQ ID NO: 208224 - RNA, 25 nt, Human
cgaggaaucagcgccgggccgauga

SEQ ID NO: 208225 - RNA, 22 nt, Human
cgcacacguuacuguuugcaca

SEQ ID NO: 208226 - RNA, 18 nt, Human
cgccgggccgaugaggga

SEQ ID NO: 208227 - RNA, 23 nt, Human
cucucucuccccccccaccccgc

SEQ ID NO: 208228 - RNA, 19 nt, Human
cuucuccccaccuucacug

SEQ ID NO: 208229 - RNA, 23 nt, Human
gaaaaaaggaacaucccaaaugu

SEQ ID NO: 208230 - RNA, 22 nt, Human
gagaacagggaaggacagggac

SEQ ID NO: 208231 - RNA, 19 nt, Human
gagaggagagagaaaggga

SEQ ID NO: 208232 - RNA, 24 nt, Human
gcccaugucaguuaaggguuuggg

SEQ ID NO: 208233 - RNA, 19 nt, Human
gcggguguguacagugguu

SEQ ID NO: 208234 - RNA, 23 nt, Human
ggaaggacagggacagagugagg

SEQ ID NO: 208235 - RNA, 19 nt, Human
ggcagaacugaagauccac

SEQ ID NO: 208236 - RNA, 23 nt, Human
ggcagcaagggcagaacugaaga

SEQ ID NO: 208237 - RNA, 20 nt, Human
ggcccuuuguaaauuucaug

SEQ ID NO: 208238 - RNA, 23 nt, Human
ggcccuuuguaaauuucaugucc

SEQ ID NO: 208239 - RNA, 20 nt, Human
ggcggguguguacagugguu

SEQ ID NO: 208240 - RNA, 23 nt, Human
uaaaaugguaacagccuuggaug

SEQ ID NO: 208241 - RNA, 22 nt, Human
ucauuaagguucuuaaaggccc

SEQ ID NO: 208242 - RNA, 24 nt, Human
ucccuuucucaaaaaaaaaaaaaa

SEQ ID NO: 208243 - RNA, 21 nt, Human
ucucccgcgggcagcaagggc

SEQ ID NO: 208244 - RNA, 26 nt, Human
ucucccgcgggcagcaagggcagaac

SEQ ID NO: 208245 - RNA, 18 nt, Human
ucucuccccccccacccc

SEQ ID NO: 208246 - RNA, 21 nt, Human
ugaaaaaaggaacaucccaaa

SEQ ID NO: 208247 - RNA, 24 nt, Human
ugcgcacacguuacuguuugcaca

SEQ ID NO: 208248 - RNA, 23 nt, Human
ugcucacccaugccuccggacac

SEQ ID NO: 208249 - RNA, 20 nt, Human
ugguuggauggggccacagg

SEQ ID NO: 208250 - RNA, 21 nt, Human
uuaagguucuuaaaggcccau

SEQ ID NO: 208251 - RNA, 21 nt, Human
aaaagguaucgggaaaugagg

SEQ ID NO: 208252 - RNA, 22 nt, Human
aaacagaaagcguguaauuaau

SEQ ID NO: 208253 - RNA, 20 nt, Human
aagaugcugcugugcuuccu

SEQ ID NO: 208254 - RNA, 20 nt, Human
acagcgggagagaacagcac

SEQ ID NO: 208255 - RNA, 18 nt, Human
agaggggggcagagauag

SEQ ID NO: 208256 - RNA, 22 nt, Human
agaguagccuguuucggggagg

SEQ ID NO: 208257 - RNA, 20 nt, Human
aggagcugggggggacggga

SEQ ID NO: 208258 - RNA, 24 nt, Human
aggaggaggcugcaggaugguggc

SEQ ID NO: 208259 - RNA, 27 nt, Human
aggauagaggggggcagagauaguggg

SEQ ID NO: 208260 - RNA, 22 nt, Human
aggcgagagggcgggcgugagg

SEQ ID NO: 208261 - RNA, 21 nt, Human
aggcugcaggaugguggcgcc

SEQ ID NO: 208262 - RNA, 21 nt, Human
augcugcugugcuuccucagc

SEQ ID NO: 208263 - RNA, 22 nt, Human
auggaaccugauggaaacgucc

SEQ ID NO: 208264 - RNA, 23 nt, Human
auggaaccugauggaaacguccg

SEQ ID NO: 208265 - RNA, 19 nt, Human
auuguccagggaggacggg

SEQ ID NO: 208266 - RNA, 25 nt, Human
caaaccgaacagcgggcguuggccc

SEQ ID NO: 208267 - RNA, 24 nt, Human
cagagauagugggagagacagagu

SEQ ID NO: 208268 - RNA, 23 nt, Human
caggaggaggcugcaggauggug

SEQ ID NO: 208269 - RNA, 19 nt, Human
caggaugguggcgccgggc

SEQ ID NO: 208270 - RNA, 21 nt, Human
ccacuuugguucggcgaaggc

SEQ ID NO: 208271 - RNA, 19 nt, Human
ccagcgccgcucuggccga

SEQ ID NO: 208272 - RNA, 19 nt, Human
ccgcccaccucccugcugc

SEQ ID NO: 208273 - RNA, 19 nt, Human
ccgcccaccucccugcugc

SEQ ID NO: 208274 - RNA, 18 nt, Human
cgcacagcgggagagaac

SEQ ID NO: 208275 - RNA, 18 nt, Human
cgugaaaggggggggccg

SEQ ID NO: 208276 - RNA, 23 nt, Human
cguggucaggaggaggcugcagg

SEQ ID NO: 208277 - RNA, 22 nt, Human
cucccugcugcgugucgcaaac

SEQ ID NO: 208278 - RNA, 19 nt, Human
cugccgcccaccucccugc

SEQ ID NO: 208279 - RNA, 19 nt, Human
cuguuucggggaggcgggg

SEQ ID NO: 208280 - RNA, 20 nt, Human
gaagccccagggggacgugg

SEQ ID NO: 208281 - RNA, 18 nt, Human
gagaagccccagggggac

SEQ ID NO: 208282 - RNA, 23 nt, Human
gagagaacagcacggagagaaac

SEQ ID NO: 208283 - RNA, 21 nt, Human
gagaguagccuguuucgggga

SEQ ID NO: 208284 - RNA, 23 nt, Human
gagauagugggagagaccgguac

SEQ ID NO: 208285 - RNA, 19 nt, Human
gagggagucggaggcuagg

SEQ ID NO: 208286 - RNA, 18 nt, Human
gagggggagagaggacag

SEQ ID NO: 208287 - RNA, 23 nt, Human
gagggggggagggagucggaggc

SEQ ID NO: 208288 - RNA, 18 nt, Human
gccggacacuccucugcc

SEQ ID NO: 208289 - RNA, 21 nt, Human
gcugucuucgggcuggggcgg

SEQ ID NO: 208290 - RNA, 23 nt, Human
ggagcugggggggacgggaggga

SEQ ID NO: 208291 - RNA, 20 nt, Human
ggcagagcggggggauggcu

SEQ ID NO: 208292 - RNA, 20 nt, Human
ggcgcacagcgggagagaac

SEQ ID NO: 208293 - RNA, 18 nt, Human
ggcgugagggggggaggg

SEQ ID NO: 208294 - RNA, 24 nt, Human
ggcgugagggggggagggagucgg

SEQ ID NO: 208295 - RNA, 20 nt, Human
gggcagagcggggggauggc

SEQ ID NO: 208296 - RNA, 24 nt, Human
gggcagagcggggggauggcuuuu

SEQ ID NO: 208297 - RNA, 21 nt, Human
gggcaggcgcacagcgggaga

SEQ ID NO: 208298 - RNA, 22 nt, Human
gggcuggggcgggccagauguu

SEQ ID NO: 208299 - RNA, 22 nt, Human
gggcugucuucgggcuggggcg

SEQ ID NO: 208300 - RNA, 23 nt, Human
ggggacgggagggagcgaaggga

SEQ ID NO: 208301 - RNA, 19 nt, Human
gggggagggagucggaggc

SEQ ID NO: 208302 - RNA, 21 nt, Human
gggucaggagaagccccaggg

SEQ ID NO: 208303 - RNA, 20 nt, Human
ggucaggagaagccccaggg

SEQ ID NO: 208304 - RNA, 20 nt, Human
uaucaaggauagaggggggc

SEQ ID NO: 208305 - RNA, 22 nt, Human
ucagcccgauggagggggccga

SEQ ID NO: 208306 - RNA, 18 nt, Human
uccguggucaggaggagg

SEQ ID NO: 208307 - RNA, 23 nt, Human
uccucugccagcgccgcucuggc

SEQ ID NO: 208308 - RNA, 18 nt, Human
ucggaggcuaggagcugg

SEQ ID NO: 208309 - RNA, 23 nt, Human
ugaacgugaaaggggggggccga

SEQ ID NO: 208310 - RNA, 21 nt, Human
uggaaacguccguggucagga

SEQ ID NO: 208311 - RNA, 19 nt, Human
uggaagccggcgacgcugc

SEQ ID NO: 208312 - RNA, 19 nt, Human
uggagggggccgaggagag

SEQ ID NO: 208313 - RNA, 19 nt, Human
uggagggggccgaggagag

SEQ ID NO: 208314 - RNA, 21 nt, Human
uggagggggccgaggagagua

SEQ ID NO: 208315 - RNA, 19 nt, Human
ugggagagacagagugaac

SEQ ID NO: 208316 - RNA, 18 nt, Human
uggucaggaggaggcugc

SEQ ID NO: 208317 - RNA, 20 nt, Human
uuccucagcccgauggaggg

SEQ ID NO: 208318 - RNA, 27 nt, Human
aaacagaaagcaaaagagaagggaccc

SEQ ID NO: 208319 - RNA, 21 nt, Human
aaacugguacaucacaccccu

SEQ ID NO: 208320 - RNA, 18 nt, Human
aaccuaggcacucgggga

SEQ ID NO: 208321 - RNA, 25 nt, Human
aacgguggcuguuuuuuuuuccuuu

SEQ ID NO: 208322 - RNA, 20 nt, Human
aacucuccaaaaccuaggca

SEQ ID NO: 208323 - RNA, 18 nt, Human
aagaaacagaaagcaaaa

SEQ ID NO: 208324 - RNA, 23 nt, Human
aagaaacagaaagcaaaagagaa

SEQ ID NO: 208325 - RNA, 23 nt, Human
aagauggacaaacugguacauca

SEQ ID NO: 208326 - RNA, 24 nt, Human
aagcaaaagagaaaagagacagaa

SEQ ID NO: 208327 - RNA, 22 nt, Human
aaucaggaaggaguggggccug

SEQ ID NO: 208328 - RNA, 23 nt, Human
acacacacacacacaaacacaca

SEQ ID NO: 208329 - RNA, 23 nt, Human
acacacacacacacacacacaca

SEQ ID NO: 208330 - RNA, 23 nt, Human
acacacacacacacacacacaca

SEQ ID NO: 208331 - RNA, 23 nt, Human
acacacacacacacacacacaca

SEQ ID NO: 208332 - RNA, 29 nt, Human
acacacacacacacacacacacaaacaca

SEQ ID NO: 208333 - RNA, 22 nt, Human
acacacacacacacacacacag

SEQ ID NO: 208334 - RNA, 19 nt, Human
acccgcccagccucccucc

SEQ ID NO: 208335 - RNA, 23 nt, Human
acucacacacacacacacacaca

SEQ ID NO: 208336 - RNA, 23 nt, Human
agaaaagagacagaaugagcucc

SEQ ID NO: 208337 - RNA, 24 nt, Human
agaaaagagacagaaugagcucca

SEQ ID NO: 208338 - RNA, 25 nt, Human
agaaaagagacagaaugagcuccaa

SEQ ID NO: 208339 - RNA, 26 nt, Human
agaaaagagacagaaugaggggaccc

SEQ ID NO: 208340 - RNA, 24 nt, Human
agaacaccagcagcgccucccucc

SEQ ID NO: 208341 - RNA, 20 nt, Human
aggaaggaguggggccugag

SEQ ID NO: 208342 - RNA, 20 nt, Human
aggcggagguggagacgggg

SEQ ID NO: 208343 - RNA, 23 nt, Human
aggcggagguggagacgggggac

SEQ ID NO: 208344 - RNA, 24 nt, Human
agguggagacggagcgggagcccg

SEQ ID NO: 208345 - RNA, 20 nt, Human
auagaacaggcaaacucucc

SEQ ID NO: 208346 - RNA, 18 nt, Human
augcaguuucuguaaguc

SEQ ID NO: 208347 - RNA, 24 nt, Human
augcugugaccgcccggccucccu

SEQ ID NO: 208348 - RNA, 22 nt, Human
augcuuuuaaaugaggacuugg

SEQ ID NO: 208349 - RNA, 18 nt, Human
caaacacacaaaucaauc

SEQ ID NO: 208350 - RNA, 22 nt, Human
cacaaacacacaaaucaaucuu

SEQ ID NO: 208351 - RNA, 23 nt, Human
cacacaaacacacaaaucaaucu

SEQ ID NO: 208352 - RNA, 18 nt, Human
cacacacacacacacaca

SEQ ID NO: 208353 - RNA, 20 nt, Human
cacacacacacacacacaca

SEQ ID NO: 208354 - RNA, 20 nt, Human
cacacacacacacacacaca

SEQ ID NO: 208355 - RNA, 20 nt, Human
cacacacacacacacacaca

SEQ ID NO: 208356 - RNA, 20 nt, Human
cacacacacacacacacaca

SEQ ID NO: 208357 - RNA, 20 nt, Human
cacacacacacacacacaca

SEQ ID NO: 208358 - RNA, 20 nt, Human
cacacacacacacacacaca

SEQ ID NO: 208359 - RNA, 22 nt, Human
cacacacacacacacacacaca

SEQ ID NO: 208360 - RNA, 22 nt, Human
cacacacacacacacacacaca

SEQ ID NO: 208361 - RNA, 26 nt, Human
cacacacacacacacacacacacaaa

SEQ ID NO: 208362 - RNA, 26 nt, Human
cacacacacacacacacacacacaca

SEQ ID NO: 208363 - RNA, 26 nt, Human
cacacacacacacacacacacacaca

SEQ ID NO: 208364 - RNA, 26 nt, Human
cacacacacacacacacacacacaca

SEQ ID NO: 208365 - RNA, 26 nt, Human
cacacacacacacacacacacacaca

SEQ ID NO: 208366 - RNA, 19 nt, Human
cacccucucccccaucaca

SEQ ID NO: 208367 - RNA, 25 nt, Human
cacccucucccccaucacaaaaacu

SEQ ID NO: 208368 - RNA, 20 nt, Human
cagcaauagaacaccagagg

SEQ ID NO: 208369 - RNA, 19 nt, Human
cagcgccucccuccuccuc

SEQ ID NO: 208370 - RNA, 23 nt, Human
ccagccaaaccgguacaggcuga

SEQ ID NO: 208371 - RNA, 18 nt, Human
ccaguucaacaucccgcc

SEQ ID NO: 208372 - RNA, 21 nt, Human
cccaaaucuggaaaaaauuca

SEQ ID NO: 208373 - RNA, 19 nt, Human
cccgcccagccucccucca

SEQ ID NO: 208374 - RNA, 19 nt, Human
cccgccggaagcugcccca

SEQ ID NO: 208375 - RNA, 19 nt, Human
ccgcccggccucccuccuc

SEQ ID NO: 208376 - RNA, 19 nt, Human
ccgccuggccucccuccuc

SEQ ID NO: 208377 - RNA, 24 nt, Human
ccuauaccccaaaucuggaaaaaa

SEQ ID NO: 208378 - RNA, 18 nt, Human
ccuccacgccaugcccgc

SEQ ID NO: 208379 - RNA, 21 nt, Human
ccugaccuccuucacccucuc

SEQ ID NO: 208380 - RNA, 20 nt, Human
ccugugcacguaugugugug

SEQ ID NO: 208381 - RNA, 30 nt, Human
cgagaaaagucauucacuaaacauggcagu

SEQ ID NO: 208382 - RNA, 18 nt, Human
cgccagaauaagaacacc

SEQ ID NO: 208383 - RNA, 20 nt, Human
cgccagaauaagaacaccag

SEQ ID NO: 208384 - RNA, 24 nt, Human
cgccgccagggcaaaggcggaggu

SEQ ID NO: 208385 - RNA, 23 nt, Human
cgcggcuccgugcuccccugcag

SEQ ID NO: 208386 - RNA, 22 nt, Human
cggaagcugccccauacacuga

SEQ ID NO: 208387 - RNA, 21 nt, Human
cucacacacacacacacacac

SEQ ID NO: 208388 - RNA, 26 nt, Human
cuccacgccaugcccgccuggccucc

SEQ ID NO: 208389 - RNA, 24 nt, Human
cuccaugcugugaccgcccggccu

SEQ ID NO: 208390 - RNA, 23 nt, Human
cuccgcgcuguacccgcccagcc

SEQ ID NO: 208391 - RNA, 18 nt, Human
cuccuccgcgcuguaccc

SEQ ID NO: 208392 - RNA, 20 nt, Human
cuccuucacccucuccccca

SEQ ID NO: 208393 - RNA, 22 nt, Human
cuucucagcaauagaacaccag

SEQ ID NO: 208394 - RNA, 20 nt, Human
gaaaaaaaaaugaagagaaa

SEQ ID NO: 208395 - RNA, 19 nt, Human
gaagcaucaucgaguggaa

SEQ ID NO: 208396 - RNA, 22 nt, Human
gcccggccucccuccuccucca

SEQ ID NO: 208397 - RNA, 19 nt, Human
gcgggcgcgaggcuaacgg

SEQ ID NO: 208398 - RNA, 19 nt, Human
ggacuaaagcagcaagggu

SEQ ID NO: 208399 - RNA, 21 nt, Human
ggacuuggggcaaaacccugg

SEQ ID NO: 208400 - RNA, 22 nt, Human
ggcaaacucuccaaaaccuagg

SEQ ID NO: 208401 - RNA, 19 nt, Human
ggcauagaacaggcaaacu

SEQ ID NO: 208402 - RNA, 19 nt, Human
ggcccggacugcgcggcgg

SEQ ID NO: 208403 - RNA, 20 nt, Human
gguggagacggagcgggagc

SEQ ID NO: 208404 - RNA, 25 nt, Human
uaaaaaaauaagcacaguaaaggug

SEQ ID NO: 208405 - RNA, 19 nt, Human
uaagaacaccagcagcgcc

SEQ ID NO: 208406 - RNA, 22 nt, Human
ucaacuccacucacacacacac

SEQ ID NO: 208407 - RNA, 26 nt, Human
ucaacuccacucacacacacacacac

SEQ ID NO: 208408 - RNA, 21 nt, Human
ucacacacacacacacacaca

SEQ ID NO: 208409 - RNA, 19 nt, Human
ucacaccccugcuggcagg

SEQ ID NO: 208410 - RNA, 22 nt, Human
ucacccucucccccaucacaaa

SEQ ID NO: 208411 - RNA, 20 nt, Human
uccacucacacacacacaca

SEQ ID NO: 208412 - RNA, 31 nt, Human
uccacucacacacacacacacacacacacag

SEQ ID NO: 208413 - RNA, 19 nt, Human
uccuucacccucuccccca

SEQ ID NO: 208414 - RNA, 18 nt, Human
ucgaaugcagcccucugu

SEQ ID NO: 208415 - RNA, 18 nt, Human
ucucccccaucacaaaaa

SEQ ID NO: 208416 - RNA, 20 nt, Human
ucuucgaaugcagcccucug

SEQ ID NO: 208417 - RNA, 20 nt, Human
ugaaaaaaaaaugaagagaa

SEQ ID NO: 208418 - RNA, 23 nt, Human
ugaagagaugagaccuauacccc

SEQ ID NO: 208419 - RNA, 20 nt, Human
ugaagauaucaugcaaaaag

SEQ ID NO: 208420 - RNA, 18 nt, Human
ugacaccucaacuccacu

SEQ ID NO: 208421 - RNA, 24 nt, Human
ugacuaaaggcauagaacaggcaa

SEQ ID NO: 208422 - RNA, 20 nt, Human
ugaggccaagugcaaugcua

SEQ ID NO: 208423 - RNA, 19 nt, Human
ugcacguaugugugugugu

SEQ ID NO: 208424 - RNA, 22 nt, Human
ugcacguaugugugugugugcu

SEQ ID NO: 208425 - RNA, 23 nt, Human
ugccccauacacugacagccuca

SEQ ID NO: 208426 - RNA, 18 nt, Human
ugcgcggcgggcgcgagg

SEQ ID NO: 208427 - RNA, 21 nt, Human
ugcuagggccgaggcucuggc

SEQ ID NO: 208428 - RNA, 22 nt, Human
ugcucgcacgcacgugugugug

SEQ ID NO: 208429 - RNA, 22 nt, Human
ugcuucucagcaauagaacacc

SEQ ID NO: 208430 - RNA, 21 nt, Human
uggcaggaagaaacgguggcu

SEQ ID NO: 208431 - RNA, 22 nt, Human
uggcuguuuuuuuuuccuuuuu

SEQ ID NO: 208432 - RNA, 18 nt, Human
ugggcagguuguuugaau

SEQ ID NO: 208433 - RNA, 21 nt, Human
ugguuggaggugcuuggcugu

SEQ ID NO: 208434 - RNA, 19 nt, Human
ugugcacguaugugugugu

SEQ ID NO: 208435 - RNA, 20 nt, Human
ugugcacguaugugugugug

SEQ ID NO: 208436 - RNA, 25 nt, Human
ugugugcucgcacgcacgugugugg

SEQ ID NO: 208437 - RNA, 19 nt, Human
ugugugugcccuuaagaaa

SEQ ID NO: 208438 - RNA, 23 nt, Human
ugugugugugugcucgcacgcac

SEQ ID NO: 208439 - RNA, 20 nt, Human
uugaaaaaaaaaugaagaga

SEQ ID NO: 208440 - RNA, 19 nt, Human
uuggggcaaaacccugggc

SEQ ID NO: 208441 - RNA, 23 nt, Human
uuuccuuuuucucaaaccugagu

SEQ ID NO: 208442 - RNA, 19 nt, Human
uuugguuggaggugcuugg

SEQ ID NO: 208443 - RNA, 19 nt, Human
aaacagacgcaggagcuuu

SEQ ID NO: 208444 - RNA, 22 nt, Human
aaauaaacuuacagugaauaaa

SEQ ID NO: 208445 - RNA, 24 nt, Human
aaguuauuaacauaguacaaguuu

SEQ ID NO: 208446 - RNA, 19 nt, Human
aauaaauaaacagcuuucu

SEQ ID NO: 208447 - RNA, 23 nt, Human
agaauauuuauuguaaauguuuc

SEQ ID NO: 208448 - RNA, 19 nt, Human
agacaggggccgaugcucu

SEQ ID NO: 208449 - RNA, 22 nt, Human
aguguacauuuuaacagguggc

SEQ ID NO: 208450 - RNA, 21 nt, Human
cagcagacaggggccgaugcu

SEQ ID NO: 208451 - RNA, 18 nt, Human
caguauuuuuccaugcuc

SEQ ID NO: 208452 - RNA, 18 nt, Human
ccuucaaacuagcugaaa

SEQ ID NO: 208453 - RNA, 18 nt, Human
cggcgcggcggcagaugc

SEQ ID NO: 208454 - RNA, 19 nt, Human
cggcgcggcggcagaugcu

SEQ ID NO: 208455 - RNA, 24 nt, Human
cgggcgguggcccaaacucugggc

SEQ ID NO: 208456 - RNA, 22 nt, Human
cuaggcaguauuuuuccaugcu

SEQ ID NO: 208457 - RNA, 22 nt, Human
cucucucuuauuucauuuugca

SEQ ID NO: 208458 - RNA, 22 nt, Human
cucugggaggguggcggcggcg

SEQ ID NO: 208459 - RNA, 23 nt, Human
cugguggcggcgggcgguggccc

SEQ ID NO: 208460 - RNA, 21 nt, Human
gagcuuuggaagagcagaaau

SEQ ID NO: 208461 - RNA, 22 nt, Human
gaggguggcggcggcgcggcgg

SEQ ID NO: 208462 - RNA, 22 nt, Human
gcugguggcggcgggcgguggc

SEQ ID NO: 208463 - RNA, 20 nt, Human
ggccagugcucucugggagg

SEQ ID NO: 208464 - RNA, 18 nt, Human
ggcggcggcgcggcggca

SEQ ID NO: 208465 - RNA, 22 nt, Human
ggguggcggcggcgcggcggca

SEQ ID NO: 208466 - RNA, 20 nt, Human
guggaauauacaaguuaacc

SEQ ID NO: 208467 - RNA, 18 nt, Human
guggcggcgggcgguggc

SEQ ID NO: 208468 - RNA, 22 nt, Human
uaaacagcuuucuauaucaagu

SEQ ID NO: 208469 - RNA, 23 nt, Human
uacauauacauauauauauaaau

SEQ ID NO: 208470 - RNA, 20 nt, Human
uacauuuuaacagguggcaa

SEQ ID NO: 208471 - RNA, 25 nt, Human
uagcugaaaaacuacucucucuuau

SEQ ID NO: 208472 - RNA, 25 nt, Human
uauacauauacauauauauauaaau

SEQ ID NO: 208473 - RNA, 20 nt, Human
uauauacauauacauauaua

SEQ ID NO: 208474 - RNA, 29 nt, Human
uauauacauauacauauauauauaaaugu

SEQ ID NO: 208475 - RNA, 18 nt, Human
uauauauacauauacaua

SEQ ID NO: 208476 - RNA, 22 nt, Human
uauauauacauauacauauaua

SEQ ID NO: 208477 - RNA, 19 nt, Human
uauauauauacauauacau

SEQ ID NO: 208478 - RNA, 20 nt, Human
uauauauauauacauauaca

SEQ ID NO: 208479 - RNA, 24 nt, Human
ucaacacuuuuaacuuucccuaca

SEQ ID NO: 208480 - RNA, 23 nt, Human
uggcaacaucaccacagguagcu

SEQ ID NO: 208481 - RNA, 29 nt, Human
uggcaacaucaccacagguagcuuugauu

SEQ ID NO: 208482 - RNA, 18 nt, Human
uggcggcggcgcggcggc

SEQ ID NO: 208483 - RNA, 18 nt, Human
uguguagaaaaaauaaac

SEQ ID NO: 208484 - RNA, 19 nt, Human
aaaagggacacagggguuc

SEQ ID NO: 208485 - RNA, 18 nt, Human
aaaauccuccagcaccca

SEQ ID NO: 208486 - RNA, 21 nt, Human
aaagcaagaaggagcaggugu

SEQ ID NO: 208487 - RNA, 23 nt, Human
aagagagaggccggggaggugcc

SEQ ID NO: 208488 - RNA, 23 nt, Human
aagcaagaaggagcagguguggg

SEQ ID NO: 208489 - RNA, 19 nt, Human
acaacccccuuccuccccc

SEQ ID NO: 208490 - RNA, 25 nt, Human
acccaagcacucuccguuuucugcc

SEQ ID NO: 208491 - RNA, 19 nt, Human
accuguaccccagcucccc

SEQ ID NO: 208492 - RNA, 20 nt, Human
agagagaggccggggaggug

SEQ ID NO: 208493 - RNA, 20 nt, Human
aggcaccggcuggcugcggu

SEQ ID NO: 208494 - RNA, 22 nt, Human
agguguggcaucugcagcuggg

SEQ ID NO: 208495 - RNA, 30 nt, Human
caaaaauaaaaauuucucuucccccucccc

SEQ ID NO: 208496 - RNA, 21 nt, Human
caagaaggagcagguguggca

SEQ ID NO: 208497 - RNA, 26 nt, Human
cacccaagcacucuccguuuucugcc

SEQ ID NO: 208498 - RNA, 22 nt, Human
cacccaccacccaagcacucuc

SEQ ID NO: 208499 - RNA, 23 nt, Human
cagcacccaccacccaagcacuc

SEQ ID NO: 208500 - RNA, 26 nt, Human
cagcacccaccacccaagcacucucc

SEQ ID NO: 208501 - RNA, 22 nt, Human
cagcuccccgaccacaaccccc

SEQ ID NO: 208502 - RNA, 20 nt, Human
ccacaacccccuuccucccc

SEQ ID NO: 208503 - RNA, 23 nt, Human
cccaagcacucuccguuuucugc

SEQ ID NO: 208504 - RNA, 21 nt, Human
cccaccacccaagcacucucc

SEQ ID NO: 208505 - RNA, 24 nt, Human
cccaccacccaagcacucuccguu

SEQ ID NO: 208506 - RNA, 18 nt, Human
ccccaaaccuguacccca

SEQ ID NO: 208507 - RNA, 21 nt, Human
ccccgaccacaacccccuucc

SEQ ID NO: 208508 - RNA, 20 nt, Human
ccuccagcacccaccaccca

SEQ ID NO: 208509 - RNA, 19 nt, Human
ccuccuccgcuucuuccuc

SEQ ID NO: 208510 - RNA, 21 nt, Human
ccuguaccccagcuccccgac

SEQ ID NO: 208511 - RNA, 20 nt, Human
ccuuuaaucuuaugcaaaag

SEQ ID NO: 208512 - RNA, 27 nt, Human
cgaccacaacccccuuccucccccggg

SEQ ID NO: 208513 - RNA, 22 nt, Human
cuccagcacccaccacccaagc

SEQ ID NO: 208514 - RNA, 18 nt, Human
cuccccgaccacaacccc

SEQ ID NO: 208515 - RNA, 19 nt, Human
cuucccccuccccaaaccu

SEQ ID NO: 208516 - RNA, 21 nt, Human
gagcgagcgggcgggcgggca

SEQ ID NO: 208517 - RNA, 21 nt, Human
gcgagcgagcgggcgggcggg

SEQ ID NO: 208518 - RNA, 20 nt, Human
gcgagcgggcgggcgggcag

SEQ ID NO: 208519 - RNA, 22 nt, Human
gcggggggcaggggcgccaggc

SEQ ID NO: 208520 - RNA, 18 nt, Human
ggagaggggcggggggca

SEQ ID NO: 208521 - RNA, 19 nt, Human
ggcaggugcacggcccugc

SEQ ID NO: 208522 - RNA, 19 nt, Human
gggaaagcaagaaggagcc

SEQ ID NO: 208523 - RNA, 21 nt, Human
gggcaggugcacggcccugcg

SEQ ID NO: 208524 - RNA, 23 nt, Human
gggcgagcgagcgagcgggcggg

SEQ ID NO: 208525 - RNA, 21 nt, Human
guuuggagaggggcggggggc

SEQ ID NO: 208526 - RNA, 26 nt, Human
uaaaaauuucucuucccccuccccaa

SEQ ID NO: 208527 - RNA, 20 nt, Human
uaccccagcuccccgaccac

SEQ ID NO: 208528 - RNA, 23 nt, Human
uaccccagcuccccgaccacaac

SEQ ID NO: 208529 - RNA, 19 nt, Human
uaugcaaaagggacacagg

SEQ ID NO: 208530 - RNA, 21 nt, Human
uaugcaaaagggacacagggg

SEQ ID NO: 208531 - RNA, 22 nt, Human
ucccccggggaaagcaagaagg

SEQ ID NO: 208532 - RNA, 19 nt, Human
uccgcuucuuccuccuccc

SEQ ID NO: 208533 - RNA, 25 nt, Human
ucggcagcgcggcgcggcgggcgag

SEQ ID NO: 208534 - RNA, 23 nt, Human
ucugcagcugggaagagagaggc

SEQ ID NO: 208535 - RNA, 24 nt, Human
ugcagcugggaagagagaggccgg

SEQ ID NO: 208536 - RNA, 19 nt, Human
uggagaggggcggggggca

SEQ ID NO: 208537 - RNA, 23 nt, Human
ugggaagagagaggccggggagg

SEQ ID NO: 208538 - RNA, 20 nt, Human
uucuuccuccucccucgccc

SEQ ID NO: 208539 - RNA, 21 nt, Human
uuuggagaggggcggggggca

SEQ ID NO: 208540 - RNA, 23 nt, Human
aaaaaaucaguucaccacaaaca

SEQ ID NO: 208541 - RNA, 24 nt, Human
aaaaauacuuuuccccccaaaaag

SEQ ID NO: 208542 - RNA, 20 nt, Human
aaacaaguaggacuccaccu

SEQ ID NO: 208543 - RNA, 24 nt, Human
aaacagaaauauaaaucgaggcug

SEQ ID NO: 208544 - RNA, 23 nt, Human
aaccauaggcauuucaaaaaccu

SEQ ID NO: 208545 - RNA, 24 nt, Human
aagaaaccauaggcauuucaaaaa

SEQ ID NO: 208546 - RNA, 22 nt, Human
aagcgacaagaaaauucaaacu

SEQ ID NO: 208547 - RNA, 19 nt, Human
aaucaguucaccacaaaca

SEQ ID NO: 208548 - RNA, 23 nt, Human
acaagaacauaucuucucugcau

SEQ ID NO: 208549 - RNA, 22 nt, Human
accacaaacagaaauauaaauc

SEQ ID NO: 208550 - RNA, 26 nt, Human
accuuauuuucuccaauaguccccaa

SEQ ID NO: 208551 - RNA, 18 nt, Human
acuauuuauaaauacauu

SEQ ID NO: 208552 - RNA, 20 nt, Human
agaucuuacuauauuugggg

SEQ ID NO: 208553 - RNA, 22 nt, Human
aggaagauuccugaagaggagg

SEQ ID NO: 208554 - RNA, 23 nt, Human
aggcagaaugucuugagaccccu

SEQ ID NO: 208555 - RNA, 23 nt, Human
aggcuguagccagcugcugguca

SEQ ID NO: 208556 - RNA, 23 nt, Human
agucugggugcugugcucgaguc

SEQ ID NO: 208557 - RNA, 18 nt, Human
augggcuccccagcaagc

SEQ ID NO: 208558 - RNA, 18 nt, Human
auuuuuuuaaugguaaaa

SEQ ID NO: 208559 - RNA, 23 nt, Human
caaaaauacuuuuccccccaaaa

SEQ ID NO: 208560 - RNA, 21 nt, Human
caaggagagcucuaugcagcg

SEQ ID NO: 208561 - RNA, 26 nt, Human
cacaaacagaaauauaaaucgaggcu

SEQ ID NO: 208562 - RNA, 18 nt, Human
caccgaggucugcagcag

SEQ ID NO: 208563 - RNA, 19 nt, Human
caccgaggucugcagcagg

SEQ ID NO: 208564 - RNA, 20 nt, Human
cacgcugcuuggcaggcugg

SEQ ID NO: 208565 - RNA, 18 nt, Human
cagaaggcugugagcucc

SEQ ID NO: 208566 - RNA, 22 nt, Human
cagcagggcagagucucccuga

SEQ ID NO: 208567 - RNA, 18 nt, Human
caggaagauuccugaaga

SEQ ID NO: 208568 - RNA, 19 nt, Human
caguguccuggaugggcuc

SEQ ID NO: 208569 - RNA, 18 nt, Human
cauucuucuugguugagg

SEQ ID NO: 208570 - RNA, 25 nt, Human
cccaagcaguacaggucacuugaag

SEQ ID NO: 208571 - RNA, 21 nt, Human
cccagagugcccuagaacauu

SEQ ID NO: 208572 - RNA, 23 nt, Human
ccccacggggccgcagcaaaagc

SEQ ID NO: 208573 - RNA, 20 nt, Human
cccugucucucugucccucc

SEQ ID NO: 208574 - RNA, 23 nt, Human
ccuccgggagagcagcccagucu

SEQ ID NO: 208575 - RNA, 22 nt, Human
ccucuuucuaaacuuugguuua

SEQ ID NO: 208576 - RNA, 26 nt, Human
ccugcaaccggggcacgcugcuuggc

SEQ ID NO: 208577 - RNA, 21 nt, Human
cgacaagaaaauucaaacugc

SEQ ID NO: 208578 - RNA, 23 nt, Human
cgacaagaaaauucaaacugcuc

SEQ ID NO: 208579 - RNA, 22 nt, Human
cggcgcgaagcugugccucgug

SEQ ID NO: 208580 - RNA, 22 nt, Human
cucccaguguccuggaugggcu

SEQ ID NO: 208581 - RNA, 18 nt, Human
cucccugucucucugucc

SEQ ID NO: 208582 - RNA, 19 nt, Human
cugugagcuccaggagcau

SEQ ID NO: 208583 - RNA, 21 nt, Human
cuucgacugggccaugucuuc

SEQ ID NO: 208584 - RNA, 20 nt, Human
cuuggguuuggccuccggga

SEQ ID NO: 208585 - RNA, 22 nt, Human
gaagauuccugaagaggagggc

SEQ ID NO: 208586 - RNA, 19 nt, Human
gacuacuggaaagugaaaa

SEQ ID NO: 208587 - RNA, 18 nt, Human
gagagaugaaaauaaagc

SEQ ID NO: 208588 - RNA, 22 nt, Human
gcccuagaacauucuuagauac

SEQ ID NO: 208589 - RNA, 20 nt, Human
gcgaagcugugccucgugcc

SEQ ID NO: 208590 - RNA, 20 nt, Human
ggagggcccgaaauaccugc

SEQ ID NO: 208591 - RNA, 20 nt, Human
ggccuccgggagagcagccc

SEQ ID NO: 208592 - RNA, 21 nt, Human
guguguccacaccgaggucug

SEQ ID NO: 208593 - RNA, 22 nt, Human
uaaaaaaaaucaguucaccaca

SEQ ID NO: 208594 - RNA, 22 nt, Human
uaaaaaaauaaagaaaagcuaa

SEQ ID NO: 208595 - RNA, 20 nt, Human
uaaagaaaagcuaauaggua

SEQ ID NO: 208596 - RNA, 24 nt, Human
uaaagagcuuauccucagaaauaa

SEQ ID NO: 208597 - RNA, 18 nt, Human
uaaaucgaggcuguagcc

SEQ ID NO: 208598 - RNA, 22 nt, Human
uaccugccuuuauagguuccca

SEQ ID NO: 208599 - RNA, 26 nt, Human
uaccugccuuuauagguucccagagu

SEQ ID NO: 208600 - RNA, 24 nt, Human
uacggggagugggggugaagcgug

SEQ ID NO: 208601 - RNA, 22 nt, Human
uacuauauuuggggcuauguug

SEQ ID NO: 208602 - RNA, 23 nt, Human
uauacaauguuaacaagaacaua

SEQ ID NO: 208603 - RNA, 21 nt, Human
uauuuucuccaauagucccca

SEQ ID NO: 208604 - RNA, 21 nt, Human
ucaaaaauacuuuucccccca

SEQ ID NO: 208605 - RNA, 19 nt, Human
uccacauuaaccuugcggc

SEQ ID NO: 208606 - RNA, 19 nt, Human
uccaccuuauuuucuccaa

SEQ ID NO: 208607 - RNA, 23 nt, Human
uccccaagcaguacaggucacuu

SEQ ID NO: 208608 - RNA, 25 nt, Human
ucccugagccugacuuugccagacc

SEQ ID NO: 208609 - RNA, 19 nt, Human
ucucccugucucucugucc

SEQ ID NO: 208610 - RNA, 19 nt, Human
ucuuugcugacuacuggaa

SEQ ID NO: 208611 - RNA, 18 nt, Human
ugaaaauaaagcuuugcc

SEQ ID NO: 208612 - RNA, 23 nt, Human
ugaaaauaaagcuuugccuuuaa

SEQ ID NO: 208613 - RNA, 24 nt, Human
ugacaccacagaaggcugugagcu

SEQ ID NO: 208614 - RNA, 20 nt, Human
ugagaccccucuguuuucaa

SEQ ID NO: 208615 - RNA, 18 nt, Human
ugagcuccaggagcaugc

SEQ ID NO: 208616 - RNA, 18 nt, Human
ugaguuguugaacuacaa

SEQ ID NO: 208617 - RNA, 21 nt, Human
ugcaaaauaaggcauauuuga

SEQ ID NO: 208618 - RNA, 19 nt, Human
ugcuggucauguccuuggc

SEQ ID NO: 208619 - RNA, 22 nt, Human
uggaugggcuccccagcaagcc

SEQ ID NO: 208620 - RNA, 19 nt, Human
uggcaggcugggcgcgcag

SEQ ID NO: 208621 - RNA, 24 nt, Human
ugggccuucgacugggccaugucu

SEQ ID NO: 208622 - RNA, 18 nt, Human
uggggcgacaguacacgg

SEQ ID NO: 208623 - RNA, 20 nt, Human
ugugagcuccaggagcaugc

SEQ ID NO: 208624 - RNA, 22 nt, Human
uuaaacaaguaggacuccaccu

SEQ ID NO: 208625 - RNA, 20 nt, Human
uuaaagguuuuccuauucuc

SEQ ID NO: 208626 - RNA, 19 nt, Human
uuccugaagaggagggccc

SEQ ID NO: 208627 - RNA, 20 nt, Human
uucuugguugagggauccac

SEQ ID NO: 208628 - RNA, 21 nt, Human
uucuugguugagggauccacg

SEQ ID NO: 208629 - RNA, 18 nt, Human
uugugcuaaggaggacaa

SEQ ID NO: 208630 - RNA, 24 nt, Human
uuucaaaaaccucuuucuaaacuu

SEQ ID NO: 208631 - RNA, 23 nt, Human
uuucagaaaugacaccacagaag

SEQ ID NO: 208632 - RNA, 21 nt, Human
uuuuauuuuuuuaaugguaaa

SEQ ID NO: 208633 - RNA, 25 nt, Human
uuuuuuuuuuuuuuuuuuuauuuuu

SEQ ID NO: 208634 - RNA, 21 nt, Human
aaaggaaggaccuggggaaga

SEQ ID NO: 208635 - RNA, 23 nt, Human
aagcagauggugcaacaaccaga

SEQ ID NO: 208636 - RNA, 20 nt, Human
aaggauagguucaucccggu

SEQ ID NO: 208637 - RNA, 22 nt, Human
aagucagaauaaaaccucccaa

SEQ ID NO: 208638 - RNA, 22 nt, Human
aagucuccuuccauccagucaa

SEQ ID NO: 208639 - RNA, 26 nt, Human
acacgcacgcacacgcacacgugcac

SEQ ID NO: 208640 - RNA, 23 nt, Human
acccaugcucacaaacacacaca

SEQ ID NO: 208641 - RNA, 22 nt, Human
accccaccucccuagcccucug

SEQ ID NO: 208642 - RNA, 31 nt, Human
agagaaauguaccccaccucccuagcccucc

SEQ ID NO: 208643 - RNA, 22 nt, Human
agccuccagagcacaggaguag

SEQ ID NO: 208644 - RNA, 21 nt, Human
aggaaggacgauggucaaggu

SEQ ID NO: 208645 - RNA, 20 nt, Human
aggaagucagaauaaaaccu

SEQ ID NO: 208646 - RNA, 22 nt, Human
aggcaggcggcggggggcggcg

SEQ ID NO: 208647 - RNA, 23 nt, Human
aggggaguagggaggugugggga

SEQ ID NO: 208648 - RNA, 19 nt, Human
augcccaggggaguaggga

SEQ ID NO: 208649 - RNA, 18 nt, Human
auuaggcacauucagucc

SEQ ID NO: 208650 - RNA, 31 nt, Human
caaacacacacacacgcacgcacacgcacag

SEQ ID NO: 208651 - RNA, 22 nt, Human
caagcagauggugcaacaacca

SEQ ID NO: 208652 - RNA, 28 nt, Human
cacacacacgcacgcacacgcacacgug

SEQ ID NO: 208653 - RNA, 25 nt, Human
cacacgcacgcacacgcacacgugc

SEQ ID NO: 208654 - RNA, 20 nt, Human
cacacgugcacacgcgcauu

SEQ ID NO: 208655 - RNA, 20 nt, Human
cacgcacacgugcacacgcg

SEQ ID NO: 208656 - RNA, 19 nt, Human
cacgcuuccuuaggcuccc

SEQ ID NO: 208657 - RNA, 24 nt, Human
cagaauaaaaccucccaaggcuga

SEQ ID NO: 208658 - RNA, 19 nt, Human
cagaccuaaaggaaggacc

SEQ ID NO: 208659 - RNA, 21 nt, Human
cccaaggcugaaaacuagagc

SEQ ID NO: 208660 - RNA, 21 nt, Human
cccaggaagccccucaucccc

SEQ ID NO: 208661 - RNA, 25 nt, Human
cccaugcucacaaacacacacacaa

SEQ ID NO: 208662 - RNA, 19 nt, Human
cccggugacuucauggcug

SEQ ID NO: 208663 - RNA, 20 nt, Human
ccggcccaggcaggcggcgg

SEQ ID NO: 208664 - RNA, 24 nt, Human
ccuuccauccagucaagccagaag

SEQ ID NO: 208665 - RNA, 23 nt, Human
cgcacacgcacacgugcacacgc

SEQ ID NO: 208666 - RNA, 24 nt, Human
cgcacacgugcacacgcgcauuug

SEQ ID NO: 208667 - RNA, 19 nt, Human
cggcccggcgggcgaacgg

SEQ ID NO: 208668 - RNA, 21 nt, Human
cggcgggcgaacggggacgua

SEQ ID NO: 208669 - RNA, 18 nt, Human
cggggacguagcggggga

SEQ ID NO: 208670 - RNA, 25 nt, Human
cuccucugacucugggaaugagauu

SEQ ID NO: 208671 - RNA, 21 nt, Human
cuuugacccccuucgcucucc

SEQ ID NO: 208672 - RNA, 18 nt, Human
gaaauguaccccaccucc

SEQ ID NO: 208673 - RNA, 21 nt, Human
gaacggggacguagcggggga

SEQ ID NO: 208674 - RNA, 19 nt, Human
gaccucgugaccauuacuc

SEQ ID NO: 208675 - RNA, 19 nt, Human
gagagggaggcagagcuac

SEQ ID NO: 208676 - RNA, 21 nt, Human
gagcacaggaguagcagggga

SEQ ID NO: 208677 - RNA, 24 nt, Human
gagcgcgcggcgcgcgggcgagcg

SEQ ID NO: 208678 - RNA, 21 nt, Human
gagcggcggagggcacacggc

SEQ ID NO: 208679 - RNA, 19 nt, Human
gcaagucugagcuuuggga

SEQ ID NO: 208680 - RNA, 18 nt, Human
gcgcggcgcgcgggcgag

SEQ ID NO: 208681 - RNA, 19 nt, Human
gcgcgggcgagcggcggag

SEQ ID NO: 208682 - RNA, 21 nt, Human
gcgcgggcgcggggcgcuggg

SEQ ID NO: 208683 - RNA, 24 nt, Human
gcggcgcgcgggcgagcggcggag

SEQ ID NO: 208684 - RNA, 18 nt, Human
gcugaaaacuagagcugg

SEQ ID NO: 208685 - RNA, 21 nt, Human
ggaaacacaccagggcucaga

SEQ ID NO: 208686 - RNA, 19 nt, Human
ggaaggagauauggagagg

SEQ ID NO: 208687 - RNA, 19 nt, Human
ggaaggagauauggagagg

SEQ ID NO: 208688 - RNA, 18 nt, Human
ggagagggaggcagagcu

SEQ ID NO: 208689 - RNA, 24 nt, Human
ggaguagggagguguggggaggga

SEQ ID NO: 208690 - RNA, 19 nt, Human
ggagugucuccacaugcca

SEQ ID NO: 208691 - RNA, 20 nt, Human
ggcgcgcgggcgagcggcgg

SEQ ID NO: 208692 - RNA, 27 nt, Human
gggaacaggacccaggaagccccucau

SEQ ID NO: 208693 - RNA, 20 nt, Human
gggaaggagauauggagagg

SEQ ID NO: 208694 - RNA, 19 nt, Human
ggggagggagguguagggg

SEQ ID NO: 208695 - RNA, 21 nt, Human
ggggcgcugggcgcaggcggg

SEQ ID NO: 208696 - RNA, 18 nt, Human
gggucuucuccauuaggc

SEQ ID NO: 208697 - RNA, 21 nt, Human
gucagaauaaaaccucccaag

SEQ ID NO: 208698 - RNA, 20 nt, Human
uaaaggaaggaccuggggaa

SEQ ID NO: 208699 - RNA, 19 nt, Human
uauggagagggaggcagag

SEQ ID NO: 208700 - RNA, 18 nt, Human
ucagaauaaaaccuccca

SEQ ID NO: 208701 - RNA, 23 nt, Human
uccacaugccaaaaucagaggaa

SEQ ID NO: 208702 - RNA, 27 nt, Human
ucccacagcagggcucucagcugccag

SEQ ID NO: 208703 - RNA, 20 nt, Human
ucccacccugacugcucaga

SEQ ID NO: 208704 - RNA, 24 nt, Human
uccuaagucuccuuccauccaguc

SEQ ID NO: 208705 - RNA, 19 nt, Human
ucugcagccuccagagcac

SEQ ID NO: 208706 - RNA, 21 nt, Human
ucugcagccuccagagcacag

SEQ ID NO: 208707 - RNA, 22 nt, Human
ugagucccuggccugcuggcaa

SEQ ID NO: 208708 - RNA, 22 nt, Human
ugagucccuggccugcuggcag

SEQ ID NO: 208709 - RNA, 24 nt, Human
ugagugaauccaggaucgaucugg

SEQ ID NO: 208710 - RNA, 19 nt, Human
ugcaacaaccagaccuaaa

SEQ ID NO: 208711 - RNA, 19 nt, Human
ugccaaaaucagaggaagu

SEQ ID NO: 208712 - RNA, 21 nt, Human
uggagagggaggcagagcuac

SEQ ID NO: 208713 - RNA, 18 nt, Human
uggggagggagguguagg

SEQ ID NO: 208714 - RNA, 23 nt, Human
uggggcgcgggcgcggggcgcug

SEQ ID NO: 208715 - RNA, 21 nt, Human
ugggguaggggaacaggaccc

SEQ ID NO: 208716 - RNA, 19 nt, Human
ugggucuucuccauuaggc

SEQ ID NO: 208717 - RNA, 21 nt, Human
uguaacaccaaagagaacacc

SEQ ID NO: 208718 - RNA, 22 nt, Human
uguaacaccaaagagaacaccc

SEQ ID NO: 208719 - RNA, 18 nt, Human
uguaggggaaggagauau

SEQ ID NO: 208720 - RNA, 22 nt, Human
uguggggagggagguguagggg

SEQ ID NO: 208721 - RNA, 18 nt, Human
aaaaaaaccccaaacccu

SEQ ID NO: 208722 - RNA, 23 nt, Human
aaaaaaaccccaaacccuaacac

SEQ ID NO: 208723 - RNA, 20 nt, Human
aaaaacaaaaaaaccccaaa

SEQ ID NO: 208724 - RNA, 24 nt, Human
aaaacaaaaacaaaaaaaccccaa

SEQ ID NO: 208725 - RNA, 25 nt, Human
aaaacaaaaacaaaaaaaccccaaa

SEQ ID NO: 208726 - RNA, 22 nt, Human
aaaacaaaaacaaaaacaaaaa

SEQ ID NO: 208727 - RNA, 27 nt, Human
aaaacaaaaacaaaaacaaaaaaaccc

SEQ ID NO: 208728 - RNA, 28 nt, Human
aaaacaaaaacaaaaacaaaaaaacccc

SEQ ID NO: 208729 - RNA, 20 nt, Human
aaaaccccaaacccuaacac

SEQ ID NO: 208730 - RNA, 23 nt, Human
aaaauguugaaaucaagaaauua

SEQ ID NO: 208731 - RNA, 25 nt, Human
aaacaaaaaaaccccaaacccuaac

SEQ ID NO: 208732 - RNA, 22 nt, Human
aaacaaaaacaaaaaaacccca

SEQ ID NO: 208733 - RNA, 24 nt, Human
aaacaaaaacaaaaaaacccccuc

SEQ ID NO: 208734 - RNA, 28 nt, Human
aaaucaagaaauuaaaaaacaaaaacaa

SEQ ID NO: 208735 - RNA, 23 nt, Human
aacaaaaacaaaaaaaccccaaa

SEQ ID NO: 208736 - RNA, 24 nt, Human
aaugaaaaggagcaaaaaaaggga

SEQ ID NO: 208737 - RNA, 19 nt, Human
aauuauaggggaaaaaaag

SEQ ID NO: 208738 - RNA, 22 nt, Human
acaaaaacaaaaaaaccccaaa

SEQ ID NO: 208739 - RNA, 26 nt, Human
acaaaaacaaaaaaaccccaaacccu

SEQ ID NO: 208740 - RNA, 24 nt, Human
acaaaaacaaaaacaaaaaaaccc

SEQ ID NO: 208741 - RNA, 22 nt, Human
accccgcuuucuaacccucagc

SEQ ID NO: 208742 - RNA, 20 nt, Human
acccuaacaccucuuuucuc

SEQ ID NO: 208743 - RNA, 22 nt, Human
acccuaacaccucuuuucuccc

SEQ ID NO: 208744 - RNA, 22 nt, Human
agcaaaaaaagggaaaaagccc

SEQ ID NO: 208745 - RNA, 19 nt, Human
aggagggguaaugaaaagg

SEQ ID NO: 208746 - RNA, 21 nt, Human
aggggaaaaaaagccacaaaa

SEQ ID NO: 208747 - RNA, 21 nt, Human
agggugaaaacggaggagggg

SEQ ID NO: 208748 - RNA, 22 nt, Human
aucaagaaauuaaaaaacaaaa

SEQ ID NO: 208749 - RNA, 23 nt, Human
caaaaacaaaaaaaccccaaacc

SEQ ID NO: 208750 - RNA, 23 nt, Human
caaaaauguagagagagguggag

SEQ ID NO: 208751 - RNA, 31 nt, Human
caagaaauuaaaaaacaaaaacaaaaacaaa

SEQ ID NO: 208752 - RNA, 18 nt, Human
caagagggcccccggaga

SEQ ID NO: 208753 - RNA, 18 nt, Human
caagcaaccaccgaaaua

SEQ ID NO: 208754 - RNA, 19 nt, Human
caccccgcuuucuaacccu

SEQ ID NO: 208755 - RNA, 23 nt, Human
caccccgcuuucuaacccucagc

SEQ ID NO: 208756 - RNA, 20 nt, Human
cacuuugccaccuccucuuc

SEQ ID NO: 208757 - RNA, 23 nt, Human
cagaacagguaagaggcguuggc

SEQ ID NO: 208758 - RNA, 20 nt, Human
cagggauaaaggggccaaga

SEQ ID NO: 208759 - RNA, 18 nt, Human
cccaaacccuaacaccuc

SEQ ID NO: 208760 - RNA, 18 nt, Human
ccccaaacccuaacaccu

SEQ ID NO: 208761 - RNA, 24 nt, Human
ccucccccagacacuugcaaaaau

SEQ ID NO: 208762 - RNA, 20 nt, Human
ccugggguggagggaggcgc

SEQ ID NO: 208763 - RNA, 18 nt, Human
cggaggccggagaaaccc

SEQ ID NO: 208764 - RNA, 20 nt, Human
cggggcugggggugggaggg

SEQ ID NO: 208765 - RNA, 22 nt, Human
cuuugccaccuccucuucgaaa

SEQ ID NO: 208766 - RNA, 18 nt, Human
gagggaaagguugggggg

SEQ ID NO: 208767 - RNA, 22 nt, Human
gagggcuggggugccugcgagc

SEQ ID NO: 208768 - RNA, 20 nt, Human
gcagguucuacgcgaagucc

SEQ ID NO: 208769 - RNA, 21 nt, Human
gccaccuccucuucgaaauuc

SEQ ID NO: 208770 - RNA, 19 nt, Human
gcugcagccgagagggugg

SEQ ID NO: 208771 - RNA, 21 nt, Human
ggagaaacccucaagccugag

SEQ ID NO: 208772 - RNA, 19 nt, Human
ggcguugggggugggagag

SEQ ID NO: 208773 - RNA, 20 nt, Human
gggcuggggugccugcgagc

SEQ ID NO: 208774 - RNA, 20 nt, Human
ggggugggagagaaaaaugg

SEQ ID NO: 208775 - RNA, 25 nt, Human
gggugagggaaagguugggggggga

SEQ ID NO: 208776 - RNA, 22 nt, Human
gggugggagagaaaaauggauu

SEQ ID NO: 208777 - RNA, 23 nt, Human
ggugggagggggugagggaaagg

SEQ ID NO: 208778 - RNA, 21 nt, Human
guagagcaggugcccuccccc

SEQ ID NO: 208779 - RNA, 26 nt, Human
uaaaauacaccccgcuuucuaacccu

SEQ ID NO: 208780 - RNA, 22 nt, Human
uaggggaaaaaaagccacaaaa

SEQ ID NO: 208781 - RNA, 20 nt, Human
ucacccccaagcaaccaccu

SEQ ID NO: 208782 - RNA, 19 nt, Human
uccugggguggagggaggc

SEQ ID NO: 208783 - RNA, 19 nt, Human
ucgggguggggcaggagag

SEQ ID NO: 208784 - RNA, 23 nt, Human
ucuaaaauacaccccgcuuucua

SEQ ID NO: 208785 - RNA, 23 nt, Human
ugaaaaggagcaaaaaaagggaa

SEQ ID NO: 208786 - RNA, 20 nt, Human
ugcagcucuuuccuagcucu

SEQ ID NO: 208787 - RNA, 20 nt, Human
ugcagcucuuuccuagcucu

SEQ ID NO: 208788 - RNA, 19 nt, Human
uggagggcuggggugccug

SEQ ID NO: 208789 - RNA, 26 nt, Human
uggcagguagagcaggugcccuccuc

SEQ ID NO: 208790 - RNA, 20 nt, Human
uggcguccugggguggaggg

SEQ ID NO: 208791 - RNA, 22 nt, Human
uggcuggagucggggcuggggg

SEQ ID NO: 208792 - RNA, 27 nt, Human
ugggagggggugagggaaagguugggg

SEQ ID NO: 208793 - RNA, 25 nt, Human
ugggggaagcagggcagcgccaggu

SEQ ID NO: 208794 - RNA, 19 nt, Human
ugggggugggaggggguga

SEQ ID NO: 208795 - RNA, 21 nt, Human
ugggguggagggaggcgcugg

SEQ ID NO: 208796 - RNA, 21 nt, Human
ugggguggagggaggcgcugg

SEQ ID NO: 208797 - RNA, 20 nt, Human
uguuuuaaaauuucuggcag

SEQ ID NO: 208798 - RNA, 24 nt, Human
uuauaggggaaaaaaagccacaaa

SEQ ID NO: 208799 - RNA, 23 nt, Human
uugggggugggagagaaaaaugg

SEQ ID NO: 208800 - RNA, 22 nt, Human
uuuuuuuuuuuuuccucaaaua

SEQ ID NO: 208801 - RNA, 23 nt, Human
uuuuuuuuuuuuuuuuuuccuca

SEQ ID NO: 208802 - RNA, 23 nt, Human
uuuuuuuuuuuuuuuuuuuuccu

SEQ ID NO: 208803 - RNA, 22 nt, Human
agcggugaggggcccauggggc

SEQ ID NO: 208804 - RNA, 22 nt, Human
ccaguggcccugcagccccucu

SEQ ID NO: 208805 - RNA, 18 nt, Human
cccagccaacaccaacac

SEQ ID NO: 208806 - RNA, 20 nt, Human
cguccucuccuuccagagca

SEQ ID NO: 208807 - RNA, 18 nt, Human
cugcagccccucuauccc

SEQ ID NO: 208808 - RNA, 18 nt, Human
gaggggcccauggggcgg

SEQ ID NO: 208809 - RNA, 19 nt, Human
gggcggggccugaaggugg

SEQ ID NO: 208810 - RNA, 22 nt, Human
guggcccugcagccccucuauc

SEQ ID NO: 208811 - RNA, 19 nt, Human
ugcagccccucuauccccc

SEQ ID NO: 208812 - RNA, 20 nt, Human
uguuccuuccaguggcccug

SEQ ID NO: 208813 - RNA, 18 nt, Human
uuccagagcagucgcagc

SEQ ID NO: 208814 - RNA, 24 nt, Human
uugacaccccagccaacaccaaca

SEQ ID NO: 208815 - RNA, 30 nt, Human
uugagugaugacagcuccauguuccuuccu

SEQ ID NO: 208816 - RNA, 19 nt, Human
aaaguguuaguggauugga

SEQ ID NO: 208817 - RNA, 18 nt, Human
auauaacuaaaguguuag

SEQ ID NO: 208818 - RNA, 24 nt, Human
uauuaggcaagaacagguaaugua

SEQ ID NO: 208819 - RNA, 23 nt, Human
uuaaugauaugcaugcuuuucuu

SEQ ID NO: 208820 - RNA, 19 nt, Human
uuuuuuuuuuuuuuuguga

SEQ ID NO: 208821 - RNA, 30 nt, Human
aaaaacccaaccuuccccaacagggcccuu

SEQ ID NO: 208822 - RNA, 18 nt, Human
aagaugcugaggcugugg

SEQ ID NO: 208823 - RNA, 23 nt, Human
aagccagagagaggugcacaggc

SEQ ID NO: 208824 - RNA, 22 nt, Human
aagugcugaagaugcugaggcu

SEQ ID NO: 208825 - RNA, 22 nt, Human
accuuuauaagccagagagagg

SEQ ID NO: 208826 - RNA, 19 nt, Human
agaaggaaaguggccccag

SEQ ID NO: 208827 - RNA, 23 nt, Human
agacagaaggaaaguggccccag

SEQ ID NO: 208828 - RNA, 20 nt, Human
agagaggugcacaggccaga

SEQ ID NO: 208829 - RNA, 24 nt, Human
agaugcugaggcuguggggcagcu

SEQ ID NO: 208830 - RNA, 23 nt, Human
aggagggguuggcacaggccagg

SEQ ID NO: 208831 - RNA, 21 nt, Human
aggauccagaggcugggaugu

SEQ ID NO: 208832 - RNA, 24 nt, Human
aggccagaaagaggugccccccag

SEQ ID NO: 208833 - RNA, 19 nt, Human
caaaaacccaaccuucccc

SEQ ID NO: 208834 - RNA, 22 nt, Human
caaaaacccaaccuuccccaac

SEQ ID NO: 208835 - RNA, 23 nt, Human
caagccccaccugcacgagcacu

SEQ ID NO: 208836 - RNA, 21 nt, Human
caagucccagacauuggaggg

SEQ ID NO: 208837 - RNA, 20 nt, Human
cacaggccagaaagaggugc

SEQ ID NO: 208838 - RNA, 23 nt, Human
cacccucauccuaacgggcugag

SEQ ID NO: 208839 - RNA, 18 nt, Human
caccuuuauaagccagag

SEQ ID NO: 208840 - RNA, 19 nt, Human
cacgagcacuguugucccc

SEQ ID NO: 208841 - RNA, 19 nt, Human
cagcuuuucccgggacaac

SEQ ID NO: 208842 - RNA, 23 nt, Human
caggcaccuuuauaagccagaga

SEQ ID NO: 208843 - RNA, 24 nt, Human
cagucaccagcagacagaaggaaa

SEQ ID NO: 208844 - RNA, 20 nt, Human
ccaaaaacccaaccuucccc

SEQ ID NO: 208845 - RNA, 21 nt, Human
ccaagccccaccugcacgagc

SEQ ID NO: 208846 - RNA, 21 nt, Human
ccagcaucuggccacauggga

SEQ ID NO: 208847 - RNA, 18 nt, Human
ccccaacagggcccuccg

SEQ ID NO: 208848 - RNA, 20 nt, Human
ccccagacucacaggagccc

SEQ ID NO: 208849 - RNA, 21 nt, Human
ccccagacucacaggagcccc

SEQ ID NO: 208850 - RNA, 23 nt, Human
cccccagacucacaggagccccc

SEQ ID NO: 208851 - RNA, 21 nt, Human
ccccccagacucacaggagcc

SEQ ID NO: 208852 - RNA, 25 nt, Human
cccugggcuaccauggagagagcuc

SEQ ID NO: 208853 - RNA, 19 nt, Human
cccugggguccaaaaaccc

SEQ ID NO: 208854 - RNA, 25 nt, Human
ccgcuccucccccauaggccccucc

SEQ ID NO: 208855 - RNA, 22 nt, Human
ccucuguggcccugguggaggc

SEQ ID NO: 208856 - RNA, 23 nt, Human
ccugagcgccauucgcagucuug

SEQ ID NO: 208857 - RNA, 21 nt, Human
cucccugcucccugccugagc

SEQ ID NO: 208858 - RNA, 21 nt, Human
cugaaacaaaacccugaggcu

SEQ ID NO: 208859 - RNA, 18 nt, Human
cuggcaagucccagacau

SEQ ID NO: 208860 - RNA, 19 nt, Human
cuucaaguuugaggcccug

SEQ ID NO: 208861 - RNA, 23 nt, Human
gaaacaaaacccugaggcucagg

SEQ ID NO: 208862 - RNA, 24 nt, Human
gagcauggucugccagcgcccugg

SEQ ID NO: 208863 - RNA, 22 nt, Human
gagggguuggcacaggccaggc

SEQ ID NO: 208864 - RNA, 21 nt, Human
gcacgagcacuguuguccccc

SEQ ID NO: 208865 - RNA, 18 nt, Human
gccugggccccuagaagc

SEQ ID NO: 208866 - RNA, 23 nt, Human
ggagggguuggcacaggccaggc

SEQ ID NO: 208867 - RNA, 19 nt, Human
ggaguaaggggaagggacg

SEQ ID NO: 208868 - RNA, 24 nt, Human
ggcggggaguaaggggaagggacg

SEQ ID NO: 208869 - RNA, 20 nt, Human
gugacaucggaaaagcuuau

SEQ ID NO: 208870 - RNA, 20 nt, Human
gugcauuucccaagccccac

SEQ ID NO: 208871 - RNA, 18 nt, Human
gugccccccagacucaca

SEQ ID NO: 208872 - RNA, 23 nt, Human
guggugaggaggagggggaacac

SEQ ID NO: 208873 - RNA, 20 nt, Human
guuugaggcccuggguauuc

SEQ ID NO: 208874 - RNA, 23 nt, Human
uagaagccgacgucccgcuucug

SEQ ID NO: 208875 - RNA, 19 nt, Human
ucagguacaucaucugagg

SEQ ID NO: 208876 - RNA, 20 nt, Human
uccaaaaacccaaccuuccc

SEQ ID NO: 208877 - RNA, 19 nt, Human
uccccaggauccagaggcu

SEQ ID NO: 208878 - RNA, 19 nt, Human
ugagcgccauucgcagucu

SEQ ID NO: 208879 - RNA, 20 nt, Human
ugaggaggagggggaacacu

SEQ ID NO: 208880 - RNA, 23 nt, Human
ugaggcccuggguauucuccagg

SEQ ID NO: 208881 - RNA, 19 nt, Human
ugcugaggcuguggggcag

SEQ ID NO: 208882 - RNA, 25 nt, Human
ugcugaggcuguggggcagcuuuuc

SEQ ID NO: 208883 - RNA, 19 nt, Human
uggagagagcuccgcgggg

SEQ ID NO: 208884 - RNA, 20 nt, Human
ugggaacgugcaagccaaac

SEQ ID NO: 208885 - RNA, 18 nt, Human
uucccaagccccaccugc

SEQ ID NO: 208886 - RNA, 23 nt, Human
uugguacaggacaccggagaagg

SEQ ID NO: 208887 - RNA, 21 nt, Human
aaaaaaagcgggggggaaugc

SEQ ID NO: 208888 - RNA, 22 nt, Human
aaaaaagcccugguuucaaauu

SEQ ID NO: 208889 - RNA, 23 nt, Human
aaaacuuucuccagagacgccag

SEQ ID NO: 208890 - RNA, 20 nt, Human
aaauacauauauuucauaag

SEQ ID NO: 208891 - RNA, 20 nt, Human
aaauauuagagauuucaccu

SEQ ID NO: 208892 - RNA, 23 nt, Human
aauggagagccucucaagaaaaa

SEQ ID NO: 208893 - RNA, 19 nt, Human
acccaaaaaaaaaaaaaag

SEQ ID NO: 208894 - RNA, 18 nt, Human
agagagcauaccucuuuc

SEQ ID NO: 208895 - RNA, 22 nt, Human
aggcaaagucaaaaaaaaaaaa

SEQ ID NO: 208896 - RNA, 24 nt, Human
augauaauuggaagauuuugauac

SEQ ID NO: 208897 - RNA, 26 nt, Human
caaaaaaaaaaaaaagcccugguuuc

SEQ ID NO: 208898 - RNA, 22 nt, Human
caccgcccagcccgugcgcucc

SEQ ID NO: 208899 - RNA, 23 nt, Human
caccgcccagcccgugcgcuccg

SEQ ID NO: 208900 - RNA, 19 nt, Human
cagcccgugcgcuccggcg

SEQ ID NO: 208901 - RNA, 23 nt, Human
caucacccaaaaaaaaaaaaaag

SEQ ID NO: 208902 - RNA, 27 nt, Human
caucacccaaaaaaaaaaaaaagcccu

SEQ ID NO: 208903 - RNA, 28 nt, Human
cauuuuauuacaccuccugauuuucacu

SEQ ID NO: 208904 - RNA, 24 nt, Human
cccgugcgcuccggcgccauggcc

SEQ ID NO: 208905 - RNA, 19 nt, Human
ccgccgcccgucagcgacc

SEQ ID NO: 208906 - RNA, 18 nt, Human
ccgcugccuccagaccgc

SEQ ID NO: 208907 - RNA, 23 nt, Human
ccgcugccuccagaccgccgccc

SEQ ID NO: 208908 - RNA, 22 nt, Human
ccggcgccauggccgcugccuc

SEQ ID NO: 208909 - RNA, 22 nt, Human
ccgugcgcuccggcgccauggc

SEQ ID NO: 208910 - RNA, 21 nt, Human
cggaagcucuggcucuccaag

SEQ ID NO: 208911 - RNA, 19 nt, Human
cggcgccauggccgcugcc

SEQ ID NO: 208912 - RNA, 24 nt, Human
cuccaaggcaaagucaaaaaaaaa

SEQ ID NO: 208913 - RNA, 19 nt, Human
cuccagagacgccagcucc

SEQ ID NO: 208914 - RNA, 23 nt, Human
cucuggcucuccaaggcaaaguc

SEQ ID NO: 208915 - RNA, 26 nt, Human
gaaaaacuuucuccagagacgccagg

SEQ ID NO: 208916 - RNA, 20 nt, Human
gaaaaagagcuaugcaguca

SEQ ID NO: 208917 - RNA, 19 nt, Human
gaaaaugcggaagcucugg

SEQ ID NO: 208918 - RNA, 19 nt, Human
gaccgccgcccgucagcga

SEQ ID NO: 208919 - RNA, 22 nt, Human
gcaaagucaaaaaaaaaaaaaa

SEQ ID NO: 208920 - RNA, 24 nt, Human
gcaaagucaaaaaaaaaaaaaagc

SEQ ID NO: 208921 - RNA, 19 nt, Human
gcccugguuucaaauucau

SEQ ID NO: 208922 - RNA, 23 nt, Human
gcucuccaaggcaaagucaaaaa

SEQ ID NO: 208923 - RNA, 19 nt, Human
uaagagagcauaccucuuu

SEQ ID NO: 208924 - RNA, 28 nt, Human
uacaucacccaaaaaaaaaaaaaagccc

SEQ ID NO: 208925 - RNA, 23 nt, Human
uaugaaaaaaagaagucuguauc

SEQ ID NO: 208926 - RNA, 22 nt, Human
uauuuugguggcggggaguugg

SEQ ID NO: 208927 - RNA, 26 nt, Human
ucaaaaaaaaaaaaaagcggggggga

SEQ ID NO: 208928 - RNA, 24 nt, Human
ucaaaauggagagccucucaagaa

SEQ ID NO: 208929 - RNA, 20 nt, Human
ucacccaaaaaaaaaaaaaa

SEQ ID NO: 208930 - RNA, 20 nt, Human
ucacccaaaaaaaaaaaaaa

SEQ ID NO: 208931 - RNA, 24 nt, Human
ucacccaaaaaaaaaaaaaagccc

SEQ ID NO: 208932 - RNA, 23 nt, Human
uccaaggcaaagucaaaaaaaaa

SEQ ID NO: 208933 - RNA, 19 nt, Human
ucuguaucaucugcuucca

SEQ ID NO: 208934 - RNA, 22 nt, Human
ugauuaugaaaaaaagaagucu

SEQ ID NO: 208935 - RNA, 23 nt, Human
uggagagccucucaagaaaaaga

SEQ ID NO: 208936 - RNA, 20 nt, Human
uggccgcugccuccagaccg

SEQ ID NO: 208937 - RNA, 21 nt, Human
uucaggugagcaugauaauug

SEQ ID NO: 208938 - RNA, 23 nt, Human
uucauaagguucaguuacaaaau

SEQ ID NO: 208939 - RNA, 22 nt, Human
uucuucugaaaaacuuucucca

SEQ ID NO: 208940 - RNA, 21 nt, Human
uuggaagauuuugauacuuag

SEQ ID NO: 208941 - RNA, 23 nt, Human
auugcaccccaguccauguggga

SEQ ID NO: 208942 - RNA, 22 nt, Human
cauugcaccccaguccaugugg

SEQ ID NO: 208943 - RNA, 20 nt, Human
ccauugcaccccaguccauc

SEQ ID NO: 208944 - RNA, 24 nt, Human
ccauugcaccccaguccauguggc

SEQ ID NO: 208945 - RNA, 24 nt, Human
ccauugcaccccaguccauguggg

SEQ ID NO: 208946 - RNA, 18 nt, Human
cccauugcaccccagucc

SEQ ID NO: 208947 - RNA, 24 nt, Human
ccccugggauccugcagcuccagg

SEQ ID NO: 208948 - RNA, 19 nt, Human
ccuagagaguggugcccug

SEQ ID NO: 208949 - RNA, 23 nt, Human
cugggauccugcagcuccaggcc

SEQ ID NO: 208950 - RNA, 24 nt, Human
gauccugcagcuccaggccuuugg

SEQ ID NO: 208951 - RNA, 21 nt, Human
gcagcagcugucccauugcac

SEQ ID NO: 208952 - RNA, 21 nt, Human
ggauccugcagcuccaggccu

SEQ ID NO: 208953 - RNA, 20 nt, Human
uagagaguggugcccugguc

SEQ ID NO: 208954 - RNA, 21 nt, Human
ucagagguccuuguggccuga

SEQ ID NO: 208955 - RNA, 23 nt, Human
uccccugggauccugcagcucca

SEQ ID NO: 208956 - RNA, 24 nt, Human
uccccugggauccugcagcuccag

SEQ ID NO: 208957 - RNA, 18 nt, Human
ucccuagagaguggugcc

SEQ ID NO: 208958 - RNA, 23 nt, Human
ucccuagagaguggugcccuggu

SEQ ID NO: 208959 - RNA, 25 nt, Human
ucccuagagaguggugcccuggucc

SEQ ID NO: 208960 - RNA, 21 nt, Human
ucgcuggcagcagcuguccca

SEQ ID NO: 208961 - RNA, 25 nt, Human
ugcccuggucccucucgcuggcagc

SEQ ID NO: 208962 - RNA, 22 nt, Human
ugggauccugcagcuccaggcc

SEQ ID NO: 208963 - RNA, 25 nt, Human
ugggauccugcagcuccaggccuuu

SEQ ID NO: 208964 - RNA, 20 nt, Human
uggggucggggcugggaacc

SEQ ID NO: 208965 - RNA, 21 nt, Human
uuccccugggauccugcagcu

SEQ ID NO: 208966 - RNA, 25 nt, Human
uuccccugggauccugcagcuccag

SEQ ID NO: 208967 - RNA, 21 nt, Human
agagcaagagagaggagagga

SEQ ID NO: 208968 - RNA, 24 nt, Human
agagcucucaacucccagaauccc

SEQ ID NO: 208969 - RNA, 23 nt, Human
aggaacagcagauggggcugacu

SEQ ID NO: 208970 - RNA, 24 nt, Human
caacucccagaauccccuuuaccc

SEQ ID NO: 208971 - RNA, 20 nt, Human
cagugaggaguuacaggggu

SEQ ID NO: 208972 - RNA, 20 nt, Human
cccagaauccccuuuacccu

SEQ ID NO: 208973 - RNA, 20 nt, Human
cucugagagcaagagagagg

SEQ ID NO: 208974 - RNA, 23 nt, Human
cucuucaggaaacaucucacccu

SEQ ID NO: 208975 - RNA, 20 nt, Human
gggaaccucucuucaggaaa

SEQ ID NO: 208976 - RNA, 20 nt, Human
gggguggggaaccucucuuc

SEQ ID NO: 208977 - RNA, 24 nt, Human
ggugcuggcugugugcucugaguc

SEQ ID NO: 208978 - RNA, 23 nt, Human
gucuugaagaauuuuucuccuca

SEQ ID NO: 208979 - RNA, 19 nt, Human
uacagugaggaguuacagg

SEQ ID NO: 208980 - RNA, 18 nt, Human
ucccagaauccccuuuac

SEQ ID NO: 208981 - RNA, 24 nt, Human
ucucaacucccagaauccccuuua

SEQ ID NO: 208982 - RNA, 19 nt, Human
ugcuggcugugugcucuga

SEQ ID NO: 208983 - RNA, 18 nt, Human
uggcagagcucucaacuc

SEQ ID NO: 208984 - RNA, 18 nt, Human
ccaaucacagagaaaggg

SEQ ID NO: 208985 - RNA, 21 nt, Human
ccguggccaacauccgcuggg

SEQ ID NO: 208986 - RNA, 19 nt, Human
cggcagccuccaggagaca

SEQ ID NO: 208987 - RNA, 25 nt, Human
cguggccaacauccgcuggggcauc

SEQ ID NO: 208988 - RNA, 23 nt, Human
cucccagcuccuaaucucucauu

SEQ ID NO: 208989 - RNA, 19 nt, Human
gagccucagcuccuccgug

SEQ ID NO: 208990 - RNA, 20 nt, Human
gagccucagcuccuccgugg

SEQ ID NO: 208991 - RNA, 23 nt, Human
guggccaacauccgcuggggcau

SEQ ID NO: 208992 - RNA, 24 nt, Human
uccguggccaacauccgcuggggc

SEQ ID NO: 208993 - RNA, 21 nt, Human
ucucccagcuccuaaucucuc

SEQ ID NO: 208994 - RNA, 19 nt, Human
uuccucuucucccagcucc

SEQ ID NO: 208995 - RNA, 22 nt, Human
uccuggaguuggauuuucagug

SEQ ID NO: 208996 - RNA, 24 nt, Human
uggaguuggauuuucagugacuuc

SEQ ID NO: 208997 - RNA, 21 nt, Human
uguagccaguugucuuuucag

SEQ ID NO: 208998 - RNA, 21 nt, Human
aaggaguggggaaggggaggc

SEQ ID NO: 208999 - RNA, 21 nt, Human
agaggagggcuuggagcuggg

SEQ ID NO: 209000 - RNA, 18 nt, Human
agagggaggggcuuggga

SEQ ID NO: 209001 - RNA, 21 nt, Human
agaggguguccaggcaaccag

SEQ ID NO: 209002 - RNA, 19 nt, Human
agaguggacagagggagag

SEQ ID NO: 209003 - RNA, 21 nt, Human
aggagggcuuggagcugggcc

SEQ ID NO: 209004 - RNA, 19 nt, Human
aggccagagggaggggcuu

SEQ ID NO: 209005 - RNA, 20 nt, Human
aggcgugggugcgccgagcg

SEQ ID NO: 209006 - RNA, 19 nt, Human
caagaacagaaggccagag

SEQ ID NO: 209007 - RNA, 20 nt, Human
caagaacagaaggccagagg

SEQ ID NO: 209008 - RNA, 20 nt, Human
ccuaagagaucaagaacaga

SEQ ID NO: 209009 - RNA, 22 nt, Human
ccugcaagaccugaggaguaag

SEQ ID NO: 209010 - RNA, 22 nt, Human
cgugggugcgccgagcgagcug

SEQ ID NO: 209011 - RNA, 18 nt, Human
gaguggacagagggagag

SEQ ID NO: 209012 - RNA, 20 nt, Human
gcucuggggaggcuccgggg

SEQ ID NO: 209013 - RNA, 23 nt, Human
ggaagacagucgacaccugcaag

SEQ ID NO: 209014 - RNA, 20 nt, Human
ggaaggaguggggaagggga

SEQ ID NO: 209015 - RNA, 25 nt, Human
ggacagagggagaggguugaaagau

SEQ ID NO: 209016 - RNA, 21 nt, Human
ggagggaaggaguggggaagg

SEQ ID NO: 209017 - RNA, 21 nt, Human
gggaaggaguggggaagggga

SEQ ID NO: 209018 - RNA, 23 nt, Human
ggguguccaggcaaccagaggag

SEQ ID NO: 209019 - RNA, 22 nt, Human
uaaaggaagaguggacagaggg

SEQ ID NO: 209020 - RNA, 23 nt, Human
ugcccagguugagggcaggaagc

SEQ ID NO: 209021 - RNA, 18 nt, Human
uggggggccggaagggug

SEQ ID NO: 209022 - RNA, 24 nt, Human
uggggggccggaaggguggggggc

SEQ ID NO: 209023 - RNA, 24 nt, Human
uuccaggacaggaaauggccuccc

SEQ ID NO: 209024 - RNA, 22 nt, Human
uucuggggggccggaagggugg

SEQ ID NO: 209025 - RNA, 18 nt, Human
uuuuuuugcuuuuuauaa

SEQ ID NO: 209026 - RNA, 20 nt, Human
uuuuuuuuuuuuuugcuuuu

SEQ ID NO: 209027 - RNA, 21 nt, Human
uuuuuuuuuuuuuuugcuuuu

SEQ ID NO: 209028 - RNA, 19 nt, Human
acuacaccacgacgggggu

SEQ ID NO: 209029 - RNA, 22 nt, Human
aggcagaguaugaaaacucgua

SEQ ID NO: 209030 - RNA, 27 nt, Human
aggcuucuggacccaguacagcaguuc

SEQ ID NO: 209031 - RNA, 21 nt, Human
aggggucaacaaccauccccu

SEQ ID NO: 209032 - RNA, 26 nt, Human
cagcucaggucccuuccagggccagc

SEQ ID NO: 209033 - RNA, 24 nt, Human
caggucccuuccagggccagcucc

SEQ ID NO: 209034 - RNA, 20 nt, Human
guacagcaguuccaggaggg

SEQ ID NO: 209035 - RNA, 24 nt, Human
ucaacaaccauccccucgccagcu

SEQ ID NO: 209036 - RNA, 20 nt, Human
ucaggucccuuccagggcca

SEQ ID NO: 209037 - RNA, 24 nt, Human
ucaggucccuuccagggccagcuc

SEQ ID NO: 209038 - RNA, 23 nt, Human
uccagggccagcucccuccuggc

SEQ ID NO: 209039 - RNA, 24 nt, Human
uccagggccagcucccuccuggcu

SEQ ID NO: 209040 - RNA, 18 nt, Human
ucccccagcucagguccc

SEQ ID NO: 209041 - RNA, 19 nt, Human
ucccccagcucaggucccu

SEQ ID NO: 209042 - RNA, 18 nt, Human
ugaguugggagucgccgu

SEQ ID NO: 209043 - RNA, 20 nt, Human
ugaguugggagucgccgugc

SEQ ID NO: 209044 - RNA, 22 nt, Human
ugcagcucuaugacuacaccac

SEQ ID NO: 209045 - RNA, 19 nt, Human
ugccagccucaaggucucu

SEQ ID NO: 209046 - RNA, 20 nt, Human
uucauggcagaggagauggc

SEQ ID NO: 209047 - RNA, 24 nt, Human
uucauggcagaggagauggcagga

SEQ ID NO: 209048 - RNA, 18 nt, Human
uugcccagucaagucuca

SEQ ID NO: 209049 - RNA, 23 nt, Human
aaaaaggcaacaccuguggagga

SEQ ID NO: 209050 - RNA, 18 nt, Human
aaacaggcaagcuguccc

SEQ ID NO: 209051 - RNA, 18 nt, Human
aaagagcuagcugacacc

SEQ ID NO: 209052 - RNA, 21 nt, Human
aaaggucccaaacaguuccag

SEQ ID NO: 209053 - RNA, 24 nt, Human
aaaguucaaagcagucugcaucua

SEQ ID NO: 209054 - RNA, 22 nt, Human
aaccaugagaaaggaaggguca

SEQ ID NO: 209055 - RNA, 20 nt, Human
aagaaugggaaccugcccac

SEQ ID NO: 209056 - RNA, 22 nt, Human
aagacucccacccauagcacaa

SEQ ID NO: 209057 - RNA, 20 nt, Human
aagcaagucuguguguccuc

SEQ ID NO: 209058 - RNA, 19 nt, Human
aagcagcagaucugugcca

SEQ ID NO: 209059 - RNA, 20 nt, Human
aagcagcagaucugugccau

SEQ ID NO: 209060 - RNA, 24 nt, Human
aagccaaacaggcacuugccuaaa

SEQ ID NO: 209061 - RNA, 23 nt, Human
aagcugaggagccuggcugagag

SEQ ID NO: 209062 - RNA, 24 nt, Human
aagcugaggagccuggcugagagg

SEQ ID NO: 209063 - RNA, 22 nt, Human
aagcuuaaaguucucccuccag

SEQ ID NO: 209064 - RNA, 24 nt, Human
aaggucccaaacaguuccagaccc

SEQ ID NO: 209065 - RNA, 18 nt, Human
accaaggcuucucacagc

SEQ ID NO: 209066 - RNA, 18 nt, Human
acccagagcccucuacuu

SEQ ID NO: 209067 - RNA, 26 nt, Human
acccgucccaccccacccucaggggc

SEQ ID NO: 209068 - RNA, 23 nt, Human
agaaaggagcgggcucggaccga

SEQ ID NO: 209069 - RNA, 22 nt, Human
agaaauauaacccuuuaaaagc

SEQ ID NO: 209070 - RNA, 21 nt, Human
agaagcaaaagaaccaggucc

SEQ ID NO: 209071 - RNA, 22 nt, Human
agaaugugggcaccugcaccca

SEQ ID NO: 209072 - RNA, 19 nt, Human
agacuggaaagcccccaag

SEQ ID NO: 209073 - RNA, 19 nt, Human
agagaaaccaauguccaag

SEQ ID NO: 209074 - RNA, 21 nt, Human
agagugggcguggaggggccc

SEQ ID NO: 209075 - RNA, 21 nt, Human
agaucucaaagaucuagacaa

SEQ ID NO: 209076 - RNA, 21 nt, Human
agaucugugccauuaagggcu

SEQ ID NO: 209077 - RNA, 18 nt, Human
agccacagaucucaaaga

SEQ ID NO: 209078 - RNA, 18 nt, Human
agcuagcugacacccaca

SEQ ID NO: 209079 - RNA, 21 nt, Human
aggaagggcauggggcaaaag

SEQ ID NO: 209080 - RNA, 23 nt, Human
aggagugagcgcgugagcagcgg

SEQ ID NO: 209081 - RNA, 19 nt, Human
agggaguggccuucuuagg

SEQ ID NO: 209082 - RNA, 19 nt, Human
augcggcagccucuccucc

SEQ ID NO: 209083 - RNA, 21 nt, Human
auuuuaagucagcacaaacau

SEQ ID NO: 209084 - RNA, 22 nt, Human
caaaagaaccagguccuuccca

SEQ ID NO: 209085 - RNA, 24 nt, Human
caaagcagucugcaucuagggaac

SEQ ID NO: 209086 - RNA, 19 nt, Human
caagaaaugggcacccaga

SEQ ID NO: 209087 - RNA, 24 nt, Human
caagggaagagugggcguggaggg

SEQ ID NO: 209088 - RNA, 27 nt, Human
cacagcauaagacuggaaagcccccaa

SEQ ID NO: 209089 - RNA, 21 nt, Human
caccacccgucccaccccacc

SEQ ID NO: 209090 - RNA, 21 nt, Human
caccagaggcccugaggccug

SEQ ID NO: 209091 - RNA, 25 nt, Human
cacccagagcccucuacuucugggg

SEQ ID NO: 209092 - RNA, 18 nt, Human
cacccagggcccauacca

SEQ ID NO: 209093 - RNA, 23 nt, Human
cacccagggcccauaccacgucc

SEQ ID NO: 209094 - RNA, 21 nt, Human
caccccaacccaugaucccau

SEQ ID NO: 209095 - RNA, 25 nt, Human
cacccccucccccgcacgcaagguc

SEQ ID NO: 209096 - RNA, 19 nt, Human
cacccgucccaccccaccc

SEQ ID NO: 209097 - RNA, 21 nt, Human
cacuaccauuaaauaacaggg

SEQ ID NO: 209098 - RNA, 18 nt, Human
cacuccucaagcccucac

SEQ ID NO: 209099 - RNA, 20 nt, Human
cagacaaagcucucauuagc

SEQ ID NO: 209100 - RNA, 22 nt, Human
cagcacagcugccgaaacuuga

SEQ ID NO: 209101 - RNA, 22 nt, Human
cagcagcagcacagcugccgaa

SEQ ID NO: 209102 - RNA, 23 nt, Human
cagcauaagacuggaaagccccc

SEQ ID NO: 209103 - RNA, 25 nt, Human
cagcauaagacuggaaagcccccaa

SEQ ID NO: 209104 - RNA, 20 nt, Human
cagccaaaaugacuaaaacc

SEQ ID NO: 209105 - RNA, 24 nt, Human
caggacauccccaaaaggucccaa

SEQ ID NO: 209106 - RNA, 22 nt, Human
caggguucuccauuauuuuuuc

SEQ ID NO: 209107 - RNA, 24 nt, Human
ccaaagaaugggaaccugcccacc

SEQ ID NO: 209108 - RNA, 19 nt, Human
ccaaagagaaauauaaccc

SEQ ID NO: 209109 - RNA, 23 nt, Human
ccaagggcacccugucccugcug

SEQ ID NO: 209110 - RNA, 19 nt, Human
ccacagaaauggugcuggg

SEQ ID NO: 209111 - RNA, 19 nt, Human
ccagagccaccagaggccc

SEQ ID NO: 209112 - RNA, 27 nt, Human
ccaggcccagggccaagagcgccuccu

SEQ ID NO: 209113 - RNA, 24 nt, Human
ccagguccuucccaggguucucca

SEQ ID NO: 209114 - RNA, 25 nt, Human
cccaaagaaugggaaccugcccacc

SEQ ID NO: 209115 - RNA, 22 nt, Human
cccaaguuggggcuaagaaggc

SEQ ID NO: 209116 - RNA, 20 nt, Human
cccaccccacccucaggggc

SEQ ID NO: 209117 - RNA, 21 nt, Human
cccagggaagcacuauagaga

SEQ ID NO: 209118 - RNA, 22 nt, Human
ccccaaagaaugggaaccugcc

SEQ ID NO: 209119 - RNA, 21 nt, Human
cccccauggcugaagccacag

SEQ ID NO: 209120 - RNA, 21 nt, Human
ccccuuccucuuuuaagcacc

SEQ ID NO: 209121 - RNA, 22 nt, Human
cccucugccauaaguuggccuc

SEQ ID NO: 209122 - RNA, 21 nt, Human
ccucacaaagggcugcugccu

SEQ ID NO: 209123 - RNA, 28 nt, Human
ccucccagccccaaagaaugggaaccug

SEQ ID NO: 209124 - RNA, 22 nt, Human
ccucugaguggcugugcagcuc

SEQ ID NO: 209125 - RNA, 19 nt, Human
ccugagggcaccuauuaaa

SEQ ID NO: 209126 - RNA, 18 nt, Human
ccugccugcaguggagag

SEQ ID NO: 209127 - RNA, 27 nt, Human
ccugcuaggacaccgacuaucccccaa

SEQ ID NO: 209128 - RNA, 21 nt, Human
ccuucggacucuuugccuccu

SEQ ID NO: 209129 - RNA, 25 nt, Human
cgagcacccccucccccgcacgcaa

SEQ ID NO: 209130 - RNA, 22 nt, Human
cuagcugacacccacagcauaa

SEQ ID NO: 209131 - RNA, 24 nt, Human
cuaggcccacagaaauggugcugg

SEQ ID NO: 209132 - RNA, 20 nt, Human
cuccagguguccaaagugcu

SEQ ID NO: 209133 - RNA, 22 nt, Human
cucugccauaaguuggccucag

SEQ ID NO: 209134 - RNA, 19 nt, Human
cugaucagacaaagcucuc

SEQ ID NO: 209135 - RNA, 19 nt, Human
cugauggacccaggacuga

SEQ ID NO: 209136 - RNA, 20 nt, Human
cugucccugcugccaagccc

SEQ ID NO: 209137 - RNA, 20 nt, Human
cuuuguucccaaguuggggc

SEQ ID NO: 209138 - RNA, 22 nt, Human
gaaccugcccaccaguggcacc

SEQ ID NO: 209139 - RNA, 24 nt, Human
gaagcagcagaucugugccauuaa

SEQ ID NO: 209140 - RNA, 19 nt, Human
gagcagcccauccagcagc

SEQ ID NO: 209141 - RNA, 22 nt, Human
gagccaccagaggcccugaggc

SEQ ID NO: 209142 - RNA, 23 nt, Human
gaggagccuggcugagagggcgu

SEQ ID NO: 209143 - RNA, 23 nt, Human
gcacccccucccccgcacgcaag

SEQ ID NO: 209144 - RNA, 22 nt, Human
gcagaaugcggcagccucuccu

SEQ ID NO: 209145 - RNA, 24 nt, Human
gcagaaugugggcaccugcaccca

SEQ ID NO: 209146 - RNA, 23 nt, Human
gcagcaaaucccaggccuuccca

SEQ ID NO: 209147 - RNA, 19 nt, Human
gcagcccauccagcagcag

SEQ ID NO: 209148 - RNA, 18 nt, Human
gcccagggaagcacuaua

SEQ ID NO: 209149 - RNA, 21 nt, Human
gcuuggcccagggaagcacua

SEQ ID NO: 209150 - RNA, 23 nt, Human
ggaaagggaccucugaguggcug

SEQ ID NO: 209151 - RNA, 22 nt, Human
ggacaccgacuaucccccacuu

SEQ ID NO: 209152 - RNA, 21 nt, Human
ggacagggcucucuggcaugg

SEQ ID NO: 209153 - RNA, 22 nt, Human
ggacccaggacugaucagacaa

SEQ ID NO: 209154 - RNA, 21 nt, Human
ggagggaguggccuucuuagg

SEQ ID NO: 209155 - RNA, 20 nt, Human
ggagggguggggucccuggc

SEQ ID NO: 209156 - RNA, 21 nt, Human
ggcacccagagcccucuacuu

SEQ ID NO: 209157 - RNA, 18 nt, Human
ggcauggggcaaaagcuc

SEQ ID NO: 209158 - RNA, 18 nt, Human
ggccuggggaaaugagac

SEQ ID NO: 209159 - RNA, 24 nt, Human
ggcuggugucagcuuggcccaggg

SEQ ID NO: 209160 - RNA, 22 nt, Human
gggaagcacuauagagagggcu

SEQ ID NO: 209161 - RNA, 22 nt, Human
gggagggaguggccuucuuagg

SEQ ID NO: 209162 - RNA, 19 nt, Human
gggcguggaggggcccugc

SEQ ID NO: 209163 - RNA, 24 nt, Human
gggcuuacaguuccccgagaagca

SEQ ID NO: 209164 - RNA, 20 nt, Human
gguucugggggcccagaaca

SEQ ID NO: 209165 - RNA, 20 nt, Human
gucccaaacaguuccagacc

SEQ ID NO: 209166 - RNA, 21 nt, Human
uaaccaaauuguacagcuuua

SEQ ID NO: 209167 - RNA, 22 nt, Human
uacagaaaggagcgggcucgga

SEQ ID NO: 209168 - RNA, 23 nt, Human
uacaggagagaagacuguaauuu

SEQ ID NO: 209169 - RNA, 21 nt, Human
uaccuuuaaagccaaacaggc

SEQ ID NO: 209170 - RNA, 21 nt, Human
uaggacaggugccaaccuguc

SEQ ID NO: 209171 - RNA, 20 nt, Human
uauaacccuuuaaaagcaag

SEQ ID NO: 209172 - RNA, 18 nt, Human
ucacaaagggcugcugcc

SEQ ID NO: 209173 - RNA, 20 nt, Human
ucaccugagcaccccaaccc

SEQ ID NO: 209174 - RNA, 18 nt, Human
ucagcagggcccugcagc

SEQ ID NO: 209175 - RNA, 19 nt, Human
ucaggagugagcgcgugag

SEQ ID NO: 209176 - RNA, 19 nt, Human
ucaguggggugggagggag

SEQ ID NO: 209177 - RNA, 18 nt, Human
uccaggcuacagcuaaaa

SEQ ID NO: 209178 - RNA, 22 nt, Human
ucccaccccacccucaggggcu

SEQ ID NO: 209179 - RNA, 22 nt, Human
ucccugcugccaagcccaccag

SEQ ID NO: 209180 - RNA, 20 nt, Human
ucucauuagcagaauguggg

SEQ ID NO: 209181 - RNA, 24 nt, Human
ucuccagguguccaaagugcuggu

SEQ ID NO: 209182 - RNA, 23 nt, Human
ugaggaaagcaugaaggaaugag

SEQ ID NO: 209183 - RNA, 21 nt, Human
ugaggagcagcagaaugcggc

SEQ ID NO: 209184 - RNA, 18 nt, Human
ugaggagccuggcugaga

SEQ ID NO: 209185 - RNA, 22 nt, Human
ugagggccauauucuaggccca

SEQ ID NO: 209186 - RNA, 26 nt, Human
ugaucagacaaagcucucauuagcag

SEQ ID NO: 209187 - RNA, 24 nt, Human
ugcagcuuugcucgcugugaggag

SEQ ID NO: 209188 - RNA, 21 nt, Human
ugcagucagcccuguggugcc

SEQ ID NO: 209189 - RNA, 18 nt, Human
ugccaggccccuugaugg

SEQ ID NO: 209190 - RNA, 26 nt, Human
uggaaagcccccaagaaaugggcacc

SEQ ID NO: 209191 - RNA, 20 nt, Human
uggaaagggaccucugagug

SEQ ID NO: 209192 - RNA, 22 nt, Human
uggaaagggaccucugaguggc

SEQ ID NO: 209193 - RNA, 21 nt, Human
uggaggaagggcauggggcaa

SEQ ID NO: 209194 - RNA, 22 nt, Human
uggcagggacagggcucucugg

SEQ ID NO: 209195 - RNA, 21 nt, Human
uggcauggggcagggagaaag

SEQ ID NO: 209196 - RNA, 22 nt, Human
uggccaucuguuagaagcagca

SEQ ID NO: 209197 - RNA, 18 nt, Human
ugggaggagcagcccauc

SEQ ID NO: 209198 - RNA, 20 nt, Human
uggggaaaugagacccugag

SEQ ID NO: 209199 - RNA, 18 nt, Human
ugggggcccagaacaggg

SEQ ID NO: 209200 - RNA, 19 nt, Human
uggggugggagggaguggc

SEQ ID NO: 209201 - RNA, 21 nt, Human
ugggugcagcuuugcucgcug

SEQ ID NO: 209202 - RNA, 24 nt, Human
ugucacgugccaacaggugccugg

SEQ ID NO: 209203 - RNA, 18 nt, Human
uguggaggaagggcaugg

SEQ ID NO: 209204 - RNA, 21 nt, Human
uuaccaaggcuucucacagcu

SEQ ID NO: 209205 - RNA, 20 nt, Human
uucacuuuauauauauggau

SEQ ID NO: 209206 - RNA, 20 nt, Human
uuuaaggaccaggaaaugag

SEQ ID NO: 209207 - RNA, 20 nt, Human
uuucaggaauaggacaggug

SEQ ID NO: 209208 - RNA, 26 nt, Human
aagaaagagguaucaucaucaaaugu

SEQ ID NO: 209209 - RNA, 25 nt, Human
agggaagaaagagguaucaucauca

SEQ ID NO: 209210 - RNA, 18 nt, Human
caggagccaccaccuggc

SEQ ID NO: 209211 - RNA, 20 nt, Human
ccaccaccuggccauacugg

SEQ ID NO: 209212 - RNA, 20 nt, Human
ccacugcacaucagcuccag

SEQ ID NO: 209213 - RNA, 21 nt, Human
ccacugcacaucagcuccagg

SEQ ID NO: 209214 - RNA, 21 nt, Human
ccacugcacaucagcuccagg

SEQ ID NO: 209215 - RNA, 22 nt, Human
ccacugcacaucagcuccaggc

SEQ ID NO: 209216 - RNA, 21 nt, Human
ccagcggccaguacgucuucu

SEQ ID NO: 209217 - RNA, 25 nt, Human
cgcagcacagcugugccugggacag

SEQ ID NO: 209218 - RNA, 21 nt, Human
cuccaggcugcaggagccacc

SEQ ID NO: 209219 - RNA, 18 nt, Human
cuccuuggcuuguucugg

SEQ ID NO: 209220 - RNA, 18 nt, Human
cugcaggagccaccaccu

SEQ ID NO: 209221 - RNA, 21 nt, Human
cuggccauacuggcuuccucc

SEQ ID NO: 209222 - RNA, 24 nt, Human
uaguuaaaauaaauaaagacucca

SEQ ID NO: 209223 - RNA, 22 nt, Human
uccagcggccaguacgucuucu

SEQ ID NO: 209224 - RNA, 24 nt, Human
ucucaaguacuggagcagcuagca

SEQ ID NO: 209225 - RNA, 21 nt, Human
uggaauguugaagaaauaguu

SEQ ID NO: 209226 - RNA, 22 nt, Human
uggcggggagaugggggaggca

SEQ ID NO: 209227 - RNA, 19 nt, Human
uggcucaggcuggggcuca

SEQ ID NO: 209228 - RNA, 20 nt, Human
ugggacuggcucaggcuggg

SEQ ID NO: 209229 - RNA, 23 nt, Human
uggggcucacagaggccacugca

SEQ ID NO: 209230 - RNA, 22 nt, Human
uguauuagaacauauacacuca

SEQ ID NO: 209231 - RNA, 22 nt, Human
uuggcuccuuggcuuguucugg

SEQ ID NO: 209232 - RNA, 19 nt, Human
aaagcagagaguagagcag

SEQ ID NO: 209233 - RNA, 19 nt, Human
aacucacucuucaaggcug

SEQ ID NO: 209234 - RNA, 19 nt, Human
aagcagagaguagagcagg

SEQ ID NO: 209235 - RNA, 21 nt, Human
aaguuuucugccucacagcuu

SEQ ID NO: 209236 - RNA, 22 nt, Human
aaucuugucucucagugcccac

SEQ ID NO: 209237 - RNA, 20 nt, Human
accuggugcaggaagggcuc

SEQ ID NO: 209238 - RNA, 22 nt, Human
acuggguuggcaaccaagcuga

SEQ ID NO: 209239 - RNA, 20 nt, Human
agaaagcagagaguagagca

SEQ ID NO: 209240 - RNA, 23 nt, Human
agaauccagauaagcccaggaag

SEQ ID NO: 209241 - RNA, 21 nt, Human
agaggcauucaugagcucugc

SEQ ID NO: 209242 - RNA, 18 nt, Human
agcaaugcuggccucuaa

SEQ ID NO: 209243 - RNA, 20 nt, Human
aggaaaaaaaagccuguaaa

SEQ ID NO: 209244 - RNA, 23 nt, Human
aggaaaaaaaagccuguaaaggg

SEQ ID NO: 209245 - RNA, 24 nt, Human
aggaaaaaaaagccuguaaaggga

SEQ ID NO: 209246 - RNA, 21 nt, Human
aggaagauaagaggcauucau

SEQ ID NO: 209247 - RNA, 20 nt, Human
aggcaaaaauggagaaucug

SEQ ID NO: 209248 - RNA, 21 nt, Human
aggcaaaaauggagaaucugg

SEQ ID NO: 209249 - RNA, 25 nt, Human
aggcaaaaauggagaaucugggguc

SEQ ID NO: 209250 - RNA, 20 nt, Human
auggcggcagaugguggugg

SEQ ID NO: 209251 - RNA, 23 nt, Human
caacaggucucuauuugagaucu

SEQ ID NO: 209252 - RNA, 23 nt, Human
cagcggcagggauucauagaacc

SEQ ID NO: 209253 - RNA, 26 nt, Human
cagcggcagggauucauagaaccucu

SEQ ID NO: 209254 - RNA, 29 nt, Human
cagcggcagggauucauagaaccuuaucu

SEQ ID NO: 209255 - RNA, 20 nt, Human
cagcgggguccucagagcuu

SEQ ID NO: 209256 - RNA, 18 nt, Human
caggcaauggcccguccc

SEQ ID NO: 209257 - RNA, 25 nt, Human
caguggucccuuuuuaugugcguuc

SEQ ID NO: 209258 - RNA, 22 nt, Human
caucacgcucaugugccccccg

SEQ ID NO: 209259 - RNA, 21 nt, Human
caugagcucaugaacucacuc

SEQ ID NO: 209260 - RNA, 20 nt, Human
ccacccccaaaauaaauaaa

SEQ ID NO: 209261 - RNA, 20 nt, Human
ccagagcucaugccugggcu

SEQ ID NO: 209262 - RNA, 22 nt, Human
ccccaaaauaaauaaauagaaa

SEQ ID NO: 209263 - RNA, 22 nt, Human
ccccacugcaagccgugucuca

SEQ ID NO: 209264 - RNA, 21 nt, Human
cccuagcaaccaacaggucuc

SEQ ID NO: 209265 - RNA, 23 nt, Human
cccuagcaaccaacaggucucua

SEQ ID NO: 209266 - RNA, 18 nt, Human
cccuccaguguacuccag

SEQ ID NO: 209267 - RNA, 24 nt, Human
ccguccuccagguucuucugacuc

SEQ ID NO: 209268 - RNA, 24 nt, Human
ccuaaaacuccgcuuaggaagaua

SEQ ID NO: 209269 - RNA, 26 nt, Human
ccuccaagaucguggggaguguaugg

SEQ ID NO: 209270 - RNA, 18 nt, Human
ccuccagguucuucugac

SEQ ID NO: 209271 - RNA, 22 nt, Human
ccuccuuuccacaggcaaaaau

SEQ ID NO: 209272 - RNA, 21 nt, Human
ccugugcugucuuuccagagg

SEQ ID NO: 209273 - RNA, 23 nt, Human
cgccgccgacucuguggagaccu

SEQ ID NO: 209274 - RNA, 25 nt, Human
cguccuccagguucuucugacuccc

SEQ ID NO: 209275 - RNA, 23 nt, Human
cuccagaaggugccacuuuaucc

SEQ ID NO: 209276 - RNA, 20 nt, Human
cuccccaacccacccccaaa

SEQ ID NO: 209277 - RNA, 19 nt, Human
cuguggggugaaccgcuuc

SEQ ID NO: 209278 - RNA, 19 nt, Human
cuguuuguucuuauuccau

SEQ ID NO: 209279 - RNA, 22 nt, Human
gaagaauccagauaagcccagg

SEQ ID NO: 209280 - RNA, 25 nt, Human
gaaggcagggcccaggaaucuuguc

SEQ ID NO: 209281 - RNA, 21 nt, Human
gaauggggaacuccaaagucu

SEQ ID NO: 209282 - RNA, 18 nt, Human
gagaaucuggggucuugc

SEQ ID NO: 209283 - RNA, 24 nt, Human
gauuuugggggaaaaaaaggaaaa

SEQ ID NO: 209284 - RNA, 21 nt, Human
gccagagcucaugccugggcu

SEQ ID NO: 209285 - RNA, 19 nt, Human
gcccaccauguacaggcau

SEQ ID NO: 209286 - RNA, 23 nt, Human
gcgggguccucagagcuuccucc

SEQ ID NO: 209287 - RNA, 19 nt, Human
gcgucugccauauggccac

SEQ ID NO: 209288 - RNA, 21 nt, Human
ggaaaaaaaagccuguaaagg

SEQ ID NO: 209289 - RNA, 21 nt, Human
ggaaaaaaaagccuguaaagg

SEQ ID NO: 209290 - RNA, 21 nt, Human
gggaacuccaaagucugcuaa

SEQ ID NO: 209291 - RNA, 19 nt, Human
ggggaguguauggaaggca

SEQ ID NO: 209292 - RNA, 19 nt, Human
gggggaaaaaaaggaaaaa

SEQ ID NO: 209293 - RNA, 19 nt, Human
ggggugaaccgcuucaugg

SEQ ID NO: 209294 - RNA, 19 nt, Human
gugcaggaagggcuccagc

SEQ ID NO: 209295 - RNA, 21 nt, Human
guggugguggggggucccugc

SEQ ID NO: 209296 - RNA, 21 nt, Human
uaacguaucucagugcuugac

SEQ ID NO: 209297 - RNA, 22 nt, Human
uaacuugggcugcccccuccag

SEQ ID NO: 209298 - RNA, 20 nt, Human
uacaaggagaaaaaccauga

SEQ ID NO: 209299 - RNA, 21 nt, Human
uacaaggagaaaaaccaugag

SEQ ID NO: 209300 - RNA, 19 nt, Human
uagaaagcagagaguagag

SEQ ID NO: 209301 - RNA, 21 nt, Human
uaucucagugcuugacucaag

SEQ ID NO: 209302 - RNA, 21 nt, Human
uauggccaccgccgccgacuc

SEQ ID NO: 209303 - RNA, 20 nt, Human
ucacuggguuggcaaccaag

SEQ ID NO: 209304 - RNA, 25 nt, Human
ucacuggguuggcaaccaagcugag

SEQ ID NO: 209305 - RNA, 18 nt, Human
ucagagcuuccuccaaga

SEQ ID NO: 209306 - RNA, 25 nt, Human
ucagagcuuccuccaagaucguggg

SEQ ID NO: 209307 - RNA, 20 nt, Human
ucagcgguccucaacuuucu

SEQ ID NO: 209308 - RNA, 20 nt, Human
ucaguggucccuuuuuaugg

SEQ ID NO: 209309 - RNA, 18 nt, Human
ucaugccugggcuuggcu

SEQ ID NO: 209310 - RNA, 22 nt, Human
ucucauggucagaauguggcag

SEQ ID NO: 209311 - RNA, 23 nt, Human
ucuccgauaagcagcauuagagc

SEQ ID NO: 209312 - RNA, 21 nt, Human
ucuccuucuuggccuuuauug

SEQ ID NO: 209313 - RNA, 23 nt, Human
ucucucagugcccaccauguaca

SEQ ID NO: 209314 - RNA, 25 nt, Human
ucucucagugcccaccauguacagg

SEQ ID NO: 209315 - RNA, 23 nt, Human
ucuguggagaccuugaagggcuc

SEQ ID NO: 209316 - RNA, 19 nt, Human
ugacuccccaacccacccc

SEQ ID NO: 209317 - RNA, 20 nt, Human
ugacuccccaacccaccccc

SEQ ID NO: 209318 - RNA, 22 nt, Human
ugagauggguagaucucuucug

SEQ ID NO: 209319 - RNA, 23 nt, Human
ugcaggaagggcuccagcugcac

SEQ ID NO: 209320 - RNA, 21 nt, Human
ugccauauauagagaugguuu

SEQ ID NO: 209321 - RNA, 22 nt, Human
ugcuucaagucaaguuuucugc

SEQ ID NO: 209322 - RNA, 20 nt, Human
uggaaggcagggcccaggaa

SEQ ID NO: 209323 - RNA, 22 nt, Human
uggcagaauggggaacuccaaa

SEQ ID NO: 209324 - RNA, 24 nt, Human
uggccucuaacuugggcugccccc

SEQ ID NO: 209325 - RNA, 20 nt, Human
uggcggcagauggugguggu

SEQ ID NO: 209326 - RNA, 19 nt, Human
ugggggaaaaaaaggaaaa

SEQ ID NO: 209327 - RNA, 22 nt, Human
ugggggaaaaaaaggaaaaaaa

SEQ ID NO: 209328 - RNA, 23 nt, Human
uggugcaggaagggcuccagcug

SEQ ID NO: 209329 - RNA, 18 nt, Human
uggugguggggggucccu

SEQ ID NO: 209330 - RNA, 20 nt, Human
uggugguggggggucccugc

SEQ ID NO: 209331 - RNA, 19 nt, Human
ugguggugguggggggucc

SEQ ID NO: 209332 - RNA, 22 nt, Human
ugguggugguggggggucccug

SEQ ID NO: 209333 - RNA, 23 nt, Human
ugguggugguggggggucccugc

SEQ ID NO: 209334 - RNA, 24 nt, Human
uguaaacauugccccugguuuccu

SEQ ID NO: 209335 - RNA, 22 nt, Human
ugucuggacuacccuagcaacc

SEQ ID NO: 209336 - RNA, 18 nt, Human
ugucuguggguucucagc

SEQ ID NO: 209337 - RNA, 19 nt, Human
ugugccccccgaccuggug

SEQ ID NO: 209338 - RNA, 21 nt, Human
uguggaaucaccuccagagcu

SEQ ID NO: 209339 - RNA, 22 nt, Human
uguuaauauagucugccauaua

SEQ ID NO: 209340 - RNA, 24 nt, Human
uucauagaaccucugcucccggga

SEQ ID NO: 209341 - RNA, 18 nt, Human
uuccagaggugcacugug

SEQ ID NO: 209342 - RNA, 18 nt, Human
uuuugggggaaaaaaagg

SEQ ID NO: 209343 - RNA, 18 nt, Human
cacagugcaccucagaau

SEQ ID NO: 209344 - RNA, 20 nt, Human
caccaacaaucgagucucca

SEQ ID NO: 209345 - RNA, 19 nt, Human
caccucagaaucaacccac

SEQ ID NO: 209346 - RNA, 19 nt, Human
cagaaucaacccacacugc

SEQ ID NO: 209347 - RNA, 20 nt, Human
cagaaucaacccacacugcu

SEQ ID NO: 209348 - RNA, 18 nt, Human
cagcaacaccgcagcgac

SEQ ID NO: 209349 - RNA, 25 nt, Human
cagcaacaccgcagcgacaagcucu

SEQ ID NO: 209350 - RNA, 23 nt, Human
ccaacagcaacaccgcagcgaca

SEQ ID NO: 209351 - RNA, 21 nt, Human
ccgcagcgacaagcucuuucc

SEQ ID NO: 209352 - RNA, 26 nt, Human
ccgcagcgacaagcucuuucccacag

SEQ ID NO: 209353 - RNA, 19 nt, Human
ccucagaaucaacccacac

SEQ ID NO: 209354 - RNA, 18 nt, Human
gagucuccaacagcaaca

SEQ ID NO: 209355 - RNA, 21 nt, Human
ucaccaacaaucgagucucca

SEQ ID NO: 209356 - RNA, 19 nt, Human
ucagaaucaacccacacug

SEQ ID NO: 209357 - RNA, 25 nt, Human
uccaacagcaacaccgcagcgacaa

SEQ ID NO: 209358 - RNA, 24 nt, Human
uuucgcugucaccaacaaucgagu

SEQ ID NO: 209359 - RNA, 23 nt, Human
aaacagcccaagugaaagaacaa

SEQ ID NO: 209360 - RNA, 26 nt, Human
aaacgcugaagcgcugcaaagaagcc

SEQ ID NO: 209361 - RNA, 24 nt, Human
aagaagccagcgacucaaugggug

SEQ ID NO: 209362 - RNA, 21 nt, Human
acccagagucagcucccacag

SEQ ID NO: 209363 - RNA, 25 nt, Human
acccccaaacagaggugcguccggc

SEQ ID NO: 209364 - RNA, 25 nt, Human
acuaauagccauuguaaucuucucc

SEQ ID NO: 209365 - RNA, 19 nt, Human
agacaaguacaacuauccc

SEQ ID NO: 209366 - RNA, 28 nt, Human
auuaaucucugaggacccccaaacagag

SEQ ID NO: 209367 - RNA, 22 nt, Human
auuaccauaauuaugcucucaa

SEQ ID NO: 209368 - RNA, 24 nt, Human
cacgcgcagccggcuacccagagu

SEQ ID NO: 209369 - RNA, 20 nt, Human
cagagucagcucccacaguc

SEQ ID NO: 209370 - RNA, 21 nt, Human
cagcccaagugaaagaacaau

SEQ ID NO: 209371 - RNA, 21 nt, Human
cagcucccacaguccgcaccc

SEQ ID NO: 209372 - RNA, 22 nt, Human
cauuuuacucuuuccaguucuc

SEQ ID NO: 209373 - RNA, 22 nt, Human
ccgacggcacuaggccuccaag

SEQ ID NO: 209374 - RNA, 18 nt, Human
ccucgccuccccagccac

SEQ ID NO: 209375 - RNA, 19 nt, Human
cuccaaggauggaggcgcc

SEQ ID NO: 209376 - RNA, 23 nt, Human
gaaagaacaaucauucucacaaa

SEQ ID NO: 209377 - RNA, 24 nt, Human
guaggacaacaggaaugaguggaa

SEQ ID NO: 209378 - RNA, 22 nt, Human
uaaucucugaggacccccaaac

SEQ ID NO: 209379 - RNA, 18 nt, Human
ucaaagagcaaggggugg

SEQ ID NO: 209380 - RNA, 23 nt, Human
ucagcucccacaguccgcaccca

SEQ ID NO: 209381 - RNA, 18 nt, Human
uccaaggauggaggcgcc

SEQ ID NO: 209382 - RNA, 20 nt, Human
ucccacaguccgcacccaga

SEQ ID NO: 209383 - RNA, 18 nt, Human
ucucuguccgcggcuccc

SEQ ID NO: 209384 - RNA, 21 nt, Human
ugaaagaacaaucauucucac

SEQ ID NO: 209385 - RNA, 22 nt, Human
ugaagcgcugcaaagaagccag

SEQ ID NO: 209386 - RNA, 21 nt, Human
ugaguggaaauggucuucucu

SEQ ID NO: 209387 - RNA, 21 nt, Human
ugcaaagaagccagcgacuca

SEQ ID NO: 209388 - RNA, 18 nt, Human
ugguaggacaacaggaau

SEQ ID NO: 209389 - RNA, 20 nt, Human
uugcgcacgcgucucugucc

SEQ ID NO: 209390 - RNA, 27 nt, Human
aaacccggggcuaugacaccccccuga

SEQ ID NO: 209391 - RNA, 18 nt, Human
aagaaacacaagcuguaa

SEQ ID NO: 209392 - RNA, 21 nt, Human
aauccagaagaaacacaagcu

SEQ ID NO: 209393 - RNA, 21 nt, Human
acaaggcgccggcagugccca

SEQ ID NO: 209394 - RNA, 19 nt, Human
acauugauaaacaguguuc

SEQ ID NO: 209395 - RNA, 21 nt, Human
accaagcgcugcucggacucu

SEQ ID NO: 209396 - RNA, 25 nt, Human
accuguuugugaucaucugaacuca

SEQ ID NO: 209397 - RNA, 20 nt, Human
acgcggggcagggggcgggc

SEQ ID NO: 209398 - RNA, 21 nt, Human
acucauuuugugcucuugccu

SEQ ID NO: 209399 - RNA, 20 nt, Human
agaaugcuucauucuaucuc

SEQ ID NO: 209400 - RNA, 21 nt, Human
agaggaagugaggauggggcc

SEQ ID NO: 209401 - RNA, 24 nt, Human
agaggacagggagcagggccuuug

SEQ ID NO: 209402 - RNA, 25 nt, Human
agggagcagggccuuuggagagcag

SEQ ID NO: 209403 - RNA, 23 nt, Human
auagugugaaucuccacaaagca

SEQ ID NO: 209404 - RNA, 18 nt, Human
auggagacaugggcaugg

SEQ ID NO: 209405 - RNA, 24 nt, Human
caacuuugccgaaaagaggacaac

SEQ ID NO: 209406 - RNA, 22 nt, Human
cacaaagcaagugaaacaugaa

SEQ ID NO: 209407 - RNA, 19 nt, Human
cacaaucagcaggagaaaa

SEQ ID NO: 209408 - RNA, 25 nt, Human
cacacgcuugagcaggaauggagac

SEQ ID NO: 209409 - RNA, 27 nt, Human
caccaaaguaguagguaaaaacacaau

SEQ ID NO: 209410 - RNA, 18 nt, Human
cacggcagaggaaggagc

SEQ ID NO: 209411 - RNA, 22 nt, Human
cagcagugaaauaaaaagagga

SEQ ID NO: 209412 - RNA, 19 nt, Human
ccagcacacacgcuugagc

SEQ ID NO: 209413 - RNA, 22 nt, Human
ccaggcagccccacgucacgcc

SEQ ID NO: 209414 - RNA, 19 nt, Human
ccaggcagccccaugucag

SEQ ID NO: 209415 - RNA, 21 nt, Human
ccauggaaaccacuugugaaa

SEQ ID NO: 209416 - RNA, 21 nt, Human
cccccaccgcacaaggccugc

SEQ ID NO: 209417 - RNA, 19 nt, Human
ccccccaccgcacaaggcc

SEQ ID NO: 209418 - RNA, 22 nt, Human
cccccugaaaacauuaaaaugc

SEQ ID NO: 209419 - RNA, 22 nt, Human
ccgcaacuauaauuaaacuguc

SEQ ID NO: 209420 - RNA, 18 nt, Human
ccucugugacaaucaccc

SEQ ID NO: 209421 - RNA, 22 nt, Human
cggccugcuccaggcagcccca

SEQ ID NO: 209422 - RNA, 20 nt, Human
cuccacaaagcaagugaaac

SEQ ID NO: 209423 - RNA, 21 nt, Human
cuccucugugacaaucacccc

SEQ ID NO: 209424 - RNA, 22 nt, Human
cucugugacaaucacccccaag

SEQ ID NO: 209425 - RNA, 22 nt, Human
gaaaccacuugugaaagucuuu

SEQ ID NO: 209426 - RNA, 22 nt, Human
gagccgcggccaggcagcccca

SEQ ID NO: 209427 - RNA, 20 nt, Human
gcagauacccuuucuguccc

SEQ ID NO: 209428 - RNA, 23 nt, Human
gggcagggggcgggcuccccggg

SEQ ID NO: 209429 - RNA, 19 nt, Human
gggcggccaaacccggggc

SEQ ID NO: 209430 - RNA, 18 nt, Human
gggcggggaaggcggggc

SEQ ID NO: 209431 - RNA, 18 nt, Human
guacuccaagcacuuuuc

SEQ ID NO: 209432 - RNA, 22 nt, Human
guccuggguccugggugaaagu

SEQ ID NO: 209433 - RNA, 19 nt, Human
gugaaucuccacaaagcaa

SEQ ID NO: 209434 - RNA, 19 nt, Human
uaauaauacugcuagaugc

SEQ ID NO: 209435 - RNA, 18 nt, Human
uaauggaggaccuccagu

SEQ ID NO: 209436 - RNA, 18 nt, Human
uaccagagaccccugggc

SEQ ID NO: 209437 - RNA, 24 nt, Human
uaggagaagcugaauccagaagaa

SEQ ID NO: 209438 - RNA, 26 nt, Human
ucacacacacaaucagcaggagaaaa

SEQ ID NO: 209439 - RNA, 18 nt, Human
ucccuaaacuuacuugac

SEQ ID NO: 209440 - RNA, 20 nt, Human
ucuggauaccagagaccccu

SEQ ID NO: 209441 - RNA, 23 nt, Human
ugaaacaugaauagcucccuaaa

SEQ ID NO: 209442 - RNA, 24 nt, Human
ugaaauaaaaagaggaagugagga

SEQ ID NO: 209443 - RNA, 25 nt, Human
ugagagacagggacuccccggccca

SEQ ID NO: 209444 - RNA, 20 nt, Human
ugcagacaaggcgccggcag

SEQ ID NO: 209445 - RNA, 20 nt, Human
ugcugaggaagcgagagcuc

SEQ ID NO: 209446 - RNA, 21 nt, Human
uggaauguuaauacauguuuc

SEQ ID NO: 209447 - RNA, 23 nt, Human
uggagagcaggagaggacaggcu

SEQ ID NO: 209448 - RNA, 22 nt, Human
uggcaaaccguacuccaagcac

SEQ ID NO: 209449 - RNA, 24 nt, Human
uggcagaaaggaccacagauggag

SEQ ID NO: 209450 - RNA, 22 nt, Human
uggggccagcgaugugcgcugg

SEQ ID NO: 209451 - RNA, 19 nt, Human
ugucggcagggacgcgggg

SEQ ID NO: 209452 - RNA, 22 nt, Human
uugaagaagcaggguuauggca

SEQ ID NO: 209453 - RNA, 21 nt, Human
uuggcagaaaggaccacagau

SEQ ID NO: 209454 - RNA, 21 nt, Human
uuuagcagcagugaaauaaaa

SEQ ID NO: 209455 - RNA, 21 nt, Human
uuuguggggccagcgaugugc

SEQ ID NO: 209456 - RNA, 21 nt, Human
aacccaaauguccaucaauag

SEQ ID NO: 209457 - RNA, 22 nt, Human
aagaugggaaacaacccaaaug

SEQ ID NO: 209458 - RNA, 21 nt, Human
aaggugccgcggccagcuccu

SEQ ID NO: 209459 - RNA, 18 nt, Human
aauguccaucaauaguga

SEQ ID NO: 209460 - RNA, 22 nt, Human
acaacccaaauguccaucaaua

SEQ ID NO: 209461 - RNA, 18 nt, Human
accccaaaagaggggacc

SEQ ID NO: 209462 - RNA, 24 nt, Human
agacagaagggaacaaaaagagca

SEQ ID NO: 209463 - RNA, 20 nt, Human
agacagaagggaacaaaagg

SEQ ID NO: 209464 - RNA, 23 nt, Human
agacagaagggaacaaaagggac

SEQ ID NO: 209465 - RNA, 23 nt, Human
agaccccgcaguggaggaggagg

SEQ ID NO: 209466 - RNA, 22 nt, Human
agagcugccacccagcucugcc

SEQ ID NO: 209467 - RNA, 21 nt, Human
agagggagggauuagcccgag

SEQ ID NO: 209468 - RNA, 21 nt, Human
agaugggaaacaacccaaaug

SEQ ID NO: 209469 - RNA, 22 nt, Human
agaugggaaacaacccaaaugu

SEQ ID NO: 209470 - RNA, 23 nt, Human
agcacucccagggcacagcagcg

SEQ ID NO: 209471 - RNA, 22 nt, Human
agcgggcgggucgguguccggu

SEQ ID NO: 209472 - RNA, 20 nt, Human
agcugccacccagcucugcc

SEQ ID NO: 209473 - RNA, 19 nt, Human
aggaagagggagggauuag

SEQ ID NO: 209474 - RNA, 21 nt, Human
agggaacaaaaagagcagcga

SEQ ID NO: 209475 - RNA, 24 nt, Human
agggaggaguagaaacaguccagc

SEQ ID NO: 209476 - RNA, 18 nt, Human
agggucagaccccgcagu

SEQ ID NO: 209477 - RNA, 20 nt, Human
aguccagcucgccgcccaag

SEQ ID NO: 209478 - RNA, 18 nt, Human
augcagcccaaaaggaga

SEQ ID NO: 209479 - RNA, 20 nt, Human
caaaagaggggaccagcgga

SEQ ID NO: 209480 - RNA, 21 nt, Human
caaauguccaucaauagugac

SEQ ID NO: 209481 - RNA, 21 nt, Human
caacccaaauguccaucaaua

SEQ ID NO: 209482 - RNA, 18 nt, Human
cacaaggaguagggucag

SEQ ID NO: 209483 - RNA, 23 nt, Human
cacccagcccuucauccugggcu

SEQ ID NO: 209484 - RNA, 24 nt, Human
cagaagggaacaaaaagagcagcg

SEQ ID NO: 209485 - RNA, 22 nt, Human
cagaaucugguugcucugccgg

SEQ ID NO: 209486 - RNA, 23 nt, Human
cagcacucccagggcacagcagc

SEQ ID NO: 209487 - RNA, 19 nt, Human
cagcuccuggguggggcuc

SEQ ID NO: 209488 - RNA, 22 nt, Human
cagcuccuggguggggcuccag

SEQ ID NO: 209489 - RNA, 18 nt, Human
cagcucugccaggggaag

SEQ ID NO: 209490 - RNA, 19 nt, Human
caguggccuugcacuggcc

SEQ ID NO: 209491 - RNA, 20 nt, Human
caguggccuugcacuggccc

SEQ ID NO: 209492 - RNA, 21 nt, Human
cccaggccccauucuugacuu

SEQ ID NO: 209493 - RNA, 19 nt, Human
ccccagugccggguggagg

SEQ ID NO: 209494 - RNA, 21 nt, Human
ccccauucuugacuuccccag

SEQ ID NO: 209495 - RNA, 20 nt, Human
ccgccuuggccagugcucca

SEQ ID NO: 209496 - RNA, 20 nt, Human
ccucacacaaggaguagggu

SEQ ID NO: 209497 - RNA, 23 nt, Human
cgcaucuaccccaaaagagggga

SEQ ID NO: 209498 - RNA, 21 nt, Human
cgccuuggccagugcuccaga

SEQ ID NO: 209499 - RNA, 24 nt, Human
cgccuuggccagugcuccagaagc

SEQ ID NO: 209500 - RNA, 18 nt, Human
cgcggagcaggaacgggc

SEQ ID NO: 209501 - RNA, 18 nt, Human
cggucccgggcacguccu

SEQ ID NO: 209502 - RNA, 22 nt, Human
cuccuggguggggcuccaggug

SEQ ID NO: 209503 - RNA, 22 nt, Human
cucgcagcgcucccgcagaauc

SEQ ID NO: 209504 - RNA, 24 nt, Human
cugccaggggaagcaguucucccu

SEQ ID NO: 209505 - RNA, 19 nt, Human
cuuggaaaugcagaagcuc

SEQ ID NO: 209506 - RNA, 20 nt, Human
gaagagggagggauuagccc

SEQ ID NO: 209507 - RNA, 22 nt, Human
gccccaggccccauucuugacu

SEQ ID NO: 209508 - RNA, 24 nt, Human
ggaagagggagggauuagcccgag

SEQ ID NO: 209509 - RNA, 21 nt, Human
ggaauagcaugcagcccaaaa

SEQ ID NO: 209510 - RNA, 19 nt, Human
gggaacaaaaagagcagcc

SEQ ID NO: 209511 - RNA, 19 nt, Human
gugguucgagcagacagaa

SEQ ID NO: 209512 - RNA, 21 nt, Human
uagcccgaggcaagugguucg

SEQ ID NO: 209513 - RNA, 22 nt, Human
uaugguaacaaaaagaugggaa

SEQ ID NO: 209514 - RNA, 18 nt, Human
ucccugagagccccaggc

SEQ ID NO: 209515 - RNA, 19 nt, Human
ucccugagagccccaggcc

SEQ ID NO: 209516 - RNA, 27 nt, Human
ucucugaacuagaggaguccggugccc

SEQ ID NO: 209517 - RNA, 20 nt, Human
ugccaggggaagcaguucuc

SEQ ID NO: 209518 - RNA, 23 nt, Human
ugccggguggaggaagagggagg

SEQ ID NO: 209519 - RNA, 24 nt, Human
uggaauagcaugcagcccaaaagg

SEQ ID NO: 209520 - RNA, 18 nt, Human
uggaggaggagggaggag

SEQ ID NO: 209521 - RNA, 19 nt, Human
uggccagugcuccagaagc

SEQ ID NO: 209522 - RNA, 21 nt, Human
ugggaaacaacccaaaugucc

SEQ ID NO: 209523 - RNA, 18 nt, Human
uggguccugaaucggccc

SEQ ID NO: 209524 - RNA, 18 nt, Human
uuagcccgaggcaagugg

SEQ ID NO: 209525 - RNA, 22 nt, Human
uuuuuuuuuuuuuuuuuuaaug

SEQ ID NO: 209526 - RNA, 24 nt, Human
aaagugcugggauuacaggcguga

SEQ ID NO: 209527 - RNA, 19 nt, Human
aaguagcugggauuacagg

SEQ ID NO: 209528 - RNA, 24 nt, Human
aagugauccacccgccucagccuc

SEQ ID NO: 209529 - RNA, 19 nt, Human
aagugcugggauuacaggc

SEQ ID NO: 209530 - RNA, 19 nt, Human
aagugcugggauuacaggc

SEQ ID NO: 209531 - RNA, 26 nt, Human
aagugcugggauuacaggcgugagcc

SEQ ID NO: 209532 - RNA, 25 nt, Human
acccgccucagccucccaaagugcu

SEQ ID NO: 209533 - RNA, 18 nt, Human
acgggguuucaccauguu

SEQ ID NO: 209534 - RNA, 19 nt, Human
acgggguuucaccauguug

SEQ ID NO: 209535 - RNA, 24 nt, Human
acgggguuucaccauguugaccag

SEQ ID NO: 209536 - RNA, 26 nt, Human
agacagacaaacaauguaacauuccc

SEQ ID NO: 209537 - RNA, 19 nt, Human
agccccaagcccagagaca

SEQ ID NO: 209538 - RNA, 23 nt, Human
aguagcugggauuacaggugcgc

SEQ ID NO: 209539 - RNA, 18 nt, Human
agugcugggauuacaggc

SEQ ID NO: 209540 - RNA, 23 nt, Human
auaaauaacaagcuggccacagc

SEQ ID NO: 209541 - RNA, 20 nt, Human
auggaaacagcuuaaaaaca

SEQ ID NO: 209542 - RNA, 21 nt, Human
auuacaggugcgcgccaccau

SEQ ID NO: 209543 - RNA, 24 nt, Human
auuuuuguauuuuuaguagagacg

SEQ ID NO: 209544 - RNA, 24 nt, Human
caaagugcugggauuacaggcgug

SEQ ID NO: 209545 - RNA, 22 nt, Human
caaauaccauagugugucaccc

SEQ ID NO: 209546 - RNA, 23 nt, Human
caacuuccaucuccuggguucaa

SEQ ID NO: 209547 - RNA, 22 nt, Human
caagcaauucucuugccucagc

SEQ ID NO: 209548 - RNA, 27 nt, Human
caagcaauucucuugccucagccuccc

SEQ ID NO: 209549 - RNA, 24 nt, Human
caccaugcccggcuaauuuuugua

SEQ ID NO: 209550 - RNA, 19 nt, Human
caccauguugaccaggcug

SEQ ID NO: 209551 - RNA, 21 nt, Human
caccauguugaccaggcuggu

SEQ ID NO: 209552 - RNA, 21 nt, Human
caccauguugaccaggcuggu

SEQ ID NO: 209553 - RNA, 31 nt, Human
caccauguugaccaggcugguuaggaacucc

SEQ ID NO: 209554 - RNA, 23 nt, Human
cacccaggcuggaguacaggggc

SEQ ID NO: 209555 - RNA, 23 nt, Human
cacccgccucagccucccaaagu

SEQ ID NO: 209556 - RNA, 23 nt, Human
cacugcaacuuccaucuccuggg

SEQ ID NO: 209557 - RNA, 22 nt, Human
cagacaaacaauguaacauucc

SEQ ID NO: 209558 - RNA, 25 nt, Human
cagagccccagauccgauuccgagg

SEQ ID NO: 209559 - RNA, 23 nt, Human
cauguugaccaggcugguuagga

SEQ ID NO: 209560 - RNA, 20 nt, Human
ccaaagaacauuuuuuuucc

SEQ ID NO: 209561 - RNA, 22 nt, Human
ccaaagugcugggauuacaggc

SEQ ID NO: 209562 - RNA, 22 nt, Human
ccaaagugcugggauuacaggc

SEQ ID NO: 209563 - RNA, 24 nt, Human
ccaaagugcugggauuacaggcgu

SEQ ID NO: 209564 - RNA, 21 nt, Human
ccaaguagcugggauuacagg

SEQ ID NO: 209565 - RNA, 26 nt, Human
ccacccgccucagccucccaaagugc

SEQ ID NO: 209566 - RNA, 22 nt, Human
cccaaguagcugggauuacagg

SEQ ID NO: 209567 - RNA, 23 nt, Human
cccaaguagcugggauuacaggu

SEQ ID NO: 209568 - RNA, 24 nt, Human
cccaaguagcugggauuacaggug

SEQ ID NO: 209569 - RNA, 23 nt, Human
cccaggcuggaguacaggggcau

SEQ ID NO: 209570 - RNA, 24 nt, Human
ccgccucagccucccaaagugcug

SEQ ID NO: 209571 - RNA, 23 nt, Human
ccuccgagacacuggaaggugaa

SEQ ID NO: 209572 - RNA, 22 nt, Human
ccugaccucaagugauccaccc

SEQ ID NO: 209573 - RNA, 23 nt, Human
ccugaccucaagugauccacccg

SEQ ID NO: 209574 - RNA, 20 nt, Human
ccuggguucaagcaauucuc

SEQ ID NO: 209575 - RNA, 24 nt, Human
cgggguuucaccauguugaccagg

SEQ ID NO: 209576 - RNA, 24 nt, Human
cucacugcaacuuccaucuccugg

SEQ ID NO: 209577 - RNA, 24 nt, Human
cucagccucccaaguagcugggau

SEQ ID NO: 209578 - RNA, 22 nt, Human
cucccugguuucucuuccuaag

SEQ ID NO: 209579 - RNA, 21 nt, Human
cuccuggguucaagcaauucu

SEQ ID NO: 209580 - RNA, 18 nt, Human
cugucacccaggcuggag

SEQ ID NO: 209581 - RNA, 23 nt, Human
cuugccucagccucccaaguagc

SEQ ID NO: 209582 - RNA, 24 nt, Human
cuugccucagccucccaaguagcu

SEQ ID NO: 209583 - RNA, 22 nt, Human
gaaaacagcucaacagcuagaa

SEQ ID NO: 209584 - RNA, 18 nt, Human
gaagccccaagcccagag

SEQ ID NO: 209585 - RNA, 21 nt, Human
gaagcuucuguuggcucccca

SEQ ID NO: 209586 - RNA, 24 nt, Human
gaccucaagugauccacccgccuc

SEQ ID NO: 209587 - RNA, 20 nt, Human
gagacgggguuucaccaugu

SEQ ID NO: 209588 - RNA, 18 nt, Human
gauuacaggcgugagcca

SEQ ID NO: 209589 - RNA, 22 nt, Human
gauuacaggcgugagccaccgc

SEQ ID NO: 209590 - RNA, 22 nt, Human
gauuacaggcgugagccaccgc

SEQ ID NO: 209591 - RNA, 18 nt, Human
gauuacaggugcgcgcca

SEQ ID NO: 209592 - RNA, 22 nt, Human
gcccggcuaauuuuuguauuuu

SEQ ID NO: 209593 - RNA, 23 nt, Human
gccucagccucccaaagugcugg

SEQ ID NO: 209594 - RNA, 25 nt, Human
gcucugucacccaggcuggaguaca

SEQ ID NO: 209595 - RNA, 22 nt, Human
gcuggaguacaggggcaugaua

SEQ ID NO: 209596 - RNA, 23 nt, Human
gcugguuaggaacuccugaccuc

SEQ ID NO: 209597 - RNA, 20 nt, Human
ggaaaacagcucaacagcua

SEQ ID NO: 209598 - RNA, 24 nt, Human
ggaagcuucuguuggcuccccaaa

SEQ ID NO: 209599 - RNA, 18 nt, Human
ggaaucccuccgagacac

SEQ ID NO: 209600 - RNA, 24 nt, Human
ggcugguuaggaacuccugaccuc

SEQ ID NO: 209601 - RNA, 24 nt, Human
gggcaugauaucagcucacugcaa

SEQ ID NO: 209602 - RNA, 23 nt, Human
gggguuucaccauguugaccagg

SEQ ID NO: 209603 - RNA, 23 nt, Human
guagagacgggguuucaccaugu

SEQ ID NO: 209604 - RNA, 18 nt, Human
guagcugggauuacaggu

SEQ ID NO: 209605 - RNA, 24 nt, Human
gugauccacccgccucagccuccc

SEQ ID NO: 209606 - RNA, 20 nt, Human
uaaaacacucaaauaccaua

SEQ ID NO: 209607 - RNA, 19 nt, Human
uaaauaacaagcuggccac

SEQ ID NO: 209608 - RNA, 24 nt, Human
uaauuuuuguauuuuuaguagaga

SEQ ID NO: 209609 - RNA, 23 nt, Human
uacaggcgugagccaccgcgccc

SEQ ID NO: 209610 - RNA, 19 nt, Human
uagaaagcguggucaggcu

SEQ ID NO: 209611 - RNA, 22 nt, Human
uagagacgggguuucaccaugu

SEQ ID NO: 209612 - RNA, 24 nt, Human
uaguagagacgggguuucaccaug

SEQ ID NO: 209613 - RNA, 26 nt, Human
uaguagagacgggguuucaccauguu

SEQ ID NO: 209614 - RNA, 25 nt, Human
ucaagaaugaagugguuggggaaug

SEQ ID NO: 209615 - RNA, 24 nt, Human
ucacugcaacuuccaucuccuggg

SEQ ID NO: 209616 - RNA, 20 nt, Human
ucagccucccaaguagcugg

SEQ ID NO: 209617 - RNA, 21 nt, Human
uccacccgccucagccuccca

SEQ ID NO: 209618 - RNA, 24 nt, Human
ucccaaagugcugggauuacaggc

SEQ ID NO: 209619 - RNA, 23 nt, Human
ucccaaguagcugggauuacagg

SEQ ID NO: 209620 - RNA, 24 nt, Human
ucccaaguagcugggauuacaggu

SEQ ID NO: 209621 - RNA, 19 nt, Human
ucccugguuucucuuccua

SEQ ID NO: 209622 - RNA, 21 nt, Human
uccuggguucaagcaauucuc

SEQ ID NO: 209623 - RNA, 24 nt, Human
uccuggguucaagcaauucucuug

SEQ ID NO: 209624 - RNA, 21 nt, Human
ucucaaggggcugggucagcu

SEQ ID NO: 209625 - RNA, 24 nt, Human
ucuccuggguucaagcaauucucu

SEQ ID NO: 209626 - RNA, 18 nt, Human
ucugucacccaggcugga

SEQ ID NO: 209627 - RNA, 24 nt, Human
ucugucacccaggcuggaguacag

SEQ ID NO: 209628 - RNA, 18 nt, Human
ucuguuggcuccccaaag

SEQ ID NO: 209629 - RNA, 26 nt, Human
ucuugccucagccucccaaguagcug

SEQ ID NO: 209630 - RNA, 23 nt, Human
ucuugcucugucacccaggcugg

SEQ ID NO: 209631 - RNA, 24 nt, Human
ucuugcucugucacccaggcugga

SEQ ID NO: 209632 - RNA, 24 nt, Human
ugaccaggcugguuaggaacuccu

SEQ ID NO: 209633 - RNA, 24 nt, Human
ugaccucaagugauccacccgccu

SEQ ID NO: 209634 - RNA, 18 nt, Human
ugagacagagucuugcuc

SEQ ID NO: 209635 - RNA, 22 nt, Human
ugagacagagucuugcucuguc

SEQ ID NO: 209636 - RNA, 24 nt, Human
ugcccggcuaauuuuuguauuuuu

SEQ ID NO: 209637 - RNA, 24 nt, Human
ugccucagccucccaaguagcugg

SEQ ID NO: 209638 - RNA, 22 nt, Human
ugcucugucacccaggcuggag

SEQ ID NO: 209639 - RNA, 24 nt, Human
ugcugggauuacaggcgugagcca

SEQ ID NO: 209640 - RNA, 18 nt, Human
uggaauggaagcuucugu

SEQ ID NO: 209641 - RNA, 18 nt, Human
ugggauuacaggcgugag

SEQ ID NO: 209642 - RNA, 19 nt, Human
ugggauuacaggcgugagc

SEQ ID NO: 209643 - RNA, 21 nt, Human
ugggauuacaggcgugagcca

SEQ ID NO: 209644 - RNA, 22 nt, Human
ugggauuacaggcgugagccac

SEQ ID NO: 209645 - RNA, 23 nt, Human
ugggauuacaggcgugagccacc

SEQ ID NO: 209646 - RNA, 24 nt, Human
ugggauuacaggcgugagccaccg

SEQ ID NO: 209647 - RNA, 18 nt, Human
ugggauuacaggugcgcg

SEQ ID NO: 209648 - RNA, 22 nt, Human
ugggauuacaggugcgcgccac

SEQ ID NO: 209649 - RNA, 24 nt, Human
ugggauuacaggugcgcgccacca

SEQ ID NO: 209650 - RNA, 25 nt, Human
ugggauuacaggugcgcgccaccau

SEQ ID NO: 209651 - RNA, 19 nt, Human
ugggcuucuuucuaaaucg

SEQ ID NO: 209652 - RNA, 23 nt, Human
uggguucaagcaauucucuugcc

SEQ ID NO: 209653 - RNA, 23 nt, Human
uggucaggcuuggaauggaagcu

SEQ ID NO: 209654 - RNA, 21 nt, Human
uguauuuuuaguagagacggg

SEQ ID NO: 209655 - RNA, 18 nt, Human
ugugucacccuauggaaa

SEQ ID NO: 209656 - RNA, 19 nt, Human
uuaaaacacucaaauacca

SEQ ID NO: 209657 - RNA, 20 nt, Human
uuagagggaggucagggaaa

SEQ ID NO: 209658 - RNA, 18 nt, Human
uuaguagagacgggguuu

SEQ ID NO: 209659 - RNA, 22 nt, Human
uuaguagagacgggguuucacc

SEQ ID NO: 209660 - RNA, 24 nt, Human
uuaguagagacgggguuucaccau

SEQ ID NO: 209661 - RNA, 19 nt, Human
uuauuuuuuugagacagag

SEQ ID NO: 209662 - RNA, 24 nt, Human
uugcucugucacccaggcuggagu

SEQ ID NO: 209663 - RNA, 24 nt, Human
uuucaccauguugaccaggcuggu

SEQ ID NO: 209664 - RNA, 24 nt, Human
uuuuuaguagagacgggguuucac

SEQ ID NO: 209665 - RNA, 20 nt, Human
uuuuuguauuuuuaguagag

SEQ ID NO: 209666 - RNA, 24 nt, Human
aaaaacauguaucacuuauugacc

SEQ ID NO: 209667 - RNA, 24 nt, Human
aaacacaagcacaggccuccaacc

SEQ ID NO: 209668 - RNA, 21 nt, Human
aaagugaggaugugaguggcu

SEQ ID NO: 209669 - RNA, 21 nt, Human
aaaugaccccagcagcaaggc

SEQ ID NO: 209670 - RNA, 23 nt, Human
aacccugaggaauccucccucaa

SEQ ID NO: 209671 - RNA, 18 nt, Human
aagcagccucucagcccg

SEQ ID NO: 209672 - RNA, 21 nt, Human
aagcagggaggucugggucug

SEQ ID NO: 209673 - RNA, 20 nt, Human
aagcccagaggccgcccaaa

SEQ ID NO: 209674 - RNA, 19 nt, Human
aagccccauccagggucuc

SEQ ID NO: 209675 - RNA, 23 nt, Human
aagcuuccugccccagaggcccg

SEQ ID NO: 209676 - RNA, 21 nt, Human
aaggcagggcugagaugacuc

SEQ ID NO: 209677 - RNA, 23 nt, Human
aaucacacagcugaacaccaaca

SEQ ID NO: 209678 - RNA, 21 nt, Human
acacagcugaacaccaacaac

SEQ ID NO: 209679 - RNA, 21 nt, Human
acagcugaacaccaacaaggc

SEQ ID NO: 209680 - RNA, 19 nt, Human
acauguaucacuuauugac

SEQ ID NO: 209681 - RNA, 18 nt, Human
accacaacuccagaaagc

SEQ ID NO: 209682 - RNA, 18 nt, Human
acccacauacccugcacu

SEQ ID NO: 209683 - RNA, 22 nt, Human
acuaguucagugaguuggccuc

SEQ ID NO: 209684 - RNA, 28 nt, Human
agaauucuuucacugugcaaugcugccu

SEQ ID NO: 209685 - RNA, 21 nt, Human
agacacccugaccagcccugc

SEQ ID NO: 209686 - RNA, 21 nt, Human
agagggaguucaguuaccaga

SEQ ID NO: 209687 - RNA, 22 nt, Human
agcaggcauggcuaaaaucaaa

SEQ ID NO: 209688 - RNA, 23 nt, Human
agccccaugguuccccugagcaa

SEQ ID NO: 209689 - RNA, 21 nt, Human
agcccugcagggccuggcugg

SEQ ID NO: 209690 - RNA, 20 nt, Human
agcugacuucagccuggugg

SEQ ID NO: 209691 - RNA, 24 nt, Human
agcugacuucagccugguggccuc

SEQ ID NO: 209692 - RNA, 23 nt, Human
aggaauccucccucaagccugcc

SEQ ID NO: 209693 - RNA, 24 nt, Human
aggaauccucccucaagccugccu

SEQ ID NO: 209694 - RNA, 24 nt, Human
aggcagaguccaaauggccuaugg

SEQ ID NO: 209695 - RNA, 20 nt, Human
aggcagggcugagaugacuc

SEQ ID NO: 209696 - RNA, 22 nt, Human
aggccuccaacccugacccucu

SEQ ID NO: 209697 - RNA, 21 nt, Human
agggaccccagcccagugccc

SEQ ID NO: 209698 - RNA, 19 nt, Human
aggucauaccacuggaaac

SEQ ID NO: 209699 - RNA, 22 nt, Human
aguacuuuggcagagggguggg

SEQ ID NO: 209700 - RNA, 22 nt, Human
auaccacuggaaacagcaaagu

SEQ ID NO: 209701 - RNA, 24 nt, Human
auggcacgcacaggccuguccccu

SEQ ID NO: 209702 - RNA, 22 nt, Human
auguaucacuuauugacagagc

SEQ ID NO: 209703 - RNA, 21 nt, Human
caaaagcagccucucagcccg

SEQ ID NO: 209704 - RNA, 20 nt, Human
caacagaacaggucagugcc

SEQ ID NO: 209705 - RNA, 19 nt, Human
caagcccagaggccgccca

SEQ ID NO: 209706 - RNA, 18 nt, Human
caaggcagggaccccagc

SEQ ID NO: 209707 - RNA, 19 nt, Human
cacaacuccagaaagcccc

SEQ ID NO: 209708 - RNA, 19 nt, Human
cacacagcugaacaccaac

SEQ ID NO: 209709 - RNA, 22 nt, Human
cacagcugaacaccaacaaggc

SEQ ID NO: 209710 - RNA, 20 nt, Human
caccacaacuccagaaagcc

SEQ ID NO: 209711 - RNA, 18 nt, Human
cacuggaaacagcaaagu

SEQ ID NO: 209712 - RNA, 19 nt, Human
cagggccuggcuggggcca

SEQ ID NO: 209713 - RNA, 20 nt, Human
cauuggaucuguuagccucu

SEQ ID NO: 209714 - RNA, 21 nt, Human
ccacuggaaacagcaaaguca

SEQ ID NO: 209715 - RNA, 18 nt, Human
ccagagaaaggcagggcu

SEQ ID NO: 209716 - RNA, 23 nt, Human
ccaguggcuuauccucugggucu

SEQ ID NO: 209717 - RNA, 18 nt, Human
ccauggacucccauugga

SEQ ID NO: 209718 - RNA, 23 nt, Human
ccccagacacccugaccagcccu

SEQ ID NO: 209719 - RNA, 26 nt, Human
ccccagacacccugaccagcccugca

SEQ ID NO: 209720 - RNA, 21 nt, Human
ccccaggggcccuccuccugg

SEQ ID NO: 209721 - RNA, 18 nt, Human
ccggagcggagccggccu

SEQ ID NO: 209722 - RNA, 22 nt, Human
ccuaacuucugccccaggggcc

SEQ ID NO: 209723 - RNA, 22 nt, Human
ccucgugccuaacuucugcccc

SEQ ID NO: 209724 - RNA, 20 nt, Human
ccucuggggcuggcaugagc

SEQ ID NO: 209725 - RNA, 19 nt, Human
ccugcagggccuggcuggg

SEQ ID NO: 209726 - RNA, 20 nt, Human
ccugcagggccuggcugggg

SEQ ID NO: 209727 - RNA, 18 nt, Human
ccugccccagacacccug

SEQ ID NO: 209728 - RNA, 19 nt, Human
ccugccccagacacccuga

SEQ ID NO: 209729 - RNA, 23 nt, Human
ccuuuuuccccuaaaaaugaccc

SEQ ID NO: 209730 - RNA, 27 nt, Human
cuccaacccugacccucuggggcuggc

SEQ ID NO: 209731 - RNA, 21 nt, Human
cuccagagaaaggcagggcug

SEQ ID NO: 209732 - RNA, 30 nt, Human
cucccaggaccagcuuggcuaauacccagg

SEQ ID NO: 209733 - RNA, 20 nt, Human
cucccucaagccugccucca

SEQ ID NO: 209734 - RNA, 23 nt, Human
cuccugcuggaagcucugaugcu

SEQ ID NO: 209735 - RNA, 25 nt, Human
cugaacaccaacaaggcagggaccc

SEQ ID NO: 209736 - RNA, 19 nt, Human
cugaagcuuccauuccuac

SEQ ID NO: 209737 - RNA, 20 nt, Human
cugaagcuuccauuccuaca

SEQ ID NO: 209738 - RNA, 19 nt, Human
cugacccucuggggcuggc

SEQ ID NO: 209739 - RNA, 19 nt, Human
cugguccaggcagaggagc

SEQ ID NO: 209740 - RNA, 22 nt, Human
gaaacagcaaagucagagcuag

SEQ ID NO: 209741 - RNA, 19 nt, Human
gagagagggagauauuugc

SEQ ID NO: 209742 - RNA, 24 nt, Human
gagcaggcauggcuaaaaucaaaa

SEQ ID NO: 209743 - RNA, 22 nt, Human
gaguacuuuggcagaggggugg

SEQ ID NO: 209744 - RNA, 21 nt, Human
gaguuggccuccuccugcccc

SEQ ID NO: 209745 - RNA, 19 nt, Human
gcagcaaacacaagcacag

SEQ ID NO: 209746 - RNA, 20 nt, Human
gcccagugcccaguggcuua

SEQ ID NO: 209747 - RNA, 24 nt, Human
gccccagacacccugaccagcccu

SEQ ID NO: 209748 - RNA, 19 nt, Human
gcccugaagcuuccauucc

SEQ ID NO: 209749 - RNA, 22 nt, Human
gcccugaagcuuccauuccuac

SEQ ID NO: 209750 - RNA, 23 nt, Human
gcccugcagggccuggcuggggc

SEQ ID NO: 209751 - RNA, 18 nt, Human
gccuauggggaggcaggg

SEQ ID NO: 209752 - RNA, 21 nt, Human
gcuggggccagccccagugga

SEQ ID NO: 209753 - RNA, 19 nt, Human
ggaccccagcccagugccc

SEQ ID NO: 209754 - RNA, 20 nt, Human
ggacuugcagaaaagugccc

SEQ ID NO: 209755 - RNA, 21 nt, Human
ggaggcagggcccauaaugcc

SEQ ID NO: 209756 - RNA, 21 nt, Human
ggauggguucugagcuggaag

SEQ ID NO: 209757 - RNA, 21 nt, Human
ggcagggcccauaaugccccc

SEQ ID NO: 209758 - RNA, 22 nt, Human
ggccggagcggagccggccugc

SEQ ID NO: 209759 - RNA, 18 nt, Human
gggauggguucugagcug

SEQ ID NO: 209760 - RNA, 23 nt, Human
gggccggagcggagccggccugc

SEQ ID NO: 209761 - RNA, 18 nt, Human
ggggugggggucauggcu

SEQ ID NO: 209762 - RNA, 22 nt, Human
guacuuuggcagaggggugggg

SEQ ID NO: 209763 - RNA, 20 nt, Human
gugcaaugcugccucuccaa

SEQ ID NO: 209764 - RNA, 24 nt, Human
gugccuaacuucugccccaggggc

SEQ ID NO: 209765 - RNA, 23 nt, Human
uaaauaaagcuuucaagggaacc

SEQ ID NO: 209766 - RNA, 23 nt, Human
uaacuucugccccaggggcccuc

SEQ ID NO: 209767 - RNA, 24 nt, Human
uaagaaacaagccagcuugguagu

SEQ ID NO: 209768 - RNA, 25 nt, Human
uaagaaacaagccagcuugguaguc

SEQ ID NO: 209769 - RNA, 24 nt, Human
uaagaucuuccagugacaagcuuc

SEQ ID NO: 209770 - RNA, 20 nt, Human
uaccacuggaaacagcaaag

SEQ ID NO: 209771 - RNA, 23 nt, Human
uacuuuggcagaggggugggggu

SEQ ID NO: 209772 - RNA, 26 nt, Human
uagcagcaaacacaagcacaggccuc

SEQ ID NO: 209773 - RNA, 20 nt, Human
uagcuggacauuagcagcaa

SEQ ID NO: 209774 - RNA, 18 nt, Human
uaggagggagaagguccc

SEQ ID NO: 209775 - RNA, 19 nt, Human
uaugauacaggaaagaguu

SEQ ID NO: 209776 - RNA, 18 nt, Human
uauuucacagaugggaga

SEQ ID NO: 209777 - RNA, 20 nt, Human
ucaaaagcagccucucagcu

SEQ ID NO: 209778 - RNA, 22 nt, Human
ucacagaugggagauugaggcc

SEQ ID NO: 209779 - RNA, 20 nt, Human
ucacugugcaaugcugccuc

SEQ ID NO: 209780 - RNA, 23 nt, Human
uccagaaaauauauaccuuaaga

SEQ ID NO: 209781 - RNA, 19 nt, Human
ucccaggaccagcuuggcu

SEQ ID NO: 209782 - RNA, 23 nt, Human
uccccaugugaccaucauauccu

SEQ ID NO: 209783 - RNA, 22 nt, Human
uccccuaaaaaugaccccagca

SEQ ID NO: 209784 - RNA, 25 nt, Human
uccccuaaaaaugaccccagcagca

SEQ ID NO: 209785 - RNA, 21 nt, Human
ucccucaagccugccuccaga

SEQ ID NO: 209786 - RNA, 22 nt, Human
ucccuuugucuccccucaguga

SEQ ID NO: 209787 - RNA, 21 nt, Human
uccuaggagggagaagguccc

SEQ ID NO: 209788 - RNA, 19 nt, Human
uccuuuuuccccuaaaaau

SEQ ID NO: 209789 - RNA, 21 nt, Human
ucuggcauaagaaacaagcca

SEQ ID NO: 209790 - RNA, 25 nt, Human
ucuuccagugacaagcuuccugccc

SEQ ID NO: 209791 - RNA, 18 nt, Human
ugacaccauggacuccca

SEQ ID NO: 209792 - RNA, 23 nt, Human
ugacuucagccugguggccccaa

SEQ ID NO: 209793 - RNA, 19 nt, Human
ugagcuggaagccccaucc

SEQ ID NO: 209794 - RNA, 19 nt, Human
ugaggaaacugaggcucca

SEQ ID NO: 209795 - RNA, 24 nt, Human
ugaggaaacugaggcuccaagagg

SEQ ID NO: 209796 - RNA, 19 nt, Human
ugcaaugcugccucuccaa

SEQ ID NO: 209797 - RNA, 21 nt, Human
ugcccagacugccucgugccu

SEQ ID NO: 209798 - RNA, 19 nt, Human
ugccccagacacccugacc

SEQ ID NO: 209799 - RNA, 21 nt, Human
ugccccagacacccugaccag

SEQ ID NO: 209800 - RNA, 22 nt, Human
ugccccagacacccugaccagc

SEQ ID NO: 209801 - RNA, 24 nt, Human
ugccccagggggaugcuacuccau

SEQ ID NO: 209802 - RNA, 26 nt, Human
ugccccagggggaugcuacuccauuu

SEQ ID NO: 209803 - RNA, 19 nt, Human
uggacugaacugccuuugu

SEQ ID NO: 209804 - RNA, 20 nt, Human
uggcagagggguggggguca

SEQ ID NO: 209805 - RNA, 22 nt, Human
uggcaugagcuggugcccaagc

SEQ ID NO: 209806 - RNA, 22 nt, Human
uggguucugagcuggaagcccc

SEQ ID NO: 209807 - RNA, 24 nt, Human
ugguggggcagcaaagugaggaug

SEQ ID NO: 209808 - RNA, 23 nt, Human
uguaucacuuauugacagagcuu

SEQ ID NO: 209809 - RNA, 23 nt, Human
uucacagaugggagauugaggcc

SEQ ID NO: 209810 - RNA, 18 nt, Human
uucacugugcaaugcugc

SEQ ID NO: 209811 - RNA, 25 nt, Human
uuccucagcagaaccucacaucccu

SEQ ID NO: 209812 - RNA, 24 nt, Human
uuggcaugacaccauggacuccca

SEQ ID NO: 209813 - RNA, 19 nt, Human
uuggccuccuccugcccca

SEQ ID NO: 209814 - RNA, 20 nt, Human
aaaaaacaaacaaacggccc

SEQ ID NO: 209815 - RNA, 19 nt, Human
aaaacaaacaaacggcccu

SEQ ID NO: 209816 - RNA, 20 nt, Human
aaaagucacccacaauccca

SEQ ID NO: 209817 - RNA, 24 nt, Human
aaagaaaaacacaaaauugggauc

SEQ ID NO: 209818 - RNA, 24 nt, Human
aaagugccaggauuacaggcguga

SEQ ID NO: 209819 - RNA, 20 nt, Human
aacagagcgagacuccaucu

SEQ ID NO: 209820 - RNA, 20 nt, Human
aacauggugaaacccugucu

SEQ ID NO: 209821 - RNA, 21 nt, Human
aacauggugaaacccugucuc

SEQ ID NO: 209822 - RNA, 23 nt, Human
aagagccagggcagaagucugug

SEQ ID NO: 209823 - RNA, 23 nt, Human
aagcauccagccccagcucucag

SEQ ID NO: 209824 - RNA, 20 nt, Human
aagucacccacaaucccacc

SEQ ID NO: 209825 - RNA, 26 nt, Human
aagugccaggauuacaggcgugagcc

SEQ ID NO: 209826 - RNA, 20 nt, Human
aaucccaccucucuccuuug

SEQ ID NO: 209827 - RNA, 24 nt, Human
aauugcuugaacccgggaggugga

SEQ ID NO: 209828 - RNA, 24 nt, Human
acagagcgagacuccaucucaaaa

SEQ ID NO: 209829 - RNA, 19 nt, Human
acaggguuuugccaugucu

SEQ ID NO: 209830 - RNA, 23 nt, Human
acaggguuuugccaugucucgca

SEQ ID NO: 209831 - RNA, 24 nt, Human
acaggguuuugccaugucucgcag

SEQ ID NO: 209832 - RNA, 19 nt, Human
accccaguccccuccuccu

SEQ ID NO: 209833 - RNA, 24 nt, Human
acccugucucuacuaaaaauacaa

SEQ ID NO: 209834 - RNA, 25 nt, Human
acucgcuucguccucccaaagugcc

SEQ ID NO: 209835 - RNA, 24 nt, Human
acugcacuccagccuaggcaacag

SEQ ID NO: 209836 - RNA, 24 nt, Human
acugcacuccagccuaggcaacag

SEQ ID NO: 209837 - RNA, 23 nt, Human
agaaagaaaaacacaaaauuggg

SEQ ID NO: 209838 - RNA, 22 nt, Human
agaauugcuugaacccgggagg

SEQ ID NO: 209839 - RNA, 18 nt, Human
agacaggguuuugccaug

SEQ ID NO: 209840 - RNA, 22 nt, Human
agacaggguuuugccaugucuc

SEQ ID NO: 209841 - RNA, 24 nt, Human
agcacuuugggaggccgaggcagg

SEQ ID NO: 209842 - RNA, 24 nt, Human
agccuaggcaacagagcgagacuc

SEQ ID NO: 209843 - RNA, 22 nt, Human
agccuggccaacauggugaaac

SEQ ID NO: 209844 - RNA, 24 nt, Human
agccuggccaacauggugaaaccc

SEQ ID NO: 209845 - RNA, 24 nt, Human
aggaucaccugaggucaggaguuc

SEQ ID NO: 209846 - RNA, 23 nt, Human
aggauuacaggcgugagccacca

SEQ ID NO: 209847 - RNA, 24 nt, Human
aggcaggagaauugcuugaacccg

SEQ ID NO: 209848 - RNA, 18 nt, Human
aggcaggaggaucaccug

SEQ ID NO: 209849 - RNA, 18 nt, Human
aggcaggaggaucaccug

SEQ ID NO: 209850 - RNA, 22 nt, Human
aggcaggaggaucaccugaggu

SEQ ID NO: 209851 - RNA, 24 nt, Human
aggccgaggcaggaggaucaccug

SEQ ID NO: 209852 - RNA, 21 nt, Human
aggcugaggcaggagaauugc

SEQ ID NO: 209853 - RNA, 24 nt, Human
aggcugaggcaggagaauugcuug

SEQ ID NO: 209854 - RNA, 21 nt, Human
agggggagauaauggcggggg

SEQ ID NO: 209855 - RNA, 19 nt, Human
agguggagcuugcagugac

SEQ ID NO: 209856 - RNA, 25 nt, Human
agguggagcuugcagugacaacggu

SEQ ID NO: 209857 - RNA, 24 nt, Human
aggugugguggcucacaccuguaa

SEQ ID NO: 209858 - RNA, 20 nt, Human
auaaggcacagauguccccc

SEQ ID NO: 209859 - RNA, 20 nt, Human
aucauacacauuaaaaguca

SEQ ID NO: 209860 - RNA, 22 nt, Human
augggucaggugugguggcuca

SEQ ID NO: 209861 - RNA, 24 nt, Human
augggucaggugugguggcucaca

SEQ ID NO: 209862 - RNA, 20 nt, Human
auugccucacugcacuccag

SEQ ID NO: 209863 - RNA, 18 nt, Human
auuuuggcguauuucccu

SEQ ID NO: 209864 - RNA, 18 nt, Human
caaaaacccaggcuuccc

SEQ ID NO: 209865 - RNA, 22 nt, Human
caaaaacccaggcuucccuuuc

SEQ ID NO: 209866 - RNA, 27 nt, Human
caaaagaaauaaauaauuagcugggca

SEQ ID NO: 209867 - RNA, 24 nt, Human
caaagugccaggauuacaggcgug

SEQ ID NO: 209868 - RNA, 24 nt, Human
caacauggugaaacccugucucua

SEQ ID NO: 209869 - RNA, 24 nt, Human
caagaauccgggaccccagucccc

SEQ ID NO: 209870 - RNA, 24 nt, Human
cacaccuguaaucccagcacuuug

SEQ ID NO: 209871 - RNA, 19 nt, Human
cacaccugugaucccagcu

SEQ ID NO: 209872 - RNA, 22 nt, Human
caccaugccuggccaaugucag

SEQ ID NO: 209873 - RNA, 24 nt, Human
caccucucuccuuugaccuggaga

SEQ ID NO: 209874 - RNA, 19 nt, Human
caccugccucccaccccug

SEQ ID NO: 209875 - RNA, 20 nt, Human
caccugccucccaccccugc

SEQ ID NO: 209876 - RNA, 23 nt, Human
caccuguaaucccagcacuuugg

SEQ ID NO: 209877 - RNA, 24 nt, Human
caccuguaaucccagcacuuuggg

SEQ ID NO: 209878 - RNA, 21 nt, Human
caccugugaucccagcuaauc

SEQ ID NO: 209879 - RNA, 24 nt, Human
caccugugaucccagcuaaucggg

SEQ ID NO: 209880 - RNA, 23 nt, Human
cacuccagccuaggcaacagagc

SEQ ID NO: 209881 - RNA, 18 nt, Human
cacucgggaccuccaccu

SEQ ID NO: 209882 - RNA, 19 nt, Human
cacugcacuccagccuagg

SEQ ID NO: 209883 - RNA, 20 nt, Human
cacugcacuccagccuaggc

SEQ ID NO: 209884 - RNA, 21 nt, Human
cacugcacuccagccuaggca

SEQ ID NO: 209885 - RNA, 22 nt, Human
cacugcacuccagccuaggcaa

SEQ ID NO: 209886 - RNA, 23 nt, Human
cacugcacuccagccuaggcaac

SEQ ID NO: 209887 - RNA, 24 nt, Human
cacugcacuccagccuaggcaaca

SEQ ID NO: 209888 - RNA, 19 nt, Human
cagaagucuguggacagac

SEQ ID NO: 209889 - RNA, 24 nt, Human
cagcacuuugggaggccgaggcag

SEQ ID NO: 209890 - RNA, 25 nt, Human
cagcacuuugggaggccgaggcagg

SEQ ID NO: 209891 - RNA, 24 nt, Human
cagcuaaucgggaggcugaggcag

SEQ ID NO: 209892 - RNA, 18 nt, Human
caggacaucauucuuucu

SEQ ID NO: 209893 - RNA, 24 nt, Human
caggaggaucaccugaggucagga

SEQ ID NO: 209894 - RNA, 24 nt, Human
caggauuacaggcgugagccacca

SEQ ID NO: 209895 - RNA, 19 nt, Human
caggcuucccuuuccccuc

SEQ ID NO: 209896 - RNA, 24 nt, Human
caggguuuugccaugucucgcagg

SEQ ID NO: 209897 - RNA, 20 nt, Human
caucucaaaaaacaaacaaa

SEQ ID NO: 209898 - RNA, 20 nt, Human
ccaaagugccaggauuacag

SEQ ID NO: 209899 - RNA, 22 nt, Human
ccaaagugccaggauuacaggc

SEQ ID NO: 209900 - RNA, 24 nt, Human
ccaaagugccaggauuacaggcgu

SEQ ID NO: 209901 - RNA, 21 nt, Human
ccaccaugccuggccaauguc

SEQ ID NO: 209902 - RNA, 19 nt, Human
ccaccucucuccuuugacc

SEQ ID NO: 209903 - RNA, 18 nt, Human
ccaccugcccugccccag

SEQ ID NO: 209904 - RNA, 21 nt, Human
ccaggaguccaccugccuccc

SEQ ID NO: 209905 - RNA, 18 nt, Human
cccaagcauccagcccca

SEQ ID NO: 209906 - RNA, 18 nt, Human
cccaccccaacaugaaaa

SEQ ID NO: 209907 - RNA, 23 nt, Human
cccaccccugcuccugaaauaaa

SEQ ID NO: 209908 - RNA, 19 nt, Human
ccccagggcagggggcagg

SEQ ID NO: 209909 - RNA, 18 nt, Human
ccccuccaccugcccugc

SEQ ID NO: 209910 - RNA, 24 nt, Human
cccgcccacucgggaccuccaccu

SEQ ID NO: 209911 - RNA, 20 nt, Human
cccuccguccccaccccaac

SEQ ID NO: 209912 - RNA, 18 nt, Human
cccugcuccgggcggcug

SEQ ID NO: 209913 - RNA, 24 nt, Human
ccucacugcacuccagccuaggca

SEQ ID NO: 209914 - RNA, 20 nt, Human
ccugaaugacagucccugcu

SEQ ID NO: 209915 - RNA, 22 nt, Human
ccugaggucaggaguucgaaac

SEQ ID NO: 209916 - RNA, 22 nt, Human
ccuggccaacauggugaaaccc

SEQ ID NO: 209917 - RNA, 24 nt, Human
ccuggccaacauggugaaacccug

SEQ ID NO: 209918 - RNA, 21 nt, Human
ccugugaucccagcuaaucgg

SEQ ID NO: 209919 - RNA, 24 nt, Human
cgaaaccagccuggccaacauggu

SEQ ID NO: 209920 - RNA, 20 nt, Human
cgaggcaggaggaucaccug

SEQ ID NO: 209921 - RNA, 25 nt, Human
cgaggcaggaggaucaccugagguc

SEQ ID NO: 209922 - RNA, 26 nt, Human
cgaggcaggaggaucaccugagguca

SEQ ID NO: 209923 - RNA, 19 nt, Human
cggcccuaugcagugcggg

SEQ ID NO: 209924 - RNA, 23 nt, Human
cucaaacucuuggacuucaguga

SEQ ID NO: 209925 - RNA, 22 nt, Human
cucacaccuguaaucccagcac

SEQ ID NO: 209926 - RNA, 24 nt, Human
cucacaccuguaaucccagcacuu

SEQ ID NO: 209927 - RNA, 18 nt, Human
cuccaccugcccugcccc

SEQ ID NO: 209928 - RNA, 22 nt, Human
cuccaucucaaaaaacaaacaa

SEQ ID NO: 209929 - RNA, 24 nt, Human
cuggccaacauggugaaacccugu

SEQ ID NO: 209930 - RNA, 19 nt, Human
gaaacccugucucuacuaa

SEQ ID NO: 209931 - RNA, 26 nt, Human
gaacacagccauaaugaaccaucuug

SEQ ID NO: 209932 - RNA, 20 nt, Human
gagacaggguuuugccaugu

SEQ ID NO: 209933 - RNA, 23 nt, Human
gagcuugcagugaccuuagauug

SEQ ID NO: 209934 - RNA, 21 nt, Human
gaucaccugaggucaggaguu

SEQ ID NO: 209935 - RNA, 24 nt, Human
gaucaccugaggucaggaguucga

SEQ ID NO: 209936 - RNA, 18 nt, Human
gaucccagcuaaucggga

SEQ ID NO: 209937 - RNA, 18 nt, Human
gauuacaggcgugagcca

SEQ ID NO: 209938 - RNA, 21 nt, Human
gauuacaggcgugagccacca

SEQ ID NO: 209939 - RNA, 22 nt, Human
gauuacaggcgugagccaccau

SEQ ID NO: 209940 - RNA, 24 nt, Human
gcacuccagccuaggcaacagagc

SEQ ID NO: 209941 - RNA, 24 nt, Human
gccaacauggugaaacccugucuc

SEQ ID NO: 209942 - RNA, 23 nt, Human
gcccacucgggaccuccaccuga

SEQ ID NO: 209943 - RNA, 21 nt, Human
gccccaggcaaggcucagacc

SEQ ID NO: 209944 - RNA, 24 nt, Human
ggacuucagugauccacucgcuuc

SEQ ID NO: 209945 - RNA, 24 nt, Human
ggagcuugcagugaccuuagauug

SEQ ID NO: 209946 - RNA, 18 nt, Human
ggaggucuccccuccacc

SEQ ID NO: 209947 - RNA, 23 nt, Human
ggaucaccugaggucaggaguuc

SEQ ID NO: 209948 - RNA, 22 nt, Human
ggauuacaggcgugagccacca

SEQ ID NO: 209949 - RNA, 24 nt, Human
ggauuacaggcgugagccaccaug

SEQ ID NO: 209950 - RNA, 23 nt, Human
ggcagggggcagggagccggggg

SEQ ID NO: 209951 - RNA, 21 nt, Human
ggcucacaccuguaaucccag

SEQ ID NO: 209952 - RNA, 19 nt, Human
gggcagggagccgggggcc

SEQ ID NO: 209953 - RNA, 24 nt, Human
gggcaugguggugcacaccuguga

SEQ ID NO: 209954 - RNA, 20 nt, Human
ggggaagagccagggcagaa

SEQ ID NO: 209955 - RNA, 20 nt, Human
gggugguguucuauccacag

SEQ ID NO: 209956 - RNA, 24 nt, Human
gguggugcacaccugugaucccag

SEQ ID NO: 209957 - RNA, 23 nt, Human
ggugguguucuauccacagaugc

SEQ ID NO: 209958 - RNA, 23 nt, Human
guccaccugccucccaccccugc

SEQ ID NO: 209959 - RNA, 24 nt, Human
gugauccacucgcuucguccuccc

SEQ ID NO: 209960 - RNA, 23 nt, Human
guggcucacaccuguaaucccag

SEQ ID NO: 209961 - RNA, 18 nt, Human
gugugguggcucacaccu

SEQ ID NO: 209962 - RNA, 18 nt, Human
guugcuuaacccucacug

SEQ ID NO: 209963 - RNA, 22 nt, Human
uacacagucauggcagaaauuc

SEQ ID NO: 209964 - RNA, 22 nt, Human
uacaggcgugagccaccaugcc

SEQ ID NO: 209965 - RNA, 23 nt, Human
uacaggcgugagccaccaugccu

SEQ ID NO: 209966 - RNA, 23 nt, Human
uacggguacuguugaucacaggg

SEQ ID NO: 209967 - RNA, 19 nt, Human
uagaaagaaaaacacaaaa

SEQ ID NO: 209968 - RNA, 23 nt, Human
uauauagaaagaaaaacacaaaa

SEQ ID NO: 209969 - RNA, 21 nt, Human
ucaaguggauauguaugacac

SEQ ID NO: 209970 - RNA, 23 nt, Human
ucacggaaggacugucucuaacu

SEQ ID NO: 209971 - RNA, 19 nt, Human
ucacugcacuccagccuag

SEQ ID NO: 209972 - RNA, 21 nt, Human
ucacugcacuccagccuaggc

SEQ ID NO: 209973 - RNA, 24 nt, Human
ucacugcacuccagccuaggcaac

SEQ ID NO: 209974 - RNA, 18 nt, Human
ucacuguuggauaucuag

SEQ ID NO: 209975 - RNA, 26 nt, Human
ucagugauccacucgcuucguccucc

SEQ ID NO: 209976 - RNA, 21 nt, Human
uccagccccagcucucagaca

SEQ ID NO: 209977 - RNA, 23 nt, Human
uccagccuaggcaacagagcgag

SEQ ID NO: 209978 - RNA, 22 nt, Human
uccauauauagaaagaaaaaca

SEQ ID NO: 209979 - RNA, 24 nt, Human
ucccaaagugccaggauuacaggc

SEQ ID NO: 209980 - RNA, 18 nt, Human
uccccacagggccagggg

SEQ ID NO: 209981 - RNA, 22 nt, Human
uccccuccguccccaccccaac

SEQ ID NO: 209982 - RNA, 20 nt, Human
ucccugaaugacagucccug

SEQ ID NO: 209983 - RNA, 18 nt, Human
ucgcugccccgcccacuc

SEQ ID NO: 209984 - RNA, 23 nt, Human
ucgggaggcugaggcaggagaau

SEQ ID NO: 209985 - RNA, 18 nt, Human
ucucccagucgcugcccc

SEQ ID NO: 209986 - RNA, 23 nt, Human
ucucuacuaaaaauacaaaagaa

SEQ ID NO: 209987 - RNA, 25 nt, Human
ucuuuccaguuugcuauggugaaca

SEQ ID NO: 209988 - RNA, 19 nt, Human
ugacuuguggaaccuucca

SEQ ID NO: 209989 - RNA, 24 nt, Human
ugaggcaggagaauugcuugaacc

SEQ ID NO: 209990 - RNA, 25 nt, Human
ugaggcaggagaauugcuugaaccc

SEQ ID NO: 209991 - RNA, 23 nt, Human
ugaggucaggaguucgaaaccag

SEQ ID NO: 209992 - RNA, 24 nt, Human
ugcagugguuuuguagccugcugu

SEQ ID NO: 209993 - RNA, 24 nt, Human
ugccaggauuacaggcgugagcca

SEQ ID NO: 209994 - RNA, 22 nt, Human
ugcccaggccuagauggggaag

SEQ ID NO: 209995 - RNA, 25 nt, Human
ugccccaguuacccaagcauccagc

SEQ ID NO: 209996 - RNA, 19 nt, Human
ugccucacugcacuccagc

SEQ ID NO: 209997 - RNA, 26 nt, Human
ugccucacugcacuccagccuaggca

SEQ ID NO: 209998 - RNA, 18 nt, Human
ugccucccaccccugcuc

SEQ ID NO: 209999 - RNA, 20 nt, Human
uggagacccaagaauccggg

SEQ ID NO: 210000 - RNA, 24 nt, Human
uggccaacauggugaaacccuguc

SEQ ID NO: 210001 - RNA, 21 nt, Human
uggcucacaccuguaauccca

SEQ ID NO: 210002 - RNA, 22 nt, Human
uggcucacaccuguaaucccag

SEQ ID NO: 210003 - RNA, 24 nt, Human
uggcucacaccuguaaucccagca

SEQ ID NO: 210004 - RNA, 20 nt, Human
ugggaggccgaggcaggagg

SEQ ID NO: 210005 - RNA, 24 nt, Human
ugggaggccgaggcaggaggauca

SEQ ID NO: 210006 - RNA, 21 nt, Human
ugggucaggugugguggcuca

SEQ ID NO: 210007 - RNA, 22 nt, Human
uggugcacaccugugaucccag

SEQ ID NO: 210008 - RNA, 24 nt, Human
ugguggcucacaccuguaauccca

SEQ ID NO: 210009 - RNA, 24 nt, Human
ugguggugcacaccugugauccca

SEQ ID NO: 210010 - RNA, 19 nt, Human
uguacaaaaacccaggcuu

SEQ ID NO: 210011 - RNA, 21 nt, Human
uguacaaaaacccaggcuucc

SEQ ID NO: 210012 - RNA, 20 nt, Human
uguggacagacuucuuggag

SEQ ID NO: 210013 - RNA, 18 nt, Human
uguuccugcccaggccua

SEQ ID NO: 210014 - RNA, 20 nt, Human
uuagcugggcaugguggugc

SEQ ID NO: 210015 - RNA, 19 nt, Human
uucagugauccacucgcuu

SEQ ID NO: 210016 - RNA, 22 nt, Human
uugagacaggguuuugccaugu

SEQ ID NO: 210017 - RNA, 18 nt, Human
uugcuugaacccgggagg

SEQ ID NO: 210018 - RNA, 23 nt, Human
uugcuugaacccgggagguggag

SEQ ID NO: 210019 - RNA, 24 nt, Human
uuggauaucuagauucuuuccagu

SEQ ID NO: 210020 - RNA, 25 nt, Human
uugggaggccgaggcaggaggauca

SEQ ID NO: 210021 - RNA, 22 nt, Human
uuucuuuuuugagacaggguuu

SEQ ID NO: 210022 - RNA, 22 nt, Human
uuuugagacaggguuuugccau

SEQ ID NO: 210023 - RNA, 24 nt, Human
uuuuuugagacaggguuuugccau

SEQ ID NO: 210024 - RNA, 19 nt, Human
aaucugccgaagcccuccu

SEQ ID NO: 210025 - RNA, 30 nt, Human
acacagauguacacauuacacacguuccuu

SEQ ID NO: 210026 - RNA, 18 nt, Human
acaccagcaagacagaau

SEQ ID NO: 210027 - RNA, 28 nt, Human
acagauguacacauuacacacguuccuu

SEQ ID NO: 210028 - RNA, 24 nt, Human
aggccaagagccaaggacccacag

SEQ ID NO: 210029 - RNA, 18 nt, Human
caccagcaagacagaauu

SEQ ID NO: 210030 - RNA, 27 nt, Human
caccuacauacaugcaugcagagaaua

SEQ ID NO: 210031 - RNA, 20 nt, Human
cagagguacaagcaccuuuc

SEQ ID NO: 210032 - RNA, 18 nt, Human
cagaguguccauagccuc

SEQ ID NO: 210033 - RNA, 18 nt, Human
cagcagcagaguguccau

SEQ ID NO: 210034 - RNA, 21 nt, Human
ccaaacagaacuuccagcuga

SEQ ID NO: 210035 - RNA, 18 nt, Human
ccaacucuggggugaaau

SEQ ID NO: 210036 - RNA, 19 nt, Human
ccacacacacuccccaggc

SEQ ID NO: 210037 - RNA, 21 nt, Human
cccacacacacuccccaggca

SEQ ID NO: 210038 - RNA, 24 nt, Human
cccagcagcagaguguccauagcc

SEQ ID NO: 210039 - RNA, 26 nt, Human
cccaggcaccuacauacaugcaugca

SEQ ID NO: 210040 - RNA, 19 nt, Human
cgagguuuuuuuuuuuuuu

SEQ ID NO: 210041 - RNA, 21 nt, Human
cgagguuuuuuuuuuuuuuuu

SEQ ID NO: 210042 - RNA, 19 nt, Human
cucacagacacauggucac

SEQ ID NO: 210043 - RNA, 21 nt, Human
cugccgaagcccuccuggguc

SEQ ID NO: 210044 - RNA, 22 nt, Human
cugccugguuucuauccacacc

SEQ ID NO: 210045 - RNA, 24 nt, Human
gaacuccaacucuggggugaaauc

SEQ ID NO: 210046 - RNA, 18 nt, Human
gccaagagccaaggaccc

SEQ ID NO: 210047 - RNA, 21 nt, Human
ggugaaaucagagguacaagc

SEQ ID NO: 210048 - RNA, 22 nt, Human
guacaagcaccuuucagcugca

SEQ ID NO: 210049 - RNA, 27 nt, Human
uacauacaugcaugcagagaauacaug

SEQ ID NO: 210050 - RNA, 19 nt, Human
uagccucuaggacuuccuu

SEQ ID NO: 210051 - RNA, 21 nt, Human
uccacaccagcaagacagaau

SEQ ID NO: 210052 - RNA, 21 nt, Human
uccucucaccagcuacagccc

SEQ ID NO: 210053 - RNA, 21 nt, Human
ucuauccacaccagcaagaca

SEQ ID NO: 210054 - RNA, 23 nt, Human
ucugccgaagcccuccugggucc

SEQ ID NO: 210055 - RNA, 24 nt, Human
ugaaaucagagguacaagcaccuu

SEQ ID NO: 210056 - RNA, 25 nt, Human
ugcaaggggaaaggccaagagccaa

SEQ ID NO: 210057 - RNA, 22 nt, Human
ugcaugcagagaauacauguuc

SEQ ID NO: 210058 - RNA, 24 nt, Human
uguacacauuacacacguuccuug

SEQ ID NO: 210059 - RNA, 20 nt, Human
uuccuugagcagaacuccaa

SEQ ID NO: 210060 - RNA, 24 nt, Human
uuuuuuuuuuuuuuuuuuuccaag

SEQ ID NO: 210061 - RNA, 21 nt, Human
aaugacaacgguuuggaggga

SEQ ID NO: 210062 - RNA, 22 nt, Human
acucuggucucuugcuuucugg

SEQ ID NO: 210063 - RNA, 19 nt, Human
agccggcacugcagggaca

SEQ ID NO: 210064 - RNA, 21 nt, Human
agccggcacugcagggacaca

SEQ ID NO: 210065 - RNA, 19 nt, Human
aggugagggcgguggcugg

SEQ ID NO: 210066 - RNA, 23 nt, Human
aucaaaguuuccucauuucaaag

SEQ ID NO: 210067 - RNA, 21 nt, Human
caaaguuuccucauuucaaag

SEQ ID NO: 210068 - RNA, 19 nt, Human
cacugcagggacacagggc

SEQ ID NO: 210069 - RNA, 22 nt, Human
cccccucccuaguucuuaaucc

SEQ ID NO: 210070 - RNA, 24 nt, Human
ccuguggccgcggcaggugagggc

SEQ ID NO: 210071 - RNA, 21 nt, Human
ccuucuuucccccucccuagu

SEQ ID NO: 210072 - RNA, 22 nt, Human
gagccggcacugcagggacaca

SEQ ID NO: 210073 - RNA, 23 nt, Human
gggacucuggucucuugcuuucu

SEQ ID NO: 210074 - RNA, 18 nt, Human
gggcgguggcugggaggc

SEQ ID NO: 210075 - RNA, 21 nt, Human
uaaaaacaauuuauccacagu

SEQ ID NO: 210076 - RNA, 19 nt, Human
ucaaaaauacuugaucaga

SEQ ID NO: 210077 - RNA, 25 nt, Human
uccuucuuucccccucccuaguucu

SEQ ID NO: 210078 - RNA, 21 nt, Human
ugagccggcacugcagggaca

SEQ ID NO: 210079 - RNA, 21 nt, Human
ugaucagagguaucaugugga

SEQ ID NO: 210080 - RNA, 19 nt, Human
uggaugcagaccuguggcc

SEQ ID NO: 210081 - RNA, 19 nt, Human
ugggaggcugacccagggg

SEQ ID NO: 210082 - RNA, 19 nt, Human
uguaauagucccauccuuc

SEQ ID NO: 210083 - RNA, 18 nt, Human
uucaugaaaacuuaaaaa

SEQ ID NO: 210084 - RNA, 18 nt, Human
uuuauccacaguaaaugu

SEQ ID NO: 210085 - RNA, 24 nt, Human
uuucaaaguuuuauaaaaaugaca

SEQ ID NO: 210086 - RNA, 22 nt, Human
aaacaaacaggaaacaaaugua

SEQ ID NO: 210087 - RNA, 24 nt, Human
aaacaaauguaaucacuuuacaga

SEQ ID NO: 210088 - RNA, 20 nt, Human
aaacguuuuaaagcaaaucc

SEQ ID NO: 210089 - RNA, 22 nt, Human
aaauagcaugaaggcccauggc

SEQ ID NO: 210090 - RNA, 23 nt, Human
aagauaucauugugauccuaaaa

SEQ ID NO: 210091 - RNA, 23 nt, Human
aaguaucucuugcguucccaucc

SEQ ID NO: 210092 - RNA, 23 nt, Human
aaucacggcucaccauagccuug

SEQ ID NO: 210093 - RNA, 22 nt, Human
aaugcaaaaauaaauaaauaaa

SEQ ID NO: 210094 - RNA, 23 nt, Human
aauuaucuuuuugggucuauucc

SEQ ID NO: 210095 - RNA, 19 nt, Human
acauggcuguuaagaagcc

SEQ ID NO: 210096 - RNA, 21 nt, Human
accacaagcaugagccaccac

SEQ ID NO: 210097 - RNA, 24 nt, Human
acggcucaccauagccuugaccuc

SEQ ID NO: 210098 - RNA, 24 nt, Human
acggggucuuguuauguuucccag

SEQ ID NO: 210099 - RNA, 24 nt, Human
agagcgcacauacauuacuuaaaa

SEQ ID NO: 210100 - RNA, 24 nt, Human
agcugggaccacaagcaugagcca

SEQ ID NO: 210101 - RNA, 22 nt, Human
augcaguggcacaaucacggcu

SEQ ID NO: 210102 - RNA, 20 nt, Human
auuuugcuuaauaucuucca

SEQ ID NO: 210103 - RNA, 21 nt, Human
auuuuuuuuuuugagacaggg

SEQ ID NO: 210104 - RNA, 22 nt, Human
cacaagcaugagccaccacgcc

SEQ ID NO: 210105 - RNA, 19 nt, Human
caccauagccuugaccucc

SEQ ID NO: 210106 - RNA, 22 nt, Human
caccauagccuugaccuccugg

SEQ ID NO: 210107 - RNA, 20 nt, Human
caccaucuccaggaagucuu

SEQ ID NO: 210108 - RNA, 19 nt, Human
cagaaugcaaaaauaaaua

SEQ ID NO: 210109 - RNA, 26 nt, Human
caguacaaauaaaauuaaauucacag

SEQ ID NO: 210110 - RNA, 24 nt, Human
caucuuguucuccuggaucuucuc

SEQ ID NO: 210111 - RNA, 23 nt, Human
cauuccauacauccuggcagaca

SEQ ID NO: 210112 - RNA, 24 nt, Human
cauucugucaccuaggcugguaug

SEQ ID NO: 210113 - RNA, 23 nt, Human
cauuuagcaucgaacuauacaaa

SEQ ID NO: 210114 - RNA, 22 nt, Human
cauuuuuuuuuuugagacaggg

SEQ ID NO: 210115 - RNA, 20 nt, Human
ccaccacgccuggcuaauuu

SEQ ID NO: 210116 - RNA, 24 nt, Human
ccaccugccauucugacaauuuca

SEQ ID NO: 210117 - RNA, 22 nt, Human
ccauagccuugaccuccugggc

SEQ ID NO: 210118 - RNA, 18 nt, Human
ccaucacaaguguaugau

SEQ ID NO: 210119 - RNA, 25 nt, Human
ccauguaaguaucucuugcguuccc

SEQ ID NO: 210120 - RNA, 22 nt, Human
ccuccugccucauccuccugaa

SEQ ID NO: 210121 - RNA, 24 nt, Human
ccuccugggcucaagagauccucc

SEQ ID NO: 210122 - RNA, 20 nt, Human
ccugggcucaagagauccuc

SEQ ID NO: 210123 - RNA, 19 nt, Human
ccuugaccuccugggcuca

SEQ ID NO: 210124 - RNA, 24 nt, Human
cggcucaccauagccuugaccucc

SEQ ID NO: 210125 - RNA, 18 nt, Human
cucaagagauccuccugc

SEQ ID NO: 210126 - RNA, 25 nt, Human
cuccugggcucaagagauccuccug

SEQ ID NO: 210127 - RNA, 23 nt, Human
cugcauucuuccugauugucaua

SEQ ID NO: 210128 - RNA, 25 nt, Human
cuggcagacaaacguuaaauaacag

SEQ ID NO: 210129 - RNA, 24 nt, Human
cugugucuuuuagagagguggggg

SEQ ID NO: 210130 - RNA, 21 nt, Human
cuugcagccuugcuugaaaag

SEQ ID NO: 210131 - RNA, 25 nt, Human
cuuuacagagcgcacauacauuacu

SEQ ID NO: 210132 - RNA, 27 nt, Human
gaacagcugggaccacaagcaugagcc

SEQ ID NO: 210133 - RNA, 19 nt, Human
gaacuauacaaauacagca

SEQ ID NO: 210134 - RNA, 22 nt, Human
gggcucaagagauccuccugcc

SEQ ID NO: 210135 - RNA, 22 nt, Human
gugauccuaaaaaaacguuuua

SEQ ID NO: 210136 - RNA, 21 nt, Human
uaagaguaugaaacauuccag

SEQ ID NO: 210137 - RNA, 21 nt, Human
uaaguaucucuugcguuccca

SEQ ID NO: 210138 - RNA, 21 nt, Human
uacaaauaaaauuaaauucac

SEQ ID NO: 210139 - RNA, 22 nt, Human
uagcaugaaggcccauggcaac

SEQ ID NO: 210140 - RNA, 21 nt, Human
uagccuugaccuccugggcuc

SEQ ID NO: 210141 - RNA, 22 nt, Human
uaucuuccacuuuuccuccaaa

SEQ ID NO: 210142 - RNA, 19 nt, Human
uauguuucccaggcugguc

SEQ ID NO: 210143 - RNA, 21 nt, Human
uauguuucccaggcuggucaa

SEQ ID NO: 210144 - RNA, 23 nt, Human
ucaccauagccuugaccuccugg

SEQ ID NO: 210145 - RNA, 23 nt, Human
ucaugcuaaugagaaagggauuc

SEQ ID NO: 210146 - RNA, 24 nt, Human
uccuccugccucauccuccugaac

SEQ ID NO: 210147 - RNA, 18 nt, Human
uccugggcucaagagauc

SEQ ID NO: 210148 - RNA, 21 nt, Human
ucgaacuauacaaauacagca

SEQ ID NO: 210149 - RNA, 19 nt, Human
ucucauucugucaccuagg

SEQ ID NO: 210150 - RNA, 22 nt, Human
ucucauucugucaccuaggcug

SEQ ID NO: 210151 - RNA, 24 nt, Human
ucuuguuauguuucccaggcuggu

SEQ ID NO: 210152 - RNA, 19 nt, Human
ucuuuuagagagguggggg

SEQ ID NO: 210153 - RNA, 23 nt, Human
ugaaaaguugucaguacaaauaa

SEQ ID NO: 210154 - RNA, 25 nt, Human
ugaccuccugggcucaagagauccu

SEQ ID NO: 210155 - RNA, 19 nt, Human
ugagaaagggauuccagau

SEQ ID NO: 210156 - RNA, 20 nt, Human
ugagaaagggauuccagauu

SEQ ID NO: 210157 - RNA, 20 nt, Human
ugagacagggucucauucug

SEQ ID NO: 210158 - RNA, 22 nt, Human
ugagacagggucucauucuguc

SEQ ID NO: 210159 - RNA, 23 nt, Human
ugccucauccuccugaacagcug

SEQ ID NO: 210160 - RNA, 24 nt, Human
ugccucauccuccugaacagcugg

SEQ ID NO: 210161 - RNA, 28 nt, Human
ugccucauccuccugaacagcugggacc

SEQ ID NO: 210162 - RNA, 20 nt, Human
uggaaaaucuauacauaaau

SEQ ID NO: 210163 - RNA, 24 nt, Human
uggcacaaucacggcucaccauag

SEQ ID NO: 210164 - RNA, 24 nt, Human
ugggaccacaagcaugagccacca

SEQ ID NO: 210165 - RNA, 24 nt, Human
ugggaccacaagcaugagccacca

SEQ ID NO: 210166 - RNA, 24 nt, Human
ugggcucaagagauccuccugccu

SEQ ID NO: 210167 - RNA, 24 nt, Human
ugguaugcaguggcacaaucacgg

SEQ ID NO: 210168 - RNA, 24 nt, Human
uguagagacggggucuuguuaugu

SEQ ID NO: 210169 - RNA, 24 nt, Human
ugugucauccuccugugucuuuua

SEQ ID NO: 210170 - RNA, 19 nt, Human
uucuccuggaucuucucaa

SEQ ID NO: 210171 - RNA, 18 nt, Human
uugagagcuggaaaaucu

SEQ ID NO: 210172 - RNA, 24 nt, Human
uuguagagacggggucuuguuaug

SEQ ID NO: 210173 - RNA, 23 nt, Human
uugugucuuuaaacauuuugcuu

SEQ ID NO: 210174 - RNA, 24 nt, Human
uuucuagcccuuuuaaaauucagg

SEQ ID NO: 210175 - RNA, 20 nt, Human
uuucugugucauccuccugu

SEQ ID NO: 210176 - RNA, 18 nt, Human
uuuguagagacggggucu

SEQ ID NO: 210177 - RNA, 24 nt, Human
uuuguagagacggggucuuguuau

SEQ ID NO: 210178 - RNA, 22 nt, Human
uuuuuuuguagagacggggucu

SEQ ID NO: 210179 - RNA, 23 nt, Human
uuuuuuuuuugagacagggucuc

SEQ ID NO: 210180 - RNA, 20 nt, Human
uuuuuuuuuuugagacaggg

SEQ ID NO: 210181 - RNA, 22 nt, Human
uuuuuuuuuuugagacaggguc

SEQ ID NO: 210182 - RNA, 25 nt, Human
uuuuuuuuuuugagacagggucuca

SEQ ID NO: 210183 - RNA, 25 nt, Human
agccccacagccccaggggagccuc

SEQ ID NO: 210184 - RNA, 24 nt, Human
ccacguagagccccacagccccag

SEQ ID NO: 210185 - RNA, 18 nt, Human
cucacccucucugagccu

SEQ ID NO: 210186 - RNA, 22 nt, Human
cucacccucucugagccucaac

SEQ ID NO: 210187 - RNA, 24 nt, Human
gccccacagccccaggggagccuc

SEQ ID NO: 210188 - RNA, 23 nt, Human
uacguagccucgggcgagucacu

SEQ ID NO: 210189 - RNA, 25 nt, Human
uagagccccacagccccaggggagc

SEQ ID NO: 210190 - RNA, 23 nt, Human
aaaaagguacauucuuagacuuc

SEQ ID NO: 210191 - RNA, 24 nt, Human
aaagugcugggauuacaggcauga

SEQ ID NO: 210192 - RNA, 18 nt, Human
aagcgggcucggguggga

SEQ ID NO: 210193 - RNA, 19 nt, Human
aagugcugggauuacaggc

SEQ ID NO: 210194 - RNA, 21 nt, Human
aagugcugggauuacaggcau

SEQ ID NO: 210195 - RNA, 26 nt, Human
aagugcugggauuacaggcaugagcu

SEQ ID NO: 210196 - RNA, 21 nt, Human
acacagugaaggauguaauuu

SEQ ID NO: 210197 - RNA, 22 nt, Human
accacgcccggccagaaaaagg

SEQ ID NO: 210198 - RNA, 22 nt, Human
agagacguggcacuuuguugac

SEQ ID NO: 210199 - RNA, 19 nt, Human
agccagaccgaugguggca

SEQ ID NO: 210200 - RNA, 22 nt, Human
aggcccugggaaaggcaagaug

SEQ ID NO: 210201 - RNA, 19 nt, Human
auguccuuucucuguucuc

SEQ ID NO: 210202 - RNA, 24 nt, Human
caaagugcugggauuacaggcaug

SEQ ID NO: 210203 - RNA, 24 nt, Human
caacucccaguuccuaagacuccc

SEQ ID NO: 210204 - RNA, 23 nt, Human
caccaagauaugauaggcgcgau

SEQ ID NO: 210205 - RNA, 24 nt, Human
caccaagauaugauaggcgcgaua

SEQ ID NO: 210206 - RNA, 18 nt, Human
cacgugucgccugccagc

SEQ ID NO: 210207 - RNA, 20 nt, Human
caucugagugaagaccaacu

SEQ ID NO: 210208 - RNA, 23 nt, Human
ccaaagugcugggauuacaggca

SEQ ID NO: 210209 - RNA, 24 nt, Human
ccaaagugcugggauuacaggcau

SEQ ID NO: 210210 - RNA, 25 nt, Human
ccaagugauuaacagccaaugugcc

SEQ ID NO: 210211 - RNA, 22 nt, Human
ccaauacaguagccacuagcca

SEQ ID NO: 210212 - RNA, 21 nt, Human
ccacgcccggccagaaaaagg

SEQ ID NO: 210213 - RNA, 23 nt, Human
ccacgcccggccagaaaaaggua

SEQ ID NO: 210214 - RNA, 19 nt, Human
ccagcgcccgcccucccgc

SEQ ID NO: 210215 - RNA, 23 nt, Human
ccagcgcccgcccucccgccucc

SEQ ID NO: 210216 - RNA, 24 nt, Human
cccaaagugcugggauuacaggca

SEQ ID NO: 210217 - RNA, 18 nt, Human
ccgcccucccgccuccgc

SEQ ID NO: 210218 - RNA, 29 nt, Human
ccgcccucccgccuccgccucccgccucu

SEQ ID NO: 210219 - RNA, 19 nt, Human
ccucccgccuccgccuccc

SEQ ID NO: 210220 - RNA, 18 nt, Human
ccugugggcucugcugug

SEQ ID NO: 210221 - RNA, 18 nt, Human
cgaggugaggugcguuua

SEQ ID NO: 210222 - RNA, 22 nt, Human
cgcagccgggcgggcgcccgug

SEQ ID NO: 210223 - RNA, 19 nt, Human
cgggucgaagcgggcucgg

SEQ ID NO: 210224 - RNA, 20 nt, Human
cguuuaugcaccaagauaug

SEQ ID NO: 210225 - RNA, 20 nt, Human
cucccgccuccgccucccgc

SEQ ID NO: 210226 - RNA, 20 nt, Human
cucucuccaccgucagauuc

SEQ ID NO: 210227 - RNA, 19 nt, Human
cugcuguguacagccugcu

SEQ ID NO: 210228 - RNA, 18 nt, Human
cuggagcaggggcugggg

SEQ ID NO: 210229 - RNA, 18 nt, Human
cugugucgccuugagcaa

SEQ ID NO: 210230 - RNA, 19 nt, Human
gauuacaggcaugagcuac

SEQ ID NO: 210231 - RNA, 21 nt, Human
gauuacaggcaugagcuacca

SEQ ID NO: 210232 - RNA, 21 nt, Human
gccaccugugggcucugcugu

SEQ ID NO: 210233 - RNA, 19 nt, Human
gccugcggggaccgggugg

SEQ ID NO: 210234 - RNA, 18 nt, Human
gccuugagcaagauaauu

SEQ ID NO: 210235 - RNA, 20 nt, Human
gcuggagcaggggcuggggg

SEQ ID NO: 210236 - RNA, 19 nt, Human
gcugggggaauuggggcag

SEQ ID NO: 210237 - RNA, 20 nt, Human
ggagcaggggcugggggaau

SEQ ID NO: 210238 - RNA, 19 nt, Human
ggauuacaggcaugagcua

SEQ ID NO: 210239 - RNA, 22 nt, Human
ggccggggcgggggucggggcu

SEQ ID NO: 210240 - RNA, 20 nt, Human
ggggcugggcgguggccgca

SEQ ID NO: 210241 - RNA, 22 nt, Human
ggggcugggggaauuggggcag

SEQ ID NO: 210242 - RNA, 23 nt, Human
gggggucggggcugggcgguggc

SEQ ID NO: 210243 - RNA, 20 nt, Human
ggugggcgcggggagcuggc

SEQ ID NO: 210244 - RNA, 18 nt, Human
gugugcucagcguacaca

SEQ ID NO: 210245 - RNA, 22 nt, Human
uacacagccauagagacguggc

SEQ ID NO: 210246 - RNA, 23 nt, Human
uacaggcaugagcuaccacgccc

SEQ ID NO: 210247 - RNA, 19 nt, Human
uaccaagaaaguuacuagg

SEQ ID NO: 210248 - RNA, 18 nt, Human
ucagccucccaaagugcu

SEQ ID NO: 210249 - RNA, 24 nt, Human
ucagucaagcuaaacacauuccaa

SEQ ID NO: 210250 - RNA, 20 nt, Human
uccaagugauuaacagccaa

SEQ ID NO: 210251 - RNA, 24 nt, Human
ucccaaagugcugggauuacaggc

SEQ ID NO: 210252 - RNA, 21 nt, Human
ucccccagagcuggcuugccc

SEQ ID NO: 210253 - RNA, 21 nt, Human
ucccgggccugcggggaccgg

SEQ ID NO: 210254 - RNA, 18 nt, Human
uccggggugggcgcgggg

SEQ ID NO: 210255 - RNA, 22 nt, Human
ucgggccggggcgggggucggg

SEQ ID NO: 210256 - RNA, 25 nt, Human
ucgggugggauucugccaccugugg

SEQ ID NO: 210257 - RNA, 22 nt, Human
ucucauaagacggagcaagggu

SEQ ID NO: 210258 - RNA, 19 nt, Human
ucugagugaagaccaacuc

SEQ ID NO: 210259 - RNA, 20 nt, Human
ucugccaccugugggcucug

SEQ ID NO: 210260 - RNA, 18 nt, Human
ugagaccagucaugacca

SEQ ID NO: 210261 - RNA, 24 nt, Human
ugcagccagaccgaugguggcacc

SEQ ID NO: 210262 - RNA, 23 nt, Human
ugccaccugugggcucugcugug

SEQ ID NO: 210263 - RNA, 18 nt, Human
ugcggauaauaaagccug

SEQ ID NO: 210264 - RNA, 22 nt, Human
ugcggggaccggguggccccgg

SEQ ID NO: 210265 - RNA, 20 nt, Human
ugcugggauuacaggcauga

SEQ ID NO: 210266 - RNA, 20 nt, Human
uggagucucuagguccacac

SEQ ID NO: 210267 - RNA, 18 nt, Human
ugggauuacaggcaugag

SEQ ID NO: 210268 - RNA, 19 nt, Human
ugggauuacaggcaugagc

SEQ ID NO: 210269 - RNA, 22 nt, Human
ugggauuacaggcaugagcuac

SEQ ID NO: 210270 - RNA, 23 nt, Human
ugggauuacaggcaugagcuacc

SEQ ID NO: 210271 - RNA, 24 nt, Human
ugggauuacaggcaugagcuacca

SEQ ID NO: 210272 - RNA, 20 nt, Human
uggggcaggcugugcugguu

SEQ ID NO: 210273 - RNA, 22 nt, Human
uggggcaggcugugcugguuga

SEQ ID NO: 210274 - RNA, 20 nt, Human
ugggggaauuggggcaggcu

SEQ ID NO: 210275 - RNA, 21 nt, Human
ugguuucuacucuccuccuca

SEQ ID NO: 210276 - RNA, 23 nt, Human
uguaugccauuacuacuaagagc

SEQ ID NO: 210277 - RNA, 21 nt, Human
uguguacagccugcuguguag

SEQ ID NO: 210278 - RNA, 19 nt, Human
uguguagcaggugcuuuag

SEQ ID NO: 210279 - RNA, 24 nt, Human
uugcaugaaugguccucuagacug

SEQ ID NO: 210280 - RNA, 20 nt, Human
uuggaggcucucaauaaucu

SEQ ID NO: 210281 - RNA, 18 nt, Human
uuggggcaggcugugcug

SEQ ID NO: 210282 - RNA, 21 nt, Human
uuuuaaggcccugggaaaggc

SEQ ID NO: 210283 - RNA, 24 nt, Human
aauaauaaauaagaccaagaagaa

SEQ ID NO: 210284 - RNA, 21 nt, Human
acaacuuguucaauguccccu

SEQ ID NO: 210285 - RNA, 18 nt, Human
acccaagacauuuuugac

SEQ ID NO: 210286 - RNA, 23 nt, Human
acuuguucaauguccccuccccc

SEQ ID NO: 210287 - RNA, 21 nt, Human
agaccaagaagaagugugccu

SEQ ID NO: 210288 - RNA, 19 nt, Human
aggccccaggaccccagug

SEQ ID NO: 210289 - RNA, 22 nt, Human
agggacuccugggguccacugc

SEQ ID NO: 210290 - RNA, 19 nt, Human
augaggcuccgaggcccca

SEQ ID NO: 210291 - RNA, 21 nt, Human
caagugccagcagccacaguc

SEQ ID NO: 210292 - RNA, 23 nt, Human
cacaauaauaaauaagaccaaga

SEQ ID NO: 210293 - RNA, 20 nt, Human
cagugccaacaggagaggau

SEQ ID NO: 210294 - RNA, 20 nt, Human
caguguucaagguacccuuc

SEQ ID NO: 210295 - RNA, 21 nt, Human
caucagaaagaaaaaugaauc

SEQ ID NO: 210296 - RNA, 18 nt, Human
ccaauccccaacggugac

SEQ ID NO: 210297 - RNA, 22 nt, Human
ccaccgagcucagggcccugga

SEQ ID NO: 210298 - RNA, 24 nt, Human
cccaccacaugucuggcaaggggg

SEQ ID NO: 210299 - RNA, 30 nt, Human
cccaccaggcugagcccugggcaaggggag

SEQ ID NO: 210300 - RNA, 24 nt, Human
ccccaacggugacaaacacacuca

SEQ ID NO: 210301 - RNA, 22 nt, Human
cccuccuucccgccuacccaag

SEQ ID NO: 210302 - RNA, 19 nt, Human
cccuggguccaccgagcuc

SEQ ID NO: 210303 - RNA, 23 nt, Human
ccgaggccccaggaccccaguga

SEQ ID NO: 210304 - RNA, 19 nt, Human
ccucccuaacccuccuucc

SEQ ID NO: 210305 - RNA, 23 nt, Human
ccugacccugccucggaugaggc

SEQ ID NO: 210306 - RNA, 19 nt, Human
cggcuaggcugaagacggg

SEQ ID NO: 210307 - RNA, 22 nt, Human
cggcuguucugccccucuccug

SEQ ID NO: 210308 - RNA, 18 nt, Human
cuaacccuccuucccgcc

SEQ ID NO: 210309 - RNA, 19 nt, Human
cuccugacccugccucgga

SEQ ID NO: 210310 - RNA, 19 nt, Human
cuccugggguccacugcuu

SEQ ID NO: 210311 - RNA, 20 nt, Human
cugaacccuuggcuccaagu

SEQ ID NO: 210312 - RNA, 25 nt, Human
cugaacccuuggcuccaagugccag

SEQ ID NO: 210313 - RNA, 19 nt, Human
cuggguccaccgagcucag

SEQ ID NO: 210314 - RNA, 23 nt, Human
cuuguucaauguccccuccccca

SEQ ID NO: 210315 - RNA, 25 nt, Human
gaaacaacuuguucaauguccccuu

SEQ ID NO: 210316 - RNA, 20 nt, Human
gacaggagcggcuguucugc

SEQ ID NO: 210317 - RNA, 20 nt, Human
gagcucagggcccuggacag

SEQ ID NO: 210318 - RNA, 24 nt, Human
gagcucagggcccuggacagagga

SEQ ID NO: 210319 - RNA, 20 nt, Human
gccacagucuuccccaaucc

SEQ ID NO: 210320 - RNA, 21 nt, Human
gccacagucuuccccaauccc

SEQ ID NO: 210321 - RNA, 19 nt, Human
gcccaccaggcugagcccu

SEQ ID NO: 210322 - RNA, 23 nt, Human
gccugagcugcugucugccucag

SEQ ID NO: 210323 - RNA, 22 nt, Human
gcugagagcuggcugcuggcug

SEQ ID NO: 210324 - RNA, 20 nt, Human
ggcaggggagggguguaggg

SEQ ID NO: 210325 - RNA, 22 nt, Human
ggggagggguguagggacaugu

SEQ ID NO: 210326 - RNA, 19 nt, Human
guacccuucuauauauuaa

SEQ ID NO: 210327 - RNA, 20 nt, Human
gugcuggggcccugagucuc

SEQ ID NO: 210328 - RNA, 18 nt, Human
guucaauguccccucccc

SEQ ID NO: 210329 - RNA, 22 nt, Human
uaacccuccuucccgccuaccc

SEQ ID NO: 210330 - RNA, 22 nt, Human
uaacccuccuucccgccuaccc

SEQ ID NO: 210331 - RNA, 20 nt, Human
uacacaguacuuauuaccag

SEQ ID NO: 210332 - RNA, 22 nt, Human
uaucugucaccaacuuuauuuc

SEQ ID NO: 210333 - RNA, 18 nt, Human
ucccgccuacccaagaca

SEQ ID NO: 210334 - RNA, 18 nt, Human
ucccuggguccaccgagc

SEQ ID NO: 210335 - RNA, 18 nt, Human
ucucugaacccuuggcuc

SEQ ID NO: 210336 - RNA, 27 nt, Human
ucuguacacaguacuuauuaccaggga

SEQ ID NO: 210337 - RNA, 19 nt, Human
ugaaacaacuuguucaaug

SEQ ID NO: 210338 - RNA, 21 nt, Human
ugagagcuggcugcuggcugg

SEQ ID NO: 210339 - RNA, 26 nt, Human
ugaggagcggaugcauaggcugggug

SEQ ID NO: 210340 - RNA, 20 nt, Human
ugaggucggcuaggcugaag

SEQ ID NO: 210341 - RNA, 21 nt, Human
ugcaaauaaugaugcuuucga

SEQ ID NO: 210342 - RNA, 23 nt, Human
ugccugagcugcugucugccuca

SEQ ID NO: 210343 - RNA, 24 nt, Human
ugccugagcugcugucugccucag

SEQ ID NO: 210344 - RNA, 21 nt, Human
uguccccucccccaguguuca

SEQ ID NO: 210345 - RNA, 19 nt, Human
uuaccccucccuaacccuc

SEQ ID NO: 210346 - RNA, 19 nt, Human
uuagugcuggggcccugag

SEQ ID NO: 210347 - RNA, 23 nt, Human
aaaagaagaggaugggaacaaaa

SEQ ID NO: 210348 - RNA, 19 nt, Human
aaauagacuguaaaccccu

SEQ ID NO: 210349 - RNA, 23 nt, Human
aacuuccuuuucccucccuuuuc

SEQ ID NO: 210350 - RNA, 20 nt, Human
aagaacacaaagcaaguaua

SEQ ID NO: 210351 - RNA, 21 nt, Human
aagaaguuaaacagaaacaau

SEQ ID NO: 210352 - RNA, 23 nt, Human
aagaguuuuaauagccacaaaca

SEQ ID NO: 210353 - RNA, 23 nt, Human
aauauaugccccccaaaagcaua

SEQ ID NO: 210354 - RNA, 24 nt, Human
acaaaccaaagacacaguaaaugc

SEQ ID NO: 210355 - RNA, 21 nt, Human
acaaagcaaguauagaucccu

SEQ ID NO: 210356 - RNA, 18 nt, Human
acaauucaccugccucag

SEQ ID NO: 210357 - RNA, 24 nt, Human
acaauucaccugccucagcuuccc

SEQ ID NO: 210358 - RNA, 20 nt, Human
acagacaccuccaagagcuc

SEQ ID NO: 210359 - RNA, 18 nt, Human
accauccugacacugggu

SEQ ID NO: 210360 - RNA, 23 nt, Human
accauuuuggucaggcuggucug

SEQ ID NO: 210361 - RNA, 24 nt, Human
acccaggcuagagugcaguggugu

SEQ ID NO: 210362 - RNA, 25 nt, Human
accccagcuuccucagagaagccag

SEQ ID NO: 210363 - RNA, 23 nt, Human
acggauauguuguguggauaggu

SEQ ID NO: 210364 - RNA, 22 nt, Human
acggccauggaagcagguugcc

SEQ ID NO: 210365 - RNA, 23 nt, Human
agaaaagaggaauccuggaccca

SEQ ID NO: 210366 - RNA, 18 nt, Human
agaaguuaaacagaaaca

SEQ ID NO: 210367 - RNA, 22 nt, Human
agagugcaguggugugaucucu

SEQ ID NO: 210368 - RNA, 22 nt, Human
agaugcuaauuauccucugcuc

SEQ ID NO: 210369 - RNA, 20 nt, Human
agccagggcaccaugcuucu

SEQ ID NO: 210370 - RNA, 18 nt, Human
aggaaaaccaaauauucu

SEQ ID NO: 210371 - RNA, 20 nt, Human
aggagggagaaugcaaaagg

SEQ ID NO: 210372 - RNA, 21 nt, Human
aggagggagaaugcaaaaggg

SEQ ID NO: 210373 - RNA, 21 nt, Human
aggggucugugcuucacaccc

SEQ ID NO: 210374 - RNA, 18 nt, Human
aguagcugggauuacagg

SEQ ID NO: 210375 - RNA, 24 nt, Human
agucauucuaccuccacugccccu

SEQ ID NO: 210376 - RNA, 18 nt, Human
agugcaguggugugaucu

SEQ ID NO: 210377 - RNA, 19 nt, Human
agugcaguggugugaucuc

SEQ ID NO: 210378 - RNA, 21 nt, Human
agugcaguggugugaucucug

SEQ ID NO: 210379 - RNA, 24 nt, Human
agugcaguggugugaucucugcuc

SEQ ID NO: 210380 - RNA, 30 nt, Human
aguuuccauuuaauaaguucccagauaacc

SEQ ID NO: 210381 - RNA, 19 nt, Human
auggugcaguaguuucagu

SEQ ID NO: 210382 - RNA, 20 nt, Human
auuguuucucagauuacuca

SEQ ID NO: 210383 - RNA, 22 nt, Human
caaaagaucacuuccccacucc

SEQ ID NO: 210384 - RNA, 21 nt, Human
caaauagacuguaaaccccug

SEQ ID NO: 210385 - RNA, 24 nt, Human
caaauugcugggauuacaggcgug

SEQ ID NO: 210386 - RNA, 24 nt, Human
caacauaaagaccuguggcucuua

SEQ ID NO: 210387 - RNA, 21 nt, Human
caaccaccacagguauuccca

SEQ ID NO: 210388 - RNA, 23 nt, Human
caaccuccaccucccagguucaa

SEQ ID NO: 210389 - RNA, 21 nt, Human
caagagcucccaagaccuagg

SEQ ID NO: 210390 - RNA, 22 nt, Human
caagcgaauaccaauguucuac

SEQ ID NO: 210391 - RNA, 22 nt, Human
caaucugacuucaagaauaacu

SEQ ID NO: 210392 - RNA, 21 nt, Human
cacaaagcaaguauagauccc

SEQ ID NO: 210393 - RNA, 21 nt, Human
cacaaauaucaaugcugaaaa

SEQ ID NO: 210394 - RNA, 23 nt, Human
cacacucuucuccaaagcgccca

SEQ ID NO: 210395 - RNA, 24 nt, Human
caccacacccaguuaauuuuugua

SEQ ID NO: 210396 - RNA, 21 nt, Human
caccauuuuggucaggcuggu

SEQ ID NO: 210397 - RNA, 22 nt, Human
caccauuuuggucaggcugguc

SEQ ID NO: 210398 - RNA, 21 nt, Human
cacugcaaccuccaccuccca

SEQ ID NO: 210399 - RNA, 18 nt, Human
caugcuucuacacggcca

SEQ ID NO: 210400 - RNA, 21 nt, Human
caugguugaaacucuaauacc

SEQ ID NO: 210401 - RNA, 26 nt, Human
cauguugacacaaagaacacaaagca

SEQ ID NO: 210402 - RNA, 18 nt, Human
ccaaaugaguuccccuac

SEQ ID NO: 210403 - RNA, 20 nt, Human
ccaaauugcugggauuacag

SEQ ID NO: 210404 - RNA, 22 nt, Human
ccaaauugcugggauuacaggc

SEQ ID NO: 210405 - RNA, 22 nt, Human
ccaaauugcugggauuacaggc

SEQ ID NO: 210406 - RNA, 24 nt, Human
ccaaauugcugggauuacaggcgu

SEQ ID NO: 210407 - RNA, 27 nt, Human
ccaccucccagguucaaacaauucuuu

SEQ ID NO: 210408 - RNA, 24 nt, Human
cccaaaagcauaaacagagccuug

SEQ ID NO: 210409 - RNA, 24 nt, Human
cccaaggagucauucuaccuccac

SEQ ID NO: 210410 - RNA, 20 nt, Human
ccccaaaagcauaaacagag

SEQ ID NO: 210411 - RNA, 21 nt, Human
ccccccaaaagcauaaacaga

SEQ ID NO: 210412 - RNA, 23 nt, Human
cccgaguagcugggauuacaggc

SEQ ID NO: 210413 - RNA, 24 nt, Human
cccgaguagcugggauuacaggca

SEQ ID NO: 210414 - RNA, 23 nt, Human
ccgaguagcugggauuacaggca

SEQ ID NO: 210415 - RNA, 24 nt, Human
ccuccaagagcucccaagaccuag

SEQ ID NO: 210416 - RNA, 21 nt, Human
ccucccuuuucccucagcuau

SEQ ID NO: 210417 - RNA, 20 nt, Human
ccucggagcccggccgggcu

SEQ ID NO: 210418 - RNA, 22 nt, Human
ccugaccucgagugauccgccc

SEQ ID NO: 210419 - RNA, 20 nt, Human
ccuuuucccucccuuuuccc

SEQ ID NO: 210420 - RNA, 22 nt, Human
cgggggccuagcacaaaccaaa

SEQ ID NO: 210421 - RNA, 22 nt, Human
cuaccaauguaagacacaaaag

SEQ ID NO: 210422 - RNA, 22 nt, Human
cuagcacaaaccaaagacacag

SEQ ID NO: 210423 - RNA, 21 nt, Human
cuagggggaggcauggguuuu

SEQ ID NO: 210424 - RNA, 24 nt, Human
cucacugcaaccuccaccucccag

SEQ ID NO: 210425 - RNA, 23 nt, Human
cucagcuucccgaguagcuggga

SEQ ID NO: 210426 - RNA, 20 nt, Human
cucaggaaguugucacaacu

SEQ ID NO: 210427 - RNA, 21 nt, Human
cuccaagagcucccaagaccu

SEQ ID NO: 210428 - RNA, 22 nt, Human
cucccagccucaaucugacuuc

SEQ ID NO: 210429 - RNA, 26 nt, Human
cuccugaccucgagugauccgcccgc

SEQ ID NO: 210430 - RNA, 20 nt, Human
cucugucacccaggcuagag

SEQ ID NO: 210431 - RNA, 23 nt, Human
cucugucacccaggcuagagugc

SEQ ID NO: 210432 - RNA, 23 nt, Human
cugcaaccuccaccucccagguu

SEQ ID NO: 210433 - RNA, 24 nt, Human
cugcaaccuccaccucccagguuc

SEQ ID NO: 210434 - RNA, 23 nt, Human
cugccucagcuucccgaguagcu

SEQ ID NO: 210435 - RNA, 23 nt, Human
cuuccuuuucccucccuuuuccc

SEQ ID NO: 210436 - RNA, 20 nt, Human
cuuuguccccuaguuugaag

SEQ ID NO: 210437 - RNA, 21 nt, Human
gaagggaaggagggagaaugc

SEQ ID NO: 210438 - RNA, 24 nt, Human
gaccucgagugauccgcccgccuc

SEQ ID NO: 210439 - RNA, 24 nt, Human
gaguagcugggauuacaggcacgc

SEQ ID NO: 210440 - RNA, 24 nt, Human
gauaccaccucaucucuguuuaga

SEQ ID NO: 210441 - RNA, 18 nt, Human
gauuacaggcacgcgcca

SEQ ID NO: 210442 - RNA, 18 nt, Human
gauuacaggcgugagcca

SEQ ID NO: 210443 - RNA, 21 nt, Human
gauuacaggcgugagccaccg

SEQ ID NO: 210444 - RNA, 24 nt, Human
gauuacaggcgugagccaccggac

SEQ ID NO: 210445 - RNA, 22 nt, Human
gcaaccuccaccucccagguuc

SEQ ID NO: 210446 - RNA, 23 nt, Human
gcagagaaaagaggaauccugga

SEQ ID NO: 210447 - RNA, 24 nt, Human
gccucagcuucccgaguagcuggg

SEQ ID NO: 210448 - RNA, 24 nt, Human
gcucccaagaccuagggaucacaa

SEQ ID NO: 210449 - RNA, 23 nt, Human
gcuggucuggaacuccugaccuc

SEQ ID NO: 210450 - RNA, 19 nt, Human
ggaacccaauauaugcccc

SEQ ID NO: 210451 - RNA, 19 nt, Human
ggaagggaaggagggagaa

SEQ ID NO: 210452 - RNA, 18 nt, Human
ggaggcauggguuuugcu

SEQ ID NO: 210453 - RNA, 22 nt, Human
ggcuagagugcaguggugugau

SEQ ID NO: 210454 - RNA, 24 nt, Human
ggcuggucuggaacuccugaccuc

SEQ ID NO: 210455 - RNA, 22 nt, Human
gggcuuucaaagcagaggaaaa

SEQ ID NO: 210456 - RNA, 20 nt, Human
guaaauguuugaacaacuug

SEQ ID NO: 210457 - RNA, 22 nt, Human
guaagacacaaaagcuauuuaa

SEQ ID NO: 210458 - RNA, 24 nt, Human
gugauccgcccgccucggacuccc

SEQ ID NO: 210459 - RNA, 21 nt, Human
guggagauuaaaaaaaaaagu

SEQ ID NO: 210460 - RNA, 24 nt, Human
guucaaacaauucaccugccucag

SEQ ID NO: 210461 - RNA, 24 nt, Human
guuuuaguagagaggagguuucac

SEQ ID NO: 210462 - RNA, 21 nt, Human
uaaaaauggcuagggggaggc

SEQ ID NO: 210463 - RNA, 21 nt, Human
uaaaagaagaggaugggaaca

SEQ ID NO: 210464 - RNA, 24 nt, Human
uaaaagaguuuuaauagccacaaa

SEQ ID NO: 210465 - RNA, 22 nt, Human
uaaaaggucugaaaaaugacug

SEQ ID NO: 210466 - RNA, 22 nt, Human
uaaaauggcuuugaaaggucuu

SEQ ID NO: 210467 - RNA, 24 nt, Human
uaacuuccuuuucccucccuuuuc

SEQ ID NO: 210468 - RNA, 24 nt, Human
uaauuuuuguaguuuuaguagaga

SEQ ID NO: 210469 - RNA, 24 nt, Human
uacaggcacgcgccaccacaccca

SEQ ID NO: 210470 - RNA, 24 nt, Human
uacaggcgugagccaccggaccca

SEQ ID NO: 210471 - RNA, 19 nt, Human
uacccaaaccuguagagag

SEQ ID NO: 210472 - RNA, 22 nt, Human
uaccuggaaaggaauuaaucuc

SEQ ID NO: 210473 - RNA, 21 nt, Human
uacuugaguagcagaggugaa

SEQ ID NO: 210474 - RNA, 22 nt, Human
uagagugcaguggugugaucuc

SEQ ID NO: 210475 - RNA, 23 nt, Human
uagagugcaguggugugaucucu

SEQ ID NO: 210476 - RNA, 24 nt, Human
uagagugcaguggugugaucucug

SEQ ID NO: 210477 - RNA, 22 nt, Human
uagcacaaaccaaagacacagu

SEQ ID NO: 210478 - RNA, 24 nt, Human
uaggaaaaaauccacauaggcuag

SEQ ID NO: 210479 - RNA, 24 nt, Human
uaggaucccaaacaauacauauca

SEQ ID NO: 210480 - RNA, 22 nt, Human
uagguauguuaggaaaaaaucc

SEQ ID NO: 210481 - RNA, 26 nt, Human
uaguagagaggagguuucaccauuuu

SEQ ID NO: 210482 - RNA, 18 nt, Human
uauaaaauaccuggaaag

SEQ ID NO: 210483 - RNA, 18 nt, Human
uauuuauuuuacucaagc

SEQ ID NO: 210484 - RNA, 20 nt, Human
ucaaacaauucaccugccuc

SEQ ID NO: 210485 - RNA, 20 nt, Human
ucacacccgggggccuagca

SEQ ID NO: 210486 - RNA, 18 nt, Human
ucacagcauccucuucau

SEQ ID NO: 210487 - RNA, 24 nt, Human
ucacugcaaccuccaccucccagg

SEQ ID NO: 210488 - RNA, 25 nt, Human
ucacugcaaccuccaccucccaggu

SEQ ID NO: 210489 - RNA, 27 nt, Human
ucacugcaaccuccaccucccagguuc

SEQ ID NO: 210490 - RNA, 20 nt, Human
ucagcuucccgaguagcugg

SEQ ID NO: 210491 - RNA, 19 nt, Human
ucagugcccagaugaaggg

SEQ ID NO: 210492 - RNA, 20 nt, Human
ucagugcccagaugaaggga

SEQ ID NO: 210493 - RNA, 22 nt, Human
uccacauaggcuagaccuaaaa

SEQ ID NO: 210494 - RNA, 18 nt, Human
ucccaaacaauacauauc

SEQ ID NO: 210495 - RNA, 24 nt, Human
ucccaaauugcugggauuacaggc

SEQ ID NO: 210496 - RNA, 19 nt, Human
ucccagguucaaacaauuc

SEQ ID NO: 210497 - RNA, 24 nt, Human
ucccagguucaaacaauucaccug

SEQ ID NO: 210498 - RNA, 20 nt, Human
ucccagguucaaacaauucc

SEQ ID NO: 210499 - RNA, 24 nt, Human
ucccgaguagcugggauuacaggc

SEQ ID NO: 210500 - RNA, 18 nt, Human
ucuagagaacagcagaac

SEQ ID NO: 210501 - RNA, 19 nt, Human
ucucaaggucacagugaag

SEQ ID NO: 210502 - RNA, 18 nt, Human
ucucagauuacucacacu

SEQ ID NO: 210503 - RNA, 24 nt, Human
ucucagauuacucacacuuaaccu

SEQ ID NO: 210504 - RNA, 19 nt, Human
ucuccccuccccuaggagc

SEQ ID NO: 210505 - RNA, 19 nt, Human
ucugaaaaaugacuggugg

SEQ ID NO: 210506 - RNA, 21 nt, Human
ucuguaguugucaucauggcc

SEQ ID NO: 210507 - RNA, 24 nt, Human
ucugucacccaggcuagagugcag

SEQ ID NO: 210508 - RNA, 19 nt, Human
ucuugcucugucacccagg

SEQ ID NO: 210509 - RNA, 23 nt, Human
ucuugcucugucacccaggcuag

SEQ ID NO: 210510 - RNA, 24 nt, Human
ucuugcucugucacccaggcuaga

SEQ ID NO: 210511 - RNA, 18 nt, Human
ugaccucgagugauccgc

SEQ ID NO: 210512 - RNA, 24 nt, Human
ugaccucgagugauccgcccgccu

SEQ ID NO: 210513 - RNA, 24 nt, Human
ugagaauggaacccaauauaugcc

SEQ ID NO: 210514 - RNA, 21 nt, Human
ugagccaccggacccagccca

SEQ ID NO: 210515 - RNA, 23 nt, Human
ugaucucugcucacugcaaccuc

SEQ ID NO: 210516 - RNA, 21 nt, Human
ugcaugacugucagcaucaau

SEQ ID NO: 210517 - RNA, 24 nt, Human
ugcaugacugucagcaucaauguu

SEQ ID NO: 210518 - RNA, 22 nt, Human
ugccauugucaugaaccccagc

SEQ ID NO: 210519 - RNA, 24 nt, Human
ugccucagcuucccgaguagcugg

SEQ ID NO: 210520 - RNA, 20 nt, Human
ugcugggauuacaggcguga

SEQ ID NO: 210521 - RNA, 24 nt, Human
ugcugggauuacaggcgugagcca

SEQ ID NO: 210522 - RNA, 20 nt, Human
uggaaaggaauuaaucucau

SEQ ID NO: 210523 - RNA, 21 nt, Human
uggaacccaauauaugccccc

SEQ ID NO: 210524 - RNA, 21 nt, Human
uggauaggugagaauggaacc

SEQ ID NO: 210525 - RNA, 21 nt, Human
uggcaagaacugaggagucuc

SEQ ID NO: 210526 - RNA, 21 nt, Human
uggcuggcuggcuaccaaugu

SEQ ID NO: 210527 - RNA, 21 nt, Human
ugggaauuucacagcauccuc

SEQ ID NO: 210528 - RNA, 21 nt, Human
ugggauuacaggcacgcgcca

SEQ ID NO: 210529 - RNA, 22 nt, Human
ugggauuacaggcacgcgccac

SEQ ID NO: 210530 - RNA, 24 nt, Human
ugggauuacaggcacgcgccacca

SEQ ID NO: 210531 - RNA, 19 nt, Human
ugggauuacaggcgugagc

SEQ ID NO: 210532 - RNA, 21 nt, Human
ugggauuacaggcgugagcca

SEQ ID NO: 210533 - RNA, 22 nt, Human
ugggauuacaggcgugagccac

SEQ ID NO: 210534 - RNA, 23 nt, Human
ugggauuacaggcgugagccacc

SEQ ID NO: 210535 - RNA, 24 nt, Human
ugggauuacaggcgugagccaccg

SEQ ID NO: 210536 - RNA, 24 nt, Human
uggucaggcuggucuggaacuccu

SEQ ID NO: 210537 - RNA, 19 nt, Human
uguaguuuuaguagagagg

SEQ ID NO: 210538 - RNA, 21 nt, Human
uguaguuuuaguagagaggag

SEQ ID NO: 210539 - RNA, 22 nt, Human
uguccccuaguuugaagccugc

SEQ ID NO: 210540 - RNA, 25 nt, Human
uguuuuguuuuguuuuguuuugauu

SEQ ID NO: 210541 - RNA, 26 nt, Human
uguuuuguuuuguuuuguuuuuuaau

SEQ ID NO: 210542 - RNA, 24 nt, Human
uguuuuguuuuuuagacagagucu

SEQ ID NO: 210543 - RNA, 23 nt, Human
uuaacauuguuucacauaucccu

SEQ ID NO: 210544 - RNA, 18 nt, Human
uuaguagagaggagguuu

SEQ ID NO: 210545 - RNA, 24 nt, Human
uuaguagagaggagguuucaccau

SEQ ID NO: 210546 - RNA, 20 nt, Human
uucagugcccagaugaaggg

SEQ ID NO: 210547 - RNA, 19 nt, Human
uucccagaauuauaaaaua

SEQ ID NO: 210548 - RNA, 23 nt, Human
uucccauacuucuuuaaauuugg

SEQ ID NO: 210549 - RNA, 26 nt, Human
uuccccuacaaauaaaauuuguucau

SEQ ID NO: 210550 - RNA, 19 nt, Human
uucuguaguugucaucaug

SEQ ID NO: 210551 - RNA, 24 nt, Human
uuucaccauuuuggucaggcuggu

SEQ ID NO: 210552 - RNA, 18 nt, Human
uuuguuuuguuuuguuuu

SEQ ID NO: 210553 - RNA, 21 nt, Human
uuuucggugcgcgacucaaca

SEQ ID NO: 210554 - RNA, 18 nt, Human
uuuuguaguuuuaguaga

SEQ ID NO: 210555 - RNA, 20 nt, Human
uuuuuguaguuuuaguagag

SEQ ID NO: 210556 - RNA, 24 nt, Human
aagaaaaauucaguuuauugagac

SEQ ID NO: 210557 - RNA, 22 nt, Human
gaccagguuauggcgacuucaa

SEQ ID NO: 210558 - RNA, 18 nt, Human
gagucaauaccaugucuc

SEQ ID NO: 210559 - RNA, 22 nt, Human
ugauauugccucucuccccgcc

SEQ ID NO: 210560 - RNA, 23 nt, Human
uggcgacuucaaauagccuucau

SEQ ID NO: 210561 - RNA, 19 nt, Human
uuuauugagacucauauug

SEQ ID NO: 210562 - RNA, 18 nt, Human
uuuuuuuuuuuuuuuucg

SEQ ID NO: 210563 - RNA, 22 nt, Human
uuuuuuuuuuuuuuuuucgcaa

SEQ ID NO: 210564 - RNA, 24 nt, Human
uuuuuuuuuuuuuuuuuuuuucgu

SEQ ID NO: 210565 - RNA, 24 nt, Human
aauaacagaaacacuuuaaaaaga

SEQ ID NO: 210566 - RNA, 19 nt, Human
accgcagccgggagggugc

SEQ ID NO: 210567 - RNA, 18 nt, Human
acgaucuuguaugggcug

SEQ ID NO: 210568 - RNA, 19 nt, Human
acuauauuacucaaugaca

SEQ ID NO: 210569 - RNA, 19 nt, Human
agcagcauggaacaugaug

SEQ ID NO: 210570 - RNA, 19 nt, Human
agccgggagggugcggcca

SEQ ID NO: 210571 - RNA, 18 nt, Human
augacauuuuucugccuu

SEQ ID NO: 210572 - RNA, 18 nt, Human
auggaacaugauggaaca

SEQ ID NO: 210573 - RNA, 21 nt, Human
ccaaggucugaucaucuucuu

SEQ ID NO: 210574 - RNA, 22 nt, Human
ccauccacgaugccuccuacaa

SEQ ID NO: 210575 - RNA, 21 nt, Human
gaagaagagcuggcuauggca

SEQ ID NO: 210576 - RNA, 22 nt, Human
gaauggauucuccaucgagucc

SEQ ID NO: 210577 - RNA, 23 nt, Human
ggcugcaggguggggggcgacag

SEQ ID NO: 210578 - RNA, 24 nt, Human
guaaaauaucagugcaacuuaaaa

SEQ ID NO: 210579 - RNA, 18 nt, Human
gucagcagcagcauggaa

SEQ ID NO: 210580 - RNA, 23 nt, Human
uaaaauaucagugcaacuuaaaa

SEQ ID NO: 210581 - RNA, 18 nt, Human
uaagcagcagagugaugu

SEQ ID NO: 210582 - RNA, 21 nt, Human
uaaguauugaagaagagcugg

SEQ ID NO: 210583 - RNA, 19 nt, Human
uauuggaauggauucucca

SEQ ID NO: 210584 - RNA, 21 nt, Human
uccaaagagccacauggccau

SEQ ID NO: 210585 - RNA, 19 nt, Human
ugaagaagagcuggcuaug

SEQ ID NO: 210586 - RNA, 18 nt, Human
ugacgucagcagcagcau

SEQ ID NO: 210587 - RNA, 22 nt, Human
ugacgucagcagcagcauggaa

SEQ ID NO: 210588 - RNA, 19 nt, Human
uggaacauugcuccaaaga

SEQ ID NO: 210589 - RNA, 19 nt, Human
uggcaagggguuuccagca

SEQ ID NO: 210590 - RNA, 18 nt, Human
uggcugcagggugggggg

SEQ ID NO: 210591 - RNA, 22 nt, Human
uguaugggcuggcuaucugcua

SEQ ID NO: 210592 - RNA, 20 nt, Human
uucauagucacuauauuacu

SEQ ID NO: 210593 - RNA, 23 nt, Human
acgcuggugucuucccuguagac

SEQ ID NO: 210594 - RNA, 21 nt, Human
aggcagguggugcccauggga

SEQ ID NO: 210595 - RNA, 18 nt, Human
aucucucccaccuuuccc

SEQ ID NO: 210596 - RNA, 20 nt, Human
augagggacggaagauucgg

SEQ ID NO: 210597 - RNA, 20 nt, Human
caggagaagccuuguaauug

SEQ ID NO: 210598 - RNA, 19 nt, Human
cauuuuaaaaauauugaaa

SEQ ID NO: 210599 - RNA, 18 nt, Human
cgacaggcaggcaggugg

SEQ ID NO: 210600 - RNA, 21 nt, Human
cgggcgagcgcugcccaggcc

SEQ ID NO: 210601 - RNA, 21 nt, Human
gagcagcuggagacagggugg

SEQ ID NO: 210602 - RNA, 18 nt, Human
gcagcuggagacagggug

SEQ ID NO: 210603 - RNA, 28 nt, Human
gcuaaagcagagaggcuccuucacuccg

SEQ ID NO: 210604 - RNA, 20 nt, Human
ggacaccgcuggacuccccg

SEQ ID NO: 210605 - RNA, 20 nt, Human
uaaauauaaacgcauauauu

SEQ ID NO: 210606 - RNA, 18 nt, Human
uaugucacuuuucucugu

SEQ ID NO: 210607 - RNA, 20 nt, Human
ucagcaucucucccaccuuu

SEQ ID NO: 210608 - RNA, 22 nt, Human
ucagcaucucucccaccuuucc

SEQ ID NO: 210609 - RNA, 19 nt, Human
uccccgggcgagcgcugcc

SEQ ID NO: 210610 - RNA, 21 nt, Human
uccccgggcgagcgcugccca

SEQ ID NO: 210611 - RNA, 19 nt, Human
ucccuguagacgucuccca

SEQ ID NO: 210612 - RNA, 21 nt, Human
uccugcucagaagccuuuggu

SEQ ID NO: 210613 - RNA, 19 nt, Human
uccugggaagcugggcccu

SEQ ID NO: 210614 - RNA, 22 nt, Human
uccugggaagcugggcccuggg

SEQ ID NO: 210615 - RNA, 18 nt, Human
ucucucccaccuuuccca

SEQ ID NO: 210616 - RNA, 23 nt, Human
ucucugugaacugcaaguuagga

SEQ ID NO: 210617 - RNA, 22 nt, Human
ucuuuagcuaaagcagagaggc

SEQ ID NO: 210618 - RNA, 21 nt, Human
ugagauccugcugggacuucu

SEQ ID NO: 210619 - RNA, 18 nt, Human
ugcccaggccggggggag

SEQ ID NO: 210620 - RNA, 19 nt, Human
ugcccaugggaaugcggag

SEQ ID NO: 210621 - RNA, 21 nt, Human
ugcuccuggagcccgcuuccu

SEQ ID NO: 210622 - RNA, 20 nt, Human
uuccugaauccuucaaugga

SEQ ID NO: 210623 - RNA, 24 nt, Human
uuuauacaagguacaaugucaaaa

SEQ ID NO: 210624 - RNA, 25 nt, Human
uuuauacaagguacaaugucaaaau

SEQ ID NO: 210625 - RNA, 21 nt, Human
aagccaggcaugaaugucaua

SEQ ID NO: 210626 - RNA, 19 nt, Human
aagcccaccugugcuuucc

SEQ ID NO: 210627 - RNA, 22 nt, Human
aaggagaggccaccuauaagca

SEQ ID NO: 210628 - RNA, 20 nt, Human
aaugaccccagcaauauuuc

SEQ ID NO: 210629 - RNA, 21 nt, Human
acaaggagaggccaccuauaa

SEQ ID NO: 210630 - RNA, 23 nt, Human
acaaggagaggccaccuauaagc

SEQ ID NO: 210631 - RNA, 21 nt, Human
acaguacuugaaacauuuugc

SEQ ID NO: 210632 - RNA, 27 nt, Human
acccugagaaucagcgguuaugggagc

SEQ ID NO: 210633 - RNA, 19 nt, Human
accuuuugcuggguggcgu

SEQ ID NO: 210634 - RNA, 19 nt, Human
caaggagaggccaccuaua

SEQ ID NO: 210635 - RNA, 22 nt, Human
caaggagaggccaccuauaaga

SEQ ID NO: 210636 - RNA, 22 nt, Human
cacaauauuaucauuaagcucu

SEQ ID NO: 210637 - RNA, 18 nt, Human
cagcugccccagugugac

SEQ ID NO: 210638 - RNA, 24 nt, Human
cagcugccccagugugacucugcc

SEQ ID NO: 210639 - RNA, 21 nt, Human
caggccacaaggagaggccac

SEQ ID NO: 210640 - RNA, 20 nt, Human
caugacuuugcaugacgcca

SEQ ID NO: 210641 - RNA, 24 nt, Human
cauuccaaucucugcccacauugc

SEQ ID NO: 210642 - RNA, 18 nt, Human
cauuuugcgaagccaggc

SEQ ID NO: 210643 - RNA, 19 nt, Human
ccacaaggagaggccaccu

SEQ ID NO: 210644 - RNA, 22 nt, Human
cccaggccacaaggagaggcca

SEQ ID NO: 210645 - RNA, 20 nt, Human
cccuucccuaggauuacuuc

SEQ ID NO: 210646 - RNA, 19 nt, Human
ccuggcucgcccucugugg

SEQ ID NO: 210647 - RNA, 18 nt, Human
cucagguggucccagccu

SEQ ID NO: 210648 - RNA, 20 nt, Human
cuccucuauuuacuggcucc

SEQ ID NO: 210649 - RNA, 18 nt, Human
cugggcuggcucuucucc

SEQ ID NO: 210650 - RNA, 19 nt, Human
cuggguggcguccuagaag

SEQ ID NO: 210651 - RNA, 18 nt, Human
cugugcuuucccccaucu

SEQ ID NO: 210652 - RNA, 19 nt, Human
cuguguguuagcugugugu

SEQ ID NO: 210653 - RNA, 20 nt, Human
cuucccuaggauuacuucuc

SEQ ID NO: 210654 - RNA, 24 nt, Human
gagcugcccauuccaaucucugcc

SEQ ID NO: 210655 - RNA, 27 nt, Human
gcagcaguggcagcagcucucucgcuu

SEQ ID NO: 210656 - RNA, 25 nt, Human
gcagccccaggugaguucccagcca

SEQ ID NO: 210657 - RNA, 18 nt, Human
gcuggcucuucuccaccc

SEQ ID NO: 210658 - RNA, 22 nt, Human
ggacuuggucugugggccgaua

SEQ ID NO: 210659 - RNA, 22 nt, Human
ggggauguuugggucacugggc

SEQ ID NO: 210660 - RNA, 18 nt, Human
gguccugggcagccggca

SEQ ID NO: 210661 - RNA, 18 nt, Human
guggaggacuuggucugu

SEQ ID NO: 210662 - RNA, 24 nt, Human
uaaaugaccccagcaauauuuccu

SEQ ID NO: 210663 - RNA, 22 nt, Human
uaagcauucaggccagcagccc

SEQ ID NO: 210664 - RNA, 24 nt, Human
uagcagcaguggcagcagcucucu

SEQ ID NO: 210665 - RNA, 18 nt, Human
uauuaucauuaagcucuc

SEQ ID NO: 210666 - RNA, 24 nt, Human
uccaaggcaaagguauaaacaaga

SEQ ID NO: 210667 - RNA, 19 nt, Human
ucucagguggucccagccu

SEQ ID NO: 210668 - RNA, 22 nt, Human
ucugcaauuuguaucagcugcc

SEQ ID NO: 210669 - RNA, 18 nt, Human
ugaccccagcaauauuuc

SEQ ID NO: 210670 - RNA, 20 nt, Human
ugacgccagcugaugccaag

SEQ ID NO: 210671 - RNA, 18 nt, Human
ugagaaaaauaaauguca

SEQ ID NO: 210672 - RNA, 22 nt, Human
ugaucucagguggucccagccu

SEQ ID NO: 210673 - RNA, 20 nt, Human
ugccaagugggacagagaug

SEQ ID NO: 210674 - RNA, 24 nt, Human
ugccaugcaacuuccaaggcaaag

SEQ ID NO: 210675 - RNA, 25 nt, Human
ugcuucaccuguacuccucuauuua

SEQ ID NO: 210676 - RNA, 23 nt, Human
uggcagcagcucucucgcuuccu

SEQ ID NO: 210677 - RNA, 22 nt, Human
uggcucuugcgauccugggaug

SEQ ID NO: 210678 - RNA, 18 nt, Human
uggcuuuggcuucagcau

SEQ ID NO: 210679 - RNA, 22 nt, Human
uggcuuuggcuucagcaugucc

SEQ ID NO: 210680 - RNA, 23 nt, Human
ugguuuuuuuguuuguuuucuaa

SEQ ID NO: 210681 - RNA, 18 nt, Human
uguacuccucuauuuacu

SEQ ID NO: 210682 - RNA, 18 nt, Human
ugugguagcagcaguggc

SEQ ID NO: 210683 - RNA, 19 nt, Human
ugugguagcagcaguggca

SEQ ID NO: 210684 - RNA, 32 nt, Human
ugugguagcagcaguggcagcagcucucucuu

SEQ ID NO: 210685 - RNA, 22 nt, Human
ugugucagcucuaacugaugga

SEQ ID NO: 210686 - RNA, 21 nt, Human
uucccuaggauuacuucucca

SEQ ID NO: 210687 - RNA, 22 nt, Human
uuuuucauaaaugaccccagca

SEQ ID NO: 210688 - RNA, 21 nt, Human
aaaaaaguaaacaagaagcaa

SEQ ID NO: 210689 - RNA, 20 nt, Human
aaaaagacaaacaaaauaaa

SEQ ID NO: 210690 - RNA, 24 nt, Human
aaaaugcuucugucuacagcauug

SEQ ID NO: 210691 - RNA, 23 nt, Human
aagacaaugucuccucccagaac

SEQ ID NO: 210692 - RNA, 19 nt, Human
aaggcaugugaaaucgaga

SEQ ID NO: 210693 - RNA, 24 nt, Human
acaugcuuuguuuugcuuauagga

SEQ ID NO: 210694 - RNA, 26 nt, Human
agaaucuuaucuucuuucuccucugg

SEQ ID NO: 210695 - RNA, 22 nt, Human
agacagaagccaggcccuagga

SEQ ID NO: 210696 - RNA, 21 nt, Human
agugcuuuuucaccuuuuucu

SEQ ID NO: 210697 - RNA, 18 nt, Human
auuugcucuauuccuauc

SEQ ID NO: 210698 - RNA, 19 nt, Human
cagaagccaggcccuagga

SEQ ID NO: 210699 - RNA, 20 nt, Human
cagaagccaggcccuaggag

SEQ ID NO: 210700 - RNA, 27 nt, Human
ccaucagcuccuuucuggggggccgcc

SEQ ID NO: 210701 - RNA, 21 nt, Human
cuacagcauuggcuaauagua

SEQ ID NO: 210702 - RNA, 24 nt, Human
cuaggcagaacugauaauagugcu

SEQ ID NO: 210703 - RNA, 19 nt, Human
cuuauaggagaauuugcau

SEQ ID NO: 210704 - RNA, 23 nt, Human
cuuguaaaaccucaacaaauugc

SEQ ID NO: 210705 - RNA, 22 nt, Human
gaaaaugguuacgaugugaaac

SEQ ID NO: 210706 - RNA, 19 nt, Human
gaacaaauaaacauuuucu

SEQ ID NO: 210707 - RNA, 20 nt, Human
gaaggaugaggguuccugag

SEQ ID NO: 210708 - RNA, 25 nt, Human
gacaugcuuuguuuugcuuauagga

SEQ ID NO: 210709 - RNA, 27 nt, Human
gacuugcuguaucucuuguaaaaccuc

SEQ ID NO: 210710 - RNA, 23 nt, Human
uaaaaacaaagaggaggaaauac

SEQ ID NO: 210711 - RNA, 25 nt, Human
uaaaaagacaaacaaaauaaaguag

SEQ ID NO: 210712 - RNA, 22 nt, Human
uaaacaagaagcaaauugguac

SEQ ID NO: 210713 - RNA, 19 nt, Human
uaaauaacuuaaagcccuu

SEQ ID NO: 210714 - RNA, 26 nt, Human
uaaauaauaaaauucccaagcccaga

SEQ ID NO: 210715 - RNA, 24 nt, Human
uacagaaggauuuuauuauaaggg

SEQ ID NO: 210716 - RNA, 19 nt, Human
uacgaugugaaacuugaaa

SEQ ID NO: 210717 - RNA, 18 nt, Human
uacuauauccguauguug

SEQ ID NO: 210718 - RNA, 22 nt, Human
uagauccuuaaauagcucaaau

SEQ ID NO: 210719 - RNA, 21 nt, Human
uaggcagaacugauaauagug

SEQ ID NO: 210720 - RNA, 22 nt, Human
uauauccguauguuguaaagac

SEQ ID NO: 210721 - RNA, 22 nt, Human
uaucuuacauuuaccuaggcag

SEQ ID NO: 210722 - RNA, 22 nt, Human
uccgaaaugaggcugucuuuga

SEQ ID NO: 210723 - RNA, 22 nt, Human
ucuacagcauuggcuaauagua

SEQ ID NO: 210724 - RNA, 19 nt, Human
ucucugaggggccuuaauc

SEQ ID NO: 210725 - RNA, 20 nt, Human
ugaaacuugaaacuacucug

SEQ ID NO: 210726 - RNA, 20 nt, Human
ugaagacaaugucuccuccc

SEQ ID NO: 210727 - RNA, 22 nt, Human
ugaggaagagaaaaauguuggu

SEQ ID NO: 210728 - RNA, 21 nt, Human
ugaggguuccugaggggcugg

SEQ ID NO: 210729 - RNA, 22 nt, Human
ugaggguuccugaggggcuggg

SEQ ID NO: 210730 - RNA, 21 nt, Human
ugagucuaggggagaaacugg

SEQ ID NO: 210731 - RNA, 20 nt, Human
ugccuuaagaacucuaauga

SEQ ID NO: 210732 - RNA, 21 nt, Human
uggaauuuuggguauuuccag

SEQ ID NO: 210733 - RNA, 20 nt, Human
uggaugaguuugugccugcc

SEQ ID NO: 210734 - RNA, 19 nt, Human
uuaguccgaaaugaggcug

SEQ ID NO: 210735 - RNA, 18 nt, Human
uuccugaggggcuggguc

SEQ ID NO: 210736 - RNA, 18 nt, Human
ccugcagcugcugcccgc

SEQ ID NO: 210737 - RNA, 19 nt, Human
gugcaaggaggauggucuc

SEQ ID NO: 210738 - RNA, 23 nt, Human
ucuuggcacaaaggugcaaggag

SEQ ID NO: 210739 - RNA, 24 nt, Human
uggcacaaaggugcaaggaggaug

SEQ ID NO: 210740 - RNA, 21 nt, Human
uggucucgggcugcuggccug

SEQ ID NO: 210741 - RNA, 22 nt, Human
uuggcacaaaggugcaaggagg

SEQ ID NO: 210742 - RNA, 23 nt, Human
cagcagccaucguggcaggcuug

SEQ ID NO: 210743 - RNA, 28 nt, Human
ccugcugacaccugcuacuugacaugga

SEQ ID NO: 210744 - RNA, 19 nt, Human
ucaaucucucuaaaguaga

SEQ ID NO: 210745 - RNA, 25 nt, Human
ucguggcaggcuugugaucuuuuuc

SEQ ID NO: 210746 - RNA, 22 nt, Human
ucugcacagaaagcaguggcau

SEQ ID NO: 210747 - RNA, 19 nt, Human
ugacaccugcuacuugaca

SEQ ID NO: 210748 - RNA, 24 nt, Human
ugaggugguacuuggggcagacac

SEQ ID NO: 210749 - RNA, 21 nt, Human
ugcuacuugacauggagaagu

SEQ ID NO: 210750 - RNA, 24 nt, Human
ugugaucuuuuuccugcugacacc

SEQ ID NO: 210751 - RNA, 18 nt, Human
uucaugaggugguacuug

SEQ ID NO: 210752 - RNA, 18 nt, Human
uuggggcagacacugaga

SEQ ID NO: 210753 - RNA, 19 nt, Human
uuggggcagacacugagag

SEQ ID NO: 210754 - RNA, 26 nt, Human
uuuccugcugacaccugcuacuugac

SEQ ID NO: 210755 - RNA, 18 nt, Human
uuuuccugcugacaccuu

SEQ ID NO: 210756 - RNA, 21 nt, Human
aaacaaacaaauaaaaccagg

SEQ ID NO: 210757 - RNA, 24 nt, Human
aaaccuuuccugagagaaaaugac

SEQ ID NO: 210758 - RNA, 19 nt, Human
aaagauauuuauuuggaua

SEQ ID NO: 210759 - RNA, 19 nt, Human
aaagccccccauccugucc

SEQ ID NO: 210760 - RNA, 24 nt, Human
aagugcagguuuuccccaaagccc

SEQ ID NO: 210761 - RNA, 26 nt, Human
acccucagcagcaucucugcuccucu

SEQ ID NO: 210762 - RNA, 21 nt, Human
agcacagcccucaggcagccc

SEQ ID NO: 210763 - RNA, 22 nt, Human
agcuuccggcggcccuaagcag

SEQ ID NO: 210764 - RNA, 22 nt, Human
agggaccagccuccagcagguc

SEQ ID NO: 210765 - RNA, 21 nt, Human
caaacaaauaaaaccaggggc

SEQ ID NO: 210766 - RNA, 21 nt, Human
caaagccccccauccuguccc

SEQ ID NO: 210767 - RNA, 21 nt, Human
caauaacagcuuccuccucag

SEQ ID NO: 210768 - RNA, 20 nt, Human
cacagcccucaggcagcccc

SEQ ID NO: 210769 - RNA, 22 nt, Human
cacucagucacaagucgggcac

SEQ ID NO: 210770 - RNA, 20 nt, Human
cagacagcacuucacagggg

SEQ ID NO: 210771 - RNA, 18 nt, Human
caggggcucuuucuucuu

SEQ ID NO: 210772 - RNA, 25 nt, Human
cccaaagccccccauccugucccgg

SEQ ID NO: 210773 - RNA, 26 nt, Human
cccagccccaaaccuggcagcuuggc

SEQ ID NO: 210774 - RNA, 23 nt, Human
ccccaaaccuggcagcuuggccu

SEQ ID NO: 210775 - RNA, 21 nt, Human
ccccagccccaaaccuggcag

SEQ ID NO: 210776 - RNA, 25 nt, Human
ccccugggaucccaguuucucacuc

SEQ ID NO: 210777 - RNA, 22 nt, Human
ccuccacccucagcagcaucuc

SEQ ID NO: 210778 - RNA, 21 nt, Human
ccucucccucucagcacagcc

SEQ ID NO: 210779 - RNA, 21 nt, Human
ccuggcagcuuggccucccuc

SEQ ID NO: 210780 - RNA, 21 nt, Human
cgggauccugcugcuccagac

SEQ ID NO: 210781 - RNA, 19 nt, Human
cucacuccacuuggccccc

SEQ ID NO: 210782 - RNA, 18 nt, Human
cuccagacagcacuucac

SEQ ID NO: 210783 - RNA, 18 nt, Human
cucccucucagcacagcc

SEQ ID NO: 210784 - RNA, 21 nt, Human
cuggagcagguuaggaguccu

SEQ ID NO: 210785 - RNA, 19 nt, Human
cuucacaggggccaagcau

SEQ ID NO: 210786 - RNA, 25 nt, Human
cuuggcccccagccccaaaccuggc

SEQ ID NO: 210787 - RNA, 24 nt, Human
gaaugcacccaaaguagaugcuca

SEQ ID NO: 210788 - RNA, 21 nt, Human
gaucccaguuucucacuccac

SEQ ID NO: 210789 - RNA, 21 nt, Human
gcagcccucugcacugaccug

SEQ ID NO: 210790 - RNA, 18 nt, Human
gcccccagccccaaaccu

SEQ ID NO: 210791 - RNA, 19 nt, Human
ggaagagacaggaguggug

SEQ ID NO: 210792 - RNA, 21 nt, Human
ggaucccaguuucucacucca

SEQ ID NO: 210793 - RNA, 22 nt, Human
gguagcaggggaugggaaaaga

SEQ ID NO: 210794 - RNA, 22 nt, Human
gguuguacaccuggcuccaggu

SEQ ID NO: 210795 - RNA, 18 nt, Human
guagcaggggaugggaaa

SEQ ID NO: 210796 - RNA, 28 nt, Human
uaaaucucuauacauucaauaacagcuu

SEQ ID NO: 210797 - RNA, 23 nt, Human
uacacuagaaugcacccaaagua

SEQ ID NO: 210798 - RNA, 23 nt, Human
uagcaggggaugggaaaagagga

SEQ ID NO: 210799 - RNA, 21 nt, Human
ucacaggggccaagcaucugg

SEQ ID NO: 210800 - RNA, 19 nt, Human
ucaggcagcccucugcacu

SEQ ID NO: 210801 - RNA, 21 nt, Human
ucccaaaaagggaccagccuc

SEQ ID NO: 210802 - RNA, 20 nt, Human
uccccaaagccccccauccu

SEQ ID NO: 210803 - RNA, 22 nt, Human
uccccaaagccccccauccugu

SEQ ID NO: 210804 - RNA, 20 nt, Human
ucccccugggaucccaguuu

SEQ ID NO: 210805 - RNA, 23 nt, Human
ucccgggauccugcugcuccaga

SEQ ID NO: 210806 - RNA, 20 nt, Human
ugacuggagcagguuaggag

SEQ ID NO: 210807 - RNA, 24 nt, Human
ugaguaaacaaacaaauaaaacca

SEQ ID NO: 210808 - RNA, 18 nt, Human
ugccugugcugggccagg

SEQ ID NO: 210809 - RNA, 20 nt, Human
uggcccccagccccaaaccu

SEQ ID NO: 210810 - RNA, 27 nt, Human
uggcccccagccccaaaccuggcagcu

SEQ ID NO: 210811 - RNA, 19 nt, Human
ugggccaggguagcagggg

SEQ ID NO: 210812 - RNA, 22 nt, Human
uuccccaaagccccccauccug

SEQ ID NO: 210813 - RNA, 23 nt, Human
uuguacaccuggcuccagguuuc

SEQ ID NO: 210814 - RNA, 25 nt, Human
uuuuuuuuuuuuuuuuuucauuuuu

SEQ ID NO: 210815 - RNA, 24 nt, Human
aaguagcuaggacuacaggcaugu

SEQ ID NO: 210816 - RNA, 27 nt, Human
aaguagcuaggacuacaggcauguguc

SEQ ID NO: 210817 - RNA, 24 nt, Human
aaugugcugggauuacaggcguga

SEQ ID NO: 210818 - RNA, 19 nt, Human
acacacgaacauauacaca

SEQ ID NO: 210819 - RNA, 19 nt, Human
acaugcagacauguacaca

SEQ ID NO: 210820 - RNA, 18 nt, Human
accauguuggccaggcug

SEQ ID NO: 210821 - RNA, 19 nt, Human
agagugauccaccugccuc

SEQ ID NO: 210822 - RNA, 21 nt, Human
agcgggcuguguggauucccc

SEQ ID NO: 210823 - RNA, 23 nt, Human
aggcgugagccaccgugcccggc

SEQ ID NO: 210824 - RNA, 24 nt, Human
aggcuggcucaaacuccugaccuc

SEQ ID NO: 210825 - RNA, 25 nt, Human
aggcuuucuuuuccgcccucgugcc

SEQ ID NO: 210826 - RNA, 23 nt, Human
agugauccaccugccucggccuc

SEQ ID NO: 210827 - RNA, 24 nt, Human
agugcaauggcacaaucucggcuc

SEQ ID NO: 210828 - RNA, 22 nt, Human
aguggagaugggguuucaccau

SEQ ID NO: 210829 - RNA, 18 nt, Human
augggguuucaccauguu

SEQ ID NO: 210830 - RNA, 22 nt, Human
augggguuucaccauguuggcc

SEQ ID NO: 210831 - RNA, 23 nt, Human
augggguuucaccauguuggcca

SEQ ID NO: 210832 - RNA, 24 nt, Human
augggguuucaccauguuggccag

SEQ ID NO: 210833 - RNA, 31 nt, Human
auguacacacagaugaauacgugcacacagu

SEQ ID NO: 210834 - RNA, 24 nt, Human
auuuuucuauuuuuaguggagaug

SEQ ID NO: 210835 - RNA, 22 nt, Human
caagcaauucuccugccucagc

SEQ ID NO: 210836 - RNA, 27 nt, Human
caagcaauucuccugccucagccuccc

SEQ ID NO: 210837 - RNA, 24 nt, Human
caaugugcugggauuacaggcgug

SEQ ID NO: 210838 - RNA, 21 nt, Human
caccauguuggccaggcuggc

SEQ ID NO: 210839 - RNA, 23 nt, Human
caccauguuggccaggcuggcuc

SEQ ID NO: 210840 - RNA, 26 nt, Human
caccauguuggccaggcuggcucaaa

SEQ ID NO: 210841 - RNA, 18 nt, Human
cacugcaaccucugccuc

SEQ ID NO: 210842 - RNA, 21 nt, Human
cacugcaaccucugccuccca

SEQ ID NO: 210843 - RNA, 22 nt, Human
cagaccgcugcacaaagaaaag

SEQ ID NO: 210844 - RNA, 24 nt, Human
cagcgagcgaacguucugaggcuu

SEQ ID NO: 210845 - RNA, 22 nt, Human
cauauacacaugcagacaugua

SEQ ID NO: 210846 - RNA, 24 nt, Human
cauguacacacagaugaauacgug

SEQ ID NO: 210847 - RNA, 23 nt, Human
cauguuggccaggcuggcucaaa

SEQ ID NO: 210848 - RNA, 20 nt, Human
ccaaugugcugggauuacag

SEQ ID NO: 210849 - RNA, 22 nt, Human
ccaaugugcugggauuacaggc

SEQ ID NO: 210850 - RNA, 24 nt, Human
ccaaugugcugggauuacaggcgu

SEQ ID NO: 210851 - RNA, 21 nt, Human
ccauuagcuccugggagcggg

SEQ ID NO: 210852 - RNA, 24 nt, Human
cccaaguagcuaggacuacaggca

SEQ ID NO: 210853 - RNA, 24 nt, Human
ccucccagauucaagcaauucucc

SEQ ID NO: 210854 - RNA, 24 nt, Human
ccugaccucagagugauccaccug

SEQ ID NO: 210855 - RNA, 21 nt, Human
ccugccucggccucccaaugu

SEQ ID NO: 210856 - RNA, 24 nt, Human
ccugccucggccucccaaugugcu

SEQ ID NO: 210857 - RNA, 24 nt, Human
cgcucugucauccaggcugcagug

SEQ ID NO: 210858 - RNA, 24 nt, Human
cgugagccaccgugcccggcccau

SEQ ID NO: 210859 - RNA, 20 nt, Human
cucaaggcugggaucugggc

SEQ ID NO: 210860 - RNA, 24 nt, Human
cucacugcaaccucugccucccag

SEQ ID NO: 210861 - RNA, 24 nt, Human
cucccaaguagcuaggacuacagg

SEQ ID NO: 210862 - RNA, 21 nt, Human
cuccugggagcgggcugugug

SEQ ID NO: 210863 - RNA, 23 nt, Human
cugcaaccucugccucccagauu

SEQ ID NO: 210864 - RNA, 24 nt, Human
cugcaaccucugccucccagauuc

SEQ ID NO: 210865 - RNA, 23 nt, Human
cugccucagccucccaaguagcu

SEQ ID NO: 210866 - RNA, 25 nt, Human
gaccucagagugauccaccugccuc

SEQ ID NO: 210867 - RNA, 24 nt, Human
gacuacaggcaugugucaccaugc

SEQ ID NO: 210868 - RNA, 18 nt, Human
gagaugggguuucaccau

SEQ ID NO: 210869 - RNA, 24 nt, Human
gagaugggguuucaccauguuggc

SEQ ID NO: 210870 - RNA, 24 nt, Human
gagcgggcuguguggauuccccug

SEQ ID NO: 210871 - RNA, 18 nt, Human
gauuacaggcgugagcca

SEQ ID NO: 210872 - RNA, 21 nt, Human
gauuacaggcgugagccaccg

SEQ ID NO: 210873 - RNA, 24 nt, Human
gauuacaggcgugagccaccgugc

SEQ ID NO: 210874 - RNA, 20 nt, Human
gccucagccucccaaguagc

SEQ ID NO: 210875 - RNA, 22 nt, Human
gcuggcucaaacuccugaccuc

SEQ ID NO: 210876 - RNA, 22 nt, Human
ggacuacaggcaugugucacca

SEQ ID NO: 210877 - RNA, 24 nt, Human
ggacuacaggcaugugucaccaug

SEQ ID NO: 210878 - RNA, 24 nt, Human
ggcucaaacuccugaccucagagu

SEQ ID NO: 210879 - RNA, 20 nt, Human
gggcggucccuggggagccg

SEQ ID NO: 210880 - RNA, 22 nt, Human
gggguuucaccauguuggccag

SEQ ID NO: 210881 - RNA, 24 nt, Human
gugauccaccugccucggccuccc

SEQ ID NO: 210882 - RNA, 21 nt, Human
gugcugggauuacaggcguga

SEQ ID NO: 210883 - RNA, 23 nt, Human
guggagaugggguuucaccaugu

SEQ ID NO: 210884 - RNA, 19 nt, Human
uaaccagaccgcugcacaa

SEQ ID NO: 210885 - RNA, 23 nt, Human
uaauuuuucuauuuuuaguggag

SEQ ID NO: 210886 - RNA, 24 nt, Human
uaauuuuucuauuuuuaguggaga

SEQ ID NO: 210887 - RNA, 23 nt, Human
uacaggcaugugucaccaugccc

SEQ ID NO: 210888 - RNA, 23 nt, Human
uacaggcgugagccaccgugccc

SEQ ID NO: 210889 - RNA, 24 nt, Human
uaggacuacaggcaugugucacca

SEQ ID NO: 210890 - RNA, 24 nt, Human
uaguggagaugggguuucaccaug

SEQ ID NO: 210891 - RNA, 24 nt, Human
uauacacaugcagacauguacaca

SEQ ID NO: 210892 - RNA, 18 nt, Human
ucacugcaaccucugccu

SEQ ID NO: 210893 - RNA, 19 nt, Human
ucacugcaaccucugccuc

SEQ ID NO: 210894 - RNA, 23 nt, Human
ucacugcaaccucugccucccag

SEQ ID NO: 210895 - RNA, 24 nt, Human
ucacugcaaccucugccucccaga

SEQ ID NO: 210896 - RNA, 23 nt, Human
ucagagugauccaccugccucgg

SEQ ID NO: 210897 - RNA, 18 nt, Human
ucagccucccaaguagcu

SEQ ID NO: 210898 - RNA, 20 nt, Human
ucagccucccaaguagcuag

SEQ ID NO: 210899 - RNA, 20 nt, Human
uccaggcugcagugcaaugg

SEQ ID NO: 210900 - RNA, 19 nt, Human
ucccaaaugcccgccacau

SEQ ID NO: 210901 - RNA, 24 nt, Human
ucccaaguagcuaggacuacaggc

SEQ ID NO: 210902 - RNA, 24 nt, Human
ucccaaugugcugggauuacaggc

SEQ ID NO: 210903 - RNA, 21 nt, Human
ucccagauucaagcaauucuc

SEQ ID NO: 210904 - RNA, 24 nt, Human
ucccagauucaagcaauucuccug

SEQ ID NO: 210905 - RNA, 26 nt, Human
ucuccugccucagccucccaaguagc

SEQ ID NO: 210906 - RNA, 19 nt, Human
ucucgcucugucauccagg

SEQ ID NO: 210907 - RNA, 22 nt, Human
ucucgcucugucauccaggcug

SEQ ID NO: 210908 - RNA, 26 nt, Human
ucucgcucugucauccaggcugcagu

SEQ ID NO: 210909 - RNA, 27 nt, Human
ucucgcucugucauccaggcugcagug

SEQ ID NO: 210910 - RNA, 24 nt, Human
ucugucauccaggcugcagugcaa

SEQ ID NO: 210911 - RNA, 25 nt, Human
ugaccucagagugauccaccugccu

SEQ ID NO: 210912 - RNA, 18 nt, Human
ugagauagagucucgcuc

SEQ ID NO: 210913 - RNA, 22 nt, Human
ugagauagagucucgcucuguc

SEQ ID NO: 210914 - RNA, 20 nt, Human
ugcccggcuaauuuuucuau

SEQ ID NO: 210915 - RNA, 23 nt, Human
ugccucagccucccaaguagcua

SEQ ID NO: 210916 - RNA, 24 nt, Human
ugccucagccucccaaguagcuag

SEQ ID NO: 210917 - RNA, 21 nt, Human
ugccucggccucccaaugugc

SEQ ID NO: 210918 - RNA, 24 nt, Human
ugccucggccucccaaugugcugg

SEQ ID NO: 210919 - RNA, 24 nt, Human
ugcugggauuacaggcgugagcca

SEQ ID NO: 210920 - RNA, 24 nt, Human
uggcacaaucucggcucacugcaa

SEQ ID NO: 210921 - RNA, 18 nt, Human
ugggauuacaggcgugag

SEQ ID NO: 210922 - RNA, 21 nt, Human
ugggauuacaggcgugagcca

SEQ ID NO: 210923 - RNA, 22 nt, Human
ugggauuacaggcgugagccac

SEQ ID NO: 210924 - RNA, 23 nt, Human
ugggauuacaggcgugagccacc

SEQ ID NO: 210925 - RNA, 23 nt, Human
ugggauuacaggcgugagccacc

SEQ ID NO: 210926 - RNA, 24 nt, Human
ugggauuacaggcgugagccaccg

SEQ ID NO: 210927 - RNA, 24 nt, Human
ugggguuucaccauguuggccagg

SEQ ID NO: 210928 - RNA, 18 nt, Human
uguguggauuccccuggg

SEQ ID NO: 210929 - RNA, 18 nt, Human
uuaguggagaugggguuu

SEQ ID NO: 210930 - RNA, 22 nt, Human
uuaguggagaugggguuucacc

SEQ ID NO: 210931 - RNA, 24 nt, Human
uuaguggagaugggguuucaccau

SEQ ID NO: 210932 - RNA, 21 nt, Human
uucaagcaauucuccugccuc

SEQ ID NO: 210933 - RNA, 24 nt, Human
uucaagcaauucuccugccucagc

SEQ ID NO: 210934 - RNA, 24 nt, Human
uuggccaggcuggcucaaacuccu

SEQ ID NO: 210935 - RNA, 21 nt, Human
uuucaccauguuggccaggcu

SEQ ID NO: 210936 - RNA, 24 nt, Human
uuuuuaguggagaugggguuucac

SEQ ID NO: 210937 - RNA, 25 nt, Human
uuuuuuuuuuuugagauagagucuc

SEQ ID NO: 210938 - RNA, 20 nt, Human
uuuuuuuuuuuuuuuuuugg

SEQ ID NO: 210939 - RNA, 24 nt, Human
aaagggcugggauuacaggcguga

SEQ ID NO: 210940 - RNA, 19 nt, Human
aacaccugaccucugguga

SEQ ID NO: 210941 - RNA, 24 nt, Human
accauguuggucaggcuggucuug

SEQ ID NO: 210942 - RNA, 21 nt, Human
agccagaguuggcagccagga

SEQ ID NO: 210943 - RNA, 18 nt, Human
aggaagcgaucuggaagg

SEQ ID NO: 210944 - RNA, 24 nt, Human
agggcugggauuacaggcgugagc

SEQ ID NO: 210945 - RNA, 24 nt, Human
agugauucuccugccucagccucu

SEQ ID NO: 210946 - RNA, 20 nt, Human
augagguuucaccauguugg

SEQ ID NO: 210947 - RNA, 21 nt, Human
augagguuucaccauguuggu

SEQ ID NO: 210948 - RNA, 24 nt, Human
augagguuucaccauguuggucag

SEQ ID NO: 210949 - RNA, 25 nt, Human
auuuuuaguagagaugagguuucac

SEQ ID NO: 210950 - RNA, 24 nt, Human
caaagggcugggauuacaggcgug

SEQ ID NO: 210951 - RNA, 22 nt, Human
caagugauucuccugccucagc

SEQ ID NO: 210952 - RNA, 21 nt, Human
caccauguuggucaggcuggu

SEQ ID NO: 210953 - RNA, 23 nt, Human
caccauguuggucaggcuggucu

SEQ ID NO: 210954 - RNA, 24 nt, Human
caccauguuggucaggcuggucuu

SEQ ID NO: 210955 - RNA, 26 nt, Human
caccugaccucuggugaucugcccgc

SEQ ID NO: 210956 - RNA, 24 nt, Human
cacuacacucagcuaauuuuuagu

SEQ ID NO: 210957 - RNA, 24 nt, Human
cauguuggucaggcuggucuugaa

SEQ ID NO: 210958 - RNA, 22 nt, Human
ccaaagggcugggauuacaggc

SEQ ID NO: 210959 - RNA, 23 nt, Human
ccaaagggcugggauuacaggcg

SEQ ID NO: 210960 - RNA, 24 nt, Human
ccaaagggcugggauuacaggcgu

SEQ ID NO: 210961 - RNA, 22 nt, Human
ccacaaccucuaccuccggagu

SEQ ID NO: 210962 - RNA, 21 nt, Human
ccugaccucuggugaucuggu

SEQ ID NO: 210963 - RNA, 24 nt, Human
cgccucagccucccaaagggcugg

SEQ ID NO: 210964 - RNA, 24 nt, Human
cucagccucuugaguagcugggau

SEQ ID NO: 210965 - RNA, 23 nt, Human
cugccucagccucuugaguagcu

SEQ ID NO: 210966 - RNA, 18 nt, Human
gagaggaagcgaucugga

SEQ ID NO: 210967 - RNA, 24 nt, Human
gagaugagguuucaccauguuggu

SEQ ID NO: 210968 - RNA, 22 nt, Human
gagguuucaccauguuggucag

SEQ ID NO: 210969 - RNA, 24 nt, Human
gaguagcugggauugagggcaugc

SEQ ID NO: 210970 - RNA, 18 nt, Human
gauuacaggcgugagcca

SEQ ID NO: 210971 - RNA, 22 nt, Human
gauuacaggcgugagccacugc

SEQ ID NO: 210972 - RNA, 22 nt, Human
gauuacaggcgugagccacugc

SEQ ID NO: 210973 - RNA, 21 nt, Human
gcaauggugcaaucucggcuc

SEQ ID NO: 210974 - RNA, 21 nt, Human
gcuguuguugcccaggcuaga

SEQ ID NO: 210975 - RNA, 23 nt, Human
ggagugcaagugauucuccugcc

SEQ ID NO: 210976 - RNA, 21 nt, Human
ggcagccaggagggcaaaaug

SEQ ID NO: 210977 - RNA, 24 nt, Human
ggcuggucuugaacaccugaccuc

SEQ ID NO: 210978 - RNA, 18 nt, Human
ggucuugaacaccugacc

SEQ ID NO: 210979 - RNA, 24 nt, Human
gugaucugcccgccucagccuccc

SEQ ID NO: 210980 - RNA, 24 nt, Human
gugauucuccugccucagccucuu

SEQ ID NO: 210981 - RNA, 24 nt, Human
uaauuuuuaguauuuuuaguagag

SEQ ID NO: 210982 - RNA, 25 nt, Human
uaauuuuuaguauuuuuaguagaga

SEQ ID NO: 210983 - RNA, 19 nt, Human
uacaggcgugagccacugc

SEQ ID NO: 210984 - RNA, 23 nt, Human
uacaggcgugagccacugcgccc

SEQ ID NO: 210985 - RNA, 22 nt, Human
uagagaugagguuucaccaugu

SEQ ID NO: 210986 - RNA, 24 nt, Human
uaguagagaugagguuucaccaug

SEQ ID NO: 210987 - RNA, 26 nt, Human
uaguagagaugagguuucaccauguu

SEQ ID NO: 210988 - RNA, 24 nt, Human
uaguuuguugcgagaggaagcgau

SEQ ID NO: 210989 - RNA, 27 nt, Human
ucaccacaaccucuaccuccggagugc

SEQ ID NO: 210990 - RNA, 20 nt, Human
ucagccucuugaguagcugg

SEQ ID NO: 210991 - RNA, 19 nt, Human
ucccaaagggcugggauua

SEQ ID NO: 210992 - RNA, 23 nt, Human
ucccaaagggcugggauuacagg

SEQ ID NO: 210993 - RNA, 24 nt, Human
ucccaaagggcugggauuacaggc

SEQ ID NO: 210994 - RNA, 24 nt, Human
uccggagugcaagugauucuccug

SEQ ID NO: 210995 - RNA, 24 nt, Human
ucuccugccucagccucuugagua

SEQ ID NO: 210996 - RNA, 21 nt, Human
ucugcccgccucagccuccca

SEQ ID NO: 210997 - RNA, 25 nt, Human
ucuggaaggucugagguuccuuucc

SEQ ID NO: 210998 - RNA, 24 nt, Human
ucuugaguagcugggauugagggc

SEQ ID NO: 210999 - RNA, 25 nt, Human
ucuugaguagcugggauugagggca

SEQ ID NO: 211000 - RNA, 20 nt, Human
ugaccucuggugaucugccc

SEQ ID NO: 211001 - RNA, 24 nt, Human
ugagguuucaccauguuggucagg

SEQ ID NO: 211002 - RNA, 20 nt, Human
ugauucuccugccucagccu

SEQ ID NO: 211003 - RNA, 23 nt, Human
ugcaagugauucuccugccucag

SEQ ID NO: 211004 - RNA, 21 nt, Human
ugcccaggcuagagcgcaaug

SEQ ID NO: 211005 - RNA, 24 nt, Human
ugccucagccucuugaguagcugg

SEQ ID NO: 211006 - RNA, 22 nt, Human
ugggagacaauuccuugcugac

SEQ ID NO: 211007 - RNA, 23 nt, Human
ugggagacaauuccuugcugacu

SEQ ID NO: 211008 - RNA, 18 nt, Human
ugggauuacaggcgugag

SEQ ID NO: 211009 - RNA, 19 nt, Human
ugggauuacaggcgugagc

SEQ ID NO: 211010 - RNA, 21 nt, Human
ugggauuacaggcgugagcca

SEQ ID NO: 211011 - RNA, 22 nt, Human
ugggauuacaggcgugagccac

SEQ ID NO: 211012 - RNA, 22 nt, Human
ugggauuacaggcgugagccac

SEQ ID NO: 211013 - RNA, 24 nt, Human
ugggauuacaggcgugagccacug

SEQ ID NO: 211014 - RNA, 26 nt, Human
ugggauuacaggcgugagccacugcg

SEQ ID NO: 211015 - RNA, 22 nt, Human
ugggauugagggcaugcgucac

SEQ ID NO: 211016 - RNA, 24 nt, Human
uggucaggcuggucuugaacaccu

SEQ ID NO: 211017 - RNA, 22 nt, Human
uggugaucugcccgccucagcc

SEQ ID NO: 211018 - RNA, 24 nt, Human
uggugcaaucucggcucaccacaa

SEQ ID NO: 211019 - RNA, 19 nt, Human
uguugcccaggcuagagcg

SEQ ID NO: 211020 - RNA, 22 nt, Human
uguugcccaggcuagagcgcaa

SEQ ID NO: 211021 - RNA, 18 nt, Human
uuaguagagaugagguuu

SEQ ID NO: 211022 - RNA, 22 nt, Human
uuaguagagaugagguuucacc

SEQ ID NO: 211023 - RNA, 24 nt, Human
uuaguagagaugagguuucaccau

SEQ ID NO: 211024 - RNA, 21 nt, Human
uuauuuauuuauuuuauuuuu

SEQ ID NO: 211025 - RNA, 26 nt, Human
uuauuuuauuuuuugagauggaguuu

SEQ ID NO: 211026 - RNA, 22 nt, Human
uugcgagaggaagcgaucugga

SEQ ID NO: 211027 - RNA, 24 nt, Human
uuucaccauguuggucaggcuggu

SEQ ID NO: 211028 - RNA, 24 nt, Human
uuugcuguuguugcccaggcuaga

SEQ ID NO: 211029 - RNA, 21 nt, Human
uuuuaguauuuuuaguagaga

SEQ ID NO: 211030 - RNA, 23 nt, Human
uuuugcuguuguugcccaggcua

SEQ ID NO: 211031 - RNA, 20 nt, Human
aaaaauagucauggcaacac

SEQ ID NO: 211032 - RNA, 21 nt, Human
aaaacugccuuccucccuaga

SEQ ID NO: 211033 - RNA, 23 nt, Human
aaaaucaacaaauguuucagagc

SEQ ID NO: 211034 - RNA, 30 nt, Human
aaaaugccucuucagacacuuaaaaucccu

SEQ ID NO: 211035 - RNA, 27 nt, Human
aaaugccucuucagacacuuaaaaucc

SEQ ID NO: 211036 - RNA, 18 nt, Human
aaccagccuuccgaacug

SEQ ID NO: 211037 - RNA, 22 nt, Human
aaccuggcaaacauuuugauau

SEQ ID NO: 211038 - RNA, 19 nt, Human
accacagcccacagcgcaa

SEQ ID NO: 211039 - RNA, 23 nt, Human
agacacuuaaaauccccucauuc

SEQ ID NO: 211040 - RNA, 18 nt, Human
agacauuuaacuugaaau

SEQ ID NO: 211041 - RNA, 22 nt, Human
agagguuggauaagguuccaga

SEQ ID NO: 211042 - RNA, 19 nt, Human
agccccuccucccacaucc

SEQ ID NO: 211043 - RNA, 20 nt, Human
auucacacaaaaucaacaaa

SEQ ID NO: 211044 - RNA, 25 nt, Human
cacacaaaaucaacaaauguuucag

SEQ ID NO: 211045 - RNA, 18 nt, Human
cacacauaaaauaugagc

SEQ ID NO: 211046 - RNA, 19 nt, Human
caccaugcugccuuaugcc

SEQ ID NO: 211047 - RNA, 27 nt, Human
cacuacaaacauuaaaucacauucuua

SEQ ID NO: 211048 - RNA, 19 nt, Human
caggaaccacuguaaguac

SEQ ID NO: 211049 - RNA, 24 nt, Human
caggaaccacuguaaguacuuuau

SEQ ID NO: 211050 - RNA, 23 nt, Human
caggauacauuaaaugcauccug

SEQ ID NO: 211051 - RNA, 19 nt, Human
cauuucaguuacucaguca

SEQ ID NO: 211052 - RNA, 24 nt, Human
ccacagcccacagcgcaaucuuua

SEQ ID NO: 211053 - RNA, 26 nt, Human
ccacauguucuaaccagccuuccgaa

SEQ ID NO: 211054 - RNA, 22 nt, Human
ccagccccuccucccacauccu

SEQ ID NO: 211055 - RNA, 20 nt, Human
cccacauguucuaaccagcc

SEQ ID NO: 211056 - RNA, 20 nt, Human
cccugccagccccuccuccc

SEQ ID NO: 211057 - RNA, 23 nt, Human
ccgccaaccuaaugacaaguuuc

SEQ ID NO: 211058 - RNA, 21 nt, Human
ccuuaccgagcuuucaagaac

SEQ ID NO: 211059 - RNA, 21 nt, Human
cucugcguugcagggccuuac

SEQ ID NO: 211060 - RNA, 23 nt, Human
cuggagcucaggaugggcugcac

SEQ ID NO: 211061 - RNA, 24 nt, Human
gacacuuaaaauccccucauucga

SEQ ID NO: 211062 - RNA, 18 nt, Human
gaggaaacugaagcacca

SEQ ID NO: 211063 - RNA, 20 nt, Human
gagugaaagcagcauuucag

SEQ ID NO: 211064 - RNA, 18 nt, Human
gaucugcuucccuucccu

SEQ ID NO: 211065 - RNA, 19 nt, Human
gcacaaccagauccauggu

SEQ ID NO: 211066 - RNA, 23 nt, Human
gugcugggcucccuuuggggagu

SEQ ID NO: 211067 - RNA, 18 nt, Human
uaaaaaacaagcaaguaa

SEQ ID NO: 211068 - RNA, 20 nt, Human
uaaaaaacaagcaaguaacu

SEQ ID NO: 211069 - RNA, 18 nt, Human
uaaccagccuuccgaacu

SEQ ID NO: 211070 - RNA, 19 nt, Human
uaagacauuuaacuugaaa

SEQ ID NO: 211071 - RNA, 24 nt, Human
uaauaaaagagaaaagcaaaauca

SEQ ID NO: 211072 - RNA, 19 nt, Human
uagaacauucauguugcuc

SEQ ID NO: 211073 - RNA, 24 nt, Human
uagggagugaaagcagcauuucag

SEQ ID NO: 211074 - RNA, 26 nt, Human
ucaacaaauguuucagagcauccaaa

SEQ ID NO: 211075 - RNA, 18 nt, Human
ucauaugcucagucccca

SEQ ID NO: 211076 - RNA, 21 nt, Human
ucauaugcucaguccccagaa

SEQ ID NO: 211077 - RNA, 19 nt, Human
uccauuucuuuugaauucc

SEQ ID NO: 211078 - RNA, 22 nt, Human
ucccagugcugggcucccuuug

SEQ ID NO: 211079 - RNA, 24 nt, Human
ucccagugcugggcucccuuuggg

SEQ ID NO: 211080 - RNA, 20 nt, Human
ucccuagaucugcuucccuu

SEQ ID NO: 211081 - RNA, 20 nt, Human
ucugcuucccuucccugcuc

SEQ ID NO: 211082 - RNA, 22 nt, Human
ucuguagcuuccauuaguccac

SEQ ID NO: 211083 - RNA, 24 nt, Human
ugaaagagggagaaaaagaauagc

SEQ ID NO: 211084 - RNA, 20 nt, Human
ugagaucaucaagaaggcuc

SEQ ID NO: 211085 - RNA, 24 nt, Human
ugaggaaacugaagcaccaagagg

SEQ ID NO: 211086 - RNA, 20 nt, Human
ugaggaaacugaagcaccag

SEQ ID NO: 211087 - RNA, 19 nt, Human
ugaguucuuuuuggcguuc

SEQ ID NO: 211088 - RNA, 25 nt, Human
ugauauaaacauucacacaaaauca

SEQ ID NO: 211089 - RNA, 23 nt, Human
ugcugaauaugggauugaguaug

SEQ ID NO: 211090 - RNA, 21 nt, Human
ugggagcacgugaccacagcc

SEQ ID NO: 211091 - RNA, 20 nt, Human
uguauacauuuaagacauuu

SEQ ID NO: 211092 - RNA, 24 nt, Human
uguauacauuuaagacauuuaacu

SEQ ID NO: 211093 - RNA, 21 nt, Human
uuaaaacacacaucuaaugua

SEQ ID NO: 211094 - RNA, 21 nt, Human
uuagaauuugugucucuugug

SEQ ID NO: 211095 - RNA, 22 nt, Human
uuauuuugcaucacguccagcu

SEQ ID NO: 211096 - RNA, 25 nt, Human
uucacagaugaggaaacugaagcac

SEQ ID NO: 211097 - RNA, 22 nt, Human
uucccuucccugcucuguagcu

SEQ ID NO: 211098 - RNA, 22 nt, Human
uuggauaagguuccagaggcca

SEQ ID NO: 211099 - RNA, 25 nt, Human
uuuaaaacacacaucuaauguauac

SEQ ID NO: 211100 - RNA, 19 nt, Human
uuucagagcauccaaagug

SEQ ID NO: 211101 - RNA, 19 nt, Human
aaaccacagucucaauccc

SEQ ID NO: 211102 - RNA, 18 nt, Human
aagaggaaggaacuucaa

SEQ ID NO: 211103 - RNA, 20 nt, Human
acacacacacagagcuguga

SEQ ID NO: 211104 - RNA, 23 nt, Human
agagcugugaguucuguccagca

SEQ ID NO: 211105 - RNA, 20 nt, Human
aguauacauaaagucauaug

SEQ ID NO: 211106 - RNA, 24 nt, Human
aguauacauaaagucauauguaca

SEQ ID NO: 211107 - RNA, 27 nt, Human
cacagucucaaucccauuccauugucc

SEQ ID NO: 211108 - RNA, 22 nt, Human
cagcugucucuuuauuuccugc

SEQ ID NO: 211109 - RNA, 24 nt, Human
cauaaaaaaagaggaaggaacuuc

SEQ ID NO: 211110 - RNA, 30 nt, Human
caucucuaucccagggacuggacuggaggg

SEQ ID NO: 211111 - RNA, 22 nt, Human
cauuucugguaaguauuagaag

SEQ ID NO: 211112 - RNA, 19 nt, Human
ccaucaagcuugcuuggug

SEQ ID NO: 211113 - RNA, 24 nt, Human
ccccaucaccauauguuguccuuc

SEQ ID NO: 211114 - RNA, 20 nt, Human
cuaaaccacagucucaaucc

SEQ ID NO: 211115 - RNA, 18 nt, Human
cucccguguuccugucau

SEQ ID NO: 211116 - RNA, 20 nt, Human
gaaggaauugagagcccaac

SEQ ID NO: 211117 - RNA, 22 nt, Human
gccugaacacacacacacagag

SEQ ID NO: 211118 - RNA, 22 nt, Human
ggacuggagggggcuccagggc

SEQ ID NO: 211119 - RNA, 26 nt, Human
uaaaaaaagaggaaggaacuucaagu

SEQ ID NO: 211120 - RNA, 23 nt, Human
uaaagucauauguacaauacaug

SEQ ID NO: 211121 - RNA, 24 nt, Human
uagaagggggauucauauccaggu

SEQ ID NO: 211122 - RNA, 24 nt, Human
uauguacaauacaugguagacaug

SEQ ID NO: 211123 - RNA, 19 nt, Human
uauguuguccuucacagaa

SEQ ID NO: 211124 - RNA, 21 nt, Human
ucaaagcuucugauuucccca

SEQ ID NO: 211125 - RNA, 20 nt, Human
ucaaucccauuccauugucc

SEQ ID NO: 211126 - RNA, 18 nt, Human
ucauauccagguguagag

SEQ ID NO: 211127 - RNA, 19 nt, Human
uccaguccaggaaaucaaa

SEQ ID NO: 211128 - RNA, 24 nt, Human
ucggaccacugggaaaucuuaggg

SEQ ID NO: 211129 - RNA, 20 nt, Human
ucugcucggaccacugggaa

SEQ ID NO: 211130 - RNA, 24 nt, Human
ugaacacacacacacagagcugug

SEQ ID NO: 211131 - RNA, 23 nt, Human
ugaguucuguccagcaacaucuc

SEQ ID NO: 211132 - RNA, 21 nt, Human
ugcccugaguauccccuucaa

SEQ ID NO: 211133 - RNA, 18 nt, Human
uuccauuguccaucaagc

SEQ ID NO: 211134 - RNA, 26 nt, Human
uucccuagccauaaggcagaaguugg

SEQ ID NO: 211135 - RNA, 20 nt, Human
uucugauucugcucggacca

SEQ ID NO: 211136 - RNA, 25 nt, Human
agccugaggccagccagugggacuu

SEQ ID NO: 211137 - RNA, 20 nt, Human
agcggaauaagacagccuga

SEQ ID NO: 211138 - RNA, 20 nt, Human
aggauaucacuuggcucaca

SEQ ID NO: 211139 - RNA, 18 nt, Human
aggauggccugcaggccc

SEQ ID NO: 211140 - RNA, 20 nt, Human
agguaaaauauggaauuuau

SEQ ID NO: 211141 - RNA, 21 nt, Human
cacagacauggacuauaugac

SEQ ID NO: 211142 - RNA, 20 nt, Human
cacuauacagguuccuuguc

SEQ ID NO: 211143 - RNA, 24 nt, Human
ccagccagugggacuuucagcugc

SEQ ID NO: 211144 - RNA, 19 nt, Human
cccacaguaaaccgcacag

SEQ ID NO: 211145 - RNA, 20 nt, Human
cccaggauggccugcaggcc

SEQ ID NO: 211146 - RNA, 23 nt, Human
cccuuucagcagauagaguuuau

SEQ ID NO: 211147 - RNA, 21 nt, Human
cucccacaguaaaccgcacag

SEQ ID NO: 211148 - RNA, 23 nt, Human
gugggacuuucagcugcaagggg

SEQ ID NO: 211149 - RNA, 22 nt, Human
uagaguuuauuacaaauaccac

SEQ ID NO: 211150 - RNA, 22 nt, Human
ucagcugcaaggggccuucccc

SEQ ID NO: 211151 - RNA, 22 nt, Human
ucccaggauggccugcaggccc

SEQ ID NO: 211152 - RNA, 23 nt, Human
ugggaaggcagcccuuuacuccc

SEQ ID NO: 211153 - RNA, 19 nt, Human
ugggacuuucagcugcaag

SEQ ID NO: 211154 - RNA, 22 nt, Human
uuccccaucuccuuccccuuca

SEQ ID NO: 211155 - RNA, 21 nt, Human
uuccccuucaaggugggcugu

SEQ ID NO: 211156 - RNA, 19 nt, Human
aagagucaaagaucggacc

SEQ ID NO: 211157 - RNA, 19 nt, Human
aagcacaacuuggaccaaa

SEQ ID NO: 211158 - RNA, 23 nt, Human
aagcacaacuuggaccaaaaugc

SEQ ID NO: 211159 - RNA, 23 nt, Human
aaguacuagaaugcagaguuucc

SEQ ID NO: 211160 - RNA, 20 nt, Human
acaugcucagcaaaugacua

SEQ ID NO: 211161 - RNA, 21 nt, Human
acuagaaugcagaguuuccug

SEQ ID NO: 211162 - RNA, 20 nt, Human
aggucucccaaguacuagaa

SEQ ID NO: 211163 - RNA, 20 nt, Human
cauaaaaaacuguugcggca

SEQ ID NO: 211164 - RNA, 18 nt, Human
cccaaguacuagaaugca

SEQ ID NO: 211165 - RNA, 21 nt, Human
gggguucccauaaauauagua

SEQ ID NO: 211166 - RNA, 19 nt, Human
ggucucccaaguacuagaa

SEQ ID NO: 211167 - RNA, 20 nt, Human
uaaaacugaggucccagaaa

SEQ ID NO: 211168 - RNA, 23 nt, Human
uaaauaauaauuaaaaaauaaca

SEQ ID NO: 211169 - RNA, 24 nt, Human
uaacaacauuauauguuaguguug

SEQ ID NO: 211170 - RNA, 21 nt, Human
uaagcacaacuuggaccaaaa

SEQ ID NO: 211171 - RNA, 18 nt, Human
uagcauaaaaaacuguug

SEQ ID NO: 211172 - RNA, 19 nt, Human
ucaaacuuacuuaucccag

SEQ ID NO: 211173 - RNA, 18 nt, Human
ucaguagcucugguccuc

SEQ ID NO: 211174 - RNA, 20 nt, Human
ucauguacaugguacauaug

SEQ ID NO: 211175 - RNA, 18 nt, Human
uccacucuuacaaagagu

SEQ ID NO: 211176 - RNA, 19 nt, Human
uccuaggucuguggcuucu

SEQ ID NO: 211177 - RNA, 22 nt, Human
ucucaugguugucaaaguugag

SEQ ID NO: 211178 - RNA, 24 nt, Human
ugaaaaugauaaaacugagguccc

SEQ ID NO: 211179 - RNA, 18 nt, Human
ugaacugucaacacugca

SEQ ID NO: 211180 - RNA, 18 nt, Human
ugacucaaacgccaauga

SEQ ID NO: 211181 - RNA, 23 nt, Human
ugauaaaacugaggucccagaaa

SEQ ID NO: 211182 - RNA, 24 nt, Human
ugauaaaacugaggucccagaaac

SEQ ID NO: 211183 - RNA, 23 nt, Human
ugcccagguaaguuuaauggcaa

SEQ ID NO: 211184 - RNA, 19 nt, Human
ugcccuguauuaaugaaau

SEQ ID NO: 211185 - RNA, 22 nt, Human
uggaauugaaacaagaaugccc

SEQ ID NO: 211186 - RNA, 22 nt, Human
ugguuccacucuuacaaagagu

SEQ ID NO: 211187 - RNA, 23 nt, Human
uguggcuucuuguuucaacugcu

SEQ ID NO: 211188 - RNA, 23 nt, Human
uuaaaaguagaaggcaaacaguu

SEQ ID NO: 211189 - RNA, 22 nt, Human
uuacaggucucccaaguacuag

SEQ ID NO: 211190 - RNA, 19 nt, Human
uuagcuucuucauguacau

SEQ ID NO: 211191 - RNA, 18 nt, Human
uucaucuugaggcucggc

SEQ ID NO: 211192 - RNA, 18 nt, Human
aaaggagagagcugacug

SEQ ID NO: 211193 - RNA, 22 nt, Human
accaaugaauaaaacaaacaaa

SEQ ID NO: 211194 - RNA, 18 nt, Human
agacaacaggaaagucca

SEQ ID NO: 211195 - RNA, 21 nt, Human
agcagccuguugugccuugug

SEQ ID NO: 211196 - RNA, 18 nt, Human
aggcaggcaguugggcau

SEQ ID NO: 211197 - RNA, 24 nt, Human
caaauaaauaaauaaauagggaag

SEQ ID NO: 211198 - RNA, 21 nt, Human
cacugcuacuucuugcccccu

SEQ ID NO: 211199 - RNA, 20 nt, Human
ccgugguuucugucaggcgg

SEQ ID NO: 211200 - RNA, 22 nt, Human
ccuuucuguucccuuucugcca

SEQ ID NO: 211201 - RNA, 21 nt, Human
cucaaaaaccuuucuguuccc

SEQ ID NO: 211202 - RNA, 21 nt, Human
cucaaaaaccuuucuguuccc

SEQ ID NO: 211203 - RNA, 25 nt, Human
cucaaaaaccuuucuguucccuuuc

SEQ ID NO: 211204 - RNA, 27 nt, Human
cuuucuguucccuuucugccagcccua

SEQ ID NO: 211205 - RNA, 24 nt, Human
gaaccaaauguggccgugguuucu

SEQ ID NO: 211206 - RNA, 20 nt, Human
gaauaaauuagaccaaugaa

SEQ ID NO: 211207 - RNA, 24 nt, Human
uaaggcaggcaguugggcauuggu

SEQ ID NO: 211208 - RNA, 19 nt, Human
uacccuaaggcaggcaguu

SEQ ID NO: 211209 - RNA, 24 nt, Human
uccaggcuauagccguacucaaaa

SEQ ID NO: 211210 - RNA, 21 nt, Human
ucugccagcccuagggauuga

SEQ ID NO: 211211 - RNA, 18 nt, Human
ugaagagaaucccagagc

SEQ ID NO: 211212 - RNA, 24 nt, Human
ugacagaggguuucuuagaaccaa

SEQ ID NO: 211213 - RNA, 22 nt, Human
ugaguccacauucagcacagga

SEQ ID NO: 211214 - RNA, 20 nt, Human
ugcuacuucuugcccccuuu

SEQ ID NO: 211215 - RNA, 20 nt, Human
ugggagcgaaugacagaggg

SEQ ID NO: 211216 - RNA, 21 nt, Human
ugggagcgaaugacagagggu

SEQ ID NO: 211217 - RNA, 18 nt, Human
uggggauuggcccugaaa

SEQ ID NO: 211218 - RNA, 26 nt, Human
uucccauuuaaauaaucugagcuuau

SEQ ID NO: 211219 - RNA, 21 nt, Human
uucccuuucugccagcccuag

SEQ ID NO: 211220 - RNA, 22 nt, Human
uugaauaaauuagaccaaugaa

SEQ ID NO: 211221 - RNA, 18 nt, Human
aaagacaacuuugguaca

SEQ ID NO: 211222 - RNA, 21 nt, Human
aaaucaccuauacugccacca

SEQ ID NO: 211223 - RNA, 19 nt, Human
acaaccaaccagagcagcu

SEQ ID NO: 211224 - RNA, 24 nt, Human
acacuugucaguuaccauuaagca

SEQ ID NO: 211225 - RNA, 19 nt, Human
accacucccccaccccacc

SEQ ID NO: 211226 - RNA, 23 nt, Human
accacucccccaccccaccccca

SEQ ID NO: 211227 - RNA, 18 nt, Human
accuucauccagcaugac

SEQ ID NO: 211228 - RNA, 19 nt, Human
acucccccaccccaccccc

SEQ ID NO: 211229 - RNA, 22 nt, Human
agaaaaaucaccuauacugcca

SEQ ID NO: 211230 - RNA, 22 nt, Human
agaagacaaaguggucaggugc

SEQ ID NO: 211231 - RNA, 22 nt, Human
agaauuuauccaaacugggaac

SEQ ID NO: 211232 - RNA, 25 nt, Human
agaccaaaacugagcaacuuuaaaa

SEQ ID NO: 211233 - RNA, 19 nt, Human
agcauaugacaguggcagg

SEQ ID NO: 211234 - RNA, 25 nt, Human
agccacacaacuucagcacagccuc

SEQ ID NO: 211235 - RNA, 19 nt, Human
agcuggcucugcccaggga

SEQ ID NO: 211236 - RNA, 19 nt, Human
agggaagagauaggaaagg

SEQ ID NO: 211237 - RNA, 18 nt, Human
agggaguucuggggggcc

SEQ ID NO: 211238 - RNA, 18 nt, Human
aggggcccugaaacuugc

SEQ ID NO: 211239 - RNA, 21 nt, Human
auagaucccugacucuaugac

SEQ ID NO: 211240 - RNA, 18 nt, Human
auaugacaguggcaggau

SEQ ID NO: 211241 - RNA, 18 nt, Human
aucauuuuagcagcugua

SEQ ID NO: 211242 - RNA, 22 nt, Human
aucuccaaauaaacucacagac

SEQ ID NO: 211243 - RNA, 21 nt, Human
augggaauagagaccagcauc

SEQ ID NO: 211244 - RNA, 18 nt, Human
auucccaccacuccccca

SEQ ID NO: 211245 - RNA, 22 nt, Human
caaauaaacucacagacugaga

SEQ ID NO: 211246 - RNA, 21 nt, Human
caaccaaccagagcagcagag

SEQ ID NO: 211247 - RNA, 22 nt, Human
caagcuucugaugguugccaca

SEQ ID NO: 211248 - RNA, 22 nt, Human
caaggaugccucagccuuuuaa

SEQ ID NO: 211249 - RNA, 20 nt, Human
cacacacagaauguaaacac

SEQ ID NO: 211250 - RNA, 24 nt, Human
cacacacagaauguaaacacgagg

SEQ ID NO: 211251 - RNA, 27 nt, Human
cacagaauguaaacacgaggagacagg

SEQ ID NO: 211252 - RNA, 18 nt, Human
cacccgagcuggcucugc

SEQ ID NO: 211253 - RNA, 18 nt, Human
cacucccccaccccaccc

SEQ ID NO: 211254 - RNA, 22 nt, Human
cacucccccaccccacccccac

SEQ ID NO: 211255 - RNA, 19 nt, Human
cagcacagccuccuccuca

SEQ ID NO: 211256 - RNA, 19 nt, Human
cagcagagccguuaucccu

SEQ ID NO: 211257 - RNA, 20 nt, Human
cagcagagccguuaucccuc

SEQ ID NO: 211258 - RNA, 28 nt, Human
caucaccaccuccucaugcccacaacaa

SEQ ID NO: 211259 - RNA, 18 nt, Human
cauccagugggggaggac

SEQ ID NO: 211260 - RNA, 19 nt, Human
cauuucuucugacaucacc

SEQ ID NO: 211261 - RNA, 24 nt, Human
ccaaacugggaaccagaagacaaa

SEQ ID NO: 211262 - RNA, 21 nt, Human
ccaaauaaacucacagacuga

SEQ ID NO: 211263 - RNA, 24 nt, Human
ccacaauccuugguguuucuuagc

SEQ ID NO: 211264 - RNA, 19 nt, Human
ccaccacucccccacccca

SEQ ID NO: 211265 - RNA, 21 nt, Human
ccacucccccaccccaccccc

SEQ ID NO: 211266 - RNA, 24 nt, Human
ccagagcgagugagccaagauaga

SEQ ID NO: 211267 - RNA, 21 nt, Human
ccaggaccugaggaggagcag

SEQ ID NO: 211268 - RNA, 24 nt, Human
cccaccacucccccaccccacccc

SEQ ID NO: 211269 - RNA, 20 nt, Human
cccaccacucccccaccccc

SEQ ID NO: 211270 - RNA, 20 nt, Human
ccccaccccacccccacaga

SEQ ID NO: 211271 - RNA, 19 nt, Human
ccccagagcgagugagcca

SEQ ID NO: 211272 - RNA, 25 nt, Human
cccccaccccacccccacagaaauc

SEQ ID NO: 211273 - RNA, 23 nt, Human
cccgagcuggcucugcccaggga

SEQ ID NO: 211274 - RNA, 19 nt, Human
ccuaaucuuggaaguggca

SEQ ID NO: 211275 - RNA, 21 nt, Human
ccucugucucuguguccucuc

SEQ ID NO: 211276 - RNA, 19 nt, Human
cuaaucuuggaaguggcau

SEQ ID NO: 211277 - RNA, 23 nt, Human
cucccccaccccacccccacaga

SEQ ID NO: 211278 - RNA, 19 nt, Human
cuccuggcgggagcugugg

SEQ ID NO: 211279 - RNA, 24 nt, Human
cuccuggcgggagcuguggagucu

SEQ ID NO: 211280 - RNA, 19 nt, Human
cugagauuaagguuucagc

SEQ ID NO: 211281 - RNA, 18 nt, Human
cugagcuccaaaucucag

SEQ ID NO: 211282 - RNA, 19 nt, Human
cuguguccucuccuuuuca

SEQ ID NO: 211283 - RNA, 21 nt, Human
cuuaacuaacuacaucugcag

SEQ ID NO: 211284 - RNA, 24 nt, Human
cuuacccagagauuccagccacac

SEQ ID NO: 211285 - RNA, 22 nt, Human
cuuccaagcuucugaugguugc

SEQ ID NO: 211286 - RNA, 22 nt, Human
gaaaaaucaccuauacugccac

SEQ ID NO: 211287 - RNA, 22 nt, Human
gaaaucuuuucauguuauuccc

SEQ ID NO: 211288 - RNA, 20 nt, Human
gaccugaggaggagcaggau

SEQ ID NO: 211289 - RNA, 27 nt, Human
gagggcucaaguagaagcugcaguguc

SEQ ID NO: 211290 - RNA, 22 nt, Human
gaugaugagggaagagauagga

SEQ ID NO: 211291 - RNA, 22 nt, Human
gauucccaccacucccccaccc

SEQ ID NO: 211292 - RNA, 19 nt, Human
gcacagccuccuccucagu

SEQ ID NO: 211293 - RNA, 21 nt, Human
gcagagaccuuaucuccaaau

SEQ ID NO: 211294 - RNA, 27 nt, Human
gcccagggaguucuggggggcacguug

SEQ ID NO: 211295 - RNA, 23 nt, Human
ggagagcuacugacccuauaagg

SEQ ID NO: 211296 - RNA, 24 nt, Human
ggagagcuacugacccuauaaggc

SEQ ID NO: 211297 - RNA, 20 nt, Human
gggaaggggguggggcuggg

SEQ ID NO: 211298 - RNA, 21 nt, Human
gggaaggggguggggcugggc

SEQ ID NO: 211299 - RNA, 22 nt, Human
gggguggggcugggccaagggc

SEQ ID NO: 211300 - RNA, 18 nt, Human
ggguggggcugggccaag

SEQ ID NO: 211301 - RNA, 19 nt, Human
gguggguggcagagagaga

SEQ ID NO: 211302 - RNA, 22 nt, Human
guggucaggugcccacuaaguc

SEQ ID NO: 211303 - RNA, 21 nt, Human
guuagaccaaaacugagcaac

SEQ ID NO: 211304 - RNA, 22 nt, Human
uaacaaguuagaccaaaacuga

SEQ ID NO: 211305 - RNA, 20 nt, Human
uaaccuaaucuuggaagugg

SEQ ID NO: 211306 - RNA, 23 nt, Human
uaaguuccuuacccagagauucc

SEQ ID NO: 211307 - RNA, 25 nt, Human
uacaaggaaaccagucauauugaau

SEQ ID NO: 211308 - RNA, 19 nt, Human
uaccagaugauuuuuguuc

SEQ ID NO: 211309 - RNA, 22 nt, Human
uacccagagauuccagccacac

SEQ ID NO: 211310 - RNA, 21 nt, Human
uagaucccugacucuaugacc

SEQ ID NO: 211311 - RNA, 21 nt, Human
uaugaccaccucccucuccug

SEQ ID NO: 211312 - RNA, 19 nt, Human
uaugccacuuuguaaguag

SEQ ID NO: 211313 - RNA, 19 nt, Human
ucaaccaguacagcagccu

SEQ ID NO: 211314 - RNA, 22 nt, Human
ucacaaagacaacuuugguacc

SEQ ID NO: 211315 - RNA, 22 nt, Human
ucaccaccuccucaugcccaca

SEQ ID NO: 211316 - RNA, 22 nt, Human
ucaccccucacccgagcuggcc

SEQ ID NO: 211317 - RNA, 18 nt, Human
ucagccuuuuaaguaagg

SEQ ID NO: 211318 - RNA, 22 nt, Human
uccaaacugggaaccagaagac

SEQ ID NO: 211319 - RNA, 24 nt, Human
uccaaauaaacucacagacugaga

SEQ ID NO: 211320 - RNA, 22 nt, Human
uccaaaucucagaauuuaucca

SEQ ID NO: 211321 - RNA, 21 nt, Human
uccaaugccuuggaaucccag

SEQ ID NO: 211322 - RNA, 18 nt, Human
uccacucaccccucaccc

SEQ ID NO: 211323 - RNA, 21 nt, Human
uccagugggggaggaccgugg

SEQ ID NO: 211324 - RNA, 18 nt, Human
ucccccaccccaccccca

SEQ ID NO: 211325 - RNA, 20 nt, Human
uccccgcgucuccucugucu

SEQ ID NO: 211326 - RNA, 24 nt, Human
ucccugacucuaugaccaccuccc

SEQ ID NO: 211327 - RNA, 23 nt, Human
uccuccucaguggcuuugcugag

SEQ ID NO: 211328 - RNA, 21 nt, Human
uccugaucacuacuacaacca

SEQ ID NO: 211329 - RNA, 21 nt, Human
ucuaggaaagaauuaccagau

SEQ ID NO: 211330 - RNA, 21 nt, Human
ucuccaaauaaacucacagac

SEQ ID NO: 211331 - RNA, 21 nt, Human
ucugcagagaccuuaucucca

SEQ ID NO: 211332 - RNA, 23 nt, Human
ucugcagagaccuuaucuccaaa

SEQ ID NO: 211333 - RNA, 18 nt, Human
ucugucucuguguccucu

SEQ ID NO: 211334 - RNA, 20 nt, Human
ucugucucuguguccucucc

SEQ ID NO: 211335 - RNA, 20 nt, Human
ucuucguucaggaggcugga

SEQ ID NO: 211336 - RNA, 22 nt, Human
ugagaucuguuuccugaucacu

SEQ ID NO: 211337 - RNA, 19 nt, Human
ugagggaagagauaggaaa

SEQ ID NO: 211338 - RNA, 23 nt, Human
ugagugacaggacuucaugugga

SEQ ID NO: 211339 - RNA, 20 nt, Human
ugaugagggaagagauagga

SEQ ID NO: 211340 - RNA, 22 nt, Human
ugauucccaccacucccccacc

SEQ ID NO: 211341 - RNA, 24 nt, Human
ugauucccaccacucccccacccc

SEQ ID NO: 211342 - RNA, 21 nt, Human
ugcaaaacuccgaucucugcc

SEQ ID NO: 211343 - RNA, 19 nt, Human
ugccucuuccaagcuucug

SEQ ID NO: 211344 - RNA, 25 nt, Human
ugccuguuccuccaaggaugccuca

SEQ ID NO: 211345 - RNA, 19 nt, Human
ugccuuggaaucccagggg

SEQ ID NO: 211346 - RNA, 19 nt, Human
uggaggcugaggacaauca

SEQ ID NO: 211347 - RNA, 24 nt, Human
uggcucugcccagggaguucuggg

SEQ ID NO: 211348 - RNA, 25 nt, Human
uggcucugcccagggaguucugggg

SEQ ID NO: 211349 - RNA, 19 nt, Human
uggguggcagagagagagg

SEQ ID NO: 211350 - RNA, 20 nt, Human
uguagaaaaauuaggaaaua

SEQ ID NO: 211351 - RNA, 22 nt, Human
uguccgccaugggucuccucca

SEQ ID NO: 211352 - RNA, 21 nt, Human
uguuccuuucuccuggcggga

SEQ ID NO: 211353 - RNA, 24 nt, Human
uuaaagggaaggggguggggcugg

SEQ ID NO: 211354 - RNA, 21 nt, Human
uuuuaaguaaggccuagggag

SEQ ID NO: 211355 - RNA, 20 nt, Human
uuuuuuuuuuuuuuuucucu

SEQ ID NO: 211356 - RNA, 26 nt, Human
caacagaaaauggaaugaagggaccc

SEQ ID NO: 211357 - RNA, 22 nt, Human
uacucaacagaaaauggaauga

SEQ ID NO: 211358 - RNA, 22 nt, Human
uuuuuagugagcagguuuggug

SEQ ID NO: 211359 - RNA, 21 nt, Human
aaaagugaaggagaggugaga

SEQ ID NO: 211360 - RNA, 22 nt, Human
aagagaaaaauuucugcaacuu

SEQ ID NO: 211361 - RNA, 23 nt, Human
aagagaacaagauagaucagaug

SEQ ID NO: 211362 - RNA, 22 nt, Human
agacagaguggggaggaaccuc

SEQ ID NO: 211363 - RNA, 28 nt, Human
aggcuaggaaaagugaaggagaggugag

SEQ ID NO: 211364 - RNA, 22 nt, Human
agugaaggagaggugagaaaga

SEQ ID NO: 211365 - RNA, 23 nt, Human
caaacucuccagaacccaagaaa

SEQ ID NO: 211366 - RNA, 23 nt, Human
cagaguggggaggaaccucgugc

SEQ ID NO: 211367 - RNA, 20 nt, Human
caggaaaagaaauaacagau

SEQ ID NO: 211368 - RNA, 22 nt, Human
cccaagaaaagagaaaaauuuc

SEQ ID NO: 211369 - RNA, 21 nt, Human
cguuucacuccucaugcucua

SEQ ID NO: 211370 - RNA, 21 nt, Human
gaaaugucuuucaauuacuuu

SEQ ID NO: 211371 - RNA, 20 nt, Human
gaccuucucuagcuuuacag

SEQ ID NO: 211372 - RNA, 26 nt, Human
gcuaggaaaagugaaggagaggugag

SEQ ID NO: 211373 - RNA, 26 nt, Human
ggugagaaagacagaguggggaggaa

SEQ ID NO: 211374 - RNA, 19 nt, Human
uaaaaaacacucuaaggac

SEQ ID NO: 211375 - RNA, 22 nt, Human
uaggaaaagugaaggagaggug

SEQ ID NO: 211376 - RNA, 21 nt, Human
ucuuccccauuuuucaugaaa

SEQ ID NO: 211377 - RNA, 22 nt, Human
ucuuccccauuuuucaugaaaa

SEQ ID NO: 211378 - RNA, 24 nt, Human
ugaagagaacaagauagaucagau

SEQ ID NO: 211379 - RNA, 28 nt, Human
ugaaggagaggugagaaagacagagugg

SEQ ID NO: 211380 - RNA, 23 nt, Human
ugaauaauugcacauuauguaaa

SEQ ID NO: 211381 - RNA, 20 nt, Human
ugguggugaggaggcuagga

SEQ ID NO: 211382 - RNA, 20 nt, Human
uguagagaugggaaucuucc

SEQ ID NO: 211383 - RNA, 23 nt, Human
uucaucaggaaaagaaauaacag

SEQ ID NO: 211384 - RNA, 21 nt, Human
uuuacaaacucuccagaaccc

SEQ ID NO: 211385 - RNA, 21 nt, Human
aaagcaaaacagaaacagaga

SEQ ID NO: 211386 - RNA, 23 nt, Human
aagcaaaacagaaacagagauca

SEQ ID NO: 211387 - RNA, 24 nt, Human
aagcaaaacagaaacagagaucag

SEQ ID NO: 211388 - RNA, 18 nt, Human
aagcugccaccucuaggc

SEQ ID NO: 211389 - RNA, 20 nt, Human
aagcugccaccucuaggcug

SEQ ID NO: 211390 - RNA, 21 nt, Human
aagcugccaccucuaggcuga

SEQ ID NO: 211391 - RNA, 25 nt, Human
acagagaucagcucugugcuaguca

SEQ ID NO: 211392 - RNA, 26 nt, Human
agacgaaaacacauugggaaccagaa

SEQ ID NO: 211393 - RNA, 19 nt, Human
agaggacagccuuauacca

SEQ ID NO: 211394 - RNA, 20 nt, Human
agccuugccccugucucagc

SEQ ID NO: 211395 - RNA, 23 nt, Human
auaaagcaaaacagaaacagaga

SEQ ID NO: 211396 - RNA, 19 nt, Human
augauaacagcagccuugc

SEQ ID NO: 211397 - RNA, 24 nt, Human
auuacaauuaggacaaaaaugauu

SEQ ID NO: 211398 - RNA, 21 nt, Human
cauccuguucuucaguugcua

SEQ ID NO: 211399 - RNA, 22 nt, Human
ccagcgugaaaaugacacuaag

SEQ ID NO: 211400 - RNA, 22 nt, Human
ccugcuucugaggccacauccu

SEQ ID NO: 211401 - RNA, 21 nt, Human
ccuuauaccacccagcucucc

SEQ ID NO: 211402 - RNA, 23 nt, Human
cgaaaacacauugggaaccagaa

SEQ ID NO: 211403 - RNA, 19 nt, Human
cucagcaccuggcaagaaa

SEQ ID NO: 211404 - RNA, 19 nt, Human
cugaagcaucuucauaccc

SEQ ID NO: 211405 - RNA, 22 nt, Human
gaaacuuuaagacaaagaccaa

SEQ ID NO: 211406 - RNA, 19 nt, Human
gaaagggucuuuaucuaca

SEQ ID NO: 211407 - RNA, 26 nt, Human
gauaucaucccaagagggaauaaagc

SEQ ID NO: 211408 - RNA, 22 nt, Human
gaugauaucaucccaagaggga

SEQ ID NO: 211409 - RNA, 20 nt, Human
gcuucugaggccacauccug

SEQ ID NO: 211410 - RNA, 25 nt, Human
uaaagcaaaacagaaacagagauca

SEQ ID NO: 211411 - RNA, 27 nt, Human
uaacagcagccuugccccugucucagc

SEQ ID NO: 211412 - RNA, 28 nt, Human
uaagaaaauguagacgaaaacacauugg

SEQ ID NO: 211413 - RNA, 21 nt, Human
uaagacaaagaccaagcugcc

SEQ ID NO: 211414 - RNA, 27 nt, Human
ucagcaccuggcaagaaagggucuuua

SEQ ID NO: 211415 - RNA, 18 nt, Human
ucaguguuuggucuuuga

SEQ ID NO: 211416 - RNA, 19 nt, Human
uccugcuucugaggccaca

SEQ ID NO: 211417 - RNA, 19 nt, Human
ucugaagcaucuucauacc

SEQ ID NO: 211418 - RNA, 20 nt, Human
ucugaggccacauccuguuc

SEQ ID NO: 211419 - RNA, 19 nt, Human
ugcagaugccuuguggccu

SEQ ID NO: 211420 - RNA, 23 nt, Human
ugccccugucucagcaccagcgu

SEQ ID NO: 211421 - RNA, 24 nt, Human
uuaagacaaagaccaagcugccac

SEQ ID NO: 211422 - RNA, 19 nt, Human
uuuaacuuaacacaagaau

SEQ ID NO: 211423 - RNA, 23 nt, Human
aaaaugccauaaaaaaacugcaa

SEQ ID NO: 211424 - RNA, 24 nt, Human
aaagugcugggauuauaggcguga

SEQ ID NO: 211425 - RNA, 24 nt, Human
aaaguucuccaagaauaugucucc

SEQ ID NO: 211426 - RNA, 20 nt, Human
aaccuggccugcaacgccau

SEQ ID NO: 211427 - RNA, 21 nt, Human
aacuaagccaucuguagacgg

SEQ ID NO: 211428 - RNA, 18 nt, Human
aagaaguggaucaauucc

SEQ ID NO: 211429 - RNA, 22 nt, Human
aagaucuucccaagcccucuac

SEQ ID NO: 211430 - RNA, 22 nt, Human
aagcaggcaaagcgggcccagg

SEQ ID NO: 211431 - RNA, 24 nt, Human
aagucagcaugaggcauaaccugg

SEQ ID NO: 211432 - RNA, 19 nt, Human
aagugcugggauuauaggc

SEQ ID NO: 211433 - RNA, 19 nt, Human
aagugcugggauuauaggc

SEQ ID NO: 211434 - RNA, 18 nt, Human
acuuaacuaagccaucug

SEQ ID NO: 211435 - RNA, 23 nt, Human
acuucagccucccaaagugcugg

SEQ ID NO: 211436 - RNA, 19 nt, Human
agaaagcagguggaaaggc

SEQ ID NO: 211437 - RNA, 22 nt, Human
agaaagcagguggaaaggcaag

SEQ ID NO: 211438 - RNA, 20 nt, Human
agagcagcaauuccagcugg

SEQ ID NO: 211439 - RNA, 18 nt, Human
agcagcaauuccagcugg

SEQ ID NO: 211440 - RNA, 18 nt, Human
agcaggagcgggaugaca

SEQ ID NO: 211441 - RNA, 19 nt, Human
agccaccacaccgggccua

SEQ ID NO: 211442 - RNA, 20 nt, Human
agccacuagggagcuguucc

SEQ ID NO: 211443 - RNA, 21 nt, Human
agcgaggggaagcuggaggac

SEQ ID NO: 211444 - RNA, 18 nt, Human
aggagaaagcagguggaa

SEQ ID NO: 211445 - RNA, 19 nt, Human
aggcaagagcagagacaga

SEQ ID NO: 211446 - RNA, 19 nt, Human
aggcgugagccaccacacc

SEQ ID NO: 211447 - RNA, 23 nt, Human
agggguccagcuucucaggaggg

SEQ ID NO: 211448 - RNA, 24 nt, Human
agugcaguggcccaaacucggcuc

SEQ ID NO: 211449 - RNA, 20 nt, Human
aguucaaacauucagagagg

SEQ ID NO: 211450 - RNA, 24 nt, Human
auaauaacaaaggacaggaugguc

SEQ ID NO: 211451 - RNA, 24 nt, Human
augggguuuugccauguuggcugg

SEQ ID NO: 211452 - RNA, 21 nt, Human
auuacaggcgugugccaccau

SEQ ID NO: 211453 - RNA, 20 nt, Human
auucugaucagcuagagaaa

SEQ ID NO: 211454 - RNA, 22 nt, Human
auuuuuguauuuuuaguagaga

SEQ ID NO: 211455 - RNA, 18 nt, Human
caaaaguccucuccaugu

SEQ ID NO: 211456 - RNA, 24 nt, Human
caaagugcugggauuauaggcgug

SEQ ID NO: 211457 - RNA, 18 nt, Human
caacgccauaagacagga

SEQ ID NO: 211458 - RNA, 22 nt, Human
caagcaauucuccugccucagc

SEQ ID NO: 211459 - RNA, 24 nt, Human
caccaggccaaccugggaauucac

SEQ ID NO: 211460 - RNA, 19 nt, Human
caccaugccuagcucauuu

SEQ ID NO: 211461 - RNA, 22 nt, Human
cagcagcuccagaacagcacuu

SEQ ID NO: 211462 - RNA, 22 nt, Human
cagccaccacagccucucccuc

SEQ ID NO: 211463 - RNA, 22 nt, Human
cagugacucuacaggguccccc

SEQ ID NO: 211464 - RNA, 22 nt, Human
cauuccaugaacucugcaaguc

SEQ ID NO: 211465 - RNA, 22 nt, Human
ccaaagugcugggauuauaggc

SEQ ID NO: 211466 - RNA, 24 nt, Human
ccaaagugcugggauuauaggcgu

SEQ ID NO: 211467 - RNA, 19 nt, Human
ccagacaaggcauagcccc

SEQ ID NO: 211468 - RNA, 21 nt, Human
ccagggucagugacucuacag

SEQ ID NO: 211469 - RNA, 19 nt, Human
ccauguuggcugggcuggu

SEQ ID NO: 211470 - RNA, 22 nt, Human
ccauguuggcugggcuggucuc

SEQ ID NO: 211471 - RNA, 23 nt, Human
ccauguuggcugggcuggucucg

SEQ ID NO: 211472 - RNA, 18 nt, Human
cccccacucucuggccaa

SEQ ID NO: 211473 - RNA, 23 nt, Human
ccccgguucaagcaauucuccug

SEQ ID NO: 211474 - RNA, 18 nt, Human
ccccugggagguguuuca

SEQ ID NO: 211475 - RNA, 22 nt, Human
ccugaaaucaaguacucagaac

SEQ ID NO: 211476 - RNA, 24 nt, Human
ccugaccucuggugauccacccac

SEQ ID NO: 211477 - RNA, 24 nt, Human
ccugccucagccucagguguagcu

SEQ ID NO: 211478 - RNA, 21 nt, Human
cgagaaauauaaaaaccaaaa

SEQ ID NO: 211479 - RNA, 24 nt, Human
cuagaagccagaaauggaggcuca

SEQ ID NO: 211480 - RNA, 25 nt, Human
cucacugcaaccuccgucuccccgg

SEQ ID NO: 211481 - RNA, 26 nt, Human
cucagaacaccagacuagaagccaga

SEQ ID NO: 211482 - RNA, 23 nt, Human
cucagccucagguguagcuggga

SEQ ID NO: 211483 - RNA, 19 nt, Human
cucaggagggagucaccau

SEQ ID NO: 211484 - RNA, 21 nt, Human
cuccaaagacguaaaaugcag

SEQ ID NO: 211485 - RNA, 19 nt, Human
cuccaagaauaugucuccc

SEQ ID NO: 211486 - RNA, 23 nt, Human
cucccagaugugcucaccaccau

SEQ ID NO: 211487 - RNA, 21 nt, Human
cuccuucaucaacuaguacaa

SEQ ID NO: 211488 - RNA, 19 nt, Human
cucugcagugggccugacc

SEQ ID NO: 211489 - RNA, 19 nt, Human
cucuguugccaggcuagag

SEQ ID NO: 211490 - RNA, 20 nt, Human
cugcaaaauuauauaaacag

SEQ ID NO: 211491 - RNA, 24 nt, Human
cugcaaccuccgucuccccgguuc

SEQ ID NO: 211492 - RNA, 19 nt, Human
gaaaaugcgagaaggccuc

SEQ ID NO: 211493 - RNA, 18 nt, Human
gaaacauuuuaagaaaug

SEQ ID NO: 211494 - RNA, 19 nt, Human
gaaauggaggcucaagucc

SEQ ID NO: 211495 - RNA, 23 nt, Human
gaaauggaggcucaaguccuagg

SEQ ID NO: 211496 - RNA, 20 nt, Human
gacagggcagggaggugguc

SEQ ID NO: 211497 - RNA, 18 nt, Human
gacauggccaccaggcca

SEQ ID NO: 211498 - RNA, 24 nt, Human
gaccucuggugauccacccacuuc

SEQ ID NO: 211499 - RNA, 18 nt, Human
gagagagaaggcuggaga

SEQ ID NO: 211500 - RNA, 18 nt, Human
gagaugggguuuugccau

SEQ ID NO: 211501 - RNA, 20 nt, Human
gagcagagacagaggagugc

SEQ ID NO: 211502 - RNA, 19 nt, Human
gagcagcaauuccagcugg

SEQ ID NO: 211503 - RNA, 22 nt, Human
gaggauguucugaauuuuggua

SEQ ID NO: 211504 - RNA, 18 nt, Human
gagugcugggggcaggcg

SEQ ID NO: 211505 - RNA, 19 nt, Human
gauguucugaauuuuggua

SEQ ID NO: 211506 - RNA, 18 nt, Human
gauuacaggcgugugcca

SEQ ID NO: 211507 - RNA, 24 nt, Human
gauuacaggcgugugccaccaugc

SEQ ID NO: 211508 - RNA, 18 nt, Human
gauuauaggcgugagcca

SEQ ID NO: 211509 - RNA, 21 nt, Human
gauuauaggcgugagccacca

SEQ ID NO: 211510 - RNA, 22 nt, Human
gauuauaggcgugagccaccac

SEQ ID NO: 211511 - RNA, 28 nt, Human
gcaacgccauaagacaggaggcaccgua

SEQ ID NO: 211512 - RNA, 23 nt, Human
gcaauuccagcuggagggagacc

SEQ ID NO: 211513 - RNA, 21 nt, Human
gcaggacagcgaggggaagcu

SEQ ID NO: 211514 - RNA, 20 nt, Human
gccauguuggcugggcuggu

SEQ ID NO: 211515 - RNA, 22 nt, Human
gccauguuggcugggcuggucu

SEQ ID NO: 211516 - RNA, 22 nt, Human
gcgugugccaccaugccuagcu

SEQ ID NO: 211517 - RNA, 24 nt, Human
gcuagagugcaguggcccaaacuc

SEQ ID NO: 211518 - RNA, 20 nt, Human
gcugcaaaauuauauaaaca

SEQ ID NO: 211519 - RNA, 23 nt, Human
gcuggucucgaacuccugaccuc

SEQ ID NO: 211520 - RNA, 19 nt, Human
gcuugcuuucuuagcacua

SEQ ID NO: 211521 - RNA, 24 nt, Human
ggaagauggggaauaacuuugcac

SEQ ID NO: 211522 - RNA, 20 nt, Human
ggaccguuauugaccugaaa

SEQ ID NO: 211523 - RNA, 18 nt, Human
ggagcgggaugacagaag

SEQ ID NO: 211524 - RNA, 24 nt, Human
ggauuacaggcgugugccaccaug

SEQ ID NO: 211525 - RNA, 20 nt, Human
ggccaaccugggaauucaca

SEQ ID NO: 211526 - RNA, 24 nt, Human
ggcuggucucgaacuccugaccuc

SEQ ID NO: 211527 - RNA, 24 nt, Human
gggaagcuggaggacagggcaggg

SEQ ID NO: 211528 - RNA, 18 nt, Human
gggaauucacacagcagg

SEQ ID NO: 211529 - RNA, 19 nt, Human
gggagguguuucagcagga

SEQ ID NO: 211530 - RNA, 21 nt, Human
gggcagggagguggucuggga

SEQ ID NO: 211531 - RNA, 24 nt, Human
gggcagggagguggucugggagug

SEQ ID NO: 211532 - RNA, 18 nt, Human
gggcccaggagaaagcag

SEQ ID NO: 211533 - RNA, 20 nt, Human
gggcuggucucgaacuccug

SEQ ID NO: 211534 - RNA, 19 nt, Human
gggguuuugccauguuggc

SEQ ID NO: 211535 - RNA, 18 nt, Human
ggguuuugccauguuggc

SEQ ID NO: 211536 - RNA, 19 nt, Human
ggucucgaacuccugaccu

SEQ ID NO: 211537 - RNA, 23 nt, Human
guagagaugggguuuugccaugu

SEQ ID NO: 211538 - RNA, 18 nt, Human
guagcugggauuacaggc

SEQ ID NO: 211539 - RNA, 18 nt, Human
guagcugggauuacaggc

SEQ ID NO: 211540 - RNA, 18 nt, Human
guagcugggauuacaggc

SEQ ID NO: 211541 - RNA, 22 nt, Human
guagcugggauuacaggcgugu

SEQ ID NO: 211542 - RNA, 19 nt, Human
gugagccaccacaccgggc

SEQ ID NO: 211543 - RNA, 24 nt, Human
gugauccacccacuucagccuccc

SEQ ID NO: 211544 - RNA, 18 nt, Human
guggagugaggggggacc

SEQ ID NO: 211545 - RNA, 21 nt, Human
guguagcugggauuacaggcg

SEQ ID NO: 211546 - RNA, 22 nt, Human
guguagcugggauuacaggcgu

SEQ ID NO: 211547 - RNA, 21 nt, Human
uaacaguacaaaguuugaaaa

SEQ ID NO: 211548 - RNA, 21 nt, Human
uaacaguacaaaguuugaaaa

SEQ ID NO: 211549 - RNA, 22 nt, Human
uaagaaaggcaagagagggaaa

SEQ ID NO: 211550 - RNA, 23 nt, Human
uaagaaauguuugccucuaggga

SEQ ID NO: 211551 - RNA, 24 nt, Human
uaagccaucuguagacgguggcua

SEQ ID NO: 211552 - RNA, 21 nt, Human
uacaacucuuaaaacugugcu

SEQ ID NO: 211553 - RNA, 22 nt, Human
uagagaugggguuuugccaugu

SEQ ID NO: 211554 - RNA, 23 nt, Human
uagagugcaguggcccaaacucg

SEQ ID NO: 211555 - RNA, 24 nt, Human
uagagugcaguggcccaaacucgg

SEQ ID NO: 211556 - RNA, 20 nt, Human
uagcucauuuuuguauuuuu

SEQ ID NO: 211557 - RNA, 20 nt, Human
uaggcaaaggaggaggaagg

SEQ ID NO: 211558 - RNA, 26 nt, Human
uaguacaaacauaauuuaucaaaaau

SEQ ID NO: 211559 - RNA, 24 nt, Human
uaguagagaugggguuuugccaug

SEQ ID NO: 211560 - RNA, 19 nt, Human
ucacugcaaccuccgucuc

SEQ ID NO: 211561 - RNA, 24 nt, Human
ucacugcaaccuccgucuccccgg

SEQ ID NO: 211562 - RNA, 24 nt, Human
ucacugcaaccuccgucuccccgg

SEQ ID NO: 211563 - RNA, 27 nt, Human
ucacugcaaccuccgucuccccgguuc

SEQ ID NO: 211564 - RNA, 21 nt, Human
ucagaacaccagacuagaagc

SEQ ID NO: 211565 - RNA, 24 nt, Human
ucagaacaccagacuagaagccaa

SEQ ID NO: 211566 - RNA, 19 nt, Human
ucagccucagguguagcug

SEQ ID NO: 211567 - RNA, 24 nt, Human
ucagguguagcugggauuacaggc

SEQ ID NO: 211568 - RNA, 23 nt, Human
ucagugaggugucagucucacuu

SEQ ID NO: 211569 - RNA, 24 nt, Human
ucauuuuuguauuuuuaguagaga

SEQ ID NO: 211570 - RNA, 21 nt, Human
uccacccacuucagccuccca

SEQ ID NO: 211571 - RNA, 24 nt, Human
ucccaaagugcugggauuauaggc

SEQ ID NO: 211572 - RNA, 22 nt, Human
ucccagaugugcucaccaccau

SEQ ID NO: 211573 - RNA, 26 nt, Human
ucccagaugugcucaccaccaucucu

SEQ ID NO: 211574 - RNA, 21 nt, Human
uccccgguucaagcaauucuc

SEQ ID NO: 211575 - RNA, 24 nt, Human
uccccgguucaagcaauucuccug

SEQ ID NO: 211576 - RNA, 24 nt, Human
uccgucuccccgguucaagcaauu

SEQ ID NO: 211577 - RNA, 24 nt, Human
uccucagugaggugucagucucac

SEQ ID NO: 211578 - RNA, 25 nt, Human
uccuccaaagacguaaaaugcagga

SEQ ID NO: 211579 - RNA, 18 nt, Human
ucuagggaaagaauagau

SEQ ID NO: 211580 - RNA, 24 nt, Human
ucuccccgguucaagcaauucucc

SEQ ID NO: 211581 - RNA, 22 nt, Human
ucuccugccucagccucaggug

SEQ ID NO: 211582 - RNA, 24 nt, Human
ucugcagugggccugaccagagag

SEQ ID NO: 211583 - RNA, 18 nt, Human
ucuggcuguagucugugu

SEQ ID NO: 211584 - RNA, 23 nt, Human
ucuguugccaggcuagagugcag

SEQ ID NO: 211585 - RNA, 18 nt, Human
ucuugcucuguugccagg

SEQ ID NO: 211586 - RNA, 22 nt, Human
ucuugcucuguugccaggcuag

SEQ ID NO: 211587 - RNA, 23 nt, Human
ucuugcucuguugccaggcuaga

SEQ ID NO: 211588 - RNA, 23 nt, Human
ugaaaucaaguacucagaacacc

SEQ ID NO: 211589 - RNA, 20 nt, Human
ugaacagguggagccccugg

SEQ ID NO: 211590 - RNA, 22 nt, Human
ugacuuaacuaagccaucugua

SEQ ID NO: 211591 - RNA, 22 nt, Human
ugagacggagucuugcucuguu

SEQ ID NO: 211592 - RNA, 23 nt, Human
ugcaaaauuaaauuuguaaaaca

SEQ ID NO: 211593 - RNA, 18 nt, Human
ugccaguguggagugagg

SEQ ID NO: 211594 - RNA, 24 nt, Human
ugccauguuggcugggcuggucuc

SEQ ID NO: 211595 - RNA, 24 nt, Human
ugccucagccucagguguagcugg

SEQ ID NO: 211596 - RNA, 19 nt, Human
uggaaggcagugagggaca

SEQ ID NO: 211597 - RNA, 21 nt, Human
uggaaggcagugagggacaga

SEQ ID NO: 211598 - RNA, 20 nt, Human
uggagccccugggagguguu

SEQ ID NO: 211599 - RNA, 22 nt, Human
uggccaccaggccaaccuggga

SEQ ID NO: 211600 - RNA, 22 nt, Human
uggcccaaacucggcucacugc

SEQ ID NO: 211601 - RNA, 24 nt, Human
uggcugggcuggucucgaacuccu

SEQ ID NO: 211602 - RNA, 21 nt, Human
ugggagugacaugcugguggg

SEQ ID NO: 211603 - RNA, 18 nt, Human
ugggauuacaggcgugug

SEQ ID NO: 211604 - RNA, 21 nt, Human
ugggauuacaggcgugugcca

SEQ ID NO: 211605 - RNA, 22 nt, Human
ugggauuacaggcgugugccac

SEQ ID NO: 211606 - RNA, 24 nt, Human
ugggauuacaggcgugugccacca

SEQ ID NO: 211607 - RNA, 25 nt, Human
ugggauuacaggcgugugccaccau

SEQ ID NO: 211608 - RNA, 18 nt, Human
ugggauuauaggcgugag

SEQ ID NO: 211609 - RNA, 19 nt, Human
ugggauuauaggcgugagc

SEQ ID NO: 211610 - RNA, 22 nt, Human
ugggauuauaggcgugagccac

SEQ ID NO: 211611 - RNA, 23 nt, Human
ugggauuauaggcgugagccacc

SEQ ID NO: 211612 - RNA, 24 nt, Human
ugggauuauaggcgugagccacca

SEQ ID NO: 211613 - RNA, 20 nt, Human
uggggaauguuuuuaaacau

SEQ ID NO: 211614 - RNA, 24 nt, Human
ugggguuuugccauguuggcuggg

SEQ ID NO: 211615 - RNA, 23 nt, Human
uguaaaacaucuaauaggcuuuu

SEQ ID NO: 211616 - RNA, 24 nt, Human
uguagcugggauuacaggcgugug

SEQ ID NO: 211617 - RNA, 22 nt, Human
uguauggaaaauacaagcagau

SEQ ID NO: 211618 - RNA, 21 nt, Human
uguauuuuuaguagagauggg

SEQ ID NO: 211619 - RNA, 21 nt, Human
ugucuuuuaccaaggggucca

SEQ ID NO: 211620 - RNA, 23 nt, Human
uguggaauuggaggauguucuga

SEQ ID NO: 211621 - RNA, 18 nt, Human
uuaguagagaugggguuu

SEQ ID NO: 211622 - RNA, 22 nt, Human
uuaguagagaugggguuuugcc

SEQ ID NO: 211623 - RNA, 24 nt, Human
uuaguagagaugggguuuugccau

SEQ ID NO: 211624 - RNA, 23 nt, Human
uucaagacgugacaucccugcuc

SEQ ID NO: 211625 - RNA, 21 nt, Human
uucaagcaauucuccugccuc

SEQ ID NO: 211626 - RNA, 24 nt, Human
uucaagcaauucuccugccucagc

SEQ ID NO: 211627 - RNA, 19 nt, Human
uucagccucccaaagugcu

SEQ ID NO: 211628 - RNA, 23 nt, Human
uucaucaacuaguacaaacauaa

SEQ ID NO: 211629 - RNA, 24 nt, Human
uuccucagugaggugucagucuca

SEQ ID NO: 211630 - RNA, 19 nt, Human
uucucaggagggagucacc

SEQ ID NO: 211631 - RNA, 19 nt, Human
uucuccugccucagccuca

SEQ ID NO: 211632 - RNA, 21 nt, Human
uugaagugaguuuucaagcuc

SEQ ID NO: 211633 - RNA, 23 nt, Human
uuggucaucaucacccccacucu

SEQ ID NO: 211634 - RNA, 23 nt, Human
uuguauuuuuaguagagaugggg

SEQ ID NO: 211635 - RNA, 18 nt, Human
uugucuuuuaccaagggg

SEQ ID NO: 211636 - RNA, 23 nt, Human
uuucuuagcacuaugcaugcuga

SEQ ID NO: 211637 - RNA, 21 nt, Human
uuucuuggcaguucaaacauu

SEQ ID NO: 211638 - RNA, 23 nt, Human
uuuugccauguuggcugggcugg

SEQ ID NO: 211639 - RNA, 20 nt, Human
uuuuguauuuuuaguagaga

SEQ ID NO: 211640 - RNA, 21 nt, Human
uuuuuaaacauaaagcauuac

SEQ ID NO: 211641 - RNA, 21 nt, Human
uuuuuaguagagaugggguuu

SEQ ID NO: 211642 - RNA, 24 nt, Human
uuuuuaguagagaugggguuuugc

SEQ ID NO: 211643 - RNA, 20 nt, Human
uuuuuguauuuuuaguagag

SEQ ID NO: 211644 - RNA, 21 nt, Human
gaggacacgggaaguggagga

SEQ ID NO: 211645 - RNA, 19 nt, Human
ggaaguggaggacugagac

SEQ ID NO: 211646 - RNA, 25 nt, Human
ugcuccugacaacuuccagaggaca

SEQ ID NO: 211647 - RNA, 19 nt, Human
aaaaaaaaguagauccaag

SEQ ID NO: 211648 - RNA, 22 nt, Human
aaaaaagacacucucaaaauau

SEQ ID NO: 211649 - RNA, 21 nt, Human
aaaaacaucaagguauuucua

SEQ ID NO: 211650 - RNA, 23 nt, Human
aaagcaacucucaaggccacuaa

SEQ ID NO: 211651 - RNA, 21 nt, Human
aacaguucaaauaguugagca

SEQ ID NO: 211652 - RNA, 19 nt, Human
aacucuaaaugagcaaugc

SEQ ID NO: 211653 - RNA, 25 nt, Human
aaugaaauaaaaaagacacucucaa

SEQ ID NO: 211654 - RNA, 24 nt, Human
aauuaaugaaugauguuuuuguuu

SEQ ID NO: 211655 - RNA, 23 nt, Human
acaaauuauauauauauauauau

SEQ ID NO: 211656 - RNA, 22 nt, Human
acaauggagcaacaaaaacgag

SEQ ID NO: 211657 - RNA, 22 nt, Human
accauuuaaaaucauaauuuaa

SEQ ID NO: 211658 - RNA, 20 nt, Human
accccggagaccuggauccc

SEQ ID NO: 211659 - RNA, 23 nt, Human
acugcaaccuagauaaacuguag

SEQ ID NO: 211660 - RNA, 21 nt, Human
agacaaauugccaaacauccu

SEQ ID NO: 211661 - RNA, 22 nt, Human
agacaaauugccaaacauccuu

SEQ ID NO: 211662 - RNA, 19 nt, Human
agacugaaccuaguaugga

SEQ ID NO: 211663 - RNA, 20 nt, Human
agauauauaucucauauaca

SEQ ID NO: 211664 - RNA, 23 nt, Human
agcugugaauuaacaaauaauau

SEQ ID NO: 211665 - RNA, 19 nt, Human
aggcaagaacuaugacaac

SEQ ID NO: 211666 - RNA, 22 nt, Human
aggcaagaacuaugacaacuau

SEQ ID NO: 211667 - RNA, 23 nt, Human
aggcuaaaaaaaaguagauccaa

SEQ ID NO: 211668 - RNA, 26 nt, Human
aggcuucuagggccugcugauguucu

SEQ ID NO: 211669 - RNA, 21 nt, Human
agggaggggcaagagugaggc

SEQ ID NO: 211670 - RNA, 23 nt, Human
agggaggggcaagagugaggcuu

SEQ ID NO: 211671 - RNA, 18 nt, Human
agguauauaauucccuuu

SEQ ID NO: 211672 - RNA, 23 nt, Human
aggucagaugaugcaaucuuuuu

SEQ ID NO: 211673 - RNA, 18 nt, Human
agucuugcugugguuaug

SEQ ID NO: 211674 - RNA, 18 nt, Human
aguucuuaggugaugauc

SEQ ID NO: 211675 - RNA, 24 nt, Human
auauaagcagauagggagaaggaa

SEQ ID NO: 211676 - RNA, 26 nt, Human
auauacacguguguauauauauguau

SEQ ID NO: 211677 - RNA, 24 nt, Human
auauuacugaaaacaaacaaaaca

SEQ ID NO: 211678 - RNA, 23 nt, Human
auggagcaacaaaaacgagugag

SEQ ID NO: 211679 - RNA, 18 nt, Human
auguauguguguggauau

SEQ ID NO: 211680 - RNA, 25 nt, Human
auguauguguguggauauguauaua

SEQ ID NO: 211681 - RNA, 19 nt, Human
caaaagcaacucucaaggc

SEQ ID NO: 211682 - RNA, 24 nt, Human
caaaagcaacucucaaggccaguc

SEQ ID NO: 211683 - RNA, 22 nt, Human
caaauuauauauauauauauau

SEQ ID NO: 211684 - RNA, 21 nt, Human
caacaaaaacgagugagaaaa

SEQ ID NO: 211685 - RNA, 19 nt, Human
caaggccacuaagacugac

SEQ ID NO: 211686 - RNA, 23 nt, Human
cagaugccacugcaaccuagaua

SEQ ID NO: 211687 - RNA, 20 nt, Human
caucaagguauuucuagggg

SEQ ID NO: 211688 - RNA, 21 nt, Human
cauggaagcucugugcacagc

SEQ ID NO: 211689 - RNA, 21 nt, Human
ccaaacauccuuuucugugcu

SEQ ID NO: 211690 - RNA, 24 nt, Human
ccacacagucacccuaaauuuauc

SEQ ID NO: 211691 - RNA, 19 nt, Human
ccccuuguucuuuuuaccc

SEQ ID NO: 211692 - RNA, 25 nt, Human
ccccuuguucuuuuuacccuuuuca

SEQ ID NO: 211693 - RNA, 22 nt, Human
ccgggcacugcuuccuuccgcg

SEQ ID NO: 211694 - RNA, 18 nt, Human
ccuaaguggaugucaguc

SEQ ID NO: 211695 - RNA, 22 nt, Human
ccucuggccaaagcggaccccc

SEQ ID NO: 211696 - RNA, 20 nt, Human
ccugcaaacucuaaaugagc

SEQ ID NO: 211697 - RNA, 21 nt, Human
cggaaacucaugacccuguca

SEQ ID NO: 211698 - RNA, 25 nt, Human
cgggaugggugcagugucgccgggc

SEQ ID NO: 211699 - RNA, 20 nt, Human
cgguacuaacaauaucagaa

SEQ ID NO: 211700 - RNA, 22 nt, Human
cguguguauauauauguauaau

SEQ ID NO: 211701 - RNA, 23 nt, Human
cucaaaauauuaaaaccuaugga

SEQ ID NO: 211702 - RNA, 18 nt, Human
cugaaaacaaacaaaaca

SEQ ID NO: 211703 - RNA, 20 nt, Human
cuuccuggagcaccccuugu

SEQ ID NO: 211704 - RNA, 21 nt, Human
gaaaacaaacaaaacaacuuu

SEQ ID NO: 211705 - RNA, 18 nt, Human
gacucuuucuuccuggag

SEQ ID NO: 211706 - RNA, 20 nt, Human
gcacagcagaugccacugca

SEQ ID NO: 211707 - RNA, 22 nt, Human
gggagaaggaaugaaaaaaugu

SEQ ID NO: 211708 - RNA, 20 nt, Human
gggaggggcaagagugaggc

SEQ ID NO: 211709 - RNA, 24 nt, Human
gguauuucuaggggugcccaacag

SEQ ID NO: 211710 - RNA, 21 nt, Human
guaaaauuaaguaccaaaggc

SEQ ID NO: 211711 - RNA, 20 nt, Human
gugcaaaaggaaugcagcau

SEQ ID NO: 211712 - RNA, 18 nt, Human
gugcauguggauuuauau

SEQ ID NO: 211713 - RNA, 25 nt, Human
uaaaaaagacacucucaaaauauua

SEQ ID NO: 211714 - RNA, 20 nt, Human
uaaaaaagauaaaaagaaaa

SEQ ID NO: 211715 - RNA, 21 nt, Human
uaaaaacagcaaaauauuacu

SEQ ID NO: 211716 - RNA, 23 nt, Human
uaaaaagaaaacuauacucggaa

SEQ ID NO: 211717 - RNA, 24 nt, Human
uaaaaagaaaacuauacucggaaa

SEQ ID NO: 211718 - RNA, 18 nt, Human
uaaaagguauauaauucc

SEQ ID NO: 211719 - RNA, 23 nt, Human
uaaaauaauauuauaauuaugca

SEQ ID NO: 211720 - RNA, 25 nt, Human
uaaauuauguuuccccauuucccuu

SEQ ID NO: 211721 - RNA, 24 nt, Human
uaacaauaucagaaacaauauuuu

SEQ ID NO: 211722 - RNA, 24 nt, Human
uaacauaaguaaauuuacaaauca

SEQ ID NO: 211723 - RNA, 25 nt, Human
uaaguaaauuuacaaaucaaaugaa

SEQ ID NO: 211724 - RNA, 19 nt, Human
uaaugcccgauggcuggcu

SEQ ID NO: 211725 - RNA, 22 nt, Human
uaauguauguguguggauaugu

SEQ ID NO: 211726 - RNA, 22 nt, Human
uacacacacacaaauuauauau

SEQ ID NO: 211727 - RNA, 22 nt, Human
uacgguacuaacaauaucagaa

SEQ ID NO: 211728 - RNA, 19 nt, Human
uagaaaaaacaucaaggua

SEQ ID NO: 211729 - RNA, 21 nt, Human
uagaauauuaaugccaaaagc

SEQ ID NO: 211730 - RNA, 18 nt, Human
uagaccauuauuuuugcc

SEQ ID NO: 211731 - RNA, 25 nt, Human
uagauuucauaaauuaccugagaug

SEQ ID NO: 211732 - RNA, 26 nt, Human
uaggagauuucuuucagacugaaccu

SEQ ID NO: 211733 - RNA, 21 nt, Human
uagggaaaaauauuaauaagg

SEQ ID NO: 211734 - RNA, 19 nt, Human
uaguucuuaggugaugauc

SEQ ID NO: 211735 - RNA, 18 nt, Human
uauacacguguguauaua

SEQ ID NO: 211736 - RNA, 21 nt, Human
uauauauauguauaaucuaca

SEQ ID NO: 211737 - RNA, 20 nt, Human
uauauguaauguaugugugu

SEQ ID NO: 211738 - RNA, 24 nt, Human
uaugaaaccauaaacugcgaauga

SEQ ID NO: 211739 - RNA, 19 nt, Human
uauguguguggauauguau

SEQ ID NO: 211740 - RNA, 20 nt, Human
uauuucaugugcauguggau

SEQ ID NO: 211741 - RNA, 25 nt, Human
ucauauacacguguguauauauaug

SEQ ID NO: 211742 - RNA, 22 nt, Human
ucccuugaauguucucuauugg

SEQ ID NO: 211743 - RNA, 23 nt, Human
uccgcgccucuggccaaagcgga

SEQ ID NO: 211744 - RNA, 22 nt, Human
uccuuuaucacucaacaguuca

SEQ ID NO: 211745 - RNA, 20 nt, Human
ucucaaggccacuaagacuu

SEQ ID NO: 211746 - RNA, 19 nt, Human
ucucuuguucucaaucucu

SEQ ID NO: 211747 - RNA, 23 nt, Human
ucuguaaacucugcacuuaguuu

SEQ ID NO: 211748 - RNA, 23 nt, Human
ugacuggagcaaaaacaaaaauu

SEQ ID NO: 211749 - RNA, 21 nt, Human
ugagaaaaaaucacuuuccca

SEQ ID NO: 211750 - RNA, 18 nt, Human
ugagaugaggacaagggu

SEQ ID NO: 211751 - RNA, 21 nt, Human
ugcaaccuagauaaacuguag

SEQ ID NO: 211752 - RNA, 25 nt, Human
ugccaaacauccuuuucugugcucu

SEQ ID NO: 211753 - RNA, 24 nt, Human
ugccuaaaguuuauguaagaauug

SEQ ID NO: 211754 - RNA, 24 nt, Human
uggagcaacaaaaacgagugagaa

SEQ ID NO: 211755 - RNA, 19 nt, Human
uggccaaagcggaccccgg

SEQ ID NO: 211756 - RNA, 23 nt, Human
uggccaaagcggaccccggagac

SEQ ID NO: 211757 - RNA, 19 nt, Human
uguaauguaugugugugga

SEQ ID NO: 211758 - RNA, 19 nt, Human
ugucucacuguacucacgu

SEQ ID NO: 211759 - RNA, 18 nt, Human
uguggauauguauauaua

SEQ ID NO: 211760 - RNA, 19 nt, Human
uguggauauguauauauau

SEQ ID NO: 211761 - RNA, 18 nt, Human
uguguauauauauguaua

SEQ ID NO: 211762 - RNA, 20 nt, Human
ugugucugcugggaauauag

SEQ ID NO: 211763 - RNA, 18 nt, Human
uguguggauauguauaua

SEQ ID NO: 211764 - RNA, 19 nt, Human
uguguggauauguauauau

SEQ ID NO: 211765 - RNA, 24 nt, Human
uguguggauauguauauauauaau

SEQ ID NO: 211766 - RNA, 27 nt, Human
uguguggauauguauauauauaaucaa

SEQ ID NO: 211767 - RNA, 20 nt, Human
uguguguggauauguauaua

SEQ ID NO: 211768 - RNA, 22 nt, Human
uuaaaaccuauggaaagaaaau

SEQ ID NO: 211769 - RNA, 22 nt, Human
uuaauaaggcuaaaaaaaagua

SEQ ID NO: 211770 - RNA, 21 nt, Human
uuagaauauuaaugccaaaag

SEQ ID NO: 211771 - RNA, 22 nt, Human
uucaaguuuacauagauuucau

SEQ ID NO: 211772 - RNA, 22 nt, Human
uucacaggauaccaagauucau

SEQ ID NO: 211773 - RNA, 21 nt, Human
uucaugagucagaaaaaugcc

SEQ ID NO: 211774 - RNA, 27 nt, Human
uucauugacagugacuucucauacuga

SEQ ID NO: 211775 - RNA, 19 nt, Human
uuccaguaaaaacauaagg

SEQ ID NO: 211776 - RNA, 21 nt, Human
uuccgaaagucuuaggucaga

SEQ ID NO: 211777 - RNA, 22 nt, Human
uucugugcucuuuucaugaguc

SEQ ID NO: 211778 - RNA, 22 nt, Human
uugggaggcuuagaccauuauu

SEQ ID NO: 211779 - RNA, 20 nt, Human
uuuauauacacagauauaug

SEQ ID NO: 211780 - RNA, 19 nt, Human
uuucacaggauaccaagau

SEQ ID NO: 211781 - RNA, 23 nt, Human
uuucuuccuggagcaccccuugu

SEQ ID NO: 211782 - RNA, 24 nt, Human
uuuuuuuagcuacauuugggcauu

SEQ ID NO: 211783 - RNA, 18 nt, Human
uuuuuuuuuuuuaggagc

SEQ ID NO: 211784 - RNA, 23 nt, Human
uuuuuuuuuuuuuuuuuuuuagg

SEQ ID NO: 211785 - RNA, 28 nt, Human
aaacggccagcaaaacguccagcagguc

SEQ ID NO: 211786 - RNA, 18 nt, Human
aaagggagaguuaaggag

SEQ ID NO: 211787 - RNA, 21 nt, Human
aacagcggacaguacagcccc

SEQ ID NO: 211788 - RNA, 22 nt, Human
acuccaggagcgaaacaccagc

SEQ ID NO: 211789 - RNA, 24 nt, Human
acuuuggggagagcuggaaaggga

SEQ ID NO: 211790 - RNA, 19 nt, Human
agaauggcagaugcugccu

SEQ ID NO: 211791 - RNA, 20 nt, Human
agaguucagcagagcuucug

SEQ ID NO: 211792 - RNA, 18 nt, Human
agccuguggcccucgccc

SEQ ID NO: 211793 - RNA, 21 nt, Human
aggcagucggaguggcugaag

SEQ ID NO: 211794 - RNA, 19 nt, Human
agggcgccuggaaaugagc

SEQ ID NO: 211795 - RNA, 22 nt, Human
caccagcugcccugucgcccua

SEQ ID NO: 211796 - RNA, 22 nt, Human
cagcaacaccuugccucggcca

SEQ ID NO: 211797 - RNA, 20 nt, Human
caguacagccccgccuguuu

SEQ ID NO: 211798 - RNA, 21 nt, Human
ccaaacagcggacaguacagc

SEQ ID NO: 211799 - RNA, 24 nt, Human
cccaggcagucggaguggcugaag

SEQ ID NO: 211800 - RNA, 23 nt, Human
cccccagccagggaagauuucua

SEQ ID NO: 211801 - RNA, 28 nt, Human
cccgccuguuuuuuccacucccugucuu

SEQ ID NO: 211802 - RNA, 21 nt, Human
ccggagagcgcgggcugggac

SEQ ID NO: 211803 - RNA, 21 nt, Human
ccuguccaccucucucccucc

SEQ ID NO: 211804 - RNA, 20 nt, Human
cuccguaguuagaauggcag

SEQ ID NO: 211805 - RNA, 20 nt, Human
cuucacuuuucuugacagcu

SEQ ID NO: 211806 - RNA, 18 nt, Human
gacgcgggcgccucagcc

SEQ ID NO: 211807 - RNA, 27 nt, Human
gagcagccuugccccagcaacaccuug

SEQ ID NO: 211808 - RNA, 19 nt, Human
gaggugcaggcggcaggug

SEQ ID NO: 211809 - RNA, 24 nt, Human
gcaaaacggccagcaaaacgucca

SEQ ID NO: 211810 - RNA, 21 nt, Human
gccagugugcaaaagcccaca

SEQ ID NO: 211811 - RNA, 23 nt, Human
gcccuaacggaggugcaggcggc

SEQ ID NO: 211812 - RNA, 20 nt, Human
ggugcagacucugccugucc

SEQ ID NO: 211813 - RNA, 21 nt, Human
gguguacuuuaugcuugguau

SEQ ID NO: 211814 - RNA, 23 nt, Human
guaaacuuccccccagccaggga

SEQ ID NO: 211815 - RNA, 24 nt, Human
guaaacuuccccccagccagggaa

SEQ ID NO: 211816 - RNA, 21 nt, Human
guccagcaggucucagaugcg

SEQ ID NO: 211817 - RNA, 18 nt, Human
gugcagacucugccuguc

SEQ ID NO: 211818 - RNA, 18 nt, Human
uacucagcuccguaguua

SEQ ID NO: 211819 - RNA, 19 nt, Human
ucccugucuuagccaaaga

SEQ ID NO: 211820 - RNA, 21 nt, Human
ucuagaguucagcagagcuuc

SEQ ID NO: 211821 - RNA, 21 nt, Human
ucucucagugacuagacucuc

SEQ ID NO: 211822 - RNA, 19 nt, Human
ugacuagacucuccuaagu

SEQ ID NO: 211823 - RNA, 18 nt, Human
ugcacuccgggacgcggg

SEQ ID NO: 211824 - RNA, 22 nt, Human
ugccuguccaccucucucccuc

SEQ ID NO: 211825 - RNA, 22 nt, Human
uggaaagggagaguuaaggagg

SEQ ID NO: 211826 - RNA, 20 nt, Human
uguccagggcgagacggcga

SEQ ID NO: 211827 - RNA, 18 nt, Human
uuagaauggcagaugcug

SEQ ID NO: 211828 - RNA, 21 nt, Human
uuagaauggcagaugcugccu

SEQ ID NO: 211829 - RNA, 21 nt, Human
uugguauaacagaaauucucu

SEQ ID NO: 211830 - RNA, 23 nt, Human
uuuggggagagcuggaaagggag

SEQ ID NO: 211831 - RNA, 19 nt, Human
aaacaggaacagucuacaa

SEQ ID NO: 211832 - RNA, 19 nt, Human
aagcagcagagaagcuccc

SEQ ID NO: 211833 - RNA, 23 nt, Human
aagcucccagcaaacaggaacag

SEQ ID NO: 211834 - RNA, 26 nt, Human
aagcucccagcaaacaggaacagucu

SEQ ID NO: 211835 - RNA, 21 nt, Human
acaaagaucagacagcaaaca

SEQ ID NO: 211836 - RNA, 19 nt, Human
acagcaaacaacaucccga

SEQ ID NO: 211837 - RNA, 21 nt, Human
acaggaacagucuacaaagau

SEQ ID NO: 211838 - RNA, 24 nt, Human
agacagcaaacaacaucccgaaga

SEQ ID NO: 211839 - RNA, 18 nt, Human
aggagggagugggggagg

SEQ ID NO: 211840 - RNA, 20 nt, Human
aggagggagugggggaggac

SEQ ID NO: 211841 - RNA, 22 nt, Human
aucccgaagaagagaagcacau

SEQ ID NO: 211842 - RNA, 21 nt, Human
caaacaacaucccgaagaaga

SEQ ID NO: 211843 - RNA, 27 nt, Human
cagcaaacaacaucccgaagaagagaa

SEQ ID NO: 211844 - RNA, 23 nt, Human
caggaacagucuacaaagaucag

SEQ ID NO: 211845 - RNA, 19 nt, Human
cgguuguuggugcauuucc

SEQ ID NO: 211846 - RNA, 18 nt, Human
cucccagcaaacaggaac

SEQ ID NO: 211847 - RNA, 23 nt, Human
gaagagaagcacauuuuauggca

SEQ ID NO: 211848 - RNA, 20 nt, Human
gagaagcacauuuuauggca

SEQ ID NO: 211849 - RNA, 24 nt, Human
uaagcagcagagaagcucccagca

SEQ ID NO: 211850 - RNA, 23 nt, Human
uacaaagaucagacagcaaacaa

SEQ ID NO: 211851 - RNA, 23 nt, Human
ucaaucaagagcaaguauugguc

SEQ ID NO: 211852 - RNA, 24 nt, Human
ucagacagcaaacaacaucccgaa

SEQ ID NO: 211853 - RNA, 29 nt, Human
uccauucugcuuacacuugcuagagaaaa

SEQ ID NO: 211854 - RNA, 20 nt, Human
uguuuaucaaucaagagcag

SEQ ID NO: 211855 - RNA, 19 nt, Human
uuagaaaacaaggaugacc

SEQ ID NO: 211856 - RNA, 19 nt, Human
uuccuuucacauacaguga

SEQ ID NO: 211857 - RNA, 22 nt, Human
uucugcuuacacuugcuagaga

SEQ ID NO: 211858 - RNA, 19 nt, Human
acacacccugcugccccuc

SEQ ID NO: 211859 - RNA, 19 nt, Human
caccaggcaacgcuaacac

SEQ ID NO: 211860 - RNA, 21 nt, Human
cacugagccgucccuucuaca

SEQ ID NO: 211861 - RNA, 21 nt, Human
caggccacaccacccuuuguu

SEQ ID NO: 211862 - RNA, 23 nt, Human
ccaaugcccaggccacaccaccc

SEQ ID NO: 211863 - RNA, 19 nt, Human
ccaggcccccuuccuggca

SEQ ID NO: 211864 - RNA, 23 nt, Human
cccaggccacaccacccuuuguu

SEQ ID NO: 211865 - RNA, 24 nt, Human
cccguucuuccuuccauggcaggg

SEQ ID NO: 211866 - RNA, 18 nt, Human
cccugcugccccuccuuu

SEQ ID NO: 211867 - RNA, 21 nt, Human
ccgaggcucacguuccaacgc

SEQ ID NO: 211868 - RNA, 21 nt, Human
ccgcaccaggcaacgcuaaca

SEQ ID NO: 211869 - RNA, 18 nt, Human
ccucuggucugcaaaggg

SEQ ID NO: 211870 - RNA, 23 nt, Human
cguuccaacgcugcagugcccac

SEQ ID NO: 211871 - RNA, 20 nt, Human
cuuuggccgggccaucccuc

SEQ ID NO: 211872 - RNA, 21 nt, Human
gaccgcaggcccugacugcac

SEQ ID NO: 211873 - RNA, 19 nt, Human
ggagggcccagguuuccuu

SEQ ID NO: 211874 - RNA, 23 nt, Human
ggcccagguuuccuuguuaggcc

SEQ ID NO: 211875 - RNA, 19 nt, Human
gggccggggcagguggucu

SEQ ID NO: 211876 - RNA, 21 nt, Human
gggccggggcagguggucuuc

SEQ ID NO: 211877 - RNA, 21 nt, Human
ugccccggugcuacucggcgg

SEQ ID NO: 211878 - RNA, 20 nt, Human
ugccuagacuuuggccgggc

SEQ ID NO: 211879 - RNA, 22 nt, Human
uggccgggccaucccucaugcc

SEQ ID NO: 211880 - RNA, 23 nt, Human
ugucccguucuuccuuccauggc

SEQ ID NO: 211881 - RNA, 19 nt, Human
uuggggagggacccccaag

SEQ ID NO: 211882 - RNA, 22 nt, Human
uugucccguucuuccuuccaug

SEQ ID NO: 211883 - RNA, 21 nt, Human
uuuggcaggaaacuaaaauug

SEQ ID NO: 211884 - RNA, 25 nt, Human
gcuaacccuagccucauccugcagc

SEQ ID NO: 211885 - RNA, 19 nt, Human
uaacccuagccucauccug

SEQ ID NO: 211886 - RNA, 19 nt, Human
uagaaugcuaacccuagcc

SEQ ID NO: 211887 - RNA, 21 nt, Human
uagaaugcuaacccuagccuc

SEQ ID NO: 211888 - RNA, 22 nt, Human
uagccucauccugcagcagaaa

SEQ ID NO: 211889 - RNA, 20 nt, Human
uguaggaaugaggagacaug

SEQ ID NO: 211890 - RNA, 20 nt, Human
aaagaagaaaaagaagggaa

SEQ ID NO: 211891 - RNA, 21 nt, Human
aagaacccccaggagccacau

SEQ ID NO: 211892 - RNA, 21 nt, Human
aagaagaaaaagaagggaaaa

SEQ ID NO: 211893 - RNA, 23 nt, Human
aagaagaaaaagaagggaaaagc

SEQ ID NO: 211894 - RNA, 23 nt, Human
aaguggccugauggauccagggc

SEQ ID NO: 211895 - RNA, 26 nt, Human
acaucacaaaaaaagaagaaaaagaa

SEQ ID NO: 211896 - RNA, 22 nt, Human
acauuagaaagaccauucugga

SEQ ID NO: 211897 - RNA, 25 nt, Human
accauucuggaggcagcauggaggc

SEQ ID NO: 211898 - RNA, 21 nt, Human
agaagaaaaagaagggaaaag

SEQ ID NO: 211899 - RNA, 18 nt, Human
agagcugaagucacagga

SEQ ID NO: 211900 - RNA, 23 nt, Human
agcagguugggcagguggucggg

SEQ ID NO: 211901 - RNA, 22 nt, Human
agccaucuuucauacaagucuc

SEQ ID NO: 211902 - RNA, 21 nt, Human
aggcacagccaucuuucauac

SEQ ID NO: 211903 - RNA, 21 nt, Human
aggcaguggcaagaggagagc

SEQ ID NO: 211904 - RNA, 24 nt, Human
aggcaguggcaagaggagagcagg

SEQ ID NO: 211905 - RNA, 19 nt, Human
agggccugauaggacagga

SEQ ID NO: 211906 - RNA, 22 nt, Human
agggcucuccuucacggggacu

SEQ ID NO: 211907 - RNA, 18 nt, Human
agucuccaagugccagaa

SEQ ID NO: 211908 - RNA, 21 nt, Human
aguggagauggagcuuggagg

SEQ ID NO: 211909 - RNA, 20 nt, Human
auacagcauucauucgcuga

SEQ ID NO: 211910 - RNA, 18 nt, Human
auuugcucagagccuugg

SEQ ID NO: 211911 - RNA, 20 nt, Human
caagucuccaagugccagaa

SEQ ID NO: 211912 - RNA, 21 nt, Human
caagucuccaagugccagaag

SEQ ID NO: 211913 - RNA, 23 nt, Human
cacauuagaaagaccauucugga

SEQ ID NO: 211914 - RNA, 25 nt, Human
cagcagaggaagaaagaacccccag

SEQ ID NO: 211915 - RNA, 24 nt, Human
cagccaucuuucauacaagucucc

SEQ ID NO: 211916 - RNA, 24 nt, Human
caucacaaaaaaagaagaaaaaga

SEQ ID NO: 211917 - RNA, 20 nt, Human
ccacuugguugggggucauc

SEQ ID NO: 211918 - RNA, 23 nt, Human
cccauagccgggagcccuggggc

SEQ ID NO: 211919 - RNA, 22 nt, Human
cccccaggagccacauuugcuc

SEQ ID NO: 211920 - RNA, 21 nt, Human
ccccgaaagaacauaaucucc

SEQ ID NO: 211921 - RNA, 21 nt, Human
cccuggggcagggggacuggc

SEQ ID NO: 211922 - RNA, 22 nt, Human
cgccuucugaggguccaccccu

SEQ ID NO: 211923 - RNA, 23 nt, Human
cggggacugaaaaaaaaaaauca

SEQ ID NO: 211924 - RNA, 23 nt, Human
cucuacaaugucaaggagcaauu

SEQ ID NO: 211925 - RNA, 28 nt, Human
cucuccccgaaagaacauaaucuccaaa

SEQ ID NO: 211926 - RNA, 24 nt, Human
cugauaggacaggaggucuucccc

SEQ ID NO: 211927 - RNA, 26 nt, Human
gaagaaagaacccccaggagccacau

SEQ ID NO: 211928 - RNA, 18 nt, Human
gacuggucuuuucuuuuu

SEQ ID NO: 211929 - RNA, 22 nt, Human
gaggaagaggcaguggcaagag

SEQ ID NO: 211930 - RNA, 21 nt, Human
gaggguccaccccucaauggc

SEQ ID NO: 211931 - RNA, 20 nt, Human
gcaugggaagguggaaugag

SEQ ID NO: 211932 - RNA, 21 nt, Human
gccacauuugcucagagccuu

SEQ ID NO: 211933 - RNA, 18 nt, Human
ggaauauuuuaaguccuc

SEQ ID NO: 211934 - RNA, 23 nt, Human
ggagacaggcagaggcacagcca

SEQ ID NO: 211935 - RNA, 22 nt, Human
ggcuaggugcuuggcccugcag

SEQ ID NO: 211936 - RNA, 23 nt, Human
gggcagcagugccuggacagagg

SEQ ID NO: 211937 - RNA, 19 nt, Human
uaaaacagggugugggagc

SEQ ID NO: 211938 - RNA, 19 nt, Human
uagaaagaccauucuggag

SEQ ID NO: 211939 - RNA, 24 nt, Human
uagccgggagcccuggggcagggg

SEQ ID NO: 211940 - RNA, 21 nt, Human
ucagccucuccccgaaagaac

SEQ ID NO: 211941 - RNA, 18 nt, Human
ucagugcccccauagccg

SEQ ID NO: 211942 - RNA, 20 nt, Human
ucagugcccccauagccggg

SEQ ID NO: 211943 - RNA, 23 nt, Human
ucauggacuggucuuuucuuuuu

SEQ ID NO: 211944 - RNA, 20 nt, Human
ucccugcaguccuugccaug

SEQ ID NO: 211945 - RNA, 18 nt, Human
uccugugaccagguuguu

SEQ ID NO: 211946 - RNA, 24 nt, Human
uccuugccaugcaagaaugggaac

SEQ ID NO: 211947 - RNA, 20 nt, Human
ucuccaagugccagaagcuc

SEQ ID NO: 211948 - RNA, 18 nt, Human
ucuggaggcagcauggag

SEQ ID NO: 211949 - RNA, 22 nt, Human
ucuggaggcagcauggaggcug

SEQ ID NO: 211950 - RNA, 27 nt, Human
ucuuuucuuuuuuguaaaacagggugu

SEQ ID NO: 211951 - RNA, 21 nt, Human
ugaagaggaggcagaguccug

SEQ ID NO: 211952 - RNA, 18 nt, Human
ugcucagagccuugggag

SEQ ID NO: 211953 - RNA, 24 nt, Human
ugcucagagccuugggagcugaga

SEQ ID NO: 211954 - RNA, 20 nt, Human
uggcaagaggagagcagguu

SEQ ID NO: 211955 - RNA, 21 nt, Human
uggcaagaggagagcagguug

SEQ ID NO: 211956 - RNA, 19 nt, Human
uggccugauggauccaggg

SEQ ID NO: 211957 - RNA, 20 nt, Human
uggccugauggauccaggga

SEQ ID NO: 211958 - RNA, 21 nt, Human
ugggaacaggcaggccugggc

SEQ ID NO: 211959 - RNA, 23 nt, Human
ugggacaucacaaaaaaagaaga

SEQ ID NO: 211960 - RNA, 23 nt, Human
ugggcagcagugccuggacagag

SEQ ID NO: 211961 - RNA, 18 nt, Human
uggggcagggggacuggc

SEQ ID NO: 211962 - RNA, 19 nt, Human
uggugggggagacaggcag

SEQ ID NO: 211963 - RNA, 23 nt, Human
ugugaccagguuguugugacgcc

SEQ ID NO: 211964 - RNA, 21 nt, Human
uguuuuaaaaggaaaaaaaaa

SEQ ID NO: 211965 - RNA, 24 nt, Human
uuaaaaaccucccucauggacugg

SEQ ID NO: 211966 - RNA, 20 nt, Human
uucagcagaggaagaaagaa

SEQ ID NO: 211967 - RNA, 18 nt, Human
uucgcugaguaccugcca

SEQ ID NO: 211968 - RNA, 21 nt, Human
uugggcagguggucgggguuu

SEQ ID NO: 211969 - RNA, 23 nt, Human
uuuuuuuuuuuuuuuuuuuuagg

SEQ ID NO: 211970 - RNA, 19 nt, Human
caaaccauacauucaacaa

SEQ ID NO: 211971 - RNA, 21 nt, Human
caauagguagcaaaccauaca

SEQ ID NO: 211972 - RNA, 28 nt, Human
uaaauagaaggccugauauuguaaugac

SEQ ID NO: 211973 - RNA, 24 nt, Human
uacaaaaagaaucauaaaagaucc

SEQ ID NO: 211974 - RNA, 18 nt, Human
uacaauagguagcaaacc

SEQ ID NO: 211975 - RNA, 18 nt, Human
uauaguuuuaagauuaag

SEQ ID NO: 211976 - RNA, 20 nt, Human
ugaguagugauuaaagagag

SEQ ID NO: 211977 - RNA, 21 nt, Human
aaaaacagccaaauauccaca

SEQ ID NO: 211978 - RNA, 19 nt, Human
aaaacuucuuucaucccag

SEQ ID NO: 211979 - RNA, 18 nt, Human
aaacagccaaauauccac

SEQ ID NO: 211980 - RNA, 25 nt, Human
aaaccaagggcgagcgacucgcgga

SEQ ID NO: 211981 - RNA, 18 nt, Human
aacuacuuuuacaguuag

SEQ ID NO: 211982 - RNA, 27 nt, Human
aagaggccagaguacacccaccugaau

SEQ ID NO: 211983 - RNA, 18 nt, Human
aaguauuaaagauggccu

SEQ ID NO: 211984 - RNA, 18 nt, Human
aauccaucucuccuacca

SEQ ID NO: 211985 - RNA, 20 nt, Human
accugagucccagggcgccu

SEQ ID NO: 211986 - RNA, 22 nt, Human
agaaaagaaauaaguaauucuc

SEQ ID NO: 211987 - RNA, 23 nt, Human
agaaaagaaauaaguaauucuca

SEQ ID NO: 211988 - RNA, 24 nt, Human
agaaaccaagggcgagcgguggga

SEQ ID NO: 211989 - RNA, 22 nt, Human
agaauagaggauauucauucau

SEQ ID NO: 211990 - RNA, 20 nt, Human
agacaauaagccccuacuaa

SEQ ID NO: 211991 - RNA, 21 nt, Human
agacaauaagccccuacuaaa

SEQ ID NO: 211992 - RNA, 18 nt, Human
agcagcgugacugaagaa

SEQ ID NO: 211993 - RNA, 21 nt, Human
aggcaaaaggaaguguuggca

SEQ ID NO: 211994 - RNA, 18 nt, Human
auaaugaaccaagaggcc

SEQ ID NO: 211995 - RNA, 21 nt, Human
aucauuguuaagagaccuaca

SEQ ID NO: 211996 - RNA, 27 nt, Human
augaaccaagaggccagaguacaccca

SEQ ID NO: 211997 - RNA, 23 nt, Human
cacuccagaacuacucauaaagu

SEQ ID NO: 211998 - RNA, 21 nt, Human
cacugacaaacuggaaaaaac

SEQ ID NO: 211999 - RNA, 22 nt, Human
cagaacacucugauuaauauaa

SEQ ID NO: 212000 - RNA, 22 nt, Human
cagaacuacucauaaaguauua

SEQ ID NO: 212001 - RNA, 20 nt, Human
cagcagacugcucaguccca

SEQ ID NO: 212002 - RNA, 23 nt, Human
cagccccuggacuccagaggccc

SEQ ID NO: 212003 - RNA, 24 nt, Human
caggaaacaaaaggcaaaaggaag

SEQ ID NO: 212004 - RNA, 23 nt, Human
caugaccccagaauccaucucuc

SEQ ID NO: 212005 - RNA, 20 nt, Human
cauuuucuuuuagguuaguu

SEQ ID NO: 212006 - RNA, 22 nt, Human
ccacagccgcgucccccaggcu

SEQ ID NO: 212007 - RNA, 23 nt, Human
ccaccugaauaaauucugcaccc

SEQ ID NO: 212008 - RNA, 18 nt, Human
cccacgcgcgcucccccg

SEQ ID NO: 212009 - RNA, 24 nt, Human
cccacgcgcgcucccccggcuacc

SEQ ID NO: 212010 - RNA, 26 nt, Human
ccccacgcgcgcucccccggcuaccc

SEQ ID NO: 212011 - RNA, 20 nt, Human
ccccagaaaccaagggcgag

SEQ ID NO: 212012 - RNA, 19 nt, Human
cccuggacuccagaggccc

SEQ ID NO: 212013 - RNA, 18 nt, Human
ccgcuggggccaagcgcg

SEQ ID NO: 212014 - RNA, 25 nt, Human
ccugaauaaauucugcacccagucu

SEQ ID NO: 212015 - RNA, 25 nt, Human
cuaaaacaaauauauauuaaggcaa

SEQ ID NO: 212016 - RNA, 24 nt, Human
cuaccaggguugucugccuguacc

SEQ ID NO: 212017 - RNA, 18 nt, Human
cucauaaaguauuaaaga

SEQ ID NO: 212018 - RNA, 19 nt, Human
cuccagaggcccaccauca

SEQ ID NO: 212019 - RNA, 20 nt, Human
cuccgcgccuggggcucugc

SEQ ID NO: 212020 - RNA, 26 nt, Human
gaaacaaaaggcaaaaggagggaccc

SEQ ID NO: 212021 - RNA, 18 nt, Human
gaccccagaauccaucuc

SEQ ID NO: 212022 - RNA, 22 nt, Human
gagacaauaagccccuacuaaa

SEQ ID NO: 212023 - RNA, 23 nt, Human
gagaugggaacaguuacuggaaa

SEQ ID NO: 212024 - RNA, 21 nt, Human
gagcccccacgcgcgcucccc

SEQ ID NO: 212025 - RNA, 21 nt, Human
gcagacugcucagucccacgc

SEQ ID NO: 212026 - RNA, 19 nt, Human
gggaacaguuacuggaaau

SEQ ID NO: 212027 - RNA, 20 nt, Human
gggcugggucacaugucggg

SEQ ID NO: 212028 - RNA, 22 nt, Human
gucacaugucggggggcagcag

SEQ ID NO: 212029 - RNA, 23 nt, Human
gucccccaggcuuccccagaaac

SEQ ID NO: 212030 - RNA, 23 nt, Human
uaaaacaaauauauauuaaggca

SEQ ID NO: 212031 - RNA, 22 nt, Human
uaaaccauuagaucugaaacug

SEQ ID NO: 212032 - RNA, 25 nt, Human
uaaguaauucucacagacacugaca

SEQ ID NO: 212033 - RNA, 23 nt, Human
uacccagaaaauaauuguacaag

SEQ ID NO: 212034 - RNA, 22 nt, Human
uagaaagcuauuguuuuauggc

SEQ ID NO: 212035 - RNA, 25 nt, Human
uauccacaauuauauaugguucaac

SEQ ID NO: 212036 - RNA, 24 nt, Human
uaucuccuccugcucgcaauaaac

SEQ ID NO: 212037 - RNA, 21 nt, Human
uauggcugggaucaaaggggu

SEQ ID NO: 212038 - RNA, 21 nt, Human
ucacacacgugcuaugagaau

SEQ ID NO: 212039 - RNA, 22 nt, Human
ucacucaaaauaugaaucauga

SEQ ID NO: 212040 - RNA, 22 nt, Human
uccagaaauaaauguaauauuc

SEQ ID NO: 212041 - RNA, 19 nt, Human
ucuauuauaaaauguguca

SEQ ID NO: 212042 - RNA, 21 nt, Human
ucugauuaauauaauuacucc

SEQ ID NO: 212043 - RNA, 21 nt, Human
ugaaaacacacuuccagaaau

SEQ ID NO: 212044 - RNA, 22 nt, Human
ugaaaacacacuuccagaaaua

SEQ ID NO: 212045 - RNA, 24 nt, Human
ugaaaauaaugaaccaagaggcca

SEQ ID NO: 212046 - RNA, 18 nt, Human
ugacuaaaacaaauauau

SEQ ID NO: 212047 - RNA, 20 nt, Human
ugcaugaaccaaucacacac

SEQ ID NO: 212048 - RNA, 24 nt, Human
ugcgugccacgcuccaggcgaccu

SEQ ID NO: 212049 - RNA, 23 nt, Human
ugcuuguuugaaaauaaugaacc

SEQ ID NO: 212050 - RNA, 22 nt, Human
uggcauaguuuaguuccuacag

SEQ ID NO: 212051 - RNA, 18 nt, Human
ugggaacaguuacuggaa

SEQ ID NO: 212052 - RNA, 18 nt, Human
ugggaucaaaggggugac

SEQ ID NO: 212053 - RNA, 23 nt, Human
uguaauacaucuguucuucaaaa

SEQ ID NO: 212054 - RNA, 24 nt, Human
uguuuaauauuauaauaguaacac

SEQ ID NO: 212055 - RNA, 20 nt, Human
uugcggauaaucacgaaagg

SEQ ID NO: 212056 - RNA, 24 nt, Human
uuugcacaggaaacaaaaggcaaa

SEQ ID NO: 212057 - RNA, 20 nt, Human
accuuggucucguuuucacu

SEQ ID NO: 212058 - RNA, 21 nt, Human
auaguguccaacugcaaguua

SEQ ID NO: 212059 - RNA, 21 nt, Human
caacaguagagcuagaccuug

SEQ ID NO: 212060 - RNA, 20 nt, Human
uaauagggcuccuccacuuu

SEQ ID NO: 212061 - RNA, 19 nt, Human
aaaucuugguuggugggga

SEQ ID NO: 212062 - RNA, 18 nt, Human
acaaagccccggagaugc

SEQ ID NO: 212063 - RNA, 24 nt, Human
acacacacacacacacacaugcag

SEQ ID NO: 212064 - RNA, 23 nt, Human
acacacacacaugcauaugcaca

SEQ ID NO: 212065 - RNA, 28 nt, Human
acacacacacaugcauaugcacacacaa

SEQ ID NO: 212066 - RNA, 23 nt, Human
acacacacauaugcacacacaca

SEQ ID NO: 212067 - RNA, 25 nt, Human
acacacacaugcauaugcacacaca

SEQ ID NO: 212068 - RNA, 25 nt, Human
acacacaugcauaugcacacacaca

SEQ ID NO: 212069 - RNA, 27 nt, Human
acaggcaaugcccugaucccacaaagc

SEQ ID NO: 212070 - RNA, 28 nt, Human
acauaugcacacacacacacagacacug

SEQ ID NO: 212071 - RNA, 19 nt, Human
accugcagcccccuccaug

SEQ ID NO: 212072 - RNA, 18 nt, Human
acgcuggagggcugggcu

SEQ ID NO: 212073 - RNA, 19 nt, Human
agacgcuggagggcugggc

SEQ ID NO: 212074 - RNA, 21 nt, Human
agaugcuguggaccaacuugc

SEQ ID NO: 212075 - RNA, 18 nt, Human
aggcccacaggcacgugc

SEQ ID NO: 212076 - RNA, 21 nt, Human
auccccuuucgcuuccuguug

SEQ ID NO: 212077 - RNA, 26 nt, Human
augcacacacacacauaugcacacac

SEQ ID NO: 212078 - RNA, 18 nt, Human
cacacacacacacacaca

SEQ ID NO: 212079 - RNA, 26 nt, Human
cacacacacacacacacaugcauaug

SEQ ID NO: 212080 - RNA, 28 nt, Human
cacacacacacacacaugcauaugcaca

SEQ ID NO: 212081 - RNA, 23 nt, Human
cacacacacacacagacacugua

SEQ ID NO: 212082 - RNA, 24 nt, Human
cacacacacauaugcacacacaca

SEQ ID NO: 212083 - RNA, 24 nt, Human
cacacacacaugcauaugcacaca

SEQ ID NO: 212084 - RNA, 22 nt, Human
cacagcccaggugaccuugucu

SEQ ID NO: 212085 - RNA, 33 nt, Human
cacaggcacgugcaaucacacacacacguggug

SEQ ID NO: 212086 - RNA, 31 nt, Human
cacaugcauaugcacacacacacauaugcag

SEQ ID NO: 212087 - RNA, 24 nt, Human
caccaugggcucacuccauccccu

SEQ ID NO: 212088 - RNA, 31 nt, Human
cacugcgcaccuaagacacacacacacacag

SEQ ID NO: 212089 - RNA, 28 nt, Human
caggcaaugcccugaucccacaaagccc

SEQ ID NO: 212090 - RNA, 26 nt, Human
caucacagagcccuagggauguggag

SEQ ID NO: 212091 - RNA, 25 nt, Human
caugcacagggcaggugaaugcaug

SEQ ID NO: 212092 - RNA, 20 nt, Human
ccaggagaccaaaggcugca

SEQ ID NO: 212093 - RNA, 23 nt, Human
ccauccaggagaccaaaggcugc

SEQ ID NO: 212094 - RNA, 25 nt, Human
ccauccaggagaccaaaggcugcag

SEQ ID NO: 212095 - RNA, 21 nt, Human
cccacaaagccccggagaugc

SEQ ID NO: 212096 - RNA, 18 nt, Human
cccaguggccuggccagc

SEQ ID NO: 212097 - RNA, 20 nt, Human
cccccccgaguggcccucug

SEQ ID NO: 212098 - RNA, 22 nt, Human
cccccgcccgccucggcucugg

SEQ ID NO: 212099 - RNA, 21 nt, Human
cccgcgggugcccaggcuguc

SEQ ID NO: 212100 - RNA, 21 nt, Human
cgcaccuaagacacacacaca

SEQ ID NO: 212101 - RNA, 22 nt, Human
cggcucuggccgcagaaggaag

SEQ ID NO: 212102 - RNA, 31 nt, Human
cuaagacacacacacacacacacaugcauag

SEQ ID NO: 212103 - RNA, 26 nt, Human
cuagcccagagaggggaggcgacuug

SEQ ID NO: 212104 - RNA, 19 nt, Human
cucacuccauccccuuucg

SEQ ID NO: 212105 - RNA, 25 nt, Human
cucugccuacaucacagagcccuag

SEQ ID NO: 212106 - RNA, 19 nt, Human
cugaucccacaaagccccg

SEQ ID NO: 212107 - RNA, 25 nt, Human
cuggccgcagaaggaaggaagcuga

SEQ ID NO: 212108 - RNA, 18 nt, Human
cuugcagcuccuggaggc

SEQ ID NO: 212109 - RNA, 20 nt, Human
gagaccaaaggcugcaggug

SEQ ID NO: 212110 - RNA, 21 nt, Human
gagcccuagggauguggaggg

SEQ ID NO: 212111 - RNA, 20 nt, Human
gaggggguaccugcugcuuc

SEQ ID NO: 212112 - RNA, 25 nt, Human
gcacacacacacauaugcacacaca

SEQ ID NO: 212113 - RNA, 33 nt, Human
gcaccuaagacacacacacacacacacauggug

SEQ ID NO: 212114 - RNA, 19 nt, Human
gcccaguggccuggccagc

SEQ ID NO: 212115 - RNA, 23 nt, Human
gcccaguggccuggccagcucug

SEQ ID NO: 212116 - RNA, 30 nt, Human
gccggagcacacugcauaguuccaaccugg

SEQ ID NO: 212117 - RNA, 20 nt, Human
ggaagcugacguuuauugag

SEQ ID NO: 212118 - RNA, 26 nt, Human
ggaggcagacgcuggagggcugggcu

SEQ ID NO: 212119 - RNA, 19 nt, Human
ggagggcugggcuccgccu

SEQ ID NO: 212120 - RNA, 24 nt, Human
ggcccaguggccuggccagcucug

SEQ ID NO: 212121 - RNA, 18 nt, Human
ggccccgcgggugcccag

SEQ ID NO: 212122 - RNA, 21 nt, Human
gggcaggguagggggcccagc

SEQ ID NO: 212123 - RNA, 21 nt, Human
gggcaggguagggggcccagc

SEQ ID NO: 212124 - RNA, 20 nt, Human
uaagacacacacacacacac

SEQ ID NO: 212125 - RNA, 21 nt, Human
uacaucacagagcccuaggga

SEQ ID NO: 212126 - RNA, 21 nt, Human
uagcccagagaggggaggcga

SEQ ID NO: 212127 - RNA, 24 nt, Human
uaugcacacacacacauaugcaca

SEQ ID NO: 212128 - RNA, 25 nt, Human
uaugcacacacacacauaugcacac

SEQ ID NO: 212129 - RNA, 21 nt, Human
ucacacacacacguggacaug

SEQ ID NO: 212130 - RNA, 24 nt, Human
ucacacacacacguggacaugcca

SEQ ID NO: 212131 - RNA, 21 nt, Human
ucgcugacgauugauguucuc

SEQ ID NO: 212132 - RNA, 24 nt, Human
ucucacccccgcccgccucggcuc

SEQ ID NO: 212133 - RNA, 20 nt, Human
ucucuugggugcauaaaggg

SEQ ID NO: 212134 - RNA, 21 nt, Human
ucuggacauccagucagccuc

SEQ ID NO: 212135 - RNA, 19 nt, Human
ucuugggugcauaaaggga

SEQ ID NO: 212136 - RNA, 22 nt, Human
ugacgauugauguucucacccc

SEQ ID NO: 212137 - RNA, 23 nt, Human
ugauaaggaacaauauggacuuc

SEQ ID NO: 212138 - RNA, 22 nt, Human
ugcauaugcacacacacacaua

SEQ ID NO: 212139 - RNA, 24 nt, Human
ugcauaugcacacacacacauaug

SEQ ID NO: 212140 - RNA, 29 nt, Human
ugcgcaccuaagacacacacacacacaca

SEQ ID NO: 212141 - RNA, 23 nt, Human
uggcaggugauaaggaacaauau

SEQ ID NO: 212142 - RNA, 18 nt, Human
uggcucagggcccagugg

SEQ ID NO: 212143 - RNA, 23 nt, Human
uggcucagggcccaguggccugg

SEQ ID NO: 212144 - RNA, 18 nt, Human
ugguugguggggagcugu

SEQ ID NO: 212145 - RNA, 21 nt, Human
ugucucuggcucagggcccag

SEQ ID NO: 212146 - RNA, 20 nt, Human
ugugcacacuugugcacaug

SEQ ID NO: 212147 - RNA, 20 nt, Human
uuacugugcacacuugugca

SEQ ID NO: 212148 - RNA, 20 nt, Human
uuccaaccugcagcccccuc

SEQ ID NO: 212149 - RNA, 23 nt, Human
uuccaaccugcagcccccuccau

SEQ ID NO: 212150 - RNA, 18 nt, Human
uugguggggagcuguuuc

SEQ ID NO: 212151 - RNA, 24 nt, Human
uuuaagccuggaaacccccccgag

SEQ ID NO: 212152 - RNA, 20 nt, Human
agacaauucuaacucgagca

SEQ ID NO: 212153 - RNA, 19 nt, Human
ucugaagauucugcuugug

SEQ ID NO: 212154 - RNA, 18 nt, Human
uggggaaggagaaccugu

SEQ ID NO: 212155 - RNA, 19 nt, Human
uuuuucagcuuugcucugg

SEQ ID NO: 212156 - RNA, 26 nt, Human
aaaaacaaacagaaaagaaaagcuua

SEQ ID NO: 212157 - RNA, 18 nt, Human
aaaaacuaaacaaaacaa

SEQ ID NO: 212158 - RNA, 20 nt, Human
aaaacuaaacaaaacaaaaa

SEQ ID NO: 212159 - RNA, 19 nt, Human
aaaaggacaaaaggcaaaa

SEQ ID NO: 212160 - RNA, 25 nt, Human
aaaaggacaaaaggcaaaaaaggua

SEQ ID NO: 212161 - RNA, 22 nt, Human
aaacaaaacaaaaacaaacaga

SEQ ID NO: 212162 - RNA, 22 nt, Human
aaacaauauacaaacaaaacuu

SEQ ID NO: 212163 - RNA, 22 nt, Human
aaacuaaacaaaacaaaaacaa

SEQ ID NO: 212164 - RNA, 20 nt, Human
aacaaaaacaaacagaaaag

SEQ ID NO: 212165 - RNA, 21 nt, Human
aacaaaaacaaacagaaaaga

SEQ ID NO: 212166 - RNA, 23 nt, Human
aagaaggcagcuuucuguugacc

SEQ ID NO: 212167 - RNA, 19 nt, Human
aagacaggauuaaaaacua

SEQ ID NO: 212168 - RNA, 22 nt, Human
aagcaaaaacagagcaaggcaa

SEQ ID NO: 212169 - RNA, 23 nt, Human
aaggcaaaaaagguaguaagcaa

SEQ ID NO: 212170 - RNA, 23 nt, Human
aauuuuacuuacucgccacccac

SEQ ID NO: 212171 - RNA, 21 nt, Human
acaaaacaaaaacaaacagaa

SEQ ID NO: 212172 - RNA, 22 nt, Human
acaaaacaaaaacaaacagaaa

SEQ ID NO: 212173 - RNA, 20 nt, Human
accaauucucuagcucuugc

SEQ ID NO: 212174 - RNA, 19 nt, Human
agaaaagaaaagcuuaaua

SEQ ID NO: 212175 - RNA, 21 nt, Human
agaacacuuuauucucugccu

SEQ ID NO: 212176 - RNA, 25 nt, Human
agacaggauuaaaaacuaaacaaaa

SEQ ID NO: 212177 - RNA, 22 nt, Human
agagguggagagaacuugacca

SEQ ID NO: 212178 - RNA, 22 nt, Human
agcacaaaagcaaaaacagagc

SEQ ID NO: 212179 - RNA, 21 nt, Human
aggaggggccaguuuggaggg

SEQ ID NO: 212180 - RNA, 19 nt, Human
aggcagugagcaggagggg

SEQ ID NO: 212181 - RNA, 23 nt, Human
auagagaugaggaaggcgccaca

SEQ ID NO: 212182 - RNA, 18 nt, Human
aucuccucacuagaaaga

SEQ ID NO: 212183 - RNA, 19 nt, Human
caccaugaagaagaugaca

SEQ ID NO: 212184 - RNA, 19 nt, Human
cacccaccccacuacucuu

SEQ ID NO: 212185 - RNA, 19 nt, Human
caccuaccaacaccggucc

SEQ ID NO: 212186 - RNA, 18 nt, Human
cagaaggauugaguaaug

SEQ ID NO: 212187 - RNA, 18 nt, Human
cagcaguucccaauaaac

SEQ ID NO: 212188 - RNA, 26 nt, Human
cagcucaggaccaaagaggaaacagg

SEQ ID NO: 212189 - RNA, 23 nt, Human
caggauuaaaaacuaaacaaaac

SEQ ID NO: 212190 - RNA, 22 nt, Human
ccacaaaaggacaaaaggcaaa

SEQ ID NO: 212191 - RNA, 22 nt, Human
ccaguguuccuuuuaaccagcu

SEQ ID NO: 212192 - RNA, 27 nt, Human
cccaccccacuacucuuaauucaucgc

SEQ ID NO: 212193 - RNA, 20 nt, Human
ccuucuccugcuacccacug

SEQ ID NO: 212194 - RNA, 26 nt, Human
cuacugaauugcauucacuaaaaugc

SEQ ID NO: 212195 - RNA, 20 nt, Human
cugauauguaucuccucacu

SEQ ID NO: 212196 - RNA, 19 nt, Human
cuucaagcugaguucucug

SEQ ID NO: 212197 - RNA, 22 nt, Human
gcaaccaguguuccuuuuaacc

SEQ ID NO: 212198 - RNA, 26 nt, Human
ggacaauuguacagagcagacuuccu

SEQ ID NO: 212199 - RNA, 18 nt, Human
gggaagcaaggaaaccaa

SEQ ID NO: 212200 - RNA, 19 nt, Human
gggacgccauguuauguuu

SEQ ID NO: 212201 - RNA, 18 nt, Human
guggagagaacuugacca

SEQ ID NO: 212202 - RNA, 22 nt, Human
guucaggcaaccaguguuccuu

SEQ ID NO: 212203 - RNA, 19 nt, Human
uaaacauauaugaagacuu

SEQ ID NO: 212204 - RNA, 19 nt, Human
uaaauacuauuccuugguu

SEQ ID NO: 212205 - RNA, 23 nt, Human
uaaaugagggacaauuguacaga

SEQ ID NO: 212206 - RNA, 23 nt, Human
uaagacaggauuaaaaacuaaac

SEQ ID NO: 212207 - RNA, 23 nt, Human
uaagauccuucaaacacgaguca

SEQ ID NO: 212208 - RNA, 21 nt, Human
uacaaacaaaacuugauccua

SEQ ID NO: 212209 - RNA, 20 nt, Human
uacagggaagcaaggaaacc

SEQ ID NO: 212210 - RNA, 18 nt, Human
uacauucagaaauaaagu

SEQ ID NO: 212211 - RNA, 19 nt, Human
uacccacugugugcuucca

SEQ ID NO: 212212 - RNA, 21 nt, Human
uagaaagacaaccuuaaacau

SEQ ID NO: 212213 - RNA, 18 nt, Human
uagaagaaugaagguugu

SEQ ID NO: 212214 - RNA, 21 nt, Human
ucagaaauaaaguucugaauu

SEQ ID NO: 212215 - RNA, 19 nt, Human
ucaggagaggcagugagca

SEQ ID NO: 212216 - RNA, 18 nt, Human
ucauagaacacuuuauuc

SEQ ID NO: 212217 - RNA, 20 nt, Human
uccacaaaaggacaaaaggc

SEQ ID NO: 212218 - RNA, 27 nt, Human
uccacaaaaggacaaaaggcaaaaaag

SEQ ID NO: 212219 - RNA, 24 nt, Human
uccuccuauauagagaugaggaag

SEQ ID NO: 212220 - RNA, 20 nt, Human
ucugccucuuauucuccucc

SEQ ID NO: 212221 - RNA, 28 nt, Human
ucuguaaugcuauuuuaaaaaaauuauu

SEQ ID NO: 212222 - RNA, 24 nt, Human
ucuguaggcaccuaccaacaccgg

SEQ ID NO: 212223 - RNA, 22 nt, Human
ucuuaauucaucgcccucucca

SEQ ID NO: 212224 - RNA, 25 nt, Human
ugaagaaacugagacauagauagag

SEQ ID NO: 212225 - RNA, 18 nt, Human
ugacaauauaucccuaac

SEQ ID NO: 212226 - RNA, 19 nt, Human
ugagcauacagggaagcaa

SEQ ID NO: 212227 - RNA, 24 nt, Human
ugcucugccucuuauucuccucca

SEQ ID NO: 212228 - RNA, 24 nt, Human
ugcuuccagcuucaagcugaguuc

SEQ ID NO: 212229 - RNA, 19 nt, Human
ugcuuuaagaaaauacaaa

SEQ ID NO: 212230 - RNA, 18 nt, Human
uggauaaacaaagaaguc

SEQ ID NO: 212231 - RNA, 23 nt, Human
uggauaaacaaagaaguccccaa

SEQ ID NO: 212232 - RNA, 19 nt, Human
uggggucgaccccagcagg

SEQ ID NO: 212233 - RNA, 21 nt, Human
ugucaauaauaagaucuaaua

SEQ ID NO: 212234 - RNA, 24 nt, Human
uucaaaaacagagaucaaaguaaa

SEQ ID NO: 212235 - RNA, 24 nt, Human
uucucugccucaucuuuacauuuc

SEQ ID NO: 212236 - RNA, 21 nt, Human
uugauguuacagaugaagaaa

SEQ ID NO: 212237 - RNA, 18 nt, Human
uuggagcaauuuucaugg

SEQ ID NO: 212238 - RNA, 22 nt, Human
uuucauggggaauuguacaaau

SEQ ID NO: 212239 - RNA, 23 nt, Human
uuuuuuuccccaaaaccuguucu

SEQ ID NO: 212240 - RNA, 18 nt, Human
aaaaaaaaaaggagggca

SEQ ID NO: 212241 - RNA, 21 nt, Human
aaacagaugcaccuuaccccc

SEQ ID NO: 212242 - RNA, 26 nt, Human
aaaggagggcaccaagggaaagggau

SEQ ID NO: 212243 - RNA, 21 nt, Human
aaagggaugauggggugagcu

SEQ ID NO: 212244 - RNA, 23 nt, Human
aagcaccacaguuuauuaaguac

SEQ ID NO: 212245 - RNA, 22 nt, Human
aagcacccauccacugccccac

SEQ ID NO: 212246 - RNA, 26 nt, Human
aagcagccucaauucuucuugguguu

SEQ ID NO: 212247 - RNA, 19 nt, Human
aagcagcuccucaucacag

SEQ ID NO: 212248 - RNA, 23 nt, Human
aagcaucccucucuguuuuuuaa

SEQ ID NO: 212249 - RNA, 19 nt, Human
aagggaugauggggugagc

SEQ ID NO: 212250 - RNA, 23 nt, Human
aauccaaagacaggccaaaaaaa

SEQ ID NO: 212251 - RNA, 19 nt, Human
acaggccaaaaaaagcacc

SEQ ID NO: 212252 - RNA, 22 nt, Human
acaggccaaaaaaagcaccaca

SEQ ID NO: 212253 - RNA, 20 nt, Human
accacaguuuauuaaguacu

SEQ ID NO: 212254 - RNA, 19 nt, Human
acccauggccaagggcgug

SEQ ID NO: 212255 - RNA, 18 nt, Human
agacaggccaaaaaaagc

SEQ ID NO: 212256 - RNA, 23 nt, Human
agacaggccaaaaaaagcaccac

SEQ ID NO: 212257 - RNA, 30 nt, Human
agcacccauccacugccccacacuguggcc

SEQ ID NO: 212258 - RNA, 20 nt, Human
agcauccagaggcaccuucc

SEQ ID NO: 212259 - RNA, 24 nt, Human
aggagggcaccaagggaaagggau

SEQ ID NO: 212260 - RNA, 25 nt, Human
aggcaccuucaccauucaccaauca

SEQ ID NO: 212261 - RNA, 23 nt, Human
aguggaagauuagggaagaauga

SEQ ID NO: 212262 - RNA, 23 nt, Human
auaaauagaacuucaguugaaau

SEQ ID NO: 212263 - RNA, 22 nt, Human
caagaaucuucucuguagacuc

SEQ ID NO: 212264 - RNA, 22 nt, Human
caagaaugggacccauggccaa

SEQ ID NO: 212265 - RNA, 19 nt, Human
caauccaaagacaggccaa

SEQ ID NO: 212266 - RNA, 21 nt, Human
cacagucaugucuugucccuc

SEQ ID NO: 212267 - RNA, 19 nt, Human
caccaagggaaagggauga

SEQ ID NO: 212268 - RNA, 22 nt, Human
caccccaaugcucugucccugc

SEQ ID NO: 212269 - RNA, 21 nt, Human
caccuucaccauucaccaauc

SEQ ID NO: 212270 - RNA, 26 nt, Human
caccuucaccauucaccaaucagagg

SEQ ID NO: 212271 - RNA, 19 nt, Human
cagaaaaguuagacaggca

SEQ ID NO: 212272 - RNA, 22 nt, Human
cagcaaggucagcuugacacuc

SEQ ID NO: 212273 - RNA, 19 nt, Human
cagggaaugucaucacaga

SEQ ID NO: 212274 - RNA, 20 nt, Human
caggugcaaugucaccauca

SEQ ID NO: 212275 - RNA, 27 nt, Human
cagugugauuuucaugcucugaaguuc

SEQ ID NO: 212276 - RNA, 21 nt, Human
ccagggggagggagguccugg

SEQ ID NO: 212277 - RNA, 20 nt, Human
ccccacacuguggcaaggau

SEQ ID NO: 212278 - RNA, 18 nt, Human
cccgucccagccguggaa

SEQ ID NO: 212279 - RNA, 22 nt, Human
ccuccuggccuuccucccaagc

SEQ ID NO: 212280 - RNA, 19 nt, Human
ccuggaggcagcugguucu

SEQ ID NO: 212281 - RNA, 18 nt, Human
ccugggccaagaauggga

SEQ ID NO: 212282 - RNA, 24 nt, Human
ccuucauguaacuuacagucucac

SEQ ID NO: 212283 - RNA, 23 nt, Human
cucaaguggaagauuagggaaga

SEQ ID NO: 212284 - RNA, 23 nt, Human
cucacaaauaaauagaacuucag

SEQ ID NO: 212285 - RNA, 22 nt, Human
cuggaggcagcugguucuuuuu

SEQ ID NO: 212286 - RNA, 22 nt, Human
cuguggcaaggauugugagggg

SEQ ID NO: 212287 - RNA, 19 nt, Human
cuuacuaagcacccaucca

SEQ ID NO: 212288 - RNA, 19 nt, Human
cuucaccauucaccaauca

SEQ ID NO: 212289 - RNA, 24 nt, Human
cuuccucccaagcagccucaauuc

SEQ ID NO: 212290 - RNA, 22 nt, Human
cuucucuguagacucuucacag

SEQ ID NO: 212291 - RNA, 20 nt, Human
gaaagcagcuccucaucaca

SEQ ID NO: 212292 - RNA, 21 nt, Human
gaaguaaagguuugcaggcaa

SEQ ID NO: 212293 - RNA, 19 nt, Human
gagggguaaagaagcaugg

SEQ ID NO: 212294 - RNA, 27 nt, Human
gcauccagaggcaccuucccugacugu

SEQ ID NO: 212295 - RNA, 19 nt, Human
ggaaaugaaauguuuauug

SEQ ID NO: 212296 - RNA, 18 nt, Human
gggaaagggaugaugggg

SEQ ID NO: 212297 - RNA, 24 nt, Human
gugagcuggcgaguguggguggga

SEQ ID NO: 212298 - RNA, 21 nt, Human
uaacuuacagucucacaaaua

SEQ ID NO: 212299 - RNA, 20 nt, Human
uagacaggcaccuucaccau

SEQ ID NO: 212300 - RNA, 23 nt, Human
uagggaagaaugacuaggauaaa

SEQ ID NO: 212301 - RNA, 24 nt, Human
ucccugacugucacuggcgcugcu

SEQ ID NO: 212302 - RNA, 20 nt, Human
ucccugcagauaucagcaga

SEQ ID NO: 212303 - RNA, 18 nt, Human
ugaaaugacacagggaac

SEQ ID NO: 212304 - RNA, 23 nt, Human
ugacuaggauaaaaaaaaaagga

SEQ ID NO: 212305 - RNA, 21 nt, Human
ugagggguaaagaagcauggg

SEQ ID NO: 212306 - RNA, 18 nt, Human
ugccagggggagggaggu

SEQ ID NO: 212307 - RNA, 22 nt, Human
ugcucugucccugcagauauca

SEQ ID NO: 212308 - RNA, 24 nt, Human
ugcucugucccugcagauaucagc

SEQ ID NO: 212309 - RNA, 21 nt, Human
ugggcacuuuaauccacauuu

SEQ ID NO: 212310 - RNA, 23 nt, Human
uguccagugaacagcauaggaag

SEQ ID NO: 212311 - RNA, 23 nt, Human
ugucuugucccucugguccugua

SEQ ID NO: 212312 - RNA, 18 nt, Human
uguuugaaaugacacagg

SEQ ID NO: 212313 - RNA, 19 nt, Human
uuccucccaagcagccuca

SEQ ID NO: 212314 - RNA, 19 nt, Human
uuggcgaaagcagcuccuc

SEQ ID NO: 212315 - RNA, 22 nt, Human
uuguaauaaauacaagaaucuu

SEQ ID NO: 212316 - RNA, 19 nt, Human
uuuacagaaaaguuagaca

SEQ ID NO: 212317 - RNA, 23 nt, Human
agaauggaaacauuauuugaaaa

SEQ ID NO: 212318 - RNA, 18 nt, Human
aucccacuccacacacaa

SEQ ID NO: 212319 - RNA, 18 nt, Human
cacaauguacuugugaau

SEQ ID NO: 212320 - RNA, 22 nt, Human
cacaucccacuccacacacaaa

SEQ ID NO: 212321 - RNA, 26 nt, Human
cccacuccacacacaaauauuacacg

SEQ ID NO: 212322 - RNA, 24 nt, Human
ccccacaucccacuccacacacaa

SEQ ID NO: 212323 - RNA, 24 nt, Human
ccccacaucccacuccacacacaa

SEQ ID NO: 212324 - RNA, 26 nt, Human
cccccacaucccacuccacacacaaa

SEQ ID NO: 212325 - RNA, 26 nt, Human
ccccccacaucccacuccacacacaa

SEQ ID NO: 212326 - RNA, 20 nt, Human
ccccuccaccccccacaucc

SEQ ID NO: 212327 - RNA, 25 nt, Human
cccuccaccccccacaucccacucc

SEQ ID NO: 212328 - RNA, 18 nt, Human
ccuccaccccccacaucc

SEQ ID NO: 212329 - RNA, 18 nt, Human
cuccaccccccacauccc

SEQ ID NO: 212330 - RNA, 21 nt, Human
cugucauucccccuccacccc

SEQ ID NO: 212331 - RNA, 18 nt, Human
ggaaacauuauuugaaaa

SEQ ID NO: 212332 - RNA, 21 nt, Human
uaaacauauuucuagcaguuc

SEQ ID NO: 212333 - RNA, 27 nt, Human
ucccacuccacacacaaaaggucggac

SEQ ID NO: 212334 - RNA, 23 nt, Human
ucccccuccaccccccacauccc

SEQ ID NO: 212335 - RNA, 24 nt, Human
ugacaaaacauguucagaauggaa

SEQ ID NO: 212336 - RNA, 18 nt, Human
ugcauuccagaaaucugu

SEQ ID NO: 212337 - RNA, 26 nt, Human
uucagaauggaaacauuauuugaaaa

SEQ ID NO: 212338 - RNA, 22 nt, Human
uuuacuaaauccuucuugucua

SEQ ID NO: 212339 - RNA, 19 nt, Human
aaacauuucaucucuuccc

SEQ ID NO: 212340 - RNA, 21 nt, Human
acauuucaucucuucccaguu

SEQ ID NO: 212341 - RNA, 21 nt, Human
agagucccuccuagaaaacca

SEQ ID NO: 212342 - RNA, 22 nt, Human
agcauagcccccauguucccca

SEQ ID NO: 212343 - RNA, 23 nt, Human
cacccugcaagccccuccggaca

SEQ ID NO: 212344 - RNA, 18 nt, Human
cagcauagcccccauguu

SEQ ID NO: 212345 - RNA, 23 nt, Human
cagcauagcccccauguucccca

SEQ ID NO: 212346 - RNA, 21 nt, Human
cagccacccugcaagccccuc

SEQ ID NO: 212347 - RNA, 29 nt, Human
cagcuucaccggagaugagaaggugccac

SEQ ID NO: 212348 - RNA, 23 nt, Human
cagggcuucagccacccugcaag

SEQ ID NO: 212349 - RNA, 22 nt, Human
ccagugaugugcuggcccuuuc

SEQ ID NO: 212350 - RNA, 20 nt, Human
ccccagggcuucagccaccc

SEQ ID NO: 212351 - RNA, 21 nt, Human
ccccauguuccccacccucuu

SEQ ID NO: 212352 - RNA, 18 nt, Human
ccccuggguaaacauagg

SEQ ID NO: 212353 - RNA, 26 nt, Human
ccccuggguaaacauaggaaagcagu

SEQ ID NO: 212354 - RNA, 23 nt, Human
cuggaggucggggggagcauggc

SEQ ID NO: 212355 - RNA, 19 nt, Human
gagaugagaaggugccacc

SEQ ID NO: 212356 - RNA, 18 nt, Human
gagcauggcugcuuuccc

SEQ ID NO: 212357 - RNA, 22 nt, Human
gagggcccuggacccucuguuc

SEQ ID NO: 212358 - RNA, 20 nt, Human
gcccuggacccucuguucuc

SEQ ID NO: 212359 - RNA, 19 nt, Human
ggacccucuguucucugcc

SEQ ID NO: 212360 - RNA, 20 nt, Human
ggagcauggcugcuuucccc

SEQ ID NO: 212361 - RNA, 22 nt, Human
uagcccccauguuccccacccu

SEQ ID NO: 212362 - RNA, 24 nt, Human
ucagcuucaccggagaugagaagg

SEQ ID NO: 212363 - RNA, 18 nt, Human
uccucagggcaggggcgg

SEQ ID NO: 212364 - RNA, 19 nt, Human
ucggcuggaggucgggggg

SEQ ID NO: 212365 - RNA, 22 nt, Human
ugagaaggugccacccgcaaca

SEQ ID NO: 212366 - RNA, 20 nt, Human
ugccccagggcuucagccac

SEQ ID NO: 212367 - RNA, 22 nt, Human
uggacuaggguccucagggccg

SEQ ID NO: 212368 - RNA, 21 nt, Human
ugggagccaggagggcccugg

SEQ ID NO: 212369 - RNA, 22 nt, Human
uuaaauaugaaaaaacauuuca

SEQ ID NO: 212370 - RNA, 23 nt, Human
uucagccacccugcaagccccuc

SEQ ID NO: 212371 - RNA, 21 nt, Human
aaaacgcaggcaagcacaacg

SEQ ID NO: 212372 - RNA, 22 nt, Human
aaagacaggaucuugcucuguu

SEQ ID NO: 212373 - RNA, 19 nt, Human
aacggaugucuccugggcg

SEQ ID NO: 212374 - RNA, 25 nt, Human
aagcaauccuccugccucagccucc

SEQ ID NO: 212375 - RNA, 25 nt, Human
accagugugaccuccaucccuucuc

SEQ ID NO: 212376 - RNA, 20 nt, Human
accuccaucccuucucccuc

SEQ ID NO: 212377 - RNA, 19 nt, Human
acuacaggcguaugccacc

SEQ ID NO: 212378 - RNA, 22 nt, Human
acugcagccucgaacuccuggg

SEQ ID NO: 212379 - RNA, 19 nt, Human
acuucuguugucuguuccc

SEQ ID NO: 212380 - RNA, 21 nt, Human
acuugggcuucaugacuucug

SEQ ID NO: 212381 - RNA, 21 nt, Human
agcggcugagaaaggaaccac

SEQ ID NO: 212382 - RNA, 22 nt, Human
aggcaagcacaacggaugucuc

SEQ ID NO: 212383 - RNA, 18 nt, Human
agggagcugggguuauag

SEQ ID NO: 212384 - RNA, 18 nt, Human
agggagcugggguuauag

SEQ ID NO: 212385 - RNA, 20 nt, Human
agugcaguggugccaucaug

SEQ ID NO: 212386 - RNA, 20 nt, Human
auccuccugccucagccucc

SEQ ID NO: 212387 - RNA, 20 nt, Human
augcugcccaggcuggucuc

SEQ ID NO: 212388 - RNA, 19 nt, Human
caaaacgcaggcaagcaca

SEQ ID NO: 212389 - RNA, 21 nt, Human
caaaacgcaggcaagcacaac

SEQ ID NO: 212390 - RNA, 22 nt, Human
caaaacgcaggcaagcacaacg

SEQ ID NO: 212391 - RNA, 22 nt, Human
caagcaauccuccugccucagc

SEQ ID NO: 212392 - RNA, 27 nt, Human
caagcaauccuccugccucagccuccu

SEQ ID NO: 212393 - RNA, 22 nt, Human
cacauauacaugaaaauaagau

SEQ ID NO: 212394 - RNA, 23 nt, Human
caccuuugauuucacuugggcuu

SEQ ID NO: 212395 - RNA, 20 nt, Human
cagccggggcagugaagcgg

SEQ ID NO: 212396 - RNA, 19 nt, Human
cagccuccugaguggcuag

SEQ ID NO: 212397 - RNA, 24 nt, Human
cagccucgaacuccugggcucaag

SEQ ID NO: 212398 - RNA, 24 nt, Human
caggaucuugcucuguugcccagg

SEQ ID NO: 212399 - RNA, 20 nt, Human
cagugugaccuccaucccuu

SEQ ID NO: 212400 - RNA, 19 nt, Human
cauagagacaagguugcca

SEQ ID NO: 212401 - RNA, 23 nt, Human
cauggccucuguuuuuuagaaau

SEQ ID NO: 212402 - RNA, 20 nt, Human
ccaccacauccagccaauuu

SEQ ID NO: 212403 - RNA, 21 nt, Human
cccuucucccucuucacuucc

SEQ ID NO: 212404 - RNA, 20 nt, Human
ccggggcagugaagcggagg

SEQ ID NO: 212405 - RNA, 28 nt, Human
ccggggcagugaagcggaggucuuucuc

SEQ ID NO: 212406 - RNA, 22 nt, Human
ccgugccaggccugaugcgcuc

SEQ ID NO: 212407 - RNA, 21 nt, Human
ccucauggguuuggcugcccc

SEQ ID NO: 212408 - RNA, 19 nt, Human
ccucgaacuccugggcuca

SEQ ID NO: 212409 - RNA, 23 nt, Human
ccucgaacuccugggcucaagca

SEQ ID NO: 212410 - RNA, 24 nt, Human
ccugaguggcuaggacuacaggcg

SEQ ID NO: 212411 - RNA, 23 nt, Human
ccugccucagccuccugaguggc

SEQ ID NO: 212412 - RNA, 24 nt, Human
ccugccucagccuccugaguggcu

SEQ ID NO: 212413 - RNA, 20 nt, Human
ccugggcucaagcaauccuc

SEQ ID NO: 212414 - RNA, 23 nt, Human
ccugggcucaagcaauccuccug

SEQ ID NO: 212415 - RNA, 20 nt, Human
ccuguaaacaucaaauuagu

SEQ ID NO: 212416 - RNA, 22 nt, Human
ccuucuuucuuuccuuccuugc

SEQ ID NO: 212417 - RNA, 19 nt, Human
ccuugggaccagccggggc

SEQ ID NO: 212418 - RNA, 25 nt, Human
cgaacuccugggcucaagcaauccu

SEQ ID NO: 212419 - RNA, 23 nt, Human
cuaauuuuuuguagggauguguc

SEQ ID NO: 212420 - RNA, 24 nt, Human
cucaagcaauccuccugccucagc

SEQ ID NO: 212421 - RNA, 19 nt, Human
cucauucauccuucuguuc

SEQ ID NO: 212422 - RNA, 21 nt, Human
cucauucauccuucuguuccu

SEQ ID NO: 212423 - RNA, 24 nt, Human
cuccugaguggcuaggacuacagg

SEQ ID NO: 212424 - RNA, 20 nt, Human
cucuguugcccaggcuggag

SEQ ID NO: 212425 - RNA, 20 nt, Human
cucuuuuuggcaucgcgccg

SEQ ID NO: 212426 - RNA, 22 nt, Human
cugaaggcucaguagaaggggg

SEQ ID NO: 212427 - RNA, 24 nt, Human
cugaaggcucaguagaaggggguu

SEQ ID NO: 212428 - RNA, 23 nt, Human
cugcagccucgaacuccugggcu

SEQ ID NO: 212429 - RNA, 20 nt, Human
cugugaugugacuucagagc

SEQ ID NO: 212430 - RNA, 19 nt, Human
cuugggacuccugaacugg

SEQ ID NO: 212431 - RNA, 19 nt, Human
cuuuuuggcaucgcgccgg

SEQ ID NO: 212432 - RNA, 23 nt, Human
gaacuccugggcucaagcaaucc

SEQ ID NO: 212433 - RNA, 20 nt, Human
gacccuugggaccagccggg

SEQ ID NO: 212434 - RNA, 25 nt, Human
gcaaucccaaagaaacuaacucuua

SEQ ID NO: 212435 - RNA, 19 nt, Human
gcccaggcuggagugcagu

SEQ ID NO: 212436 - RNA, 20 nt, Human
gcccaggcuggagugcagug

SEQ ID NO: 212437 - RNA, 24 nt, Human
gccucagccuccugaguggcuagg

SEQ ID NO: 212438 - RNA, 18 nt, Human
gcgccggaggauguggga

SEQ ID NO: 212439 - RNA, 25 nt, Human
gcucuguugcccaggcuggagugca

SEQ ID NO: 212440 - RNA, 21 nt, Human
gcuggagugcaguggugccag

SEQ ID NO: 212441 - RNA, 23 nt, Human
gcuggucucaaacuccuggccuc

SEQ ID NO: 212442 - RNA, 19 nt, Human
ggacuacaggcguaugcca

SEQ ID NO: 212443 - RNA, 22 nt, Human
ggacuacaggcguaugccacca

SEQ ID NO: 212444 - RNA, 24 nt, Human
ggagcugggguuauaggccugagc

SEQ ID NO: 212445 - RNA, 22 nt, Human
ggagugcaguggugccaucaug

SEQ ID NO: 212446 - RNA, 24 nt, Human
ggcuggucucaaacuccuggccuc

SEQ ID NO: 212447 - RNA, 22 nt, Human
gggcucaagcaauccuccugcc

SEQ ID NO: 212448 - RNA, 24 nt, Human
gguuauaggccugagccaccgugc

SEQ ID NO: 212449 - RNA, 22 nt, Human
guccugugaugugacuucagag

SEQ ID NO: 212450 - RNA, 18 nt, Human
gugaacgggagaaucagc

SEQ ID NO: 212451 - RNA, 22 nt, Human
uaaagacaggaucuugcucugu

SEQ ID NO: 212452 - RNA, 21 nt, Human
uaagauggagaguucuagugg

SEQ ID NO: 212453 - RNA, 19 nt, Human
uaaguaugauucucugccu

SEQ ID NO: 212454 - RNA, 24 nt, Human
uacaggcguaugccaccacaucca

SEQ ID NO: 212455 - RNA, 24 nt, Human
uacgcauugauuugcaccuugugu

SEQ ID NO: 212456 - RNA, 19 nt, Human
uagcaccuuugauuucacu

SEQ ID NO: 212457 - RNA, 24 nt, Human
uaggacuacaggcguaugccacca

SEQ ID NO: 212458 - RNA, 23 nt, Human
uaugcugcccaggcuggucucaa

SEQ ID NO: 212459 - RNA, 24 nt, Human
uaugcugcccaggcuggucucaaa

SEQ ID NO: 212460 - RNA, 20 nt, Human
ucagagcuuccaaaacgcag

SEQ ID NO: 212461 - RNA, 24 nt, Human
uccaaaacgcaggcaagcacaacg

SEQ ID NO: 212462 - RNA, 24 nt, Human
uccuagggagcugggguuauaggc

SEQ ID NO: 212463 - RNA, 26 nt, Human
uccuccugccucagccuccugagugg

SEQ ID NO: 212464 - RNA, 24 nt, Human
uccugaguggcuaggacuacaggc

SEQ ID NO: 212465 - RNA, 20 nt, Human
uccugggcgaccauuuagca

SEQ ID NO: 212466 - RNA, 18 nt, Human
uccugggcucaagcaauc

SEQ ID NO: 212467 - RNA, 22 nt, Human
uccugggcucaagcaauccucc

SEQ ID NO: 212468 - RNA, 22 nt, Human
uccugggcucaagcaauccucc

SEQ ID NO: 212469 - RNA, 24 nt, Human
uccugggcucaagcaauccuccug

SEQ ID NO: 212470 - RNA, 24 nt, Human
ucucaggaaacguacgcauugauu

SEQ ID NO: 212471 - RNA, 28 nt, Human
ucucccucuucacuuccuucuuucuuuc

SEQ ID NO: 212472 - RNA, 18 nt, Human
ucuguugcccaggcugga

SEQ ID NO: 212473 - RNA, 24 nt, Human
ucuguugcccaggcuggagugcag

SEQ ID NO: 212474 - RNA, 27 nt, Human
ucuucacuuccuucuuucugggccgcc

SEQ ID NO: 212475 - RNA, 22 nt, Human
ucuugcuaugcugcccaggcug

SEQ ID NO: 212476 - RNA, 23 nt, Human
ucuugcuaugcugcccaggcugg

SEQ ID NO: 212477 - RNA, 24 nt, Human
ucuugcuaugcugcccaggcuggu

SEQ ID NO: 212478 - RNA, 23 nt, Human
ucuugcucuguugcccaggcugg

SEQ ID NO: 212479 - RNA, 24 nt, Human
ucuugcucuguugcccaggcugga

SEQ ID NO: 212480 - RNA, 20 nt, Human
ugaauguacggaucccuuuu

SEQ ID NO: 212481 - RNA, 20 nt, Human
ugaccuccaucccuucuccc

SEQ ID NO: 212482 - RNA, 24 nt, Human
ugacugcagccucgaacuccuggg

SEQ ID NO: 212483 - RNA, 19 nt, Human
ugagaaaggaaccacgcug

SEQ ID NO: 212484 - RNA, 19 nt, Human
ugagaugaauguaaaccua

SEQ ID NO: 212485 - RNA, 22 nt, Human
ugaguggcuaggacuacaggcg

SEQ ID NO: 212486 - RNA, 20 nt, Human
ugcagaaggcccaguugccg

SEQ ID NO: 212487 - RNA, 19 nt, Human
ugccaggccugaugcgcuc

SEQ ID NO: 212488 - RNA, 18 nt, Human
ugcccaggcuggagugca

SEQ ID NO: 212489 - RNA, 21 nt, Human
ugcccaggcuggagugcagug

SEQ ID NO: 212490 - RNA, 24 nt, Human
ugcccaggcuggagugcaguggug

SEQ ID NO: 212491 - RNA, 24 nt, Human
ugcccaggcuggucucaaacuccu

SEQ ID NO: 212492 - RNA, 23 nt, Human
ugccucagccuccugaguggcua

SEQ ID NO: 212493 - RNA, 24 nt, Human
ugccucagccuccugaguggcuag

SEQ ID NO: 212494 - RNA, 27 nt, Human
ugcuaugcugcccaggcuggucucaaa

SEQ ID NO: 212495 - RNA, 22 nt, Human
uggaaugagaugaauguaaaaa

SEQ ID NO: 212496 - RNA, 26 nt, Human
uggaaugagaugaauguaaaccuacu

SEQ ID NO: 212497 - RNA, 21 nt, Human
uggagugcaguggugccauca

SEQ ID NO: 212498 - RNA, 23 nt, Human
uggagugcaguggugccaucaug

SEQ ID NO: 212499 - RNA, 28 nt, Human
uggagugcaguggugccauccuagcacg

SEQ ID NO: 212500 - RNA, 28 nt, Human
uggagugcaguggugccauggcucuagc

SEQ ID NO: 212501 - RNA, 20 nt, Human
uggccucaagagaugcuccc

SEQ ID NO: 212502 - RNA, 24 nt, Human
uggccucaagagaugcucccgccu

SEQ ID NO: 212503 - RNA, 19 nt, Human
ugggacugagcuggcauag

SEQ ID NO: 212504 - RNA, 24 nt, Human
ugggcucaagcaauccuccugccu

SEQ ID NO: 212505 - RNA, 18 nt, Human
ugggguuauaggccugag

SEQ ID NO: 212506 - RNA, 24 nt, Human
ugggguuauaggccugagccaccg

SEQ ID NO: 212507 - RNA, 18 nt, Human
uguguauuuacguuagug

SEQ ID NO: 212508 - RNA, 19 nt, Human
uuauaggccugagccaccg

SEQ ID NO: 212509 - RNA, 21 nt, Human
uuccugacauugccucauggg

SEQ ID NO: 212510 - RNA, 24 nt, Human
uuccugacccuugggaccagccgg

SEQ ID NO: 212511 - RNA, 26 nt, Human
uuccugacccuugggaccagccgggg

SEQ ID NO: 212512 - RNA, 22 nt, Human
uuccuucuuucuuuccuuccuu

SEQ ID NO: 212513 - RNA, 25 nt, Human
uucuagugguuuugcccuuccucuu

SEQ ID NO: 212514 - RNA, 19 nt, Human
uucucugccugggaccuca

SEQ ID NO: 212515 - RNA, 24 nt, Human
uugcucuguugcccaggcuggagu

SEQ ID NO: 212516 - RNA, 18 nt, Human
uuuagaaauucaagacug

SEQ ID NO: 212517 - RNA, 20 nt, Human
uuucuggguagcagcccaga

SEQ ID NO: 212518 - RNA, 21 nt, Human
aaacauucaggacccuauggc

SEQ ID NO: 212519 - RNA, 25 nt, Human
aagcacucugaggccucagagaucc

SEQ ID NO: 212520 - RNA, 21 nt, Human
aaguaccaggcugagaagugg

SEQ ID NO: 212521 - RNA, 23 nt, Human
acagaguaacaaagauuuuucuu

SEQ ID NO: 212522 - RNA, 20 nt, Human
accaggcugagaaguggggc

SEQ ID NO: 212523 - RNA, 23 nt, Human
acgacaccggagguacaaguacc

SEQ ID NO: 212524 - RNA, 18 nt, Human
acuccccaucagcuucuc

SEQ ID NO: 212525 - RNA, 18 nt, Human
acugccccccugcaacac

SEQ ID NO: 212526 - RNA, 22 nt, Human
acugccccccugcaacacacac

SEQ ID NO: 212527 - RNA, 21 nt, Human
acuuuguggggggaucugugc

SEQ ID NO: 212528 - RNA, 28 nt, Human
agacaaccucaagaaaggggggaacgcc

SEQ ID NO: 212529 - RNA, 19 nt, Human
agacccaagacucagacaa

SEQ ID NO: 212530 - RNA, 26 nt, Human
agagcaggcagcugccugccucccac

SEQ ID NO: 212531 - RNA, 22 nt, Human
agcagccaagcacucugaggcc

SEQ ID NO: 212532 - RNA, 22 nt, Human
agccgaggaaggaagcccuggc

SEQ ID NO: 212533 - RNA, 24 nt, Human
aggaauccugaccaaauggucagc

SEQ ID NO: 212534 - RNA, 19 nt, Human
aggaggaggcuggggcaga

SEQ ID NO: 212535 - RNA, 19 nt, Human
aggcaacaggaauccugac

SEQ ID NO: 212536 - RNA, 23 nt, Human
aggcuggggcagaaaacccaggg

SEQ ID NO: 212537 - RNA, 18 nt, Human
agggagcccuggagagcc

SEQ ID NO: 212538 - RNA, 22 nt, Human
aguuugucaccuagaugagggg

SEQ ID NO: 212539 - RNA, 21 nt, Human
augaggcccugcccuguggag

SEQ ID NO: 212540 - RNA, 27 nt, Human
auuguacuuauuuuguacaguuaccuu

SEQ ID NO: 212541 - RNA, 26 nt, Human
caaggcauagacccaagacucagaca

SEQ ID NO: 212542 - RNA, 18 nt, Human
cacaagcaccugcuccca

SEQ ID NO: 212543 - RNA, 19 nt, Human
cacacagcaaaggugugga

SEQ ID NO: 212544 - RNA, 21 nt, Human
cacuguccugcugggguggaa

SEQ ID NO: 212545 - RNA, 18 nt, Human
cagagccugugggggcgu

SEQ ID NO: 212546 - RNA, 22 nt, Human
cagagccugugggggcgugugg

SEQ ID NO: 212547 - RNA, 19 nt, Human
cagcaguagguauuuuugu

SEQ ID NO: 212548 - RNA, 23 nt, Human
cagcauuaaagauacagcagcca

SEQ ID NO: 212549 - RNA, 21 nt, Human
caggaggugagacuguccaau

SEQ ID NO: 212550 - RNA, 18 nt, Human
cagggagcccuggagagc

SEQ ID NO: 212551 - RNA, 19 nt, Human
caggguccuucugaggcuc

SEQ ID NO: 212552 - RNA, 25 nt, Human
caggguggagccgaggaaggaagcc

SEQ ID NO: 212553 - RNA, 19 nt, Human
cagugcuucccuccaggag

SEQ ID NO: 212554 - RNA, 25 nt, Human
cagugggaggucccaggccuggcag

SEQ ID NO: 212555 - RNA, 27 nt, Human
ccaccacuaggcggggcugcugccugg

SEQ ID NO: 212556 - RNA, 19 nt, Human
ccagaccuaaugggcacgg

SEQ ID NO: 212557 - RNA, 21 nt, Human
ccagguaauuaauucguucau

SEQ ID NO: 212558 - RNA, 19 nt, Human
cccaagggccucccucccu

SEQ ID NO: 212559 - RNA, 23 nt, Human
cccaggucagaguuagcugggac

SEQ ID NO: 212560 - RNA, 23 nt, Human
cccccugcaacacacacaguucc

SEQ ID NO: 212561 - RNA, 23 nt, Human
ccccugcaacacacacaguuccu

SEQ ID NO: 212562 - RNA, 24 nt, Human
ccccugcaacacacacaguuccug

SEQ ID NO: 212563 - RNA, 18 nt, Human
cccuccaggagaagcaaa

SEQ ID NO: 212564 - RNA, 23 nt, Human
cccugagcugcagaggagacccc

SEQ ID NO: 212565 - RNA, 24 nt, Human
cccugcccuguggagcugcccuuc

SEQ ID NO: 212566 - RNA, 21 nt, Human
cccugggucccugacagcuuc

SEQ ID NO: 212567 - RNA, 19 nt, Human
ccuauggcaggaggugaga

SEQ ID NO: 212568 - RNA, 22 nt, Human
ccuccaguggagggggcagugg

SEQ ID NO: 212569 - RNA, 18 nt, Human
ccugacagcuucucccuc

SEQ ID NO: 212570 - RNA, 23 nt, Human
ccugcucccaagggccucccucc

SEQ ID NO: 212571 - RNA, 18 nt, Human
ccugggucccugacagcu

SEQ ID NO: 212572 - RNA, 23 nt, Human
cgacaccggagguacaaguacca

SEQ ID NO: 212573 - RNA, 21 nt, Human
cggacuccaggguuuacuccc

SEQ ID NO: 212574 - RNA, 22 nt, Human
cggcgcagagcaggcagcugcc

SEQ ID NO: 212575 - RNA, 23 nt, Human
cgggagcagcaguggagguuugg

SEQ ID NO: 212576 - RNA, 18 nt, Human
cuaguucaggcccagccu

SEQ ID NO: 212577 - RNA, 23 nt, Human
cugaccaaauggucagcagcccu

SEQ ID NO: 212578 - RNA, 19 nt, Human
cugacgcuagaaguuucug

SEQ ID NO: 212579 - RNA, 23 nt, Human
cugacgcuagaaguuucuggucc

SEQ ID NO: 212580 - RNA, 23 nt, Human
cugccucccacccuggccaucug

SEQ ID NO: 212581 - RNA, 21 nt, Human
cuggucagagccugugggggc

SEQ ID NO: 212582 - RNA, 24 nt, Human
cuuaaaaaauguaacccucccaag

SEQ ID NO: 212583 - RNA, 19 nt, Human
cuuggugccaaacccccuc

SEQ ID NO: 212584 - RNA, 19 nt, Human
gaaagauacguggaggggu

SEQ ID NO: 212585 - RNA, 23 nt, Human
gaagcaaaaccggcacuugaaga

SEQ ID NO: 212586 - RNA, 18 nt, Human
gaaggaggaggcuggggc

SEQ ID NO: 212587 - RNA, 23 nt, Human
gaccccuccaguggagggggcag

SEQ ID NO: 212588 - RNA, 23 nt, Human
gagcagcaguggagguuuggaaa

SEQ ID NO: 212589 - RNA, 22 nt, Human
gaggcagugcuucccuccagga

SEQ ID NO: 212590 - RNA, 18 nt, Human
gcagagaggauuaguagg

SEQ ID NO: 212591 - RNA, 19 nt, Human
gcaggacccgggagcagcg

SEQ ID NO: 212592 - RNA, 19 nt, Human
gcagugcuucccuccagga

SEQ ID NO: 212593 - RNA, 18 nt, Human
gccacugugggaagaugc

SEQ ID NO: 212594 - RNA, 23 nt, Human
gcccaagacagaguugaucugau

SEQ ID NO: 212595 - RNA, 19 nt, Human
gccccccugcaacacacac

SEQ ID NO: 212596 - RNA, 19 nt, Human
gcccugggucccugacagc

SEQ ID NO: 212597 - RNA, 19 nt, Human
gccugccucccacccuggc

SEQ ID NO: 212598 - RNA, 22 nt, Human
gcgguggcagcgcgcgcucucc

SEQ ID NO: 212599 - RNA, 22 nt, Human
gcucugaguggcucgggaggac

SEQ ID NO: 212600 - RNA, 19 nt, Human
gcuggucagagccuguggg

SEQ ID NO: 212601 - RNA, 23 nt, Human
gcuucucccuccagcacugacgc

SEQ ID NO: 212602 - RNA, 24 nt, Human
gcuugucuaccuuuccaaggcuca

SEQ ID NO: 212603 - RNA, 26 nt, Human
ggaaauggauggaccaagugugcagg

SEQ ID NO: 212604 - RNA, 21 nt, Human
ggaacccaagguccucugcuu

SEQ ID NO: 212605 - RNA, 22 nt, Human
ggaagaggucagggcagggagc

SEQ ID NO: 212606 - RNA, 24 nt, Human
ggagaccccuccaguggagggggc

SEQ ID NO: 212607 - RNA, 18 nt, Human
ggcagugggaggucccag

SEQ ID NO: 212608 - RNA, 21 nt, Human
ggccuggcagcaucagggccc

SEQ ID NO: 212609 - RNA, 20 nt, Human
ggcgguggcagcgcgcgcuc

SEQ ID NO: 212610 - RNA, 22 nt, Human
ggcugagaaguggggcugaggg

SEQ ID NO: 212611 - RNA, 24 nt, Human
gggaaggaggaggcuggggcagaa

SEQ ID NO: 212612 - RNA, 21 nt, Human
gggcagggagcccuggagagc

SEQ ID NO: 212613 - RNA, 20 nt, Human
gggccccagcauuaaagaua

SEQ ID NO: 212614 - RNA, 23 nt, Human
ggggagggaaggaggaggcuggg

SEQ ID NO: 212615 - RNA, 22 nt, Human
ggugccugagggcucccagguc

SEQ ID NO: 212616 - RNA, 19 nt, Human
gucagcagcccucucagca

SEQ ID NO: 212617 - RNA, 18 nt, Human
guccugcugggguggaau

SEQ ID NO: 212618 - RNA, 24 nt, Human
gugaauagcugcagggcuggagag

SEQ ID NO: 212619 - RNA, 21 nt, Human
gugcaggacugggugggggcc

SEQ ID NO: 212620 - RNA, 20 nt, Human
guggagccuuguccacaagc

SEQ ID NO: 212621 - RNA, 22 nt, Human
guggagguuuggaaauggaugg

SEQ ID NO: 212622 - RNA, 20 nt, Human
guggggcugagggcaguggg

SEQ ID NO: 212623 - RNA, 20 nt, Human
uaagggaggcagugcuuccc

SEQ ID NO: 212624 - RNA, 21 nt, Human
uaagugcaggugccugagggc

SEQ ID NO: 212625 - RNA, 21 nt, Human
uaccaggcugagaaguggggc

SEQ ID NO: 212626 - RNA, 20 nt, Human
uagacccaagacucagacaa

SEQ ID NO: 212627 - RNA, 22 nt, Human
uagacccaagacucagacaacc

SEQ ID NO: 212628 - RNA, 22 nt, Human
uagcugggacuggggucacugu

SEQ ID NO: 212629 - RNA, 19 nt, Human
ucagcagcccucucagcag

SEQ ID NO: 212630 - RNA, 21 nt, Human
uccacaagcaccugcucccaa

SEQ ID NO: 212631 - RNA, 24 nt, Human
ucccaagaagugggagccucccaa

SEQ ID NO: 212632 - RNA, 19 nt, Human
ucuccaggcgcccuggguc

SEQ ID NO: 212633 - RNA, 23 nt, Human
ucuccaggcgcccugggucccug

SEQ ID NO: 212634 - RNA, 21 nt, Human
ugagacuguccaauaauucag

SEQ ID NO: 212635 - RNA, 24 nt, Human
ugagccuaaauucgugggauccug

SEQ ID NO: 212636 - RNA, 19 nt, Human
ugagggagcucugaguggc

SEQ ID NO: 212637 - RNA, 20 nt, Human
ugaguucaaacgcccaagac

SEQ ID NO: 212638 - RNA, 20 nt, Human
ugccccagaacacacagcaa

SEQ ID NO: 212639 - RNA, 20 nt, Human
ugcccuguggagcugcccuu

SEQ ID NO: 212640 - RNA, 21 nt, Human
ugcccuguggagcugcccuuc

SEQ ID NO: 212641 - RNA, 22 nt, Human
ugcccuguggagcugcccuucu

SEQ ID NO: 212642 - RNA, 21 nt, Human
ugcccuuacuugggccccagc

SEQ ID NO: 212643 - RNA, 18 nt, Human
ugccugagggcucccagg

SEQ ID NO: 212644 - RNA, 21 nt, Human
ugcugggguggaauguuguuu

SEQ ID NO: 212645 - RNA, 24 nt, Human
ugcugggguggaauguuguuugag

SEQ ID NO: 212646 - RNA, 18 nt, Human
uggacagagcuuggugcc

SEQ ID NO: 212647 - RNA, 19 nt, Human
uggagccccuuguggucug

SEQ ID NO: 212648 - RNA, 19 nt, Human
uggagggggcagugggagg

SEQ ID NO: 212649 - RNA, 22 nt, Human
uggaggggucgggguagggggu

SEQ ID NO: 212650 - RNA, 21 nt, Human
uggccaucucuccagggcccu

SEQ ID NO: 212651 - RNA, 22 nt, Human
uggggggaucugugcccuuacu

SEQ ID NO: 212652 - RNA, 18 nt, Human
uggguuuuuucauuuaca

SEQ ID NO: 212653 - RNA, 20 nt, Human
uggucagagccugugggggc

SEQ ID NO: 212654 - RNA, 21 nt, Human
uggucaggugcccaaucagcu

SEQ ID NO: 212655 - RNA, 19 nt, Human
uguauagauacauauguca

SEQ ID NO: 212656 - RNA, 21 nt, Human
ugugauuaacgagggaguugg

SEQ ID NO: 212657 - RNA, 26 nt, Human
ugugcaggacuggguggggggaacgc

SEQ ID NO: 212658 - RNA, 20 nt, Human
ugugggggcguguggucagg

SEQ ID NO: 212659 - RNA, 18 nt, Human
uguggucaggugcccaau

SEQ ID NO: 212660 - RNA, 19 nt, Human
uguggucaggugcccaauc

SEQ ID NO: 212661 - RNA, 24 nt, Human
uuuccaaggcucaacgcuugugga

SEQ ID NO: 212662 - RNA, 21 nt, Human
aagaggaagggagggaaagag

SEQ ID NO: 212663 - RNA, 21 nt, Human
aagggagggaaagagggaggg

SEQ ID NO: 212664 - RNA, 21 nt, Human
acaaaauuccaaaucagccac

SEQ ID NO: 212665 - RNA, 19 nt, Human
agaggaagggagggaaaga

SEQ ID NO: 212666 - RNA, 18 nt, Human
agagggagggaggaagaa

SEQ ID NO: 212667 - RNA, 20 nt, Human
aggaagaauccugcgaaaag

SEQ ID NO: 212668 - RNA, 22 nt, Human
aggaagaauccugcgaaaagga

SEQ ID NO: 212669 - RNA, 20 nt, Human
aggaagggagggaaagaggg

SEQ ID NO: 212670 - RNA, 24 nt, Human
aggacccugggguucuucugucag

SEQ ID NO: 212671 - RNA, 20 nt, Human
auuccaaaucagccacaggg

SEQ ID NO: 212672 - RNA, 18 nt, Human
caugggggcacaaaauuc

SEQ ID NO: 212673 - RNA, 21 nt, Human
gagaagaaaaacauguucggg

SEQ ID NO: 212674 - RNA, 23 nt, Human
gaggaagaauccugcgaaaagga

SEQ ID NO: 212675 - RNA, 19 nt, Human
ggaaugccaaaugaagggg

SEQ ID NO: 212676 - RNA, 18 nt, Human
gggaaugccaaaugaagg

SEQ ID NO: 212677 - RNA, 19 nt, Human
gggaaugccaaaugaaggg

SEQ ID NO: 212678 - RNA, 19 nt, Human
gguagauggaaagaggaag

SEQ ID NO: 212679 - RNA, 22 nt, Human
gguagauggaaagaggaaggga

SEQ ID NO: 212680 - RNA, 18 nt, Human
uaucaacagaaacuuuau

SEQ ID NO: 212681 - RNA, 21 nt, Human
ugaaggggugcuuacaugggg

SEQ ID NO: 212682 - RNA, 24 nt, Human
ugaaggggugcuuacaugggggca

SEQ ID NO: 212683 - RNA, 20 nt, Human
ugagggagaagaaaaacaug

SEQ ID NO: 212684 - RNA, 21 nt, Human
ugaggugaguaugagacgcag

SEQ ID NO: 212685 - RNA, 22 nt, Human
ugaguaugagacgcaggugggu

SEQ ID NO: 212686 - RNA, 19 nt, Human
uggaaagaggaagggaggg

SEQ ID NO: 212687 - RNA, 18 nt, Human
caggagaagcuaacgaug

SEQ ID NO: 212688 - RNA, 18 nt, Human
aaaacacacagacgagca

SEQ ID NO: 212689 - RNA, 22 nt, Human
aaagugcugggauuauaggcau

SEQ ID NO: 212690 - RNA, 23 nt, Human
aaagugcugggauuauaggcaug

SEQ ID NO: 212691 - RNA, 24 nt, Human
aaagugcugggauuauaggcauga

SEQ ID NO: 212692 - RNA, 27 nt, Human
aacuggugccuuaugccugcugucugg

SEQ ID NO: 212693 - RNA, 24 nt, Human
aagugaucugcccgccucagccuc

SEQ ID NO: 212694 - RNA, 19 nt, Human
aagugcugggauuauaggc

SEQ ID NO: 212695 - RNA, 21 nt, Human
aagugcugggauuauaggcau

SEQ ID NO: 212696 - RNA, 23 nt, Human
aaucaccuucauaccaugguucu

SEQ ID NO: 212697 - RNA, 20 nt, Human
aggcaugagccaccacgccc

SEQ ID NO: 212698 - RNA, 28 nt, Human
agugcccucuacucucaugggauguggc

SEQ ID NO: 212699 - RNA, 18 nt, Human
aucugcagacucagcaac

SEQ ID NO: 212700 - RNA, 21 nt, Human
augaaacuaaaacacacagac

SEQ ID NO: 212701 - RNA, 20 nt, Human
augagccaccacgcccggcu

SEQ ID NO: 212702 - RNA, 24 nt, Human
augaucuggugggcaaaacaugcc

SEQ ID NO: 212703 - RNA, 18 nt, Human
caaaagugcugggauuau

SEQ ID NO: 212704 - RNA, 24 nt, Human
caaaagugcugggauuauaggcau

SEQ ID NO: 212705 - RNA, 24 nt, Human
caaugaccacccucccugaaguuc

SEQ ID NO: 212706 - RNA, 23 nt, Human
cacagacgagcauuacucaaccc

SEQ ID NO: 212707 - RNA, 23 nt, Human
cacgcccggcuucucuaugauuu

SEQ ID NO: 212708 - RNA, 22 nt, Human
cagacgagcauuacucaaccca

SEQ ID NO: 212709 - RNA, 21 nt, Human
ccaaggcaccaggcuggucuc

SEQ ID NO: 212710 - RNA, 22 nt, Human
ccagccuggcugccuuccagga

SEQ ID NO: 212711 - RNA, 21 nt, Human
cccaaggccgcccaagucauu

SEQ ID NO: 212712 - RNA, 18 nt, Human
cccccagccauacagcug

SEQ ID NO: 212713 - RNA, 22 nt, Human
ccugaucucaagugaucugccc

SEQ ID NO: 212714 - RNA, 18 nt, Human
ccuggcugccuuccagga

SEQ ID NO: 212715 - RNA, 21 nt, Human
ccuucuguuccacucuccuca

SEQ ID NO: 212716 - RNA, 19 nt, Human
cgccucagccuccaaaagu

SEQ ID NO: 212717 - RNA, 24 nt, Human
cgccucagccuccaaaagugcugg

SEQ ID NO: 212718 - RNA, 22 nt, Human
cuaugauuucuuccagcugugu

SEQ ID NO: 212719 - RNA, 18 nt, Human
cucaagugaucugcccgc

SEQ ID NO: 212720 - RNA, 21 nt, Human
cucaagugaucugcccgccuc

SEQ ID NO: 212721 - RNA, 21 nt, Human
cucagccuccaaaagugcugg

SEQ ID NO: 212722 - RNA, 21 nt, Human
cucaucugcagacucagcaac

SEQ ID NO: 212723 - RNA, 21 nt, Human
cugccagccuggcugccuucc

SEQ ID NO: 212724 - RNA, 19 nt, Human
cugcgcgccccugcuccau

SEQ ID NO: 212725 - RNA, 26 nt, Human
cuguuccacucuccucagcaaacaca

SEQ ID NO: 212726 - RNA, 26 nt, Human
cuuccagcuguguguaaaucuuuaau

SEQ ID NO: 212727 - RNA, 24 nt, Human
gacccagugcccucuacucucaug

SEQ ID NO: 212728 - RNA, 21 nt, Human
gauuauaggcaugagccacca

SEQ ID NO: 212729 - RNA, 22 nt, Human
gauuauaggcaugagccaccac

SEQ ID NO: 212730 - RNA, 24 nt, Human
gcaccaggcuggucucgaacuccu

SEQ ID NO: 212731 - RNA, 19 nt, Human
ggauuauaggcaugagcca

SEQ ID NO: 212732 - RNA, 24 nt, Human
ggcuggucucgaacuccugaucuc

SEQ ID NO: 212733 - RNA, 19 nt, Human
gggcauggguguuuggcag

SEQ ID NO: 212734 - RNA, 19 nt, Human
gguccagucucugcagccc

SEQ ID NO: 212735 - RNA, 19 nt, Human
ggucugggccaacaugcag

SEQ ID NO: 212736 - RNA, 22 nt, Human
guccucuguugcuccccuuaac

SEQ ID NO: 212737 - RNA, 22 nt, Human
gugaucugcccgccucagccuc

SEQ ID NO: 212738 - RNA, 19 nt, Human
gugcugggauuauaggcau

SEQ ID NO: 212739 - RNA, 22 nt, Human
ucaauuucucaucgauuuccca

SEQ ID NO: 212740 - RNA, 20 nt, Human
ucaguggggccaaucaccuu

SEQ ID NO: 212741 - RNA, 24 nt, Human
uccaaaagugcugggauuauaggc

SEQ ID NO: 212742 - RNA, 21 nt, Human
ucccaggcauggauaagcccu

SEQ ID NO: 212743 - RNA, 21 nt, Human
ucucgaacuccugaucucaag

SEQ ID NO: 212744 - RNA, 18 nt, Human
ucugcagacucagcaaca

SEQ ID NO: 212745 - RNA, 20 nt, Human
ucugcccgccucagccucca

SEQ ID NO: 212746 - RNA, 27 nt, Human
ugaaacuaaaacacacagacgagcauu

SEQ ID NO: 212747 - RNA, 22 nt, Human
ugaggucugggccaacaugcag

SEQ ID NO: 212748 - RNA, 18 nt, Human
ugaucucaagugaucugc

SEQ ID NO: 212749 - RNA, 24 nt, Human
ugaucucaagugaucugcccgccu

SEQ ID NO: 212750 - RNA, 23 nt, Human
ugccaaggcaccaggcuggucuc

SEQ ID NO: 212751 - RNA, 19 nt, Human
ugcccggcccacagggugg

SEQ ID NO: 212752 - RNA, 18 nt, Human
ugggauuauaggcaugag

SEQ ID NO: 212753 - RNA, 19 nt, Human
ugggauuauaggcaugagc

SEQ ID NO: 212754 - RNA, 22 nt, Human
ugggauuauaggcaugagccac

SEQ ID NO: 212755 - RNA, 23 nt, Human
ugggauuauaggcaugagccacc

SEQ ID NO: 212756 - RNA, 24 nt, Human
ugggauuauaggcaugagccacca

SEQ ID NO: 212757 - RNA, 21 nt, Human
uggggcacggcgacccagugc

SEQ ID NO: 212758 - RNA, 19 nt, Human
ugucuggauugcccggccc

SEQ ID NO: 212759 - RNA, 23 nt, Human
uguuccacucuccucagcaaaca

SEQ ID NO: 212760 - RNA, 22 nt, Human
uucccuagcaccugaggucugg

SEQ ID NO: 212761 - RNA, 25 nt, Human
uucuggggguuccaugcauacgagg

SEQ ID NO: 212762 - RNA, 19 nt, Human
uuggaaaucugccagccug

SEQ ID NO: 212763 - RNA, 20 nt, Human
uuucauguccucuguugcuc

SEQ ID NO: 212764 - RNA, 22 nt, Human
uuuccugcaggggccugccgug

SEQ ID NO: 212765 - RNA, 26 nt, Human
aaaauguccuucuccuccaaaaucuu

SEQ ID NO: 212766 - RNA, 22 nt, Human
aaauaagaaaaaaguauaucaa

SEQ ID NO: 212767 - RNA, 22 nt, Human
caaagugucaguaugccugaaa

SEQ ID NO: 212768 - RNA, 25 nt, Human
ccugaaauauuuacuuucccucuga

SEQ ID NO: 212769 - RNA, 24 nt, Human
gaacacaacauaacauuaaauaaa

SEQ ID NO: 212770 - RNA, 18 nt, Human
ggcaaagugucaguaugc

SEQ ID NO: 212771 - RNA, 27 nt, Human
guaaaauguccuucuccuccaaaaucu

SEQ ID NO: 212772 - RNA, 18 nt, Human
uaaaauguccuucuccuc

SEQ ID NO: 212773 - RNA, 23 nt, Human
uaucugaaauauauuuuaagaau

SEQ ID NO: 212774 - RNA, 21 nt, Human
uccuccaaaaucuuuggcugc

SEQ ID NO: 212775 - RNA, 21 nt, Human
ugccuuuggcaaagaaagugc

SEQ ID NO: 212776 - RNA, 24 nt, Human
uggaggaaaauacuucaaugauuc

SEQ ID NO: 212777 - RNA, 22 nt, Human
uggcugcaacaaaccaguuuag

SEQ ID NO: 212778 - RNA, 23 nt, Human
uguuaaguuaaauaagaaaaaag

SEQ ID NO: 212779 - RNA, 18 nt, Human
uucuuggcccucauucuc

SEQ ID NO: 212780 - RNA, 19 nt, Human
aaacagccaaacggcacag

SEQ ID NO: 212781 - RNA, 22 nt, Human
aagcaaauugcaaagauuggca

SEQ ID NO: 212782 - RNA, 19 nt, Human
acuuuuaagagauacaaga

SEQ ID NO: 212783 - RNA, 19 nt, Human
agaaaaaacauggcaaaag

SEQ ID NO: 212784 - RNA, 22 nt, Human
agccaaacggcacagccagaaa

SEQ ID NO: 212785 - RNA, 24 nt, Human
cagcuggacguuagccuuaaaagc

SEQ ID NO: 212786 - RNA, 19 nt, Human
cauggggagaaaaaacaug

SEQ ID NO: 212787 - RNA, 22 nt, Human
ccagaaguaaauacagcuggac

SEQ ID NO: 212788 - RNA, 25 nt, Human
ccaguacucaacagaagauggcgag

SEQ ID NO: 212789 - RNA, 18 nt, Human
cuucgcagguaaauugag

SEQ ID NO: 212790 - RNA, 20 nt, Human
gacaggaaacuucaaucuaa

SEQ ID NO: 212791 - RNA, 19 nt, Human
gacuggugugucugggugu

SEQ ID NO: 212792 - RNA, 20 nt, Human
gagugcuacaauuggcagcu

SEQ ID NO: 212793 - RNA, 19 nt, Human
gccaagagccagcaucccu

SEQ ID NO: 212794 - RNA, 22 nt, Human
gccugagaaaugcgguggccau

SEQ ID NO: 212795 - RNA, 21 nt, Human
ggcacugaggcaugugugagu

SEQ ID NO: 212796 - RNA, 24 nt, Human
ggcagcuuaaacagccaaacggca

SEQ ID NO: 212797 - RNA, 24 nt, Human
gggagaaaaaacauggcaaaaugc

SEQ ID NO: 212798 - RNA, 22 nt, Human
uaaacagccaaacggcacagcc

SEQ ID NO: 212799 - RNA, 21 nt, Human
uaaagaugagugaacaugaca

SEQ ID NO: 212800 - RNA, 23 nt, Human
uacaagacuggugugucugggug

SEQ ID NO: 212801 - RNA, 21 nt, Human
uacuaugaggauuuaaagaug

SEQ ID NO: 212802 - RNA, 18 nt, Human
ucccugcuguaggugagg

SEQ ID NO: 212803 - RNA, 22 nt, Human
ucuuccucagaugguagcugag

SEQ ID NO: 212804 - RNA, 26 nt, Human
ugccuaaauucugaacaccucuuagc

SEQ ID NO: 212805 - RNA, 22 nt, Human
ugcuucgcagguaaauugagug

SEQ ID NO: 212806 - RNA, 20 nt, Human
uggggagaaaaaacauggca

SEQ ID NO: 212807 - RNA, 20 nt, Human
uggugugucuggguguauug

SEQ ID NO: 212808 - RNA, 18 nt, Human
ugucuacagacgauccuc

SEQ ID NO: 212809 - RNA, 19 nt, Human
aaaugaucuggcucugaaa

SEQ ID NO: 212810 - RNA, 18 nt, Human
auaaauuaacucagcuuc

SEQ ID NO: 212811 - RNA, 23 nt, Human
cgcucauacuuuuaguucuccau

SEQ ID NO: 212812 - RNA, 23 nt, Human
gaaacaaaggauauucaaacugc

SEQ ID NO: 212813 - RNA, 20 nt, Human
gcugggcuccuggaggcgag

SEQ ID NO: 212814 - RNA, 18 nt, Human
ggacagguuucugaccag

SEQ ID NO: 212815 - RNA, 25 nt, Human
uaaaaugccauuuauugguauaaaa

SEQ ID NO: 212816 - RNA, 22 nt, Human
uacacuuuccaagaaaugaucu

SEQ ID NO: 212817 - RNA, 23 nt, Human
ucuggcucugaaacaaaggauau

SEQ ID NO: 212818 - RNA, 21 nt, Human
ugcccaguggacagguuucug

SEQ ID NO: 212819 - RNA, 18 nt, Human
uucaagugguacuucuua

SEQ ID NO: 212820 - RNA, 24 nt, Human
aaaaacagaauuugcuaagggcac

SEQ ID NO: 212821 - RNA, 21 nt, Human
aaaacagaauuugcuaagggc

SEQ ID NO: 212822 - RNA, 26 nt, Human
aaacaaaguuauggugcuucccccac

SEQ ID NO: 212823 - RNA, 21 nt, Human
aaacgcauucuugccaggcuc

SEQ ID NO: 212824 - RNA, 18 nt, Human
aacccaaagccaaugcag

SEQ ID NO: 212825 - RNA, 24 nt, Human
aaccucaaccagcugaacagcugg

SEQ ID NO: 212826 - RNA, 23 nt, Human
aacuucuggacucaagugauccu

SEQ ID NO: 212827 - RNA, 24 nt, Human
aaguaaaagccguccccaggccua

SEQ ID NO: 212828 - RNA, 21 nt, Human
acaccgaggcccccaccaacc

SEQ ID NO: 212829 - RNA, 19 nt, Human
acuccauggucccgcagag

SEQ ID NO: 212830 - RNA, 20 nt, Human
acuugcucugucaccccagg

SEQ ID NO: 212831 - RNA, 24 nt, Human
acuugcucugucaccccaggcugg

SEQ ID NO: 212832 - RNA, 25 nt, Human
acuugcucugucaccccaggcugga

SEQ ID NO: 212833 - RNA, 18 nt, Human
agagauccucccaccuca

SEQ ID NO: 212834 - RNA, 19 nt, Human
agagaugggguuuuaucac

SEQ ID NO: 212835 - RNA, 21 nt, Human
agcccucccugcugcuagcuc

SEQ ID NO: 212836 - RNA, 20 nt, Human
agcuucuucccccaggccuu

SEQ ID NO: 212837 - RNA, 19 nt, Human
aggaaaauauuuuuucucu

SEQ ID NO: 212838 - RNA, 22 nt, Human
aggcccccaccaaccugcccag

SEQ ID NO: 212839 - RNA, 25 nt, Human
aggcuggagugcaguggugcaaucu

SEQ ID NO: 212840 - RNA, 19 nt, Human
agguggagaagagagaaca

SEQ ID NO: 212841 - RNA, 20 nt, Human
agugcaguggugcaaucucg

SEQ ID NO: 212842 - RNA, 24 nt, Human
agugcaguggugcaaucucggcuc

SEQ ID NO: 212843 - RNA, 23 nt, Human
aguuggaagaugaaacgaugcag

SEQ ID NO: 212844 - RNA, 20 nt, Human
aucuuuugcugagcccguuu

SEQ ID NO: 212845 - RNA, 21 nt, Human
augacucagagcggcggacgg

SEQ ID NO: 212846 - RNA, 21 nt, Human
caagugauccuccugccucga

SEQ ID NO: 212847 - RNA, 23 nt, Human
caagugauccuccugccucgacc

SEQ ID NO: 212848 - RNA, 20 nt, Human
caaguucacucuaaccccuu

SEQ ID NO: 212849 - RNA, 21 nt, Human
cacaccccugagauaagcugg

SEQ ID NO: 212850 - RNA, 21 nt, Human
cacaggguccaggcugcuggu

SEQ ID NO: 212851 - RNA, 24 nt, Human
cacauugcccaggcugaucucaaa

SEQ ID NO: 212852 - RNA, 25 nt, Human
caccccaggcuggagugcaguggug

SEQ ID NO: 212853 - RNA, 19 nt, Human
cacccucucaagagaaaac

SEQ ID NO: 212854 - RNA, 24 nt, Human
caccucagccccccaaguaucugg

SEQ ID NO: 212855 - RNA, 20 nt, Human
caccugagguccugcaaccc

SEQ ID NO: 212856 - RNA, 21 nt, Human
cacuccauggucccgcagagg

SEQ ID NO: 212857 - RNA, 20 nt, Human
cacucuaccacacuuggcua

SEQ ID NO: 212858 - RNA, 22 nt, Human
cacugcagccuugaccucccag

SEQ ID NO: 212859 - RNA, 20 nt, Human
cacuugacuugguuuugggc

SEQ ID NO: 212860 - RNA, 19 nt, Human
cagccccccaaguaucugg

SEQ ID NO: 212861 - RNA, 21 nt, Human
cagccuugaccucccaggcuc

SEQ ID NO: 212862 - RNA, 23 nt, Human
cagccuugaccucccaggcucaa

SEQ ID NO: 212863 - RNA, 24 nt, Human
cagccuugaccucccaggcucaag

SEQ ID NO: 212864 - RNA, 18 nt, Human
cagcugacaacaaacaaa

SEQ ID NO: 212865 - RNA, 23 nt, Human
caggccccgggggcagccccccc

SEQ ID NO: 212866 - RNA, 22 nt, Human
caggcugaucucaaacuucugg

SEQ ID NO: 212867 - RNA, 18 nt, Human
caggguccaggcugcugg

SEQ ID NO: 212868 - RNA, 23 nt, Human
cagguucagcugacaacaaacaa

SEQ ID NO: 212869 - RNA, 23 nt, Human
ccaaaggccgcacaccccugaga

SEQ ID NO: 212870 - RNA, 19 nt, Human
cccacaccuaaguaaguua

SEQ ID NO: 212871 - RNA, 20 nt, Human
cccaccucagccccccaagu

SEQ ID NO: 212872 - RNA, 22 nt, Human
cccaccugccugagggugcagc

SEQ ID NO: 212873 - RNA, 21 nt, Human
cccacucacccucagcuguuu

SEQ ID NO: 212874 - RNA, 20 nt, Human
cccaggcucaagagauccuc

SEQ ID NO: 212875 - RNA, 22 nt, Human
cccaggcuggagugcaguggug

SEQ ID NO: 212876 - RNA, 24 nt, Human
cccagguucagcugacaacaaaca

SEQ ID NO: 212877 - RNA, 18 nt, Human
ccccaccaaccugcccag

SEQ ID NO: 212878 - RNA, 19 nt, Human
ccccaggcuggagugcagu

SEQ ID NO: 212879 - RNA, 23 nt, Human
ccccgcgccgcgcucggcuccuc

SEQ ID NO: 212880 - RNA, 18 nt, Human
ccccucuccucuccuucc

SEQ ID NO: 212881 - RNA, 20 nt, Human
ccccucuccucuccuuccuc

SEQ ID NO: 212882 - RNA, 19 nt, Human
cccgcgcaccggccgaccg

SEQ ID NO: 212883 - RNA, 25 nt, Human
cccugugccccucuccucuccuucc

SEQ ID NO: 212884 - RNA, 24 nt, Human
ccgaggcccccaccaaccugccca

SEQ ID NO: 212885 - RNA, 23 nt, Human
ccucccaccucagccccccaagu

SEQ ID NO: 212886 - RNA, 22 nt, Human
ccuccugccucgaccucccgaa

SEQ ID NO: 212887 - RNA, 25 nt, Human
ccuccugccucgaccucccgaagug

SEQ ID NO: 212888 - RNA, 23 nt, Human
ccugagguccugcaacccaaagc

SEQ ID NO: 212889 - RNA, 23 nt, Human
ccugcaacccaaagccaaugcag

SEQ ID NO: 212890 - RNA, 24 nt, Human
cggcucacugcagccuugaccucc

SEQ ID NO: 212891 - RNA, 21 nt, Human
cggcuccucucccucuggccc

SEQ ID NO: 212892 - RNA, 19 nt, Human
cucaagagauccucccacc

SEQ ID NO: 212893 - RNA, 24 nt, Human
cucaagagauccucccaccucagc

SEQ ID NO: 212894 - RNA, 24 nt, Human
cucaagugauccuccugccucgac

SEQ ID NO: 212895 - RNA, 24 nt, Human
cucccaccucagccccccaaguau

SEQ ID NO: 212896 - RNA, 25 nt, Human
cucccaggcucaagagauccuccca

SEQ ID NO: 212897 - RNA, 23 nt, Human
cucccgaagugcgugggccucca

SEQ ID NO: 212898 - RNA, 18 nt, Human
cuccucucccucuggccc

SEQ ID NO: 212899 - RNA, 23 nt, Human
cucggccccgcgccgcgcucggc

SEQ ID NO: 212900 - RNA, 22 nt, Human
cucggcucacugcagccuugac

SEQ ID NO: 212901 - RNA, 21 nt, Human
cucuccuuccucugcuucuca

SEQ ID NO: 212902 - RNA, 21 nt, Human
cucugucaccccaggcuggag

SEQ ID NO: 212903 - RNA, 22 nt, Human
cugacaacaaacaaagcugcag

SEQ ID NO: 212904 - RNA, 22 nt, Human
cugcagccuugaccucccaggc

SEQ ID NO: 212905 - RNA, 23 nt, Human
cugcagccuugaccucccaggcu

SEQ ID NO: 212906 - RNA, 19 nt, Human
cugcugcuagcucuccuuu

SEQ ID NO: 212907 - RNA, 23 nt, Human
cuggagcaggcugauuuuccccu

SEQ ID NO: 212908 - RNA, 24 nt, Human
cuggagcaggcugauuuuccccug

SEQ ID NO: 212909 - RNA, 20 nt, Human
cuggcccggcucagugucag

SEQ ID NO: 212910 - RNA, 23 nt, Human
cuguauuauucacccacucaccc

SEQ ID NO: 212911 - RNA, 22 nt, Human
cuuccuccucggcuaccacucc

SEQ ID NO: 212912 - RNA, 23 nt, Human
cuugcucugucaccccaggcugg

SEQ ID NO: 212913 - RNA, 24 nt, Human
cuugcucugucaccccaggcugga

SEQ ID NO: 212914 - RNA, 25 nt, Human
cuugcucugucaccccaggcuggag

SEQ ID NO: 212915 - RNA, 26 nt, Human
cuuuugcugagcccguuuguguuuug

SEQ ID NO: 212916 - RNA, 24 nt, Human
cuuuuuguagagaugggguuuuau

SEQ ID NO: 212917 - RNA, 24 nt, Human
gaacucgcgcuggagcgucucugg

SEQ ID NO: 212918 - RNA, 23 nt, Human
gaagcccucccugcugcuagcuc

SEQ ID NO: 212919 - RNA, 20 nt, Human
gagaugggguuuuaucacau

SEQ ID NO: 212920 - RNA, 19 nt, Human
gccaaaggccgcacacccc

SEQ ID NO: 212921 - RNA, 20 nt, Human
gcggggcggugggcgggcag

SEQ ID NO: 212922 - RNA, 21 nt, Human
gcucugucaccccaggcugga

SEQ ID NO: 212923 - RNA, 22 nt, Human
gcugcuagcucuccuuuguggg

SEQ ID NO: 212924 - RNA, 18 nt, Human
gcuggagcgucucugggc

SEQ ID NO: 212925 - RNA, 20 nt, Human
gcuucuucccccaggccuug

SEQ ID NO: 212926 - RNA, 24 nt, Human
ggaaaauauuuuuucucuuccucc

SEQ ID NO: 212927 - RNA, 22 nt, Human
ggacucaagugauccuccugcc

SEQ ID NO: 212928 - RNA, 25 nt, Human
ggagguggagaagagagaacauugg

SEQ ID NO: 212929 - RNA, 24 nt, Human
ggcagugagaagcaucuuuugcug

SEQ ID NO: 212930 - RNA, 24 nt, Human
ggcguuuaaguaaaagccgucccc

SEQ ID NO: 212931 - RNA, 21 nt, Human
gggcagcccccauccgcagga

SEQ ID NO: 212932 - RNA, 18 nt, Human
gggcaggcgggcucaggc

SEQ ID NO: 212933 - RNA, 18 nt, Human
gggcggcagggguggcag

SEQ ID NO: 212934 - RNA, 23 nt, Human
gggguuuuaucacauugcccagg

SEQ ID NO: 212935 - RNA, 19 nt, Human
gguagagacccugugcccc

SEQ ID NO: 212936 - RNA, 18 nt, Human
guagagacccugugcccc

SEQ ID NO: 212937 - RNA, 20 nt, Human
gugggcgggcaggcgggcuc

SEQ ID NO: 212938 - RNA, 20 nt, Human
guguugaggggugggcugcc

SEQ ID NO: 212939 - RNA, 19 nt, Human
uagagacccugugccccuc

SEQ ID NO: 212940 - RNA, 24 nt, Human
uaucacauugcccaggcugaucuc

SEQ ID NO: 212941 - RNA, 22 nt, Human
ucacccacucacccucagcugu

SEQ ID NO: 212942 - RNA, 20 nt, Human
ucaccugagguccugcaacc

SEQ ID NO: 212943 - RNA, 19 nt, Human
ucacugcagccuugaccuc

SEQ ID NO: 212944 - RNA, 23 nt, Human
ucacugcagccuugaccucccag

SEQ ID NO: 212945 - RNA, 24 nt, Human
ucacugcagccuugaccucccagg

SEQ ID NO: 212946 - RNA, 21 nt, Human
ucagugucagugcgacuuccc

SEQ ID NO: 212947 - RNA, 24 nt, Human
uccacaccgaggcccccaccaacc

SEQ ID NO: 212948 - RNA, 21 nt, Human
uccauggucccgcagaggcgg

SEQ ID NO: 212949 - RNA, 18 nt, Human
ucccaggcucaagagauc

SEQ ID NO: 212950 - RNA, 20 nt, Human
uccccaggccuagaaaaaca

SEQ ID NO: 212951 - RNA, 25 nt, Human
ucccccaggccuuggcguuuaagua

SEQ ID NO: 212952 - RNA, 19 nt, Human
ucccgaagugcgugggccu

SEQ ID NO: 212953 - RNA, 23 nt, Human
ucccucggccccgcgccgcgcuc

SEQ ID NO: 212954 - RNA, 19 nt, Human
uccgugugaguguccaaag

SEQ ID NO: 212955 - RNA, 18 nt, Human
uccucccaccucagcccc

SEQ ID NO: 212956 - RNA, 20 nt, Human
uccucccaccucagcccccc

SEQ ID NO: 212957 - RNA, 23 nt, Human
uccucggcuaccacuccaugguc

SEQ ID NO: 212958 - RNA, 19 nt, Human
uccuuaauauuaucuuccc

SEQ ID NO: 212959 - RNA, 23 nt, Human
ucggcuccucucccucuggcccg

SEQ ID NO: 212960 - RNA, 21 nt, Human
ucucuuccuccuuuuucacuu

SEQ ID NO: 212961 - RNA, 22 nt, Human
ucuggacucaagugauccuccu

SEQ ID NO: 212962 - RNA, 23 nt, Human
ucuggacucaagugauccuccug

SEQ ID NO: 212963 - RNA, 21 nt, Human
ucugucaccccaggcuggagu

SEQ ID NO: 212964 - RNA, 25 nt, Human
ucugucaccccaggcuggagugcag

SEQ ID NO: 212965 - RNA, 19 nt, Human
ugaaaacgaccaggcccug

SEQ ID NO: 212966 - RNA, 18 nt, Human
ugaacagcuggagcaggc

SEQ ID NO: 212967 - RNA, 25 nt, Human
ugaccucccaggcucaagagauccu

SEQ ID NO: 212968 - RNA, 18 nt, Human
ugagcggggagaacaggg

SEQ ID NO: 212969 - RNA, 24 nt, Human
ugaggaacuaauuauaauucuguu

SEQ ID NO: 212970 - RNA, 24 nt, Human
ugaggaacucgcgcuggagcgucu

SEQ ID NO: 212971 - RNA, 24 nt, Human
ugaggggugggcugccagccgcuu

SEQ ID NO: 212972 - RNA, 22 nt, Human
ugagguccugcaacccaaagcc

SEQ ID NO: 212973 - RNA, 23 nt, Human
ugagguccugcaacccaaagcca

SEQ ID NO: 212974 - RNA, 22 nt, Human
ugcagagguguugagggguggg

SEQ ID NO: 212975 - RNA, 22 nt, Human
ugcaguggugcaaucucggcuc

SEQ ID NO: 212976 - RNA, 25 nt, Human
ugccucgaccucccgaagugcgugg

SEQ ID NO: 212977 - RNA, 21 nt, Human
ugcgugggccuccaugccugg

SEQ ID NO: 212978 - RNA, 20 nt, Human
ugcuggugccacccagccag

SEQ ID NO: 212979 - RNA, 24 nt, Human
uggacucaagugauccuccugccu

SEQ ID NO: 212980 - RNA, 23 nt, Human
uggagugcaguggugcaaucucg

SEQ ID NO: 212981 - RNA, 24 nt, Human
uggagugcaguggugcaaucucgg

SEQ ID NO: 212982 - RNA, 20 nt, Human
uggcaggggcggggcggggc

SEQ ID NO: 212983 - RNA, 24 nt, Human
ugggacuucaggcacacucuacca

SEQ ID NO: 212984 - RNA, 20 nt, Human
ugggccuccaugccuggcag

SEQ ID NO: 212985 - RNA, 24 nt, Human
ugggguuuuaucacauugcccagg

SEQ ID NO: 212986 - RNA, 24 nt, Human
uggugcaaucucggcucacugcag

SEQ ID NO: 212987 - RNA, 19 nt, Human
ugguucucuucacaguggc

SEQ ID NO: 212988 - RNA, 20 nt, Human
uguagggaagaaagggagga

SEQ ID NO: 212989 - RNA, 25 nt, Human
uguauuauucacccacucacccuca

SEQ ID NO: 212990 - RNA, 23 nt, Human
uuaaacgcauucuugccaggcuc

SEQ ID NO: 212991 - RNA, 21 nt, Human
uucuugccaggcucauuuuuc

SEQ ID NO: 212992 - RNA, 21 nt, Human
uugaucucagaaauggcagaa

SEQ ID NO: 212993 - RNA, 24 nt, Human
uuguagagaugggguuuuaucaca

SEQ ID NO: 212994 - RNA, 24 nt, Human
uuguagagaugggguuuuaucacg

SEQ ID NO: 212995 - RNA, 19 nt, Human
uuuaugcuuuuuguagaga

SEQ ID NO: 212996 - RNA, 21 nt, Human
uuucagaggcugugauccccc

SEQ ID NO: 212997 - RNA, 21 nt, Human
uuuguagagaugggguuuuau

SEQ ID NO: 212998 - RNA, 26 nt, Human
uuuguagagaugggguuuuaucacau

SEQ ID NO: 212999 - RNA, 23 nt, Human
uuuuaucacauugcccaggcuga

SEQ ID NO: 213000 - RNA, 20 nt, Human
cacucaggccgcgccgccuc

SEQ ID NO: 213001 - RNA, 20 nt, Human
cauuuuagcuuuacuuuaua

SEQ ID NO: 213002 - RNA, 19 nt, Human
cgcgacuccgcgggccuuu

SEQ ID NO: 213003 - RNA, 21 nt, Human
cggcccagcgcgacuccgcgg

SEQ ID NO: 213004 - RNA, 20 nt, Human
cuggcaggcgcggcccccgg

SEQ ID NO: 213005 - RNA, 18 nt, Human
gccaggcugggccagacc

SEQ ID NO: 213006 - RNA, 19 nt, Human
gcgccaggcugggccagac

SEQ ID NO: 213007 - RNA, 20 nt, Human
uccauuggguuucacucagg

SEQ ID NO: 213008 - RNA, 19 nt, Human
ucuccacagcgcacgaacc

SEQ ID NO: 213009 - RNA, 19 nt, Human
ucuccacagcgcacgaacc

SEQ ID NO: 213010 - RNA, 19 nt, Human
ugaagcuaagucuucuacu

SEQ ID NO: 213011 - RNA, 23 nt, Human
uucuaaaugucaugcuuuuucca

SEQ ID NO: 213012 - RNA, 26 nt, Human
aaucucuuuuagguaucuuggaccuu

SEQ ID NO: 213013 - RNA, 18 nt, Human
acucuaaaacaucuccag

SEQ ID NO: 213014 - RNA, 20 nt, Human
aguaacuucuaggaagcauu

SEQ ID NO: 213015 - RNA, 21 nt, Human
agucacucccaggacccuggu

SEQ ID NO: 213016 - RNA, 25 nt, Human
cagcauggaaucuucauuauccccu

SEQ ID NO: 213017 - RNA, 20 nt, Human
cagcugguuccucuuacccu

SEQ ID NO: 213018 - RNA, 24 nt, Human
cauuguuuguauucaucuucuagu

SEQ ID NO: 213019 - RNA, 20 nt, Human
cccauagucacucccaggac

SEQ ID NO: 213020 - RNA, 23 nt, Human
cccgcgcaccuggaugaggacca

SEQ ID NO: 213021 - RNA, 21 nt, Human
cuaaaacaucuccagcacaga

SEQ ID NO: 213022 - RNA, 19 nt, Human
cucaccgcccauagucacu

SEQ ID NO: 213023 - RNA, 23 nt, Human
cucaccgcccauagucacuccca

SEQ ID NO: 213024 - RNA, 22 nt, Human
cuccagcacagaagaagacaau

SEQ ID NO: 213025 - RNA, 19 nt, Human
cucucuccugggcaccugc

SEQ ID NO: 213026 - RNA, 24 nt, Human
cuucccgcgcaccuggaugaggac

SEQ ID NO: 213027 - RNA, 18 nt, Human
gagcaggagcaagcucuc

SEQ ID NO: 213028 - RNA, 24 nt, Human
gcuauaccauuuauugaaggcacu

SEQ ID NO: 213029 - RNA, 24 nt, Human
ggcguggcucugcgcuuugccuuu

SEQ ID NO: 213030 - RNA, 19 nt, Human
gggcguagucaugaugacc

SEQ ID NO: 213031 - RNA, 19 nt, Human
gggggcggcacacacuacg

SEQ ID NO: 213032 - RNA, 18 nt, Human
gggugaucucugcagcug

SEQ ID NO: 213033 - RNA, 22 nt, Human
gucugcagguucaaucuuuggg

SEQ ID NO: 213034 - RNA, 25 nt, Human
guuucauccaucccaaggggggcgg

SEQ ID NO: 213035 - RNA, 19 nt, Human
uaaaucucuugaaaucucu

SEQ ID NO: 213036 - RNA, 25 nt, Human
uaaauguucacauauauaagaaaua

SEQ ID NO: 213037 - RNA, 18 nt, Human
uaauacaguauaauagau

SEQ ID NO: 213038 - RNA, 23 nt, Human
uacaguauaauagauucauagug

SEQ ID NO: 213039 - RNA, 25 nt, Human
uacaguauaauagauucauagugag

SEQ ID NO: 213040 - RNA, 18 nt, Human
ucacauauauaagaaaua

SEQ ID NO: 213041 - RNA, 19 nt, Human
ucacucccaggacccuggu

SEQ ID NO: 213042 - RNA, 23 nt, Human
ucuaggaagcauuccacucugaa

SEQ ID NO: 213043 - RNA, 18 nt, Human
ucucugcagcugguuccu

SEQ ID NO: 213044 - RNA, 23 nt, Human
ucuuacccacgccgcgacugcag

SEQ ID NO: 213045 - RNA, 19 nt, Human
ugcauuucucaaaugcccu

SEQ ID NO: 213046 - RNA, 23 nt, Human
uguguugggcagggugaucucug

SEQ ID NO: 213047 - RNA, 21 nt, Human
uuucauccaucccaagggggg

SEQ ID NO: 213048 - RNA, 20 nt, Human
aggaugcucuugacucaugu

SEQ ID NO: 213049 - RNA, 18 nt, Human
agucuggguuucuuacac

SEQ ID NO: 213050 - RNA, 19 nt, Human
cacaugguagaagcaggau

SEQ ID NO: 213051 - RNA, 18 nt, Human
cagaaucuugcagacugu

SEQ ID NO: 213052 - RNA, 18 nt, Human
cagaaucuugcagacugu

SEQ ID NO: 213053 - RNA, 23 nt, Human
caggaagaguggucaaagcaaug

SEQ ID NO: 213054 - RNA, 24 nt, Human
gcuaauuuugucuucucugugcug

SEQ ID NO: 213055 - RNA, 24 nt, Human
uagaagcaggaugcucuugacuca

SEQ ID NO: 213056 - RNA, 21 nt, Human
uccacaugguagaagcaggau

SEQ ID NO: 213057 - RNA, 18 nt, Human
ugaacucaggaagagugg

SEQ ID NO: 213058 - RNA, 22 nt, Human
ugcugugagggagacuaggaac

SEQ ID NO: 213059 - RNA, 20 nt, Human
ugguagaagcaggaugcucu

SEQ ID NO: 213060 - RNA, 20 nt, Human
uggucaaagcaauguuucag

SEQ ID NO: 213061 - RNA, 23 nt, Human
uugggucaccuuaaaccuuguga

SEQ ID NO: 213062 - RNA, 25 nt, Human
aaaacuucuccacaacccucugcac

SEQ ID NO: 213063 - RNA, 21 nt, Human
aaagugcuuccacauguccuu

SEQ ID NO: 213064 - RNA, 25 nt, Human
aaggagaaaccaaggcacaguggaa

SEQ ID NO: 213065 - RNA, 19 nt, Human
aauaaacaaguuucaacca

SEQ ID NO: 213066 - RNA, 21 nt, Human
aauuauuuguuguuuuuugua

SEQ ID NO: 213067 - RNA, 20 nt, Human
aauuuaucuaauaaaacauc

SEQ ID NO: 213068 - RNA, 22 nt, Human
acacagcacuaccaacacagcu

SEQ ID NO: 213069 - RNA, 24 nt, Human
acagaaaaaaauccaggauuucca

SEQ ID NO: 213070 - RNA, 24 nt, Human
acagagcucucuuccaucagaaag

SEQ ID NO: 213071 - RNA, 24 nt, Human
agaaaaaaauccaggauuuccagc

SEQ ID NO: 213072 - RNA, 18 nt, Human
agaaaccaaggcacagug

SEQ ID NO: 213073 - RNA, 23 nt, Human
agaaauaaaggagaaaccaaggc

SEQ ID NO: 213074 - RNA, 26 nt, Human
auaaacaauaauguacuuauacuaaa

SEQ ID NO: 213075 - RNA, 24 nt, Human
auugacuguggaguuuuggcuguu

SEQ ID NO: 213076 - RNA, 21 nt, Human
caacacagcacuaccaacaca

SEQ ID NO: 213077 - RNA, 22 nt, Human
caaggcacaguggaacaaggac

SEQ ID NO: 213078 - RNA, 19 nt, Human
cacaaauauuugaugcuua

SEQ ID NO: 213079 - RNA, 22 nt, Human
cacaacaucacugugagguaag

SEQ ID NO: 213080 - RNA, 26 nt, Human
cacaauacaugaaguguugaaguaga

SEQ ID NO: 213081 - RNA, 21 nt, Human
cacagugagaugguuccuucc

SEQ ID NO: 213082 - RNA, 23 nt, Human
cacauucuagcaaacccauucaa

SEQ ID NO: 213083 - RNA, 23 nt, Human
cagagcucucuuccaucagaaag

SEQ ID NO: 213084 - RNA, 18 nt, Human
cagauaaacaauaaugua

SEQ ID NO: 213085 - RNA, 19 nt, Human
cccacacaauacaugaagu

SEQ ID NO: 213086 - RNA, 18 nt, Human
ccuggcuagcagacuagg

SEQ ID NO: 213087 - RNA, 18 nt, Human
cuauuuguauauucuccc

SEQ ID NO: 213088 - RNA, 19 nt, Human
cuggcaacccuacaacaga

SEQ ID NO: 213089 - RNA, 24 nt, Human
cuucaaaaacuucuccacaacccu

SEQ ID NO: 213090 - RNA, 26 nt, Human
cuucaaaaacuucuccacaacccucu

SEQ ID NO: 213091 - RNA, 20 nt, Human
cuuccuggcucuuguccuag

SEQ ID NO: 213092 - RNA, 24 nt, Human
cuuggcccuuggccucaauuuugc

SEQ ID NO: 213093 - RNA, 18 nt, Human
gaauucucagcccucuuc

SEQ ID NO: 213094 - RNA, 25 nt, Human
ggagaaaccaaggcacaguggaaca

SEQ ID NO: 213095 - RNA, 24 nt, Human
guugccagauuuaacagaaaaaaa

SEQ ID NO: 213096 - RNA, 24 nt, Human
guuuuggcuguuuuaauaguucua

SEQ ID NO: 213097 - RNA, 21 nt, Human
uaaaaaaaauuuggagagcac

SEQ ID NO: 213098 - RNA, 24 nt, Human
uaacagaaaaaaauccaggauuuc

SEQ ID NO: 213099 - RNA, 26 nt, Human
uacaacagacccacacaauacaugaa

SEQ ID NO: 213100 - RNA, 20 nt, Human
uauuauaagaaucuauuugu

SEQ ID NO: 213101 - RNA, 20 nt, Human
ucacauucuagcaaacccau

SEQ ID NO: 213102 - RNA, 23 nt, Human
ucagcccucuucaaaaacuucuc

SEQ ID NO: 213103 - RNA, 19 nt, Human
uccacaacccucugcaccc

SEQ ID NO: 213104 - RNA, 20 nt, Human
uccacaacccucugcacccu

SEQ ID NO: 213105 - RNA, 24 nt, Human
ugaaaaaacuuaaagugcuuccac

SEQ ID NO: 213106 - RNA, 23 nt, Human
ugaaaugaaaauuuaacugggua

SEQ ID NO: 213107 - RNA, 19 nt, Human
ugacaagacugggaguauc

SEQ ID NO: 213108 - RNA, 26 nt, Human
ugcuugaaguuucacuggucgaaaag

SEQ ID NO: 213109 - RNA, 23 nt, Human
uggcaacccuacaacagacccac

SEQ ID NO: 213110 - RNA, 22 nt, Human
uguauugcaucuggcaacccua

SEQ ID NO: 213111 - RNA, 19 nt, Human
ugugagguaagaugguggc

SEQ ID NO: 213112 - RNA, 19 nt, Human
uguggaguuuuggcuguuu

SEQ ID NO: 213113 - RNA, 25 nt, Human
uucaaaaacuucuccacaacccucu

SEQ ID NO: 213114 - RNA, 27 nt, Human
uucaaaaacuucuccacaacccucugc

SEQ ID NO: 213115 - RNA, 19 nt, Human
uuccacauguccucacaac

SEQ ID NO: 213116 - RNA, 21 nt, Human
uuccacuuagaaauaaaggag

SEQ ID NO: 213117 - RNA, 23 nt, Human
uuccuggcucuuguccuagaagc

SEQ ID NO: 213118 - RNA, 20 nt, Human
uuuuccaaauucuugcacaa

SEQ ID NO: 213119 - RNA, 21 nt, Human
uuuuuuguagauucaaauaaa

SEQ ID NO: 213120 - RNA, 21 nt, Human
aacacucagaguugaggagau

SEQ ID NO: 213121 - RNA, 26 nt, Human
aacccucuuucucuuuguucauccac

SEQ ID NO: 213122 - RNA, 21 nt, Human
aagcauuuggggagggacugg

SEQ ID NO: 213123 - RNA, 21 nt, Human
acaccugagaugggaaaacca

SEQ ID NO: 213124 - RNA, 19 nt, Human
acagugaacaaaccgacag

SEQ ID NO: 213125 - RNA, 22 nt, Human
acugcaacucauggaaagcauu

SEQ ID NO: 213126 - RNA, 26 nt, Human
acuuguggacaaagggaucuuccuuu

SEQ ID NO: 213127 - RNA, 22 nt, Human
agcaggaguuaaagccccaggg

SEQ ID NO: 213128 - RNA, 23 nt, Human
agcaugcauucauuccugugauc

SEQ ID NO: 213129 - RNA, 21 nt, Human
agggaaaacagacuaggaaaa

SEQ ID NO: 213130 - RNA, 20 nt, Human
agguggccagcacauguguc

SEQ ID NO: 213131 - RNA, 22 nt, Human
agucagagaucagagugacuua

SEQ ID NO: 213132 - RNA, 23 nt, Human
auagcguccccccaaaacccaga

SEQ ID NO: 213133 - RNA, 22 nt, Human
caacaguaggagcugcagucag

SEQ ID NO: 213134 - RNA, 25 nt, Human
cacacagagccaccagcuugguggc

SEQ ID NO: 213135 - RNA, 23 nt, Human
cacaccugagaugggaaaaccac

SEQ ID NO: 213136 - RNA, 22 nt, Human
cacagcuucagcccuguucucu

SEQ ID NO: 213137 - RNA, 25 nt, Human
caccaaggacauacagugaacaaag

SEQ ID NO: 213138 - RNA, 23 nt, Human
cagcaaugguuugaucuaacuga

SEQ ID NO: 213139 - RNA, 20 nt, Human
cagcagacacugcaacacac

SEQ ID NO: 213140 - RNA, 19 nt, Human
caggaguuaaagccccagg

SEQ ID NO: 213141 - RNA, 19 nt, Human
cauggaggugcaaaggccg

SEQ ID NO: 213142 - RNA, 25 nt, Human
ccaagauacuuccacagggacaagc

SEQ ID NO: 213143 - RNA, 19 nt, Human
ccagcacaugugucugcga

SEQ ID NO: 213144 - RNA, 21 nt, Human
ccccaaaacccagauagugcc

SEQ ID NO: 213145 - RNA, 19 nt, Human
ccccagggaacacugcccu

SEQ ID NO: 213146 - RNA, 21 nt, Human
ccccagggaacacugcccuuc

SEQ ID NO: 213147 - RNA, 18 nt, Human
ccccccaaaacccagaua

SEQ ID NO: 213148 - RNA, 22 nt, Human
ccccugaagacaccaguuccua

SEQ ID NO: 213149 - RNA, 19 nt, Human
ccuaggcaaggccuaaccc

SEQ ID NO: 213150 - RNA, 22 nt, Human
ccuuggagguaccucaacagcu

SEQ ID NO: 213151 - RNA, 26 nt, Human
cuaacccagaagaugaugcucaccuc

SEQ ID NO: 213152 - RNA, 21 nt, Human
cuauagcguccccccaaaacc

SEQ ID NO: 213153 - RNA, 18 nt, Human
cucaacgcuuaacacuca

SEQ ID NO: 213154 - RNA, 22 nt, Human
cucaacgcuuaacacucagagu

SEQ ID NO: 213155 - RNA, 21 nt, Human
cucggaucagagcacacagag

SEQ ID NO: 213156 - RNA, 22 nt, Human
cugcagucagagaucagaguga

SEQ ID NO: 213157 - RNA, 23 nt, Human
cuuccacacacaaccucagggug

SEQ ID NO: 213158 - RNA, 23 nt, Human
cuuggagguaccucaacagcucc

SEQ ID NO: 213159 - RNA, 22 nt, Human
cuuuguucauccaccaccccca

SEQ ID NO: 213160 - RNA, 18 nt, Human
gagccagaucaccuucca

SEQ ID NO: 213161 - RNA, 21 nt, Human
gagggaaaacagacuaggaaa

SEQ ID NO: 213162 - RNA, 24 nt, Human
gaguuucugugccucaagagacug

SEQ ID NO: 213163 - RNA, 26 nt, Human
gcugcacgccagccuggaagcugcag

SEQ ID NO: 213164 - RNA, 22 nt, Human
ggaaaaaacugcaacucaugga

SEQ ID NO: 213165 - RNA, 25 nt, Human
ggagguaccucaacagcuccucaga

SEQ ID NO: 213166 - RNA, 18 nt, Human
ggccccugaagacaccag

SEQ ID NO: 213167 - RNA, 20 nt, Human
ggcuaagggcugcuugucuc

SEQ ID NO: 213168 - RNA, 18 nt, Human
ggcucagcagguggccag

SEQ ID NO: 213169 - RNA, 19 nt, Human
gggcuaagggcugcuuguc

SEQ ID NO: 213170 - RNA, 21 nt, Human
gucauggggguaaaggggguu

SEQ ID NO: 213171 - RNA, 21 nt, Human
guccccccaaaacccagauag

SEQ ID NO: 213172 - RNA, 23 nt, Human
gugaucauuauuuauugagcauu

SEQ ID NO: 213173 - RNA, 24 nt, Human
uaaagccccagggaacacugcccu

SEQ ID NO: 213174 - RNA, 19 nt, Human
uaggaaaaaacugcaacuc

SEQ ID NO: 213175 - RNA, 21 nt, Human
uagugccuguccagagccaga

SEQ ID NO: 213176 - RNA, 21 nt, Human
uaugggcaugaacaggaguuu

SEQ ID NO: 213177 - RNA, 19 nt, Human
ucaacccagagaggugccu

SEQ ID NO: 213178 - RNA, 26 nt, Human
uccaaacccucuuucucuuuguucau

SEQ ID NO: 213179 - RNA, 27 nt, Human
uccaaacccucuuucucuuuguucauc

SEQ ID NO: 213180 - RNA, 20 nt, Human
uccacacacaaccucagggu

SEQ ID NO: 213181 - RNA, 24 nt, Human
uccccacauccuauagcguccccc

SEQ ID NO: 213182 - RNA, 21 nt, Human
ucccuggaggaggauuuccuu

SEQ ID NO: 213183 - RNA, 20 nt, Human
uccuuggagguaccucaaca

SEQ ID NO: 213184 - RNA, 22 nt, Human
uccuuggagguaccucaacagc

SEQ ID NO: 213185 - RNA, 25 nt, Human
ucuucaguuucagcaaugguuugau

SEQ ID NO: 213186 - RNA, 18 nt, Human
ucuuccuuggccaggggu

SEQ ID NO: 213187 - RNA, 22 nt, Human
ugaacaaaccgacagggcccug

SEQ ID NO: 213188 - RNA, 20 nt, Human
ugaagacaccaguuccuaac

SEQ ID NO: 213189 - RNA, 21 nt, Human
ugagacucccuggaggaggau

SEQ ID NO: 213190 - RNA, 21 nt, Human
ugaggcaggcuaugccuaggc

SEQ ID NO: 213191 - RNA, 19 nt, Human
ugcaacacaccugagaugg

SEQ ID NO: 213192 - RNA, 19 nt, Human
ugccuaggcaaggccuaac

SEQ ID NO: 213193 - RNA, 25 nt, Human
ugcuccugugagggucaacgagagc

SEQ ID NO: 213194 - RNA, 19 nt, Human
uggcagguugauguuuugg

SEQ ID NO: 213195 - RNA, 22 nt, Human
uggcagguugauguuuuggcag

SEQ ID NO: 213196 - RNA, 18 nt, Human
uggcucaacgcuuaacac

SEQ ID NO: 213197 - RNA, 20 nt, Human
ugggaaaaccaccccccuga

SEQ ID NO: 213198 - RNA, 18 nt, Human
ugucacaaccaagauacu

SEQ ID NO: 213199 - RNA, 18 nt, Human
ugucuccagcagacacug

SEQ ID NO: 213200 - RNA, 23 nt, Human
ugucucguuccacuuggggcuca

SEQ ID NO: 213201 - RNA, 24 nt, Human
ugugaucauuauuuauugagcauu

SEQ ID NO: 213202 - RNA, 23 nt, Human
uguggcauagaucuggcuuccaa

SEQ ID NO: 213203 - RNA, 22 nt, Human
uuaaagccccagggaacacugc

SEQ ID NO: 213204 - RNA, 19 nt, Human
uucauccaccacccccaag

SEQ ID NO: 213205 - RNA, 19 nt, Human
uuuggcagugccugccuca

SEQ ID NO: 213206 - RNA, 20 nt, Human
aaacaaauaaucacaacuga

SEQ ID NO: 213207 - RNA, 22 nt, Human
aaucacaacugauacugauuua

SEQ ID NO: 213208 - RNA, 30 nt, Human
cuuuuuaaauuuaauaaauaggauaaauaa

SEQ ID NO: 213209 - RNA, 22 nt, Human
gauuuuuaaauuguagcaacuu

SEQ ID NO: 213210 - RNA, 22 nt, Human
uuaaacaaauaaucacaacuga

SEQ ID NO: 213211 - RNA, 24 nt, Human
uuauuucaaaauaaagacauacaa

SEQ ID NO: 213212 - RNA, 21 nt, Human
acaagggcuccagaaacuuca

SEQ ID NO: 213213 - RNA, 21 nt, Human
acaagucugaggcauccccaa

SEQ ID NO: 213214 - RNA, 22 nt, Human
acacaggccgcccacaucugaa

SEQ ID NO: 213215 - RNA, 20 nt, Human
acgacagguucacacaggcc

SEQ ID NO: 213216 - RNA, 21 nt, Human
agagggguugaggggggagcc

SEQ ID NO: 213217 - RNA, 23 nt, Human
agagggguugaggggggagccuc

SEQ ID NO: 213218 - RNA, 20 nt, Human
agcuuugcacgacagguuca

SEQ ID NO: 213219 - RNA, 21 nt, Human
cagcaaagacccucagccuga

SEQ ID NO: 213220 - RNA, 21 nt, Human
cagccugauucaggagauaac

SEQ ID NO: 213221 - RNA, 18 nt, Human
caggagauaacugcagca

SEQ ID NO: 213222 - RNA, 19 nt, Human
caggagauaacugcagcag

SEQ ID NO: 213223 - RNA, 22 nt, Human
cauccagacaggaccucugacc

SEQ ID NO: 213224 - RNA, 25 nt, Human
ccauccagacaggaccucugaccgc

SEQ ID NO: 213225 - RNA, 25 nt, Human
cccacaucugaaaccacaagcgcau

SEQ ID NO: 213226 - RNA, 19 nt, Human
cucagccugauucaggaga

SEQ ID NO: 213227 - RNA, 20 nt, Human
cuccagaaacuucaguccau

SEQ ID NO: 213228 - RNA, 25 nt, Human
cuccagccuccauccagacaggacc

SEQ ID NO: 213229 - RNA, 21 nt, Human
cugcuaggggccccuucucag

SEQ ID NO: 213230 - RNA, 24 nt, Human
gagcagagggguugaggggggagc

SEQ ID NO: 213231 - RNA, 21 nt, Human
gagccuccagccuccauccag

SEQ ID NO: 213232 - RNA, 21 nt, Human
gccgcccacaucugaaaccac

SEQ ID NO: 213233 - RNA, 21 nt, Human
gggagccuccagccuccaucc

SEQ ID NO: 213234 - RNA, 19 nt, Human
gggguugaggggggagccu

SEQ ID NO: 213235 - RNA, 21 nt, Human
gguugaggggggagccuccag

SEQ ID NO: 213236 - RNA, 21 nt, Human
gugcacagcaaagacccucag

SEQ ID NO: 213237 - RNA, 24 nt, Human
uaggggccccuucucaggagguuc

SEQ ID NO: 213238 - RNA, 18 nt, Human
ucagacaagggcuccaga

SEQ ID NO: 213239 - RNA, 20 nt, Human
ucaguccauuuucccaaaau

SEQ ID NO: 213240 - RNA, 25 nt, Human
ucagucucagacaagggcuccagaa

SEQ ID NO: 213241 - RNA, 23 nt, Human
ucugaaaccacaagcgcauuaca

SEQ ID NO: 213242 - RNA, 21 nt, Human
ucugaggcauccccaaccugg

SEQ ID NO: 213243 - RNA, 20 nt, Human
ugaggcauccccaaccugga

SEQ ID NO: 213244 - RNA, 22 nt, Human
ugauuugucacccaacuaucuc

SEQ ID NO: 213245 - RNA, 21 nt, Human
ugcuccccacaggcacugagc

SEQ ID NO: 213246 - RNA, 20 nt, Human
ugucacccaacuaucucugg

SEQ ID NO: 213247 - RNA, 22 nt, Human
uucacacaggccgcccacaucu

SEQ ID NO: 213248 - RNA, 23 nt, Human
uugcacgacagguucacacaggc

SEQ ID NO: 213249 - RNA, 23 nt, Human
aaacaaacaacaaaaaauagcca

SEQ ID NO: 213250 - RNA, 24 nt, Human
aaacaacaaaaaauagccagaaag

SEQ ID NO: 213251 - RNA, 21 nt, Human
aaagaaacaaacaacaaaaaa

SEQ ID NO: 213252 - RNA, 29 nt, Human
aaagaaacaaacaacaaaaaauagccagg

SEQ ID NO: 213253 - RNA, 26 nt, Human
aacaacaaaaaauagccagaaagaga

SEQ ID NO: 213254 - RNA, 22 nt, Human
aagaaaggacaccucaaaauac

SEQ ID NO: 213255 - RNA, 24 nt, Human
acaaacaacaaaaaauagccagaa

SEQ ID NO: 213256 - RNA, 21 nt, Human
acaaagaaacaaacaacaaaa

SEQ ID NO: 213257 - RNA, 21 nt, Human
acagcaggcgcuggccgugcc

SEQ ID NO: 213258 - RNA, 21 nt, Human
acuugaacaagacagacaaaa

SEQ ID NO: 213259 - RNA, 19 nt, Human
agcggcggcgaggggcggg

SEQ ID NO: 213260 - RNA, 22 nt, Human
aggacaccucaaaauacucuaa

SEQ ID NO: 213261 - RNA, 28 nt, Human
aggcugaaaacaaaaacaaaagggaccc

SEQ ID NO: 213262 - RNA, 21 nt, Human
augaaauccacggaaagggcc

SEQ ID NO: 213263 - RNA, 23 nt, Human
caaaaaauagccagaaagagaac

SEQ ID NO: 213264 - RNA, 24 nt, Human
caacaaaaaauagccagaaagaga

SEQ ID NO: 213265 - RNA, 22 nt, Human
cacaaagaaacaaacaacaaaa

SEQ ID NO: 213266 - RNA, 22 nt, Human
cacagcaggcgcuggccgugcc

SEQ ID NO: 213267 - RNA, 20 nt, Human
caccggagcugagggagggg

SEQ ID NO: 213268 - RNA, 22 nt, Human
caccggagcugagggagggggc

SEQ ID NO: 213269 - RNA, 21 nt, Human
cagcucggugagucccggcag

SEQ ID NO: 213270 - RNA, 22 nt, Human
cagcuggguuuuggguuuucag

SEQ ID NO: 213271 - RNA, 23 nt, Human
cagugcugagaggugaaguccaa

SEQ ID NO: 213272 - RNA, 25 nt, Human
caugcggccacagcguccguccacc

SEQ ID NO: 213273 - RNA, 18 nt, Human
ccacgcgagccacaugcu

SEQ ID NO: 213274 - RNA, 21 nt, Human
ccacgcgagccacaugcugaa

SEQ ID NO: 213275 - RNA, 22 nt, Human
ccauaggcugaaaacaaaaaca

SEQ ID NO: 213276 - RNA, 18 nt, Human
cccccgagugcuggcggg

SEQ ID NO: 213277 - RNA, 21 nt, Human
cccccgcguccugaggccuag

SEQ ID NO: 213278 - RNA, 21 nt, Human
ccugaggccuagucuugggag

SEQ ID NO: 213279 - RNA, 22 nt, Human
cgcuggccgugccguccucaca

SEQ ID NO: 213280 - RNA, 23 nt, Human
cgcuggccgugccguccucacac

SEQ ID NO: 213281 - RNA, 23 nt, Human
cucgcgggaggacagaguuucac

SEQ ID NO: 213282 - RNA, 19 nt, Human
cugaaaacaaaaacaaaac

SEQ ID NO: 213283 - RNA, 25 nt, Human
cuucccggcacuggcucgucccugg

SEQ ID NO: 213284 - RNA, 24 nt, Human
gagcggcggcgaggggcgggagca

SEQ ID NO: 213285 - RNA, 22 nt, Human
gccagggacaaagucaacacaa

SEQ ID NO: 213286 - RNA, 22 nt, Human
gcgccgguggcgcgccgaggcc

SEQ ID NO: 213287 - RNA, 21 nt, Human
gcgggcgccgguggcgcgccg

SEQ ID NO: 213288 - RNA, 22 nt, Human
gcugaaaacaaaaacaaaacua

SEQ ID NO: 213289 - RNA, 22 nt, Human
gcuggguuuuggguuuucagug

SEQ ID NO: 213290 - RNA, 20 nt, Human
ggaggaggcguggggggggg

SEQ ID NO: 213291 - RNA, 22 nt, Human
ggaggaggggaggaggcguggg

SEQ ID NO: 213292 - RNA, 18 nt, Human
ggagguggauaaaauuca

SEQ ID NO: 213293 - RNA, 25 nt, Human
ggccggcgagcgagcgagcggcggg

SEQ ID NO: 213294 - RNA, 19 nt, Human
ggggaggaggcgugggggg

SEQ ID NO: 213295 - RNA, 21 nt, Human
ggggauggcuccccccgcguc

SEQ ID NO: 213296 - RNA, 19 nt, Human
gguuuuguugugugugggu

SEQ ID NO: 213297 - RNA, 24 nt, Human
guaaagaaaggacaccucaaaaua

SEQ ID NO: 213298 - RNA, 20 nt, Human
gucccggcaguuccuucccg

SEQ ID NO: 213299 - RNA, 19 nt, Human
gucucaguagaaauggagu

SEQ ID NO: 213300 - RNA, 19 nt, Human
gugaaaugcccaagacccc

SEQ ID NO: 213301 - RNA, 21 nt, Human
uaacacggaaaugugcagaug

SEQ ID NO: 213302 - RNA, 18 nt, Human
uaaggaguguuaaggcca

SEQ ID NO: 213303 - RNA, 20 nt, Human
uauguuguuucuuugcccca

SEQ ID NO: 213304 - RNA, 18 nt, Human
ucacucguagguagaagc

SEQ ID NO: 213305 - RNA, 20 nt, Human
ucaguagaaauggagugaug

SEQ ID NO: 213306 - RNA, 21 nt, Human
uccaugcggccacagcguccg

SEQ ID NO: 213307 - RNA, 25 nt, Human
uccucgcgggaggacagaguuucac

SEQ ID NO: 213308 - RNA, 18 nt, Human
ugaaaugcccaagacccc

SEQ ID NO: 213309 - RNA, 25 nt, Human
ugaaauggagguggauaaaauucau

SEQ ID NO: 213310 - RNA, 23 nt, Human
ugaacaagacagacaaaaggaaa

SEQ ID NO: 213311 - RNA, 24 nt, Human
ugagggagggggccgagcggaggc

SEQ ID NO: 213312 - RNA, 25 nt, Human
ugccagggacaaagucaacacaaag

SEQ ID NO: 213313 - RNA, 23 nt, Human
ugcggccacagcguccguccacc

SEQ ID NO: 213314 - RNA, 24 nt, Human
uggagugaugugaaaugcccaaga

SEQ ID NO: 213315 - RNA, 20 nt, Human
uuccuucccggcacuggcuc

SEQ ID NO: 213316 - RNA, 23 nt, Human
uugaacaagacagacaaaaggaa

SEQ ID NO: 213317 - RNA, 21 nt, Human
uuguucaagugugacuucugu

SEQ ID NO: 213318 - RNA, 20 nt, Human
aaccagaggccugcugcuuu

SEQ ID NO: 213319 - RNA, 21 nt, Human
aaccccaagcuuuauccucgg

SEQ ID NO: 213320 - RNA, 20 nt, Human
aggcaaccagaggccugcug

SEQ ID NO: 213321 - RNA, 24 nt, Human
aggccugcugcuuuggggaggugc

SEQ ID NO: 213322 - RNA, 22 nt, Human
caaagcucugagcccgccccuc

SEQ ID NO: 213323 - RNA, 23 nt, Human
caccauguggcaagugacaaagc

SEQ ID NO: 213324 - RNA, 22 nt, Human
cagggaaggaggaugaacccca

SEQ ID NO: 213325 - RNA, 18 nt, Human
ccagggaaggaggaugaa

SEQ ID NO: 213326 - RNA, 23 nt, Human
ccccaggcugggguaguaccauu

SEQ ID NO: 213327 - RNA, 19 nt, Human
ccucuggaguucaggcaag

SEQ ID NO: 213328 - RNA, 24 nt, Human
ccucuugcgcacagugguagggau

SEQ ID NO: 213329 - RNA, 23 nt, Human
cugaucccucccauguuggaaga

SEQ ID NO: 213330 - RNA, 19 nt, Human
gacucgggcugcaggaucc

SEQ ID NO: 213331 - RNA, 22 nt, Human
gacuguggagugauccagggaa

SEQ ID NO: 213332 - RNA, 21 nt, Human
gagcccgccccucuugcgcac

SEQ ID NO: 213333 - RNA, 21 nt, Human
ggaggcgggggaggcaaccag

SEQ ID NO: 213334 - RNA, 25 nt, Human
uauccucgggacucgggcugcagga

SEQ ID NO: 213335 - RNA, 18 nt, Human
uccagggaaggaggauga

SEQ ID NO: 213336 - RNA, 26 nt, Human
ugacaggcggggcugaucccuccucu

SEQ ID NO: 213337 - RNA, 18 nt, Human
ugacuggaggcgggggag

SEQ ID NO: 213338 - RNA, 19 nt, Human
ugacuggaggcgggggagg

SEQ ID NO: 213339 - RNA, 20 nt, Human
ugacuggaggcgggggaggc

SEQ ID NO: 213340 - RNA, 21 nt, Human
uggcaagugacaaagcucuga

SEQ ID NO: 213341 - RNA, 18 nt, Human
uguuggaagacaccaugu

SEQ ID NO: 213342 - RNA, 25 nt, Human
uucccccaaccaugucccgacaccu

SEQ ID NO: 213343 - RNA, 20 nt, Human
uuggaagacaccauguggca

SEQ ID NO: 213344 - RNA, 19 nt, Human
accccuccauccccuccuc

SEQ ID NO: 213345 - RNA, 22 nt, Human
aggcccagggcaagcaaugaug

SEQ ID NO: 213346 - RNA, 22 nt, Human
aggcccagggcaagcaaugaug

SEQ ID NO: 213347 - RNA, 23 nt, Human
auuugaccccuccauccccuccu

SEQ ID NO: 213348 - RNA, 21 nt, Human
caagcaaugaugagacuccaa

SEQ ID NO: 213349 - RNA, 18 nt, Human
cagcggcgccccgccucg

SEQ ID NO: 213350 - RNA, 18 nt, Human
ccgugucacgugacccgg

SEQ ID NO: 213351 - RNA, 22 nt, Human
ccuccagcagaauucggccccc

SEQ ID NO: 213352 - RNA, 23 nt, Human
cuccaaaccagcuggacacaguc

SEQ ID NO: 213353 - RNA, 18 nt, Human
gcuggacacaguccaggg

SEQ ID NO: 213354 - RNA, 23 nt, Human
gguccgugaagaggaggguccaa

SEQ ID NO: 213355 - RNA, 23 nt, Human
gugaagaggaggguccaagagcu

SEQ ID NO: 213356 - RNA, 21 nt, Human
ucagcggcgccccgccucgug

SEQ ID NO: 213357 - RNA, 23 nt, Human
uccagcagaauucggcccccucc

SEQ ID NO: 213358 - RNA, 19 nt, Human
uccagggggaggaaggcag

SEQ ID NO: 213359 - RNA, 22 nt, Human
uccgugucacgugacccgggag

SEQ ID NO: 213360 - RNA, 18 nt, Human
uccucagggagguugugg

SEQ ID NO: 213361 - RNA, 23 nt, Human
ucugagauuugaccccuccaucc

SEQ ID NO: 213362 - RNA, 21 nt, Human
ugaagaggaggguccaagagc

SEQ ID NO: 213363 - RNA, 19 nt, Human
ugaccccuccauccccucc

SEQ ID NO: 213364 - RNA, 21 nt, Human
ugacccgggagcguggccgug

SEQ ID NO: 213365 - RNA, 23 nt, Human
ugcccggguggcccacuuggcuc

SEQ ID NO: 213366 - RNA, 23 nt, Human
ugggccucaugggauaggcccag

SEQ ID NO: 213367 - RNA, 20 nt, Human
uguggagucacugggccuca

SEQ ID NO: 213368 - RNA, 21 nt, Human
uuugaccccuccauccccucc

SEQ ID NO: 213369 - RNA, 24 nt, Human
uuuuuuuuuuuuuacuugggccua

SEQ ID NO: 213370 - RNA, 24 nt, Human
uuuuuuuuuuuuuuuuuuacuugg

SEQ ID NO: 213371 - RNA, 25 nt, Human
uuuuuuuuuuuuuuuuuuacuuggg

SEQ ID NO: 213372 - RNA, 21 nt, Human
aacacgcgcacgcacacaugg

SEQ ID NO: 213373 - RNA, 23 nt, Human
aagcaccaaaaucaaaacccaac

SEQ ID NO: 213374 - RNA, 21 nt, Human
aaguuuuucccuuuuggaggc

SEQ ID NO: 213375 - RNA, 22 nt, Human
aaucaaaacccaacaaucaaua

SEQ ID NO: 213376 - RNA, 21 nt, Human
accaccugcccaacacuucca

SEQ ID NO: 213377 - RNA, 18 nt, Human
acgcaggacucgcggccg

SEQ ID NO: 213378 - RNA, 18 nt, Human
agcaagcaccaaaaucaa

SEQ ID NO: 213379 - RNA, 20 nt, Human
agcuccgggccaggugugcc

SEQ ID NO: 213380 - RNA, 22 nt, Human
cacagcgcucccucacggccag

SEQ ID NO: 213381 - RNA, 22 nt, Human
caccaaaaucaaaacccaacaa

SEQ ID NO: 213382 - RNA, 19 nt, Human
cagaaggcagcgcgccccc

SEQ ID NO: 213383 - RNA, 26 nt, Human
cagaaguuuuucccuuuuggaggcuu

SEQ ID NO: 213384 - RNA, 23 nt, Human
cagcaagcaccaaaaucaaaacc

SEQ ID NO: 213385 - RNA, 28 nt, Human
cagcaagcaccaaaaucaaaacccaaca

SEQ ID NO: 213386 - RNA, 21 nt, Human
cagcagcaagcaccaaaauca

SEQ ID NO: 213387 - RNA, 23 nt, Human
cagcaucauauugucagaaguuu

SEQ ID NO: 213388 - RNA, 23 nt, Human
ccaccaccugcccaacacuucca

SEQ ID NO: 213389 - RNA, 18 nt, Human
ccucgcccaauuuggcca

SEQ ID NO: 213390 - RNA, 22 nt, Human
cgcacgcgccucagauaaacac

SEQ ID NO: 213391 - RNA, 22 nt, Human
cgcgcacgcacacaugcucgcg

SEQ ID NO: 213392 - RNA, 18 nt, Human
cucagauaaacacgcgca

SEQ ID NO: 213393 - RNA, 20 nt, Human
cuccuuuguagauaguacaa

SEQ ID NO: 213394 - RNA, 18 nt, Human
cuuugugaggacugggag

SEQ ID NO: 213395 - RNA, 26 nt, Human
gaaaauuauuuauuuaauaauacaga

SEQ ID NO: 213396 - RNA, 22 nt, Human
gacgcucucccaccaccugccc

SEQ ID NO: 213397 - RNA, 20 nt, Human
gcacgcacacaugcucgcga

SEQ ID NO: 213398 - RNA, 19 nt, Human
gcagaaggcagcgcgcccc

SEQ ID NO: 213399 - RNA, 22 nt, Human
gcagaaggcagcgcgcccccac

SEQ ID NO: 213400 - RNA, 19 nt, Human
gcgcguuguuggggcgccg

SEQ ID NO: 213401 - RNA, 23 nt, Human
gcuucuuuuuuccauuccuuucc

SEQ ID NO: 213402 - RNA, 21 nt, Human
ggggcauuaaacaacagggaa

SEQ ID NO: 213403 - RNA, 22 nt, Human
uaaaaaacgacagacagacacg

SEQ ID NO: 213404 - RNA, 20 nt, Human
uaaauauuucucgcacagca

SEQ ID NO: 213405 - RNA, 18 nt, Human
uaacuggccucccaaugc

SEQ ID NO: 213406 - RNA, 20 nt, Human
uaauaauacagaucguuuua

SEQ ID NO: 213407 - RNA, 19 nt, Human
uaaucugaaauucagcccc

SEQ ID NO: 213408 - RNA, 19 nt, Human
uacuguucuuccuaacugg

SEQ ID NO: 213409 - RNA, 19 nt, Human
uauguguauaauauguguu

SEQ ID NO: 213410 - RNA, 18 nt, Human
ucccaaugccagcaacuc

SEQ ID NO: 213411 - RNA, 22 nt, Human
ucccucacggccagagccgggg

SEQ ID NO: 213412 - RNA, 24 nt, Human
ucccucacggccagagccgggggc

SEQ ID NO: 213413 - RNA, 24 nt, Human
ugaaaauuauuuauuuaauaauac

SEQ ID NO: 213414 - RNA, 19 nt, Human
ugaggacugggagagggcg

SEQ ID NO: 213415 - RNA, 22 nt, Human
uggccaaaacccuaaaaguaaa

SEQ ID NO: 213416 - RNA, 23 nt, Human
uggccucccaaugccagcaacuc

SEQ ID NO: 213417 - RNA, 21 nt, Human
ugggagagggcgcguuguugg

SEQ ID NO: 213418 - RNA, 23 nt, Human
ugggagagggcgcguuguuggag

SEQ ID NO: 213419 - RNA, 23 nt, Human
ugggagagggcgcguuguugggg

SEQ ID NO: 213420 - RNA, 24 nt, Human
uggggcgccggcucggcggggagg

SEQ ID NO: 213421 - RNA, 23 nt, Human
ugucagaaguuuuucccuuuugg

SEQ ID NO: 213422 - RNA, 19 nt, Human
ugugaggacugggagaggg

SEQ ID NO: 213423 - RNA, 20 nt, Human
uguucuaccuuaacagcaag

SEQ ID NO: 213424 - RNA, 22 nt, Human
uucaagccugacgcucucccac

SEQ ID NO: 213425 - RNA, 21 nt, Human
uucccuuuuggaggcuucuuu

SEQ ID NO: 213426 - RNA, 23 nt, Human
uuggccaaaacccuaaaaguaaa

SEQ ID NO: 213427 - RNA, 27 nt, Human
uuuaauacuguuuaacauuugaaaauu

SEQ ID NO: 213428 - RNA, 25 nt, Human
uuuuggaggcuucuuuuuuccauuc

SEQ ID NO: 213429 - RNA, 19 nt, Human
aaaaccugaaaaaacagaa

SEQ ID NO: 213430 - RNA, 27 nt, Human
aaagaaagcacuccuggcguucacuga

SEQ ID NO: 213431 - RNA, 21 nt, Human
acaagccucaucaguaaaacc

SEQ ID NO: 213432 - RNA, 19 nt, Human
agcaaauggaaagaauaua

SEQ ID NO: 213433 - RNA, 25 nt, Human
aggcgugcuuccgugugugcgugcc

SEQ ID NO: 213434 - RNA, 28 nt, Human
caaagaaagcacuccuggcguucacuga

SEQ ID NO: 213435 - RNA, 23 nt, Human
caaauggaaagaauauaaaugca

SEQ ID NO: 213436 - RNA, 24 nt, Human
caguaguagagaucacaaacauua

SEQ ID NO: 213437 - RNA, 22 nt, Human
cgggacucucgcugcgaacccu

SEQ ID NO: 213438 - RNA, 21 nt, Human
ggacucgagcugccgcggcgg

SEQ ID NO: 213439 - RNA, 18 nt, Human
ggccucacaagccucauc

SEQ ID NO: 213440 - RNA, 22 nt, Human
guaaaccugcucauuucuagac

SEQ ID NO: 213441 - RNA, 20 nt, Human
uacacaaguugcaaagaaag

SEQ ID NO: 213442 - RNA, 24 nt, Human
uagaacaguacuuguaaaccugcu

SEQ ID NO: 213443 - RNA, 21 nt, Human
ucaucuaucacugcugauuuc

SEQ ID NO: 213444 - RNA, 25 nt, Human
ugaaaaaacagaaaauguuacacaa

SEQ ID NO: 213445 - RNA, 24 nt, Human
ugacaugauagcaaauggaaagaa

SEQ ID NO: 213446 - RNA, 23 nt, Human
uggaaagaauauaaaugcaacag

SEQ ID NO: 213447 - RNA, 30 nt, Human
uucaucuaucacugcugauuuccuuugacu

SEQ ID NO: 213448 - RNA, 25 nt, Human
uucuagacaaguccgggacucucgc

SEQ ID NO: 213449 - RNA, 22 nt, Human
uuuaugaaaaucuuccuaaacc

SEQ ID NO: 213450 - RNA, 26 nt, Human
aaacaaguuccaaauuuuugaccugg

SEQ ID NO: 213451 - RNA, 21 nt, Human
aaagaaaaaaaaguuggccua

SEQ ID NO: 213452 - RNA, 24 nt, Human
aaagaaaaaaaaguuggccuaggg

SEQ ID NO: 213453 - RNA, 22 nt, Human
aaauuuaauugcaaaaacaacc

SEQ ID NO: 213454 - RNA, 21 nt, Human
aacagaauccagcggcaauga

SEQ ID NO: 213455 - RNA, 21 nt, Human
aaccugaagcaaaaguacaga

SEQ ID NO: 213456 - RNA, 25 nt, Human
aagcaaaaguacagaaugcugaguu

SEQ ID NO: 213457 - RNA, 20 nt, Human
aauaagaaacaaguuccaaa

SEQ ID NO: 213458 - RNA, 21 nt, Human
acauccaaaacacauauccau

SEQ ID NO: 213459 - RNA, 21 nt, Human
accaagcauaucauacaucca

SEQ ID NO: 213460 - RNA, 23 nt, Human
auccaaaacacauauccauugau

SEQ ID NO: 213461 - RNA, 19 nt, Human
augagucaccaaaucuggg

SEQ ID NO: 213462 - RNA, 20 nt, Human
augguaacgugaaauaaaaa

SEQ ID NO: 213463 - RNA, 22 nt, Human
auuuaauugcaaaaacaaccug

SEQ ID NO: 213464 - RNA, 18 nt, Human
caaaauuucaggggacca

SEQ ID NO: 213465 - RNA, 23 nt, Human
cacaaucaaaucaguauaaacac

SEQ ID NO: 213466 - RNA, 22 nt, Human
caccuauauacuaagucaaaau

SEQ ID NO: 213467 - RNA, 20 nt, Human
caguauaaacaccuuuaaaa

SEQ ID NO: 213468 - RNA, 21 nt, Human
cauaguaaaauaagaaacaag

SEQ ID NO: 213469 - RNA, 25 nt, Human
cauaguaaaauaagaaacaaguucc

SEQ ID NO: 213470 - RNA, 23 nt, Human
ccaaauuuuugaccuggacaaag

SEQ ID NO: 213471 - RNA, 24 nt, Human
cccacaauaagccaugcuaucuga

SEQ ID NO: 213472 - RNA, 19 nt, Human
ccuaaaguacauucuuaca

SEQ ID NO: 213473 - RNA, 21 nt, Human
cucgucucuuccggagguaga

SEQ ID NO: 213474 - RNA, 22 nt, Human
cucugcaccuauauacuaaguc

SEQ ID NO: 213475 - RNA, 25 nt, Human
cugcagagcaaugaccacuaagaaa

SEQ ID NO: 213476 - RNA, 19 nt, Human
gaaaugcccacaauaagcc

SEQ ID NO: 213477 - RNA, 25 nt, Human
gaccacuaagaaauauuuuuaaagg

SEQ ID NO: 213478 - RNA, 21 nt, Human
gaggacguccggcuagcucug

SEQ ID NO: 213479 - RNA, 23 nt, Human
gcauaucauacauccaaaacaca

SEQ ID NO: 213480 - RNA, 19 nt, Human
gugucucugcaccuauaua

SEQ ID NO: 213481 - RNA, 21 nt, Human
uaaagcaaauccaaacagaca

SEQ ID NO: 213482 - RNA, 30 nt, Human
uaaguacaugugaucaacaguacaaauaaa

SEQ ID NO: 213483 - RNA, 22 nt, Human
uaagugggugucucugcaccua

SEQ ID NO: 213484 - RNA, 19 nt, Human
uagaaauaguuucuucucu

SEQ ID NO: 213485 - RNA, 25 nt, Human
uagcagucaaaccuuaguaucacac

SEQ ID NO: 213486 - RNA, 20 nt, Human
uauccauugaugagucacca

SEQ ID NO: 213487 - RNA, 21 nt, Human
ucuauuguaacuaggaauuac

SEQ ID NO: 213488 - RNA, 19 nt, Human
ucucugcaaagaaaaaaaa

SEQ ID NO: 213489 - RNA, 24 nt, Human
ugaaacuaaagagaaauguuuuuc

SEQ ID NO: 213490 - RNA, 26 nt, Human
ugaaacuaaagagaaauguuuuucca

SEQ ID NO: 213491 - RNA, 19 nt, Human
ugaagaauaaaacaaaaaa

SEQ ID NO: 213492 - RNA, 24 nt, Human
ugagucaccaaaucuggggaaaag

SEQ ID NO: 213493 - RNA, 22 nt, Human
ugcaaagaaaaaaaaguuggcc

SEQ ID NO: 213494 - RNA, 22 nt, Human
ugcaaagaaaaaaaaguuggcc

SEQ ID NO: 213495 - RNA, 21 nt, Human
ugcccacaauaagccaugcua

SEQ ID NO: 213496 - RNA, 24 nt, Human
ugcuuuuuauuauagaaauaguuu

SEQ ID NO: 213497 - RNA, 25 nt, Human
uggguauguuuccuaaaguacauuc

SEQ ID NO: 213498 - RNA, 24 nt, Human
ugggugucucugcaccuauauacu

SEQ ID NO: 213499 - RNA, 26 nt, Human
uuacuuuauguaucuauuguaacuag

SEQ ID NO: 213500 - RNA, 19 nt, Human
uucaaaccugaagcaaaag

SEQ ID NO: 213501 - RNA, 23 nt, Human
uuccuggguauguuuccuaaagu

SEQ ID NO: 213502 - RNA, 21 nt, Human
uugaguucugcagagcaauga

SEQ ID NO: 213503 - RNA, 24 nt, Human
uuuuuaaaucagugaaacaaacau

SEQ ID NO: 213504 - RNA, 23 nt, Human
uuuuuuuuuuuuuuuuaaguuuu

SEQ ID NO: 213505 - RNA, 19 nt, Human
uuuuuuuuuuuuuuuuuaa

SEQ ID NO: 213506 - RNA, 22 nt, Human
aaacagcuaaacaccaaauccu

SEQ ID NO: 213507 - RNA, 20 nt, Human
aaggcgccccgaccccgccg

SEQ ID NO: 213508 - RNA, 19 nt, Human
aaguacuccggggggaggg

SEQ ID NO: 213509 - RNA, 23 nt, Human
acuguagcgugacaacucccucu

SEQ ID NO: 213510 - RNA, 21 nt, Human
agaaacagcuaaacaccaaau

SEQ ID NO: 213511 - RNA, 23 nt, Human
agaaacagcuaaacaccaaaucc

SEQ ID NO: 213512 - RNA, 21 nt, Human
agaacacguacuaaccugaaa

SEQ ID NO: 213513 - RNA, 21 nt, Human
agaagaacacguacuaaccug

SEQ ID NO: 213514 - RNA, 24 nt, Human
agcauggcgaagccccaucucugu

SEQ ID NO: 213515 - RNA, 20 nt, Human
agccugggcagcauggcgaa

SEQ ID NO: 213516 - RNA, 24 nt, Human
agccugggcagcauggcgaagccc

SEQ ID NO: 213517 - RNA, 23 nt, Human
aggacuucaagaccagccugggc

SEQ ID NO: 213518 - RNA, 21 nt, Human
agggccaccuccccaggagcc

SEQ ID NO: 213519 - RNA, 18 nt, Human
aggucaggacuucaagac

SEQ ID NO: 213520 - RNA, 20 nt, Human
cacagcagcccagggaggcc

SEQ ID NO: 213521 - RNA, 20 nt, Human
cacagcagcccagggaggcc

SEQ ID NO: 213522 - RNA, 21 nt, Human
cagcagcccagggaggccuug

SEQ ID NO: 213523 - RNA, 23 nt, Human
cagcccagggaggccuugggagc

SEQ ID NO: 213524 - RNA, 18 nt, Human
cauggcgaagccccaucu

SEQ ID NO: 213525 - RNA, 19 nt, Human
cauggcgaagccccaucuc

SEQ ID NO: 213526 - RNA, 23 nt, Human
cauggcgaagccccaucucuguc

SEQ ID NO: 213527 - RNA, 19 nt, Human
ccaccuccccaggagccca

SEQ ID NO: 213528 - RNA, 21 nt, Human
ccagaagccgcggccucuucu

SEQ ID NO: 213529 - RNA, 18 nt, Human
ccaggagcagagcgugag

SEQ ID NO: 213530 - RNA, 21 nt, Human
ccaucucugucuccccggaga

SEQ ID NO: 213531 - RNA, 19 nt, Human
cccacagcagcccagggag

SEQ ID NO: 213532 - RNA, 22 nt, Human
ccccggagacccggagccgcuu

SEQ ID NO: 213533 - RNA, 20 nt, Human
ccgcuggccauugcagaagg

SEQ ID NO: 213534 - RNA, 20 nt, Human
ccggagccgcuggccauugc

SEQ ID NO: 213535 - RNA, 24 nt, Human
ccucugugcagugguaaaucacuc

SEQ ID NO: 213536 - RNA, 24 nt, Human
ccugggcagcauggcgaagcccca

SEQ ID NO: 213537 - RNA, 20 nt, Human
ccuguaaucccagcacuuug

SEQ ID NO: 213538 - RNA, 24 nt, Human
cgauccgcuuuaucagcaguucua

SEQ ID NO: 213539 - RNA, 19 nt, Human
cgccccgaccccgccggcc

SEQ ID NO: 213540 - RNA, 22 nt, Human
cuaaccugaaaaaggcuacgug

SEQ ID NO: 213541 - RNA, 18 nt, Human
cuccgaauucaagcugug

SEQ ID NO: 213542 - RNA, 19 nt, Human
cuucaagaccagccugggc

SEQ ID NO: 213543 - RNA, 23 nt, Human
cuucaagaccagccugggcagca

SEQ ID NO: 213544 - RNA, 21 nt, Human
gccaccuccccaggagcccac

SEQ ID NO: 213545 - RNA, 20 nt, Human
gccggcccguguacagccgc

SEQ ID NO: 213546 - RNA, 23 nt, Human
gccugggcagcauggcgaagccc

SEQ ID NO: 213547 - RNA, 18 nt, Human
gccuguaaucccagcacu

SEQ ID NO: 213548 - RNA, 20 nt, Human
gcugugggugagcacacacu

SEQ ID NO: 213549 - RNA, 23 nt, Human
ggagacccggagccgcuggccau

SEQ ID NO: 213550 - RNA, 21 nt, Human
ggagcagagcgugagccacug

SEQ ID NO: 213551 - RNA, 21 nt, Human
ggagcagagcgugagccacug

SEQ ID NO: 213552 - RNA, 21 nt, Human
ggcugugggugagcacacacu

SEQ ID NO: 213553 - RNA, 22 nt, Human
uauuuugauuuauugcauucug

SEQ ID NO: 213554 - RNA, 19 nt, Human
ucacaggagauuugaguuu

SEQ ID NO: 213555 - RNA, 23 nt, Human
uccccaggagcccacagcagccc

SEQ ID NO: 213556 - RNA, 26 nt, Human
uccgaauucaagcugugcacaaaauu

SEQ ID NO: 213557 - RNA, 24 nt, Human
ugcaaggcugaggugcgccgaucg

SEQ ID NO: 213558 - RNA, 19 nt, Human
ugcgccgaucgcuuugagg

SEQ ID NO: 213559 - RNA, 23 nt, Human
ugcgccgaucgcuuugaggucag

SEQ ID NO: 213560 - RNA, 21 nt, Human
uggcauggagcgugggccacg

SEQ ID NO: 213561 - RNA, 22 nt, Human
uggcccugacagaagaacacgu

SEQ ID NO: 213562 - RNA, 22 nt, Human
ugggcagcauggcgaagcccca

SEQ ID NO: 213563 - RNA, 26 nt, Human
uugcaaggcugaggugcgccgaucga

SEQ ID NO: 213564 - RNA, 23 nt, Human
uuggccccagaagccgcggccuc

SEQ ID NO: 213565 - RNA, 23 nt, Human
uuugaggucaggacuucaagacc

SEQ ID NO: 213566 - RNA, 18 nt, Human
aaaguggacacuggggug

SEQ ID NO: 213567 - RNA, 21 nt, Human
aaggagcuggagaacccguag

SEQ ID NO: 213568 - RNA, 22 nt, Human
aaggagcuggagaacccguagg

SEQ ID NO: 213569 - RNA, 22 nt, Human
acagcgccguccgccucccugc

SEQ ID NO: 213570 - RNA, 23 nt, Human
acaggagaagccaggaggggccg

SEQ ID NO: 213571 - RNA, 18 nt, Human
accccguccccuucccug

SEQ ID NO: 213572 - RNA, 20 nt, Human
accccguccccuucccugcc

SEQ ID NO: 213573 - RNA, 22 nt, Human
agaaccccguccccuucccugc

SEQ ID NO: 213574 - RNA, 24 nt, Human
agagcagggccaggagagcaccau

SEQ ID NO: 213575 - RNA, 20 nt, Human
aggagaagggaggaaugguu

SEQ ID NO: 213576 - RNA, 18 nt, Human
aggcaggcggccaugacc

SEQ ID NO: 213577 - RNA, 21 nt, Human
aggcaggcggccaugaccagg

SEQ ID NO: 213578 - RNA, 21 nt, Human
aggcggccaugaccagggcag

SEQ ID NO: 213579 - RNA, 26 nt, Human
aggcuggagcaggcugcagcaagaaa

SEQ ID NO: 213580 - RNA, 20 nt, Human
aggugcccuacaggagaagc

SEQ ID NO: 213581 - RNA, 21 nt, Human
agugaguggcccuccaugcgg

SEQ ID NO: 213582 - RNA, 24 nt, Human
caagaaagauccuaaggcagcgca

SEQ ID NO: 213583 - RNA, 21 nt, Human
cagcgccguccgccucccugc

SEQ ID NO: 213584 - RNA, 23 nt, Human
cagcucagggcgggcgagccugg

SEQ ID NO: 213585 - RNA, 23 nt, Human
caggcugcagcaagaaagauccu

SEQ ID NO: 213586 - RNA, 18 nt, Human
cagggccggggaaggggg

SEQ ID NO: 213587 - RNA, 22 nt, Human
cauccccuccaccaccucggcc

SEQ ID NO: 213588 - RNA, 20 nt, Human
ccagggacaggggagcggcc

SEQ ID NO: 213589 - RNA, 23 nt, Human
ccagggccggggaagggggcaga

SEQ ID NO: 213590 - RNA, 20 nt, Human
cccagggccggggaaggggg

SEQ ID NO: 213591 - RNA, 21 nt, Human
cccagggccggggaagggggc

SEQ ID NO: 213592 - RNA, 23 nt, Human
cccauggccagggacaggggagc

SEQ ID NO: 213593 - RNA, 22 nt, Human
cccccgggagcaguccugacuc

SEQ ID NO: 213594 - RNA, 24 nt, Human
ccccguccccuucccugccguccg

SEQ ID NO: 213595 - RNA, 19 nt, Human
cccucaggaccuccccucc

SEQ ID NO: 213596 - RNA, 18 nt, Human
cccuccaccaccucggcc

SEQ ID NO: 213597 - RNA, 20 nt, Human
ccgcagcucagggcgggcga

SEQ ID NO: 213598 - RNA, 23 nt, Human
ccgccugccccuggggugggggc

SEQ ID NO: 213599 - RNA, 23 nt, Human
ccggggccccggcugggcaguga

SEQ ID NO: 213600 - RNA, 23 nt, Human
ccgucucgugucccggguguugc

SEQ ID NO: 213601 - RNA, 27 nt, Human
ccucucugccuggaaaggagcuggaga

SEQ ID NO: 213602 - RNA, 21 nt, Human
ccugcagcagucgggcgcugu

SEQ ID NO: 213603 - RNA, 18 nt, Human
ccugccccuggggugggg

SEQ ID NO: 213604 - RNA, 23 nt, Human
cgcagguccugagagccuggcug

SEQ ID NO: 213605 - RNA, 23 nt, Human
cggaacagcgccguccgccuccc

SEQ ID NO: 213606 - RNA, 23 nt, Human
cggcccgggaagggccagagcag

SEQ ID NO: 213607 - RNA, 24 nt, Human
cggccugcagcagucgggcgcugu

SEQ ID NO: 213608 - RNA, 22 nt, Human
cgggggcggggcaggggaaucc

SEQ ID NO: 213609 - RNA, 22 nt, Human
cuagacucgguucgucucuccc

SEQ ID NO: 213610 - RNA, 21 nt, Human
cucagggcgggcgagccugga

SEQ ID NO: 213611 - RNA, 19 nt, Human
cucccaucccagauucagc

SEQ ID NO: 213612 - RNA, 21 nt, Human
cugcagcaagaaagauccuaa

SEQ ID NO: 213613 - RNA, 19 nt, Human
cuggacaccaacaccugcc

SEQ ID NO: 213614 - RNA, 20 nt, Human
cuggaggcucccggggcccc

SEQ ID NO: 213615 - RNA, 20 nt, Human
cuggcuggucucggaggggg

SEQ ID NO: 213616 - RNA, 24 nt, Human
gaaagaaccccguccccuucccug

SEQ ID NO: 213617 - RNA, 18 nt, Human
gacucugcaggggaugcc

SEQ ID NO: 213618 - RNA, 19 nt, Human
gacugggcuccgccugggc

SEQ ID NO: 213619 - RNA, 18 nt, Human
gagcaggacccaagggua

SEQ ID NO: 213620 - RNA, 21 nt, Human
gagcaguccugacucugcagg

SEQ ID NO: 213621 - RNA, 24 nt, Human
gagcaguccugacucugcagggga

SEQ ID NO: 213622 - RNA, 21 nt, Human
gagcggccugaggagcaggac

SEQ ID NO: 213623 - RNA, 22 nt, Human
gagcggccugaggagcaggacc

SEQ ID NO: 213624 - RNA, 19 nt, Human
gaggggcagcaguccccuc

SEQ ID NO: 213625 - RNA, 24 nt, Human
gcagcaguccccucaggaccuccc

SEQ ID NO: 213626 - RNA, 18 nt, Human
gcagcagucgggcgcugu

SEQ ID NO: 213627 - RNA, 18 nt, Human
gcagccuggcccccggga

SEQ ID NO: 213628 - RNA, 22 nt, Human
gcagggccaggagagcaccauu

SEQ ID NO: 213629 - RNA, 19 nt, Human
gccaggaggggccgccugc

SEQ ID NO: 213630 - RNA, 22 nt, Human
ggaccuccccuccucucugccu

SEQ ID NO: 213631 - RNA, 21 nt, Human
ggaggccgcagcucagggcgg

SEQ ID NO: 213632 - RNA, 19 nt, Human
ggcagugagcgcagcccgg

SEQ ID NO: 213633 - RNA, 19 nt, Human
ggcgggcgagccuggaggc

SEQ ID NO: 213634 - RNA, 22 nt, Human
gggccagagcagggccaggaga

SEQ ID NO: 213635 - RNA, 20 nt, Human
gggcgggcgagccuggaggc

SEQ ID NO: 213636 - RNA, 22 nt, Human
gggcggggccucgugccggggg

SEQ ID NO: 213637 - RNA, 19 nt, Human
gucuccuggccccuuccga

SEQ ID NO: 213638 - RNA, 19 nt, Human
uaaagccuucgacugcagc

SEQ ID NO: 213639 - RNA, 18 nt, Human
uagcccugcgaaggcgau

SEQ ID NO: 213640 - RNA, 18 nt, Human
ucccagggcagccuggcc

SEQ ID NO: 213641 - RNA, 22 nt, Human
ucccagggcagccuggcccccg

SEQ ID NO: 213642 - RNA, 23 nt, Human
uccccuccaccaccucggccucc

SEQ ID NO: 213643 - RNA, 19 nt, Human
ucccgaggaggggcggggc

SEQ ID NO: 213644 - RNA, 19 nt, Human
ucccggggccccggcuggg

SEQ ID NO: 213645 - RNA, 20 nt, Human
ugaggagaagggaggaaugg

SEQ ID NO: 213646 - RNA, 21 nt, Human
ugagggggagaggugucccua

SEQ ID NO: 213647 - RNA, 20 nt, Human
ugccuggaaaggagcuggag

SEQ ID NO: 213648 - RNA, 20 nt, Human
ugcugggaggcuaggggcag

SEQ ID NO: 213649 - RNA, 22 nt, Human
uggaaaggagcuggagaacccg

SEQ ID NO: 213650 - RNA, 19 nt, Human
uggacaccaacaccugcca

SEQ ID NO: 213651 - RNA, 18 nt, Human
uggcuggcuggucucgga

SEQ ID NO: 213652 - RNA, 21 nt, Human
ugggacuggaaagaaccccgu

SEQ ID NO: 213653 - RNA, 26 nt, Human
ugggaggcuaggggcagggaggugcc

SEQ ID NO: 213654 - RNA, 18 nt, Human
ugggcagugagcgcagcc

SEQ ID NO: 213655 - RNA, 21 nt, Human
ugggcagugagcgcagcccgg

SEQ ID NO: 213656 - RNA, 19 nt, Human
uggggugggggccaggcug

SEQ ID NO: 213657 - RNA, 21 nt, Human
uguagcgagguccaaucuagg

SEQ ID NO: 213658 - RNA, 18 nt, Human
uguugccgggcuccgggc

SEQ ID NO: 213659 - RNA, 19 nt, Human
acaaucacagaacaaccuc

SEQ ID NO: 213660 - RNA, 20 nt, Human
acagaacaaccucaaaucuc

SEQ ID NO: 213661 - RNA, 22 nt, Human
agguggaagcaaaccuggcuua

SEQ ID NO: 213662 - RNA, 21 nt, Human
cagaacaaccucaaaucucau

SEQ ID NO: 213663 - RNA, 23 nt, Human
cagucccuaaacaauaaguaagc

SEQ ID NO: 213664 - RNA, 19 nt, Human
cucaaaucucauuaaaaag

SEQ ID NO: 213665 - RNA, 23 nt, Human
cuuuuuuuucagaauuuacuggu

SEQ ID NO: 213666 - RNA, 20 nt, Human
gaaccucaguuucuuuuaaa

SEQ ID NO: 213667 - RNA, 21 nt, Human
gaaccucaguuucuuuuaaag

SEQ ID NO: 213668 - RNA, 21 nt, Human
uaaaauuuucagggaaggugg

SEQ ID NO: 213669 - RNA, 22 nt, Human
uaagcaguaguugcguauaaaa

SEQ ID NO: 213670 - RNA, 24 nt, Human
uaaguaagcuaugcuuguugcaaa

SEQ ID NO: 213671 - RNA, 23 nt, Human
uacacacuacauacauucaugcg

SEQ ID NO: 213672 - RNA, 24 nt, Human
uacacacuacauacauucaugcgg

SEQ ID NO: 213673 - RNA, 21 nt, Human
uacacucacuacagugccuac

SEQ ID NO: 213674 - RNA, 18 nt, Human
uaguacaacuucgcccuu

SEQ ID NO: 213675 - RNA, 19 nt, Human
uaucagacguaguguggag

SEQ ID NO: 213676 - RNA, 20 nt, Human
uccauuuuccuugagaaggc

SEQ ID NO: 213677 - RNA, 22 nt, Human
ucucccaacauagcaucuucuu

SEQ ID NO: 213678 - RNA, 20 nt, Human
ucuggauuuugaugacccau

SEQ ID NO: 213679 - RNA, 23 nt, Human
ucuuuuuuuucagaauuuacugg

SEQ ID NO: 213680 - RNA, 18 nt, Human
ugaggauaaccuucuugg

SEQ ID NO: 213681 - RNA, 19 nt, Human
ugccuacacacuacauaca

SEQ ID NO: 213682 - RNA, 18 nt, Human
ugccugucuccauuuucc

SEQ ID NO: 213683 - RNA, 20 nt, Human
ugccugucuccauuuuccuu

SEQ ID NO: 213684 - RNA, 18 nt, Human
uggaagcaaaccuggcuu

SEQ ID NO: 213685 - RNA, 25 nt, Human
uguaguaacaagaaaaguaagauuu

SEQ ID NO: 213686 - RNA, 21 nt, Human
ugugcugauucucaguguuga

SEQ ID NO: 213687 - RNA, 20 nt, Human
uguguaucugaaccucaguu

SEQ ID NO: 213688 - RNA, 18 nt, Human
uguucagucccuaaacaa

SEQ ID NO: 213689 - RNA, 20 nt, Human
uguucagucccuaaacaaua

SEQ ID NO: 213690 - RNA, 24 nt, Human
uuccaugguauguguaucugaacc

SEQ ID NO: 213691 - RNA, 23 nt, Human
uuugugcauugguaauucugaua

SEQ ID NO: 213692 - RNA, 23 nt, Human
uuuucagaauuuacugguugcca

SEQ ID NO: 213693 - RNA, 18 nt, Human
aaaggaaugaggagagga

SEQ ID NO: 213694 - RNA, 23 nt, Human
aacuuccaauaacaaagaguuau

SEQ ID NO: 213695 - RNA, 24 nt, Human
aauaacaaagaguuauaggaaaga

SEQ ID NO: 213696 - RNA, 23 nt, Human
caauaacaaagaguuauaggaaa

SEQ ID NO: 213697 - RNA, 24 nt, Human
ccaaauccuugaaacuuccaauaa

SEQ ID NO: 213698 - RNA, 30 nt, Human
ccaaauccuugaaacuuccaauaacaaagg

SEQ ID NO: 213699 - RNA, 25 nt, Human
gggccaaaaccaaaggaaugaggag

SEQ ID NO: 213700 - RNA, 20 nt, Human
uaggaaagaccuaacauuua

SEQ ID NO: 213701 - RNA, 26 nt, Human
uauaggaaagaccuaacauuuaaaag

SEQ ID NO: 213702 - RNA, 20 nt, Human
uccuugaaacuuccaauaac

SEQ ID NO: 213703 - RNA, 27 nt, Human
ugagaaugaacaaccacuucaaaacca

SEQ ID NO: 213704 - RNA, 21 nt, Human
uuauaggaaagaccuaacauu

SEQ ID NO: 213705 - RNA, 20 nt, Human
aaaaggcaaacagaaucacu

SEQ ID NO: 213706 - RNA, 25 nt, Human
aaacaaaaggcaaacagaagggacc

SEQ ID NO: 213707 - RNA, 23 nt, Human
aaacaaaaggcaaacagaauccu

SEQ ID NO: 213708 - RNA, 21 nt, Human
aaacagagcccccaaagccuu

SEQ ID NO: 213709 - RNA, 19 nt, Human
aaauauacuacuagaggaa

SEQ ID NO: 213710 - RNA, 22 nt, Human
aacagagcccccaaagccuuga

SEQ ID NO: 213711 - RNA, 19 nt, Human
aacucgccaccucucucug

SEQ ID NO: 213712 - RNA, 23 nt, Human
aagaaaucagucugagacuuaag

SEQ ID NO: 213713 - RNA, 20 nt, Human
aagcauuuuaaaauggccau

SEQ ID NO: 213714 - RNA, 19 nt, Human
aauaagugagaacaauaau

SEQ ID NO: 213715 - RNA, 20 nt, Human
accugccacaguccucucca

SEQ ID NO: 213716 - RNA, 24 nt, Human
agaacgcgcaggggcgccuucccg

SEQ ID NO: 213717 - RNA, 22 nt, Human
aggaaaguuuccccaacagcca

SEQ ID NO: 213718 - RNA, 22 nt, Human
aggcaaacagaaucacugccau

SEQ ID NO: 213719 - RNA, 18 nt, Human
auaaauuaaagaugggua

SEQ ID NO: 213720 - RNA, 20 nt, Human
auagaacgcgcaggggcgcc

SEQ ID NO: 213721 - RNA, 23 nt, Human
auggcagcaagaaacacauuuac

SEQ ID NO: 213722 - RNA, 21 nt, Human
caaaacagagcccccaaagcc

SEQ ID NO: 213723 - RNA, 24 nt, Human
caaaacagagcccccaaagccuug

SEQ ID NO: 213724 - RNA, 19 nt, Human
caaaggcagcaauguaaua

SEQ ID NO: 213725 - RNA, 19 nt, Human
cacauacagcaggaagcac

SEQ ID NO: 213726 - RNA, 18 nt, Human
cacccggggcggccaggu

SEQ ID NO: 213727 - RNA, 21 nt, Human
caccucucucugacacccggg

SEQ ID NO: 213728 - RNA, 26 nt, Human
cagguccucucaccugccacaguccu

SEQ ID NO: 213729 - RNA, 18 nt, Human
caucugcugacugcacuu

SEQ ID NO: 213730 - RNA, 21 nt, Human
caugacuugagguuccuugaa

SEQ ID NO: 213731 - RNA, 21 nt, Human
ccaaagccuugacugaccucg

SEQ ID NO: 213732 - RNA, 20 nt, Human
ccaacucuuccguuucccua

SEQ ID NO: 213733 - RNA, 22 nt, Human
ccacauucaaaacagagccccc

SEQ ID NO: 213734 - RNA, 23 nt, Human
ccagcgaucugcccgcgcccccc

SEQ ID NO: 213735 - RNA, 23 nt, Human
ccccacccaacucuuccguuucc

SEQ ID NO: 213736 - RNA, 25 nt, Human
ccccacccaacucuuccguuucccu

SEQ ID NO: 213737 - RNA, 18 nt, Human
cccgcaagaaaucagucu

SEQ ID NO: 213738 - RNA, 21 nt, Human
ccucacaccaggcgccugucc

SEQ ID NO: 213739 - RNA, 24 nt, Human
cuauauuuguaguuucuaaaaugc

SEQ ID NO: 213740 - RNA, 22 nt, Human
cucaccugccacaguccucucc

SEQ ID NO: 213741 - RNA, 18 nt, Human
cuccaagccagcgaucug

SEQ ID NO: 213742 - RNA, 22 nt, Human
cuccuugcaccucaacaaaggc

SEQ ID NO: 213743 - RNA, 21 nt, Human
cuucccggcagaggcgucuag

SEQ ID NO: 213744 - RNA, 21 nt, Human
gaacucgccaccucucucuga

SEQ ID NO: 213745 - RNA, 18 nt, Human
gaguggugauccacauuc

SEQ ID NO: 213746 - RNA, 18 nt, Human
gcaagaaaucagucugag

SEQ ID NO: 213747 - RNA, 20 nt, Human
gcaccucaacaaaggcagcc

SEQ ID NO: 213748 - RNA, 18 nt, Human
guuccuauaaaauucgcu

SEQ ID NO: 213749 - RNA, 20 nt, Human
uaaaaaagcuaaaugaaaua

SEQ ID NO: 213750 - RNA, 23 nt, Human
uaagacaaauuuuaaaaguuacu

SEQ ID NO: 213751 - RNA, 26 nt, Human
uaccaaugaaaacaaaaggcaaacag

SEQ ID NO: 213752 - RNA, 23 nt, Human
uacuauaggcuguauuuuuggcg

SEQ ID NO: 213753 - RNA, 19 nt, Human
uacuggggggcugaggcgg

SEQ ID NO: 213754 - RNA, 21 nt, Human
uauuuuguccuccucacacca

SEQ ID NO: 213755 - RNA, 25 nt, Human
ucaaaacagagcccccaaagccuug

SEQ ID NO: 213756 - RNA, 22 nt, Human
ucaauuuuuuuuuuugccccca

SEQ ID NO: 213757 - RNA, 19 nt, Human
uccacauucaaaacagagc

SEQ ID NO: 213758 - RNA, 28 nt, Human
uccacauucaaaacagagcccccaaagc

SEQ ID NO: 213759 - RNA, 25 nt, Human
ucggggacagcggucaauuuuuuuu

SEQ ID NO: 213760 - RNA, 21 nt, Human
ugacccagggucugaauacag

SEQ ID NO: 213761 - RNA, 19 nt, Human
ugauagcaaaagcaugacu

SEQ ID NO: 213762 - RNA, 18 nt, Human
ugcgcagccuuguaaaca

SEQ ID NO: 213763 - RNA, 25 nt, Human
uguaccaaugaaaacaaaaggcaaa

SEQ ID NO: 213764 - RNA, 24 nt, Human
uuauuuuguccuccucacaccagg

SEQ ID NO: 213765 - RNA, 20 nt, Human
uucacaacagcaucugcuga

SEQ ID NO: 213766 - RNA, 23 nt, Human
uugaguuuagucccccuccuccc

SEQ ID NO: 213767 - RNA, 23 nt, Human
uuuaaaauggccauuuggggaac

SEQ ID NO: 213768 - RNA, 20 nt, Human
uuuguaguuucuaaaaugcu

SEQ ID NO: 213769 - RNA, 20 nt, Human
uuuuuuuuuugcccccaccc

SEQ ID NO: 213770 - RNA, 23 nt, Human
uuuuuuuuuuuuuuuuuuguguu

SEQ ID NO: 213771 - RNA, 27 nt, Human
uuuuuuuuuuuuuuuuuuuuuuugggg

SEQ ID NO: 213772 - RNA, 23 nt, Human
aaauaacccuuuaaaauguggau

SEQ ID NO: 213773 - RNA, 27 nt, Human
aagcaaacggauuauauaauagucaaa

SEQ ID NO: 213774 - RNA, 23 nt, Human
acccuaaaacauuuucugaaagc

SEQ ID NO: 213775 - RNA, 26 nt, Human
acccuaaaacauuuucugaaagcaaa

SEQ ID NO: 213776 - RNA, 22 nt, Human
cauccagcagccgcacaugcac

SEQ ID NO: 213777 - RNA, 19 nt, Human
caugcaccggccgcggccg

SEQ ID NO: 213778 - RNA, 20 nt, Human
ccgccgcgggcccucagcuc

SEQ ID NO: 213779 - RNA, 19 nt, Human
ccgcgccgucgccgccgcc

SEQ ID NO: 213780 - RNA, 18 nt, Human
ccgucgccgccgccuccg

SEQ ID NO: 213781 - RNA, 20 nt, Human
ccuccgcauccagcagccgc

SEQ ID NO: 213782 - RNA, 19 nt, Human
cgccgccgccuccgcaucc

SEQ ID NO: 213783 - RNA, 20 nt, Human
cgccgccgccuccgcaucca

SEQ ID NO: 213784 - RNA, 20 nt, Human
cgccgucgccgccgccuccg

SEQ ID NO: 213785 - RNA, 20 nt, Human
cuccgcauccagcagccgca

SEQ ID NO: 213786 - RNA, 22 nt, Human
gcauccagcagccgcacaugca

SEQ ID NO: 213787 - RNA, 18 nt, Human
gcccucagcucagcuugg

SEQ ID NO: 213788 - RNA, 23 nt, Human
gccgauccgcgccgucgccgccg

SEQ ID NO: 213789 - RNA, 21 nt, Human
uccgcgccgucgccgccgccu

SEQ ID NO: 213790 - RNA, 23 nt, Human
uccgcgccgucgccgccgccucc

SEQ ID NO: 213791 - RNA, 24 nt, Human
uccgcgccgucgccgccgccuccg

SEQ ID NO: 213792 - RNA, 20 nt, Human
ucgccgccgccuccgcaucc

SEQ ID NO: 213793 - RNA, 19 nt, Human
aagaaggaagaccccccac

SEQ ID NO: 213794 - RNA, 22 nt, Human
acccugccccgugccccuucug

SEQ ID NO: 213795 - RNA, 19 nt, Human
agauagaaguggggugggg

SEQ ID NO: 213796 - RNA, 19 nt, Human
agccaugggauuaagaagg

SEQ ID NO: 213797 - RNA, 20 nt, Human
agccaugggauuaagaagga

SEQ ID NO: 213798 - RNA, 18 nt, Human
aggagggaggagugggag

SEQ ID NO: 213799 - RNA, 19 nt, Human
auccagucuuccccagucc

SEQ ID NO: 213800 - RNA, 24 nt, Human
cacacccacccucuucuacccuuc

SEQ ID NO: 213801 - RNA, 21 nt, Human
cacucuccccuccccauccca

SEQ ID NO: 213802 - RNA, 19 nt, Human
cacuguguucuuuauugag

SEQ ID NO: 213803 - RNA, 23 nt, Human
caucccacacccacccucuucua

SEQ ID NO: 213804 - RNA, 20 nt, Human
ccacucuccccuccccaucc

SEQ ID NO: 213805 - RNA, 24 nt, Human
cccacacccacccucuucuacccu

SEQ ID NO: 213806 - RNA, 23 nt, Human
cccacccucuucuacccuucuca

SEQ ID NO: 213807 - RNA, 19 nt, Human
ccccaucccacacccaccc

SEQ ID NO: 213808 - RNA, 18 nt, Human
ccccgugccccuucugcc

SEQ ID NO: 213809 - RNA, 20 nt, Human
ccccgugccccuucugccag

SEQ ID NO: 213810 - RNA, 21 nt, Human
ccccuccccaucccacaccca

SEQ ID NO: 213811 - RNA, 20 nt, Human
cccgugccccuucugccagg

SEQ ID NO: 213812 - RNA, 20 nt, Human
cccuccccaucccacaccca

SEQ ID NO: 213813 - RNA, 19 nt, Human
cccugccccgugccccuuc

SEQ ID NO: 213814 - RNA, 19 nt, Human
ccgugccccuucugccagg

SEQ ID NO: 213815 - RNA, 24 nt, Human
cuccccuccccaucccacacccac

SEQ ID NO: 213816 - RNA, 21 nt, Human
cuuuccacucuccccucccca

SEQ ID NO: 213817 - RNA, 19 nt, Human
gagaagugaaaggagggag

SEQ ID NO: 213818 - RNA, 19 nt, Human
ggggaggguagcccauagg

SEQ ID NO: 213819 - RNA, 23 nt, Human
gugaaaggagggaggagugggag

SEQ ID NO: 213820 - RNA, 25 nt, Human
ucccacacccacccucuucuacccu

SEQ ID NO: 213821 - RNA, 20 nt, Human
ucucauccagucuuccccag

SEQ ID NO: 213822 - RNA, 24 nt, Human
ucugccagggucugcccagggccu

SEQ ID NO: 213823 - RNA, 24 nt, Human
ugcccagggccuuuccacucuccc

SEQ ID NO: 213824 - RNA, 19 nt, Human
ugccccgugccccuucugc

SEQ ID NO: 213825 - RNA, 19 nt, Human
aaacucauggcuuucuaga

SEQ ID NO: 213826 - RNA, 24 nt, Human
aaccucaaggggggaaaggacaau

SEQ ID NO: 213827 - RNA, 20 nt, Human
aaggguacaccauucucccu

SEQ ID NO: 213828 - RNA, 21 nt, Human
acugcuucaucucugagcccu

SEQ ID NO: 213829 - RNA, 23 nt, Human
acuuuuguuuuuuuuuguuuuuu

SEQ ID NO: 213830 - RNA, 22 nt, Human
caacucuugcucccuuuccccc

SEQ ID NO: 213831 - RNA, 22 nt, Human
caacugaugucaucagugugau

SEQ ID NO: 213832 - RNA, 19 nt, Human
caucucugagcccuggcua

SEQ ID NO: 213833 - RNA, 18 nt, Human
cauuuugccacugucuuc

SEQ ID NO: 213834 - RNA, 21 nt, Human
ccauucucccuuucccuccca

SEQ ID NO: 213835 - RNA, 24 nt, Human
ccauucucccuuucccucccaauc

SEQ ID NO: 213836 - RNA, 18 nt, Human
ccccugggcugggcaacu

SEQ ID NO: 213837 - RNA, 23 nt, Human
cccuggcuaaggcaggccggggc

SEQ ID NO: 213838 - RNA, 18 nt, Human
cccuuucccccugggcug

SEQ ID NO: 213839 - RNA, 21 nt, Human
cccuuucccucccaaucuguc

SEQ ID NO: 213840 - RNA, 25 nt, Human
ccugugaugggcccuuucaaacuca

SEQ ID NO: 213841 - RNA, 23 nt, Human
cucuucacugcuucaucucugag

SEQ ID NO: 213842 - RNA, 24 nt, Human
cuuaaaaauuucuucauuuugccu

SEQ ID NO: 213843 - RNA, 18 nt, Human
gaaagugccugugauggg

SEQ ID NO: 213844 - RNA, 18 nt, Human
gauuuccacaucuuccuu

SEQ ID NO: 213845 - RNA, 23 nt, Human
gcccugcuuuuccuccccccuca

SEQ ID NO: 213846 - RNA, 20 nt, Human
gggaaaggacaauaccccgu

SEQ ID NO: 213847 - RNA, 18 nt, Human
uaaaggguacaccauucu

SEQ ID NO: 213848 - RNA, 19 nt, Human
uaccccguuuaaacaacug

SEQ ID NO: 213849 - RNA, 19 nt, Human
uaggaaagugccugugaug

SEQ ID NO: 213850 - RNA, 24 nt, Human
ucaucagugugauuucagaagaaa

SEQ ID NO: 213851 - RNA, 26 nt, Human
ucucccuuucccucccaaucugucuc

SEQ ID NO: 213852 - RNA, 21 nt, Human
ucucugagcccuggcuaaggc

SEQ ID NO: 213853 - RNA, 18 nt, Human
uguuuuguuuuguuuuua

SEQ ID NO: 213854 - RNA, 27 nt, Human
uuaaaggcccugcuuuucccucucgug

SEQ ID NO: 213855 - RNA, 22 nt, Human
uucaaacucauggcuuucuaga

SEQ ID NO: 213856 - RNA, 20 nt, Human
uucugguuaacucagaaacc

SEQ ID NO: 213857 - RNA, 21 nt, Human
uuguuuuguuuuuaauuucua

SEQ ID NO: 213858 - RNA, 22 nt, Human
uuguuuuuuuuuguuuuuuuuu

SEQ ID NO: 213859 - RNA, 28 nt, Human
uuguuuuuuuuuuuguuuuguuuuguuu

SEQ ID NO: 213860 - RNA, 24 nt, Human
uuuacuuuuguuuuuuuuuguuuu

SEQ ID NO: 213861 - RNA, 18 nt, Human
uuuguuuuguuuuguuuu

SEQ ID NO: 213862 - RNA, 25 nt, Human
uuuuguuuuuuuuuguuuuuuuuuu

SEQ ID NO: 213863 - RNA, 25 nt, Human
uuuuuuguuuuguuuuguuuuuaau

SEQ ID NO: 213864 - RNA, 25 nt, Human
uuuuuuuuguuuuuuuuuuuguuuu

SEQ ID NO: 213865 - RNA, 23 nt, Human
aacuaggcugcuccccucccuug

SEQ ID NO: 213866 - RNA, 22 nt, Human
aacuuggcugagacggaagcga

SEQ ID NO: 213867 - RNA, 22 nt, Human
aagaagcagacaucgagccagg

SEQ ID NO: 213868 - RNA, 18 nt, Human
aagaagcccacccgggac

SEQ ID NO: 213869 - RNA, 21 nt, Human
aagaagcccacccgggacugc

SEQ ID NO: 213870 - RNA, 22 nt, Human
aagaaugccaccuccccgccau

SEQ ID NO: 213871 - RNA, 19 nt, Human
acaagggcauggaaggaca

SEQ ID NO: 213872 - RNA, 20 nt, Human
acacacacacacauaaguca

SEQ ID NO: 213873 - RNA, 21 nt, Human
acauaagucaugucagaggcc

SEQ ID NO: 213874 - RNA, 27 nt, Human
accccaaaaacacacacacacauaagu

SEQ ID NO: 213875 - RNA, 22 nt, Human
acuucugcaaaucagcugaaag

SEQ ID NO: 213876 - RNA, 22 nt, Human
agaggaauguccccaaugaagg

SEQ ID NO: 213877 - RNA, 21 nt, Human
agccacggggcacacgcagcc

SEQ ID NO: 213878 - RNA, 23 nt, Human
agccacggggcacacgcagccuc

SEQ ID NO: 213879 - RNA, 21 nt, Human
agcccccucuucucucccucc

SEQ ID NO: 213880 - RNA, 20 nt, Human
aggaagggccgccggcggcg

SEQ ID NO: 213881 - RNA, 21 nt, Human
aggcugcuccccucccuuggc

SEQ ID NO: 213882 - RNA, 23 nt, Human
agggccccgggggcccgaggggc

SEQ ID NO: 213883 - RNA, 23 nt, Human
agggggagggggccggccgggcc

SEQ ID NO: 213884 - RNA, 24 nt, Human
agggggccggccgggccucggggg

SEQ ID NO: 213885 - RNA, 21 nt, Human
aguggcgcggagcaagcuugg

SEQ ID NO: 213886 - RNA, 22 nt, Human
aucugcagccuucuccccaucc

SEQ ID NO: 213887 - RNA, 22 nt, Human
augaagcuguagaaaaauaucu

SEQ ID NO: 213888 - RNA, 20 nt, Human
caacuucgagacguggccgg

SEQ ID NO: 213889 - RNA, 18 nt, Human
caccccaaaaacacacac

SEQ ID NO: 213890 - RNA, 23 nt, Human
caccccccauccucagcaguuca

SEQ ID NO: 213891 - RNA, 25 nt, Human
caccccccauccucagcaguucaag

SEQ ID NO: 213892 - RNA, 24 nt, Human
cacccuggcacuaucuccacagcc

SEQ ID NO: 213893 - RNA, 18 nt, Human
cagaggcccaagccacaa

SEQ ID NO: 213894 - RNA, 21 nt, Human
cagaggcccaagccacaaaca

SEQ ID NO: 213895 - RNA, 21 nt, Human
cagcgucagugggagcggcgg

SEQ ID NO: 213896 - RNA, 19 nt, Human
caggccugguaaaagccac

SEQ ID NO: 213897 - RNA, 20 nt, Human
caguggcgcggagcaagcuu

SEQ ID NO: 213898 - RNA, 21 nt, Human
cauucccacccguccccaaac

SEQ ID NO: 213899 - RNA, 18 nt, Human
ccaaaaacacacacacac

SEQ ID NO: 213900 - RNA, 20 nt, Human
ccaccccaaaaacacacaca

SEQ ID NO: 213901 - RNA, 26 nt, Human
ccacccgggacugcccuccgugcccc

SEQ ID NO: 213902 - RNA, 18 nt, Human
ccacggccagcccugaug

SEQ ID NO: 213903 - RNA, 20 nt, Human
ccacggccagcccugauggu

SEQ ID NO: 213904 - RNA, 24 nt, Human
ccacggccagcccugaugguuggg

SEQ ID NO: 213905 - RNA, 21 nt, Human
cccaccaccgugccccugccu

SEQ ID NO: 213906 - RNA, 19 nt, Human
cccaggcugggaagaagcc

SEQ ID NO: 213907 - RNA, 22 nt, Human
cccauccucagcaguucaagaa

SEQ ID NO: 213908 - RNA, 20 nt, Human
ccccaaaaacacacacacac

SEQ ID NO: 213909 - RNA, 18 nt, Human
ccccaccaccgugccccu

SEQ ID NO: 213910 - RNA, 22 nt, Human
ccccaccccaaaaacacacaca

SEQ ID NO: 213911 - RNA, 18 nt, Human
ccccaucucuccaagaca

SEQ ID NO: 213912 - RNA, 21 nt, Human
ccccgcccccgcccgcgcccg

SEQ ID NO: 213913 - RNA, 19 nt, Human
ccccgccccgcccccgccc

SEQ ID NO: 213914 - RNA, 24 nt, Human
ccccgccccgcccccgcccgcgcc

SEQ ID NO: 213915 - RNA, 18 nt, Human
ccccggagcggagccggg

SEQ ID NO: 213916 - RNA, 26 nt, Human
ccccgggggcccgaggggcgcgccgg

SEQ ID NO: 213917 - RNA, 20 nt, Human
ccccugcucccaggucucug

SEQ ID NO: 213918 - RNA, 26 nt, Human
cccgcccgggccuccgcccgcccgcc

SEQ ID NO: 213919 - RNA, 22 nt, Human
cccgcucacaggcggcgccgag

SEQ ID NO: 213920 - RNA, 22 nt, Human
cccuccccaccccaaaaacaca

SEQ ID NO: 213921 - RNA, 18 nt, Human
cccucccuccccacccca

SEQ ID NO: 213922 - RNA, 22 nt, Human
cccucuucucucccucccuccc

SEQ ID NO: 213923 - RNA, 23 nt, Human
ccgagcugcgcuccccaccccug

SEQ ID NO: 213924 - RNA, 27 nt, Human
ccgcccccgcccgcgcccgcgcccgcc

SEQ ID NO: 213925 - RNA, 23 nt, Human
ccgccccgcccccgcccgcgccc

SEQ ID NO: 213926 - RNA, 22 nt, Human
ccgccccgccccgcccccgccc

SEQ ID NO: 213927 - RNA, 24 nt, Human
ccgccccgccccgcccccgcccgc

SEQ ID NO: 213928 - RNA, 20 nt, Human
ccgcccgcgcccgcgcccgc

SEQ ID NO: 213929 - RNA, 22 nt, Human
ccgcccgcgcccgcgcccgccc

SEQ ID NO: 213930 - RNA, 18 nt, Human
ccgcccgggccuccgccu

SEQ ID NO: 213931 - RNA, 20 nt, Human
ccuccccgccauuuccuccu

SEQ ID NO: 213932 - RNA, 20 nt, Human
ccuccgcccgcccgcccgcc

SEQ ID NO: 213933 - RNA, 22 nt, Human
ccuccgccgagcugcgcucccc

SEQ ID NO: 213934 - RNA, 21 nt, Human
ccucggccgcgggcccugcag

SEQ ID NO: 213935 - RNA, 21 nt, Human
cgagcugcgcuccccaccccu

SEQ ID NO: 213936 - RNA, 19 nt, Human
cgccaggaagggccgccgg

SEQ ID NO: 213937 - RNA, 18 nt, Human
cgcccgcgcccgcccggg

SEQ ID NO: 213938 - RNA, 20 nt, Human
cgccgagcugcgcuccccac

SEQ ID NO: 213939 - RNA, 18 nt, Human
cgccgagggccccggggg

SEQ ID NO: 213940 - RNA, 21 nt, Human
cgccgggagggcugccgccgg

SEQ ID NO: 213941 - RNA, 21 nt, Human
cgcuggagccccccggagcgg

SEQ ID NO: 213942 - RNA, 22 nt, Human
cggcgggcgcugcggcggggcc

SEQ ID NO: 213943 - RNA, 21 nt, Human
cgggcgggcaggcgggcaggu

SEQ ID NO: 213944 - RNA, 20 nt, Human
cggggccccgcgcucgcacc

SEQ ID NO: 213945 - RNA, 19 nt, Human
cuccacagcccaacagaau

SEQ ID NO: 213946 - RNA, 25 nt, Human
cuccccauccuuuccgcgucggggg

SEQ ID NO: 213947 - RNA, 22 nt, Human
cucccucccuccccaccccaaa

SEQ ID NO: 213948 - RNA, 19 nt, Human
cucggcaucugcagccuuc

SEQ ID NO: 213949 - RNA, 25 nt, Human
cugaaagccuuccccaucucuccaa

SEQ ID NO: 213950 - RNA, 18 nt, Human
cugcuccccucccuuggc

SEQ ID NO: 213951 - RNA, 22 nt, Human
cugcuccccucccuuggccucc

SEQ ID NO: 213952 - RNA, 19 nt, Human
cuggcugugcguggcuacg

SEQ ID NO: 213953 - RNA, 25 nt, Human
cugguugcucuaugaagcuguagaa

SEQ ID NO: 213954 - RNA, 18 nt, Human
cugugcguggcuacgugu

SEQ ID NO: 213955 - RNA, 20 nt, Human
gaagaagcccacccgggacu

SEQ ID NO: 213956 - RNA, 20 nt, Human
gaaugguggcugcucacccc

SEQ ID NO: 213957 - RNA, 18 nt, Human
gagcccucggccgcgggc

SEQ ID NO: 213958 - RNA, 18 nt, Human
gagcggcgguucggccgg

SEQ ID NO: 213959 - RNA, 18 nt, Human
gcaaaguugucuccagga

SEQ ID NO: 213960 - RNA, 27 nt, Human
gcaggaugcgucuggcugugcguggaa

SEQ ID NO: 213961 - RNA, 18 nt, Human
gcaucaaauuuagccccc

SEQ ID NO: 213962 - RNA, 25 nt, Human
gccaccuccccgccauuuccuccug

SEQ ID NO: 213963 - RNA, 23 nt, Human
gcgcuggagccccccggagcgga

SEQ ID NO: 213964 - RNA, 18 nt, Human
gcgggcaguggcgcggag

SEQ ID NO: 213965 - RNA, 29 nt, Human
gcggggccccgcgcucgcaccugagcgcc

SEQ ID NO: 213966 - RNA, 21 nt, Human
gcuaugcgggcgggcgggcag

SEQ ID NO: 213967 - RNA, 22 nt, Human
gcugcggcgggcgcugcggcgg

SEQ ID NO: 213968 - RNA, 19 nt, Human
ggaaggacaggcuccccag

SEQ ID NO: 213969 - RNA, 22 nt, Human
gggaagguggcgaaagagcggg

SEQ ID NO: 213970 - RNA, 20 nt, Human
gggcaggugagugggcaggg

SEQ ID NO: 213971 - RNA, 24 nt, Human
gggcccgaggggcgcgccgggcgg

SEQ ID NO: 213972 - RNA, 18 nt, Human
gggcggggcggaggucgc

SEQ ID NO: 213973 - RNA, 23 nt, Human
ggggccggccgggccucgggggu

SEQ ID NO: 213974 - RNA, 18 nt, Human
ggggcgcgccgggcgggg

SEQ ID NO: 213975 - RNA, 19 nt, Human
gugcuaugcgggcgggcgg

SEQ ID NO: 213976 - RNA, 23 nt, Human
guggaaugguggcugcucacccc

SEQ ID NO: 213977 - RNA, 21 nt, Human
guggccgggccagcuggugga

SEQ ID NO: 213978 - RNA, 19 nt, Human
uaaaagccacggggcacac

SEQ ID NO: 213979 - RNA, 28 nt, Human
uaaaucagugcaaacauuaguuaaagag

SEQ ID NO: 213980 - RNA, 18 nt, Human
uagcuaagcugccauuug

SEQ ID NO: 213981 - RNA, 18 nt, Human
uaggcugcuccccucccu

SEQ ID NO: 213982 - RNA, 18 nt, Human
ucacacggcaaaguuguc

SEQ ID NO: 213983 - RNA, 20 nt, Human
ucagcugaaagccuucccca

SEQ ID NO: 213984 - RNA, 18 nt, Human
uccccaaaccaguccuag

SEQ ID NO: 213985 - RNA, 22 nt, Human
uccccaaaccaguccuagagga

SEQ ID NO: 213986 - RNA, 18 nt, Human
uccccaccccaaaaacac

SEQ ID NO: 213987 - RNA, 20 nt, Human
ucccgcgcggcagggaaggg

SEQ ID NO: 213988 - RNA, 21 nt, Human
ucccucccuccccaccccaaa

SEQ ID NO: 213989 - RNA, 22 nt, Human
ucccucccuccccaccccaaaa

SEQ ID NO: 213990 - RNA, 21 nt, Human
uccgccgagcugcgcucccca

SEQ ID NO: 213991 - RNA, 24 nt, Human
uccgccgagcugcgcuccccaccc

SEQ ID NO: 213992 - RNA, 22 nt, Human
uccgcugaggggacacccccca

SEQ ID NO: 213993 - RNA, 18 nt, Human
uccgggcgcgccgccccg

SEQ ID NO: 213994 - RNA, 24 nt, Human
uccuggaggcugcugugugggugg

SEQ ID NO: 213995 - RNA, 21 nt, Human
ucgcuuaaaaaagaagcaaag

SEQ ID NO: 213996 - RNA, 23 nt, Human
ucgcuuaaaaaagaagcaaagga

SEQ ID NO: 213997 - RNA, 21 nt, Human
ucggcgcucggccaagggcca

SEQ ID NO: 213998 - RNA, 23 nt, Human
ucgggggccccgcagccccguag

SEQ ID NO: 213999 - RNA, 18 nt, Human
ucugacggguuguguccu

SEQ ID NO: 214000 - RNA, 26 nt, Human
ucugcagccuucuccccauccuuucc

SEQ ID NO: 214001 - RNA, 25 nt, Human
ucugcuuuuccucuccguggcucuc

SEQ ID NO: 214002 - RNA, 23 nt, Human
ugagcgccucgcccucacugccu

SEQ ID NO: 214003 - RNA, 22 nt, Human
ugcagccuucuccccauccuuu

SEQ ID NO: 214004 - RNA, 18 nt, Human
ugccccugcucccagguc

SEQ ID NO: 214005 - RNA, 22 nt, Human
ugccccugcucccaggucucug

SEQ ID NO: 214006 - RNA, 23 nt, Human
ugccgcacgggcgucucggggcg

SEQ ID NO: 214007 - RNA, 20 nt, Human
ugcuguguggguggcaggau

SEQ ID NO: 214008 - RNA, 20 nt, Human
uggagaucaguuaaagcauc

SEQ ID NO: 214009 - RNA, 22 nt, Human
uggcacuuggacaucuagaggg

SEQ ID NO: 214010 - RNA, 19 nt, Human
uggcgcggagcaagcuugg

SEQ ID NO: 214011 - RNA, 22 nt, Human
uggcugugcguggcuacgugug

SEQ ID NO: 214012 - RNA, 19 nt, Human
ugggaagaagcagacaucg

SEQ ID NO: 214013 - RNA, 24 nt, Human
uggguggcaggaugcgucuggcug

SEQ ID NO: 214014 - RNA, 19 nt, Human
ugguaaaagccacggggca

SEQ ID NO: 214015 - RNA, 22 nt, Human
uguagaaaaauaucucaggccg

SEQ ID NO: 214016 - RNA, 21 nt, Human
ugucagaggcccaagccacaa

SEQ ID NO: 214017 - RNA, 20 nt, Human
ugugugcucgggaaggcgca

SEQ ID NO: 214018 - RNA, 21 nt, Human
uucucucccucccuccccacc

SEQ ID NO: 214019 - RNA, 25 nt, Human
uuuuuuuucaaauggcaguuucuga

SEQ ID NO: 214020 - RNA, 21 nt, Human
aacagcuguggucucaacucu

SEQ ID NO: 214021 - RNA, 18 nt, Human
aaccaugacaccuagaca

SEQ ID NO: 214022 - RNA, 19 nt, Human
aagggccucucuggagauc

SEQ ID NO: 214023 - RNA, 18 nt, Human
aauguaggcagagcuggg

SEQ ID NO: 214024 - RNA, 18 nt, Human
accuagacagagagggaa

SEQ ID NO: 214025 - RNA, 18 nt, Human
agaaccaugacaccuaga

SEQ ID NO: 214026 - RNA, 21 nt, Human
agaaggacaggggcucacaac

SEQ ID NO: 214027 - RNA, 19 nt, Human
agaaguguguguccagcug

SEQ ID NO: 214028 - RNA, 23 nt, Human
agacagagagggaacagggauaa

SEQ ID NO: 214029 - RNA, 24 nt, Human
agagaaaggcagagaaggacaaaa

SEQ ID NO: 214030 - RNA, 18 nt, Human
agagggcaggggagcuca

SEQ ID NO: 214031 - RNA, 21 nt, Human
agaggguaguggucaggaaga

SEQ ID NO: 214032 - RNA, 18 nt, Human
agccucuauuuugggcag

SEQ ID NO: 214033 - RNA, 20 nt, Human
aggaagauggcacagugacu

SEQ ID NO: 214034 - RNA, 28 nt, Human
aggaaggcauaguggguuauggggucua

SEQ ID NO: 214035 - RNA, 29 nt, Human
aggacaaaaaauggaugaagggggacccc

SEQ ID NO: 214036 - RNA, 26 nt, Human
aggcagagcuggggccauggaagggg

SEQ ID NO: 214037 - RNA, 21 nt, Human
agggacacagaauagccacag

SEQ ID NO: 214038 - RNA, 24 nt, Human
auaagaugcucaggaagagggagu

SEQ ID NO: 214039 - RNA, 24 nt, Human
caaaaaauggaugaagguaugcaa

SEQ ID NO: 214040 - RNA, 24 nt, Human
caacucuguccuggcugccagagg

SEQ ID NO: 214041 - RNA, 23 nt, Human
cagaauagccacaguuacacaga

SEQ ID NO: 214042 - RNA, 22 nt, Human
cagcagugaucuaaacuuuggu

SEQ ID NO: 214043 - RNA, 21 nt, Human
caggcaagucaccccuuaagg

SEQ ID NO: 214044 - RNA, 27 nt, Human
caugcaaccuugggcugcccauaccac

SEQ ID NO: 214045 - RNA, 22 nt, Human
ccacaguuacacagaaccauga

SEQ ID NO: 214046 - RNA, 21 nt, Human
ccuuaagggcauagagaaagg

SEQ ID NO: 214047 - RNA, 21 nt, Human
cuaagaaggacaggggcucac

SEQ ID NO: 214048 - RNA, 18 nt, Human
gaagaaguguguguccag

SEQ ID NO: 214049 - RNA, 18 nt, Human
gaagccagagggcagggg

SEQ ID NO: 214050 - RNA, 24 nt, Human
gaauagccacaguuacacagaacc

SEQ ID NO: 214051 - RNA, 22 nt, Human
gagaaaggcagagaaggacaaa

SEQ ID NO: 214052 - RNA, 24 nt, Human
gagcucaggcaagucaccccuuaa

SEQ ID NO: 214053 - RNA, 22 nt, Human
gcgggauggacuagcgggaugg

SEQ ID NO: 214054 - RNA, 21 nt, Human
gggaacagggauaagaaaugc

SEQ ID NO: 214055 - RNA, 19 nt, Human
gggcucagggucucaacag

SEQ ID NO: 214056 - RNA, 19 nt, Human
gugacuugcuuuagaugaa

SEQ ID NO: 214057 - RNA, 20 nt, Human
uaagccucuauuuugggcag

SEQ ID NO: 214058 - RNA, 24 nt, Human
uagaaaggacaggaaggcauagug

SEQ ID NO: 214059 - RNA, 20 nt, Human
uaggcagagcuggggccaug

SEQ ID NO: 214060 - RNA, 19 nt, Human
ucaggaagagggaguccac

SEQ ID NO: 214061 - RNA, 22 nt, Human
uccaaagaagggccucucugga

SEQ ID NO: 214062 - RNA, 22 nt, Human
ucccuggaguggggcuagcggg

SEQ ID NO: 214063 - RNA, 24 nt, Human
ucucaaggaagugcacuucuguag

SEQ ID NO: 214064 - RNA, 20 nt, Human
ucuguccuggcugccagagg

SEQ ID NO: 214065 - RNA, 25 nt, Human
ugagcuaagggugucuuugccuggg

SEQ ID NO: 214066 - RNA, 24 nt, Human
ugcuggggaaggcccuucuugagc

SEQ ID NO: 214067 - RNA, 18 nt, Human
uggaaggggguagccagg

SEQ ID NO: 214068 - RNA, 23 nt, Human
uggaaggggguagccagguagug

SEQ ID NO: 214069 - RNA, 20 nt, Human
uggacagagaaugaggucau

SEQ ID NO: 214070 - RNA, 19 nt, Human
uggaguggggaccauugag

SEQ ID NO: 214071 - RNA, 20 nt, Human
uggggaccauugaguagaaa

SEQ ID NO: 214072 - RNA, 18 nt, Human
ugguuggagaugggucug

SEQ ID NO: 214073 - RNA, 22 nt, Human
ugucuuugccugggaaccagau

SEQ ID NO: 214074 - RNA, 19 nt, Human
aaaaaaaaaaaaaauuagc

SEQ ID NO: 214075 - RNA, 21 nt, Human
aaaaaauuccccaauauacca

SEQ ID NO: 214076 - RNA, 18 nt, Human
aacacggugaaaccccau

SEQ ID NO: 214077 - RNA, 20 nt, Human
aacacggugaaaccccauau

SEQ ID NO: 214078 - RNA, 21 nt, Human
aacacggugaaaccccauauc

SEQ ID NO: 214079 - RNA, 21 nt, Human
aacacggugaaaccccauauc

SEQ ID NO: 214080 - RNA, 18 nt, Human
aacagguuauauaacaag

SEQ ID NO: 214081 - RNA, 24 nt, Human
aacaguggcucagaccaaguauga

SEQ ID NO: 214082 - RNA, 20 nt, Human
aauuaccuuuuacagacaac

SEQ ID NO: 214083 - RNA, 20 nt, Human
acagagccagacuccgucuc

SEQ ID NO: 214084 - RNA, 23 nt, Human
acagagccagacuccgucucaaa

SEQ ID NO: 214085 - RNA, 24 nt, Human
acagagccagacuccgucucaaaa

SEQ ID NO: 214086 - RNA, 19 nt, Human
acagagcgaaacuccgucu

SEQ ID NO: 214087 - RNA, 20 nt, Human
acagagcgaaacuccgucuc

SEQ ID NO: 214088 - RNA, 23 nt, Human
acagagcgaaacuccgucucaaa

SEQ ID NO: 214089 - RNA, 23 nt, Human
accccaagagccccuguacagca

SEQ ID NO: 214090 - RNA, 18 nt, Human
accucuggcuggcccucc

SEQ ID NO: 214091 - RNA, 24 nt, Human
acgcagagcuugcagugagccgag

SEQ ID NO: 214092 - RNA, 24 nt, Human
acugcacuccagccugggcgacag

SEQ ID NO: 214093 - RNA, 26 nt, Human
acugcacuccagccugggcgacagag

SEQ ID NO: 214094 - RNA, 23 nt, Human
agacaacaguggcucagaccaag

SEQ ID NO: 214095 - RNA, 24 nt, Human
agagcuugcagugagccgagaucg

SEQ ID NO: 214096 - RNA, 22 nt, Human
agcaagcugagcuguguccugg

SEQ ID NO: 214097 - RNA, 24 nt, Human
agcacuuugggaggccgagguggg

SEQ ID NO: 214098 - RNA, 20 nt, Human
agcagcuuaacuuuuucucu

SEQ ID NO: 214099 - RNA, 25 nt, Human
agccauguugagcugagccgaaccc

SEQ ID NO: 214100 - RNA, 23 nt, Human
agccgggcaugguggcgcgugcc

SEQ ID NO: 214101 - RNA, 22 nt, Human
agccugggcgacagagcgaaac

SEQ ID NO: 214102 - RNA, 24 nt, Human
agccugggcgacagagcgaaacuc

SEQ ID NO: 214103 - RNA, 24 nt, Human
agccugggugacagagccagacuc

SEQ ID NO: 214104 - RNA, 22 nt, Human
agcugagcuguguccuggcccc

SEQ ID NO: 214105 - RNA, 20 nt, Human
agcugggugugguggcgagc

SEQ ID NO: 214106 - RNA, 21 nt, Human
agcugguuauagaacauuccc

SEQ ID NO: 214107 - RNA, 22 nt, Human
agcugugcagccugcucucccu

SEQ ID NO: 214108 - RNA, 25 nt, Human
aggcaggagaauggcgucaacccag

SEQ ID NO: 214109 - RNA, 27 nt, Human
aggcaggagaauggcgucaacccagga

SEQ ID NO: 214110 - RNA, 24 nt, Human
aggcaggagaauggcgugaacccg

SEQ ID NO: 214111 - RNA, 21 nt, Human
aggcauggaucucugccuugg

SEQ ID NO: 214112 - RNA, 21 nt, Human
aggccgagguggguggaucac

SEQ ID NO: 214113 - RNA, 19 nt, Human
aggccucacagccugacca

SEQ ID NO: 214114 - RNA, 24 nt, Human
aggcggagcuugcagugagucgag

SEQ ID NO: 214115 - RNA, 19 nt, Human
aggcugaggcaggagaaug

SEQ ID NO: 214116 - RNA, 19 nt, Human
aggcugaggcaggagaaug

SEQ ID NO: 214117 - RNA, 24 nt, Human
agguggguggaucaccaggucagg

SEQ ID NO: 214118 - RNA, 24 nt, Human
aggugugugccugugcaccaaacc

SEQ ID NO: 214119 - RNA, 24 nt, Human
aucgcgccacugcacuccagccug

SEQ ID NO: 214120 - RNA, 23 nt, Human
auuaagcauguuccaugcaguuc

SEQ ID NO: 214121 - RNA, 21 nt, Human
auuaccuuuuacagacaacag

SEQ ID NO: 214122 - RNA, 18 nt, Human
auugcacucuagccuggg

SEQ ID NO: 214123 - RNA, 24 nt, Human
auugcacucuagccugggugacag

SEQ ID NO: 214124 - RNA, 21 nt, Human
caaaacggacagcuuuggcuc

SEQ ID NO: 214125 - RNA, 24 nt, Human
caacccaggacgcagagcuugcag

SEQ ID NO: 214126 - RNA, 19 nt, Human
caagagccccuguacagca

SEQ ID NO: 214127 - RNA, 21 nt, Human
caagagccccuguacagcauu

SEQ ID NO: 214128 - RNA, 22 nt, Human
caauauaccacuguccagaggu

SEQ ID NO: 214129 - RNA, 23 nt, Human
caauuaccuuuuacagacaacag

SEQ ID NO: 214130 - RNA, 18 nt, Human
cacacuguccacccugcc

SEQ ID NO: 214131 - RNA, 20 nt, Human
cacagccugaccagaccucu

SEQ ID NO: 214132 - RNA, 24 nt, Human
cacgccuguaaucccagcacuuug

SEQ ID NO: 214133 - RNA, 24 nt, Human
cacuccagccugggcgacagagcg

SEQ ID NO: 214134 - RNA, 22 nt, Human
cacucuagccugggugacagag

SEQ ID NO: 214135 - RNA, 19 nt, Human
cacugcacuccagccuggg

SEQ ID NO: 214136 - RNA, 20 nt, Human
cacugcacuccagccugggc

SEQ ID NO: 214137 - RNA, 22 nt, Human
cacugcacuccagccugggcga

SEQ ID NO: 214138 - RNA, 23 nt, Human
cacugcacuccagccugggcgac

SEQ ID NO: 214139 - RNA, 24 nt, Human
cacugcacuccagccugggcgaca

SEQ ID NO: 214140 - RNA, 24 nt, Human
cagcacuuugggaggccgaggugg

SEQ ID NO: 214141 - RNA, 24 nt, Human
cagcuacacgggaggcugaggcag

SEQ ID NO: 214142 - RNA, 24 nt, Human
cagcuacucaggaggcugaggcag

SEQ ID NO: 214143 - RNA, 19 nt, Human
cauugcacucuagccuggg

SEQ ID NO: 214144 - RNA, 19 nt, Human
cauugcacucuagccuggg

SEQ ID NO: 214145 - RNA, 21 nt, Human
cauugcacucuagccugggug

SEQ ID NO: 214146 - RNA, 22 nt, Human
cauugcacucuagccuggguga

SEQ ID NO: 214147 - RNA, 24 nt, Human
cauugcacucuagccugggugaca

SEQ ID NO: 214148 - RNA, 25 nt, Human
cauugcacucuagccugggugacag

SEQ ID NO: 214149 - RNA, 20 nt, Human
ccacugcacuccagccuggg

SEQ ID NO: 214150 - RNA, 21 nt, Human
ccacugcacuccagccugggc

SEQ ID NO: 214151 - RNA, 21 nt, Human
ccacugcacuccagccugggc

SEQ ID NO: 214152 - RNA, 23 nt, Human
ccacugcacuccagccugggcga

SEQ ID NO: 214153 - RNA, 24 nt, Human
ccacugcacuccagccugggcgac

SEQ ID NO: 214154 - RNA, 22 nt, Human
ccagagguuuccuuguccuuaa

SEQ ID NO: 214155 - RNA, 23 nt, Human
ccauguaccuuacaccugggucu

SEQ ID NO: 214156 - RNA, 20 nt, Human
ccauugcacucuagccuggg

SEQ ID NO: 214157 - RNA, 21 nt, Human
ccauugcacucuagccugggu

SEQ ID NO: 214158 - RNA, 21 nt, Human
ccauugcacucuagccugggu

SEQ ID NO: 214159 - RNA, 22 nt, Human
ccauugcacucuagccugggug

SEQ ID NO: 214160 - RNA, 23 nt, Human
ccauugcacucuagccuggguga

SEQ ID NO: 214161 - RNA, 24 nt, Human
ccauugcacucuagccugggugac

SEQ ID NO: 214162 - RNA, 21 nt, Human
cccaauauaccacuguccaga

SEQ ID NO: 214163 - RNA, 23 nt, Human
ccccuguacagcauuagcaggac

SEQ ID NO: 214164 - RNA, 24 nt, Human
ccuggccccuuccugguccccugg

SEQ ID NO: 214165 - RNA, 19 nt, Human
ccuggccccuuccugucca

SEQ ID NO: 214166 - RNA, 24 nt, Human
ccuggcuaacacggugaaacccca

SEQ ID NO: 214167 - RNA, 24 nt, Human
ccuggcugggugcgguggcucacg

SEQ ID NO: 214168 - RNA, 23 nt, Human
ccugggcgacagagcgaaacucc

SEQ ID NO: 214169 - RNA, 22 nt, Human
ccugggugacagagccagacuc

SEQ ID NO: 214170 - RNA, 22 nt, Human
ccuguaaucccagcacuuuggg

SEQ ID NO: 214171 - RNA, 21 nt, Human
ccuguagucccagcuacacgg

SEQ ID NO: 214172 - RNA, 21 nt, Human
ccuguagucccagcuacucag

SEQ ID NO: 214173 - RNA, 22 nt, Human
ccuguagucccagcuacucagg

SEQ ID NO: 214174 - RNA, 24 nt, Human
cgagaccauccuggcuaacacggu

SEQ ID NO: 214175 - RNA, 24 nt, Human
cgagaucgcgccacugcacuccag

SEQ ID NO: 214176 - RNA, 24 nt, Human
cgagguggguggaucaccagguca

SEQ ID NO: 214177 - RNA, 23 nt, Human
cgccuguaaucccagcacuuugg

SEQ ID NO: 214178 - RNA, 22 nt, Human
cuaaaaccacgucccugggugc

SEQ ID NO: 214179 - RNA, 22 nt, Human
cucacgccuguaaucccagcac

SEQ ID NO: 214180 - RNA, 24 nt, Human
cucacgccuguaaucccagcacuu

SEQ ID NO: 214181 - RNA, 26 nt, Human
cuccgucucaaaaaaaaaaaaaaaau

SEQ ID NO: 214182 - RNA, 18 nt, Human
cuccuguagucccagcua

SEQ ID NO: 214183 - RNA, 24 nt, Human
cuccuguagucccagcuacucagg

SEQ ID NO: 214184 - RNA, 24 nt, Human
cucugccuuggccuauuccuugac

SEQ ID NO: 214185 - RNA, 23 nt, Human
cuggcuaacacggugaaacccca

SEQ ID NO: 214186 - RNA, 24 nt, Human
cuugcagugagccgagaucgugcc

SEQ ID NO: 214187 - RNA, 19 nt, Human
cuugcagugagucgagauc

SEQ ID NO: 214188 - RNA, 21 nt, Human
cuugcagugagucgagaucgc

SEQ ID NO: 214189 - RNA, 21 nt, Human
gacagagcgaaacuccgucuc

SEQ ID NO: 214190 - RNA, 20 nt, Human
gacagcuuuggcucucucuc

SEQ ID NO: 214191 - RNA, 20 nt, Human
gaccaaguaugaacuuacac

SEQ ID NO: 214192 - RNA, 18 nt, Human
gagcuugcagugagccga

SEQ ID NO: 214193 - RNA, 23 nt, Human
gagcuugcagugagucgagaucg

SEQ ID NO: 214194 - RNA, 24 nt, Human
gaucaccaggucaggagaucgaga

SEQ ID NO: 214195 - RNA, 20 nt, Human
gaugaaauacaggacaccca

SEQ ID NO: 214196 - RNA, 24 nt, Human
gcacuccagccugggcgacagagc

SEQ ID NO: 214197 - RNA, 24 nt, Human
gcacucuagccugggugacagagc

SEQ ID NO: 214198 - RNA, 19 nt, Human
gcagagcuugcagugagcc

SEQ ID NO: 214199 - RNA, 22 nt, Human
gccacugcacuccagccugggc

SEQ ID NO: 214200 - RNA, 24 nt, Human
gccacugcacuccagccugggcga

SEQ ID NO: 214201 - RNA, 24 nt, Human
gccauugcacucuagccuggguga

SEQ ID NO: 214202 - RNA, 20 nt, Human
gcgguggcucacgccuguaa

SEQ ID NO: 214203 - RNA, 18 nt, Human
gcuaacacggugaaaccc

SEQ ID NO: 214204 - RNA, 21 nt, Human
gcucucucucucuuacugggc

SEQ ID NO: 214205 - RNA, 22 nt, Human
gcugaggcaggagaauggcgug

SEQ ID NO: 214206 - RNA, 18 nt, Human
gcuuuggcucucucucuc

SEQ ID NO: 214207 - RNA, 21 nt, Human
gcuuuggcucucucucucuua

SEQ ID NO: 214208 - RNA, 24 nt, Human
ggagcuugcagugagucgagaucg

SEQ ID NO: 214209 - RNA, 19 nt, Human
ggcugggugcgguggcuca

SEQ ID NO: 214210 - RNA, 19 nt, Human
ggguggaucaccaggucag

SEQ ID NO: 214211 - RNA, 23 nt, Human
gguggcucacgccuguaauccca

SEQ ID NO: 214212 - RNA, 24 nt, Human
gguggcucacgccuguaaucccag

SEQ ID NO: 214213 - RNA, 22 nt, Human
gugccuguagucccagcuacac

SEQ ID NO: 214214 - RNA, 24 nt, Human
uaacacggugaaaccccauaucua

SEQ ID NO: 214215 - RNA, 19 nt, Human
uacacgggaggcugaggca

SEQ ID NO: 214216 - RNA, 24 nt, Human
uagaauucuaaaacaaggauguua

SEQ ID NO: 214217 - RNA, 20 nt, Human
uaguauauuagaaaauggaa

SEQ ID NO: 214218 - RNA, 22 nt, Human
uauuucauuuaucuaaaauuca

SEQ ID NO: 214219 - RNA, 22 nt, Human
ucaaaaaaaaaaaaaaaauucc

SEQ ID NO: 214220 - RNA, 25 nt, Human
ucaaauaaaaaaaaaaaaaaaaaaa

SEQ ID NO: 214221 - RNA, 22 nt, Human
ucacacuguccacccugccuug

SEQ ID NO: 214222 - RNA, 18 nt, Human
ucaccaggucaggagauc

SEQ ID NO: 214223 - RNA, 24 nt, Human
ucaccaggucaggagaucgagacc

SEQ ID NO: 214224 - RNA, 24 nt, Human
ucagaagauggaauguuaguguug

SEQ ID NO: 214225 - RNA, 24 nt, Human
ucagaccaaguaugaacuuacaca

SEQ ID NO: 214226 - RNA, 22 nt, Human
ucagagguuuccuuguccuuaa

SEQ ID NO: 214227 - RNA, 22 nt, Human
uccagccugggcgacagagcga

SEQ ID NO: 214228 - RNA, 24 nt, Human
ucccugggugcuccacagucacac

SEQ ID NO: 214229 - RNA, 23 nt, Human
uccgucucaaaaaaaaaaaaaaa

SEQ ID NO: 214230 - RNA, 24 nt, Human
uccgucucaaaaaaaaaaaaaaaa

SEQ ID NO: 214231 - RNA, 24 nt, Human
uccgucucaaaaaaaaaaaaaaag

SEQ ID NO: 214232 - RNA, 23 nt, Human
ucgcgccacugcacuccagccug

SEQ ID NO: 214233 - RNA, 19 nt, Human
ucuacuaaaaauacaaaaa

SEQ ID NO: 214234 - RNA, 24 nt, Human
ucuagccugggugacagagccaga

SEQ ID NO: 214235 - RNA, 19 nt, Human
ucuggggacauacuuaacu

SEQ ID NO: 214236 - RNA, 24 nt, Human
ugagccgaaccccaagagccccug

SEQ ID NO: 214237 - RNA, 22 nt, Human
ugagccgagaucgugccauugc

SEQ ID NO: 214238 - RNA, 18 nt, Human
ugagcugagccgaacccc

SEQ ID NO: 214239 - RNA, 21 nt, Human
ugagcuguguccuggccccuu

SEQ ID NO: 214240 - RNA, 20 nt, Human
ugaggcaggagaauggcguc

SEQ ID NO: 214241 - RNA, 21 nt, Human
ugaggcaggagaauggcguca

SEQ ID NO: 214242 - RNA, 23 nt, Human
ugaggcaggagaauggcgugaac

SEQ ID NO: 214243 - RNA, 24 nt, Human
ugaggcaggagaauggcgugaacc

SEQ ID NO: 214244 - RNA, 25 nt, Human
ugaggcaggagaauggcgugaaccc

SEQ ID NO: 214245 - RNA, 22 nt, Human
ugagucgagaucgcgccacugc

SEQ ID NO: 214246 - RNA, 22 nt, Human
ugcacucuagccugggugacag

SEQ ID NO: 214247 - RNA, 24 nt, Human
ugcacucuagccugggugacagag

SEQ ID NO: 214248 - RNA, 21 nt, Human
ugccuguagucccagcuacac

SEQ ID NO: 214249 - RNA, 23 nt, Human
ugccuguagucccagcuacacgg

SEQ ID NO: 214250 - RNA, 23 nt, Human
ugccuguagucccagcuacacgg

SEQ ID NO: 214251 - RNA, 24 nt, Human
ugccuguagucccagcuacacggg

SEQ ID NO: 214252 - RNA, 24 nt, Human
ugccuuggcugcuugagcccgugg

SEQ ID NO: 214253 - RNA, 18 nt, Human
uggaggugugugccugug

SEQ ID NO: 214254 - RNA, 19 nt, Human
uggccuauuccuugaccaa

SEQ ID NO: 214255 - RNA, 24 nt, Human
uggcgcgugccuguagucccagcu

SEQ ID NO: 214256 - RNA, 21 nt, Human
uggcgucaacccaggacgcag

SEQ ID NO: 214257 - RNA, 22 nt, Human
uggcucacgccuguaaucccag

SEQ ID NO: 214258 - RNA, 24 nt, Human
uggcucacgccuguaaucccagca

SEQ ID NO: 214259 - RNA, 23 nt, Human
uggcugggugcgguggcucacgc

SEQ ID NO: 214260 - RNA, 23 nt, Human
ugggaggccgagguggguggauc

SEQ ID NO: 214261 - RNA, 24 nt, Human
ugggaggccgagguggguggauca

SEQ ID NO: 214262 - RNA, 20 nt, Human
ugggcgugagcaagcugagc

SEQ ID NO: 214263 - RNA, 24 nt, Human
ugguggcgcgugccuguaguccca

SEQ ID NO: 214264 - RNA, 22 nt, Human
ugugccugugcaccaaacccac

SEQ ID NO: 214265 - RNA, 21 nt, Human
uguugagcugagccgaacccc

SEQ ID NO: 214266 - RNA, 24 nt, Human
uuagccgggcaugguggcgcgugc

SEQ ID NO: 214267 - RNA, 18 nt, Human
uuagcugggugugguggc

SEQ ID NO: 214268 - RNA, 18 nt, Human
uuauagaacauucccccu

SEQ ID NO: 214269 - RNA, 18 nt, Human
uugcagugagccgagauc

SEQ ID NO: 214270 - RNA, 21 nt, Human
uugcagugagccgagaucgug

SEQ ID NO: 214271 - RNA, 22 nt, Human
uugcagugagccgagaucgugc

SEQ ID NO: 214272 - RNA, 18 nt, Human
uugcagugagucgagauc

SEQ ID NO: 214273 - RNA, 19 nt, Human
uugcagugagucgagaucg

SEQ ID NO: 214274 - RNA, 22 nt, Human
uugcagugagucgagaucgcgc

SEQ ID NO: 214275 - RNA, 25 nt, Human
uugggaggccgagguggguggauca

SEQ ID NO: 214276 - RNA, 19 nt, Human
uuuacagacaacaguggcu

SEQ ID NO: 214277 - RNA, 19 nt, Human
uuuuccuuuacagagcugg

SEQ ID NO: 214278 - RNA, 19 nt, Human
agcaggaggcagcagccuu

SEQ ID NO: 214279 - RNA, 23 nt, Human
aggacaaagccauccucaaaaga

SEQ ID NO: 214280 - RNA, 24 nt, Human
aggaggaggcgcggcccggcggga

SEQ ID NO: 214281 - RNA, 25 nt, Human
caaaagacagagauaaccgaaacag

SEQ ID NO: 214282 - RNA, 23 nt, Human
caaagccauccucaaaagacaga

SEQ ID NO: 214283 - RNA, 22 nt, Human
cagcuaagccggggaugaggac

SEQ ID NO: 214284 - RNA, 22 nt, Human
caggaggaggaggaggcgcggc

SEQ ID NO: 214285 - RNA, 20 nt, Human
ccucaaaagaggaaggugaa

SEQ ID NO: 214286 - RNA, 20 nt, Human
cucaaaagacagagauaacc

SEQ ID NO: 214287 - RNA, 19 nt, Human
cucaaaagaggaaggugaa

SEQ ID NO: 214288 - RNA, 25 nt, Human
gaaaaauacuccucaaaagaggaag

SEQ ID NO: 214289 - RNA, 19 nt, Human
gaauacauaauggaaaaau

SEQ ID NO: 214290 - RNA, 18 nt, Human
gaaugucauuuauugaaa

SEQ ID NO: 214291 - RNA, 21 nt, Human
gaggacagagcaggaggcagc

SEQ ID NO: 214292 - RNA, 19 nt, Human
gaggacgaggguuggggag

SEQ ID NO: 214293 - RNA, 20 nt, Human
gcagcugcugguggaauugg

SEQ ID NO: 214294 - RNA, 21 nt, Human
gcgcagaggacgaggguuggg

SEQ ID NO: 214295 - RNA, 19 nt, Human
gcggggagcaggaggagga

SEQ ID NO: 214296 - RNA, 19 nt, Human
ggaugaggacagagcagga

SEQ ID NO: 214297 - RNA, 22 nt, Human
gggagcaggaggaggaggaggc

SEQ ID NO: 214298 - RNA, 20 nt, Human
gggaugaggacagagcagga

SEQ ID NO: 214299 - RNA, 20 nt, Human
aaaccaauccuucagucucc

SEQ ID NO: 214300 - RNA, 19 nt, Human
aagaacacaaaauaaacca

SEQ ID NO: 214301 - RNA, 22 nt, Human
agucggccugcggcccggccuc

SEQ ID NO: 214302 - RNA, 21 nt, Human
cagcagcagcagcgacgcgcg

SEQ ID NO: 214303 - RNA, 20 nt, Human
cagcagcagcgacgcgcgcg

SEQ ID NO: 214304 - RNA, 21 nt, Human
cagcccccgcugucccgccgg

SEQ ID NO: 214305 - RNA, 24 nt, Human
cccccgcugucccgccggcuggcg

SEQ ID NO: 214306 - RNA, 23 nt, Human
ccccgccagcccccgcugucccg

SEQ ID NO: 214307 - RNA, 23 nt, Human
cccgccagcccccgcugucccgc

SEQ ID NO: 214308 - RNA, 19 nt, Human
ccggcccccgccagccccc

SEQ ID NO: 214309 - RNA, 22 nt, Human
cgccagagccccgcagcagcag

SEQ ID NO: 214310 - RNA, 26 nt, Human
cgccagagccccgcagcagcagcagc

SEQ ID NO: 214311 - RNA, 20 nt, Human
cuccccggcccccgccagcc

SEQ ID NO: 214312 - RNA, 22 nt, Human
cuccccggcccccgccagcccc

SEQ ID NO: 214313 - RNA, 20 nt, Human
cuggcacuuuuguuuuucuu

SEQ ID NO: 214314 - RNA, 22 nt, Human
gaacacaaaauaaaccaauccu

SEQ ID NO: 214315 - RNA, 19 nt, Human
gacaucuucuggcacuuuu

SEQ ID NO: 214316 - RNA, 20 nt, Human
gaugaugugcuucuugaucc

SEQ ID NO: 214317 - RNA, 22 nt, Human
gccagagccccgcagcagcagc

SEQ ID NO: 214318 - RNA, 23 nt, Human
ucauuggugaugaugugcuucuu

SEQ ID NO: 214319 - RNA, 21 nt, Human
ucuggcacuuuuguuuuucuu

SEQ ID NO: 214320 - RNA, 26 nt, Human
uggcacuuuuguuuuucuugugacuc

SEQ ID NO: 214321 - RNA, 19 nt, Human
uggcuggacaucuucuggc

SEQ ID NO: 214322 - RNA, 20 nt, Human
uggcuggacaucuucuggca

SEQ ID NO: 214323 - RNA, 23 nt, Human
uguccaaauccaucaucuggcgc

SEQ ID NO: 214324 - RNA, 18 nt, Human
uuagaggaaaccgugugu

SEQ ID NO: 214325 - RNA, 24 nt, Human
aaaagacagacaaacgguuuacaa

SEQ ID NO: 214326 - RNA, 23 nt, Human
aaacaguaacaaaagacagacaa

SEQ ID NO: 214327 - RNA, 22 nt, Human
aaccacagcagcgacacggacc

SEQ ID NO: 214328 - RNA, 19 nt, Human
aaccgcggacagcggcaac

SEQ ID NO: 214329 - RNA, 22 nt, Human
aagcagcugcagugugauucaa

SEQ ID NO: 214330 - RNA, 19 nt, Human
acacaaacacccagcuaau

SEQ ID NO: 214331 - RNA, 23 nt, Human
acacagcugagcuccuagacucc

SEQ ID NO: 214332 - RNA, 22 nt, Human
acacccaggcuagcuauaaacu

SEQ ID NO: 214333 - RNA, 20 nt, Human
acagggaggcucacgaagug

SEQ ID NO: 214334 - RNA, 19 nt, Human
acagugagguauguggggc

SEQ ID NO: 214335 - RNA, 22 nt, Human
accaugugacacggcgcagagu

SEQ ID NO: 214336 - RNA, 22 nt, Human
agacagacaaacgguuuacaaa

SEQ ID NO: 214337 - RNA, 22 nt, Human
agacagacccccuugccaugcu

SEQ ID NO: 214338 - RNA, 19 nt, Human
agagacagacccccuugcc

SEQ ID NO: 214339 - RNA, 18 nt, Human
agccccuggacacaccuc

SEQ ID NO: 214340 - RNA, 18 nt, Human
agcgacacggaccugugc

SEQ ID NO: 214341 - RNA, 22 nt, Human
agcgagcccacguuggccgccc

SEQ ID NO: 214342 - RNA, 19 nt, Human
agcggcaaccacagcagcg

SEQ ID NO: 214343 - RNA, 24 nt, Human
auaaaacaguaacaaaagacagac

SEQ ID NO: 214344 - RNA, 18 nt, Human
cacauucaguucuuaaua

SEQ ID NO: 214345 - RNA, 22 nt, Human
caccacggucaauuuuauugcu

SEQ ID NO: 214346 - RNA, 19 nt, Human
cagaacgaccaacagcuga

SEQ ID NO: 214347 - RNA, 18 nt, Human
caggcuagcuauaaacuu

SEQ ID NO: 214348 - RNA, 18 nt, Human
caucggcagagacagacc

SEQ ID NO: 214349 - RNA, 23 nt, Human
ccaacagcugaaacccgcggggc

SEQ ID NO: 214350 - RNA, 19 nt, Human
ccagccccuggacacaccu

SEQ ID NO: 214351 - RNA, 22 nt, Human
ccccucagaacgaccaacagcu

SEQ ID NO: 214352 - RNA, 21 nt, Human
cccgcggggcggacuccgugu

SEQ ID NO: 214353 - RNA, 18 nt, Human
cggcgcagagucagugcc

SEQ ID NO: 214354 - RNA, 20 nt, Human
cgucucggcuuccccagccc

SEQ ID NO: 214355 - RNA, 21 nt, Human
cucagggccacgcugccggcc

SEQ ID NO: 214356 - RNA, 22 nt, Human
cucugugcugaagaagccccuc

SEQ ID NO: 214357 - RNA, 23 nt, Human
cugaaacccgcggggcggacucc

SEQ ID NO: 214358 - RNA, 31 nt, Human
cugugacuuauuuaaaaaaaaaaaaaaaccc

SEQ ID NO: 214359 - RNA, 24 nt, Human
cuuccccagccccuggacacaccu

SEQ ID NO: 214360 - RNA, 20 nt, Human
cuugccaugcucagggccaa

SEQ ID NO: 214361 - RNA, 23 nt, Human
gacacaguggggggucucugugc

SEQ ID NO: 214362 - RNA, 22 nt, Human
gagacagugagguauguggggc

SEQ ID NO: 214363 - RNA, 20 nt, Human
gcagcgacacggaccugugc

SEQ ID NO: 214364 - RNA, 21 nt, Human
gcagcgacacggaccugugcu

SEQ ID NO: 214365 - RNA, 24 nt, Human
gcagugguaguauuuaucccacac

SEQ ID NO: 214366 - RNA, 24 nt, Human
gcccgucucggcuuccccagcccc

SEQ ID NO: 214367 - RNA, 23 nt, Human
ggacacaccuccaccuggcagag

SEQ ID NO: 214368 - RNA, 22 nt, Human
guccucucguggcgcuggcauc

SEQ ID NO: 214369 - RNA, 21 nt, Human
uaaaaauggaaagcagcugca

SEQ ID NO: 214370 - RNA, 22 nt, Human
uaaaagguacacccaggcuagc

SEQ ID NO: 214371 - RNA, 19 nt, Human
uaaaauucccgaagccagu

SEQ ID NO: 214372 - RNA, 21 nt, Human
uaaaauucccgaagccaguuc

SEQ ID NO: 214373 - RNA, 18 nt, Human
uaacguaggauacuuggc

SEQ ID NO: 214374 - RNA, 21 nt, Human
uacacagaagaacggcauggg

SEQ ID NO: 214375 - RNA, 24 nt, Human
uaggaaccagaccggucacuucca

SEQ ID NO: 214376 - RNA, 20 nt, Human
uauauauuuauauauauaua

SEQ ID NO: 214377 - RNA, 18 nt, Human
uauuguuguaacguagga

SEQ ID NO: 214378 - RNA, 25 nt, Human
ucaacagacucucuaaucaccuucu

SEQ ID NO: 214379 - RNA, 23 nt, Human
ucaucaacagacucucuaaucac

SEQ ID NO: 214380 - RNA, 18 nt, Human
uccacggcuacagggagg

SEQ ID NO: 214381 - RNA, 20 nt, Human
ucccacacaaacacccagcu

SEQ ID NO: 214382 - RNA, 26 nt, Human
ucccuggacacaguggggggucucug

SEQ ID NO: 214383 - RNA, 26 nt, Human
ucggcagagacagacccccuugccau

SEQ ID NO: 214384 - RNA, 23 nt, Human
ugacuuauuuaaaaaaaaaaaaa

SEQ ID NO: 214385 - RNA, 26 nt, Human
ugagcuccuagacuccaaugccgccu

SEQ ID NO: 214386 - RNA, 19 nt, Human
ugcaacaagguuaugacau

SEQ ID NO: 214387 - RNA, 19 nt, Human
ugcagcuuucaagagugcg

SEQ ID NO: 214388 - RNA, 19 nt, Human
ugcugaagaagccccucca

SEQ ID NO: 214389 - RNA, 19 nt, Human
ugcuguacuuacugcuaua

SEQ ID NO: 214390 - RNA, 20 nt, Human
uggcaccauaaaacaguaac

SEQ ID NO: 214391 - RNA, 20 nt, Human
uguguugauggacacacagc

SEQ ID NO: 214392 - RNA, 20 nt, Human
uucaucaacagacucucuaa

SEQ ID NO: 214393 - RNA, 21 nt, Human
aacacaguguaugaaugggag

SEQ ID NO: 214394 - RNA, 24 nt, Human
aacuggcucccaucaucuccaguc

SEQ ID NO: 214395 - RNA, 18 nt, Human
aagcuuuuggugaccagc

SEQ ID NO: 214396 - RNA, 21 nt, Human
acacccuccugagcugucacc

SEQ ID NO: 214397 - RNA, 23 nt, Human
acuccgcugccccagguuccggg

SEQ ID NO: 214398 - RNA, 21 nt, Human
agacccaaaacagcugggcag

SEQ ID NO: 214399 - RNA, 24 nt, Human
agguaaucaaccaucauccagagc

SEQ ID NO: 214400 - RNA, 21 nt, Human
agguggggcugguaauuggca

SEQ ID NO: 214401 - RNA, 23 nt, Human
aguggguugcagaggaacuggug

SEQ ID NO: 214402 - RNA, 23 nt, Human
caagcagucccugauauguucaa

SEQ ID NO: 214403 - RNA, 18 nt, Human
caagcuuuuggugaccag

SEQ ID NO: 214404 - RNA, 24 nt, Human
cacacccuccugagcugucaccac

SEQ ID NO: 214405 - RNA, 18 nt, Human
cagaaccagaauguccuc

SEQ ID NO: 214406 - RNA, 20 nt, Human
cagaaccagaauguccucaa

SEQ ID NO: 214407 - RNA, 21 nt, Human
cagaauguccucaauuuuguc

SEQ ID NO: 214408 - RNA, 24 nt, Human
cagagucagcucacuaaugguuuc

SEQ ID NO: 214409 - RNA, 18 nt, Human
cagguaaucaaccaucau

SEQ ID NO: 214410 - RNA, 24 nt, Human
cagguaguucccagacacagacaa

SEQ ID NO: 214411 - RNA, 24 nt, Human
caucuuauuuacgaagagcuccaa

SEQ ID NO: 214412 - RNA, 24 nt, Human
ccagaacacuccaagcaacccgcg

SEQ ID NO: 214413 - RNA, 19 nt, Human
ccauggggcuauccaacug

SEQ ID NO: 214414 - RNA, 19 nt, Human
cccagacacagacaaaaag

SEQ ID NO: 214415 - RNA, 25 nt, Human
ccccugcugagcgcacacacccucc

SEQ ID NO: 214416 - RNA, 19 nt, Human
cuccaagucaaucucaaca

SEQ ID NO: 214417 - RNA, 24 nt, Human
cuccaggaaaagcagcagggcuuc

SEQ ID NO: 214418 - RNA, 21 nt, Human
cuuccugcuggacagcauuuc

SEQ ID NO: 214419 - RNA, 18 nt, Human
gagucagcucacuaaugg

SEQ ID NO: 214420 - RNA, 19 nt, Human
gcagaaccagaauguccuc

SEQ ID NO: 214421 - RNA, 22 nt, Human
ggagacccaaaacagcugggca

SEQ ID NO: 214422 - RNA, 20 nt, Human
ggagagagaggcucagagug

SEQ ID NO: 214423 - RNA, 22 nt, Human
ggaggagagagaggcucagagu

SEQ ID NO: 214424 - RNA, 18 nt, Human
gguugcagaggaacuggu

SEQ ID NO: 214425 - RNA, 20 nt, Human
guggauuuucucccgugucu

SEQ ID NO: 214426 - RNA, 22 nt, Human
uaaggcaucucuugagcugaaa

SEQ ID NO: 214427 - RNA, 23 nt, Human
uagcuagaauauucucauccaaa

SEQ ID NO: 214428 - RNA, 21 nt, Human
uaugguaggugcuguaacaga

SEQ ID NO: 214429 - RNA, 20 nt, Human
uccaacuggcucccaucauc

SEQ ID NO: 214430 - RNA, 20 nt, Human
uccaagcaguuaugguaggu

SEQ ID NO: 214431 - RNA, 18 nt, Human
uccagagcucuuugggga

SEQ ID NO: 214432 - RNA, 21 nt, Human
ucgaagcaauaagcugccaaa

SEQ ID NO: 214433 - RNA, 23 nt, Human
ucugaccucaggccugguugcug

SEQ ID NO: 214434 - RNA, 22 nt, Human
ugcagaaccagaauguccucaa

SEQ ID NO: 214435 - RNA, 21 nt, Human
ugccccagguuccgggacagu

SEQ ID NO: 214436 - RNA, 23 nt, Human
ugcugagcgcacacacccuccug

SEQ ID NO: 214437 - RNA, 22 nt, Human
ugggagacccaaaacagcuggg

SEQ ID NO: 214438 - RNA, 20 nt, Human
ugguagguccaagauuggcu

SEQ ID NO: 214439 - RNA, 24 nt, Human
uucccagacacagacaaaaaguaa

SEQ ID NO: 214440 - RNA, 27 nt, Human
aaaaagcaacauaaggaaagacaucac

SEQ ID NO: 214441 - RNA, 23 nt, Human
aaacaagcuacccagacucuuca

SEQ ID NO: 214442 - RNA, 20 nt, Human
aacaagcuacccagacucuu

SEQ ID NO: 214443 - RNA, 21 nt, Human
aaccaaagaacugagaagcca

SEQ ID NO: 214444 - RNA, 21 nt, Human
aauucugcuauguugaaaaag

SEQ ID NO: 214445 - RNA, 24 nt, Human
acagagauaggaagaaaaggcugc

SEQ ID NO: 214446 - RNA, 19 nt, Human
acugagaagccagguagau

SEQ ID NO: 214447 - RNA, 20 nt, Human
acugggcuucuuaaugcuuu

SEQ ID NO: 214448 - RNA, 20 nt, Human
agagcugaaagccacagaga

SEQ ID NO: 214449 - RNA, 18 nt, Human
agcaaagacucuucuacc

SEQ ID NO: 214450 - RNA, 19 nt, Human
agccacagagauaggaaga

SEQ ID NO: 214451 - RNA, 18 nt, Human
agccaggcuggagagcac

SEQ ID NO: 214452 - RNA, 20 nt, Human
aggcagugaacucugugggc

SEQ ID NO: 214453 - RNA, 19 nt, Human
aggccuuggcaucucuagc

SEQ ID NO: 214454 - RNA, 19 nt, Human
aucucuccacuggagaaua

SEQ ID NO: 214455 - RNA, 22 nt, Human
caaagacucuucuaccagcacg

SEQ ID NO: 214456 - RNA, 21 nt, Human
caacagcaaagacucuucuac

SEQ ID NO: 214457 - RNA, 24 nt, Human
caacagcaaagacucuucuaccag

SEQ ID NO: 214458 - RNA, 18 nt, Human
cacaggccuuggcaucuc

SEQ ID NO: 214459 - RNA, 23 nt, Human
cacccaucuauucuccuaauaac

SEQ ID NO: 214460 - RNA, 25 nt, Human
caggaggagccagcaggaggucccg

SEQ ID NO: 214461 - RNA, 21 nt, Human
caucuauucuccuaauaacca

SEQ ID NO: 214462 - RNA, 21 nt, Human
caucucuagcccaagcugagg

SEQ ID NO: 214463 - RNA, 18 nt, Human
ccaaggaagcagagcuga

SEQ ID NO: 214464 - RNA, 19 nt, Human
ccaggcuggagagcacggc

SEQ ID NO: 214465 - RNA, 18 nt, Human
ccucccuggcagccaggc

SEQ ID NO: 214466 - RNA, 18 nt, Human
ccuccgaacacacaccgu

SEQ ID NO: 214467 - RNA, 21 nt, Human
cgauggaauacauguuggggg

SEQ ID NO: 214468 - RNA, 18 nt, Human
cucucgaggucauccuga

SEQ ID NO: 214469 - RNA, 18 nt, Human
cugcacuauuucaagagc

SEQ ID NO: 214470 - RNA, 25 nt, Human
cuggaaccaagaggcccacccuccc

SEQ ID NO: 214471 - RNA, 27 nt, Human
cugggcaggaggagccagcaggagguu

SEQ ID NO: 214472 - RNA, 22 nt, Human
cugguggguuugggcacguggu

SEQ ID NO: 214473 - RNA, 19 nt, Human
cuuaaugcuuucaccccuc

SEQ ID NO: 214474 - RNA, 23 nt, Human
cuuaaugcuuucaccccuccgaa

SEQ ID NO: 214475 - RNA, 18 nt, Human
gcauaggaagcugggcag

SEQ ID NO: 214476 - RNA, 22 nt, Human
gcugcaguuccuuucuucagaa

SEQ ID NO: 214477 - RNA, 22 nt, Human
gggacuuuagcuaaagcagcuu

SEQ ID NO: 214478 - RNA, 22 nt, Human
gggcaggaggagccagcaggag

SEQ ID NO: 214479 - RNA, 20 nt, Human
gucucacuccaggagggcac

SEQ ID NO: 214480 - RNA, 24 nt, Human
uaaagcagcuugugucacugaagc

SEQ ID NO: 214481 - RNA, 21 nt, Human
uacgcagacuuccaucauggg

SEQ ID NO: 214482 - RNA, 18 nt, Human
uagcccaagcugaggcca

SEQ ID NO: 214483 - RNA, 21 nt, Human
ucaguggcagcucacugaggg

SEQ ID NO: 214484 - RNA, 19 nt, Human
ucaugaguguucgauccau

SEQ ID NO: 214485 - RNA, 23 nt, Human
ucucuccacuggagaauaggagc

SEQ ID NO: 214486 - RNA, 22 nt, Human
ugaaaaagcaacauaaggaaag

SEQ ID NO: 214487 - RNA, 18 nt, Human
ugcacuauuucaagagcc

SEQ ID NO: 214488 - RNA, 18 nt, Human
uggaauacauguuggggg

SEQ ID NO: 214489 - RNA, 19 nt, Human
uggcagccaggcuggagag

SEQ ID NO: 214490 - RNA, 21 nt, Human
uggcagccaggcuggagagca

SEQ ID NO: 214491 - RNA, 18 nt, Human
uggcuuaacuguggcugg

SEQ ID NO: 214492 - RNA, 18 nt, Human
ugggcacgugguuuuagg

SEQ ID NO: 214493 - RNA, 25 nt, Human
ugggcucccgacucaguggcagcuc

SEQ ID NO: 214494 - RNA, 22 nt, Human
uggugcuaagucucacaggcag

SEQ ID NO: 214495 - RNA, 28 nt, Human
uuccagccucagcacuuggugcuaaguc

SEQ ID NO: 214496 - RNA, 19 nt, Human
uucguaaagcacuuagcac

SEQ ID NO: 214497 - RNA, 21 nt, Human
uuggggggcuuggcuuaacug

SEQ ID NO: 214498 - RNA, 18 nt, Human
uuggugcuaagucucaca

SEQ ID NO: 214499 - RNA, 19 nt, Human
aaccauggcaacugaccuu

SEQ ID NO: 214500 - RNA, 20 nt, Human
aaccccaauaauauuaaggu

SEQ ID NO: 214501 - RNA, 19 nt, Human
aaccucccucccccacccu

SEQ ID NO: 214502 - RNA, 19 nt, Human
acagcaccagaguaaccag

SEQ ID NO: 214503 - RNA, 20 nt, Human
acccaaauggacccccacag

SEQ ID NO: 214504 - RNA, 23 nt, Human
acccccacaggcaccccuggggc

SEQ ID NO: 214505 - RNA, 19 nt, Human
accccuggggcugggaggc

SEQ ID NO: 214506 - RNA, 20 nt, Human
acccuggggccauagcuggg

SEQ ID NO: 214507 - RNA, 20 nt, Human
accucccucccccacccugc

SEQ ID NO: 214508 - RNA, 23 nt, Human
acuccgccgcgcaggccgccucg

SEQ ID NO: 214509 - RNA, 26 nt, Human
agacguacccaaauggacccccacag

SEQ ID NO: 214510 - RNA, 23 nt, Human
agagagauacugcccugacccuc

SEQ ID NO: 214511 - RNA, 19 nt, Human
agagauacugcccugaccc

SEQ ID NO: 214512 - RNA, 20 nt, Human
agaguaaccaggguccucgg

SEQ ID NO: 214513 - RNA, 22 nt, Human
agcagggaggggcucugaguuc

SEQ ID NO: 214514 - RNA, 20 nt, Human
aggcuggggccgggcccggg

SEQ ID NO: 214515 - RNA, 19 nt, Human
aggugcucucccuccccag

SEQ ID NO: 214516 - RNA, 22 nt, Human
auccccaauaaauaggcacccc

SEQ ID NO: 214517 - RNA, 20 nt, Human
caauaaauaggcaccccaau

SEQ ID NO: 214518 - RNA, 24 nt, Human
cacagaccaggagacagugagaac

SEQ ID NO: 214519 - RNA, 18 nt, Human
caccagaguaaccagggu

SEQ ID NO: 214520 - RNA, 21 nt, Human
cacccugccgccgugcauccc

SEQ ID NO: 214521 - RNA, 19 nt, Human
caccgcccgcccccgccgc

SEQ ID NO: 214522 - RNA, 21 nt, Human
caccgcgcagccgccgcugcc

SEQ ID NO: 214523 - RNA, 22 nt, Human
cagaacaguuuaaauaaacccc

SEQ ID NO: 214524 - RNA, 18 nt, Human
cagccgccgcugccugca

SEQ ID NO: 214525 - RNA, 18 nt, Human
caggaugcccuaauuagg

SEQ ID NO: 214526 - RNA, 22 nt, Human
ccaaccaaccccaauaauauua

SEQ ID NO: 214527 - RNA, 23 nt, Human
cccacaggcaccccuggggcugg

SEQ ID NO: 214528 - RNA, 25 nt, Human
cccacaggcaccccuggggcuggga

SEQ ID NO: 214529 - RNA, 21 nt, Human
ccccuggggcugggaggcggg

SEQ ID NO: 214530 - RNA, 24 nt, Human
cccgggcugagaccugcgaggaac

SEQ ID NO: 214531 - RNA, 23 nt, Human
cccgguccucgggcuauuccuuc

SEQ ID NO: 214532 - RNA, 19 nt, Human
cccucccccacccugccgc

SEQ ID NO: 214533 - RNA, 21 nt, Human
cccuggggccauagcugggcc

SEQ ID NO: 214534 - RNA, 23 nt, Human
cccuggggccauagcugggccuu

SEQ ID NO: 214535 - RNA, 20 nt, Human
cccuggggcugggaggcggg

SEQ ID NO: 214536 - RNA, 18 nt, Human
ccgcccgcccccgccgcc

SEQ ID NO: 214537 - RNA, 20 nt, Human
ccgcccgcccccgccgcccc

SEQ ID NO: 214538 - RNA, 18 nt, Human
ccgccgcgcaggccgccu

SEQ ID NO: 214539 - RNA, 19 nt, Human
ccgccgcugccugcagcgc

SEQ ID NO: 214540 - RNA, 18 nt, Human
ccgcgcagccgccgcugc

SEQ ID NO: 214541 - RNA, 21 nt, Human
ccgggcccggggcccgggcuu

SEQ ID NO: 214542 - RNA, 18 nt, Human
ccucccucccccacccug

SEQ ID NO: 214543 - RNA, 26 nt, Human
ccugagccuaaaaggcgaggggcagg

SEQ ID NO: 214544 - RNA, 22 nt, Human
ccugccccaccccaaccaaccc

SEQ ID NO: 214545 - RNA, 27 nt, Human
ccugcgaggaaccucccucccccaccc

SEQ ID NO: 214546 - RNA, 25 nt, Human
ccuuacgacugcccaggaggcugcu

SEQ ID NO: 214547 - RNA, 22 nt, Human
cgaggaaccucccucccccacc

SEQ ID NO: 214548 - RNA, 18 nt, Human
cgccgccccgcgccaucc

SEQ ID NO: 214549 - RNA, 18 nt, Human
cuugguagcagggagggg

SEQ ID NO: 214550 - RNA, 21 nt, Human
cuuuauggcugagauccugcc

SEQ ID NO: 214551 - RNA, 18 nt, Human
gaacuaagcaaacuggca

SEQ ID NO: 214552 - RNA, 18 nt, Human
gacacccgcccccacccc

SEQ ID NO: 214553 - RNA, 21 nt, Human
gaccugcgaggaaccucccuc

SEQ ID NO: 214554 - RNA, 22 nt, Human
gaccuuccguccugagccuaaa

SEQ ID NO: 214555 - RNA, 23 nt, Human
gacguacccaaauggacccccac

SEQ ID NO: 214556 - RNA, 24 nt, Human
gagauccugccccaccccaaccaa

SEQ ID NO: 214557 - RNA, 18 nt, Human
gaggaaccucccuccccc

SEQ ID NO: 214558 - RNA, 19 nt, Human
gcagaaacuggugaaagug

SEQ ID NO: 214559 - RNA, 24 nt, Human
gcccgcgcagggcucagcaccgcc

SEQ ID NO: 214560 - RNA, 19 nt, Human
gcgaggggcaggaugcccu

SEQ ID NO: 214561 - RNA, 19 nt, Human
ggaaccucccucccccacc

SEQ ID NO: 214562 - RNA, 21 nt, Human
ggacagagccggggaucggga

SEQ ID NO: 214563 - RNA, 25 nt, Human
ggacggacacccgcccccaccccca

SEQ ID NO: 214564 - RNA, 19 nt, Human
ggagacagugagaacuaag

SEQ ID NO: 214565 - RNA, 21 nt, Human
ggccgggcccggggcccgggc

SEQ ID NO: 214566 - RNA, 19 nt, Human
gggcugagaccugcgagga

SEQ ID NO: 214567 - RNA, 21 nt, Human
gggcuugaggauccgugggcc

SEQ ID NO: 214568 - RNA, 22 nt, Human
ggggccgggcccggggcccggg

SEQ ID NO: 214569 - RNA, 25 nt, Human
ggggccgggcccggggcccgggcuu

SEQ ID NO: 214570 - RNA, 21 nt, Human
gggguggggaggucuuagcgg

SEQ ID NO: 214571 - RNA, 21 nt, Human
gguagcagggaggggcucuga

SEQ ID NO: 214572 - RNA, 22 nt, Human
uaaaacaggacagcaccagagu

SEQ ID NO: 214573 - RNA, 22 nt, Human
uaaauaggcagagagauacugc

SEQ ID NO: 214574 - RNA, 24 nt, Human
uaacuuuucaacccuggggccaua

SEQ ID NO: 214575 - RNA, 20 nt, Human
uaagcaaacuggcacuuuau

SEQ ID NO: 214576 - RNA, 22 nt, Human
uacccaaauggacccccacagg

SEQ ID NO: 214577 - RNA, 25 nt, Human
uagcggagcuccuccgcugugguuc

SEQ ID NO: 214578 - RNA, 23 nt, Human
ucaccgcgcagccgccgcugccu

SEQ ID NO: 214579 - RNA, 21 nt, Human
uccccaauaaauaggcacccc

SEQ ID NO: 214580 - RNA, 18 nt, Human
uccccagacccacacaga

SEQ ID NO: 214581 - RNA, 20 nt, Human
uccugccccaccccaaccaa

SEQ ID NO: 214582 - RNA, 21 nt, Human
ugagaccugcgaggaaccucc

SEQ ID NO: 214583 - RNA, 19 nt, Human
ugcauccccagagcagggc

SEQ ID NO: 214584 - RNA, 18 nt, Human
ugccccaccccaaccaac

SEQ ID NO: 214585 - RNA, 19 nt, Human
ugccccaccccaaccaacc

SEQ ID NO: 214586 - RNA, 22 nt, Human
ugcgaggaaccucccuccccca

SEQ ID NO: 214587 - RNA, 21 nt, Human
ugggccggacagagccgggga

SEQ ID NO: 214588 - RNA, 19 nt, Human
ugggccuugguagcaggga

SEQ ID NO: 214589 - RNA, 18 nt, Human
uggggccauagcugggcc

SEQ ID NO: 214590 - RNA, 21 nt, Human
ugguagcagggaggggcucug

SEQ ID NO: 214591 - RNA, 19 nt, Human
ugguucaggcccgguggaa

SEQ ID NO: 214592 - RNA, 27 nt, Human
ugucccgggcugagaccugcgaggaac

SEQ ID NO: 214593 - RNA, 18 nt, Human
aggcggcggguggggggc

SEQ ID NO: 214594 - RNA, 20 nt, Human
aggcggcggguggggggcug

SEQ ID NO: 214595 - RNA, 19 nt, Human
agugaugugcuugauggcc

SEQ ID NO: 214596 - RNA, 25 nt, Human
agugaugugcuugauggccucuucu

SEQ ID NO: 214597 - RNA, 18 nt, Human
gaggcggcgggugggggg

SEQ ID NO: 214598 - RNA, 21 nt, Human
uauuccaucucucucggugca

SEQ ID NO: 214599 - RNA, 18 nt, Human
ugaugugcuugauggccu

SEQ ID NO: 214600 - RNA, 19 nt, Human
ugaugugcuugauggccuc

SEQ ID NO: 214601 - RNA, 21 nt, Human
ugaugugcuugauggccucuu

SEQ ID NO: 214602 - RNA, 22 nt, Human
ugcaggaggcggcggguggggg

SEQ ID NO: 214603 - RNA, 20 nt, Human
accagacugugcuggugugu

SEQ ID NO: 214604 - RNA, 23 nt, Human
cuguagccuaccagacugugcug

SEQ ID NO: 214605 - RNA, 19 nt, Human
guccaguccaugauuacuc

SEQ ID NO: 214606 - RNA, 19 nt, Human
ucucagccuuucuuuagag

SEQ ID NO: 214607 - RNA, 18 nt, Human
ugagaauggaugagaugu

SEQ ID NO: 214608 - RNA, 20 nt, Human
ugagauguccaguccaugau

SEQ ID NO: 214609 - RNA, 20 nt, Human
uggaugagauguccagucca

SEQ ID NO: 214610 - RNA, 21 nt, Human
acacaauauuaguguucuacc

SEQ ID NO: 214611 - RNA, 20 nt, Human
acuguaauuaaacaugugaa

SEQ ID NO: 214612 - RNA, 22 nt, Human
cacugugguuucaaccgcucag

SEQ ID NO: 214613 - RNA, 18 nt, Human
cauuggguauuugcucuu

SEQ ID NO: 214614 - RNA, 23 nt, Human
cgcagcauuugaaauuucaaagc

SEQ ID NO: 214615 - RNA, 23 nt, Human
gaaucugauaugguaacccacgc

SEQ ID NO: 214616 - RNA, 21 nt, Human
ucacugugguuucaaccgcuc

SEQ ID NO: 214617 - RNA, 23 nt, Human
ucacugugguuucaaccgcucag

SEQ ID NO: 214618 - RNA, 24 nt, Human
uugcaauuuugcgcagcauuugaa

SEQ ID NO: 214619 - RNA, 24 nt, Human
agcuuuuauuagguuagaaaaaau

SEQ ID NO: 214620 - RNA, 19 nt, Human
aaaaagcuucuccccgcca

SEQ ID NO: 214621 - RNA, 18 nt, Human
aaaacgcacaguggaaug

SEQ ID NO: 214622 - RNA, 23 nt, Human
aaacaaucccagacaacaguuca

SEQ ID NO: 214623 - RNA, 22 nt, Human
aacaaagaugaucaaaccaaaa

SEQ ID NO: 214624 - RNA, 26 nt, Human
aagcagaucccuuuagaaaaaggcuc

SEQ ID NO: 214625 - RNA, 23 nt, Human
acauacaaaaagguaaagccaga

SEQ ID NO: 214626 - RNA, 18 nt, Human
acccguacgcuacauaca

SEQ ID NO: 214627 - RNA, 18 nt, Human
aggguggggagggggcag

SEQ ID NO: 214628 - RNA, 24 nt, Human
aguggcaggguggggagggggcag

SEQ ID NO: 214629 - RNA, 25 nt, Human
auuuauuccucaagauucacccaaa

SEQ ID NO: 214630 - RNA, 18 nt, Human
caacguaaaagugggggu

SEQ ID NO: 214631 - RNA, 19 nt, Human
cacaagccauaauaaagcu

SEQ ID NO: 214632 - RNA, 21 nt, Human
cacgagacaaacgcguacagc

SEQ ID NO: 214633 - RNA, 18 nt, Human
cacucccuucccuccccc

SEQ ID NO: 214634 - RNA, 18 nt, Human
cacucucacccggugggg

SEQ ID NO: 214635 - RNA, 19 nt, Human
cagaaagagacugacuccu

SEQ ID NO: 214636 - RNA, 18 nt, Human
cagggcgcacucucuuug

SEQ ID NO: 214637 - RNA, 18 nt, Human
caggguggggagggggca

SEQ ID NO: 214638 - RNA, 23 nt, Human
cccccacaaaacaaucccagaca

SEQ ID NO: 214639 - RNA, 23 nt, Human
ccccccuccgcgcucggccccgg

SEQ ID NO: 214640 - RNA, 20 nt, Human
cccgggcgcggcggcugcgg

SEQ ID NO: 214641 - RNA, 22 nt, Human
cccuccccccacaaaacaaucc

SEQ ID NO: 214642 - RNA, 18 nt, Human
cccuccgcgcucggcccc

SEQ ID NO: 214643 - RNA, 19 nt, Human
cgagacaaacgcguacagc

SEQ ID NO: 214644 - RNA, 19 nt, Human
cgaggcgagaccagaccgc

SEQ ID NO: 214645 - RNA, 21 nt, Human
cgagggcacggcacuggcucg

SEQ ID NO: 214646 - RNA, 21 nt, Human
cgggggcgaggcucccccagc

SEQ ID NO: 214647 - RNA, 23 nt, Human
cguacgcuacauacauagagagc

SEQ ID NO: 214648 - RNA, 24 nt, Human
cucaacaaagaugaucaaaccaaa

SEQ ID NO: 214649 - RNA, 20 nt, Human
cucaagauucacccaaaaca

SEQ ID NO: 214650 - RNA, 19 nt, Human
cuccccccacaaaacaauc

SEQ ID NO: 214651 - RNA, 20 nt, Human
cuccgcgcucggccccggcc

SEQ ID NO: 214652 - RNA, 26 nt, Human
cuccgcgcucggccccggcggcccuc

SEQ ID NO: 214653 - RNA, 21 nt, Human
cucgguccccccuccgcgcuc

SEQ ID NO: 214654 - RNA, 21 nt, Human
gaacacucccuucccuccccc

SEQ ID NO: 214655 - RNA, 21 nt, Human
gcacuggcucgguccccccuc

SEQ ID NO: 214656 - RNA, 25 nt, Human
gcccuggggacccucgaagcagaau

SEQ ID NO: 214657 - RNA, 19 nt, Human
gcgcggcccgagggcacgg

SEQ ID NO: 214658 - RNA, 19 nt, Human
ggagacgacacucucaccc

SEQ ID NO: 214659 - RNA, 20 nt, Human
gggcgaggcucccccagcgc

SEQ ID NO: 214660 - RNA, 26 nt, Human
uacaguugaaacaguucuauugaagc

SEQ ID NO: 214661 - RNA, 19 nt, Human
uagaaaagagauugcauuu

SEQ ID NO: 214662 - RNA, 19 nt, Human
uagaccaugaacacagcga

SEQ ID NO: 214663 - RNA, 19 nt, Human
uagcaagaaaaaaagcuuc

SEQ ID NO: 214664 - RNA, 19 nt, Human
uagcaagaaaaaaagcuuc

SEQ ID NO: 214665 - RNA, 23 nt, Human
uauaaaggcauuuauuccucaag

SEQ ID NO: 214666 - RNA, 25 nt, Human
uaucauaaucuucauaauuaauaua

SEQ ID NO: 214667 - RNA, 22 nt, Human
uauguagaaaagagauugcauu

SEQ ID NO: 214668 - RNA, 23 nt, Human
ucaacaaagaugaucaaaccaaa

SEQ ID NO: 214669 - RNA, 21 nt, Human
ucacccggugggggcgggggc

SEQ ID NO: 214670 - RNA, 18 nt, Human
ucagugcccccggcccau

SEQ ID NO: 214671 - RNA, 19 nt, Human
uccccccuccgcgcucggc

SEQ ID NO: 214672 - RNA, 19 nt, Human
uccucaagauucacccaaa

SEQ ID NO: 214673 - RNA, 19 nt, Human
ucgggggccgggguggagg

SEQ ID NO: 214674 - RNA, 22 nt, Human
ugaaacacugaggcaguuacua

SEQ ID NO: 214675 - RNA, 22 nt, Human
ugauuuguucacauacaaaaag

SEQ ID NO: 214676 - RNA, 20 nt, Human
ugcccgggcgcggcggcugc

SEQ ID NO: 214677 - RNA, 20 nt, Human
uggaaugucaagaguggcag

SEQ ID NO: 214678 - RNA, 22 nt, Human
uguacagaaagagacugacucc

SEQ ID NO: 214679 - RNA, 22 nt, Human
uucacauacaaaaagguaaagc

SEQ ID NO: 214680 - RNA, 23 nt, Human
aaaaaaaaccaaaaaaaccaucu

SEQ ID NO: 214681 - RNA, 22 nt, Human
aaaaaaaauccuucagccugga

SEQ ID NO: 214682 - RNA, 23 nt, Human
aaaaaaccaaaaaaaccaucuug

SEQ ID NO: 214683 - RNA, 21 nt, Human
aaaaaaccaucuugaagcuca

SEQ ID NO: 214684 - RNA, 24 nt, Human
aaacacaaaauccugguuugaaac

SEQ ID NO: 214685 - RNA, 22 nt, Human
aagaagaaucugucgagagcac

SEQ ID NO: 214686 - RNA, 19 nt, Human
aagcucagacaccagcaaa

SEQ ID NO: 214687 - RNA, 18 nt, Human
aaugugaagggaggguag

SEQ ID NO: 214688 - RNA, 23 nt, Human
accgucguugccccaaaggagca

SEQ ID NO: 214689 - RNA, 20 nt, Human
acuguggaaaccccuugccc

SEQ ID NO: 214690 - RNA, 23 nt, Human
agaaaaaaaaaaaaccaaaaaaa

SEQ ID NO: 214691 - RNA, 26 nt, Human
agaaggaaggagagagggggaugagc

SEQ ID NO: 214692 - RNA, 18 nt, Human
aguucuuuuuuuuuuucc

SEQ ID NO: 214693 - RNA, 25 nt, Human
auaggaacgaucucugaacuccauu

SEQ ID NO: 214694 - RNA, 20 nt, Human
aucuugaagcucaaccugua

SEQ ID NO: 214695 - RNA, 23 nt, Human
auggacacacacacgugcauaca

SEQ ID NO: 214696 - RNA, 30 nt, Human
cacacacgugcauacacacgugagcacacg

SEQ ID NO: 214697 - RNA, 18 nt, Human
cacacgugagcacacgcc

SEQ ID NO: 214698 - RNA, 20 nt, Human
ccaccgccaccagcagcggg

SEQ ID NO: 214699 - RNA, 20 nt, Human
ccagcaaaaaaaaaaaaaaa

SEQ ID NO: 214700 - RNA, 24 nt, Human
ccagcaaaaaaaaaaaaaaaaaaa

SEQ ID NO: 214701 - RNA, 26 nt, Human
ccagcaaaaaaaaaaaaaaaaaaaaa

SEQ ID NO: 214702 - RNA, 22 nt, Human
ccccaaaggagcagcaacugug

SEQ ID NO: 214703 - RNA, 22 nt, Human
ccccgccggcccccggugccca

SEQ ID NO: 214704 - RNA, 20 nt, Human
ccccggugcccauggcugcg

SEQ ID NO: 214705 - RNA, 19 nt, Human
cccggugcccauggcugcg

SEQ ID NO: 214706 - RNA, 21 nt, Human
cccugcccgcccccgccacgg

SEQ ID NO: 214707 - RNA, 18 nt, Human
ccgcccccgccggccccc

SEQ ID NO: 214708 - RNA, 23 nt, Human
ccgccgcccccgccggcccccgg

SEQ ID NO: 214709 - RNA, 18 nt, Human
ccgccggcccccggugcc

SEQ ID NO: 214710 - RNA, 19 nt, Human
ccgccggcccccggugccc

SEQ ID NO: 214711 - RNA, 21 nt, Human
ccuugcccuccagguucacag

SEQ ID NO: 214712 - RNA, 19 nt, Human
cgaaaaaacacaaaauccu

SEQ ID NO: 214713 - RNA, 21 nt, Human
cgcgcgggcuuggcccggggg

SEQ ID NO: 214714 - RNA, 20 nt, Human
cgcgggcuuggcccgggggg

SEQ ID NO: 214715 - RNA, 23 nt, Human
cucaguucuuuuuuuuuuuccuu

SEQ ID NO: 214716 - RNA, 21 nt, Human
cugaagcucagacaccagcaa

SEQ ID NO: 214717 - RNA, 21 nt, Human
cugcugggggcgggugggggg

SEQ ID NO: 214718 - RNA, 21 nt, Human
cugguuugaaaccgucguugc

SEQ ID NO: 214719 - RNA, 20 nt, Human
gaaaaaacacaaaauccugg

SEQ ID NO: 214720 - RNA, 21 nt, Human
gaacagggcuggguguuuuug

SEQ ID NO: 214721 - RNA, 18 nt, Human
gaccacagacccuuaucc

SEQ ID NO: 214722 - RNA, 20 nt, Human
gagagcacagucucccaguc

SEQ ID NO: 214723 - RNA, 23 nt, Human
gagcacacgccgggaccacagac

SEQ ID NO: 214724 - RNA, 23 nt, Human
gccgugucuaauggacacacaca

SEQ ID NO: 214725 - RNA, 18 nt, Human
ggagagagggggaugagc

SEQ ID NO: 214726 - RNA, 18 nt, Human
ggaugagagaaaaaaaaa

SEQ ID NO: 214727 - RNA, 19 nt, Human
gggaaccccugcccgcccc

SEQ ID NO: 214728 - RNA, 21 nt, Human
gggaccacagacccuuaucca

SEQ ID NO: 214729 - RNA, 21 nt, Human
ggggcggguggggggaacgaa

SEQ ID NO: 214730 - RNA, 23 nt, Human
guggggggaacgaaaaaacacaa

SEQ ID NO: 214731 - RNA, 20 nt, Human
guuugaaaccgucguugccc

SEQ ID NO: 214732 - RNA, 24 nt, Human
guuuuuucuuucuuuuucuuuuuu

SEQ ID NO: 214733 - RNA, 19 nt, Human
uaaaaacaggugcuuucuu

SEQ ID NO: 214734 - RNA, 20 nt, Human
uaagaaggaaggagagaggg

SEQ ID NO: 214735 - RNA, 24 nt, Human
uagacuucugacacaagaagaauc

SEQ ID NO: 214736 - RNA, 19 nt, Human
uauucucaaaacucuguca

SEQ ID NO: 214737 - RNA, 24 nt, Human
ucagacaccagcaaaaaaaaaaaa

SEQ ID NO: 214738 - RNA, 23 nt, Human
ucaucucaguucuuuuuuuuuuu

SEQ ID NO: 214739 - RNA, 20 nt, Human
uccugaguuuuccagaggcu

SEQ ID NO: 214740 - RNA, 18 nt, Human
ucuccuggaacagggcug

SEQ ID NO: 214741 - RNA, 21 nt, Human
ucuccuggaacagggcugggu

SEQ ID NO: 214742 - RNA, 26 nt, Human
ucuuuuuuuuuuuccuuuuuccauuu

SEQ ID NO: 214743 - RNA, 26 nt, Human
ugaaagcagcagcuauuggucaauuu

SEQ ID NO: 214744 - RNA, 19 nt, Human
ugacacaagaagaaucugu

SEQ ID NO: 214745 - RNA, 18 nt, Human
ugagcacacgccgggacc

SEQ ID NO: 214746 - RNA, 19 nt, Human
ugcacacacaucagccgug

SEQ ID NO: 214747 - RNA, 19 nt, Human
ugccccaaaggagcagcaa

SEQ ID NO: 214748 - RNA, 22 nt, Human
uggaaaccccuugcccuccagg

SEQ ID NO: 214749 - RNA, 23 nt, Human
uggacacacacacgugcauacac

SEQ ID NO: 214750 - RNA, 20 nt, Human
uggaugagagaaaaaaaaaa

SEQ ID NO: 214751 - RNA, 21 nt, Human
ugggggcggguggggggaacg

SEQ ID NO: 214752 - RNA, 23 nt, Human
uguaaagaaaaaaaaaauccuuc

SEQ ID NO: 214753 - RNA, 31 nt, Human
ugucaucucaguucuuuuuuuuuuuccuuuu

SEQ ID NO: 214754 - RNA, 21 nt, Human
uucaaaccagaggaaagcgaa

SEQ ID NO: 214755 - RNA, 23 nt, Human
uucaaaccagaggaaagcgaaaa

SEQ ID NO: 214756 - RNA, 19 nt, Human
uuggcccggggggucuugc

SEQ ID NO: 214757 - RNA, 21 nt, Human
uuguuuuuucuuucgaacuuu

SEQ ID NO: 214758 - RNA, 19 nt, Human
uuucuuuuuuuuuuuuuaa

SEQ ID NO: 214759 - RNA, 21 nt, Human
uuuucuuuuuuuuuuuuuaau

SEQ ID NO: 214760 - RNA, 24 nt, Human
uuuuuuuuuuuuaauguccuagcu

SEQ ID NO: 214761 - RNA, 19 nt, Human
aaguccccgaucuugacgg

SEQ ID NO: 214762 - RNA, 22 nt, Human
accaucccaaaagagcccuggc

SEQ ID NO: 214763 - RNA, 21 nt, Human
agauaccacacccaggagacg

SEQ ID NO: 214764 - RNA, 19 nt, Human
agcccuccagcuccuccag

SEQ ID NO: 214765 - RNA, 19 nt, Human
agcgcacgggcagcagccc

SEQ ID NO: 214766 - RNA, 23 nt, Human
aggagaggaggcggaaggagggc

SEQ ID NO: 214767 - RNA, 22 nt, Human
agggagccccgggccccccggc

SEQ ID NO: 214768 - RNA, 18 nt, Human
auccaugacgaacuucag

SEQ ID NO: 214769 - RNA, 23 nt, Human
augcaguugcgggcugcuagauc

SEQ ID NO: 214770 - RNA, 24 nt, Human
caaguccucgugccagccccucau

SEQ ID NO: 214771 - RNA, 19 nt, Human
cacccuugcgguaauaguc

SEQ ID NO: 214772 - RNA, 22 nt, Human
caccgucuucagggccacgggu

SEQ ID NO: 214773 - RNA, 24 nt, Human
cacgccaaaggaccagacauccga

SEQ ID NO: 214774 - RNA, 24 nt, Human
cagcugaaggggacagcccuccag

SEQ ID NO: 214775 - RNA, 21 nt, Human
caggagacgcaccacauggug

SEQ ID NO: 214776 - RNA, 20 nt, Human
caguugcgggcugcuagauc

SEQ ID NO: 214777 - RNA, 21 nt, Human
caugccgucugcaaucucacc

SEQ ID NO: 214778 - RNA, 19 nt, Human
ccaaaagagcccuggccca

SEQ ID NO: 214779 - RNA, 25 nt, Human
cccccauuuugagggcugcagucuc

SEQ ID NO: 214780 - RNA, 21 nt, Human
ccgcaaagaucgaagauggcu

SEQ ID NO: 214781 - RNA, 22 nt, Human
ccuccagcuccuccaggacccc

SEQ ID NO: 214782 - RNA, 22 nt, Human
ccuccaggaccccgccauccau

SEQ ID NO: 214783 - RNA, 22 nt, Human
ccugagauaccacacccaggag

SEQ ID NO: 214784 - RNA, 27 nt, Human
cuccagccucaaguccucgugccagcc

SEQ ID NO: 214785 - RNA, 21 nt, Human
gaagauggcucuugagguccc

SEQ ID NO: 214786 - RNA, 18 nt, Human
gagcaggaucugcaggug

SEQ ID NO: 214787 - RNA, 19 nt, Human
gccccccggcauuccgggc

SEQ ID NO: 214788 - RNA, 18 nt, Human
ggacagcccuccagcucc

SEQ ID NO: 214789 - RNA, 21 nt, Human
ggacucgggggccauccagcg

SEQ ID NO: 214790 - RNA, 21 nt, Human
gggcgcaggcguggguucggc

SEQ ID NO: 214791 - RNA, 21 nt, Human
gggcugcagucucuuggagug

SEQ ID NO: 214792 - RNA, 18 nt, Human
gucauuaacuccaugaug

SEQ ID NO: 214793 - RNA, 21 nt, Human
uauaccaucccaaaagagccc

SEQ ID NO: 214794 - RNA, 23 nt, Human
ucaccagccauuuggaucauuuc

SEQ ID NO: 214795 - RNA, 22 nt, Human
uccaccacgcugcaguucucca

SEQ ID NO: 214796 - RNA, 22 nt, Human
uccuccaggaccccgccaucca

SEQ ID NO: 214797 - RNA, 18 nt, Human
uccuccuguaugcugucc

SEQ ID NO: 214798 - RNA, 18 nt, Human
uccucgugccagccccuc

SEQ ID NO: 214799 - RNA, 19 nt, Human
uccugggacaccaugcagu

SEQ ID NO: 214800 - RNA, 19 nt, Human
ucucauacacgucccgagu

SEQ ID NO: 214801 - RNA, 21 nt, Human
ucugccaccucugagcgaaua

SEQ ID NO: 214802 - RNA, 21 nt, Human
ucuucagggccacgggugugg

SEQ ID NO: 214803 - RNA, 22 nt, Human
ugacgaacuucagcaccugcuc

SEQ ID NO: 214804 - RNA, 22 nt, Human
ugacggugaaguccugggacac

SEQ ID NO: 214805 - RNA, 19 nt, Human
uggacaggcccugguaggg

SEQ ID NO: 214806 - RNA, 21 nt, Human
uggcucuugagguccccacgg

SEQ ID NO: 214807 - RNA, 26 nt, Human
ugugaaagaugggcgcaggcgugggu

SEQ ID NO: 214808 - RNA, 27 nt, Human
uguggacuccucuccagccucaagucc

SEQ ID NO: 214809 - RNA, 25 nt, Human
uucaugacagaagcuuccuugagga

SEQ ID NO: 214810 - RNA, 20 nt, Human
uucuccagcugacgaagcuc

SEQ ID NO: 214811 - RNA, 19 nt, Human
agagcggguuuuccccuuc

SEQ ID NO: 214812 - RNA, 21 nt, Human
agccacaaacaacgccaaucc

SEQ ID NO: 214813 - RNA, 21 nt, Human
agccgggagccgggagucggg

SEQ ID NO: 214814 - RNA, 19 nt, Human
agguggagugcuguaggag

SEQ ID NO: 214815 - RNA, 22 nt, Human
caacagccacaaacaacgccaa

SEQ ID NO: 214816 - RNA, 28 nt, Human
caauggcucuuuuucuuccggaaggccu

SEQ ID NO: 214817 - RNA, 18 nt, Human
cagccacaaacaacgcca

SEQ ID NO: 214818 - RNA, 28 nt, Human
caggucccaagguggagugcuguaggag

SEQ ID NO: 214819 - RNA, 18 nt, Human
ccacgcccgggguccucc

SEQ ID NO: 214820 - RNA, 22 nt, Human
ccccaacuggcacaugcgccug

SEQ ID NO: 214821 - RNA, 18 nt, Human
ccgcggggccccaacugg

SEQ ID NO: 214822 - RNA, 22 nt, Human
ccuccuaggcccucugcuccuc

SEQ ID NO: 214823 - RNA, 22 nt, Human
cgcccgggguccuccuaggccc

SEQ ID NO: 214824 - RNA, 28 nt, Human
cggcccgggauugggcacccccucuagg

SEQ ID NO: 214825 - RNA, 26 nt, Human
cuguauuccacuggcaucaauuucac

SEQ ID NO: 214826 - RNA, 21 nt, Human
cuguguggcguucccacuccc

SEQ ID NO: 214827 - RNA, 23 nt, Human
gagccgggagccgggagccggga

SEQ ID NO: 214828 - RNA, 23 nt, Human
gagccgggagccgggagucggga

SEQ ID NO: 214829 - RNA, 23 nt, Human
gagcggguuuuccccuucggucu

SEQ ID NO: 214830 - RNA, 21 nt, Human
gcaacagccacaaacaacgcc

SEQ ID NO: 214831 - RNA, 22 nt, Human
gccccauucaacugccagggcg

SEQ ID NO: 214832 - RNA, 19 nt, Human
gcccgggguccuccuaggc

SEQ ID NO: 214833 - RNA, 25 nt, Human
gggagccgggagccgggagccgggg

SEQ ID NO: 214834 - RNA, 23 nt, Human
ggguccuccuaggcccucugcuc

SEQ ID NO: 214835 - RNA, 19 nt, Human
guguaugguacaguuucca

SEQ ID NO: 214836 - RNA, 24 nt, Human
uacccgcggggccccaacuggcac

SEQ ID NO: 214837 - RNA, 24 nt, Human
ucacgggaucuuugaaaacucaaa

SEQ ID NO: 214838 - RNA, 18 nt, Human
uccuccucggcgaguggu

SEQ ID NO: 214839 - RNA, 19 nt, Human
ugaagccccucagccagga

SEQ ID NO: 214840 - RNA, 19 nt, Human
uugaugccagaggaagagg

SEQ ID NO: 214841 - RNA, 24 nt, Human
aaagugcugggacuacaggcguga

SEQ ID NO: 214842 - RNA, 24 nt, Human
aaagugcugggauuauaggcauga

SEQ ID NO: 214843 - RNA, 20 nt, Human
aaccucagccucccaagcag

SEQ ID NO: 214844 - RNA, 21 nt, Human
aaccuggcaaaucugugugag

SEQ ID NO: 214845 - RNA, 25 nt, Human
aagcagaugggaccacagguacaag

SEQ ID NO: 214846 - RNA, 19 nt, Human
aagugcugggacuacaggc

SEQ ID NO: 214847 - RNA, 26 nt, Human
aagugcugggacuacaggcgugagcc

SEQ ID NO: 214848 - RNA, 19 nt, Human
aagugcugggauuauaggc

SEQ ID NO: 214849 - RNA, 21 nt, Human
aagugcugggauuauaggcau

SEQ ID NO: 214850 - RNA, 22 nt, Human
accccuccuaggauaucugcug

SEQ ID NO: 214851 - RNA, 19 nt, Human
acugcagcccugaccuccu

SEQ ID NO: 214852 - RNA, 22 nt, Human
agauauuucccaaacaccccuc

SEQ ID NO: 214853 - RNA, 25 nt, Human
agcgaucccccugccucagccuucc

SEQ ID NO: 214854 - RNA, 22 nt, Human
aggcaugaggccacugcgccca

SEQ ID NO: 214855 - RNA, 23 nt, Human
agugcaguggcaugaucguagcu

SEQ ID NO: 214856 - RNA, 24 nt, Human
agugcaguggcaugaucguagcuc

SEQ ID NO: 214857 - RNA, 22 nt, Human
auauauuccauauccauucuca

SEQ ID NO: 214858 - RNA, 25 nt, Human
aucacguugcccaggcuagucucga

SEQ ID NO: 214859 - RNA, 20 nt, Human
aucucauucuguugcccagg

SEQ ID NO: 214860 - RNA, 19 nt, Human
auucuguugcccagagugg

SEQ ID NO: 214861 - RNA, 19 nt, Human
caaagugcugggacuacag

SEQ ID NO: 214862 - RNA, 21 nt, Human
caaagugcugggacuacaggc

SEQ ID NO: 214863 - RNA, 24 nt, Human
caaagugcugggacuacaggcgug

SEQ ID NO: 214864 - RNA, 24 nt, Human
caaagugcugggauuauaggcaug

SEQ ID NO: 214865 - RNA, 19 nt, Human
caaccucagccucccaagc

SEQ ID NO: 214866 - RNA, 19 nt, Human
caagacaaaaaauaugagc

SEQ ID NO: 214867 - RNA, 20 nt, Human
caagcgaucccccugccuca

SEQ ID NO: 214868 - RNA, 26 nt, Human
cacagguacaagccacaacgcccggg

SEQ ID NO: 214869 - RNA, 19 nt, Human
cacccaggccggugugcag

SEQ ID NO: 214870 - RNA, 24 nt, Human
cacguugcccaggcuagucucgaa

SEQ ID NO: 214871 - RNA, 21 nt, Human
cagcccugaccuccugggcuc

SEQ ID NO: 214872 - RNA, 23 nt, Human
cagcccugaccuccugggcucaa

SEQ ID NO: 214873 - RNA, 24 nt, Human
cagcccugaccuccugggcucaag

SEQ ID NO: 214874 - RNA, 22 nt, Human
ccaaagugcugggauuauaggc

SEQ ID NO: 214875 - RNA, 24 nt, Human
ccaaagugcugggauuauaggcau

SEQ ID NO: 214876 - RNA, 20 nt, Human
ccaggccggugugcaguggc

SEQ ID NO: 214877 - RNA, 23 nt, Human
ccaggccggugugcaguggcaca

SEQ ID NO: 214878 - RNA, 21 nt, Human
cccagaguggagugcaguggc

SEQ ID NO: 214879 - RNA, 26 nt, Human
cccccugccucagccuuccaaagugc

SEQ ID NO: 214880 - RNA, 20 nt, Human
cccgaguucaagccaucuuc

SEQ ID NO: 214881 - RNA, 19 nt, Human
cccugaccuccugggcuca

SEQ ID NO: 214882 - RNA, 20 nt, Human
ccugggcucaagcgaucccc

SEQ ID NO: 214883 - RNA, 23 nt, Human
ccugggcucaagcgaucccccug

SEQ ID NO: 214884 - RNA, 19 nt, Human
ccugggcucaagcgauccu

SEQ ID NO: 214885 - RNA, 20 nt, Human
ccugggcucaagcgauccug

SEQ ID NO: 214886 - RNA, 20 nt, Human
cgaacucccgaguucaagcc

SEQ ID NO: 214887 - RNA, 23 nt, Human
cuacaaccucaaauuccugggcu

SEQ ID NO: 214888 - RNA, 19 nt, Human
cuauuucauuggcuuucuc

SEQ ID NO: 214889 - RNA, 24 nt, Human
cucaagcgaucccccugccucagc

SEQ ID NO: 214890 - RNA, 18 nt, Human
cucaccucggccucucaa

SEQ ID NO: 214891 - RNA, 24 nt, Human
cucacugcagcccugaccuccugg

SEQ ID NO: 214892 - RNA, 19 nt, Human
cucaggaucaagacaaaaa

SEQ ID NO: 214893 - RNA, 22 nt, Human
cucggcucacugcagcccugac

SEQ ID NO: 214894 - RNA, 22 nt, Human
cugcaaccucagccucccaagc

SEQ ID NO: 214895 - RNA, 22 nt, Human
cugcagcccugaccuccugggc

SEQ ID NO: 214896 - RNA, 23 nt, Human
cugcagcccugaccuccugggcu

SEQ ID NO: 214897 - RNA, 23 nt, Human
cugccucagccuuccaaagugcu

SEQ ID NO: 214898 - RNA, 24 nt, Human
cugccucagccuuccaaagugcug

SEQ ID NO: 214899 - RNA, 24 nt, Human
cugcugccaauaaaaaguuugggg

SEQ ID NO: 214900 - RNA, 19 nt, Human
cuggucacuaagaaccucc

SEQ ID NO: 214901 - RNA, 18 nt, Human
gacuacaggcgugagcca

SEQ ID NO: 214902 - RNA, 21 nt, Human
gacuacaggcgugagccacca

SEQ ID NO: 214903 - RNA, 24 nt, Human
gacuacaggcgugagccaccaugc

SEQ ID NO: 214904 - RNA, 18 nt, Human
gagugcaguggcaugauc

SEQ ID NO: 214905 - RNA, 19 nt, Human
gaucguagcucacuacaac

SEQ ID NO: 214906 - RNA, 20 nt, Human
gauuauaggcaugaggccac

SEQ ID NO: 214907 - RNA, 23 nt, Human
gauuauaggcaugaggccacugc

SEQ ID NO: 214908 - RNA, 23 nt, Human
gccauggaaaauuaugcucugga

SEQ ID NO: 214909 - RNA, 24 nt, Human
gcgaucccccugccucagccuucc

SEQ ID NO: 214910 - RNA, 24 nt, Human
gcgauccugcaaccucagccuccc

SEQ ID NO: 214911 - RNA, 21 nt, Human
ggaccacagguacaagccaca

SEQ ID NO: 214912 - RNA, 24 nt, Human
ggacuacaggcgugagccaccaug

SEQ ID NO: 214913 - RNA, 21 nt, Human
guaucuaucuauuaaaauagc

SEQ ID NO: 214914 - RNA, 23 nt, Human
gugcaguggcacaaucucggcuc

SEQ ID NO: 214915 - RNA, 24 nt, Human
uaaaaggacuguugcccauaaucu

SEQ ID NO: 214916 - RNA, 24 nt, Human
uaaaauaggaguugucuacacuua

SEQ ID NO: 214917 - RNA, 26 nt, Human
uaauuuuuauauauuuuuugguagag

SEQ ID NO: 214918 - RNA, 27 nt, Human
uaauuuuuauauauuuuuugguagaga

SEQ ID NO: 214919 - RNA, 24 nt, Human
uacaggcgugagccaccaugccca

SEQ ID NO: 214920 - RNA, 23 nt, Human
uaccaaauacauggaaaacucac

SEQ ID NO: 214921 - RNA, 25 nt, Human
uagcuaaagggacuauuugccagaa

SEQ ID NO: 214922 - RNA, 19 nt, Human
uauagaggucuuuaaacug

SEQ ID NO: 214923 - RNA, 22 nt, Human
uauuugccaggaagcuucuagu

SEQ ID NO: 214924 - RNA, 22 nt, Human
ucaaagugcugggacuacaggc

SEQ ID NO: 214925 - RNA, 24 nt, Human
ucaaagugcugggacuacaggcgu

SEQ ID NO: 214926 - RNA, 22 nt, Human
ucaagacaaaaaauaugagcaa

SEQ ID NO: 214927 - RNA, 23 nt, Human
ucaagcgauccugcaaccucagc

SEQ ID NO: 214928 - RNA, 24 nt, Human
ucacuacaaccucaaauuccuggg

SEQ ID NO: 214929 - RNA, 24 nt, Human
ucacugcagcccugaccuccuggg

SEQ ID NO: 214930 - RNA, 22 nt, Human
ucaugcugucacccaggccggu

SEQ ID NO: 214931 - RNA, 23 nt, Human
uccaaagugcugggauuauaggc

SEQ ID NO: 214932 - RNA, 20 nt, Human
ucccgaguucaagccaucuu

SEQ ID NO: 214933 - RNA, 23 nt, Human
uccugcaaccucagccucccaag

SEQ ID NO: 214934 - RNA, 19 nt, Human
uccugcauuuucaaaaugu

SEQ ID NO: 214935 - RNA, 18 nt, Human
uccugggcucaagcgauc

SEQ ID NO: 214936 - RNA, 18 nt, Human
uccugggcucaagcgauc

SEQ ID NO: 214937 - RNA, 24 nt, Human
uccugggcucaagcgaucccccug

SEQ ID NO: 214938 - RNA, 20 nt, Human
uccugggcucaagcgauccu

SEQ ID NO: 214939 - RNA, 21 nt, Human
uccugggcucaagcgauccug

SEQ ID NO: 214940 - RNA, 24 nt, Human
ucucaaagugcugggacuacaggc

SEQ ID NO: 214941 - RNA, 24 nt, Human
ucucauucuguugcccagagugga

SEQ ID NO: 214942 - RNA, 21 nt, Human
ucucgaacucccgaguucaag

SEQ ID NO: 214943 - RNA, 24 nt, Human
ucuguggcucaaacuauggccaug

SEQ ID NO: 214944 - RNA, 24 nt, Human
ucuguugcccagaguggagugcag

SEQ ID NO: 214945 - RNA, 25 nt, Human
ugaccuccugggcucaagcgauccu

SEQ ID NO: 214946 - RNA, 20 nt, Human
ugaguuuauuuuuuuucuuu

SEQ ID NO: 214947 - RNA, 23 nt, Human
ugaguuuauuuuuuuucuuuaag

SEQ ID NO: 214948 - RNA, 19 nt, Human
ugcaaccucagccucccaa

SEQ ID NO: 214949 - RNA, 22 nt, Human
ugcaguggcacaaucucggcuc

SEQ ID NO: 214950 - RNA, 24 nt, Human
ugccucagccuuccaaagugcugg

SEQ ID NO: 214951 - RNA, 24 nt, Human
ugcugggacuacaggcgugagcca

SEQ ID NO: 214952 - RNA, 18 nt, Human
uggaaaacucacagaauc

SEQ ID NO: 214953 - RNA, 19 nt, Human
uggagugcaguggcaugau

SEQ ID NO: 214954 - RNA, 19 nt, Human
uggagugcaguggcaugau

SEQ ID NO: 214955 - RNA, 24 nt, Human
uggcacaaucucggcucacugcag

SEQ ID NO: 214956 - RNA, 18 nt, Human
uggcaugaucguagcuca

SEQ ID NO: 214957 - RNA, 24 nt, Human
uggcaugaucguagcucacuacaa

SEQ ID NO: 214958 - RNA, 21 nt, Human
ugggaccacagguacaagcca

SEQ ID NO: 214959 - RNA, 24 nt, Human
ugggaccacagguacaagccacaa

SEQ ID NO: 214960 - RNA, 27 nt, Human
ugggaccacagguacaagccacaacgc

SEQ ID NO: 214961 - RNA, 18 nt, Human
ugggacuacaggcgugag

SEQ ID NO: 214962 - RNA, 22 nt, Human
ugggacuacaggcgugagccac

SEQ ID NO: 214963 - RNA, 24 nt, Human
ugggacuacaggcgugagccacca

SEQ ID NO: 214964 - RNA, 25 nt, Human
ugggacuacaggcgugagccaccau

SEQ ID NO: 214965 - RNA, 18 nt, Human
ugggauuauaggcaugag

SEQ ID NO: 214966 - RNA, 19 nt, Human
ugggauuauaggcaugagg

SEQ ID NO: 214967 - RNA, 22 nt, Human
ugggauuauaggcaugaggcca

SEQ ID NO: 214968 - RNA, 23 nt, Human
ugggauuauaggcaugaggccac

SEQ ID NO: 214969 - RNA, 23 nt, Human
ugggauuauaggcaugaggccac

SEQ ID NO: 214970 - RNA, 25 nt, Human
ugggauuauaggcaugaggccacug

SEQ ID NO: 214971 - RNA, 24 nt, Human
ugguagagacggagucucaucacg

SEQ ID NO: 214972 - RNA, 22 nt, Human
ugugcaguggcacaaucucggc

SEQ ID NO: 214973 - RNA, 23 nt, Human
ugugcaguggcacaaucucggcu

SEQ ID NO: 214974 - RNA, 18 nt, Human
uuauaggcaugaggccac

SEQ ID NO: 214975 - RNA, 23 nt, Human
uucaagccaucuucccgucucac

SEQ ID NO: 214976 - RNA, 25 nt, Human
uuccugggcucaagcgaucccccug

SEQ ID NO: 214977 - RNA, 18 nt, Human
uucuaggugcauacugcc

SEQ ID NO: 214978 - RNA, 23 nt, Human
uucucuguggcucaaacuauggc

SEQ ID NO: 214979 - RNA, 21 nt, Human
uuggggcuagugaaaacucuu

SEQ ID NO: 214980 - RNA, 21 nt, Human
uugguagagacggagucucau

SEQ ID NO: 214981 - RNA, 26 nt, Human
uuuuuauauauuuuuugguagagacg

SEQ ID NO: 214982 - RNA, 24 nt, Human
uuuuugguagagacggagucucau

SEQ ID NO: 214983 - RNA, 18 nt, Human
uuuuuugguagagacgga

SEQ ID NO: 214984 - RNA, 26 nt, Human
uuuuuuuuuuuugagacagguucuca

SEQ ID NO: 214985 - RNA, 18 nt, Human
uuuuuuuuuuuuuuuuug

SEQ ID NO: 214986 - RNA, 21 nt, Human
aaacaaacaccaaagcuuaca

SEQ ID NO: 214987 - RNA, 20 nt, Human
aaggagcugugaggugcuuc

SEQ ID NO: 214988 - RNA, 21 nt, Human
aaggagcugugaggugcuucu

SEQ ID NO: 214989 - RNA, 18 nt, Human
acuaagccugaaacacaa

SEQ ID NO: 214990 - RNA, 22 nt, Human
acugcaaccucuaagacuguaa

SEQ ID NO: 214991 - RNA, 26 nt, Human
agaaaccagaaaggucagacuaagcc

SEQ ID NO: 214992 - RNA, 19 nt, Human
agccgugaaaccuuggagg

SEQ ID NO: 214993 - RNA, 20 nt, Human
aggaaagaaggaccuagaaa

SEQ ID NO: 214994 - RNA, 23 nt, Human
aguaauggaagaaaaugaagaaa

SEQ ID NO: 214995 - RNA, 19 nt, Human
auggaagaaaaugaagaaa

SEQ ID NO: 214996 - RNA, 18 nt, Human
caaacaccaaagcuuaca

SEQ ID NO: 214997 - RNA, 26 nt, Human
caauuucacuaugaaaaaaggguaac

SEQ ID NO: 214998 - RNA, 24 nt, Human
caccaaagcuuacaauauaguacu

SEQ ID NO: 214999 - RNA, 23 nt, Human
cacucuuuccuaaguaauggaag

SEQ ID NO: 215000 - RNA, 18 nt, Human
cagacuaagccugaaaca

SEQ ID NO: 215001 - RNA, 20 nt, Human
ccaaugaggaaagaaggacc

SEQ ID NO: 215002 - RNA, 21 nt, Human
ccugaaacacaauuucacuau

SEQ ID NO: 215003 - RNA, 23 nt, Human
cgagaggaguuaaaaauguggca

SEQ ID NO: 215004 - RNA, 19 nt, Human
cuaagacuguaacaacaca

SEQ ID NO: 215005 - RNA, 19 nt, Human
gaaaaaaggguaacaaaug

SEQ ID NO: 215006 - RNA, 20 nt, Human
gaaagaaggaccuagaaagg

SEQ ID NO: 215007 - RNA, 24 nt, Human
gaggaguuaaaaauguggcaucgg

SEQ ID NO: 215008 - RNA, 20 nt, Human
ggucagacuaagccugaaac

SEQ ID NO: 215009 - RNA, 22 nt, Human
gugaggugcuucuuuccuucau

SEQ ID NO: 215010 - RNA, 21 nt, Human
uaaacaaacaccaaagcuuac

SEQ ID NO: 215011 - RNA, 22 nt, Human
uaaaugacacacauuugaaucc

SEQ ID NO: 215012 - RNA, 20 nt, Human
uagaaaggagcugugaggug

SEQ ID NO: 215013 - RNA, 22 nt, Human
ucagacuaagccugaaacacaa

SEQ ID NO: 215014 - RNA, 22 nt, Human
ucagagcgagaggaguuaaaaa

SEQ ID NO: 215015 - RNA, 21 nt, Human
ugaaacacaauuucacuauga

SEQ ID NO: 215016 - RNA, 25 nt, Human
ugaagaaaccagaaaggucagacua

SEQ ID NO: 215017 - RNA, 19 nt, Human
ugaggaaagaaggaccuag

SEQ ID NO: 215018 - RNA, 25 nt, Human
ugcuucuuuccuucauccuucuggg

SEQ ID NO: 215019 - RNA, 23 nt, Human
uggaagauaaccaaugauucccc

SEQ ID NO: 215020 - RNA, 24 nt, Human
uuaaaaauguggcaucgggagugu

SEQ ID NO: 215021 - RNA, 21 nt, Human
uuaaacaaacaccaaagcuua

SEQ ID NO: 215022 - RNA, 18 nt, Human
uuggugcuaauagcuucc

SEQ ID NO: 215023 - RNA, 20 nt, Human
agagccagccacggccgccg

SEQ ID NO: 215024 - RNA, 19 nt, Human
agcaaaaaggcaccugggu

SEQ ID NO: 215025 - RNA, 24 nt, Human
auuacguuauucaagugggacauu

SEQ ID NO: 215026 - RNA, 21 nt, Human
auugugagggguggagguggg

SEQ ID NO: 215027 - RNA, 23 nt, Human
auuucaaucauguuuaaaaacaa

SEQ ID NO: 215028 - RNA, 22 nt, Human
cagagccagccacggccgccgc

SEQ ID NO: 215029 - RNA, 22 nt, Human
ccaggcucgcgggcucugcgcc

SEQ ID NO: 215030 - RNA, 22 nt, Human
ccccccaacuuuaaaacagauc

SEQ ID NO: 215031 - RNA, 25 nt, Human
ccccccgcggcuacccucgcuggcc

SEQ ID NO: 215032 - RNA, 19 nt, Human
cccccgcggcuacccucgc

SEQ ID NO: 215033 - RNA, 19 nt, Human
ccccgccggcgcgcucgga

SEQ ID NO: 215034 - RNA, 22 nt, Human
cccgaagaucugcgacccacuc

SEQ ID NO: 215035 - RNA, 21 nt, Human
ccgcggcuacccucgcuggcc

SEQ ID NO: 215036 - RNA, 23 nt, Human
ccugcgcgucuccgggggcccgc

SEQ ID NO: 215037 - RNA, 20 nt, Human
cucauucuauuauaguauca

SEQ ID NO: 215038 - RNA, 19 nt, Human
gacccacucccucggugcu

SEQ ID NO: 215039 - RNA, 22 nt, Human
gagccagccacggccgccgcgc

SEQ ID NO: 215040 - RNA, 20 nt, Human
gaucugcgacccacucccuc

SEQ ID NO: 215041 - RNA, 22 nt, Human
uaaaagugaacucuccucccuc

SEQ ID NO: 215042 - RNA, 24 nt, Human
uaaaggcucugcgugcaagagucu

SEQ ID NO: 215043 - RNA, 18 nt, Human
uacaguguggauauguuu

SEQ ID NO: 215044 - RNA, 19 nt, Human
uaggaaaauagguuuacau

SEQ ID NO: 215045 - RNA, 18 nt, Human
uagugcacuuucauuuag

SEQ ID NO: 215046 - RNA, 19 nt, Human
uaucaaauuagcaaaaagg

SEQ ID NO: 215047 - RNA, 25 nt, Human
ucagaguaccuauaucacaguacag

SEQ ID NO: 215048 - RNA, 24 nt, Human
uccccuagccgcccgaagaucugc

SEQ ID NO: 215049 - RNA, 20 nt, Human
ucccucggugcucucucgcc

SEQ ID NO: 215050 - RNA, 18 nt, Human
uccuaauccagaugauac

SEQ ID NO: 215051 - RNA, 21 nt, Human
uccuaauccagaugauacaga

SEQ ID NO: 215052 - RNA, 21 nt, Human
uccuuagucacuuaaaggcuc

SEQ ID NO: 215053 - RNA, 21 nt, Human
ucgccgauuuccccuagccgc

SEQ ID NO: 215054 - RNA, 19 nt, Human
ucuccgggggcccgcccgg

SEQ ID NO: 215055 - RNA, 18 nt, Human
ucuucagaacaguuuugg

SEQ ID NO: 215056 - RNA, 18 nt, Human
ugaggcaguagugcacuu

SEQ ID NO: 215057 - RNA, 27 nt, Human
ugauacagaauccaagaaauuucugua

SEQ ID NO: 215058 - RNA, 23 nt, Human
ugucucauucuauuauaguauca

SEQ ID NO: 215059 - RNA, 24 nt, Human
uguuauuguguugucauuuucaau

SEQ ID NO: 215060 - RNA, 24 nt, Human
uucccaccccccaacuuuaaaaca

SEQ ID NO: 215061 - RNA, 18 nt, Human
aaagagcugcugccagag

SEQ ID NO: 215062 - RNA, 24 nt, Human
aaagugcugggauuacaggcguga

SEQ ID NO: 215063 - RNA, 19 nt, Human
aacacaaaaucacugugaa

SEQ ID NO: 215064 - RNA, 19 nt, Human
aacaugcgccagccuccuc

SEQ ID NO: 215065 - RNA, 18 nt, Human
aaccaugagacuuacagc

SEQ ID NO: 215066 - RNA, 19 nt, Human
aacuaggucuugggccuag

SEQ ID NO: 215067 - RNA, 19 nt, Human
aagugcugggauuacaggc

SEQ ID NO: 215068 - RNA, 19 nt, Human
aagugcugggauuacaggc

SEQ ID NO: 215069 - RNA, 26 nt, Human
aagugcugggauuacaggcgugagcc

SEQ ID NO: 215070 - RNA, 19 nt, Human
acagggucucaucauguug

SEQ ID NO: 215071 - RNA, 19 nt, Human
acccaggcuggagugcagu

SEQ ID NO: 215072 - RNA, 22 nt, Human
accucccaagcauaaaugaucc

SEQ ID NO: 215073 - RNA, 18 nt, Human
accuccuucucucccccg

SEQ ID NO: 215074 - RNA, 18 nt, Human
agaggccugggcugcaga

SEQ ID NO: 215075 - RNA, 21 nt, Human
agagugcugaggacucgugca

SEQ ID NO: 215076 - RNA, 23 nt, Human
agccucccaacaugcgccagccu

SEQ ID NO: 215077 - RNA, 20 nt, Human
agcgauccuccugccuuggc

SEQ ID NO: 215078 - RNA, 23 nt, Human
agcgauccuccugccuuggccuc

SEQ ID NO: 215079 - RNA, 21 nt, Human
agcuucacgggggcauguagu

SEQ ID NO: 215080 - RNA, 18 nt, Human
aucaugacucacugcagc

SEQ ID NO: 215081 - RNA, 24 nt, Human
aucauguugcccuggcuggucuug

SEQ ID NO: 215082 - RNA, 22 nt, Human
augggcccccacccccacugcc

SEQ ID NO: 215083 - RNA, 21 nt, Human
caaagagcugcugccagaggc

SEQ ID NO: 215084 - RNA, 24 nt, Human
caaagugcugggauuacaggcgug

SEQ ID NO: 215085 - RNA, 22 nt, Human
cacaccccugcacagcagcccc

SEQ ID NO: 215086 - RNA, 24 nt, Human
caccacauuaggccagcucgcagg

SEQ ID NO: 215087 - RNA, 19 nt, Human
caccccugcacagcagccc

SEQ ID NO: 215088 - RNA, 22 nt, Human
cagagacagggucucaucaugu

SEQ ID NO: 215089 - RNA, 22 nt, Human
cagagccuagaacagcagggcc

SEQ ID NO: 215090 - RNA, 26 nt, Human
cagagccuagaacagcagggccaccu

SEQ ID NO: 215091 - RNA, 25 nt, Human
cagaggccugggcugcagacgcccu

SEQ ID NO: 215092 - RNA, 18 nt, Human
cagcagccccucuccucc

SEQ ID NO: 215093 - RNA, 27 nt, Human
cagcagcugggaccacaggcgugcgcu

SEQ ID NO: 215094 - RNA, 27 nt, Human
cagcagggccaccuccuucucuccccc

SEQ ID NO: 215095 - RNA, 24 nt, Human
cagccucgaccucccaagcauaaa

SEQ ID NO: 215096 - RNA, 26 nt, Human
cagcgauccuccugccuuggccuccc

SEQ ID NO: 215097 - RNA, 18 nt, Human
cagggucucaucauguug

SEQ ID NO: 215098 - RNA, 24 nt, Human
cagggucuugcucugucacccagg

SEQ ID NO: 215099 - RNA, 18 nt, Human
cauacuucacuuuuccca

SEQ ID NO: 215100 - RNA, 26 nt, Human
caucauguugcccuggcuggucuuga

SEQ ID NO: 215101 - RNA, 20 nt, Human
cauggcucucaggggagcca

SEQ ID NO: 215102 - RNA, 20 nt, Human
cauguugcccuggcuggucu

SEQ ID NO: 215103 - RNA, 23 nt, Human
cauguugcccuggcuggucuuga

SEQ ID NO: 215104 - RNA, 20 nt, Human
ccaaagugcugggauuacag

SEQ ID NO: 215105 - RNA, 22 nt, Human
ccaaagugcugggauuacaggc

SEQ ID NO: 215106 - RNA, 22 nt, Human
ccaaagugcugggauuacaggc

SEQ ID NO: 215107 - RNA, 24 nt, Human
ccaaagugcugggauuacaggcgu

SEQ ID NO: 215108 - RNA, 24 nt, Human
ccaacaugcgccagccuccucacu

SEQ ID NO: 215109 - RNA, 24 nt, Human
ccaugagaacuucugaccaugaga

SEQ ID NO: 215110 - RNA, 21 nt, Human
ccauugugcaggguggccacu

SEQ ID NO: 215111 - RNA, 21 nt, Human
cccacagagccuagaacagca

SEQ ID NO: 215112 - RNA, 21 nt, Human
ccccagcagcugggaccacag

SEQ ID NO: 215113 - RNA, 19 nt, Human
cccccacugccggcagagu

SEQ ID NO: 215114 - RNA, 19 nt, Human
ccccugcacagcagccccu

SEQ ID NO: 215115 - RNA, 19 nt, Human
cccuaggccucgucggccc

SEQ ID NO: 215116 - RNA, 21 nt, Human
cccucugccacaaucagugcc

SEQ ID NO: 215117 - RNA, 19 nt, Human
cccugcacagcagccccuc

SEQ ID NO: 215118 - RNA, 24 nt, Human
ccgcacccggccacacuuuuccag

SEQ ID NO: 215119 - RNA, 18 nt, Human
ccggcagagugcugagga

SEQ ID NO: 215120 - RNA, 23 nt, Human
ccuaugcccacagagccuagaac

SEQ ID NO: 215121 - RNA, 22 nt, Human
ccuccgaagccugaccuggcuc

SEQ ID NO: 215122 - RNA, 24 nt, Human
ccuccuacuucagccuccccagca

SEQ ID NO: 215123 - RNA, 26 nt, Human
ccuccugccuuggccucccaaagugc

SEQ ID NO: 215124 - RNA, 21 nt, Human
ccugaaaauguuucccuuccc

SEQ ID NO: 215125 - RNA, 24 nt, Human
ccugccuuggccucccaaagugcu

SEQ ID NO: 215126 - RNA, 19 nt, Human
ccugugcuacagcccuggg

SEQ ID NO: 215127 - RNA, 28 nt, Human
cgaccucccaagcauaaaugauccuuuu

SEQ ID NO: 215128 - RNA, 20 nt, Human
cuacagcccugggcuacuuu

SEQ ID NO: 215129 - RNA, 19 nt, Human
cuagaacagcagggccacc

SEQ ID NO: 215130 - RNA, 21 nt, Human
cucacugcagccucgaccucc

SEQ ID NO: 215131 - RNA, 23 nt, Human
cuccacaccccugcacagcagcc

SEQ ID NO: 215132 - RNA, 18 nt, Human
cuccagcgauccuccugc

SEQ ID NO: 215133 - RNA, 25 nt, Human
cuccccagcagcugggaccacaggc

SEQ ID NO: 215134 - RNA, 22 nt, Human
cucccccgcgggcaugggcccc

SEQ ID NO: 215135 - RNA, 21 nt, Human
cugaggacucgugcaccauga

SEQ ID NO: 215136 - RNA, 22 nt, Human
cugcagccucgaccucccaagc

SEQ ID NO: 215137 - RNA, 22 nt, Human
cugccggggccucucagggccg

SEQ ID NO: 215138 - RNA, 18 nt, Human
cuggcauggaggcagggu

SEQ ID NO: 215139 - RNA, 25 nt, Human
cuggcuggucuugaccuacuggggg

SEQ ID NO: 215140 - RNA, 20 nt, Human
cugggccugaggcugagcuu

SEQ ID NO: 215141 - RNA, 19 nt, Human
cugucacccaggcuggagu

SEQ ID NO: 215142 - RNA, 19 nt, Human
cuuacagccauacuucacu

SEQ ID NO: 215143 - RNA, 19 nt, Human
cuucagccuccccagcagc

SEQ ID NO: 215144 - RNA, 18 nt, Human
cuugaccuacugggcucc

SEQ ID NO: 215145 - RNA, 21 nt, Human
cuugcucugucacccaggcug

SEQ ID NO: 215146 - RNA, 24 nt, Human
cuugcucugucacccaggcuggag

SEQ ID NO: 215147 - RNA, 25 nt, Human
gagcucgucuguggcgcccagggau

SEQ ID NO: 215148 - RNA, 19 nt, Human
gagguuggaggugggugcu

SEQ ID NO: 215149 - RNA, 18 nt, Human
gauuacaggcgugagcca

SEQ ID NO: 215150 - RNA, 22 nt, Human
gauuacaggcgugagccaccgc

SEQ ID NO: 215151 - RNA, 23 nt, Human
gauuacaggcgugagccaccgca

SEQ ID NO: 215152 - RNA, 18 nt, Human
gcagcugggaccacaggc

SEQ ID NO: 215153 - RNA, 21 nt, Human
gcaggguggccacuguccaaa

SEQ ID NO: 215154 - RNA, 26 nt, Human
gcaugggcccccacccccacugccgg

SEQ ID NO: 215155 - RNA, 21 nt, Human
gccaccuccuucucucccccg

SEQ ID NO: 215156 - RNA, 22 nt, Human
gccuuggccucccaaagugcug

SEQ ID NO: 215157 - RNA, 25 nt, Human
gcucugucacccaggcuggagugca

SEQ ID NO: 215158 - RNA, 19 nt, Human
gcugccagaggccugggcu

SEQ ID NO: 215159 - RNA, 20 nt, Human
ggaggcaggguuccacucug

SEQ ID NO: 215160 - RNA, 20 nt, Human
ggccaccacauuaggccagc

SEQ ID NO: 215161 - RNA, 21 nt, Human
ggccugaggcugagcuugugg

SEQ ID NO: 215162 - RNA, 23 nt, Human
ggccugggcugcagacgcccugc

SEQ ID NO: 215163 - RNA, 23 nt, Human
gggccgggaccugccggggccuc

SEQ ID NO: 215164 - RNA, 19 nt, Human
gggcuccagcgauccuccu

SEQ ID NO: 215165 - RNA, 22 nt, Human
gggcuccagcgauccuccugcc

SEQ ID NO: 215166 - RNA, 18 nt, Human
gggcugcagacgcccugc

SEQ ID NO: 215167 - RNA, 22 nt, Human
gggucugugcagccagcagccu

SEQ ID NO: 215168 - RNA, 20 nt, Human
gugcugcucgacuuucugga

SEQ ID NO: 215169 - RNA, 20 nt, Human
uaaaugauccuccuacuuca

SEQ ID NO: 215170 - RNA, 27 nt, Human
uaaaugauccuccuacuucagccuccc

SEQ ID NO: 215171 - RNA, 30 nt, Human
uaaaugauccuccuacuucagccuccccaa

SEQ ID NO: 215172 - RNA, 24 nt, Human
uacagccauacuucacuuuuccca

SEQ ID NO: 215173 - RNA, 23 nt, Human
uacaggcgugagccaccgcaccc

SEQ ID NO: 215174 - RNA, 21 nt, Human
uacuccacaccccugcacagc

SEQ ID NO: 215175 - RNA, 24 nt, Human
uacuucagccuccccagcagcugg

SEQ ID NO: 215176 - RNA, 24 nt, Human
uaugcccacagagccuagaacagc

SEQ ID NO: 215177 - RNA, 21 nt, Human
ucacccaggcuggagugcagu

SEQ ID NO: 215178 - RNA, 19 nt, Human
ucacugcagccucgaccuc

SEQ ID NO: 215179 - RNA, 24 nt, Human
ucacugcagccucgaccucccaag

SEQ ID NO: 215180 - RNA, 20 nt, Human
ucacuggaugaugccagccu

SEQ ID NO: 215181 - RNA, 18 nt, Human
ucagccuccccagcagcu

SEQ ID NO: 215182 - RNA, 20 nt, Human
ucagccuccccagcagcugg

SEQ ID NO: 215183 - RNA, 24 nt, Human
ucccaaagugcugggauuacaggc

SEQ ID NO: 215184 - RNA, 23 nt, Human
uccccagcagcugggaccacagg

SEQ ID NO: 215185 - RNA, 23 nt, Human
ucccccgcgggcaugggccccca

SEQ ID NO: 215186 - RNA, 24 nt, Human
ucccccgcgggcaugggcccccac

SEQ ID NO: 215187 - RNA, 20 nt, Human
ucccugaaaauguuucccuu

SEQ ID NO: 215188 - RNA, 19 nt, Human
uccuucucucccccgcggg

SEQ ID NO: 215189 - RNA, 20 nt, Human
ucgucuguggcgcccaggga

SEQ ID NO: 215190 - RNA, 22 nt, Human
ucucagaauucucgcuucuugc

SEQ ID NO: 215191 - RNA, 23 nt, Human
ucugaagacaugugauacauguc

SEQ ID NO: 215192 - RNA, 22 nt, Human
ucugaccaugagaacuuugacu

SEQ ID NO: 215193 - RNA, 24 nt, Human
ucugucacccaggcuggagugcag

SEQ ID NO: 215194 - RNA, 22 nt, Human
ucuugcucugucacccaggcug

SEQ ID NO: 215195 - RNA, 23 nt, Human
ucuugcucugucacccaggcugg

SEQ ID NO: 215196 - RNA, 24 nt, Human
ucuugcucugucacccaggcugga

SEQ ID NO: 215197 - RNA, 21 nt, Human
ucuugggccuagcuagaccuu

SEQ ID NO: 215198 - RNA, 21 nt, Human
ugaaaauguuucccuucccug

SEQ ID NO: 215199 - RNA, 19 nt, Human
ugaccaugagaacuuugac

SEQ ID NO: 215200 - RNA, 21 nt, Human
ugagcuuguggccuccgaagc

SEQ ID NO: 215201 - RNA, 18 nt, Human
ugaggacucgugcaccau

SEQ ID NO: 215202 - RNA, 23 nt, Human
ugcacagcagccccucuccuccc

SEQ ID NO: 215203 - RNA, 22 nt, Human
ugcagacgcccugcauggcucu

SEQ ID NO: 215204 - RNA, 19 nt, Human
ugcagccagcagccuccca

SEQ ID NO: 215205 - RNA, 22 nt, Human
ugccaugcucccaacuuuucug

SEQ ID NO: 215206 - RNA, 20 nt, Human
ugccugggccugaggcugag

SEQ ID NO: 215207 - RNA, 22 nt, Human
ugccugggccugaggcugagcu

SEQ ID NO: 215208 - RNA, 19 nt, Human
ugcgccagccuccucacug

SEQ ID NO: 215209 - RNA, 24 nt, Human
ugcucugucacccaggcuggagug

SEQ ID NO: 215210 - RNA, 24 nt, Human
ugcugccagaggccugggcugcag

SEQ ID NO: 215211 - RNA, 24 nt, Human
ugcugggauuacaggcgugagcca

SEQ ID NO: 215212 - RNA, 18 nt, Human
uggaggaucucagaauuc

SEQ ID NO: 215213 - RNA, 24 nt, Human
uggcagagacagggucucaucaug

SEQ ID NO: 215214 - RNA, 20 nt, Human
uggccuccgaagccugaccu

SEQ ID NO: 215215 - RNA, 24 nt, Human
ugggaccacaggcgugcgcuacca

SEQ ID NO: 215216 - RNA, 18 nt, Human
ugggauuacaggcgugag

SEQ ID NO: 215217 - RNA, 19 nt, Human
ugggauuacaggcgugagc

SEQ ID NO: 215218 - RNA, 21 nt, Human
ugggauuacaggcgugagcca

SEQ ID NO: 215219 - RNA, 22 nt, Human
ugggauuacaggcgugagccac

SEQ ID NO: 215220 - RNA, 23 nt, Human
ugggauuacaggcgugagccacc

SEQ ID NO: 215221 - RNA, 24 nt, Human
ugggauuacaggcgugagccaccg

SEQ ID NO: 215222 - RNA, 22 nt, Human
ugggcaaagagcugcugccaga

SEQ ID NO: 215223 - RNA, 25 nt, Human
ugggcaaagagcugcugccagaggc

SEQ ID NO: 215224 - RNA, 27 nt, Human
ugggcccccacccccacugccggcagg

SEQ ID NO: 215225 - RNA, 22 nt, Human
ugggcuacuuuuggacacgcaa

SEQ ID NO: 215226 - RNA, 24 nt, Human
ugggcuccagcgauccuccugccu

SEQ ID NO: 215227 - RNA, 22 nt, Human
uuccacucugccugccuaugcc

SEQ ID NO: 215228 - RNA, 21 nt, Human
uuggcagagacagggucucau

SEQ ID NO: 215229 - RNA, 18 nt, Human
uuggccucccaaagugcu

SEQ ID NO: 215230 - RNA, 25 nt, Human
uuuuucuuuuugaaacagggucuug

SEQ ID NO: 215231 - RNA, 18 nt, Human
uuuuuuggcagagacagg

SEQ ID NO: 215232 - RNA, 25 nt, Human
aaagugcugggauuuacagguauga

SEQ ID NO: 215233 - RNA, 21 nt, Human
aacccuguaauuuucaaacug

SEQ ID NO: 215234 - RNA, 20 nt, Human
aaccucuaccucccugguuc

SEQ ID NO: 215235 - RNA, 19 nt, Human
aacuggcucuauaaacuuu

SEQ ID NO: 215236 - RNA, 21 nt, Human
aacuguguuuggugaugcuug

SEQ ID NO: 215237 - RNA, 23 nt, Human
aagaagaauauuuaggaaaaaaa

SEQ ID NO: 215238 - RNA, 19 nt, Human
aagcacagcagauauuagc

SEQ ID NO: 215239 - RNA, 18 nt, Human
aagcuuggaguacucuuc

SEQ ID NO: 215240 - RNA, 19 nt, Human
aaguagcugggacuacagg

SEQ ID NO: 215241 - RNA, 20 nt, Human
aaguagcugggacuacaggu

SEQ ID NO: 215242 - RNA, 25 nt, Human
aaguagcugggacuacaggugucca

SEQ ID NO: 215243 - RNA, 24 nt, Human
accauguuggccaggccggucuug

SEQ ID NO: 215244 - RNA, 18 nt, Human
acgggguuucaccauguu

SEQ ID NO: 215245 - RNA, 23 nt, Human
acgggguuucaccauguuggcca

SEQ ID NO: 215246 - RNA, 24 nt, Human
acgggguuucaccauguuggccag

SEQ ID NO: 215247 - RNA, 18 nt, Human
acucugucacccaggcug

SEQ ID NO: 215248 - RNA, 25 nt, Human
acucugucacccaggcuggagugca

SEQ ID NO: 215249 - RNA, 23 nt, Human
agauuuuuggcagaauucaguuc

SEQ ID NO: 215250 - RNA, 20 nt, Human
agcuagucuccugccucagc

SEQ ID NO: 215251 - RNA, 18 nt, Human
agcuuggaguacucuucu

SEQ ID NO: 215252 - RNA, 23 nt, Human
aggaaaaaaaucaguuaaaaaaa

SEQ ID NO: 215253 - RNA, 24 nt, Human
aggaaccuuaacugcaucugccaa

SEQ ID NO: 215254 - RNA, 25 nt, Human
aggcuggagugcaguggcacgaucu

SEQ ID NO: 215255 - RNA, 24 nt, Human
aggugaucugccugccucggccuc

SEQ ID NO: 215256 - RNA, 18 nt, Human
aggugucagcccaggcug

SEQ ID NO: 215257 - RNA, 21 nt, Human
agucuccugccucagccuccc

SEQ ID NO: 215258 - RNA, 21 nt, Human
agugcaguggcacgaucucag

SEQ ID NO: 215259 - RNA, 23 nt, Human
agugcaguggcacgaucucagcu

SEQ ID NO: 215260 - RNA, 24 nt, Human
agugcaguggcacgaucucagcuc

SEQ ID NO: 215261 - RNA, 18 nt, Human
auuacuguaagaacuggg

SEQ ID NO: 215262 - RNA, 23 nt, Human
auuuauuuaugauggagucucac

SEQ ID NO: 215263 - RNA, 24 nt, Human
auuuuuguauuuuuaguagagacg

SEQ ID NO: 215264 - RNA, 25 nt, Human
caaagugcugggauuuacagguaug

SEQ ID NO: 215265 - RNA, 18 nt, Human
caccauguuggccaggcc

SEQ ID NO: 215266 - RNA, 21 nt, Human
caccauguuggccaggccggu

SEQ ID NO: 215267 - RNA, 24 nt, Human
caccauguuggccaggccggucuu

SEQ ID NO: 215268 - RNA, 27 nt, Human
caccauguuggccaggccggucuugaa

SEQ ID NO: 215269 - RNA, 23 nt, Human
cacucugucacccaggcuggagu

SEQ ID NO: 215270 - RNA, 24 nt, Human
cacucugucacccaggcuggagug

SEQ ID NO: 215271 - RNA, 23 nt, Human
cagcacagaacagauagauucuc

SEQ ID NO: 215272 - RNA, 22 nt, Human
caggugaucugccugccucggc

SEQ ID NO: 215273 - RNA, 19 nt, Human
cagguguccaccaccacgc

SEQ ID NO: 215274 - RNA, 21 nt, Human
cagguguccaccaccacgcuc

SEQ ID NO: 215275 - RNA, 24 nt, Human
cauguuggccaggccggucuugaa

SEQ ID NO: 215276 - RNA, 21 nt, Human
ccaaagugcugggauuuacag

SEQ ID NO: 215277 - RNA, 22 nt, Human
ccaaagugcugggauuuacagg

SEQ ID NO: 215278 - RNA, 23 nt, Human
ccaaagugcugggauuuacaggu

SEQ ID NO: 215279 - RNA, 25 nt, Human
ccaaagugcugggauuuacagguau

SEQ ID NO: 215280 - RNA, 22 nt, Human
cccaaguagcugggacuacagg

SEQ ID NO: 215281 - RNA, 23 nt, Human
cccaaguagcugggacuacaggu

SEQ ID NO: 215282 - RNA, 23 nt, Human
cccugguuccagcuagucuccug

SEQ ID NO: 215283 - RNA, 21 nt, Human
ccggucuugaacucuugaccu

SEQ ID NO: 215284 - RNA, 24 nt, Human
ccugccucagccucccaaguagcu

SEQ ID NO: 215285 - RNA, 19 nt, Human
ccugcuugcugacaacugg

SEQ ID NO: 215286 - RNA, 24 nt, Human
cgggguuucaccauguuggccagg

SEQ ID NO: 215287 - RNA, 24 nt, Human
cucacucugucacccaggcuggag

SEQ ID NO: 215288 - RNA, 24 nt, Human
cucagccucccaaguagcugggac

SEQ ID NO: 215289 - RNA, 18 nt, Human
cucuaccucccugguucc

SEQ ID NO: 215290 - RNA, 26 nt, Human
cucuugaccucaggugaucugccugc

SEQ ID NO: 215291 - RNA, 21 nt, Human
cugcaaccucuaccucccugg

SEQ ID NO: 215292 - RNA, 24 nt, Human
cugcaaccucuaccucccugguuc

SEQ ID NO: 215293 - RNA, 23 nt, Human
cugccucggccucccaaagugcu

SEQ ID NO: 215294 - RNA, 24 nt, Human
gaccucaggugaucugccugccuc

SEQ ID NO: 215295 - RNA, 24 nt, Human
gagacgggguuucaccauguuggc

SEQ ID NO: 215296 - RNA, 20 nt, Human
gccucagccucccaaguagc

SEQ ID NO: 215297 - RNA, 19 nt, Human
gcuggagugcaguggcacg

SEQ ID NO: 215298 - RNA, 23 nt, Human
ggauuuacagguaugagccacca

SEQ ID NO: 215299 - RNA, 24 nt, Human
gggauuuacagguaugagccacca

SEQ ID NO: 215300 - RNA, 23 nt, Human
gggguuucaccauguuggccagg

SEQ ID NO: 215301 - RNA, 25 nt, Human
gguaaagaagaauauuuaggaaaaa

SEQ ID NO: 215302 - RNA, 24 nt, Human
ggucaggcccuuucaacagucuca

SEQ ID NO: 215303 - RNA, 23 nt, Human
guagagacgggguuucaccaugu

SEQ ID NO: 215304 - RNA, 18 nt, Human
gucccaauuuuuuuuucc

SEQ ID NO: 215305 - RNA, 24 nt, Human
gugaacacaaucuauaaauauaug

SEQ ID NO: 215306 - RNA, 18 nt, Human
guuaaagguaaagaagaa

SEQ ID NO: 215307 - RNA, 24 nt, Human
uaauuuuuguauuuuuaguagaga

SEQ ID NO: 215308 - RNA, 24 nt, Human
uacagguaugagccaccacaucca

SEQ ID NO: 215309 - RNA, 19 nt, Human
uacagguguccaccaccac

SEQ ID NO: 215310 - RNA, 22 nt, Human
uagagacgggguuucaccaugu

SEQ ID NO: 215311 - RNA, 24 nt, Human
uaggaaaaaaaucaguuaaaaaaa

SEQ ID NO: 215312 - RNA, 24 nt, Human
uaguagagacgggguuucaccaug

SEQ ID NO: 215313 - RNA, 25 nt, Human
uaguagagacgggguuucaccaugu

SEQ ID NO: 215314 - RNA, 19 nt, Human
uagucuccugccucagccu

SEQ ID NO: 215315 - RNA, 25 nt, Human
uauauuagaaguccagcacagaaca

SEQ ID NO: 215316 - RNA, 19 nt, Human
uauuagaaguccagcacag

SEQ ID NO: 215317 - RNA, 24 nt, Human
ucacccaggcuggagugcaguggc

SEQ ID NO: 215318 - RNA, 24 nt, Human
ucacucugucacccaggcuggagu

SEQ ID NO: 215319 - RNA, 24 nt, Human
ucacugcaaccucuaccucccugg

SEQ ID NO: 215320 - RNA, 24 nt, Human
ucacugcaaccucuaccucccugg

SEQ ID NO: 215321 - RNA, 25 nt, Human
ucacugcaaccucuaccucccuggu

SEQ ID NO: 215322 - RNA, 18 nt, Human
ucagccucccaaguagcu

SEQ ID NO: 215323 - RNA, 23 nt, Human
uccagccaaugugacccauuauc

SEQ ID NO: 215324 - RNA, 23 nt, Human
uccaggugucagcccaggcugug

SEQ ID NO: 215325 - RNA, 18 nt, Human
ucccaaagugcugggauu

SEQ ID NO: 215326 - RNA, 24 nt, Human
ucccaaagugcugggauuuacagg

SEQ ID NO: 215327 - RNA, 24 nt, Human
ucccaaguagcugggacuacaggu

SEQ ID NO: 215328 - RNA, 18 nt, Human
ucggccucccaaagugcu

SEQ ID NO: 215329 - RNA, 18 nt, Human
ucucacaguucuauauau

SEQ ID NO: 215330 - RNA, 23 nt, Human
ucucacucugucacccaggcugg

SEQ ID NO: 215331 - RNA, 24 nt, Human
ucucacucugucacccaggcugga

SEQ ID NO: 215332 - RNA, 26 nt, Human
ucucacucugucacccaggcuggagu

SEQ ID NO: 215333 - RNA, 27 nt, Human
ucucacucugucacccaggcuggagug

SEQ ID NO: 215334 - RNA, 26 nt, Human
ucuccugccucagccucccaaguagc

SEQ ID NO: 215335 - RNA, 24 nt, Human
ucugucacccaggcuggagugcag

SEQ ID NO: 215336 - RNA, 24 nt, Human
ugaagcuuggaguacucuucuaag

SEQ ID NO: 215337 - RNA, 22 nt, Human
ugacccauuuauuuauuuauuu

SEQ ID NO: 215338 - RNA, 18 nt, Human
ugaccucaggugaucugc

SEQ ID NO: 215339 - RNA, 19 nt, Human
ugaccucaggugaucugcc

SEQ ID NO: 215340 - RNA, 21 nt, Human
ugaccucaggugaucugccug

SEQ ID NO: 215341 - RNA, 24 nt, Human
ugaccucaggugaucugccugccu

SEQ ID NO: 215342 - RNA, 25 nt, Human
ugagauagguguauauaaaaaguca

SEQ ID NO: 215343 - RNA, 20 nt, Human
ugauaugguggcucuauuuu

SEQ ID NO: 215344 - RNA, 24 nt, Human
ugccucagccucccaaguagcugg

SEQ ID NO: 215345 - RNA, 21 nt, Human
ugccucggccucccaaagugc

SEQ ID NO: 215346 - RNA, 24 nt, Human
ugccucggccucccaaagugcugg

SEQ ID NO: 215347 - RNA, 23 nt, Human
uggagugcaguggcacgaucuca

SEQ ID NO: 215348 - RNA, 24 nt, Human
uggagugcaguggcacgaucucag

SEQ ID NO: 215349 - RNA, 24 nt, Human
uggcacgaucucagcucacugcaa

SEQ ID NO: 215350 - RNA, 24 nt, Human
uggccaggccggucuugaacucuu

SEQ ID NO: 215351 - RNA, 21 nt, Human
ugggacuacagguguccacca

SEQ ID NO: 215352 - RNA, 24 nt, Human
ugggacuacagguguccaccacca

SEQ ID NO: 215353 - RNA, 28 nt, Human
uggguagggcuaaguguugauauggugg

SEQ ID NO: 215354 - RNA, 21 nt, Human
uguauuuuuaguagagacggg

SEQ ID NO: 215355 - RNA, 21 nt, Human
uuacuguaagaacugggggug

SEQ ID NO: 215356 - RNA, 18 nt, Human
uuaguagagacgggguuu

SEQ ID NO: 215357 - RNA, 22 nt, Human
uuaguagagacgggguuucacc

SEQ ID NO: 215358 - RNA, 24 nt, Human
uuaguagagacgggguuucaccau

SEQ ID NO: 215359 - RNA, 21 nt, Human
uuauuuauuuauuuauuuaug

SEQ ID NO: 215360 - RNA, 26 nt, Human
uucaaacuguguuuggugaugcuuga

SEQ ID NO: 215361 - RNA, 20 nt, Human
uuccugcuugcugacaacug

SEQ ID NO: 215362 - RNA, 21 nt, Human
uuccuugugguugcaacugag

SEQ ID NO: 215363 - RNA, 20 nt, Human
uuguuaaagguaaagaagaa

SEQ ID NO: 215364 - RNA, 23 nt, Human
uuuaggaaaaaaaucaguuaaaa

SEQ ID NO: 215365 - RNA, 19 nt, Human
uuuauuuaugauggagucu

SEQ ID NO: 215366 - RNA, 24 nt, Human
uuucaccauguuggccaggccggu

SEQ ID NO: 215367 - RNA, 22 nt, Human
uuuccacccuacauacagccca

SEQ ID NO: 215368 - RNA, 25 nt, Human
uuucucagggauuacuguaagaacu

SEQ ID NO: 215369 - RNA, 24 nt, Human
uuuuuaguagagacgggguuucac

SEQ ID NO: 215370 - RNA, 20 nt, Human
uuuuuguauuuuuaguagag

SEQ ID NO: 215371 - RNA, 18 nt, Human
aaauaugaaaggcugcau

SEQ ID NO: 215372 - RNA, 21 nt, Human
aacacaaauucugccuuuauu

SEQ ID NO: 215373 - RNA, 22 nt, Human
aacacacuucacacguugauuu

SEQ ID NO: 215374 - RNA, 18 nt, Human
aagaaaucaguucagagu

SEQ ID NO: 215375 - RNA, 19 nt, Human
acaaacuaagaaugccaaa

SEQ ID NO: 215376 - RNA, 22 nt, Human
acacaaucaguuguauccugcc

SEQ ID NO: 215377 - RNA, 20 nt, Human
agagucuaaucuggcuucuu

SEQ ID NO: 215378 - RNA, 21 nt, Human
aguauacugggacuaucugcu

SEQ ID NO: 215379 - RNA, 18 nt, Human
aguggcaaacugcugaaa

SEQ ID NO: 215380 - RNA, 19 nt, Human
augaaaggcugcaucauau

SEQ ID NO: 215381 - RNA, 21 nt, Human
auuuaaauguauagaagaaau

SEQ ID NO: 215382 - RNA, 18 nt, Human
cacaacacacuucacacg

SEQ ID NO: 215383 - RNA, 21 nt, Human
cacaguggcaaacugcugaaa

SEQ ID NO: 215384 - RNA, 23 nt, Human
cauacuuacaggucucuuccaca

SEQ ID NO: 215385 - RNA, 19 nt, Human
ccagacagucacaguggca

SEQ ID NO: 215386 - RNA, 18 nt, Human
ccauacuuacaggucucu

SEQ ID NO: 215387 - RNA, 20 nt, Human
cccauacuuacaggucucuu

SEQ ID NO: 215388 - RNA, 22 nt, Human
ccccauacuuacaggucucuuc

SEQ ID NO: 215389 - RNA, 18 nt, Human
cgccccccccccauacuu

SEQ ID NO: 215390 - RNA, 23 nt, Human
cugcaucauaugugauacauauu

SEQ ID NO: 215391 - RNA, 24 nt, Human
cugcugaaauaugaaaggcugcau

SEQ ID NO: 215392 - RNA, 18 nt, Human
ggacagaaugauugugac

SEQ ID NO: 215393 - RNA, 22 nt, Human
gggggcuugccagacagucaca

SEQ ID NO: 215394 - RNA, 20 nt, Human
guggagggaaccuuggcugg

SEQ ID NO: 215395 - RNA, 20 nt, Human
uaaaauaucgcccccccccc

SEQ ID NO: 215396 - RNA, 25 nt, Human
uaaggugagcaaaauaaucuaaucc

SEQ ID NO: 215397 - RNA, 24 nt, Human
uacacaguuuuauuggugcaaaac

SEQ ID NO: 215398 - RNA, 24 nt, Human
uacaggucucuuccacaacacacu

SEQ ID NO: 215399 - RNA, 21 nt, Human
uacaguauuacauaaggugag

SEQ ID NO: 215400 - RNA, 24 nt, Human
uauacugggacuaucugcugcucc

SEQ ID NO: 215401 - RNA, 27 nt, Human
uaugaaaggcugcaucauaugugauag

SEQ ID NO: 215402 - RNA, 21 nt, Human
uauuggugcaaaacuaaacaa

SEQ ID NO: 215403 - RNA, 20 nt, Human
uccaauggccacaauuuuag

SEQ ID NO: 215404 - RNA, 21 nt, Human
uccaugguaaggauuccuggg

SEQ ID NO: 215405 - RNA, 23 nt, Human
uccggggagggggccagcggggg

SEQ ID NO: 215406 - RNA, 26 nt, Human
uccggggagggggccagcgggggaag

SEQ ID NO: 215407 - RNA, 20 nt, Human
uccuggguccagcacaaaag

SEQ ID NO: 215408 - RNA, 21 nt, Human
ucgccccccccccauacuuac

SEQ ID NO: 215409 - RNA, 26 nt, Human
ucuggcuucuuauauuucaaucuggu

SEQ ID NO: 215410 - RNA, 19 nt, Human
ucuuccacaacacacuuca

SEQ ID NO: 215411 - RNA, 21 nt, Human
ugauaaaauaucgccccccuc

SEQ ID NO: 215412 - RNA, 21 nt, Human
ugcauaggguugagcacccgu

SEQ ID NO: 215413 - RNA, 21 nt, Human
ugcuaauacauggugccacac

SEQ ID NO: 215414 - RNA, 24 nt, Human
ugcuacucuuaaaccaacaaacag

SEQ ID NO: 215415 - RNA, 20 nt, Human
uguggagggaaccuuggcug

SEQ ID NO: 215416 - RNA, 20 nt, Human
uuggugcaaaacuaaacaaa

SEQ ID NO: 215417 - RNA, 24 nt, Human
uuuaaugauugaauaacauucucu

SEQ ID NO: 215418 - RNA, 18 nt, Human
aaaagccagacacugacu

SEQ ID NO: 215419 - RNA, 19 nt, Human
aaauaaaugcaaaggccaa

SEQ ID NO: 215420 - RNA, 19 nt, Human
aaaugcaaaggccaagagc

SEQ ID NO: 215421 - RNA, 20 nt, Human
aauguacauauuuacacacg

SEQ ID NO: 215422 - RNA, 22 nt, Human
acaccacaagaaaaacccagac

SEQ ID NO: 215423 - RNA, 23 nt, Human
acaugacuuaaugguuagaugac

SEQ ID NO: 215424 - RNA, 18 nt, Human
acuccgaguggaagaggg

SEQ ID NO: 215425 - RNA, 21 nt, Human
agaaaaacccagacacuggcc

SEQ ID NO: 215426 - RNA, 31 nt, Human
agacaaauguacauauuuacacacguccuuu

SEQ ID NO: 215427 - RNA, 23 nt, Human
agagcucgggggaaauguuagug

SEQ ID NO: 215428 - RNA, 23 nt, Human
agcugggcucagaggaaaaagcc

SEQ ID NO: 215429 - RNA, 18 nt, Human
aggccaagagcucggggg

SEQ ID NO: 215430 - RNA, 23 nt, Human
auacacuggucucagaaccucau

SEQ ID NO: 215431 - RNA, 19 nt, Human
augacauuuccaauuuuaa

SEQ ID NO: 215432 - RNA, 27 nt, Human
caagaaaaacccagacacuggccugcc

SEQ ID NO: 215433 - RNA, 22 nt, Human
caagagcucgggggaaauguua

SEQ ID NO: 215434 - RNA, 24 nt, Human
caagauccacacgaaaaagugcca

SEQ ID NO: 215435 - RNA, 20 nt, Human
cacacgaaaaagugccaagu

SEQ ID NO: 215436 - RNA, 19 nt, Human
caccacaagaaaaacccag

SEQ ID NO: 215437 - RNA, 23 nt, Human
cacuguauaaauaaaugcaaagg

SEQ ID NO: 215438 - RNA, 19 nt, Human
cagccaaagcagggagcag

SEQ ID NO: 215439 - RNA, 21 nt, Human
cauuucacuggcuuuggaaca

SEQ ID NO: 215440 - RNA, 21 nt, Human
ccaagucccugaccugauaca

SEQ ID NO: 215441 - RNA, 27 nt, Human
cccacagaaguccagcuucucugcacc

SEQ ID NO: 215442 - RNA, 18 nt, Human
cccacuuggcaguggggu

SEQ ID NO: 215443 - RNA, 21 nt, Human
ccggcgacgcaggggcugcag

SEQ ID NO: 215444 - RNA, 18 nt, Human
ccucugaggcugagggag

SEQ ID NO: 215445 - RNA, 19 nt, Human
cgccgagcaaggcacugua

SEQ ID NO: 215446 - RNA, 29 nt, Human
cguggacugggcacggcuccggguggccu

SEQ ID NO: 215447 - RNA, 22 nt, Human
cucagaaccucaucuucccagg

SEQ ID NO: 215448 - RNA, 21 nt, Human
cuccgaguggaagagggaaga

SEQ ID NO: 215449 - RNA, 23 nt, Human
cugggcucagaggaaaaagccag

SEQ ID NO: 215450 - RNA, 19 nt, Human
cuggggcuugagggggugg

SEQ ID NO: 215451 - RNA, 20 nt, Human
cuuauguguucacacaugac

SEQ ID NO: 215452 - RNA, 25 nt, Human
gaccccacuuuccuucacauuucac

SEQ ID NO: 215453 - RNA, 20 nt, Human
gcaguggggucacacuuggc

SEQ ID NO: 215454 - RNA, 18 nt, Human
gccagcuuuacaccacaa

SEQ ID NO: 215455 - RNA, 21 nt, Human
gccagcuuuacaccacaagaa

SEQ ID NO: 215456 - RNA, 19 nt, Human
gccuguugagggcugcugg

SEQ ID NO: 215457 - RNA, 25 nt, Human
ggaggcagggccagcuucccaaggg

SEQ ID NO: 215458 - RNA, 28 nt, Human
ggccggcguggacugggcacggcuccgg

SEQ ID NO: 215459 - RNA, 23 nt, Human
ggucacacuuggcuguugagggg

SEQ ID NO: 215460 - RNA, 20 nt, Human
guacaccucugaucagaaau

SEQ ID NO: 215461 - RNA, 22 nt, Human
uaaauaaaugcaaaggccaaga

SEQ ID NO: 215462 - RNA, 22 nt, Human
uaaaugcaaaggccaagagcuc

SEQ ID NO: 215463 - RNA, 21 nt, Human
uauaaauaaaugcaaaggcca

SEQ ID NO: 215464 - RNA, 18 nt, Human
ucagccaaagcagggagc

SEQ ID NO: 215465 - RNA, 22 nt, Human
ucagcugaaaaggggguaguuc

SEQ ID NO: 215466 - RNA, 22 nt, Human
uccacacgaaaaagugccaagu

SEQ ID NO: 215467 - RNA, 20 nt, Human
ucccaagccccucagccaaa

SEQ ID NO: 215468 - RNA, 19 nt, Human
ucccugggccuguugaggg

SEQ ID NO: 215469 - RNA, 22 nt, Human
ucccugggccuguugagggcug

SEQ ID NO: 215470 - RNA, 21 nt, Human
ucuccaggcagcugggcucag

SEQ ID NO: 215471 - RNA, 19 nt, Human
ugacuccuguccaaguccc

SEQ ID NO: 215472 - RNA, 23 nt, Human
ugagggcugcuggggcuugaggg

SEQ ID NO: 215473 - RNA, 20 nt, Human
ugcagagccagcccugggau

SEQ ID NO: 215474 - RNA, 19 nt, Human
uggaagagggaagaaggca

SEQ ID NO: 215475 - RNA, 24 nt, Human
uggaagagggaagaaggcagaggu

SEQ ID NO: 215476 - RNA, 22 nt, Human
uggucuguuccccuaggagcca

SEQ ID NO: 215477 - RNA, 21 nt, Human
uguacauauuuacacacgucc

SEQ ID NO: 215478 - RNA, 21 nt, Human
uguccaagucccugaccugau

SEQ ID NO: 215479 - RNA, 21 nt, Human
uguugaggggcccacagaagu

SEQ ID NO: 215480 - RNA, 20 nt, Human
uugguguuaugcuuuucugg

SEQ ID NO: 215481 - RNA, 22 nt, Human
uugguguuaugcuuuucugggg

SEQ ID NO: 215482 - RNA, 23 nt, Human
uuuggaacaguccccagggcuca

SEQ ID NO: 215483 - RNA, 23 nt, Human
uuuucccaagccccucagccaaa

SEQ ID NO: 215484 - RNA, 19 nt, Human
aaaaaauaaaaaagcuugc

SEQ ID NO: 215485 - RNA, 23 nt, Human
aaacaaacaacaaaacaaagcca

SEQ ID NO: 215486 - RNA, 26 nt, Human
aaacaaacaacaaaacaaagccaagg

SEQ ID NO: 215487 - RNA, 22 nt, Human
aaacaacaaaacaaagccaaga

SEQ ID NO: 215488 - RNA, 19 nt, Human
aaacaagaaaaggaaucuu

SEQ ID NO: 215489 - RNA, 18 nt, Human
aaauggaaaugaaagccc

SEQ ID NO: 215490 - RNA, 24 nt, Human
aaauuaaaaaaaaaugugccacaa

SEQ ID NO: 215491 - RNA, 24 nt, Human
aacaaacaacaaaacaaagccaag

SEQ ID NO: 215492 - RNA, 19 nt, Human
aacaaagccaagaagcccc

SEQ ID NO: 215493 - RNA, 22 nt, Human
aacaacaaaacaaagccaagaa

SEQ ID NO: 215494 - RNA, 24 nt, Human
aacugcugauaaacaagaaaagga

SEQ ID NO: 215495 - RNA, 22 nt, Human
aagaaaaggaaucuuaaaauua

SEQ ID NO: 215496 - RNA, 22 nt, Human
aagagcgggaugggaugggaug

SEQ ID NO: 215497 - RNA, 22 nt, Human
aaguaggaaaagagcgggaugg

SEQ ID NO: 215498 - RNA, 21 nt, Human
aaugcagcaccuccacugccc

SEQ ID NO: 215499 - RNA, 24 nt, Human
aauucauuuccuucuucuccuccg

SEQ ID NO: 215500 - RNA, 20 nt, Human
acaaaacaaagccaagaagc

SEQ ID NO: 215501 - RNA, 30 nt, Human
acaaacaaacaacaaaacaaagccaagaag

SEQ ID NO: 215502 - RNA, 19 nt, Human
agaguauuuuugucuucaa

SEQ ID NO: 215503 - RNA, 20 nt, Human
agauccagcaggcucuagaa

SEQ ID NO: 215504 - RNA, 22 nt, Human
aggaaaaguaggaaaagagccg

SEQ ID NO: 215505 - RNA, 22 nt, Human
aggcuggggaaugggcagagaa

SEQ ID NO: 215506 - RNA, 19 nt, Human
agucugaaaaugggacauc

SEQ ID NO: 215507 - RNA, 18 nt, Human
auggaaaugaaagcccgu

SEQ ID NO: 215508 - RNA, 20 nt, Human
caaaacaaagccaagaagcc

SEQ ID NO: 215509 - RNA, 21 nt, Human
caaaacaaagccaagaagccc

SEQ ID NO: 215510 - RNA, 23 nt, Human
caaaacaaagccaagaagcccca

SEQ ID NO: 215511 - RNA, 22 nt, Human
caaacaaacaacaaaacaaagc

SEQ ID NO: 215512 - RNA, 27 nt, Human
caaacaaacaacaaaacaaagccaaga

SEQ ID NO: 215513 - RNA, 27 nt, Human
caacaaaacaaagccaagaagccccaa

SEQ ID NO: 215514 - RNA, 20 nt, Human
caaccaccgcggagagucag

SEQ ID NO: 215515 - RNA, 20 nt, Human
caagaagccccaacaaccac

SEQ ID NO: 215516 - RNA, 22 nt, Human
caagaaggccuaucuguaagug

SEQ ID NO: 215517 - RNA, 18 nt, Human
caaugcagcaccuccacu

SEQ ID NO: 215518 - RNA, 19 nt, Human
caccuugcuggccuugacc

SEQ ID NO: 215519 - RNA, 18 nt, Human
cagcaggcucuagaaaca

SEQ ID NO: 215520 - RNA, 23 nt, Human
caggaaaaucugauugcuagaug

SEQ ID NO: 215521 - RNA, 23 nt, Human
ccccaacaaccaccgcggagagu

SEQ ID NO: 215522 - RNA, 19 nt, Human
ccuccggauguggaaugga

SEQ ID NO: 215523 - RNA, 22 nt, Human
ccuccggauguggaauggaagc

SEQ ID NO: 215524 - RNA, 21 nt, Human
cuagaaacacacgucuaccaa

SEQ ID NO: 215525 - RNA, 19 nt, Human
cugcccuuguugguccuug

SEQ ID NO: 215526 - RNA, 24 nt, Human
gaaaaggaaucuuaaaauuauaaa

SEQ ID NO: 215527 - RNA, 18 nt, Human
gcccuuguugguccuuga

SEQ ID NO: 215528 - RNA, 20 nt, Human
gcuuugagggaaggaaaagu

SEQ ID NO: 215529 - RNA, 24 nt, Human
ggaauggaagcuuugagggaagga

SEQ ID NO: 215530 - RNA, 25 nt, Human
ggagauccagcaggcucuagaaaca

SEQ ID NO: 215531 - RNA, 22 nt, Human
ggauaggaagagaggcugggga

SEQ ID NO: 215532 - RNA, 18 nt, Human
gggaaugggcagagaagg

SEQ ID NO: 215533 - RNA, 20 nt, Human
gggaaugggcagagaagggg

SEQ ID NO: 215534 - RNA, 18 nt, Human
gggaugggauaggaagag

SEQ ID NO: 215535 - RNA, 18 nt, Human
ggggaaugggcagagaag

SEQ ID NO: 215536 - RNA, 18 nt, Human
ggggaaugggcagagaag

SEQ ID NO: 215537 - RNA, 20 nt, Human
gugcuuuaagauaaggugca

SEQ ID NO: 215538 - RNA, 23 nt, Human
uaaaauacaaacaaacaacaaaa

SEQ ID NO: 215539 - RNA, 22 nt, Human
uaaagcagucugaaaaugggac

SEQ ID NO: 215540 - RNA, 24 nt, Human
uaagauaaggugcagaagcagacu

SEQ ID NO: 215541 - RNA, 22 nt, Human
uaaggugcagaagcagacugca

SEQ ID NO: 215542 - RNA, 27 nt, Human
uagagcaagaucacaagaaggccuauc

SEQ ID NO: 215543 - RNA, 19 nt, Human
uagaugagcucauaaaagc

SEQ ID NO: 215544 - RNA, 25 nt, Human
uaucucguccguucugaggcaucca

SEQ ID NO: 215545 - RNA, 20 nt, Human
ucagagagaaaaaaauaaaa

SEQ ID NO: 215546 - RNA, 20 nt, Human
uccacuccaccuugcuggcc

SEQ ID NO: 215547 - RNA, 22 nt, Human
uccccuguauaaaaaauaaaaa

SEQ ID NO: 215548 - RNA, 20 nt, Human
uccuuuguaccgcguggcau

SEQ ID NO: 215549 - RNA, 22 nt, Human
ucucagugugcuuuuuucacgc

SEQ ID NO: 215550 - RNA, 18 nt, Human
ucuccuccggauguggaa

SEQ ID NO: 215551 - RNA, 19 nt, Human
ugaaauggaaaugaaagcc

SEQ ID NO: 215552 - RNA, 19 nt, Human
ugaguuaaagagaagcucc

SEQ ID NO: 215553 - RNA, 20 nt, Human
ugccacaaggauguaauaac

SEQ ID NO: 215554 - RNA, 18 nt, Human
uggaauggaagcuuugag

SEQ ID NO: 215555 - RNA, 18 nt, Human
uggaauggaagcuuugag

SEQ ID NO: 215556 - RNA, 23 nt, Human
uggaauggaagcuuugagggaag

SEQ ID NO: 215557 - RNA, 24 nt, Human
ugggauaggaagagaggcugggga

SEQ ID NO: 215558 - RNA, 18 nt, Human
ugggaugggaugggauag

SEQ ID NO: 215559 - RNA, 18 nt, Human
ugggaugggaugggaugg

SEQ ID NO: 215560 - RNA, 18 nt, Human
ugggaugggaugggaugg

SEQ ID NO: 215561 - RNA, 18 nt, Human
ugggaugggaugggaugg

SEQ ID NO: 215562 - RNA, 18 nt, Human
ugggaugggaugggaugg

SEQ ID NO: 215563 - RNA, 19 nt, Human
ugggaugggaugggauggg

SEQ ID NO: 215564 - RNA, 19 nt, Human
ugggaugggaugggauggg

SEQ ID NO: 215565 - RNA, 19 nt, Human
ugggaugggaugggauggg

SEQ ID NO: 215566 - RNA, 19 nt, Human
ugggaugggaugggauggg

SEQ ID NO: 215567 - RNA, 24 nt, Human
ugggaugggaugggaugggauggg

SEQ ID NO: 215568 - RNA, 18 nt, Human
ugggcagagaaggggguc

SEQ ID NO: 215569 - RNA, 24 nt, Human
ugucuucaaaucugggaauuugca

SEQ ID NO: 215570 - RNA, 25 nt, Human
uuaaaauuauaaauuugcuguagaa

SEQ ID NO: 215571 - RNA, 23 nt, Human
uuccaugauacuuuuuccuuugu

SEQ ID NO: 215572 - RNA, 19 nt, Human
acgauggaaggucggggcg

SEQ ID NO: 215573 - RNA, 21 nt, Human
aggugguggggaacagggggg

SEQ ID NO: 215574 - RNA, 20 nt, Human
caguuuauugguugaggugg

SEQ ID NO: 215575 - RNA, 20 nt, Human
gaggugguggggaacagggg

SEQ ID NO: 215576 - RNA, 22 nt, Human
ggaacagggggguuggaggcac

SEQ ID NO: 215577 - RNA, 20 nt, Human
ugaggugguggggaacaggg

SEQ ID NO: 215578 - RNA, 24 nt, Human
ugaggugguggggaacaggggggu

SEQ ID NO: 215579 - RNA, 24 nt, Human
ugaggugguggggaacaggggggu

SEQ ID NO: 215580 - RNA, 21 nt, Human
uggaggcacaccaugaggagc

SEQ ID NO: 215581 - RNA, 21 nt, Human
uggaggcacaccaugaggagc

SEQ ID NO: 215582 - RNA, 20 nt, Human
uggggaacagggggguugga

SEQ ID NO: 215583 - RNA, 20 nt, Human
ugguggggaacagggggguu

SEQ ID NO: 215584 - RNA, 18 nt, Human
uugguugagguggugggg

SEQ ID NO: 215585 - RNA, 22 nt, Human
aaaagcugguuaaaucuaaaca

SEQ ID NO: 215586 - RNA, 20 nt, Human
aaacuucuaacacuguuaga

SEQ ID NO: 215587 - RNA, 22 nt, Human
aaagcugguuaaaucuaaacaa

SEQ ID NO: 215588 - RNA, 19 nt, Human
aaaucagcuuuaaaucuag

SEQ ID NO: 215589 - RNA, 21 nt, Human
aagcaauaaaucugaagccca

SEQ ID NO: 215590 - RNA, 21 nt, Human
aagcugcagcuagaacuuugg

SEQ ID NO: 215591 - RNA, 23 nt, Human
acaaacuucuaacacuguuagag

SEQ ID NO: 215592 - RNA, 24 nt, Human
acuucuaacacuguuagagaaaag

SEQ ID NO: 215593 - RNA, 21 nt, Human
agaagaaggucauugaguccg

SEQ ID NO: 215594 - RNA, 18 nt, Human
agaaggaagaagauggca

SEQ ID NO: 215595 - RNA, 21 nt, Human
agaaggaagaagauggcauuc

SEQ ID NO: 215596 - RNA, 22 nt, Human
agcaauaaaucugaagcccaga

SEQ ID NO: 215597 - RNA, 21 nt, Human
aggaaacuuuaacaaaaccaa

SEQ ID NO: 215598 - RNA, 26 nt, Human
auggaagagcaggcaguguguccaca

SEQ ID NO: 215599 - RNA, 23 nt, Human
caaacucccaggccaaaucuccu

SEQ ID NO: 215600 - RNA, 18 nt, Human
ccaaacucccaggccaaa

SEQ ID NO: 215601 - RNA, 22 nt, Human
gagaaaagagagauuuaaaagc

SEQ ID NO: 215602 - RNA, 23 nt, Human
gcaguuuagccuuguacaaguag

SEQ ID NO: 215603 - RNA, 22 nt, Human
ggaaacuuuaacaaaaccaagg

SEQ ID NO: 215604 - RNA, 22 nt, Human
ggaagagcaggcagugugucca

SEQ ID NO: 215605 - RNA, 23 nt, Human
gguacaagaacaaugcagaagga

SEQ ID NO: 215606 - RNA, 19 nt, Human
gucacauuggaagcaaagc

SEQ ID NO: 215607 - RNA, 22 nt, Human
uaagcaauaaaucugaagccca

SEQ ID NO: 215608 - RNA, 24 nt, Human
uacaagaacaaugcagaaggauuc

SEQ ID NO: 215609 - RNA, 25 nt, Human
uaccauuaggagauuugaaaaagaa

SEQ ID NO: 215610 - RNA, 23 nt, Human
ucaaggucacauuggaaggaacc

SEQ ID NO: 215611 - RNA, 23 nt, Human
ucauugaguccguucuaaagcug

SEQ ID NO: 215612 - RNA, 21 nt, Human
ucccaggccaaaucuccuucu

SEQ ID NO: 215613 - RNA, 23 nt, Human
ucccaggccaaaucuccuucuac

SEQ ID NO: 215614 - RNA, 22 nt, Human
ugaggaaacuuuaacaaaacca

SEQ ID NO: 215615 - RNA, 22 nt, Human
ugcagaaggauucuguuccagg

SEQ ID NO: 215616 - RNA, 25 nt, Human
uggaagagcaggcaguguguccaca

SEQ ID NO: 215617 - RNA, 21 nt, Human
uucaggcacuacuccaaucuc

SEQ ID NO: 215618 - RNA, 21 nt, Human
aaaaacaaccggguggggggc

SEQ ID NO: 215619 - RNA, 20 nt, Human
aacauuguauaccuccaucc

SEQ ID NO: 215620 - RNA, 18 nt, Human
aagcggcggcgucuggcu

SEQ ID NO: 215621 - RNA, 23 nt, Human
aauacucucuccacccaaggcac

SEQ ID NO: 215622 - RNA, 20 nt, Human
aauagaaagacauuuccaga

SEQ ID NO: 215623 - RNA, 19 nt, Human
aauugaaggaaucacccau

SEQ ID NO: 215624 - RNA, 23 nt, Human
acagggcuggaggcagcagaaac

SEQ ID NO: 215625 - RNA, 20 nt, Human
accggguggggggcggaggc

SEQ ID NO: 215626 - RNA, 22 nt, Human
agaaaccccgacucugaaaucc

SEQ ID NO: 215627 - RNA, 26 nt, Human
agacauuuccagaauuuacaaacgcc

SEQ ID NO: 215628 - RNA, 22 nt, Human
agaguaaacccauucucucaug

SEQ ID NO: 215629 - RNA, 19 nt, Human
agccccaaccaaaacaagc

SEQ ID NO: 215630 - RNA, 21 nt, Human
agccccauccgggcccaucuc

SEQ ID NO: 215631 - RNA, 18 nt, Human
agccgccaccagccgccc

SEQ ID NO: 215632 - RNA, 20 nt, Human
aggaaaaaauacaaaauuaa

SEQ ID NO: 215633 - RNA, 22 nt, Human
aggaaaaaauacaaaauuaaga

SEQ ID NO: 215634 - RNA, 21 nt, Human
aggaggggaggggacaagggc

SEQ ID NO: 215635 - RNA, 18 nt, Human
aggcagcagaaaccccac

SEQ ID NO: 215636 - RNA, 20 nt, Human
aggcagugcguccgggguga

SEQ ID NO: 215637 - RNA, 22 nt, Human
agggcuggaggcagcagaaacc

SEQ ID NO: 215638 - RNA, 24 nt, Human
aggggacaagggcgagaggggaug

SEQ ID NO: 215639 - RNA, 21 nt, Human
aggggaugggggagguuuggg

SEQ ID NO: 215640 - RNA, 24 nt, Human
agguugaagaugaaguuuaugcag

SEQ ID NO: 215641 - RNA, 20 nt, Human
auccuugggcagggggaggc

SEQ ID NO: 215642 - RNA, 18 nt, Human
auuuuuuuuuuucgcuug

SEQ ID NO: 215643 - RNA, 19 nt, Human
caaaacaagcggcggcguc

SEQ ID NO: 215644 - RNA, 20 nt, Human
caaacgcccacauuguucag

SEQ ID NO: 215645 - RNA, 22 nt, Human
cacaucagcucacuguggccag

SEQ ID NO: 215646 - RNA, 22 nt, Human
caccaccaacgcugagcagagg

SEQ ID NO: 215647 - RNA, 19 nt, Human
caccagccgcccaaauacc

SEQ ID NO: 215648 - RNA, 24 nt, Human
caccagccgcccaaauaccagcuc

SEQ ID NO: 215649 - RNA, 20 nt, Human
cagacucaucccugccccuc

SEQ ID NO: 215650 - RNA, 24 nt, Human
cagcagaaaccccgacucugaaau

SEQ ID NO: 215651 - RNA, 23 nt, Human
cagccccauccgggcccaucucg

SEQ ID NO: 215652 - RNA, 25 nt, Human
cagccccgauccuccgagagccaag

SEQ ID NO: 215653 - RNA, 21 nt, Human
cagccgccgccgccaccagga

SEQ ID NO: 215654 - RNA, 18 nt, Human
caggaaggagcgaagaug

SEQ ID NO: 215655 - RNA, 19 nt, Human
cagguuuauaugacaagag

SEQ ID NO: 215656 - RNA, 20 nt, Human
ccaaccaaaacaagcggcgg

SEQ ID NO: 215657 - RNA, 24 nt, Human
ccaccgccaccaccaacgcugagc

SEQ ID NO: 215658 - RNA, 21 nt, Human
ccacgccgccccccgcgccgg

SEQ ID NO: 215659 - RNA, 26 nt, Human
cccaccccccaaccgucccagccgcc

SEQ ID NO: 215660 - RNA, 22 nt, Human
cccagccgccaccagccgccca

SEQ ID NO: 215661 - RNA, 19 nt, Human
ccccauccgggcccaucuc

SEQ ID NO: 215662 - RNA, 18 nt, Human
ccccuccucccuccuccu

SEQ ID NO: 215663 - RNA, 24 nt, Human
ccccucgcuccaggcggcugggga

SEQ ID NO: 215664 - RNA, 19 nt, Human
cccuccucccuccuccucc

SEQ ID NO: 215665 - RNA, 18 nt, Human
cccuccuccuccuccucc

SEQ ID NO: 215666 - RNA, 19 nt, Human
cccuccugaguuccccucu

SEQ ID NO: 215667 - RNA, 19 nt, Human
ccgacucugaaauccacgc

SEQ ID NO: 215668 - RNA, 19 nt, Human
ccgccaccagccgcccaaa

SEQ ID NO: 215669 - RNA, 24 nt, Human
ccgcccaaauaccagcucagucgc

SEQ ID NO: 215670 - RNA, 18 nt, Human
ccgccgcccgcgggcgcg

SEQ ID NO: 215671 - RNA, 19 nt, Human
ccucccaccccccaaccgu

SEQ ID NO: 215672 - RNA, 18 nt, Human
ccucccuccuccuccucc

SEQ ID NO: 215673 - RNA, 21 nt, Human
ccuccugaguuccccucugga

SEQ ID NO: 215674 - RNA, 21 nt, Human
ccucucagccgccgccgccac

SEQ ID NO: 215675 - RNA, 18 nt, Human
ccucuggaagcagcgauu

SEQ ID NO: 215676 - RNA, 19 nt, Human
ccugaguuccccucuggaa

SEQ ID NO: 215677 - RNA, 19 nt, Human
ccugcggugccccuccagg

SEQ ID NO: 215678 - RNA, 21 nt, Human
ccugcggugccccuccaggag

SEQ ID NO: 215679 - RNA, 18 nt, Human
ccuugggcagggggaggc

SEQ ID NO: 215680 - RNA, 22 nt, Human
cgaggcaaauuaaauauccuug

SEQ ID NO: 215681 - RNA, 21 nt, Human
cggcccggcacaugcaaacag

SEQ ID NO: 215682 - RNA, 18 nt, Human
cggcuggaguccggcaca

SEQ ID NO: 215683 - RNA, 21 nt, Human
cgggagggcgcugccgcugca

SEQ ID NO: 215684 - RNA, 23 nt, Human
cggguggagaaaguggcuuuucc

SEQ ID NO: 215685 - RNA, 18 nt, Human
cguccggggugagggcag

SEQ ID NO: 215686 - RNA, 28 nt, Human
cuauucuacucuuuuaagccuuguuuua

SEQ ID NO: 215687 - RNA, 18 nt, Human
cucccaccccccaaccgu

SEQ ID NO: 215688 - RNA, 21 nt, Human
cucccaccccccaaccguccc

SEQ ID NO: 215689 - RNA, 22 nt, Human
cuccccuccucccuccuccucc

SEQ ID NO: 215690 - RNA, 20 nt, Human
cucccuccuccuucgccucc

SEQ ID NO: 215691 - RNA, 23 nt, Human
cuccucccaccccccaaccgucc

SEQ ID NO: 215692 - RNA, 20 nt, Human
cucugcgcgccggcccccuc

SEQ ID NO: 215693 - RNA, 25 nt, Human
cugaaauccacgccgccccccgcgc

SEQ ID NO: 215694 - RNA, 18 nt, Human
cuggaguccggcacaggg

SEQ ID NO: 215695 - RNA, 21 nt, Human
cuuacaggaaaaaauacaaaa

SEQ ID NO: 215696 - RNA, 21 nt, Human
cuucgccuccucccacccccc

SEQ ID NO: 215697 - RNA, 22 nt, Human
gaaaaugcauugagaguaaacc

SEQ ID NO: 215698 - RNA, 23 nt, Human
gaagaugcaucucucgucgcccc

SEQ ID NO: 215699 - RNA, 20 nt, Human
gacaagggcgagaggggaug

SEQ ID NO: 215700 - RNA, 18 nt, Human
gagagcuuuugaauugaa

SEQ ID NO: 215701 - RNA, 21 nt, Human
gcauuuuuuuuuuucgcuugg

SEQ ID NO: 215702 - RNA, 18 nt, Human
gcccaaauaccagcucag

SEQ ID NO: 215703 - RNA, 21 nt, Human
gccgccaccagccgcccaaau

SEQ ID NO: 215704 - RNA, 18 nt, Human
gccgccgcccgcgggcgc

SEQ ID NO: 215705 - RNA, 23 nt, Human
gcgccggcccccuccgaccgcgc

SEQ ID NO: 215706 - RNA, 19 nt, Human
gcggcuggggaggagggga

SEQ ID NO: 215707 - RNA, 18 nt, Human
gcugcugcugccgccgcc

SEQ ID NO: 215708 - RNA, 19 nt, Human
gcugcugcugcugccgccg

SEQ ID NO: 215709 - RNA, 22 nt, Human
gcugcugcugcugccgccgccc

SEQ ID NO: 215710 - RNA, 19 nt, Human
ggaaggguucggggaagac

SEQ ID NO: 215711 - RNA, 22 nt, Human
ggacagacucaucccugccccu

SEQ ID NO: 215712 - RNA, 21 nt, Human
ggacgcagcugcugagcccag

SEQ ID NO: 215713 - RNA, 22 nt, Human
ggaggaggggaggggacaaggg

SEQ ID NO: 215714 - RNA, 19 nt, Human
ggaggcagcagaaaccccg

SEQ ID NO: 215715 - RNA, 19 nt, Human
ggaggcggguugccaaguc

SEQ ID NO: 215716 - RNA, 21 nt, Human
ggcuguugcuguugcugcugc

SEQ ID NO: 215717 - RNA, 18 nt, Human
gggcagggggaggcgggu

SEQ ID NO: 215718 - RNA, 19 nt, Human
ggggaccggccggagggac

SEQ ID NO: 215719 - RNA, 19 nt, Human
ggggaugggggagguuugg

SEQ ID NO: 215720 - RNA, 20 nt, Human
gggggagguuugggaagggu

SEQ ID NO: 215721 - RNA, 23 nt, Human
uaaaguaaacaaacugaaaugga

SEQ ID NO: 215722 - RNA, 22 nt, Human
uaagcugacauuugaaaacacc

SEQ ID NO: 215723 - RNA, 19 nt, Human
uagagucuggguacccaug

SEQ ID NO: 215724 - RNA, 21 nt, Human
ucaacaucagguuuauaugac

SEQ ID NO: 215725 - RNA, 22 nt, Human
uccaaaaaaaagaugugcugua

SEQ ID NO: 215726 - RNA, 19 nt, Human
uccaucccacauccaaaaa

SEQ ID NO: 215727 - RNA, 21 nt, Human
ucccgaggcaaauuaaauauc

SEQ ID NO: 215728 - RNA, 23 nt, Human
ucccuccuccuucgccuccuccc

SEQ ID NO: 215729 - RNA, 20 nt, Human
ucccugcggugccccuccag

SEQ ID NO: 215730 - RNA, 19 nt, Human
uccgagagccaagucuccu

SEQ ID NO: 215731 - RNA, 19 nt, Human
uccucccuccuccuccucc

SEQ ID NO: 215732 - RNA, 23 nt, Human
uccucggagaguugccgagagcc

SEQ ID NO: 215733 - RNA, 18 nt, Human
uccuugggcagggggagg

SEQ ID NO: 215734 - RNA, 22 nt, Human
ucucccuccuccuucgccuccu

SEQ ID NO: 215735 - RNA, 22 nt, Human
ucugaauuacaaucuuaaaaca

SEQ ID NO: 215736 - RNA, 23 nt, Human
ucugcagccccauccgggcccau

SEQ ID NO: 215737 - RNA, 26 nt, Human
ucugcagccccauccgggcccaucuc

SEQ ID NO: 215738 - RNA, 18 nt, Human
ugaaaaugcauugagagu

SEQ ID NO: 215739 - RNA, 19 nt, Human
ugaaauggaugcaucguac

SEQ ID NO: 215740 - RNA, 20 nt, Human
ugagcccaggagagagcccg

SEQ ID NO: 215741 - RNA, 22 nt, Human
ugccaccgccaccaccaacgcu

SEQ ID NO: 215742 - RNA, 23 nt, Human
ugcggcuguugcuguugcugcug

SEQ ID NO: 215743 - RNA, 24 nt, Human
ugcuccacucuuuacaacagaaca

SEQ ID NO: 215744 - RNA, 22 nt, Human
ugcugagcccaggagagagccc

SEQ ID NO: 215745 - RNA, 23 nt, Human
ugcugcugcugcugccgccgccc

SEQ ID NO: 215746 - RNA, 21 nt, Human
ugcugcugcugcugcugcugc

SEQ ID NO: 215747 - RNA, 21 nt, Human
ugcugcugcugcugcugcugc

SEQ ID NO: 215748 - RNA, 21 nt, Human
ugcugcugcugcugcugcugc

SEQ ID NO: 215749 - RNA, 21 nt, Human
ugcuguugcugcugcugcugc

SEQ ID NO: 215750 - RNA, 20 nt, Human
uggaagacuuuaauuuccuc

SEQ ID NO: 215751 - RNA, 18 nt, Human
uggaguccggcacaggga

SEQ ID NO: 215752 - RNA, 20 nt, Human
uggcucugcgcgccggcccc

SEQ ID NO: 215753 - RNA, 19 nt, Human
ugggcagggggaggcgggu

SEQ ID NO: 215754 - RNA, 25 nt, Human
uggggaggaggggaggggacaaggg

SEQ ID NO: 215755 - RNA, 19 nt, Human
ugggggagguuugggaagg

SEQ ID NO: 215756 - RNA, 18 nt, Human
ugugaaucaugaaauauu

SEQ ID NO: 215757 - RNA, 21 nt, Human
uguugcugcugcugcugcugc

SEQ ID NO: 215758 - RNA, 21 nt, Human
uguugcuguugcugcugcugc

SEQ ID NO: 215759 - RNA, 21 nt, Human
uuaaaagaucaacaguaucua

SEQ ID NO: 215760 - RNA, 19 nt, Human
uuccaugcgaaacgauacc

SEQ ID NO: 215761 - RNA, 22 nt, Human
uucucccuccuccuucgccucc

SEQ ID NO: 215762 - RNA, 24 nt, Human
uugaagaugaaguuuaugcagacu

SEQ ID NO: 215763 - RNA, 18 nt, Human
uuuacaaugaugcuuugu

SEQ ID NO: 215764 - RNA, 21 nt, Human
uuuuuuuuuuuuuaaaagauc

SEQ ID NO: 215765 - RNA, 23 nt, Human
uuuuuuuuuuuuuuuuuuaaaag

SEQ ID NO: 215766 - RNA, 18 nt, Human
aaaaagaaaacacuguuu

SEQ ID NO: 215767 - RNA, 18 nt, Human
aaacaaaacaaaacaaaa

SEQ ID NO: 215768 - RNA, 22 nt, Human
aaacaaaacaaaacaaaaccaa

SEQ ID NO: 215769 - RNA, 24 nt, Human
aaacaaaacaaaacaaaacgcaaa

SEQ ID NO: 215770 - RNA, 28 nt, Human
aaacaaaaccaacaacuuacaucuccaa

SEQ ID NO: 215771 - RNA, 21 nt, Human
aaacaaaacgcaaacagcaca

SEQ ID NO: 215772 - RNA, 23 nt, Human
aaacaauacguacccaaaaagaa

SEQ ID NO: 215773 - RNA, 19 nt, Human
aaacaucgcagguaccugc

SEQ ID NO: 215774 - RNA, 23 nt, Human
aaaccaacaacuuacaucuccaa

SEQ ID NO: 215775 - RNA, 20 nt, Human
aaagcccuucccucccaccu

SEQ ID NO: 215776 - RNA, 21 nt, Human
aaagcccuucccucccaccuc

SEQ ID NO: 215777 - RNA, 20 nt, Human
aaauuucacuuccauugaga

SEQ ID NO: 215778 - RNA, 21 nt, Human
aacaaaacaaaacgcaaacag

SEQ ID NO: 215779 - RNA, 20 nt, Human
aagaagaagaaauuaaaaga

SEQ ID NO: 215780 - RNA, 22 nt, Human
aaggaaaagaagaagaaauuaa

SEQ ID NO: 215781 - RNA, 26 nt, Human
aaggaaaagaagaagaaauuaaaaga

SEQ ID NO: 215782 - RNA, 20 nt, Human
acaaaacaaaacaaaaccaa

SEQ ID NO: 215783 - RNA, 21 nt, Human
acaaaacaaaacaaaaccaac

SEQ ID NO: 215784 - RNA, 22 nt, Human
acaaaacaaaacaaaacgcaaa

SEQ ID NO: 215785 - RNA, 23 nt, Human
acaaaacaaaacgcaaacagcac

SEQ ID NO: 215786 - RNA, 18 nt, Human
acaaaacgcaaacagcac

SEQ ID NO: 215787 - RNA, 21 nt, Human
acaaagacccaauauacauug

SEQ ID NO: 215788 - RNA, 19 nt, Human
acaaagcaaauaccaccca

SEQ ID NO: 215789 - RNA, 21 nt, Human
acaaugaugaaugccccaucc

SEQ ID NO: 215790 - RNA, 19 nt, Human
acacugcuuucagcagggu

SEQ ID NO: 215791 - RNA, 20 nt, Human
acagcccuccaaucaagugu

SEQ ID NO: 215792 - RNA, 22 nt, Human
acauaauaacauuuuauuaaag

SEQ ID NO: 215793 - RNA, 19 nt, Human
acccuggaauugcuagcac

SEQ ID NO: 215794 - RNA, 24 nt, Human
acgccuacagggauuuuugguuac

SEQ ID NO: 215795 - RNA, 22 nt, Human
acuacucuacggauagagggcg

SEQ ID NO: 215796 - RNA, 18 nt, Human
acugaaaacauaaaacaa

SEQ ID NO: 215797 - RNA, 20 nt, Human
agaaaacggcagaacauucu

SEQ ID NO: 215798 - RNA, 24 nt, Human
agaaaaguaaaaccuuaaaaaugu

SEQ ID NO: 215799 - RNA, 20 nt, Human
agaacugccacacacuggua

SEQ ID NO: 215800 - RNA, 20 nt, Human
agaaggccaaugaaaacauc

SEQ ID NO: 215801 - RNA, 20 nt, Human
agagauauucauccccuucc

SEQ ID NO: 215802 - RNA, 18 nt, Human
agcacaaugaugaaugcc

SEQ ID NO: 215803 - RNA, 24 nt, Human
agcaugcugaggguuauaucugcu

SEQ ID NO: 215804 - RNA, 20 nt, Human
agcccuucccucccaccucc

SEQ ID NO: 215805 - RNA, 19 nt, Human
agccggggugcgcccgggc

SEQ ID NO: 215806 - RNA, 23 nt, Human
aggagaggucgacagcccuccaa

SEQ ID NO: 215807 - RNA, 22 nt, Human
aggcaaaauguacaaagaccca

SEQ ID NO: 215808 - RNA, 25 nt, Human
aggccgaggaccgcgcuccagacac

SEQ ID NO: 215809 - RNA, 18 nt, Human
aggccgcgcggcccgggc

SEQ ID NO: 215810 - RNA, 27 nt, Human
auacaucuuaauaaaguauaucauaca

SEQ ID NO: 215811 - RNA, 26 nt, Human
aucaguuucuuucuuuccuuuuuuuu

SEQ ID NO: 215812 - RNA, 22 nt, Human
caaaacaaaacaaaaccaacaa

SEQ ID NO: 215813 - RNA, 24 nt, Human
caaaacaaaacaaaacgcaaacag

SEQ ID NO: 215814 - RNA, 24 nt, Human
caaagcccuucccucccaccuccc

SEQ ID NO: 215815 - RNA, 21 nt, Human
caagcagcugucuacuuggac

SEQ ID NO: 215816 - RNA, 22 nt, Human
caagggaaagaggcaggugacc

SEQ ID NO: 215817 - RNA, 24 nt, Human
caauacguacccaaaaagaaaaca

SEQ ID NO: 215818 - RNA, 23 nt, Human
caccggggcugcugccgccgcgu

SEQ ID NO: 215819 - RNA, 25 nt, Human
cagagcaagauaaguuaagucucuu

SEQ ID NO: 215820 - RNA, 21 nt, Human
cagcacaaugaugaaugcccc

SEQ ID NO: 215821 - RNA, 19 nt, Human
cagcgcaggggcuacuaca

SEQ ID NO: 215822 - RNA, 22 nt, Human
cagcgcaggggcuacuacagga

SEQ ID NO: 215823 - RNA, 18 nt, Human
cauguacugcgagauugc

SEQ ID NO: 215824 - RNA, 18 nt, Human
ccaaagcccuucccuccc

SEQ ID NO: 215825 - RNA, 21 nt, Human
ccagggguuggggcgaggggc

SEQ ID NO: 215826 - RNA, 24 nt, Human
cccaaagcccuucccucccaccuc

SEQ ID NO: 215827 - RNA, 19 nt, Human
cccauugaugccuauuccc

SEQ ID NO: 215828 - RNA, 19 nt, Human
cccgccacggaaauccggc

SEQ ID NO: 215829 - RNA, 21 nt, Human
cccgcgggggccagcaccgcu

SEQ ID NO: 215830 - RNA, 20 nt, Human
cccuucccucccaccuccca

SEQ ID NO: 215831 - RNA, 21 nt, Human
cccuucccucccaccucccac

SEQ ID NO: 215832 - RNA, 18 nt, Human
ccgcaccggggcugcugc

SEQ ID NO: 215833 - RNA, 22 nt, Human
ccgccggggcugcugcugcugc

SEQ ID NO: 215834 - RNA, 20 nt, Human
ccgcgcccuccgcgcucugg

SEQ ID NO: 215835 - RNA, 21 nt, Human
ccgcgcccuccgcgcucuggg

SEQ ID NO: 215836 - RNA, 18 nt, Human
ccgcgccgccgccggggc

SEQ ID NO: 215837 - RNA, 20 nt, Human
ccgcgggggccagcaccgcu

SEQ ID NO: 215838 - RNA, 22 nt, Human
ccggccgcccgcccgaucacgc

SEQ ID NO: 215839 - RNA, 18 nt, Human
ccggcgcgggcgguggcc

SEQ ID NO: 215840 - RNA, 25 nt, Human
ccuauauacagcguguacaguggaa

SEQ ID NO: 215841 - RNA, 22 nt, Human
ccucccaccucccacuacccaa

SEQ ID NO: 215842 - RNA, 19 nt, Human
ccucgggcucucgggcggc

SEQ ID NO: 215843 - RNA, 22 nt, Human
ccucgggcucucgggcggcgcc

SEQ ID NO: 215844 - RNA, 18 nt, Human
ccuugcgcccggccgccc

SEQ ID NO: 215845 - RNA, 24 nt, Human
cgacaaguaacauguacugcgaga

SEQ ID NO: 215846 - RNA, 18 nt, Human
cgccgccggggcugcugc

SEQ ID NO: 215847 - RNA, 18 nt, Human
cgcgcggcccgggcccgg

SEQ ID NO: 215848 - RNA, 24 nt, Human
cggcgcgggcgguggccgcccccc

SEQ ID NO: 215849 - RNA, 21 nt, Human
cgggcgggggcggcucccucc

SEQ ID NO: 215850 - RNA, 22 nt, Human
cguguacaguggaagacagagc

SEQ ID NO: 215851 - RNA, 24 nt, Human
cucccacccuugcgcccggccgcc

SEQ ID NO: 215852 - RNA, 21 nt, Human
cucccucccacccuugcgccc

SEQ ID NO: 215853 - RNA, 23 nt, Human
cucucugacaugugacauccugg

SEQ ID NO: 215854 - RNA, 18 nt, Human
cucugacaugugacaucc

SEQ ID NO: 215855 - RNA, 23 nt, Human
cugcggccgcugccuccucgggc

SEQ ID NO: 215856 - RNA, 24 nt, Human
cugcggccgcugccuccucgggcu

SEQ ID NO: 215857 - RNA, 23 nt, Human
cugcugcugccaacggcgacccg

SEQ ID NO: 215858 - RNA, 26 nt, Human
cugcugcugcugguguugcugcugcc

SEQ ID NO: 215859 - RNA, 23 nt, Human
cugcugcugguguugcugcugcc

SEQ ID NO: 215860 - RNA, 22 nt, Human
gaaaagaagaagaaauuaaaag

SEQ ID NO: 215861 - RNA, 18 nt, Human
gaagccggggugcgcccg

SEQ ID NO: 215862 - RNA, 24 nt, Human
gagaucacuuuacauucaacuuug

SEQ ID NO: 215863 - RNA, 20 nt, Human
gaggaccgcgcuccagacac

SEQ ID NO: 215864 - RNA, 24 nt, Human
gcacuggggaagcccccacgggag

SEQ ID NO: 215865 - RNA, 24 nt, Human
gcccccacgggaggagaggucgac

SEQ ID NO: 215866 - RNA, 22 nt, Human
gcccgcgggggccagcaccgcu

SEQ ID NO: 215867 - RNA, 20 nt, Human
gcccggcgcccagggguugg

SEQ ID NO: 215868 - RNA, 23 nt, Human
gccgccggggcugcugcugcugc

SEQ ID NO: 215869 - RNA, 20 nt, Human
gcgccgcgcccuccgcgcuc

SEQ ID NO: 215870 - RNA, 21 nt, Human
gcgccgggggacgcgcucgcu

SEQ ID NO: 215871 - RNA, 22 nt, Human
gcgggcgguggccgccccccuc

SEQ ID NO: 215872 - RNA, 20 nt, Human
gcgucuucuuuuaaugauac

SEQ ID NO: 215873 - RNA, 22 nt, Human
gcugcugcugguguugcugcug

SEQ ID NO: 215874 - RNA, 20 nt, Human
gcugcugguguugcugcugc

SEQ ID NO: 215875 - RNA, 25 nt, Human
gcugguguugcugcugcugcugccc

SEQ ID NO: 215876 - RNA, 20 nt, Human
ggaggcccgcgggggccagc

SEQ ID NO: 215877 - RNA, 18 nt, Human
ggcgggggcggcucccuc

SEQ ID NO: 215878 - RNA, 19 nt, Human
ggcgguggccgccccccuc

SEQ ID NO: 215879 - RNA, 19 nt, Human
ggggcgaggggcggagggg

SEQ ID NO: 215880 - RNA, 20 nt, Human
ggguccgcgccgccgccggg

SEQ ID NO: 215881 - RNA, 23 nt, Human
gguggggaagguccggggaggcc

SEQ ID NO: 215882 - RNA, 24 nt, Human
gguuccauucuguaaacuaaauua

SEQ ID NO: 215883 - RNA, 18 nt, Human
guaaaaagagauauucau

SEQ ID NO: 215884 - RNA, 24 nt, Human
guaaacaucgcagguaccugcacu

SEQ ID NO: 215885 - RNA, 21 nt, Human
guguacaguggaagacagagc

SEQ ID NO: 215886 - RNA, 20 nt, Human
guuggggcgaggggcggagg

SEQ ID NO: 215887 - RNA, 23 nt, Human
uaaaaacaaaacaaaacaaaacc

SEQ ID NO: 215888 - RNA, 24 nt, Human
uaaaaacaaaacaaaacaaaacca

SEQ ID NO: 215889 - RNA, 22 nt, Human
uaaaacaaaacaaaacaaaacg

SEQ ID NO: 215890 - RNA, 23 nt, Human
uaaaagacacuggccacaauuua

SEQ ID NO: 215891 - RNA, 21 nt, Human
uacacugcuuucagcaggguc

SEQ ID NO: 215892 - RNA, 24 nt, Human
uacugaaaacauaaaacaagggua

SEQ ID NO: 215893 - RNA, 23 nt, Human
uauauacagcguguacaguggaa

SEQ ID NO: 215894 - RNA, 23 nt, Human
uaugaacacgaaccaucuguaua

SEQ ID NO: 215895 - RNA, 22 nt, Human
ucaauaaggccgaggaccgcgc

SEQ ID NO: 215896 - RNA, 18 nt, Human
ucagucccacacugggcu

SEQ ID NO: 215897 - RNA, 19 nt, Human
ucagucccacacugggcuc

SEQ ID NO: 215898 - RNA, 24 nt, Human
uccaugaucaauacagaccggggc

SEQ ID NO: 215899 - RNA, 24 nt, Human
uccccuucccaaagcccuucccuc

SEQ ID NO: 215900 - RNA, 18 nt, Human
ucccucgggcccaggcgg

SEQ ID NO: 215901 - RNA, 19 nt, Human
uccgcgccgccgccggggc

SEQ ID NO: 215902 - RNA, 21 nt, Human
uccgcgccgccgccggggcug

SEQ ID NO: 215903 - RNA, 20 nt, Human
ucggcggcgccgcgcccucc

SEQ ID NO: 215904 - RNA, 21 nt, Human
ucuaaaaacaaaacaaaacaa

SEQ ID NO: 215905 - RNA, 22 nt, Human
ucuccuagcaugcugaggguua

SEQ ID NO: 215906 - RNA, 21 nt, Human
ucuggggcuccugaggaugcc

SEQ ID NO: 215907 - RNA, 20 nt, Human
ucuucaaaguccaaucccaa

SEQ ID NO: 215908 - RNA, 18 nt, Human
ugaaguaccuacauaaac

SEQ ID NO: 215909 - RNA, 24 nt, Human
ugcacuauucuaguccaguuuauu

SEQ ID NO: 215910 - RNA, 20 nt, Human
ugccggucaaguucagcagu

SEQ ID NO: 215911 - RNA, 25 nt, Human
ugccuuguuggugccucaucuaaca

SEQ ID NO: 215912 - RNA, 27 nt, Human
ugcgcccgggcgcucgggguccgcgcc

SEQ ID NO: 215913 - RNA, 22 nt, Human
ugcugccgccgcgucgcgcucc

SEQ ID NO: 215914 - RNA, 18 nt, Human
ugcugcugguguugcugc

SEQ ID NO: 215915 - RNA, 28 nt, Human
ugcugcugguguugcugcugcugcugcc

SEQ ID NO: 215916 - RNA, 23 nt, Human
uggacguaaacaucgcagguacc

SEQ ID NO: 215917 - RNA, 18 nt, Human
uggcuauuaaggagggca

SEQ ID NO: 215918 - RNA, 28 nt, Human
uggggcgaggggcggagggggcgcgggc

SEQ ID NO: 215919 - RNA, 25 nt, Human
uguaaacuaaauuaaaaauguaaau

SEQ ID NO: 215920 - RNA, 21 nt, Human
uguacaaagacccaauauaca

SEQ ID NO: 215921 - RNA, 19 nt, Human
uguuaaaacaaaacaaaac

SEQ ID NO: 215922 - RNA, 20 nt, Human
uguuaaaacaaaacaaaaca

SEQ ID NO: 215923 - RNA, 22 nt, Human
uguucuaaaguucagcacggaa

SEQ ID NO: 215924 - RNA, 19 nt, Human
uuaaaagacacuggccaca

SEQ ID NO: 215925 - RNA, 18 nt, Human
uuccauugagaaauguca

SEQ ID NO: 215926 - RNA, 24 nt, Human
uucccaaaacuaaauaaaaacuuc

SEQ ID NO: 215927 - RNA, 19 nt, Human
uuccucuaaaaaagccuca

SEQ ID NO: 215928 - RNA, 23 nt, Human
uugaugccuauucccaaaacuaa

SEQ ID NO: 215929 - RNA, 23 nt, Human
uuuaacaucuugauauccagaaa

SEQ ID NO: 215930 - RNA, 20 nt, Human
uuuugcauugccauuaaaua

SEQ ID NO: 215931 - RNA, 22 nt, Human
uuuuuguuuuuuuuguucaggg

SEQ ID NO: 215932 - RNA, 20 nt, Human
uuuuuuuuuuuucuuuuugg

SEQ ID NO: 215933 - RNA, 18 nt, Human
aaaaccucucugcaagga

SEQ ID NO: 215934 - RNA, 21 nt, Human
aaacaagacccacacauuccu

SEQ ID NO: 215935 - RNA, 19 nt, Human
aaagcagcacuugccuaca

SEQ ID NO: 215936 - RNA, 23 nt, Human
aaagcagcacuugccuacaccag

SEQ ID NO: 215937 - RNA, 22 nt, Human
aaccaguagguguaucaugaaa

SEQ ID NO: 215938 - RNA, 18 nt, Human
aacugaauccugacagug

SEQ ID NO: 215939 - RNA, 20 nt, Human
aagacacaguuccuacaaga

SEQ ID NO: 215940 - RNA, 22 nt, Human
aagcagagauccaggucaccca

SEQ ID NO: 215941 - RNA, 22 nt, Human
aaggaguucugaggagacaagc

SEQ ID NO: 215942 - RNA, 18 nt, Human
acaaugguuguagaugua

SEQ ID NO: 215943 - RNA, 24 nt, Human
acagggucuucucuuaacugugga

SEQ ID NO: 215944 - RNA, 19 nt, Human
acugcacugggccugggac

SEQ ID NO: 215945 - RNA, 19 nt, Human
agaauuagaaagcuggaau

SEQ ID NO: 215946 - RNA, 22 nt, Human
agacaagccaggucagcccaga

SEQ ID NO: 215947 - RNA, 20 nt, Human
agagaauaaaaccucucugc

SEQ ID NO: 215948 - RNA, 19 nt, Human
agauccaggucacccaguc

SEQ ID NO: 215949 - RNA, 21 nt, Human
aguuagaaagacuugaaugga

SEQ ID NO: 215950 - RNA, 24 nt, Human
aucccccuucucuaaagcagaccc

SEQ ID NO: 215951 - RNA, 23 nt, Human
cacuugccuacaccagcaccagc

SEQ ID NO: 215952 - RNA, 18 nt, Human
cagauugccaaagcagca

SEQ ID NO: 215953 - RNA, 24 nt, Human
cagcccagauugccaaagcagcac

SEQ ID NO: 215954 - RNA, 25 nt, Human
caguaagcuucuucucugcauaaag

SEQ ID NO: 215955 - RNA, 21 nt, Human
caucagaguagacgaaugagu

SEQ ID NO: 215956 - RNA, 19 nt, Human
caugaaauauccauacaaa

SEQ ID NO: 215957 - RNA, 19 nt, Human
ccagcaccagcagugagcu

SEQ ID NO: 215958 - RNA, 28 nt, Human
ccagcagugagcucaguaagcuucuucu

SEQ ID NO: 215959 - RNA, 20 nt, Human
cccagucuuuuucaucucug

SEQ ID NO: 215960 - RNA, 19 nt, Human
cccuuucuuccucccucuc

SEQ ID NO: 215961 - RNA, 18 nt, Human
ccuucucucucuuuaucc

SEQ ID NO: 215962 - RNA, 20 nt, Human
ccuuucuuccucccucucuu

SEQ ID NO: 215963 - RNA, 20 nt, Human
cuccaggguuggagaaggag

SEQ ID NO: 215964 - RNA, 24 nt, Human
cuucuauuuuucuuuuucucuuuu

SEQ ID NO: 215965 - RNA, 18 nt, Human
cuugccuacaccagcacc

SEQ ID NO: 215966 - RNA, 24 nt, Human
cuuucuuccucccucucuucuuuu

SEQ ID NO: 215967 - RNA, 19 nt, Human
gaaggggcuuuucauuguu

SEQ ID NO: 215968 - RNA, 22 nt, Human
gaguaggacguucccguaacuu

SEQ ID NO: 215969 - RNA, 18 nt, Human
gcaaggacugcacugggc

SEQ ID NO: 215970 - RNA, 24 nt, Human
gggccugggacuuuggacaaggga

SEQ ID NO: 215971 - RNA, 18 nt, Human
guaaagaucaaaucagcg

SEQ ID NO: 215972 - RNA, 21 nt, Human
guggauccuggucauuuuagu

SEQ ID NO: 215973 - RNA, 24 nt, Human
guuuuauuuuuucuuaauuugagu

SEQ ID NO: 215974 - RNA, 20 nt, Human
uaacaguccuucucucucuu

SEQ ID NO: 215975 - RNA, 19 nt, Human
uagaagccaggugauuugc

SEQ ID NO: 215976 - RNA, 24 nt, Human
uagaagccaggugauuugcccuau

SEQ ID NO: 215977 - RNA, 18 nt, Human
uaguuuuggagaguuggu

SEQ ID NO: 215978 - RNA, 20 nt, Human
uaucaugaaauauccauaca

SEQ ID NO: 215979 - RNA, 27 nt, Human
ucagaggccauuccaucccaacaucag

SEQ ID NO: 215980 - RNA, 19 nt, Human
ucaggcccacagcaaauac

SEQ ID NO: 215981 - RNA, 20 nt, Human
ucaguaagcuucuucucugc

SEQ ID NO: 215982 - RNA, 28 nt, Human
uccaggguuggagaaggaguucugagga

SEQ ID NO: 215983 - RNA, 20 nt, Human
uccaugcauuuucuauaaaa

SEQ ID NO: 215984 - RNA, 19 nt, Human
uccuucucucucuuuaucc

SEQ ID NO: 215985 - RNA, 19 nt, Human
uccuuugagaagggaaugg

SEQ ID NO: 215986 - RNA, 18 nt, Human
ucuaaagcagacccuagg

SEQ ID NO: 215987 - RNA, 20 nt, Human
ucucucuguaaaccauucca

SEQ ID NO: 215988 - RNA, 21 nt, Human
ucucuuaacuguggauccugg

SEQ ID NO: 215989 - RNA, 18 nt, Human
ucucuuuuuuugggggug

SEQ ID NO: 215990 - RNA, 22 nt, Human
ucuguuuuucauaacaguccuu

SEQ ID NO: 215991 - RNA, 22 nt, Human
ucuucuauuuuucuuuuucucu

SEQ ID NO: 215992 - RNA, 21 nt, Human
ucuucucuuaacuguggaucc

SEQ ID NO: 215993 - RNA, 26 nt, Human
ucuuuucuucucucucccuuucuucc

SEQ ID NO: 215994 - RNA, 20 nt, Human
ucuuuuucucuuuuuuuggg

SEQ ID NO: 215995 - RNA, 24 nt, Human
ugaaagugaauauccuuuugcuuu

SEQ ID NO: 215996 - RNA, 21 nt, Human
ugagaagaauuagaaagcugg

SEQ ID NO: 215997 - RNA, 23 nt, Human
ugagucuccagugagacaauggu

SEQ ID NO: 215998 - RNA, 19 nt, Human
ugaguugaucauuccaggu

SEQ ID NO: 215999 - RNA, 18 nt, Human
ugauuugcccuauagaac

SEQ ID NO: 216000 - RNA, 18 nt, Human
ugcaagugagucuccagu

SEQ ID NO: 216001 - RNA, 19 nt, Human
ugcaggcagaagugaaggg

SEQ ID NO: 216002 - RNA, 22 nt, Human
uggaaugaguugaucauuccag

SEQ ID NO: 216003 - RNA, 19 nt, Human
ugggacuuuggacaaggga

SEQ ID NO: 216004 - RNA, 24 nt, Human
ugguauuguacacuuccaucagga

SEQ ID NO: 216005 - RNA, 24 nt, Human
ugucuucuauuuuucuuuuucucu

SEQ ID NO: 216006 - RNA, 27 nt, Human
ugugcagccacucacaguuaaacaaac

SEQ ID NO: 216007 - RNA, 18 nt, Human
uuagaaagcuggaaugag

SEQ ID NO: 216008 - RNA, 21 nt, Human
uuauauuugugucucuuuucu

SEQ ID NO: 216009 - RNA, 21 nt, Human
uuaucauuugcuuuuggaagc

SEQ ID NO: 216010 - RNA, 24 nt, Human
uuccuuuuggucgacaugucucgu

SEQ ID NO: 216011 - RNA, 27 nt, Human
uucuuuaaucugcaacugaauccugag

SEQ ID NO: 216012 - RNA, 21 nt, Human
uugcaagaauuauucucauau

SEQ ID NO: 216013 - RNA, 19 nt, Human
uugccaaagcagcacuugc

SEQ ID NO: 216014 - RNA, 19 nt, Human
uuuguggcuuccuauuucu

SEQ ID NO: 216015 - RNA, 23 nt, Human
aaacaggugacaguccagcaggg

SEQ ID NO: 216016 - RNA, 23 nt, Human
aagcucaagacccaagaagagcc

SEQ ID NO: 216017 - RNA, 21 nt, Human
acacugcacaccagcuccaag

SEQ ID NO: 216018 - RNA, 23 nt, Human
acccaagaagagccauuuuucag

SEQ ID NO: 216019 - RNA, 20 nt, Human
acccccucugugggggugug

SEQ ID NO: 216020 - RNA, 18 nt, Human
acucucccaaugagaaau

SEQ ID NO: 216021 - RNA, 24 nt, Human
agaagaagcucucucagcaacagc

SEQ ID NO: 216022 - RNA, 20 nt, Human
agaagcugugcucucaaaaa

SEQ ID NO: 216023 - RNA, 21 nt, Human
agagccacacauucccucucc

SEQ ID NO: 216024 - RNA, 19 nt, Human
agccacuuacuugggcagg

SEQ ID NO: 216025 - RNA, 20 nt, Human
agccagagccacacauuccc

SEQ ID NO: 216026 - RNA, 22 nt, Human
agcccaaagcaggaguuccccc

SEQ ID NO: 216027 - RNA, 25 nt, Human
agccuggugccuccaccuucucaga

SEQ ID NO: 216028 - RNA, 20 nt, Human
agcggccucggugggaaugc

SEQ ID NO: 216029 - RNA, 18 nt, Human
agcuguuaggccagcccg

SEQ ID NO: 216030 - RNA, 18 nt, Human
aggaugggaagaacuugg

SEQ ID NO: 216031 - RNA, 19 nt, Human
aguagccccaccaggcuga

SEQ ID NO: 216032 - RNA, 18 nt, Human
agugaugacaaaugccuc

SEQ ID NO: 216033 - RNA, 22 nt, Human
aucuccugaaggcccacucucc

SEQ ID NO: 216034 - RNA, 21 nt, Human
augacaauugagaaaugcauc

SEQ ID NO: 216035 - RNA, 24 nt, Human
caaaaagagcagaaugcauuagug

SEQ ID NO: 216036 - RNA, 26 nt, Human
caaaaagagcagaaugcauuagugaa

SEQ ID NO: 216037 - RNA, 21 nt, Human
caaggagcacaucugagaagc

SEQ ID NO: 216038 - RNA, 23 nt, Human
cacagacccacugaaucaguauc

SEQ ID NO: 216039 - RNA, 20 nt, Human
cacaugcaugcagugcaguc

SEQ ID NO: 216040 - RNA, 24 nt, Human
cacugcacaccagcuccaaggagc

SEQ ID NO: 216041 - RNA, 22 nt, Human
cacuuggaagcaugaaaagcca

SEQ ID NO: 216042 - RNA, 24 nt, Human
cagaaaaacuuaugucccagccca

SEQ ID NO: 216043 - RNA, 20 nt, Human
cagcacacugcaguagcccc

SEQ ID NO: 216044 - RNA, 20 nt, Human
cagcagcaucagcauccccu

SEQ ID NO: 216045 - RNA, 23 nt, Human
cagcagcaucagcauccccuggg

SEQ ID NO: 216046 - RNA, 24 nt, Human
cagguagacacugacacaugagca

SEQ ID NO: 216047 - RNA, 19 nt, Human
caggugucugguuuccucc

SEQ ID NO: 216048 - RNA, 21 nt, Human
caugucacagagaagaagcuc

SEQ ID NO: 216049 - RNA, 18 nt, Human
ccagcaagcucaagaccc

SEQ ID NO: 216050 - RNA, 18 nt, Human
ccaggagauccaauagca

SEQ ID NO: 216051 - RNA, 18 nt, Human
cccccguggggagaccca

SEQ ID NO: 216052 - RNA, 23 nt, Human
ccuccagaacaaacugugagcag

SEQ ID NO: 216053 - RNA, 21 nt, Human
ccugguccuccuggccuugac

SEQ ID NO: 216054 - RNA, 18 nt, Human
ccuggugccuccaccuuc

SEQ ID NO: 216055 - RNA, 20 nt, Human
ccuggugccuccaccuucuc

SEQ ID NO: 216056 - RNA, 23 nt, Human
cuccaaggagcacaucugagaag

SEQ ID NO: 216057 - RNA, 21 nt, Human
cucucucagcaacagcagcug

SEQ ID NO: 216058 - RNA, 19 nt, Human
cucugaauggagagggcuc

SEQ ID NO: 216059 - RNA, 21 nt, Human
cucuugcugaacaguuuccuc

SEQ ID NO: 216060 - RNA, 18 nt, Human
cugacacaugagcaggag

SEQ ID NO: 216061 - RNA, 21 nt, Human
cugcagucagcaagcuggaga

SEQ ID NO: 216062 - RNA, 22 nt, Human
cuuaugucccagcccaaagcag

SEQ ID NO: 216063 - RNA, 23 nt, Human
cuugcuggguuacuucuguuagg

SEQ ID NO: 216064 - RNA, 18 nt, Human
cuuggugucaagugccga

SEQ ID NO: 216065 - RNA, 21 nt, Human
gaacagaacaucccauugcuc

SEQ ID NO: 216066 - RNA, 18 nt, Human
gaccuggaccaccaaggg

SEQ ID NO: 216067 - RNA, 19 nt, Human
gagaagcccuuccucuugc

SEQ ID NO: 216068 - RNA, 22 nt, Human
gagaagcccuuccucuugcuga

SEQ ID NO: 216069 - RNA, 23 nt, Human
gagagcuuccaaugcccuuggaa

SEQ ID NO: 216070 - RNA, 22 nt, Human
gagccauuuuucaguuugcguc

SEQ ID NO: 216071 - RNA, 21 nt, Human
gagguggggaaacaaagauag

SEQ ID NO: 216072 - RNA, 28 nt, Human
gcaacagcagcugguggugcuguggccc

SEQ ID NO: 216073 - RNA, 21 nt, Human
gcagguagacacugacacaug

SEQ ID NO: 216074 - RNA, 24 nt, Human
gccaugguucagguggagagagcu

SEQ ID NO: 216075 - RNA, 21 nt, Human
gcccaaagcaggaguuccccc

SEQ ID NO: 216076 - RNA, 20 nt, Human
gcugugugcugucccauuug

SEQ ID NO: 216077 - RNA, 18 nt, Human
ggaaagugugaggccuga

SEQ ID NO: 216078 - RNA, 19 nt, Human
ggagaugugcugggcccug

SEQ ID NO: 216079 - RNA, 23 nt, Human
ggccaaaggcuggccagggagca

SEQ ID NO: 216080 - RNA, 22 nt, Human
ggcgugagcuuuguuggugaug

SEQ ID NO: 216081 - RNA, 23 nt, Human
gggcagguagacacugacacaug

SEQ ID NO: 216082 - RNA, 18 nt, Human
gggccguggggcuuaaaa

SEQ ID NO: 216083 - RNA, 20 nt, Human
gggcuucacaugcaugcagu

SEQ ID NO: 216084 - RNA, 21 nt, Human
gggugugaugagagcaguacu

SEQ ID NO: 216085 - RNA, 22 nt, Human
gguggaguuuguucugccacug

SEQ ID NO: 216086 - RNA, 23 nt, Human
gucugguuuccuccuugaaaggu

SEQ ID NO: 216087 - RNA, 24 nt, Human
guggugcuguggccaaaggcuggc

SEQ ID NO: 216088 - RNA, 23 nt, Human
guucagguggagagagcuuccaa

SEQ ID NO: 216089 - RNA, 21 nt, Human
uacacagacccacugaaucag

SEQ ID NO: 216090 - RNA, 22 nt, Human
uacagucaggacacugcacacc

SEQ ID NO: 216091 - RNA, 19 nt, Human
uaguaauugagcaccuccu

SEQ ID NO: 216092 - RNA, 23 nt, Human
uccaaaacagguuuggacuugau

SEQ ID NO: 216093 - RNA, 21 nt, Human
uccaaugcccuuggaaggauu

SEQ ID NO: 216094 - RNA, 18 nt, Human
uccaccuucucagaacug

SEQ ID NO: 216095 - RNA, 20 nt, Human
ucccagcccaaagcaggagu

SEQ ID NO: 216096 - RNA, 23 nt, Human
ucccagggccagcagcaucagca

SEQ ID NO: 216097 - RNA, 19 nt, Human
ucccucuccaugggccucu

SEQ ID NO: 216098 - RNA, 22 nt, Human
uccgugugaaccgaguugggcc

SEQ ID NO: 216099 - RNA, 24 nt, Human
ucucaggcucuacacagacccacu

SEQ ID NO: 216100 - RNA, 20 nt, Human
ucucucagcaacagcagcug

SEQ ID NO: 216101 - RNA, 25 nt, Human
ucugccacugugcaguuaucauucu

SEQ ID NO: 216102 - RNA, 18 nt, Human
ugaaagcagaaaaacuua

SEQ ID NO: 216103 - RNA, 23 nt, Human
ugaagcccacuaaggaauccagg

SEQ ID NO: 216104 - RNA, 25 nt, Human
ugacaaaugccuccagccuuguccu

SEQ ID NO: 216105 - RNA, 18 nt, Human
ugacuguagaggcugaca

SEQ ID NO: 216106 - RNA, 23 nt, Human
ugacuguagaggcugacauaucu

SEQ ID NO: 216107 - RNA, 21 nt, Human
ugagcaccuccuguguuccaa

SEQ ID NO: 216108 - RNA, 23 nt, Human
ugagguggggaaacaaagauagu

SEQ ID NO: 216109 - RNA, 19 nt, Human
ugcaccccugguccuccug

SEQ ID NO: 216110 - RNA, 19 nt, Human
ugcacugggcugcauacag

SEQ ID NO: 216111 - RNA, 21 nt, Human
ugcacugggcugcauacaggc

SEQ ID NO: 216112 - RNA, 18 nt, Human
ugcagucagcaagcugga

SEQ ID NO: 216113 - RNA, 22 nt, Human
ugccagcaagcucaagacccaa

SEQ ID NO: 216114 - RNA, 23 nt, Human
ugcugcuguccuucuugacuuuc

SEQ ID NO: 216115 - RNA, 18 nt, Human
ugcugucccauuuggcag

SEQ ID NO: 216116 - RNA, 23 nt, Human
ugcuguggccaaaggcuggccag

SEQ ID NO: 216117 - RNA, 20 nt, Human
uggagagagcuuccaaugcc

SEQ ID NO: 216118 - RNA, 22 nt, Human
uggcagcuacuuuccgcuuccc

SEQ ID NO: 216119 - RNA, 18 nt, Human
uggccaaaggcuggccag

SEQ ID NO: 216120 - RNA, 25 nt, Human
uggccagggagcagcacgauccgug

SEQ ID NO: 216121 - RNA, 19 nt, Human
uggggugcagaggcugaaa

SEQ ID NO: 216122 - RNA, 19 nt, Human
uggugcuguggccaaaggc

SEQ ID NO: 216123 - RNA, 24 nt, Human
uguacaauccacugggagcaaaga

SEQ ID NO: 216124 - RNA, 24 nt, Human
ugugaugagagcaguacucagaaa

SEQ ID NO: 216125 - RNA, 18 nt, Human
ugugcaguuaucauucuc

SEQ ID NO: 216126 - RNA, 21 nt, Human
ugugcugggcccuggaguggg

SEQ ID NO: 216127 - RNA, 22 nt, Human
ugugugcugucccauuuggcag

SEQ ID NO: 216128 - RNA, 22 nt, Human
uuacagucaggacacugcacac

SEQ ID NO: 216129 - RNA, 24 nt, Human
uucacaggauccucaggugaucca

SEQ ID NO: 216130 - RNA, 21 nt, Human
uucccucuccaugggccucug

SEQ ID NO: 216131 - RNA, 18 nt, Human
uuccuagggagugcacug

SEQ ID NO: 216132 - RNA, 25 nt, Human
uugaaagguuggggcagcagaguca

SEQ ID NO: 216133 - RNA, 22 nt, Human
uugcugaacaguuuccucaucc

SEQ ID NO: 216134 - RNA, 18 nt, Human
uugcuggguuacuucugu

SEQ ID NO: 216135 - RNA, 25 nt, Human
uuggaagcaugaaaagccaugguuc

SEQ ID NO: 216136 - RNA, 20 nt, Human
uuucagggccguggggcuua

SEQ ID NO: 216137 - RNA, 18 nt, Human
uuugagacagguggagga

SEQ ID NO: 216138 - RNA, 19 nt, Human
aaaaagccgaaagccucua

SEQ ID NO: 216139 - RNA, 21 nt, Human
acuccaagccggcaucggcau

SEQ ID NO: 216140 - RNA, 20 nt, Human
acugcagcugcucucagcgg

SEQ ID NO: 216141 - RNA, 22 nt, Human
agccacuuuacuauuaaaaaug

SEQ ID NO: 216142 - RNA, 21 nt, Human
agucaggggcggaaggccggg

SEQ ID NO: 216143 - RNA, 26 nt, Human
cagcggugacucaucucuaacuccaa

SEQ ID NO: 216144 - RNA, 21 nt, Human
cccaaaaagccgaaagccucu

SEQ ID NO: 216145 - RNA, 22 nt, Human
cccaaaaagccgaaagccucua

SEQ ID NO: 216146 - RNA, 23 nt, Human
ccucagagaugcugccugccucu

SEQ ID NO: 216147 - RNA, 20 nt, Human
ccuuggggacccucagagau

SEQ ID NO: 216148 - RNA, 19 nt, Human
cguagagaaaauauagagc

SEQ ID NO: 216149 - RNA, 19 nt, Human
cgucugccucucugcugcc

SEQ ID NO: 216150 - RNA, 23 nt, Human
cgucugccucucugcugccacug

SEQ ID NO: 216151 - RNA, 23 nt, Human
cuacugcagcugcucucagcggu

SEQ ID NO: 216152 - RNA, 24 nt, Human
cucucugcugccacugcucagcua

SEQ ID NO: 216153 - RNA, 21 nt, Human
gcugcuccaucuccugggcua

SEQ ID NO: 216154 - RNA, 22 nt, Human
gcugggcugcuccaucuccugg

SEQ ID NO: 216155 - RNA, 19 nt, Human
ggcuaccggcaggugggga

SEQ ID NO: 216156 - RNA, 18 nt, Human
gggagcucagcuccgggc

SEQ ID NO: 216157 - RNA, 21 nt, Human
ucccaaaaagccgaaagccuc

SEQ ID NO: 216158 - RNA, 18 nt, Human
ucucugcugccacugcuc

SEQ ID NO: 216159 - RNA, 23 nt, Human
uuguuaucaagugaagucagggg

SEQ ID NO: 216160 - RNA, 21 nt, Human
uuuuuuuuuuuuuuuuugcgu

SEQ ID NO: 216161 - RNA, 24 nt, Human
uuuuuuuuuuuuuuuuuugcguag

SEQ ID NO: 216162 - RNA, 20 nt, Human
uuuuuuuuuuuuuuuuuugg

SEQ ID NO: 216163 - RNA, 19 nt, Human
accacggucacucuccagc

SEQ ID NO: 216164 - RNA, 22 nt, Human
accacggucacucuccagcccc

SEQ ID NO: 216165 - RNA, 20 nt, Human
acgcagccgccccaggucac

SEQ ID NO: 216166 - RNA, 22 nt, Human
aggagucagccccagccucgcc

SEQ ID NO: 216167 - RNA, 25 nt, Human
agggagcaggccaugggacccucau

SEQ ID NO: 216168 - RNA, 19 nt, Human
cacucuccagcccccggcc

SEQ ID NO: 216169 - RNA, 20 nt, Human
ccaccccggcccacgcagcc

SEQ ID NO: 216170 - RNA, 18 nt, Human
ccacggucacucuccagc

SEQ ID NO: 216171 - RNA, 20 nt, Human
ccgccaggacccggcgcggg

SEQ ID NO: 216172 - RNA, 20 nt, Human
ccugagggagcaggccaugg

SEQ ID NO: 216173 - RNA, 22 nt, Human
cgccccaggucacucagaccac

SEQ ID NO: 216174 - RNA, 22 nt, Human
cgcggcccgagcgccgccccuc

SEQ ID NO: 216175 - RNA, 21 nt, Human
cggcgcgggcagcgcgcggcc

SEQ ID NO: 216176 - RNA, 22 nt, Human
gcggcccgagcgccgccccucc

SEQ ID NO: 216177 - RNA, 20 nt, Human
ggccaugggacccucaucgg

SEQ ID NO: 216178 - RNA, 18 nt, Human
ucgccgcccgccaggacc

SEQ ID NO: 216179 - RNA, 23 nt, Human
ucuggugcccggcuuugaggccc

SEQ ID NO: 216180 - RNA, 24 nt, Human
ugaggcaggagucagccccagccu

SEQ ID NO: 216181 - RNA, 20 nt, Human
ugagggagcaggccauggga

SEQ ID NO: 216182 - RNA, 24 nt, Human
ugcccggcuuugaggcccaccuua

SEQ ID NO: 216183 - RNA, 22 nt, Human
ugguaagaugccucuuuauugg

SEQ ID NO: 216184 - RNA, 20 nt, Human
uggugcuggagcuguuccug

SEQ ID NO: 216185 - RNA, 23 nt, Human
uuccugagggagcaggccauggg

SEQ ID NO: 216186 - RNA, 21 nt, Human
uuggugguaagaugccucuuu

SEQ ID NO: 216187 - RNA, 18 nt, Human
uuuuuuuuuuuuuuuuug

SEQ ID NO: 216188 - RNA, 20 nt, Human
uuuuuuuuuuuuuuuuuggu

SEQ ID NO: 216189 - RNA, 22 nt, Human
uuuuuuuuuuuuuuuuuggugg

SEQ ID NO: 216190 - RNA, 19 nt, Human
aaaaaaaguggggaggggg

SEQ ID NO: 216191 - RNA, 25 nt, Human
aaaaagacaaaacacauagaauuag

SEQ ID NO: 216192 - RNA, 19 nt, Human
aaccaaugcagcuccaccu

SEQ ID NO: 216193 - RNA, 24 nt, Human
aagaaaaagacaaaacacauagaa

SEQ ID NO: 216194 - RNA, 22 nt, Human
aagucaaacacaaucccgagac

SEQ ID NO: 216195 - RNA, 27 nt, Human
aagucaacuuuaaacauaucaaaccaa

SEQ ID NO: 216196 - RNA, 21 nt, Human
aaguuuccuuuuuuuuuuccu

SEQ ID NO: 216197 - RNA, 22 nt, Human
aaugcaagagcaaacaaaaaaa

SEQ ID NO: 216198 - RNA, 18 nt, Human
acagcccacagagaggau

SEQ ID NO: 216199 - RNA, 23 nt, Human
agaaaaagacaaaacacauagaa

SEQ ID NO: 216200 - RNA, 24 nt, Human
agaaaaagacaaaacacauagaaa

SEQ ID NO: 216201 - RNA, 18 nt, Human
agacacaagucaaacaca

SEQ ID NO: 216202 - RNA, 23 nt, Human
agcuacaggacaggccaagagac

SEQ ID NO: 216203 - RNA, 18 nt, Human
agggggcaaaguaaaaaa

SEQ ID NO: 216204 - RNA, 23 nt, Human
aguaaaaaauaaaccagcuacag

SEQ ID NO: 216205 - RNA, 19 nt, Human
aguuuccuuuuuuuuuucc

SEQ ID NO: 216206 - RNA, 22 nt, Human
aguuuccuuuuuuuuuuccuuu

SEQ ID NO: 216207 - RNA, 26 nt, Human
cacaaucccgagacgcuuguggcaaa

SEQ ID NO: 216208 - RNA, 18 nt, Human
cagcuccaccuuccugaa

SEQ ID NO: 216209 - RNA, 19 nt, Human
cauauaauucaaagaccac

SEQ ID NO: 216210 - RNA, 21 nt, Human
ccuuguuaaagucaacuuuaa

SEQ ID NO: 216211 - RNA, 19 nt, Human
cgcugcggcggcggcagac

SEQ ID NO: 216212 - RNA, 19 nt, Human
cgcugcucggcugcgccgc

SEQ ID NO: 216213 - RNA, 20 nt, Human
cuggagcuguggcuaagugg

SEQ ID NO: 216214 - RNA, 26 nt, Human
cuucacaguguugcuaccauaucacc

SEQ ID NO: 216215 - RNA, 24 nt, Human
cuuuugcuggagcuccuguuuggc

SEQ ID NO: 216216 - RNA, 22 nt, Human
gaaaaagacaaaacacauagaa

SEQ ID NO: 216217 - RNA, 23 nt, Human
gaugcuggagcuguggcuaagug

SEQ ID NO: 216218 - RNA, 18 nt, Human
gcaaaauagagguaaccu

SEQ ID NO: 216219 - RNA, 21 nt, Human
gcaaugcaagagcaaacaaaa

SEQ ID NO: 216220 - RNA, 21 nt, Human
gcccucgcggaucuaggaguu

SEQ ID NO: 216221 - RNA, 24 nt, Human
ggccaagagacccaggauuucaau

SEQ ID NO: 216222 - RNA, 18 nt, Human
ggcgcugcggcggcggca

SEQ ID NO: 216223 - RNA, 25 nt, Human
gggaaaaaaaauacagaaugaaugu

SEQ ID NO: 216224 - RNA, 21 nt, Human
gggaaauauuggccccugggg

SEQ ID NO: 216225 - RNA, 18 nt, Human
gguuuugcguuuuguuug

SEQ ID NO: 216226 - RNA, 23 nt, Human
guuuccuuuuuuuuuuccuuuuu

SEQ ID NO: 216227 - RNA, 24 nt, Human
uaaaaaauaaaccagcuacaggac

SEQ ID NO: 216228 - RNA, 24 nt, Human
uaagaaaaagacaaaacacauaga

SEQ ID NO: 216229 - RNA, 21 nt, Human
uaagagggaguaauguccaca

SEQ ID NO: 216230 - RNA, 24 nt, Human
uaagagggaguaauguccacagug

SEQ ID NO: 216231 - RNA, 28 nt, Human
uacuggguuuugcguuuuggagagaucu

SEQ ID NO: 216232 - RNA, 19 nt, Human
uaucuguaagagggaguaa

SEQ ID NO: 216233 - RNA, 18 nt, Human
ucaaaccaaugcagcucc

SEQ ID NO: 216234 - RNA, 24 nt, Human
ucaguuuucauugacugggucguu

SEQ ID NO: 216235 - RNA, 19 nt, Human
uccaccuuccugaaaggac

SEQ ID NO: 216236 - RNA, 27 nt, Human
ucccaugauugucuucacaguguugcu

SEQ ID NO: 216237 - RNA, 20 nt, Human
ucggcugcgccgcgcccucg

SEQ ID NO: 216238 - RNA, 21 nt, Human
ucuuccgacaauaaauaauaa

SEQ ID NO: 216239 - RNA, 18 nt, Human
ucuuuuuuuuucacuuca

SEQ ID NO: 216240 - RNA, 21 nt, Human
ugaaaggacucuuucagccaa

SEQ ID NO: 216241 - RNA, 19 nt, Human
ugcaaugcaagagcaaaca

SEQ ID NO: 216242 - RNA, 20 nt, Human
ugcuggagcuccuguuuggc

SEQ ID NO: 216243 - RNA, 21 nt, Human
uggcaaaauagagguaaccuu

SEQ ID NO: 216244 - RNA, 18 nt, Human
uggccccugggguugccu

SEQ ID NO: 216245 - RNA, 20 nt, Human
uucaguuuucauugacuggg

SEQ ID NO: 216246 - RNA, 18 nt, Human
uucauggagcauucauuu

SEQ ID NO: 216247 - RNA, 20 nt, Human
uucauggagcauucauuucu

SEQ ID NO: 216248 - RNA, 21 nt, Human
uucauggagcauucauuucuu

SEQ ID NO: 216249 - RNA, 23 nt, Human
uucauggagcauucauuucuuga

SEQ ID NO: 216250 - RNA, 21 nt, Human
uucucuagaugugcagugaaa

SEQ ID NO: 216251 - RNA, 27 nt, Human
uucuuggacagacacaagucaaacaca

SEQ ID NO: 216252 - RNA, 18 nt, Human
uuuauagucgcuucagac

SEQ ID NO: 216253 - RNA, 22 nt, Human
aagaggaaggaagccauccugg

SEQ ID NO: 216254 - RNA, 25 nt, Human
aagcccccaaaucaucagaaaacag

SEQ ID NO: 216255 - RNA, 21 nt, Human
accucccagcuaagccccagc

SEQ ID NO: 216256 - RNA, 23 nt, Human
acuuaaaggggcauugguagggg

SEQ ID NO: 216257 - RNA, 25 nt, Human
agaccaccucccagcuaagccccag

SEQ ID NO: 216258 - RNA, 22 nt, Human
agaggagcagacaacagaugca

SEQ ID NO: 216259 - RNA, 22 nt, Human
agaguucucccugccucggccu

SEQ ID NO: 216260 - RNA, 22 nt, Human
aggagcaggaggagcuugagca

SEQ ID NO: 216261 - RNA, 18 nt, Human
aggcaggaugaagacggg

SEQ ID NO: 216262 - RNA, 23 nt, Human
aggcaggaugaagacgggauggg

SEQ ID NO: 216263 - RNA, 22 nt, Human
agggaggaaggguaagaggaaa

SEQ ID NO: 216264 - RNA, 20 nt, Human
aggggcaaggggaggaguua

SEQ ID NO: 216265 - RNA, 20 nt, Human
aguucucccugccucggccu

SEQ ID NO: 216266 - RNA, 18 nt, Human
augcaggccucaggaguu

SEQ ID NO: 216267 - RNA, 18 nt, Human
caaagggacucccaagcc

SEQ ID NO: 216268 - RNA, 22 nt, Human
caagcccccaaaucaucagaaa

SEQ ID NO: 216269 - RNA, 22 nt, Human
cagaaaacagcaaggagcagga

SEQ ID NO: 216270 - RNA, 21 nt, Human
cagcuccauucccccaauccu

SEQ ID NO: 216271 - RNA, 22 nt, Human
cagcuccauucccccaauccug

SEQ ID NO: 216272 - RNA, 21 nt, Human
ccaccacugaggcuucuccca

SEQ ID NO: 216273 - RNA, 21 nt, Human
ccagcuccauucccccaaucc

SEQ ID NO: 216274 - RNA, 21 nt, Human
cccaaaucaucagaaaacagc

SEQ ID NO: 216275 - RNA, 24 nt, Human
ccccagcuccauucccccaauccu

SEQ ID NO: 216276 - RNA, 20 nt, Human
ccucaggaguugccaacccc

SEQ ID NO: 216277 - RNA, 22 nt, Human
ccucccgaggucacgcagccag

SEQ ID NO: 216278 - RNA, 23 nt, Human
cuacuucccauccuccucuccca

SEQ ID NO: 216279 - RNA, 21 nt, Human
cucagagccauaccagccacu

SEQ ID NO: 216280 - RNA, 23 nt, Human
cuggauccccacauuucagucuc

SEQ ID NO: 216281 - RNA, 24 nt, Human
gacaaagggacucccaagccccca

SEQ ID NO: 216282 - RNA, 27 nt, Human
gacaacagaugcauaguuggggagaaa

SEQ ID NO: 216283 - RNA, 22 nt, Human
gagcacaggcaaugcuguuagc

SEQ ID NO: 216284 - RNA, 21 nt, Human
gagcaggccccagggagccuc

SEQ ID NO: 216285 - RNA, 22 nt, Human
gcaggcugagggaggaagggua

SEQ ID NO: 216286 - RNA, 18 nt, Human
gccuggaauuccaccacu

SEQ ID NO: 216287 - RNA, 21 nt, Human
gcuggccuuugcagaggagca

SEQ ID NO: 216288 - RNA, 22 nt, Human
ggauagagguugcaggcugagg

SEQ ID NO: 216289 - RNA, 22 nt, Human
ggauggaagaggaccccagcuc

SEQ ID NO: 216290 - RNA, 18 nt, Human
ggcauugguaggggcaag

SEQ ID NO: 216291 - RNA, 21 nt, Human
ggccccagggagccucagagc

SEQ ID NO: 216292 - RNA, 22 nt, Human
uaaaggggcauugguaggggca

SEQ ID NO: 216293 - RNA, 22 nt, Human
ucaaauucuauccuagucacua

SEQ ID NO: 216294 - RNA, 20 nt, Human
ucagaaaacagcaaggagca

SEQ ID NO: 216295 - RNA, 19 nt, Human
ucagaugaggacaaaggga

SEQ ID NO: 216296 - RNA, 22 nt, Human
ucaucagaaaacagcaaggagc

SEQ ID NO: 216297 - RNA, 19 nt, Human
uccaggauagagguugcag

SEQ ID NO: 216298 - RNA, 23 nt, Human
uccaggauagagguugcaggcug

SEQ ID NO: 216299 - RNA, 18 nt, Human
ugccuggaauuccaccac

SEQ ID NO: 216300 - RNA, 21 nt, Human
ugccuggaauuccaccacuga

SEQ ID NO: 216301 - RNA, 23 nt, Human
ugccuggaauuccaccacugagg

SEQ ID NO: 216302 - RNA, 23 nt, Human
ugcuucagaccaccucccagcua

SEQ ID NO: 216303 - RNA, 21 nt, Human
uggauccccacauuucagucu

SEQ ID NO: 216304 - RNA, 27 nt, Human
ugucuacuucccauccuccucucccaa

SEQ ID NO: 216305 - RNA, 22 nt, Human
uugcagaggagcagacaacaga

SEQ ID NO: 216306 - RNA, 23 nt, Human
uugcaggcugagggaggaagggu

SEQ ID NO: 216307 - RNA, 18 nt, Human
uuggagcaggucuagaag

SEQ ID NO: 216308 - RNA, 21 nt, Human
aaacaauagucaagucagacu

SEQ ID NO: 216309 - RNA, 22 nt, Human
agaaaggaaaaacaauagucaa

SEQ ID NO: 216310 - RNA, 23 nt, Human
agacagggucucccuauguugcc

SEQ ID NO: 216311 - RNA, 23 nt, Human
agacuuuugacacacauaaaaua

SEQ ID NO: 216312 - RNA, 24 nt, Human
agagugcuaggauuacagguauga

SEQ ID NO: 216313 - RNA, 21 nt, Human
aggaaaaucuuguauauugca

SEQ ID NO: 216314 - RNA, 22 nt, Human
agugcuaggauuacagguauga

SEQ ID NO: 216315 - RNA, 25 nt, Human
caauagguuggaaaaccugaaguuc

SEQ ID NO: 216316 - RNA, 24 nt, Human
cagagugcuaggauuacagguaug

SEQ ID NO: 216317 - RNA, 24 nt, Human
cagggucucccuauguugcccagg

SEQ ID NO: 216318 - RNA, 21 nt, Human
ccagagugcuaggauuacagg

SEQ ID NO: 216319 - RNA, 22 nt, Human
ccagagugcuaggauuacaggu

SEQ ID NO: 216320 - RNA, 24 nt, Human
ccagagugcuaggauuacagguau

SEQ ID NO: 216321 - RNA, 19 nt, Human
ccccaccacgcugcccaaa

SEQ ID NO: 216322 - RNA, 19 nt, Human
ccccaccacgcugcccaaa

SEQ ID NO: 216323 - RNA, 22 nt, Human
ccccaccacgcugcccaaaaaa

SEQ ID NO: 216324 - RNA, 21 nt, Human
ccccagaagcaggaguaagcu

SEQ ID NO: 216325 - RNA, 22 nt, Human
cccccaccacgcugcccaaaaa

SEQ ID NO: 216326 - RNA, 24 nt, Human
cccccaccacgcugcccaaaaaaa

SEQ ID NO: 216327 - RNA, 24 nt, Human
cccuauguugcccaggcuggucuu

SEQ ID NO: 216328 - RNA, 21 nt, Human
ccuccugccucggccucccag

SEQ ID NO: 216329 - RNA, 22 nt, Human
ccuccugccucggccucccaga

SEQ ID NO: 216330 - RNA, 25 nt, Human
ccuccugccucggccucccagagug

SEQ ID NO: 216331 - RNA, 24 nt, Human
ccugccucggccucccagagugcu

SEQ ID NO: 216332 - RNA, 20 nt, Human
ccugggcuaaagggauccuc

SEQ ID NO: 216333 - RNA, 25 nt, Human
cugcagaaugucuaaaagaaaaaaa

SEQ ID NO: 216334 - RNA, 18 nt, Human
gauuacagguaugagcca

SEQ ID NO: 216335 - RNA, 21 nt, Human
gauuacagguaugagccacca

SEQ ID NO: 216336 - RNA, 22 nt, Human
gauuacagguaugagccaccau

SEQ ID NO: 216337 - RNA, 18 nt, Human
gccagaaaggaaaaacaa

SEQ ID NO: 216338 - RNA, 20 nt, Human
gccucacuuccaggaaugau

SEQ ID NO: 216339 - RNA, 25 nt, Human
gcgccagaaaggaaaaacaauaguc

SEQ ID NO: 216340 - RNA, 23 nt, Human
ggagauaaaucuaaaugagaaca

SEQ ID NO: 216341 - RNA, 22 nt, Human
ggauccuccugccucggccucc

SEQ ID NO: 216342 - RNA, 22 nt, Human
ggauuacagguaugagccacca

SEQ ID NO: 216343 - RNA, 24 nt, Human
ggauuacagguaugagccaccaug

SEQ ID NO: 216344 - RNA, 19 nt, Human
ggcggcggcgacuccucag

SEQ ID NO: 216345 - RNA, 19 nt, Human
guauggauucaugcgccag

SEQ ID NO: 216346 - RNA, 18 nt, Human
gucuccacaaggccacug

SEQ ID NO: 216347 - RNA, 21 nt, Human
gugcaacaggcagagaaggac

SEQ ID NO: 216348 - RNA, 18 nt, Human
guuguguuaaaaucucau

SEQ ID NO: 216349 - RNA, 22 nt, Human
uaaaacaaugaaggaaucacaa

SEQ ID NO: 216350 - RNA, 28 nt, Human
uaaaacaaugaaggaaucaccgguaccc

SEQ ID NO: 216351 - RNA, 20 nt, Human
uaaacuaguggaauaagaca

SEQ ID NO: 216352 - RNA, 23 nt, Human
uaaagggauccuccugccucggc

SEQ ID NO: 216353 - RNA, 27 nt, Human
uaacaaaugccucuuaccaagaggcuu

SEQ ID NO: 216354 - RNA, 20 nt, Human
uaacuccugggcuaaaggga

SEQ ID NO: 216355 - RNA, 24 nt, Human
uaaggcguugucuccacaaggcca

SEQ ID NO: 216356 - RNA, 21 nt, Human
uacaagaugugcaacaggcag

SEQ ID NO: 216357 - RNA, 23 nt, Human
uacagguaugagccaccaugccc

SEQ ID NO: 216358 - RNA, 18 nt, Human
uaggauuacagguaugag

SEQ ID NO: 216359 - RNA, 22 nt, Human
uaggauuacagguaugagccac

SEQ ID NO: 216360 - RNA, 24 nt, Human
uaggauuacagguaugagccacca

SEQ ID NO: 216361 - RNA, 20 nt, Human
uagguuggaaaaccugaagu

SEQ ID NO: 216362 - RNA, 19 nt, Human
uauguugcccaggcugguc

SEQ ID NO: 216363 - RNA, 23 nt, Human
uauguugcccaggcuggucuuua

SEQ ID NO: 216364 - RNA, 24 nt, Human
uauguugcccaggcuggucuuuaa

SEQ ID NO: 216365 - RNA, 25 nt, Human
uauuguuguuaaaggaauaaacuag

SEQ ID NO: 216366 - RNA, 19 nt, Human
ucaagucagacuaaaauga

SEQ ID NO: 216367 - RNA, 21 nt, Human
ucaagucagacuaaaaugaga

SEQ ID NO: 216368 - RNA, 23 nt, Human
ucccagagugcuaggauuacagg

SEQ ID NO: 216369 - RNA, 20 nt, Human
uccccagaagcaggaguaag

SEQ ID NO: 216370 - RNA, 23 nt, Human
ucccuauguugcccaggcugguc

SEQ ID NO: 216371 - RNA, 22 nt, Human
uccuccugccucggccucccag

SEQ ID NO: 216372 - RNA, 25 nt, Human
ucggggcggcggcgacuccucaguc

SEQ ID NO: 216373 - RNA, 23 nt, Human
ucucccuauguugcccaggcugg

SEQ ID NO: 216374 - RNA, 24 nt, Human
ucucccuauguugcccaggcuggu

SEQ ID NO: 216375 - RNA, 25 nt, Human
ucucuaaagagccauuguccaauuu

SEQ ID NO: 216376 - RNA, 21 nt, Human
ucuuuaacuccugggcuaaag

SEQ ID NO: 216377 - RNA, 21 nt, Human
ugaaggaaucacaguguuaac

SEQ ID NO: 216378 - RNA, 27 nt, Human
ugagaacauuaauuuacuucccugcgg

SEQ ID NO: 216379 - RNA, 18 nt, Human
ugagacuuuugacacaca

SEQ ID NO: 216380 - RNA, 25 nt, Human
ugcagaaugucuaaaagaaaaaaac

SEQ ID NO: 216381 - RNA, 24 nt, Human
ugcccaaaaaaaagacagggucuc

SEQ ID NO: 216382 - RNA, 24 nt, Human
ugcccaggcuggucuuuaacuccu

SEQ ID NO: 216383 - RNA, 28 nt, Human
ugcccaggcuggucuuuaacuccugggc

SEQ ID NO: 216384 - RNA, 21 nt, Human
ugccucggccucccagagugc

SEQ ID NO: 216385 - RNA, 23 nt, Human
ugccucggccucccagagugcua

SEQ ID NO: 216386 - RNA, 24 nt, Human
ugccucggccucccagagugcuag

SEQ ID NO: 216387 - RNA, 21 nt, Human
ugccucuuaccaagaggcuua

SEQ ID NO: 216388 - RNA, 24 nt, Human
ugcuaggauuacagguaugagcca

SEQ ID NO: 216389 - RNA, 23 nt, Human
uggaaaaccugaaguucucacag

SEQ ID NO: 216390 - RNA, 21 nt, Human
uggguuaaggcguugucucca

SEQ ID NO: 216391 - RNA, 21 nt, Human
ugguaccgggacucggggcgg

SEQ ID NO: 216392 - RNA, 22 nt, Human
uuuaacuccugggcuaaaggga

SEQ ID NO: 216393 - RNA, 23 nt, Human
uuuguagagaugcaagagucuug

SEQ ID NO: 216394 - RNA, 25 nt, Human
uuugucaggcaacugaaacaaucag

SEQ ID NO: 216395 - RNA, 18 nt, Human
uuuuauuuaucccccacc

SEQ ID NO: 216396 - RNA, 21 nt, Human
uuuuuuuuuuuuuuuuuauuu

SEQ ID NO: 216397 - RNA, 23 nt, Human
aaaagcacucagcaggaugaccc

SEQ ID NO: 216398 - RNA, 23 nt, Human
aaaaugcccucauuucuauuuuu

SEQ ID NO: 216399 - RNA, 22 nt, Human
aaacaggacuucugguucaugg

SEQ ID NO: 216400 - RNA, 21 nt, Human
aaccucaacaaauuauaauau

SEQ ID NO: 216401 - RNA, 19 nt, Human
aagcauguucuguaaaagc

SEQ ID NO: 216402 - RNA, 24 nt, Human
aaggaguugagacaacucuuucuu

SEQ ID NO: 216403 - RNA, 24 nt, Human
acagcaacaauccggcaaaagcac

SEQ ID NO: 216404 - RNA, 22 nt, Human
acagcacaggguaaccauuuga

SEQ ID NO: 216405 - RNA, 19 nt, Human
agagaugcauuuucacucc

SEQ ID NO: 216406 - RNA, 20 nt, Human
agagcuauuuuuguauucaa

SEQ ID NO: 216407 - RNA, 22 nt, Human
agcuuuacuacuaagaucuugc

SEQ ID NO: 216408 - RNA, 26 nt, Human
aggagcuuaugcuacaguagauucca

SEQ ID NO: 216409 - RNA, 21 nt, Human
aggaugacccauaauggcacu

SEQ ID NO: 216410 - RNA, 20 nt, Human
auacauuucuugucacauau

SEQ ID NO: 216411 - RNA, 18 nt, Human
aucaccuugggcagggag

SEQ ID NO: 216412 - RNA, 21 nt, Human
aucauucugggaucggacaau

SEQ ID NO: 216413 - RNA, 23 nt, Human
auccaguuggguacagcacaggg

SEQ ID NO: 216414 - RNA, 25 nt, Human
auccaguuggguacagcacaggggg

SEQ ID NO: 216415 - RNA, 22 nt, Human
augaaucccugauggauuacau

SEQ ID NO: 216416 - RNA, 21 nt, Human
auguguacaugugucugcaca

SEQ ID NO: 216417 - RNA, 22 nt, Human
auguuucuaugaucauaaaaau

SEQ ID NO: 216418 - RNA, 24 nt, Human
auuaauaaaaaugaaacuauauga

SEQ ID NO: 216419 - RNA, 24 nt, Human
auugaauaauuguuauuauuuucu

SEQ ID NO: 216420 - RNA, 28 nt, Human
caaaagcacucagcaggauuggagaccc

SEQ ID NO: 216421 - RNA, 21 nt, Human
caagaacaaagaagcacauac

SEQ ID NO: 216422 - RNA, 24 nt, Human
caagauaagcgaaacauugacuug

SEQ ID NO: 216423 - RNA, 23 nt, Human
caauccggcaaaagcacucagca

SEQ ID NO: 216424 - RNA, 25 nt, Human
cacacaaaccucaacaaauuauaau

SEQ ID NO: 216425 - RNA, 18 nt, Human
cacacacacacacacaca

SEQ ID NO: 216426 - RNA, 23 nt, Human
cacucugcccgguagcccaucuu

SEQ ID NO: 216427 - RNA, 18 nt, Human
cagagcuguaaaacugua

SEQ ID NO: 216428 - RNA, 21 nt, Human
cagcggcgcccaggagcggga

SEQ ID NO: 216429 - RNA, 21 nt, Human
cagcuaaauucuuuggaaauu

SEQ ID NO: 216430 - RNA, 18 nt, Human
cagcucuuccucucuuuu

SEQ ID NO: 216431 - RNA, 27 nt, Human
caggccagcaagaggacaccaaaccuc

SEQ ID NO: 216432 - RNA, 22 nt, Human
caguggcagcggcgcccaggag

SEQ ID NO: 216433 - RNA, 23 nt, Human
cauaaugacuacuucaagaacaa

SEQ ID NO: 216434 - RNA, 24 nt, Human
caugacaaaucacugugaugccac

SEQ ID NO: 216435 - RNA, 25 nt, Human
caugacaaaucacugugaugccaca

SEQ ID NO: 216436 - RNA, 26 nt, Human
caugacaaaucacugugaugccacac

SEQ ID NO: 216437 - RNA, 22 nt, Human
ccaaucuuccacagugcuaaaa

SEQ ID NO: 216438 - RNA, 23 nt, Human
ccacaucgcccgccccuucgcgg

SEQ ID NO: 216439 - RNA, 23 nt, Human
ccaguggcagcggcgcccaggag

SEQ ID NO: 216440 - RNA, 18 nt, Human
cucacuggcagcuuccca

SEQ ID NO: 216441 - RNA, 18 nt, Human
cucauuggcagcaauuga

SEQ ID NO: 216442 - RNA, 20 nt, Human
cucuggcugggccacuuauc

SEQ ID NO: 216443 - RNA, 23 nt, Human
cucuuggucucugaaaucucacu

SEQ ID NO: 216444 - RNA, 22 nt, Human
cugauggauuacauaguuacau

SEQ ID NO: 216445 - RNA, 23 nt, Human
cuuggucucugaaaucucacuuc

SEQ ID NO: 216446 - RNA, 22 nt, Human
cuuuacuacuaagaucuugcug

SEQ ID NO: 216447 - RNA, 19 nt, Human
gaaaguuaccaucucuccu

SEQ ID NO: 216448 - RNA, 19 nt, Human
gaguuucuggaugaauaca

SEQ ID NO: 216449 - RNA, 26 nt, Human
ggagaggagugauuuccuguguuuuc

SEQ ID NO: 216450 - RNA, 21 nt, Human
ggcaaagaaagaacaaguggu

SEQ ID NO: 216451 - RNA, 20 nt, Human
ggcaggcugagcacuggggg

SEQ ID NO: 216452 - RNA, 24 nt, Human
ggcagggagggaaaauuuuuaggu

SEQ ID NO: 216453 - RNA, 23 nt, Human
gucauuuuccaaguaaugaaucc

SEQ ID NO: 216454 - RNA, 21 nt, Human
uaaaaacuucaaaaugcccuc

SEQ ID NO: 216455 - RNA, 23 nt, Human
uaaaauauuucauuucuccauuu

SEQ ID NO: 216456 - RNA, 22 nt, Human
uaagcuggaaaaauaugauuuu

SEQ ID NO: 216457 - RNA, 24 nt, Human
uaagcuggaaaaauaugauuuuau

SEQ ID NO: 216458 - RNA, 21 nt, Human
uacagguucugguaaaucaga

SEQ ID NO: 216459 - RNA, 23 nt, Human
uacaugugaugguagcaaauuua

SEQ ID NO: 216460 - RNA, 18 nt, Human
uacauguucuggucuugu

SEQ ID NO: 216461 - RNA, 18 nt, Human
uaccaagggaaaauauuc

SEQ ID NO: 216462 - RNA, 24 nt, Human
uagauuauugaauaauuguuauua

SEQ ID NO: 216463 - RNA, 26 nt, Human
uauacuuguuuuuaaacgagucuauc

SEQ ID NO: 216464 - RNA, 19 nt, Human
uaucagaaaggguuucagg

SEQ ID NO: 216465 - RNA, 18 nt, Human
uaugucuuuuugguauug

SEQ ID NO: 216466 - RNA, 25 nt, Human
ucaaaauuaagcauguucuguaaaa

SEQ ID NO: 216467 - RNA, 19 nt, Human
ucagggacugucucauugg

SEQ ID NO: 216468 - RNA, 23 nt, Human
ucaguggcaucuuucucugcugg

SEQ ID NO: 216469 - RNA, 19 nt, Human
ucaugaauuauacauuucu

SEQ ID NO: 216470 - RNA, 19 nt, Human
ucauucagaagccauuuua

SEQ ID NO: 216471 - RNA, 18 nt, Human
uccaaaagcgcguauuuc

SEQ ID NO: 216472 - RNA, 20 nt, Human
uccaauguccucaguagaau

SEQ ID NO: 216473 - RNA, 21 nt, Human
uccuguugguuugaguuuuca

SEQ ID NO: 216474 - RNA, 23 nt, Human
ucucacuggcagcuucccaggcu

SEQ ID NO: 216475 - RNA, 18 nt, Human
ucugcaguuugcauucuc

SEQ ID NO: 216476 - RNA, 29 nt, Human
ugaaauggaaaauugucuuuucaaaaaaa

SEQ ID NO: 216477 - RNA, 20 nt, Human
ugaacaaagcagagcccagg

SEQ ID NO: 216478 - RNA, 21 nt, Human
ugaauaagagaaacccugagu

SEQ ID NO: 216479 - RNA, 22 nt, Human
ugacaggccagcaagaggacac

SEQ ID NO: 216480 - RNA, 18 nt, Human
ugacuuggcugaugucag

SEQ ID NO: 216481 - RNA, 24 nt, Human
ugaggucugagauacauuuuuccu

SEQ ID NO: 216482 - RNA, 19 nt, Human
ugaguuuucaaaccugaaa

SEQ ID NO: 216483 - RNA, 19 nt, Human
ugaugccacacaaaacuac

SEQ ID NO: 216484 - RNA, 23 nt, Human
ugauguagucauuuucuuuccag

SEQ ID NO: 216485 - RNA, 24 nt, Human
ugauuagauucacaacugucuuuu

SEQ ID NO: 216486 - RNA, 28 nt, Human
ugauuagauucacaacugucuuuuugga

SEQ ID NO: 216487 - RNA, 21 nt, Human
ugcagagcuguaaaacuguag

SEQ ID NO: 216488 - RNA, 18 nt, Human
ugccccaguggcagcggc

SEQ ID NO: 216489 - RNA, 19 nt, Human
ugccccaguggcagcggcg

SEQ ID NO: 216490 - RNA, 23 nt, Human
ugcggauguggagagucaagagg

SEQ ID NO: 216491 - RNA, 21 nt, Human
ugcuacuuaaaaccagagaug

SEQ ID NO: 216492 - RNA, 22 nt, Human
uggcugggccacuuaucccgcu

SEQ ID NO: 216493 - RNA, 21 nt, Human
uggguacagcacaggguaacc

SEQ ID NO: 216494 - RNA, 19 nt, Human
uggucucugaaaucucacu

SEQ ID NO: 216495 - RNA, 21 nt, Human
uguaccaaggaguugagacaa

SEQ ID NO: 216496 - RNA, 22 nt, Human
uguagucauuuucuuuccagag

SEQ ID NO: 216497 - RNA, 18 nt, Human
uguauugcaguccagaau

SEQ ID NO: 216498 - RNA, 18 nt, Human
ugucagaagaagugagau

SEQ ID NO: 216499 - RNA, 18 nt, Human
ugucagaagaagugagau

SEQ ID NO: 216500 - RNA, 19 nt, Human
ugucagaagaagugagauu

SEQ ID NO: 216501 - RNA, 21 nt, Human
uguguacaugugucugcacau

SEQ ID NO: 216502 - RNA, 25 nt, Human
uguugcagaaaugucagcaaacuuu

SEQ ID NO: 216503 - RNA, 22 nt, Human
uguuuuaaaaguaaaugauaga

SEQ ID NO: 216504 - RNA, 24 nt, Human
uuaaaaccagagaugcauuuucac

SEQ ID NO: 216505 - RNA, 23 nt, Human
uuaacagcaacaauccggcaaaa

SEQ ID NO: 216506 - RNA, 23 nt, Human
uuccaaauaaugacaggccagca

SEQ ID NO: 216507 - RNA, 19 nt, Human
uucucaggaagggauaucc

SEQ ID NO: 216508 - RNA, 20 nt, Human
uugaaugaacccuguaccaa

SEQ ID NO: 216509 - RNA, 23 nt, Human
uuggaaaagauccacuuuuucua

SEQ ID NO: 216510 - RNA, 21 nt, Human
uuuaauauacuuguuuuuaaa

SEQ ID NO: 216511 - RNA, 18 nt, Human
uuuacagcaguaguucac

SEQ ID NO: 216512 - RNA, 23 nt, Human
uuuauuuucuguaaacucuguuu

SEQ ID NO: 216513 - RNA, 24 nt, Human
uuuccaaucaccuugggcagggag

SEQ ID NO: 216514 - RNA, 20 nt, Human
uuuggcaauuuggccaauaa

SEQ ID NO: 216515 - RNA, 21 nt, Human
uuuguauuuuugacugugagg

SEQ ID NO: 216516 - RNA, 24 nt, Human
uuuucacuccgaaguucuccccuu

SEQ ID NO: 216517 - RNA, 24 nt, Human
aagacuaaggcauaaauuacucca

SEQ ID NO: 216518 - RNA, 18 nt, Human
acagagccugagggaggc

SEQ ID NO: 216519 - RNA, 22 nt, Human
accucaaaacaagacuaaggca

SEQ ID NO: 216520 - RNA, 23 nt, Human
agaucuguuuugucuuggauccu

SEQ ID NO: 216521 - RNA, 25 nt, Human
agcaagaagacgugggaaugcacag

SEQ ID NO: 216522 - RNA, 22 nt, Human
agcaccuuaguagcuggggcag

SEQ ID NO: 216523 - RNA, 21 nt, Human
agggaaggaugggaggcagug

SEQ ID NO: 216524 - RNA, 24 nt, Human
agggagugggugugacuugggagc

SEQ ID NO: 216525 - RNA, 18 nt, Human
aggggcugcagcuggugg

SEQ ID NO: 216526 - RNA, 33 nt, Human
augggaggcaguguguguguguguguguguggu

SEQ ID NO: 216527 - RNA, 20 nt, Human
caaagccagcuggcuuccuc

SEQ ID NO: 216528 - RNA, 19 nt, Human
caacagcgcuggccaagcc

SEQ ID NO: 216529 - RNA, 18 nt, Human
caacucaaagucuccucu

SEQ ID NO: 216530 - RNA, 24 nt, Human
cacuggucauaccacuuguccugg

SEQ ID NO: 216531 - RNA, 23 nt, Human
cagaauucagaucuguuuugucu

SEQ ID NO: 216532 - RNA, 19 nt, Human
cagagcccggcuaccucuc

SEQ ID NO: 216533 - RNA, 19 nt, Human
cagcucgguggggccacag

SEQ ID NO: 216534 - RNA, 18 nt, Human
cagugcauuccagagggg

SEQ ID NO: 216535 - RNA, 20 nt, Human
caucucaggacagcguccag

SEQ ID NO: 216536 - RNA, 23 nt, Human
cauuaucacuggucauaccacuu

SEQ ID NO: 216537 - RNA, 25 nt, Human
ccacuuguccugggggccggcagau

SEQ ID NO: 216538 - RNA, 18 nt, Human
ccaugagguaccugggaa

SEQ ID NO: 216539 - RNA, 20 nt, Human
ccauucuggagggagcaggc

SEQ ID NO: 216540 - RNA, 23 nt, Human
ccccaucaacucaaagucuccuc

SEQ ID NO: 216541 - RNA, 25 nt, Human
ccccucaacagcgcuggccaagccc

SEQ ID NO: 216542 - RNA, 22 nt, Human
ccccuugcauuucuaccucaaa

SEQ ID NO: 216543 - RNA, 23 nt, Human
ccuagcaccuuaguagcuggggc

SEQ ID NO: 216544 - RNA, 24 nt, Human
ccuaggggucuguguuaaaggugu

SEQ ID NO: 216545 - RNA, 20 nt, Human
cucagagucuuucuucaucc

SEQ ID NO: 216546 - RNA, 19 nt, Human
gaaugcacgugggugcaga

SEQ ID NO: 216547 - RNA, 19 nt, Human
gagcaggcgccauugcucg

SEQ ID NO: 216548 - RNA, 20 nt, Human
gagccaauggagggguggga

SEQ ID NO: 216549 - RNA, 21 nt, Human
gccaggcacgccccuuguccu

SEQ ID NO: 216550 - RNA, 20 nt, Human
gcccgcggcacggcggcugg

SEQ ID NO: 216551 - RNA, 19 nt, Human
gcggcggggggcggcaagc

SEQ ID NO: 216552 - RNA, 19 nt, Human
gcucccuaccccuaccccu

SEQ ID NO: 216553 - RNA, 21 nt, Human
ggaggcucccuaccccuaccc

SEQ ID NO: 216554 - RNA, 19 nt, Human
ggagggggugauacaggga

SEQ ID NO: 216555 - RNA, 20 nt, Human
ggcagugugugugugugugu

SEQ ID NO: 216556 - RNA, 18 nt, Human
gggaaggaugggaggcag

SEQ ID NO: 216557 - RNA, 19 nt, Human
ggggaggcucccuaccccu

SEQ ID NO: 216558 - RNA, 19 nt, Human
ggggugucccuuuaaaucc

SEQ ID NO: 216559 - RNA, 21 nt, Human
gugacccgggaggguuggcag

SEQ ID NO: 216560 - RNA, 20 nt, Human
gugugugugugugugugugu

SEQ ID NO: 216561 - RNA, 26 nt, Human
uagaggccuggagugugcagauuggg

SEQ ID NO: 216562 - RNA, 19 nt, Human
uagggagggggugauacag

SEQ ID NO: 216563 - RNA, 20 nt, Human
uagggcaguuccacuuaaaa

SEQ ID NO: 216564 - RNA, 21 nt, Human
ucacuggucauaccacuuguc

SEQ ID NO: 216565 - RNA, 24 nt, Human
ucauucuucgggagccccaggggc

SEQ ID NO: 216566 - RNA, 23 nt, Human
uccacagagccugaggggcggac

SEQ ID NO: 216567 - RNA, 21 nt, Human
uccacaugcuucccaugaggu

SEQ ID NO: 216568 - RNA, 25 nt, Human
ucccuuuaaaucccuaggggucugu

SEQ ID NO: 216569 - RNA, 21 nt, Human
uccuucuggaacuagaggccu

SEQ ID NO: 216570 - RNA, 20 nt, Human
uccuuggggcauuaucacug

SEQ ID NO: 216571 - RNA, 18 nt, Human
ucucuggaggauggggau

SEQ ID NO: 216572 - RNA, 18 nt, Human
ugacuugggagccaaugg

SEQ ID NO: 216573 - RNA, 19 nt, Human
ugagagcaaggggcugcag

SEQ ID NO: 216574 - RNA, 19 nt, Human
ugcacuggcgggcaugagg

SEQ ID NO: 216575 - RNA, 22 nt, Human
ugcccagcugcagccaggccgg

SEQ ID NO: 216576 - RNA, 19 nt, Human
ugcugcccagcugcagcca

SEQ ID NO: 216577 - RNA, 20 nt, Human
uggaacuagaggccuggagu

SEQ ID NO: 216578 - RNA, 18 nt, Human
uggcuuccucuccgcucc

SEQ ID NO: 216579 - RNA, 20 nt, Human
ugggagccaauggagggguc

SEQ ID NO: 216580 - RNA, 21 nt, Human
ugggagccaauggaggggugg

SEQ ID NO: 216581 - RNA, 18 nt, Human
ugggaugggugagagaaa

SEQ ID NO: 216582 - RNA, 23 nt, Human
ugggaugggugagagaaaagggg

SEQ ID NO: 216583 - RNA, 23 nt, Human
ugggugagagaaaagggcagaau

SEQ ID NO: 216584 - RNA, 23 nt, Human
ugggugagagaaaagggcagaau

SEQ ID NO: 216585 - RNA, 21 nt, Human
ugggugcagagcccggcuacc

SEQ ID NO: 216586 - RNA, 21 nt, Human
uggugggggaaugugugaguu

SEQ ID NO: 216587 - RNA, 18 nt, Human
uguagggagggggugaua

SEQ ID NO: 216588 - RNA, 21 nt, Human
uguagggagggggugauacag

SEQ ID NO: 216589 - RNA, 21 nt, Human
uguagggagggggugauacag

SEQ ID NO: 216590 - RNA, 19 nt, Human
uguccugggggccggcaga

SEQ ID NO: 216591 - RNA, 21 nt, Human
uguccugggggccggcagaug

SEQ ID NO: 216592 - RNA, 24 nt, Human
ugugcagcggcggcggggggcggc

SEQ ID NO: 216593 - RNA, 21 nt, Human
uguguguagggagggggugau

SEQ ID NO: 216594 - RNA, 19 nt, Human
uguguguguguguguguag

SEQ ID NO: 216595 - RNA, 18 nt, Human
ugugugugugugugugug

SEQ ID NO: 216596 - RNA, 18 nt, Human
ugugugugugugugugug

SEQ ID NO: 216597 - RNA, 18 nt, Human
ugugugugugugugugug

SEQ ID NO: 216598 - RNA, 18 nt, Human
ugugugugugugugugug

SEQ ID NO: 216599 - RNA, 18 nt, Human
ugugugugugugugugug

SEQ ID NO: 216600 - RNA, 18 nt, Human
ugugugugugugugugug

SEQ ID NO: 216601 - RNA, 21 nt, Human
ugugugugugugugugugugu

SEQ ID NO: 216602 - RNA, 21 nt, Human
ugugugugugugugugugugu

SEQ ID NO: 216603 - RNA, 21 nt, Human
ugugugugugugugugugugu

SEQ ID NO: 216604 - RNA, 21 nt, Human
ugugugugugugugugugugu

SEQ ID NO: 216605 - RNA, 21 nt, Human
ugugugugugugugugugugu

SEQ ID NO: 216606 - RNA, 21 nt, Human
ugugugugugugugugugugu

SEQ ID NO: 216607 - RNA, 21 nt, Human
ugugugugugugugugugugu

SEQ ID NO: 216608 - RNA, 21 nt, Human
ugugugugugugugugugugu

SEQ ID NO: 216609 - RNA, 21 nt, Human
ugugugugugugugugugugu

SEQ ID NO: 216610 - RNA, 22 nt, Human
ugugugugugugugugugugua

SEQ ID NO: 216611 - RNA, 22 nt, Human
ugugugugugugugugugugug

SEQ ID NO: 216612 - RNA, 22 nt, Human
ugugugugugugugugugugug

SEQ ID NO: 216613 - RNA, 22 nt, Human
ugugugugugugugugugugug

SEQ ID NO: 216614 - RNA, 22 nt, Human
ugugugugugugugugugugug

SEQ ID NO: 216615 - RNA, 19 nt, Human
uguguuaaaggugucccag

SEQ ID NO: 216616 - RNA, 22 nt, Human
uuaaaaccagcuugaguuccau

SEQ ID NO: 216617 - RNA, 23 nt, Human
uuggcagcugagagcaaggggcu

SEQ ID NO: 216618 - RNA, 23 nt, Human
uuggcgugggccugggugugugu

SEQ ID NO: 216619 - RNA, 23 nt, Human
uuuuuuuguuuuuaaacacugua

SEQ ID NO: 216620 - RNA, 18 nt, Human
uuuuuuuuuuuuuuuuug

SEQ ID NO: 216621 - RNA, 24 nt, Human
uuuuuuuuuuuuuuuuuuguuuuu

SEQ ID NO: 216622 - RNA, 30 nt, Human
uuuuuuuuuuuuuuuuuuuuuguuuuuaaa

SEQ ID NO: 216623 - RNA, 22 nt, Human
aaacagcaaacccuggcuggga

SEQ ID NO: 216624 - RNA, 21 nt, Human
aaccuguguuuuguuuucccc

SEQ ID NO: 216625 - RNA, 19 nt, Human
aagcaucacugcugaacuc

SEQ ID NO: 216626 - RNA, 20 nt, Human
aaguagaaaugggugguguu

SEQ ID NO: 216627 - RNA, 19 nt, Human
acagccacagaaggugcac

SEQ ID NO: 216628 - RNA, 23 nt, Human
accugccccccgcaccuccccca

SEQ ID NO: 216629 - RNA, 25 nt, Human
accugccccccgcaccucccccacc

SEQ ID NO: 216630 - RNA, 21 nt, Human
agaaacaagacagccacagaa

SEQ ID NO: 216631 - RNA, 23 nt, Human
agacaaauauuuuaaagagaaca

SEQ ID NO: 216632 - RNA, 22 nt, Human
agagaaaauaaggugcaaaaag

SEQ ID NO: 216633 - RNA, 19 nt, Human
agagcaagauggggugugg

SEQ ID NO: 216634 - RNA, 21 nt, Human
agccgugguauaaaaggaacc

SEQ ID NO: 216635 - RNA, 22 nt, Human
auagacuuuuaaaacuaaaaag

SEQ ID NO: 216636 - RNA, 19 nt, Human
auccaugcacgcaaacagc

SEQ ID NO: 216637 - RNA, 18 nt, Human
cacaaugcaaauuagaau

SEQ ID NO: 216638 - RNA, 18 nt, Human
cagccaaacaaauccuag

SEQ ID NO: 216639 - RNA, 19 nt, Human
ccacaauuucuucauccaa

SEQ ID NO: 216640 - RNA, 22 nt, Human
ccaugcacgcaaacagcaaacc

SEQ ID NO: 216641 - RNA, 20 nt, Human
cccacaauuucuucauccaa

SEQ ID NO: 216642 - RNA, 19 nt, Human
cccaucauauaaaauaggu

SEQ ID NO: 216643 - RNA, 23 nt, Human
cccccgcaccucccccacccccc

SEQ ID NO: 216644 - RNA, 18 nt, Human
ccccgcaccucccccacc

SEQ ID NO: 216645 - RNA, 20 nt, Human
ccccgcaccucccccacccc

SEQ ID NO: 216646 - RNA, 22 nt, Human
ccccgcaccucccccacccccc

SEQ ID NO: 216647 - RNA, 26 nt, Human
cccuaccugccccccgcaccuccccc

SEQ ID NO: 216648 - RNA, 21 nt, Human
cgcaccucccccaccccccac

SEQ ID NO: 216649 - RNA, 23 nt, Human
cucccccaccccccacaauuucu

SEQ ID NO: 216650 - RNA, 25 nt, Human
cucuauaucgcccccucuccuaacu

SEQ ID NO: 216651 - RNA, 18 nt, Human
cugccgguucccacugca

SEQ ID NO: 216652 - RNA, 18 nt, Human
cuucuggugaaauccuga

SEQ ID NO: 216653 - RNA, 18 nt, Human
cuuuaaaaguugucaugc

SEQ ID NO: 216654 - RNA, 25 nt, Human
cuuuggaugagggguaaaggagggg

SEQ ID NO: 216655 - RNA, 22 nt, Human
gagcagcauaaauugaaaaaac

SEQ ID NO: 216656 - RNA, 22 nt, Human
gcaaauuagaauguaaacucug

SEQ ID NO: 216657 - RNA, 19 nt, Human
gccccccgcaccuccccca

SEQ ID NO: 216658 - RNA, 22 nt, Human
gcucaggaacagagaaaauaag

SEQ ID NO: 216659 - RNA, 23 nt, Human
gcucccugaaguuaaggaguuua

SEQ ID NO: 216660 - RNA, 19 nt, Human
ggcagccgugguauaaaag

SEQ ID NO: 216661 - RNA, 23 nt, Human
ggucaaggacuugucaaagcuuu

SEQ ID NO: 216662 - RNA, 18 nt, Human
guuuuguuuuccccucuu

SEQ ID NO: 216663 - RNA, 23 nt, Human
uaaaaagaaauccaugcacgcaa

SEQ ID NO: 216664 - RNA, 18 nt, Human
uaaaaagcaucacugcug

SEQ ID NO: 216665 - RNA, 24 nt, Human
uaaaauuaucacuuggaaguauca

SEQ ID NO: 216666 - RNA, 28 nt, Human
uaaagagaacaguuuucccccuuaauuc

SEQ ID NO: 216667 - RNA, 19 nt, Human
uaaauugaaaaaaccugug

SEQ ID NO: 216668 - RNA, 21 nt, Human
uacugccagucagccaaacaa

SEQ ID NO: 216669 - RNA, 18 nt, Human
uagaagagaacuguugug

SEQ ID NO: 216670 - RNA, 22 nt, Human
uagguuacugccagucagccaa

SEQ ID NO: 216671 - RNA, 20 nt, Human
uauaaaaggaaccaacaaca

SEQ ID NO: 216672 - RNA, 19 nt, Human
uauagaggucaaggacuug

SEQ ID NO: 216673 - RNA, 24 nt, Human
ucccuaccugccccccgcaccucc

SEQ ID NO: 216674 - RNA, 18 nt, Human
ucgcccccucuccuaacu

SEQ ID NO: 216675 - RNA, 20 nt, Human
ucuggcacaggaugggcuuc

SEQ ID NO: 216676 - RNA, 23 nt, Human
ucuggcacaggaugggcuucuag

SEQ ID NO: 216677 - RNA, 20 nt, Human
uggaaggggcagccguggua

SEQ ID NO: 216678 - RNA, 19 nt, Human
uggagagaaagucaggcug

SEQ ID NO: 216679 - RNA, 22 nt, Human
ugggaugcugccgguucccacu

SEQ ID NO: 216680 - RNA, 24 nt, Human
ugggugguguuucucaaagugugg

SEQ ID NO: 216681 - RNA, 20 nt, Human
uguagagggcuucuauaaua

SEQ ID NO: 216682 - RNA, 21 nt, Human
uguuuuguuuuccccucuugu

SEQ ID NO: 216683 - RNA, 24 nt, Human
uguuuuguuuuccccucuuguuaa

SEQ ID NO: 216684 - RNA, 23 nt, Human
uuacauaucaagcacuuccacuu

SEQ ID NO: 216685 - RNA, 22 nt, Human
uucauuaaaauauacacaagug

SEQ ID NO: 216686 - RNA, 21 nt, Human
uucccacugcagguaggucug

SEQ ID NO: 216687 - RNA, 18 nt, Human
uugcugggccuuauccca

SEQ ID NO: 216688 - RNA, 22 nt, Human
uuggaugagggguaaaggaggg

SEQ ID NO: 216689 - RNA, 18 nt, Human
uuugguggugguuuccag

SEQ ID NO: 216690 - RNA, 25 nt, Human
acccaauggaacagcuccaacccuu

SEQ ID NO: 216691 - RNA, 20 nt, Human
agaggacccaauggaacagc

SEQ ID NO: 216692 - RNA, 19 nt, Human
aggcagcaggagggggggu

SEQ ID NO: 216693 - RNA, 20 nt, Human
aggcagcaggagggggggua

SEQ ID NO: 216694 - RNA, 26 nt, Human
caaagcuuggaggcaacuuguuggag

SEQ ID NO: 216695 - RNA, 21 nt, Human
caacccaaagcuuggaggcaa

SEQ ID NO: 216696 - RNA, 19 nt, Human
caagaggacccaauggaac

SEQ ID NO: 216697 - RNA, 24 nt, Human
cagcucuguugggagggaaacgac

SEQ ID NO: 216698 - RNA, 18 nt, Human
caggaggggggguagccc

SEQ ID NO: 216699 - RNA, 22 nt, Human
cccaauggaacagcuccaaccc

SEQ ID NO: 216700 - RNA, 26 nt, Human
ggaacagcuccaacccaaagcuugga

SEQ ID NO: 216701 - RNA, 20 nt, Human
ggaggggggguagcccagcu

SEQ ID NO: 216702 - RNA, 18 nt, Human
uagcccagcucuguuggg

SEQ ID NO: 216703 - RNA, 22 nt, Human
uggaacagcuccaacccaaagc

SEQ ID NO: 216704 - RNA, 23 nt, Human
uggagaaggggcggugcagguag

SEQ ID NO: 216705 - RNA, 21 nt, Human
uuggagaaggggcggugcagg

SEQ ID NO: 216706 - RNA, 27 nt, Human
aaaggggacacugggggaggagggggu

SEQ ID NO: 216707 - RNA, 27 nt, Human
aaaggggacacugggggaggagggggu

SEQ ID NO: 216708 - RNA, 19 nt, Human
aagcaagccuucugggucc

SEQ ID NO: 216709 - RNA, 19 nt, Human
aagcaagccuucugggucc

SEQ ID NO: 216710 - RNA, 19 nt, Human
aagugcccccguagacaac

SEQ ID NO: 216711 - RNA, 20 nt, Human
aagugcccccguagacaacc

SEQ ID NO: 216712 - RNA, 24 nt, Human
aagugucggcucccuccguggucu

SEQ ID NO: 216713 - RNA, 24 nt, Human
aagugucggcucccuccguggucu

SEQ ID NO: 216714 - RNA, 21 nt, Human
acagaaagccaaggauagcua

SEQ ID NO: 216715 - RNA, 21 nt, Human
acagaaagccaaggauagcua

SEQ ID NO: 216716 - RNA, 18 nt, Human
acaguaccauggaagggg

SEQ ID NO: 216717 - RNA, 18 nt, Human
acaguaccauggaagggg

SEQ ID NO: 216718 - RNA, 23 nt, Human
agaaaggggacacugggggagga

SEQ ID NO: 216719 - RNA, 23 nt, Human
agaaaggggacacugggggagga

SEQ ID NO: 216720 - RNA, 21 nt, Human
agacagcaugugcaugcucuu

SEQ ID NO: 216721 - RNA, 21 nt, Human
agacagcaugugcaugcucuu

SEQ ID NO: 216722 - RNA, 21 nt, Human
agccaggcuggcacagaaagc

SEQ ID NO: 216723 - RNA, 21 nt, Human
agccaggcuggcacagaaagc

SEQ ID NO: 216724 - RNA, 19 nt, Human
aggaagaaaggggacacug

SEQ ID NO: 216725 - RNA, 19 nt, Human
aggaagaaaggggacacug

SEQ ID NO: 216726 - RNA, 20 nt, Human
aggacacagcccauggggga

SEQ ID NO: 216727 - RNA, 20 nt, Human
aggacacagcccauggggga

SEQ ID NO: 216728 - RNA, 20 nt, Human
aggcacaaggagggggaggg

SEQ ID NO: 216729 - RNA, 21 nt, Human
aggcuggcacagaaagccaag

SEQ ID NO: 216730 - RNA, 21 nt, Human
aggcuggcacagaaagccaag

SEQ ID NO: 216731 - RNA, 21 nt, Human
agggucucucuggggccuucu

SEQ ID NO: 216732 - RNA, 21 nt, Human
agggucucucuggggccuucu

SEQ ID NO: 216733 - RNA, 22 nt, Human
auggauccaggugugaaagggg

SEQ ID NO: 216734 - RNA, 20 nt, Human
caauugggggcccaccagcc

SEQ ID NO: 216735 - RNA, 20 nt, Human
caauugggggcccaccagcc

SEQ ID NO: 216736 - RNA, 24 nt, Human
cacagcccaugggggaggggcaga

SEQ ID NO: 216737 - RNA, 24 nt, Human
cacagcccaugggggaggggcaga

SEQ ID NO: 216738 - RNA, 24 nt, Human
cacaguccacgagcagugggcccc

SEQ ID NO: 216739 - RNA, 24 nt, Human
cacaguccacgagcagugggcccc

SEQ ID NO: 216740 - RNA, 27 nt, Human
caccucuaggccccugacgcaugguuc

SEQ ID NO: 216741 - RNA, 27 nt, Human
caccucuaggccccugacgcaugguuc

SEQ ID NO: 216742 - RNA, 18 nt, Human
cagcccaugggggagggg

SEQ ID NO: 216743 - RNA, 18 nt, Human
cagcccaugggggagggg

SEQ ID NO: 216744 - RNA, 23 nt, Human
cagcggcccgggggcugcucccu

SEQ ID NO: 216745 - RNA, 23 nt, Human
cagcggcccgggggcugcucccu

SEQ ID NO: 216746 - RNA, 18 nt, Human
cagcuggggucuggcugg

SEQ ID NO: 216747 - RNA, 18 nt, Human
caggcuggcacagaaagc

SEQ ID NO: 216748 - RNA, 18 nt, Human
caggcuggcacagaaagc

SEQ ID NO: 216749 - RNA, 22 nt, Human
cagguccuccaagugcccccgu

SEQ ID NO: 216750 - RNA, 23 nt, Human
cagguccuccaagugcccccgua

SEQ ID NO: 216751 - RNA, 23 nt, Human
caggugggccgggggcggggggc

SEQ ID NO: 216752 - RNA, 21 nt, Human
ccacgugcaucuagggcacag

SEQ ID NO: 216753 - RNA, 21 nt, Human
ccacgugcaucuagggcacag

SEQ ID NO: 216754 - RNA, 22 nt, Human
ccagaauugguccccuccucuc

SEQ ID NO: 216755 - RNA, 22 nt, Human
ccagaauugguccccuccucuc

SEQ ID NO: 216756 - RNA, 20 nt, Human
cccccguagacaaccuuagg

SEQ ID NO: 216757 - RNA, 20 nt, Human
cccccguagacaaccuuagg

SEQ ID NO: 216758 - RNA, 23 nt, Human
ccccugcuacaguaccauggaag

SEQ ID NO: 216759 - RNA, 23 nt, Human
ccccugcuacaguaccauggaag

SEQ ID NO: 216760 - RNA, 25 nt, Human
ccccugcuacaguaccauggaaggg

SEQ ID NO: 216761 - RNA, 25 nt, Human
ccccugcuacaguaccauggaaggg

SEQ ID NO: 216762 - RNA, 21 nt, Human
ccccuguggacugucagaggc

SEQ ID NO: 216763 - RNA, 22 nt, Human
cccgccaugccccagcacagug

SEQ ID NO: 216764 - RNA, 23 nt, Human
cccgccaugccccagcacaguga

SEQ ID NO: 216765 - RNA, 23 nt, Human
ccucagcuucucaaaugggccuu

SEQ ID NO: 216766 - RNA, 23 nt, Human
ccucagcuucucaaaugggccuu

SEQ ID NO: 216767 - RNA, 25 nt, Human
ccuccugugggaagauccccagggc

SEQ ID NO: 216768 - RNA, 25 nt, Human
ccuccugugggaagauccccagggc

SEQ ID NO: 216769 - RNA, 22 nt, Human
cgccagguccuccaagugcccc

SEQ ID NO: 216770 - RNA, 22 nt, Human
cgcgugagggggcggagcuggg

SEQ ID NO: 216771 - RNA, 18 nt, Human
cggcccgggggcugcucc

SEQ ID NO: 216772 - RNA, 18 nt, Human
cggcccgggggcugcucc

SEQ ID NO: 216773 - RNA, 20 nt, Human
cucccuggagguggguagcg

SEQ ID NO: 216774 - RNA, 21 nt, Human
cuggggccuucuggaggcugg

SEQ ID NO: 216775 - RNA, 21 nt, Human
cuggggccuucuggaggcugg

SEQ ID NO: 216776 - RNA, 20 nt, Human
cuggggcuggggagugggcu

SEQ ID NO: 216777 - RNA, 21 nt, Human
gaaaggggacacugggggagg

SEQ ID NO: 216778 - RNA, 21 nt, Human
gaaaggggacacugggggagg

SEQ ID NO: 216779 - RNA, 25 nt, Human
gaaaggggacacugggggaggaggg

SEQ ID NO: 216780 - RNA, 21 nt, Human
gaaggggcuggggcuggggag

SEQ ID NO: 216781 - RNA, 21 nt, Human
gaaggggcuggggcuggggag

SEQ ID NO: 216782 - RNA, 24 nt, Human
gacaaccuuaggcaggauccccac

SEQ ID NO: 216783 - RNA, 24 nt, Human
gacaaccuuaggcaggauccccac

SEQ ID NO: 216784 - RNA, 18 nt, Human
gagagcgcgugagggggc

SEQ ID NO: 216785 - RNA, 23 nt, Human
gauggauccaggugugaaagggg

SEQ ID NO: 216786 - RNA, 18 nt, Human
gcacaaggagggggaggg

SEQ ID NO: 216787 - RNA, 18 nt, Human
gcacaaggagggggaggg

SEQ ID NO: 216788 - RNA, 21 nt, Human
gccagguccuccaagugcccc

SEQ ID NO: 216789 - RNA, 21 nt, Human
gcccaugggggaggggcagag

SEQ ID NO: 216790 - RNA, 21 nt, Human
gcccaugggggaggggcagag

SEQ ID NO: 216791 - RNA, 22 nt, Human
gccccuguggacugucagaggc

SEQ ID NO: 216792 - RNA, 18 nt, Human
gccucagcuucucaaaug

SEQ ID NO: 216793 - RNA, 18 nt, Human
gccucagcuucucaaaug

SEQ ID NO: 216794 - RNA, 23 nt, Human
ggaggcucuuuggcuuguuuugg

SEQ ID NO: 216795 - RNA, 23 nt, Human
ggaggcucuuuggcuuguuuugg

SEQ ID NO: 216796 - RNA, 22 nt, Human
ggcaucuccucuguauccuccc

SEQ ID NO: 216797 - RNA, 22 nt, Human
ggcaucuccucuguauccuccc

SEQ ID NO: 216798 - RNA, 24 nt, Human
gggaggcucuuuggcuuguuuugg

SEQ ID NO: 216799 - RNA, 24 nt, Human
gggaggcucuuuggcuuguuuugg

SEQ ID NO: 216800 - RNA, 19 nt, Human
gggagugggcugccaacag

SEQ ID NO: 216801 - RNA, 19 nt, Human
gggagugggcugccaacag

SEQ ID NO: 216802 - RNA, 22 nt, Human
gggcaugaucugauaauagcgg

SEQ ID NO: 216803 - RNA, 18 nt, Human
gggccuuuuccucccggc

SEQ ID NO: 216804 - RNA, 18 nt, Human
gggccuuuuccucccggc

SEQ ID NO: 216805 - RNA, 21 nt, Human
gggcuggggcuggggaguggg

SEQ ID NO: 216806 - RNA, 21 nt, Human
gggcuggggcuggggaguggg

SEQ ID NO: 216807 - RNA, 23 nt, Human
gggcuggggcuggggagugggcu

SEQ ID NO: 216808 - RNA, 19 nt, Human
ggggacacugggggaggag

SEQ ID NO: 216809 - RNA, 22 nt, Human
ggggacacugggggaggagggg

SEQ ID NO: 216810 - RNA, 22 nt, Human
ggggacacugggggaggagggg

SEQ ID NO: 216811 - RNA, 26 nt, Human
ggggcagagccaggcuggcacagaaa

SEQ ID NO: 216812 - RNA, 26 nt, Human
ggggcagagccaggcuggcacagaaa

SEQ ID NO: 216813 - RNA, 24 nt, Human
ggggcccaccagccagcggcccgg

SEQ ID NO: 216814 - RNA, 24 nt, Human
ggggcccaccagccagcggcccgg

SEQ ID NO: 216815 - RNA, 18 nt, Human
ggggcuggggcuggggag

SEQ ID NO: 216816 - RNA, 18 nt, Human
ggggcuggggcuggggag

SEQ ID NO: 216817 - RNA, 22 nt, Human
gguucagcuggggucuggcugg

SEQ ID NO: 216818 - RNA, 22 nt, Human
gguucagcuggggucuggcugg

SEQ ID NO: 216819 - RNA, 23 nt, Human
guggaggaucccgccaugcccca

SEQ ID NO: 216820 - RNA, 23 nt, Human
guggaggaucccgccaugcccca

SEQ ID NO: 216821 - RNA, 21 nt, Human
gugggccgggggcggggggcu

SEQ ID NO: 216822 - RNA, 23 nt, Human
uacaguaccauggaaggggcugg

SEQ ID NO: 216823 - RNA, 23 nt, Human
uacaguaccauggaaggggcugg

SEQ ID NO: 216824 - RNA, 22 nt, Human
uaccauggaaggggcuggggcu

SEQ ID NO: 216825 - RNA, 22 nt, Human
uaccauggaaggggcuggggcu

SEQ ID NO: 216826 - RNA, 21 nt, Human
uaggcaggauccccaccucuc

SEQ ID NO: 216827 - RNA, 21 nt, Human
uaggcaggauccccaccucuc

SEQ ID NO: 216828 - RNA, 18 nt, Human
uaggccccugacgcaugg

SEQ ID NO: 216829 - RNA, 21 nt, Human
uaggccccugacgcaugguuc

SEQ ID NO: 216830 - RNA, 21 nt, Human
uaggccccugacgcaugguuc

SEQ ID NO: 216831 - RNA, 22 nt, Human
ucaaaugggccuuaggacacag

SEQ ID NO: 216832 - RNA, 22 nt, Human
ucaaaugggccuuaggacacag

SEQ ID NO: 216833 - RNA, 20 nt, Human
ucacaccaggugggccgggg

SEQ ID NO: 216834 - RNA, 19 nt, Human
ucaguaguauuggucccga

SEQ ID NO: 216835 - RNA, 18 nt, Human
ucccgagucugccagcug

SEQ ID NO: 216836 - RNA, 20 nt, Human
ucccggauccgcacugcgug

SEQ ID NO: 216837 - RNA, 23 nt, Human
ucucucuggggccuucuggaggc

SEQ ID NO: 216838 - RNA, 23 nt, Human
ucucucuggggccuucuggaggc

SEQ ID NO: 216839 - RNA, 21 nt, Human
ucuguggccaaggagagaggc

SEQ ID NO: 216840 - RNA, 21 nt, Human
ucuguggccaaggagagaggc

SEQ ID NO: 216841 - RNA, 18 nt, Human
ugacuguggcucucaaga

SEQ ID NO: 216842 - RNA, 18 nt, Human
ugacuguggcucucaaga

SEQ ID NO: 216843 - RNA, 20 nt, Human
ugagcccaggcuacguugcc

SEQ ID NO: 216844 - RNA, 20 nt, Human
ugagcccaggcuacguugcc

SEQ ID NO: 216845 - RNA, 20 nt, Human
ugccugagccugcugcuacc

SEQ ID NO: 216846 - RNA, 20 nt, Human
ugccugagccugcugcuacc

SEQ ID NO: 216847 - RNA, 18 nt, Human
uggaaggggcuggggcug

SEQ ID NO: 216848 - RNA, 18 nt, Human
uggaaggggcuggggcug

SEQ ID NO: 216849 - RNA, 22 nt, Human
uggaggcuggcugguaguggug

SEQ ID NO: 216850 - RNA, 22 nt, Human
uggaggcuggcugguaguggug

SEQ ID NO: 216851 - RNA, 21 nt, Human
uggagguggguagcgcuccuc

SEQ ID NO: 216852 - RNA, 23 nt, Human
uggaugggguggcagggcccccu

SEQ ID NO: 216853 - RNA, 23 nt, Human
uggaugggguggcagggcccccu

SEQ ID NO: 216854 - RNA, 18 nt, Human
uggcacagaaagccaagg

SEQ ID NO: 216855 - RNA, 18 nt, Human
uggcacagaaagccaagg

SEQ ID NO: 216856 - RNA, 22 nt, Human
uggcagaggcugagacacggcg

SEQ ID NO: 216857 - RNA, 22 nt, Human
uggcagaggcugagacacggcg

SEQ ID NO: 216858 - RNA, 18 nt, Human
uggcaugggugucaauug

SEQ ID NO: 216859 - RNA, 18 nt, Human
uggcaugggugucaauug

SEQ ID NO: 216860 - RNA, 22 nt, Human
uggcuggaugggguggcagggc

SEQ ID NO: 216861 - RNA, 22 nt, Human
uggcuggaugggguggcagggc

SEQ ID NO: 216862 - RNA, 18 nt, Human
uggcugguaguggugagu

SEQ ID NO: 216863 - RNA, 18 nt, Human
uggcugguaguggugagu

SEQ ID NO: 216864 - RNA, 19 nt, Human
ugggccgggggcggggggc

SEQ ID NO: 216865 - RNA, 18 nt, Human
ugggccuuaggacacagc

SEQ ID NO: 216866 - RNA, 18 nt, Human
ugggccuuaggacacagc

SEQ ID NO: 216867 - RNA, 21 nt, Human
uggggagugggcugccaacag

SEQ ID NO: 216868 - RNA, 21 nt, Human
uggggagugggcugccaacag

SEQ ID NO: 216869 - RNA, 23 nt, Human
ugggggaggagggggugggauca

SEQ ID NO: 216870 - RNA, 23 nt, Human
ugggggaggagggggugggauca

SEQ ID NO: 216871 - RNA, 22 nt, Human
ugggucugagcacgccaggucc

SEQ ID NO: 216872 - RNA, 22 nt, Human
ugggucugagcacgccaggucc

SEQ ID NO: 216873 - RNA, 19 nt, Human
ugguucagcuggggucugg

SEQ ID NO: 216874 - RNA, 19 nt, Human
ugguucagcuggggucugg

SEQ ID NO: 216875 - RNA, 20 nt, Human
uuaaagaagucacaccaggu

SEQ ID NO: 216876 - RNA, 22 nt, Human
uucuuggugggcagggugcucc

SEQ ID NO: 216877 - RNA, 22 nt, Human
uuggucccgagucugccagcug

SEQ ID NO: 216878 - RNA, 18 nt, Human
uuucuaguuccuuugcug

SEQ ID NO: 216879 - RNA, 18 nt, Human
uuucuaguuccuuugcug

SEQ ID NO: 216880 - RNA, 23 nt, Human
aaaaacaaaaaaccaaacaaaaa

SEQ ID NO: 216881 - RNA, 22 nt, Human
aaaaaccaaacaaaaagacucg

SEQ ID NO: 216882 - RNA, 22 nt, Human
aaaacaaaaaaccaaacaaaaa

SEQ ID NO: 216883 - RNA, 22 nt, Human
aaaggaaggagagagggaagag

SEQ ID NO: 216884 - RNA, 21 nt, Human
aaaugaaccucugcccaccca

SEQ ID NO: 216885 - RNA, 22 nt, Human
aacacuaagcggccacuacccc

SEQ ID NO: 216886 - RNA, 20 nt, Human
aagauaucuucaagggcuua

SEQ ID NO: 216887 - RNA, 23 nt, Human
aaggaaggagagagggaagagga

SEQ ID NO: 216888 - RNA, 20 nt, Human
aaggagagagggaagaggag

SEQ ID NO: 216889 - RNA, 21 nt, Human
aaggagagagggaagaggagg

SEQ ID NO: 216890 - RNA, 18 nt, Human
acaacgcaacacaccuga

SEQ ID NO: 216891 - RNA, 20 nt, Human
acccacuuccuuccucccca

SEQ ID NO: 216892 - RNA, 20 nt, Human
acgguuggccaacggggaag

SEQ ID NO: 216893 - RNA, 21 nt, Human
acucggggagugggacugcgg

SEQ ID NO: 216894 - RNA, 20 nt, Human
acugugucuuguuuuucagg

SEQ ID NO: 216895 - RNA, 27 nt, Human
agauuccggaagucauuucacuaagcu

SEQ ID NO: 216896 - RNA, 28 nt, Human
agcugugugaccccaaacugcgcgcccc

SEQ ID NO: 216897 - RNA, 22 nt, Human
aggaaggagagagggaagagga

SEQ ID NO: 216898 - RNA, 22 nt, Human
aggaaggagagagggaagagga

SEQ ID NO: 216899 - RNA, 22 nt, Human
aguaaaagaaguccaaacaaaa

SEQ ID NO: 216900 - RNA, 20 nt, Human
augaguaaaagaaguccaaa

SEQ ID NO: 216901 - RNA, 25 nt, Human
auuaaaaacaaaaaaccaaacaaaa

SEQ ID NO: 216902 - RNA, 25 nt, Human
caacacuaagcggccacuaccccaa

SEQ ID NO: 216903 - RNA, 20 nt, Human
caagagaugaggcgcagcgu

SEQ ID NO: 216904 - RNA, 20 nt, Human
caccugaacuggguagugag

SEQ ID NO: 216905 - RNA, 23 nt, Human
cacuaagcggccacuaccccaaa

SEQ ID NO: 216906 - RNA, 21 nt, Human
cacucgcccggccccacuccc

SEQ ID NO: 216907 - RNA, 23 nt, Human
cagauuaaaaacaaaaaaccaaa

SEQ ID NO: 216908 - RNA, 19 nt, Human
cagcagccucucaggcuga

SEQ ID NO: 216909 - RNA, 25 nt, Human
ccaaacaaaaagacucgccgaaggc

SEQ ID NO: 216910 - RNA, 23 nt, Human
cccacaacgcaacacaccugaac

SEQ ID NO: 216911 - RNA, 21 nt, Human
cccacacuuccucugcagccc

SEQ ID NO: 216912 - RNA, 20 nt, Human
ccccaaacugcgcgccccuc

SEQ ID NO: 216913 - RNA, 18 nt, Human
cccgggcguggugcggag

SEQ ID NO: 216914 - RNA, 22 nt, Human
ccgagccgggagcuucgggugc

SEQ ID NO: 216915 - RNA, 22 nt, Human
ccgcccagcccggcguggccca

SEQ ID NO: 216916 - RNA, 19 nt, Human
ccucccagcccgcagagcg

SEQ ID NO: 216917 - RNA, 19 nt, Human
cggagacccacaacgcaac

SEQ ID NO: 216918 - RNA, 22 nt, Human
cggcugcgcaggacucgcgucu

SEQ ID NO: 216919 - RNA, 18 nt, Human
cucgcccggccccacucc

SEQ ID NO: 216920 - RNA, 21 nt, Human
cucgcccggccccacucccgg

SEQ ID NO: 216921 - RNA, 24 nt, Human
cucuacccauuuaaaagcugagag

SEQ ID NO: 216922 - RNA, 22 nt, Human
cugaaaugugccggagacccac

SEQ ID NO: 216923 - RNA, 19 nt, Human
cuguauuauuaccuuugca

SEQ ID NO: 216924 - RNA, 19 nt, Human
gaagaggaggggaagucgg

SEQ ID NO: 216925 - RNA, 19 nt, Human
gauaucuucaagggcuuaa

SEQ ID NO: 216926 - RNA, 24 nt, Human
gauccccccuuuucacgcacccac

SEQ ID NO: 216927 - RNA, 19 nt, Human
gcccggcguggcccaaaug

SEQ ID NO: 216928 - RNA, 22 nt, Human
gcgcagcguguccggcgccagc

SEQ ID NO: 216929 - RNA, 21 nt, Human
gcgcaggacucgcgucuggcc

SEQ ID NO: 216930 - RNA, 21 nt, Human
gcguggugcggaggcgcaggg

SEQ ID NO: 216931 - RNA, 18 nt, Human
gcucagcaagagcggacc

SEQ ID NO: 216932 - RNA, 23 nt, Human
ggacucgcgucuggcccgggccu

SEQ ID NO: 216933 - RNA, 20 nt, Human
ggagagagggaagaggaggg

SEQ ID NO: 216934 - RNA, 19 nt, Human
ggcugcagggggcgcuggg

SEQ ID NO: 216935 - RNA, 24 nt, Human
gggagugggacugcggcggggagc

SEQ ID NO: 216936 - RNA, 19 nt, Human
gggcacgggcuuccccuuu

SEQ ID NO: 216937 - RNA, 18 nt, Human
guuagaaaauuugggaac

SEQ ID NO: 216938 - RNA, 18 nt, Human
guugccacgggacacacc

SEQ ID NO: 216939 - RNA, 19 nt, Human
uaaaaacaaaaaaccaaac

SEQ ID NO: 216940 - RNA, 21 nt, Human
uaaagaacauauuuugaacaa

SEQ ID NO: 216941 - RNA, 19 nt, Human
uaaaggaaggagagaggga

SEQ ID NO: 216942 - RNA, 28 nt, Human
uacuuucauuucaagauaucuucaaggg

SEQ ID NO: 216943 - RNA, 18 nt, Human
ucaaagauguauuugaaa

SEQ ID NO: 216944 - RNA, 23 nt, Human
ucaagauaucuucaagggcuuac

SEQ ID NO: 216945 - RNA, 18 nt, Human
ucagcaagagcggaccug

SEQ ID NO: 216946 - RNA, 21 nt, Human
ucagcacccuucuauacccac

SEQ ID NO: 216947 - RNA, 18 nt, Human
ucccgguuucugccgccg

SEQ ID NO: 216948 - RNA, 20 nt, Human
uccucugcagcccgggcugg

SEQ ID NO: 216949 - RNA, 18 nt, Human
ucgcccggccccacuccc

SEQ ID NO: 216950 - RNA, 19 nt, Human
ucgccgaaggccccugggg

SEQ ID NO: 216951 - RNA, 22 nt, Human
ucucuucaagacccacaucuca

SEQ ID NO: 216952 - RNA, 21 nt, Human
ucugccgccgagccgggagcu

SEQ ID NO: 216953 - RNA, 24 nt, Human
ugaaaugugccggagacccacaac

SEQ ID NO: 216954 - RNA, 19 nt, Human
ugaaccucugcccacccag

SEQ ID NO: 216955 - RNA, 22 nt, Human
ugaccccaaacugcgcgccccu

SEQ ID NO: 216956 - RNA, 28 nt, Human
ugagccgcccagcccggcguggcccaag

SEQ ID NO: 216957 - RNA, 21 nt, Human
uggcccaaaugccagccacaa

SEQ ID NO: 216958 - RNA, 22 nt, Human
uggcugaccccaacagagaggu

SEQ ID NO: 216959 - RNA, 22 nt, Human
ugggcucagcaagagcggaccu

SEQ ID NO: 216960 - RNA, 20 nt, Human
ugucuuguuuuucaggugua

SEQ ID NO: 216961 - RNA, 24 nt, Human
uguggcugaccccaacagagaggu

SEQ ID NO: 216962 - RNA, 18 nt, Human
ugugugaccccaaacugc

SEQ ID NO: 216963 - RNA, 20 nt, Human
uuccucugcagcccgggcuc

SEQ ID NO: 216964 - RNA, 18 nt, Human
aaacaaggguccuucaca

SEQ ID NO: 216965 - RNA, 21 nt, Human
aaagaacugugaauggauuuc

SEQ ID NO: 216966 - RNA, 21 nt, Human
aaggcuucagggaggcugggg

SEQ ID NO: 216967 - RNA, 18 nt, Human
aaguuccagguucuuagc

SEQ ID NO: 216968 - RNA, 19 nt, Human
agacaugguggacagcagg

SEQ ID NO: 216969 - RNA, 21 nt, Human
agacucggaaaugcaacugca

SEQ ID NO: 216970 - RNA, 24 nt, Human
agaucuguugccaucauggccccu

SEQ ID NO: 216971 - RNA, 19 nt, Human
agcaucuauccuugugugg

SEQ ID NO: 216972 - RNA, 21 nt, Human
agccuggggacagcugaguuc

SEQ ID NO: 216973 - RNA, 21 nt, Human
agcugccuucugccuuggucc

SEQ ID NO: 216974 - RNA, 20 nt, Human
aggcaggauucgguagggca

SEQ ID NO: 216975 - RNA, 24 nt, Human
aggcaucagagguggcuggaggcu

SEQ ID NO: 216976 - RNA, 19 nt, Human
aggcuggaucuggccccau

SEQ ID NO: 216977 - RNA, 24 nt, Human
aggcuggaucuggccccauuugag

SEQ ID NO: 216978 - RNA, 21 nt, Human
agggccugugucuggccaggc

SEQ ID NO: 216979 - RNA, 26 nt, Human
agguggcuggaggcuugagcugagcu

SEQ ID NO: 216980 - RNA, 24 nt, Human
aguaugucucugggcuggggagag

SEQ ID NO: 216981 - RNA, 23 nt, Human
aucaacuccagaccccaggcugg

SEQ ID NO: 216982 - RNA, 25 nt, Human
auugcacagcuguggccaccugacg

SEQ ID NO: 216983 - RNA, 18 nt, Human
caacagaguuuaaauaag

SEQ ID NO: 216984 - RNA, 20 nt, Human
caacuccagaccccaggcug

SEQ ID NO: 216985 - RNA, 24 nt, Human
caacuccaggcccuuuggguuaau

SEQ ID NO: 216986 - RNA, 21 nt, Human
cacccuggcuaauggagcugg

SEQ ID NO: 216987 - RNA, 21 nt, Human
cacucagccuccgggcauuuc

SEQ ID NO: 216988 - RNA, 20 nt, Human
cagagccuggggacagcuga

SEQ ID NO: 216989 - RNA, 25 nt, Human
cagcugccgaggcaggauucgguag

SEQ ID NO: 216990 - RNA, 20 nt, Human
caggcccaggacagugggcu

SEQ ID NO: 216991 - RNA, 22 nt, Human
caggcccuuuggguuaaugggg

SEQ ID NO: 216992 - RNA, 22 nt, Human
cagggaggcuggggccucuguc

SEQ ID NO: 216993 - RNA, 21 nt, Human
cagggagggccugugucuggc

SEQ ID NO: 216994 - RNA, 22 nt, Human
caggucccagguccuccuccuu

SEQ ID NO: 216995 - RNA, 23 nt, Human
caguugagucccguaacucuggu

SEQ ID NO: 216996 - RNA, 26 nt, Human
caugguggacagcaggucccaggucc

SEQ ID NO: 216997 - RNA, 20 nt, Human
ccaaugucugagucuggguu

SEQ ID NO: 216998 - RNA, 22 nt, Human
ccagcacacccuggcuaaugga

SEQ ID NO: 216999 - RNA, 18 nt, Human
ccagcuccucaccccccu

SEQ ID NO: 217000 - RNA, 18 nt, Human
ccagguccuccuccuucu

SEQ ID NO: 217001 - RNA, 18 nt, Human
ccccccuggcucuggccc

SEQ ID NO: 217002 - RNA, 20 nt, Human
cccucgggauccaacuccag

SEQ ID NO: 217003 - RNA, 18 nt, Human
cccuggcucuggcccuuc

SEQ ID NO: 217004 - RNA, 19 nt, Human
cccuuggagcugggcucug

SEQ ID NO: 217005 - RNA, 18 nt, Human
ccucacacugcaggcuaa

SEQ ID NO: 217006 - RNA, 25 nt, Human
ccucacacugcaggcuaaauggcug

SEQ ID NO: 217007 - RNA, 24 nt, Human
ccuccuucugaggcuggucucggg

SEQ ID NO: 217008 - RNA, 23 nt, Human
ccuccuuuucaguagaaugaggg

SEQ ID NO: 217009 - RNA, 18 nt, Human
ccugagcugguccugggg

SEQ ID NO: 217010 - RNA, 19 nt, Human
ccugagcugguccuggggc

SEQ ID NO: 217011 - RNA, 21 nt, Human
ccuuggagcugggcucugggc

SEQ ID NO: 217012 - RNA, 24 nt, Human
ccuuggagcugggcucugggcccu

SEQ ID NO: 217013 - RNA, 21 nt, Human
cggagagccgaaaggaaacca

SEQ ID NO: 217014 - RNA, 21 nt, Human
cuaauggagcuggggccuugg

SEQ ID NO: 217015 - RNA, 21 nt, Human
cuccagaccccaggcuggauc

SEQ ID NO: 217016 - RNA, 18 nt, Human
cuccuaaaucagggugaa

SEQ ID NO: 217017 - RNA, 25 nt, Human
cuccucaccccccuggcucuggccc

SEQ ID NO: 217018 - RNA, 18 nt, Human
cugauuccccuuggagcu

SEQ ID NO: 217019 - RNA, 20 nt, Human
cuggaucugaguucccccau

SEQ ID NO: 217020 - RNA, 21 nt, Human
cugggcucugggcccugggcc

SEQ ID NO: 217021 - RNA, 18 nt, Human
cuggggccucugucccug

SEQ ID NO: 217022 - RNA, 24 nt, Human
cuggggccucugucccuggaucug

SEQ ID NO: 217023 - RNA, 25 nt, Human
cuucaagaaguacccagaccccucc

SEQ ID NO: 217024 - RNA, 21 nt, Human
cuucagggcuuuguacacagc

SEQ ID NO: 217025 - RNA, 24 nt, Human
cuucaggguccugggaaauuccug

SEQ ID NO: 217026 - RNA, 18 nt, Human
gaccuaggagcaggaggc

SEQ ID NO: 217027 - RNA, 18 nt, Human
gagcucacagcgcagccu

SEQ ID NO: 217028 - RNA, 21 nt, Human
gagcugccaggucuuaacucc

SEQ ID NO: 217029 - RNA, 18 nt, Human
gcauuucaggaucugagg

SEQ ID NO: 217030 - RNA, 21 nt, Human
gccuggggacagcugaguucc

SEQ ID NO: 217031 - RNA, 19 nt, Human
gcucccgcugcaagaaagu

SEQ ID NO: 217032 - RNA, 24 nt, Human
ggaaugggagucugaaauugggag

SEQ ID NO: 217033 - RNA, 21 nt, Human
ggccaggcugagguuccagau

SEQ ID NO: 217034 - RNA, 18 nt, Human
gggagggccugugucugg

SEQ ID NO: 217035 - RNA, 20 nt, Human
gggcuggggagaggagcuuc

SEQ ID NO: 217036 - RNA, 22 nt, Human
ggggggacugguucuucaggaa

SEQ ID NO: 217037 - RNA, 19 nt, Human
ggguggggcuguccagagc

SEQ ID NO: 217038 - RNA, 19 nt, Human
ggucccagguccuccuccu

SEQ ID NO: 217039 - RNA, 21 nt, Human
gguccuucacagugcaugggg

SEQ ID NO: 217040 - RNA, 22 nt, Human
ggugauugguggugcaguugag

SEQ ID NO: 217041 - RNA, 18 nt, Human
ggugccauaugggaggga

SEQ ID NO: 217042 - RNA, 22 nt, Human
guccugagcugguccuggggcc

SEQ ID NO: 217043 - RNA, 20 nt, Human
guccugggugucuggugccc

SEQ ID NO: 217044 - RNA, 18 nt, Human
guuaguguucuuuguugg

SEQ ID NO: 217045 - RNA, 22 nt, Human
uaaguccugggugucuggugcc

SEQ ID NO: 217046 - RNA, 18 nt, Human
uaauggggugauuggugg

SEQ ID NO: 217047 - RNA, 25 nt, Human
uacacagccucacacugcaggcuaa

SEQ ID NO: 217048 - RNA, 18 nt, Human
uagcugggggcuucuuuu

SEQ ID NO: 217049 - RNA, 21 nt, Human
uaggagcugcugaccuuccag

SEQ ID NO: 217050 - RNA, 23 nt, Human
ucaggaaacucuccaaaaugcaa

SEQ ID NO: 217051 - RNA, 19 nt, Human
ucaggcaucagagguggcu

SEQ ID NO: 217052 - RNA, 22 nt, Human
ucagggugaacugggccuccag

SEQ ID NO: 217053 - RNA, 19 nt, Human
ucauggccccuucaggguc

SEQ ID NO: 217054 - RNA, 21 nt, Human
ucauggccccuucaggguccu

SEQ ID NO: 217055 - RNA, 20 nt, Human
uccaaaaugcaaaggcuuca

SEQ ID NO: 217056 - RNA, 19 nt, Human
uccagguucuuagcugggg

SEQ ID NO: 217057 - RNA, 23 nt, Human
uccauugcacagcuguggccacc

SEQ ID NO: 217058 - RNA, 20 nt, Human
ucccagguccuccuccuucu

SEQ ID NO: 217059 - RNA, 18 nt, Human
uccccuuucucuggggaa

SEQ ID NO: 217060 - RNA, 20 nt, Human
uccuuuucaguagaaugagg

SEQ ID NO: 217061 - RNA, 19 nt, Human
ucgggauccaacuccaggc

SEQ ID NO: 217062 - RNA, 21 nt, Human
ucucccuggccgucagcaccu

SEQ ID NO: 217063 - RNA, 19 nt, Human
ucugaaauugggaggacuc

SEQ ID NO: 217064 - RNA, 21 nt, Human
ucugagucuggguuccagauc

SEQ ID NO: 217065 - RNA, 25 nt, Human
ucugcaggcccaggacagugggcuu

SEQ ID NO: 217066 - RNA, 21 nt, Human
ucuggcaaggcugaggacaga

SEQ ID NO: 217067 - RNA, 20 nt, Human
ucuggcccuucaaguauguc

SEQ ID NO: 217068 - RNA, 19 nt, Human
ucugggcuggggagaggag

SEQ ID NO: 217069 - RNA, 23 nt, Human
ucuguugccaucauggccccuuc

SEQ ID NO: 217070 - RNA, 19 nt, Human
ucuuugcagguuggagcug

SEQ ID NO: 217071 - RNA, 20 nt, Human
ugaggcuggucucggggaug

SEQ ID NO: 217072 - RNA, 22 nt, Human
ugaggguggggggacugguucu

SEQ ID NO: 217073 - RNA, 19 nt, Human
ugaguucugauuccccuug

SEQ ID NO: 217074 - RNA, 22 nt, Human
ugcaaaggcuucagggaggcug

SEQ ID NO: 217075 - RNA, 22 nt, Human
uggagcaggcccaaauauaguc

SEQ ID NO: 217076 - RNA, 19 nt, Human
uggagcugggcucugggcc

SEQ ID NO: 217077 - RNA, 22 nt, Human
uggcaggcagaacccaaauucu

SEQ ID NO: 217078 - RNA, 22 nt, Human
uggcaucuguccugagcugguc

SEQ ID NO: 217079 - RNA, 21 nt, Human
uggccaggcugagguuccaga

SEQ ID NO: 217080 - RNA, 21 nt, Human
uggcuaggaugaugauccaca

SEQ ID NO: 217081 - RNA, 20 nt, Human
ugggagucugaaauugggag

SEQ ID NO: 217082 - RNA, 18 nt, Human
ugggcuggggagaggagc

SEQ ID NO: 217083 - RNA, 20 nt, Human
ugggcuggggagaggagcuu

SEQ ID NO: 217084 - RNA, 25 nt, Human
uggggcagcugccgaggcaggauuc

SEQ ID NO: 217085 - RNA, 19 nt, Human
ugggucagauuuauugcac

SEQ ID NO: 217086 - RNA, 20 nt, Human
ugguggugcaguugaguccc

SEQ ID NO: 217087 - RNA, 21 nt, Human
uguugccaucauggccccuuc

SEQ ID NO: 217088 - RNA, 24 nt, Human
uucaaguaugucucugggcuggaa

SEQ ID NO: 217089 - RNA, 19 nt, Human
uugcugaggaucuggaagu

SEQ ID NO: 217090 - RNA, 23 nt, Human
uuggagcuucccguuuuugcugg

SEQ ID NO: 217091 - RNA, 18 nt, Human
uuggugcaggggcccgag

SEQ ID NO: 217092 - RNA, 19 nt, Human
uuucaggaucugagguccc

SEQ ID NO: 217093 - RNA, 22 nt, Human
aaaaacaaaggcaacccagaaa

SEQ ID NO: 217094 - RNA, 18 nt, Human
aaaagccccccccaaaac

SEQ ID NO: 217095 - RNA, 20 nt, Human
aaaauauccaaugccugaaa

SEQ ID NO: 217096 - RNA, 18 nt, Human
aaacaaaggcaacccaga

SEQ ID NO: 217097 - RNA, 27 nt, Human
aaacagaccagugacuugacuugagau

SEQ ID NO: 217098 - RNA, 29 nt, Human
aaacaggaaaagacgguaggagggacccc

SEQ ID NO: 217099 - RNA, 21 nt, Human
aaacaggaaaagacgguaggg

SEQ ID NO: 217100 - RNA, 22 nt, Human
aaacaggagccuuaggcuacgg

SEQ ID NO: 217101 - RNA, 22 nt, Human
aacaaaacaaaaaauagaacac

SEQ ID NO: 217102 - RNA, 25 nt, Human
aacccaucuucuccaagaauuccug

SEQ ID NO: 217103 - RNA, 23 nt, Human
aagaaaaaaagccccccccaaaa

SEQ ID NO: 217104 - RNA, 24 nt, Human
acaaaacaaaaaauagaacacucg

SEQ ID NO: 217105 - RNA, 25 nt, Human
acaaaacaaaaaauagaacacucga

SEQ ID NO: 217106 - RNA, 19 nt, Human
accuucgccuccucucgcc

SEQ ID NO: 217107 - RNA, 20 nt, Human
acguaacaauauccacaguu

SEQ ID NO: 217108 - RNA, 19 nt, Human
agaacacucgacucacuga

SEQ ID NO: 217109 - RNA, 23 nt, Human
agccacgccaaaaacaaaggcaa

SEQ ID NO: 217110 - RNA, 19 nt, Human
aggcccgagguuaggacgg

SEQ ID NO: 217111 - RNA, 20 nt, Human
augucaccugagugcaacug

SEQ ID NO: 217112 - RNA, 23 nt, Human
caaaggcaacccagaaaguuaaa

SEQ ID NO: 217113 - RNA, 23 nt, Human
caaauauccacagguaauuucua

SEQ ID NO: 217114 - RNA, 23 nt, Human
caacugggcaggcccuuccccaa

SEQ ID NO: 217115 - RNA, 27 nt, Human
caagcaagaaacugagacuuuaaacac

SEQ ID NO: 217116 - RNA, 25 nt, Human
cacagcuaggaaacaggaaaagacg

SEQ ID NO: 217117 - RNA, 22 nt, Human
caccuucgccuccucucgccgc

SEQ ID NO: 217118 - RNA, 23 nt, Human
cacgccaaaaacaaaggcaaccc

SEQ ID NO: 217119 - RNA, 25 nt, Human
cagcuccuuagcaaucuagcaaucu

SEQ ID NO: 217120 - RNA, 18 nt, Human
cagguaauuucuaaucau

SEQ ID NO: 217121 - RNA, 18 nt, Human
cagugaauaaacccaucu

SEQ ID NO: 217122 - RNA, 21 nt, Human
cagugaauaaacccaucuucu

SEQ ID NO: 217123 - RNA, 23 nt, Human
ccacgccaaaaacaaaggcaacc

SEQ ID NO: 217124 - RNA, 24 nt, Human
ccagaaaguuaaauuacggcaguu

SEQ ID NO: 217125 - RNA, 20 nt, Human
ccccaaaacaacaguggcac

SEQ ID NO: 217126 - RNA, 23 nt, Human
ccgcgcugcugcuaccgcagcca

SEQ ID NO: 217127 - RNA, 19 nt, Human
ccuccucucgccgcugcgc

SEQ ID NO: 217128 - RNA, 24 nt, Human
ccucucgccgcugcgcccggcccc

SEQ ID NO: 217129 - RNA, 24 nt, Human
cgccaaaaacaaaggcaacccaga

SEQ ID NO: 217130 - RNA, 19 nt, Human
cuaacacauuagggacaca

SEQ ID NO: 217131 - RNA, 18 nt, Human
cuacguaacaauauccac

SEQ ID NO: 217132 - RNA, 21 nt, Human
cuccucagcuacacuaucugg

SEQ ID NO: 217133 - RNA, 22 nt, Human
cuguuagugcaggugaguguag

SEQ ID NO: 217134 - RNA, 20 nt, Human
cuuuuuuuuuuuuaggcccc

SEQ ID NO: 217135 - RNA, 18 nt, Human
gaacacucgacucacuga

SEQ ID NO: 217136 - RNA, 19 nt, Human
gcaacccagaaaguuaaau

SEQ ID NO: 217137 - RNA, 22 nt, Human
gccaaaaacaaaggcaacccag

SEQ ID NO: 217138 - RNA, 19 nt, Human
gcccugcgcuccgggcugg

SEQ ID NO: 217139 - RNA, 24 nt, Human
gcgcugcugcuaccgcagccaccu

SEQ ID NO: 217140 - RNA, 21 nt, Human
gggaauacagauaggggagga

SEQ ID NO: 217141 - RNA, 19 nt, Human
ggggaggggagcggggacc

SEQ ID NO: 217142 - RNA, 18 nt, Human
gguggaggcugucaugaa

SEQ ID NO: 217143 - RNA, 18 nt, Human
guacaaaaauguaucaaa

SEQ ID NO: 217144 - RNA, 21 nt, Human
gugacuaagaauuccaaguac

SEQ ID NO: 217145 - RNA, 22 nt, Human
guguguuuuuagugaaagggag

SEQ ID NO: 217146 - RNA, 20 nt, Human
guugugggguggaggcuguc

SEQ ID NO: 217147 - RNA, 18 nt, Human
uaaaaaauauccaaugcc

SEQ ID NO: 217148 - RNA, 23 nt, Human
uaaaaaauauccaaugccugaaa

SEQ ID NO: 217149 - RNA, 21 nt, Human
uaacaaccauaagucuaaaca

SEQ ID NO: 217150 - RNA, 20 nt, Human
uaacuuaacauugugaagca

SEQ ID NO: 217151 - RNA, 21 nt, Human
uaagucagccacgccaaaaac

SEQ ID NO: 217152 - RNA, 19 nt, Human
uaagucuaaacaccauaac

SEQ ID NO: 217153 - RNA, 22 nt, Human
uaauucugauugauuaaaccaa

SEQ ID NO: 217154 - RNA, 18 nt, Human
uacaguauuugcagcagu

SEQ ID NO: 217155 - RNA, 20 nt, Human
uacaguauuugcagcaguga

SEQ ID NO: 217156 - RNA, 25 nt, Human
uaccccaauggcauagucuugugau

SEQ ID NO: 217157 - RNA, 23 nt, Human
uaccgcagccaccuucgccuccu

SEQ ID NO: 217158 - RNA, 21 nt, Human
uacggcaguuaaagaaaaauc

SEQ ID NO: 217159 - RNA, 19 nt, Human
uagaguaauaauuccaccc

SEQ ID NO: 217160 - RNA, 19 nt, Human
uagccccaaaguaauuuuu

SEQ ID NO: 217161 - RNA, 21 nt, Human
uagugcaggugaguguaggug

SEQ ID NO: 217162 - RNA, 18 nt, Human
uauacaaauauccacagg

SEQ ID NO: 217163 - RNA, 18 nt, Human
ucauaucuauucagucuc

SEQ ID NO: 217164 - RNA, 23 nt, Human
ucauuuauaauuuuagaguuugc

SEQ ID NO: 217165 - RNA, 22 nt, Human
uccaaugccugaaauaaacauc

SEQ ID NO: 217166 - RNA, 23 nt, Human
uccccauauaacuuaacauugug

SEQ ID NO: 217167 - RNA, 18 nt, Human
uccgggcuggguccgagg

SEQ ID NO: 217168 - RNA, 22 nt, Human
ucuaaacaccauaacaucuuug

SEQ ID NO: 217169 - RNA, 18 nt, Human
ucugaguuggaaaaagcc

SEQ ID NO: 217170 - RNA, 18 nt, Human
ugaaacacaacuacccca

SEQ ID NO: 217171 - RNA, 19 nt, Human
ugaaacacaacuaccccaa

SEQ ID NO: 217172 - RNA, 24 nt, Human
ugaaauagauaauucagguuguca

SEQ ID NO: 217173 - RNA, 24 nt, Human
ugaauaaacccaucuucuccaaga

SEQ ID NO: 217174 - RNA, 19 nt, Human
ugaccacccucccaacacc

SEQ ID NO: 217175 - RNA, 22 nt, Human
ugacuaagaauuccaaguacaa

SEQ ID NO: 217176 - RNA, 23 nt, Human
ugaguagcuuucauuucuguucc

SEQ ID NO: 217177 - RNA, 23 nt, Human
ugcagcggccgcccugcgcuccg

SEQ ID NO: 217178 - RNA, 19 nt, Human
ugcgcccggccccaccccc

SEQ ID NO: 217179 - RNA, 20 nt, Human
uggcauagucuugugaugug

SEQ ID NO: 217180 - RNA, 21 nt, Human
ugggaauacagauaggggagg

SEQ ID NO: 217181 - RNA, 24 nt, Human
ugggaauacagauaggggaggaaa

SEQ ID NO: 217182 - RNA, 23 nt, Human
uguaaauccagaaacauuaugca

SEQ ID NO: 217183 - RNA, 21 nt, Human
uguguuuuuagugaaagggag

SEQ ID NO: 217184 - RNA, 18 nt, Human
uguuagugcaggugagug

SEQ ID NO: 217185 - RNA, 25 nt, Human
uuagccccaaaguaauuuuugggaa

SEQ ID NO: 217186 - RNA, 22 nt, Human
uuaguacaaaaauguaucaaau

SEQ ID NO: 217187 - RNA, 28 nt, Human
uucaagucuguugcaccuguguguuuuu

SEQ ID NO: 217188 - RNA, 23 nt, Human
uuccggaaaaagaaaaaaagccc

SEQ ID NO: 217189 - RNA, 24 nt, Human
uucuuuguugaccacccucccaac

SEQ ID NO: 217190 - RNA, 24 nt, Human
uuggguugugggguggaggcuguc

SEQ ID NO: 217191 - RNA, 19 nt, Human
uuguaaacaaaauauauuu

SEQ ID NO: 217192 - RNA, 19 nt, Human
uuuuuuuuuuuuaggcccc

SEQ ID NO: 217193 - RNA, 18 nt, Human
uuuuuuuuuuuuuuuuug

SEQ ID NO: 217194 - RNA, 21 nt, Human
aaccuccuccccgacccucua

SEQ ID NO: 217195 - RNA, 19 nt, Human
aagccccagguccccccag

SEQ ID NO: 217196 - RNA, 22 nt, Human
aagccgauccugccaaaucuug

SEQ ID NO: 217197 - RNA, 24 nt, Human
aaggagccaucucuggggaaggga

SEQ ID NO: 217198 - RNA, 26 nt, Human
aaggagccaucucuggggaagggaug

SEQ ID NO: 217199 - RNA, 19 nt, Human
acacaaccuccuccccgac

SEQ ID NO: 217200 - RNA, 24 nt, Human
acacaaccuccuccccgacccucu

SEQ ID NO: 217201 - RNA, 23 nt, Human
accccauggcccugucccugauu

SEQ ID NO: 217202 - RNA, 23 nt, Human
acgaaaccacgaaaccacuagac

SEQ ID NO: 217203 - RNA, 24 nt, Human
agcccacucuacccucuucauccc

SEQ ID NO: 217204 - RNA, 19 nt, Human
agccccagguccccccagg

SEQ ID NO: 217205 - RNA, 20 nt, Human
agccccagguccccccaggc

SEQ ID NO: 217206 - RNA, 21 nt, Human
aggacaccccugcccuucuca

SEQ ID NO: 217207 - RNA, 22 nt, Human
aggaguucuugugggugggaga

SEQ ID NO: 217208 - RNA, 18 nt, Human
aggcugggacaugggaac

SEQ ID NO: 217209 - RNA, 21 nt, Human
auggagggcagccacaggcca

SEQ ID NO: 217210 - RNA, 19 nt, Human
cacgaaaccacuagacuga

SEQ ID NO: 217211 - RNA, 19 nt, Human
cacucuacccucuucaucc

SEQ ID NO: 217212 - RNA, 27 nt, Human
cacucucaucucacagcacucuaaggg

SEQ ID NO: 217213 - RNA, 19 nt, Human
caggacaccccugcccuuc

SEQ ID NO: 217214 - RNA, 22 nt, Human
caucaggacaccccugcccuuc

SEQ ID NO: 217215 - RNA, 26 nt, Human
caucucacagcacucuaaggggaagu

SEQ ID NO: 217216 - RNA, 20 nt, Human
ccacaggccaggcugggaca

SEQ ID NO: 217217 - RNA, 22 nt, Human
ccagcagcccacucuacccucu

SEQ ID NO: 217218 - RNA, 23 nt, Human
cccaagccccagguccccccagg

SEQ ID NO: 217219 - RNA, 22 nt, Human
cccccaggcgcgucucuggucu

SEQ ID NO: 217220 - RNA, 25 nt, Human
cccccaggcgcgucucuggucucca

SEQ ID NO: 217221 - RNA, 19 nt, Human
ccccgccagcccucccgcc

SEQ ID NO: 217222 - RNA, 21 nt, Human
ccccgccagcccucccgcccg

SEQ ID NO: 217223 - RNA, 27 nt, Human
ccccgccagcccucccgcccgcccgcc

SEQ ID NO: 217224 - RNA, 21 nt, Human
cccugucccugauuuacccac

SEQ ID NO: 217225 - RNA, 25 nt, Human
ccuaccccauggcccugucccugau

SEQ ID NO: 217226 - RNA, 21 nt, Human
ccucccgcccgcccgccgcuc

SEQ ID NO: 217227 - RNA, 24 nt, Human
cucacagcacucuaaggggaaguu

SEQ ID NO: 217228 - RNA, 21 nt, Human
cucccgcccgcccgccgcucc

SEQ ID NO: 217229 - RNA, 21 nt, Human
cuccuccccgacccucuaggu

SEQ ID NO: 217230 - RNA, 19 nt, Human
cucuacccucuucauccca

SEQ ID NO: 217231 - RNA, 19 nt, Human
cucucaucucacagcacuc

SEQ ID NO: 217232 - RNA, 23 nt, Human
cucuggggaagggauggagggca

SEQ ID NO: 217233 - RNA, 21 nt, Human
gaaaccacuagacugauggca

SEQ ID NO: 217234 - RNA, 24 nt, Human
gacacaaccuccuccccgacccuc

SEQ ID NO: 217235 - RNA, 20 nt, Human
gaggcagguccuuggggucc

SEQ ID NO: 217236 - RNA, 22 nt, Human
gaucccuucuccccaccuuugc

SEQ ID NO: 217237 - RNA, 19 nt, Human
gccacaggccaggcuggga

SEQ ID NO: 217238 - RNA, 28 nt, Human
gccagcccucccgcccgcccgccgcucc

SEQ ID NO: 217239 - RNA, 24 nt, Human
gccgauccugccaaaucuugaugc

SEQ ID NO: 217240 - RNA, 18 nt, Human
ggaucccuucuccccacc

SEQ ID NO: 217241 - RNA, 18 nt, Human
gggagaggucugugcccc

SEQ ID NO: 217242 - RNA, 19 nt, Human
gggauggagggcagccaca

SEQ ID NO: 217243 - RNA, 21 nt, Human
ggugaaugggagaggaaggga

SEQ ID NO: 217244 - RNA, 20 nt, Human
gugaaugggagaggaaggga

SEQ ID NO: 217245 - RNA, 19 nt, Human
gugacacaaccuccucccc

SEQ ID NO: 217246 - RNA, 18 nt, Human
uaaggggaaguugggugg

SEQ ID NO: 217247 - RNA, 20 nt, Human
uaaggggaaguuggguggga

SEQ ID NO: 217248 - RNA, 21 nt, Human
uaccccauggcccugucccug

SEQ ID NO: 217249 - RNA, 21 nt, Human
ucccugauuuacccacucuca

SEQ ID NO: 217250 - RNA, 22 nt, Human
ucucacccuaccccauggcccu

SEQ ID NO: 217251 - RNA, 20 nt, Human
ucucuggggaagggauggag

SEQ ID NO: 217252 - RNA, 22 nt, Human
ucucuggucuccaaagucucgu

SEQ ID NO: 217253 - RNA, 18 nt, Human
ucuugugggugggagagg

SEQ ID NO: 217254 - RNA, 21 nt, Human
ugagaggggaaacuagagaag

SEQ ID NO: 217255 - RNA, 23 nt, Human
ugagaggggaaacuagagaagga

SEQ ID NO: 217256 - RNA, 28 nt, Human
ugagaggggaaacuagagaaggagcagc

SEQ ID NO: 217257 - RNA, 19 nt, Human
ugcaucaggacaccccugc

SEQ ID NO: 217258 - RNA, 23 nt, Human
ugccaaaucuugaugcgacacug

SEQ ID NO: 217259 - RNA, 20 nt, Human
ugcccuucucacccuacccc

SEQ ID NO: 217260 - RNA, 22 nt, Human
ugggugggaggaguucuugugg

SEQ ID NO: 217261 - RNA, 22 nt, Human
ugggugggaggaguucuugugg

SEQ ID NO: 217262 - RNA, 19 nt, Human
uuaggaucccuucucccca

SEQ ID NO: 217263 - RNA, 20 nt, Human
uuuuuuuuuuuuuuuuuugg

SEQ ID NO: 217264 - RNA, 23 nt, Human
uuuuuuuuuuuuuuuuuuguucu

SEQ ID NO: 217265 - RNA, 22 nt, Human
agucuuuaaagcgaaguggugc

SEQ ID NO: 217266 - RNA, 20 nt, Human
caccugggcuugauagaaug

SEQ ID NO: 217267 - RNA, 19 nt, Human
caguggggccuccgaaaaa

SEQ ID NO: 217268 - RNA, 19 nt, Human
ccccugagggugaccaugc

SEQ ID NO: 217269 - RNA, 20 nt, Human
ccggccgccuuccccucugc

SEQ ID NO: 217270 - RNA, 18 nt, Human
ccuaaauauugcucggcu

SEQ ID NO: 217271 - RNA, 20 nt, Human
gaagaagagaacagcaucag

SEQ ID NO: 217272 - RNA, 19 nt, Human
gaccuggccgaaguggcug

SEQ ID NO: 217273 - RNA, 19 nt, Human
gcgaaguggugcugccccc

SEQ ID NO: 217274 - RNA, 23 nt, Human
uaaaaggcuuauauuuauaaaaa

SEQ ID NO: 217275 - RNA, 20 nt, Human
uauggaagauacaaagacca

SEQ ID NO: 217276 - RNA, 22 nt, Human
ucugucacucuccaaaguucag

SEQ ID NO: 217277 - RNA, 18 nt, Human
ugaagaagagaacagcau

SEQ ID NO: 217278 - RNA, 20 nt, Human
ugaagaagagaacagcauca

SEQ ID NO: 217279 - RNA, 22 nt, Human
uggaagauacaaagaccaagga

SEQ ID NO: 217280 - RNA, 21 nt, Human
uggccgaaguggcugccucag

SEQ ID NO: 217281 - RNA, 21 nt, Human
uggugcugcccccggucgugu

SEQ ID NO: 217282 - RNA, 24 nt, Human
aaagugcugggauuacaggcguga

SEQ ID NO: 217283 - RNA, 18 nt, Human
aagaaacaugacgugugc

SEQ ID NO: 217284 - RNA, 21 nt, Human
aaggaaggaaccaagagaggc

SEQ ID NO: 217285 - RNA, 18 nt, Human
aaggagccuggccuggga

SEQ ID NO: 217286 - RNA, 25 nt, Human
aaggagccuggccugggagaaaggc

SEQ ID NO: 217287 - RNA, 19 nt, Human
aagugcugggauuacaggc

SEQ ID NO: 217288 - RNA, 19 nt, Human
aagugcugggauuacaggc

SEQ ID NO: 217289 - RNA, 26 nt, Human
aagugcugggauuacaggcgugaacc

SEQ ID NO: 217290 - RNA, 21 nt, Human
aaugcaggaagacaggaagga

SEQ ID NO: 217291 - RNA, 18 nt, Human
acagggaaaaaacaucca

SEQ ID NO: 217292 - RNA, 20 nt, Human
accucaaccuccugaguagc

SEQ ID NO: 217293 - RNA, 24 nt, Human
acggagucucgcuguguugcccag

SEQ ID NO: 217294 - RNA, 19 nt, Human
acuacaggugugugccacc

SEQ ID NO: 217295 - RNA, 23 nt, Human
agacaaguauagccuuuacccuc

SEQ ID NO: 217296 - RNA, 23 nt, Human
agacaggaaggagccuggccugg

SEQ ID NO: 217297 - RNA, 21 nt, Human
agaggcuggugaaccgucugg

SEQ ID NO: 217298 - RNA, 20 nt, Human
agauagggaaacugagggcc

SEQ ID NO: 217299 - RNA, 18 nt, Human
agaucagacauucucuuc

SEQ ID NO: 217300 - RNA, 20 nt, Human
aggaaccaagagaggcuggu

SEQ ID NO: 217301 - RNA, 23 nt, Human
aggcagaggcagaguggcccugg

SEQ ID NO: 217302 - RNA, 24 nt, Human
aggcagaggcagaguggcccuggg

SEQ ID NO: 217303 - RNA, 23 nt, Human
aggcagaguggcccugggcaucc

SEQ ID NO: 217304 - RNA, 24 nt, Human
aggcagaguggcccugggcauccu

SEQ ID NO: 217305 - RNA, 22 nt, Human
aggcagugacucgcccgagggc

SEQ ID NO: 217306 - RNA, 19 nt, Human
aggcgugaaccaccgcgcc

SEQ ID NO: 217307 - RNA, 21 nt, Human
agggaccuguggccccagggg

SEQ ID NO: 217308 - RNA, 22 nt, Human
agggcaggggugagggccagaa

SEQ ID NO: 217309 - RNA, 24 nt, Human
aggugauccacccuccuuggccuc

SEQ ID NO: 217310 - RNA, 23 nt, Human
aguagcugggacuacaggugugu

SEQ ID NO: 217311 - RNA, 22 nt, Human
agucuuucugugggggccacug

SEQ ID NO: 217312 - RNA, 19 nt, Human
agugacacaggucacauuu

SEQ ID NO: 217313 - RNA, 23 nt, Human
agugcaauggcgcaaucuuggcu

SEQ ID NO: 217314 - RNA, 24 nt, Human
agugcaauggcgcaaucuuggcuc

SEQ ID NO: 217315 - RNA, 18 nt, Human
agugcugggauuacaggc

SEQ ID NO: 217316 - RNA, 20 nt, Human
aguuagcagacgugguuccc

SEQ ID NO: 217317 - RNA, 21 nt, Human
aucuucccacuggcucuguca

SEQ ID NO: 217318 - RNA, 20 nt, Human
augggguuucgccaggcugg

SEQ ID NO: 217319 - RNA, 24 nt, Human
caaagugcugggauuacaggcgug

SEQ ID NO: 217320 - RNA, 19 nt, Human
caacagggaggcaucacgg

SEQ ID NO: 217321 - RNA, 20 nt, Human
caaccuccaccucccagguu

SEQ ID NO: 217322 - RNA, 23 nt, Human
caaccuccaccucccagguucaa

SEQ ID NO: 217323 - RNA, 18 nt, Human
caagaacaaggcgugugc

SEQ ID NO: 217324 - RNA, 25 nt, Human
caagaacaaggcgugugccacaguc

SEQ ID NO: 217325 - RNA, 22 nt, Human
caagacaaguauagccuuuacc

SEQ ID NO: 217326 - RNA, 22 nt, Human
caaggaaggaaccaagagaggc

SEQ ID NO: 217327 - RNA, 21 nt, Human
caccgcgcccagccccggccc

SEQ ID NO: 217328 - RNA, 23 nt, Human
cacggcucuagaagaggcugggg

SEQ ID NO: 217329 - RNA, 21 nt, Human
cacugcaaccuccaccuccca

SEQ ID NO: 217330 - RNA, 21 nt, Human
cacugugcuuggcacuggggc

SEQ ID NO: 217331 - RNA, 21 nt, Human
cagaacaucccuagguccuga

SEQ ID NO: 217332 - RNA, 22 nt, Human
cagaagagacuggacuccagug

SEQ ID NO: 217333 - RNA, 19 nt, Human
cagaaugcaggcagaggca

SEQ ID NO: 217334 - RNA, 24 nt, Human
cagcagaagagacuggacuccagu

SEQ ID NO: 217335 - RNA, 18 nt, Human
cagcccucuuggcugguc

SEQ ID NO: 217336 - RNA, 20 nt, Human
caggaaggagccuggccugg

SEQ ID NO: 217337 - RNA, 22 nt, Human
caggcagagggagcugucuggg

SEQ ID NO: 217338 - RNA, 22 nt, Human
cagguucugggggguggaggca

SEQ ID NO: 217339 - RNA, 23 nt, Human
caucccagggcaggggugagggc

SEQ ID NO: 217340 - RNA, 18 nt, Human
cauucucuuccaaggaag

SEQ ID NO: 217341 - RNA, 22 nt, Human
ccaaagugcugggauuacaggc

SEQ ID NO: 217342 - RNA, 22 nt, Human
ccaaagugcugggauuacaggc

SEQ ID NO: 217343 - RNA, 24 nt, Human
ccaaagugcugggauuacaggcgu

SEQ ID NO: 217344 - RNA, 27 nt, Human
ccaccucccagguucaagcaauucuuu

SEQ ID NO: 217345 - RNA, 24 nt, Human
ccacgagggucucauuuugcaggg

SEQ ID NO: 217346 - RNA, 22 nt, Human
ccagaacaucccuagguccuga

SEQ ID NO: 217347 - RNA, 23 nt, Human
cccagccccggcccucuuuuucu

SEQ ID NO: 217348 - RNA, 22 nt, Human
cccaggcuggagugcaauggcg

SEQ ID NO: 217349 - RNA, 21 nt, Human
cccucacuuuugcagcccucu

SEQ ID NO: 217350 - RNA, 24 nt, Human
ccucccagguucaagcaauucucc

SEQ ID NO: 217351 - RNA, 20 nt, Human
ccugaccucaggugauccac

SEQ ID NO: 217352 - RNA, 23 nt, Human
ccugaccucaggugauccacccu

SEQ ID NO: 217353 - RNA, 24 nt, Human
ccugaccucaggugauccacccuc

SEQ ID NO: 217354 - RNA, 22 nt, Human
ccugaguagcugggacuacagg

SEQ ID NO: 217355 - RNA, 23 nt, Human
ccugaguagcugggacuacaggu

SEQ ID NO: 217356 - RNA, 23 nt, Human
cgagauagggaaacugagggcca

SEQ ID NO: 217357 - RNA, 25 nt, Human
cgagggcacacggcagaaugcaggc

SEQ ID NO: 217358 - RNA, 24 nt, Human
cgcuguguugcccaggcuggagug

SEQ ID NO: 217359 - RNA, 24 nt, Human
cggagucucgcuguguugcccagg

SEQ ID NO: 217360 - RNA, 22 nt, Human
cggcucuagaagaggcugggga

SEQ ID NO: 217361 - RNA, 20 nt, Human
cgugugccacagucacguag

SEQ ID NO: 217362 - RNA, 22 nt, Human
cuagaugucccacgcccugaca

SEQ ID NO: 217363 - RNA, 23 nt, Human
cuagaugucccacgcccugacau

SEQ ID NO: 217364 - RNA, 24 nt, Human
cucacugcaaccuccaccucccag

SEQ ID NO: 217365 - RNA, 20 nt, Human
cuccaaggguggggaugucc

SEQ ID NO: 217366 - RNA, 23 nt, Human
cucugcaccucacaggccuggac

SEQ ID NO: 217367 - RNA, 24 nt, Human
cugcaaccuccaccucccagguuc

SEQ ID NO: 217368 - RNA, 23 nt, Human
cuggaaggcaugccaaggaauuu

SEQ ID NO: 217369 - RNA, 24 nt, Human
cuggaaggcaugccaaggaauuug

SEQ ID NO: 217370 - RNA, 24 nt, Human
gaccucaggugauccacccuccuu

SEQ ID NO: 217371 - RNA, 19 nt, Human
gagaugggguuucgccagg

SEQ ID NO: 217372 - RNA, 20 nt, Human
gagaugggguuucgccaggc

SEQ ID NO: 217373 - RNA, 20 nt, Human
gaggcuggugaaccgucugg

SEQ ID NO: 217374 - RNA, 21 nt, Human
gagggccagggagaggcagug

SEQ ID NO: 217375 - RNA, 26 nt, Human
gaguagcugggacuacaggugugugc

SEQ ID NO: 217376 - RNA, 20 nt, Human
gaguccaguucugggcacuc

SEQ ID NO: 217377 - RNA, 22 nt, Human
gauuacaggcgugaaccaccgc

SEQ ID NO: 217378 - RNA, 24 nt, Human
gauuuuguauuuuuaguagagaug

SEQ ID NO: 217379 - RNA, 22 nt, Human
gcaaccuccaccucccagguuc

SEQ ID NO: 217380 - RNA, 19 nt, Human
gcccaggcuggagugcaau

SEQ ID NO: 217381 - RNA, 19 nt, Human
gcccugggcauccugaguc

SEQ ID NO: 217382 - RNA, 25 nt, Human
gcucagucuuucugugggggccacu

SEQ ID NO: 217383 - RNA, 19 nt, Human
gcuggagugcaauggcgca

SEQ ID NO: 217384 - RNA, 23 nt, Human
gcuggccucuaacuccugaccuc

SEQ ID NO: 217385 - RNA, 22 nt, Human
ggagcugucugggugaaugcag

SEQ ID NO: 217386 - RNA, 23 nt, Human
ggagucucgcuguguugcccagg

SEQ ID NO: 217387 - RNA, 20 nt, Human
ggauguccgggcccgugccc

SEQ ID NO: 217388 - RNA, 20 nt, Human
ggcuggggaaggccacgagg

SEQ ID NO: 217389 - RNA, 19 nt, Human
gggcagcgucaggaggccc

SEQ ID NO: 217390 - RNA, 21 nt, Human
gggcgagauggaagguucagg

SEQ ID NO: 217391 - RNA, 24 nt, Human
ggugauccacccuccuuggccucc

SEQ ID NO: 217392 - RNA, 19 nt, Human
guagugcagggugguggaa

SEQ ID NO: 217393 - RNA, 23 nt, Human
gugaacaagacaaguauagccuu

SEQ ID NO: 217394 - RNA, 24 nt, Human
gugauccacccuccuuggccuccc

SEQ ID NO: 217395 - RNA, 21 nt, Human
guggagcuagggcagggcaga

SEQ ID NO: 217396 - RNA, 20 nt, Human
guggcccugggcauccugag

SEQ ID NO: 217397 - RNA, 21 nt, Human
guguugcccaggcuggagugc

SEQ ID NO: 217398 - RNA, 23 nt, Human
guucugggggguggaggcaucug

SEQ ID NO: 217399 - RNA, 24 nt, Human
uacaggcgugaaccaccgcgccca

SEQ ID NO: 217400 - RNA, 22 nt, Human
uacaggugugugccaccacgcc

SEQ ID NO: 217401 - RNA, 24 nt, Human
uaccucaaccuccugaguagcugg

SEQ ID NO: 217402 - RNA, 18 nt, Human
uagaagaggcuggggaag

SEQ ID NO: 217403 - RNA, 21 nt, Human
uagaagaggcuggggaaggcc

SEQ ID NO: 217404 - RNA, 21 nt, Human
uagguccugagacuacaguuu

SEQ ID NO: 217405 - RNA, 18 nt, Human
uaguagagaugggguuuc

SEQ ID NO: 217406 - RNA, 22 nt, Human
uaguagagaugggguuucgcca

SEQ ID NO: 217407 - RNA, 23 nt, Human
uaguagagaugggguuucgccag

SEQ ID NO: 217408 - RNA, 23 nt, Human
uaguagagaugggguuucgccag

SEQ ID NO: 217409 - RNA, 24 nt, Human
uaguagagaugggguuucgccagg

SEQ ID NO: 217410 - RNA, 25 nt, Human
uaguagagaugggguuucgccaggc

SEQ ID NO: 217411 - RNA, 19 nt, Human
uagugcagggugguggaag

SEQ ID NO: 217412 - RNA, 25 nt, Human
uaugucaagcaccuacuagaugucc

SEQ ID NO: 217413 - RNA, 23 nt, Human
ucacguagugacacaggucacau

SEQ ID NO: 217414 - RNA, 24 nt, Human
ucacugcaaccuccaccucccagg

SEQ ID NO: 217415 - RNA, 25 nt, Human
ucacugcaaccuccaccucccaggu

SEQ ID NO: 217416 - RNA, 26 nt, Human
ucacugcaaccuccaccucccagguu

SEQ ID NO: 217417 - RNA, 23 nt, Human
ucagcaggucuucccuaugagcc

SEQ ID NO: 217418 - RNA, 21 nt, Human
ucaggcagagggagcugucug

SEQ ID NO: 217419 - RNA, 21 nt, Human
uccacccuccuuggccuccca

SEQ ID NO: 217420 - RNA, 24 nt, Human
ucccaaagugcugggauuacaggc

SEQ ID NO: 217421 - RNA, 21 nt, Human
ucccagguucaagcaauucuc

SEQ ID NO: 217422 - RNA, 23 nt, Human
ucccagguucaagcaauucuccu

SEQ ID NO: 217423 - RNA, 19 nt, Human
ucccuagguccugagacua

SEQ ID NO: 217424 - RNA, 24 nt, Human
uccugaguagcugggacuacaggu

SEQ ID NO: 217425 - RNA, 21 nt, Human
uccuuggccucccaaagugcu

SEQ ID NO: 217426 - RNA, 21 nt, Human
ucgcccgagggcacacggcag

SEQ ID NO: 217427 - RNA, 24 nt, Human
ucgcuguguugcccaggcuggagu

SEQ ID NO: 217428 - RNA, 24 nt, Human
ucuccuaccucaaccuccugagua

SEQ ID NO: 217429 - RNA, 23 nt, Human
ucucgcuguguugcccaggcugg

SEQ ID NO: 217430 - RNA, 24 nt, Human
ucucgcuguguugcccaggcugga

SEQ ID NO: 217431 - RNA, 24 nt, Human
ucuguaucuucccacuggcucugu

SEQ ID NO: 217432 - RNA, 18 nt, Human
ucuguggacaucccaggg

SEQ ID NO: 217433 - RNA, 18 nt, Human
ucuuucugugggggccac

SEQ ID NO: 217434 - RNA, 20 nt, Human
ugaccucaggugauccaccc

SEQ ID NO: 217435 - RNA, 21 nt, Human
ugaccucaggugauccacccu

SEQ ID NO: 217436 - RNA, 22 nt, Human
ugaccucaggugauccacccuc

SEQ ID NO: 217437 - RNA, 26 nt, Human
ugaguccaguucugggcacucugcac

SEQ ID NO: 217438 - RNA, 23 nt, Human
ugcaauggcgcaaucuuggcuca

SEQ ID NO: 217439 - RNA, 24 nt, Human
ugccaaggaauuuggucuuuggcc

SEQ ID NO: 217440 - RNA, 23 nt, Human
ugccagcagaagagacuggacuc

SEQ ID NO: 217441 - RNA, 18 nt, Human
ugcccaggcuggagugca

SEQ ID NO: 217442 - RNA, 21 nt, Human
ugcccaggcuggagugcaaug

SEQ ID NO: 217443 - RNA, 21 nt, Human
ugcccaggcuggagugcaaug

SEQ ID NO: 217444 - RNA, 22 nt, Human
ugcugggauuacaggcgugaac

SEQ ID NO: 217445 - RNA, 23 nt, Human
ugcuggucaaggaaggaggggug

SEQ ID NO: 217446 - RNA, 23 nt, Human
uggagugcaauggcgcaaucuug

SEQ ID NO: 217447 - RNA, 24 nt, Human
uggagugcaauggcgcaaucuugg

SEQ ID NO: 217448 - RNA, 24 nt, Human
uggauuuuguauuuuuaguagaga

SEQ ID NO: 217449 - RNA, 20 nt, Human
uggccucuaacuccugaccu

SEQ ID NO: 217450 - RNA, 19 nt, Human
uggccugggagaaaggcug

SEQ ID NO: 217451 - RNA, 18 nt, Human
ugggacuacaggugugug

SEQ ID NO: 217452 - RNA, 21 nt, Human
ugggacuacaggugugugcca

SEQ ID NO: 217453 - RNA, 22 nt, Human
ugggacuacaggugugugccac

SEQ ID NO: 217454 - RNA, 24 nt, Human
ugggacuacaggugugugccacca

SEQ ID NO: 217455 - RNA, 19 nt, Human
ugggauuacaggcgugaac

SEQ ID NO: 217456 - RNA, 21 nt, Human
ugggauuacaggcgugaacca

SEQ ID NO: 217457 - RNA, 22 nt, Human
ugggauuacaggcgugaaccac

SEQ ID NO: 217458 - RNA, 23 nt, Human
ugggauuacaggcgugaaccacc

SEQ ID NO: 217459 - RNA, 24 nt, Human
ugggauuacaggcgugaaccaccg

SEQ ID NO: 217460 - RNA, 24 nt, Human
ugggauuugcuggcaaccuagaca

SEQ ID NO: 217461 - RNA, 21 nt, Human
uguauuuuuaguagagauggg

SEQ ID NO: 217462 - RNA, 24 nt, Human
ugucaagcaccuacuagauguccc

SEQ ID NO: 217463 - RNA, 19 nt, Human
ugucugggugaaugcagga

SEQ ID NO: 217464 - RNA, 18 nt, Human
ugugugacgugagcuggg

SEQ ID NO: 217465 - RNA, 18 nt, Human
uguguugcccaggcugga

SEQ ID NO: 217466 - RNA, 24 nt, Human
uguguugcccaggcuggagugcaa

SEQ ID NO: 217467 - RNA, 20 nt, Human
uguugcccaggcuggagugc

SEQ ID NO: 217468 - RNA, 18 nt, Human
uuaguagagaugggguuu

SEQ ID NO: 217469 - RNA, 22 nt, Human
uuaguagagaugggguuucgcc

SEQ ID NO: 217470 - RNA, 23 nt, Human
uuaguagagaugggguuucgcca

SEQ ID NO: 217471 - RNA, 24 nt, Human
uucaagcaauucuccuaccucaac

SEQ ID NO: 217472 - RNA, 22 nt, Human
uucugggggguggaggcaucug

SEQ ID NO: 217473 - RNA, 23 nt, Human
uugcagcccucuuggcugguccc

SEQ ID NO: 217474 - RNA, 18 nt, Human
uugcccaggcuggagugc

SEQ ID NO: 217475 - RNA, 23 nt, Human
uuguauuuuuaguagagaugggg

SEQ ID NO: 217476 - RNA, 19 nt, Human
uuuuguauuuuuaguagag

SEQ ID NO: 217477 - RNA, 20 nt, Human
uuuuguauuuuuaguagaga

SEQ ID NO: 217478 - RNA, 23 nt, Human
uuuuuaguagagaugggguuucg

SEQ ID NO: 217479 - RNA, 24 nt, Human
uuuuuaguagagaugggguuucgc

SEQ ID NO: 217480 - RNA, 18 nt, Human
aaaaaaaaaaaaaaagaa

SEQ ID NO: 217481 - RNA, 23 nt, Human
aaaagaaaaaaaaaaaaaaagaa

SEQ ID NO: 217482 - RNA, 23 nt, Human
aagcaagacguuuucucccaaag

SEQ ID NO: 217483 - RNA, 21 nt, Human
aagucccacuucuuucagugg

SEQ ID NO: 217484 - RNA, 24 nt, Human
aauaauaaaugaauccagaaagga

SEQ ID NO: 217485 - RNA, 18 nt, Human
aauuacuugaacccggga

SEQ ID NO: 217486 - RNA, 21 nt, Human
acacacugcacacacauggac

SEQ ID NO: 217487 - RNA, 18 nt, Human
acacacuugcacacacac

SEQ ID NO: 217488 - RNA, 20 nt, Human
acacgcacacgugcacacac

SEQ ID NO: 217489 - RNA, 20 nt, Human
acagagcgagacuccgucuc

SEQ ID NO: 217490 - RNA, 24 nt, Human
acagagcgagacuccgucucaaaa

SEQ ID NO: 217491 - RNA, 23 nt, Human
acaugcacgcacacgcacacgug

SEQ ID NO: 217492 - RNA, 26 nt, Human
acaugcacgcacacgcacacgugcac

SEQ ID NO: 217493 - RNA, 22 nt, Human
accacugaggaaccacaaggaa

SEQ ID NO: 217494 - RNA, 23 nt, Human
acgcacacgcacacgugcacaca

SEQ ID NO: 217495 - RNA, 27 nt, Human
acgcacauacacacuugcacacacaca

SEQ ID NO: 217496 - RNA, 22 nt, Human
acgggaagucccacuucuuuca

SEQ ID NO: 217497 - RNA, 18 nt, Human
acuaccuuuaaggaggug

SEQ ID NO: 217498 - RNA, 22 nt, Human
agaagaaguccaaggcaaagag

SEQ ID NO: 217499 - RNA, 23 nt, Human
agacaaaggccccuucccaagca

SEQ ID NO: 217500 - RNA, 22 nt, Human
agacagcagaauuacuugaacc

SEQ ID NO: 217501 - RNA, 24 nt, Human
agacagcagaauuacuugaacccg

SEQ ID NO: 217502 - RNA, 23 nt, Human
agacaggaagcaggcccauccca

SEQ ID NO: 217503 - RNA, 23 nt, Human
agacaggaagcaggcccauccca

SEQ ID NO: 217504 - RNA, 23 nt, Human
agagccucucaugcugugcgccc

SEQ ID NO: 217505 - RNA, 19 nt, Human
agaggcuacgcugccguca

SEQ ID NO: 217506 - RNA, 18 nt, Human
agauguggagcucugagc

SEQ ID NO: 217507 - RNA, 23 nt, Human
agccagcaauguugcccaacgcg

SEQ ID NO: 217508 - RNA, 24 nt, Human
agccugggugacagagcgagacuc

SEQ ID NO: 217509 - RNA, 25 nt, Human
aggaaaccucaaaacacaaucuuga

SEQ ID NO: 217510 - RNA, 18 nt, Human
aggaaccacaaggaagcc

SEQ ID NO: 217511 - RNA, 22 nt, Human
aggaagcaggcccaucccagcc

SEQ ID NO: 217512 - RNA, 19 nt, Human
aggagccagaaccuggaag

SEQ ID NO: 217513 - RNA, 19 nt, Human
aggaggcugagacagcaga

SEQ ID NO: 217514 - RNA, 24 nt, Human
aggcgacgggaagucccacuucuu

SEQ ID NO: 217515 - RNA, 21 nt, Human
aggcggagguugcagugagcc

SEQ ID NO: 217516 - RNA, 24 nt, Human
aggcggagguugcagugagccgag

SEQ ID NO: 217517 - RNA, 23 nt, Human
aggcuuuuuuauuuuuagaccuu

SEQ ID NO: 217518 - RNA, 21 nt, Human
agguagaaauugcaagucaag

SEQ ID NO: 217519 - RNA, 18 nt, Human
aguaaguggggaaaacuc

SEQ ID NO: 217520 - RNA, 24 nt, Human
aucacgccauugcacuccagccug

SEQ ID NO: 217521 - RNA, 21 nt, Human
augaagcccugagcugaugcu

SEQ ID NO: 217522 - RNA, 24 nt, Human
augaauccagaaaggaagcuucau

SEQ ID NO: 217523 - RNA, 21 nt, Human
auugcacuccagccuggguga

SEQ ID NO: 217524 - RNA, 24 nt, Human
auugcacuccagccugggugacag

SEQ ID NO: 217525 - RNA, 18 nt, Human
caagacaaaggccccuuc

SEQ ID NO: 217526 - RNA, 24 nt, Human
caagacaaaggccccuucccaagc

SEQ ID NO: 217527 - RNA, 22 nt, Human
cacacacacuggacacacucac

SEQ ID NO: 217528 - RNA, 31 nt, Human
cacacacaugcacacacucgcacacaugcag

SEQ ID NO: 217529 - RNA, 30 nt, Human
cacacacgcacauacacacuugcacacaca

SEQ ID NO: 217530 - RNA, 19 nt, Human
cacacagacacuugcacac

SEQ ID NO: 217531 - RNA, 29 nt, Human
cacacgcacauacacacuugcacacacac

SEQ ID NO: 217532 - RNA, 22 nt, Human
cacagagccucucaugcugugc

SEQ ID NO: 217533 - RNA, 29 nt, Human
cacaugcacacacucgcacacaugcacac

SEQ ID NO: 217534 - RNA, 23 nt, Human
cacaugcacacacugcacacaca

SEQ ID NO: 217535 - RNA, 19 nt, Human
caccacugaggaaccacaa

SEQ ID NO: 217536 - RNA, 26 nt, Human
cacgcacacgugcacacacuugcaca

SEQ ID NO: 217537 - RNA, 20 nt, Human
cacuccagccugggugacag

SEQ ID NO: 217538 - RNA, 22 nt, Human
cacuccagccugggugacagag

SEQ ID NO: 217539 - RNA, 23 nt, Human
cacuccagccugggugacagagc

SEQ ID NO: 217540 - RNA, 24 nt, Human
cacuccagccugggugacagagcg

SEQ ID NO: 217541 - RNA, 31 nt, Human
cacugcacacacauggacacacgcacacaca

SEQ ID NO: 217542 - RNA, 25 nt, Human
cacuugcacacacucgcacacacgc

SEQ ID NO: 217543 - RNA, 24 nt, Human
cagaaggcuuuuuuauuuuuagac

SEQ ID NO: 217544 - RNA, 23 nt, Human
cagcagaugcaauaacaagagau

SEQ ID NO: 217545 - RNA, 19 nt, Human
cagccagcaauguugccca

SEQ ID NO: 217546 - RNA, 22 nt, Human
cagccugggaaaucggaacuga

SEQ ID NO: 217547 - RNA, 20 nt, Human
cagcucugucgggaaggagc

SEQ ID NO: 217548 - RNA, 19 nt, Human
cagggacccuguccuaagg

SEQ ID NO: 217549 - RNA, 24 nt, Human
cagugguuccuccccgucaggccu

SEQ ID NO: 217550 - RNA, 19 nt, Human
cauugcacuccagccuggg

SEQ ID NO: 217551 - RNA, 19 nt, Human
cauugcacuccagccuggg

SEQ ID NO: 217552 - RNA, 21 nt, Human
cauugcacuccagccugggug

SEQ ID NO: 217553 - RNA, 22 nt, Human
cauugcacuccagccuggguga

SEQ ID NO: 217554 - RNA, 24 nt, Human
cauugcacuccagccugggugaca

SEQ ID NO: 217555 - RNA, 25 nt, Human
cauugcacuccagccugggugacag

SEQ ID NO: 217556 - RNA, 19 nt, Human
ccagccagcaauguugccc

SEQ ID NO: 217557 - RNA, 20 nt, Human
ccauugcacuccagccuggg

SEQ ID NO: 217558 - RNA, 21 nt, Human
ccauugcacuccagccugggu

SEQ ID NO: 217559 - RNA, 21 nt, Human
ccauugcacuccagccugggu

SEQ ID NO: 217560 - RNA, 22 nt, Human
ccauugcacuccagccugggug

SEQ ID NO: 217561 - RNA, 23 nt, Human
ccauugcacuccagccuggguga

SEQ ID NO: 217562 - RNA, 24 nt, Human
ccauugcacuccagccugggugac

SEQ ID NO: 217563 - RNA, 19 nt, Human
cccaaagacaggaagcagg

SEQ ID NO: 217564 - RNA, 22 nt, Human
cccaaagacaggaagcaggccc

SEQ ID NO: 217565 - RNA, 26 nt, Human
cccaagcaagacguuuucucccaaag

SEQ ID NO: 217566 - RNA, 19 nt, Human
cccacgaugaagcccugag

SEQ ID NO: 217567 - RNA, 24 nt, Human
cccacgcacaagggagcccaggca

SEQ ID NO: 217568 - RNA, 25 nt, Human
ccccugagcacacacaugcacacag

SEQ ID NO: 217569 - RNA, 21 nt, Human
ccccugagcacacacaugguc

SEQ ID NO: 217570 - RNA, 20 nt, Human
ccuacccacacgccagagac

SEQ ID NO: 217571 - RNA, 22 nt, Human
ccucccuagagggcgcuccucc

SEQ ID NO: 217572 - RNA, 22 nt, Human
ccugggugacagagcgagacuc

SEQ ID NO: 217573 - RNA, 21 nt, Human
ccuguagucccagcuacucag

SEQ ID NO: 217574 - RNA, 22 nt, Human
ccuguagucccagcuacucagg

SEQ ID NO: 217575 - RNA, 22 nt, Human
cgagugcacaugcacgcacacg

SEQ ID NO: 217576 - RNA, 22 nt, Human
cgcacacacacuggacacacuc

SEQ ID NO: 217577 - RNA, 23 nt, Human
cgcacacacgcacauacacacuu

SEQ ID NO: 217578 - RNA, 28 nt, Human
cgcacacacgcacauacacacuugcaca

SEQ ID NO: 217579 - RNA, 27 nt, Human
cgcacacaugcacacacugcacacaca

SEQ ID NO: 217580 - RNA, 26 nt, Human
cgcacacaugcacacacugcacacag

SEQ ID NO: 217581 - RNA, 23 nt, Human
cgcacacgcacacgugcacacac

SEQ ID NO: 217582 - RNA, 24 nt, Human
cgggaggcggagguugcagugagc

SEQ ID NO: 217583 - RNA, 20 nt, Human
cgggggagaagaaguccaag

SEQ ID NO: 217584 - RNA, 18 nt, Human
cucaaaaaaaaaaaaaag

SEQ ID NO: 217585 - RNA, 25 nt, Human
cucaaaaaaaaaaaaaagaaaagaa

SEQ ID NO: 217586 - RNA, 18 nt, Human
cucaaaacacaaucuuga

SEQ ID NO: 217587 - RNA, 21 nt, Human
cucacacaugggcgugcgagu

SEQ ID NO: 217588 - RNA, 19 nt, Human
cuccgucucaaaaaaaaaa

SEQ ID NO: 217589 - RNA, 21 nt, Human
cuccugguuccacccacggcu

SEQ ID NO: 217590 - RNA, 22 nt, Human
cuccugguuccacccacggcuu

SEQ ID NO: 217591 - RNA, 22 nt, Human
cugaugcugacaugacacuaau

SEQ ID NO: 217592 - RNA, 22 nt, Human
cuggccaccgagaggcagcucu

SEQ ID NO: 217593 - RNA, 21 nt, Human
cuucucacgcgaagcuggaga

SEQ ID NO: 217594 - RNA, 21 nt, Human
cuuguguguguguaugugugu

SEQ ID NO: 217595 - RNA, 21 nt, Human
gaagacagguggggaugagca

SEQ ID NO: 217596 - RNA, 21 nt, Human
gaagcccugagcugaugcuga

SEQ ID NO: 217597 - RNA, 21 nt, Human
gacacuaauucacuggaaacg

SEQ ID NO: 217598 - RNA, 24 nt, Human
gacagagcgagacuccgucucaaa

SEQ ID NO: 217599 - RNA, 23 nt, Human
gagaucacgccauugcacuccag

SEQ ID NO: 217600 - RNA, 18 nt, Human
gagccagaaccuggaagg

SEQ ID NO: 217601 - RNA, 22 nt, Human
gagguugcagugagccgagauc

SEQ ID NO: 217602 - RNA, 20 nt, Human
gaugucugagaaauauuggu

SEQ ID NO: 217603 - RNA, 30 nt, Human
gcacacacaugcacacacucgcacacaugg

SEQ ID NO: 217604 - RNA, 23 nt, Human
gcaccacugaggaaccacaagga

SEQ ID NO: 217605 - RNA, 24 nt, Human
gcacuccagccugggugacagagc

SEQ ID NO: 217606 - RNA, 18 nt, Human
gcagugguuccuccccgu

SEQ ID NO: 217607 - RNA, 19 nt, Human
gccauugcacuccagccug

SEQ ID NO: 217608 - RNA, 24 nt, Human
gccauugcacuccagccuggguga

SEQ ID NO: 217609 - RNA, 24 nt, Human
gcccugaagcccacccucugggau

SEQ ID NO: 217610 - RNA, 21 nt, Human
gccgcaccggggccauguccc

SEQ ID NO: 217611 - RNA, 22 nt, Human
gccgggcgagguggcgugugcc

SEQ ID NO: 217612 - RNA, 33 nt, Human
gcgugcgagugcacaugcacgcacacgcacagu

SEQ ID NO: 217613 - RNA, 22 nt, Human
gcuccagcaggccgcaggcucc

SEQ ID NO: 217614 - RNA, 20 nt, Human
ggaaacgagggugauggggg

SEQ ID NO: 217615 - RNA, 21 nt, Human
ggaaacgagggugaugggggc

SEQ ID NO: 217616 - RNA, 18 nt, Human
ggaaggaggugaaccagg

SEQ ID NO: 217617 - RNA, 21 nt, Human
ggagaagaaguccaaggcaaa

SEQ ID NO: 217618 - RNA, 24 nt, Human
ggagaagaaguccaaggcaaagag

SEQ ID NO: 217619 - RNA, 20 nt, Human
ggagaagggagacugaggcc

SEQ ID NO: 217620 - RNA, 24 nt, Human
ggagaagggagacugaggccuggg

SEQ ID NO: 217621 - RNA, 19 nt, Human
ggagacugaggccuggggg

SEQ ID NO: 217622 - RNA, 20 nt, Human
ggagacugaggccugggggu

SEQ ID NO: 217623 - RNA, 20 nt, Human
ggagguugcagugagccgag

SEQ ID NO: 217624 - RNA, 22 nt, Human
ggagguugcagugagccgagau

SEQ ID NO: 217625 - RNA, 23 nt, Human
ggagguugcagugagccgagauc

SEQ ID NO: 217626 - RNA, 24 nt, Human
ggagguugcagugagccgagauca

SEQ ID NO: 217627 - RNA, 31 nt, Human
ggcgugcgagugcacaugcacgcacacggug

SEQ ID NO: 217628 - RNA, 25 nt, Human
gggagaagaaguccaaggcaaagag

SEQ ID NO: 217629 - RNA, 27 nt, Human
gggagaagggagacugaggccuggggg

SEQ ID NO: 217630 - RNA, 18 nt, Human
gggagcuguugaagacag

SEQ ID NO: 217631 - RNA, 18 nt, Human
gggcagaguccugcuggc

SEQ ID NO: 217632 - RNA, 19 nt, Human
gggcgagguggcgugugcc

SEQ ID NO: 217633 - RNA, 18 nt, Human
ggggacuucucacgcgaa

SEQ ID NO: 217634 - RNA, 25 nt, Human
ggggagaagaaguccaaggcaaaga

SEQ ID NO: 217635 - RNA, 27 nt, Human
ggugaugggggcacagaagggagggcc

SEQ ID NO: 217636 - RNA, 23 nt, Human
gguggcgugugccuguaguccca

SEQ ID NO: 217637 - RNA, 20 nt, Human
gucucaaaaaaaaaaaaaag

SEQ ID NO: 217638 - RNA, 25 nt, Human
gugcacaugcacgcacacgcacacg

SEQ ID NO: 217639 - RNA, 19 nt, Human
guugcagugagccgagauc

SEQ ID NO: 217640 - RNA, 19 nt, Human
uaacaagagaugaaaauag

SEQ ID NO: 217641 - RNA, 27 nt, Human
uaacaagagaugaaaauaggggacccc

SEQ ID NO: 217642 - RNA, 21 nt, Human
uaaguaaguggggaaaacucg

SEQ ID NO: 217643 - RNA, 25 nt, Human
uacacacuugcacacacacaaaugg

SEQ ID NO: 217644 - RNA, 23 nt, Human
uacacucacacaauggaauacua

SEQ ID NO: 217645 - RNA, 24 nt, Human
uagaaagaucgggccgggcgaggu

SEQ ID NO: 217646 - RNA, 18 nt, Human
uauaaaagaaugaaaaag

SEQ ID NO: 217647 - RNA, 22 nt, Human
uauccauccaaaaaauuaaagu

SEQ ID NO: 217648 - RNA, 20 nt, Human
uaugguacacucacacaaug

SEQ ID NO: 217649 - RNA, 22 nt, Human
uauguguguggugugugcacac

SEQ ID NO: 217650 - RNA, 24 nt, Human
uauguguguggugugugcacacgu

SEQ ID NO: 217651 - RNA, 21 nt, Human
uauuguccauguauuucuagg

SEQ ID NO: 217652 - RNA, 22 nt, Human
ucacccacaggauugaccgucc

SEQ ID NO: 217653 - RNA, 23 nt, Human
ucacgccauugcacuccagccug

SEQ ID NO: 217654 - RNA, 25 nt, Human
uccaaaaaauuaaagucacauugaa

SEQ ID NO: 217655 - RNA, 19 nt, Human
uccacccacggcuuuucuc

SEQ ID NO: 217656 - RNA, 23 nt, Human
uccagccugggugacagagcgag

SEQ ID NO: 217657 - RNA, 24 nt, Human
uccagccugggugacagagcgaga

SEQ ID NO: 217658 - RNA, 22 nt, Human
ucccaaagacaggaagcaggcc

SEQ ID NO: 217659 - RNA, 18 nt, Human
ucccucucucuucaccca

SEQ ID NO: 217660 - RNA, 20 nt, Human
ucccucucucuucacccaca

SEQ ID NO: 217661 - RNA, 22 nt, Human
uccgucucaaaaaaaaaaaaaa

SEQ ID NO: 217662 - RNA, 23 nt, Human
uccgucucaaaaaaaaaaaaaag

SEQ ID NO: 217663 - RNA, 25 nt, Human
uccgucucaaaaaaaaaaaaaagaa

SEQ ID NO: 217664 - RNA, 22 nt, Human
ucgcgggggagaagaaguccaa

SEQ ID NO: 217665 - RNA, 23 nt, Human
ucucacucccaauucagccuggg

SEQ ID NO: 217666 - RNA, 23 nt, Human
ucucaugcugugcgcccugaagc

SEQ ID NO: 217667 - RNA, 23 nt, Human
ucucccaaagacaggaagcaggc

SEQ ID NO: 217668 - RNA, 21 nt, Human
ucugaaggaaaccucaaaaca

SEQ ID NO: 217669 - RNA, 23 nt, Human
ucugagcuccugggccguugcag

SEQ ID NO: 217670 - RNA, 21 nt, Human
ucuucugccccuggggcuggg

SEQ ID NO: 217671 - RNA, 24 nt, Human
ugaaaaaaagcaagauacagacca

SEQ ID NO: 217672 - RNA, 25 nt, Human
ugaaauaauaaaugaauccagaaag

SEQ ID NO: 217673 - RNA, 19 nt, Human
ugaagacagguggggauga

SEQ ID NO: 217674 - RNA, 25 nt, Human
ugacaagacaaaggccccuucccaa

SEQ ID NO: 217675 - RNA, 20 nt, Human
ugagacagcagaauuacuug

SEQ ID NO: 217676 - RNA, 24 nt, Human
ugagacagcagaauuacuugaacc

SEQ ID NO: 217677 - RNA, 27 nt, Human
ugagcacacacaugcacacacucgcac

SEQ ID NO: 217678 - RNA, 22 nt, Human
ugagccgagaucacgccauugc

SEQ ID NO: 217679 - RNA, 19 nt, Human
ugagcugaugcugacauga

SEQ ID NO: 217680 - RNA, 23 nt, Human
ugagcugaugcugacaugacacu

SEQ ID NO: 217681 - RNA, 18 nt, Human
ugcaagucaaguccuuug

SEQ ID NO: 217682 - RNA, 19 nt, Human
ugcaauaacaagagaugaa

SEQ ID NO: 217683 - RNA, 26 nt, Human
ugcacacacauggacacacgcacaca

SEQ ID NO: 217684 - RNA, 25 nt, Human
ugcacacacucacacaugggcgugc

SEQ ID NO: 217685 - RNA, 21 nt, Human
ugcacacacucacacauggug

SEQ ID NO: 217686 - RNA, 26 nt, Human
ugcacacacucgcacacacgcacaua

SEQ ID NO: 217687 - RNA, 29 nt, Human
ugcacacacugcacacacauggacacacg

SEQ ID NO: 217688 - RNA, 20 nt, Human
ugcacacagacacuugcaca

SEQ ID NO: 217689 - RNA, 22 nt, Human
ugcacacagacacuugcacaca

SEQ ID NO: 217690 - RNA, 24 nt, Human
ugcacacagacacuugcacacacu

SEQ ID NO: 217691 - RNA, 22 nt, Human
ugcacuccagccugggugacag

SEQ ID NO: 217692 - RNA, 24 nt, Human
ugcacuccagccugggugacagag

SEQ ID NO: 217693 - RNA, 18 nt, Human
ugccgucaccuacccaca

SEQ ID NO: 217694 - RNA, 24 nt, Human
ugccuguagucccagcuacucagg

SEQ ID NO: 217695 - RNA, 21 nt, Human
uggaaagggagacuuuucacu

SEQ ID NO: 217696 - RNA, 20 nt, Human
uggaagcccaagcccguccu

SEQ ID NO: 217697 - RNA, 20 nt, Human
uggaagcccaagcccguccu

SEQ ID NO: 217698 - RNA, 19 nt, Human
uggaaggagccagaaccug

SEQ ID NO: 217699 - RNA, 21 nt, Human
uggaaggaggugaaccagggg

SEQ ID NO: 217700 - RNA, 20 nt, Human
uggaauacuaugcagcggua

SEQ ID NO: 217701 - RNA, 25 nt, Human
uggacacacgcacacacacuggaca

SEQ ID NO: 217702 - RNA, 26 nt, Human
uggacacacgcacacacacuggacac

SEQ ID NO: 217703 - RNA, 24 nt, Human
uggcgugugccuguagucccagcu

SEQ ID NO: 217704 - RNA, 18 nt, Human
uggggaaaacucgcgggg

SEQ ID NO: 217705 - RNA, 19 nt, Human
uggucugggcagaguccug

SEQ ID NO: 217706 - RNA, 27 nt, Human
ugguguggaggaggcuccugguuccac

SEQ ID NO: 217707 - RNA, 26 nt, Human
ugugcacacgugcauacacuugcaca

SEQ ID NO: 217708 - RNA, 21 nt, Human
ugugcagaacccagcaugcag

SEQ ID NO: 217709 - RNA, 20 nt, Human
uguggagcucugagcuccug

SEQ ID NO: 217710 - RNA, 20 nt, Human
uguguaaaaaagcuugugug

SEQ ID NO: 217711 - RNA, 26 nt, Human
ugugugcacacgugcauacacuugca

SEQ ID NO: 217712 - RNA, 22 nt, Human
uguguggugugugcacacgugc

SEQ ID NO: 217713 - RNA, 27 nt, Human
uguguggugugugcacacgugcauaca

SEQ ID NO: 217714 - RNA, 22 nt, Human
uguguguauguguguggugugu

SEQ ID NO: 217715 - RNA, 25 nt, Human
uguguguauguguguggugugugca

SEQ ID NO: 217716 - RNA, 20 nt, Human
uguguguggugugugcacac

SEQ ID NO: 217717 - RNA, 19 nt, Human
uguguguguguaugugugu

SEQ ID NO: 217718 - RNA, 20 nt, Human
uguguguguguaugugugug

SEQ ID NO: 217719 - RNA, 20 nt, Human
uguguguguguaugugugug

SEQ ID NO: 217720 - RNA, 24 nt, Human
uuacuugaacccgggaggcggagg

SEQ ID NO: 217721 - RNA, 21 nt, Human
uucacuggaaacgagggugau

SEQ ID NO: 217722 - RNA, 24 nt, Human
uugaacccgggaggcggagguugc

SEQ ID NO: 217723 - RNA, 18 nt, Human
uugcagugagccgagauc

SEQ ID NO: 217724 - RNA, 20 nt, Human
uugcagugagccgagaucac

SEQ ID NO: 217725 - RNA, 21 nt, Human
uugcagugagccgagaucacg

SEQ ID NO: 217726 - RNA, 27 nt, Human
uuuuuuuuuuuuuuuuuuuuuuugggg

SEQ ID NO: 217727 - RNA, 22 nt, Human
aaaaaucuauacuccaagaccc

SEQ ID NO: 217728 - RNA, 19 nt, Human
aaaaggaauagauggcaca

SEQ ID NO: 217729 - RNA, 25 nt, Human
aaaaucccaccauuuucuucagaaa

SEQ ID NO: 217730 - RNA, 25 nt, Human
aaacaacaacaacaacaacaacaac

SEQ ID NO: 217731 - RNA, 23 nt, Human
aaacagaaguguaauaggauccu

SEQ ID NO: 217732 - RNA, 23 nt, Human
aaacagaaguguaauaggaucua

SEQ ID NO: 217733 - RNA, 18 nt, Human
aaauaugguaguauuuca

SEQ ID NO: 217734 - RNA, 24 nt, Human
aacaacaacaacaacaacaacaac

SEQ ID NO: 217735 - RNA, 27 nt, Human
aacaacaacaacaacaacaacaacaac

SEQ ID NO: 217736 - RNA, 27 nt, Human
aacaacaacaacaacaacaacaacaac

SEQ ID NO: 217737 - RNA, 22 nt, Human
aacaugauguaauugcacaaaa

SEQ ID NO: 217738 - RNA, 21 nt, Human
aagauguagcauaacuuaaaa

SEQ ID NO: 217739 - RNA, 20 nt, Human
aauagaagguuuugucuaga

SEQ ID NO: 217740 - RNA, 27 nt, Human
acaacaacaacaaauaaaguuccguac

SEQ ID NO: 217741 - RNA, 19 nt, Human
acaacaacaacaacaacaa

SEQ ID NO: 217742 - RNA, 19 nt, Human
acaacaacaacaacaacaa

SEQ ID NO: 217743 - RNA, 19 nt, Human
acaacaacaacaacaacaa

SEQ ID NO: 217744 - RNA, 19 nt, Human
acaacaacaacaacaacaa

SEQ ID NO: 217745 - RNA, 19 nt, Human
acaacaacaacaacaacaa

SEQ ID NO: 217746 - RNA, 23 nt, Human
acaacaacaacaacaacaaauaa

SEQ ID NO: 217747 - RNA, 22 nt, Human
acaacaacaacaacaacaacaa

SEQ ID NO: 217748 - RNA, 22 nt, Human
acaacaacaacaacaacaacaa

SEQ ID NO: 217749 - RNA, 24 nt, Human
acagagccauauaaaacuacaacu

SEQ ID NO: 217750 - RNA, 22 nt, Human
acagcaucuuucaaucuccaau

SEQ ID NO: 217751 - RNA, 18 nt, Human
acaguaacugaaggaggu

SEQ ID NO: 217752 - RNA, 18 nt, Human
accaaugucaaauguuuu

SEQ ID NO: 217753 - RNA, 21 nt, Human
agaaaagagaaacagaaaaaa

SEQ ID NO: 217754 - RNA, 21 nt, Human
agaaacagaaaaaaugacuca

SEQ ID NO: 217755 - RNA, 24 nt, Human
agaaguguaauaggaucuaccaga

SEQ ID NO: 217756 - RNA, 21 nt, Human
agagaaaagagaaacagaaaa

SEQ ID NO: 217757 - RNA, 23 nt, Human
agagaaaagagaaacagaaaaaa

SEQ ID NO: 217758 - RNA, 20 nt, Human
agaugccauaaaaggaauag

SEQ ID NO: 217759 - RNA, 18 nt, Human
agccauuugugauuaugg

SEQ ID NO: 217760 - RNA, 21 nt, Human
agccgagacugauuuuacaca

SEQ ID NO: 217761 - RNA, 24 nt, Human
aggugaaauuaaacaauuacacaa

SEQ ID NO: 217762 - RNA, 19 nt, Human
aguaaaucaggcacuaccu

SEQ ID NO: 217763 - RNA, 21 nt, Human
auaucauguuaauuucuaaau

SEQ ID NO: 217764 - RNA, 25 nt, Human
aucaauaucaguaucaauauuucuu

SEQ ID NO: 217765 - RNA, 18 nt, Human
aucucaaagaacuacaca

SEQ ID NO: 217766 - RNA, 20 nt, Human
augagugauuaaaaaaaucc

SEQ ID NO: 217767 - RNA, 23 nt, Human
caaaauaucaauucugaaauaaa

SEQ ID NO: 217768 - RNA, 18 nt, Human
caacaacaacaacaacaa

SEQ ID NO: 217769 - RNA, 18 nt, Human
caacaacaacaacaacaa

SEQ ID NO: 217770 - RNA, 18 nt, Human
caacaacaacaacaacaa

SEQ ID NO: 217771 - RNA, 18 nt, Human
caacaacaacaacaacaa

SEQ ID NO: 217772 - RNA, 25 nt, Human
caacaacaacaacaacaacaaauaa

SEQ ID NO: 217773 - RNA, 23 nt, Human
caacaacaacaacaacaacaaca

SEQ ID NO: 217774 - RNA, 23 nt, Human
caacaacaacaacaacaacaaca

SEQ ID NO: 217775 - RNA, 25 nt, Human
caacaacaacaacaacaacaacaaa

SEQ ID NO: 217776 - RNA, 23 nt, Human
cagagccauauaaaacuacaacu

SEQ ID NO: 217777 - RNA, 24 nt, Human
cauugaauaaaaacuaucccuuga

SEQ ID NO: 217778 - RNA, 20 nt, Human
ccaagccgggagcgguagcc

SEQ ID NO: 217779 - RNA, 28 nt, Human
ccaaugucaaauguuuuuaauaucuucu

SEQ ID NO: 217780 - RNA, 19 nt, Human
ccuaaaaacacaagucacc

SEQ ID NO: 217781 - RNA, 19 nt, Human
cgccaagccgggagcggua

SEQ ID NO: 217782 - RNA, 21 nt, Human
cuagaguccuaccuuguauac

SEQ ID NO: 217783 - RNA, 22 nt, Human
cuaguucauucauguuuucuua

SEQ ID NO: 217784 - RNA, 20 nt, Human
cuaucucaaagaacuacaca

SEQ ID NO: 217785 - RNA, 18 nt, Human
cugcuuuaaaacaacaac

SEQ ID NO: 217786 - RNA, 21 nt, Human
cuugacccauucucaguaaca

SEQ ID NO: 217787 - RNA, 26 nt, Human
gacugcuuuaaaacaacaacaacaac

SEQ ID NO: 217788 - RNA, 23 nt, Human
gcuaaaauagaagguuuugucua

SEQ ID NO: 217789 - RNA, 23 nt, Human
gugggucaagauguagcauaacu

SEQ ID NO: 217790 - RNA, 18 nt, Human
uaaaaacacaagucaccc

SEQ ID NO: 217791 - RNA, 21 nt, Human
uaaaacacagcaaaauaguca

SEQ ID NO: 217792 - RNA, 18 nt, Human
uaaaguaguaaaucaggc

SEQ ID NO: 217793 - RNA, 22 nt, Human
uaaaguaguaaaucaggcacua

SEQ ID NO: 217794 - RNA, 19 nt, Human
uaaauagccagacuaaaac

SEQ ID NO: 217795 - RNA, 22 nt, Human
uaaaucauauauuccucuagaa

SEQ ID NO: 217796 - RNA, 22 nt, Human
uaacuaaaaacucugcucuacu

SEQ ID NO: 217797 - RNA, 19 nt, Human
uaacugaucaucaucccca

SEQ ID NO: 217798 - RNA, 20 nt, Human
uaagcaacuaucucaaagaa

SEQ ID NO: 217799 - RNA, 22 nt, Human
uacuaaaacaaaauauuguacc

SEQ ID NO: 217800 - RNA, 18 nt, Human
uagagauuuaaaguuuuc

SEQ ID NO: 217801 - RNA, 24 nt, Human
uagcacuaucagcaguaaagccuu

SEQ ID NO: 217802 - RNA, 25 nt, Human
uagccagacuaaaacaauggaauaa

SEQ ID NO: 217803 - RNA, 20 nt, Human
uaucagcaguaaagccuugg

SEQ ID NO: 217804 - RNA, 19 nt, Human
ucuaacacuuuugccaaag

SEQ ID NO: 217805 - RNA, 22 nt, Human
ucuacagagccauauaaaacua

SEQ ID NO: 217806 - RNA, 24 nt, Human
ugacagccgagacugauuuuacac

SEQ ID NO: 217807 - RNA, 24 nt, Human
ugccauaaaaggaauagauggcac

SEQ ID NO: 217808 - RNA, 22 nt, Human
uggaauaaauaugcuuuggaaa

SEQ ID NO: 217809 - RNA, 20 nt, Human
uggaugguaucauguaugug

SEQ ID NO: 217810 - RNA, 18 nt, Human
uggcacaaaagcaaauuc

SEQ ID NO: 217811 - RNA, 23 nt, Human
uggcacaaaagcaaauucuaaca

SEQ ID NO: 217812 - RNA, 19 nt, Human
ugguuaaugccaauuagca

SEQ ID NO: 217813 - RNA, 24 nt, Human
ugucaacuguaaagauuucucacu

SEQ ID NO: 217814 - RNA, 21 nt, Human
ugucugaacuuauuuauaagg

SEQ ID NO: 217815 - RNA, 22 nt, Human
uguggcuuuuauuaauaauccu

SEQ ID NO: 217816 - RNA, 19 nt, Human
uuaaaacaacaacaacaac

SEQ ID NO: 217817 - RNA, 26 nt, Human
uuaaucaugauaaaaaaaaaucccac

SEQ ID NO: 217818 - RNA, 22 nt, Human
uucaaaauggauuuuuauucuc

SEQ ID NO: 217819 - RNA, 23 nt, Human
uugaaggauuugaccuaaaauuu

SEQ ID NO: 217820 - RNA, 20 nt, Human
uugcuaauucuaguggguca

SEQ ID NO: 217821 - RNA, 20 nt, Human
uuuaaaguuuucauagggca

SEQ ID NO: 217822 - RNA, 24 nt, Human
aaaaggcaaauugaccgcuaaaac

SEQ ID NO: 217823 - RNA, 22 nt, Human
aaagaugaauacacaaaggcca

SEQ ID NO: 217824 - RNA, 24 nt, Human
aaaggucaaaaaggcacaauguga

SEQ ID NO: 217825 - RNA, 23 nt, Human
aaauacugaagauuggcauugcu

SEQ ID NO: 217826 - RNA, 21 nt, Human
aagugaacuguuaaaacuaaa

SEQ ID NO: 217827 - RNA, 18 nt, Human
aauggaaucauauaguau

SEQ ID NO: 217828 - RNA, 21 nt, Human
acaagcuugguauauaaccuu

SEQ ID NO: 217829 - RNA, 19 nt, Human
acucauaaaaaagucuuac

SEQ ID NO: 217830 - RNA, 22 nt, Human
acuucaaagaaaaaguacucau

SEQ ID NO: 217831 - RNA, 21 nt, Human
acuuuggauucugcauaacug

SEQ ID NO: 217832 - RNA, 23 nt, Human
agacauuaaacaaaauaaaaaua

SEQ ID NO: 217833 - RNA, 23 nt, Human
agacucgcguaggugagagcugu

SEQ ID NO: 217834 - RNA, 26 nt, Human
agcaaccacugauuuuugccccuaca

SEQ ID NO: 217835 - RNA, 22 nt, Human
agcuuuaaaaaaaguuaccaaa

SEQ ID NO: 217836 - RNA, 20 nt, Human
aggaagaaaaggucaaaaag

SEQ ID NO: 217837 - RNA, 20 nt, Human
aggcacaaugugaccuuagc

SEQ ID NO: 217838 - RNA, 19 nt, Human
aggggccguucgggcccgg

SEQ ID NO: 217839 - RNA, 18 nt, Human
aguuaccaaaaaaaaaua

SEQ ID NO: 217840 - RNA, 26 nt, Human
augaaaaggcagauuuaggaucaaaa

SEQ ID NO: 217841 - RNA, 19 nt, Human
augaaccagaauauacaug

SEQ ID NO: 217842 - RNA, 19 nt, Human
caaaagguccccauucagc

SEQ ID NO: 217843 - RNA, 25 nt, Human
caaacaaauacauuaaaagauuaga

SEQ ID NO: 217844 - RNA, 22 nt, Human
caaagcacucaaugcuaacaua

SEQ ID NO: 217845 - RNA, 18 nt, Human
caaggacuuuuuagcaga

SEQ ID NO: 217846 - RNA, 21 nt, Human
caagucaucccaaggaagauc

SEQ ID NO: 217847 - RNA, 25 nt, Human
caauccuuaacuagcuagcaggaca

SEQ ID NO: 217848 - RNA, 27 nt, Human
cagcaaauacuuuguaaaguauggccu

SEQ ID NO: 217849 - RNA, 19 nt, Human
cagccccuagcaaccacug

SEQ ID NO: 217850 - RNA, 21 nt, Human
cagccccuagcaaccacugau

SEQ ID NO: 217851 - RNA, 22 nt, Human
cccccgcagcuccggcagcccc

SEQ ID NO: 217852 - RNA, 18 nt, Human
cccgcagcuccggcagcc

SEQ ID NO: 217853 - RNA, 18 nt, Human
cccucauacuucggauug

SEQ ID NO: 217854 - RNA, 18 nt, Human
cccucauacuucggauug

SEQ ID NO: 217855 - RNA, 18 nt, Human
ccgacgugacagcgccca

SEQ ID NO: 217856 - RNA, 20 nt, Human
ccgcagcuccggcagccccg

SEQ ID NO: 217857 - RNA, 21 nt, Human
ccuacaguuuugcuuuuccag

SEQ ID NO: 217858 - RNA, 19 nt, Human
ccucccgggugucgggcgc

SEQ ID NO: 217859 - RNA, 18 nt, Human
ccucuguggucaacacuu

SEQ ID NO: 217860 - RNA, 21 nt, Human
cgcgcggcguccggggcccgg

SEQ ID NO: 217861 - RNA, 18 nt, Human
cgcggcguccggggcccg

SEQ ID NO: 217862 - RNA, 21 nt, Human
cggugggcucgggccugcugu

SEQ ID NO: 217863 - RNA, 21 nt, Human
cguauuuuacaccagcaacuc

SEQ ID NO: 217864 - RNA, 21 nt, Human
cguucggaacgcggcugggcu

SEQ ID NO: 217865 - RNA, 26 nt, Human
cuaacaggcaaauagcaaaauaacag

SEQ ID NO: 217866 - RNA, 22 nt, Human
cucaacauacuugucuuucaga

SEQ ID NO: 217867 - RNA, 19 nt, Human
cucauacuucggauugacc

SEQ ID NO: 217868 - RNA, 19 nt, Human
cucauacuucggauugacc

SEQ ID NO: 217869 - RNA, 24 nt, Human
cucccgcgggcuggcggggccucc

SEQ ID NO: 217870 - RNA, 21 nt, Human
cucccgggugucgggcgcggc

SEQ ID NO: 217871 - RNA, 25 nt, Human
gaaacucucaucaugcucauuacuu

SEQ ID NO: 217872 - RNA, 22 nt, Human
gaacuguuaaaacuaaaggcac

SEQ ID NO: 217873 - RNA, 22 nt, Human
gaagaggugauagaaagcacca

SEQ ID NO: 217874 - RNA, 21 nt, Human
gaugaaaaggcagauuuagga

SEQ ID NO: 217875 - RNA, 20 nt, Human
gcuaaaacuucaaagaaaaa

SEQ ID NO: 217876 - RNA, 21 nt, Human
ggccugcuguuccgcgacucc

SEQ ID NO: 217877 - RNA, 21 nt, Human
ggcguccggggcccggcgcgg

SEQ ID NO: 217878 - RNA, 23 nt, Human
gggaauaaaauacuuagaaagga

SEQ ID NO: 217879 - RNA, 20 nt, Human
gugaacuguuaaaacuaaag

SEQ ID NO: 217880 - RNA, 19 nt, Human
uaaaaaagucuuaccccaa

SEQ ID NO: 217881 - RNA, 18 nt, Human
uaaaaauacugaagauug

SEQ ID NO: 217882 - RNA, 24 nt, Human
uaaauaacuucaguaaauagcacu

SEQ ID NO: 217883 - RNA, 22 nt, Human
uaacagaaacucucaucaugcu

SEQ ID NO: 217884 - RNA, 19 nt, Human
uaacugugacuauggaaau

SEQ ID NO: 217885 - RNA, 20 nt, Human
uaagaaaguuuacaaauuug

SEQ ID NO: 217886 - RNA, 22 nt, Human
uaaguaacucuuaaaauggcac

SEQ ID NO: 217887 - RNA, 25 nt, Human
uaccccaaaauugcaaacaaauaca

SEQ ID NO: 217888 - RNA, 18 nt, Human
uaccccacccucugacuc

SEQ ID NO: 217889 - RNA, 18 nt, Human
uaccccacccucugacuc

SEQ ID NO: 217890 - RNA, 24 nt, Human
uacucauaaaaaagucuuacccca

SEQ ID NO: 217891 - RNA, 18 nt, Human
uagcaaaauaacagauuu

SEQ ID NO: 217892 - RNA, 20 nt, Human
uagcaaaauaacagauuuaa

SEQ ID NO: 217893 - RNA, 23 nt, Human
uauguaaauagugcuaaaucaag

SEQ ID NO: 217894 - RNA, 26 nt, Human
uauuguacauuuucaaaaccugcaca

SEQ ID NO: 217895 - RNA, 22 nt, Human
ucagucaugucuaacaggcaaa

SEQ ID NO: 217896 - RNA, 22 nt, Human
uccaggaagaaaaggucaaaaa

SEQ ID NO: 217897 - RNA, 21 nt, Human
ucccgcgggcuggcggggccu

SEQ ID NO: 217898 - RNA, 19 nt, Human
ucggaacgcggcugggcug

SEQ ID NO: 217899 - RNA, 20 nt, Human
ucucaucaugcucauuacuu

SEQ ID NO: 217900 - RNA, 21 nt, Human
ucucccgcgggcuggcggggc

SEQ ID NO: 217901 - RNA, 23 nt, Human
ucuuuuggcuucccugggccaca

SEQ ID NO: 217902 - RNA, 24 nt, Human
ugaaacaagaugggcaacucaaau

SEQ ID NO: 217903 - RNA, 25 nt, Human
ugaaacaagaugggcaacucaaaug

SEQ ID NO: 217904 - RNA, 20 nt, Human
ugaaggcauaaaaguuacca

SEQ ID NO: 217905 - RNA, 22 nt, Human
ugcauagccacaguauaacuuc

SEQ ID NO: 217906 - RNA, 19 nt, Human
uggcauugcuuucuuguau

SEQ ID NO: 217907 - RNA, 20 nt, Human
uggcuucccugggccacacu

SEQ ID NO: 217908 - RNA, 21 nt, Human
uggugagaaguaaacauacag

SEQ ID NO: 217909 - RNA, 23 nt, Human
uggugagaaguaaacauacagug

SEQ ID NO: 217910 - RNA, 24 nt, Human
uguaaagugaaggcauaaaaguua

SEQ ID NO: 217911 - RNA, 25 nt, Human
uguaaauagugcuaaaucaaggacu

SEQ ID NO: 217912 - RNA, 24 nt, Human
ugugaaacaagaugggcaacucaa

SEQ ID NO: 217913 - RNA, 19 nt, Human
uguggucaacacuuucccc

SEQ ID NO: 217914 - RNA, 25 nt, Human
uguuacggcacucuuauaaauagga

SEQ ID NO: 217915 - RNA, 22 nt, Human
uucaaagcacucaaugcuaaca

SEQ ID NO: 217916 - RNA, 18 nt, Human
uucccccauuccagcccc

SEQ ID NO: 217917 - RNA, 18 nt, Human
uucccugggccacacugg

SEQ ID NO: 217918 - RNA, 24 nt, Human
uuggcuucccugggccacacuggc

SEQ ID NO: 217919 - RNA, 21 nt, Human
uugugggauuugcacgggcag

SEQ ID NO: 217920 - RNA, 27 nt, Human
uuuaaaacaauccuuaacuagcuagca

SEQ ID NO: 217921 - RNA, 23 nt, Human
uuucuuguaucaaaagaugaaua

SEQ ID NO: 217922 - RNA, 19 nt, Human
uuuggauucugcauaacug

SEQ ID NO: 217923 - RNA, 20 nt, Human
uuuggcuucccugggccaca

SEQ ID NO: 217924 - RNA, 20 nt, Human
uuuuaaagaaagaagcagcu

SEQ ID NO: 217925 - RNA, 20 nt, Human
uuuuuguuuguuuguuuuaa

SEQ ID NO: 217926 - RNA, 20 nt, Human
aaaaaaacagcaugguuugg

SEQ ID NO: 217927 - RNA, 23 nt, Human
aaaaaacagcaugguuuggacaa

SEQ ID NO: 217928 - RNA, 23 nt, Human
aacaauauccugguaucuaagau

SEQ ID NO: 217929 - RNA, 19 nt, Human
cacauggccaacaauaucc

SEQ ID NO: 217930 - RNA, 18 nt, Human
ccaacaauauccugguau

SEQ ID NO: 217931 - RNA, 18 nt, Human
ccccuccuucagccuccu

SEQ ID NO: 217932 - RNA, 21 nt, Human
cccuccuucagccuccugcug

SEQ ID NO: 217933 - RNA, 23 nt, Human
uaagauucuaagggaaucauuga

SEQ ID NO: 217934 - RNA, 20 nt, Human
ugguuuggacaauuuuguuc

SEQ ID NO: 217935 - RNA, 21 nt, Human
uuggacaauuuuguucucccc

SEQ ID NO: 217936 - RNA, 22 nt, Human
uuguucuccccuccuucagccu

SEQ ID NO: 217937 - RNA, 23 nt, Human
aaacacgcaccuaaccucaccaa

SEQ ID NO: 217938 - RNA, 19 nt, Human
aaucagacugauguccuga

SEQ ID NO: 217939 - RNA, 25 nt, Human
accucaccaaccucaagcccuccuc

SEQ ID NO: 217940 - RNA, 21 nt, Human
agcuguggccaagccaugucu

SEQ ID NO: 217941 - RNA, 23 nt, Human
augguggguccugacggccuugu

SEQ ID NO: 217942 - RNA, 18 nt, Human
cagaguggagcugucccc

SEQ ID NO: 217943 - RNA, 19 nt, Human
caggaaacacgcaccuaac

SEQ ID NO: 217944 - RNA, 22 nt, Human
cauccucaagagcuguggccaa

SEQ ID NO: 217945 - RNA, 18 nt, Human
ccagucagaguggagcug

SEQ ID NO: 217946 - RNA, 20 nt, Human
ccccgacgagcccccagaag

SEQ ID NO: 217947 - RNA, 19 nt, Human
ccgcggcggugcuccuggc

SEQ ID NO: 217948 - RNA, 25 nt, Human
ccucaccaaccucaagcccuccuca

SEQ ID NO: 217949 - RNA, 21 nt, Human
cgacgagcccccagaagcacc

SEQ ID NO: 217950 - RNA, 22 nt, Human
cuaaccucaccaaccucaagcc

SEQ ID NO: 217951 - RNA, 20 nt, Human
ggaaacacgcaccuaaccuc

SEQ ID NO: 217952 - RNA, 22 nt, Human
ggagcuguccccccgacgagcc

SEQ ID NO: 217953 - RNA, 18 nt, Human
ggggcagacauggugggu

SEQ ID NO: 217954 - RNA, 18 nt, Human
guccugacggccuugucu

SEQ ID NO: 217955 - RNA, 20 nt, Human
ucccucggugugcuggaguc

SEQ ID NO: 217956 - RNA, 19 nt, Human
ucuccaugcaaagacugug

SEQ ID NO: 217957 - RNA, 19 nt, Human
uggcugucauuuugagggc

SEQ ID NO: 217958 - RNA, 21 nt, Human
uuugagggcggaaaauaacug

SEQ ID NO: 217959 - RNA, 19 nt, Human
aaagaacagucccucuucc

SEQ ID NO: 217960 - RNA, 20 nt, Human
aaagaauuagcuugcaagga

SEQ ID NO: 217961 - RNA, 20 nt, Human
aacacacagacccccacaua

SEQ ID NO: 217962 - RNA, 23 nt, Human
aaccuaccccacucugagcccca

SEQ ID NO: 217963 - RNA, 21 nt, Human
aacucaugggaauaauuccuu

SEQ ID NO: 217964 - RNA, 18 nt, Human
aagaacaccugcucagcu

SEQ ID NO: 217965 - RNA, 22 nt, Human
aaggagcucagcuuaucaggac

SEQ ID NO: 217966 - RNA, 24 nt, Human
acaaaccuccagaguagagcugcc

SEQ ID NO: 217967 - RNA, 20 nt, Human
acaacacacacacauaaaca

SEQ ID NO: 217968 - RNA, 22 nt, Human
acaaggcagccaagagguagaa

SEQ ID NO: 217969 - RNA, 20 nt, Human
acacacaacacacacacaua

SEQ ID NO: 217970 - RNA, 24 nt, Human
acacacaacacacacacauaaaca

SEQ ID NO: 217971 - RNA, 21 nt, Human
acacacacacauaaacacaca

SEQ ID NO: 217972 - RNA, 21 nt, Human
acacacagacccacacuucca

SEQ ID NO: 217973 - RNA, 20 nt, Human
acacucccacacacaacaca

SEQ ID NO: 217974 - RNA, 22 nt, Human
agacauccccagcucauagcaa

SEQ ID NO: 217975 - RNA, 21 nt, Human
agagauggugcuggccuaagg

SEQ ID NO: 217976 - RNA, 28 nt, Human
agccaagagguagaagguaaagggaccc

SEQ ID NO: 217977 - RNA, 24 nt, Human
agcucauagcaaaugucuacagca

SEQ ID NO: 217978 - RNA, 19 nt, Human
aggaaagcuggcuucucac

SEQ ID NO: 217979 - RNA, 18 nt, Human
aggcauucugggacaaag

SEQ ID NO: 217980 - RNA, 21 nt, Human
aggccaugaaugaccccugag

SEQ ID NO: 217981 - RNA, 24 nt, Human
aggguagagccaaggcuugguguc

SEQ ID NO: 217982 - RNA, 19 nt, Human
agguaaagagauggugcug

SEQ ID NO: 217983 - RNA, 22 nt, Human
agugacuugcugugaaugaugc

SEQ ID NO: 217984 - RNA, 21 nt, Human
aguucagcucucccugacucc

SEQ ID NO: 217985 - RNA, 21 nt, Human
auacagcacaccaaggcucag

SEQ ID NO: 217986 - RNA, 24 nt, Human
aucuauccccauagccuucuauca

SEQ ID NO: 217987 - RNA, 18 nt, Human
augaacucaggguagagc

SEQ ID NO: 217988 - RNA, 20 nt, Human
augaccccugaguggcccuc

SEQ ID NO: 217989 - RNA, 21 nt, Human
augagagacauccccagcuca

SEQ ID NO: 217990 - RNA, 20 nt, Human
caaaugucuacagcaguggu

SEQ ID NO: 217991 - RNA, 21 nt, Human
caacccauagaagaacaggcc

SEQ ID NO: 217992 - RNA, 24 nt, Human
cacacaacacacacacauaaacac

SEQ ID NO: 217993 - RNA, 23 nt, Human
cacacacaacacacacacauaaa

SEQ ID NO: 217994 - RNA, 26 nt, Human
cacacacaacacacacacauaaacac

SEQ ID NO: 217995 - RNA, 18 nt, Human
cacuggccagugacuugc

SEQ ID NO: 217996 - RNA, 21 nt, Human
cagacccacacuuccacauac

SEQ ID NO: 217997 - RNA, 23 nt, Human
cagcuuaucaggacacaucacaa

SEQ ID NO: 217998 - RNA, 18 nt, Human
caggaaagguccaaugug

SEQ ID NO: 217999 - RNA, 24 nt, Human
cagggacaauggccugaugaggaa

SEQ ID NO: 218000 - RNA, 23 nt, Human
caucacaauuuuaaauuacacac

SEQ ID NO: 218001 - RNA, 21 nt, Human
caugagaaaaauaaaauaaaa

SEQ ID NO: 218002 - RNA, 24 nt, Human
caugagaaaaauaaaauaaaauug

SEQ ID NO: 218003 - RNA, 26 nt, Human
ccaauguguccacacaucuaucccca

SEQ ID NO: 218004 - RNA, 27 nt, Human
cccaaccuaccccacucugagccccaa

SEQ ID NO: 218005 - RNA, 21 nt, Human
cccacacacaacacacacaca

SEQ ID NO: 218006 - RNA, 23 nt, Human
cccacacacaacacacacacaua

SEQ ID NO: 218007 - RNA, 23 nt, Human
cccacauacacacacacagaccc

SEQ ID NO: 218008 - RNA, 24 nt, Human
cccacauacacacacacagaccca

SEQ ID NO: 218009 - RNA, 19 nt, Human
cccacucugagccccaaau

SEQ ID NO: 218010 - RNA, 26 nt, Human
ccccacucugagccccaaaucccucc

SEQ ID NO: 218011 - RNA, 20 nt, Human
cccccacauacacacacaca

SEQ ID NO: 218012 - RNA, 22 nt, Human
cccccacauacacacacacaga

SEQ ID NO: 218013 - RNA, 24 nt, Human
cccccaggccaugaaugaccccug

SEQ ID NO: 218014 - RNA, 21 nt, Human
ccccucacagauccagccacu

SEQ ID NO: 218015 - RNA, 18 nt, Human
ccccugaguggcccagac

SEQ ID NO: 218016 - RNA, 20 nt, Human
cccgggcugccaagcccagc

SEQ ID NO: 218017 - RNA, 20 nt, Human
ccucaagcuaagcaggaaga

SEQ ID NO: 218018 - RNA, 19 nt, Human
ccucuggaaugagaggccu

SEQ ID NO: 218019 - RNA, 27 nt, Human
ccucuggaaugagaggccucagcccuu

SEQ ID NO: 218020 - RNA, 25 nt, Human
ccucuguaaacaugauggcagggac

SEQ ID NO: 218021 - RNA, 19 nt, Human
ccuucuaucaugagagagc

SEQ ID NO: 218022 - RNA, 21 nt, Human
cggccugagggaggggaaagg

SEQ ID NO: 218023 - RNA, 23 nt, Human
cucagcuuaucaggacacaucac

SEQ ID NO: 218024 - RNA, 19 nt, Human
cucccaaccuaccccacuc

SEQ ID NO: 218025 - RNA, 19 nt, Human
cuccuucggccugagggag

SEQ ID NO: 218026 - RNA, 21 nt, Human
cugcucagcuccauagucacc

SEQ ID NO: 218027 - RNA, 19 nt, Human
cuucggccugagggagggg

SEQ ID NO: 218028 - RNA, 18 nt, Human
cuugcaaggacuucccuu

SEQ ID NO: 218029 - RNA, 19 nt, Human
cuugggcauuugggggugg

SEQ ID NO: 218030 - RNA, 18 nt, Human
gaacagucccucuuccuc

SEQ ID NO: 218031 - RNA, 18 nt, Human
gacccacacuuccacaua

SEQ ID NO: 218032 - RNA, 25 nt, Human
gacccaucauuccauccuggcacuu

SEQ ID NO: 218033 - RNA, 18 nt, Human
gaccccugaguggcccag

SEQ ID NO: 218034 - RNA, 19 nt, Human
gaggggaaaggaggcagag

SEQ ID NO: 218035 - RNA, 23 nt, Human
gcagccaagagguagaagguaaa

SEQ ID NO: 218036 - RNA, 22 nt, Human
gccaaggcuuggugucccuucc

SEQ ID NO: 218037 - RNA, 21 nt, Human
ggaaagcuggcuucucacuga

SEQ ID NO: 218038 - RNA, 19 nt, Human
ggacaggaggccggaagca

SEQ ID NO: 218039 - RNA, 24 nt, Human
ggcucagggccagguauguggagg

SEQ ID NO: 218040 - RNA, 22 nt, Human
gggcugccaagcccagcaguuc

SEQ ID NO: 218041 - RNA, 18 nt, Human
ggggaaaggaggcagagg

SEQ ID NO: 218042 - RNA, 23 nt, Human
gucccucuuccucaggaaagguc

SEQ ID NO: 218043 - RNA, 21 nt, Human
guuaagaaaaccucaucauga

SEQ ID NO: 218044 - RNA, 21 nt, Human
uaaacaaaccuccagaguaga

SEQ ID NO: 218045 - RNA, 22 nt, Human
uaaacacacagacccccacaua

SEQ ID NO: 218046 - RNA, 21 nt, Human
uaagaaaaccucaucaugaga

SEQ ID NO: 218047 - RNA, 24 nt, Human
uaaguuaagaaaaccucaucauga

SEQ ID NO: 218048 - RNA, 21 nt, Human
uaccauagcugcugagaguca

SEQ ID NO: 218049 - RNA, 27 nt, Human
uaccauagcugcugagagucaggccug

SEQ ID NO: 218050 - RNA, 18 nt, Human
uagaagaacaggccacac

SEQ ID NO: 218051 - RNA, 18 nt, Human
uagcaaaugucuacagca

SEQ ID NO: 218052 - RNA, 21 nt, Human
ucagcucucccugacuccucc

SEQ ID NO: 218053 - RNA, 21 nt, Human
uccaacccauagaagaacagg

SEQ ID NO: 218054 - RNA, 24 nt, Human
uccauagucacccucaagcuaagc

SEQ ID NO: 218055 - RNA, 24 nt, Human
ucccccaggccaugaaugaccccc

SEQ ID NO: 218056 - RNA, 22 nt, Human
ucccuugcgagagaaccauagc

SEQ ID NO: 218057 - RNA, 22 nt, Human
ucuaauaguucagcucucccug

SEQ ID NO: 218058 - RNA, 25 nt, Human
ucuacaauagcacucucucccuuug

SEQ ID NO: 218059 - RNA, 20 nt, Human
ucuuucuuuuuuucuugggc

SEQ ID NO: 218060 - RNA, 22 nt, Human
ugaaugaccccugaguggccca

SEQ ID NO: 218061 - RNA, 24 nt, Human
ugacccaucauuccauccuggcac

SEQ ID NO: 218062 - RNA, 20 nt, Human
ugagaaccauaaauuuauga

SEQ ID NO: 218063 - RNA, 22 nt, Human
ugagagagccccucacagaucc

SEQ ID NO: 218064 - RNA, 20 nt, Human
ugagccccaaaucccucccc

SEQ ID NO: 218065 - RNA, 27 nt, Human
ugaggaaaagcauuuggggaggcgcuu

SEQ ID NO: 218066 - RNA, 20 nt, Human
ugaggaaaagcauuugguca

SEQ ID NO: 218067 - RNA, 21 nt, Human
ugaggaaaagcauuuggucau

SEQ ID NO: 218068 - RNA, 26 nt, Human
ugaggaaagcuggcuucucacugagg

SEQ ID NO: 218069 - RNA, 19 nt, Human
ugaggggauggcaaaaggc

SEQ ID NO: 218070 - RNA, 18 nt, Human
ugaugccaagugggagug

SEQ ID NO: 218071 - RNA, 20 nt, Human
ugaugccaagugggaguguc

SEQ ID NO: 218072 - RNA, 22 nt, Human
ugcaagcauguuuauauacaug

SEQ ID NO: 218073 - RNA, 20 nt, Human
ugcucuccuucuuugccauu

SEQ ID NO: 218074 - RNA, 18 nt, Human
uggcccagacauccucac

SEQ ID NO: 218075 - RNA, 20 nt, Human
ugggacaaaggcuaaggagc

SEQ ID NO: 218076 - RNA, 23 nt, Human
uguacccugcccaagucugugug

SEQ ID NO: 218077 - RNA, 22 nt, Human
uguggaggugcuauggaugagg

SEQ ID NO: 218078 - RNA, 20 nt, Human
uuccuaccauagcugcugag

SEQ ID NO: 218079 - RNA, 21 nt, Human
uuccucuggaaugagaggccu

SEQ ID NO: 218080 - RNA, 21 nt, Human
uuuuuuucuugggcauuuggg

SEQ ID NO: 218081 - RNA, 21 nt, Human
acauuaaagagccaagaagaa

SEQ ID NO: 218082 - RNA, 21 nt, Human
acccacaaaugcuaaaagucc

SEQ ID NO: 218083 - RNA, 18 nt, Human
agaugcagaaguuggugc

SEQ ID NO: 218084 - RNA, 19 nt, Human
auaagucaagaucuuccuc

SEQ ID NO: 218085 - RNA, 19 nt, Human
cacagaaguguauguggua

SEQ ID NO: 218086 - RNA, 22 nt, Human
cccacaaaugcuaaaaguccac

SEQ ID NO: 218087 - RNA, 23 nt, Human
cucauggugagugcauuucuucu

SEQ ID NO: 218088 - RNA, 22 nt, Human
cugccgcugaauaaaacgaacc

SEQ ID NO: 218089 - RNA, 21 nt, Human
uaaaacgaacccagcaacuuc

SEQ ID NO: 218090 - RNA, 26 nt, Human
uagaaaguuuaaauuagcugcaagaa

SEQ ID NO: 218091 - RNA, 26 nt, Human
uagcugcaagaaauuuuaucuagaca

SEQ ID NO: 218092 - RNA, 22 nt, Human
ugcuuuauuaagucuacccaca

SEQ ID NO: 218093 - RNA, 25 nt, Human
uuuuuuuuuuuuuuuuuuuuuaagg

SEQ ID NO: 218094 - RNA, 19 nt, Human
aagugcagaacaaaggcug

SEQ ID NO: 218095 - RNA, 24 nt, Human
accuugcccccuucaugccuccca

SEQ ID NO: 218096 - RNA, 22 nt, Human
auggcggggguggggcagggug

SEQ ID NO: 218097 - RNA, 21 nt, Human
ccacagaggacggaccuugcc

SEQ ID NO: 218098 - RNA, 26 nt, Human
ccagccucggcugcugcugugcgccc

SEQ ID NO: 218099 - RNA, 28 nt, Human
cccugcucugugcaugcgggugggcugg

SEQ ID NO: 218100 - RNA, 22 nt, Human
ccugggcugccgcuaggagaug

SEQ ID NO: 218101 - RNA, 18 nt, Human
cgccugggcugccgcuag

SEQ ID NO: 218102 - RNA, 24 nt, Human
cgggcgcgggggguuggggggugg

SEQ ID NO: 218103 - RNA, 21 nt, Human
cgggugggcugggcccccagg

SEQ ID NO: 218104 - RNA, 22 nt, Human
cuagccccugcucugugcaugc

SEQ ID NO: 218105 - RNA, 22 nt, Human
cucccaggagacaccuagcccc

SEQ ID NO: 218106 - RNA, 18 nt, Human
cucccggccagccucggc

SEQ ID NO: 218107 - RNA, 21 nt, Human
cucccggccagccucggcugc

SEQ ID NO: 218108 - RNA, 18 nt, Human
cugcugugcgcccguccu

SEQ ID NO: 218109 - RNA, 20 nt, Human
cuggguccuugugcugcucc

SEQ ID NO: 218110 - RNA, 18 nt, Human
gacauggcgggggugggg

SEQ ID NO: 218111 - RNA, 24 nt, Human
gaccuugcccccuucaugccuccc

SEQ ID NO: 218112 - RNA, 22 nt, Human
gagucgggaggacgccuagugg

SEQ ID NO: 218113 - RNA, 22 nt, Human
gcagaacaaaggcuggguccuu

SEQ ID NO: 218114 - RNA, 18 nt, Human
gccucggcugcugcugug

SEQ ID NO: 218115 - RNA, 19 nt, Human
gcgcgggggguuggggggu

SEQ ID NO: 218116 - RNA, 21 nt, Human
gcgggugggcugggcccccag

SEQ ID NO: 218117 - RNA, 20 nt, Human
gggacgaggcgggcagcgcc

SEQ ID NO: 218118 - RNA, 20 nt, Human
gggcgcgggggguugggggg

SEQ ID NO: 218119 - RNA, 23 nt, Human
gggcugcagcgcgcgggcgagca

SEQ ID NO: 218120 - RNA, 18 nt, Human
gggguggggacgaggcgg

SEQ ID NO: 218121 - RNA, 18 nt, Human
gggguuggggggugggga

SEQ ID NO: 218122 - RNA, 20 nt, Human
uagcugaggaggcuccggga

SEQ ID NO: 218123 - RNA, 21 nt, Human
uccgagggcgggcgcgggggg

SEQ ID NO: 218124 - RNA, 22 nt, Human
ucggggcggacucgcucccucc

SEQ ID NO: 218125 - RNA, 22 nt, Human
ucucccggccagccucggcugc

SEQ ID NO: 218126 - RNA, 23 nt, Human
ucucccggccagccucggcugcu

SEQ ID NO: 218127 - RNA, 19 nt, Human
ugcccccuucaugccuccc

SEQ ID NO: 218128 - RNA, 20 nt, Human
ugcugcucccagcucuuugg

SEQ ID NO: 218129 - RNA, 21 nt, Human
uggcggggguggggcaggguc

SEQ ID NO: 218130 - RNA, 23 nt, Human
ugggcugccgcuaggagaugggg

SEQ ID NO: 218131 - RNA, 22 nt, Human
uggggcugcagcgcgcgggcga

SEQ ID NO: 218132 - RNA, 23 nt, Human
uggggcugcagcgcgcgggcgag

SEQ ID NO: 218133 - RNA, 22 nt, Human
uguccgagggcgggcgcggggg

SEQ ID NO: 218134 - RNA, 24 nt, Human
aacugcacuuuaaugggguggcac

SEQ ID NO: 218135 - RNA, 18 nt, Human
aagcacagguggaaaagg

SEQ ID NO: 218136 - RNA, 21 nt, Human
aaguaaccaguaacaagcucg

SEQ ID NO: 218137 - RNA, 19 nt, Human
acaggacagcagaacccuc

SEQ ID NO: 218138 - RNA, 21 nt, Human
acaggacagcagaacccucag

SEQ ID NO: 218139 - RNA, 22 nt, Human
agccaggagcccauggaacaac

SEQ ID NO: 218140 - RNA, 19 nt, Human
aggagcccauggaacaacu

SEQ ID NO: 218141 - RNA, 21 nt, Human
agguuggccacaguccagagc

SEQ ID NO: 218142 - RNA, 22 nt, Human
cacaguccagagccaggagccc

SEQ ID NO: 218143 - RNA, 18 nt, Human
cagaacccucagccagca

SEQ ID NO: 218144 - RNA, 20 nt, Human
cagaacccucagccagcagc

SEQ ID NO: 218145 - RNA, 18 nt, Human
cagcagccacagggccug

SEQ ID NO: 218146 - RNA, 24 nt, Human
caggagcccauggaacaacuugga

SEQ ID NO: 218147 - RNA, 19 nt, Human
caguccagagccaggagcc

SEQ ID NO: 218148 - RNA, 20 nt, Human
cagugagcucucugccaccu

SEQ ID NO: 218149 - RNA, 24 nt, Human
ccagugagcucucugccaccuccc

SEQ ID NO: 218150 - RNA, 24 nt, Human
ccauggaacaacuuggaaggugac

SEQ ID NO: 218151 - RNA, 18 nt, Human
cccagccccucaguccca

SEQ ID NO: 218152 - RNA, 20 nt, Human
cccucagucccagugagcuc

SEQ ID NO: 218153 - RNA, 22 nt, Human
ccggaggaacugcacuuuaaug

SEQ ID NO: 218154 - RNA, 18 nt, Human
cucccuaaaaagguuucc

SEQ ID NO: 218155 - RNA, 18 nt, Human
gccacagggccugccagc

SEQ ID NO: 218156 - RNA, 20 nt, Human
ggcgauaagcacagguggaa

SEQ ID NO: 218157 - RNA, 23 nt, Human
gguacagauugggcggaaugugg

SEQ ID NO: 218158 - RNA, 24 nt, Human
uccagagccaggagcccauggaac

SEQ ID NO: 218159 - RNA, 20 nt, Human
ucccagugagcucucugcca

SEQ ID NO: 218160 - RNA, 22 nt, Human
uuuuuuuuuuuuuuuuuccgga

SEQ ID NO: 218161 - RNA, 23 nt, Human
uuuuuuuuuuuuuuuuuuuccgg

SEQ ID NO: 218162 - RNA, 19 nt, Human
aaacaggaaacagaccaga

SEQ ID NO: 218163 - RNA, 25 nt, Human
aaacaggaaacagaccagauucugg

SEQ ID NO: 218164 - RNA, 20 nt, Human
aagcagcccucuuggguguc

SEQ ID NO: 218165 - RNA, 21 nt, Human
acccacccuuccucucacccu

SEQ ID NO: 218166 - RNA, 25 nt, Human
acccacccuuccucucacccuccag

SEQ ID NO: 218167 - RNA, 20 nt, Human
acccuccaguucccacuguc

SEQ ID NO: 218168 - RNA, 23 nt, Human
agccaaacaggaaacagaccaga

SEQ ID NO: 218169 - RNA, 19 nt, Human
aggaaacagaccagauucu

SEQ ID NO: 218170 - RNA, 19 nt, Human
augcaagguugcaggcaug

SEQ ID NO: 218171 - RNA, 24 nt, Human
auggaugcaagguugcaggcaugg

SEQ ID NO: 218172 - RNA, 20 nt, Human
cacucugaaaaugaaguagg

SEQ ID NO: 218173 - RNA, 19 nt, Human
ccccuaccaaggucuuaca

SEQ ID NO: 218174 - RNA, 18 nt, Human
cgagaucccaagccguag

SEQ ID NO: 218175 - RNA, 22 nt, Human
gacccacccuuccucucacccu

SEQ ID NO: 218176 - RNA, 18 nt, Human
ggagaagagccuugggua

SEQ ID NO: 218177 - RNA, 19 nt, Human
guagugguagaagagccaa

SEQ ID NO: 218178 - RNA, 19 nt, Human
gucacucugaaaaugaagu

SEQ ID NO: 218179 - RNA, 18 nt, Human
uaagugucccucccuccu

SEQ ID NO: 218180 - RNA, 18 nt, Human
uagcccagauggaugcaa

SEQ ID NO: 218181 - RNA, 21 nt, Human
uccacauaggugcgugcagag

SEQ ID NO: 218182 - RNA, 18 nt, Human
uccccuaccaaggucuua

SEQ ID NO: 218183 - RNA, 20 nt, Human
ucucugggcuuuaguuucca

SEQ ID NO: 218184 - RNA, 19 nt, Human
ugaaaaugaaguagggugg

SEQ ID NO: 218185 - RNA, 20 nt, Human
ugggaagcagcccucuuggg

SEQ ID NO: 218186 - RNA, 25 nt, Human
uggggcaagucagacuuucucucug

SEQ ID NO: 218187 - RNA, 18 nt, Human
uuuuuuuuuuuuuuucug

SEQ ID NO: 218188 - RNA, 21 nt, Human
uuuuuuuuuuuuuuucugagg

SEQ ID NO: 218189 - RNA, 25 nt, Human
accaaaugucugcagcauaccuucc

SEQ ID NO: 218190 - RNA, 22 nt, Human
accuccugugugcuugucuuca

SEQ ID NO: 218191 - RNA, 20 nt, Human
agaaauagaaaaacauacaa

SEQ ID NO: 218192 - RNA, 19 nt, Human
agcaucccuggccucuacc

SEQ ID NO: 218193 - RNA, 23 nt, Human
agccauauaacucaauguuucuc

SEQ ID NO: 218194 - RNA, 23 nt, Human
aggugggguucaccgagggaggc

SEQ ID NO: 218195 - RNA, 23 nt, Human
caauggucuuuuuaaccuguccu

SEQ ID NO: 218196 - RNA, 19 nt, Human
cagcagcaucccuggccuc

SEQ ID NO: 218197 - RNA, 19 nt, Human
cagcggcacugcucugggc

SEQ ID NO: 218198 - RNA, 22 nt, Human
ccagaaaaaauaagaauccaga

SEQ ID NO: 218199 - RNA, 19 nt, Human
ccagaccucucucauguaa

SEQ ID NO: 218200 - RNA, 25 nt, Human
cccagaaaaaauaagaauccagacc

SEQ ID NO: 218201 - RNA, 23 nt, Human
cuacccaccaaaugucugcagca

SEQ ID NO: 218202 - RNA, 21 nt, Human
cugcaaggugggguucaccga

SEQ ID NO: 218203 - RNA, 19 nt, Human
cuggccucuacccaccaaa

SEQ ID NO: 218204 - RNA, 24 nt, Human
gacccagugugacaaucaaaauug

SEQ ID NO: 218205 - RNA, 19 nt, Human
gacggacccacggacaccc

SEQ ID NO: 218206 - RNA, 19 nt, Human
gggaggcggcaggagggag

SEQ ID NO: 218207 - RNA, 19 nt, Human
gggaugcucagcagcaucc

SEQ ID NO: 218208 - RNA, 20 nt, Human
uaagagaaucuucuuuggug

SEQ ID NO: 218209 - RNA, 19 nt, Human
uaaugugaauaugcauguu

SEQ ID NO: 218210 - RNA, 21 nt, Human
uccagccccacucugauauuc

SEQ ID NO: 218211 - RNA, 21 nt, Human
ucccuggccucuacccaccuu

SEQ ID NO: 218212 - RNA, 22 nt, Human
ugauccagccccacucugauau

SEQ ID NO: 218213 - RNA, 24 nt, Human
ugauccagccccacucugauauuc

SEQ ID NO: 218214 - RNA, 20 nt, Human
ugcaaggugggguucaccga

SEQ ID NO: 218215 - RNA, 22 nt, Human
ugcgggaugcucagcagcaucc

SEQ ID NO: 218216 - RNA, 19 nt, Human
uggguggaaaaauugcucu

SEQ ID NO: 218217 - RNA, 20 nt, Human
uguccuguacacugcgggau

SEQ ID NO: 218218 - RNA, 18 nt, Human
uucuuuggugaguuuaaa

SEQ ID NO: 218219 - RNA, 21 nt, Human
uuucuuguguaagaaugugga

SEQ ID NO: 218220 - RNA, 25 nt, Human
uuugggcagcggcacugcucugggc

SEQ ID NO: 218221 - RNA, 23 nt, Human
uuuuugcccuugauccagcccca

SEQ ID NO: 218222 - RNA, 21 nt, Human
aaggaaccagcuuagucaagg

SEQ ID NO: 218223 - RNA, 18 nt, Human
aggcgugcuggccagagg

SEQ ID NO: 218224 - RNA, 24 nt, Human
ccuccuccucugccuuggccccgg

SEQ ID NO: 218225 - RNA, 18 nt, Human
cuccucugccuuggcccc

SEQ ID NO: 218226 - RNA, 23 nt, Human
cuccucugccuuggccccggggg

SEQ ID NO: 218227 - RNA, 25 nt, Human
cucugccuuggccccgggggaggac

SEQ ID NO: 218228 - RNA, 21 nt, Human
gcuuugacacaaggaaccagc

SEQ ID NO: 218229 - RNA, 18 nt, Human
ggaggacaggcgugcugg

SEQ ID NO: 218230 - RNA, 24 nt, Human
gggaggacaggcgugcuggccaga

SEQ ID NO: 218231 - RNA, 18 nt, Human
ucuaaggcuccugcugcc

SEQ ID NO: 218232 - RNA, 21 nt, Human
ucugccuuggccccgggggag

SEQ ID NO: 218233 - RNA, 22 nt, Human
uuaauggaaggcaugaggugcu

SEQ ID NO: 218234 - RNA, 21 nt, Human
uuuaauggaaggcaugaggug

SEQ ID NO: 218235 - RNA, 24 nt, Human
ccaaagcagauggucuggggagga

SEQ ID NO: 218236 - RNA, 23 nt, Human
ccccaaagcagauggucugggga

SEQ ID NO: 218237 - RNA, 21 nt, Human
uaucugguucauuuuaauuau

SEQ ID NO: 218238 - RNA, 24 nt, Human
ucaaaccgaagaauaucugcaaaa

SEQ ID NO: 218239 - RNA, 18 nt, Human
agaugccauaaaauccgg

SEQ ID NO: 218240 - RNA, 22 nt, Human
ccacaggccccucucugugccc

SEQ ID NO: 218241 - RNA, 24 nt, Human
cccagccccucccacaggccccuc

SEQ ID NO: 218242 - RNA, 27 nt, Human
cucgaccuuggacuuuauuuucccagc

SEQ ID NO: 218243 - RNA, 23 nt, Human
uauuuucccagccccucccacag

SEQ ID NO: 218244 - RNA, 21 nt, Human
uccaucccaacaggagcuggu

SEQ ID NO: 218245 - RNA, 23 nt, Human
ucccagccccucccacaggcccc

SEQ ID NO: 218246 - RNA, 25 nt, Human
ucccagccccucccacaggccccuc

SEQ ID NO: 218247 - RNA, 18 nt, Human
uuuuucuggcucgaccuu

SEQ ID NO: 218248 - RNA, 19 nt, Human
uuuuuuuucuggcucgacc

SEQ ID NO: 218249 - RNA, 19 nt, Human
accaccuuucuuuauuugu

SEQ ID NO: 218250 - RNA, 19 nt, Human
caaguguacagggugggca

SEQ ID NO: 218251 - RNA, 20 nt, Human
ccagaagcggcccugcaguu

SEQ ID NO: 218252 - RNA, 18 nt, Human
cccaggcucacaccaccu

SEQ ID NO: 218253 - RNA, 23 nt, Human
ccccauggugguccaggccccag

SEQ ID NO: 218254 - RNA, 21 nt, Human
gccaaguguacagggugggca

SEQ ID NO: 218255 - RNA, 18 nt, Human
gggaagccaaguguacag

SEQ ID NO: 218256 - RNA, 21 nt, Human
uccaggccccagaagcggccc

SEQ ID NO: 218257 - RNA, 24 nt, Human
uuuguaaugagugggacucuuccu

SEQ ID NO: 218258 - RNA, 19 nt, Human
aaauaaaacuagaaccaaa

SEQ ID NO: 218259 - RNA, 22 nt, Human
aaauacauagucucaaaaggua

SEQ ID NO: 218260 - RNA, 18 nt, Human
aacacuauucgcuagugg

SEQ ID NO: 218261 - RNA, 22 nt, Human
aacucaccaguuuucuuggaaa

SEQ ID NO: 218262 - RNA, 19 nt, Human
aagaaucuuuuaaaguugc

SEQ ID NO: 218263 - RNA, 21 nt, Human
aagacuacagcugaaaguugg

SEQ ID NO: 218264 - RNA, 23 nt, Human
aagagaaaaaccaggcaggaagc

SEQ ID NO: 218265 - RNA, 22 nt, Human
aagaguuuuggggcaaagaaug

SEQ ID NO: 218266 - RNA, 21 nt, Human
aagcuguggcugacagcauca

SEQ ID NO: 218267 - RNA, 24 nt, Human
aaggaaagaguuuuggggcaaaga

SEQ ID NO: 218268 - RNA, 19 nt, Human
aaucucaagccagucaaaa

SEQ ID NO: 218269 - RNA, 21 nt, Human
aaucuuuuaaaguugcuuuga

SEQ ID NO: 218270 - RNA, 22 nt, Human
acaaaauucuaaaaaguaaaca

SEQ ID NO: 218271 - RNA, 25 nt, Human
acaaaauucuaaaaaguaaacagag

SEQ ID NO: 218272 - RNA, 20 nt, Human
acagcaacagagcacacuca

SEQ ID NO: 218273 - RNA, 18 nt, Human
acagcaucacagcaacag

SEQ ID NO: 218274 - RNA, 19 nt, Human
accacaugugacaagaggc

SEQ ID NO: 218275 - RNA, 22 nt, Human
accauuuaaaaaaugugagaag

SEQ ID NO: 218276 - RNA, 20 nt, Human
agacuuggagucucaaccuu

SEQ ID NO: 218277 - RNA, 19 nt, Human
agagacaucacuccuguuc

SEQ ID NO: 218278 - RNA, 24 nt, Human
agaggcuggaaaaaaggauguuuu

SEQ ID NO: 218279 - RNA, 18 nt, Human
agcaccccagucagugcc

SEQ ID NO: 218280 - RNA, 19 nt, Human
aggaagcuguggcugacag

SEQ ID NO: 218281 - RNA, 23 nt, Human
aggagacuuggagucucaaccuu

SEQ ID NO: 218282 - RNA, 24 nt, Human
aggcaggaagcccauuuugcggga

SEQ ID NO: 218283 - RNA, 22 nt, Human
agguagcagcauacucuguaaa

SEQ ID NO: 218284 - RNA, 26 nt, Human
aguucuugaaagguggugcaccuuuu

SEQ ID NO: 218285 - RNA, 20 nt, Human
auacccaaugcuccaagcau

SEQ ID NO: 218286 - RNA, 21 nt, Human
auagggcaccaggaggugaag

SEQ ID NO: 218287 - RNA, 20 nt, Human
aucacagcaacagagcacac

SEQ ID NO: 218288 - RNA, 23 nt, Human
aucagucaauuccaauguuuucu

SEQ ID NO: 218289 - RNA, 25 nt, Human
caaaaacagacucuuuauuucucuc

SEQ ID NO: 218290 - RNA, 24 nt, Human
caacagagcacacucacucuaauc

SEQ ID NO: 218291 - RNA, 19 nt, Human
caaccacaguggucugugc

SEQ ID NO: 218292 - RNA, 21 nt, Human
cacaaccaaaggaaagaguuu

SEQ ID NO: 218293 - RNA, 25 nt, Human
cagacaucagauacccaaugcucca

SEQ ID NO: 218294 - RNA, 23 nt, Human
cagagcacacucacucuaaucuu

SEQ ID NO: 218295 - RNA, 26 nt, Human
cagaugucuuggcuuuuuaaagccuc

SEQ ID NO: 218296 - RNA, 19 nt, Human
cagcaucacagcaacagag

SEQ ID NO: 218297 - RNA, 20 nt, Human
cagcaucacagcaacagagc

SEQ ID NO: 218298 - RNA, 21 nt, Human
caggaucugcagcccguggcc

SEQ ID NO: 218299 - RNA, 23 nt, Human
caggggaauuuucuaaaccaaac

SEQ ID NO: 218300 - RNA, 24 nt, Human
caguggucugugccagagcaacac

SEQ ID NO: 218301 - RNA, 21 nt, Human
caucaccucuuagcacaacca

SEQ ID NO: 218302 - RNA, 23 nt, Human
cauccugaugguuugagcaaaaa

SEQ ID NO: 218303 - RNA, 23 nt, Human
ccaagggaacauugaccaacacc

SEQ ID NO: 218304 - RNA, 24 nt, Human
ccaaugggucucgccaugcucccu

SEQ ID NO: 218305 - RNA, 20 nt, Human
ccagcucuagacuuucuagu

SEQ ID NO: 218306 - RNA, 20 nt, Human
ccugaugguuugagcaaaaa

SEQ ID NO: 218307 - RNA, 21 nt, Human
cgggauagggcaccaggaggu

SEQ ID NO: 218308 - RNA, 24 nt, Human
cuacgaaauaaaacuagaaccaaa

SEQ ID NO: 218309 - RNA, 23 nt, Human
cucaaccuuaaaauugcucaacu

SEQ ID NO: 218310 - RNA, 23 nt, Human
cucaugaaguguucaagaagacu

SEQ ID NO: 218311 - RNA, 18 nt, Human
cucccagcuugguggcug

SEQ ID NO: 218312 - RNA, 24 nt, Human
cuccuagcucaguacauauucacc

SEQ ID NO: 218313 - RNA, 23 nt, Human
cugacagcaucacagcaacagag

SEQ ID NO: 218314 - RNA, 21 nt, Human
cugucagguugagguuugugc

SEQ ID NO: 218315 - RNA, 21 nt, Human
cuguucuggcucagcucccag

SEQ ID NO: 218316 - RNA, 21 nt, Human
gagaagagaaaaaccaggcag

SEQ ID NO: 218317 - RNA, 24 nt, Human
gagaagagaaaaaccaggcaggaa

SEQ ID NO: 218318 - RNA, 18 nt, Human
gauaagcugaguaaaauc

SEQ ID NO: 218319 - RNA, 18 nt, Human
gcaacagagcacacucac

SEQ ID NO: 218320 - RNA, 20 nt, Human
gcgggauagggcaccaggag

SEQ ID NO: 218321 - RNA, 21 nt, Human
ggaggugaagaauguacacau

SEQ ID NO: 218322 - RNA, 21 nt, Human
gugaacccagggugaacagag

SEQ ID NO: 218323 - RNA, 22 nt, Human
guggucaggaugcugcuuccau

SEQ ID NO: 218324 - RNA, 22 nt, Human
uaaaaagucccuggaaccauaa

SEQ ID NO: 218325 - RNA, 20 nt, Human
uaaaagaagagaccuaagau

SEQ ID NO: 218326 - RNA, 18 nt, Human
uaacuccaaagucauuaa

SEQ ID NO: 218327 - RNA, 26 nt, Human
uaagaagugcaagaaugcugucugaa

SEQ ID NO: 218328 - RNA, 21 nt, Human
uacacauguacaguugaggau

SEQ ID NO: 218329 - RNA, 23 nt, Human
uaccagcucuagacuuucuaguu

SEQ ID NO: 218330 - RNA, 26 nt, Human
uaccagcucuagacuuucuaguucca

SEQ ID NO: 218331 - RNA, 19 nt, Human
uagaauaccagcucuagac

SEQ ID NO: 218332 - RNA, 22 nt, Human
uagacugaauguuccagaaauc

SEQ ID NO: 218333 - RNA, 21 nt, Human
uagggcaccaggaggugaaga

SEQ ID NO: 218334 - RNA, 21 nt, Human
ucaaccacaguggucugugcc

SEQ ID NO: 218335 - RNA, 25 nt, Human
ucaagccagaguaggcacucucaug

SEQ ID NO: 218336 - RNA, 23 nt, Human
ucaccccaauccauccaaugggu

SEQ ID NO: 218337 - RNA, 18 nt, Human
ucaggaugcugguggaag

SEQ ID NO: 218338 - RNA, 20 nt, Human
ucuaaaaaguaaacagagau

SEQ ID NO: 218339 - RNA, 20 nt, Human
ucucaggaugcugguggaag

SEQ ID NO: 218340 - RNA, 18 nt, Human
ugaaagguggugcaccuu

SEQ ID NO: 218341 - RNA, 25 nt, Human
ugaacuguucaccccaauccaucca

SEQ ID NO: 218342 - RNA, 21 nt, Human
ugaaucucaagccagucaaaa

SEQ ID NO: 218343 - RNA, 20 nt, Human
ugaggacauauccuuccucc

SEQ ID NO: 218344 - RNA, 18 nt, Human
ugcucgccaagggaacau

SEQ ID NO: 218345 - RNA, 24 nt, Human
uggcugacccuccagcuguggcuu

SEQ ID NO: 218346 - RNA, 22 nt, Human
ugggaccugaacuguucacccc

SEQ ID NO: 218347 - RNA, 18 nt, Human
ugggcagaugucuuggcu

SEQ ID NO: 218348 - RNA, 26 nt, Human
ugguauaaaagaugagcuugguauaa

SEQ ID NO: 218349 - RNA, 19 nt, Human
ugugagaagagaaaaacca

SEQ ID NO: 218350 - RNA, 21 nt, Human
uugaaagguggugcaccuugg

SEQ ID NO: 218351 - RNA, 23 nt, Human
uugaggauuagaugaaucugagc

SEQ ID NO: 218352 - RNA, 24 nt, Human
uugguggcugacccuccagcugug

SEQ ID NO: 218353 - RNA, 19 nt, Human
uuucuaaaccaaaccacag

SEQ ID NO: 218354 - RNA, 21 nt, Human
uuucuaguuccaucacuuugg

SEQ ID NO: 218355 - RNA, 18 nt, Human
uuugagcaaaaacagacu

SEQ ID NO: 218356 - RNA, 21 nt, Human
uuugcagggaagucuccuagc

SEQ ID NO: 218357 - RNA, 20 nt, Human
caagaggagauccuguuagc

SEQ ID NO: 218358 - RNA, 22 nt, Human
caaggacacucuaucuguugcc

SEQ ID NO: 218359 - RNA, 21 nt, Human
cuacugcaagccgaggucugg

SEQ ID NO: 218360 - RNA, 19 nt, Human
gggcugcagacugcaagag

SEQ ID NO: 218361 - RNA, 23 nt, Human
uaaaugcaugaguaaauaucuug

SEQ ID NO: 218362 - RNA, 22 nt, Human
ucuugaguaucccauaaaccuu

SEQ ID NO: 218363 - RNA, 24 nt, Human
ugacuucuuauuaccaaggacacu

SEQ ID NO: 218364 - RNA, 20 nt, Human
uggaaucagcguccugggcu

SEQ ID NO: 218365 - RNA, 19 nt, Human
uuagcccaaacagcacuua

SEQ ID NO: 218366 - RNA, 23 nt, Human
uuuuuuuuuuuuuuuuuuuacgg

SEQ ID NO: 218367 - RNA, 18 nt, Human
aaaaauccagauaaauga

SEQ ID NO: 218368 - RNA, 21 nt, Human
aaaacauaaaaauccagauaa

SEQ ID NO: 218369 - RNA, 20 nt, Human
aacauaaaaauccagauaaa

SEQ ID NO: 218370 - RNA, 25 nt, Human
acuaauucaaauauaaaagacacca

SEQ ID NO: 218371 - RNA, 18 nt, Human
agauuugaagaaccaaac

SEQ ID NO: 218372 - RNA, 23 nt, Human
auaaaacauaaaaauccagauaa

SEQ ID NO: 218373 - RNA, 20 nt, Human
cacugcacaaaauguaaagg

SEQ ID NO: 218374 - RNA, 24 nt, Human
cauugcacagauauggguuauaca

SEQ ID NO: 218375 - RNA, 22 nt, Human
cggccgggcuccgggagcggcu

SEQ ID NO: 218376 - RNA, 23 nt, Human
cugaaaauacugcacauuuuaau

SEQ ID NO: 218377 - RNA, 25 nt, Human
cuuuaaaaaauaaucacugcacaaa

SEQ ID NO: 218378 - RNA, 19 nt, Human
gcggcugagagguucggga

SEQ ID NO: 218379 - RNA, 26 nt, Human
ggaaaaacaacacgcagucuaguuaa

SEQ ID NO: 218380 - RNA, 25 nt, Human
gggcucccggcugcgauugcagccu

SEQ ID NO: 218381 - RNA, 24 nt, Human
gggcugcgggcucccggcugcgau

SEQ ID NO: 218382 - RNA, 20 nt, Human
uacgggaaaaacaacacgca

SEQ ID NO: 218383 - RNA, 20 nt, Human
uagcagggcaacuaacaacu

SEQ ID NO: 218384 - RNA, 26 nt, Human
uauuaaaaugacuuauuuuuauuuaa

SEQ ID NO: 218385 - RNA, 22 nt, Human
ucuacggccgggcuccgggagc

SEQ ID NO: 218386 - RNA, 21 nt, Human
ugaaaagauaguaaagcccug

SEQ ID NO: 218387 - RNA, 22 nt, Human
ugaaaauacugcacauuuuaau

SEQ ID NO: 218388 - RNA, 20 nt, Human
ugacauguacuauuaucuaa

SEQ ID NO: 218389 - RNA, 22 nt, Human
ugccuaggauauuaaaacauaa

SEQ ID NO: 218390 - RNA, 22 nt, Human
uuaaaaaauaaucacugcacaa

SEQ ID NO: 218391 - RNA, 19 nt, Human
uuuacguaugcauauauau

SEQ ID NO: 218392 - RNA, 21 nt, Human
aaacagauauagcugguuuau

SEQ ID NO: 218393 - RNA, 19 nt, Human
aaccauggaaggcgauuug

SEQ ID NO: 218394 - RNA, 18 nt, Human
acacccucacaaagggga

SEQ ID NO: 218395 - RNA, 20 nt, Human
acccucacaaaggggaaacc

SEQ ID NO: 218396 - RNA, 24 nt, Human
acccugaaggaaguacuucagggg

SEQ ID NO: 218397 - RNA, 22 nt, Human
agauccccggccugaggggccu

SEQ ID NO: 218398 - RNA, 24 nt, Human
augguuccuccccacgcccucacu

SEQ ID NO: 218399 - RNA, 22 nt, Human
caagucucauccagaaauguua

SEQ ID NO: 218400 - RNA, 18 nt, Human
cacccaagguccuuucag

SEQ ID NO: 218401 - RNA, 21 nt, Human
cacccucacaaaggggaaacc

SEQ ID NO: 218402 - RNA, 18 nt, Human
cagagccagcugcuccuc

SEQ ID NO: 218403 - RNA, 20 nt, Human
cagcugcuccuccagacagg

SEQ ID NO: 218404 - RNA, 22 nt, Human
ccacgcccucacucccaccaag

SEQ ID NO: 218405 - RNA, 21 nt, Human
cuccccagauccccggccuga

SEQ ID NO: 218406 - RNA, 24 nt, Human
gacacccucacaaaggggaaaccc

SEQ ID NO: 218407 - RNA, 18 nt, Human
gagcagagccagcugcuc

SEQ ID NO: 218408 - RNA, 20 nt, Human
gauuugcaugguuccucccc

SEQ ID NO: 218409 - RNA, 21 nt, Human
gcagugaauccuaagggcaag

SEQ ID NO: 218410 - RNA, 20 nt, Human
guacagcuuuaccacccaag

SEQ ID NO: 218411 - RNA, 18 nt, Human
uacagcuuuaccacccaa

SEQ ID NO: 218412 - RNA, 23 nt, Human
uacccagcugagccaccgaaaac

SEQ ID NO: 218413 - RNA, 22 nt, Human
uaggagagagcagugaauccua

SEQ ID NO: 218414 - RNA, 24 nt, Human
ucaaaacagauauagcugguuuau

SEQ ID NO: 218415 - RNA, 24 nt, Human
ucauccagaaauguuauuuacugc

SEQ ID NO: 218416 - RNA, 20 nt, Human
uccccacgcccucacucccc

SEQ ID NO: 218417 - RNA, 21 nt, Human
uccccggccugaggggccucc

SEQ ID NO: 218418 - RNA, 19 nt, Human
ucucagagcagagccagcu

SEQ ID NO: 218419 - RNA, 22 nt, Human
ugaggggccuccuccagcugca

SEQ ID NO: 218420 - RNA, 18 nt, Human
ugccugcccgaugcggga

SEQ ID NO: 218421 - RNA, 23 nt, Human
uucagggggugccugcccgaugc

SEQ ID NO: 218422 - RNA, 19 nt, Human
uugcaugguuccuccccac

SEQ ID NO: 218423 - RNA, 19 nt, Human
uuugcaugguuccucccca

SEQ ID NO: 218424 - RNA, 26 nt, Human
uuuuuuuucaaaacagauauagcugg

SEQ ID NO: 218425 - RNA, 24 nt, Human
aagccggcaugcacaguggggaca

SEQ ID NO: 218426 - RNA, 23 nt, Human
agacguuagaccggaaggucugg

SEQ ID NO: 218427 - RNA, 22 nt, Human
ccccccuuaguggcuggcaccu

SEQ ID NO: 218428 - RNA, 19 nt, Human
cccugcaccgcggggcucc

SEQ ID NO: 218429 - RNA, 19 nt, Human
cgcuggggcccgggugggc

SEQ ID NO: 218430 - RNA, 23 nt, Human
cuggcaucggcggugcccccccu

SEQ ID NO: 218431 - RNA, 18 nt, Human
gcagagccuccucagaag

SEQ ID NO: 218432 - RNA, 26 nt, Human
gcuaaauaaaauccgcggucuggcac

SEQ ID NO: 218433 - RNA, 18 nt, Human
guccgucguggugugaga

SEQ ID NO: 218434 - RNA, 23 nt, Human
uaaaauccgcggucuggcaccuc

SEQ ID NO: 218435 - RNA, 18 nt, Human
ugcacaguggggacaaag

SEQ ID NO: 218436 - RNA, 21 nt, Human
aaaaaaacagaaaacaaaaac

SEQ ID NO: 218437 - RNA, 23 nt, Human
aaaaagagaaaaaaaaaacagaa

SEQ ID NO: 218438 - RNA, 24 nt, Human
aaaaaugugcuccucccuggggcc

SEQ ID NO: 218439 - RNA, 18 nt, Human
aaaacaaaaacccuaagu

SEQ ID NO: 218440 - RNA, 22 nt, Human
aaacagaaaacaaaaacccuaa

SEQ ID NO: 218441 - RNA, 23 nt, Human
aaacagaaaacaaaaacccuaag

SEQ ID NO: 218442 - RNA, 25 nt, Human
aaacagaaaacaaaaacccuaagua

SEQ ID NO: 218443 - RNA, 23 nt, Human
aaaggcaagccugggaaaagcaa

SEQ ID NO: 218444 - RNA, 19 nt, Human
aacagaauaacccuaaaau

SEQ ID NO: 218445 - RNA, 21 nt, Human
aacagaauaacccuaaaauga

SEQ ID NO: 218446 - RNA, 18 nt, Human
aacccuaaguaacagaau

SEQ ID NO: 218447 - RNA, 20 nt, Human
aagaguccaucuuacagggc

SEQ ID NO: 218448 - RNA, 21 nt, Human
aagauacccacacuacauugg

SEQ ID NO: 218449 - RNA, 24 nt, Human
aagcaggaaucuaagcccuccagg

SEQ ID NO: 218450 - RNA, 23 nt, Human
aaggaaguucaaaacaaaggcaa

SEQ ID NO: 218451 - RNA, 29 nt, Human
acaaaaaaagagaaaaaaaaaacagaaaa

SEQ ID NO: 218452 - RNA, 19 nt, Human
acaaaaagcagugcaaaca

SEQ ID NO: 218453 - RNA, 30 nt, Human
acagaaaacaaaaacccuaaguaacagaag

SEQ ID NO: 218454 - RNA, 23 nt, Human
acccugcgcccauucaccugggc

SEQ ID NO: 218455 - RNA, 19 nt, Human
acgaaucuccaaaugcaga

SEQ ID NO: 218456 - RNA, 23 nt, Human
acucucaucuccucuucuacaaa

SEQ ID NO: 218457 - RNA, 25 nt, Human
agaaaaaaaaaacagaaaacaaaaa

SEQ ID NO: 218458 - RNA, 19 nt, Human
agaaaacaaaaacccuaag

SEQ ID NO: 218459 - RNA, 29 nt, Human
agaaaggaagcacaggaggaggaaaggag

SEQ ID NO: 218460 - RNA, 27 nt, Human
agagaaaaaaaaaacagaaaacaaaaa

SEQ ID NO: 218461 - RNA, 18 nt, Human
agauggguggggggccuu

SEQ ID NO: 218462 - RNA, 22 nt, Human
agcauggggcacagagcugggg

SEQ ID NO: 218463 - RNA, 21 nt, Human
agccagaagccugccuucuuc

SEQ ID NO: 218464 - RNA, 20 nt, Human
agccagggaccaggaacccg

SEQ ID NO: 218465 - RNA, 21 nt, Human
agccagggaccaggaacccgg

SEQ ID NO: 218466 - RNA, 22 nt, Human
aggaaguucaaaacaaaggcaa

SEQ ID NO: 218467 - RNA, 24 nt, Human
aggaggaaaggaggcccaggcggg

SEQ ID NO: 218468 - RNA, 19 nt, Human
aggaggaggaaaggaggcc

SEQ ID NO: 218469 - RNA, 22 nt, Human
aggagucccuguggugacgagg

SEQ ID NO: 218470 - RNA, 23 nt, Human
aggccccaugggccuccuuuaau

SEQ ID NO: 218471 - RNA, 23 nt, Human
agggaagcgaguggcaaaauggc

SEQ ID NO: 218472 - RNA, 23 nt, Human
agggcagggguucugggagauuc

SEQ ID NO: 218473 - RNA, 23 nt, Human
aggggcuggguuauauacacaug

SEQ ID NO: 218474 - RNA, 21 nt, Human
agggucccuucuagcccaaaa

SEQ ID NO: 218475 - RNA, 18 nt, Human
auagaucccaucuucccc

SEQ ID NO: 218476 - RNA, 23 nt, Human
auagcuccagaggcccagaguug

SEQ ID NO: 218477 - RNA, 21 nt, Human
auagucucccucugugucccu

SEQ ID NO: 218478 - RNA, 19 nt, Human
augacacuaaaggcaagcc

SEQ ID NO: 218479 - RNA, 23 nt, Human
augcagagacuucaggaagaggu

SEQ ID NO: 218480 - RNA, 19 nt, Human
augggguggacagaugcag

SEQ ID NO: 218481 - RNA, 22 nt, Human
caaaaagcagugcaaacaccac

SEQ ID NO: 218482 - RNA, 23 nt, Human
caaaaagcagugcaaacaccacc

SEQ ID NO: 218483 - RNA, 24 nt, Human
caaacaccaccuccaagcccugaa

SEQ ID NO: 218484 - RNA, 21 nt, Human
caagccccaaggagcaugggg

SEQ ID NO: 218485 - RNA, 20 nt, Human
cacaaaaggggaaauguaca

SEQ ID NO: 218486 - RNA, 21 nt, Human
cacagaccaccagggucccuu

SEQ ID NO: 218487 - RNA, 18 nt, Human
cacagaguuuguccugcc

SEQ ID NO: 218488 - RNA, 28 nt, Human
cacagccaaguauugccaauaagaggcc

SEQ ID NO: 218489 - RNA, 20 nt, Human
caccacauacccuacaagau

SEQ ID NO: 218490 - RNA, 24 nt, Human
caccacauacccuacaagauaccc

SEQ ID NO: 218491 - RNA, 20 nt, Human
cacccuccacccccagcaag

SEQ ID NO: 218492 - RNA, 20 nt, Human
caccgcggcaccucuggaag

SEQ ID NO: 218493 - RNA, 25 nt, Human
cagaacaaaaggcacugacgaggug

SEQ ID NO: 218494 - RNA, 22 nt, Human
cagcaagugucacucacacuuc

SEQ ID NO: 218495 - RNA, 20 nt, Human
cagcacucuaacagcacugg

SEQ ID NO: 218496 - RNA, 23 nt, Human
cagcagccagggacccccuccag

SEQ ID NO: 218497 - RNA, 25 nt, Human
cagccuucucuuggcuccugggucu

SEQ ID NO: 218498 - RNA, 25 nt, Human
cagcuucugcucgccuccucuggga

SEQ ID NO: 218499 - RNA, 22 nt, Human
cagggcugcuucugggcucuuu

SEQ ID NO: 218500 - RNA, 24 nt, Human
cagugguuccuccagacacacaca

SEQ ID NO: 218501 - RNA, 22 nt, Human
cauagucucccucugugucccu

SEQ ID NO: 218502 - RNA, 18 nt, Human
caugacaggagcccaugu

SEQ ID NO: 218503 - RNA, 23 nt, Human
cauuuuguucucuuaaacagguc

SEQ ID NO: 218504 - RNA, 21 nt, Human
ccagccagggaccaggaaccc

SEQ ID NO: 218505 - RNA, 18 nt, Human
ccagggacccccuccagc

SEQ ID NO: 218506 - RNA, 19 nt, Human
ccauguaugcaggcagggu

SEQ ID NO: 218507 - RNA, 22 nt, Human
cccaugggccuccuuuaauaag

SEQ ID NO: 218508 - RNA, 23 nt, Human
ccccaacgcccccguccugccug

SEQ ID NO: 218509 - RNA, 18 nt, Human
ccccagagccaggggcug

SEQ ID NO: 218510 - RNA, 19 nt, Human
ccccggggugguggggugg

SEQ ID NO: 218511 - RNA, 19 nt, Human
ccccucagcagccagggac

SEQ ID NO: 218512 - RNA, 21 nt, Human
ccccucagcagccagggaccc

SEQ ID NO: 218513 - RNA, 23 nt, Human
cccgccuccacauucccgguccc

SEQ ID NO: 218514 - RNA, 24 nt, Human
cccgguccccggcugugcugaggg

SEQ ID NO: 218515 - RNA, 18 nt, Human
cccugcucccagccaggg

SEQ ID NO: 218516 - RNA, 20 nt, Human
ccggcccccugggcucuccg

SEQ ID NO: 218517 - RNA, 20 nt, Human
ccuagaucagagaacacagc

SEQ ID NO: 218518 - RNA, 20 nt, Human
ccuagggggcucccagaggc

SEQ ID NO: 218519 - RNA, 20 nt, Human
ccucaugugucccacccucc

SEQ ID NO: 218520 - RNA, 25 nt, Human
ccuccagacacacacaccuuggucc

SEQ ID NO: 218521 - RNA, 20 nt, Human
ccucuggaagccagaagccu

SEQ ID NO: 218522 - RNA, 22 nt, Human
ccugaaguuaggaaaaugacua

SEQ ID NO: 218523 - RNA, 19 nt, Human
ccuggacucucccagcucc

SEQ ID NO: 218524 - RNA, 22 nt, Human
ccuggcauccaccacauacccu

SEQ ID NO: 218525 - RNA, 22 nt, Human
ccuggggccagggcccagagac

SEQ ID NO: 218526 - RNA, 21 nt, Human
cgcaggugguagguccaggcu

SEQ ID NO: 218527 - RNA, 21 nt, Human
cggcagaaauaaggcugugcu

SEQ ID NO: 218528 - RNA, 22 nt, Human
cgggggccagggagggcguggg

SEQ ID NO: 218529 - RNA, 22 nt, Human
cuagaucagagaacacagccaa

SEQ ID NO: 218530 - RNA, 26 nt, Human
cucaugugucccacccuccaccccca

SEQ ID NO: 218531 - RNA, 18 nt, Human
cuccucugggaaggccua

SEQ ID NO: 218532 - RNA, 24 nt, Human
cucugggccccaugacaggagccc

SEQ ID NO: 218533 - RNA, 19 nt, Human
gaaacaagaguccagccuu

SEQ ID NO: 218534 - RNA, 19 nt, Human
gagucccuguggugacgag

SEQ ID NO: 218535 - RNA, 23 nt, Human
gagucccuguggugacgagggcu

SEQ ID NO: 218536 - RNA, 24 nt, Human
gaucccaucuuccccugguagcac

SEQ ID NO: 218537 - RNA, 21 nt, Human
gcaagccccaaggagcauggg

SEQ ID NO: 218538 - RNA, 19 nt, Human
gcaauuuuaaaacccaaca

SEQ ID NO: 218539 - RNA, 24 nt, Human
gcacagguacacagaguuuguccu

SEQ ID NO: 218540 - RNA, 20 nt, Human
gccagggaccaggaacccgg

SEQ ID NO: 218541 - RNA, 21 nt, Human
gccagggcagggguucuggga

SEQ ID NO: 218542 - RNA, 18 nt, Human
gcccccaagcaagcccag

SEQ ID NO: 218543 - RNA, 24 nt, Human
gcccugaaguuaggaaaaugacua

SEQ ID NO: 218544 - RNA, 19 nt, Human
gcccuggcauccaccacau

SEQ ID NO: 218545 - RNA, 19 nt, Human
ggccagggagggcgugggc

SEQ ID NO: 218546 - RNA, 26 nt, Human
ggccagggcugcuucugggcucuuuc

SEQ ID NO: 218547 - RNA, 21 nt, Human
ggcuggugcuuccuagggggc

SEQ ID NO: 218548 - RNA, 22 nt, Human
gggagauuccauuucacaaucc

SEQ ID NO: 218549 - RNA, 18 nt, Human
gggcacagguacacagag

SEQ ID NO: 218550 - RNA, 20 nt, Human
gggcagggguucugggagau

SEQ ID NO: 218551 - RNA, 27 nt, Human
gggcucuuucuaccaagugggaaagga

SEQ ID NO: 218552 - RNA, 22 nt, Human
gggcugggcaggcacggucuuc

SEQ ID NO: 218553 - RNA, 25 nt, Human
ggggcagcaggccuccgcagguggu

SEQ ID NO: 218554 - RNA, 19 nt, Human
ggggugcagaacaggaaga

SEQ ID NO: 218555 - RNA, 19 nt, Human
gggguucugggagauucca

SEQ ID NO: 218556 - RNA, 19 nt, Human
guagaagagaacuagcacg

SEQ ID NO: 218557 - RNA, 22 nt, Human
guccugccugccuuccagauca

SEQ ID NO: 218558 - RNA, 19 nt, Human
gugguggggugggcagugg

SEQ ID NO: 218559 - RNA, 21 nt, Human
uaaaacccaacaaaauaaaua

SEQ ID NO: 218560 - RNA, 21 nt, Human
uaaguaacagaauaacccuaa

SEQ ID NO: 218561 - RNA, 22 nt, Human
uaccagaaagcccugcucccag

SEQ ID NO: 218562 - RNA, 21 nt, Human
uacccuacaagauacccacac

SEQ ID NO: 218563 - RNA, 20 nt, Human
uagaucagagaacacagcca

SEQ ID NO: 218564 - RNA, 19 nt, Human
uagcacccuuggagcucag

SEQ ID NO: 218565 - RNA, 19 nt, Human
uagcacgguaaauacaaaa

SEQ ID NO: 218566 - RNA, 18 nt, Human
uagcuccagaggcccaga

SEQ ID NO: 218567 - RNA, 25 nt, Human
uagcuccuggacucucccagcuccu

SEQ ID NO: 218568 - RNA, 24 nt, Human
uaggaaaaugacuagaaacucuca

SEQ ID NO: 218569 - RNA, 20 nt, Human
uagguucuccacgaaucucc

SEQ ID NO: 218570 - RNA, 20 nt, Human
uaguaggugacccucucuac

SEQ ID NO: 218571 - RNA, 23 nt, Human
ucaaaacaaaggcaaagcuuuca

SEQ ID NO: 218572 - RNA, 24 nt, Human
ucacuauagcuccagaggcccaga

SEQ ID NO: 218573 - RNA, 21 nt, Human
ucacuggcuuucaguuaaaau

SEQ ID NO: 218574 - RNA, 18 nt, Human
ucagucagguguaaguga

SEQ ID NO: 218575 - RNA, 19 nt, Human
uccaaggucccauggggag

SEQ ID NO: 218576 - RNA, 18 nt, Human
uccaaguggcacagcuuc

SEQ ID NO: 218577 - RNA, 21 nt, Human
uccagaggcccagaguugacu

SEQ ID NO: 218578 - RNA, 19 nt, Human
uccauaccagauggguggg

SEQ ID NO: 218579 - RNA, 18 nt, Human
uccauagucucccucugu

SEQ ID NO: 218580 - RNA, 18 nt, Human
ucccacccuccaccccca

SEQ ID NO: 218581 - RNA, 20 nt, Human
ucccacccuccacccccagc

SEQ ID NO: 218582 - RNA, 21 nt, Human
ucccagccagggaccaggaac

SEQ ID NO: 218583 - RNA, 21 nt, Human
ucccucugugucccuagcucc

SEQ ID NO: 218584 - RNA, 21 nt, Human
ucccuguggugacgagggcug

SEQ ID NO: 218585 - RNA, 18 nt, Human
ucgccuccucugggaagg

SEQ ID NO: 218586 - RNA, 19 nt, Human
ucggcaggcgggggggucc

SEQ ID NO: 218587 - RNA, 20 nt, Human
ucucccagcuccuguaccuc

SEQ ID NO: 218588 - RNA, 19 nt, Human
ucuuggcuccugggucugg

SEQ ID NO: 218589 - RNA, 21 nt, Human
ugaccaccccagagccagggg

SEQ ID NO: 218590 - RNA, 18 nt, Human
ugacuagaaacucucauc

SEQ ID NO: 218591 - RNA, 19 nt, Human
ugagagacagaguaggugu

SEQ ID NO: 218592 - RNA, 21 nt, Human
ugagcagcccuggagaggcca

SEQ ID NO: 218593 - RNA, 20 nt, Human
ugauuugcuuuagcaaacuu

SEQ ID NO: 218594 - RNA, 21 nt, Human
ugcacugccaggacccaagga

SEQ ID NO: 218595 - RNA, 19 nt, Human
ugcagagaaacucaaagcu

SEQ ID NO: 218596 - RNA, 20 nt, Human
ugcagagaaacucaaagcua

SEQ ID NO: 218597 - RNA, 21 nt, Human
ugcagagaaacucaaagcuaa

SEQ ID NO: 218598 - RNA, 20 nt, Human
ugccaauaagaggccccaug

SEQ ID NO: 218599 - RNA, 22 nt, Human
ugccagaaggaauucccgccuc

SEQ ID NO: 218600 - RNA, 24 nt, Human
ugccagaaggaauucccgccucca

SEQ ID NO: 218601 - RNA, 18 nt, Human
ugccaggaacucgugggg

SEQ ID NO: 218602 - RNA, 20 nt, Human
ugccaggacccaaggagucc

SEQ ID NO: 218603 - RNA, 19 nt, Human
ugccagggcagggguucug

SEQ ID NO: 218604 - RNA, 27 nt, Human
ugccccaacuaccagaaagcccugcug

SEQ ID NO: 218605 - RNA, 18 nt, Human
uggaagccagaagccugc

SEQ ID NO: 218606 - RNA, 19 nt, Human
uggacagaugcagagaaac

SEQ ID NO: 218607 - RNA, 23 nt, Human
uggcaaaauggcuugagagacag

SEQ ID NO: 218608 - RNA, 19 nt, Human
uggcaagccccaaggagca

SEQ ID NO: 218609 - RNA, 24 nt, Human
uggcacagcuucugcucgccuccu

SEQ ID NO: 218610 - RNA, 18 nt, Human
uggcuccccaacgccccc

SEQ ID NO: 218611 - RNA, 19 nt, Human
uggcuccugggucuggccu

SEQ ID NO: 218612 - RNA, 25 nt, Human
ugggcaggcacggucuuccaggcug

SEQ ID NO: 218613 - RNA, 19 nt, Human
ugggcagguugacaguucc

SEQ ID NO: 218614 - RNA, 22 nt, Human
ugggcucuuucuaccaaguggg

SEQ ID NO: 218615 - RNA, 18 nt, Human
uggggccagggcccagag

SEQ ID NO: 218616 - RNA, 29 nt, Human
uggggccagggcccagagacuccgagggg

SEQ ID NO: 218617 - RNA, 22 nt, Human
uggggccccccgcaggacaggg

SEQ ID NO: 218618 - RNA, 24 nt, Human
uggggugggcagugguuccuccag

SEQ ID NO: 218619 - RNA, 19 nt, Human
uggguggcaagccccaagg

SEQ ID NO: 218620 - RNA, 24 nt, Human
uggguuauauacacauggggugga

SEQ ID NO: 218621 - RNA, 23 nt, Human
ugguagcacccuuggagcucagc

SEQ ID NO: 218622 - RNA, 18 nt, Human
ugucccacccuccacccc

SEQ ID NO: 218623 - RNA, 19 nt, Human
ugucccacccuccaccccc

SEQ ID NO: 218624 - RNA, 23 nt, Human
ugugcaauuuuaaaacccaacaa

SEQ ID NO: 218625 - RNA, 20 nt, Human
ugugcugaggggcugccccc

SEQ ID NO: 218626 - RNA, 21 nt, Human
uguuugacaggcacugugcag

SEQ ID NO: 218627 - RNA, 25 nt, Human
uuccccagagaccccgggguggugg

SEQ ID NO: 218628 - RNA, 23 nt, Human
uuguccugccugcuggcacaugc

SEQ ID NO: 218629 - RNA, 20 nt, Human
aaaacuaggcaacagauaua

SEQ ID NO: 218630 - RNA, 21 nt, Human
aaaugcccaggggccugaaac

SEQ ID NO: 218631 - RNA, 23 nt, Human
aaaugucaucaugccaacaauuc

SEQ ID NO: 218632 - RNA, 28 nt, Human
aaucauauacauacaguauaaaacugag

SEQ ID NO: 218633 - RNA, 21 nt, Human
aauccugcuccucuguaguca

SEQ ID NO: 218634 - RNA, 20 nt, Human
acacaccagcuucaaagaag

SEQ ID NO: 218635 - RNA, 21 nt, Human
acauauauccaaaccuuuaga

SEQ ID NO: 218636 - RNA, 18 nt, Human
acucuguugccaaagcaa

SEQ ID NO: 218637 - RNA, 24 nt, Human
agaaaagaaaucaugugacaagaa

SEQ ID NO: 218638 - RNA, 18 nt, Human
agaugaagaaaaaauaaa

SEQ ID NO: 218639 - RNA, 24 nt, Human
aggcaacagauauaaaagauuuca

SEQ ID NO: 218640 - RNA, 20 nt, Human
aguaucgauuuauccugaac

SEQ ID NO: 218641 - RNA, 20 nt, Human
aguauuaacacaccagcuuc

SEQ ID NO: 218642 - RNA, 22 nt, Human
caaaaugcccaggggccugaaa

SEQ ID NO: 218643 - RNA, 21 nt, Human
caacagauauaaaagauuuca

SEQ ID NO: 218644 - RNA, 18 nt, Human
caagcccagcgaggggug

SEQ ID NO: 218645 - RNA, 22 nt, Human
cacucuguugccaaagcaagcc

SEQ ID NO: 218646 - RNA, 24 nt, Human
caucaagaaaagaaaucaugugac

SEQ ID NO: 218647 - RNA, 25 nt, Human
caucaagaaaagaaaucaugugaca

SEQ ID NO: 218648 - RNA, 21 nt, Human
cauuaucuucuucacaagcua

SEQ ID NO: 218649 - RNA, 21 nt, Human
cccacaccuccucucgggugc

SEQ ID NO: 218650 - RNA, 18 nt, Human
cccggggagccacgccgg

SEQ ID NO: 218651 - RNA, 19 nt, Human
ccgcuggguaaucccaugu

SEQ ID NO: 218652 - RNA, 22 nt, Human
cgagaaacagcaucaccagagg

SEQ ID NO: 218653 - RNA, 22 nt, Human
cgcuggguaaucccauguccgc

SEQ ID NO: 218654 - RNA, 20 nt, Human
cggaacacccacaccuccuc

SEQ ID NO: 218655 - RNA, 19 nt, Human
cucauuagccauacccaca

SEQ ID NO: 218656 - RNA, 28 nt, Human
cucauuagccauacccacacuaauaaua

SEQ ID NO: 218657 - RNA, 29 nt, Human
cucauuagccauacccacacuaauaauaa

SEQ ID NO: 218658 - RNA, 19 nt, Human
cuccucuguagucagcucc

SEQ ID NO: 218659 - RNA, 19 nt, Human
cugauuuaacaguucauag

SEQ ID NO: 218660 - RNA, 21 nt, Human
cuuucuguuaguccuuccaaa

SEQ ID NO: 218661 - RNA, 20 nt, Human
gaaacagcaucaccagagga

SEQ ID NO: 218662 - RNA, 19 nt, Human
gcauuuuuaauauuuuugg

SEQ ID NO: 218663 - RNA, 23 nt, Human
gggggagcagggcgaggagaggg

SEQ ID NO: 218664 - RNA, 21 nt, Human
ggugcaaauccugcuccucug

SEQ ID NO: 218665 - RNA, 22 nt, Human
ggugcaaauccugcuccucuga

SEQ ID NO: 218666 - RNA, 20 nt, Human
uaaaaaacauaaauacuggc

SEQ ID NO: 218667 - RNA, 21 nt, Human
uaaaaguaucuuugaaacuaa

SEQ ID NO: 218668 - RNA, 21 nt, Human
uaacacaccagcuucaaagaa

SEQ ID NO: 218669 - RNA, 19 nt, Human
uaacgagaaacagcaucac

SEQ ID NO: 218670 - RNA, 22 nt, Human
uaaucuagaaaccaucaauuau

SEQ ID NO: 218671 - RNA, 18 nt, Human
uacaugguacaaaaugcc

SEQ ID NO: 218672 - RNA, 18 nt, Human
uacccaggagaugacacu

SEQ ID NO: 218673 - RNA, 24 nt, Human
uagaaaguucccuuuaaaaaauuc

SEQ ID NO: 218674 - RNA, 24 nt, Human
uaggagacggaggcacuacugcca

SEQ ID NO: 218675 - RNA, 24 nt, Human
uaggcaacagauauaaaagauuuc

SEQ ID NO: 218676 - RNA, 24 nt, Human
uauaaaaaacauaaauacuggcua

SEQ ID NO: 218677 - RNA, 19 nt, Human
uaucacuaggagacggagg

SEQ ID NO: 218678 - RNA, 22 nt, Human
ucaaagaagugcacucccuuua

SEQ ID NO: 218679 - RNA, 23 nt, Human
ucacaagcuaaaguaugagccuc

SEQ ID NO: 218680 - RNA, 22 nt, Human
ucagaagaauaacaugucugug

SEQ ID NO: 218681 - RNA, 18 nt, Human
ucucuuguaaaaugagau

SEQ ID NO: 218682 - RNA, 20 nt, Human
ucucuuguaaaaugagaucc

SEQ ID NO: 218683 - RNA, 23 nt, Human
ucuguugccaaagcaagcccagc

SEQ ID NO: 218684 - RNA, 20 nt, Human
ucuugaaaauccugaccugg

SEQ ID NO: 218685 - RNA, 24 nt, Human
ucuuucuugaaaauccugaccugg

SEQ ID NO: 218686 - RNA, 19 nt, Human
ugacaagaaauaaaaccaa

SEQ ID NO: 218687 - RNA, 21 nt, Human
uggacuagauaaucuagaaac

SEQ ID NO: 218688 - RNA, 19 nt, Human
uggcagcagcaucauuuga

SEQ ID NO: 218689 - RNA, 21 nt, Human
ugggucaggcacucuguugcc

SEQ ID NO: 218690 - RNA, 23 nt, Human
uguaaaaugagauccauguacaa

SEQ ID NO: 218691 - RNA, 21 nt, Human
uguagucagcuccuuggugcc

SEQ ID NO: 218692 - RNA, 20 nt, Human
uuuggcacaaaugaaauguc

SEQ ID NO: 218693 - RNA, 20 nt, Human
aaaagcuccaaaguacuaag

SEQ ID NO: 218694 - RNA, 18 nt, Human
aaacaaacaaauaugugg

SEQ ID NO: 218695 - RNA, 19 nt, Human
aagagccacggcggaggca

SEQ ID NO: 218696 - RNA, 25 nt, Human
aagcuuuaaaaauugucagagcaaa

SEQ ID NO: 218697 - RNA, 19 nt, Human
acaucuuggcacuugguug

SEQ ID NO: 218698 - RNA, 18 nt, Human
accugauacuguuaauag

SEQ ID NO: 218699 - RNA, 20 nt, Human
agaauaaccugaacacacca

SEQ ID NO: 218700 - RNA, 27 nt, Human
agaccggggccaagcgccagcucggga

SEQ ID NO: 218701 - RNA, 24 nt, Human
agaguucucccugccccgugucuc

SEQ ID NO: 218702 - RNA, 19 nt, Human
agcucgggacaccccgcga

SEQ ID NO: 218703 - RNA, 21 nt, Human
aguaugagguggugcugggga

SEQ ID NO: 218704 - RNA, 21 nt, Human
auacaguuuuaaauauguaau

SEQ ID NO: 218705 - RNA, 24 nt, Human
aucacuuuuaagcauuuucaugua

SEQ ID NO: 218706 - RNA, 22 nt, Human
auggucucaaaaaacccuuucc

SEQ ID NO: 218707 - RNA, 24 nt, Human
caaauaugugguaucauuuaaagu

SEQ ID NO: 218708 - RNA, 23 nt, Human
caaauggcuuucacuccauguuu

SEQ ID NO: 218709 - RNA, 21 nt, Human
caccccgcgaagaggcagccc

SEQ ID NO: 218710 - RNA, 23 nt, Human
cacucccugucacaucacuuuuu

SEQ ID NO: 218711 - RNA, 22 nt, Human
cagaguaucucccagagucugg

SEQ ID NO: 218712 - RNA, 20 nt, Human
cagccaaccaugucaguggc

SEQ ID NO: 218713 - RNA, 23 nt, Human
cagcccaggcgcccagagaagcc

SEQ ID NO: 218714 - RNA, 21 nt, Human
caggacacugaugaaaggcua

SEQ ID NO: 218715 - RNA, 19 nt, Human
caguggacgucccucuucu

SEQ ID NO: 218716 - RNA, 19 nt, Human
cauccugccgcucccugcc

SEQ ID NO: 218717 - RNA, 20 nt, Human
caugcagacauaucaaaauu

SEQ ID NO: 218718 - RNA, 19 nt, Human
ccaccucguguccacuccc

SEQ ID NO: 218719 - RNA, 20 nt, Human
cccucuucuucccugcgccc

SEQ ID NO: 218720 - RNA, 22 nt, Human
cccugucacaucacuuuuuucc

SEQ ID NO: 218721 - RNA, 21 nt, Human
ccgcagccgccgcccgcuccc

SEQ ID NO: 218722 - RNA, 22 nt, Human
ccgcccgcuccccggcagguuu

SEQ ID NO: 218723 - RNA, 20 nt, Human
ccuauccauaaaacucugcc

SEQ ID NO: 218724 - RNA, 18 nt, Human
ccuccuccuccuccuucc

SEQ ID NO: 218725 - RNA, 18 nt, Human
ccuccuccuucccucucc

SEQ ID NO: 218726 - RNA, 21 nt, Human
ccuccuucccucuccgcuccc

SEQ ID NO: 218727 - RNA, 22 nt, Human
ccuccuucccucuccgcuccca

SEQ ID NO: 218728 - RNA, 19 nt, Human
ccugcgcccucgccgcccu

SEQ ID NO: 218729 - RNA, 20 nt, Human
ccuggggcuuacuguuggcu

SEQ ID NO: 218730 - RNA, 18 nt, Human
cgccgcccucucuccagg

SEQ ID NO: 218731 - RNA, 21 nt, Human
cgcucccugcccucuccagcc

SEQ ID NO: 218732 - RNA, 24 nt, Human
cggcggaggcacggcccgagccac

SEQ ID NO: 218733 - RNA, 23 nt, Human
cgggacaccccgcgaagagggag

SEQ ID NO: 218734 - RNA, 20 nt, Human
cuagaccuuaaaccuuggcc

SEQ ID NO: 218735 - RNA, 21 nt, Human
cuagguucaaaguucugugcu

SEQ ID NO: 218736 - RNA, 21 nt, Human
cuccaacaccuuugcuccucc

SEQ ID NO: 218737 - RNA, 18 nt, Human
cuccagggagccgccgcg

SEQ ID NO: 218738 - RNA, 19 nt, Human
cuccuagguucaaaguucu

SEQ ID NO: 218739 - RNA, 20 nt, Human
cuccuccuccuccuccuucc

SEQ ID NO: 218740 - RNA, 23 nt, Human
cuccuccuucccucuccgcuccc

SEQ ID NO: 218741 - RNA, 22 nt, Human
cugaagcaauucuuuaagcaca

SEQ ID NO: 218742 - RNA, 22 nt, Human
cuggucagaaaaaauacuguca

SEQ ID NO: 218743 - RNA, 25 nt, Human
cugugcugcaugcagacauaucaaa

SEQ ID NO: 218744 - RNA, 18 nt, Human
cuuggauuuuuuuuuccu

SEQ ID NO: 218745 - RNA, 19 nt, Human
cuuggcacuugguuguuuu

SEQ ID NO: 218746 - RNA, 18 nt, Human
gacucuggaggcaguguu

SEQ ID NO: 218747 - RNA, 19 nt, Human
gagaagccgcagccgccgc

SEQ ID NO: 218748 - RNA, 20 nt, Human
gauuaaaauauuuuaaagug

SEQ ID NO: 218749 - RNA, 20 nt, Human
gcacuugguuguuuuuaacu

SEQ ID NO: 218750 - RNA, 25 nt, Human
gcaggacacugaugaaaggcuaguc

SEQ ID NO: 218751 - RNA, 29 nt, Human
gcagguuuccuguuccuuucugaaguuuu

SEQ ID NO: 218752 - RNA, 23 nt, Human
gcugcuucaugcugcuucauguu

SEQ ID NO: 218753 - RNA, 26 nt, Human
ggccaagcgccagcucgggacacccc

SEQ ID NO: 218754 - RNA, 21 nt, Human
ggucuucgcaaccaugaaaac

SEQ ID NO: 218755 - RNA, 24 nt, Human
guggugcuggggaguaccaguagc

SEQ ID NO: 218756 - RNA, 21 nt, Human
uaaaagaagaaauuccagccc

SEQ ID NO: 218757 - RNA, 20 nt, Human
uaaaaggcaaugccaccauc

SEQ ID NO: 218758 - RNA, 24 nt, Human
uaaauuguucucggagcuaaccca

SEQ ID NO: 218759 - RNA, 23 nt, Human
uaacccacucaacaucuuggcac

SEQ ID NO: 218760 - RNA, 23 nt, Human
uaagaauaaccugaacacaccag

SEQ ID NO: 218761 - RNA, 23 nt, Human
uaagaguaacugaaugacagcug

SEQ ID NO: 218762 - RNA, 18 nt, Human
uagcaaacccuaucuaga

SEQ ID NO: 218763 - RNA, 21 nt, Human
uagccaccaaaguaugacuuc

SEQ ID NO: 218764 - RNA, 22 nt, Human
uauaaaaggcaaugccaccauc

SEQ ID NO: 218765 - RNA, 20 nt, Human
uauacaugacuuagaacaug

SEQ ID NO: 218766 - RNA, 20 nt, Human
uauagcaaacccuaucuaga

SEQ ID NO: 218767 - RNA, 23 nt, Human
uauucagugaucaggcaggacac

SEQ ID NO: 218768 - RNA, 22 nt, Human
uauuuugcucugcuauuccaaa

SEQ ID NO: 218769 - RNA, 20 nt, Human
ucagaaaaaauacugucaug

SEQ ID NO: 218770 - RNA, 19 nt, Human
ucagagugaggaauucuuu

SEQ ID NO: 218771 - RNA, 18 nt, Human
ucagggucuuucagcucc

SEQ ID NO: 218772 - RNA, 20 nt, Human
ucccaccucguguccacucc

SEQ ID NO: 218773 - RNA, 23 nt, Human
ucccugccccgugucuccuucca

SEQ ID NO: 218774 - RNA, 20 nt, Human
ucccugcgcccucgccgccc

SEQ ID NO: 218775 - RNA, 19 nt, Human
uccuagguucaaaguucug

SEQ ID NO: 218776 - RNA, 19 nt, Human
uccuggggcuuacuguugg

SEQ ID NO: 218777 - RNA, 21 nt, Human
ucucaauaauuccuaucacuu

SEQ ID NO: 218778 - RNA, 24 nt, Human
ucugaaguuuucucuccaacaccu

SEQ ID NO: 218779 - RNA, 21 nt, Human
ugaaugacagcugaauuucuc

SEQ ID NO: 218780 - RNA, 22 nt, Human
ugaaugacagcugaauuucuca

SEQ ID NO: 218781 - RNA, 21 nt, Human
ugccgcucccugcccucucca

SEQ ID NO: 218782 - RNA, 20 nt, Human
ugcuauuccaaauguguagu

SEQ ID NO: 218783 - RNA, 21 nt, Human
ugcuccacauugacagagccu

SEQ ID NO: 218784 - RNA, 19 nt, Human
ugcucugggucccaacagc

SEQ ID NO: 218785 - RNA, 19 nt, Human
ugcuggggaguaccaguag

SEQ ID NO: 218786 - RNA, 23 nt, Human
uguacuuuuuaccugauacuguu

SEQ ID NO: 218787 - RNA, 21 nt, Human
ugucuccuuccauccugccgc

SEQ ID NO: 218788 - RNA, 18 nt, Human
ugugagaggcaaaagcuc

SEQ ID NO: 218789 - RNA, 21 nt, Human
ugugcuccacauugacagagc

SEQ ID NO: 218790 - RNA, 18 nt, Human
ugugggggagaggccagg

SEQ ID NO: 218791 - RNA, 23 nt, Human
ugugucacaaaccuauaugccac

SEQ ID NO: 218792 - RNA, 24 nt, Human
uuaaaaauugucagagcaaacccu

SEQ ID NO: 218793 - RNA, 18 nt, Human
uucaauacauuucuugga

SEQ ID NO: 218794 - RNA, 19 nt, Human
uucaauacauuucuuggau

SEQ ID NO: 218795 - RNA, 24 nt, Human
uuccuggggcuuacuguuggcuuu

SEQ ID NO: 218796 - RNA, 18 nt, Human
uuccuguuccuuucugaa

SEQ ID NO: 218797 - RNA, 23 nt, Human
uucgcaaccaugaaaacacaguu

SEQ ID NO: 218798 - RNA, 21 nt, Human
uucuucccugcgcccucgccg

SEQ ID NO: 218799 - RNA, 21 nt, Human
uugaaauguggcauuuucuug

SEQ ID NO: 218800 - RNA, 23 nt, Human
uugcuacauuuugaaaagcccuu

SEQ ID NO: 218801 - RNA, 22 nt, Human
uuuaagcacagcaaacguugag

SEQ ID NO: 218802 - RNA, 21 nt, Human
uuuaggaaccaauagcuuaag

SEQ ID NO: 218803 - RNA, 21 nt, Human
aagaggcagguccugggagca

SEQ ID NO: 218804 - RNA, 19 nt, Human
aagccugggaagaggcagg

SEQ ID NO: 218805 - RNA, 23 nt, Human
acagugaggucugcacuggcuac

SEQ ID NO: 218806 - RNA, 19 nt, Human
agcugcacagccaugggca

SEQ ID NO: 218807 - RNA, 27 nt, Human
caaagcccuaaaaucacuaguaacagc

SEQ ID NO: 218808 - RNA, 20 nt, Human
caccaaaaggagaaaaacaa

SEQ ID NO: 218809 - RNA, 22 nt, Human
cacccaacccgagggagggggc

SEQ ID NO: 218810 - RNA, 19 nt, Human
caccuggagccaugccggg

SEQ ID NO: 218811 - RNA, 21 nt, Human
cacgcaagcgcagcucagccc

SEQ ID NO: 218812 - RNA, 19 nt, Human
cagcagaucugaggcacgg

SEQ ID NO: 218813 - RNA, 22 nt, Human
cagcauaacugccaccuccccc

SEQ ID NO: 218814 - RNA, 22 nt, Human
cagccaugggcagggcugagca

SEQ ID NO: 218815 - RNA, 23 nt, Human
cauaacugccaccucccccagag

SEQ ID NO: 218816 - RNA, 19 nt, Human
caucauggagucaccaggc

SEQ ID NO: 218817 - RNA, 24 nt, Human
caugaaacagccacgcaagcgcag

SEQ ID NO: 218818 - RNA, 18 nt, Human
caugccggggguggcaug

SEQ ID NO: 218819 - RNA, 22 nt, Human
cccacaaggaggacuacaaaga

SEQ ID NO: 218820 - RNA, 19 nt, Human
ccccagaggccgcagccgc

SEQ ID NO: 218821 - RNA, 20 nt, Human
ccccagaggccgcagccgcc

SEQ ID NO: 218822 - RNA, 20 nt, Human
ccggggguggcauggacacg

SEQ ID NO: 218823 - RNA, 18 nt, Human
ccuccggggcccagggcg

SEQ ID NO: 218824 - RNA, 24 nt, Human
ccuccggggcccagggcguggggg

SEQ ID NO: 218825 - RNA, 19 nt, Human
ccugggaagaggcaggucc

SEQ ID NO: 218826 - RNA, 24 nt, Human
cucaggccaaaggauuuguaaaac

SEQ ID NO: 218827 - RNA, 22 nt, Human
cucuaagcaggacugucagcuc

SEQ ID NO: 218828 - RNA, 23 nt, Human
cugaggcacggagggagcugcac

SEQ ID NO: 218829 - RNA, 22 nt, Human
gaccccacucuuaacuacccac

SEQ ID NO: 218830 - RNA, 21 nt, Human
gcacagcacccuugaaauaag

SEQ ID NO: 218831 - RNA, 18 nt, Human
gcauaacugccaccuccc

SEQ ID NO: 218832 - RNA, 24 nt, Human
ggaagccugggaagaggcaggucc

SEQ ID NO: 218833 - RNA, 21 nt, Human
gggaagaggcagguccuggga

SEQ ID NO: 218834 - RNA, 26 nt, Human
ggggguggcauggacacgacagugag

SEQ ID NO: 218835 - RNA, 20 nt, Human
ggugggugucagggugucug

SEQ ID NO: 218836 - RNA, 21 nt, Human
uaacagcauaacugccaccuc

SEQ ID NO: 218837 - RNA, 19 nt, Human
uaacauauuaguucucagg

SEQ ID NO: 218838 - RNA, 23 nt, Human
uacaccaaaaggagaaaaacaag

SEQ ID NO: 218839 - RNA, 18 nt, Human
ucaugaaacagccacgca

SEQ ID NO: 218840 - RNA, 20 nt, Human
uccccaggaagccugggaag

SEQ ID NO: 218841 - RNA, 18 nt, Human
ucccccuccaugcucuuc

SEQ ID NO: 218842 - RNA, 19 nt, Human
uccccuguuggggccuucg

SEQ ID NO: 218843 - RNA, 21 nt, Human
ucugcacuggcuacagcagau

SEQ ID NO: 218844 - RNA, 23 nt, Human
ugaggcucccccuccaugcucuu

SEQ ID NO: 218845 - RNA, 19 nt, Human
ugaugagcauccccuguug

SEQ ID NO: 218846 - RNA, 20 nt, Human
ugggaagaggcagguccugg

SEQ ID NO: 218847 - RNA, 21 nt, Human
ugggaagaggcagguccuggg

SEQ ID NO: 218848 - RNA, 21 nt, Human
ugggcagggcugagcacagca

SEQ ID NO: 218849 - RNA, 22 nt, Human
ugggcguacaacucuuccccag

SEQ ID NO: 218850 - RNA, 24 nt, Human
ugucagggugucuggcagaguggg

SEQ ID NO: 218851 - RNA, 24 nt, Human
uuacaccaaaaggagaaaaacaag

SEQ ID NO: 218852 - RNA, 20 nt, Human
uucucaggccaaaggauuug

SEQ ID NO: 218853 - RNA, 22 nt, Human
aaacaaaacacggcccccacuu

SEQ ID NO: 218854 - RNA, 20 nt, Human
aaacacggcccccacuuuuc

SEQ ID NO: 218855 - RNA, 21 nt, Human
aaagaacucaaaccaaacagc

SEQ ID NO: 218856 - RNA, 22 nt, Human
aaauaucacaggccuccgagcc

SEQ ID NO: 218857 - RNA, 27 nt, Human
aacaugcaaacaaaacacggggaaagu

SEQ ID NO: 218858 - RNA, 20 nt, Human
aaccagacccaucccucaag

SEQ ID NO: 218859 - RNA, 24 nt, Human
aaccagacccaucccucaagcccg

SEQ ID NO: 218860 - RNA, 19 nt, Human
acacauucaguucccagca

SEQ ID NO: 218861 - RNA, 20 nt, Human
acaccaguguguuuucauug

SEQ ID NO: 218862 - RNA, 19 nt, Human
acuuugauaacccuaauua

SEQ ID NO: 218863 - RNA, 23 nt, Human
agaaaaggaauacaauuuccaga

SEQ ID NO: 218864 - RNA, 20 nt, Human
agcucuaggcagcauuuccc

SEQ ID NO: 218865 - RNA, 20 nt, Human
agcugcacccuguugagggc

SEQ ID NO: 218866 - RNA, 18 nt, Human
aggcagcauuucccugca

SEQ ID NO: 218867 - RNA, 23 nt, Human
auaauggacugccuucauuuucu

SEQ ID NO: 218868 - RNA, 18 nt, Human
aucacaggccuccgagcc

SEQ ID NO: 218869 - RNA, 20 nt, Human
auguguggccgugggcuggg

SEQ ID NO: 218870 - RNA, 18 nt, Human
caaaacacggcccccacu

SEQ ID NO: 218871 - RNA, 22 nt, Human
caaagagaacaccaucuaguac

SEQ ID NO: 218872 - RNA, 20 nt, Human
cagcagaggggugacuuucu

SEQ ID NO: 218873 - RNA, 23 nt, Human
cagcagaggggugacuuucuaga

SEQ ID NO: 218874 - RNA, 19 nt, Human
caggagagaugggauucug

SEQ ID NO: 218875 - RNA, 20 nt, Human
caguaccaacagaacaugca

SEQ ID NO: 218876 - RNA, 25 nt, Human
ccaaccgagacccagugacccaaca

SEQ ID NO: 218877 - RNA, 18 nt, Human
ccaguaccaacagaacau

SEQ ID NO: 218878 - RNA, 23 nt, Human
ccaguaccaacagaacaugcaaa

SEQ ID NO: 218879 - RNA, 21 nt, Human
cccaucccucaagcccgggaa

SEQ ID NO: 218880 - RNA, 23 nt, Human
cccuagaagccauaaugagaccc

SEQ ID NO: 218881 - RNA, 23 nt, Human
ccgggaaggggcuagacucccag

SEQ ID NO: 218882 - RNA, 21 nt, Human
ccucaagcccgggaaggggcu

SEQ ID NO: 218883 - RNA, 20 nt, Human
ccuguagugaggacaaagga

SEQ ID NO: 218884 - RNA, 20 nt, Human
cgccccagggacaaaucagu

SEQ ID NO: 218885 - RNA, 19 nt, Human
cgggcggguccgcgcugcc

SEQ ID NO: 218886 - RNA, 22 nt, Human
cgucauaauuguuucuaaacuc

SEQ ID NO: 218887 - RNA, 25 nt, Human
cucucaugggaaaugauaacccuac

SEQ ID NO: 218888 - RNA, 19 nt, Human
cugccacaacgcugaugcu

SEQ ID NO: 218889 - RNA, 21 nt, Human
cugccuucauuuucuuuccca

SEQ ID NO: 218890 - RNA, 19 nt, Human
cuguagugaucugauccag

SEQ ID NO: 218891 - RNA, 22 nt, Human
cuuugaggggccugucuuugcc

SEQ ID NO: 218892 - RNA, 20 nt, Human
gaacugaauccacgcaacaa

SEQ ID NO: 218893 - RNA, 22 nt, Human
gaccagcucuucaaagagcuaa

SEQ ID NO: 218894 - RNA, 24 nt, Human
gagaaugauuccuaggagcuuuga

SEQ ID NO: 218895 - RNA, 22 nt, Human
gccuagagggggaaggaacggc

SEQ ID NO: 218896 - RNA, 19 nt, Human
gcgcugccgccccagggac

SEQ ID NO: 218897 - RNA, 18 nt, Human
gcuagacucccagcugca

SEQ ID NO: 218898 - RNA, 21 nt, Human
gcugagcacacccugagcccg

SEQ ID NO: 218899 - RNA, 20 nt, Human
ggcugccaaccgagacccag

SEQ ID NO: 218900 - RNA, 21 nt, Human
gggugguggaggguggaaaag

SEQ ID NO: 218901 - RNA, 23 nt, Human
ggugguggaggguggaaaagugu

SEQ ID NO: 218902 - RNA, 21 nt, Human
uaaacucacaccaaggacugg

SEQ ID NO: 218903 - RNA, 18 nt, Human
uaaagaacucaaaccaaa

SEQ ID NO: 218904 - RNA, 24 nt, Human
uaaaguugccuuuccagugaccug

SEQ ID NO: 218905 - RNA, 22 nt, Human
uaagcaugcugggaaucagaac

SEQ ID NO: 218906 - RNA, 22 nt, Human
uagcauaucuuucauaaauaca

SEQ ID NO: 218907 - RNA, 18 nt, Human
uagggucuuucacccacc

SEQ ID NO: 218908 - RNA, 21 nt, Human
uaguaaccagacccaucccuc

SEQ ID NO: 218909 - RNA, 25 nt, Human
uaugucuguuguucuugauacaaaa

SEQ ID NO: 218910 - RNA, 22 nt, Human
ucaaaccaaacagcuuggcaca

SEQ ID NO: 218911 - RNA, 27 nt, Human
ucacccaccacauaauggacugccuuc

SEQ ID NO: 218912 - RNA, 18 nt, Human
ucaccgagugaucagcuc

SEQ ID NO: 218913 - RNA, 18 nt, Human
ucagaacugaauccacgc

SEQ ID NO: 218914 - RNA, 20 nt, Human
uccacgcaacaauacaccag

SEQ ID NO: 218915 - RNA, 21 nt, Human
uccgagccaaaagagauuuuu

SEQ ID NO: 218916 - RNA, 21 nt, Human
uccgcgcugccgccccaggga

SEQ ID NO: 218917 - RNA, 22 nt, Human
uccuaggagcuuugaggggccu

SEQ ID NO: 218918 - RNA, 20 nt, Human
ugaggacaaaggaaaacaca

SEQ ID NO: 218919 - RNA, 22 nt, Human
ugcaaacaaaacacggccccca

SEQ ID NO: 218920 - RNA, 22 nt, Human
ugccaucccauaucccugugac

SEQ ID NO: 218921 - RNA, 19 nt, Human
ugccccgggaugugcgggg

SEQ ID NO: 218922 - RNA, 20 nt, Human
ugccccgggaugugcggggc

SEQ ID NO: 218923 - RNA, 22 nt, Human
ugcuugaaguaugaccgggcuc

SEQ ID NO: 218924 - RNA, 23 nt, Human
uggauguaagaaacaggaggguu

SEQ ID NO: 218925 - RNA, 21 nt, Human
ugggcugggacccugcugagc

SEQ ID NO: 218926 - RNA, 19 nt, Human
uggggaacguaccaaaaag

SEQ ID NO: 218927 - RNA, 22 nt, Human
uggggugguggaggguggaaaa

SEQ ID NO: 218928 - RNA, 20 nt, Human
uuagcaaaucaaguuacuau

SEQ ID NO: 218929 - RNA, 21 nt, Human
uuauagaaauaggaaagcaug

SEQ ID NO: 218930 - RNA, 20 nt, Human
uucaagcacagaacagguca

SEQ ID NO: 218931 - RNA, 22 nt, Human
uucaugaccacaacaaacuagg

SEQ ID NO: 218932 - RNA, 23 nt, Human
uucauugacauauauuaauacaa

SEQ ID NO: 218933 - RNA, 23 nt, Human
uuuagaaagcacuuugauaaccc

SEQ ID NO: 218934 - RNA, 22 nt, Human
uuucggggcagggaggauuguc

SEQ ID NO: 218935 - RNA, 18 nt, Human
aaacaaacagagcugaac

SEQ ID NO: 218936 - RNA, 19 nt, Human
aaacagagcccccagcgug

SEQ ID NO: 218937 - RNA, 21 nt, Human
aaaccacuccacgguggacac

SEQ ID NO: 218938 - RNA, 23 nt, Human
aacagagcccccagcgugcaugg

SEQ ID NO: 218939 - RNA, 22 nt, Human
aauggaaaccuuggcaucuaaa

SEQ ID NO: 218940 - RNA, 21 nt, Human
aggcugcagccucucauccug

SEQ ID NO: 218941 - RNA, 19 nt, Human
aucaagcuuucccacuuau

SEQ ID NO: 218942 - RNA, 20 nt, Human
aucaaguuucuguuuuuauu

SEQ ID NO: 218943 - RNA, 22 nt, Human
cagcgugcauggcuuugugagg

SEQ ID NO: 218944 - RNA, 22 nt, Human
cauccugacccuuccccuccug

SEQ ID NO: 218945 - RNA, 18 nt, Human
cauucuccagccccagcc

SEQ ID NO: 218946 - RNA, 21 nt, Human
ccccaagagagcgcagucucu

SEQ ID NO: 218947 - RNA, 22 nt, Human
ccccagccuugugggcuguccc

SEQ ID NO: 218948 - RNA, 24 nt, Human
cccucagccccaagagagcgcagu

SEQ ID NO: 218949 - RNA, 21 nt, Human
ccugaguggcugugacccagc

SEQ ID NO: 218950 - RNA, 23 nt, Human
cgagcgguaacaucugguggucu

SEQ ID NO: 218951 - RNA, 20 nt, Human
cuccacgguggacacauuca

SEQ ID NO: 218952 - RNA, 19 nt, Human
cucucauucuccagcccca

SEQ ID NO: 218953 - RNA, 23 nt, Human
cugcauggugcucccucagcccc

SEQ ID NO: 218954 - RNA, 18 nt, Human
gaagcugcauggugcucc

SEQ ID NO: 218955 - RNA, 23 nt, Human
gcccugaaaauggaaaccuuggc

SEQ ID NO: 218956 - RNA, 22 nt, Human
ggcacuguacuaugggguuugg

SEQ ID NO: 218957 - RNA, 23 nt, Human
uaagaaauaugcaaaaacaauga

SEQ ID NO: 218958 - RNA, 18 nt, Human
uagcagagagugauaaaa

SEQ ID NO: 218959 - RNA, 19 nt, Human
uauagcccugaaaauggaa

SEQ ID NO: 218960 - RNA, 20 nt, Human
uccacauuauuagaguucac

SEQ ID NO: 218961 - RNA, 19 nt, Human
uccugaguggcugugaccc

SEQ ID NO: 218962 - RNA, 21 nt, Human
ucucauccugacccuuccccu

SEQ ID NO: 218963 - RNA, 19 nt, Human
ugaggggugaagcugcaug

SEQ ID NO: 218964 - RNA, 19 nt, Human
ugcaggaaaacagagcccc

SEQ ID NO: 218965 - RNA, 21 nt, Human
ugcaggaaaacagagccccca

SEQ ID NO: 218966 - RNA, 24 nt, Human
uggcugugacccagcagaggucac

SEQ ID NO: 218967 - RNA, 22 nt, Human
uguccuaagaaauaugcaaaaa

SEQ ID NO: 218968 - RNA, 19 nt, Human
uucaguaucaggccgcgcc

SEQ ID NO: 218969 - RNA, 19 nt, Human
uuucccacuuauacuccag

SEQ ID NO: 218970 - RNA, 24 nt, Human
aagagccagcgcugaaacugagcc

SEQ ID NO: 218971 - RNA, 22 nt, Human
aagggcacagagucaccaaaac

SEQ ID NO: 218972 - RNA, 18 nt, Human
accaaaaccugucccaac

SEQ ID NO: 218973 - RNA, 21 nt, Human
agagcagcugggcaggagggc

SEQ ID NO: 218974 - RNA, 19 nt, Human
agagguggguaccugcaug

SEQ ID NO: 218975 - RNA, 23 nt, Human
agcagccaaucacccuaggcggc

SEQ ID NO: 218976 - RNA, 18 nt, Human
agcagcugggcaggaggg

SEQ ID NO: 218977 - RNA, 19 nt, Human
agccagugcaacggccgca

SEQ ID NO: 218978 - RNA, 18 nt, Human
aggagggccugcuguggg

SEQ ID NO: 218979 - RNA, 23 nt, Human
caaaaugcuuggaaccacaagug

SEQ ID NO: 218980 - RNA, 23 nt, Human
caaccucauccagaggccagagg

SEQ ID NO: 218981 - RNA, 19 nt, Human
caagaaaggccacuaggug

SEQ ID NO: 218982 - RNA, 19 nt, Human
cacagagucaccaaaaccu

SEQ ID NO: 218983 - RNA, 21 nt, Human
caccaaaaccugucccaacaa

SEQ ID NO: 218984 - RNA, 23 nt, Human
caccaauccaggcuucgccgccc

SEQ ID NO: 218985 - RNA, 26 nt, Human
cagacaauaugcuuccugcugagucc

SEQ ID NO: 218986 - RNA, 19 nt, Human
cagagucaccaaaaccugu

SEQ ID NO: 218987 - RNA, 19 nt, Human
cagauuucaggauuaggga

SEQ ID NO: 218988 - RNA, 18 nt, Human
caugaugcuugggagcug

SEQ ID NO: 218989 - RNA, 20 nt, Human
ccaauccaggcuucgccgcc

SEQ ID NO: 218990 - RNA, 20 nt, Human
ccagagggcugacaagagca

SEQ ID NO: 218991 - RNA, 24 nt, Human
ccagugcaacggccgcaggccgag

SEQ ID NO: 218992 - RNA, 19 nt, Human
cccaagagaaagagguggg

SEQ ID NO: 218993 - RNA, 21 nt, Human
cccaccaaaccggcuaggggg

SEQ ID NO: 218994 - RNA, 19 nt, Human
cccccagaaaagagacuga

SEQ ID NO: 218995 - RNA, 21 nt, Human
ccgcacccgagccaaucaacc

SEQ ID NO: 218996 - RNA, 22 nt, Human
ccugccagcuuccagccagugc

SEQ ID NO: 218997 - RNA, 22 nt, Human
ccugccccgaacgcugcaaaug

SEQ ID NO: 218998 - RNA, 24 nt, Human
ccugcugugggcagggugggaaag

SEQ ID NO: 218999 - RNA, 23 nt, Human
cgaagagccagcgcugaaacuga

SEQ ID NO: 219000 - RNA, 23 nt, Human
cucugccaugcacgaagagccag

SEQ ID NO: 219001 - RNA, 18 nt, Human
cucuuagcuccaccaauc

SEQ ID NO: 219002 - RNA, 25 nt, Human
cugcugaguccauuuuaaaucacac

SEQ ID NO: 219003 - RNA, 19 nt, Human
cugggcaggagggccugcu

SEQ ID NO: 219004 - RNA, 22 nt, Human
cugucccaacaauccccagaca

SEQ ID NO: 219005 - RNA, 19 nt, Human
cuugccagagccucaccca

SEQ ID NO: 219006 - RNA, 23 nt, Human
gaaaagggggcgaagggucucag

SEQ ID NO: 219007 - RNA, 24 nt, Human
gaaauagcagccccuaacugcgga

SEQ ID NO: 219008 - RNA, 18 nt, Human
gagccagcgcugaaacug

SEQ ID NO: 219009 - RNA, 23 nt, Human
gagccagcucuuagcuccaccaa

SEQ ID NO: 219010 - RNA, 28 nt, Human
gaguccauuuuaaaucacacaacacuag

SEQ ID NO: 219011 - RNA, 19 nt, Human
gcacagagucaccaaaacc

SEQ ID NO: 219012 - RNA, 19 nt, Human
gccagcucuuagcuccacc

SEQ ID NO: 219013 - RNA, 19 nt, Human
ggaggugggcaccugcaug

SEQ ID NO: 219014 - RNA, 23 nt, Human
ggccacuaggugcaggaaaaggg

SEQ ID NO: 219015 - RNA, 18 nt, Human
ggcugcgaggcccaugau

SEQ ID NO: 219016 - RNA, 18 nt, Human
gggcaggagggccugcug

SEQ ID NO: 219017 - RNA, 21 nt, Human
gggcaggagggccugcugugg

SEQ ID NO: 219018 - RNA, 19 nt, Human
gugggcaccugcaugcccc

SEQ ID NO: 219019 - RNA, 19 nt, Human
guggguaccugcaugcccc

SEQ ID NO: 219020 - RNA, 26 nt, Human
uaaaucacacaacacuagccguggca

SEQ ID NO: 219021 - RNA, 19 nt, Human
uccccagacaauaugcuuc

SEQ ID NO: 219022 - RNA, 22 nt, Human
uccccagacaauaugcuuccug

SEQ ID NO: 219023 - RNA, 21 nt, Human
ucgccgcccaccaaaccggcu

SEQ ID NO: 219024 - RNA, 21 nt, Human
ugccccgaacgcugcaaaugc

SEQ ID NO: 219025 - RNA, 19 nt, Human
ugccuacccugggaggugg

SEQ ID NO: 219026 - RNA, 19 nt, Human
ugccuacccugggaggugg

SEQ ID NO: 219027 - RNA, 24 nt, Human
ugcugaguccauuuuaaaucacac

SEQ ID NO: 219028 - RNA, 20 nt, Human
ugcuuggaaccacaaguguu

SEQ ID NO: 219029 - RNA, 18 nt, Human
uggagaacucaaccucau

SEQ ID NO: 219030 - RNA, 18 nt, Human
uggcgugcucccuaggau

SEQ ID NO: 219031 - RNA, 20 nt, Human
ugggcagggugggaaagccg

SEQ ID NO: 219032 - RNA, 20 nt, Human
uguggagaacucaaccucau

SEQ ID NO: 219033 - RNA, 22 nt, Human
uuagggauacuuaaccuguacc

SEQ ID NO: 219034 - RNA, 23 nt, Human
uucccaagaaaggccacuaggug

SEQ ID NO: 219035 - RNA, 24 nt, Human
uuggaccgcacccgagccaaucaa

SEQ ID NO: 219036 - RNA, 18 nt, Human
cacaguaaggcugaggca

SEQ ID NO: 219037 - RNA, 19 nt, Human
caguaaggcugaggcagag

SEQ ID NO: 219038 - RNA, 20 nt, Human
uagaagcuacugucaaccag

SEQ ID NO: 219039 - RNA, 21 nt, Human
ucacaguaaggcugaggcaga

SEQ ID NO: 219040 - RNA, 20 nt, Human
uuagaagcuacugucaaccg

SEQ ID NO: 219041 - RNA, 23 nt, Human
aaaaaacccagccuagcucgcgg

SEQ ID NO: 219042 - RNA, 18 nt, Human
aaaaaaccuguucuaaac

SEQ ID NO: 219043 - RNA, 23 nt, Human
aaaaacaaaaaacaaacaaacaa

SEQ ID NO: 219044 - RNA, 21 nt, Human
aaaacaaaaaacaaacaaaca

SEQ ID NO: 219045 - RNA, 18 nt, Human
aaaaggggggagggaggg

SEQ ID NO: 219046 - RNA, 18 nt, Human
aaacaaacaaaaaaaccu

SEQ ID NO: 219047 - RNA, 26 nt, Human
aaacaacaccacuuuucaaaagcccu

SEQ ID NO: 219048 - RNA, 24 nt, Human
aaacaucugacgucguacaaaaaa

SEQ ID NO: 219049 - RNA, 30 nt, Human
aaacaucugacgucguacaaaaaaaauucc

SEQ ID NO: 219050 - RNA, 24 nt, Human
aaaccuguucuaaacuaauccuca

SEQ ID NO: 219051 - RNA, 23 nt, Human
aaaucagaauuuacaaagucaga

SEQ ID NO: 219052 - RNA, 19 nt, Human
aacaaaaaacaaacaaaca

SEQ ID NO: 219053 - RNA, 23 nt, Human
aacaaguaaugagaagaguucaa

SEQ ID NO: 219054 - RNA, 20 nt, Human
aaccacucacauuuuggcua

SEQ ID NO: 219055 - RNA, 20 nt, Human
aacucaagagucaauaaaua

SEQ ID NO: 219056 - RNA, 22 nt, Human
aacuuguucccuuacugcucug

SEQ ID NO: 219057 - RNA, 21 nt, Human
aagcagaaaaacaaaaaacaa

SEQ ID NO: 219058 - RNA, 21 nt, Human
aaggcacuuucaaauacagaa

SEQ ID NO: 219059 - RNA, 24 nt, Human
acaaacaaaaaaaccuguucuaaa

SEQ ID NO: 219060 - RNA, 19 nt, Human
acaaaguucuacuuuugac

SEQ ID NO: 219061 - RNA, 24 nt, Human
acaucaaagucuccccucccccaa

SEQ ID NO: 219062 - RNA, 22 nt, Human
accaauauacaaaaacaacuca

SEQ ID NO: 219063 - RNA, 23 nt, Human
accaauauacaaaaacaacucag

SEQ ID NO: 219064 - RNA, 18 nt, Human
accacuuuucaaaagccc

SEQ ID NO: 219065 - RNA, 27 nt, Human
agaaaaacaaaaaacaaacaaacaaaa

SEQ ID NO: 219066 - RNA, 20 nt, Human
agaaacuaccauugccagug

SEQ ID NO: 219067 - RNA, 22 nt, Human
agacucgaguaugacacgacag

SEQ ID NO: 219068 - RNA, 19 nt, Human
agccaaccacagaaacuac

SEQ ID NO: 219069 - RNA, 21 nt, Human
aggcaaagagcccggccuccu

SEQ ID NO: 219070 - RNA, 19 nt, Human
aggcaguguacucuauggc

SEQ ID NO: 219071 - RNA, 22 nt, Human
agggggcugggcaggcuccugg

SEQ ID NO: 219072 - RNA, 24 nt, Human
aguaaugagaagaguucaaaaaaa

SEQ ID NO: 219073 - RNA, 24 nt, Human
auaggacaauacaaaguaucuuca

SEQ ID NO: 219074 - RNA, 21 nt, Human
auggaaaaaggggggagggag

SEQ ID NO: 219075 - RNA, 25 nt, Human
auggaaaaaggggggagggagggga

SEQ ID NO: 219076 - RNA, 22 nt, Human
caaaaaaaccuguucuaaacua

SEQ ID NO: 219077 - RNA, 21 nt, Human
caaacaaacaaaaaaaccugu

SEQ ID NO: 219078 - RNA, 24 nt, Human
caaaggcacuuucaaauacagaac

SEQ ID NO: 219079 - RNA, 22 nt, Human
caacucaagagucaauaaauau

SEQ ID NO: 219080 - RNA, 20 nt, Human
caauggugaaccaacaagau

SEQ ID NO: 219081 - RNA, 18 nt, Human
cacagaaacuaccauugc

SEQ ID NO: 219082 - RNA, 23 nt, Human
cacauacauauaaauaaaaagga

SEQ ID NO: 219083 - RNA, 23 nt, Human
cagaaaaacaaaaaacaaacaaa

SEQ ID NO: 219084 - RNA, 23 nt, Human
cagaaacuaccauugccagugua

SEQ ID NO: 219085 - RNA, 24 nt, Human
cagcagaucaccugccugucucuu

SEQ ID NO: 219086 - RNA, 21 nt, Human
cagccaaccacagaaacuacc

SEQ ID NO: 219087 - RNA, 24 nt, Human
cagucaguccuuaaaacguguuuu

SEQ ID NO: 219088 - RNA, 23 nt, Human
cauuuuuuucuuuaaauucuuca

SEQ ID NO: 219089 - RNA, 19 nt, Human
ccaaccacagaaacuacca

SEQ ID NO: 219090 - RNA, 19 nt, Human
ccaagaacaacacaucaaa

SEQ ID NO: 219091 - RNA, 23 nt, Human
ccacacuguuccauguuuucaua

SEQ ID NO: 219092 - RNA, 21 nt, Human
ccagccaaccacagaaacuac

SEQ ID NO: 219093 - RNA, 21 nt, Human
cccccuccucuuccaccuccc

SEQ ID NO: 219094 - RNA, 19 nt, Human
ccgcugccccugcggccgc

SEQ ID NO: 219095 - RNA, 18 nt, Human
ccgcugcuguucgcgcug

SEQ ID NO: 219096 - RNA, 26 nt, Human
ccgcugcuguucgcgcuggugcugcc

SEQ ID NO: 219097 - RNA, 18 nt, Human
ccucccggcuuucuuucc

SEQ ID NO: 219098 - RNA, 23 nt, Human
cgaauggugaaaagaaaucagaa

SEQ ID NO: 219099 - RNA, 18 nt, Human
cgcucccccuccucuucc

SEQ ID NO: 219100 - RNA, 18 nt, Human
cuaaagcagaaaaacaaa

SEQ ID NO: 219101 - RNA, 22 nt, Human
cucaagagucaauaaauauaaa

SEQ ID NO: 219102 - RNA, 23 nt, Human
cucccccaacaacaaaaauacaa

SEQ ID NO: 219103 - RNA, 23 nt, Human
cucccccuccucuuccaccuccc

SEQ ID NO: 219104 - RNA, 19 nt, Human
cuccccuagauggggcucc

SEQ ID NO: 219105 - RNA, 23 nt, Human
cuggaaaacaacaccacuuuuca

SEQ ID NO: 219106 - RNA, 22 nt, Human
cuggugcugccgccggugcugc

SEQ ID NO: 219107 - RNA, 19 nt, Human
cuuaaauuaacacagggau

SEQ ID NO: 219108 - RNA, 19 nt, Human
cuugaacuucguaauagca

SEQ ID NO: 219109 - RNA, 23 nt, Human
cuuucaagagcggcccguuccag

SEQ ID NO: 219110 - RNA, 25 nt, Human
cuuucuuuccuucucucgcgcuccc

SEQ ID NO: 219111 - RNA, 18 nt, Human
gaagugggagcucaaaga

SEQ ID NO: 219112 - RNA, 18 nt, Human
gaggggagaaaaaaaaaa

SEQ ID NO: 219113 - RNA, 20 nt, Human
gcagaaaaacaaaaaacaaa

SEQ ID NO: 219114 - RNA, 19 nt, Human
gcagagccuauuauacccc

SEQ ID NO: 219115 - RNA, 21 nt, Human
gccccaggucuuugagaacuc

SEQ ID NO: 219116 - RNA, 24 nt, Human
gcugcuguucgcgcuggugcugcc

SEQ ID NO: 219117 - RNA, 23 nt, Human
gcuucacagcagccccaggucuu

SEQ ID NO: 219118 - RNA, 20 nt, Human
ggaaaaaggggggagggagg

SEQ ID NO: 219119 - RNA, 18 nt, Human
ggcugggcaggcuccugg

SEQ ID NO: 219120 - RNA, 19 nt, Human
gugcuuccaaguucacaca

SEQ ID NO: 219121 - RNA, 24 nt, Human
uaaagcagaaaaacaaaaaacaaa

SEQ ID NO: 219122 - RNA, 23 nt, Human
uaacacuaauaggacaauacaaa

SEQ ID NO: 219123 - RNA, 18 nt, Human
uaacuauacaaaguucua

SEQ ID NO: 219124 - RNA, 25 nt, Human
uaaggcaggcaguguacucuauggc

SEQ ID NO: 219125 - RNA, 18 nt, Human
uacaaagucagauuggug

SEQ ID NO: 219126 - RNA, 20 nt, Human
uacaaugcuaucaaaaaccu

SEQ ID NO: 219127 - RNA, 22 nt, Human
uauaaauaaaacuaugaucuaa

SEQ ID NO: 219128 - RNA, 23 nt, Human
uauaccccgauuaccagaacaga

SEQ ID NO: 219129 - RNA, 26 nt, Human
uauugccaagaacaacacaucaaaga

SEQ ID NO: 219130 - RNA, 22 nt, Human
ucaaaacuuaaauuaacacagg

SEQ ID NO: 219131 - RNA, 21 nt, Human
ucaaaauuuauugccaagaac

SEQ ID NO: 219132 - RNA, 18 nt, Human
ucagacucgaguaugaca

SEQ ID NO: 219133 - RNA, 19 nt, Human
ucagcaggguggcagaagc

SEQ ID NO: 219134 - RNA, 20 nt, Human
ucagcaggguggcagaagca

SEQ ID NO: 219135 - RNA, 19 nt, Human
ucaguucuuccuccauccc

SEQ ID NO: 219136 - RNA, 19 nt, Human
uccagaugaguuuuguggu

SEQ ID NO: 219137 - RNA, 18 nt, Human
uccaucaguauucugggc

SEQ ID NO: 219138 - RNA, 18 nt, Human
ucccagccaaccacagaa

SEQ ID NO: 219139 - RNA, 20 nt, Human
uccccuagauggggcucccg

SEQ ID NO: 219140 - RNA, 20 nt, Human
ucccuaaaugcaguagauua

SEQ ID NO: 219141 - RNA, 27 nt, Human
ucgcgcuggugcugccgccggugcugc

SEQ ID NO: 219142 - RNA, 20 nt, Human
ucgggacgccgccgcugcug

SEQ ID NO: 219143 - RNA, 24 nt, Human
ucuaaacacauacauauaaauaaa

SEQ ID NO: 219144 - RNA, 22 nt, Human
ucuccccucccccaacaacaaa

SEQ ID NO: 219145 - RNA, 18 nt, Human
ucuggcagaagugggagc

SEQ ID NO: 219146 - RNA, 19 nt, Human
ucuuacuggacauuuuaug

SEQ ID NO: 219147 - RNA, 22 nt, Human
ucuuuccuucucucgcgcuccc

SEQ ID NO: 219148 - RNA, 24 nt, Human
ugacaucaaagucuccccuccccc

SEQ ID NO: 219149 - RNA, 23 nt, Human
ugacgucguacaaaaaaaauucc

SEQ ID NO: 219150 - RNA, 22 nt, Human
ugagaacuccagaugaguuuug

SEQ ID NO: 219151 - RNA, 24 nt, Human
ugagaacuccagaugaguuuugug

SEQ ID NO: 219152 - RNA, 23 nt, Human
ugagacgcucccccuccucuucc

SEQ ID NO: 219153 - RNA, 23 nt, Human
ugcauggaaaaaggggggaggga

SEQ ID NO: 219154 - RNA, 19 nt, Human
ugcugccgccggugcugcc

SEQ ID NO: 219155 - RNA, 26 nt, Human
uggaaaacaacaccacuuuucaaaag

SEQ ID NO: 219156 - RNA, 27 nt, Human
uggaaaacaacaccacuuuucaaaagc

SEQ ID NO: 219157 - RNA, 21 nt, Human
uggcagaagcacacggcaaag

SEQ ID NO: 219158 - RNA, 19 nt, Human
uggcagaagugggagcuca

SEQ ID NO: 219159 - RNA, 19 nt, Human
uggcagaagugggagcuca

SEQ ID NO: 219160 - RNA, 23 nt, Human
uggcagaagugggagcucaaaga

SEQ ID NO: 219161 - RNA, 22 nt, Human
ugggcaggcuccugggagccug

SEQ ID NO: 219162 - RNA, 21 nt, Human
uuaaagaacuacaagcccuca

SEQ ID NO: 219163 - RNA, 21 nt, Human
uucaagucuaaagcagaaaaa

SEQ ID NO: 219164 - RNA, 20 nt, Human
uuccaaguucacacaauuaa

SEQ ID NO: 219165 - RNA, 19 nt, Human
uuccuucucucgcgcuccc

SEQ ID NO: 219166 - RNA, 22 nt, Human
uucgcgcuggugcugccgccgg

SEQ ID NO: 219167 - RNA, 23 nt, Human
uuuacauaacuauacaaaguucu

SEQ ID NO: 219168 - RNA, 22 nt, Human
uuugugguugaaaagccuuuca

SEQ ID NO: 219169 - RNA, 21 nt, Human
uuuuuuuuuuuuuuuuccauu

SEQ ID NO: 219170 - RNA, 21 nt, Human
aaaaaugcacuuucacgagga

SEQ ID NO: 219171 - RNA, 20 nt, Human
aacugcgcagcaggaagggc

SEQ ID NO: 219172 - RNA, 28 nt, Human
aagcacaguggagagaucgccgguaccc

SEQ ID NO: 219173 - RNA, 24 nt, Human
aaucaaauauacagagugcuuccu

SEQ ID NO: 219174 - RNA, 22 nt, Human
acaaaaauagcaacuauccgag

SEQ ID NO: 219175 - RNA, 20 nt, Human
acaguggagagaucgcugga

SEQ ID NO: 219176 - RNA, 21 nt, Human
accggcacuuuggccuggagc

SEQ ID NO: 219177 - RNA, 21 nt, Human
accguaggucccaccgacagc

SEQ ID NO: 219178 - RNA, 21 nt, Human
accucaggccccacuaacaac

SEQ ID NO: 219179 - RNA, 25 nt, Human
acgccgaugaccucaggccccacua

SEQ ID NO: 219180 - RNA, 22 nt, Human
agccaugggucucaccggcacu

SEQ ID NO: 219181 - RNA, 24 nt, Human
agccaugggucucaccggcacuuu

SEQ ID NO: 219182 - RNA, 18 nt, Human
agcgcccgcccgcccucc

SEQ ID NO: 219183 - RNA, 22 nt, Human
agcggcagaggcggcggcggcg

SEQ ID NO: 219184 - RNA, 19 nt, Human
aggcggcggcggcggcggc

SEQ ID NO: 219185 - RNA, 18 nt, Human
aggugcgucaacagccac

SEQ ID NO: 219186 - RNA, 21 nt, Human
caaauauacagagugcuuccu

SEQ ID NO: 219187 - RNA, 23 nt, Human
caaauauacagagugcuuccuuu

SEQ ID NO: 219188 - RNA, 21 nt, Human
caagcgcgagguugaccugcc

SEQ ID NO: 219189 - RNA, 18 nt, Human
caauacugccgccguccc

SEQ ID NO: 219190 - RNA, 25 nt, Human
cacaccaucagccacgggucccacc

SEQ ID NO: 219191 - RNA, 27 nt, Human
caccaacagccaugggccacaccaaca

SEQ ID NO: 219192 - RNA, 19 nt, Human
caccaucagccacgggucc

SEQ ID NO: 219193 - RNA, 25 nt, Human
caccaucagccacgggucccaccaa

SEQ ID NO: 219194 - RNA, 24 nt, Human
cacccgcgcaccugcauaugcaug

SEQ ID NO: 219195 - RNA, 21 nt, Human
caccgacagccacaggccaca

SEQ ID NO: 219196 - RNA, 19 nt, Human
caccgaccaccguaggucc

SEQ ID NO: 219197 - RNA, 18 nt, Human
cagcggcagcggcagagg

SEQ ID NO: 219198 - RNA, 21 nt, Human
caggccccacuaacaaccaca

SEQ ID NO: 219199 - RNA, 21 nt, Human
caggguggacuggccagcaag

SEQ ID NO: 219200 - RNA, 27 nt, Human
cauugacagccacgagucccaccgaca

SEQ ID NO: 219201 - RNA, 21 nt, Human
ccacaccaucagccacggguc

SEQ ID NO: 219202 - RNA, 23 nt, Human
ccagggccacaucaauaaccagg

SEQ ID NO: 219203 - RNA, 21 nt, Human
cccaccgacagccacaggucc

SEQ ID NO: 219204 - RNA, 18 nt, Human
cccccgcgacccgcccgc

SEQ ID NO: 219205 - RNA, 19 nt, Human
cccccgcgacccgcccgcc

SEQ ID NO: 219206 - RNA, 22 nt, Human
ccccgccgccgccgcccgcgcc

SEQ ID NO: 219207 - RNA, 24 nt, Human
ccccgccgccgccgcccgcgcccg

SEQ ID NO: 219208 - RNA, 19 nt, Human
cccgcgcaccugcauaugc

SEQ ID NO: 219209 - RNA, 22 nt, Human
cccgcgcaccugcauaugcaug

SEQ ID NO: 219210 - RNA, 24 nt, Human
cccgcgcucccggcaccgcagcca

SEQ ID NO: 219211 - RNA, 22 nt, Human
cccggccccgccgccgccgccc

SEQ ID NO: 219212 - RNA, 25 nt, Human
cccggccucggcucugcgccgguuc

SEQ ID NO: 219213 - RNA, 21 nt, Human
cccggcggcgacggcggcggc

SEQ ID NO: 219214 - RNA, 18 nt, Human
ccgcccgcgcccggcucc

SEQ ID NO: 219215 - RNA, 19 nt, Human
ccgccgccgccgcccgcgc

SEQ ID NO: 219216 - RNA, 23 nt, Human
ccgccgccgccgcccgcgcccgg

SEQ ID NO: 219217 - RNA, 19 nt, Human
ccgccgcgccggccuccca

SEQ ID NO: 219218 - RNA, 22 nt, Human
ccgcggcgcgcgggccugggcg

SEQ ID NO: 219219 - RNA, 21 nt, Human
ccggccccgccgccgccgccc

SEQ ID NO: 219220 - RNA, 22 nt, Human
ccggccucggcucugcgcgccc

SEQ ID NO: 219221 - RNA, 21 nt, Human
ccggcucccagccgccgcgcc

SEQ ID NO: 219222 - RNA, 24 nt, Human
ccucccagcgcccgcccgcccucc

SEQ ID NO: 219223 - RNA, 18 nt, Human
ccugggcggcgggcgugc

SEQ ID NO: 219224 - RNA, 23 nt, Human
ccuugggccacgccgaugaccuc

SEQ ID NO: 219225 - RNA, 23 nt, Human
cgagggcccugggucccggccca

SEQ ID NO: 219226 - RNA, 23 nt, Human
cgcccgcccuccgagcgcccgca

SEQ ID NO: 219227 - RNA, 18 nt, Human
cgccgcggcgcgcgggcc

SEQ ID NO: 219228 - RNA, 19 nt, Human
cgcgcccggcucccagccg

SEQ ID NO: 219229 - RNA, 23 nt, Human
cggcagccagggccacaucaaua

SEQ ID NO: 219230 - RNA, 21 nt, Human
cggcccagcuggcagccgccc

SEQ ID NO: 219231 - RNA, 20 nt, Human
cggcccggcucccacccggc

SEQ ID NO: 219232 - RNA, 21 nt, Human
cggcggcggcggugaaggcag

SEQ ID NO: 219233 - RNA, 25 nt, Human
cgucaacagccacgggccgugccgg

SEQ ID NO: 219234 - RNA, 24 nt, Human
cuccggcugcccggcccggcuccc

SEQ ID NO: 219235 - RNA, 22 nt, Human
gaacgagacugacagcucgcuc

SEQ ID NO: 219236 - RNA, 20 nt, Human
gaggcggcggcggcggcggc

SEQ ID NO: 219237 - RNA, 18 nt, Human
gagugaggaauaaaagga

SEQ ID NO: 219238 - RNA, 22 nt, Human
gcagcaggaagggcacuucuga

SEQ ID NO: 219239 - RNA, 20 nt, Human
gcaggaagggcacuucugaa

SEQ ID NO: 219240 - RNA, 20 nt, Human
gcccugggucccggcccagc

SEQ ID NO: 219241 - RNA, 19 nt, Human
gccggggccggcagguggg

SEQ ID NO: 219242 - RNA, 21 nt, Human
gccucccagcgcccgcccgcc

SEQ ID NO: 219243 - RNA, 24 nt, Human
gcgacggcggcggcggugaaggcu

SEQ ID NO: 219244 - RNA, 23 nt, Human
gcggcagaggcggcggcggcggc

SEQ ID NO: 219245 - RNA, 19 nt, Human
gcggcgacggcggcggcgg

SEQ ID NO: 219246 - RNA, 20 nt, Human
gcggcggcggcggcgcgggc

SEQ ID NO: 219247 - RNA, 19 nt, Human
gcggcggcggcggcggcgc

SEQ ID NO: 219248 - RNA, 19 nt, Human
gcggcggcggugaaggcag

SEQ ID NO: 219249 - RNA, 20 nt, Human
gcggcggcggugaaggcagc

SEQ ID NO: 219250 - RNA, 18 nt, Human
gcggcggugaaggcagcg

SEQ ID NO: 219251 - RNA, 23 nt, Human
ggcagaggcggcggcggcggcgg

SEQ ID NO: 219252 - RNA, 22 nt, Human
ggcggcgacggcggcggcggug

SEQ ID NO: 219253 - RNA, 20 nt, Human
gggcagcgccuggugccacg

SEQ ID NO: 219254 - RNA, 18 nt, Human
gggcggcggcagcuccgg

SEQ ID NO: 219255 - RNA, 19 nt, Human
gggcguucugggcaggagg

SEQ ID NO: 219256 - RNA, 21 nt, Human
uaaagaaacuaugcacauggc

SEQ ID NO: 219257 - RNA, 19 nt, Human
uacaaaaauagcaacuauc

SEQ ID NO: 219258 - RNA, 18 nt, Human
uacuccauuguuuucagc

SEQ ID NO: 219259 - RNA, 19 nt, Human
ucaggccccacuaacaacc

SEQ ID NO: 219260 - RNA, 19 nt, Human
uccauuguuuucagccuga

SEQ ID NO: 219261 - RNA, 21 nt, Human
ucccacccggcggcgacggcg

SEQ ID NO: 219262 - RNA, 18 nt, Human
ucccaccgagggcccugg

SEQ ID NO: 219263 - RNA, 19 nt, Human
ugaaagcacaguggagaga

SEQ ID NO: 219264 - RNA, 22 nt, Human
ugaccucaggccccacuaacaa

SEQ ID NO: 219265 - RNA, 18 nt, Human
ugccggccuugggccacg

SEQ ID NO: 219266 - RNA, 18 nt, Human
uggccagcaagcgcgagg

SEQ ID NO: 219267 - RNA, 23 nt, Human
uggccucggccuccggguccggc

SEQ ID NO: 219268 - RNA, 18 nt, Human
ugggagaacugcgcagca

SEQ ID NO: 219269 - RNA, 23 nt, Human
uucugggcaggaggaagcacaga

SEQ ID NO: 219270 - RNA, 19 nt, Human
uugguuuuuguuuuuggug

SEQ ID NO: 219271 - RNA, 18 nt, Human
uuuuuguuuuuggugguu

SEQ ID NO: 219272 - RNA, 23 nt, Human
cagcuguccaguguucuccaaga

SEQ ID NO: 219273 - RNA, 19 nt, Human
ucagcuguccaguguucuc

SEQ ID NO: 219274 - RNA, 20 nt, Human
uccaguguucuccaagaagc

SEQ ID NO: 219275 - RNA, 23 nt, Human
aaaaaacacauucaccacaaaua

SEQ ID NO: 219276 - RNA, 18 nt, Human
aaagcugaguugaaaaag

SEQ ID NO: 219277 - RNA, 21 nt, Human
aacagacaauguuuaagaaac

SEQ ID NO: 219278 - RNA, 19 nt, Human
aauaauaguccacagcaau

SEQ ID NO: 219279 - RNA, 18 nt, Human
acacagaucgggcgacca

SEQ ID NO: 219280 - RNA, 20 nt, Human
accacaaauagauacaaggg

SEQ ID NO: 219281 - RNA, 22 nt, Human
accacaaauagauacaagggaa

SEQ ID NO: 219282 - RNA, 18 nt, Human
accuccaggcugggcccu

SEQ ID NO: 219283 - RNA, 19 nt, Human
acugcaaugcaaaauucug

SEQ ID NO: 219284 - RNA, 18 nt, Human
aggaauucucauuaaugu

SEQ ID NO: 219285 - RNA, 18 nt, Human
cagcucaaaggaugacaa

SEQ ID NO: 219286 - RNA, 21 nt, Human
cagcucaaaggaugacaauau

SEQ ID NO: 219287 - RNA, 21 nt, Human
cauuuccccucuaaaaaggaa

SEQ ID NO: 219288 - RNA, 20 nt, Human
ccccuucugcuccucuuccu

SEQ ID NO: 219289 - RNA, 21 nt, Human
ccccuucugcuccucuuccuc

SEQ ID NO: 219290 - RNA, 20 nt, Human
cccgacgcgcgccgcaagcc

SEQ ID NO: 219291 - RNA, 21 nt, Human
cccgacgcgcgccgcaagccc

SEQ ID NO: 219292 - RNA, 24 nt, Human
cccuccagugugggcucagcuccc

SEQ ID NO: 219293 - RNA, 20 nt, Human
cccucuaaaaaggaaauaaa

SEQ ID NO: 219294 - RNA, 21 nt, Human
cccugcgccgcagcagcccuc

SEQ ID NO: 219295 - RNA, 23 nt, Human
ccgaccggccgagaagccgaagu

SEQ ID NO: 219296 - RNA, 23 nt, Human
ccgcagcagcccucagccccgac

SEQ ID NO: 219297 - RNA, 21 nt, Human
ccuccagugugggcucagcuc

SEQ ID NO: 219298 - RNA, 19 nt, Human
ccucuuccucucuccuucc

SEQ ID NO: 219299 - RNA, 22 nt, Human
ccugcgccgcagcagcccucag

SEQ ID NO: 219300 - RNA, 21 nt, Human
cgaacacccaagcgagccggg

SEQ ID NO: 219301 - RNA, 21 nt, Human
cgcugcugcccccuucugcuc

SEQ ID NO: 219302 - RNA, 18 nt, Human
cgggcgccggcccagccu

SEQ ID NO: 219303 - RNA, 29 nt, Human
cuccaggcugggcccucgggggcccuccc

SEQ ID NO: 219304 - RNA, 22 nt, Human
cucuucuaugacugcaaugcaa

SEQ ID NO: 219305 - RNA, 20 nt, Human
cugggcccucgggggcccuc

SEQ ID NO: 219306 - RNA, 18 nt, Human
cuuuuacugguggccuca

SEQ ID NO: 219307 - RNA, 22 nt, Human
gacgcgaacacccaagcgagcc

SEQ ID NO: 219308 - RNA, 23 nt, Human
gcaaaauucugaaaccccucaaa

SEQ ID NO: 219309 - RNA, 18 nt, Human
gcagagucuuuuucagaa

SEQ ID NO: 219310 - RNA, 20 nt, Human
gccccggggcgggcacggcu

SEQ ID NO: 219311 - RNA, 21 nt, Human
gcccuccagugugggcucagc

SEQ ID NO: 219312 - RNA, 20 nt, Human
gccgcaagcccgggccgagg

SEQ ID NO: 219313 - RNA, 21 nt, Human
gccggcccagccugucagcgc

SEQ ID NO: 219314 - RNA, 22 nt, Human
gugaaauauaaaacuuuguucu

SEQ ID NO: 219315 - RNA, 20 nt, Human
uaaaaaacaaucuaaucuag

SEQ ID NO: 219316 - RNA, 19 nt, Human
uaaaucccagagaucgaag

SEQ ID NO: 219317 - RNA, 21 nt, Human
uaacagacaauguuuaagaaa

SEQ ID NO: 219318 - RNA, 22 nt, Human
uaagaaacuucuuacaaaaucc

SEQ ID NO: 219319 - RNA, 22 nt, Human
uacaagcuaaaaguauacaccu

SEQ ID NO: 219320 - RNA, 20 nt, Human
uacacagaucgggcgaccag

SEQ ID NO: 219321 - RNA, 21 nt, Human
uacaguacauggaacuacaag

SEQ ID NO: 219322 - RNA, 20 nt, Human
uagcaucaugauuuauauaa

SEQ ID NO: 219323 - RNA, 23 nt, Human
uaggaaaaaauucuuaaccugcu

SEQ ID NO: 219324 - RNA, 21 nt, Human
uauacauacauauucugugca

SEQ ID NO: 219325 - RNA, 21 nt, Human
ucccucggcagcgaggaccag

SEQ ID NO: 219326 - RNA, 18 nt, Human
uccgcugcugcccccuuc

SEQ ID NO: 219327 - RNA, 20 nt, Human
uccuacccggcgggucaagg

SEQ ID NO: 219328 - RNA, 26 nt, Human
ucggcagcgaggaccaggccucuccc

SEQ ID NO: 219329 - RNA, 21 nt, Human
ucugcuccucuuccucucucc

SEQ ID NO: 219330 - RNA, 25 nt, Human
ucuucuaugacugcaaugcaaaauu

SEQ ID NO: 219331 - RNA, 20 nt, Human
ucuuuugccagacaagaguu

SEQ ID NO: 219332 - RNA, 19 nt, Human
ugaaaccccucaaauauac

SEQ ID NO: 219333 - RNA, 24 nt, Human
ugcaucuuuaacauugcaaaauuu

SEQ ID NO: 219334 - RNA, 20 nt, Human
ugcuaaggaauucucauuaa

SEQ ID NO: 219335 - RNA, 20 nt, Human
ugcuccucuuccucucuccu

SEQ ID NO: 219336 - RNA, 19 nt, Human
uggaacuacaagcuaaaag

SEQ ID NO: 219337 - RNA, 25 nt, Human
uggaacuacaagcuaaaaguauaca

SEQ ID NO: 219338 - RNA, 24 nt, Human
uguaauaauaguccacagcaaugu

SEQ ID NO: 219339 - RNA, 24 nt, Human
uuaaaaaacacauucaccacaaau

SEQ ID NO: 219340 - RNA, 19 nt, Human
uuaaugaacaccagcccuc

SEQ ID NO: 219341 - RNA, 25 nt, Human
uuagcggcguccgcugcugcccccu

SEQ ID NO: 219342 - RNA, 24 nt, Human
uucuaugacugcaaugcaaaauuc

SEQ ID NO: 219343 - RNA, 20 nt, Human
uuggucucagaaugaagguc

SEQ ID NO: 219344 - RNA, 23 nt, Human
uuuaaaaaacacauucaccacaa

SEQ ID NO: 219345 - RNA, 23 nt, Human
uuuaacauugcaaaauuuacaua

SEQ ID NO: 219346 - RNA, 19 nt, Human
uuugcuggcuagcaucaug

SEQ ID NO: 219347 - RNA, 21 nt, Human
aaaaggaaacucagggggccc

SEQ ID NO: 219348 - RNA, 24 nt, Human
aacgagcgaggcucugucucaaaa

SEQ ID NO: 219349 - RNA, 21 nt, Human
aagagagagacgagaaaagga

SEQ ID NO: 219350 - RNA, 23 nt, Human
aagcagagguugcacugugagcc

SEQ ID NO: 219351 - RNA, 18 nt, Human
aaucgcuugaaccuggga

SEQ ID NO: 219352 - RNA, 24 nt, Human
aaucgcuugaaccugggaagcaga

SEQ ID NO: 219353 - RNA, 21 nt, Human
acagccagucaacagagaccu

SEQ ID NO: 219354 - RNA, 18 nt, Human
accacugcacuccacccu

SEQ ID NO: 219355 - RNA, 22 nt, Human
accucaucucuauuaaaaauaa

SEQ ID NO: 219356 - RNA, 23 nt, Human
accuuaacaaauugcaaaggcca

SEQ ID NO: 219357 - RNA, 18 nt, Human
acugcacuccacccuggg

SEQ ID NO: 219358 - RNA, 24 nt, Human
acuugagguuaggaguucgagauc

SEQ ID NO: 219359 - RNA, 22 nt, Human
agaaucgcuugaaccugggaag

SEQ ID NO: 219360 - RNA, 23 nt, Human
agagaaaaagccccucaguccug

SEQ ID NO: 219361 - RNA, 21 nt, Human
agagagaaaaagccccucagu

SEQ ID NO: 219362 - RNA, 26 nt, Human
agagguugcacugugagccgagaucg

SEQ ID NO: 219363 - RNA, 20 nt, Human
agccagucaacagagaccua

SEQ ID NO: 219364 - RNA, 18 nt, Human
agccgggugugguggugc

SEQ ID NO: 219365 - RNA, 23 nt, Human
agccuggccaucauggugaaacc

SEQ ID NO: 219366 - RNA, 21 nt, Human
agcgaggcucugucucaaaaa

SEQ ID NO: 219367 - RNA, 24 nt, Human
aggaucacuugagguuaggaguuc

SEQ ID NO: 219368 - RNA, 22 nt, Human
aggcaggagaaucgcuugaacc

SEQ ID NO: 219369 - RNA, 24 nt, Human
aggcaggagaaucgcuugaaccug

SEQ ID NO: 219370 - RNA, 18 nt, Human
aggcccagagaggggcag

SEQ ID NO: 219371 - RNA, 20 nt, Human
aggcugaggcaggagaaucg

SEQ ID NO: 219372 - RNA, 24 nt, Human
aggcugaggcaggagaaucgcuug

SEQ ID NO: 219373 - RNA, 22 nt, Human
agggggccagggcuuaaggggu

SEQ ID NO: 219374 - RNA, 21 nt, Human
aucacuugagguuaggaguuc

SEQ ID NO: 219375 - RNA, 19 nt, Human
aucauggugaaaccucauc

SEQ ID NO: 219376 - RNA, 19 nt, Human
cacaccuguaaucccagcu

SEQ ID NO: 219377 - RNA, 23 nt, Human
caccuguaaucccagcuacucgg

SEQ ID NO: 219378 - RNA, 24 nt, Human
caccuguaaucccagcuacucggg

SEQ ID NO: 219379 - RNA, 21 nt, Human
cacugcacuccacccugggua

SEQ ID NO: 219380 - RNA, 23 nt, Human
cacugcacuccacccuggguaac

SEQ ID NO: 219381 - RNA, 24 nt, Human
cacugcacuccacccuggguaacg

SEQ ID NO: 219382 - RNA, 23 nt, Human
cacuugagguuaggaguucgaga

SEQ ID NO: 219383 - RNA, 24 nt, Human
cagcuacucgggaggcugaggcag

SEQ ID NO: 219384 - RNA, 23 nt, Human
caggacucagagagccccacuga

SEQ ID NO: 219385 - RNA, 18 nt, Human
cauggugaaaccucaucu

SEQ ID NO: 219386 - RNA, 19 nt, Human
cauggugaaaccucaucuc

SEQ ID NO: 219387 - RNA, 20 nt, Human
ccacugcacuccacccuggg

SEQ ID NO: 219388 - RNA, 21 nt, Human
ccacugcacuccacccugggu

SEQ ID NO: 219389 - RNA, 24 nt, Human
ccacugcacuccacccuggguaac

SEQ ID NO: 219390 - RNA, 21 nt, Human
ccauaaugagugcaacuugcc

SEQ ID NO: 219391 - RNA, 21 nt, Human
ccccacugacacauaugccca

SEQ ID NO: 219392 - RNA, 25 nt, Human
cccucauaaggccucugaggcccag

SEQ ID NO: 219393 - RNA, 24 nt, Human
ccuggccaucauggugaaaccuca

SEQ ID NO: 219394 - RNA, 21 nt, Human
ccuguaaucccagcuacucgg

SEQ ID NO: 219395 - RNA, 24 nt, Human
cgagaucagccuggccaucauggu

SEQ ID NO: 219396 - RNA, 20 nt, Human
cucugaggcccagagagggg

SEQ ID NO: 219397 - RNA, 21 nt, Human
cuguaaucccagcuacucggg

SEQ ID NO: 219398 - RNA, 24 nt, Human
gaucacuugagguuaggaguucga

SEQ ID NO: 219399 - RNA, 24 nt, Human
gccaucauggugaaaccucaucuc

SEQ ID NO: 219400 - RNA, 20 nt, Human
ggacucagagagccccacug

SEQ ID NO: 219401 - RNA, 23 nt, Human
ggaucacuugagguuaggaguuc

SEQ ID NO: 219402 - RNA, 21 nt, Human
ggcagcuccgggccuaagguc

SEQ ID NO: 219403 - RNA, 23 nt, Human
ggccacgggagcccccccaaaug

SEQ ID NO: 219404 - RNA, 19 nt, Human
ggccagggcuuaagggguu

SEQ ID NO: 219405 - RNA, 20 nt, Human
ggccaucauggugaaaccuc

SEQ ID NO: 219406 - RNA, 24 nt, Human
gggagcccccccaaaugcaauguc

SEQ ID NO: 219407 - RNA, 23 nt, Human
ggggccagggcuuaagggguugg

SEQ ID NO: 219408 - RNA, 25 nt, Human
gggggccagggcuuaagggguuggg

SEQ ID NO: 219409 - RNA, 24 nt, Human
gggugugguggugcacaccuguaa

SEQ ID NO: 219410 - RNA, 24 nt, Human
gguggugcacaccuguaaucccag

SEQ ID NO: 219411 - RNA, 23 nt, Human
guaacgagcgaggcucugucuca

SEQ ID NO: 219412 - RNA, 19 nt, Human
gugggaggaucacuugagg

SEQ ID NO: 219413 - RNA, 25 nt, Human
uaaaaaaaauuagccggguguggug

SEQ ID NO: 219414 - RNA, 25 nt, Human
uaaaaagagagagacgagaaaagga

SEQ ID NO: 219415 - RNA, 21 nt, Human
uaacaaauugcaaaggccaca

SEQ ID NO: 219416 - RNA, 24 nt, Human
uaacgagcgaggcucugucucaaa

SEQ ID NO: 219417 - RNA, 22 nt, Human
uaccacugcacuccacccuggg

SEQ ID NO: 219418 - RNA, 31 nt, Human
uagaggacccucauaaggccucugaggcccu

SEQ ID NO: 219419 - RNA, 20 nt, Human
ucacuugagguuaggaguuc

SEQ ID NO: 219420 - RNA, 24 nt, Human
ucagggggccagggcuuaaggggu

SEQ ID NO: 219421 - RNA, 24 nt, Human
ucgcuugaaccugggaagcagagg

SEQ ID NO: 219422 - RNA, 24 nt, Human
ucgggaggcugaggcaggagaauc

SEQ ID NO: 219423 - RNA, 24 nt, Human
ugaaccugggaagcagagguugca

SEQ ID NO: 219424 - RNA, 23 nt, Human
ugagccgagaucgcuaccacugc

SEQ ID NO: 219425 - RNA, 24 nt, Human
ugaggcaggagaaucgcuugaacc

SEQ ID NO: 219426 - RNA, 25 nt, Human
ugaggcaggagaaucgcuugaaccu

SEQ ID NO: 219427 - RNA, 26 nt, Human
ugaggcccagagaggggcagcuccgg

SEQ ID NO: 219428 - RNA, 19 nt, Human
ugccuagcgggccgccgga

SEQ ID NO: 219429 - RNA, 21 nt, Human
ugggaagaugcgagagucuua

SEQ ID NO: 219430 - RNA, 22 nt, Human
uggugcacaccuguaaucccag

SEQ ID NO: 219431 - RNA, 24 nt, Human
ugguggugcacaccuguaauccca

SEQ ID NO: 219432 - RNA, 20 nt, Human
uuagccgggugugguggugc

SEQ ID NO: 219433 - RNA, 22 nt, Human
uuagccgggugugguggugcac

SEQ ID NO: 219434 - RNA, 19 nt, Human
uuccugaaguagaggaccc

SEQ ID NO: 219435 - RNA, 24 nt, Human
uugaaccugggaagcagagguugc

SEQ ID NO: 219436 - RNA, 20 nt, Human
aaacgccuccuguuuugccc

SEQ ID NO: 219437 - RNA, 18 nt, Human
aacuccuuucuuccccuc

SEQ ID NO: 219438 - RNA, 25 nt, Human
aagaagccagauuauauuuuaggug

SEQ ID NO: 219439 - RNA, 21 nt, Human
aaggagcagagagucgggagg

SEQ ID NO: 219440 - RNA, 20 nt, Human
agagagucgggaggggagga

SEQ ID NO: 219441 - RNA, 23 nt, Human
aggagggacggcucuagauggga

SEQ ID NO: 219442 - RNA, 19 nt, Human
agggggcagcaggaggaga

SEQ ID NO: 219443 - RNA, 21 nt, Human
aguagucaugaaaauuaaaau

SEQ ID NO: 219444 - RNA, 19 nt, Human
caacuccuuucuuccccuc

SEQ ID NO: 219445 - RNA, 18 nt, Human
cacaagaagccagauuau

SEQ ID NO: 219446 - RNA, 18 nt, Human
cagacacaagaagccaga

SEQ ID NO: 219447 - RNA, 20 nt, Human
cagccggcugcucugaggag

SEQ ID NO: 219448 - RNA, 19 nt, Human
caggaggagagcagcgccc

SEQ ID NO: 219449 - RNA, 19 nt, Human
cccaacuccuuucuucccc

SEQ ID NO: 219450 - RNA, 22 nt, Human
ccccaacuccuuucuuccccuc

SEQ ID NO: 219451 - RNA, 23 nt, Human
ccccaacuccuuucuuccccucg

SEQ ID NO: 219452 - RNA, 22 nt, Human
cccccacgccuccgggauugau

SEQ ID NO: 219453 - RNA, 23 nt, Human
ccccggcgggucgucccuccgcc

SEQ ID NO: 219454 - RNA, 20 nt, Human
cccuugaacuucuggggcgg

SEQ ID NO: 219455 - RNA, 20 nt, Human
ccgcccccacgccuccggga

SEQ ID NO: 219456 - RNA, 19 nt, Human
ccuccagcccagggauggg

SEQ ID NO: 219457 - RNA, 21 nt, Human
cgcccgggaaagccccggcgg

SEQ ID NO: 219458 - RNA, 23 nt, Human
cgccuccuguuuugccccaacuc

SEQ ID NO: 219459 - RNA, 19 nt, Human
cggcggcaggagcgcagga

SEQ ID NO: 219460 - RNA, 22 nt, Human
cgggcaggcugggggugggggg

SEQ ID NO: 219461 - RNA, 21 nt, Human
cucuagaugggaugucaguuu

SEQ ID NO: 219462 - RNA, 23 nt, Human
cuggggcgggaaaggagcagaga

SEQ ID NO: 219463 - RNA, 18 nt, Human
gagcugggggcgggaggc

SEQ ID NO: 219464 - RNA, 19 nt, Human
gaggaagaggagggacggc

SEQ ID NO: 219465 - RNA, 19 nt, Human
gcagcgcccgggaaagccc

SEQ ID NO: 219466 - RNA, 20 nt, Human
gcaggagcgcaggaggccgg

SEQ ID NO: 219467 - RNA, 21 nt, Human
gccggguccuagcgagggggc

SEQ ID NO: 219468 - RNA, 18 nt, Human
gcgggaaaggagcagaga

SEQ ID NO: 219469 - RNA, 22 nt, Human
ggaaagccccggcgggucgucc

SEQ ID NO: 219470 - RNA, 24 nt, Human
ggaggggaggaagaggagggacgg

SEQ ID NO: 219471 - RNA, 22 nt, Human
ggcccuugaacuucuggggcgg

SEQ ID NO: 219472 - RNA, 19 nt, Human
ggcuggggguggggggauu

SEQ ID NO: 219473 - RNA, 18 nt, Human
gggaggggaggaagagga

SEQ ID NO: 219474 - RNA, 18 nt, Human
gggaggggaggaagagga

SEQ ID NO: 219475 - RNA, 21 nt, Human
gggaggggaggaagaggaggg

SEQ ID NO: 219476 - RNA, 20 nt, Human
gggcgggaggcgcgggcagg

SEQ ID NO: 219477 - RNA, 23 nt, Human
gggcugccagcuguccccagggc

SEQ ID NO: 219478 - RNA, 21 nt, Human
ggggauugggugucucgggga

SEQ ID NO: 219479 - RNA, 19 nt, Human
uaaaauagcaaguucaggu

SEQ ID NO: 219480 - RNA, 23 nt, Human
uaaaaugaaauaccaauuccauu

SEQ ID NO: 219481 - RNA, 23 nt, Human
uccuccagcccagggaugggggu

SEQ ID NO: 219482 - RNA, 18 nt, Human
ucugaggaggucgagggu

SEQ ID NO: 219483 - RNA, 21 nt, Human
ugaaauaccaauuccauuucc

SEQ ID NO: 219484 - RNA, 19 nt, Human
uggcugccaagaggcgggu

SEQ ID NO: 219485 - RNA, 18 nt, Human
ugucugguccgcgcgggg

SEQ ID NO: 219486 - RNA, 20 nt, Human
ugucugguccgcgcggggcu

SEQ ID NO: 219487 - RNA, 19 nt, Human
uguguaacaacgguggcuu

SEQ ID NO: 219488 - RNA, 18 nt, Human
uguuuugggggugugggg

SEQ ID NO: 219489 - RNA, 22 nt, Human
uuaguccagacacaagaagcca

SEQ ID NO: 219490 - RNA, 22 nt, Human
uuugccccaacuccuuucuucc

SEQ ID NO: 219491 - RNA, 27 nt, Human
uuuuuuuuuuuuuuuuuuuuuuugggg

SEQ ID NO: 219492 - RNA, 18 nt, Human
aaacaaaugccaaauuac

SEQ ID NO: 219493 - RNA, 23 nt, Human
aaagcuucuccacaauggacacu

SEQ ID NO: 219494 - RNA, 21 nt, Human
aaaguauaaaaaacccaagac

SEQ ID NO: 219495 - RNA, 18 nt, Human
aaauagcauugggggccc

SEQ ID NO: 219496 - RNA, 22 nt, Human
aaccccaggagcugacuggcau

SEQ ID NO: 219497 - RNA, 22 nt, Human
aacgcugaggguggggagccau

SEQ ID NO: 219498 - RNA, 20 nt, Human
aacucagugaacgcacccag

SEQ ID NO: 219499 - RNA, 19 nt, Human
aagaucacccuaauacuca

SEQ ID NO: 219500 - RNA, 22 nt, Human
aagcaacuauggucugaugugu

SEQ ID NO: 219501 - RNA, 19 nt, Human
aagcaggguuccucaggca

SEQ ID NO: 219502 - RNA, 22 nt, Human
aagcucacugggacacagccac

SEQ ID NO: 219503 - RNA, 20 nt, Human
aaggugaguagugagagcca

SEQ ID NO: 219504 - RNA, 21 nt, Human
acccaacucagugaacgcacc

SEQ ID NO: 219505 - RNA, 21 nt, Human
agacacuggaagcugaaagac

SEQ ID NO: 219506 - RNA, 18 nt, Human
agagcgggggcgccuggc

SEQ ID NO: 219507 - RNA, 23 nt, Human
agcagacaccagggagcacugag

SEQ ID NO: 219508 - RNA, 18 nt, Human
aggaacccaacucaguga

SEQ ID NO: 219509 - RNA, 22 nt, Human
aggaagaggcaguucaaagcua

SEQ ID NO: 219510 - RNA, 24 nt, Human
aggcaagaucccucuuccagcaac

SEQ ID NO: 219511 - RNA, 18 nt, Human
aggcagaaucacagccuc

SEQ ID NO: 219512 - RNA, 21 nt, Human
aggccagaaacagauuaggaa

SEQ ID NO: 219513 - RNA, 20 nt, Human
aggcuggagcgugaaucccc

SEQ ID NO: 219514 - RNA, 21 nt, Human
agucaaaauuagaaaacugcu

SEQ ID NO: 219515 - RNA, 23 nt, Human
aucacuaugacaaccaagaagga

SEQ ID NO: 219516 - RNA, 20 nt, Human
auggaagacaccaguguccc

SEQ ID NO: 219517 - RNA, 25 nt, Human
caaaaagcuucuccacaauggacac

SEQ ID NO: 219518 - RNA, 24 nt, Human
caaaguauaaaaaacccaagacac

SEQ ID NO: 219519 - RNA, 18 nt, Human
caccagugucccugcagu

SEQ ID NO: 219520 - RNA, 18 nt, Human
cacugccagggcccaagg

SEQ ID NO: 219521 - RNA, 23 nt, Human
cagacaccagggagcacugagcc

SEQ ID NO: 219522 - RNA, 19 nt, Human
cagccaccucgccaucuca

SEQ ID NO: 219523 - RNA, 24 nt, Human
caggaagaggcaguucaaagcuaa

SEQ ID NO: 219524 - RNA, 18 nt, Human
caggaugccaugcagcag

SEQ ID NO: 219525 - RNA, 23 nt, Human
caggccagaaacagauuaggaac

SEQ ID NO: 219526 - RNA, 23 nt, Human
cagggcccaaggauggcagggcc

SEQ ID NO: 219527 - RNA, 18 nt, Human
caucugagggcuucuggg

SEQ ID NO: 219528 - RNA, 20 nt, Human
ccaaaggcagaaucacagcc

SEQ ID NO: 219529 - RNA, 21 nt, Human
ccacugccagggcccaaggau

SEQ ID NO: 219530 - RNA, 21 nt, Human
ccaggcacacaguggagugcu

SEQ ID NO: 219531 - RNA, 20 nt, Human
ccauagaaaagcauauuuca

SEQ ID NO: 219532 - RNA, 22 nt, Human
ccccaggagcugacuggcaucu

SEQ ID NO: 219533 - RNA, 20 nt, Human
ccuggcgcaaccccaggagc

SEQ ID NO: 219534 - RNA, 21 nt, Human
ccuuuggccuuagacaaucuu

SEQ ID NO: 219535 - RNA, 20 nt, Human
cgccaggccuuucaccuggc

SEQ ID NO: 219536 - RNA, 19 nt, Human
cgccgggaugcgcugcugg

SEQ ID NO: 219537 - RNA, 19 nt, Human
cgcucugugcgcucucagc

SEQ ID NO: 219538 - RNA, 24 nt, Human
cggaugaaaaauuuaaagucaaaa

SEQ ID NO: 219539 - RNA, 23 nt, Human
cucuacuuucacuucucucuacu

SEQ ID NO: 219540 - RNA, 21 nt, Human
cucucagccacaccgcggguc

SEQ ID NO: 219541 - RNA, 19 nt, Human
cuggagcauuuccugccuc

SEQ ID NO: 219542 - RNA, 22 nt, Human
cuggcagacagcgaggcaacag

SEQ ID NO: 219543 - RNA, 20 nt, Human
cuggguucccgccgggaugc

SEQ ID NO: 219544 - RNA, 23 nt, Human
gaacuugcaugcuaagcauccag

SEQ ID NO: 219545 - RNA, 22 nt, Human
gaagacaccagugucccugcag

SEQ ID NO: 219546 - RNA, 19 nt, Human
gaagcugaaagacaaggug

SEQ ID NO: 219547 - RNA, 23 nt, Human
gcgccuggcgcaaccccaggagc

SEQ ID NO: 219548 - RNA, 20 nt, Human
ggcuucacagggcccagcac

SEQ ID NO: 219549 - RNA, 23 nt, Human
gggacgcuacauggaagacacca

SEQ ID NO: 219550 - RNA, 23 nt, Human
uaaaaaacccaagacacuggaag

SEQ ID NO: 219551 - RNA, 22 nt, Human
uaaacaagacccauagaaaagc

SEQ ID NO: 219552 - RNA, 22 nt, Human
uaccaagguggcaaugauggag

SEQ ID NO: 219553 - RNA, 23 nt, Human
uacccuaucacuaugacaaccaa

SEQ ID NO: 219554 - RNA, 20 nt, Human
uagagcgggggcgccuggcg

SEQ ID NO: 219555 - RNA, 24 nt, Human
uagugagagccauucuccaggcac

SEQ ID NO: 219556 - RNA, 20 nt, Human
uaguggucaacuuuggccaa

SEQ ID NO: 219557 - RNA, 19 nt, Human
uauaggcagcuacuuccca

SEQ ID NO: 219558 - RNA, 23 nt, Human
ucacaguaaacuuccaugagagg

SEQ ID NO: 219559 - RNA, 18 nt, Human
uccaaaggcagaaucaca

SEQ ID NO: 219560 - RNA, 18 nt, Human
uccaaaggcagaaucaca

SEQ ID NO: 219561 - RNA, 24 nt, Human
uccauaaccaaaaagaggucuguu

SEQ ID NO: 219562 - RNA, 18 nt, Human
uccccgccaggccuuuca

SEQ ID NO: 219563 - RNA, 24 nt, Human
ucccgccgggaugcgcugcuggug

SEQ ID NO: 219564 - RNA, 19 nt, Human
ucccugcagugcccaccug

SEQ ID NO: 219565 - RNA, 20 nt, Human
ucguggcugcugaacgacca

SEQ ID NO: 219566 - RNA, 20 nt, Human
ucugaaugagugucuagcuc

SEQ ID NO: 219567 - RNA, 18 nt, Human
ucugccaggcggccugcg

SEQ ID NO: 219568 - RNA, 18 nt, Human
ucuguggcaaagaggaac

SEQ ID NO: 219569 - RNA, 19 nt, Human
ugaaaaaggcuaaaacuug

SEQ ID NO: 219570 - RNA, 22 nt, Human
ugaaaugcgacagagccugugg

SEQ ID NO: 219571 - RNA, 19 nt, Human
ugaaguaaggcugcugugu

SEQ ID NO: 219572 - RNA, 18 nt, Human
ugacagaggaagcugagg

SEQ ID NO: 219573 - RNA, 20 nt, Human
ugacaggaguuucuagcaga

SEQ ID NO: 219574 - RNA, 24 nt, Human
ugagugauguugcuaauguccccc

SEQ ID NO: 219575 - RNA, 23 nt, Human
ugauccaaaaagcuucuccacaa

SEQ ID NO: 219576 - RNA, 18 nt, Human
ugauuucgcaauugccuu

SEQ ID NO: 219577 - RNA, 18 nt, Human
ugccaggcggccugcggc

SEQ ID NO: 219578 - RNA, 24 nt, Human
ugccaggcggccugcggcaaagug

SEQ ID NO: 219579 - RNA, 20 nt, Human
ugccucugccaggcggccug

SEQ ID NO: 219580 - RNA, 21 nt, Human
ugcgguggugucugugggccg

SEQ ID NO: 219581 - RNA, 23 nt, Human
ugcuggagcauuuccugccucug

SEQ ID NO: 219582 - RNA, 19 nt, Human
uggcaaagaggaacagugg

SEQ ID NO: 219583 - RNA, 20 nt, Human
uggcaaagaggaacaguggg

SEQ ID NO: 219584 - RNA, 23 nt, Human
uggcaaagaggaacagugggauc

SEQ ID NO: 219585 - RNA, 23 nt, Human
uggccaaaacgaaaagcuucuga

SEQ ID NO: 219586 - RNA, 24 nt, Human
uggccucuggguacagacuguccu

SEQ ID NO: 219587 - RNA, 19 nt, Human
ugggacacagccacugcca

SEQ ID NO: 219588 - RNA, 21 nt, Human
ugggagcagugucuccggcgg

SEQ ID NO: 219589 - RNA, 22 nt, Human
uguacagcaacauccauccaaa

SEQ ID NO: 219590 - RNA, 18 nt, Human
uguacuugacagacuuga

SEQ ID NO: 219591 - RNA, 18 nt, Human
ugugagccauccauaacc

SEQ ID NO: 219592 - RNA, 19 nt, Human
uguugcuaaugucccccca

SEQ ID NO: 219593 - RNA, 23 nt, Human
uuagaaaacugcuuuugauucag

SEQ ID NO: 219594 - RNA, 22 nt, Human
uucaacauugcuuaacuggaau

SEQ ID NO: 219595 - RNA, 21 nt, Human
uucacauaacuaaaaaaaguu

SEQ ID NO: 219596 - RNA, 18 nt, Human
uucugaaugagugucuag

SEQ ID NO: 219597 - RNA, 20 nt, Human
uugaagcuuuuauaaaugag

SEQ ID NO: 219598 - RNA, 23 nt, Human
uugaagcuuuuauaaaugagguu

SEQ ID NO: 219599 - RNA, 22 nt, Human
uuggccuuagacaaucuuaaca

SEQ ID NO: 219600 - RNA, 23 nt, Human
uuggccuuagacaaucuuaacaa

SEQ ID NO: 219601 - RNA, 24 nt, Human
uuguuuugaaaugcgacagagccu

SEQ ID NO: 219602 - RNA, 22 nt, Human
uuuaagaucacccuaauacuca

SEQ ID NO: 219603 - RNA, 22 nt, Human
uuucaguaccauuucagacuua

SEQ ID NO: 219604 - RNA, 22 nt, Human
uuuuccuuaaauccugacaccc

SEQ ID NO: 219605 - RNA, 21 nt, Human
uuuuuuggguuuuuuugaagc

SEQ ID NO: 219606 - RNA, 20 nt, Human
aaacaaagacugcauguugg

SEQ ID NO: 219607 - RNA, 20 nt, Human
aaacuagcuuuaagacuggg

SEQ ID NO: 219608 - RNA, 22 nt, Human
aacaugacauuuuuaagacaua

SEQ ID NO: 219609 - RNA, 20 nt, Human
agcaauucacagacaugaca

SEQ ID NO: 219610 - RNA, 18 nt, Human
aggaaaaagcauauaaua

SEQ ID NO: 219611 - RNA, 21 nt, Human
aggaaaaagcauauaauacaa

SEQ ID NO: 219612 - RNA, 19 nt, Human
caaauauuggaagaaauuc

SEQ ID NO: 219613 - RNA, 18 nt, Human
cacagacaugacauaaac

SEQ ID NO: 219614 - RNA, 18 nt, Human
cacgggguucagacaagu

SEQ ID NO: 219615 - RNA, 21 nt, Human
cagcaauucacagacaugaca

SEQ ID NO: 219616 - RNA, 22 nt, Human
cauagcaaaaacuagcuuuaag

SEQ ID NO: 219617 - RNA, 24 nt, Human
ccucauuuuuugaagcagagauug

SEQ ID NO: 219618 - RNA, 19 nt, Human
cugauucaaggauggagga

SEQ ID NO: 219619 - RNA, 24 nt, Human
gaggaaucaauuaguacucagcaa

SEQ ID NO: 219620 - RNA, 26 nt, Human
gauugcuuuuuaauggauuucuauaa

SEQ ID NO: 219621 - RNA, 24 nt, Human
ggaaaauuauuuauuucuccccac

SEQ ID NO: 219622 - RNA, 22 nt, Human
ggacagucuugcucuuccucau

SEQ ID NO: 219623 - RNA, 20 nt, Human
gggaaaauuauuuauuucuc

SEQ ID NO: 219624 - RNA, 22 nt, Human
uaaaaagcauuaugagaacuga

SEQ ID NO: 219625 - RNA, 22 nt, Human
uaagacauaaacaaagacugca

SEQ ID NO: 219626 - RNA, 20 nt, Human
uaaucaguccuucuucccuc

SEQ ID NO: 219627 - RNA, 19 nt, Human
uacagagauugcuuuuuaa

SEQ ID NO: 219628 - RNA, 21 nt, Human
uauuuaaauacacuguacaga

SEQ ID NO: 219629 - RNA, 20 nt, Human
ucacaguaugucaaugaaau

SEQ ID NO: 219630 - RNA, 23 nt, Human
ucacuaauagagaucacaguaug

SEQ ID NO: 219631 - RNA, 18 nt, Human
uccacauagcaaaaacua

SEQ ID NO: 219632 - RNA, 24 nt, Human
ucccucggaaacaagaggcacagu

SEQ ID NO: 219633 - RNA, 22 nt, Human
ugaauuagagcagcauguucca

SEQ ID NO: 219634 - RNA, 18 nt, Human
ugagaacugauucaagga

SEQ ID NO: 219635 - RNA, 23 nt, Human
uggcagcauaggggacagucuug

SEQ ID NO: 219636 - RNA, 23 nt, Human
uuaaaaagcauuaugagaacuga

SEQ ID NO: 219637 - RNA, 21 nt, Human
uuaaucaguccuucuucccuc

SEQ ID NO: 219638 - RNA, 18 nt, Human
uucaaggauggaggaauc

SEQ ID NO: 219639 - RNA, 19 nt, Human
uuuaaaaagcauuaugaga

SEQ ID NO: 219640 - RNA, 21 nt, Human
aaaaaaaaaaaacauaccggg

SEQ ID NO: 219641 - RNA, 24 nt, Human
aaaaaagaaaaacaaaacaagcaa

SEQ ID NO: 219642 - RNA, 21 nt, Human
aaaaaagggaaccauuccaau

SEQ ID NO: 219643 - RNA, 26 nt, Human
aaaacaaaaacauaauucuuagagga

SEQ ID NO: 219644 - RNA, 25 nt, Human
aaacaaaauagggaacugcaucuga

SEQ ID NO: 219645 - RNA, 31 nt, Human
aaacaaauaaaaggcauaacaguuuucuggg

SEQ ID NO: 219646 - RNA, 18 nt, Human
aagaaaaacaaaacaagc

SEQ ID NO: 219647 - RNA, 22 nt, Human
aagaaaaacaaaacaagcaaaa

SEQ ID NO: 219648 - RNA, 19 nt, Human
aaggaggagagaggggagg

SEQ ID NO: 219649 - RNA, 24 nt, Human
aauaccaaccgcucgccccagcag

SEQ ID NO: 219650 - RNA, 18 nt, Human
acucaaccacagugcucg

SEQ ID NO: 219651 - RNA, 21 nt, Human
agaaaaacaaaacaagcaaaa

SEQ ID NO: 219652 - RNA, 24 nt, Human
agaggggaggagaggggaagggaa

SEQ ID NO: 219653 - RNA, 23 nt, Human
agcugcaguuucccucuuuccua

SEQ ID NO: 219654 - RNA, 24 nt, Human
aggaaaaaaaaagugucuccucag

SEQ ID NO: 219655 - RNA, 20 nt, Human
aggagagaggggaggagagg

SEQ ID NO: 219656 - RNA, 21 nt, Human
aggagagaggggaggagaggg

SEQ ID NO: 219657 - RNA, 18 nt, Human
aggaggagagaggggagg

SEQ ID NO: 219658 - RNA, 24 nt, Human
aggaggagagaggggaggagaggg

SEQ ID NO: 219659 - RNA, 20 nt, Human
aggcaaaaaucagaguuuac

SEQ ID NO: 219660 - RNA, 19 nt, Human
agggaggaggagaggaggg

SEQ ID NO: 219661 - RNA, 25 nt, Human
agggaggaggagaggagggaaggag

SEQ ID NO: 219662 - RNA, 18 nt, Human
agggcaaaauugcucaaa

SEQ ID NO: 219663 - RNA, 19 nt, Human
agggcaaaauugcucaaaa

SEQ ID NO: 219664 - RNA, 21 nt, Human
auaaauuucugaagacaccau

SEQ ID NO: 219665 - RNA, 22 nt, Human
aucauuuacuucaucuaacagu

SEQ ID NO: 219666 - RNA, 18 nt, Human
aucccuucauuaaacaaa

SEQ ID NO: 219667 - RNA, 24 nt, Human
auucuacaccuacaucuccccuaa

SEQ ID NO: 219668 - RNA, 18 nt, Human
auuuggggugggaaucac

SEQ ID NO: 219669 - RNA, 20 nt, Human
caaaugcguucuuuccuugg

SEQ ID NO: 219670 - RNA, 21 nt, Human
caaaugcguucuuuccuuggu

SEQ ID NO: 219671 - RNA, 21 nt, Human
caauaccaaccgcucgcccca

SEQ ID NO: 219672 - RNA, 24 nt, Human
caaugcacuaaaauuauccacaug

SEQ ID NO: 219673 - RNA, 21 nt, Human
cagcuacccgccgggcggccc

SEQ ID NO: 219674 - RNA, 19 nt, Human
caguagugaauccacuuuc

SEQ ID NO: 219675 - RNA, 27 nt, Human
cauuaaacaaaauagggaacugcaucu

SEQ ID NO: 219676 - RNA, 25 nt, Human
cauuuggagagcuuaccaaucaagg

SEQ ID NO: 219677 - RNA, 19 nt, Human
ccccccgccagcuacccgc

SEQ ID NO: 219678 - RNA, 20 nt, Human
ccccccgccagcuacccgcc

SEQ ID NO: 219679 - RNA, 18 nt, Human
ccgccagcuacccgccgg

SEQ ID NO: 219680 - RNA, 18 nt, Human
ccggcggaccgagggggg

SEQ ID NO: 219681 - RNA, 22 nt, Human
cgagaucuacuauccagaggca

SEQ ID NO: 219682 - RNA, 21 nt, Human
cgccugcaauaccaaccgcuc

SEQ ID NO: 219683 - RNA, 19 nt, Human
cgcucgagaucuacuaucc

SEQ ID NO: 219684 - RNA, 23 nt, Human
cggaguuggaauaaaaaccuauu

SEQ ID NO: 219685 - RNA, 25 nt, Human
cuuuuuuuuuuuuuuuuuacauaug

SEQ ID NO: 219686 - RNA, 20 nt, Human
gaaaaacaaaacaagcaaaa

SEQ ID NO: 219687 - RNA, 23 nt, Human
gaaaaacaaaacaagcaaaaugu

SEQ ID NO: 219688 - RNA, 19 nt, Human
gaaacacauuacaaagaca

SEQ ID NO: 219689 - RNA, 23 nt, Human
gaagggaagggaggaggagagga

SEQ ID NO: 219690 - RNA, 23 nt, Human
gacauuuguugaguuuaaaaaua

SEQ ID NO: 219691 - RNA, 20 nt, Human
ggaagggaagggaggaggag

SEQ ID NO: 219692 - RNA, 20 nt, Human
ggaagggaggaggagaggag

SEQ ID NO: 219693 - RNA, 21 nt, Human
ggaagggaggaggagaggagg

SEQ ID NO: 219694 - RNA, 20 nt, Human
ggagaggggaagggaaggga

SEQ ID NO: 219695 - RNA, 23 nt, Human
ggaggagagaggggaggagaggg

SEQ ID NO: 219696 - RNA, 18 nt, Human
ggaguuggaauaaaaacc

SEQ ID NO: 219697 - RNA, 21 nt, Human
gggaaggaggagagaggggag

SEQ ID NO: 219698 - RNA, 18 nt, Human
ggggaagggaagggagga

SEQ ID NO: 219699 - RNA, 21 nt, Human
ggggaagggaagggaggagga

SEQ ID NO: 219700 - RNA, 18 nt, Human
ggugggaaucaccaacuu

SEQ ID NO: 219701 - RNA, 19 nt, Human
guaaucuuauaaaccaaca

SEQ ID NO: 219702 - RNA, 20 nt, Human
gugaaaauuuaauaucuucu

SEQ ID NO: 219703 - RNA, 23 nt, Human
gugaaacacauauaacacagggc

SEQ ID NO: 219704 - RNA, 18 nt, Human
gugauguuacucaaccac

SEQ ID NO: 219705 - RNA, 22 nt, Human
uaaaaaagggaaccauuccaau

SEQ ID NO: 219706 - RNA, 19 nt, Human
uaaagcccgagauaaacgc

SEQ ID NO: 219707 - RNA, 25 nt, Human
uaaagcccgagauaaacgcucgaga

SEQ ID NO: 219708 - RNA, 20 nt, Human
uaaauagccucacaguuaaa

SEQ ID NO: 219709 - RNA, 18 nt, Human
uaagaacacuucuccccc

SEQ ID NO: 219710 - RNA, 21 nt, Human
uaagaacuuaauacuggauga

SEQ ID NO: 219711 - RNA, 22 nt, Human
uaaugcaauauaauuucauaaa

SEQ ID NO: 219712 - RNA, 23 nt, Human
uacaaagacauccuugcaaacaa

SEQ ID NO: 219713 - RNA, 18 nt, Human
uacaaaguagaaaaacag

SEQ ID NO: 219714 - RNA, 20 nt, Human
uacauaugugcacagcuuua

SEQ ID NO: 219715 - RNA, 19 nt, Human
uagaaaaacagccguucau

SEQ ID NO: 219716 - RNA, 18 nt, Human
uauccagaggcaaaaauc

SEQ ID NO: 219717 - RNA, 19 nt, Human
uaugauuaaaaacaaaaac

SEQ ID NO: 219718 - RNA, 21 nt, Human
uaugugcgugaaacacauaua

SEQ ID NO: 219719 - RNA, 18 nt, Human
ucaaacaggcauaagaug

SEQ ID NO: 219720 - RNA, 21 nt, Human
ucaaccacagugcucggaguu

SEQ ID NO: 219721 - RNA, 21 nt, Human
ucaaguuaaaaaaaaaaaaca

SEQ ID NO: 219722 - RNA, 18 nt, Human
ucccucuuuccuauuuuu

SEQ ID NO: 219723 - RNA, 19 nt, Human
uccgaauugacaaaugauu

SEQ ID NO: 219724 - RNA, 24 nt, Human
ucuaauuaaaaaagaaaaacaaaa

SEQ ID NO: 219725 - RNA, 18 nt, Human
ucucaaacaggcauaaga

SEQ ID NO: 219726 - RNA, 19 nt, Human
ucuguaaugaaagcugcag

SEQ ID NO: 219727 - RNA, 21 nt, Human
ucuguaaugaaagcugcaguu

SEQ ID NO: 219728 - RNA, 20 nt, Human
ucuguaguugacauaugaag

SEQ ID NO: 219729 - RNA, 23 nt, Human
ucuuaaaaucucaaaugcguucu

SEQ ID NO: 219730 - RNA, 18 nt, Human
ugaaaacaaauggucugu

SEQ ID NO: 219731 - RNA, 22 nt, Human
ugaaaacaaauggucuguaauc

SEQ ID NO: 219732 - RNA, 25 nt, Human
ugaaacacauuacaaagacauccuu

SEQ ID NO: 219733 - RNA, 23 nt, Human
ugaagaccacuucaauuucuaaa

SEQ ID NO: 219734 - RNA, 21 nt, Human
ugacaucaauaaaagugauau

SEQ ID NO: 219735 - RNA, 21 nt, Human
ugauuaaaaacaaaaacauaa

SEQ ID NO: 219736 - RNA, 24 nt, Human
ugcaaacaaauaaaaggcauaaca

SEQ ID NO: 219737 - RNA, 27 nt, Human
ugcacuaaaauuauccacaugaaaaca

SEQ ID NO: 219738 - RNA, 18 nt, Human
ugccuccuccccccgcca

SEQ ID NO: 219739 - RNA, 23 nt, Human
uggggugggaaucaccaacuuuu

SEQ ID NO: 219740 - RNA, 19 nt, Human
uggugcuuguuaaugugcc

SEQ ID NO: 219741 - RNA, 23 nt, Human
uuaaaaaaaaaaaacauaccggg

SEQ ID NO: 219742 - RNA, 24 nt, Human
uuaaaauuaaaaauaccuguauuu

SEQ ID NO: 219743 - RNA, 20 nt, Human
uuaaauagccucacaguuaa

SEQ ID NO: 219744 - RNA, 18 nt, Human
uuaagaaaugacauaagc

SEQ ID NO: 219745 - RNA, 19 nt, Human
uucaacauauuugaugaca

SEQ ID NO: 219746 - RNA, 21 nt, Human
uucaaguuaaaaaaaaaaaac

SEQ ID NO: 219747 - RNA, 22 nt, Human
uucauaaaaauccuucaauuuc

SEQ ID NO: 219748 - RNA, 18 nt, Human
uucuagaucaauucaaca

SEQ ID NO: 219749 - RNA, 23 nt, Human
uucuuagaggaugaauucccuaa

SEQ ID NO: 219750 - RNA, 18 nt, Human
uuggagaaaauccaacug

SEQ ID NO: 219751 - RNA, 21 nt, Human
uuuauaaauuucugaagacac

SEQ ID NO: 219752 - RNA, 26 nt, Human
uuucaaauaaacauuuaauguaaaaa

SEQ ID NO: 219753 - RNA, 22 nt, Human
uuucuucaaaaucuguuaucaa

SEQ ID NO: 219754 - RNA, 24 nt, Human
aaaaaaaaaaaaaucaaaaccaaa

SEQ ID NO: 219755 - RNA, 18 nt, Human
aaaaucuucuuuagagcu

SEQ ID NO: 219756 - RNA, 22 nt, Human
aaacaaaacgggggugccccgg

SEQ ID NO: 219757 - RNA, 18 nt, Human
aaagaacagcuugugaaa

SEQ ID NO: 219758 - RNA, 21 nt, Human
aaagacagcuugaauccuaca

SEQ ID NO: 219759 - RNA, 20 nt, Human
aaagccauuucaaguuucgu

SEQ ID NO: 219760 - RNA, 20 nt, Human
aacccuguaagcauccaauc

SEQ ID NO: 219761 - RNA, 20 nt, Human
aagaaaaacccuguaagcau

SEQ ID NO: 219762 - RNA, 21 nt, Human
aagacgaacgaagcaaacaaa

SEQ ID NO: 219763 - RNA, 21 nt, Human
aagcacuuacggcuuccauca

SEQ ID NO: 219764 - RNA, 22 nt, Human
aagcauccaauccaaccgauga

SEQ ID NO: 219765 - RNA, 23 nt, Human
acaaagaacagcuugugaaaaca

SEQ ID NO: 219766 - RNA, 23 nt, Human
acacaaccggagaagggcaacag

SEQ ID NO: 219767 - RNA, 28 nt, Human
acagcuugugaaaacaguuucccuuuuu

SEQ ID NO: 219768 - RNA, 18 nt, Human
acaggcauauguacaaaa

SEQ ID NO: 219769 - RNA, 23 nt, Human
accacauuggaaaacacuugacu

SEQ ID NO: 219770 - RNA, 21 nt, Human
accccccuccccaccccccac

SEQ ID NO: 219771 - RNA, 22 nt, Human
accccccuccccaccccccacc

SEQ ID NO: 219772 - RNA, 22 nt, Human
accgagaaaaaggcucaaguau

SEQ ID NO: 219773 - RNA, 19 nt, Human
acgaacgaagcaaacaaaa

SEQ ID NO: 219774 - RNA, 23 nt, Human
acucgcucccgucuccucguucc

SEQ ID NO: 219775 - RNA, 25 nt, Human
agccaaagacgaacgaagcaaacaa

SEQ ID NO: 219776 - RNA, 24 nt, Human
aggccauagaaaccggacaaccac

SEQ ID NO: 219777 - RNA, 24 nt, Human
agggaugggauuuuuuuuucuuuu

SEQ ID NO: 219778 - RNA, 19 nt, Human
agugcaaagacagcuugaa

SEQ ID NO: 219779 - RNA, 24 nt, Human
aguuucgugugugugugugugugg

SEQ ID NO: 219780 - RNA, 21 nt, Human
aucaaaaccaaaaaaaaaggc

SEQ ID NO: 219781 - RNA, 27 nt, Human
auccgacuuuucuuccucuucccccaa

SEQ ID NO: 219782 - RNA, 19 nt, Human
augaaacaaagaacagcuu

SEQ ID NO: 219783 - RNA, 18 nt, Human
auuauuuuuuuguuguug

SEQ ID NO: 219784 - RNA, 24 nt, Human
caaaaccaaaaaaaaaggcuuuug

SEQ ID NO: 219785 - RNA, 20 nt, Human
caaaacgggggugccccggc

SEQ ID NO: 219786 - RNA, 21 nt, Human
caagaaaaacccuguaagcau

SEQ ID NO: 219787 - RNA, 22 nt, Human
cacaaccgcccagagaaacaaa

SEQ ID NO: 219788 - RNA, 19 nt, Human
cacagcaaggccauagaaa

SEQ ID NO: 219789 - RNA, 21 nt, Human
cacagcaaggccauagaaacc

SEQ ID NO: 219790 - RNA, 20 nt, Human
caccaaaaaauaacagaaug

SEQ ID NO: 219791 - RNA, 20 nt, Human
caccaaaaaauaacagaauu

SEQ ID NO: 219792 - RNA, 23 nt, Human
caccccccuccccaccccccacc

SEQ ID NO: 219793 - RNA, 19 nt, Human
cacccucuucaaaaauggg

SEQ ID NO: 219794 - RNA, 22 nt, Human
cagaagacgacagccaaagcaa

SEQ ID NO: 219795 - RNA, 23 nt, Human
cagccaaagcaaagccauuucaa

SEQ ID NO: 219796 - RNA, 25 nt, Human
cagcgcuaauaaauuaaaugucaaa

SEQ ID NO: 219797 - RNA, 18 nt, Human
cagcuugugaaaacaguu

SEQ ID NO: 219798 - RNA, 20 nt, Human
cagucuuuuccgucuuccuc

SEQ ID NO: 219799 - RNA, 20 nt, Human
cauagaaaccggacaaccac

SEQ ID NO: 219800 - RNA, 19 nt, Human
caucuugucuucucacccc

SEQ ID NO: 219801 - RNA, 20 nt, Human
caucuugucuucucaccccc

SEQ ID NO: 219802 - RNA, 30 nt, Human
caucuugucuucucaccccccuccccaccu

SEQ ID NO: 219803 - RNA, 21 nt, Human
caugaagucucccucccaagg

SEQ ID NO: 219804 - RNA, 28 nt, Human
cauuuucacauucaaaaauaacugcagg

SEQ ID NO: 219805 - RNA, 20 nt, Human
ccaaaaucugacugcaguau

SEQ ID NO: 219806 - RNA, 23 nt, Human
ccaacagcaccaaaaaauaacag

SEQ ID NO: 219807 - RNA, 24 nt, Human
ccaacaguuacaaaaaaaaaaaaa

SEQ ID NO: 219808 - RNA, 28 nt, Human
ccccaacaguuacaaaaaaaaaaaaauc

SEQ ID NO: 219809 - RNA, 18 nt, Human
ccccaccccccaccgaga

SEQ ID NO: 219810 - RNA, 21 nt, Human
cccccaccgagaaaaaggcuc

SEQ ID NO: 219811 - RNA, 19 nt, Human
ccccuccccaccccccacc

SEQ ID NO: 219812 - RNA, 23 nt, Human
cccuccccaccccccaccgagaa

SEQ ID NO: 219813 - RNA, 22 nt, Human
ccgccuucagcugccacaaccg

SEQ ID NO: 219814 - RNA, 21 nt, Human
ccgggguuuuuaaaacaguga

SEQ ID NO: 219815 - RNA, 19 nt, Human
ccuaugguuaggaaacaac

SEQ ID NO: 219816 - RNA, 19 nt, Human
ccuccccaccccccaccga

SEQ ID NO: 219817 - RNA, 21 nt, Human
ccuucuaaaaaaucugcucac

SEQ ID NO: 219818 - RNA, 24 nt, Human
ccuuuuuuuuuuuuuuuuuuuuaa

SEQ ID NO: 219819 - RNA, 22 nt, Human
cgaacgaagcaaacaaaaaaaa

SEQ ID NO: 219820 - RNA, 18 nt, Human
cgugugugugugugugug

SEQ ID NO: 219821 - RNA, 21 nt, Human
cucaugugaccccuccaaggc

SEQ ID NO: 219822 - RNA, 18 nt, Human
cuccaaggcaggcagucu

SEQ ID NO: 219823 - RNA, 20 nt, Human
cugauugcaaaaggggacaa

SEQ ID NO: 219824 - RNA, 21 nt, Human
cugcaacaacaaccaacaaag

SEQ ID NO: 219825 - RNA, 18 nt, Human
cuggcacacggcagaaga

SEQ ID NO: 219826 - RNA, 22 nt, Human
cuuccucgcucgcuuuucuucu

SEQ ID NO: 219827 - RNA, 21 nt, Human
cuugugaaaacaguuucccuu

SEQ ID NO: 219828 - RNA, 22 nt, Human
cuuuagagcuagugcaaagaca

SEQ ID NO: 219829 - RNA, 25 nt, Human
gaaaaaauagacaagaugaacgcaa

SEQ ID NO: 219830 - RNA, 21 nt, Human
gaaacaaaacgggggugcccc

SEQ ID NO: 219831 - RNA, 24 nt, Human
gacgaacgaagcaaacaaaaaaaa

SEQ ID NO: 219832 - RNA, 23 nt, Human
gagcagcgcuaauaaauuaaaug

SEQ ID NO: 219833 - RNA, 28 nt, Human
gagccaaagacgaacgaagcaaacaaaa

SEQ ID NO: 219834 - RNA, 18 nt, Human
gcaacaacaaccaacaaa

SEQ ID NO: 219835 - RNA, 23 nt, Human
gcaauacaaauuaauacagcccc

SEQ ID NO: 219836 - RNA, 21 nt, Human
ggcagaagacgacagccaaag

SEQ ID NO: 219837 - RNA, 21 nt, Human
ggccauagaaaccggacaacc

SEQ ID NO: 219838 - RNA, 19 nt, Human
guagccaacagcaccaaaa

SEQ ID NO: 219839 - RNA, 21 nt, Human
uaaaacagugacuauacggca

SEQ ID NO: 219840 - RNA, 19 nt, Human
uaaaccacaugaagucucc

SEQ ID NO: 219841 - RNA, 22 nt, Human
uaaauguuacaagaaaaacccu

SEQ ID NO: 219842 - RNA, 20 nt, Human
uaacagaauggauuuccuaa

SEQ ID NO: 219843 - RNA, 20 nt, Human
uaauuguuaaauauuccaaa

SEQ ID NO: 219844 - RNA, 21 nt, Human
uacaaaaaaaaguucaacagu

SEQ ID NO: 219845 - RNA, 21 nt, Human
uacacagcaaggccauagaaa

SEQ ID NO: 219846 - RNA, 18 nt, Human
uacagcaaguacuccaaa

SEQ ID NO: 219847 - RNA, 24 nt, Human
uagccaacagcaccaaaaaauaac

SEQ ID NO: 219848 - RNA, 22 nt, Human
ucaaaaagagggaaaguacaca

SEQ ID NO: 219849 - RNA, 20 nt, Human
ucaccccccuccccaccccc

SEQ ID NO: 219850 - RNA, 21 nt, Human
ucaccccccuccccacccccc

SEQ ID NO: 219851 - RNA, 21 nt, Human
ucacuuuuuuuuccuuuuuuu

SEQ ID NO: 219852 - RNA, 19 nt, Human
uccaaacuucacccucuuc

SEQ ID NO: 219853 - RNA, 19 nt, Human
uccaaacuucacccucuuc

SEQ ID NO: 219854 - RNA, 19 nt, Human
uccacacauacuguacaca

SEQ ID NO: 219855 - RNA, 21 nt, Human
uccacacauacuguacacaca

SEQ ID NO: 219856 - RNA, 25 nt, Human
uccacacauacuguacacacaaccg

SEQ ID NO: 219857 - RNA, 18 nt, Human
ucccccaaagccagauuc

SEQ ID NO: 219858 - RNA, 22 nt, Human
ucccucaugugaccccuccaaa

SEQ ID NO: 219859 - RNA, 23 nt, Human
uccgaaauugggaaggaaaaaaa

SEQ ID NO: 219860 - RNA, 21 nt, Human
uccuaucccuucuaaaaaauc

SEQ ID NO: 219861 - RNA, 25 nt, Human
uccucguuccaccuaugguuaggaa

SEQ ID NO: 219862 - RNA, 18 nt, Human
uccuuuuuuuuuuuuuuu

SEQ ID NO: 219863 - RNA, 18 nt, Human
uccuuuuuuuuuuuuuuu

SEQ ID NO: 219864 - RNA, 19 nt, Human
ucugacugcaguaucuagg

SEQ ID NO: 219865 - RNA, 25 nt, Human
ugaaaaguaaacaaaaaacucgcaa

SEQ ID NO: 219866 - RNA, 22 nt, Human
ugaauccuacagcaaguacucc

SEQ ID NO: 219867 - RNA, 18 nt, Human
ugacuauacggcaguuuc

SEQ ID NO: 219868 - RNA, 18 nt, Human
ugagauggagauggaaug

SEQ ID NO: 219869 - RNA, 20 nt, Human
ugaucauaaaugaaacaagu

SEQ ID NO: 219870 - RNA, 19 nt, Human
ugcaaaaaaauauccuggu

SEQ ID NO: 219871 - RNA, 19 nt, Human
ugcaaaaaaauauccuggu

SEQ ID NO: 219872 - RNA, 23 nt, Human
ugccacaaccgcccagagaaaca

SEQ ID NO: 219873 - RNA, 23 nt, Human
ugccccggcuucccagaucacaa

SEQ ID NO: 219874 - RNA, 19 nt, Human
uggcacacggcagaagacg

SEQ ID NO: 219875 - RNA, 18 nt, Human
ugggaaggaaaaaaaaag

SEQ ID NO: 219876 - RNA, 24 nt, Human
ugggaaggaaaaaaaaagagccaa

SEQ ID NO: 219877 - RNA, 25 nt, Human
ugggaaggaaaaaaaaagagcugga

SEQ ID NO: 219878 - RNA, 21 nt, Human
ugggauuuuuuuuucuuuuuu

SEQ ID NO: 219879 - RNA, 20 nt, Human
uguaauccgacuuuucuucc

SEQ ID NO: 219880 - RNA, 20 nt, Human
uguacaaaagggaugggauu

SEQ ID NO: 219881 - RNA, 25 nt, Human
ugucuucucaccccccuccccaccc

SEQ ID NO: 219882 - RNA, 23 nt, Human
ugugcgcgugugucuccuauccc

SEQ ID NO: 219883 - RNA, 22 nt, Human
ugugugugcgcgugugucuccu

SEQ ID NO: 219884 - RNA, 20 nt, Human
ugugugugugugcgcgugug

SEQ ID NO: 219885 - RNA, 21 nt, Human
ugugugugugugcgcgugugu

SEQ ID NO: 219886 - RNA, 21 nt, Human
ugugugugugugugcgcgugu

SEQ ID NO: 219887 - RNA, 22 nt, Human
ugugugugugugugugcgcgug

SEQ ID NO: 219888 - RNA, 22 nt, Human
uuaaugcuaaaacaaaauuagu

SEQ ID NO: 219889 - RNA, 21 nt, Human
uuaaugcugacuugugaaggu

SEQ ID NO: 219890 - RNA, 19 nt, Human
uuaguucucuaaaaccaga

SEQ ID NO: 219891 - RNA, 21 nt, Human
uuccucgcucgcuuuucuucu

SEQ ID NO: 219892 - RNA, 23 nt, Human
uugaauccuacagcaaguacucc

SEQ ID NO: 219893 - RNA, 21 nt, Human
uugggaaggaaaaaaaaagag

SEQ ID NO: 219894 - RNA, 20 nt, Human
uugucuucucaccccccucc

SEQ ID NO: 219895 - RNA, 21 nt, Human
uuguugguggugguugaucuu

SEQ ID NO: 219896 - RNA, 23 nt, Human
aaaacaaggccguggacaggaaa

SEQ ID NO: 219897 - RNA, 19 nt, Human
aacaugguacaugccaucc

SEQ ID NO: 219898 - RNA, 25 nt, Human
aacccugucccccucgccccacacc

SEQ ID NO: 219899 - RNA, 18 nt, Human
aacucguuuuuguccuca

SEQ ID NO: 219900 - RNA, 23 nt, Human
aacugggacaugagauuuccaag

SEQ ID NO: 219901 - RNA, 19 nt, Human
aagcaacccugucccccuc

SEQ ID NO: 219902 - RNA, 21 nt, Human
aagcaggaaggaaagguucaa

SEQ ID NO: 219903 - RNA, 23 nt, Human
aagcaggaaggaaagguucaaag

SEQ ID NO: 219904 - RNA, 21 nt, Human
aagggucugcugugcucuccu

SEQ ID NO: 219905 - RNA, 22 nt, Human
acaugccauccagagugucccc

SEQ ID NO: 219906 - RNA, 22 nt, Human
acgcugaugccuggcugugaac

SEQ ID NO: 219907 - RNA, 19 nt, Human
acgguccgcuuuucuguuc

SEQ ID NO: 219908 - RNA, 21 nt, Human
acucuggaguuccuagcacac

SEQ ID NO: 219909 - RNA, 19 nt, Human
agaaauaauaaaaacaugg

SEQ ID NO: 219910 - RNA, 19 nt, Human
aggaagcaacccugucccc

SEQ ID NO: 219911 - RNA, 18 nt, Human
aggaaggaaagguucaaa

SEQ ID NO: 219912 - RNA, 22 nt, Human
aggaugccagcagaggcugaaa

SEQ ID NO: 219913 - RNA, 23 nt, Human
aggcugccugcuggaaagaaagc

SEQ ID NO: 219914 - RNA, 24 nt, Human
agggauaggugagaacaaggauaa

SEQ ID NO: 219915 - RNA, 22 nt, Human
aggucccggaaacaagcaagcu

SEQ ID NO: 219916 - RNA, 24 nt, Human
aggugcucauuccuggccuggagc

SEQ ID NO: 219917 - RNA, 20 nt, Human
agugaaagggugggguggag

SEQ ID NO: 219918 - RNA, 22 nt, Human
agugaaaguuacacgggaggga

SEQ ID NO: 219919 - RNA, 21 nt, Human
augccugcaacacuccuccag

SEQ ID NO: 219920 - RNA, 24 nt, Human
caaagcgucccaagucugccuucc

SEQ ID NO: 219921 - RNA, 22 nt, Human
caaaguccccacaaagcguccc

SEQ ID NO: 219922 - RNA, 21 nt, Human
caacccugucccccucgcccc

SEQ ID NO: 219923 - RNA, 18 nt, Human
caaggauaacccuccaag

SEQ ID NO: 219924 - RNA, 18 nt, Human
caccagccagagcaaggc

SEQ ID NO: 219925 - RNA, 23 nt, Human
caccagccagagcaaggcugccu

SEQ ID NO: 219926 - RNA, 25 nt, Human
cacggaauuagcaggucccggaaac

SEQ ID NO: 219927 - RNA, 21 nt, Human
cagaucugugccaggcaacuc

SEQ ID NO: 219928 - RNA, 24 nt, Human
cagcaguggcaggaagaccuccag

SEQ ID NO: 219929 - RNA, 22 nt, Human
cagcugacugucacgcugaugc

SEQ ID NO: 219930 - RNA, 21 nt, Human
caggaaagacuaauacggucc

SEQ ID NO: 219931 - RNA, 23 nt, Human
caggaagcaacccugucccccuc

SEQ ID NO: 219932 - RNA, 18 nt, Human
caggcaugaugcucagug

SEQ ID NO: 219933 - RNA, 20 nt, Human
caggucccggaaacaagcaa

SEQ ID NO: 219934 - RNA, 21 nt, Human
caggucccggaaacaagcaag

SEQ ID NO: 219935 - RNA, 22 nt, Human
ccacaccccacccucaaccagg

SEQ ID NO: 219936 - RNA, 22 nt, Human
ccagcagaggcugaaagagccc

SEQ ID NO: 219937 - RNA, 21 nt, Human
ccaggcacagaucugugccag

SEQ ID NO: 219938 - RNA, 26 nt, Human
ccaugcccgggagccccgacuccacc

SEQ ID NO: 219939 - RNA, 19 nt, Human
cccacaccccacccucaac

SEQ ID NO: 219940 - RNA, 20 nt, Human
cccacaccccacccucaacc

SEQ ID NO: 219941 - RNA, 23 nt, Human
ccccacaccccacccucaaccag

SEQ ID NO: 219942 - RNA, 19 nt, Human
ccccacccucaaccagggc

SEQ ID NO: 219943 - RNA, 23 nt, Human
ccccagacucaccacugcacccc

SEQ ID NO: 219944 - RNA, 24 nt, Human
cccccagacucaccacugcacccc

SEQ ID NO: 219945 - RNA, 23 nt, Human
ccccggcgccaagucagcaccgg

SEQ ID NO: 219946 - RNA, 18 nt, Human
cccgacuccaccagccag

SEQ ID NO: 219947 - RNA, 19 nt, Human
cccgacuccaccagccaga

SEQ ID NO: 219948 - RNA, 18 nt, Human
ccucaugaggguguggag

SEQ ID NO: 219949 - RNA, 24 nt, Human
ccucaugaggguguggagggcagg

SEQ ID NO: 219950 - RNA, 21 nt, Human
ccuccagcgugggugcagagg

SEQ ID NO: 219951 - RNA, 25 nt, Human
ccuccagcgugggugcagagggcgu

SEQ ID NO: 219952 - RNA, 24 nt, Human
ccuccagugcccucgggggcaggc

SEQ ID NO: 219953 - RNA, 21 nt, Human
ccuccccguccuccagcgugg

SEQ ID NO: 219954 - RNA, 24 nt, Human
ccucccgaagacagugacagcuau

SEQ ID NO: 219955 - RNA, 23 nt, Human
ccuggagcaggggucacucugga

SEQ ID NO: 219956 - RNA, 19 nt, Human
ccuuuaagcagggagugaa

SEQ ID NO: 219957 - RNA, 22 nt, Human
cuaagggucugcugugcucucc

SEQ ID NO: 219958 - RNA, 18 nt, Human
cuagcacaccugggcugc

SEQ ID NO: 219959 - RNA, 22 nt, Human
cucuccuacucuguggcuucag

SEQ ID NO: 219960 - RNA, 19 nt, Human
cucuguggauucugccagg

SEQ ID NO: 219961 - RNA, 21 nt, Human
cugacugucacgcugaugccu

SEQ ID NO: 219962 - RNA, 21 nt, Human
cugcaacacuccuccagugcc

SEQ ID NO: 219963 - RNA, 19 nt, Human
gaaagguucaaagucccca

SEQ ID NO: 219964 - RNA, 18 nt, Human
gaaaguuacacgggaggg

SEQ ID NO: 219965 - RNA, 20 nt, Human
gaggguguggagggcagggc

SEQ ID NO: 219966 - RNA, 20 nt, Human
gcaggaagcaacccuguccc

SEQ ID NO: 219967 - RNA, 18 nt, Human
gcaggcugcaugcagcug

SEQ ID NO: 219968 - RNA, 26 nt, Human
gcaguggcaggaagaccuccaggcac

SEQ ID NO: 219969 - RNA, 23 nt, Human
gcccagaagcugccaagacagca

SEQ ID NO: 219970 - RNA, 18 nt, Human
gccccacaccccacccuc

SEQ ID NO: 219971 - RNA, 20 nt, Human
gccccugacaaccuccccgu

SEQ ID NO: 219972 - RNA, 19 nt, Human
gcuccggggaacagcugcu

SEQ ID NO: 219973 - RNA, 21 nt, Human
ggaaagaaagcaggaaggaaa

SEQ ID NO: 219974 - RNA, 22 nt, Human
ggaagcaacccugucccccucg

SEQ ID NO: 219975 - RNA, 18 nt, Human
ggacaggaaagacuaaua

SEQ ID NO: 219976 - RNA, 23 nt, Human
ggacucaaggcagaacuaagcga

SEQ ID NO: 219977 - RNA, 23 nt, Human
gggcacaugaaucacugaaaaca

SEQ ID NO: 219978 - RNA, 20 nt, Human
gggcagccagcaguggcagg

SEQ ID NO: 219979 - RNA, 24 nt, Human
gggcagccagcaguggcaggaaga

SEQ ID NO: 219980 - RNA, 23 nt, Human
ggguggagggguccccagccuuu

SEQ ID NO: 219981 - RNA, 18 nt, Human
ggugcucauuccuggccu

SEQ ID NO: 219982 - RNA, 18 nt, Human
gugacuccagcucuaccc

SEQ ID NO: 219983 - RNA, 20 nt, Human
gugcagagggcgugggugau

SEQ ID NO: 219984 - RNA, 24 nt, Human
gugggguggagggguccccagccu

SEQ ID NO: 219985 - RNA, 22 nt, Human
uacacuggcaggacucaaggca

SEQ ID NO: 219986 - RNA, 20 nt, Human
uagaaugcccagaagcugcc

SEQ ID NO: 219987 - RNA, 19 nt, Human
uagccccugacaaccuccc

SEQ ID NO: 219988 - RNA, 21 nt, Human
uagccccugacaaccuccccg

SEQ ID NO: 219989 - RNA, 18 nt, Human
ucacugaaaacaaggccg

SEQ ID NO: 219990 - RNA, 22 nt, Human
ucagaaaaugagacucggcauu

SEQ ID NO: 219991 - RNA, 19 nt, Human
uccaccagccagagcaagg

SEQ ID NO: 219992 - RNA, 25 nt, Human
uccaccagccagagcaaggcugccu

SEQ ID NO: 219993 - RNA, 19 nt, Human
uccagccuccaugugugac

SEQ ID NO: 219994 - RNA, 18 nt, Human
uccauagaaugcccagaa

SEQ ID NO: 219995 - RNA, 18 nt, Human
uccccacaaagcguccca

SEQ ID NO: 219996 - RNA, 24 nt, Human
ucccuuuaagcagggagugaaagu

SEQ ID NO: 219997 - RNA, 21 nt, Human
uccuccagugcccucgggggc

SEQ ID NO: 219998 - RNA, 20 nt, Human
uccuggccuggagcaggggu

SEQ ID NO: 219999 - RNA, 19 nt, Human
ucuacauucgaaauggaau

SEQ ID NO: 220000 - RNA, 19 nt, Human
ucuccauagaaugcccaga

SEQ ID NO: 220001 - RNA, 23 nt, Human
ucuccauagaaugcccagaagcu

SEQ ID NO: 220002 - RNA, 19 nt, Human
ugaaaacaaggccguggac

SEQ ID NO: 220003 - RNA, 23 nt, Human
ugacaaccuccccguccuccagc

SEQ ID NO: 220004 - RNA, 22 nt, Human
ugagaacaaggauaacccucca

SEQ ID NO: 220005 - RNA, 23 nt, Human
ugagaacaaggauaacccuccaa

SEQ ID NO: 220006 - RNA, 19 nt, Human
ugcaugcagcuguccagcc

SEQ ID NO: 220007 - RNA, 24 nt, Human
ugccaggcaacucucaucaguucc

SEQ ID NO: 220008 - RNA, 20 nt, Human
ugcccgggagccccgacucc

SEQ ID NO: 220009 - RNA, 23 nt, Human
ugcugugcucuccuggggucucc

SEQ ID NO: 220010 - RNA, 19 nt, Human
ugcuucauugucuuguuuc

SEQ ID NO: 220011 - RNA, 21 nt, Human
uggaaagaaagcaggaaggaa

SEQ ID NO: 220012 - RNA, 20 nt, Human
uggaaucaugucuggcaugg

SEQ ID NO: 220013 - RNA, 19 nt, Human
uggagcaggggucacucug

SEQ ID NO: 220014 - RNA, 18 nt, Human
uggcaggaagcaacccug

SEQ ID NO: 220015 - RNA, 21 nt, Human
ugggcagccagcaguggcagg

SEQ ID NO: 220016 - RNA, 22 nt, Human
ugggguggagggguccccagcc

SEQ ID NO: 220017 - RNA, 18 nt, Human
ugucuuauuuacuguucc

SEQ ID NO: 220018 - RNA, 22 nt, Human
ugugccaggcaugaugcucagu

SEQ ID NO: 220019 - RNA, 23 nt, Human
aaaaaaaggcaaacugugaguga

SEQ ID NO: 220020 - RNA, 20 nt, Human
aaaaaacauuacccagaaaa

SEQ ID NO: 220021 - RNA, 18 nt, Human
aaacagcuaaacauaagc

SEQ ID NO: 220022 - RNA, 20 nt, Human
aagcgcacacacccagagcc

SEQ ID NO: 220023 - RNA, 20 nt, Human
aauaugcauaucuguuaggg

SEQ ID NO: 220024 - RNA, 22 nt, Human
acagcccccuuggcuuccgugc

SEQ ID NO: 220025 - RNA, 21 nt, Human
agaaaaaggccaggcuacugc

SEQ ID NO: 220026 - RNA, 23 nt, Human
agcacugaggcaucuggaaggaa

SEQ ID NO: 220027 - RNA, 21 nt, Human
agcagaagaaaagggcuuugc

SEQ ID NO: 220028 - RNA, 18 nt, Human
agcuccacggcacagccc

SEQ ID NO: 220029 - RNA, 23 nt, Human
aggccgggggcagugccgagaag

SEQ ID NO: 220030 - RNA, 21 nt, Human
agugagugggcagcagaagaa

SEQ ID NO: 220031 - RNA, 21 nt, Human
agugccgagaagagggaagga

SEQ ID NO: 220032 - RNA, 22 nt, Human
caacguccgcuguuaccacuga

SEQ ID NO: 220033 - RNA, 24 nt, Human
caagcgcacacacccagagccccg

SEQ ID NO: 220034 - RNA, 18 nt, Human
cacacccagagccccggc

SEQ ID NO: 220035 - RNA, 19 nt, Human
cacagcccccuuggcuucc

SEQ ID NO: 220036 - RNA, 21 nt, Human
cacugcuggggacacggaacc

SEQ ID NO: 220037 - RNA, 22 nt, Human
cacuggguuugaaccgcauucc

SEQ ID NO: 220038 - RNA, 22 nt, Human
cagagaaagcagugaauccacu

SEQ ID NO: 220039 - RNA, 19 nt, Human
cagagccccggcgcgagcc

SEQ ID NO: 220040 - RNA, 24 nt, Human
cagaucccgcaaacggugaaaagg

SEQ ID NO: 220041 - RNA, 23 nt, Human
cagcccccuuggcuuccgggagg

SEQ ID NO: 220042 - RNA, 21 nt, Human
cagcccugccacucaggggcc

SEQ ID NO: 220043 - RNA, 19 nt, Human
cagcuccacggcacagccc

SEQ ID NO: 220044 - RNA, 18 nt, Human
caugccacacagcagagu

SEQ ID NO: 220045 - RNA, 21 nt, Human
ccacacccaagacgggacggu

SEQ ID NO: 220046 - RNA, 24 nt, Human
cccacagugagugggcagcagaag

SEQ ID NO: 220047 - RNA, 24 nt, Human
cccacgcguccacccugcacgcca

SEQ ID NO: 220048 - RNA, 25 nt, Human
cccacgcguccacccugcacgccaa

SEQ ID NO: 220049 - RNA, 22 nt, Human
cccagagccccggcgcgagccc

SEQ ID NO: 220050 - RNA, 19 nt, Human
ccccacgcguccacccugc

SEQ ID NO: 220051 - RNA, 23 nt, Human
ccccggcgcgagcccagcuccac

SEQ ID NO: 220052 - RNA, 28 nt, Human
cccuucugucuccacguggagcuggagg

SEQ ID NO: 220053 - RNA, 22 nt, Human
cccuuucucuauuuuugcuacc

SEQ ID NO: 220054 - RNA, 21 nt, Human
ccgcggggcugaggcucugcc

SEQ ID NO: 220055 - RNA, 18 nt, Human
ccuccccgggcacagggg

SEQ ID NO: 220056 - RNA, 23 nt, Human
ccuccugcccauacuugucaccc

SEQ ID NO: 220057 - RNA, 21 nt, Human
ccuuuuuucuacccuuucucu

SEQ ID NO: 220058 - RNA, 23 nt, Human
cgggagucagcccugccacucag

SEQ ID NO: 220059 - RNA, 19 nt, Human
cggucucgggcgcgggcgg

SEQ ID NO: 220060 - RNA, 21 nt, Human
cucugccccgggcugcccucc

SEQ ID NO: 220061 - RNA, 24 nt, Human
cugaggcucugccccgggcugccc

SEQ ID NO: 220062 - RNA, 22 nt, Human
cugccccaugccuccugcccau

SEQ ID NO: 220063 - RNA, 18 nt, Human
cugccccgggcugcccuc

SEQ ID NO: 220064 - RNA, 23 nt, Human
cugugagugauacccaaucgugu

SEQ ID NO: 220065 - RNA, 26 nt, Human
gaaggcagaaacauaaggaaccuguu

SEQ ID NO: 220066 - RNA, 18 nt, Human
gacccugguggagaaggc

SEQ ID NO: 220067 - RNA, 25 nt, Human
gagccagggccagggggcacucgga

SEQ ID NO: 220068 - RNA, 23 nt, Human
gagcgacccugguggagaaggca

SEQ ID NO: 220069 - RNA, 21 nt, Human
gaggaauuucagucaaucggg

SEQ ID NO: 220070 - RNA, 18 nt, Human
gaguugcggucuuucccu

SEQ ID NO: 220071 - RNA, 21 nt, Human
gcagaguccauaagacgggcu

SEQ ID NO: 220072 - RNA, 23 nt, Human
gcagcacagaucucacacagaaa

SEQ ID NO: 220073 - RNA, 19 nt, Human
gcccccuuggcuuccgugc

SEQ ID NO: 220074 - RNA, 18 nt, Human
gccgccggcggcccuggg

SEQ ID NO: 220075 - RNA, 28 nt, Human
gcuaaaauccaaaaaacauuacccaguc

SEQ ID NO: 220076 - RNA, 21 nt, Human
ggcacagcccccuuggcuucc

SEQ ID NO: 220077 - RNA, 23 nt, Human
ggccccaagacgaccggaugggg

SEQ ID NO: 220078 - RNA, 21 nt, Human
ggcccucacugcuggggacac

SEQ ID NO: 220079 - RNA, 20 nt, Human
gguuaaaaauauagcaaucc

SEQ ID NO: 220080 - RNA, 24 nt, Human
guccauaagacgggcuggccccaa

SEQ ID NO: 220081 - RNA, 18 nt, Human
uacccagaaaaaaaggca

SEQ ID NO: 220082 - RNA, 19 nt, Human
uagcacugaggcaucugga

SEQ ID NO: 220083 - RNA, 22 nt, Human
uagcagagaaacagcuaaacau

SEQ ID NO: 220084 - RNA, 23 nt, Human
uccauccacacccaagacgggac

SEQ ID NO: 220085 - RNA, 19 nt, Human
uccaugcacacgagagcca

SEQ ID NO: 220086 - RNA, 19 nt, Human
ucccgcaaacggugaaaac

SEQ ID NO: 220087 - RNA, 20 nt, Human
uccgcuguuaccacugaugu

SEQ ID NO: 220088 - RNA, 21 nt, Human
ucgcugggcuguccgaguugc

SEQ ID NO: 220089 - RNA, 21 nt, Human
ucgggggcgauuauuccuuuu

SEQ ID NO: 220090 - RNA, 19 nt, Human
ucgguguggggagucggcu

SEQ ID NO: 220091 - RNA, 18 nt, Human
ucucacagggaggaggug

SEQ ID NO: 220092 - RNA, 19 nt, Human
ucucuauuuuugcuaccgc

SEQ ID NO: 220093 - RNA, 19 nt, Human
ucugccaugccacacagca

SEQ ID NO: 220094 - RNA, 20 nt, Human
ucugccccgggcugcccucc

SEQ ID NO: 220095 - RNA, 19 nt, Human
ucuggugggggaaacagcc

SEQ ID NO: 220096 - RNA, 21 nt, Human
ucuggugggggaaacagccga

SEQ ID NO: 220097 - RNA, 18 nt, Human
ucugucuccacguggagc

SEQ ID NO: 220098 - RNA, 27 nt, Human
ugagcccaggcggaucgggaccaaagu

SEQ ID NO: 220099 - RNA, 21 nt, Human
ugcacgccaagcgcacacacc

SEQ ID NO: 220100 - RNA, 24 nt, Human
ugccacacagcagaguguuauaca

SEQ ID NO: 220101 - RNA, 21 nt, Human
ugccaugccacacagcagagu

SEQ ID NO: 220102 - RNA, 18 nt, Human
ugcccggaccccucaggc

SEQ ID NO: 220103 - RNA, 18 nt, Human
ugcccuccauccacaccc

SEQ ID NO: 220104 - RNA, 26 nt, Human
ugcuuagcugagcccaggcggaucgg

SEQ ID NO: 220105 - RNA, 21 nt, Human
ugggagaaggcguccucuagg

SEQ ID NO: 220106 - RNA, 18 nt, Human
uggggugggccacccugc

SEQ ID NO: 220107 - RNA, 21 nt, Human
uguagcacugaggcaucugga

SEQ ID NO: 220108 - RNA, 25 nt, Human
ugugccgggaucccuucugucucca

SEQ ID NO: 220109 - RNA, 23 nt, Human
uuguuggacugaacaaguuacau

SEQ ID NO: 220110 - RNA, 25 nt, Human
uuuucgagcugcgccgcggagccug

SEQ ID NO: 220111 - RNA, 18 nt, Human
aaauucugggcaacaugg

SEQ ID NO: 220112 - RNA, 20 nt, Human
aacacagugagacccugucu

SEQ ID NO: 220113 - RNA, 21 nt, Human
aacacagugagacccugucuc

SEQ ID NO: 220114 - RNA, 28 nt, Human
aacacccauaaccucaagggcacuggug

SEQ ID NO: 220115 - RNA, 25 nt, Human
aacagcuggggauaagagcacacau

SEQ ID NO: 220116 - RNA, 23 nt, Human
aagaguucaagaccagccugggc

SEQ ID NO: 220117 - RNA, 25 nt, Human
aagcaagaaacacacacuuccagga

SEQ ID NO: 220118 - RNA, 23 nt, Human
aagcagcaggugccucuccaggg

SEQ ID NO: 220119 - RNA, 24 nt, Human
aaguacgagaaaccacagcgagcc

SEQ ID NO: 220120 - RNA, 18 nt, Human
acaaagugaccucgcucu

SEQ ID NO: 220121 - RNA, 20 nt, Human
acacgcugcaccuccugccu

SEQ ID NO: 220122 - RNA, 24 nt, Human
acagagugagacccugccucaaga

SEQ ID NO: 220123 - RNA, 25 nt, Human
accaggacagacaacuccuccccaa

SEQ ID NO: 220124 - RNA, 21 nt, Human
accaugcugacacugggcaac

SEQ ID NO: 220125 - RNA, 20 nt, Human
accuaggccuuggcuccugg

SEQ ID NO: 220126 - RNA, 20 nt, Human
acuacuucccucuccuccug

SEQ ID NO: 220127 - RNA, 24 nt, Human
acuccagccuggucaacagaguga

SEQ ID NO: 220128 - RNA, 18 nt, Human
acugacaucuccacccuc

SEQ ID NO: 220129 - RNA, 24 nt, Human
acuucacuccagccuggucaacag

SEQ ID NO: 220130 - RNA, 25 nt, Human
acuucacuccagccuggucaacaga

SEQ ID NO: 220131 - RNA, 21 nt, Human
acuucccucugccagggagaa

SEQ ID NO: 220132 - RNA, 18 nt, Human
agaaaagaaaaggacaau

SEQ ID NO: 220133 - RNA, 19 nt, Human
agacaacuccuccccaaaa

SEQ ID NO: 220134 - RNA, 20 nt, Human
agaccuaccaacacccauaa

SEQ ID NO: 220135 - RNA, 22 nt, Human
agacgcuggaaugcaaacuacg

SEQ ID NO: 220136 - RNA, 21 nt, Human
agagaggaaaugggcccaggg

SEQ ID NO: 220137 - RNA, 18 nt, Human
agagcccaugggacagga

SEQ ID NO: 220138 - RNA, 19 nt, Human
agaggaaaagaauucaagg

SEQ ID NO: 220139 - RNA, 20 nt, Human
agaggaaaugggcccaggga

SEQ ID NO: 220140 - RNA, 20 nt, Human
agcagauagagccuucugag

SEQ ID NO: 220141 - RNA, 22 nt, Human
agccagggaggucgaggcugca

SEQ ID NO: 220142 - RNA, 19 nt, Human
agccuggcagcuccuccca

SEQ ID NO: 220143 - RNA, 19 nt, Human
agccuggcccccauuccag

SEQ ID NO: 220144 - RNA, 22 nt, Human
agccugggcaacacagugagac

SEQ ID NO: 220145 - RNA, 24 nt, Human
agccugggcaacacagugagaccc

SEQ ID NO: 220146 - RNA, 24 nt, Human
agccuggucaacagagugagaccc

SEQ ID NO: 220147 - RNA, 18 nt, Human
aggaaggaggaucgcuug

SEQ ID NO: 220148 - RNA, 20 nt, Human
aggacauagauagggcucug

SEQ ID NO: 220149 - RNA, 24 nt, Human
aggaucgcuugaggccaagaguuc

SEQ ID NO: 220150 - RNA, 24 nt, Human
aggaugaggaaggaggaucgcuug

SEQ ID NO: 220151 - RNA, 30 nt, Human
aggaugaggaaggaggaucgcuugaggccc

SEQ ID NO: 220152 - RNA, 24 nt, Human
aggcagugaguguugcccgugaaa

SEQ ID NO: 220153 - RNA, 22 nt, Human
aggccgagugcuguggcucaca

SEQ ID NO: 220154 - RNA, 19 nt, Human
aggcuggggcgggaggauc

SEQ ID NO: 220155 - RNA, 24 nt, Human
aggucgaggcugcagugagcuggg

SEQ ID NO: 220156 - RNA, 18 nt, Human
agugcugggauuacaggc

SEQ ID NO: 220157 - RNA, 23 nt, Human
agugucugcacaugcccuccugc

SEQ ID NO: 220158 - RNA, 24 nt, Human
aucacaccacuucacuccagccug

SEQ ID NO: 220159 - RNA, 26 nt, Human
aucagaaauagggaacccaagaccuc

SEQ ID NO: 220160 - RNA, 18 nt, Human
auccucuccuucaugaga

SEQ ID NO: 220161 - RNA, 19 nt, Human
auccugagcacaggcccca

SEQ ID NO: 220162 - RNA, 18 nt, Human
augaggccacaacugaag

SEQ ID NO: 220163 - RNA, 22 nt, Human
augccgcaaagcaacuacagac

SEQ ID NO: 220164 - RNA, 19 nt, Human
caaaaaaaauaaaaaggcg

SEQ ID NO: 220165 - RNA, 22 nt, Human
caaaaugccaaaauaccacaca

SEQ ID NO: 220166 - RNA, 25 nt, Human
caaagcaagaaacacacacuuccag

SEQ ID NO: 220167 - RNA, 21 nt, Human
caaauccucuccuucaugaga

SEQ ID NO: 220168 - RNA, 22 nt, Human
caacacagugagacccugucuc

SEQ ID NO: 220169 - RNA, 24 nt, Human
caacacagugagacccugucucua

SEQ ID NO: 220170 - RNA, 20 nt, Human
caacagagugagacccugcc

SEQ ID NO: 220171 - RNA, 23 nt, Human
caacagcagacgcuggaaugcaa

SEQ ID NO: 220172 - RNA, 21 nt, Human
caacuacagacauggagaaaa

SEQ ID NO: 220173 - RNA, 22 nt, Human
caagaaaagaaaaggacaaugc

SEQ ID NO: 220174 - RNA, 23 nt, Human
caagaaacacacacuuccaggac

SEQ ID NO: 220175 - RNA, 19 nt, Human
caagccagggaggucgagg

SEQ ID NO: 220176 - RNA, 18 nt, Human
cacacagcacaaagugac

SEQ ID NO: 220177 - RNA, 23 nt, Human
cacaccuguaaucccagcacuuu

SEQ ID NO: 220178 - RNA, 24 nt, Human
caccaucgucauggagauggaggc

SEQ ID NO: 220179 - RNA, 28 nt, Human
caccuaagccuagucaccucccaaaggc

SEQ ID NO: 220180 - RNA, 20 nt, Human
caccuaggccuuggcuccug

SEQ ID NO: 220181 - RNA, 18 nt, Human
caccuguaaucccagcac

SEQ ID NO: 220182 - RNA, 19 nt, Human
caccuguaaucccagcacu

SEQ ID NO: 220183 - RNA, 18 nt, Human
cacggggauggccgccag

SEQ ID NO: 220184 - RNA, 20 nt, Human
cacuaccacauccucaaggc

SEQ ID NO: 220185 - RNA, 21 nt, Human
cacuacuucccucuccuccug

SEQ ID NO: 220186 - RNA, 27 nt, Human
cacuccacacgcugcaccuccugccuc

SEQ ID NO: 220187 - RNA, 22 nt, Human
cacuccagccuggucaacagag

SEQ ID NO: 220188 - RNA, 22 nt, Human
cacuccagccuggucaacagag

SEQ ID NO: 220189 - RNA, 24 nt, Human
cacuccagccuggucaacagagug

SEQ ID NO: 220190 - RNA, 23 nt, Human
cacuccuggaagggcucuugagu

SEQ ID NO: 220191 - RNA, 24 nt, Human
cacuucacuccagccuggucaaca

SEQ ID NO: 220192 - RNA, 19 nt, Human
cacuugcaggacacacgcc

SEQ ID NO: 220193 - RNA, 23 nt, Human
cagacaacuccuccccaaaagua

SEQ ID NO: 220194 - RNA, 26 nt, Human
cagaccaugcugacacugguuaaaga

SEQ ID NO: 220195 - RNA, 18 nt, Human
cagcaaugacuuuugccc

SEQ ID NO: 220196 - RNA, 20 nt, Human
cagcaggugccucuccaggg

SEQ ID NO: 220197 - RNA, 23 nt, Human
cagcaggugccucuccagggucc

SEQ ID NO: 220198 - RNA, 19 nt, Human
cagcccaucaagguacaau

SEQ ID NO: 220199 - RNA, 20 nt, Human
cagcuacucaggaggcuggg

SEQ ID NO: 220200 - RNA, 24 nt, Human
cagcuacucaggaggcuggggcgg

SEQ ID NO: 220201 - RNA, 21 nt, Human
caggacacacgccuggccugg

SEQ ID NO: 220202 - RNA, 20 nt, Human
cagggcagggcagagaagcc

SEQ ID NO: 220203 - RNA, 25 nt, Human
cagugcugggauuacaggcgugagc

SEQ ID NO: 220204 - RNA, 19 nt, Human
caguuuucuuguaugcuca

SEQ ID NO: 220205 - RNA, 18 nt, Human
cauagcaagaaaaaccua

SEQ ID NO: 220206 - RNA, 25 nt, Human
cauccucaaggcccacagucuccug

SEQ ID NO: 220207 - RNA, 22 nt, Human
caugcaauccuaaugccuuggc

SEQ ID NO: 220208 - RNA, 21 nt, Human
caugcugacacugggcaacac

SEQ ID NO: 220209 - RNA, 19 nt, Human
cauggucaccccagaggac

SEQ ID NO: 220210 - RNA, 20 nt, Human
ccaagaacugagucccagcu

SEQ ID NO: 220211 - RNA, 19 nt, Human
ccacagaccuaccaacacc

SEQ ID NO: 220212 - RNA, 24 nt, Human
ccacagaccuaccaacacccauaa

SEQ ID NO: 220213 - RNA, 24 nt, Human
ccaccuccuaauaccacccuccug

SEQ ID NO: 220214 - RNA, 19 nt, Human
ccacugcacccagcuugaa

SEQ ID NO: 220215 - RNA, 21 nt, Human
ccacugcacccagcuugaaga

SEQ ID NO: 220216 - RNA, 19 nt, Human
ccacuucacuccagccugg

SEQ ID NO: 220217 - RNA, 19 nt, Human
ccacuucacuccagccugg

SEQ ID NO: 220218 - RNA, 22 nt, Human
ccagcccagcagauagagccuu

SEQ ID NO: 220219 - RNA, 24 nt, Human
ccaggacagacaacuccuccccaa

SEQ ID NO: 220220 - RNA, 18 nt, Human
ccagugcugggauuacag

SEQ ID NO: 220221 - RNA, 20 nt, Human
ccagugcugggauuacaggc

SEQ ID NO: 220222 - RNA, 20 nt, Human
ccagugcugggauuacaggc

SEQ ID NO: 220223 - RNA, 22 nt, Human
ccagugcugggauuacaggcgu

SEQ ID NO: 220224 - RNA, 24 nt, Human
ccagugcugggauuacaggcguga

SEQ ID NO: 220225 - RNA, 23 nt, Human
cccaagaccucgagagaggaaau

SEQ ID NO: 220226 - RNA, 23 nt, Human
cccacagucuccugaaacaacag

SEQ ID NO: 220227 - RNA, 23 nt, Human
cccagagcagaccaugcugacac

SEQ ID NO: 220228 - RNA, 24 nt, Human
ccccaaaaguauuacuaacgugcu

SEQ ID NO: 220229 - RNA, 21 nt, Human
cccgugggcgacccacuccug

SEQ ID NO: 220230 - RNA, 23 nt, Human
cccgugggcgacccacuccugga

SEQ ID NO: 220231 - RNA, 19 nt, Human
ccuaggccuuggcuccugg

SEQ ID NO: 220232 - RNA, 18 nt, Human
ccucaagaaaagaaaagg

SEQ ID NO: 220233 - RNA, 18 nt, Human
ccucagguaucccugguc

SEQ ID NO: 220234 - RNA, 22 nt, Human
ccuccaggcagcacuuaggaau

SEQ ID NO: 220235 - RNA, 19 nt, Human
ccucccaaaggccccaccu

SEQ ID NO: 220236 - RNA, 19 nt, Human
ccuccuaauaccacccucc

SEQ ID NO: 220237 - RNA, 21 nt, Human
ccucgcucuaguuccuuccuu

SEQ ID NO: 220238 - RNA, 21 nt, Human
ccucuagucccagcuacucag

SEQ ID NO: 220239 - RNA, 22 nt, Human
ccucuagucccagcuacucagg

SEQ ID NO: 220240 - RNA, 21 nt, Human
ccugagcacaggccccagucc

SEQ ID NO: 220241 - RNA, 22 nt, Human
ccugggcaacacagugagaccc

SEQ ID NO: 220242 - RNA, 25 nt, Human
cgaacuccuggacucaugcaauccu

SEQ ID NO: 220243 - RNA, 20 nt, Human
cgggaggaucacucaagcca

SEQ ID NO: 220244 - RNA, 23 nt, Human
cgucaguauguccacaccauagg

SEQ ID NO: 220245 - RNA, 24 nt, Human
cgugcugacucggccaaaugauau

SEQ ID NO: 220246 - RNA, 19 nt, Human
cuacuucccucuccuccug

SEQ ID NO: 220247 - RNA, 19 nt, Human
cuaguuccuuccuuuucuu

SEQ ID NO: 220248 - RNA, 22 nt, Human
cucacaccuguaaucccagcac

SEQ ID NO: 220249 - RNA, 24 nt, Human
cucacaccuguaaucccagcacuu

SEQ ID NO: 220250 - RNA, 23 nt, Human
cucagccuggcccccauuccagc

SEQ ID NO: 220251 - RNA, 19 nt, Human
cucucgggccaucggaccu

SEQ ID NO: 220252 - RNA, 20 nt, Human
cugcacaugcccuccugccu

SEQ ID NO: 220253 - RNA, 19 nt, Human
cugcaccuccugccucagg

SEQ ID NO: 220254 - RNA, 19 nt, Human
cugcagugagcugggauca

SEQ ID NO: 220255 - RNA, 20 nt, Human
cugcagugagcugggaucac

SEQ ID NO: 220256 - RNA, 19 nt, Human
cugccugcucugcugaucc

SEQ ID NO: 220257 - RNA, 19 nt, Human
cugccugcucugcugaucc

SEQ ID NO: 220258 - RNA, 21 nt, Human
cugggcacccgagccacaccc

SEQ ID NO: 220259 - RNA, 21 nt, Human
cuucccucuccuccugcuccc

SEQ ID NO: 220260 - RNA, 19 nt, Human
gaaaaaccuauuuaggccg

SEQ ID NO: 220261 - RNA, 19 nt, Human
gaaauucugggcaacaugg

SEQ ID NO: 220262 - RNA, 24 nt, Human
gaaguucuccaacauuaugucucu

SEQ ID NO: 220263 - RNA, 20 nt, Human
gagcacaggccccagucccu

SEQ ID NO: 220264 - RNA, 21 nt, Human
gagccccacccucacgaucuc

SEQ ID NO: 220265 - RNA, 20 nt, Human
gaggcugcagugagcuggga

SEQ ID NO: 220266 - RNA, 24 nt, Human
gaggcugcagugagcugggaucaa

SEQ ID NO: 220267 - RNA, 24 nt, Human
gaucacucaagccagggaggucga

SEQ ID NO: 220268 - RNA, 24 nt, Human
gaucgcuugaggccaagaguucaa

SEQ ID NO: 220269 - RNA, 18 nt, Human
gauuacaggcgugagcca

SEQ ID NO: 220270 - RNA, 22 nt, Human
gauuacaggcgugagccacugc

SEQ ID NO: 220271 - RNA, 23 nt, Human
gauuacaggcgugagccacugca

SEQ ID NO: 220272 - RNA, 18 nt, Human
gcaagaaacacacacuuc

SEQ ID NO: 220273 - RNA, 21 nt, Human
gcaauccuaaugccuuggccu

SEQ ID NO: 220274 - RNA, 20 nt, Human
gcaggugccucuccaggguc

SEQ ID NO: 220275 - RNA, 21 nt, Human
gccaaaaugccaaaauaccac

SEQ ID NO: 220276 - RNA, 19 nt, Human
gccacaacugaagugagau

SEQ ID NO: 220277 - RNA, 24 nt, Human
gccagggaggucgaggcugcagug

SEQ ID NO: 220278 - RNA, 24 nt, Human
gccauaaguaugaaauucugggca

SEQ ID NO: 220279 - RNA, 21 nt, Human
gcugaaugaggccacaacuga

SEQ ID NO: 220280 - RNA, 18 nt, Human
gcuuguucuaggcuaggg

SEQ ID NO: 220281 - RNA, 21 nt, Human
ggaccagggcaagacgccuga

SEQ ID NO: 220282 - RNA, 22 nt, Human
ggagaaacagggccaguggcca

SEQ ID NO: 220283 - RNA, 19 nt, Human
ggagaugccgcaaagcaac

SEQ ID NO: 220284 - RNA, 23 nt, Human
ggaucgcuugaggccaagaguuc

SEQ ID NO: 220285 - RNA, 23 nt, Human
ggccaagaacugagucccagcuc

SEQ ID NO: 220286 - RNA, 19 nt, Human
gggcagggcagagaagcca

SEQ ID NO: 220287 - RNA, 28 nt, Human
gggccaguggccagggcagggcagagaa

SEQ ID NO: 220288 - RNA, 24 nt, Human
gggcggugggcauggccuccuguc

SEQ ID NO: 220289 - RNA, 24 nt, Human
ggguguggggagaaacagggccag

SEQ ID NO: 220290 - RNA, 19 nt, Human
ggugcggcucuggcuuguu

SEQ ID NO: 220291 - RNA, 23 nt, Human
gguggugcgugccucuaguccca

SEQ ID NO: 220292 - RNA, 21 nt, Human
gucaggguuucaacauauaaa

SEQ ID NO: 220293 - RNA, 18 nt, Human
gugaaauggagaugccgc

SEQ ID NO: 220294 - RNA, 22 nt, Human
guggccagggcagggcagagaa

SEQ ID NO: 220295 - RNA, 22 nt, Human
guggcucacaccuguaauccca

SEQ ID NO: 220296 - RNA, 24 nt, Human
guggugcgugccucuagucccagc

SEQ ID NO: 220297 - RNA, 20 nt, Human
guucuaggcuaggguggacc

SEQ ID NO: 220298 - RNA, 24 nt, Human
uaacagcuggggauaagagcacac

SEQ ID NO: 220299 - RNA, 18 nt, Human
uacaaaaaaaauaaaaag

SEQ ID NO: 220300 - RNA, 18 nt, Human
uacaaugaaauagaaaaa

SEQ ID NO: 220301 - RNA, 23 nt, Human
uacagacauggagaaaauaacca

SEQ ID NO: 220302 - RNA, 19 nt, Human
uacaggcgugagccacugc

SEQ ID NO: 220303 - RNA, 24 nt, Human
uacaggcgugagccacugcaccca

SEQ ID NO: 220304 - RNA, 22 nt, Human
uaccaacacccauaaccucaag

SEQ ID NO: 220305 - RNA, 19 nt, Human
uaccacauccucaaggccc

SEQ ID NO: 220306 - RNA, 21 nt, Human
uacgagaaaccacagcgagcc

SEQ ID NO: 220307 - RNA, 19 nt, Human
uagaaggaugaggaaggag

SEQ ID NO: 220308 - RNA, 22 nt, Human
uagcaggccaagaacugagucc

SEQ ID NO: 220309 - RNA, 23 nt, Human
uagggaacccaagaccucgagag

SEQ ID NO: 220310 - RNA, 21 nt, Human
uaucaugccuaggcuggucuc

SEQ ID NO: 220311 - RNA, 22 nt, Human
uaucaugccuaggcuggucucg

SEQ ID NO: 220312 - RNA, 22 nt, Human
uaugaaauucugggcaacaugg

SEQ ID NO: 220313 - RNA, 18 nt, Human
ucaacagcagacgcugga

SEQ ID NO: 220314 - RNA, 21 nt, Human
ucaagccagggaggucgaggc

SEQ ID NO: 220315 - RNA, 21 nt, Human
ucagguggggucggggcacag

SEQ ID NO: 220316 - RNA, 20 nt, Human
ucaguggaaucaacagcaga

SEQ ID NO: 220317 - RNA, 23 nt, Human
uccagccuggucaacagagugag

SEQ ID NO: 220318 - RNA, 24 nt, Human
uccagccuggucaacagagugaga

SEQ ID NO: 220319 - RNA, 23 nt, Human
uccaggggcggugggcauggccu

SEQ ID NO: 220320 - RNA, 21 nt, Human
uccagugcugggauuacaggc

SEQ ID NO: 220321 - RNA, 18 nt, Human
ucccugcucuggaccuca

SEQ ID NO: 220322 - RNA, 25 nt, Human
uccguggggccccccaacaucuugg

SEQ ID NO: 220323 - RNA, 23 nt, Human
uccugggcacccgagccacaccc

SEQ ID NO: 220324 - RNA, 24 nt, Human
uccuuucacacacaucagaaauag

SEQ ID NO: 220325 - RNA, 23 nt, Human
ucgcuugaggccaagaguucaag

SEQ ID NO: 220326 - RNA, 18 nt, Human
ucucacuccacacgcugc

SEQ ID NO: 220327 - RNA, 20 nt, Human
ucucacuccacacgcugcac

SEQ ID NO: 220328 - RNA, 19 nt, Human
ucucgaacuccuggacuca

SEQ ID NO: 220329 - RNA, 21 nt, Human
ucucgaacuccuggacucaug

SEQ ID NO: 220330 - RNA, 20 nt, Human
ucucgcauaagcagcagguu

SEQ ID NO: 220331 - RNA, 18 nt, Human
ucucucccucuccacucu

SEQ ID NO: 220332 - RNA, 18 nt, Human
ucucuguagaggccucca

SEQ ID NO: 220333 - RNA, 22 nt, Human
ucuguagaggccuccaggcagc

SEQ ID NO: 220334 - RNA, 18 nt, Human
ugaaagacgaggcuaauc

SEQ ID NO: 220335 - RNA, 19 nt, Human
ugaaaguacgagaaaccag

SEQ ID NO: 220336 - RNA, 23 nt, Human
ugaaauagaaaaaaggcuggcca

SEQ ID NO: 220337 - RNA, 20 nt, Human
ugaaauggagaugccgcaaa

SEQ ID NO: 220338 - RNA, 21 nt, Human
ugacagcccaucaagguacaa

SEQ ID NO: 220339 - RNA, 18 nt, Human
ugaccaggacagacaacu

SEQ ID NO: 220340 - RNA, 19 nt, Human
ugacuuuugccccuguauc

SEQ ID NO: 220341 - RNA, 20 nt, Human
ugagaugugcggccuguuca

SEQ ID NO: 220342 - RNA, 21 nt, Human
ugagccucauggucaccccag

SEQ ID NO: 220343 - RNA, 20 nt, Human
ugauccugagcacaggcccc

SEQ ID NO: 220344 - RNA, 22 nt, Human
ugccauguggcagaaguucucc

SEQ ID NO: 220345 - RNA, 24 nt, Human
ugccuaggcuggucucgaacuccu

SEQ ID NO: 220346 - RNA, 20 nt, Human
ugccucagguggggucgggg

SEQ ID NO: 220347 - RNA, 24 nt, Human
ugccucuagucccagcuacucagg

SEQ ID NO: 220348 - RNA, 19 nt, Human
ugccuuggcuugggguggc

SEQ ID NO: 220349 - RNA, 22 nt, Human
ugcucacacagcacaaagugac

SEQ ID NO: 220350 - RNA, 22 nt, Human
ugcugaaugaggccacaacuga

SEQ ID NO: 220351 - RNA, 24 nt, Human
ugcugggauuacaggcgugagcca

SEQ ID NO: 220352 - RNA, 20 nt, Human
uggagggcaacuucucucca

SEQ ID NO: 220353 - RNA, 21 nt, Human
uggcucacaccuguaauccca

SEQ ID NO: 220354 - RNA, 22 nt, Human
uggcucacaccuguaaucccag

SEQ ID NO: 220355 - RNA, 24 nt, Human
uggcucacaccuguaaucccagca

SEQ ID NO: 220356 - RNA, 19 nt, Human
ugggauuacaggcgugagc

SEQ ID NO: 220357 - RNA, 21 nt, Human
ugggauuacaggcgugagcca

SEQ ID NO: 220358 - RNA, 22 nt, Human
ugggauuacaggcgugagccac

SEQ ID NO: 220359 - RNA, 22 nt, Human
ugggauuacaggcgugagccac

SEQ ID NO: 220360 - RNA, 24 nt, Human
ugggauuacaggcgugagccacug

SEQ ID NO: 220361 - RNA, 26 nt, Human
ugggauuacaggcgugagccacugca

SEQ ID NO: 220362 - RNA, 24 nt, Human
ugggcaacacagugagacccuguc

SEQ ID NO: 220363 - RNA, 20 nt, Human
uggggcgggaggaucacuca

SEQ ID NO: 220364 - RNA, 20 nt, Human
uggggucggggcacaggacc

SEQ ID NO: 220365 - RNA, 24 nt, Human
uggggucggggcacaggaccaugc

SEQ ID NO: 220366 - RNA, 21 nt, Human
uggucaacagagugagacccu

SEQ ID NO: 220367 - RNA, 24 nt, Human
uggugcgugccucuagucccagcu

SEQ ID NO: 220368 - RNA, 19 nt, Human
ugucugcacaugcccuccu

SEQ ID NO: 220369 - RNA, 24 nt, Human
uguggcucacaccuguaaucccag

SEQ ID NO: 220370 - RNA, 24 nt, Human
uuccagugcugggauuacaggcgu

SEQ ID NO: 220371 - RNA, 21 nt, Human
uucuaggcuaggguggacccu

SEQ ID NO: 220372 - RNA, 24 nt, Human
uucucacuccacacgcugcaccuc

SEQ ID NO: 220373 - RNA, 22 nt, Human
uugaggccaagaguucaagacc

SEQ ID NO: 220374 - RNA, 19 nt, Human
uuuagaaggaugaggaagg

SEQ ID NO: 220375 - RNA, 19 nt, Human
uuuggggggggacacaaac

SEQ ID NO: 220376 - RNA, 24 nt, Human
aaaaaaaaaacuuauuaaaucuca

SEQ ID NO: 220377 - RNA, 20 nt, Human
aaacaggauacaaacauaug

SEQ ID NO: 220378 - RNA, 22 nt, Human
aaacaggauacaaacauaugac

SEQ ID NO: 220379 - RNA, 23 nt, Human
aaacaggauacaaacauaugacu

SEQ ID NO: 220380 - RNA, 22 nt, Human
aaagauaacuauggcagccuuc

SEQ ID NO: 220381 - RNA, 23 nt, Human
aacuuucacuagaaaauuaaggg

SEQ ID NO: 220382 - RNA, 23 nt, Human
aaucucccccucuugcaacccac

SEQ ID NO: 220383 - RNA, 20 nt, Human
acaggauacaaacauaugac

SEQ ID NO: 220384 - RNA, 21 nt, Human
agaacacaaagaaaauuaagc

SEQ ID NO: 220385 - RNA, 22 nt, Human
agaugaugaaaacacauaaucc

SEQ ID NO: 220386 - RNA, 19 nt, Human
agggaaugccacuguuaca

SEQ ID NO: 220387 - RNA, 23 nt, Human
agguuuuuauuucccaguuuccu

SEQ ID NO: 220388 - RNA, 27 nt, Human
auaaaacaggauacaaacauaugacuu

SEQ ID NO: 220389 - RNA, 18 nt, Human
auagauuuccucuuggcc

SEQ ID NO: 220390 - RNA, 22 nt, Human
auagauuuccucuuggccaaaa

SEQ ID NO: 220391 - RNA, 23 nt, Human
auggaaacacuuuacuuuuaaau

SEQ ID NO: 220392 - RNA, 24 nt, Human
auuuauuuuuuaaaaauuuuuggc

SEQ ID NO: 220393 - RNA, 24 nt, Human
caaaagacacagaugaugaaaaca

SEQ ID NO: 220394 - RNA, 21 nt, Human
caaaccacuucagauacauuu

SEQ ID NO: 220395 - RNA, 25 nt, Human
caaauguaagagaaugaaggcauaa

SEQ ID NO: 220396 - RNA, 23 nt, Human
caacccacacaaauguaagagaa

SEQ ID NO: 220397 - RNA, 21 nt, Human
caagaaaagauaacuauggca

SEQ ID NO: 220398 - RNA, 22 nt, Human
cauggaaacacuuuacuuuuaa

SEQ ID NO: 220399 - RNA, 18 nt, Human
cccacacaaauguaagag

SEQ ID NO: 220400 - RNA, 20 nt, Human
cuucagauacauuuugugcc

SEQ ID NO: 220401 - RNA, 26 nt, Human
gaaaacacauaauccucaaaccacuu

SEQ ID NO: 220402 - RNA, 22 nt, Human
gagcagaacaauaaaauugaaa

SEQ ID NO: 220403 - RNA, 28 nt, Human
ggauacaaacauaugacuuauuuaaaau

SEQ ID NO: 220404 - RNA, 22 nt, Human
gucuguucaguuaucucuaacu

SEQ ID NO: 220405 - RNA, 21 nt, Human
guggaaucagaacugcuugca

SEQ ID NO: 220406 - RNA, 25 nt, Human
uaaaaacacuaaaaaaaaaaaaaaa

SEQ ID NO: 220407 - RNA, 24 nt, Human
uaaaaagaucaacuuaccaaauua

SEQ ID NO: 220408 - RNA, 23 nt, Human
uaaaaggacaaaagacacagaug

SEQ ID NO: 220409 - RNA, 23 nt, Human
uaaaaucagccuauuuauucccc

SEQ ID NO: 220410 - RNA, 25 nt, Human
uaaaguuccccagguuuuuauuucc

SEQ ID NO: 220411 - RNA, 23 nt, Human
uaaauaaccuaaaguuccccagg

SEQ ID NO: 220412 - RNA, 25 nt, Human
uaaaucacugccaguuguuuggaag

SEQ ID NO: 220413 - RNA, 22 nt, Human
uaaaucucaaauucccaagaug

SEQ ID NO: 220414 - RNA, 23 nt, Human
uaagggaaugccacuguuacaga

SEQ ID NO: 220415 - RNA, 23 nt, Human
uaauaaacaauaauauuccuuag

SEQ ID NO: 220416 - RNA, 26 nt, Human
uaauaauauaaaucuuucucauccua

SEQ ID NO: 220417 - RNA, 24 nt, Human
uacaaaaaaaauuuaucaaaauuc

SEQ ID NO: 220418 - RNA, 24 nt, Human
uacauggauggcuucauagauuuc

SEQ ID NO: 220419 - RNA, 20 nt, Human
uacuauaaaauuagaugaau

SEQ ID NO: 220420 - RNA, 22 nt, Human
uauuaaaucucaaauucccaag

SEQ ID NO: 220421 - RNA, 25 nt, Human
ucagaacacaaagaaaauuaagcca

SEQ ID NO: 220422 - RNA, 24 nt, Human
ucagcuuucccauaguuucucucu

SEQ ID NO: 220423 - RNA, 22 nt, Human
ucaguaucaucuucugauuauc

SEQ ID NO: 220424 - RNA, 19 nt, Human
ucccauaguuucucucuca

SEQ ID NO: 220425 - RNA, 21 nt, Human
ucccccauauaaggugggagc

SEQ ID NO: 220426 - RNA, 20 nt, Human
ucccccucuugcaacccaca

SEQ ID NO: 220427 - RNA, 23 nt, Human
uccucauacauggauggcuucau

SEQ ID NO: 220428 - RNA, 22 nt, Human
uccuuuucucaucaaagggcca

SEQ ID NO: 220429 - RNA, 23 nt, Human
ucuugaauaaacauacuuaguuu

SEQ ID NO: 220430 - RNA, 19 nt, Human
ugaauacauguguacaugu

SEQ ID NO: 220431 - RNA, 22 nt, Human
uuacagaagguauaauugcaga

SEQ ID NO: 220432 - RNA, 24 nt, Human
uuagaugaauaaauaauaaaccua

SEQ ID NO: 220433 - RNA, 23 nt, Human
uuagcagauuaaucccuuuuuau

SEQ ID NO: 220434 - RNA, 25 nt, Human
uuagcagauuaaucccuuuuuauau

SEQ ID NO: 220435 - RNA, 25 nt, Human
uuauaaucuuuuccuuauuuuuucu

SEQ ID NO: 220436 - RNA, 18 nt, Human
uuauuaaaucucaaauuc

SEQ ID NO: 220437 - RNA, 25 nt, Human
uucccauaguuucucucucauuugg

SEQ ID NO: 220438 - RNA, 23 nt, Human
uuuccagaauaaucucccccucu

SEQ ID NO: 220439 - RNA, 24 nt, Human
uuucuuauaucccgaacuguuguu

SEQ ID NO: 220440 - RNA, 21 nt, Human
uuuuuuuuuuuuacuaauaga

SEQ ID NO: 220441 - RNA, 22 nt, Human
uuuuuuuuuuuuuuuuuacuaa

SEQ ID NO: 220442 - RNA, 20 nt, Human
aagaagaagauggggaaaag

SEQ ID NO: 220443 - RNA, 18 nt, Human
acgcagccaucuagcccc

SEQ ID NO: 220444 - RNA, 21 nt, Human
acuuacucugcagcccuccca

SEQ ID NO: 220445 - RNA, 19 nt, Human
agaagaagauggggaaaag

SEQ ID NO: 220446 - RNA, 21 nt, Human
caaggcuccaaagaaccaaga

SEQ ID NO: 220447 - RNA, 19 nt, Human
ccaaagaaccaagagugca

SEQ ID NO: 220448 - RNA, 19 nt, Human
cuagccccguggaggaucc

SEQ ID NO: 220449 - RNA, 21 nt, Human
cuagccccguggaggauccuc

SEQ ID NO: 220450 - RNA, 21 nt, Human
cucaccuccgcucccgccccc

SEQ ID NO: 220451 - RNA, 22 nt, Human
cuuacucugcagcccucccaga

SEQ ID NO: 220452 - RNA, 19 nt, Human
gcgggcuagggaggcgagc

SEQ ID NO: 220453 - RNA, 21 nt, Human
ggcuuauagucuuccgcgucg

SEQ ID NO: 220454 - RNA, 22 nt, Human
gggcgcuggaggaagggccggc

SEQ ID NO: 220455 - RNA, 24 nt, Human
gggggcguucggucgucgcccgcu

SEQ ID NO: 220456 - RNA, 18 nt, Human
ucagggcagggaaggccg

SEQ ID NO: 220457 - RNA, 20 nt, Human
ucagggcagggaaggccgga

SEQ ID NO: 220458 - RNA, 22 nt, Human
uccaggucagggcagggaaggc

SEQ ID NO: 220459 - RNA, 25 nt, Human
ucggaacagagggaccuacuccaca

SEQ ID NO: 220460 - RNA, 18 nt, Human
ucuaagacccaggauaca

SEQ ID NO: 220461 - RNA, 29 nt, Human
ucucuaagacccaggauacaaggguggag

SEQ ID NO: 220462 - RNA, 23 nt, Human
ucugcagcccucccagagguucc

SEQ ID NO: 220463 - RNA, 24 nt, Human
ugaaagaagaagauggggaaaagg

SEQ ID NO: 220464 - RNA, 19 nt, Human
ugccacagcgagaaaaauc

SEQ ID NO: 220465 - RNA, 25 nt, Human
uggaggaagggccggcgggggcucg

SEQ ID NO: 220466 - RNA, 25 nt, Human
aacccuuuaaaaucaguuacggcaa

SEQ ID NO: 220467 - RNA, 22 nt, Human
agaaccaaagcaaaagggugua

SEQ ID NO: 220468 - RNA, 18 nt, Human
agagcaccauucuuaaaa

SEQ ID NO: 220469 - RNA, 23 nt, Human
caacgcucagaaaccgucagaag

SEQ ID NO: 220470 - RNA, 23 nt, Human
caacgcucagaaaccgucagagg

SEQ ID NO: 220471 - RNA, 25 nt, Human
gaccggccaccucccuucugacccu

SEQ ID NO: 220472 - RNA, 21 nt, Human
gccaccucccuucugacccug

SEQ ID NO: 220473 - RNA, 24 nt, Human
ggccaccucccuucugacccugcu

SEQ ID NO: 220474 - RNA, 20 nt, Human
guguagcgcgugccaaaggc

SEQ ID NO: 220475 - RNA, 23 nt, Human
uaaauaaaaagacucugacucua

SEQ ID NO: 220476 - RNA, 24 nt, Human
uagcgcgugccaaaggccaacgcu

SEQ ID NO: 220477 - RNA, 19 nt, Human
ucagaaaccgucagagguc

SEQ ID NO: 220478 - RNA, 20 nt, Human
uggccuaaauaaaaagacuc

SEQ ID NO: 220479 - RNA, 21 nt, Human
aaaguuucucuaagagcgcac

SEQ ID NO: 220480 - RNA, 18 nt, Human
aacccccucccccucccc

SEQ ID NO: 220481 - RNA, 26 nt, Human
aaccggugcgagcgaagcugagcgca

SEQ ID NO: 220482 - RNA, 21 nt, Human
aagaguucaucuguaggcuca

SEQ ID NO: 220483 - RNA, 23 nt, Human
acacuucuuuuuucucuccgucg

SEQ ID NO: 220484 - RNA, 20 nt, Human
accaaguccuucccacucgu

SEQ ID NO: 220485 - RNA, 21 nt, Human
acccccucccccuccccccuu

SEQ ID NO: 220486 - RNA, 26 nt, Human
accucccuccugccgccccuccccaa

SEQ ID NO: 220487 - RNA, 24 nt, Human
acgcacccgcuggcugucgucccc

SEQ ID NO: 220488 - RNA, 19 nt, Human
acugccgaccuggcuggcu

SEQ ID NO: 220489 - RNA, 20 nt, Human
acuugucuccgguccucccc

SEQ ID NO: 220490 - RNA, 21 nt, Human
agagagaaggugaaaagaaaa

SEQ ID NO: 220491 - RNA, 29 nt, Human
agagagaaggugaaaagaaaagggacccc

SEQ ID NO: 220492 - RNA, 22 nt, Human
agagagaaggugaaaagaaaau

SEQ ID NO: 220493 - RNA, 21 nt, Human
agauagacuaggaucuacaga

SEQ ID NO: 220494 - RNA, 19 nt, Human
agccuuugguaagcaauuc

SEQ ID NO: 220495 - RNA, 19 nt, Human
auaagacaaaggccaucuu

SEQ ID NO: 220496 - RNA, 19 nt, Human
aucagguacaucagguaca

SEQ ID NO: 220497 - RNA, 20 nt, Human
auugugacagaaugcuguua

SEQ ID NO: 220498 - RNA, 20 nt, Human
caacuuggauacccuuggcu

SEQ ID NO: 220499 - RNA, 23 nt, Human
cacucccgaaccaccagcccggg

SEQ ID NO: 220500 - RNA, 24 nt, Human
cagcagggcucuccucccggggcc

SEQ ID NO: 220501 - RNA, 19 nt, Human
caggaaaggcuugcaaaag

SEQ ID NO: 220502 - RNA, 24 nt, Human
cagugcggacccugcaguggccgg

SEQ ID NO: 220503 - RNA, 21 nt, Human
ccacucgugcacacugggggc

SEQ ID NO: 220504 - RNA, 23 nt, Human
cccaaacaaacaaacaagaaaua

SEQ ID NO: 220505 - RNA, 19 nt, Human
cccagagcagcggcucucc

SEQ ID NO: 220506 - RNA, 20 nt, Human
ccccggagccuuugacaggg

SEQ ID NO: 220507 - RNA, 18 nt, Human
ccccuuccuccagccucc

SEQ ID NO: 220508 - RNA, 19 nt, Human
cccgaaccaccagcccggg

SEQ ID NO: 220509 - RNA, 25 nt, Human
cccgcaggcggccgcucccuggcuc

SEQ ID NO: 220510 - RNA, 19 nt, Human
cccuccugccgccccuccc

SEQ ID NO: 220511 - RNA, 22 nt, Human
ccgccgcugucaacagcgccug

SEQ ID NO: 220512 - RNA, 23 nt, Human
ccucccgcacucuuacuugucga

SEQ ID NO: 220513 - RNA, 23 nt, Human
ccuccugccgccccuccccaacc

SEQ ID NO: 220514 - RNA, 20 nt, Human
ccucgcugcuucagccacac

SEQ ID NO: 220515 - RNA, 21 nt, Human
ccucggaguccgcaggcgaac

SEQ ID NO: 220516 - RNA, 23 nt, Human
cgccaagggagggcgcgaccaag

SEQ ID NO: 220517 - RNA, 19 nt, Human
cgccucgcugcuucagccg

SEQ ID NO: 220518 - RNA, 18 nt, Human
cgcgaccaaguccuuccc

SEQ ID NO: 220519 - RNA, 18 nt, Human
cgcucgcccaaguucaac

SEQ ID NO: 220520 - RNA, 19 nt, Human
cggcagccgcggcucgcgc

SEQ ID NO: 220521 - RNA, 20 nt, Human
cgugcacacugggggcgccg

SEQ ID NO: 220522 - RNA, 20 nt, Human
cucacaaaccucccuccugc

SEQ ID NO: 220523 - RNA, 22 nt, Human
cucacuucccagagcagcggcu

SEQ ID NO: 220524 - RNA, 21 nt, Human
cucagagugcuccaaaucucc

SEQ ID NO: 220525 - RNA, 24 nt, Human
cucccgaaccaccagcccgggagc

SEQ ID NO: 220526 - RNA, 23 nt, Human
cucccggggccggcuggagacaa

SEQ ID NO: 220527 - RNA, 25 nt, Human
cucccuggcuccacgccaagggagg

SEQ ID NO: 220528 - RNA, 23 nt, Human
cugccgccccuccccaacccucc

SEQ ID NO: 220529 - RNA, 18 nt, Human
cugcgcccuccucaccag

SEQ ID NO: 220530 - RNA, 19 nt, Human
cugcgcccuccucaccagc

SEQ ID NO: 220531 - RNA, 21 nt, Human
cuggcugugucugucugucug

SEQ ID NO: 220532 - RNA, 19 nt, Human
cuggucuuuaccgccgugg

SEQ ID NO: 220533 - RNA, 22 nt, Human
cuuguccccuccuccgcugcua

SEQ ID NO: 220534 - RNA, 24 nt, Human
cuuguccccuccuccgcugcuagg

SEQ ID NO: 220535 - RNA, 23 nt, Human
gaaaagucgcggucacucacuga

SEQ ID NO: 220536 - RNA, 20 nt, Human
gacuuguccccuccuccgcu

SEQ ID NO: 220537 - RNA, 20 nt, Human
gaugcagaaaagagguuagg

SEQ ID NO: 220538 - RNA, 21 nt, Human
gccgccccuccccaacccucc

SEQ ID NO: 220539 - RNA, 23 nt, Human
gcgcccuccucaccagcucgcuc

SEQ ID NO: 220540 - RNA, 21 nt, Human
gcucuccgccgccuucugguc

SEQ ID NO: 220541 - RNA, 20 nt, Human
gcuuuccgccgcugucaacu

SEQ ID NO: 220542 - RNA, 20 nt, Human
ggaaaguucuuugcugcugc

SEQ ID NO: 220543 - RNA, 20 nt, Human
ggacacuucuuuuuucucuc

SEQ ID NO: 220544 - RNA, 22 nt, Human
ggcgccgucagaccgaacccag

SEQ ID NO: 220545 - RNA, 21 nt, Human
ggcuggagacaaggcucucug

SEQ ID NO: 220546 - RNA, 21 nt, Human
gucagaccgaacccaguccaa

SEQ ID NO: 220547 - RNA, 24 nt, Human
guuaacgaaagcaggccagaaaga

SEQ ID NO: 220548 - RNA, 21 nt, Human
uaacccccucccccucccccc

SEQ ID NO: 220549 - RNA, 22 nt, Human
uaacuuacaaaggcaugaagcu

SEQ ID NO: 220550 - RNA, 22 nt, Human
uagcaucagguacaucagguac

SEQ ID NO: 220551 - RNA, 20 nt, Human
uauauauauguacauacaca

SEQ ID NO: 220552 - RNA, 23 nt, Human
uaucuaggaauugucaaagagaa

SEQ ID NO: 220553 - RNA, 24 nt, Human
uccacugcaaccccccuuccucca

SEQ ID NO: 220554 - RNA, 18 nt, Human
uccccaacccuccccccg

SEQ ID NO: 220555 - RNA, 19 nt, Human
uccccaacccuccccccgc

SEQ ID NO: 220556 - RNA, 22 nt, Human
ucccgaaccaccagcccgggag

SEQ ID NO: 220557 - RNA, 24 nt, Human
ucccuccugccgccccuccccaac

SEQ ID NO: 220558 - RNA, 27 nt, Human
ucccuccugccgccccuccccaacccu

SEQ ID NO: 220559 - RNA, 24 nt, Human
uccgacgacuuguccccuccuccg

SEQ ID NO: 220560 - RNA, 24 nt, Human
uccuccgcugcuagggggaggggg

SEQ ID NO: 220561 - RNA, 23 nt, Human
uccugccgccccuccccaacccu

SEQ ID NO: 220562 - RNA, 23 nt, Human
ucgcugcuucagccacacucagu

SEQ ID NO: 220563 - RNA, 23 nt, Human
ucguugccccucagcccccgacg

SEQ ID NO: 220564 - RNA, 19 nt, Human
ucucaagucugucucucug

SEQ ID NO: 220565 - RNA, 21 nt, Human
ucuccgguccuccccgccggg

SEQ ID NO: 220566 - RNA, 21 nt, Human
ucuuucaacuccaccuagaua

SEQ ID NO: 220567 - RNA, 22 nt, Human
ugacuucucagugggcuguccc

SEQ ID NO: 220568 - RNA, 25 nt, Human
ugcaaccccccuuccuccagccucc

SEQ ID NO: 220569 - RNA, 23 nt, Human
ugccccucagcccccgacggucu

SEQ ID NO: 220570 - RNA, 19 nt, Human
ugccgccccuccccaaccc

SEQ ID NO: 220571 - RNA, 21 nt, Human
ugcugcugcagccgcucgccg

SEQ ID NO: 220572 - RNA, 21 nt, Human
ugcuucagccacacucagugc

SEQ ID NO: 220573 - RNA, 21 nt, Human
uggaauuuucagaaacaaaac

SEQ ID NO: 220574 - RNA, 19 nt, Human
uggagacaaggcucucugg

SEQ ID NO: 220575 - RNA, 21 nt, Human
uggcuggcuggcugugucugu

SEQ ID NO: 220576 - RNA, 19 nt, Human
uggcuggcugugucugucu

SEQ ID NO: 220577 - RNA, 19 nt, Human
uggcugugucugucugucu

SEQ ID NO: 220578 - RNA, 23 nt, Human
uggcuuuaguucucggacacuuc

SEQ ID NO: 220579 - RNA, 22 nt, Human
uguccccuccuccgcugcuagg

SEQ ID NO: 220580 - RNA, 22 nt, Human
uuagagagaaggugaaaagaaa

SEQ ID NO: 220581 - RNA, 21 nt, Human
uuccuccagccuccugaaaca

SEQ ID NO: 220582 - RNA, 28 nt, Human
uucuuugcugcugcagccgcucgccgac

SEQ ID NO: 220583 - RNA, 23 nt, Human
uugaauacauuuauugugacaga

SEQ ID NO: 220584 - RNA, 22 nt, Human
uuguaacccccucccccucccc

SEQ ID NO: 220585 - RNA, 21 nt, Human
uuucggggccgcaacagggcu

SEQ ID NO: 220586 - RNA, 24 nt, Human
aaaaagaacaaacacacacaaaca

SEQ ID NO: 220587 - RNA, 20 nt, Human
aaaagaacaaacacacacaa

SEQ ID NO: 220588 - RNA, 27 nt, Human
aaaagaacaaacacacacaaacacaaa

SEQ ID NO: 220589 - RNA, 21 nt, Human
aaacacacacaaacacaaaca

SEQ ID NO: 220590 - RNA, 21 nt, Human
aaauagauucaauaaaaagaa

SEQ ID NO: 220591 - RNA, 22 nt, Human
acacaaacacgucuuaaaauaa

SEQ ID NO: 220592 - RNA, 18 nt, Human
agagaggggagggcaggg

SEQ ID NO: 220593 - RNA, 24 nt, Human
agcagaaaaaaaacauacaaaaaa

SEQ ID NO: 220594 - RNA, 21 nt, Human
aggggagggcagggggcgggg

SEQ ID NO: 220595 - RNA, 25 nt, Human
auacaaaaaaaaguggaaggggggg

SEQ ID NO: 220596 - RNA, 19 nt, Human
cacacacaaacacaaacac

SEQ ID NO: 220597 - RNA, 19 nt, Human
cagcagaaaaaaaacauac

SEQ ID NO: 220598 - RNA, 22 nt, Human
cagcagaaaaaaaacauacaaa

SEQ ID NO: 220599 - RNA, 23 nt, Human
cagcagaaaaaaaacauacaaaa

SEQ ID NO: 220600 - RNA, 24 nt, Human
cagggugggugcccaccgccugcu

SEQ ID NO: 220601 - RNA, 27 nt, Human
cauacaaaaaaaaguggaagggggggc

SEQ ID NO: 220602 - RNA, 23 nt, Human
cccagcucccagcucccugcugg

SEQ ID NO: 220603 - RNA, 23 nt, Human
ccccagugggaggcgugugccca

SEQ ID NO: 220604 - RNA, 24 nt, Human
cccuaggucccagggugggugccc

SEQ ID NO: 220605 - RNA, 19 nt, Human
ccugcucccuggaccccag

SEQ ID NO: 220606 - RNA, 22 nt, Human
cgagguggaaggacugggcgca

SEQ ID NO: 220607 - RNA, 23 nt, Human
cgcaaaagcccugucaggcuucc

SEQ ID NO: 220608 - RNA, 21 nt, Human
cuaagugcguguuucuuuucc

SEQ ID NO: 220609 - RNA, 19 nt, Human
gaagggggggcuuguaaac

SEQ ID NO: 220610 - RNA, 24 nt, Human
gccgcgaucgcccccucuuccccu

SEQ ID NO: 220611 - RNA, 23 nt, Human
ggaaggacugggcgcaggguagg

SEQ ID NO: 220612 - RNA, 23 nt, Human
ggagggcagggggcggggguccc

SEQ ID NO: 220613 - RNA, 20 nt, Human
gggagggcagggggcggggg

SEQ ID NO: 220614 - RNA, 19 nt, Human
gggagggucccugcggggc

SEQ ID NO: 220615 - RNA, 23 nt, Human
gggcagggggcggggguccccuu

SEQ ID NO: 220616 - RNA, 21 nt, Human
gggccggaguccagugugguu

SEQ ID NO: 220617 - RNA, 18 nt, Human
gggcuggcgcgggcgggu

SEQ ID NO: 220618 - RNA, 18 nt, Human
ggggagggcagggggcgg

SEQ ID NO: 220619 - RNA, 20 nt, Human
gggggcggggguccccuucc

SEQ ID NO: 220620 - RNA, 24 nt, Human
ggggggccggaguccagugugguu

SEQ ID NO: 220621 - RNA, 24 nt, Human
guucucgggggcuggcgcgggcgg

SEQ ID NO: 220622 - RNA, 20 nt, Human
guuuccagcagaaaaaaaac

SEQ ID NO: 220623 - RNA, 21 nt, Human
ucaauaaaaagaacaaacaca

SEQ ID NO: 220624 - RNA, 19 nt, Human
uccacaguacggugcagag

SEQ ID NO: 220625 - RNA, 22 nt, Human
uccacaguacggugcagagagg

SEQ ID NO: 220626 - RNA, 23 nt, Human
uccacaguacggugcagagaggg

SEQ ID NO: 220627 - RNA, 25 nt, Human
uccagcagaaaaaaaacauacaaaa

SEQ ID NO: 220628 - RNA, 24 nt, Human
ucccagggugggugcccaccgccu

SEQ ID NO: 220629 - RNA, 19 nt, Human
ucccgagcccccgucgccc

SEQ ID NO: 220630 - RNA, 18 nt, Human
ucccugcggggccgcucc

SEQ ID NO: 220631 - RNA, 19 nt, Human
ucgcugcagcgagcggcga

SEQ ID NO: 220632 - RNA, 22 nt, Human
ugccuggucgcgcguucucggg

SEQ ID NO: 220633 - RNA, 25 nt, Human
ugccuggucgcgcguucucgggggc

SEQ ID NO: 220634 - RNA, 20 nt, Human
uucccccagcucccagcucc

SEQ ID NO: 220635 - RNA, 24 nt, Human
uucucgggggcuggcgcgggcggg

SEQ ID NO: 220636 - RNA, 19 nt, Human
aaaaaaggggaggggggga

SEQ ID NO: 220637 - RNA, 19 nt, Human
aaaacaaaacaaaacagaa

SEQ ID NO: 220638 - RNA, 24 nt, Human
aaaacaaaacaaaacagaacaaaa

SEQ ID NO: 220639 - RNA, 18 nt, Human
aaaacagaacaaaaaaag

SEQ ID NO: 220640 - RNA, 20 nt, Human
aaaaccaacacaagaaaaca

SEQ ID NO: 220641 - RNA, 21 nt, Human
aaacaaaacaaaacagaacaa

SEQ ID NO: 220642 - RNA, 22 nt, Human
aaacaaaacaaaacagaacaaa

SEQ ID NO: 220643 - RNA, 26 nt, Human
aaacaaaacagaacaaaaaaagggga

SEQ ID NO: 220644 - RNA, 22 nt, Human
aaagaaaaaaaaaaaguaaaag

SEQ ID NO: 220645 - RNA, 21 nt, Human
aacaaaaaaaggggagggggg

SEQ ID NO: 220646 - RNA, 23 nt, Human
aacagaacaaaaaaaggggaggg

SEQ ID NO: 220647 - RNA, 19 nt, Human
aaccaaggauuacaaacag

SEQ ID NO: 220648 - RNA, 26 nt, Human
aagaaaacacacacacacacaaccaa

SEQ ID NO: 220649 - RNA, 19 nt, Human
aaggggagggggggacggu

SEQ ID NO: 220650 - RNA, 22 nt, Human
acaaaacaaaacagaacaaaaa

SEQ ID NO: 220651 - RNA, 21 nt, Human
acacaaccaacguuuguuccc

SEQ ID NO: 220652 - RNA, 23 nt, Human
accaacacaagaaaacacacaca

SEQ ID NO: 220653 - RNA, 27 nt, Human
agaaaaaaaaaaaguaaaaguaaagga

SEQ ID NO: 220654 - RNA, 20 nt, Human
agaacaaaaaaaggggaggg

SEQ ID NO: 220655 - RNA, 21 nt, Human
aggggguccagcuugucgagu

SEQ ID NO: 220656 - RNA, 23 nt, Human
auuuuuuuuucuucuucccauuu

SEQ ID NO: 220657 - RNA, 26 nt, Human
caagaaaacacacacacacacaacca

SEQ ID NO: 220658 - RNA, 28 nt, Human
caagaaaacacacacacacacaaccaac

SEQ ID NO: 220659 - RNA, 22 nt, Human
cacgacacccccccgcgagccc

SEQ ID NO: 220660 - RNA, 18 nt, Human
cacucuguucuucucucu

SEQ ID NO: 220661 - RNA, 24 nt, Human
cagaaaaccgggcgaaccaaggaa

SEQ ID NO: 220662 - RNA, 18 nt, Human
ccaacacaagaaaacaca

SEQ ID NO: 220663 - RNA, 24 nt, Human
ccaacacaagaaaacacacacaca

SEQ ID NO: 220664 - RNA, 18 nt, Human
ccacuggcggcggcuccu

SEQ ID NO: 220665 - RNA, 21 nt, Human
cccccguccgcucggcccugc

SEQ ID NO: 220666 - RNA, 23 nt, Human
cccccuugcggcgcgguguacaa

SEQ ID NO: 220667 - RNA, 21 nt, Human
cccgccccggccgcggccgca

SEQ ID NO: 220668 - RNA, 21 nt, Human
cccggcccuccacuggcggcg

SEQ ID NO: 220669 - RNA, 19 nt, Human
cccggggggcccgcgcccc

SEQ ID NO: 220670 - RNA, 28 nt, Human
ccgcgccggcccgggggggaguggccgc

SEQ ID NO: 220671 - RNA, 21 nt, Human
ccgggagcaggggguccagcu

SEQ ID NO: 220672 - RNA, 24 nt, Human
cgcccacgacacccccccgcgagc

SEQ ID NO: 220673 - RNA, 18 nt, Human
cgccccggccgcggccgc

SEQ ID NO: 220674 - RNA, 19 nt, Human
cgccccggccgcggccgca

SEQ ID NO: 220675 - RNA, 20 nt, Human
cgcggccgcagcgcccggcc

SEQ ID NO: 220676 - RNA, 24 nt, Human
cggagaauuuuuuuuucuucuucc

SEQ ID NO: 220677 - RNA, 22 nt, Human
cggcggcuccugcgccgcgcca

SEQ ID NO: 220678 - RNA, 28 nt, Human
cguagcaaaacaaaacaaaacagaacaa

SEQ ID NO: 220679 - RNA, 19 nt, Human
cuccacuggcggcggcucc

SEQ ID NO: 220680 - RNA, 24 nt, Human
cuccacuggcggcggcuccugcgc

SEQ ID NO: 220681 - RNA, 18 nt, Human
cuccgccucccccgccgc

SEQ ID NO: 220682 - RNA, 23 nt, Human
cucggcccugcgcccgccccggc

SEQ ID NO: 220683 - RNA, 19 nt, Human
cucucugaguuccugggca

SEQ ID NO: 220684 - RNA, 20 nt, Human
cucuguucuucucucuucca

SEQ ID NO: 220685 - RNA, 22 nt, Human
gcagcgcgagggcggggggguc

SEQ ID NO: 220686 - RNA, 25 nt, Human
gccgcacccucuccaaguccggggc

SEQ ID NO: 220687 - RNA, 18 nt, Human
gcgcgguguacaaagggg

SEQ ID NO: 220688 - RNA, 20 nt, Human
gcucgcccccgggagcaggg

SEQ ID NO: 220689 - RNA, 22 nt, Human
gggagggggggacggucgaaag

SEQ ID NO: 220690 - RNA, 21 nt, Human
gggcacacucggggagggggg

SEQ ID NO: 220691 - RNA, 18 nt, Human
ggggagggggggguggag

SEQ ID NO: 220692 - RNA, 20 nt, Human
ggggagggggggguggaggg

SEQ ID NO: 220693 - RNA, 23 nt, Human
gggggaguggccgcggccucccg

SEQ ID NO: 220694 - RNA, 20 nt, Human
ggggguggagggccgcaccc

SEQ ID NO: 220695 - RNA, 18 nt, Human
gggguccagcuugucgag

SEQ ID NO: 220696 - RNA, 21 nt, Human
guccagcuugucgaguccggg

SEQ ID NO: 220697 - RNA, 20 nt, Human
uaaaggaaaggcaggguuug

SEQ ID NO: 220698 - RNA, 21 nt, Human
uagcaaaacaaaacaaaacag

SEQ ID NO: 220699 - RNA, 22 nt, Human
uagcaaaacaaaacaaaacaga

SEQ ID NO: 220700 - RNA, 24 nt, Human
uagggcagaaucgaacacucuguu

SEQ ID NO: 220701 - RNA, 24 nt, Human
uccaaagaaaaaaaaaaaguaaaa

SEQ ID NO: 220702 - RNA, 20 nt, Human
uccagcuugucgaguccggg

SEQ ID NO: 220703 - RNA, 25 nt, Human
ucucucuuccaaagaaaaaaaaaaa

SEQ ID NO: 220704 - RNA, 18 nt, Human
ucuguucuucucucuucc

SEQ ID NO: 220705 - RNA, 19 nt, Human
ugcaacacggggcggccgc

SEQ ID NO: 220706 - RNA, 20 nt, Human
ugcaacacggggcggccgcg

SEQ ID NO: 220707 - RNA, 23 nt, Human
ugggcacacucggggaggggggg

SEQ ID NO: 220708 - RNA, 23 nt, Human
ugggcacacucggggaggggggg

SEQ ID NO: 220709 - RNA, 26 nt, Human
ugggcacacucggggaggggggggug

SEQ ID NO: 220710 - RNA, 25 nt, Human
uugacgugcgcccccucggagcccc

SEQ ID NO: 220711 - RNA, 24 nt, Human
aaaaaaaccaauaaccaaaaacau

SEQ ID NO: 220712 - RNA, 21 nt, Human
aaaaaaccaauaaccaaaaac

SEQ ID NO: 220713 - RNA, 24 nt, Human
aaacagaauggguacuugagucug

SEQ ID NO: 220714 - RNA, 26 nt, Human
aaacaggaaggggaagagaagggacc

SEQ ID NO: 220715 - RNA, 20 nt, Human
aaagacacaagaagaaggca

SEQ ID NO: 220716 - RNA, 21 nt, Human
aaagcccuuccgggcccaggc

SEQ ID NO: 220717 - RNA, 25 nt, Human
aaaucagacccagagaaggaaccaa

SEQ ID NO: 220718 - RNA, 18 nt, Human
aaccaaaaacauaaagcg

SEQ ID NO: 220719 - RNA, 18 nt, Human
aaccaaaaacauaaagcg

SEQ ID NO: 220720 - RNA, 22 nt, Human
aaccaaagcccuuccgggccca

SEQ ID NO: 220721 - RNA, 27 nt, Human
aaccugggcccuggaggcccugggggc

SEQ ID NO: 220722 - RNA, 20 nt, Human
aagaaggcaggccagggcac

SEQ ID NO: 220723 - RNA, 27 nt, Human
aagcaggagcagaacacuaucccaaga

SEQ ID NO: 220724 - RNA, 18 nt, Human
aagcucagcagcaaagga

SEQ ID NO: 220725 - RNA, 22 nt, Human
aagcuggcaucuucuggagcag

SEQ ID NO: 220726 - RNA, 21 nt, Human
aaggagguucuagagaggagg

SEQ ID NO: 220727 - RNA, 19 nt, Human
accugggcccuggaggccc

SEQ ID NO: 220728 - RNA, 18 nt, Human
acuugagucugaagcuuu

SEQ ID NO: 220729 - RNA, 24 nt, Human
agaacacuaucccaagaaagaccc

SEQ ID NO: 220730 - RNA, 21 nt, Human
agaagaaggcaggccagggca

SEQ ID NO: 220731 - RNA, 21 nt, Human
agaaggagguucuagagagga

SEQ ID NO: 220732 - RNA, 26 nt, Human
agagccucucagaugaggaaccgcac

SEQ ID NO: 220733 - RNA, 24 nt, Human
agaggaggaaaagccugcaaagag

SEQ ID NO: 220734 - RNA, 22 nt, Human
agcaaaggauccccccaaaaaa

SEQ ID NO: 220735 - RNA, 20 nt, Human
agccaacuaagcacccugga

SEQ ID NO: 220736 - RNA, 19 nt, Human
agcgauaauaauaaaacac

SEQ ID NO: 220737 - RNA, 20 nt, Human
aggaaaagccugcaaagagg

SEQ ID NO: 220738 - RNA, 23 nt, Human
aggcagcuggagacagggaggcu

SEQ ID NO: 220739 - RNA, 18 nt, Human
agggcagcugugugggug

SEQ ID NO: 220740 - RNA, 20 nt, Human
agggcagcuguguggguggg

SEQ ID NO: 220741 - RNA, 21 nt, Human
aguggccagggccacaggggc

SEQ ID NO: 220742 - RNA, 23 nt, Human
caaaaaaaccaauaaccaaaaac

SEQ ID NO: 220743 - RNA, 24 nt, Human
caaaaaaaccaauaaccaaaaaca

SEQ ID NO: 220744 - RNA, 27 nt, Human
caaaaaaaccaauaaccaaaaacauaa

SEQ ID NO: 220745 - RNA, 20 nt, Human
caacagaaggagguucuaga

SEQ ID NO: 220746 - RNA, 21 nt, Human
caagaaagacccuacggagga

SEQ ID NO: 220747 - RNA, 22 nt, Human
caagaaagacccuacggaggac

SEQ ID NO: 220748 - RNA, 19 nt, Human
cacaagaagaaggcaggcc

SEQ ID NO: 220749 - RNA, 18 nt, Human
caccacacaccagagggg

SEQ ID NO: 220750 - RNA, 23 nt, Human
caccacacaccagaggggucagc

SEQ ID NO: 220751 - RNA, 19 nt, Human
caccccggcuuccccagcu

SEQ ID NO: 220752 - RNA, 18 nt, Human
caccugcccaccaccccc

SEQ ID NO: 220753 - RNA, 24 nt, Human
cacuccauaucuccuccccaucuc

SEQ ID NO: 220754 - RNA, 23 nt, Human
cagacccagagaaggaaccaaag

SEQ ID NO: 220755 - RNA, 22 nt, Human
cagcagcaaaggauccccccaa

SEQ ID NO: 220756 - RNA, 23 nt, Human
cagcagcaaaggauccccccaaa

SEQ ID NO: 220757 - RNA, 20 nt, Human
caggaauaggccuccccauc

SEQ ID NO: 220758 - RNA, 21 nt, Human
ccaaagcccuuccgggcccag

SEQ ID NO: 220759 - RNA, 18 nt, Human
ccaccaaagacacaagaa

SEQ ID NO: 220760 - RNA, 23 nt, Human
ccacuccgugucaccugcccacc

SEQ ID NO: 220761 - RNA, 22 nt, Human
ccagaagcucaagccacuccgu

SEQ ID NO: 220762 - RNA, 18 nt, Human
cccaagaaagacccuacg

SEQ ID NO: 220763 - RNA, 24 nt, Human
cccagccccccacaccaugugcgg

SEQ ID NO: 220764 - RNA, 22 nt, Human
cccaugcccaggacagaaaagc

SEQ ID NO: 220765 - RNA, 24 nt, Human
ccccaaaaaaggagcgcagguuuc

SEQ ID NO: 220766 - RNA, 22 nt, Human
ccccaccaaagacacaagaaga

SEQ ID NO: 220767 - RNA, 22 nt, Human
ccccagaagcucaagccacucc

SEQ ID NO: 220768 - RNA, 20 nt, Human
cccccagccccccacaccau

SEQ ID NO: 220769 - RNA, 22 nt, Human
ccccuggacggucccugaacuu

SEQ ID NO: 220770 - RNA, 18 nt, Human
cccuggaggcccuggggg

SEQ ID NO: 220771 - RNA, 19 nt, Human
cccuggaggcccugggggc

SEQ ID NO: 220772 - RNA, 19 nt, Human
cccugggggcuuagggcag

SEQ ID NO: 220773 - RNA, 20 nt, Human
ccgugucaccugcccaccac

SEQ ID NO: 220774 - RNA, 25 nt, Human
ccugcaaagagggggccgucacugg

SEQ ID NO: 220775 - RNA, 21 nt, Human
ccugcccaccacccccagaag

SEQ ID NO: 220776 - RNA, 19 nt, Human
ccuggaggcccugggggcu

SEQ ID NO: 220777 - RNA, 23 nt, Human
ccugggcccuggaggcccugggg

SEQ ID NO: 220778 - RNA, 18 nt, Human
ccuguuaggggagcgggg

SEQ ID NO: 220779 - RNA, 26 nt, Human
cuaagcacccuggagagagaagcugg

SEQ ID NO: 220780 - RNA, 22 nt, Human
cucacuccauaucuccucccca

SEQ ID NO: 220781 - RNA, 24 nt, Human
cucagcagcaaaggauccccccaa

SEQ ID NO: 220782 - RNA, 24 nt, Human
cuccgugucaccugcccaccaccc

SEQ ID NO: 220783 - RNA, 21 nt, Human
cucggggucagcuagggcagc

SEQ ID NO: 220784 - RNA, 22 nt, Human
cucggggucagcuagggcagcu

SEQ ID NO: 220785 - RNA, 20 nt, Human
cucugcuuggaccuccccca

SEQ ID NO: 220786 - RNA, 20 nt, Human
cuggagacagggaggcugga

SEQ ID NO: 220787 - RNA, 21 nt, Human
cuguccccggagcucccuggg

SEQ ID NO: 220788 - RNA, 18 nt, Human
gacccagagaaggaacca

SEQ ID NO: 220789 - RNA, 19 nt, Human
gagcaggugacucacucca

SEQ ID NO: 220790 - RNA, 22 nt, Human
gagcucggcgcggucgggcggc

SEQ ID NO: 220791 - RNA, 23 nt, Human
gaggaccucuggaggcgcagggu

SEQ ID NO: 220792 - RNA, 24 nt, Human
gaggcccugggggcuuagggcagu

SEQ ID NO: 220793 - RNA, 20 nt, Human
gcaaaggauccccccaaaaa

SEQ ID NO: 220794 - RNA, 19 nt, Human
gccacaggggcggggaggg

SEQ ID NO: 220795 - RNA, 20 nt, Human
gcccugggggcuuagggcag

SEQ ID NO: 220796 - RNA, 21 nt, Human
gccuccaacagaaggagguuc

SEQ ID NO: 220797 - RNA, 23 nt, Human
gccuccccauccccaccaaagac

SEQ ID NO: 220798 - RNA, 26 nt, Human
gcucccuggggagugaggggugggca

SEQ ID NO: 220799 - RNA, 18 nt, Human
ggaaccaaagcccuuccg

SEQ ID NO: 220800 - RNA, 22 nt, Human
ggacggucccugaacuuuucaa

SEQ ID NO: 220801 - RNA, 21 nt, Human
ggagcgcagguuucagcgggg

SEQ ID NO: 220802 - RNA, 20 nt, Human
ggaggaaaagccugcaaaga

SEQ ID NO: 220803 - RNA, 21 nt, Human
ggaggcccugggggcuuaggg

SEQ ID NO: 220804 - RNA, 23 nt, Human
ggcuuagggcaguuggucggugg

SEQ ID NO: 220805 - RNA, 19 nt, Human
gggagcggggacagacagg

SEQ ID NO: 220806 - RNA, 22 nt, Human
gggcaaagccaacuaagcaccc

SEQ ID NO: 220807 - RNA, 21 nt, Human
gggcagcugugugggugggac

SEQ ID NO: 220808 - RNA, 23 nt, Human
uaaccaaaaacauaaagcgauaa

SEQ ID NO: 220809 - RNA, 24 nt, Human
uaaccaaaaacauaaagcgauaau

SEQ ID NO: 220810 - RNA, 26 nt, Human
uaaccaaaaacauaaagcgauaauaa

SEQ ID NO: 220811 - RNA, 24 nt, Human
uacaaaaaaaccaauaaccaaaaa

SEQ ID NO: 220812 - RNA, 20 nt, Human
uacaaaaaaaccaauaaccu

SEQ ID NO: 220813 - RNA, 19 nt, Human
uagagaggaggaaaagccu

SEQ ID NO: 220814 - RNA, 21 nt, Human
ucacuccauaucuccucccca

SEQ ID NO: 220815 - RNA, 24 nt, Human
ucagacccagagaaggaaccaaag

SEQ ID NO: 220816 - RNA, 24 nt, Human
ucagcagcaaaggauccccccaaa

SEQ ID NO: 220817 - RNA, 20 nt, Human
ucaggcccuggacccaugcc

SEQ ID NO: 220818 - RNA, 19 nt, Human
uccauaucuccuccccauc

SEQ ID NO: 220819 - RNA, 19 nt, Human
ucccaagaaagacccuacg

SEQ ID NO: 220820 - RNA, 23 nt, Human
uccccaccaaagacacaagaaga

SEQ ID NO: 220821 - RNA, 21 nt, Human
uccccccaaaaaaggagcgca

SEQ ID NO: 220822 - RNA, 19 nt, Human
uccccggagcucccugggg

SEQ ID NO: 220823 - RNA, 22 nt, Human
uccccggagcucccuggggagu

SEQ ID NO: 220824 - RNA, 22 nt, Human
ucccugaacuuuucaagagaag

SEQ ID NO: 220825 - RNA, 24 nt, Human
ucccugaacuuuucaagagaaguu

SEQ ID NO: 220826 - RNA, 18 nt, Human
ucgguggaguucagugag

SEQ ID NO: 220827 - RNA, 26 nt, Human
ucugcuuggaccucccccagcccccc

SEQ ID NO: 220828 - RNA, 23 nt, Human
ucuugccccaucgccugcacgga

SEQ ID NO: 220829 - RNA, 21 nt, Human
ugacucacuccauaucuccuc

SEQ ID NO: 220830 - RNA, 20 nt, Human
ugagaaaaucagacccagag

SEQ ID NO: 220831 - RNA, 21 nt, Human
ugagaaaaucagacccagaga

SEQ ID NO: 220832 - RNA, 19 nt, Human
ugcgggaaauggggggguc

SEQ ID NO: 220833 - RNA, 24 nt, Human
ugcgggaaaugggggggucugaaa

SEQ ID NO: 220834 - RNA, 21 nt, Human
ugcuuggggaagcucagcagc

SEQ ID NO: 220835 - RNA, 21 nt, Human
uggacccaugcccaggacaga

SEQ ID NO: 220836 - RNA, 18 nt, Human
uggaccucccccagcccc

SEQ ID NO: 220837 - RNA, 19 nt, Human
uggaccucccccagccccc

SEQ ID NO: 220838 - RNA, 22 nt, Human
uggaccucccccagccccccac

SEQ ID NO: 220839 - RNA, 21 nt, Human
uggagacagggaggcuggagg

SEQ ID NO: 220840 - RNA, 24 nt, Human
uggagagagaagcuggcaucuucu

SEQ ID NO: 220841 - RNA, 23 nt, Human
uggaggcccugggggcuuagggc

SEQ ID NO: 220842 - RNA, 22 nt, Human
uggaggcgcagggugcagcagg

SEQ ID NO: 220843 - RNA, 20 nt, Human
uggagguuuggaggggcguu

SEQ ID NO: 220844 - RNA, 18 nt, Human
uggggagugagggguggg

SEQ ID NO: 220845 - RNA, 19 nt, Human
ugucaccugcccaccaccc

SEQ ID NO: 220846 - RNA, 20 nt, Human
ugucaggcccuggacccaug

SEQ ID NO: 220847 - RNA, 18 nt, Human
uuacaccccggcuucccc

SEQ ID NO: 220848 - RNA, 19 nt, Human
uuauuuuuauuuucuuugc

SEQ ID NO: 220849 - RNA, 24 nt, Human
aaagugcugggauuacaggcguga

SEQ ID NO: 220850 - RNA, 19 nt, Human
aaguagcugggacuacagg

SEQ ID NO: 220851 - RNA, 20 nt, Human
aaguagcugggacuacaggu

SEQ ID NO: 220852 - RNA, 19 nt, Human
aagugcugggauuacaggc

SEQ ID NO: 220853 - RNA, 19 nt, Human
aagugcugggauuacaggc

SEQ ID NO: 220854 - RNA, 23 nt, Human
aagugggaggcaggccuggagga

SEQ ID NO: 220855 - RNA, 21 nt, Human
acagaacagccagggcucaag

SEQ ID NO: 220856 - RNA, 25 nt, Human
acccgccucggccucccaaagugcu

SEQ ID NO: 220857 - RNA, 18 nt, Human
acgggguuucaccauguu

SEQ ID NO: 220858 - RNA, 19 nt, Human
acgggguuucaccauguua

SEQ ID NO: 220859 - RNA, 20 nt, Human
acgggguuucaccauguuag

SEQ ID NO: 220860 - RNA, 24 nt, Human
acgggguuucaccauguuagccag

SEQ ID NO: 220861 - RNA, 21 nt, Human
agaccccugggagcccugagg

SEQ ID NO: 220862 - RNA, 24 nt, Human
agccagggagaccccugggagccc

SEQ ID NO: 220863 - RNA, 18 nt, Human
agcccaccugcgccaggg

SEQ ID NO: 220864 - RNA, 21 nt, Human
agcccaccugcgccagggacg

SEQ ID NO: 220865 - RNA, 21 nt, Human
aggcaggccuggaggagggag

SEQ ID NO: 220866 - RNA, 23 nt, Human
aggccccagaaagcccccuacuu

SEQ ID NO: 220867 - RNA, 25 nt, Human
aggcuggagugcaguagcacgaucu

SEQ ID NO: 220868 - RNA, 18 nt, Human
agggagaccccugggagc

SEQ ID NO: 220869 - RNA, 22 nt, Human
agggagauggggauagcagcug

SEQ ID NO: 220870 - RNA, 19 nt, Human
agggcagguagaaguccag

SEQ ID NO: 220871 - RNA, 22 nt, Human
agggcccacuucugccugugcc

SEQ ID NO: 220872 - RNA, 24 nt, Human
agugcaguagcacgaucucagcuc

SEQ ID NO: 220873 - RNA, 21 nt, Human
auucuccugccucagccuccc

SEQ ID NO: 220874 - RNA, 24 nt, Human
caaagugcugggauuacaggcgug

SEQ ID NO: 220875 - RNA, 22 nt, Human
cacaccauucuccugccucagc

SEQ ID NO: 220876 - RNA, 18 nt, Human
caccauguuagccaggau

SEQ ID NO: 220877 - RNA, 22 nt, Human
caccauguuagccaggaugguc

SEQ ID NO: 220878 - RNA, 24 nt, Human
caccauguuagccaggauggucuc

SEQ ID NO: 220879 - RNA, 23 nt, Human
cacccgccucggccucccaaagu

SEQ ID NO: 220880 - RNA, 22 nt, Human
cacugcaaccuccgcucccggg

SEQ ID NO: 220881 - RNA, 19 nt, Human
cagcagcagggaggacucu

SEQ ID NO: 220882 - RNA, 22 nt, Human
caggccuggaggagggagccag

SEQ ID NO: 220883 - RNA, 19 nt, Human
caggugcccgccaccgcgc

SEQ ID NO: 220884 - RNA, 21 nt, Human
caggugcccgccaccgcgccc

SEQ ID NO: 220885 - RNA, 22 nt, Human
ccaaagugcugggauuacaggc

SEQ ID NO: 220886 - RNA, 22 nt, Human
ccaaagugcugggauuacaggc

SEQ ID NO: 220887 - RNA, 24 nt, Human
ccaaagugcugggauuacaggcgu

SEQ ID NO: 220888 - RNA, 23 nt, Human
cccaaguagcugggacuacaggu

SEQ ID NO: 220889 - RNA, 24 nt, Human
cccaaguagcugggacuacaggug

SEQ ID NO: 220890 - RNA, 22 nt, Human
cccagcgucacccgcucgugcc

SEQ ID NO: 220891 - RNA, 19 nt, Human
ccccaggcuggagugcagu

SEQ ID NO: 220892 - RNA, 24 nt, Human
cccggcccccuccuccccaauuuu

SEQ ID NO: 220893 - RNA, 22 nt, Human
cccugggagcccugagguuggg

SEQ ID NO: 220894 - RNA, 24 nt, Human
ccgcgcccggcccccuccucccca

SEQ ID NO: 220895 - RNA, 24 nt, Human
ccgcgcugcaggcccagcgucacc

SEQ ID NO: 220896 - RNA, 19 nt, Human
ccgcucccggguucacacc

SEQ ID NO: 220897 - RNA, 18 nt, Human
ccuccgcucccggguuca

SEQ ID NO: 220898 - RNA, 20 nt, Human
ccugaccucgugauccaccc

SEQ ID NO: 220899 - RNA, 23 nt, Human
ccugccucagccucccaaguagc

SEQ ID NO: 220900 - RNA, 24 nt, Human
ccugccucagccucccaaguagcu

SEQ ID NO: 220901 - RNA, 22 nt, Human
cggcccccuccuccccaauuuu

SEQ ID NO: 220902 - RNA, 24 nt, Human
cggcccccuccuccccaauuuuuc

SEQ ID NO: 220903 - RNA, 18 nt, Human
cucaaggcuggcagcgga

SEQ ID NO: 220904 - RNA, 23 nt, Human
cucacugcaaccuccgcucccgg

SEQ ID NO: 220905 - RNA, 24 nt, Human
cucacugcaaccuccgcucccggg

SEQ ID NO: 220906 - RNA, 24 nt, Human
cucagccucccaaguagcugggac

SEQ ID NO: 220907 - RNA, 21 nt, Human
cucccggguucacaccauucu

SEQ ID NO: 220908 - RNA, 19 nt, Human
cuccgcgcugcaggcccag

SEQ ID NO: 220909 - RNA, 24 nt, Human
cuccugaccucgugauccacccgc

SEQ ID NO: 220910 - RNA, 22 nt, Human
cucuuucugucccccaggcugg

SEQ ID NO: 220911 - RNA, 24 nt, Human
cucuuucugucccccaggcuggag

SEQ ID NO: 220912 - RNA, 20 nt, Human
cugaguugauaagagaaccc

SEQ ID NO: 220913 - RNA, 22 nt, Human
cugcaaccuccgcucccggguu

SEQ ID NO: 220914 - RNA, 24 nt, Human
cuuucugucccccaggcuggagug

SEQ ID NO: 220915 - RNA, 22 nt, Human
gaccucgugauccacccgccuc

SEQ ID NO: 220916 - RNA, 22 nt, Human
gaccucgugauccacccgccuc

SEQ ID NO: 220917 - RNA, 24 nt, Human
gaccucgugauccacccgccucgg

SEQ ID NO: 220918 - RNA, 24 nt, Human
gagacgggguuucaccauguuagc

SEQ ID NO: 220919 - RNA, 23 nt, Human
gagcaccgcgcccggcccccucc

SEQ ID NO: 220920 - RNA, 21 nt, Human
gauuacaggcgugagcaccgc

SEQ ID NO: 220921 - RNA, 21 nt, Human
gcaaccuccgcucccggguuc

SEQ ID NO: 220922 - RNA, 23 nt, Human
gccucggccucccaaagugcugg

SEQ ID NO: 220923 - RNA, 24 nt, Human
gcuaaauuuuuuuuguauuuuuag

SEQ ID NO: 220924 - RNA, 22 nt, Human
ggaggagggagccagggagacc

SEQ ID NO: 220925 - RNA, 24 nt, Human
ggaggcaggccuggaggagggagc

SEQ ID NO: 220926 - RNA, 24 nt, Human
ggauggucucgaucuccugaccuc

SEQ ID NO: 220927 - RNA, 23 nt, Human
ggcagcggauaggccaggagaga

SEQ ID NO: 220928 - RNA, 19 nt, Human
ggccuggaggagggagcca

SEQ ID NO: 220929 - RNA, 22 nt, Human
gggagccagggagaccccuggg

SEQ ID NO: 220930 - RNA, 20 nt, Human
gggcucaaggcuggcagcgg

SEQ ID NO: 220931 - RNA, 19 nt, Human
ggggccaggcagggagaug

SEQ ID NO: 220932 - RNA, 23 nt, Human
gggguuucaccauguuagccagg

SEQ ID NO: 220933 - RNA, 22 nt, Human
ggguuucaccauguuagccagg

SEQ ID NO: 220934 - RNA, 23 nt, Human
guagagacgggguuucaccaugu

SEQ ID NO: 220935 - RNA, 24 nt, Human
gucagggugggcaagagggucuuc

SEQ ID NO: 220936 - RNA, 24 nt, Human
gugauccacccgccucggccuccc

SEQ ID NO: 220937 - RNA, 19 nt, Human
gugcagcuggucacagggc

SEQ ID NO: 220938 - RNA, 23 nt, Human
uaagagaacccugaugggcggug

SEQ ID NO: 220939 - RNA, 22 nt, Human
uagagacgggguuucaccaugu

SEQ ID NO: 220940 - RNA, 24 nt, Human
uagcacgaucucagcucacugcaa

SEQ ID NO: 220941 - RNA, 24 nt, Human
uaguagagacgggguuucaccaug

SEQ ID NO: 220942 - RNA, 26 nt, Human
uaguagagacgggguuucaccauguu

SEQ ID NO: 220943 - RNA, 22 nt, Human
uauacaauauacacacccuuga

SEQ ID NO: 220944 - RNA, 21 nt, Human
ucacaccauucuccugccuca

SEQ ID NO: 220945 - RNA, 24 nt, Human
ucaccauguuagccaggauggucu

SEQ ID NO: 220946 - RNA, 18 nt, Human
ucacugcaaccuccgcuc

SEQ ID NO: 220947 - RNA, 23 nt, Human
ucacugcaaccuccgcucccggg

SEQ ID NO: 220948 - RNA, 20 nt, Human
ucagccucccaaguagcugg

SEQ ID NO: 220949 - RNA, 24 nt, Human
ucccaaagugcugggauuacaggc

SEQ ID NO: 220950 - RNA, 23 nt, Human
ucccaaguagcugggacuacagg

SEQ ID NO: 220951 - RNA, 24 nt, Human
ucccccaggcuggagugcaguagc

SEQ ID NO: 220952 - RNA, 21 nt, Human
ucccggguucacaccauucuc

SEQ ID NO: 220953 - RNA, 24 nt, Human
ucccggguucacaccauucuccug

SEQ ID NO: 220954 - RNA, 21 nt, Human
ucgcuaggccccagaaagccc

SEQ ID NO: 220955 - RNA, 18 nt, Human
ucggccucccaaagugcu

SEQ ID NO: 220956 - RNA, 26 nt, Human
ucuccugccucagccucccaaguagc

SEQ ID NO: 220957 - RNA, 24 nt, Human
ucucuuucugucccccaggcugga

SEQ ID NO: 220958 - RNA, 24 nt, Human
ucugucccccaggcuggagugcag

SEQ ID NO: 220959 - RNA, 21 nt, Human
ucuuucugucccccaggcugg

SEQ ID NO: 220960 - RNA, 22 nt, Human
ucuuucugucccccaggcugga

SEQ ID NO: 220961 - RNA, 24 nt, Human
ucuuucugucccccaggcuggagu

SEQ ID NO: 220962 - RNA, 22 nt, Human
ugagacggagucucuuucuguc

SEQ ID NO: 220963 - RNA, 24 nt, Human
ugagguugggggccaggcagggag

SEQ ID NO: 220964 - RNA, 22 nt, Human
ugccccuauacaauauacacug

SEQ ID NO: 220965 - RNA, 24 nt, Human
ugccucagccucccaaguagcugg

SEQ ID NO: 220966 - RNA, 25 nt, Human
ugcgccagggacgcuguggggagca

SEQ ID NO: 220967 - RNA, 23 nt, Human
ugcugggauuacaggcgugagca

SEQ ID NO: 220968 - RNA, 23 nt, Human
uggagugcaguagcacgaucuca

SEQ ID NO: 220969 - RNA, 24 nt, Human
uggagugcaguagcacgaucucag

SEQ ID NO: 220970 - RNA, 21 nt, Human
ugggacuacaggugcccgcca

SEQ ID NO: 220971 - RNA, 22 nt, Human
ugggacuacaggugcccgccac

SEQ ID NO: 220972 - RNA, 23 nt, Human
ugggacuacaggugcccgccacc

SEQ ID NO: 220973 - RNA, 24 nt, Human
ugggacuacaggugcccgccaccg

SEQ ID NO: 220974 - RNA, 18 nt, Human
ugggauuacaggcgugag

SEQ ID NO: 220975 - RNA, 19 nt, Human
ugggauuacaggcgugagc

SEQ ID NO: 220976 - RNA, 20 nt, Human
ugggauuacaggcgugagca

SEQ ID NO: 220977 - RNA, 22 nt, Human
ugggauuacaggcgugagcacc

SEQ ID NO: 220978 - RNA, 23 nt, Human
ugggauuacaggcgugagcaccg

SEQ ID NO: 220979 - RNA, 19 nt, Human
uuacaggcgugagcaccgc

SEQ ID NO: 220980 - RNA, 18 nt, Human
uuaguagagacgggguuu

SEQ ID NO: 220981 - RNA, 22 nt, Human
uuaguagagacgggguuucacc

SEQ ID NO: 220982 - RNA, 24 nt, Human
uuaguagagacgggguuucaccau

SEQ ID NO: 220983 - RNA, 23 nt, Human
uuguauuuuuaguagagacgggg

SEQ ID NO: 220984 - RNA, 19 nt, Human
uuucaccauguuagccagg

SEQ ID NO: 220985 - RNA, 20 nt, Human
uuucaccauguuagccagga

SEQ ID NO: 220986 - RNA, 24 nt, Human
uuuuuaguagagacgggguuucac

SEQ ID NO: 220987 - RNA, 21 nt, Human
uuuuuguauuuuuaguagaga

SEQ ID NO: 220988 - RNA, 21 nt, Human
uuuuuuguauuuuuaguagag

SEQ ID NO: 220989 - RNA, 24 nt, Human
uuuuuuguauuuuuaguagagacg

SEQ ID NO: 220990 - RNA, 24 nt, Human
uuuuuuuuguauuuuuaguagaga

SEQ ID NO: 220991 - RNA, 20 nt, Human
aaaaucacagguaagaguca

SEQ ID NO: 220992 - RNA, 23 nt, Human
aaacaacaagaagcaaguaccau

SEQ ID NO: 220993 - RNA, 19 nt, Human
aaacauuugaauuuguuca

SEQ ID NO: 220994 - RNA, 23 nt, Human
aacaagcuuacacaucugugcaa

SEQ ID NO: 220995 - RNA, 23 nt, Human
aaccuuaucuucucuaccauguc

SEQ ID NO: 220996 - RNA, 21 nt, Human
aacuauccagccccaaaaguc

SEQ ID NO: 220997 - RNA, 25 nt, Human
aacuccggccggacccuccucgccg

SEQ ID NO: 220998 - RNA, 23 nt, Human
aagcugcaaaacauuccuggaau

SEQ ID NO: 220999 - RNA, 22 nt, Human
acaaacccccacaacagagaac

SEQ ID NO: 221000 - RNA, 18 nt, Human
acaaacucuaacaugaaa

SEQ ID NO: 221001 - RNA, 24 nt, Human
acaagacaaacccccacaacagag

SEQ ID NO: 221002 - RNA, 23 nt, Human
acaccgagucugaccaugcaaaa

SEQ ID NO: 221003 - RNA, 24 nt, Human
acagugcacaagacaaacccccac

SEQ ID NO: 221004 - RNA, 18 nt, Human
accaguauguacaaacuc

SEQ ID NO: 221005 - RNA, 20 nt, Human
acccccacaacagagaacua

SEQ ID NO: 221006 - RNA, 19 nt, Human
acugcaacacucuauauug

SEQ ID NO: 221007 - RNA, 19 nt, Human
acuggagcuuauuaaaauc

SEQ ID NO: 221008 - RNA, 22 nt, Human
agcuaauaaugaaaaauuuuaa

SEQ ID NO: 221009 - RNA, 21 nt, Human
aggaaacaauaaaacaacaag

SEQ ID NO: 221010 - RNA, 21 nt, Human
agggagauguaagcuucagaa

SEQ ID NO: 221011 - RNA, 20 nt, Human
auaaaacaacaagaagcaag

SEQ ID NO: 221012 - RNA, 19 nt, Human
auucuucauuuucuccaug

SEQ ID NO: 221013 - RNA, 22 nt, Human
auucuucauuuucuccaugcuu

SEQ ID NO: 221014 - RNA, 19 nt, Human
auuuuguaucuaugcagag

SEQ ID NO: 221015 - RNA, 22 nt, Human
caaaaaauuaccugccauaaac

SEQ ID NO: 221016 - RNA, 24 nt, Human
caaaaucacagguaagagucaaca

SEQ ID NO: 221017 - RNA, 18 nt, Human
caacaucagaaaaguuau

SEQ ID NO: 221018 - RNA, 23 nt, Human
caaccagagguaccaucccucaa

SEQ ID NO: 221019 - RNA, 24 nt, Human
caaccagagguaccaucccucaag

SEQ ID NO: 221020 - RNA, 24 nt, Human
caagacaaacccccacaacagaga

SEQ ID NO: 221021 - RNA, 26 nt, Human
caagacaaacccccacaacagagaac

SEQ ID NO: 221022 - RNA, 20 nt, Human
caccauacaugaaaacaaaa

SEQ ID NO: 221023 - RNA, 20 nt, Human
caccuaggauaaaaaugauc

SEQ ID NO: 221024 - RNA, 22 nt, Human
cacuccguaaaucauauaacuc

SEQ ID NO: 221025 - RNA, 22 nt, Human
cacugcaacacucuauauugau

SEQ ID NO: 221026 - RNA, 23 nt, Human
cacugcugaggaccaggcagccg

SEQ ID NO: 221027 - RNA, 21 nt, Human
cagcauugauggggaaaauau

SEQ ID NO: 221028 - RNA, 20 nt, Human
caggagcugcagugaaccau

SEQ ID NO: 221029 - RNA, 24 nt, Human
cauauauuugcauauauauacaca

SEQ ID NO: 221030 - RNA, 18 nt, Human
caugaaaauaaugaguca

SEQ ID NO: 221031 - RNA, 25 nt, Human
ccaaagacaugcaucaacaucagaa

SEQ ID NO: 221032 - RNA, 18 nt, Human
ccaauaauauucuagcac

SEQ ID NO: 221033 - RNA, 18 nt, Human
ccaggcaucugcaugaau

SEQ ID NO: 221034 - RNA, 19 nt, Human
cccugcuccgcgccggggc

SEQ ID NO: 221035 - RNA, 23 nt, Human
ccugcacuaaagucacauaggag

SEQ ID NO: 221036 - RNA, 24 nt, Human
cgccggggcugcacugcugaggac

SEQ ID NO: 221037 - RNA, 18 nt, Human
cgggccgaggcucccugc

SEQ ID NO: 221038 - RNA, 20 nt, Human
cgggccucugagcaguuccc

SEQ ID NO: 221039 - RNA, 19 nt, Human
cucacuagaauauucagua

SEQ ID NO: 221040 - RNA, 21 nt, Human
cugcacugcugaggaccaggc

SEQ ID NO: 221041 - RNA, 21 nt, Human
gaaaaggcaaaucucugcaaa

SEQ ID NO: 221042 - RNA, 23 nt, Human
gaaaauauauuauccuuaugacc

SEQ ID NO: 221043 - RNA, 18 nt, Human
gagauguaagcuucagaa

SEQ ID NO: 221044 - RNA, 19 nt, Human
gagcugcagugaaccauuc

SEQ ID NO: 221045 - RNA, 22 nt, Human
gagguaccaucccucaaggggu

SEQ ID NO: 221046 - RNA, 27 nt, Human
gccgcgacugagccggaaaguucaauc

SEQ ID NO: 221047 - RNA, 22 nt, Human
ggaaagauucaaaaaaacaaag

SEQ ID NO: 221048 - RNA, 20 nt, Human
ggaacuuugauuuaccuuug

SEQ ID NO: 221049 - RNA, 24 nt, Human
ggaguuccagguagaaaaacaggg

SEQ ID NO: 221050 - RNA, 24 nt, Human
ggcgccgggcgcgggccgaggcuc

SEQ ID NO: 221051 - RNA, 20 nt, Human
gggaaaacugaguucuguug

SEQ ID NO: 221052 - RNA, 23 nt, Human
gguagcuggcaauaucuggagac

SEQ ID NO: 221053 - RNA, 21 nt, Human
guccgggccucugagcaguuc

SEQ ID NO: 221054 - RNA, 26 nt, Human
gugaauuuucagauggugaaacaaaa

SEQ ID NO: 221055 - RNA, 26 nt, Human
guggacauaaaaaacacaguuuaggc

SEQ ID NO: 221056 - RNA, 24 nt, Human
guguauauacauguauauguacau

SEQ ID NO: 221057 - RNA, 21 nt, Human
guucuuccugcacuaaaguca

SEQ ID NO: 221058 - RNA, 23 nt, Human
uaaaauccauaagagaaacacau

SEQ ID NO: 221059 - RNA, 19 nt, Human
uaacacagauaaauucauc

SEQ ID NO: 221060 - RNA, 19 nt, Human
uaagaacuugaaauucaga

SEQ ID NO: 221061 - RNA, 22 nt, Human
uaaugacaccagaauaaaaaag

SEQ ID NO: 221062 - RNA, 24 nt, Human
uacacaaaaauccaacuuuuuuua

SEQ ID NO: 221063 - RNA, 19 nt, Human
uacaguguuuaauuuugau

SEQ ID NO: 221064 - RNA, 27 nt, Human
uacuaaaaaccuacagugcacaagaca

SEQ ID NO: 221065 - RNA, 24 nt, Human
uagauuacacauuuucauuuaaaa

SEQ ID NO: 221066 - RNA, 20 nt, Human
uauauacauguauauguaca

SEQ ID NO: 221067 - RNA, 20 nt, Human
uauauacauguauauguaca

SEQ ID NO: 221068 - RNA, 23 nt, Human
uauaugcaugugucuguguguau

SEQ ID NO: 221069 - RNA, 24 nt, Human
uauguacauauauuugcauauaua

SEQ ID NO: 221070 - RNA, 23 nt, Human
uauuagcccauuaauagcauuuu

SEQ ID NO: 221071 - RNA, 19 nt, Human
uauucaguagagguaagac

SEQ ID NO: 221072 - RNA, 23 nt, Human
uauuucauugaguuccucuggcu

SEQ ID NO: 221073 - RNA, 20 nt, Human
uauuuuguaucuaugcagag

SEQ ID NO: 221074 - RNA, 21 nt, Human
ucagaugcugguaaugacacc

SEQ ID NO: 221075 - RNA, 18 nt, Human
ucauguauaugcaugugu

SEQ ID NO: 221076 - RNA, 21 nt, Human
uccagggauucaugcucaagg

SEQ ID NO: 221077 - RNA, 21 nt, Human
ucccaaagacaugcaucaaca

SEQ ID NO: 221078 - RNA, 23 nt, Human
ucuaaauaaugugacagacauac

SEQ ID NO: 221079 - RNA, 21 nt, Human
ucuaccuuuagacacugcagu

SEQ ID NO: 221080 - RNA, 23 nt, Human
ucuacuguuucucacuugucucc

SEQ ID NO: 221081 - RNA, 20 nt, Human
ucuaugcacauuucaaacca

SEQ ID NO: 221082 - RNA, 22 nt, Human
ucuaugcacauuucaaaccaug

SEQ ID NO: 221083 - RNA, 19 nt, Human
ucucugcaaagauuuaaac

SEQ ID NO: 221084 - RNA, 19 nt, Human
ucuuccugcacuaaaguca

SEQ ID NO: 221085 - RNA, 19 nt, Human
ugaaaagagcacauguugg

SEQ ID NO: 221086 - RNA, 21 nt, Human
ugaaaagagcacauguugguu

SEQ ID NO: 221087 - RNA, 23 nt, Human
ugaaacaaaagugcaccaaaagc

SEQ ID NO: 221088 - RNA, 26 nt, Human
ugacaaguucauguaaaaaggguuuc

SEQ ID NO: 221089 - RNA, 19 nt, Human
ugaccaugcaaaaucacag

SEQ ID NO: 221090 - RNA, 18 nt, Human
ugacuucugaguuauccu

SEQ ID NO: 221091 - RNA, 21 nt, Human
ugaggagaaaguguggaugcu

SEQ ID NO: 221092 - RNA, 22 nt, Human
ugauacagacacgagucaaaau

SEQ ID NO: 221093 - RNA, 18 nt, Human
ugcaaauaacuguccuuc

SEQ ID NO: 221094 - RNA, 18 nt, Human
ugcaacagauauuuagcc

SEQ ID NO: 221095 - RNA, 21 nt, Human
ugcagugaaccauucagaacc

SEQ ID NO: 221096 - RNA, 21 nt, Human
ugcauauauauacacaugcau

SEQ ID NO: 221097 - RNA, 21 nt, Human
ugcauauauauacacaugcau

SEQ ID NO: 221098 - RNA, 23 nt, Human
ugcauauauauacacaugcauuu

SEQ ID NO: 221099 - RNA, 18 nt, Human
uggcaauaucuggagaca

SEQ ID NO: 221100 - RNA, 19 nt, Human
uguagcauaaaacauuucc

SEQ ID NO: 221101 - RNA, 24 nt, Human
uguauauacauguauauguacaua

SEQ ID NO: 221102 - RNA, 24 nt, Human
ugucaaaaccuaaggauaauguua

SEQ ID NO: 221103 - RNA, 19 nt, Human
uguguauauacauguauau

SEQ ID NO: 221104 - RNA, 20 nt, Human
ugugucuguguguauauaca

SEQ ID NO: 221105 - RNA, 31 nt, Human
ugugucuguguguauauacauguauauguaa

SEQ ID NO: 221106 - RNA, 19 nt, Human
uguguguauauacauguau

SEQ ID NO: 221107 - RNA, 20 nt, Human
uguguguauauacauguaua

SEQ ID NO: 221108 - RNA, 21 nt, Human
uuaauagcauuuuucuuccaa

SEQ ID NO: 221109 - RNA, 20 nt, Human
uuaauuuuugaaauuuuaag

SEQ ID NO: 221110 - RNA, 23 nt, Human
uuagacacugcagugaggcucug

SEQ ID NO: 221111 - RNA, 20 nt, Human
uuagagaaaugaaucuaauu

SEQ ID NO: 221112 - RNA, 18 nt, Human
uuccagguagaaaaacag

SEQ ID NO: 221113 - RNA, 18 nt, Human
uuccuggaauauccacuu

SEQ ID NO: 221114 - RNA, 21 nt, Human
uuccuggaauauccacuuuuu

SEQ ID NO: 221115 - RNA, 19 nt, Human
uucuucauuuucuccaugc

SEQ ID NO: 221116 - RNA, 18 nt, Human
uugaggaaaauaagggaa

SEQ ID NO: 221117 - RNA, 26 nt, Human
uuguagcauaaaacauuuccaaaaag

SEQ ID NO: 221118 - RNA, 20 nt, Human
uuugggacuugcucuagaaa

SEQ ID NO: 221119 - RNA, 18 nt, Human
uuuuaagaacuugaaauu

SEQ ID NO: 221120 - RNA, 24 nt, Human
uuuuugggacuugcucuagaaauu

SEQ ID NO: 221121 - RNA, 24 nt, Human
acagaacugcggugucaaauggaa

SEQ ID NO: 221122 - RNA, 22 nt, Human
agaacugcggugucaaauggaa

SEQ ID NO: 221123 - RNA, 19 nt, Human
cggagggcccgacccaaaa

SEQ ID NO: 221124 - RNA, 21 nt, Human
gcagaaaugcaaagacgccug

SEQ ID NO: 221125 - RNA, 22 nt, Human
gcccgacccaaaaguaaggagg

SEQ ID NO: 221126 - RNA, 19 nt, Human
uaacaggauuaaaaagaaa

SEQ ID NO: 221127 - RNA, 21 nt, Human
aaaaagaagaagaaaaaaaga

SEQ ID NO: 221128 - RNA, 22 nt, Human
aaaaagaagaagaaaaaaagaa

SEQ ID NO: 221129 - RNA, 19 nt, Human
aagaagaaaaaaagaaaca

SEQ ID NO: 221130 - RNA, 19 nt, Human
aagaagaagaaaaaaagaa

SEQ ID NO: 221131 - RNA, 19 nt, Human
agaagaagaaaaaaagaaa

SEQ ID NO: 221132 - RNA, 19 nt, Human
gaagaagaaaaaaagaaac

SEQ ID NO: 221133 - RNA, 22 nt, Human
uaagcuaaaaagaagaagaaaa

SEQ ID NO: 221134 - RNA, 25 nt, Human
aaacaggcaccuguuucagcuucca

SEQ ID NO: 221135 - RNA, 21 nt, Human
aaacaucuguuucuagacuuu

SEQ ID NO: 221136 - RNA, 21 nt, Human
aaacauggguugcuauggaaa

SEQ ID NO: 221137 - RNA, 22 nt, Human
aagcccgaaagaauuaaacuaa

SEQ ID NO: 221138 - RNA, 18 nt, Human
aauacugagcacagcaug

SEQ ID NO: 221139 - RNA, 23 nt, Human
aaugacauaaugauuuucauagu

SEQ ID NO: 221140 - RNA, 22 nt, Human
acaauacugagcacagcauguc

SEQ ID NO: 221141 - RNA, 23 nt, Human
acagaacuucacaggaaucuguu

SEQ ID NO: 221142 - RNA, 20 nt, Human
agaccaagggggcacguucc

SEQ ID NO: 221143 - RNA, 22 nt, Human
aggaaucuguuagucuaaugcu

SEQ ID NO: 221144 - RNA, 19 nt, Human
agggagagggagaaugaag

SEQ ID NO: 221145 - RNA, 25 nt, Human
aucuggaaagguuacugugcaagag

SEQ ID NO: 221146 - RNA, 22 nt, Human
augaagcagcagggagagggag

SEQ ID NO: 221147 - RNA, 21 nt, Human
caagagaugccaugacaaccu

SEQ ID NO: 221148 - RNA, 24 nt, Human
cacagcaugucacuuguaucacau

SEQ ID NO: 221149 - RNA, 24 nt, Human
cagaucaggacaucuugggggcau

SEQ ID NO: 221150 - RNA, 24 nt, Human
cagcccacuugcaaaacaggcacc

SEQ ID NO: 221151 - RNA, 23 nt, Human
cauuucaccuccuuagagucuca

SEQ ID NO: 221152 - RNA, 18 nt, Human
ccacacaauacugagcac

SEQ ID NO: 221153 - RNA, 22 nt, Human
ccagaucaugccuuauuguggu

SEQ ID NO: 221154 - RNA, 20 nt, Human
ccaggaaacauggguugcua

SEQ ID NO: 221155 - RNA, 22 nt, Human
ccuuuaaaauucugagguuaaa

SEQ ID NO: 221156 - RNA, 21 nt, Human
cgaagcaucauuuacuacgga

SEQ ID NO: 221157 - RNA, 22 nt, Human
cguuccacacaauacugagcac

SEQ ID NO: 221158 - RNA, 24 nt, Human
cuggaaggggugucugccacuuua

SEQ ID NO: 221159 - RNA, 21 nt, Human
cuuauugugguuaauaucuaa

SEQ ID NO: 221160 - RNA, 18 nt, Human
cuugggggcauuucccuu

SEQ ID NO: 221161 - RNA, 20 nt, Human
gaagcaucauuuacuacgga

SEQ ID NO: 221162 - RNA, 22 nt, Human
gagagaggguaaagggaaaagg

SEQ ID NO: 221163 - RNA, 23 nt, Human
gcaacacugaaaacaucuguuuc

SEQ ID NO: 221164 - RNA, 18 nt, Human
gggcggcagcucgcggcc

SEQ ID NO: 221165 - RNA, 21 nt, Human
gucauuauucuaguuagacuc

SEQ ID NO: 221166 - RNA, 18 nt, Human
gucuggaaauguauaaaa

SEQ ID NO: 221167 - RNA, 21 nt, Human
uacuagaaaugaaguuuaacg

SEQ ID NO: 221168 - RNA, 22 nt, Human
uaggaaagaaacaacugccuuu

SEQ ID NO: 221169 - RNA, 23 nt, Human
ucagguccuuuccuugaugaaug

SEQ ID NO: 221170 - RNA, 20 nt, Human
ucaugccuuauugugguuaa

SEQ ID NO: 221171 - RNA, 25 nt, Human
uccaaacaccauauuuuccuccuug

SEQ ID NO: 221172 - RNA, 18 nt, Human
ucuaacauuccaaacacc

SEQ ID NO: 221173 - RNA, 24 nt, Human
ucuaacuguucuuuaguuucauuu

SEQ ID NO: 221174 - RNA, 21 nt, Human
ugcaaaacaggcaccuguuuc

SEQ ID NO: 221175 - RNA, 19 nt, Human
ugcuuuagaaaugcuuagc

SEQ ID NO: 221176 - RNA, 18 nt, Human
uggggcugggacauaugc

SEQ ID NO: 221177 - RNA, 18 nt, Human
uuccacacaauacugagc

SEQ ID NO: 221178 - RNA, 20 nt, Human
uucugagguuaaacaguuac

SEQ ID NO: 221179 - RNA, 23 nt, Human
uuuuucggguuucccaggaaaca

SEQ ID NO: 221180 - RNA, 20 nt, Human
aagaagaaagaaaaauaggg

SEQ ID NO: 221181 - RNA, 21 nt, Human
aagaagaagaaagaaaaauag

SEQ ID NO: 221182 - RNA, 24 nt, Human
aagaagaagaaagaaaaauaggga

SEQ ID NO: 221183 - RNA, 19 nt, Human
agaagaaagaaaaauaggg

SEQ ID NO: 221184 - RNA, 22 nt, Human
agaagaaagaaaaauagggcag

SEQ ID NO: 221185 - RNA, 20 nt, Human
agaagaagaaagaaaaauag

SEQ ID NO: 221186 - RNA, 23 nt, Human
agaagaagaaagaaaaauagggg

SEQ ID NO: 221187 - RNA, 20 nt, Human
agaaguccgaaaaugcugga

SEQ ID NO: 221188 - RNA, 20 nt, Human
caagacuaagaaguccgaaa

SEQ ID NO: 221189 - RNA, 21 nt, Human
caguggcagguggaaaaagau

SEQ ID NO: 221190 - RNA, 21 nt, Human
cauugcucuccagagcuuggc

SEQ ID NO: 221191 - RNA, 21 nt, Human
ccaguuguagaagaagaagaa

SEQ ID NO: 221192 - RNA, 23 nt, Human
cucaagacuaagaaguccgaaaa

SEQ ID NO: 221193 - RNA, 19 nt, Human
gaagaaagaaaaauagggc

SEQ ID NO: 221194 - RNA, 22 nt, Human
gagcaguggcagguggaaaaag

SEQ ID NO: 221195 - RNA, 18 nt, Human
gcucucucuucucaggga

SEQ ID NO: 221196 - RNA, 19 nt, Human
uaagguaaguuuggaaccc

SEQ ID NO: 221197 - RNA, 22 nt, Human
uccaguuguagaagaagaagaa

SEQ ID NO: 221198 - RNA, 20 nt, Human
uguagaagaagaagaaagaa

SEQ ID NO: 221199 - RNA, 21 nt, Human
uuuggagaugcugagggggga

SEQ ID NO: 221200 - RNA, 24 nt, Human
aaacagaacagcccauaccaagau

SEQ ID NO: 221201 - RNA, 18 nt, Human
aacagaacagcccauacc

SEQ ID NO: 221202 - RNA, 20 nt, Human
acagaaaaacaucaggacac

SEQ ID NO: 221203 - RNA, 22 nt, Human
acagaacagcccauaccaagau

SEQ ID NO: 221204 - RNA, 19 nt, Human
accaagaucucugacucua

SEQ ID NO: 221205 - RNA, 23 nt, Human
accaauaccacaucccagaaaag

SEQ ID NO: 221206 - RNA, 20 nt, Human
acuacaguacaaaaagccag

SEQ ID NO: 221207 - RNA, 19 nt, Human
agaaaagacagaggcuugg

SEQ ID NO: 221208 - RNA, 19 nt, Human
agagggcaugcugcgcccc

SEQ ID NO: 221209 - RNA, 20 nt, Human
agcaaauuuggaacacaugg

SEQ ID NO: 221210 - RNA, 18 nt, Human
agcugaccggcucccgcg

SEQ ID NO: 221211 - RNA, 22 nt, Human
aggaaacagaacagcccauacc

SEQ ID NO: 221212 - RNA, 19 nt, Human
aggcuccgcuccagcgguc

SEQ ID NO: 221213 - RNA, 23 nt, Human
cacaaagcaccaauaccacaucc

SEQ ID NO: 221214 - RNA, 19 nt, Human
cacaucccagaaaagacag

SEQ ID NO: 221215 - RNA, 20 nt, Human
cauggaaugugguacuuuuu

SEQ ID NO: 221216 - RNA, 22 nt, Human
ccaauaccacaucccagaaaag

SEQ ID NO: 221217 - RNA, 23 nt, Human
ccagcggucggccggccccucuc

SEQ ID NO: 221218 - RNA, 24 nt, Human
ccagcugaccggcucccgcgcccc

SEQ ID NO: 221219 - RNA, 26 nt, Human
cccauaccaagaucucugacucuaau

SEQ ID NO: 221220 - RNA, 19 nt, Human
ccccagcugaccggcuccc

SEQ ID NO: 221221 - RNA, 18 nt, Human
cccuacucacgcuccgcg

SEQ ID NO: 221222 - RNA, 22 nt, Human
cccugcucucugccucucucuc

SEQ ID NO: 221223 - RNA, 24 nt, Human
cccugcucucugccucucucucuu

SEQ ID NO: 221224 - RNA, 19 nt, Human
ccucccauucccuacucca

SEQ ID NO: 221225 - RNA, 18 nt, Human
ccucugcuggguauagga

SEQ ID NO: 221226 - RNA, 20 nt, Human
cgcuccgcgggcgccuggcg

SEQ ID NO: 221227 - RNA, 24 nt, Human
cucacagcgcucaccauuuccaca

SEQ ID NO: 221228 - RNA, 18 nt, Human
cucuggggagagcugggg

SEQ ID NO: 221229 - RNA, 22 nt, Human
cugcucucugccucucucucuu

SEQ ID NO: 221230 - RNA, 21 nt, Human
cuucaagaacauacucugccc

SEQ ID NO: 221231 - RNA, 25 nt, Human
gaaaauggggggaucgagggaggga

SEQ ID NO: 221232 - RNA, 18 nt, Human
gagggagggaggaaagga

SEQ ID NO: 221233 - RNA, 19 nt, Human
gagggagggaggaaaggag

SEQ ID NO: 221234 - RNA, 23 nt, Human
gcgucaggcuccgcuccagcggu

SEQ ID NO: 221235 - RNA, 21 nt, Human
gcuuggagacacaggaaacag

SEQ ID NO: 221236 - RNA, 23 nt, Human
ggaaaggagugaaaggagagggg

SEQ ID NO: 221237 - RNA, 19 nt, Human
ggggggaucgagggaggga

SEQ ID NO: 221238 - RNA, 23 nt, Human
guaaagcaaauuuggaacacaug

SEQ ID NO: 221239 - RNA, 22 nt, Human
gucauggaaugugguacuuuuu

SEQ ID NO: 221240 - RNA, 18 nt, Human
uaaagacaauaaauuauc

SEQ ID NO: 221241 - RNA, 24 nt, Human
uaaagcaaauuuggaacacaugga

SEQ ID NO: 221242 - RNA, 22 nt, Human
uaaggcgcacagaaaaagucag

SEQ ID NO: 221243 - RNA, 24 nt, Human
uacaaaaagccacuuaccaggcau

SEQ ID NO: 221244 - RNA, 22 nt, Human
uacacaaauacaaucauaugua

SEQ ID NO: 221245 - RNA, 21 nt, Human
uaccacaucccagaaaagaca

SEQ ID NO: 221246 - RNA, 21 nt, Human
uaucugaacuacaguacaaaa

SEQ ID NO: 221247 - RNA, 20 nt, Human
ucccagaaaagacagaggcu

SEQ ID NO: 221248 - RNA, 20 nt, Human
uccccuauacacaaauacaa

SEQ ID NO: 221249 - RNA, 21 nt, Human
ucugaacuacaguacaaaaag

SEQ ID NO: 221250 - RNA, 18 nt, Human
ucugccucucucucuucu

SEQ ID NO: 221251 - RNA, 22 nt, Human
ugaccggcucccgcgcccccua

SEQ ID NO: 221252 - RNA, 24 nt, Human
ugcccuagacacaaagcaccaauu

SEQ ID NO: 221253 - RNA, 19 nt, Human
uggcagcccguuaccaagc

SEQ ID NO: 221254 - RNA, 20 nt, Human
ugggaucugggcuauuuaga

SEQ ID NO: 221255 - RNA, 18 nt, Human
uuacauaaucucuuggga

SEQ ID NO: 221256 - RNA, 20 nt, Human
uuccugggauaaaaauaaag

SEQ ID NO: 221257 - RNA, 21 nt, Human
uuggaacacauggauggagga

SEQ ID NO: 221258 - RNA, 20 nt, Human
uuugaagaaaguuacaagaa

SEQ ID NO: 221259 - RNA, 24 nt, Human
aaaaaagccucuuagagugaggcu

SEQ ID NO: 221260 - RNA, 22 nt, Human
aaaucaaacucccaggaagcaa

SEQ ID NO: 221261 - RNA, 19 nt, Human
aaccuauuuugaggcuaug

SEQ ID NO: 221262 - RNA, 20 nt, Human
aaccuugaaugcugcaggga

SEQ ID NO: 221263 - RNA, 28 nt, Human
aagaacacuaaggagggagccgguaccc

SEQ ID NO: 221264 - RNA, 18 nt, Human
aagaagucaacugaagcu

SEQ ID NO: 221265 - RNA, 24 nt, Human
acacaaucucuggagcgcggcacc

SEQ ID NO: 221266 - RNA, 19 nt, Human
acagccgccaccuccuccc

SEQ ID NO: 221267 - RNA, 20 nt, Human
accagugagagcaggucaaa

SEQ ID NO: 221268 - RNA, 19 nt, Human
accccacucccacaucaca

SEQ ID NO: 221269 - RNA, 24 nt, Human
acccgcuccccagcucccgugcgc

SEQ ID NO: 221270 - RNA, 23 nt, Human
accugggcgcuggggauuugguu

SEQ ID NO: 221271 - RNA, 18 nt, Human
agaaaauguggggaaaau

SEQ ID NO: 221272 - RNA, 22 nt, Human
agaaacaaaaggggaggugggc

SEQ ID NO: 221273 - RNA, 22 nt, Human
agacauuccuccuggcucugug

SEQ ID NO: 221274 - RNA, 18 nt, Human
agagaaaauguggggaaa

SEQ ID NO: 221275 - RNA, 22 nt, Human
agcaaagaacacuaaggaggga

SEQ ID NO: 221276 - RNA, 18 nt, Human
agcucagugcuccccucc

SEQ ID NO: 221277 - RNA, 23 nt, Human
agcugcagcggcucggcucuccg

SEQ ID NO: 221278 - RNA, 19 nt, Human
agcuggaguuugccugagg

SEQ ID NO: 221279 - RNA, 18 nt, Human
agcuucccagacauuccc

SEQ ID NO: 221280 - RNA, 23 nt, Human
aggaaacgcacaugacccaaagc

SEQ ID NO: 221281 - RNA, 22 nt, Human
aggcaaaaaacaaauggcaagg

SEQ ID NO: 221282 - RNA, 24 nt, Human
aggcuaugcaaauaaagacucuac

SEQ ID NO: 221283 - RNA, 19 nt, Human
aguaguggaaaugagaagg

SEQ ID NO: 221284 - RNA, 24 nt, Human
agucaagaagucaacugaagcuag

SEQ ID NO: 221285 - RNA, 18 nt, Human
agugguuguuacagggca

SEQ ID NO: 221286 - RNA, 19 nt, Human
aucugcaacacgauuccuc

SEQ ID NO: 221287 - RNA, 20 nt, Human
auuggguggcaccgcuggaa

SEQ ID NO: 221288 - RNA, 23 nt, Human
caaaggcaaaaaacaaauggcaa

SEQ ID NO: 221289 - RNA, 22 nt, Human
caacacgauuccucugccccuu

SEQ ID NO: 221290 - RNA, 21 nt, Human
caagcaaacccucauaaggcu

SEQ ID NO: 221291 - RNA, 24 nt, Human
caauccuaaaucaaacucccagga

SEQ ID NO: 221292 - RNA, 22 nt, Human
cacaaucucuggagcgcggcac

SEQ ID NO: 221293 - RNA, 19 nt, Human
cacacacucuccaagugac

SEQ ID NO: 221294 - RNA, 26 nt, Human
cacccaaaagaucucagaacaguaca

SEQ ID NO: 221295 - RNA, 22 nt, Human
caccccacucccacaucacacc

SEQ ID NO: 221296 - RNA, 21 nt, Human
caccccucgcccagccagggg

SEQ ID NO: 221297 - RNA, 20 nt, Human
cacccgcuccccagcucccg

SEQ ID NO: 221298 - RNA, 19 nt, Human
cacugcgcuccuccagccg

SEQ ID NO: 221299 - RNA, 20 nt, Human
cagcaaaaaagccucuuaga

SEQ ID NO: 221300 - RNA, 19 nt, Human
cagcaauccuaaaucaaac

SEQ ID NO: 221301 - RNA, 21 nt, Human
cagccgggcuagcucuuccca

SEQ ID NO: 221302 - RNA, 24 nt, Human
cagcggcucggcucuccgcucugc

SEQ ID NO: 221303 - RNA, 24 nt, Human
caugacccaaagcaaagaacacua

SEQ ID NO: 221304 - RNA, 21 nt, Human
ccacccaaucaugcccagcuu

SEQ ID NO: 221305 - RNA, 23 nt, Human
ccagcggugccacccaaucaugc

SEQ ID NO: 221306 - RNA, 18 nt, Human
cccacaucacaccccucg

SEQ ID NO: 221307 - RNA, 18 nt, Human
cccaccccacucccacau

SEQ ID NO: 221308 - RNA, 21 nt, Human
cccaccccacucccacaucac

SEQ ID NO: 221309 - RNA, 24 nt, Human
cccacggcucaaggcuucgcugcc

SEQ ID NO: 221310 - RNA, 21 nt, Human
cccacucccacaucacacccc

SEQ ID NO: 221311 - RNA, 21 nt, Human
cccagcucccgugcgcccucu

SEQ ID NO: 221312 - RNA, 24 nt, Human
cccagcucccgugcgcccucuuua

SEQ ID NO: 221313 - RNA, 18 nt, Human
cccccucccaccccacuc

SEQ ID NO: 221314 - RNA, 21 nt, Human
cccccucccaccccacuccca

SEQ ID NO: 221315 - RNA, 18 nt, Human
ccccgccugcugcccccu

SEQ ID NO: 221316 - RNA, 19 nt, Human
ccccgccugcugcccccuc

SEQ ID NO: 221317 - RNA, 19 nt, Human
ccccgccugcugcccccuc

SEQ ID NO: 221318 - RNA, 19 nt, Human
ccccggcgcccgagccggg

SEQ ID NO: 221319 - RNA, 18 nt, Human
cccuaaagcccugguccc

SEQ ID NO: 221320 - RNA, 21 nt, Human
cccucauaaggcuguccucuc

SEQ ID NO: 221321 - RNA, 23 nt, Human
cccucgcccagccaggggcugcc

SEQ ID NO: 221322 - RNA, 19 nt, Human
ccgcagcugcagcggcucg

SEQ ID NO: 221323 - RNA, 18 nt, Human
ccgccgcagcugcagcgg

SEQ ID NO: 221324 - RNA, 23 nt, Human
ccuaaaucaaacucccaggaagc

SEQ ID NO: 221325 - RNA, 26 nt, Human
ccuccaagugguaaaguuugauuuca

SEQ ID NO: 221326 - RNA, 21 nt, Human
ccuccagccgcuccggacccc

SEQ ID NO: 221327 - RNA, 20 nt, Human
ccuccuccggcucggcaaag

SEQ ID NO: 221328 - RNA, 18 nt, Human
ccugcggggcucggccuc

SEQ ID NO: 221329 - RNA, 18 nt, Human
ccugcggggcucggccuc

SEQ ID NO: 221330 - RNA, 22 nt, Human
ccuugagaccccggcucccgga

SEQ ID NO: 221331 - RNA, 22 nt, Human
cgagccggggacccaccucccc

SEQ ID NO: 221332 - RNA, 25 nt, Human
cgccacagccgccaccuccucccua

SEQ ID NO: 221333 - RNA, 19 nt, Human
cgccacuaggacggcgccc

SEQ ID NO: 221334 - RNA, 18 nt, Human
cgcgccgcaggccucgca

SEQ ID NO: 221335 - RNA, 22 nt, Human
cgcucugcccuuccuucccaac

SEQ ID NO: 221336 - RNA, 18 nt, Human
cgcugccgccgccgcagc

SEQ ID NO: 221337 - RNA, 21 nt, Human
cggugccuugagaccccggcu

SEQ ID NO: 221338 - RNA, 22 nt, Human
cuaaaccacauauuucaugccc

SEQ ID NO: 221339 - RNA, 19 nt, Human
cuaaagcccuggucccugc

SEQ ID NO: 221340 - RNA, 20 nt, Human
cuaaauguagaccgaacacc

SEQ ID NO: 221341 - RNA, 19 nt, Human
cuccaguucuucugcucag

SEQ ID NO: 221342 - RNA, 19 nt, Human
cucccggacgcagaggucc

SEQ ID NO: 221343 - RNA, 20 nt, Human
cuccgcucugcccuuccuuc

SEQ ID NO: 221344 - RNA, 20 nt, Human
cuccuggcucugugguuccc

SEQ ID NO: 221345 - RNA, 20 nt, Human
cuccuggcucugugguuccc

SEQ ID NO: 221346 - RNA, 18 nt, Human
cucuaauuccauccaagu

SEQ ID NO: 221347 - RNA, 20 nt, Human
cucuccaagugacguggcag

SEQ ID NO: 221348 - RNA, 18 nt, Human
cucugcccuuccuuccca

SEQ ID NO: 221349 - RNA, 22 nt, Human
cucugugguucccuuucuccag

SEQ ID NO: 221350 - RNA, 21 nt, Human
cucuuagagugaggcuguugg

SEQ ID NO: 221351 - RNA, 20 nt, Human
cugcaggcccugccugcaug

SEQ ID NO: 221352 - RNA, 23 nt, Human
cugcccccucccaccccacuccc

SEQ ID NO: 221353 - RNA, 20 nt, Human
cuggcucugugguucccuuu

SEQ ID NO: 221354 - RNA, 28 nt, Human
cugugguucccuuucuccaguucuucug

SEQ ID NO: 221355 - RNA, 19 nt, Human
cuucccaguucuccacugc

SEQ ID NO: 221356 - RNA, 21 nt, Human
cuucgcugccgccgccgcagc

SEQ ID NO: 221357 - RNA, 22 nt, Human
gacagaagcugggcaugauugg

SEQ ID NO: 221358 - RNA, 24 nt, Human
gagaaaaggcugccaucugcaaca

SEQ ID NO: 221359 - RNA, 24 nt, Human
gcagcugcagcggcucggcucucc

SEQ ID NO: 221360 - RNA, 23 nt, Human
gccccgccugcugcccccuccca

SEQ ID NO: 221361 - RNA, 19 nt, Human
gcccuaaagcccugguccc

SEQ ID NO: 221362 - RNA, 22 nt, Human
gccugcugcccccucccacccc

SEQ ID NO: 221363 - RNA, 19 nt, Human
gcgcuccuccagccgcucc

SEQ ID NO: 221364 - RNA, 22 nt, Human
gcucugcccuuccuucccaaca

SEQ ID NO: 221365 - RNA, 21 nt, Human
ggcacccgcuccccagcuccc

SEQ ID NO: 221366 - RNA, 20 nt, Human
ggcagguggauagauggcag

SEQ ID NO: 221367 - RNA, 22 nt, Human
ggcgcccgagccggggacccac

SEQ ID NO: 221368 - RNA, 19 nt, Human
ggcucugugguucccuuuc

SEQ ID NO: 221369 - RNA, 22 nt, Human
gggaaaaugaaggagaaaaggc

SEQ ID NO: 221370 - RNA, 24 nt, Human
gggaagaaacccaugcugccaucc

SEQ ID NO: 221371 - RNA, 23 nt, Human
gggcuggguccggccaaggucgc

SEQ ID NO: 221372 - RNA, 23 nt, Human
gggucuggggaggugaccugggc

SEQ ID NO: 221373 - RNA, 20 nt, Human
gugcgcuccccgccacuagg

SEQ ID NO: 221374 - RNA, 18 nt, Human
gugguucccuuucuccag

SEQ ID NO: 221375 - RNA, 24 nt, Human
uaacagcaaguugaguacugcuuc

SEQ ID NO: 221376 - RNA, 18 nt, Human
uaaggagggagcgaagac

SEQ ID NO: 221377 - RNA, 20 nt, Human
uaaggagggagcgaagacuc

SEQ ID NO: 221378 - RNA, 18 nt, Human
uagcaauguccccagcuu

SEQ ID NO: 221379 - RNA, 25 nt, Human
ucaaacucccaggaagccggguguc

SEQ ID NO: 221380 - RNA, 21 nt, Human
ucaacagcaauccuaaaucaa

SEQ ID NO: 221381 - RNA, 20 nt, Human
ucacaccccucgcccagcca

SEQ ID NO: 221382 - RNA, 21 nt, Human
ucaggggaucagaguggggag

SEQ ID NO: 221383 - RNA, 21 nt, Human
ucauauaaauguauaucucau

SEQ ID NO: 221384 - RNA, 18 nt, Human
ucccaacacacacucucc

SEQ ID NO: 221385 - RNA, 22 nt, Human
uccccagcuucccagacauucc

SEQ ID NO: 221386 - RNA, 19 nt, Human
ucccugcaaggcugggucu

SEQ ID NO: 221387 - RNA, 19 nt, Human
uccgcucugcccuuccuuc

SEQ ID NO: 221388 - RNA, 19 nt, Human
uccuggcucugugguuccc

SEQ ID NO: 221389 - RNA, 24 nt, Human
ucgcagaggcccggggcugccccg

SEQ ID NO: 221390 - RNA, 19 nt, Human
ucgcccagccaggggcugc

SEQ ID NO: 221391 - RNA, 23 nt, Human
ucugcaacacgauuccucugccc

SEQ ID NO: 221392 - RNA, 21 nt, Human
ucugcccuuccuucccaacac

SEQ ID NO: 221393 - RNA, 18 nt, Human
ucugcgcuucccguuacc

SEQ ID NO: 221394 - RNA, 22 nt, Human
ugacccaaagcaaagaacacua

SEQ ID NO: 221395 - RNA, 24 nt, Human
ugagaaaacaguaucuguuuaagu

SEQ ID NO: 221396 - RNA, 18 nt, Human
ugagaaacaaaaggggag

SEQ ID NO: 221397 - RNA, 19 nt, Human
ugagaaacaaaaggggagg

SEQ ID NO: 221398 - RNA, 22 nt, Human
ugaguaguggaaaugagaagga

SEQ ID NO: 221399 - RNA, 26 nt, Human
ugcccggaaccggcacacaggcgcgu

SEQ ID NO: 221400 - RNA, 21 nt, Human
ugcucuucgagagauaauuuu

SEQ ID NO: 221401 - RNA, 22 nt, Human
uggaauaacagcaaguugagua

SEQ ID NO: 221402 - RNA, 20 nt, Human
uggaauuucaaaaaugucac

SEQ ID NO: 221403 - RNA, 22 nt, Human
uggcagucacagaagccacacu

SEQ ID NO: 221404 - RNA, 18 nt, Human
uggcaguggucucacaau

SEQ ID NO: 221405 - RNA, 21 nt, Human
ugggaagaaacccaugcugcc

SEQ ID NO: 221406 - RNA, 22 nt, Human
uggggagaacuaaauguagacc

SEQ ID NO: 221407 - RNA, 21 nt, Human
uggguccggccaaggucgcgg

SEQ ID NO: 221408 - RNA, 24 nt, Human
uggguccgugagcccuaaagcccu

SEQ ID NO: 221409 - RNA, 18 nt, Human
ugguccuggacuaacccc

SEQ ID NO: 221410 - RNA, 21 nt, Human
uguagaccgaacaccagugcc

SEQ ID NO: 221411 - RNA, 21 nt, Human
uguuacugagaaacaaaaggg

SEQ ID NO: 221412 - RNA, 18 nt, Human
uuagagcuggcagucaca

SEQ ID NO: 221413 - RNA, 22 nt, Human
uucagaacugcacccaaaagau

SEQ ID NO: 221414 - RNA, 25 nt, Human
uuccuugacauuuuugaaauuccag

SEQ ID NO: 221415 - RNA, 23 nt, Human
uucgcugccgccgccgcagcugc

SEQ ID NO: 221416 - RNA, 18 nt, Human
uugacucugcucagacau

SEQ ID NO: 221417 - RNA, 18 nt, Human
aaaauagcccggcagggc

SEQ ID NO: 221418 - RNA, 19 nt, Human
aaagugcugggguuacagg

SEQ ID NO: 221419 - RNA, 24 nt, Human
aaagugcugggguuacaggcauga

SEQ ID NO: 221420 - RNA, 23 nt, Human
aacacugaccuaggaaacucaca

SEQ ID NO: 221421 - RNA, 25 nt, Human
aacccaauccccuccccccagccuu

SEQ ID NO: 221422 - RNA, 19 nt, Human
aaccuagcucuuccuaaac

SEQ ID NO: 221423 - RNA, 19 nt, Human
aacucaacucgcuguggcc

SEQ ID NO: 221424 - RNA, 23 nt, Human
aagcccaacagaacccuacaaga

SEQ ID NO: 221425 - RNA, 21 nt, Human
aagugcugggguuacaggcau

SEQ ID NO: 221426 - RNA, 26 nt, Human
aagugcugggguuacaggcaugagcc

SEQ ID NO: 221427 - RNA, 19 nt, Human
acaaaaugauacgaccaaa

SEQ ID NO: 221428 - RNA, 20 nt, Human
acacaacccaagacccaaca

SEQ ID NO: 221429 - RNA, 19 nt, Human
acacaccucuacacaguua

SEQ ID NO: 221430 - RNA, 21 nt, Human
acaccucccagagcccucgcc

SEQ ID NO: 221431 - RNA, 22 nt, Human
acagaaccuaaaauaacaugcc

SEQ ID NO: 221432 - RNA, 24 nt, Human
acagagugaggcccccagccuguc

SEQ ID NO: 221433 - RNA, 22 nt, Human
acagaguguugcucugcugccc

SEQ ID NO: 221434 - RNA, 19 nt, Human
acaugugaagcagacagac

SEQ ID NO: 221435 - RNA, 21 nt, Human
accaaaccacagaauccuaca

SEQ ID NO: 221436 - RNA, 21 nt, Human
accaaacccaacacugaccua

SEQ ID NO: 221437 - RNA, 27 nt, Human
accaaacccaacacugaccuaggaaac

SEQ ID NO: 221438 - RNA, 27 nt, Human
accacacuaucccagacucacaaccca

SEQ ID NO: 221439 - RNA, 24 nt, Human
accauguugcccaggcuggucuug

SEQ ID NO: 221440 - RNA, 25 nt, Human
accauguugcccaggcuggucuuga

SEQ ID NO: 221441 - RNA, 21 nt, Human
acccaacaagacucaguguuu

SEQ ID NO: 221442 - RNA, 21 nt, Human
acccauugccauucgcugcug

SEQ ID NO: 221443 - RNA, 24 nt, Human
acccggcuaauuuuuuuguauuuu

SEQ ID NO: 221444 - RNA, 24 nt, Human
acccugcccucccucccucccucu

SEQ ID NO: 221445 - RNA, 18 nt, Human
acgggguuucaccguguu

SEQ ID NO: 221446 - RNA, 19 nt, Human
acgggguuucaccguguua

SEQ ID NO: 221447 - RNA, 20 nt, Human
acgggguuucaccguguuag

SEQ ID NO: 221448 - RNA, 24 nt, Human
acgggguuucaccguguuagccag

SEQ ID NO: 221449 - RNA, 20 nt, Human
acuaaaugcaaaacagcccg

SEQ ID NO: 221450 - RNA, 21 nt, Human
acugcaagcuccgccucccag

SEQ ID NO: 221451 - RNA, 24 nt, Human
agagugcugagauuacaggcaugg

SEQ ID NO: 221452 - RNA, 25 nt, Human
agagugcugagauuacaggcauggg

SEQ ID NO: 221453 - RNA, 19 nt, Human
agauuacaggcaugggcca

SEQ ID NO: 221454 - RNA, 21 nt, Human
agauuacaggcaugggccacu

SEQ ID NO: 221455 - RNA, 24 nt, Human
agcauccaccucuuccuaauuuac

SEQ ID NO: 221456 - RNA, 20 nt, Human
agcugcagggaggguaggug

SEQ ID NO: 221457 - RNA, 25 nt, Human
aggaaacucacaaaaugauacgacc

SEQ ID NO: 221458 - RNA, 18 nt, Human
aggagcuaccaaaccaca

SEQ ID NO: 221459 - RNA, 22 nt, Human
aggauuguucugugauucuaug

SEQ ID NO: 221460 - RNA, 25 nt, Human
aggcuggagugcaguggcgcaaucu

SEQ ID NO: 221461 - RNA, 20 nt, Human
aguagagacgggguuucacc

SEQ ID NO: 221462 - RNA, 21 nt, Human
aguagagacgggguuucaccg

SEQ ID NO: 221463 - RNA, 18 nt, Human
aguagcugggacuacagg

SEQ ID NO: 221464 - RNA, 23 nt, Human
aguagcugggaucacaggcaugu

SEQ ID NO: 221465 - RNA, 20 nt, Human
agugcaguggcgcaaucucg

SEQ ID NO: 221466 - RNA, 24 nt, Human
agugcaguggcgcaaucucggcuc

SEQ ID NO: 221467 - RNA, 20 nt, Human
agugcaguggugcaaucaug

SEQ ID NO: 221468 - RNA, 23 nt, Human
agugcaguggugcaaucauggcu

SEQ ID NO: 221469 - RNA, 24 nt, Human
agugcaguggugcaaucauggcuc

SEQ ID NO: 221470 - RNA, 21 nt, Human
agugcugagauuacaggcaug

SEQ ID NO: 221471 - RNA, 18 nt, Human
auggggucucaccauguu

SEQ ID NO: 221472 - RNA, 24 nt, Human
auggggucucaccauguugcccag

SEQ ID NO: 221473 - RNA, 21 nt, Human
auucuccugccucagccuccc

SEQ ID NO: 221474 - RNA, 27 nt, Human
caaaccuaucucaacacuaccccaaaa

SEQ ID NO: 221475 - RNA, 24 nt, Human
caaagugcugggguuacaggcaug

SEQ ID NO: 221476 - RNA, 20 nt, Human
caacacuaccccaaaaggcu

SEQ ID NO: 221477 - RNA, 22 nt, Human
caacacuaccccaaaaggcucc

SEQ ID NO: 221478 - RNA, 24 nt, Human
caacacuaccccaaaaggcuccau

SEQ ID NO: 221479 - RNA, 29 nt, Human
caacagaacccuacaagauucauuugguu

SEQ ID NO: 221480 - RNA, 27 nt, Human
caaccaaacccaacacugaccuaggaa

SEQ ID NO: 221481 - RNA, 18 nt, Human
caacccaagacccaacaa

SEQ ID NO: 221482 - RNA, 22 nt, Human
caagggaucuuucugccucagc

SEQ ID NO: 221483 - RNA, 18 nt, Human
cacaacccaaccaaaccc

SEQ ID NO: 221484 - RNA, 18 nt, Human
cacaacccaagacccaac

SEQ ID NO: 221485 - RNA, 21 nt, Human
cacaacccaagacccaacaag

SEQ ID NO: 221486 - RNA, 24 nt, Human
cacaggcaugugccaccacacuca

SEQ ID NO: 221487 - RNA, 23 nt, Human
cacaguuaagcccaacagaaccc

SEQ ID NO: 221488 - RNA, 19 nt, Human
caccacacacauucgaucu

SEQ ID NO: 221489 - RNA, 24 nt, Human
caccacacucagcuaauuuuugua

SEQ ID NO: 221490 - RNA, 23 nt, Human
caccauguugcccaggcuggucu

SEQ ID NO: 221491 - RNA, 24 nt, Human
caccauguugcccaggcuggucuu

SEQ ID NO: 221492 - RNA, 27 nt, Human
caccauguugcccaggcuggucuugaa

SEQ ID NO: 221493 - RNA, 22 nt, Human
cacccaaucccauggauacaga

SEQ ID NO: 221494 - RNA, 22 nt, Human
cacccugcccucccucccuccc

SEQ ID NO: 221495 - RNA, 18 nt, Human
caccguguuagccaggau

SEQ ID NO: 221496 - RNA, 22 nt, Human
caccguguuagccaggaugguc

SEQ ID NO: 221497 - RNA, 24 nt, Human
caccucggccucccaaagugcugg

SEQ ID NO: 221498 - RNA, 23 nt, Human
caccucuacacaguuaagcccaa

SEQ ID NO: 221499 - RNA, 19 nt, Human
caccucuuccuuuuucugg

SEQ ID NO: 221500 - RNA, 21 nt, Human
cagaauccagucccgcccccu

SEQ ID NO: 221501 - RNA, 24 nt, Human
cagagugcugagauuacaggcaug

SEQ ID NO: 221502 - RNA, 23 nt, Human
cagccacacaccucuacacaguu

SEQ ID NO: 221503 - RNA, 23 nt, Human
cagccuucuuccucuaaaugccc

SEQ ID NO: 221504 - RNA, 19 nt, Human
cagcgagcuggggagccag

SEQ ID NO: 221505 - RNA, 20 nt, Human
cagcuuccugaguagcuggg

SEQ ID NO: 221506 - RNA, 24 nt, Human
caggugcccgccaccgcacccggc

SEQ ID NO: 221507 - RNA, 22 nt, Human
caugccauucuccugccucagc

SEQ ID NO: 221508 - RNA, 20 nt, Human
cauguugcccaggcuggucu

SEQ ID NO: 221509 - RNA, 24 nt, Human
cauguugcccaggcuggucuugaa

SEQ ID NO: 221510 - RNA, 23 nt, Human
ccaaacccaacacugaccuagga

SEQ ID NO: 221511 - RNA, 23 nt, Human
ccaaagugcugggguuacaggca

SEQ ID NO: 221512 - RNA, 24 nt, Human
ccaaagugcugggguuacaggcau

SEQ ID NO: 221513 - RNA, 20 nt, Human
ccaccacacucagcuaauuu

SEQ ID NO: 221514 - RNA, 23 nt, Human
ccaccucuuccuuuuucuggguc

SEQ ID NO: 221515 - RNA, 24 nt, Human
ccaccucuuccuuuuucugggucu

SEQ ID NO: 221516 - RNA, 23 nt, Human
ccagagcccucgccacugcaugc

SEQ ID NO: 221517 - RNA, 23 nt, Human
ccagagugcugagauuacaggca

SEQ ID NO: 221518 - RNA, 24 nt, Human
ccagagugcugagauuacaggcau

SEQ ID NO: 221519 - RNA, 23 nt, Human
ccagcaggcugauggggacaugu

SEQ ID NO: 221520 - RNA, 22 nt, Human
ccagccuugcccuccacccugc

SEQ ID NO: 221521 - RNA, 24 nt, Human
cccaaagugcugggguuacaggca

SEQ ID NO: 221522 - RNA, 21 nt, Human
cccaagacccaacaagacuca

SEQ ID NO: 221523 - RNA, 20 nt, Human
cccagguucaugccauucuc

SEQ ID NO: 221524 - RNA, 31 nt, Human
cccccagccugucugacagccuuccugagcc

SEQ ID NO: 221525 - RNA, 23 nt, Human
ccccccagccuugcccuccaccc

SEQ ID NO: 221526 - RNA, 21 nt, Human
ccccgccgccgccgccgcccg

SEQ ID NO: 221527 - RNA, 27 nt, Human
ccccgccgccgccgccgcccgcgccug

SEQ ID NO: 221528 - RNA, 27 nt, Human
ccccuggaaaacagagugaggccccca

SEQ ID NO: 221529 - RNA, 20 nt, Human
ccccuuucucuccguccuuc

SEQ ID NO: 221530 - RNA, 24 nt, Human
cccgacgcccggccccggugcggc

SEQ ID NO: 221531 - RNA, 23 nt, Human
cccgaguagcugggacuacaggu

SEQ ID NO: 221532 - RNA, 24 nt, Human
cccgaguagcugggacuacaggug

SEQ ID NO: 221533 - RNA, 19 nt, Human
cccgugugucccagcaggc

SEQ ID NO: 221534 - RNA, 24 nt, Human
cccucuguugcccaggcuggagug

SEQ ID NO: 221535 - RNA, 21 nt, Human
cccugagucucuguuucucuc

SEQ ID NO: 221536 - RNA, 19 nt, Human
cccuggggacaagcuguga

SEQ ID NO: 221537 - RNA, 19 nt, Human
cccuuguggcucugaccuc

SEQ ID NO: 221538 - RNA, 19 nt, Human
ccgccgcccgcgccugcuc

SEQ ID NO: 221539 - RNA, 21 nt, Human
ccgccgcccgcgccugcucug

SEQ ID NO: 221540 - RNA, 18 nt, Human
ccgccgccgccccagccc

SEQ ID NO: 221541 - RNA, 20 nt, Human
ccgccgccgcccgcgccugc

SEQ ID NO: 221542 - RNA, 20 nt, Human
ccgccgccgcccgcgccugc

SEQ ID NO: 221543 - RNA, 20 nt, Human
ccgccgccgcccgcgccugc

SEQ ID NO: 221544 - RNA, 22 nt, Human
ccgccgccgcccgcgccugcuc

SEQ ID NO: 221545 - RNA, 23 nt, Human
ccgccgccgccgccccagcccgg

SEQ ID NO: 221546 - RNA, 19 nt, Human
ccgccgccgccgcccgcgc

SEQ ID NO: 221547 - RNA, 21 nt, Human
ccgccgccgccgccgccccag

SEQ ID NO: 221548 - RNA, 23 nt, Human
ccgccgccgccgccgccccagcc

SEQ ID NO: 221549 - RNA, 22 nt, Human
ccgccucggccgccucggccgc

SEQ ID NO: 221550 - RNA, 24 nt, Human
ccgcgccugcucugcgccuuuccc

SEQ ID NO: 221551 - RNA, 21 nt, Human
ccgggacgcccgcccugcccu

SEQ ID NO: 221552 - RNA, 19 nt, Human
ccgguguccgguguccgcg

SEQ ID NO: 221553 - RNA, 18 nt, Human
ccgucccgggguccccuu

SEQ ID NO: 221554 - RNA, 19 nt, Human
ccucaaucaaucccccuuc

SEQ ID NO: 221555 - RNA, 19 nt, Human
ccucccagagcccucgccu

SEQ ID NO: 221556 - RNA, 24 nt, Human
ccucggucucccagagugcugaga

SEQ ID NO: 221557 - RNA, 22 nt, Human
ccucuaaaugcccuuugaguuc

SEQ ID NO: 221558 - RNA, 22 nt, Human
ccucuggaugaacacccaaucc

SEQ ID NO: 221559 - RNA, 24 nt, Human
ccucugggucucugucccucccuc

SEQ ID NO: 221560 - RNA, 25 nt, Human
ccucuguugcccaggcuggagugca

SEQ ID NO: 221561 - RNA, 19 nt, Human
ccugaguagcugggaucac

SEQ ID NO: 221562 - RNA, 25 nt, Human
ccugccccgccgccgccgccgcccc

SEQ ID NO: 221563 - RNA, 23 nt, Human
ccugccucagccucccgaguagc

SEQ ID NO: 221564 - RNA, 18 nt, Human
ccugcucuuggucucugu

SEQ ID NO: 221565 - RNA, 18 nt, Human
ccuggugcuaccacuaaa

SEQ ID NO: 221566 - RNA, 23 nt, Human
ccuugcccuccacccugcccucc

SEQ ID NO: 221567 - RNA, 19 nt, Human
ccuugggaagccacucccc

SEQ ID NO: 221568 - RNA, 22 nt, Human
ccuuggguaacaccugcugcuc

SEQ ID NO: 221569 - RNA, 20 nt, Human
ccuuuggguccuggugcuac

SEQ ID NO: 221570 - RNA, 19 nt, Human
cgcccggccccggugcggc

SEQ ID NO: 221571 - RNA, 19 nt, Human
cggcuucuauccccugcuc

SEQ ID NO: 221572 - RNA, 24 nt, Human
cgggggcucccucuguugcccagg

SEQ ID NO: 221573 - RNA, 19 nt, Human
cuagggcgcgagggagggg

SEQ ID NO: 221574 - RNA, 24 nt, Human
cucagccucccgaguagcugggac

SEQ ID NO: 221575 - RNA, 24 nt, Human
cucagcuuccugaguagcugggau

SEQ ID NO: 221576 - RNA, 25 nt, Human
cuccaugagcuuugcacaacucaga

SEQ ID NO: 221577 - RNA, 23 nt, Human
cucccucuguugcccaggcugga

SEQ ID NO: 221578 - RNA, 24 nt, Human
cucccucuguugcccaggcuggag

SEQ ID NO: 221579 - RNA, 20 nt, Human
cuccugaccucguaauuugc

SEQ ID NO: 221580 - RNA, 27 nt, Human
cucuacacaguuaagcccaacagaacu

SEQ ID NO: 221581 - RNA, 23 nt, Human
cucuauccuuuuggcucuguccc

SEQ ID NO: 221582 - RNA, 21 nt, Human
cucugccauaccccacccucc

SEQ ID NO: 221583 - RNA, 19 nt, Human
cucugcugcccaggcugga

SEQ ID NO: 221584 - RNA, 23 nt, Human
cucugcugcccaggcuggagugc

SEQ ID NO: 221585 - RNA, 21 nt, Human
cucugggucucugucccuccc

SEQ ID NO: 221586 - RNA, 20 nt, Human
cucugucccucccuccccca

SEQ ID NO: 221587 - RNA, 22 nt, Human
cugaccuccaugucugagcaua

SEQ ID NO: 221588 - RNA, 23 nt, Human
cugagccucaguuuccccgucug

SEQ ID NO: 221589 - RNA, 24 nt, Human
cugcaagcuccgccucccagguuc

SEQ ID NO: 221590 - RNA, 24 nt, Human
cugcccaggcuggagugcaguggc

SEQ ID NO: 221591 - RNA, 21 nt, Human
cugccccgccgccgccgccgc

SEQ ID NO: 221592 - RNA, 29 nt, Human
cugcccugccccgccgccgccgccgcccc

SEQ ID NO: 221593 - RNA, 20 nt, Human
cugccgccgggauccugucc

SEQ ID NO: 221594 - RNA, 23 nt, Human
cugccucagccucccgaguagcu

SEQ ID NO: 221595 - RNA, 19 nt, Human
cugcugcccaggcuggagu

SEQ ID NO: 221596 - RNA, 18 nt, Human
cuggaccacacuaucccg

SEQ ID NO: 221597 - RNA, 21 nt, Human
cugucccucccucccccacug

SEQ ID NO: 221598 - RNA, 22 nt, Human
cuuaacaccacacacauucgau

SEQ ID NO: 221599 - RNA, 24 nt, Human
cuuccucggucucccagagugcug

SEQ ID NO: 221600 - RNA, 20 nt, Human
cuuccuuuuucugggucucu

SEQ ID NO: 221601 - RNA, 18 nt, Human
cuuuuucugggucucuuu

SEQ ID NO: 221602 - RNA, 22 nt, Human
gaccucguaauuugcccaccuc

SEQ ID NO: 221603 - RNA, 20 nt, Human
gacucaguguuuccccacuc

SEQ ID NO: 221604 - RNA, 24 nt, Human
gagacgggguuucaccguguuagc

SEQ ID NO: 221605 - RNA, 21 nt, Human
gagccucaguuuccccgucug

SEQ ID NO: 221606 - RNA, 23 nt, Human
gagcuaccaaaccacacaaccca

SEQ ID NO: 221607 - RNA, 18 nt, Human
gagcuggggagccagcuc

SEQ ID NO: 221608 - RNA, 25 nt, Human
gaguagcugggaucacaggcaugug

SEQ ID NO: 221609 - RNA, 19 nt, Human
gaugugggguaaacaggag

SEQ ID NO: 221610 - RNA, 18 nt, Human
gauuacaggcaugggcca

SEQ ID NO: 221611 - RNA, 24 nt, Human
gauuacaggcaugggccacuucgc

SEQ ID NO: 221612 - RNA, 23 nt, Human
gcaaaacagcccgauguggcccu

SEQ ID NO: 221613 - RNA, 23 nt, Human
gcaaaacagcccgauguggcccu

SEQ ID NO: 221614 - RNA, 19 nt, Human
gcccaggcuggagugcagu

SEQ ID NO: 221615 - RNA, 19 nt, Human
gcccgcccugcccugcccc

SEQ ID NO: 221616 - RNA, 23 nt, Human
gcccugccccgccgccgccgccg

SEQ ID NO: 221617 - RNA, 22 nt, Human
gccgcccgcgccugcucugcgc

SEQ ID NO: 221618 - RNA, 25 nt, Human
gccgccucggccgccgccgccgccg

SEQ ID NO: 221619 - RNA, 24 nt, Human
gccucagcuuccugaguagcuggg

SEQ ID NO: 221620 - RNA, 25 nt, Human
gccucccagguucaugccauucucc

SEQ ID NO: 221621 - RNA, 21 nt, Human
gcucaaugcagccucuaccuc

SEQ ID NO: 221622 - RNA, 24 nt, Human
gcucccucuguugcccaggcugga

SEQ ID NO: 221623 - RNA, 19 nt, Human
gcucugcugcccaggcugg

SEQ ID NO: 221624 - RNA, 20 nt, Human
gcucugcugcccaggcugga

SEQ ID NO: 221625 - RNA, 19 nt, Human
gcuggagugcaguggcgca

SEQ ID NO: 221626 - RNA, 23 nt, Human
gcuggucuugaacuccuggccuc

SEQ ID NO: 221627 - RNA, 18 nt, Human
ggaaaacagagugaggcc

SEQ ID NO: 221628 - RNA, 20 nt, Human
ggaacucaauucagcauggc

SEQ ID NO: 221629 - RNA, 22 nt, Human
ggaucuuucugccucagcuucc

SEQ ID NO: 221630 - RNA, 18 nt, Human
ggcgacccgcgaaccgac

SEQ ID NO: 221631 - RNA, 24 nt, Human
ggcuggucuugaacuccuggccuc

SEQ ID NO: 221632 - RNA, 18 nt, Human
gggacccaccaaaccaca

SEQ ID NO: 221633 - RNA, 19 nt, Human
gggaggguaggugacaggc

SEQ ID NO: 221634 - RNA, 24 nt, Human
gggaucuuucugccucagcuuccu

SEQ ID NO: 221635 - RNA, 22 nt, Human
ggggcucccucuguugcccagg

SEQ ID NO: 221636 - RNA, 22 nt, Human
ggggucucaccauguugcccag

SEQ ID NO: 221637 - RNA, 23 nt, Human
gggguuucaccguguuagccagg

SEQ ID NO: 221638 - RNA, 22 nt, Human
gggucucaccauguugcccagg

SEQ ID NO: 221639 - RNA, 23 nt, Human
gggucucugucucucuggguuuc

SEQ ID NO: 221640 - RNA, 22 nt, Human
ggguuacaggcaugagccaccg

SEQ ID NO: 221641 - RNA, 22 nt, Human
ggguuucaccguguuagccagg

SEQ ID NO: 221642 - RNA, 20 nt, Human
ggucuggaucuccugaccuc

SEQ ID NO: 221643 - RNA, 22 nt, Human
gguuacaggcaugagccaccgc

SEQ ID NO: 221644 - RNA, 24 nt, Human
guaauuugcccaccucggccuccc

SEQ ID NO: 221645 - RNA, 23 nt, Human
guagagacgggguuucaccgugu

SEQ ID NO: 221646 - RNA, 21 nt, Human
guagagauggggucucaccau

SEQ ID NO: 221647 - RNA, 22 nt, Human
guagagauggggucucaccaug

SEQ ID NO: 221648 - RNA, 19 nt, Human
guauuuuuuguagagaugg

SEQ ID NO: 221649 - RNA, 19 nt, Human
guccccuuucucuccgucc

SEQ ID NO: 221650 - RNA, 19 nt, Human
gucccucuaucaugucugg

SEQ ID NO: 221651 - RNA, 25 nt, Human
guuuucucccccucuccccuuuccc

SEQ ID NO: 221652 - RNA, 24 nt, Human
uaaacaggaggagcauccaccucu

SEQ ID NO: 221653 - RNA, 23 nt, Human
uaacacaacacaacccauugcca

SEQ ID NO: 221654 - RNA, 21 nt, Human
uaacaugccccuggaagaauc

SEQ ID NO: 221655 - RNA, 20 nt, Human
uaacccaaugugaccuagaa

SEQ ID NO: 221656 - RNA, 18 nt, Human
uaaccuagcucuuccuaa

SEQ ID NO: 221657 - RNA, 22 nt, Human
uaauuuuuguauuuuuuguaga

SEQ ID NO: 221658 - RNA, 24 nt, Human
uaauuuuuguauuuuuuguagaga

SEQ ID NO: 221659 - RNA, 26 nt, Human
uaauuuuuuuguauuuuuaguagaga

SEQ ID NO: 221660 - RNA, 25 nt, Human
uacaagauucauuuggucauacaaa

SEQ ID NO: 221661 - RNA, 21 nt, Human
uacacaguuaagcccaacaga

SEQ ID NO: 221662 - RNA, 23 nt, Human
uacaggcaugagccaccgcgccc

SEQ ID NO: 221663 - RNA, 26 nt, Human
uaccaaaccacacaacccaagaccca

SEQ ID NO: 221664 - RNA, 27 nt, Human
uaccaaaccacacaacccaagacccaa

SEQ ID NO: 221665 - RNA, 22 nt, Human
uagagauggggucucaccaugu

SEQ ID NO: 221666 - RNA, 21 nt, Human
uaguagagacgggguuucacc

SEQ ID NO: 221667 - RNA, 24 nt, Human
uaguagagacgggguuucaccgug

SEQ ID NO: 221668 - RNA, 26 nt, Human
uaguagagacgggguuucaccguguu

SEQ ID NO: 221669 - RNA, 19 nt, Human
ucaauggaacucaauucag

SEQ ID NO: 221670 - RNA, 24 nt, Human
ucaccguguuagccaggauggucu

SEQ ID NO: 221671 - RNA, 18 nt, Human
ucacugcaagcuccgccu

SEQ ID NO: 221672 - RNA, 19 nt, Human
ucacugcaagcuccgccuc

SEQ ID NO: 221673 - RNA, 19 nt, Human
ucacugcaagcuccgccuc

SEQ ID NO: 221674 - RNA, 24 nt, Human
ucacugcaagcuccgccucccagg

SEQ ID NO: 221675 - RNA, 23 nt, Human
ucagccucccgaguagcugggac

SEQ ID NO: 221676 - RNA, 20 nt, Human
ucagcuuccugaguagcugg

SEQ ID NO: 221677 - RNA, 20 nt, Human
ucaggauuguucugugauuc

SEQ ID NO: 221678 - RNA, 24 nt, Human
ucccaaagugcugggguuacaggc

SEQ ID NO: 221679 - RNA, 24 nt, Human
ucccagagugcugagauuacaggc

SEQ ID NO: 221680 - RNA, 20 nt, Human
ucccagguucaugccauucu

SEQ ID NO: 221681 - RNA, 21 nt, Human
ucccagguucaugccauucuc

SEQ ID NO: 221682 - RNA, 24 nt, Human
ucccagguucaugccauucuccug

SEQ ID NO: 221683 - RNA, 18 nt, Human
uccccacucuggauuucu

SEQ ID NO: 221684 - RNA, 21 nt, Human
ucccccuuccucggucuccca

SEQ ID NO: 221685 - RNA, 25 nt, Human
uccccuccccccagccuugcccucc

SEQ ID NO: 221686 - RNA, 18 nt, Human
uccccuuucucuccgucc

SEQ ID NO: 221687 - RNA, 23 nt, Human
ucccgaguagcugggacuacagg

SEQ ID NO: 221688 - RNA, 24 nt, Human
ucccgaguagcugggacuacaggu

SEQ ID NO: 221689 - RNA, 20 nt, Human
ucccucuguugcccaggcug

SEQ ID NO: 221690 - RNA, 22 nt, Human
ucccucuguugcccaggcugga

SEQ ID NO: 221691 - RNA, 24 nt, Human
ucccucuguugcccaggcuggagu

SEQ ID NO: 221692 - RNA, 18 nt, Human
ucccugagacucuguugu

SEQ ID NO: 221693 - RNA, 18 nt, Human
uccuaauuuacccagucg

SEQ ID NO: 221694 - RNA, 22 nt, Human
uccuacacaaugcagcuggacc

SEQ ID NO: 221695 - RNA, 24 nt, Human
uccugaguagcugggaucacaggc

SEQ ID NO: 221696 - RNA, 18 nt, Human
uccuuuuggcucuguccc

SEQ ID NO: 221697 - RNA, 23 nt, Human
ucgaucucaacaaugccaugggg

SEQ ID NO: 221698 - RNA, 20 nt, Human
ucgccucuggaugaacaccc

SEQ ID NO: 221699 - RNA, 18 nt, Human
ucggccucccaaagugcu

SEQ ID NO: 221700 - RNA, 23 nt, Human
ucggccucccaaagugcuggggu

SEQ ID NO: 221701 - RNA, 23 nt, Human
ucucaccauguugcccaggcugg

SEQ ID NO: 221702 - RNA, 26 nt, Human
ucucaccauguugcccaggcuggucu

SEQ ID NO: 221703 - RNA, 27 nt, Human
ucucaccauguugcccaggcuggucuu

SEQ ID NO: 221704 - RNA, 19 nt, Human
ucuccccuuucccuugugg

SEQ ID NO: 221705 - RNA, 19 nt, Human
ucucccucucccugagucu

SEQ ID NO: 221706 - RNA, 24 nt, Human
ucuccugccucagccucccgagua

SEQ ID NO: 221707 - RNA, 21 nt, Human
ucucugucuccccacucugga

SEQ ID NO: 221708 - RNA, 21 nt, Human
ucucuucugcgucucugccau

SEQ ID NO: 221709 - RNA, 22 nt, Human
ucugaaaauguucggccuugug

SEQ ID NO: 221710 - RNA, 24 nt, Human
ucugccucagcuuccugaguagcu

SEQ ID NO: 221711 - RNA, 21 nt, Human
ucugcgucucugccauacccc

SEQ ID NO: 221712 - RNA, 24 nt, Human
ucugcugcccaggcuggagugcag

SEQ ID NO: 221713 - RNA, 18 nt, Human
ucuguugcccaggcugga

SEQ ID NO: 221714 - RNA, 24 nt, Human
ucuguugcccaggcuggagugcag

SEQ ID NO: 221715 - RNA, 19 nt, Human
ucuugaacuccuggccuca

SEQ ID NO: 221716 - RNA, 24 nt, Human
ucuuucugccucagcuuccugagu

SEQ ID NO: 221717 - RNA, 19 nt, Human
ugaaguggaugugggguaa

SEQ ID NO: 221718 - RNA, 23 nt, Human
ugaccucguaauuugcccaccuc

SEQ ID NO: 221719 - RNA, 22 nt, Human
ugagacgggggcucccucuguu

SEQ ID NO: 221720 - RNA, 21 nt, Human
ugagauuacaggcaugggcca

SEQ ID NO: 221721 - RNA, 22 nt, Human
ugagauuacaggcaugggccac

SEQ ID NO: 221722 - RNA, 23 nt, Human
ugagauuacaggcaugggccacu

SEQ ID NO: 221723 - RNA, 24 nt, Human
ugagauuacaggcaugggccacuu

SEQ ID NO: 221724 - RNA, 19 nt, Human
ugagcugcagggaggguag

SEQ ID NO: 221725 - RNA, 18 nt, Human
ugagcugcagggaggguc

SEQ ID NO: 221726 - RNA, 20 nt, Human
ugauggggacaugugaagca

SEQ ID NO: 221727 - RNA, 20 nt, Human
ugauuucagccuucuuccuc

SEQ ID NO: 221728 - RNA, 23 nt, Human
ugcaguggcgcaaucucggcuca

SEQ ID NO: 221729 - RNA, 23 nt, Human
ugcaguggugcaaucauggcuca

SEQ ID NO: 221730 - RNA, 21 nt, Human
ugccaugggggaccaucuaac

SEQ ID NO: 221731 - RNA, 18 nt, Human
ugcccaggcuggagugca

SEQ ID NO: 221732 - RNA, 18 nt, Human
ugcccaggcuggagugca

SEQ ID NO: 221733 - RNA, 21 nt, Human
ugcccaggcuggagugcagug

SEQ ID NO: 221734 - RNA, 21 nt, Human
ugcccaggcuggagugcagug

SEQ ID NO: 221735 - RNA, 22 nt, Human
ugcccaggcuggagugcagugg

SEQ ID NO: 221736 - RNA, 24 nt, Human
ugcccaggcuggagugcaguggcg

SEQ ID NO: 221737 - RNA, 24 nt, Human
ugcccaggcuggagugcaguggug

SEQ ID NO: 221738 - RNA, 24 nt, Human
ugcccaggcuggucuugaacuccu

SEQ ID NO: 221739 - RNA, 21 nt, Human
ugcccucugggucucuguccc

SEQ ID NO: 221740 - RNA, 24 nt, Human
ugccucagccucccgaguagcugg

SEQ ID NO: 221741 - RNA, 24 nt, Human
ugccucagcuuccugaguagcugg

SEQ ID NO: 221742 - RNA, 20 nt, Human
ugcuaccacuaaaugcaaaa

SEQ ID NO: 221743 - RNA, 22 nt, Human
ugcuaccacuaaaugcaaaaca

SEQ ID NO: 221744 - RNA, 24 nt, Human
ugcucugcugcccaggcuggagug

SEQ ID NO: 221745 - RNA, 19 nt, Human
uggaagaaucacagagcua

SEQ ID NO: 221746 - RNA, 23 nt, Human
uggagugcaguggcgcaaucucg

SEQ ID NO: 221747 - RNA, 24 nt, Human
uggagugcaguggcgcaaucucgg

SEQ ID NO: 221748 - RNA, 21 nt, Human
uggagugcaguggugcaauca

SEQ ID NO: 221749 - RNA, 24 nt, Human
uggagugcaguggugcaaucaugg

SEQ ID NO: 221750 - RNA, 23 nt, Human
uggauacagaauccagucccgcc

SEQ ID NO: 221751 - RNA, 21 nt, Human
uggaugaacacccaaucccau

SEQ ID NO: 221752 - RNA, 22 nt, Human
uggaugugggguaaacaggagg

SEQ ID NO: 221753 - RNA, 23 nt, Human
uggaugugggguaaacaggagga

SEQ ID NO: 221754 - RNA, 25 nt, Human
uggaugugggguaaacaggaggagc

SEQ ID NO: 221755 - RNA, 18 nt, Human
uggcccuaggggacccac

SEQ ID NO: 221756 - RNA, 21 nt, Human
ugggacuacaggugcccgcca

SEQ ID NO: 221757 - RNA, 22 nt, Human
ugggacuacaggugcccgccac

SEQ ID NO: 221758 - RNA, 23 nt, Human
ugggacuacaggugcccgccacc

SEQ ID NO: 221759 - RNA, 24 nt, Human
ugggacuacaggugcccgccaccg

SEQ ID NO: 221760 - RNA, 18 nt, Human
ugggaucacaggcaugug

SEQ ID NO: 221761 - RNA, 21 nt, Human
ugggaucacaggcaugugcca

SEQ ID NO: 221762 - RNA, 22 nt, Human
ugggaucacaggcaugugccac

SEQ ID NO: 221763 - RNA, 24 nt, Human
ugggaucacaggcaugugccacca

SEQ ID NO: 221764 - RNA, 19 nt, Human
uggggacaugugaagcaga

SEQ ID NO: 221765 - RNA, 24 nt, Human
uggggucucaccauguugcccagg

SEQ ID NO: 221766 - RNA, 19 nt, Human
ugggguuacaggcaugagc

SEQ ID NO: 221767 - RNA, 22 nt, Human
ugggguuacaggcaugagccac

SEQ ID NO: 221768 - RNA, 23 nt, Human
ugggguuacaggcaugagccacc

SEQ ID NO: 221769 - RNA, 24 nt, Human
ugggguuacaggcaugagccaccg

SEQ ID NO: 221770 - RNA, 20 nt, Human
uggguccuggugcuaccacu

SEQ ID NO: 221771 - RNA, 23 nt, Human
uggguccuggugcuaccacuaaa

SEQ ID NO: 221772 - RNA, 18 nt, Human
ugggucucugucucucug

SEQ ID NO: 221773 - RNA, 19 nt, Human
ugggucucuuucucuaucc

SEQ ID NO: 221774 - RNA, 21 nt, Human
uggguucaggggcaccaacuu

SEQ ID NO: 221775 - RNA, 23 nt, Human
uggguuuccaccucuuccuuuuu

SEQ ID NO: 221776 - RNA, 18 nt, Human
uguacaauucaacacaac

SEQ ID NO: 221777 - RNA, 24 nt, Human
uguagagauggggucucaccaugu

SEQ ID NO: 221778 - RNA, 21 nt, Human
uguauuuuuaguagagacggg

SEQ ID NO: 221779 - RNA, 22 nt, Human
ugucuggacagaguacaguuuu

SEQ ID NO: 221780 - RNA, 18 nt, Human
ugugggguaaacaggagg

SEQ ID NO: 221781 - RNA, 24 nt, Human
uguugcucugcugcccaggcugga

SEQ ID NO: 221782 - RNA, 20 nt, Human
uuacaggcaugagccaccgc

SEQ ID NO: 221783 - RNA, 18 nt, Human
uuaguagagacgggguuu

SEQ ID NO: 221784 - RNA, 22 nt, Human
uuaguagagacgggguuucacc

SEQ ID NO: 221785 - RNA, 24 nt, Human
uuaguagagacgggguuucaccgu

SEQ ID NO: 221786 - RNA, 19 nt, Human
uucaugccauucuccugcc

SEQ ID NO: 221787 - RNA, 19 nt, Human
uucugccuuuuucuauugu

SEQ ID NO: 221788 - RNA, 24 nt, Human
uugcccaggcuggagugcaguggu

SEQ ID NO: 221789 - RNA, 20 nt, Human
uugcucugcugcccaggcug

SEQ ID NO: 221790 - RNA, 20 nt, Human
uugcucugcugcccaggcug

SEQ ID NO: 221791 - RNA, 21 nt, Human
uugcucugcugcccaggcugg

SEQ ID NO: 221792 - RNA, 22 nt, Human
uugcucugcugcccaggcugga

SEQ ID NO: 221793 - RNA, 24 nt, Human
uuggguucaggggcaccaacuuuu

SEQ ID NO: 221794 - RNA, 24 nt, Human
uuguagagauggggucucaccaug

SEQ ID NO: 221795 - RNA, 19 nt, Human
uuucaccguguuagccagg

SEQ ID NO: 221796 - RNA, 21 nt, Human
uuugcccaccucggccuccca

SEQ ID NO: 221797 - RNA, 22 nt, Human
uuuggguccuggugcuaccacu

SEQ ID NO: 221798 - RNA, 22 nt, Human
uuugggucucugucucucuggg

SEQ ID NO: 221799 - RNA, 18 nt, Human
uuuguagagauggggucu

SEQ ID NO: 221800 - RNA, 24 nt, Human
uuuguagagauggggucucaccau

SEQ ID NO: 221801 - RNA, 24 nt, Human
uuuuuaguagagacgggguuucac

SEQ ID NO: 221802 - RNA, 21 nt, Human
uuuuuguauuuuuaguagaga

SEQ ID NO: 221803 - RNA, 20 nt, Human
uuuuuguauuuuuuguagag

SEQ ID NO: 221804 - RNA, 23 nt, Human
uuuuuguauuuuuuguagagaug

SEQ ID NO: 221805 - RNA, 24 nt, Human
uuuuuuguagagauggggucucac

SEQ ID NO: 221806 - RNA, 21 nt, Human
uuuuuuguauuuuuaguagag

SEQ ID NO: 221807 - RNA, 24 nt, Human
uuuuuuguauuuuuaguagagacg

SEQ ID NO: 221808 - RNA, 20 nt, Human
uuuuuuuuuuugagacagag

SEQ ID NO: 221809 - RNA, 20 nt, Human
aaaaacccaaggaagcaaag

SEQ ID NO: 221810 - RNA, 23 nt, Human
aaaaauauaucuguacagccuuc

SEQ ID NO: 221811 - RNA, 22 nt, Human
aacaaaacauguuuucucucuu

SEQ ID NO: 221812 - RNA, 19 nt, Human
aagcaacaguaaauauuug

SEQ ID NO: 221813 - RNA, 18 nt, Human
aagcuaauugcacggugc

SEQ ID NO: 221814 - RNA, 19 nt, Human
aagggccacucccacacca

SEQ ID NO: 221815 - RNA, 19 nt, Human
aauggauuuucuugguugu

SEQ ID NO: 221816 - RNA, 21 nt, Human
acacaaugaacaacugaaaau

SEQ ID NO: 221817 - RNA, 24 nt, Human
agcgacagcagacaccucaaagaa

SEQ ID NO: 221818 - RNA, 22 nt, Human
agcuaaguuuccauagcagugu

SEQ ID NO: 221819 - RNA, 20 nt, Human
aguagccaauaguggcaggg

SEQ ID NO: 221820 - RNA, 21 nt, Human
auagcauuuuucacaaagcca

SEQ ID NO: 221821 - RNA, 21 nt, Human
auggaacaaaacuuguuagua

SEQ ID NO: 221822 - RNA, 29 nt, Human
cacaccacccccuucaaaaaaaaacaaag

SEQ ID NO: 221823 - RNA, 18 nt, Human
cacaguauagucucacaa

SEQ ID NO: 221824 - RNA, 22 nt, Human
caccacccccuucaaaaaaaaa

SEQ ID NO: 221825 - RNA, 22 nt, Human
cagauuuagaauuuaaccauga

SEQ ID NO: 221826 - RNA, 21 nt, Human
cagugcuaauuaaacaaugaa

SEQ ID NO: 221827 - RNA, 24 nt, Human
caugcauauaguuuagugcauaua

SEQ ID NO: 221828 - RNA, 19 nt, Human
cauuagacagcaccucagc

SEQ ID NO: 221829 - RNA, 20 nt, Human
cauuagacagcaccucagcu

SEQ ID NO: 221830 - RNA, 24 nt, Human
ccacaccacccccuucaaaaaaaa

SEQ ID NO: 221831 - RNA, 27 nt, Human
ccacaccacccccuucaaaaaaaaaca

SEQ ID NO: 221832 - RNA, 30 nt, Human
ccacaccacccccuucaaaaaaaaacaaag

SEQ ID NO: 221833 - RNA, 19 nt, Human
ccacucccacaccaccccc

SEQ ID NO: 221834 - RNA, 22 nt, Human
ccacucccacaccacccccuuc

SEQ ID NO: 221835 - RNA, 18 nt, Human
ccauuagacagcaccuca

SEQ ID NO: 221836 - RNA, 19 nt, Human
cccacaccacccccuucaa

SEQ ID NO: 221837 - RNA, 18 nt, Human
cccauauucuucccauug

SEQ ID NO: 221838 - RNA, 20 nt, Human
cccauuagacagcaccucaa

SEQ ID NO: 221839 - RNA, 22 nt, Human
cccccauauucuucccauugca

SEQ ID NO: 221840 - RNA, 18 nt, Human
cccccuucaaaaaaaaac

SEQ ID NO: 221841 - RNA, 19 nt, Human
cccuucaaaaaaaaacaaa

SEQ ID NO: 221842 - RNA, 25 nt, Human
cuaagcaaauaaaucaaucaaauca

SEQ ID NO: 221843 - RNA, 19 nt, Human
cuagcauuuucagauuuag

SEQ ID NO: 221844 - RNA, 24 nt, Human
cucaauuccuuuccuucacugaau

SEQ ID NO: 221845 - RNA, 21 nt, Human
cuccaguccaagauaagaaaa

SEQ ID NO: 221846 - RNA, 18 nt, Human
cuccucuauacauacagc

SEQ ID NO: 221847 - RNA, 23 nt, Human
cuucaaaaaaaaacaaaacaugu

SEQ ID NO: 221848 - RNA, 19 nt, Human
cuugcugugaauaccuugg

SEQ ID NO: 221849 - RNA, 21 nt, Human
gaacaccuaauugcagauaca

SEQ ID NO: 221850 - RNA, 25 nt, Human
gacacuagagguugagcagcaagcu

SEQ ID NO: 221851 - RNA, 21 nt, Human
gauaucucccacuagcauuuu

SEQ ID NO: 221852 - RNA, 21 nt, Human
gcuuuuuuuuuuuugcaguga

SEQ ID NO: 221853 - RNA, 24 nt, Human
gguaauaaagcaaauaccuagaaa

SEQ ID NO: 221854 - RNA, 20 nt, Human
guaaguggacauaacauuag

SEQ ID NO: 221855 - RNA, 18 nt, Human
guaccacacccccuggcc

SEQ ID NO: 221856 - RNA, 20 nt, Human
uaaaaaacugagcaugugua

SEQ ID NO: 221857 - RNA, 25 nt, Human
uaaaauguaguaaaaaaugaacacc

SEQ ID NO: 221858 - RNA, 21 nt, Human
uaaagcucaaauauuuaaacu

SEQ ID NO: 221859 - RNA, 21 nt, Human
uaacaaugccucaaaaauacc

SEQ ID NO: 221860 - RNA, 23 nt, Human
uaacaaugccucaaaaauaccaa

SEQ ID NO: 221861 - RNA, 21 nt, Human
uaacacgggcaaaaaauucaa

SEQ ID NO: 221862 - RNA, 21 nt, Human
uaagaaaaaucucucaauucc

SEQ ID NO: 221863 - RNA, 24 nt, Human
uaauaaagcaaauaccuagaaauu

SEQ ID NO: 221864 - RNA, 18 nt, Human
uaauaugauuauagaacc

SEQ ID NO: 221865 - RNA, 23 nt, Human
uaauugcagauacauugcauuuu

SEQ ID NO: 221866 - RNA, 19 nt, Human
uacagauauugacacagua

SEQ ID NO: 221867 - RNA, 19 nt, Human
uacagcaaugcaagaauag

SEQ ID NO: 221868 - RNA, 21 nt, Human
uacugcuuuuuuuuuuuugca

SEQ ID NO: 221869 - RNA, 22 nt, Human
uagacauucuggauaaguugua

SEQ ID NO: 221870 - RNA, 23 nt, Human
uagcgacagcagacaccucaaag

SEQ ID NO: 221871 - RNA, 24 nt, Human
uaguggcagggcuagauacaccuc

SEQ ID NO: 221872 - RNA, 25 nt, Human
uaugaaugugaaaauagaaaaaaaa

SEQ ID NO: 221873 - RNA, 23 nt, Human
uauuuuaaccaugcagcuucugu

SEQ ID NO: 221874 - RNA, 24 nt, Human
ucaaaaauaccaaacauuauauua

SEQ ID NO: 221875 - RNA, 20 nt, Human
ucacauugcaucuguggauu

SEQ ID NO: 221876 - RNA, 18 nt, Human
ucccacaccacccccuuc

SEQ ID NO: 221877 - RNA, 18 nt, Human
ucccacaccacccccuuc

SEQ ID NO: 221878 - RNA, 22 nt, Human
ucccacaccacccccuucaaaa

SEQ ID NO: 221879 - RNA, 22 nt, Human
ucuguaaaccucagagugauuu

SEQ ID NO: 221880 - RNA, 19 nt, Human
ugacauagcauuuuucaca

SEQ ID NO: 221881 - RNA, 18 nt, Human
ugaccagaaaauuaaaug

SEQ ID NO: 221882 - RNA, 22 nt, Human
ugaguuaccaaaugccugaagg

SEQ ID NO: 221883 - RNA, 19 nt, Human
ugcaaagaacuuucaugca

SEQ ID NO: 221884 - RNA, 20 nt, Human
ugccucaaaaauaccaaaca

SEQ ID NO: 221885 - RNA, 24 nt, Human
uggaacaaaacuuguuaguaugaa

SEQ ID NO: 221886 - RNA, 21 nt, Human
uggauaaguuguacaaggcca

SEQ ID NO: 221887 - RNA, 19 nt, Human
uggcccccauauucuuccc

SEQ ID NO: 221888 - RNA, 20 nt, Human
uguagcccucucuuucauaa

SEQ ID NO: 221889 - RNA, 24 nt, Human
uguggggaacuugcugaccagaaa

SEQ ID NO: 221890 - RNA, 20 nt, Human
uuaaccaugcagcuucugug

SEQ ID NO: 221891 - RNA, 22 nt, Human
uuaguaacaccuuucuguacug

SEQ ID NO: 221892 - RNA, 24 nt, Human
uuagucuaucuacucuguuucuua

SEQ ID NO: 221893 - RNA, 18 nt, Human
uuccauagcaguguagcc

SEQ ID NO: 221894 - RNA, 22 nt, Human
uuccuggguauuuuacagguuu

SEQ ID NO: 221895 - RNA, 20 nt, Human
uucgcuggauugaauacaca

SEQ ID NO: 221896 - RNA, 18 nt, Human
uucuucuguaaaccucag

SEQ ID NO: 221897 - RNA, 23 nt, Human
uugguugugaguuuucagaugug

SEQ ID NO: 221898 - RNA, 21 nt, Human
uuucuugguugugaguuuuca

SEQ ID NO: 221899 - RNA, 26 nt, Human
ccagccucacuuauccagacuugcuc

SEQ ID NO: 221900 - RNA, 20 nt, Human
cccggcgccaacucccccug

SEQ ID NO: 221901 - RNA, 18 nt, Human
cgcgccccccuccccggc

SEQ ID NO: 221902 - RNA, 23 nt, Human
cgcgccccccuccccggcgccaa

SEQ ID NO: 221903 - RNA, 18 nt, Human
cuccccggcgccaacucc

SEQ ID NO: 221904 - RNA, 19 nt, Human
ucccccuggcggccgcucc

SEQ ID NO: 221905 - RNA, 18 nt, Human
aaccuggggggaaggggc

SEQ ID NO: 221906 - RNA, 21 nt, Human
aagcccagugucuuggggaca

SEQ ID NO: 221907 - RNA, 20 nt, Human
aaggacggggucgggggugg

SEQ ID NO: 221908 - RNA, 20 nt, Human
aaggcucugagcuucugacg

SEQ ID NO: 221909 - RNA, 21 nt, Human
aagggagcugucuggacaaaa

SEQ ID NO: 221910 - RNA, 24 nt, Human
acggggucggggguggggggcggu

SEQ ID NO: 221911 - RNA, 19 nt, Human
acucaagauccagcaacag

SEQ ID NO: 221912 - RNA, 22 nt, Human
agagagcagggaggaggggcgg

SEQ ID NO: 221913 - RNA, 24 nt, Human
agagggacaucuuuaaagggucca

SEQ ID NO: 221914 - RNA, 22 nt, Human
agcagggaggaggggcggggcc

SEQ ID NO: 221915 - RNA, 18 nt, Human
agcccagugucuugggga

SEQ ID NO: 221916 - RNA, 20 nt, Human
agcgaagcuggcagugcccu

SEQ ID NO: 221917 - RNA, 24 nt, Human
aggacggggucggggguggggggc

SEQ ID NO: 221918 - RNA, 25 nt, Human
aggcaggggguggggucugcaaggg

SEQ ID NO: 221919 - RNA, 20 nt, Human
aggcggugacaagagcccgg

SEQ ID NO: 221920 - RNA, 21 nt, Human
aggcggugacaagagcccggg

SEQ ID NO: 221921 - RNA, 18 nt, Human
agggacaucuuuaaaggg

SEQ ID NO: 221922 - RNA, 21 nt, Human
agggaggaggggcggggcggg

SEQ ID NO: 221923 - RNA, 18 nt, Human
aggggguggggucugcaa

SEQ ID NO: 221924 - RNA, 19 nt, Human
aggggguggggucugcaag

SEQ ID NO: 221925 - RNA, 19 nt, Human
caagggaggcgggaccggu

SEQ ID NO: 221926 - RNA, 20 nt, Human
caagggggcugaguggagcg

SEQ ID NO: 221927 - RNA, 24 nt, Human
caggggguggggucugcaaggggg

SEQ ID NO: 221928 - RNA, 18 nt, Human
cagugggggggggguggg

SEQ ID NO: 221929 - RNA, 21 nt, Human
caguggggggggggugggggg

SEQ ID NO: 221930 - RNA, 22 nt, Human
ccagaagauucuaaggacgggg

SEQ ID NO: 221931 - RNA, 24 nt, Human
ccagcaacagugugugugguuucu

SEQ ID NO: 221932 - RNA, 21 nt, Human
ccaggagcagugggggggggg

SEQ ID NO: 221933 - RNA, 23 nt, Human
cccucccagccauucccaauugc

SEQ ID NO: 221934 - RNA, 23 nt, Human
cgaagcuggcagugcccuugggg

SEQ ID NO: 221935 - RNA, 21 nt, Human
cggggcuguggcugggaggag

SEQ ID NO: 221936 - RNA, 21 nt, Human
cggggguggggggcggugagg

SEQ ID NO: 221937 - RNA, 18 nt, Human
cggggucggggguggggg

SEQ ID NO: 221938 - RNA, 22 nt, Human
cggugaggcggagggcugggga

SEQ ID NO: 221939 - RNA, 21 nt, Human
cguaggagggagggcuugggg

SEQ ID NO: 221940 - RNA, 19 nt, Human
cgucaagggaggcgggacc

SEQ ID NO: 221941 - RNA, 18 nt, Human
cugacgggugcgggaagg

SEQ ID NO: 221942 - RNA, 22 nt, Human
cuguggcugggaggaguggggc

SEQ ID NO: 221943 - RNA, 19 nt, Human
cuuuaaaggguccaagaag

SEQ ID NO: 221944 - RNA, 19 nt, Human
gacggggucgggggugggg

SEQ ID NO: 221945 - RNA, 19 nt, Human
gagagcaggcagggggugg

SEQ ID NO: 221946 - RNA, 20 nt, Human
gagcaggcaggggguggggu

SEQ ID NO: 221947 - RNA, 19 nt, Human
gagcucuguggcuuuucca

SEQ ID NO: 221948 - RNA, 19 nt, Human
gaggaggagcgagguagcg

SEQ ID NO: 221949 - RNA, 23 nt, Human
gaggcuccuccagaagauucuaa

SEQ ID NO: 221950 - RNA, 19 nt, Human
gagucggggccgccaauga

SEQ ID NO: 221951 - RNA, 21 nt, Human
gcaggggcggggacacggggg

SEQ ID NO: 221952 - RNA, 22 nt, Human
gcaguggggggggggugggggg

SEQ ID NO: 221953 - RNA, 19 nt, Human
gcccuuggggaaucagaug

SEQ ID NO: 221954 - RNA, 23 nt, Human
gcggggcgggaggggcggggacg

SEQ ID NO: 221955 - RNA, 28 nt, Human
gcuccuccagaagauucuaaggacgggg

SEQ ID NO: 221956 - RNA, 21 nt, Human
ggacucaagauccagcaacag

SEQ ID NO: 221957 - RNA, 22 nt, Human
ggaggaggggcggggcggggcg

SEQ ID NO: 221958 - RNA, 18 nt, Human
ggagguggggcggggcug

SEQ ID NO: 221959 - RNA, 21 nt, Human
ggcaggggguggggucugcaa

SEQ ID NO: 221960 - RNA, 21 nt, Human
ggcggggcugggggcugaccu

SEQ ID NO: 221961 - RNA, 19 nt, Human
ggcugggggcugaccuagu

SEQ ID NO: 221962 - RNA, 23 nt, Human
gggcuggggagagggacaucuuu

SEQ ID NO: 221963 - RNA, 18 nt, Human
ggggcggggcgggagggg

SEQ ID NO: 221964 - RNA, 21 nt, Human
ggggcugggggcugaccuagu

SEQ ID NO: 221965 - RNA, 22 nt, Human
gggggcggggcgggaggggcgg

SEQ ID NO: 221966 - RNA, 23 nt, Human
ggggggagggaggcuccuccaga

SEQ ID NO: 221967 - RNA, 25 nt, Human
gggggggagggaggcuccuccagaa

SEQ ID NO: 221968 - RNA, 18 nt, Human
ggggguggggggggaggg

SEQ ID NO: 221969 - RNA, 21 nt, Human
ggggguggggggggagggagg

SEQ ID NO: 221970 - RNA, 23 nt, Human
ggggguggggggggagggaggcu

SEQ ID NO: 221971 - RNA, 19 nt, Human
ggggucggggguggggggc

SEQ ID NO: 221972 - RNA, 20 nt, Human
gggguggggggcggugaggc

SEQ ID NO: 221973 - RNA, 22 nt, Human
gggguggggucugcaagggggc

SEQ ID NO: 221974 - RNA, 21 nt, Human
ggguggggucugcaagggggc

SEQ ID NO: 221975 - RNA, 25 nt, Human
gugacaagagcccggggggaggggg

SEQ ID NO: 221976 - RNA, 18 nt, Human
gugggggggggguggggg

SEQ ID NO: 221977 - RNA, 21 nt, Human
uccaagaaggcucugagcuuc

SEQ ID NO: 221978 - RNA, 19 nt, Human
uccaggagcaguggggggg

SEQ ID NO: 221979 - RNA, 19 nt, Human
ucucacagcuaaugggacu

SEQ ID NO: 221980 - RNA, 23 nt, Human
ugacaagagcccggggggagggg

SEQ ID NO: 221981 - RNA, 21 nt, Human
ugacgggugcgggaaggcucu

SEQ ID NO: 221982 - RNA, 22 nt, Human
uggcucuuucuaagagagcagg

SEQ ID NO: 221983 - RNA, 21 nt, Human
ugggggagguggggcggggcu

SEQ ID NO: 221984 - RNA, 18 nt, Human
uggggggggggugggggg

SEQ ID NO: 221985 - RNA, 21 nt, Human
ugggugggaggaggagcgagg

SEQ ID NO: 221986 - RNA, 22 nt, Human
ugggugggaggaggagcgaggu

SEQ ID NO: 221987 - RNA, 22 nt, Human
ugugugugguuucugcaaagcc

SEQ ID NO: 221988 - RNA, 20 nt, Human
aacacccuucccgaggaggc

SEQ ID NO: 221989 - RNA, 18 nt, Human
aggcgguggcggcccccu

SEQ ID NO: 221990 - RNA, 19 nt, Human
ccaaacacccuucccgagg

SEQ ID NO: 221991 - RNA, 28 nt, Human
cgaagaggaggcaggaggcgguggcggc

SEQ ID NO: 221992 - RNA, 21 nt, Human
gcaggaggcgguggcggcccc

SEQ ID NO: 221993 - RNA, 25 nt, Human
gcaggaggcgguggcggcccccucu

SEQ ID NO: 221994 - RNA, 18 nt, Human
gcccuccaaacacccuuc

SEQ ID NO: 221995 - RNA, 19 nt, Human
gcgggucuccggcuugggg

SEQ ID NO: 221996 - RNA, 20 nt, Human
ggagggggaggagacgaaga

SEQ ID NO: 221997 - RNA, 19 nt, Human
ucccgaggaggcagcguca

SEQ ID NO: 221998 - RNA, 18 nt, Human
aaaaaggcgaccuguugu

SEQ ID NO: 221999 - RNA, 29 nt, Human
aaaauacaacguccuaacaaucacccuca

SEQ ID NO: 222000 - RNA, 20 nt, Human
aaacaacaaagacguuagag

SEQ ID NO: 222001 - RNA, 18 nt, Human
aaacuauucuagaaaugg

SEQ ID NO: 222002 - RNA, 19 nt, Human
aacacccucugugucugcc

SEQ ID NO: 222003 - RNA, 25 nt, Human
aacccagccaaaucucuuccugcag

SEQ ID NO: 222004 - RNA, 19 nt, Human
aagacgaacgagagucacc

SEQ ID NO: 222005 - RNA, 24 nt, Human
aagaggaggcagaauugucaauug

SEQ ID NO: 222006 - RNA, 22 nt, Human
aagcagccaaaagucacccacu

SEQ ID NO: 222007 - RNA, 23 nt, Human
aagcagccaaaagucacccacuu

SEQ ID NO: 222008 - RNA, 20 nt, Human
aagggaagaggagagaaagc

SEQ ID NO: 222009 - RNA, 21 nt, Human
acaaaauacaacguccuaaca

SEQ ID NO: 222010 - RNA, 20 nt, Human
acaaagucaaagggccacag

SEQ ID NO: 222011 - RNA, 18 nt, Human
acccucaacagaacccag

SEQ ID NO: 222012 - RNA, 31 nt, Human
accuuccuuuccaaguagcccuucccgccag

SEQ ID NO: 222013 - RNA, 27 nt, Human
acgguauauuuuuaaaucaccuaaaac

SEQ ID NO: 222014 - RNA, 21 nt, Human
agaaacuauucuagaaauggg

SEQ ID NO: 222015 - RNA, 23 nt, Human
aggccacccucuggcacaaauaa

SEQ ID NO: 222016 - RNA, 19 nt, Human
aguaacuuuuuaaaagaug

SEQ ID NO: 222017 - RNA, 18 nt, Human
auaaacccaauagagagg

SEQ ID NO: 222018 - RNA, 18 nt, Human
augcacuuaacacaguca

SEQ ID NO: 222019 - RNA, 20 nt, Human
augccuauucugaagacaac

SEQ ID NO: 222020 - RNA, 21 nt, Human
auggcaacaaaauacaacguc

SEQ ID NO: 222021 - RNA, 18 nt, Human
auguggaguguaggauag

SEQ ID NO: 222022 - RNA, 22 nt, Human
auguugugugaguuuuuuuuuc

SEQ ID NO: 222023 - RNA, 18 nt, Human
caaaaguaggaaagucac

SEQ ID NO: 222024 - RNA, 22 nt, Human
caaaccuuccuuuccaaguagc

SEQ ID NO: 222025 - RNA, 22 nt, Human
caaaguacuagugagaaacgug

SEQ ID NO: 222026 - RNA, 25 nt, Human
caaauaagcacacaggugcagccgu

SEQ ID NO: 222027 - RNA, 19 nt, Human
caagcaaaguacuagugag

SEQ ID NO: 222028 - RNA, 20 nt, Human
caauagaauucuuucgacga

SEQ ID NO: 222029 - RNA, 24 nt, Human
caccauggaacaugaacacucagc

SEQ ID NO: 222030 - RNA, 20 nt, Human
cacccucugugucugccaaa

SEQ ID NO: 222031 - RNA, 18 nt, Human
caccuaaaacaucaaaaa

SEQ ID NO: 222032 - RNA, 19 nt, Human
cagcagcaucugcuuccgc

SEQ ID NO: 222033 - RNA, 19 nt, Human
cagccaaaagucacccacu

SEQ ID NO: 222034 - RNA, 22 nt, Human
cagcucaggugcagugugacag

SEQ ID NO: 222035 - RNA, 25 nt, Human
caucugcuuccgcgcagaacgcgcc

SEQ ID NO: 222036 - RNA, 24 nt, Human
ccaaaagucacccacuuccuccag

SEQ ID NO: 222037 - RNA, 22 nt, Human
ccccacgucucucuuugggggu

SEQ ID NO: 222038 - RNA, 18 nt, Human
ccuaaaaccuggccacac

SEQ ID NO: 222039 - RNA, 20 nt, Human
ccuuacaccuacccuucuca

SEQ ID NO: 222040 - RNA, 22 nt, Human
ccuuuccaaguagcccuucccg

SEQ ID NO: 222041 - RNA, 24 nt, Human
cggaaagggaagaggagagaaagc

SEQ ID NO: 222042 - RNA, 18 nt, Human
cuaaaaccuggccacacc

SEQ ID NO: 222043 - RNA, 22 nt, Human
cuccaaaggucuauuuuuuucc

SEQ ID NO: 222044 - RNA, 18 nt, Human
cuccccggcacagucugg

SEQ ID NO: 222045 - RNA, 20 nt, Human
cucuguauaacaggucaaac

SEQ ID NO: 222046 - RNA, 25 nt, Human
cugcaggugggcuaggccacccucu

SEQ ID NO: 222047 - RNA, 19 nt, Human
cuuugcaucaucaaacucc

SEQ ID NO: 222048 - RNA, 18 nt, Human
cuuuuccauaaacaacaa

SEQ ID NO: 222049 - RNA, 21 nt, Human
gaagcagccaaaagucaccca

SEQ ID NO: 222050 - RNA, 18 nt, Human
gagcucaggagcuggcag

SEQ ID NO: 222051 - RNA, 22 nt, Human
gcagcagcaucugcuuccgcgc

SEQ ID NO: 222052 - RNA, 20 nt, Human
gcaggugggcuaggccaccc

SEQ ID NO: 222053 - RNA, 19 nt, Human
gcagugguuacgguggggg

SEQ ID NO: 222054 - RNA, 21 nt, Human
gccacccucuggcacaaauaa

SEQ ID NO: 222055 - RNA, 20 nt, Human
gccccacgucucucuuuggg

SEQ ID NO: 222056 - RNA, 18 nt, Human
ggaacccuuacaccuacc

SEQ ID NO: 222057 - RNA, 19 nt, Human
ggaaucaaaagacauagua

SEQ ID NO: 222058 - RNA, 25 nt, Human
ggucaacuccuuuuuuucuaguuuu

SEQ ID NO: 222059 - RNA, 23 nt, Human
gugcacccggaaagggaagagga

SEQ ID NO: 222060 - RNA, 19 nt, Human
gugcagugugacaguuaca

SEQ ID NO: 222061 - RNA, 20 nt, Human
gugcugccuuccugaauggc

SEQ ID NO: 222062 - RNA, 20 nt, Human
guggaccaaaaaauauuacu

SEQ ID NO: 222063 - RNA, 24 nt, Human
guucucagaagggcaacuuucccu

SEQ ID NO: 222064 - RNA, 19 nt, Human
uaaaaaguuaccuaaaacc

SEQ ID NO: 222065 - RNA, 21 nt, Human
uaaagcacuccaguguaucuc

SEQ ID NO: 222066 - RNA, 27 nt, Human
uaaaucaccuaaaacaucaaaaaguuu

SEQ ID NO: 222067 - RNA, 23 nt, Human
uaaauguacagagaucaacuuug

SEQ ID NO: 222068 - RNA, 18 nt, Human
uaacuuuuuaaaagaugu

SEQ ID NO: 222069 - RNA, 26 nt, Human
uaagauuggaagcuuugugguaaaga

SEQ ID NO: 222070 - RNA, 26 nt, Human
uaauggcaacaaaauacaacguccua

SEQ ID NO: 222071 - RNA, 18 nt, Human
uacaaaaguaggaaaguc

SEQ ID NO: 222072 - RNA, 21 nt, Human
uacaaaaguaggaaagucacu

SEQ ID NO: 222073 - RNA, 24 nt, Human
uacauagugauauauccaguaucu

SEQ ID NO: 222074 - RNA, 19 nt, Human
uaccguaucuauaaggauc

SEQ ID NO: 222075 - RNA, 20 nt, Human
uaccuggccaagugcgcgcc

SEQ ID NO: 222076 - RNA, 25 nt, Human
uaggaaugaagccaguucuucccaa

SEQ ID NO: 222077 - RNA, 18 nt, Human
uauucaagaucuaaagca

SEQ ID NO: 222078 - RNA, 21 nt, Human
uauucugaagacaacauaagg

SEQ ID NO: 222079 - RNA, 21 nt, Human
ucaacagaacccagccaaauc

SEQ ID NO: 222080 - RNA, 18 nt, Human
uccaaaagccuaauaaaa

SEQ ID NO: 222081 - RNA, 18 nt, Human
uccaagacagguauuugg

SEQ ID NO: 222082 - RNA, 19 nt, Human
uccaaguagcccuucccgc

SEQ ID NO: 222083 - RNA, 20 nt, Human
uccccaugagaaauacugca

SEQ ID NO: 222084 - RNA, 21 nt, Human
ucccccacgucuacaaacacc

SEQ ID NO: 222085 - RNA, 23 nt, Human
ucccccacgucuacaaacacccu

SEQ ID NO: 222086 - RNA, 27 nt, Human
ucuacaaacacccucugugucugccaa

SEQ ID NO: 222087 - RNA, 27 nt, Human
ucuacaaacacccucugugucugccaa

SEQ ID NO: 222088 - RNA, 21 nt, Human
ucuacaaugggucaccgaagc

SEQ ID NO: 222089 - RNA, 20 nt, Human
ucuuuccauguacagaagcu

SEQ ID NO: 222090 - RNA, 18 nt, Human
ugaaaauagaacuucucc

SEQ ID NO: 222091 - RNA, 19 nt, Human
ugaagccaguucuucccaa

SEQ ID NO: 222092 - RNA, 23 nt, Human
ugaauaaaaacuuugcauuugac

SEQ ID NO: 222093 - RNA, 23 nt, Human
ugagauucuuuucacagccaggg

SEQ ID NO: 222094 - RNA, 25 nt, Human
ugcacagaaauuaccccuuucuaca

SEQ ID NO: 222095 - RNA, 19 nt, Human
ugcuucaaagaauucuagc

SEQ ID NO: 222096 - RNA, 21 nt, Human
ugcuucaaagaauucuagcau

SEQ ID NO: 222097 - RNA, 22 nt, Human
uggaaugaauaaaaacuuugca

SEQ ID NO: 222098 - RNA, 18 nt, Human
uggaggugaugugcagug

SEQ ID NO: 222099 - RNA, 23 nt, Human
uggcacaaauaagcacacaggug

SEQ ID NO: 222100 - RNA, 23 nt, Human
ugguuggauuaaucccuuuuuau

SEQ ID NO: 222101 - RNA, 26 nt, Human
uguacagagaucaacuuugcaucauc

SEQ ID NO: 222102 - RNA, 24 nt, Human
uguaggauagagaagacgaacgag

SEQ ID NO: 222103 - RNA, 19 nt, Human
uuacucuguauaacagguc

SEQ ID NO: 222104 - RNA, 23 nt, Human
uuagauuuacuaaugagcauccc

SEQ ID NO: 222105 - RNA, 18 nt, Human
uuauucucaaaauguauu

SEQ ID NO: 222106 - RNA, 19 nt, Human
uuccaaguagcccuucccg

SEQ ID NO: 222107 - RNA, 21 nt, Human
uuccugauacaacaguuguac

SEQ ID NO: 222108 - RNA, 19 nt, Human
uucugagaugauugauccu

SEQ ID NO: 222109 - RNA, 24 nt, Human
uuucuaguuuucgacaaggggauu

SEQ ID NO: 222110 - RNA, 19 nt, Human
uuugauuucuccccggcac

SEQ ID NO: 222111 - RNA, 18 nt, Human
aaaggggggagggagugg

SEQ ID NO: 222112 - RNA, 18 nt, Human
aagucucagugcuagggg

SEQ ID NO: 222113 - RNA, 24 nt, Human
aauaguggggaaaggggggaggga

SEQ ID NO: 222114 - RNA, 21 nt, Human
acccacucuggcccucugucc

SEQ ID NO: 222115 - RNA, 33 nt, Human
accccaccacccucccuuccucuggccccagga

SEQ ID NO: 222116 - RNA, 21 nt, Human
accucagccuguugcugacau

SEQ ID NO: 222117 - RNA, 21 nt, Human
agguaacuuugcccagucccu

SEQ ID NO: 222118 - RNA, 22 nt, Human
agugcgauuucaggucuggaac

SEQ ID NO: 222119 - RNA, 18 nt, Human
aguucagcaaaccccuuu

SEQ ID NO: 222120 - RNA, 26 nt, Human
auggggcaggcagaaauaguggggaa

SEQ ID NO: 222121 - RNA, 19 nt, Human
cagcaaaccccuuuuucuu

SEQ ID NO: 222122 - RNA, 24 nt, Human
cagcgugaaccucaggugccccuu

SEQ ID NO: 222123 - RNA, 22 nt, Human
cccaaaccgcuccggguuucca

SEQ ID NO: 222124 - RNA, 23 nt, Human
ccccaccacccucccuuccucug

SEQ ID NO: 222125 - RNA, 21 nt, Human
ccccuuuuucuugcagugcga

SEQ ID NO: 222126 - RNA, 19 nt, Human
ccgagcuggagaacuuugc

SEQ ID NO: 222127 - RNA, 20 nt, Human
ccucccuuccucuggcccca

SEQ ID NO: 222128 - RNA, 20 nt, Human
cgaagcgccccaaaccgcuu

SEQ ID NO: 222129 - RNA, 21 nt, Human
cgugaaccucaggugccccuu

SEQ ID NO: 222130 - RNA, 20 nt, Human
cuacccacucuggcccucug

SEQ ID NO: 222131 - RNA, 26 nt, Human
cuaccucuuuuuccuuccaggcacaa

SEQ ID NO: 222132 - RNA, 24 nt, Human
cuagggguacaauggggcaggcag

SEQ ID NO: 222133 - RNA, 22 nt, Human
cuccggguuuccacuuucagcc

SEQ ID NO: 222134 - RNA, 23 nt, Human
cucuugggccggcagccgcgcgg

SEQ ID NO: 222135 - RNA, 21 nt, Human
gcaggaauuuaguugagucca

SEQ ID NO: 222136 - RNA, 24 nt, Human
gccccaaaccgcuccggguuucca

SEQ ID NO: 222137 - RNA, 27 nt, Human
gccgaccccaccacccucccuuccucu

SEQ ID NO: 222138 - RNA, 22 nt, Human
gcuccggguuuccacuuucagc

SEQ ID NO: 222139 - RNA, 23 nt, Human
gcuccggguuuccacuuucagcc

SEQ ID NO: 222140 - RNA, 22 nt, Human
ggacuggcccccagccucuggu

SEQ ID NO: 222141 - RNA, 19 nt, Human
ggccgcgacggcccuuggc

SEQ ID NO: 222142 - RNA, 22 nt, Human
gggcaggcagaaauagugggga

SEQ ID NO: 222143 - RNA, 18 nt, Human
ggggaaaggggggaggga

SEQ ID NO: 222144 - RNA, 21 nt, Human
ggggggagggaguggucucag

SEQ ID NO: 222145 - RNA, 21 nt, Human
ggugccccuuugcuaccucuu

SEQ ID NO: 222146 - RNA, 21 nt, Human
gucuggaaccucagccuguug

SEQ ID NO: 222147 - RNA, 23 nt, Human
ucaacacuaagcaagcgcaggaa

SEQ ID NO: 222148 - RNA, 19 nt, Human
ucaggugccccuuugcuac

SEQ ID NO: 222149 - RNA, 20 nt, Human
ucauuccccacuacccacuc

SEQ ID NO: 222150 - RNA, 20 nt, Human
ucauuccccacuacccacuc

SEQ ID NO: 222151 - RNA, 18 nt, Human
uccccggggccgcgacgg

SEQ ID NO: 222152 - RNA, 24 nt, Human
uccggguuuccacuuucagccauu

SEQ ID NO: 222153 - RNA, 22 nt, Human
uccuuccaggcacaagucucag

SEQ ID NO: 222154 - RNA, 22 nt, Human
ucucagugaccacccaccaaca

SEQ ID NO: 222155 - RNA, 27 nt, Human
ugaccacccaccaacaugccagucccc

SEQ ID NO: 222156 - RNA, 22 nt, Human
ugcccagucccuucccgucccc

SEQ ID NO: 222157 - RNA, 23 nt, Human
ugcgaagcgccccaaaccgcucc

SEQ ID NO: 222158 - RNA, 22 nt, Human
ugcuagggguacaauggggcag

SEQ ID NO: 222159 - RNA, 22 nt, Human
uggccccagugagaugcaguau

SEQ ID NO: 222160 - RNA, 20 nt, Human
aagagagagggagggaaaag

SEQ ID NO: 222161 - RNA, 20 nt, Human
aagcagacacugcaauaaca

SEQ ID NO: 222162 - RNA, 23 nt, Human
acagcgguagcacccagcucucc

SEQ ID NO: 222163 - RNA, 19 nt, Human
agaggagaggcauuuggaa

SEQ ID NO: 222164 - RNA, 26 nt, Human
agcuaccaaaaaucaggcguuaccac

SEQ ID NO: 222165 - RNA, 24 nt, Human
agcuggacugcugcagucggccug

SEQ ID NO: 222166 - RNA, 19 nt, Human
cagaagauggcauagcuac

SEQ ID NO: 222167 - RNA, 21 nt, Human
cagcaaucuggggcugugguu

SEQ ID NO: 222168 - RNA, 22 nt, Human
cagccccuggagcagcugccag

SEQ ID NO: 222169 - RNA, 18 nt, Human
cauugcuucaguucagug

SEQ ID NO: 222170 - RNA, 23 nt, Human
ccaggacgcugcugaccuuuccc

SEQ ID NO: 222171 - RNA, 20 nt, Human
cccccuuccgucccccauua

SEQ ID NO: 222172 - RNA, 22 nt, Human
ccccugggcgaggggaagcgag

SEQ ID NO: 222173 - RNA, 22 nt, Human
cccguugagcacuccucccccu

SEQ ID NO: 222174 - RNA, 24 nt, Human
ccuggaagggaguuggggguggaa

SEQ ID NO: 222175 - RNA, 21 nt, Human
ccuuuauuaccugccucugac

SEQ ID NO: 222176 - RNA, 23 nt, Human
cgcugcugaccuuucccccuggg

SEQ ID NO: 222177 - RNA, 25 nt, Human
cuccaggacgcugcugaccuuuccc

SEQ ID NO: 222178 - RNA, 21 nt, Human
cucccugcugaaagagagagg

SEQ ID NO: 222179 - RNA, 21 nt, Human
cuuccagacaaggucuccugg

SEQ ID NO: 222180 - RNA, 21 nt, Human
gaagagggagaaacuggcccg

SEQ ID NO: 222181 - RNA, 21 nt, Human
gaagagggagaaacuggcccg

SEQ ID NO: 222182 - RNA, 21 nt, Human
gagcgugcugucagggcuguc

SEQ ID NO: 222183 - RNA, 18 nt, Human
gaugagcgagaugaggag

SEQ ID NO: 222184 - RNA, 18 nt, Human
gcaacuggaagcuggacu

SEQ ID NO: 222185 - RNA, 21 nt, Human
gcugcagucggccugcaaccc

SEQ ID NO: 222186 - RNA, 21 nt, Human
ggcaacuggaagcuggacugc

SEQ ID NO: 222187 - RNA, 21 nt, Human
ggccuuccagacaaggucucc

SEQ ID NO: 222188 - RNA, 23 nt, Human
gggcucagcagcggaaacagcgg

SEQ ID NO: 222189 - RNA, 19 nt, Human
ggugcaggggugaagaggg

SEQ ID NO: 222190 - RNA, 19 nt, Human
gucccuaaggcaacuggaa

SEQ ID NO: 222191 - RNA, 18 nt, Human
gucccuggcagccccugg

SEQ ID NO: 222192 - RNA, 18 nt, Human
gugcaggggugaagaggg

SEQ ID NO: 222193 - RNA, 25 nt, Human
guggaaggugggaggcgcgcccagg

SEQ ID NO: 222194 - RNA, 20 nt, Human
guuaccacugggaugaaaac

SEQ ID NO: 222195 - RNA, 20 nt, Human
uaaguucauucuaucccaca

SEQ ID NO: 222196 - RNA, 22 nt, Human
uaauccucagcagaagauggca

SEQ ID NO: 222197 - RNA, 20 nt, Human
uccacggaugaagcagacac

SEQ ID NO: 222198 - RNA, 25 nt, Human
uccacggaugaagcagaccgggguc

SEQ ID NO: 222199 - RNA, 19 nt, Human
ucccccugggcgaggggaa

SEQ ID NO: 222200 - RNA, 23 nt, Human
ucccuaaggcaacuggaagcugg

SEQ ID NO: 222201 - RNA, 18 nt, Human
ucuccuggccucucacca

SEQ ID NO: 222202 - RNA, 21 nt, Human
ucuccuggccucucaccauua

SEQ ID NO: 222203 - RNA, 22 nt, Human
ugcuucuccuuccagggccuuc

SEQ ID NO: 222204 - RNA, 18 nt, Human
uggaagggaguugggggg

SEQ ID NO: 222205 - RNA, 21 nt, Human
uggaaggugcaggggugaaga

SEQ ID NO: 222206 - RNA, 18 nt, Human
ugggaugaaaacugggga

SEQ ID NO: 222207 - RNA, 19 nt, Human
aacaaagagcaaggaacuc

SEQ ID NO: 222208 - RNA, 23 nt, Human
aagcaagcauaaaucacugagau

SEQ ID NO: 222209 - RNA, 26 nt, Human
caacaaagagcaaggaacucacuuuu

SEQ ID NO: 222210 - RNA, 18 nt, Human
caagcaagcauaaaucac

SEQ ID NO: 222211 - RNA, 19 nt, Human
caagcaagcauaaaucacu

SEQ ID NO: 222212 - RNA, 24 nt, Human
caagcaagcauaaaucacugagau

SEQ ID NO: 222213 - RNA, 23 nt, Human
cagcacaaaauauugcuccaaca

SEQ ID NO: 222214 - RNA, 21 nt, Human
ccaacaagcaagcauaaauca

SEQ ID NO: 222215 - RNA, 26 nt, Human
cuccaacaagcaagcauaagguaccc

SEQ ID NO: 222216 - RNA, 24 nt, Human
gaaaauucucaacaaagagcaagg

SEQ ID NO: 222217 - RNA, 20 nt, Human
ugagauugaaaugucaucua

SEQ ID NO: 222218 - RNA, 19 nt, Human
ugccucguggcacuggcau

SEQ ID NO: 222219 - RNA, 18 nt, Human
uggcaucucuucaugucu

SEQ ID NO: 222220 - RNA, 23 nt, Human
uggccaaccacauaaucuccaug

SEQ ID NO: 222221 - RNA, 19 nt, Human
aacagggauugaggugggg

SEQ ID NO: 222222 - RNA, 19 nt, Human
acugggcucucaaucaguu

SEQ ID NO: 222223 - RNA, 24 nt, Human
cagacgcaauccccaggugucuug

SEQ ID NO: 222224 - RNA, 22 nt, Human
cugcuggcaaauccacugggcu

SEQ ID NO: 222225 - RNA, 19 nt, Human
cuuccaccgucccagcccu

SEQ ID NO: 222226 - RNA, 21 nt, Human
gcucucaaucaguuucaagga

SEQ ID NO: 222227 - RNA, 20 nt, Human
ggaggccccagacgcaaucc

SEQ ID NO: 222228 - RNA, 28 nt, Human
guccacagcagaguucuggaggccccag

SEQ ID NO: 222229 - RNA, 22 nt, Human
uccacagcagaguucuggaggc

SEQ ID NO: 222230 - RNA, 18 nt, Human
uccccaggugucuugguc

SEQ ID NO: 222231 - RNA, 22 nt, Human
acccaucuguccaccgccuggu

SEQ ID NO: 222232 - RNA, 19 nt, Human
agccugcgggggcgcgccg

SEQ ID NO: 222233 - RNA, 23 nt, Human
aggcaugcacccggcggcggggc

SEQ ID NO: 222234 - RNA, 24 nt, Human
aggccgcggccuccacucguccca

SEQ ID NO: 222235 - RNA, 23 nt, Human
cacaccccucccucccgggcucc

SEQ ID NO: 222236 - RNA, 19 nt, Human
caccccucccucccgggcu

SEQ ID NO: 222237 - RNA, 21 nt, Human
caccccucccucccgggcucc

SEQ ID NO: 222238 - RNA, 23 nt, Human
cagcccuucugugcugucgauga

SEQ ID NO: 222239 - RNA, 28 nt, Human
cagccgccgccgccgcugccgcuggggg

SEQ ID NO: 222240 - RNA, 21 nt, Human
caggcagcggcggcagguccc

SEQ ID NO: 222241 - RNA, 26 nt, Human
ccaccgccugguccaucucugccuga

SEQ ID NO: 222242 - RNA, 20 nt, Human
cccccugcagccgccgccgc

SEQ ID NO: 222243 - RNA, 20 nt, Human
ccccgcgcccccugcagccg

SEQ ID NO: 222244 - RNA, 18 nt, Human
cccgcgcgcgcccucgca

SEQ ID NO: 222245 - RNA, 18 nt, Human
ccgccgccgccgcugccg

SEQ ID NO: 222246 - RNA, 21 nt, Human
ccuccccgcgcgcgcccucgc

SEQ ID NO: 222247 - RNA, 20 nt, Human
ccucccucccgggcuccugg

SEQ ID NO: 222248 - RNA, 22 nt, Human
ccucccucccgggcuccuggac

SEQ ID NO: 222249 - RNA, 18 nt, Human
ccuccugcgggagcgggg

SEQ ID NO: 222250 - RNA, 19 nt, Human
ccugcggggaagggcgguc

SEQ ID NO: 222251 - RNA, 23 nt, Human
cgagccuuuucuaaacacaaagc

SEQ ID NO: 222252 - RNA, 21 nt, Human
cgccccgcgcccccugcagcc

SEQ ID NO: 222253 - RNA, 23 nt, Human
cgccccggggcgcgcaggcagcg

SEQ ID NO: 222254 - RNA, 20 nt, Human
cgccugguccaucucugccu

SEQ ID NO: 222255 - RNA, 18 nt, Human
cggcuccugcacaccccu

SEQ ID NO: 222256 - RNA, 20 nt, Human
cggcuccugcacaccccucc

SEQ ID NO: 222257 - RNA, 24 nt, Human
cucccgggcuccuggacagcaggc

SEQ ID NO: 222258 - RNA, 18 nt, Human
cucgcagccuccgccccg

SEQ ID NO: 222259 - RNA, 19 nt, Human
cucgcagccuccgccccgc

SEQ ID NO: 222260 - RNA, 22 nt, Human
cucgucccacacggcccugcgg

SEQ ID NO: 222261 - RNA, 18 nt, Human
cuucugugcugucgauga

SEQ ID NO: 222262 - RNA, 18 nt, Human
cuuugcccgagccuuuuc

SEQ ID NO: 222263 - RNA, 26 nt, Human
gagggccuucagagucuguccagggg

SEQ ID NO: 222264 - RNA, 19 nt, Human
gcagagagcgaacuugggc

SEQ ID NO: 222265 - RNA, 20 nt, Human
gcagcagccugcgggggcgc

SEQ ID NO: 222266 - RNA, 20 nt, Human
gcagccgccgccgccgcugc

SEQ ID NO: 222267 - RNA, 22 nt, Human
gccccggggcgcgcaggcagcg

SEQ ID NO: 222268 - RNA, 22 nt, Human
gcccgggcgagcccgcgggggc

SEQ ID NO: 222269 - RNA, 20 nt, Human
gccgccgccgccgcugccgc

SEQ ID NO: 222270 - RNA, 20 nt, Human
gccggccucgcccggggcac

SEQ ID NO: 222271 - RNA, 21 nt, Human
gcggccgccggccucgcccgg

SEQ ID NO: 222272 - RNA, 20 nt, Human
gcuucagcucggccuccugc

SEQ ID NO: 222273 - RNA, 21 nt, Human
ggcagaggugccgggagggcc

SEQ ID NO: 222274 - RNA, 25 nt, Human
ggcucggggcuggcauccgggcgcc

SEQ ID NO: 222275 - RNA, 18 nt, Human
ggcuggcauccgggcgcc

SEQ ID NO: 222276 - RNA, 19 nt, Human
gggagagccuggccggcgc

SEQ ID NO: 222277 - RNA, 23 nt, Human
gggcuuuggcggccgccggccuc

SEQ ID NO: 222278 - RNA, 20 nt, Human
ggggaagggcggucacagcg

SEQ ID NO: 222279 - RNA, 27 nt, Human
ucaccccggcuggcuggcggcgcgcuc

SEQ ID NO: 222280 - RNA, 21 nt, Human
uccaggggaggguugggggga

SEQ ID NO: 222281 - RNA, 18 nt, Human
ucccacacggcccugcgg

SEQ ID NO: 222282 - RNA, 23 nt, Human
ugcacaccccucccucccgggcu

SEQ ID NO: 222283 - RNA, 20 nt, Human
ugcgggggcgcgccgcgggg

SEQ ID NO: 222284 - RNA, 21 nt, Human
uggcaccguccuccgccccgg

SEQ ID NO: 222285 - RNA, 20 nt, Human
uggcauccgggcgcccgggc

SEQ ID NO: 222286 - RNA, 18 nt, Human
uucagcucggccuccugc

SEQ ID NO: 222287 - RNA, 22 nt, Human
uugggcuggcuuugcccgagcc

SEQ ID NO: 222288 - RNA, 20 nt, Human
uuuauugagggagauacaga

SEQ ID NO: 222289 - RNA, 24 nt, Human
uuuuuuuuugcacagagcaggagg

SEQ ID NO: 222290 - RNA, 21 nt, Human
uuuuuuuuuuuugcacagagc

SEQ ID NO: 222291 - RNA, 22 nt, Human
uuuuuuuuuuuuuuuugcacag

SEQ ID NO: 222292 - RNA, 20 nt, Human
agcaggaaacuggccucggg

SEQ ID NO: 222293 - RNA, 21 nt, Human
cagcagcucgggguccggcgg

SEQ ID NO: 222294 - RNA, 18 nt, Human
cagcaggaaacuggccuc

SEQ ID NO: 222295 - RNA, 18 nt, Human
cagcucgggguccggcgg

SEQ ID NO: 222296 - RNA, 18 nt, Human
ccucccagcagcucgggg

SEQ ID NO: 222297 - RNA, 22 nt, Human
ccucggggcccgcacgcagucc

SEQ ID NO: 222298 - RNA, 19 nt, Human
cgaagcgccccaugcgccc

SEQ ID NO: 222299 - RNA, 22 nt, Human
cgaagcgccccaugcgcccggc

SEQ ID NO: 222300 - RNA, 23 nt, Human
cgccccaugcgcccggcggggau

SEQ ID NO: 222301 - RNA, 23 nt, Human
cggcgggcguccuggcgcggcuu

SEQ ID NO: 222302 - RNA, 21 nt, Human
gcgggcguccuggcgcggcuu

SEQ ID NO: 222303 - RNA, 19 nt, Human
gcucgggguccggcgggcg

SEQ ID NO: 222304 - RNA, 22 nt, Human
ggcagggcuggcggcucccucu

SEQ ID NO: 222305 - RNA, 20 nt, Human
gggguccggcgggcguccug

SEQ ID NO: 222306 - RNA, 19 nt, Human
acaggccccaccuacugcc

SEQ ID NO: 222307 - RNA, 20 nt, Human
acugccggcccugccccugc

SEQ ID NO: 222308 - RNA, 19 nt, Human
aggagaagauggucccaag

SEQ ID NO: 222309 - RNA, 25 nt, Human
aggagaagauggucccaagggcugg

SEQ ID NO: 222310 - RNA, 20 nt, Human
aguaaauagcagaaaagucc

SEQ ID NO: 222311 - RNA, 24 nt, Human
cacaggccccaccuacugccggcc

SEQ ID NO: 222312 - RNA, 19 nt, Human
caccgcgccaagcgagcac

SEQ ID NO: 222313 - RNA, 19 nt, Human
caguggggggaccacaggc

SEQ ID NO: 222314 - RNA, 23 nt, Human
ccaagcgagcacgggcgcgcaca

SEQ ID NO: 222315 - RNA, 24 nt, Human
ccagcagcgccuugaucccugggu

SEQ ID NO: 222316 - RNA, 21 nt, Human
ccagggccgggugccuccggg

SEQ ID NO: 222317 - RNA, 23 nt, Human
cccacccacccggcgacgcacua

SEQ ID NO: 222318 - RNA, 18 nt, Human
cccagggccgggugccuc

SEQ ID NO: 222319 - RNA, 20 nt, Human
cccugccccugccccucuca

SEQ ID NO: 222320 - RNA, 18 nt, Human
ccuacugccggcccugcc

SEQ ID NO: 222321 - RNA, 21 nt, Human
ccucagggcaguggggggacc

SEQ ID NO: 222322 - RNA, 19 nt, Human
ccucccgccuccccuccga

SEQ ID NO: 222323 - RNA, 22 nt, Human
ccucccgccuccccuccgaccc

SEQ ID NO: 222324 - RNA, 23 nt, Human
ccucccgccuccccuccgaccgg

SEQ ID NO: 222325 - RNA, 26 nt, Human
ccucgcucgccucccgccuccccucc

SEQ ID NO: 222326 - RNA, 18 nt, Human
ccucuccccuuccacggu

SEQ ID NO: 222327 - RNA, 18 nt, Human
ccuugaggugccuaaggc

SEQ ID NO: 222328 - RNA, 22 nt, Human
ccuugaggugccuaaggcccag

SEQ ID NO: 222329 - RNA, 18 nt, Human
cgaguuccucuccccuuc

SEQ ID NO: 222330 - RNA, 23 nt, Human
cgcacagacuggacugcgggcgc

SEQ ID NO: 222331 - RNA, 21 nt, Human
cgccuugaucccugggugagc

SEQ ID NO: 222332 - RNA, 18 nt, Human
cgcuggucccgcaccgcg

SEQ ID NO: 222333 - RNA, 19 nt, Human
cucgccucccgccuccccu

SEQ ID NO: 222334 - RNA, 20 nt, Human
cuggaggccugagcaggccg

SEQ ID NO: 222335 - RNA, 18 nt, Human
gacuggacugcgggcgcg

SEQ ID NO: 222336 - RNA, 18 nt, Human
gccccugccccucucacu

SEQ ID NO: 222337 - RNA, 21 nt, Human
gcccugccccugccccucuca

SEQ ID NO: 222338 - RNA, 23 nt, Human
gccggcccugccccugccccucu

SEQ ID NO: 222339 - RNA, 20 nt, Human
ggcaguggggggaccacagg

SEQ ID NO: 222340 - RNA, 21 nt, Human
ggggcccaggggacugcagga

SEQ ID NO: 222341 - RNA, 26 nt, Human
uacugccggcccugccccugccccuc

SEQ ID NO: 222342 - RNA, 19 nt, Human
uagaccagcuaaugcccuc

SEQ ID NO: 222343 - RNA, 28 nt, Human
uauuauucauagucaucagcaucuucau

SEQ ID NO: 222344 - RNA, 20 nt, Human
ucauaugauccuuaauuauu

SEQ ID NO: 222345 - RNA, 18 nt, Human
uccacacugggcagcccc

SEQ ID NO: 222346 - RNA, 22 nt, Human
ucccgcaccgcgccaagcgagc

SEQ ID NO: 222347 - RNA, 22 nt, Human
uccucgcucgccucccgccucc

SEQ ID NO: 222348 - RNA, 21 nt, Human
uccugagcagggccuccaagg

SEQ ID NO: 222349 - RNA, 19 nt, Human
ucgaguuccucuccccuuc

SEQ ID NO: 222350 - RNA, 23 nt, Human
ucuccccuuccacggucagggcc

SEQ ID NO: 222351 - RNA, 19 nt, Human
ugagcccauggcgccgggc

SEQ ID NO: 222352 - RNA, 24 nt, Human
ugccccucucacuggggcccaggg

SEQ ID NO: 222353 - RNA, 18 nt, Human
uggggcccaggggacugc

SEQ ID NO: 222354 - RNA, 21 nt, Human
uguccacacugggcagcccca

SEQ ID NO: 222355 - RNA, 25 nt, Human
aaagcucuuccuuguccucaggccu

SEQ ID NO: 222356 - RNA, 24 nt, Human
agaggagcaggccgaggagaggcc

SEQ ID NO: 222357 - RNA, 22 nt, Human
aggcaggggcacaugcagggga

SEQ ID NO: 222358 - RNA, 23 nt, Human
aggccucugcccccagccugcag

SEQ ID NO: 222359 - RNA, 19 nt, Human
agggauccagccuauccuc

SEQ ID NO: 222360 - RNA, 20 nt, Human
caaagcucuuccuuguccuc

SEQ ID NO: 222361 - RNA, 22 nt, Human
caaaucccgggcuccaggcccc

SEQ ID NO: 222362 - RNA, 21 nt, Human
cagccugcagagggagaccgg

SEQ ID NO: 222363 - RNA, 23 nt, Human
caggagccagguccuccuuugcu

SEQ ID NO: 222364 - RNA, 24 nt, Human
caggagccagguccuccuuugcuu

SEQ ID NO: 222365 - RNA, 19 nt, Human
caggggauggcaaagcucu

SEQ ID NO: 222366 - RNA, 24 nt, Human
ccacaaaucccgggcuccaggccc

SEQ ID NO: 222367 - RNA, 20 nt, Human
cccacaaaucccgggcucca

SEQ ID NO: 222368 - RNA, 22 nt, Human
cccccagccugcagagggagac

SEQ ID NO: 222369 - RNA, 18 nt, Human
ccccccgccgggccccgc

SEQ ID NO: 222370 - RNA, 23 nt, Human
ccccccgccgggccccgcgcucc

SEQ ID NO: 222371 - RNA, 21 nt, Human
ccccucgcgcccucgccgccc

SEQ ID NO: 222372 - RNA, 20 nt, Human
cccgccccaucccuccgggg

SEQ ID NO: 222373 - RNA, 22 nt, Human
cccgcggcugcccgccccaucc

SEQ ID NO: 222374 - RNA, 24 nt, Human
ccuauccucucugagagucaggag

SEQ ID NO: 222375 - RNA, 24 nt, Human
ccucgccgcccacaaaucccgggc

SEQ ID NO: 222376 - RNA, 18 nt, Human
ccucgcgcccucgccgcc

SEQ ID NO: 222377 - RNA, 18 nt, Human
ccucgcgcccucgccgcc

SEQ ID NO: 222378 - RNA, 24 nt, Human
ccucucugagagucaggagccagg

SEQ ID NO: 222379 - RNA, 21 nt, Human
cggccgccccccgccgggccc

SEQ ID NO: 222380 - RNA, 19 nt, Human
gagaggccugccccaggga

SEQ ID NO: 222381 - RNA, 18 nt, Human
gcccugagccagcgggcc

SEQ ID NO: 222382 - RNA, 19 nt, Human
ggcgcgcgagggggcgucc

SEQ ID NO: 222383 - RNA, 20 nt, Human
gggaggucagaggagcaggc

SEQ ID NO: 222384 - RNA, 22 nt, Human
gggcccggagcauggcgcgcgg

SEQ ID NO: 222385 - RNA, 22 nt, Human
guccucaggccucugcccccag

SEQ ID NO: 222386 - RNA, 23 nt, Human
guggggaggcugccacccugccu

SEQ ID NO: 222387 - RNA, 24 nt, Human
uagaggcaggggcacaugcagggg

SEQ ID NO: 222388 - RNA, 18 nt, Human
ucccgggcuccaggcccc

SEQ ID NO: 222389 - RNA, 24 nt, Human
ucgccgcccacaaaucccgggcuc

SEQ ID NO: 222390 - RNA, 23 nt, Human
ugccccagggauccagccuaucc

SEQ ID NO: 222391 - RNA, 20 nt, Human
uggcagcacaccuggcaacu

SEQ ID NO: 222392 - RNA, 23 nt, Human
uuccaggcucccugcccugagcc

SEQ ID NO: 222393 - RNA, 22 nt, Human
uugcuuccaggcucccugcccu

SEQ ID NO: 222394 - RNA, 22 nt, Human
auauacuguuuuaauauauuaa

SEQ ID NO: 222395 - RNA, 18 nt, Human
caggccagaauccagcug

SEQ ID NO: 222396 - RNA, 24 nt, Human
ccagaauccagcuggacaugcaau

SEQ ID NO: 222397 - RNA, 27 nt, Human
cuguauauacacacauauguauauacu

SEQ ID NO: 222398 - RNA, 21 nt, Human
gcaggccagaauccagcugga

SEQ ID NO: 222399 - RNA, 22 nt, Human
uauauacacacauauguauaua

SEQ ID NO: 222400 - RNA, 23 nt, Human
uauauacacacauauguauauac

SEQ ID NO: 222401 - RNA, 25 nt, Human
uauauacacacauauguauauacug

SEQ ID NO: 222402 - RNA, 25 nt, Human
uauauauauguauauacuguauaua

SEQ ID NO: 222403 - RNA, 27 nt, Human
uauauauguauauacuguauauacaca

SEQ ID NO: 222404 - RNA, 23 nt, Human
uauauguauauacuguauauaca

SEQ ID NO: 222405 - RNA, 19 nt, Human
uauguauauacuguauaua

SEQ ID NO: 222406 - RNA, 20 nt, Human
uauuuacauaucaaaaucca

SEQ ID NO: 222407 - RNA, 24 nt, Human
uauuuacauaucaaaauccaugug

SEQ ID NO: 222408 - RNA, 18 nt, Human
ugaaagcaagugaaaaua

SEQ ID NO: 222409 - RNA, 23 nt, Human
uguauauacacacauauguauag

SEQ ID NO: 222410 - RNA, 23 nt, Human
uguauauacacacauauguauau

SEQ ID NO: 222411 - RNA, 21 nt, Human
aaacagacuuaaaagaagucu

SEQ ID NO: 222412 - RNA, 19 nt, Human
aacaacuggccggaaacac

SEQ ID NO: 222413 - RNA, 18 nt, Human
aagacaugacaagccauc

SEQ ID NO: 222414 - RNA, 19 nt, Human
aaguggugcugguuguugg

SEQ ID NO: 222415 - RNA, 18 nt, Human
aaucucuccauacaacag

SEQ ID NO: 222416 - RNA, 22 nt, Human
acaacaguuauguaagaaacag

SEQ ID NO: 222417 - RNA, 19 nt, Human
acugaaauacugaguuuuc

SEQ ID NO: 222418 - RNA, 21 nt, Human
agacaaaaguaagaucacacc

SEQ ID NO: 222419 - RNA, 20 nt, Human
agcaaggaaguggugcuggu

SEQ ID NO: 222420 - RNA, 22 nt, Human
aguaagaucacaccaggaagaa

SEQ ID NO: 222421 - RNA, 27 nt, Human
caaaacaagcggauuacauuacugcca

SEQ ID NO: 222422 - RNA, 20 nt, Human
caagccccaagcugaauagg

SEQ ID NO: 222423 - RNA, 24 nt, Human
caagccccaagcugaauagguauu

SEQ ID NO: 222424 - RNA, 24 nt, Human
caauugguuguucucagaccaagc

SEQ ID NO: 222425 - RNA, 20 nt, Human
caccaggaagaaacaagaua

SEQ ID NO: 222426 - RNA, 18 nt, Human
cacuuacuuaucaucaau

SEQ ID NO: 222427 - RNA, 25 nt, Human
caggauaaauucauccacuaaccaa

SEQ ID NO: 222428 - RNA, 31 nt, Human
cauccacuaaccaaaacugucauucacaugg

SEQ ID NO: 222429 - RNA, 22 nt, Human
ccaggaagaaacaagauaccau

SEQ ID NO: 222430 - RNA, 19 nt, Human
ccuuccucuccuuggccac

SEQ ID NO: 222431 - RNA, 22 nt, Human
ccuuggccacgcucuaucgcuc

SEQ ID NO: 222432 - RNA, 22 nt, Human
cggccuauucucugaaacccac

SEQ ID NO: 222433 - RNA, 20 nt, Human
cuaauaacaacuggccggaa

SEQ ID NO: 222434 - RNA, 24 nt, Human
cucccggccuauucucugaaaccc

SEQ ID NO: 222435 - RNA, 23 nt, Human
cuccuuggccacgcucuaucgcu

SEQ ID NO: 222436 - RNA, 22 nt, Human
cugaaacccacugaaauacuga

SEQ ID NO: 222437 - RNA, 21 nt, Human
cugaguuuuccaaggguucac

SEQ ID NO: 222438 - RNA, 19 nt, Human
ggaaaaagcaaggaagugg

SEQ ID NO: 222439 - RNA, 21 nt, Human
ggaaaaccuggcauuuacuga

SEQ ID NO: 222440 - RNA, 23 nt, Human
guucagagugagagggauuauuc

SEQ ID NO: 222441 - RNA, 23 nt, Human
uaaaaguugugccuaauaacaac

SEQ ID NO: 222442 - RNA, 19 nt, Human
uaaggucucugggcagcag

SEQ ID NO: 222443 - RNA, 22 nt, Human
uaaguacauauuuacaagacaa

SEQ ID NO: 222444 - RNA, 22 nt, Human
uaccaacaugcuaagacaugac

SEQ ID NO: 222445 - RNA, 23 nt, Human
uaccaacaugcuaagacaugaca

SEQ ID NO: 222446 - RNA, 21 nt, Human
uagcuaauauuuaccaaggua

SEQ ID NO: 222447 - RNA, 22 nt, Human
uaggugauuagagauugucccc

SEQ ID NO: 222448 - RNA, 22 nt, Human
uauuuaccaagguauuuuuagu

SEQ ID NO: 222449 - RNA, 19 nt, Human
ucacaccaggaagaaacaa

SEQ ID NO: 222450 - RNA, 18 nt, Human
ucuaugcagacugauuuc

SEQ ID NO: 222451 - RNA, 20 nt, Human
ucucccggccuauucucuga

SEQ ID NO: 222452 - RNA, 18 nt, Human
ugaaacccacugaaauac

SEQ ID NO: 222453 - RNA, 21 nt, Human
ugaaauacugaguuuuccaag

SEQ ID NO: 222454 - RNA, 18 nt, Human
ugaacauacagacauaag

SEQ ID NO: 222455 - RNA, 24 nt, Human
ugacaagccaucagcuaaggucuc

SEQ ID NO: 222456 - RNA, 22 nt, Human
uggaaaaagcaaggaaguggug

SEQ ID NO: 222457 - RNA, 23 nt, Human
uggcagaccuauuauugcacaga

SEQ ID NO: 222458 - RNA, 22 nt, Human
uggcauuuacugaagguguuuu

SEQ ID NO: 222459 - RNA, 20 nt, Human
uggccggaaacacuuacuua

SEQ ID NO: 222460 - RNA, 20 nt, Human
uugaaaucaguaaaucuuaa

SEQ ID NO: 222461 - RNA, 19 nt, Human
uuguaggcgacagucagug

SEQ ID NO: 222462 - RNA, 25 nt, Human
uuuauuguuggaagucuuuauuauu

SEQ ID NO: 222463 - RNA, 21 nt, Human
aaacagaucuucucugggcug

SEQ ID NO: 222464 - RNA, 18 nt, Human
aaagagaccagaggaaug

SEQ ID NO: 222465 - RNA, 24 nt, Human
aaagguaacagagggagcuccagc

SEQ ID NO: 222466 - RNA, 25 nt, Human
aagagaccagaggaaugggggagug

SEQ ID NO: 222467 - RNA, 21 nt, Human
aagaguucagaauccaggaua

SEQ ID NO: 222468 - RNA, 22 nt, Human
aagcacagaccacaaagugacc

SEQ ID NO: 222469 - RNA, 23 nt, Human
aagcauggcugaggccuucuaag

SEQ ID NO: 222470 - RNA, 22 nt, Human
aagugaccaucagagagagucu

SEQ ID NO: 222471 - RNA, 20 nt, Human
aaucccacucuuucccccag

SEQ ID NO: 222472 - RNA, 21 nt, Human
acagagggagcuccagccuca

SEQ ID NO: 222473 - RNA, 21 nt, Human
acagugggaggcgaaccugga

SEQ ID NO: 222474 - RNA, 22 nt, Human
acuccaauucucugagaacaga

SEQ ID NO: 222475 - RNA, 18 nt, Human
acuucauggugguggugg

SEQ ID NO: 222476 - RNA, 26 nt, Human
agaaacuacagagggaaaacaguggc

SEQ ID NO: 222477 - RNA, 19 nt, Human
agagaggaaaagagaccag

SEQ ID NO: 222478 - RNA, 18 nt, Human
agagauugguagaaaccc

SEQ ID NO: 222479 - RNA, 18 nt, Human
agaggaaaagagaccaga

SEQ ID NO: 222480 - RNA, 18 nt, Human
aggaguuaggagcagagc

SEQ ID NO: 222481 - RNA, 25 nt, Human
agggaaacagaucuucucugggcug

SEQ ID NO: 222482 - RNA, 20 nt, Human
aucaagcuucacaguggcaa

SEQ ID NO: 222483 - RNA, 25 nt, Human
aucccacucuuucccccauccuggc

SEQ ID NO: 222484 - RNA, 25 nt, Human
cagaagucaccagcagaaaucaagc

SEQ ID NO: 222485 - RNA, 25 nt, Human
cagaccacaaagugaccaucagaga

SEQ ID NO: 222486 - RNA, 24 nt, Human
cagcagaaaucaagcuucacagug

SEQ ID NO: 222487 - RNA, 19 nt, Human
caggccacuggguuaaaga

SEQ ID NO: 222488 - RNA, 19 nt, Human
caguggcaaacccuggcuu

SEQ ID NO: 222489 - RNA, 21 nt, Human
caguggcaaacccuggcuucu

SEQ ID NO: 222490 - RNA, 19 nt, Human
ccaaccacaugguccuccu

SEQ ID NO: 222491 - RNA, 24 nt, Human
ccacaugguccuccuaaugugagu

SEQ ID NO: 222492 - RNA, 18 nt, Human
ccacuggguuaaagaaga

SEQ ID NO: 222493 - RNA, 23 nt, Human
ccugagaguguucacuugagaaa

SEQ ID NO: 222494 - RNA, 20 nt, Human
ccuggaagauagguuuaaag

SEQ ID NO: 222495 - RNA, 23 nt, Human
cggccgggggcagagcugggccg

SEQ ID NO: 222496 - RNA, 23 nt, Human
cuccagccucaagucaccaaacu

SEQ ID NO: 222497 - RNA, 20 nt, Human
cuugagaaacuacagaggga

SEQ ID NO: 222498 - RNA, 21 nt, Human
gagaacagaggcuaugaggga

SEQ ID NO: 222499 - RNA, 22 nt, Human
gagcugggccgggccgggccgc

SEQ ID NO: 222500 - RNA, 21 nt, Human
gaggaugggugcuucggggga

SEQ ID NO: 222501 - RNA, 21 nt, Human
gaguuaggagcagagcugugc

SEQ ID NO: 222502 - RNA, 19 nt, Human
gcagagcugggccgggccg

SEQ ID NO: 222503 - RNA, 18 nt, Human
gccgggggcagagcuggg

SEQ ID NO: 222504 - RNA, 20 nt, Human
gccgggggcagagcugggcc

SEQ ID NO: 222505 - RNA, 19 nt, Human
ggaguggaggaugggugcu

SEQ ID NO: 222506 - RNA, 21 nt, Human
ggaguggaggaugggugcuuc

SEQ ID NO: 222507 - RNA, 19 nt, Human
ggauauguugauaucagau

SEQ ID NO: 222508 - RNA, 22 nt, Human
ggcauuggaagagaggaaaaga

SEQ ID NO: 222509 - RNA, 20 nt, Human
ggccaggacucuuaaacccg

SEQ ID NO: 222510 - RNA, 18 nt, Human
gggacagugggaggcgaa

SEQ ID NO: 222511 - RNA, 19 nt, Human
gggaguggaggaugggugc

SEQ ID NO: 222512 - RNA, 28 nt, Human
gggcagaagcuggggaaguggaaagggg

SEQ ID NO: 222513 - RNA, 20 nt, Human
gggcaggaguuaggagcaga

SEQ ID NO: 222514 - RNA, 20 nt, Human
gggccgggccgggccgcccc

SEQ ID NO: 222515 - RNA, 18 nt, Human
ggguccgagguggagugg

SEQ ID NO: 222516 - RNA, 23 nt, Human
uaccagggcauuggaagagagga

SEQ ID NO: 222517 - RNA, 23 nt, Human
uagaaacccuaggauauguugau

SEQ ID NO: 222518 - RNA, 21 nt, Human
uaucagauuccuguauuucug

SEQ ID NO: 222519 - RNA, 19 nt, Human
uauccaagcauggcugagg

SEQ ID NO: 222520 - RNA, 23 nt, Human
uauuggggcagaagcuggggaag

SEQ ID NO: 222521 - RNA, 23 nt, Human
ucagaagucaccagcagaaauca

SEQ ID NO: 222522 - RNA, 20 nt, Human
ucagagagagucuugccuuu

SEQ ID NO: 222523 - RNA, 25 nt, Human
ucagagagagucuugccuuugggaa

SEQ ID NO: 222524 - RNA, 25 nt, Human
ucagccuaaucccacucuuuccccc

SEQ ID NO: 222525 - RNA, 18 nt, Human
uccaaccacaugguccuc

SEQ ID NO: 222526 - RNA, 21 nt, Human
ugaaagcacagaccacaaagu

SEQ ID NO: 222527 - RNA, 26 nt, Human
ugagggaacuggguauccugagagug

SEQ ID NO: 222528 - RNA, 24 nt, Human
uggaaaggggacagugggaggcga

SEQ ID NO: 222529 - RNA, 18 nt, Human
uggaagauagguuuaaag

SEQ ID NO: 222530 - RNA, 23 nt, Human
uggaguggcccuuggaugggccg

SEQ ID NO: 222531 - RNA, 19 nt, Human
uggcugaggccuucuaagc

SEQ ID NO: 222532 - RNA, 19 nt, Human
uggguccgagguggagugg

SEQ ID NO: 222533 - RNA, 25 nt, Human
uggguuaaagaagagggaguggagg

SEQ ID NO: 222534 - RNA, 20 nt, Human
uggugggagguagggggcag

SEQ ID NO: 222535 - RNA, 24 nt, Human
uggugguggugggagguagggggc

SEQ ID NO: 222536 - RNA, 18 nt, Human
uguccgggggccggggcc

SEQ ID NO: 222537 - RNA, 24 nt, Human
uguuagucacuccaaauugaagag

SEQ ID NO: 222538 - RNA, 21 nt, Human
uguuuauguuucuugggccaa

SEQ ID NO: 222539 - RNA, 18 nt, Human
uucacaggacacagggaa

SEQ ID NO: 222540 - RNA, 21 nt, Human
uucacaguggcaaacccuggc

SEQ ID NO: 222541 - RNA, 22 nt, Human
uuggggcagaagcuggggaagu

SEQ ID NO: 222542 - RNA, 22 nt, Human
aaaacgcuacugagucugcaac

SEQ ID NO: 222543 - RNA, 21 nt, Human
aaacagucucacccaagcuaa

SEQ ID NO: 222544 - RNA, 19 nt, Human
aaacccggggccccugagc

SEQ ID NO: 222545 - RNA, 23 nt, Human
aaacgcuacugagucugcaaccc

SEQ ID NO: 222546 - RNA, 18 nt, Human
aacccggggccccugagc

SEQ ID NO: 222547 - RNA, 20 nt, Human
aacccggggccccugagcga

SEQ ID NO: 222548 - RNA, 18 nt, Human
aacccgguguuucucccc

SEQ ID NO: 222549 - RNA, 25 nt, Human
agccuggcccucguggccuggcccc

SEQ ID NO: 222550 - RNA, 23 nt, Human
aggucaagaaagcugaaacccgg

SEQ ID NO: 222551 - RNA, 19 nt, Human
auagccucugaggccgggg

SEQ ID NO: 222552 - RNA, 21 nt, Human
caagaaagcugaaacccggug

SEQ ID NO: 222553 - RNA, 24 nt, Human
caccaucgagcugagcugcuuccc

SEQ ID NO: 222554 - RNA, 24 nt, Human
cacccaagcuaaggucaagaaagc

SEQ ID NO: 222555 - RNA, 23 nt, Human
cagaagccuggcccucguggccu

SEQ ID NO: 222556 - RNA, 18 nt, Human
cagucucacccaagcuaa

SEQ ID NO: 222557 - RNA, 21 nt, Human
ccaccaucgagcugagcugcu

SEQ ID NO: 222558 - RNA, 23 nt, Human
ccccaggaggccacuucuuugcc

SEQ ID NO: 222559 - RNA, 23 nt, Human
cccccaggcuagcuccaggccuc

SEQ ID NO: 222560 - RNA, 22 nt, Human
ccccugagcgaccgcggggccu

SEQ ID NO: 222561 - RNA, 28 nt, Human
ccccugagcgaccgcggggccucucccc

SEQ ID NO: 222562 - RNA, 21 nt, Human
cccgcaggcugcagcuccauc

SEQ ID NO: 222563 - RNA, 23 nt, Human
cccucguggccuggccccccagg

SEQ ID NO: 222564 - RNA, 22 nt, Human
cccugagcgaccgcggggccuc

SEQ ID NO: 222565 - RNA, 23 nt, Human
ccggccaaacuucugaggccguu

SEQ ID NO: 222566 - RNA, 22 nt, Human
ccucuccccagccgggggugga

SEQ ID NO: 222567 - RNA, 19 nt, Human
ccuggcccucguggccugg

SEQ ID NO: 222568 - RNA, 19 nt, Human
ccugugauagccucugagg

SEQ ID NO: 222569 - RNA, 20 nt, Human
cguugcaaagaaacauaaaa

SEQ ID NO: 222570 - RNA, 20 nt, Human
cuagccagccuuggacagca

SEQ ID NO: 222571 - RNA, 20 nt, Human
cucuccggccaaacuucuga

SEQ ID NO: 222572 - RNA, 19 nt, Human
cuggccccccaggaggcca

SEQ ID NO: 222573 - RNA, 24 nt, Human
cuuugcccugagccugugauagcc

SEQ ID NO: 222574 - RNA, 19 nt, Human
gaccgcggggccucucccc

SEQ ID NO: 222575 - RNA, 24 nt, Human
gaggccacuucuuugcccugagcc

SEQ ID NO: 222576 - RNA, 19 nt, Human
gguugggggacccuggcuc

SEQ ID NO: 222577 - RNA, 25 nt, Human
uaaaacgcuacugagucugcaaccc

SEQ ID NO: 222578 - RNA, 22 nt, Human
uccccgcaggcugcagcuccau

SEQ ID NO: 222579 - RNA, 22 nt, Human
ucuccggccaaacuucugaggc

SEQ ID NO: 222580 - RNA, 21 nt, Human
ucugcaacccagggcacuggg

SEQ ID NO: 222581 - RNA, 23 nt, Human
ucugcaacccagggcacugggcc

SEQ ID NO: 222582 - RNA, 22 nt, Human
ucuucaggcagaagccuggccc

SEQ ID NO: 222583 - RNA, 24 nt, Human
ugaaacccgguguuucuccccaag

SEQ ID NO: 222584 - RNA, 21 nt, Human
ugcaaagaaacauaaaacgac

SEQ ID NO: 222585 - RNA, 23 nt, Human
ugcaaagaaacauaaaacgacua

SEQ ID NO: 222586 - RNA, 20 nt, Human
ugcccugagccugugauagc

SEQ ID NO: 222587 - RNA, 22 nt, Human
ugcccugagccugugauagccu

SEQ ID NO: 222588 - RNA, 21 nt, Human
ugccgcucuggcugcccccuc

SEQ ID NO: 222589 - RNA, 24 nt, Human
uggcucgcccccaggcuagcucca

SEQ ID NO: 222590 - RNA, 18 nt, Human
ugugauagccucugaggc

SEQ ID NO: 222591 - RNA, 22 nt, Human
uuaaaaaccagcaaggagcacc

SEQ ID NO: 222592 - RNA, 21 nt, Human
uguauuucucuaaaaucaaga

SEQ ID NO: 222593 - RNA, 22 nt, Human
aaaacucucucacuguucacag

SEQ ID NO: 222594 - RNA, 21 nt, Human
aaauacauuuccuuuuaaugu

SEQ ID NO: 222595 - RNA, 19 nt, Human
aagagaggccaggucugga

SEQ ID NO: 222596 - RNA, 19 nt, Human
aagcucuuagaaauguagc

SEQ ID NO: 222597 - RNA, 22 nt, Human
agaaauguagcuuuauuuuaua

SEQ ID NO: 222598 - RNA, 25 nt, Human
agaacacuguccagagcacagcuuu

SEQ ID NO: 222599 - RNA, 22 nt, Human
agacgaagcaccuaacaggaaa

SEQ ID NO: 222600 - RNA, 19 nt, Human
agauaagaaaugaaauggc

SEQ ID NO: 222601 - RNA, 21 nt, Human
agcagugagaucaaugaauac

SEQ ID NO: 222602 - RNA, 26 nt, Human
aggcagguagaacguccucgcucccc

SEQ ID NO: 222603 - RNA, 20 nt, Human
agguagaacguccucgcucc

SEQ ID NO: 222604 - RNA, 20 nt, Human
agugcagacuccuggcugga

SEQ ID NO: 222605 - RNA, 21 nt, Human
agugcagacuccuggcuggau

SEQ ID NO: 222606 - RNA, 22 nt, Human
auaaugaaaugaagagaggcca

SEQ ID NO: 222607 - RNA, 19 nt, Human
auagagucucucuaccucu

SEQ ID NO: 222608 - RNA, 20 nt, Human
augagaguucacuuucagac

SEQ ID NO: 222609 - RNA, 20 nt, Human
augucaagucagagaaaugc

SEQ ID NO: 222610 - RNA, 22 nt, Human
cagaaaguugcuuugagaacac

SEQ ID NO: 222611 - RNA, 24 nt, Human
caguccacugaagaaagguaaaaa

SEQ ID NO: 222612 - RNA, 19 nt, Human
ccacaauucaacucucagc

SEQ ID NO: 222613 - RNA, 23 nt, Human
ccacacagagucaguuuuccaca

SEQ ID NO: 222614 - RNA, 19 nt, Human
ccauacaauucaguccacu

SEQ ID NO: 222615 - RNA, 18 nt, Human
ccaugggauucugcuacu

SEQ ID NO: 222616 - RNA, 22 nt, Human
ccaugggauucugcuacugccu

SEQ ID NO: 222617 - RNA, 20 nt, Human
ccccuucacccaccuggcua

SEQ ID NO: 222618 - RNA, 20 nt, Human
cgggcucuccaaacaccccc

SEQ ID NO: 222619 - RNA, 21 nt, Human
cucaguccagacagguugccu

SEQ ID NO: 222620 - RNA, 22 nt, Human
cugaaccacaauucaacucuca

SEQ ID NO: 222621 - RNA, 21 nt, Human
cuuuuuagguauuaccacaua

SEQ ID NO: 222622 - RNA, 20 nt, Human
gaaaucucucaaacacagaa

SEQ ID NO: 222623 - RNA, 24 nt, Human
gaacauagagucucucuaccucuu

SEQ ID NO: 222624 - RNA, 22 nt, Human
gaagaaaacucucucacuguuc

SEQ ID NO: 222625 - RNA, 22 nt, Human
gagaacacuguccagagcacag

SEQ ID NO: 222626 - RNA, 21 nt, Human
gcaucagccccauuuguguag

SEQ ID NO: 222627 - RNA, 22 nt, Human
gccccauuuguguagguuucca

SEQ ID NO: 222628 - RNA, 23 nt, Human
gggcauccaguccgggcucucca

SEQ ID NO: 222629 - RNA, 22 nt, Human
guccagacagguugccuuggga

SEQ ID NO: 222630 - RNA, 22 nt, Human
guccucgcuccccuucacccac

SEQ ID NO: 222631 - RNA, 19 nt, Human
gucuggcugggacaugaga

SEQ ID NO: 222632 - RNA, 19 nt, Human
uagaacguccucgcucccc

SEQ ID NO: 222633 - RNA, 24 nt, Human
uauuccaauugcccuacaccaagc

SEQ ID NO: 222634 - RNA, 21 nt, Human
ucaguccagacagguugccuu

SEQ ID NO: 222635 - RNA, 18 nt, Human
uccacugaagaaagguaa

SEQ ID NO: 222636 - RNA, 22 nt, Human
uccacugaagaaagguaaaaau

SEQ ID NO: 222637 - RNA, 18 nt, Human
uccuuccauacaauucag

SEQ ID NO: 222638 - RNA, 21 nt, Human
ucucaaacacagaaaugcugg

SEQ ID NO: 222639 - RNA, 21 nt, Human
ugaacauagagucucucuacc

SEQ ID NO: 222640 - RNA, 23 nt, Human
ugaacauagagucucucuaccuc

SEQ ID NO: 222641 - RNA, 23 nt, Human
ugaaccacaauucaacucucagc

SEQ ID NO: 222642 - RNA, 19 nt, Human
ugaaccacauuuugaaugg

SEQ ID NO: 222643 - RNA, 18 nt, Human
ugaagaaaacucucucac

SEQ ID NO: 222644 - RNA, 19 nt, Human
ugaagagaggccaggucug

SEQ ID NO: 222645 - RNA, 22 nt, Human
ugaagggaguucugauguggaa

SEQ ID NO: 222646 - RNA, 19 nt, Human
ugagaacacuguccagagc

SEQ ID NO: 222647 - RNA, 23 nt, Human
ugagaucaaugaauacugaacca

SEQ ID NO: 222648 - RNA, 22 nt, Human
ugggaaagauagguguuuaggg

SEQ ID NO: 222649 - RNA, 21 nt, Human
uguccagagcacagcuuucga

SEQ ID NO: 222650 - RNA, 21 nt, Human
uguuaagauacagaccccaau

SEQ ID NO: 222651 - RNA, 24 nt, Human
uuagaaauguagcuuuauuuuaua

SEQ ID NO: 222652 - RNA, 21 nt, Human
uuagccacaagaucaaaggaa

SEQ ID NO: 222653 - RNA, 21 nt, Human
uuccauacaauucaguccacu

SEQ ID NO: 222654 - RNA, 22 nt, Human
uucugauguggaaacagcuugc

SEQ ID NO: 222655 - RNA, 21 nt, Human
uuuaauagauaagaaaugaaa

SEQ ID NO: 222656 - RNA, 22 nt, Human
uuuuuuuuuuuuuucucucaag

SEQ ID NO: 222657 - RNA, 21 nt, Human
uuuuuuuuuuuuuuuucucuc

SEQ ID NO: 222658 - RNA, 26 nt, Human
aaaaaaaaaaaaaaaagggaaaagaa

SEQ ID NO: 222659 - RNA, 21 nt, Human
aaaaaagaaaaaagaaaagaa

SEQ ID NO: 222660 - RNA, 18 nt, Human
aaaaagaaaaaagaaaag

SEQ ID NO: 222661 - RNA, 19 nt, Human
aaaacaaaaacaaaacaca

SEQ ID NO: 222662 - RNA, 24 nt, Human
aaaagaaaaaagaaaagaaaagaa

SEQ ID NO: 222663 - RNA, 23 nt, Human
aaacaaaaacaaaacacaaauaa

SEQ ID NO: 222664 - RNA, 30 nt, Human
aaacaaaaacaaaacacaaauaauucugag

SEQ ID NO: 222665 - RNA, 21 nt, Human
aaacauagccauaacacuuuc

SEQ ID NO: 222666 - RNA, 23 nt, Human
aaagaaaagaaaagaaacagaaa

SEQ ID NO: 222667 - RNA, 22 nt, Human
aaagaaggagaaagggaaggau

SEQ ID NO: 222668 - RNA, 23 nt, Human
aaagauaaaaugauucaguggua

SEQ ID NO: 222669 - RNA, 19 nt, Human
aagaaaagaaaagaaacag

SEQ ID NO: 222670 - RNA, 22 nt, Human
aagagaaagaaagauuuuccag

SEQ ID NO: 222671 - RNA, 21 nt, Human
aaggagaaagggaaggaugag

SEQ ID NO: 222672 - RNA, 25 nt, Human
aauguaaaacaaaaacaaaacacaa

SEQ ID NO: 222673 - RNA, 18 nt, Human
acaaaaaaagaaaaaaga

SEQ ID NO: 222674 - RNA, 23 nt, Human
acccagcaucaucauaaaacaua

SEQ ID NO: 222675 - RNA, 21 nt, Human
agaaaaaagaaaagaaaagaa

SEQ ID NO: 222676 - RNA, 28 nt, Human
agaaaaaagaaaagaaaagaaacagaaa

SEQ ID NO: 222677 - RNA, 27 nt, Human
agaaaaaauugcuucuaacucucacug

SEQ ID NO: 222678 - RNA, 19 nt, Human
agaaaaagcaaaaacugug

SEQ ID NO: 222679 - RNA, 22 nt, Human
agaaaagaaaagaaacagaaag

SEQ ID NO: 222680 - RNA, 20 nt, Human
agcaacgguuucucuccaag

SEQ ID NO: 222681 - RNA, 20 nt, Human
agcagagauugggcucacca

SEQ ID NO: 222682 - RNA, 18 nt, Human
agcagccaaaguugcaau

SEQ ID NO: 222683 - RNA, 18 nt, Human
agcugggcaaugguagag

SEQ ID NO: 222684 - RNA, 22 nt, Human
aggaaggaagaacaaaaaaaga

SEQ ID NO: 222685 - RNA, 21 nt, Human
agggaaaagaaggagaaagga

SEQ ID NO: 222686 - RNA, 20 nt, Human
agggggaggagggaagaaag

SEQ ID NO: 222687 - RNA, 25 nt, Human
aguuagaauccugugucucacuaac

SEQ ID NO: 222688 - RNA, 25 nt, Human
auaaacaaauaaaaacagugccaca

SEQ ID NO: 222689 - RNA, 19 nt, Human
auaaaguuuaaagugacuc

SEQ ID NO: 222690 - RNA, 19 nt, Human
auauugacaaggcaaacau

SEQ ID NO: 222691 - RNA, 19 nt, Human
aucaucuugaguuacuccu

SEQ ID NO: 222692 - RNA, 19 nt, Human
aucuaccuauaccuauaua

SEQ ID NO: 222693 - RNA, 25 nt, Human
aucucccuccccacccuccccccaa

SEQ ID NO: 222694 - RNA, 26 nt, Human
augagggggaggagggaagaaaggaa

SEQ ID NO: 222695 - RNA, 21 nt, Human
caaaaaaaaaaaaaaaaggga

SEQ ID NO: 222696 - RNA, 26 nt, Human
caaaaacaaaacacaaauaauucuga

SEQ ID NO: 222697 - RNA, 28 nt, Human
caagaagcauacauaacugccggggccc

SEQ ID NO: 222698 - RNA, 21 nt, Human
caagacuaaaaacaaucuuac

SEQ ID NO: 222699 - RNA, 24 nt, Human
caaguaauugcugcuguaaaaucc

SEQ ID NO: 222700 - RNA, 21 nt, Human
cacaaauaaauaucucccucc

SEQ ID NO: 222701 - RNA, 23 nt, Human
cacaacucgagucauuuguaucu

SEQ ID NO: 222702 - RNA, 22 nt, Human
cacugaucacuaccugggcaag

SEQ ID NO: 222703 - RNA, 18 nt, Human
cagagcgcacaauuuuuu

SEQ ID NO: 222704 - RNA, 24 nt, Human
cagcagagauugggcucaccagac

SEQ ID NO: 222705 - RNA, 23 nt, Human
cagcgguagcagagucaacaaag

SEQ ID NO: 222706 - RNA, 21 nt, Human
cagcugggcaaugguagagaa

SEQ ID NO: 222707 - RNA, 24 nt, Human
caguaaccaagacaagaagcauac

SEQ ID NO: 222708 - RNA, 27 nt, Human
cauaaaacauagccauaacacuuucaa

SEQ ID NO: 222709 - RNA, 21 nt, Human
cauagaaaguccccuccucag

SEQ ID NO: 222710 - RNA, 27 nt, Human
caucauaaaacauagccauaacacuuu

SEQ ID NO: 222711 - RNA, 19 nt, Human
ccaagacaagaagcauaca

SEQ ID NO: 222712 - RNA, 20 nt, Human
ccaagggucugagaauguuu

SEQ ID NO: 222713 - RNA, 18 nt, Human
ccacccuccccccaaaaa

SEQ ID NO: 222714 - RNA, 23 nt, Human
ccacccuccccccaaaaagguuc

SEQ ID NO: 222715 - RNA, 21 nt, Human
ccaggucaaaaaaaaaaaaaa

SEQ ID NO: 222716 - RNA, 28 nt, Human
ccaggucaaaaaaaaaaaaaaaagggaa

SEQ ID NO: 222717 - RNA, 24 nt, Human
cccaggucaaaaaaaaaaaaaaaa

SEQ ID NO: 222718 - RNA, 21 nt, Human
ccccaaaaagguucuauccuu

SEQ ID NO: 222719 - RNA, 20 nt, Human
cccccauucuuuauucacuc

SEQ ID NO: 222720 - RNA, 21 nt, Human
ccuccccacccuccccccaaa

SEQ ID NO: 222721 - RNA, 24 nt, Human
ccugaccucaacugcgugacugac

SEQ ID NO: 222722 - RNA, 24 nt, Human
cucaagucaaagugaaauuuaaaa

SEQ ID NO: 222723 - RNA, 23 nt, Human
cucaccagacgggcaaggcccag

SEQ ID NO: 222724 - RNA, 20 nt, Human
cuccaagggucugagaaugu

SEQ ID NO: 222725 - RNA, 25 nt, Human
cucccaggucaaaaaaaaaaaaaaa

SEQ ID NO: 222726 - RNA, 19 nt, Human
cuccccccaaaaagguucu

SEQ ID NO: 222727 - RNA, 21 nt, Human
cuccccccaaaaagguucuau

SEQ ID NO: 222728 - RNA, 18 nt, Human
cucuccccacagagaauc

SEQ ID NO: 222729 - RNA, 19 nt, Human
cugggcaaguagcagugga

SEQ ID NO: 222730 - RNA, 22 nt, Human
cugggcacaaauaaauaucucc

SEQ ID NO: 222731 - RNA, 26 nt, Human
cuggugagcugauuucacaguuacau

SEQ ID NO: 222732 - RNA, 23 nt, Human
cugugugugugugugucugggug

SEQ ID NO: 222733 - RNA, 25 nt, Human
cuuacagccacucgcuaugcucgcu

SEQ ID NO: 222734 - RNA, 22 nt, Human
cuuuacucaguggaugugggcu

SEQ ID NO: 222735 - RNA, 23 nt, Human
gaacauagaaaguccccuccuca

SEQ ID NO: 222736 - RNA, 27 nt, Human
gcaacaauguaaaacaaaaacaaaaca

SEQ ID NO: 222737 - RNA, 22 nt, Human
gcaagacuaaaaacaaucuuac

SEQ ID NO: 222738 - RNA, 24 nt, Human
ggaaaagaaggagaaagggaaggg

SEQ ID NO: 222739 - RNA, 20 nt, Human
ggagugugcauuccucaagc

SEQ ID NO: 222740 - RNA, 26 nt, Human
gggaaaagaaggagaaagggaaggau

SEQ ID NO: 222741 - RNA, 22 nt, Human
gggaaaagaaggagaaagggga

SEQ ID NO: 222742 - RNA, 22 nt, Human
gggaaggaugagggggaggagg

SEQ ID NO: 222743 - RNA, 20 nt, Human
gggcaaugguagagaaugcu

SEQ ID NO: 222744 - RNA, 24 nt, Human
gugcagcaacaauguaaaacaaaa

SEQ ID NO: 222745 - RNA, 21 nt, Human
guggaugucuuuaaagugaga

SEQ ID NO: 222746 - RNA, 23 nt, Human
uaaaaauguauuauuuaugcugu

SEQ ID NO: 222747 - RNA, 19 nt, Human
uaaaauccaaaucuacaga

SEQ ID NO: 222748 - RNA, 18 nt, Human
uaaagugagaggcaacac

SEQ ID NO: 222749 - RNA, 19 nt, Human
uaaagugagaggcaacaca

SEQ ID NO: 222750 - RNA, 20 nt, Human
uaaccauccccucaccucag

SEQ ID NO: 222751 - RNA, 21 nt, Human
uaauaggccaaaggauuuccc

SEQ ID NO: 222752 - RNA, 24 nt, Human
uaauugcugcuguaaaauccaaau

SEQ ID NO: 222753 - RNA, 24 nt, Human
uacacagauaauuagagauauaug

SEQ ID NO: 222754 - RNA, 22 nt, Human
uacaguaaccaagacaagaagc

SEQ ID NO: 222755 - RNA, 20 nt, Human
uaccugggcaaguagcagug

SEQ ID NO: 222756 - RNA, 18 nt, Human
uagaauccugugucucac

SEQ ID NO: 222757 - RNA, 23 nt, Human
uaucgcugcuaaccauccccuca

SEQ ID NO: 222758 - RNA, 18 nt, Human
uaugauccugucccuugg

SEQ ID NO: 222759 - RNA, 18 nt, Human
uccuuccugccuucauuc

SEQ ID NO: 222760 - RNA, 19 nt, Human
ucgcugcuaaccauccccu

SEQ ID NO: 222761 - RNA, 24 nt, Human
ucuaauuuagccaaguaauugcug

SEQ ID NO: 222762 - RNA, 22 nt, Human
ucucacaaaauccuucauuuaa

SEQ ID NO: 222763 - RNA, 23 nt, Human
ucucccuccccacccucccccca

SEQ ID NO: 222764 - RNA, 25 nt, Human
ucugugccucaaucccccauucuuu

SEQ ID NO: 222765 - RNA, 22 nt, Human
ucuuacagccacucgcuaugcu

SEQ ID NO: 222766 - RNA, 21 nt, Human
ugaaaccaagacgguccaagu

SEQ ID NO: 222767 - RNA, 20 nt, Human
ugaacauagaaaguccccuc

SEQ ID NO: 222768 - RNA, 22 nt, Human
ugagauaaagugccagucugcc

SEQ ID NO: 222769 - RNA, 24 nt, Human
ugagauaaagugccagucugccag

SEQ ID NO: 222770 - RNA, 18 nt, Human
ugauccugucccuugguc

SEQ ID NO: 222771 - RNA, 23 nt, Human
ugcagcaacaauguaaaacaaaa

SEQ ID NO: 222772 - RNA, 24 nt, Human
ugggcaaguagcaguggaauuggu

SEQ ID NO: 222773 - RNA, 20 nt, Human
uguagguaaaacaagcuaaa

SEQ ID NO: 222774 - RNA, 23 nt, Human
ugucaugguggcuguuuucuacu

SEQ ID NO: 222775 - RNA, 22 nt, Human
ugugugugugugugucugggug

SEQ ID NO: 222776 - RNA, 25 nt, Human
ugugugugugugugucugggugugu

SEQ ID NO: 222777 - RNA, 26 nt, Human
ugugugugugugugucugggugugua

SEQ ID NO: 222778 - RNA, 19 nt, Human
uguugcuauuucuugguuu

SEQ ID NO: 222779 - RNA, 18 nt, Human
uucacgggacacugaugc

SEQ ID NO: 222780 - RNA, 19 nt, Human
uucacucuccccacagaga

SEQ ID NO: 222781 - RNA, 21 nt, Human
uuggcgaacaagaaaaauuuu

SEQ ID NO: 222782 - RNA, 19 nt, Human
uuggguuuucaguuagaac

SEQ ID NO: 222783 - RNA, 24 nt, Human
uuguacucagauuauccacuuacu

SEQ ID NO: 222784 - RNA, 22 nt, Human
uuucaaaaaagccacguuuaca

SEQ ID NO: 222785 - RNA, 18 nt, Human
uuugcugugcccuuaggg

SEQ ID NO: 222786 - RNA, 18 nt, Human
uuuuuuuuuuuuuuuuug

SEQ ID NO: 222787 - RNA, 21 nt, Human
aagaccuuaaacagcagaaaa

SEQ ID NO: 222788 - RNA, 18 nt, Human
aaucaugccauaaaacua

SEQ ID NO: 222789 - RNA, 22 nt, Human
acaagaacuacaacuuugaaca

SEQ ID NO: 222790 - RNA, 23 nt, Human
acacacacacacacagacauaua

SEQ ID NO: 222791 - RNA, 23 nt, Human
agccucccaagaccuuaaacagc

SEQ ID NO: 222792 - RNA, 20 nt, Human
aggugggggcggggggagga

SEQ ID NO: 222793 - RNA, 18 nt, Human
auauauauauguauaugu

SEQ ID NO: 222794 - RNA, 22 nt, Human
auauauauguauguauguaugu

SEQ ID NO: 222795 - RNA, 21 nt, Human
auauauguauguauguaugua

SEQ ID NO: 222796 - RNA, 18 nt, Human
auguauguauguauguau

SEQ ID NO: 222797 - RNA, 24 nt, Human
auguguauguauguguauauauua

SEQ ID NO: 222798 - RNA, 28 nt, Human
cacaagaacuacaacuuugaacaaaaca

SEQ ID NO: 222799 - RNA, 26 nt, Human
cacacacacacacagacauauauuua

SEQ ID NO: 222800 - RNA, 18 nt, Human
cagggagaguaucucccc

SEQ ID NO: 222801 - RNA, 19 nt, Human
caugcacaagaacuacaac

SEQ ID NO: 222802 - RNA, 19 nt, Human
ccaagaccuuaaacagcag

SEQ ID NO: 222803 - RNA, 18 nt, Human
cgaaggcgcaggagcugg

SEQ ID NO: 222804 - RNA, 18 nt, Human
cguaacuguugcuuucug

SEQ ID NO: 222805 - RNA, 24 nt, Human
cucaucgccaaauauuggacuauu

SEQ ID NO: 222806 - RNA, 18 nt, Human
cucccaagaccuuaaaca

SEQ ID NO: 222807 - RNA, 22 nt, Human
cucccaagaccuuaaacagcag

SEQ ID NO: 222808 - RNA, 18 nt, Human
cugcagacgccucuccuu

SEQ ID NO: 222809 - RNA, 19 nt, Human
cugcggucucugcccccug

SEQ ID NO: 222810 - RNA, 21 nt, Human
cuguugcuuucugcacauucg

SEQ ID NO: 222811 - RNA, 19 nt, Human
cuuuaaauauauauauaua

SEQ ID NO: 222812 - RNA, 18 nt, Human
gaaagggggcgaagcgag

SEQ ID NO: 222813 - RNA, 19 nt, Human
gaacuacaacuuugaacaa

SEQ ID NO: 222814 - RNA, 23 nt, Human
gauuccuuagggagaauuaccuc

SEQ ID NO: 222815 - RNA, 20 nt, Human
gccaguagccuuccuacucu

SEQ ID NO: 222816 - RNA, 18 nt, Human
gcccccugcagacgccuc

SEQ ID NO: 222817 - RNA, 21 nt, Human
ggaaggguucucgaaauaugc

SEQ ID NO: 222818 - RNA, 23 nt, Human
gggaggaaagggggcgaagcgag

SEQ ID NO: 222819 - RNA, 20 nt, Human
gggccauagauagcacaaac

SEQ ID NO: 222820 - RNA, 30 nt, Human
guauauguguguauacauacacacacacag

SEQ ID NO: 222821 - RNA, 21 nt, Human
guguauauauauauguauaaa

SEQ ID NO: 222822 - RNA, 24 nt, Human
guuauauuuuugcagggccauaga

SEQ ID NO: 222823 - RNA, 22 nt, Human
uaaaguaaacaugcacaagaac

SEQ ID NO: 222824 - RNA, 23 nt, Human
uaaaucaaacauuaaauaaugcc

SEQ ID NO: 222825 - RNA, 23 nt, Human
uaacuucacacagauucugauau

SEQ ID NO: 222826 - RNA, 23 nt, Human
uaauuguguaacuucacacagau

SEQ ID NO: 222827 - RNA, 26 nt, Human
uacauacacacacacacacagacaua

SEQ ID NO: 222828 - RNA, 21 nt, Human
uagcugcggucucugcccccu

SEQ ID NO: 222829 - RNA, 22 nt, Human
uagcugcggucucugcccccug

SEQ ID NO: 222830 - RNA, 19 nt, Human
uauauguauauguguguau

SEQ ID NO: 222831 - RNA, 20 nt, Human
uauauguauauguguguaua

SEQ ID NO: 222832 - RNA, 18 nt, Human
uauguauguauguaugua

SEQ ID NO: 222833 - RNA, 21 nt, Human
uauguauguauguauguaugu

SEQ ID NO: 222834 - RNA, 21 nt, Human
uauguauguauguauguguau

SEQ ID NO: 222835 - RNA, 21 nt, Human
uauguauguauguguauguau

SEQ ID NO: 222836 - RNA, 22 nt, Human
uauguguauauauauauguaua

SEQ ID NO: 222837 - RNA, 24 nt, Human
uauguguauauauauauguauaug

SEQ ID NO: 222838 - RNA, 18 nt, Human
uauguguauguaugugua

SEQ ID NO: 222839 - RNA, 19 nt, Human
uauguguauguauguguau

SEQ ID NO: 222840 - RNA, 19 nt, Human
uauguguauguauguguau

SEQ ID NO: 222841 - RNA, 22 nt, Human
uauguguauguauguguauaua

SEQ ID NO: 222842 - RNA, 18 nt, Human
uauguuagaaaugucagg

SEQ ID NO: 222843 - RNA, 24 nt, Human
uauuggacuauuacuaaaucaaac

SEQ ID NO: 222844 - RNA, 18 nt, Human
ucauugcauugucauguc

SEQ ID NO: 222845 - RNA, 19 nt, Human
ucgcaauacuugggaaagg

SEQ ID NO: 222846 - RNA, 25 nt, Human
ucuaggaaaggaauaauucucaaau

SEQ ID NO: 222847 - RNA, 24 nt, Human
ugccauaaaacuaaaugcaaaauu

SEQ ID NO: 222848 - RNA, 18 nt, Human
ugccuaagggagugcuuu

SEQ ID NO: 222849 - RNA, 22 nt, Human
ugggggcggggggaggaaaggg

SEQ ID NO: 222850 - RNA, 25 nt, Human
uguauacauacacacacacacacag

SEQ ID NO: 222851 - RNA, 25 nt, Human
uguauacauacacacacacacacag

SEQ ID NO: 222852 - RNA, 18 nt, Human
uguauauguguguauaca

SEQ ID NO: 222853 - RNA, 19 nt, Human
uguauauguguguauacau

SEQ ID NO: 222854 - RNA, 18 nt, Human
uguauguauguauguaug

SEQ ID NO: 222855 - RNA, 19 nt, Human
uguauguauguauguaugu

SEQ ID NO: 222856 - RNA, 19 nt, Human
uguauguauguauguguau

SEQ ID NO: 222857 - RNA, 21 nt, Human
uguauguauguauguguaugu

SEQ ID NO: 222858 - RNA, 23 nt, Human
uguauguauguauguguauguau

SEQ ID NO: 222859 - RNA, 25 nt, Human
uguauguauguguauauauauaugu

SEQ ID NO: 222860 - RNA, 19 nt, Human
uguauguauguguauguau

SEQ ID NO: 222861 - RNA, 23 nt, Human
uguauguauguguauguaugugu

SEQ ID NO: 222862 - RNA, 23 nt, Human
uguauuagaucauauacaaaaca

SEQ ID NO: 222863 - RNA, 19 nt, Human
uguguauauauauauguau

SEQ ID NO: 222864 - RNA, 21 nt, Human
uguguauauauauauguauau

SEQ ID NO: 222865 - RNA, 23 nt, Human
uguguauauauauauguauaugu

SEQ ID NO: 222866 - RNA, 18 nt, Human
uguguauguauguguaua

SEQ ID NO: 222867 - RNA, 20 nt, Human
uguguauguauguguauaua

SEQ ID NO: 222868 - RNA, 28 nt, Human
uguguauguauguguauauauauaugua

SEQ ID NO: 222869 - RNA, 20 nt, Human
uguugcuuucugcacauucc

SEQ ID NO: 222870 - RNA, 26 nt, Human
uuaauaacuuccuuaugauguccucc

SEQ ID NO: 222871 - RNA, 25 nt, Human
uuaauuagucuaggaaaggaauaau

SEQ ID NO: 222872 - RNA, 26 nt, Human
uuaccucaucgccaaauauuggaccg

SEQ ID NO: 222873 - RNA, 23 nt, Human
uuauauuuuugcagggccauaga

SEQ ID NO: 222874 - RNA, 24 nt, Human
uucaguguuuguucagagcucauc

SEQ ID NO: 222875 - RNA, 21 nt, Human
uucauugcauugucaugucuu

SEQ ID NO: 222876 - RNA, 26 nt, Human
uuccagaaaaagaaagaaaauguuuc

SEQ ID NO: 222877 - RNA, 19 nt, Human
uuccuuagggagaauuacc

SEQ ID NO: 222878 - RNA, 19 nt, Human
uuuccagaaaaagaaagaa

SEQ ID NO: 222879 - RNA, 21 nt, Human
aaacgcaccccccccucccca

SEQ ID NO: 222880 - RNA, 20 nt, Human
aaacuaacccccugcccacc

SEQ ID NO: 222881 - RNA, 23 nt, Human
aaacuaacccccugcccacccug

SEQ ID NO: 222882 - RNA, 23 nt, Human
aaagaaacgcaccccccccuccc

SEQ ID NO: 222883 - RNA, 19 nt, Human
acccugaaaccccgagaug

SEQ ID NO: 222884 - RNA, 23 nt, Human
acccugaaaccccgagauguccc

SEQ ID NO: 222885 - RNA, 18 nt, Human
acuaacccccugcccacc

SEQ ID NO: 222886 - RNA, 19 nt, Human
agaaacgcaccccccccuc

SEQ ID NO: 222887 - RNA, 21 nt, Human
agaaguaggcgcuggcggaac

SEQ ID NO: 222888 - RNA, 19 nt, Human
agcaguccagccaccuucc

SEQ ID NO: 222889 - RNA, 25 nt, Human
aggaaggggucccccagucuuugaa

SEQ ID NO: 222890 - RNA, 24 nt, Human
agucaggaggaaggggucccccag

SEQ ID NO: 222891 - RNA, 18 nt, Human
aguccagccaccuucccc

SEQ ID NO: 222892 - RNA, 21 nt, Human
caaaagaaacgcacccccccc

SEQ ID NO: 222893 - RNA, 20 nt, Human
caaacuaacccccugcccac

SEQ ID NO: 222894 - RNA, 20 nt, Human
caccagaaguaggcgcuggc

SEQ ID NO: 222895 - RNA, 18 nt, Human
caccccccccuccccaaa

SEQ ID NO: 222896 - RNA, 22 nt, Human
ccagccaccuuccccaagguuc

SEQ ID NO: 222897 - RNA, 23 nt, Human
cccaccuuccuccagaaggucca

SEQ ID NO: 222898 - RNA, 24 nt, Human
cccagucuuugaaacccccaccuu

SEQ ID NO: 222899 - RNA, 23 nt, Human
ccccccccuccccaaacuaaccc

SEQ ID NO: 222900 - RNA, 24 nt, Human
ccccccccuccccaaacuaacccc

SEQ ID NO: 222901 - RNA, 22 nt, Human
cccccugcccacccugaaaccc

SEQ ID NO: 222902 - RNA, 22 nt, Human
ccccugcccacccugaaacccc

SEQ ID NO: 222903 - RNA, 19 nt, Human
cccugcccacccugaaacc

SEQ ID NO: 222904 - RNA, 24 nt, Human
cccugcccacccugaaaccccgag

SEQ ID NO: 222905 - RNA, 27 nt, Human
ccuccccaaacuaacccccugcccacc

SEQ ID NO: 222906 - RNA, 20 nt, Human
ccugaaaccccgagaugucc

SEQ ID NO: 222907 - RNA, 20 nt, Human
ccugcccacccugaaacccc

SEQ ID NO: 222908 - RNA, 21 nt, Human
ccugcccacccugaaaccccg

SEQ ID NO: 222909 - RNA, 19 nt, Human
ccuuugcacuggcuguucu

SEQ ID NO: 222910 - RNA, 20 nt, Human
cgagaugucccccgcccagc

SEQ ID NO: 222911 - RNA, 23 nt, Human
cgcaccccccccuccccaaacua

SEQ ID NO: 222912 - RNA, 31 nt, Human
cgcaccccccccuccccaaacuaaccccccc

SEQ ID NO: 222913 - RNA, 21 nt, Human
cugaaaccccgagaugucccc

SEQ ID NO: 222914 - RNA, 20 nt, Human
cuggagucaggaggaagggg

SEQ ID NO: 222915 - RNA, 24 nt, Human
gaaaccccgagaugucccccgccc

SEQ ID NO: 222916 - RNA, 19 nt, Human
gaaacgcaccccccccucc

SEQ ID NO: 222917 - RNA, 23 nt, Human
gcaacaggccacagucaugcaaa

SEQ ID NO: 222918 - RNA, 19 nt, Human
gcaccccccccuccccaaa

SEQ ID NO: 222919 - RNA, 21 nt, Human
gcacuggcuguucuuucuggu

SEQ ID NO: 222920 - RNA, 24 nt, Human
gcccagcaguccagccaccuuccc

SEQ ID NO: 222921 - RNA, 24 nt, Human
gcucuugugggcaguggugagggc

SEQ ID NO: 222922 - RNA, 18 nt, Human
ggccugggugcuggaguc

SEQ ID NO: 222923 - RNA, 25 nt, Human
ggccuuugcacuggcuguucuuucu

SEQ ID NO: 222924 - RNA, 20 nt, Human
ggcugaucggggccgagcuc

SEQ ID NO: 222925 - RNA, 24 nt, Human
ggggaagggugguggauccgggga

SEQ ID NO: 222926 - RNA, 19 nt, Human
ggugcuggagucaggagga

SEQ ID NO: 222927 - RNA, 20 nt, Human
guaggcgcuggcggaacuca

SEQ ID NO: 222928 - RNA, 22 nt, Human
ucaugcaaaagaaacgcacccc

SEQ ID NO: 222929 - RNA, 22 nt, Human
uccccaaacuaacccccugccc

SEQ ID NO: 222930 - RNA, 22 nt, Human
uccccaagguucugagagcaaa

SEQ ID NO: 222931 - RNA, 22 nt, Human
ucccccagucuuugaaaccccc

SEQ ID NO: 222932 - RNA, 25 nt, Human
ucccccgcccagcaguccagccacc

SEQ ID NO: 222933 - RNA, 21 nt, Human
ucucugggccuuugcacuggc

SEQ ID NO: 222934 - RNA, 24 nt, Human
ucucugggccuuugcacuggccga

SEQ ID NO: 222935 - RNA, 26 nt, Human
ucucugggccuuugcacuggcuggcc

SEQ ID NO: 222936 - RNA, 23 nt, Human
ugaaacccccaccuuccuccaga

SEQ ID NO: 222937 - RNA, 19 nt, Human
ugaaaccccgagauguccc

SEQ ID NO: 222938 - RNA, 20 nt, Human
ugaaaccccgagaugucccc

SEQ ID NO: 222939 - RNA, 20 nt, Human
ugaagagucagugggggaag

SEQ ID NO: 222940 - RNA, 25 nt, Human
ugaagagucagugggggaagggugg

SEQ ID NO: 222941 - RNA, 21 nt, Human
uggcucuguccugaguguggg

SEQ ID NO: 222942 - RNA, 20 nt, Human
ugggaggggguguccuggca

SEQ ID NO: 222943 - RNA, 22 nt, Human
ugggccuuugcacuggcuguuc

SEQ ID NO: 222944 - RNA, 18 nt, Human
ugggggaaggguggugga

SEQ ID NO: 222945 - RNA, 20 nt, Human
uguccuggcaucccaccccc

SEQ ID NO: 222946 - RNA, 21 nt, Human
ugugggaggggguguccuggc

SEQ ID NO: 222947 - RNA, 24 nt, Human
ugugggcaguggugagggccgggc

SEQ ID NO: 222948 - RNA, 20 nt, Human
uuuuuuuuuuuuggugucuc

SEQ ID NO: 222949 - RNA, 26 nt, Human
aaaaaaacaaaacaaaacaaaacaaa

SEQ ID NO: 222950 - RNA, 20 nt, Human
aaaaggaagugacccagggc

SEQ ID NO: 222951 - RNA, 24 nt, Human
aaaaugcugggaucacagguguga

SEQ ID NO: 222952 - RNA, 22 nt, Human
aaacaaaacaaaacaaaacaaa

SEQ ID NO: 222953 - RNA, 22 nt, Human
aaacaaaacaaaacaaaacaaa

SEQ ID NO: 222954 - RNA, 22 nt, Human
aaacaaaacaaaacaaaacaaa

SEQ ID NO: 222955 - RNA, 24 nt, Human
aaacaaaacaaaacaaaacacaaa

SEQ ID NO: 222956 - RNA, 25 nt, Human
aaacaaaacacaaaaacuacuguga

SEQ ID NO: 222957 - RNA, 21 nt, Human
aaagcacuagaaaagccccag

SEQ ID NO: 222958 - RNA, 18 nt, Human
aaaugcuccuggcucucc

SEQ ID NO: 222959 - RNA, 26 nt, Human
aaaugcugggaucacaggugugagcc

SEQ ID NO: 222960 - RNA, 19 nt, Human
aacaaaacacaaaaacuac

SEQ ID NO: 222961 - RNA, 18 nt, Human
aagcacucugagauucuu

SEQ ID NO: 222962 - RNA, 21 nt, Human
acaaaacaaaacaaaacaaaa

SEQ ID NO: 222963 - RNA, 21 nt, Human
acaaaacaaaacaaaacaaaa

SEQ ID NO: 222964 - RNA, 30 nt, Human
acaaaacaaaacaaaacaaaacacaaaaaa

SEQ ID NO: 222965 - RNA, 25 nt, Human
acaaaacaaaacaaaacacaaaaaa

SEQ ID NO: 222966 - RNA, 26 nt, Human
acaaaacaaaacaaaacacaaaaacu

SEQ ID NO: 222967 - RNA, 20 nt, Human
acaaaacacaaaaacuacug

SEQ ID NO: 222968 - RNA, 23 nt, Human
acagaacacagcagaggaaaaac

SEQ ID NO: 222969 - RNA, 21 nt, Human
acaggcaccugccaccaugcc

SEQ ID NO: 222970 - RNA, 25 nt, Human
acccgccucggccucccaaaaugcu

SEQ ID NO: 222971 - RNA, 18 nt, Human
acgggguuucaccguguu

SEQ ID NO: 222972 - RNA, 19 nt, Human
acgggguuucaccguguua

SEQ ID NO: 222973 - RNA, 20 nt, Human
acgggguuucaccguguuag

SEQ ID NO: 222974 - RNA, 24 nt, Human
acgggguuucaccguguuagccag

SEQ ID NO: 222975 - RNA, 21 nt, Human
acucaacuauuccccuccccu

SEQ ID NO: 222976 - RNA, 19 nt, Human
acucauccuggccuggccc

SEQ ID NO: 222977 - RNA, 21 nt, Human
acugccauggggggcccaggc

SEQ ID NO: 222978 - RNA, 24 nt, Human
agacccaaaaaaggaagugaccca

SEQ ID NO: 222979 - RNA, 25 nt, Human
aggcuggagugcaguggcaugaucu

SEQ ID NO: 222980 - RNA, 20 nt, Human
aggggacaaggugaugguuc

SEQ ID NO: 222981 - RNA, 18 nt, Human
aguagcugggacuacagg

SEQ ID NO: 222982 - RNA, 20 nt, Human
agugcaguggcaugaucuug

SEQ ID NO: 222983 - RNA, 23 nt, Human
agugcaguggcaugaucuuggcu

SEQ ID NO: 222984 - RNA, 24 nt, Human
agugcaguggcaugaucuuggcuc

SEQ ID NO: 222985 - RNA, 24 nt, Human
aguggcaugaucuuggcucacugc

SEQ ID NO: 222986 - RNA, 18 nt, Human
auccacagcaagccucag

SEQ ID NO: 222987 - RNA, 25 nt, Human
auccacagcaagccucaggguggaa

SEQ ID NO: 222988 - RNA, 24 nt, Human
augauccacccgccucggccuccc

SEQ ID NO: 222989 - RNA, 21 nt, Human
caaaacaaaacaaaacaaaac

SEQ ID NO: 222990 - RNA, 21 nt, Human
caaaacaaaacaaaacaaaac

SEQ ID NO: 222991 - RNA, 22 nt, Human
caaaacaaaacaaaacaaaaca

SEQ ID NO: 222992 - RNA, 24 nt, Human
caaaacaaaacaaaacaaaacaaa

SEQ ID NO: 222993 - RNA, 24 nt, Human
caaaacaaaacaaaacaaaacaaa

SEQ ID NO: 222994 - RNA, 24 nt, Human
caaaacaaaacaaaacacaaaaac

SEQ ID NO: 222995 - RNA, 21 nt, Human
caaaacacaaaaacuacugug

SEQ ID NO: 222996 - RNA, 24 nt, Human
caaaacacaaaaacuacugugaug

SEQ ID NO: 222997 - RNA, 24 nt, Human
caaaaugcugggaucacaggugug

SEQ ID NO: 222998 - RNA, 18 nt, Human
caaccuccaccucccagg

SEQ ID NO: 222999 - RNA, 23 nt, Human
caacuuucuccccaggucacacc

SEQ ID NO: 223000 - RNA, 19 nt, Human
caauaggcuacacuggaca

SEQ ID NO: 223001 - RNA, 21 nt, Human
caccauggggaaacucauccu

SEQ ID NO: 223002 - RNA, 23 nt, Human
cacccgccucggccucccaaaau

SEQ ID NO: 223003 - RNA, 18 nt, Human
caccguguuagccaggau

SEQ ID NO: 223004 - RNA, 24 nt, Human
caccguguuagccaggauggucuc

SEQ ID NO: 223005 - RNA, 18 nt, Human
cacucugagauucuuggg

SEQ ID NO: 223006 - RNA, 21 nt, Human
cacugcaaccuccaccuccca

SEQ ID NO: 223007 - RNA, 19 nt, Human
cagaacacagcagaggaaa

SEQ ID NO: 223008 - RNA, 19 nt, Human
cagcugcugggguuccccc

SEQ ID NO: 223009 - RNA, 23 nt, Human
cagggccaacuggcucaucaugu

SEQ ID NO: 223010 - RNA, 21 nt, Human
caguagagacgggguuucacc

SEQ ID NO: 223011 - RNA, 24 nt, Human
caguagagacgggguuucaccgug

SEQ ID NO: 223012 - RNA, 26 nt, Human
caguagagacgggguuucaccguguu

SEQ ID NO: 223013 - RNA, 26 nt, Human
caguagagacgggguuucaccguugg

SEQ ID NO: 223014 - RNA, 18 nt, Human
caucccagacuagagguu

SEQ ID NO: 223015 - RNA, 22 nt, Human
caugccauucuucugccucagc

SEQ ID NO: 223016 - RNA, 24 nt, Human
ccaaaaugcugggaucacaggugu

SEQ ID NO: 223017 - RNA, 18 nt, Human
ccacaggcuggcugagau

SEQ ID NO: 223018 - RNA, 20 nt, Human
ccaccuucuaagagucacuc

SEQ ID NO: 223019 - RNA, 25 nt, Human
ccagcugcugggguucccccuuggu

SEQ ID NO: 223020 - RNA, 22 nt, Human
ccauccugucccuucacucgcg

SEQ ID NO: 223021 - RNA, 26 nt, Human
cccagaugcugauuuuuaaaugcucc

SEQ ID NO: 223022 - RNA, 20 nt, Human
cccagguucaugccauucuu

SEQ ID NO: 223023 - RNA, 19 nt, Human
ccccaaacagcacacucaa

SEQ ID NO: 223024 - RNA, 22 nt, Human
cccccaaacagcacacucaacu

SEQ ID NO: 223025 - RNA, 24 nt, Human
cccccaaacagcacacucaacuau

SEQ ID NO: 223026 - RNA, 23 nt, Human
cccgaguagcugggacuacaggc

SEQ ID NO: 223027 - RNA, 24 nt, Human
cccgaguagcugggacuacaggca

SEQ ID NO: 223028 - RNA, 21 nt, Human
cccugcucccaggcucugcag

SEQ ID NO: 223029 - RNA, 24 nt, Human
ccucccagguucaugccauucuuc

SEQ ID NO: 223030 - RNA, 20 nt, Human
ccugaccucaugauccaccc

SEQ ID NO: 223031 - RNA, 23 nt, Human
ccuggcccuuagccagcaccuac

SEQ ID NO: 223032 - RNA, 20 nt, Human
ccuugauggcuccugagccc

SEQ ID NO: 223033 - RNA, 22 nt, Human
cgcucuguaccucucaguaaug

SEQ ID NO: 223034 - RNA, 24 nt, Human
cgggguuucaccguguuagccagg

SEQ ID NO: 223035 - RNA, 19 nt, Human
cggugcaggggggcucagg

SEQ ID NO: 223036 - RNA, 24 nt, Human
cucacugcaaccuccaccucccag

SEQ ID NO: 223037 - RNA, 24 nt, Human
cucagcuucccgaguagcugggac

SEQ ID NO: 223038 - RNA, 24 nt, Human
cuccugaccucaugauccacccgc

SEQ ID NO: 223039 - RNA, 18 nt, Human
cuccuugcucuuugcccc

SEQ ID NO: 223040 - RNA, 21 nt, Human
cuccuugcucuuugccccauu

SEQ ID NO: 223041 - RNA, 24 nt, Human
cucgcucugucgcccaggcuggag

SEQ ID NO: 223042 - RNA, 21 nt, Human
cucuccuugcucuuugcccca

SEQ ID NO: 223043 - RNA, 18 nt, Human
cucucucucucucucucu

SEQ ID NO: 223044 - RNA, 18 nt, Human
cucucucucucucucucu

SEQ ID NO: 223045 - RNA, 18 nt, Human
cucucucucucucucucu

SEQ ID NO: 223046 - RNA, 18 nt, Human
cucucucucucucucucu

SEQ ID NO: 223047 - RNA, 18 nt, Human
cucucucucucucucucu

SEQ ID NO: 223048 - RNA, 18 nt, Human
cucucucucucucucucu

SEQ ID NO: 223049 - RNA, 18 nt, Human
cucucucucucucucucu

SEQ ID NO: 223050 - RNA, 18 nt, Human
cucucucucucucucucu

SEQ ID NO: 223051 - RNA, 20 nt, Human
cucugucgcccaggcuggag

SEQ ID NO: 223052 - RNA, 23 nt, Human
cucugucgcccaggcuggagugc

SEQ ID NO: 223053 - RNA, 23 nt, Human
cugaauaauuccccagagauuaa

SEQ ID NO: 223054 - RNA, 23 nt, Human
cugcaaccuccaccucccagguu

SEQ ID NO: 223055 - RNA, 24 nt, Human
cugcaaccuccaccucccagguuc

SEQ ID NO: 223056 - RNA, 18 nt, Human
cugcagugucuguguuca

SEQ ID NO: 223057 - RNA, 24 nt, Human
cuggagugcaguggcaugaucuug

SEQ ID NO: 223058 - RNA, 21 nt, Human
cuggcccagaugcugauuuuu

SEQ ID NO: 223059 - RNA, 20 nt, Human
cuggcucaucauguccccug

SEQ ID NO: 223060 - RNA, 24 nt, Human
cuggcugagauugugaaaaaaaca

SEQ ID NO: 223061 - RNA, 18 nt, Human
cuugggucacucccuuuc

SEQ ID NO: 223062 - RNA, 22 nt, Human
gaaaaaaacaaaacaaaacaaa

SEQ ID NO: 223063 - RNA, 18 nt, Human
gaaggaaugaggggacaa

SEQ ID NO: 223064 - RNA, 21 nt, Human
gaaugaggggacaaggugaug

SEQ ID NO: 223065 - RNA, 22 nt, Human
gaccucaugauccacccgccuc

SEQ ID NO: 223066 - RNA, 24 nt, Human
gacuacaggcaccugccaccaugc

SEQ ID NO: 223067 - RNA, 24 nt, Human
gagacgggguuucaccguguuagc

SEQ ID NO: 223068 - RNA, 23 nt, Human
gagcuuccgagucccacugaugc

SEQ ID NO: 223069 - RNA, 18 nt, Human
gagggcuggguuuauggu

SEQ ID NO: 223070 - RNA, 20 nt, Human
gaguagcugggacuacaggc

SEQ ID NO: 223071 - RNA, 25 nt, Human
gaguagcugggacuacaggcaccug

SEQ ID NO: 223072 - RNA, 18 nt, Human
gaucacaggugugagcca

SEQ ID NO: 223073 - RNA, 21 nt, Human
gaugguucucucuagguguca

SEQ ID NO: 223074 - RNA, 22 nt, Human
gcaaccuccaccucccagguuc

SEQ ID NO: 223075 - RNA, 21 nt, Human
gcagcuggaacaaucucucuc

SEQ ID NO: 223076 - RNA, 23 nt, Human
gcccaggcuggagugcaguggca

SEQ ID NO: 223077 - RNA, 24 nt, Human
gcccaggcuggagugcaguggcau

SEQ ID NO: 223078 - RNA, 19 nt, Human
gccccuugggucacucccu

SEQ ID NO: 223079 - RNA, 24 nt, Human
gccucagcuucccgaguagcuggg

SEQ ID NO: 223080 - RNA, 23 nt, Human
gccucggccucccaaaaugcugg

SEQ ID NO: 223081 - RNA, 20 nt, Human
gcuccugagcccccaaacag

SEQ ID NO: 223082 - RNA, 19 nt, Human
gcuggagugcaguggcaug

SEQ ID NO: 223083 - RNA, 24 nt, Human
ggaaaaacacacacauuuggcaga

SEQ ID NO: 223084 - RNA, 19 nt, Human
ggccccuugggucacuccc

SEQ ID NO: 223085 - RNA, 20 nt, Human
ggccccuugggucacucccu

SEQ ID NO: 223086 - RNA, 20 nt, Human
gggacuccccagccccugcc

SEQ ID NO: 223087 - RNA, 18 nt, Human
ggggcugucuagucccag

SEQ ID NO: 223088 - RNA, 20 nt, Human
gggggcccaggcaggaugcc

SEQ ID NO: 223089 - RNA, 23 nt, Human
gggguuucaccguguuagccagg

SEQ ID NO: 223090 - RNA, 19 nt, Human
ggucacucccuuucucuag

SEQ ID NO: 223091 - RNA, 20 nt, Human
ggucucgaucuccugaccuc

SEQ ID NO: 223092 - RNA, 23 nt, Human
guagagacgggguuucaccgugu

SEQ ID NO: 223093 - RNA, 19 nt, Human
gugcaggggggcucagggc

SEQ ID NO: 223094 - RNA, 23 nt, Human
uaaaaggaauugccuaugugaua

SEQ ID NO: 223095 - RNA, 18 nt, Human
uaacuucugggguguccc

SEQ ID NO: 223096 - RNA, 22 nt, Human
uaaguugaaacacugaauaauu

SEQ ID NO: 223097 - RNA, 24 nt, Human
uaauuuuuucuauuuucaguagag

SEQ ID NO: 223098 - RNA, 20 nt, Human
uacaagaggcagcacugcca

SEQ ID NO: 223099 - RNA, 21 nt, Human
uacacuggacacacagaacac

SEQ ID NO: 223100 - RNA, 22 nt, Human
uacaggcaccugccaccaugcc

SEQ ID NO: 223101 - RNA, 18 nt, Human
uagagacgggguuucacc

SEQ ID NO: 223102 - RNA, 23 nt, Human
uaggccaggaagcugcugaugcc

SEQ ID NO: 223103 - RNA, 24 nt, Human
ucaccguguuagccaggauggucu

SEQ ID NO: 223104 - RNA, 22 nt, Human
ucacucccuuucucuagcgaga

SEQ ID NO: 223105 - RNA, 24 nt, Human
ucacugcaaccuccaccucccagg

SEQ ID NO: 223106 - RNA, 25 nt, Human
ucacugcaaccuccaccucccaggu

SEQ ID NO: 223107 - RNA, 26 nt, Human
ucacugcaaccuccaccucccagguu

SEQ ID NO: 223108 - RNA, 23 nt, Human
ucagcuucccgaguagcugggac

SEQ ID NO: 223109 - RNA, 22 nt, Human
ucaguagagacgggguuucacc

SEQ ID NO: 223110 - RNA, 24 nt, Human
ucaguagagacgggguuucaccgu

SEQ ID NO: 223111 - RNA, 18 nt, Human
ucaugagggcucugugag

SEQ ID NO: 223112 - RNA, 22 nt, Human
uccaauaggcuacacuggacac

SEQ ID NO: 223113 - RNA, 25 nt, Human
uccacagcaagccucaggguggaag

SEQ ID NO: 223114 - RNA, 24 nt, Human
uccacccgccucggccucccaaaa

SEQ ID NO: 223115 - RNA, 23 nt, Human
ucccaaaaugcugggaucacagg

SEQ ID NO: 223116 - RNA, 20 nt, Human
ucccagguucaugccauucu

SEQ ID NO: 223117 - RNA, 21 nt, Human
ucccagguucaugccauucuu

SEQ ID NO: 223118 - RNA, 24 nt, Human
ucccagguucaugccauucuucug

SEQ ID NO: 223119 - RNA, 20 nt, Human
uccccagagauuaauuucug

SEQ ID NO: 223120 - RNA, 24 nt, Human
ucccgaguagcugggacuacaggc

SEQ ID NO: 223121 - RNA, 18 nt, Human
ucccuuucucuagcgaga

SEQ ID NO: 223122 - RNA, 22 nt, Human
uccgagucccacugaugcuaac

SEQ ID NO: 223123 - RNA, 23 nt, Human
uccugagcccccaaacagcacac

SEQ ID NO: 223124 - RNA, 25 nt, Human
uccugagcccccaaacagcacacuc

SEQ ID NO: 223125 - RNA, 19 nt, Human
uccugugggcagagguacc

SEQ ID NO: 223126 - RNA, 24 nt, Human
ucgcccaggcuggagugcaguggc

SEQ ID NO: 223127 - RNA, 24 nt, Human
ucgcucugucgcccaggcuggagu

SEQ ID NO: 223128 - RNA, 18 nt, Human
ucggccucccaaaaugcu

SEQ ID NO: 223129 - RNA, 19 nt, Human
ucucgcucugucgcccagg

SEQ ID NO: 223130 - RNA, 22 nt, Human
ucucgcucugucgcccaggcug

SEQ ID NO: 223131 - RNA, 23 nt, Human
ucucgcucugucgcccaggcugg

SEQ ID NO: 223132 - RNA, 24 nt, Human
ucucgcucugucgcccaggcugga

SEQ ID NO: 223133 - RNA, 26 nt, Human
ucucgcucugucgcccaggcuggagu

SEQ ID NO: 223134 - RNA, 27 nt, Human
ucucgcucugucgcccaggcuggagug

SEQ ID NO: 223135 - RNA, 26 nt, Human
ucucucugugugugugugugugugug

SEQ ID NO: 223136 - RNA, 24 nt, Human
ucugccucagcuucccgaguagcu

SEQ ID NO: 223137 - RNA, 24 nt, Human
ucugucgcccaggcuggagugcag

SEQ ID NO: 223138 - RNA, 24 nt, Human
ucugugugugugugugugugugug

SEQ ID NO: 223139 - RNA, 18 nt, Human
ucuuugccccauuccugu

SEQ ID NO: 223140 - RNA, 23 nt, Human
ugaaaaaaacaaaacaaaacaaa

SEQ ID NO: 223141 - RNA, 24 nt, Human
ugaaaaaaacaaaacaaaacaaaa

SEQ ID NO: 223142 - RNA, 24 nt, Human
ugaaacacugaauaauuccccaga

SEQ ID NO: 223143 - RNA, 23 nt, Human
ugacacucaacuuucuccccagg

SEQ ID NO: 223144 - RNA, 24 nt, Human
ugacccagggcauggagagaacag

SEQ ID NO: 223145 - RNA, 24 nt, Human
ugaccccacggaggagcuguagcu

SEQ ID NO: 223146 - RNA, 23 nt, Human
ugaccucaugauccacccgccuc

SEQ ID NO: 223147 - RNA, 22 nt, Human
ugagauggagucucgcucuguc

SEQ ID NO: 223148 - RNA, 22 nt, Human
ugagcucucaucagguaagucu

SEQ ID NO: 223149 - RNA, 18 nt, Human
ugaggggacaaggugaug

SEQ ID NO: 223150 - RNA, 22 nt, Human
ugcaguggcaugaucuuggcuc

SEQ ID NO: 223151 - RNA, 22 nt, Human
ugccaugaccccacggaggagc

SEQ ID NO: 223152 - RNA, 21 nt, Human
ugccauggggggcccaggcag

SEQ ID NO: 223153 - RNA, 20 nt, Human
ugccccauuccuguuucagg

SEQ ID NO: 223154 - RNA, 24 nt, Human
ugccucagcuucccgaguagcugg

SEQ ID NO: 223155 - RNA, 24 nt, Human
ugcugggaucacaggugugagcca

SEQ ID NO: 223156 - RNA, 24 nt, Human
uggagucucgcucugucgcccagg

SEQ ID NO: 223157 - RNA, 19 nt, Human
uggagugcaguggcaugau

SEQ ID NO: 223158 - RNA, 24 nt, Human
uggagugcaguggcaugaucuugg

SEQ ID NO: 223159 - RNA, 24 nt, Human
uggauggaucuuaacucaugaggg

SEQ ID NO: 223160 - RNA, 19 nt, Human
uggcaugaucuuggcucac

SEQ ID NO: 223161 - RNA, 21 nt, Human
uggcaugaucuuggcucacug

SEQ ID NO: 223162 - RNA, 20 nt, Human
uggcuccugagcccccaaac

SEQ ID NO: 223163 - RNA, 22 nt, Human
uggcugagauugugaaaaaaac

SEQ ID NO: 223164 - RNA, 21 nt, Human
ugggacuacaggcaccugcca

SEQ ID NO: 223165 - RNA, 22 nt, Human
ugggacuacaggcaccugccac

SEQ ID NO: 223166 - RNA, 24 nt, Human
ugggacuacaggcaccugccacca

SEQ ID NO: 223167 - RNA, 25 nt, Human
ugggacuacaggcaccugccaccau

SEQ ID NO: 223168 - RNA, 20 nt, Human
ugggagcugugagggcuggg

SEQ ID NO: 223169 - RNA, 18 nt, Human
ugggaucacaggugugag

SEQ ID NO: 223170 - RNA, 19 nt, Human
ugggaucacaggugugagc

SEQ ID NO: 223171 - RNA, 21 nt, Human
ugggaucacaggugugagcca

SEQ ID NO: 223172 - RNA, 22 nt, Human
ugggaucacaggugugagccau

SEQ ID NO: 223173 - RNA, 26 nt, Human
ugggaucacaggugugagccaucuug

SEQ ID NO: 223174 - RNA, 28 nt, Human
ugggaucacaggugugagccaucuugcc

SEQ ID NO: 223175 - RNA, 28 nt, Human
uggugggaggugcagggcacagugugau

SEQ ID NO: 223176 - RNA, 24 nt, Human
ugugaaaaaaacaaaacaaaacaa

SEQ ID NO: 223177 - RNA, 18 nt, Human
uguguguguguguguaua

SEQ ID NO: 223178 - RNA, 18 nt, Human
ugugugugugugugugug

SEQ ID NO: 223179 - RNA, 18 nt, Human
ugugugugugugugugug

SEQ ID NO: 223180 - RNA, 18 nt, Human
ugugugugugugugugug

SEQ ID NO: 223181 - RNA, 18 nt, Human
ugugugugugugugugug

SEQ ID NO: 223182 - RNA, 18 nt, Human
ugugugugugugugugug

SEQ ID NO: 223183 - RNA, 22 nt, Human
uguguguguguguguguguaua

SEQ ID NO: 223184 - RNA, 21 nt, Human
ugugugugugugugugugugu

SEQ ID NO: 223185 - RNA, 21 nt, Human
ugugugugugugugugugugu

SEQ ID NO: 223186 - RNA, 21 nt, Human
ugugugugugugugugugugu

SEQ ID NO: 223187 - RNA, 21 nt, Human
ugugugugugugugugugugu

SEQ ID NO: 223188 - RNA, 21 nt, Human
ugugugugugugugugugugu

SEQ ID NO: 223189 - RNA, 21 nt, Human
ugugugugugugugugugugu

SEQ ID NO: 223190 - RNA, 22 nt, Human
ugugugugugugugugugugua

SEQ ID NO: 223191 - RNA, 22 nt, Human
ugugugugugugugugugugug

SEQ ID NO: 223192 - RNA, 22 nt, Human
ugugugugugugugugugugug

SEQ ID NO: 223193 - RNA, 25 nt, Human
uuagcggcggugcaggggggcucuu

SEQ ID NO: 223194 - RNA, 19 nt, Human
uucaugccauucuucugcc

SEQ ID NO: 223195 - RNA, 21 nt, Human
uugccuggcccagaugcugau

SEQ ID NO: 223196 - RNA, 18 nt, Human
uugggccaaaaagcacua

SEQ ID NO: 223197 - RNA, 19 nt, Human
uuucaccguguuagccagg

SEQ ID NO: 223198 - RNA, 24 nt, Human
uuuucaguagagacgggguuucac

SEQ ID NO: 223199 - RNA, 25 nt, Human
uuuuuuuuuuuugagauggagucuc

SEQ ID NO: 223200 - RNA, 22 nt, Human
uuuuuuuuuuuuuugagaugga

SEQ ID NO: 223201 - RNA, 23 nt, Human
aaaaaaaaaauccccgguuagga

SEQ ID NO: 223202 - RNA, 20 nt, Human
aaaaaagaaaaggaaaagaa

SEQ ID NO: 223203 - RNA, 24 nt, Human
aaaaggaaaagaaaaaaacuggaa

SEQ ID NO: 223204 - RNA, 21 nt, Human
aaacggagcaagacugaacaa

SEQ ID NO: 223205 - RNA, 26 nt, Human
aaauauaaacaaauaaagaacaaagc

SEQ ID NO: 223206 - RNA, 20 nt, Human
aaaugcaaaaaagaaaagga

SEQ ID NO: 223207 - RNA, 18 nt, Human
aagaacaaagcaagagag

SEQ ID NO: 223208 - RNA, 24 nt, Human
aagaacaaagcaagagagacagaa

SEQ ID NO: 223209 - RNA, 20 nt, Human
aauauccagcacaacauugu

SEQ ID NO: 223210 - RNA, 18 nt, Human
aaucaugaucuccucucu

SEQ ID NO: 223211 - RNA, 19 nt, Human
aaugcaaaaaagaaaagga

SEQ ID NO: 223212 - RNA, 18 nt, Human
acaaagcaagagagacag

SEQ ID NO: 223213 - RNA, 19 nt, Human
acaaagcaagagagacaga

SEQ ID NO: 223214 - RNA, 21 nt, Human
acaaagcaagagagacagaaa

SEQ ID NO: 223215 - RNA, 19 nt, Human
acaaaugagggcacuuugc

SEQ ID NO: 223216 - RNA, 18 nt, Human
acaaggaaagauuguguu

SEQ ID NO: 223217 - RNA, 22 nt, Human
agaagagaaggguuugcccagc

SEQ ID NO: 223218 - RNA, 27 nt, Human
agacagaaaaagaaagagaagggaccc

SEQ ID NO: 223219 - RNA, 23 nt, Human
agacagaaaaagaaagagaauga

SEQ ID NO: 223220 - RNA, 18 nt, Human
agagacagaaaaagaaag

SEQ ID NO: 223221 - RNA, 20 nt, Human
agagacagaaaaagaaagag

SEQ ID NO: 223222 - RNA, 23 nt, Human
agcaagagagacagaaaaagaaa

SEQ ID NO: 223223 - RNA, 20 nt, Human
agcgcggagagcagggcugg

SEQ ID NO: 223224 - RNA, 22 nt, Human
agggaaggaaaugcaaaaaaga

SEQ ID NO: 223225 - RNA, 22 nt, Human
aggggcgcgcguuugggcaggg

SEQ ID NO: 223226 - RNA, 28 nt, Human
auauaucuaaaccuacauuaaugauaca

SEQ ID NO: 223227 - RNA, 26 nt, Human
augagagacaaggaaagauuguguug

SEQ ID NO: 223228 - RNA, 21 nt, Human
caaaaaagaaaaggaaaagaa

SEQ ID NO: 223229 - RNA, 22 nt, Human
caaagcaagagagacagaaaaa

SEQ ID NO: 223230 - RNA, 25 nt, Human
caagagagacagaaaaagaaagaga

SEQ ID NO: 223231 - RNA, 23 nt, Human
caccagaaaccuugcuugucaua

SEQ ID NO: 223232 - RNA, 20 nt, Human
cacccuguaguagaugaaau

SEQ ID NO: 223233 - RNA, 24 nt, Human
cagcaccgagaggcuguuaggaga

SEQ ID NO: 223234 - RNA, 23 nt, Human
caugaaauccgcagauucaauga

SEQ ID NO: 223235 - RNA, 21 nt, Human
ccagcacaacauugucagagc

SEQ ID NO: 223236 - RNA, 20 nt, Human
ccgcccgcccagccucucca

SEQ ID NO: 223237 - RNA, 22 nt, Human
cgcgggucuccaccccuccgcc

SEQ ID NO: 223238 - RNA, 24 nt, Human
cggcguccgcgggucuccaccccu

SEQ ID NO: 223239 - RNA, 21 nt, Human
cggcuccagguccggcuuccc

SEQ ID NO: 223240 - RNA, 18 nt, Human
cggcuucccggcguccgc

SEQ ID NO: 223241 - RNA, 26 nt, Human
cguuugggcagggacgggggagggag

SEQ ID NO: 223242 - RNA, 23 nt, Human
cucugugucucacugaaugaaua

SEQ ID NO: 223243 - RNA, 22 nt, Human
cugcaauauccagcacaacauu

SEQ ID NO: 223244 - RNA, 23 nt, Human
cugccacacccacaugggggcaa

SEQ ID NO: 223245 - RNA, 18 nt, Human
cugggcccaagggagggg

SEQ ID NO: 223246 - RNA, 24 nt, Human
cugggcccuguaacugccacaccc

SEQ ID NO: 223247 - RNA, 20 nt, Human
cuguaacugccacacccaca

SEQ ID NO: 223248 - RNA, 22 nt, Human
cuugaagauuuguuuucugguc

SEQ ID NO: 223249 - RNA, 22 nt, Human
gaaguggggaaagauaagagug

SEQ ID NO: 223250 - RNA, 21 nt, Human
gacgggggagggagacugggu

SEQ ID NO: 223251 - RNA, 22 nt, Human
gagaaugagagacaaggaaaga

SEQ ID NO: 223252 - RNA, 24 nt, Human
gagaccaggcuugggccacaaaug

SEQ ID NO: 223253 - RNA, 22 nt, Human
gagcagggcugggcgcugggcc

SEQ ID NO: 223254 - RNA, 20 nt, Human
gauaagaguggcagaagaaa

SEQ ID NO: 223255 - RNA, 20 nt, Human
gcaagagagacagaaaaaga

SEQ ID NO: 223256 - RNA, 19 nt, Human
gcccaagggaggggcggag

SEQ ID NO: 223257 - RNA, 20 nt, Human
ggaaggaaaugcaaaaaaga

SEQ ID NO: 223258 - RNA, 18 nt, Human
ggaaugaaguggggaaag

SEQ ID NO: 223259 - RNA, 20 nt, Human
ggcuguuaggagacuccauu

SEQ ID NO: 223260 - RNA, 22 nt, Human
gggaaagauaagaguggcagaa

SEQ ID NO: 223261 - RNA, 18 nt, Human
gggacgggggagggagac

SEQ ID NO: 223262 - RNA, 19 nt, Human
gggcccaagggaggggcgg

SEQ ID NO: 223263 - RNA, 22 nt, Human
gggcugggcgcugggcccaagg

SEQ ID NO: 223264 - RNA, 18 nt, Human
guacuuuuguacaugcug

SEQ ID NO: 223265 - RNA, 21 nt, Human
guggcagaagaaaaaaaaaaa

SEQ ID NO: 223266 - RNA, 22 nt, Human
uaaauaggcaccagaaaccuug

SEQ ID NO: 223267 - RNA, 25 nt, Human
uaacugagagagggcagguagauau

SEQ ID NO: 223268 - RNA, 20 nt, Human
uacaaaaagaaaauaauuac

SEQ ID NO: 223269 - RNA, 18 nt, Human
uacauaaggcauauauau

SEQ ID NO: 223270 - RNA, 19 nt, Human
uacuuuuguacaugcuggg

SEQ ID NO: 223271 - RNA, 20 nt, Human
uagcagugcugugcuauggu

SEQ ID NO: 223272 - RNA, 23 nt, Human
uaguagaugaaaugaauugggau

SEQ ID NO: 223273 - RNA, 19 nt, Human
uauuguacaacacaugcag

SEQ ID NO: 223274 - RNA, 18 nt, Human
uccagccaggugcggccg

SEQ ID NO: 223275 - RNA, 25 nt, Human
uccaugucuaccuugucaaucugaa

SEQ ID NO: 223276 - RNA, 21 nt, Human
ucccucuggccgagcgcggag

SEQ ID NO: 223277 - RNA, 25 nt, Human
uccuuacaucugcaccuugaaagca

SEQ ID NO: 223278 - RNA, 19 nt, Human
ucugcucgcggcugcuccg

SEQ ID NO: 223279 - RNA, 22 nt, Human
ugaaacggagcaagacugaaca

SEQ ID NO: 223280 - RNA, 21 nt, Human
ugaauaacugagagagggcag

SEQ ID NO: 223281 - RNA, 18 nt, Human
ugaaugaauaaauaggca

SEQ ID NO: 223282 - RNA, 20 nt, Human
ugagagacaaggaaagauug

SEQ ID NO: 223283 - RNA, 28 nt, Human
ugcaaaaaagaaaaggaaaagaaaaaaa

SEQ ID NO: 223284 - RNA, 23 nt, Human
ugcuccggcuccagguccggcuu

SEQ ID NO: 223285 - RNA, 22 nt, Human
uggcagaagaaaaaaaaaaauc

SEQ ID NO: 223286 - RNA, 23 nt, Human
uggcagaagaaaaaaaaaaaucc

SEQ ID NO: 223287 - RNA, 18 nt, Human
uggggggagaagagaagg

SEQ ID NO: 223288 - RNA, 21 nt, Human
uggggggagaagagaaggguu

SEQ ID NO: 223289 - RNA, 19 nt, Human
uguacaacacaugcaggua

SEQ ID NO: 223290 - RNA, 21 nt, Human
uguuaggagacuccauucugc

SEQ ID NO: 223291 - RNA, 21 nt, Human
uuaaauccuuacaucugcacc

SEQ ID NO: 223292 - RNA, 23 nt, Human
uucccggcguccgcgggucucca

SEQ ID NO: 223293 - RNA, 23 nt, Human
uucuaaaguuauauaucuaaacc

SEQ ID NO: 223294 - RNA, 22 nt, Human
uugucuucagcucaccugggcc

SEQ ID NO: 223295 - RNA, 18 nt, Human
uuucacaucagcaccgag

SEQ ID NO: 223296 - RNA, 25 nt, Human
uuugggaggagaccaggcuugggcc

SEQ ID NO: 223297 - RNA, 24 nt, Human
aaacaagcauaagccaugaauccu

SEQ ID NO: 223298 - RNA, 25 nt, Human
aaacaagcauaagccaugaauccuc

SEQ ID NO: 223299 - RNA, 28 nt, Human
aaacaagcauaagccaugaauccuccac

SEQ ID NO: 223300 - RNA, 19 nt, Human
accaggggccgcccaggcg

SEQ ID NO: 223301 - RNA, 21 nt, Human
aggcggagggacaaauugggg

SEQ ID NO: 223302 - RNA, 20 nt, Human
auaaaauguagaaggacaca

SEQ ID NO: 223303 - RNA, 20 nt, Human
caccugccucuccgucccug

SEQ ID NO: 223304 - RNA, 19 nt, Human
cagcuuagccaccucccuc

SEQ ID NO: 223305 - RNA, 19 nt, Human
cagcuuagccaccucccuc

SEQ ID NO: 223306 - RNA, 24 nt, Human
cagugcccagcauaaaccgucaaa

SEQ ID NO: 223307 - RNA, 20 nt, Human
cccucucaccugccucuccg

SEQ ID NO: 223308 - RNA, 24 nt, Human
cccuggacacccguccucagacuc

SEQ ID NO: 223309 - RNA, 24 nt, Human
cggcgggccgcgggcaggucccuc

SEQ ID NO: 223310 - RNA, 21 nt, Human
cgggaccaggggccgcccagg

SEQ ID NO: 223311 - RNA, 18 nt, Human
cguguccuaaggagaaga

SEQ ID NO: 223312 - RNA, 20 nt, Human
cuccggguagcgggcgcggc

SEQ ID NO: 223313 - RNA, 27 nt, Human
gcccaggcggagggacaaauugggggc

SEQ ID NO: 223314 - RNA, 18 nt, Human
gcgcgcgggaccaggggc

SEQ ID NO: 223315 - RNA, 19 nt, Human
ggaccuccuugcacacgcc

SEQ ID NO: 223316 - RNA, 20 nt, Human
ggaccuccuugcacacgccg

SEQ ID NO: 223317 - RNA, 19 nt, Human
ggcaggucccucgcucucc

SEQ ID NO: 223318 - RNA, 18 nt, Human
gggcgcggcggcuggacc

SEQ ID NO: 223319 - RNA, 18 nt, Human
ucccucucaccugccucu

SEQ ID NO: 223320 - RNA, 22 nt, Human
ucucaccugccucuccgucccu

SEQ ID NO: 223321 - RNA, 24 nt, Human
uguccuaaggagaagaguuaaaau

SEQ ID NO: 223322 - RNA, 23 nt, Human
uguuccagcucugguucagucug

SEQ ID NO: 223323 - RNA, 26 nt, Human
aaaaugaacauacuuaagccucuucc

SEQ ID NO: 223324 - RNA, 20 nt, Human
aaagccaaagccaaggccaa

SEQ ID NO: 223325 - RNA, 23 nt, Human
aaagccaaggccaacgccgcaga

SEQ ID NO: 223326 - RNA, 23 nt, Human
aagagaaaucaaaagaaacaaaa

SEQ ID NO: 223327 - RNA, 20 nt, Human
aagccaaagccaaggccaaa

SEQ ID NO: 223328 - RNA, 22 nt, Human
aagccaaggccaacgccgcaga

SEQ ID NO: 223329 - RNA, 23 nt, Human
acagaauauaaacauauuuauac

SEQ ID NO: 223330 - RNA, 19 nt, Human
acauugcaaacaguagcua

SEQ ID NO: 223331 - RNA, 18 nt, Human
acuacacuaggaucuggu

SEQ ID NO: 223332 - RNA, 23 nt, Human
agccaucagcuaaaugaucuaaa

SEQ ID NO: 223333 - RNA, 28 nt, Human
agccucuuccuugcacccugacccuggu

SEQ ID NO: 223334 - RNA, 21 nt, Human
aguuucagaacuacacuagga

SEQ ID NO: 223335 - RNA, 22 nt, Human
caaagccaaagccaaggccaac

SEQ ID NO: 223336 - RNA, 21 nt, Human
caaagccaaggccaacgccgc

SEQ ID NO: 223337 - RNA, 22 nt, Human
caccgccgccgccaaagccaaa

SEQ ID NO: 223338 - RNA, 24 nt, Human
caccgccgccgccaaagccaaagc

SEQ ID NO: 223339 - RNA, 20 nt, Human
cagcauacugcuucaaguau

SEQ ID NO: 223340 - RNA, 25 nt, Human
cauugcaaacaguagcuauuucuua

SEQ ID NO: 223341 - RNA, 21 nt, Human
ccaaaaauaaucauuuugggu

SEQ ID NO: 223342 - RNA, 20 nt, Human
ccaaagccaaagccaaggcc

SEQ ID NO: 223343 - RNA, 21 nt, Human
ccaaagccaaagccaaggccc

SEQ ID NO: 223344 - RNA, 26 nt, Human
ccaaagccaaggccaacgccgcagac

SEQ ID NO: 223345 - RNA, 22 nt, Human
ccaacgccgcagaccggccgga

SEQ ID NO: 223346 - RNA, 22 nt, Human
ccaccgccgccgccaaagccaa

SEQ ID NO: 223347 - RNA, 19 nt, Human
ccaguuaaaaguauaaaau

SEQ ID NO: 223348 - RNA, 19 nt, Human
ccccaaaguuuccaguuaa

SEQ ID NO: 223349 - RNA, 18 nt, Human
cccccgcccccgcccggg

SEQ ID NO: 223350 - RNA, 18 nt, Human
ccccgcccccgcccgggc

SEQ ID NO: 223351 - RNA, 20 nt, Human
ccccgcccgggccuggcucc

SEQ ID NO: 223352 - RNA, 24 nt, Human
ccccgccgcccccgcccccgcccg

SEQ ID NO: 223353 - RNA, 20 nt, Human
cccgcccgccgcccgcuccc

SEQ ID NO: 223354 - RNA, 22 nt, Human
cccgccgcccccgcccccgccc

SEQ ID NO: 223355 - RNA, 19 nt, Human
cccgcgcgcccgcccgccc

SEQ ID NO: 223356 - RNA, 19 nt, Human
ccgccccgcuccuccgggc

SEQ ID NO: 223357 - RNA, 20 nt, Human
ccgccccgcuccuccgggca

SEQ ID NO: 223358 - RNA, 22 nt, Human
ccgcccgcucccccgcgcgccc

SEQ ID NO: 223359 - RNA, 20 nt, Human
ccgcccgggccuggcucccg

SEQ ID NO: 223360 - RNA, 18 nt, Human
ccgccgcccccgcccccg

SEQ ID NO: 223361 - RNA, 19 nt, Human
ccgccgcccccgcccccgc

SEQ ID NO: 223362 - RNA, 21 nt, Human
ccgccgcccccgcccccgccc

SEQ ID NO: 223363 - RNA, 23 nt, Human
ccgccgcccccgcccccgcccgg

SEQ ID NO: 223364 - RNA, 28 nt, Human
ccgccgcccgcucccccgcgcgcccgcc

SEQ ID NO: 223365 - RNA, 25 nt, Human
ccgcucccccgcgcgcccgcccgcc

SEQ ID NO: 223366 - RNA, 22 nt, Human
ccgcuccuccgggcagcgccgu

SEQ ID NO: 223367 - RNA, 27 nt, Human
ccuccgggcagcgccgucuuccugccc

SEQ ID NO: 223368 - RNA, 21 nt, Human
cgccaaagccaaagccaaggc

SEQ ID NO: 223369 - RNA, 23 nt, Human
cgcccccgcccccgcccgggccu

SEQ ID NO: 223370 - RNA, 19 nt, Human
cgccccgcuccuccgggca

SEQ ID NO: 223371 - RNA, 20 nt, Human
cgcccgggccuggcucccgc

SEQ ID NO: 223372 - RNA, 18 nt, Human
cgccgcagaccggccgga

SEQ ID NO: 223373 - RNA, 18 nt, Human
cgcgcgcccgcccgcccc

SEQ ID NO: 223374 - RNA, 24 nt, Human
cgcgcgcccgcccgccccgcuccu

SEQ ID NO: 223375 - RNA, 24 nt, Human
cuuaguuucagaacuacacuagga

SEQ ID NO: 223376 - RNA, 18 nt, Human
cuucuaaccacagcagca

SEQ ID NO: 223377 - RNA, 27 nt, Human
cuugcacccugacccuggugcucuagc

SEQ ID NO: 223378 - RNA, 19 nt, Human
gcccccgcccccgcccggg

SEQ ID NO: 223379 - RNA, 20 nt, Human
gccccgcuccuccgggcagc

SEQ ID NO: 223380 - RNA, 20 nt, Human
gccccgcuccuccgggcagc

SEQ ID NO: 223381 - RNA, 23 nt, Human
gcccgcucccccgcgcgcccgcc

SEQ ID NO: 223382 - RNA, 22 nt, Human
gccgccgccaaagccaaagcca

SEQ ID NO: 223383 - RNA, 18 nt, Human
ggccuggcucccgcccgc

SEQ ID NO: 223384 - RNA, 19 nt, Human
gugaccuaaaccauaugua

SEQ ID NO: 223385 - RNA, 18 nt, Human
uaaaacacaucucuaugc

SEQ ID NO: 223386 - RNA, 26 nt, Human
uacacauaaaccuauuuauaaaacac

SEQ ID NO: 223387 - RNA, 18 nt, Human
uaguauaaagagaaaucc

SEQ ID NO: 223388 - RNA, 18 nt, Human
uauuguagcaacucugga

SEQ ID NO: 223389 - RNA, 22 nt, Human
ucccgcccgccgcccgcucccc

SEQ ID NO: 223390 - RNA, 23 nt, Human
ucucaaguuuauuauuccccuua

SEQ ID NO: 223391 - RNA, 21 nt, Human
ugauaaaaaugaacauacuua

SEQ ID NO: 223392 - RNA, 21 nt, Human
ugcaaaccccaaaguuuccag

SEQ ID NO: 223393 - RNA, 21 nt, Human
ugcacccugacccuggugcuc

SEQ ID NO: 223394 - RNA, 23 nt, Human
ugcuggggucacagcuucuuugu

SEQ ID NO: 223395 - RNA, 19 nt, Human
uggcucccgcccgccgccc

SEQ ID NO: 223396 - RNA, 26 nt, Human
uggguacaugcaaaccaguacacaua

SEQ ID NO: 223397 - RNA, 23 nt, Human
uucuccaccgccgccgccaaagc

SEQ ID NO: 223398 - RNA, 23 nt, Human
uuugucacauaugaauuuuaggu

SEQ ID NO: 223399 - RNA, 24 nt, Human
aaaacaucguggcgcaaagucucc

SEQ ID NO: 223400 - RNA, 25 nt, Human
aacacacacacacacacacacaacg

SEQ ID NO: 223401 - RNA, 18 nt, Human
aacgcucaguccaagacc

SEQ ID NO: 223402 - RNA, 18 nt, Human
aagaugccgcuccaagcg

SEQ ID NO: 223403 - RNA, 21 nt, Human
aaggcugggaaagcccgaaaa

SEQ ID NO: 223404 - RNA, 27 nt, Human
acacacaacgcucaguccaagaccaau

SEQ ID NO: 223405 - RNA, 25 nt, Human
acacacacacacaacgcucagucca

SEQ ID NO: 223406 - RNA, 22 nt, Human
acacacacacacacacacaacg

SEQ ID NO: 223407 - RNA, 23 nt, Human
acacacacacacacacacacaca

SEQ ID NO: 223408 - RNA, 26 nt, Human
acacacacacacacacacacacaacg

SEQ ID NO: 223409 - RNA, 20 nt, Human
acauaaccagcucccaccca

SEQ ID NO: 223410 - RNA, 20 nt, Human
acauaaccagcucccaccca

SEQ ID NO: 223411 - RNA, 22 nt, Human
acauaaccagcucccacccaau

SEQ ID NO: 223412 - RNA, 27 nt, Human
accccagaaaaagacaggugggaaaau

SEQ ID NO: 223413 - RNA, 21 nt, Human
acuagguaugaugcacugaau

SEQ ID NO: 223414 - RNA, 21 nt, Human
acuagguaugaugcacugaau

SEQ ID NO: 223415 - RNA, 21 nt, Human
acuuuaaugaaugccgugugg

SEQ ID NO: 223416 - RNA, 18 nt, Human
agaaaaagacagguggga

SEQ ID NO: 223417 - RNA, 23 nt, Human
agaaaugaaaagaacccaaauaa

SEQ ID NO: 223418 - RNA, 20 nt, Human
agaacuggagagggcuuggg

SEQ ID NO: 223419 - RNA, 21 nt, Human
agaaggggaagaaaugaaaag

SEQ ID NO: 223420 - RNA, 22 nt, Human
agaaggggaagaaaugaaaaga

SEQ ID NO: 223421 - RNA, 18 nt, Human
agcgguucugucucccuc

SEQ ID NO: 223422 - RNA, 23 nt, Human
aggugggaaaauauuagcuuggu

SEQ ID NO: 223423 - RNA, 21 nt, Human
auagaaagacuagguaugaug

SEQ ID NO: 223424 - RNA, 21 nt, Human
auagaaagacuagguaugaug

SEQ ID NO: 223425 - RNA, 31 nt, Human
auauuaaaaacacacacacacacacacacag

SEQ ID NO: 223426 - RNA, 31 nt, Human; identical to SEQ ID NO: 223425

SEQ ID NO: 223427 - RNA, 31 nt, Human
auuaaaaacacacacacacacacacacacag

SEQ ID NO: 223428 - RNA, 21 nt, Human
auuccaggugcucucaggucc

SEQ ID NO: 223429 - RNA, 21 nt, Human
auuccaggugcucucaggucc

SEQ ID NO: 223430 - RNA, 22 nt, Human
caagaaagaugccgcuccaagc

SEQ ID NO: 223431 - RNA, 24 nt, Human
cacaacgcucaguccaagaccaau

SEQ ID NO: 223432 - RNA, 23 nt, Human
cacacaacgcucaguccaagacc

SEQ ID NO: 223433 - RNA, 30 nt, Human
cacacacacacacacacaacgcucagucca

SEQ ID NO: 223434 - RNA, 20 nt, Human
cacacacacacacacacaca

SEQ ID NO: 223435 - RNA, 20 nt, Human
cacacacacacacacacaca

SEQ ID NO: 223436 - RNA, 26 nt, Human
cacacacacacacacacacaacgcuc

SEQ ID NO: 223437 - RNA, 19 nt, Human
cacgggucucugcagcuca

SEQ ID NO: 223438 - RNA, 25 nt, Human
cagaguaaagugcaggcuccaugcc

SEQ ID NO: 223439 - RNA, 19 nt, Human
cagcucaaaaccugcccgg

SEQ ID NO: 223440 - RNA, 21 nt, Human
cagggguacagcacugccacu

SEQ ID NO: 223441 - RNA, 21 nt, Human
cagggguacagcacugccacu

SEQ ID NO: 223442 - RNA, 20 nt, Human
caugccaaaaugucaacucc

SEQ ID NO: 223443 - RNA, 20 nt, Human
caugccaaaaugucaacucc

SEQ ID NO: 223444 - RNA, 18 nt, Human
ccaagaaagaugccgcuc

SEQ ID NO: 223445 - RNA, 19 nt, Human
ccagaaggggaagaaauga

SEQ ID NO: 223446 - RNA, 22 nt, Human
ccagaaggggaagaaaugaaaa

SEQ ID NO: 223447 - RNA, 21 nt, Human
ccccuccccacgcuccagccc

SEQ ID NO: 223448 - RNA, 22 nt, Human
cccgaaaaccccagucaucucu

SEQ ID NO: 223449 - RNA, 19 nt, Human
cccucugugccgccgcaac

SEQ ID NO: 223450 - RNA, 20 nt, Human
ccucaagcuuuacacgccuc

SEQ ID NO: 223451 - RNA, 24 nt, Human
ccuucugugugugcacauauuacu

SEQ ID NO: 223452 - RNA, 24 nt, Human
ccuucugugugugcacauauuacu

SEQ ID NO: 223453 - RNA, 25 nt, Human
cuggagcgcaccaauaguugccccc

SEQ ID NO: 223454 - RNA, 19 nt, Human
cuggcaacgaaguuucccc

SEQ ID NO: 223455 - RNA, 23 nt, Human
cuggcucccuuacccccucccca

SEQ ID NO: 223456 - RNA, 20 nt, Human
cuugggggagaacuggagag

SEQ ID NO: 223457 - RNA, 21 nt, Human
gaaaugaaaagaacccaaaua

SEQ ID NO: 223458 - RNA, 22 nt, Human
gcccgaaaaccccagucaucuc

SEQ ID NO: 223459 - RNA, 21 nt, Human
gcucccuuacccccuccccac

SEQ ID NO: 223460 - RNA, 22 nt, Human
ggagaacuggagagggcuuggg

SEQ ID NO: 223461 - RNA, 24 nt, Human
ggcuggcggccacugcguccuggg

SEQ ID NO: 223462 - RNA, 20 nt, Human
ggggaagaaaugaaaagaac

SEQ ID NO: 223463 - RNA, 18 nt, Human
gugcucucagguccccac

SEQ ID NO: 223464 - RNA, 18 nt, Human
gugcucucagguccccac

SEQ ID NO: 223465 - RNA, 23 nt, Human
guuccugcggcaggaaaacaaaa

SEQ ID NO: 223466 - RNA, 21 nt, Human
uaaaaacacacacacacacac

SEQ ID NO: 223467 - RNA, 25 nt, Human
uaaaaacacacacacacacacacac

SEQ ID NO: 223468 - RNA, 19 nt, Human
uaaaaagacacaccuguuu

SEQ ID NO: 223469 - RNA, 19 nt, Human
uaaaaagacacaccuguuu

SEQ ID NO: 223470 - RNA, 25 nt, Human
uaaccagcucccacccaaucagguc

SEQ ID NO: 223471 - RNA, 25 nt, Human
uaaccagcucccacccaaucagguc

SEQ ID NO: 223472 - RNA, 23 nt, Human
uacccccuccccacgcuccagcc

SEQ ID NO: 223473 - RNA, 25 nt, Human
uacgugcacggacacucuuggugug

SEQ ID NO: 223474 - RNA, 25 nt, Human
uacgugcacggacacucuuggugug

SEQ ID NO: 223475 - RNA, 21 nt, Human
ucaaaaccugcccggcuggag

SEQ ID NO: 223476 - RNA, 23 nt, Human
uccaacgcuaguuacacauaacc

SEQ ID NO: 223477 - RNA, 23 nt, Human
uccaacgcuaguuacacauaacc

SEQ ID NO: 223478 - RNA, 19 nt, Human
uccaggugcucucaggucc

SEQ ID NO: 223479 - RNA, 22 nt, Human
ucccacccaaucagguccccuu

SEQ ID NO: 223480 - RNA, 22 nt, Human
ucccacccaaucagguccccuu

SEQ ID NO: 223481 - RNA, 18 nt, Human
uccccgaguuggcuggcu

SEQ ID NO: 223482 - RNA, 18 nt, Human
ucccucugugccgccgca

SEQ ID NO: 223483 - RNA, 22 nt, Human
ucccugcacucgccggccccca

SEQ ID NO: 223484 - RNA, 25 nt, Human
ucccuuacccccuccccacgcucca

SEQ ID NO: 223485 - RNA, 23 nt, Human
uccgaggaugggggagccuugga

SEQ ID NO: 223486 - RNA, 21 nt, Human
uccucaagcuuuacacgccuc

SEQ ID NO: 223487 - RNA, 20 nt, Human
uccugggugcacucgguggc

SEQ ID NO: 223488 - RNA, 19 nt, Human
ucgguggcaaagcgcugcu

SEQ ID NO: 223489 - RNA, 20 nt, Human
ucguacgugugcucugaucu

SEQ ID NO: 223490 - RNA, 20 nt, Human
ucguacgugugcucugaucu

SEQ ID NO: 223491 - RNA, 20 nt, Human
ugaaaagaacccaaauaaua

SEQ ID NO: 223492 - RNA, 21 nt, Human
ugaaaagaacccaaauaauaa

SEQ ID NO: 223493 - RNA, 18 nt, Human
ugagaaaagcaauugcac

SEQ ID NO: 223494 - RNA, 18 nt, Human
ugagaaaagcaauugcac

SEQ ID NO: 223495 - RNA, 20 nt, Human
ugagaaaagcaauugcaccc

SEQ ID NO: 223496 - RNA, 22 nt, Human
ugaucugcuuccaacaaauucc

SEQ ID NO: 223497 - RNA, 22 nt, Human
ugaucugcuuccaacaaauucc

SEQ ID NO: 223498 - RNA, 22 nt, Human
ugcacggacacucuuggugugu

SEQ ID NO: 223499 - RNA, 22 nt, Human
ugcacggacacucuuggugugu

SEQ ID NO: 223500 - RNA, 20 nt, Human
ugcccagaaggggaagaaau

SEQ ID NO: 223501 - RNA, 18 nt, Human
ugccgcuccaagcgguuc

SEQ ID NO: 223502 - RNA, 20 nt, Human
uggaaagagacugccuagcg

SEQ ID NO: 223503 - RNA, 27 nt, Human
uggagcgcaccaauaguugccccacca

SEQ ID NO: 223504 - RNA, 22 nt, Human
uggcccggcaugggaaggcugg

SEQ ID NO: 223505 - RNA, 21 nt, Human
ugggaaaauauuagcuugggg

SEQ ID NO: 223506 - RNA, 18 nt, Human
uguccugcguuugcuauc

SEQ ID NO: 223507 - RNA, 18 nt, Human
uguccugcguuugcuauc

SEQ ID NO: 223508 - RNA, 20 nt, Human
uuaaaaacacacacacacac

SEQ ID NO: 223509 - RNA, 20 nt, Human
uuaaaaacacacacacacac

SEQ ID NO: 223510 - RNA, 23 nt, Human
uuacccccuccccacgcuccagc

SEQ ID NO: 223511 - RNA, 24 nt, Human
uucaaugcuauguaauuuuggacu

SEQ ID NO: 223512 - RNA, 24 nt, Human
uucaaugcuauguaauuuuggacu

SEQ ID NO: 223513 - RNA, 21 nt, Human
uuugucaugagaaaagcaauu

SEQ ID NO: 223514 - RNA, 21 nt, Human
uuugucaugagaaaagcaauu

SEQ ID NO: 223515 - RNA, 18 nt, Human
uuuuuuuuuuuucuuuug

SEQ ID NO: 223516 - RNA, 19 nt, Human
uuuuuuuuuuuucuuuugu

SEQ ID NO: 223517 - RNA, 24 nt, Human
uuuuuuuuuuuuuuuucuuuuggg

SEQ ID NO: 223518 - RNA, 18 nt, Human
acccugaaaaguuaagaa

SEQ ID NO: 223519 - RNA, 18 nt, Human
acccugaaaaguuaagaa

SEQ ID NO: 223520 - RNA, 20 nt, Human
agaaagaaagugcuggcuca

SEQ ID NO: 223521 - RNA, 24 nt, Human
aggugagccuaggggugggggcag

SEQ ID NO: 223522 - RNA, 19 nt, Human
agucugggcacaaaaaggc

SEQ ID NO: 223523 - RNA, 25 nt, Human
auaaggcacugacagaaaauuucuu

SEQ ID NO: 223524 - RNA, 18 nt, Human
aucagaaagaaagugcug

SEQ ID NO: 223525 - RNA, 19 nt, Human
augggagaacugggguaaa

SEQ ID NO: 223526 - RNA, 23 nt, Human
auuccacucaucaaagaaagugg

SEQ ID NO: 223527 - RNA, 23 nt, Human
caacaagcaucaucagaaagaaa

SEQ ID NO: 223528 - RNA, 20 nt, Human
cacacuguuuccagcaaggu

SEQ ID NO: 223529 - RNA, 18 nt, Human
cagcaacagucauaaaga

SEQ ID NO: 223530 - RNA, 20 nt, Human
cauuuuacacacuguuucca

SEQ ID NO: 223531 - RNA, 20 nt, Human
cccuuugagcucaugcacaa

SEQ ID NO: 223532 - RNA, 24 nt, Human
ccuauggcuaugccuaagguuauu

SEQ ID NO: 223533 - RNA, 27 nt, Human
cuauuuuguucccccuuugagcucaug

SEQ ID NO: 223534 - RNA, 22 nt, Human
gaccaugauggguguaucuagu

SEQ ID NO: 223535 - RNA, 21 nt, Human
gagaacugggguaaaagacug

SEQ ID NO: 223536 - RNA, 26 nt, Human
gagaaguccucaccuauggcuaugcc

SEQ ID NO: 223537 - RNA, 18 nt, Human
gcuagagagguucuguuu

SEQ ID NO: 223538 - RNA, 18 nt, Human
gggaaagagagaggaaaa

SEQ ID NO: 223539 - RNA, 21 nt, Human
uaaaaaaugcuaccagcaaca

SEQ ID NO: 223540 - RNA, 25 nt, Human
uaaaaaaugcuaccagcaacaguca

SEQ ID NO: 223541 - RNA, 22 nt, Human
uacaaaaaaaaaauuguuguca

SEQ ID NO: 223542 - RNA, 19 nt, Human
uacacacuguuuccagcaa

SEQ ID NO: 223543 - RNA, 23 nt, Human
uacauuguuaccagaaacaauuc

SEQ ID NO: 223544 - RNA, 24 nt, Human
uaccagaaacaauucucauucauu

SEQ ID NO: 223545 - RNA, 25 nt, Human
uaccagaaacaauucucauucauuc

SEQ ID NO: 223546 - RNA, 21 nt, Human
uaggcucaguuagguagaccc

SEQ ID NO: 223547 - RNA, 19 nt, Human
uagguagacccugaaaagu

SEQ ID NO: 223548 - RNA, 24 nt, Human
ucaaagcuacauuguuaccagaaa

SEQ ID NO: 223549 - RNA, 23 nt, Human
uccagcaagguaugguauucaaa

SEQ ID NO: 223550 - RNA, 20 nt, Human
ugagccuaggggugggggca

SEQ ID NO: 223551 - RNA, 22 nt, Human
ugggagaacugggguaaaagac

SEQ ID NO: 223552 - RNA, 24 nt, Human
uucucauucauucugaggccuuau

SEQ ID NO: 223553 - RNA, 20 nt, Human
aaacaauccucccaccucaa

SEQ ID NO: 223554 - RNA, 25 nt, Human
aaacaauccucccaccucagccucc

SEQ ID NO: 223555 - RNA, 22 nt, Human
aagccaugcaaaacaacacgaa

SEQ ID NO: 223556 - RNA, 20 nt, Human
aagggcagugucuggaaggc

SEQ ID NO: 223557 - RNA, 22 nt, Human
aagucgcugggacucccaggcc

SEQ ID NO: 223558 - RNA, 18 nt, Human
acccagcccccaccccuu

SEQ ID NO: 223559 - RNA, 19 nt, Human
acccaggcuggaguacagu

SEQ ID NO: 223560 - RNA, 23 nt, Human
accucagccucccaagucgcugg

SEQ ID NO: 223561 - RNA, 24 nt, Human
acuaugucaccuaggcuggucucg

SEQ ID NO: 223562 - RNA, 18 nt, Human
agaauguggcuggaggcc

SEQ ID NO: 223563 - RNA, 21 nt, Human
agaccuagcaggacagaggua

SEQ ID NO: 223564 - RNA, 21 nt, Human
agcaauccuccaaccucagcc

SEQ ID NO: 223565 - RNA, 18 nt, Human
agccucgaccucccaggc

SEQ ID NO: 223566 - RNA, 19 nt, Human
aguacaguggugcaaucag

SEQ ID NO: 223567 - RNA, 21 nt, Human
augaccuaaguaggguuuugu

SEQ ID NO: 223568 - RNA, 22 nt, Human
auggggucucacuaugucaccu

SEQ ID NO: 223569 - RNA, 23 nt, Human
auggggucucacuaugucaccua

SEQ ID NO: 223570 - RNA, 24 nt, Human
auggggucucacuaugucaccuag

SEQ ID NO: 223571 - RNA, 27 nt, Human
caaacaauccucccaccucagccuccc

SEQ ID NO: 223572 - RNA, 23 nt, Human
caaagccaugcaaaacaacacga

SEQ ID NO: 223573 - RNA, 24 nt, Human
caaagccaugcaaaacaacacgaa

SEQ ID NO: 223574 - RNA, 24 nt, Human
cacccuggcuuuuggaaccaaggg

SEQ ID NO: 223575 - RNA, 24 nt, Human
caccuaggcuggucucgaauuccu

SEQ ID NO: 223576 - RNA, 18 nt, Human
caccugguuaauuuuuua

SEQ ID NO: 223577 - RNA, 22 nt, Human
cacuacagccucgaccucccag

SEQ ID NO: 223578 - RNA, 24 nt, Human
cacuaugucaccuaggcuggucuc

SEQ ID NO: 223579 - RNA, 19 nt, Human
cacugcacccagcccccac

SEQ ID NO: 223580 - RNA, 18 nt, Human
cagaaggcagcaggggca

SEQ ID NO: 223581 - RNA, 19 nt, Human
cagagcccggccuccugcc

SEQ ID NO: 223582 - RNA, 23 nt, Human
cagagcccggccuccugccggcu

SEQ ID NO: 223583 - RNA, 27 nt, Human
cagccucccaagucgcugggacucccu

SEQ ID NO: 223584 - RNA, 21 nt, Human
cagccucgaccucccaggcuc

SEQ ID NO: 223585 - RNA, 25 nt, Human
cagccucgaccucccaggcucaaac

SEQ ID NO: 223586 - RNA, 21 nt, Human
caguuagcuugaaccuccagu

SEQ ID NO: 223587 - RNA, 20 nt, Human
ccacugcacccagcccccac

SEQ ID NO: 223588 - RNA, 19 nt, Human
ccccggaggcggccugggg

SEQ ID NO: 223589 - RNA, 25 nt, Human
ccccggcccgcgcaucggccccggc

SEQ ID NO: 223590 - RNA, 18 nt, Human
ccccggcgcccccggccc

SEQ ID NO: 223591 - RNA, 19 nt, Human
ccccggcgcccccggcccg

SEQ ID NO: 223592 - RNA, 19 nt, Human
ccccuuugccuuuugcucu

SEQ ID NO: 223593 - RNA, 20 nt, Human
ccccuuugccuuuugcucuc

SEQ ID NO: 223594 - RNA, 20 nt, Human
cccugucacccaggcuggag

SEQ ID NO: 223595 - RNA, 23 nt, Human
cccugucacccaggcuggaguac

SEQ ID NO: 223596 - RNA, 20 nt, Human
ccgcccgcgcccccaggugc

SEQ ID NO: 223597 - RNA, 22 nt, Human
ccgcccgcgcccccaggugcuc

SEQ ID NO: 223598 - RNA, 21 nt, Human
ccgcccgggccgccgccggcc

SEQ ID NO: 223599 - RNA, 19 nt, Human
ccgccgcugcugcugcccc

SEQ ID NO: 223600 - RNA, 20 nt, Human
ccgccggccccccggcgccc

SEQ ID NO: 223601 - RNA, 18 nt, Human
ccgcugcugcugccccgg

SEQ ID NO: 223602 - RNA, 19 nt, Human
ccggccccccggcgccccc

SEQ ID NO: 223603 - RNA, 22 nt, Human
ccggccgccgcugcugcugccc

SEQ ID NO: 223604 - RNA, 22 nt, Human
ccucagagcccggccuccugcc

SEQ ID NO: 223605 - RNA, 18 nt, Human
ccuccaaccucagccucc

SEQ ID NO: 223606 - RNA, 23 nt, Human
ccucccaccucagccucccaagu

SEQ ID NO: 223607 - RNA, 24 nt, Human
ccucccagcaggggucccccgccc

SEQ ID NO: 223608 - RNA, 20 nt, Human
ccucccagcucgccccuccu

SEQ ID NO: 223609 - RNA, 20 nt, Human
ccucgaccucccaggcucaa

SEQ ID NO: 223610 - RNA, 18 nt, Human
ccugcuaugagaaugugg

SEQ ID NO: 223611 - RNA, 20 nt, Human
ccugggcucaagcaauccuc

SEQ ID NO: 223612 - RNA, 24 nt, Human
ccugucacccaggcuggaguacag

SEQ ID NO: 223613 - RNA, 18 nt, Human
ccugucccuccuucuuuc

SEQ ID NO: 223614 - RNA, 23 nt, Human
ccuuuugcucucuggucacuuca

SEQ ID NO: 223615 - RNA, 25 nt, Human
cgaccucccaggcucaaacaauccu

SEQ ID NO: 223616 - RNA, 24 nt, Human
cgcccccggcccgcgcaucggccc

SEQ ID NO: 223617 - RNA, 23 nt, Human
cgcccgcgcccccaggugcucca

SEQ ID NO: 223618 - RNA, 20 nt, Human
cgcgcccccaggugcuccag

SEQ ID NO: 223619 - RNA, 20 nt, Human
cgcugggacucccaggcacg

SEQ ID NO: 223620 - RNA, 18 nt, Human
cggccccccggcgccccc

SEQ ID NO: 223621 - RNA, 18 nt, Human
cggccuggggcauggcug

SEQ ID NO: 223622 - RNA, 23 nt, Human
cuacagccucgaccucccaggcu

SEQ ID NO: 223623 - RNA, 21 nt, Human
cucaaacaauccucccaccuc

SEQ ID NO: 223624 - RNA, 24 nt, Human
cucaaacaauccucccaccucagc

SEQ ID NO: 223625 - RNA, 24 nt, Human
cucaagcaauccuccaaccucagc

SEQ ID NO: 223626 - RNA, 23 nt, Human
cucccaccucagccucccaaguc

SEQ ID NO: 223627 - RNA, 22 nt, Human
cucccagcucgccccuccugcu

SEQ ID NO: 223628 - RNA, 23 nt, Human
cucccagcucgccccuccugcug

SEQ ID NO: 223629 - RNA, 25 nt, Human
cucccaggcucaaacaauccuccca

SEQ ID NO: 223630 - RNA, 24 nt, Human
cucccugaccccaccaaguuucac

SEQ ID NO: 223631 - RNA, 21 nt, Human
cugcagacugacaggccgcug

SEQ ID NO: 223632 - RNA, 19 nt, Human
cuggggaugaggaagggga

SEQ ID NO: 223633 - RNA, 24 nt, Human
cuugcccugucacccaggcuggag

SEQ ID NO: 223634 - RNA, 23 nt, Human
cuuuagggacugcuggguuuccu

SEQ ID NO: 223635 - RNA, 23 nt, Human
cuuucuguccugcuuucugggga

SEQ ID NO: 223636 - RNA, 18 nt, Human
gaauacaggugugagcca

SEQ ID NO: 223637 - RNA, 22 nt, Human
gaauacaggugugagccacugc

SEQ ID NO: 223638 - RNA, 23 nt, Human
gaauacaggugugagccacugca

SEQ ID NO: 223639 - RNA, 23 nt, Human
gaauuccugggcucaagcaaucc

SEQ ID NO: 223640 - RNA, 18 nt, Human
gacacagcuggggaugag

SEQ ID NO: 223641 - RNA, 22 nt, Human
gaccagcuuuagggacugcugg

SEQ ID NO: 223642 - RNA, 19 nt, Human
gaccuaaguaggguuuugu

SEQ ID NO: 223643 - RNA, 20 nt, Human
gagacagggucuugcccugu

SEQ ID NO: 223644 - RNA, 18 nt, Human
gaggaaggggaguggggc

SEQ ID NO: 223645 - RNA, 19 nt, Human
gcaaaacaacacgaaggga

SEQ ID NO: 223646 - RNA, 23 nt, Human
gccccggccgccgcugcugcugc

SEQ ID NO: 223647 - RNA, 21 nt, Human
gcccgggccgccgccggcccc

SEQ ID NO: 223648 - RNA, 26 nt, Human
gcucccagcuucugccuuuccucccc

SEQ ID NO: 223649 - RNA, 20 nt, Human
gcugaguaggggugacuugg

SEQ ID NO: 223650 - RNA, 18 nt, Human
gcugccugccugucccuc

SEQ ID NO: 223651 - RNA, 19 nt, Human
gcugccugccugucccucc

SEQ ID NO: 223652 - RNA, 22 nt, Human
ggaauacaggugugagccacug

SEQ ID NO: 223653 - RNA, 21 nt, Human
ggagaugggggugcuggggga

SEQ ID NO: 223654 - RNA, 18 nt, Human
ggaguggggcugaguagg

SEQ ID NO: 223655 - RNA, 21 nt, Human
ggccccagggguccucagagc

SEQ ID NO: 223656 - RNA, 18 nt, Human
ggcuccgaugggggcccc

SEQ ID NO: 223657 - RNA, 22 nt, Human
ggcuccgaugggggccccaggg

SEQ ID NO: 223658 - RNA, 19 nt, Human
gggcagucuccuggccucc

SEQ ID NO: 223659 - RNA, 19 nt, Human
ggggagaguggugagggau

SEQ ID NO: 223660 - RNA, 22 nt, Human
gggucucacuaugucaccuagg

SEQ ID NO: 223661 - RNA, 19 nt, Human
gggugcugggggagagugg

SEQ ID NO: 223662 - RNA, 23 nt, Human
guaggguuuugugagacucaaag

SEQ ID NO: 223663 - RNA, 23 nt, Human
uaagggcagugucuggaaggcug

SEQ ID NO: 223664 - RNA, 23 nt, Human
uaauuuuuuauuuuuuguagaga

SEQ ID NO: 223665 - RNA, 22 nt, Human
uacacggaacaugaaguccccu

SEQ ID NO: 223666 - RNA, 19 nt, Human
uacaggugugagccacugc

SEQ ID NO: 223667 - RNA, 24 nt, Human
uacaggugugagccacugcaccca

SEQ ID NO: 223668 - RNA, 23 nt, Human
uaccagcagggucucugaggacu

SEQ ID NO: 223669 - RNA, 25 nt, Human
uaccagcagggucucugaggacugg

SEQ ID NO: 223670 - RNA, 22 nt, Human
uagagauggggucucacuaugu

SEQ ID NO: 223671 - RNA, 23 nt, Human
uaugucaccuaggcuggucucga

SEQ ID NO: 223672 - RNA, 24 nt, Human
uaugucaccuaggcuggucucgaa

SEQ ID NO: 223673 - RNA, 19 nt, Human
uauucucaucuguaaaaug

SEQ ID NO: 223674 - RNA, 23 nt, Human
ucacuacagccucgaccucccag

SEQ ID NO: 223675 - RNA, 24 nt, Human
ucacuacagccucgaccucccagg

SEQ ID NO: 223676 - RNA, 19 nt, Human
ucagagcccggccuccugc

SEQ ID NO: 223677 - RNA, 24 nt, Human
uccauaacugcaaagccaugcaaa

SEQ ID NO: 223678 - RNA, 20 nt, Human
ucccgcccgggccgccgccg

SEQ ID NO: 223679 - RNA, 19 nt, Human
ucccuccuucuuucugucc

SEQ ID NO: 223680 - RNA, 19 nt, Human
uccuccaaccucagccucc

SEQ ID NO: 223681 - RNA, 27 nt, Human
uccucccaccucagccucccaagucgc

SEQ ID NO: 223682 - RNA, 24 nt, Human
uccugcugccugccugucgucguc

SEQ ID NO: 223683 - RNA, 18 nt, Human
uccugggcucaagcaauc

SEQ ID NO: 223684 - RNA, 22 nt, Human
uccugggcucaagcaauccucc

SEQ ID NO: 223685 - RNA, 20 nt, Human
ucggccccggccgccgcugc

SEQ ID NO: 223686 - RNA, 23 nt, Human
ucucacuaugucaccuaggcugg

SEQ ID NO: 223687 - RNA, 24 nt, Human
ucucacuaugucaccuaggcuggu

SEQ ID NO: 223688 - RNA, 23 nt, Human
ucuccuggccucccagcaggggu

SEQ ID NO: 223689 - RNA, 19 nt, Human
ucucgaauuccugggcuca

SEQ ID NO: 223690 - RNA, 23 nt, Human
ucucgaauuccugggcucaagca

SEQ ID NO: 223691 - RNA, 21 nt, Human
ucugccuuuccucccugaccc

SEQ ID NO: 223692 - RNA, 23 nt, Human
ucuugcccugucacccaggcugg

SEQ ID NO: 223693 - RNA, 24 nt, Human
ucuugcccugucacccaggcugga

SEQ ID NO: 223694 - RNA, 22 nt, Human
ugagacagggucuugcccuguc

SEQ ID NO: 223695 - RNA, 20 nt, Human
ugcaaaacaacacgaaggga

SEQ ID NO: 223696 - RNA, 19 nt, Human
ugcaaagccaugcaaaaca

SEQ ID NO: 223697 - RNA, 23 nt, Human
ugcaaucagggcucacuacagcc

SEQ ID NO: 223698 - RNA, 20 nt, Human
ugcacccagcccccaccccu

SEQ ID NO: 223699 - RNA, 21 nt, Human
ugcccugucacccaggcugga

SEQ ID NO: 223700 - RNA, 25 nt, Human
ugcccugucacccaggcuggaguac

SEQ ID NO: 223701 - RNA, 19 nt, Human
ugcuaugagaauguggcug

SEQ ID NO: 223702 - RNA, 19 nt, Human
ugcuggguuuccacuuucu

SEQ ID NO: 223703 - RNA, 23 nt, Human
uggaguacaguggugcaaucagg

SEQ ID NO: 223704 - RNA, 25 nt, Human
uggccucccagcaggggucccccuc

SEQ ID NO: 223705 - RNA, 22 nt, Human
ugggaauacaggugugagccac

SEQ ID NO: 223706 - RNA, 22 nt, Human
ugggaauacaggugugagccac

SEQ ID NO: 223707 - RNA, 24 nt, Human
ugggaauacaggugugagccacug

SEQ ID NO: 223708 - RNA, 19 nt, Human
ugggagaccuagcaggaca

SEQ ID NO: 223709 - RNA, 20 nt, Human
ugggcucaagcaauccucca

SEQ ID NO: 223710 - RNA, 19 nt, Human
uggggcugaguagggguga

SEQ ID NO: 223711 - RNA, 20 nt, Human
ugggggugcugggggagagu

SEQ ID NO: 223712 - RNA, 24 nt, Human
uggggucucacuaugucaccuagg

SEQ ID NO: 223713 - RNA, 24 nt, Human
uggugcaaucagggcucacuacag

SEQ ID NO: 223714 - RNA, 24 nt, Human
uguagagauggggucucacuaugu

SEQ ID NO: 223715 - RNA, 27 nt, Human
uguccugcuuucuggggaccagcuuua

SEQ ID NO: 223716 - RNA, 19 nt, Human
ugugcggggucccacuggg

SEQ ID NO: 223717 - RNA, 20 nt, Human
uuccucccugaccccaccaa

SEQ ID NO: 223718 - RNA, 23 nt, Human
uuccugggcucaagcaauccucc

SEQ ID NO: 223719 - RNA, 24 nt, Human
uugcccugucacccaggcuggagu

SEQ ID NO: 223720 - RNA, 24 nt, Human
uuguagagauggggucucacuaug

SEQ ID NO: 223721 - RNA, 22 nt, Human
uuuauuuuuuguagagaugggg

SEQ ID NO: 223722 - RNA, 18 nt, Human
uuuguagagauggggucu

SEQ ID NO: 223723 - RNA, 24 nt, Human
uuuguagagauggggucucacuau

SEQ ID NO: 223724 - RNA, 22 nt, Human
uuuuauuuuuuguagagauggg

SEQ ID NO: 223725 - RNA, 28 nt, Human
uuuuuuauuuuuuguagagauggggucu

SEQ ID NO: 223726 - RNA, 24 nt, Human
uuuuuuguagagauggggucucac

SEQ ID NO: 223727 - RNA, 24 nt, Human
uuuuuuuuuugagacagggucuug

SEQ ID NO: 223728 - RNA, 20 nt, Human
uuuuuuuuuuugagacaggg

SEQ ID NO: 223729 - RNA, 23 nt, Human
uuuuuuuuuuuugagacaggguc

SEQ ID NO: 223730 - RNA, 24 nt, Human
uuuuuuuuuuuugagacagggucu

SEQ ID NO: 223731 - RNA, 24 nt, Human
uuuuuuuuuuuuuuugagacaggg

SEQ ID NO: 223732 - RNA, 18 nt, Human
acacacccagucccccuc

SEQ ID NO: 223733 - RNA, 20 nt, Human
acacagucuccuccaggcag

SEQ ID NO: 223734 - RNA, 23 nt, Human
accguuuucauuuauugaugcag

SEQ ID NO: 223735 - RNA, 23 nt, Human
accguuuucauuuauugaugcag

SEQ ID NO: 223736 - RNA, 18 nt, Human
acuguagccuccucccca

SEQ ID NO: 223737 - RNA, 18 nt, Human
acuguagccuccucccca

SEQ ID NO: 223738 - RNA, 22 nt, Human
acuucagucucguggaaagagg

SEQ ID NO: 223739 - RNA, 22 nt, Human
acuucagucucguggaaagagg

SEQ ID NO: 223740 - RNA, 26 nt, Human
agacaucccucuggcuggacacaccc

SEQ ID NO: 223741 - RNA, 26 nt, Human
agacgagaagggagucaacgcuccag

SEQ ID NO: 223742 - RNA, 23 nt, Human
agacgccacaggccucgagacgg

SEQ ID NO: 223743 - RNA, 20 nt, Human
agcugcacuguccacagaca

SEQ ID NO: 223744 - RNA, 24 nt, Human
agcuggccugacacccacacccuc

SEQ ID NO: 223745 - RNA, 23 nt, Human
agcuucauucuccaugaguucca

SEQ ID NO: 223746 - RNA, 22 nt, Human
aggaagacuuuucggccucgaa

SEQ ID NO: 223747 - RNA, 18 nt, Human
aggaagggggcggggcag

SEQ ID NO: 223748 - RNA, 21 nt, Human
aggaaguggucccugccgaaa

SEQ ID NO: 223749 - RNA, 20 nt, Human
aggagccggagagggguugc

SEQ ID NO: 223750 - RNA, 18 nt, Human
aggcagagacgcgggccu

SEQ ID NO: 223751 - RNA, 19 nt, Human
augcaggcuuugaggcaca

SEQ ID NO: 223752 - RNA, 19 nt, Human
augcaggcuuugaggcaca

SEQ ID NO: 223753 - RNA, 21 nt, Human
caaacgacagcccuccacgcg

SEQ ID NO: 223754 - RNA, 18 nt, Human
caaauuccacucggaugg

SEQ ID NO: 223755 - RNA, 21 nt, Human
caacuguagccuccuccccag

SEQ ID NO: 223756 - RNA, 21 nt, Human
caacuguagccuccuccccag

SEQ ID NO: 223757 - RNA, 23 nt, Human
cacacccuccuccucuauccccu

SEQ ID NO: 223758 - RNA, 20 nt, Human
cacccaaagauccauaaagc

SEQ ID NO: 223759 - RNA, 18 nt, Human
cagcggcagggccccgac

SEQ ID NO: 223760 - RNA, 18 nt, Human
cagcggcagggccccgac

SEQ ID NO: 223761 - RNA, 20 nt, Human
cagcggcauguucagcugug

SEQ ID NO: 223762 - RNA, 19 nt, Human
cagcugugccugggacagc

SEQ ID NO: 223763 - RNA, 20 nt, Human
caggccucgagacgagaagg

SEQ ID NO: 223764 - RNA, 24 nt, Human
cagucccccuccuaucuccagccu

SEQ ID NO: 223765 - RNA, 21 nt, Human
ccccacgccggacccuacaca

SEQ ID NO: 223766 - RNA, 26 nt, Human
ccccugccucucccucccugcacccc

SEQ ID NO: 223767 - RNA, 22 nt, Human
cccucccugcaccccacccgcc

SEQ ID NO: 223768 - RNA, 18 nt, Human
cccugccucucccucccu

SEQ ID NO: 223769 - RNA, 20 nt, Human
cccuugagaggcccggccag

SEQ ID NO: 223770 - RNA, 20 nt, Human
cccuugagaggcccggccag

SEQ ID NO: 223771 - RNA, 20 nt, Human
ccgccuggaggggccgggcg

SEQ ID NO: 223772 - RNA, 20 nt, Human
ccgccuggaggggccgggcg

SEQ ID NO: 223773 - RNA, 18 nt, Human
ccggccagggauccugcc

SEQ ID NO: 223774 - RNA, 26 nt, Human
ccuccuaucuccagccuuccccuuac

SEQ ID NO: 223775 - RNA, 22 nt, Human
ccucguccgagccuuggcgguc

SEQ ID NO: 223776 - RNA, 21 nt, Human
ccucucccucccugcacccca

SEQ ID NO: 223777 - RNA, 24 nt, Human
ccucuggcuggacacacccagucc

SEQ ID NO: 223778 - RNA, 20 nt, Human
ccugacacccacacccuccu

SEQ ID NO: 223779 - RNA, 18 nt, Human
ccugcucugcugcucugc

SEQ ID NO: 223780 - RNA, 20 nt, Human
ccuuccccuuaccuccgcug

SEQ ID NO: 223781 - RNA, 23 nt, Human
cgagaagggaaaggaaggcgagu

SEQ ID NO: 223782 - RNA, 21 nt, Human
cgcccaggcgccgggccagcu

SEQ ID NO: 223783 - RNA, 21 nt, Human
cgcccaggcgccgggccagcu

SEQ ID NO: 223784 - RNA, 20 nt, Human
cgcuaugcacgcucuccucg

SEQ ID NO: 223785 - RNA, 20 nt, Human
cgggcugugccacccgcggg

SEQ ID NO: 223786 - RNA, 25 nt, Human
cgugguccacaggucccgagugucu

SEQ ID NO: 223787 - RNA, 19 nt, Human
cuccagccuuccccuuacc

SEQ ID NO: 223788 - RNA, 22 nt, Human
cucccugcaccccacccgccaa

SEQ ID NO: 223789 - RNA, 24 nt, Human
cuccucuauccccuacacacccaa

SEQ ID NO: 223790 - RNA, 22 nt, Human
cucgucgaagcccucgcagacc

SEQ ID NO: 223791 - RNA, 18 nt, Human
cugcaccccacccgccaa

SEQ ID NO: 223792 - RNA, 22 nt, Human
cugcacuguccacagacauccc

SEQ ID NO: 223793 - RNA, 21 nt, Human
cugcagcuccuuagucaggaa

SEQ ID NO: 223794 - RNA, 19 nt, Human
cuggaggggccgggcgggg

SEQ ID NO: 223795 - RNA, 19 nt, Human
cuggaggggccgggcgggg

SEQ ID NO: 223796 - RNA, 25 nt, Human
cuggcacggggcugguucgggucgc

SEQ ID NO: 223797 - RNA, 18 nt, Human
cuggccuuguaccccucg

SEQ ID NO: 223798 - RNA, 19 nt, Human
cuugggucuggggaccggg

SEQ ID NO: 223799 - RNA, 18 nt, Human
gacccagacgccacaggc

SEQ ID NO: 223800 - RNA, 21 nt, Human
gacuucagucucguggaaaga

SEQ ID NO: 223801 - RNA, 21 nt, Human
gacuucagucucguggaaaga

SEQ ID NO: 223802 - RNA, 22 nt, Human
gagaagggagucaacgcuccag

SEQ ID NO: 223803 - RNA, 21 nt, Human
gagaggcccggccagggaucc

SEQ ID NO: 223804 - RNA, 21 nt, Human
gagaggcccggccagggaucc

SEQ ID NO: 223805 - RNA, 20 nt, Human
gagcagaaacgaagcccuug

SEQ ID NO: 223806 - RNA, 20 nt, Human
gagcagaaacgaagcccuug

SEQ ID NO: 223807 - RNA, 20 nt, Human
gagcuggccugacacccacc

SEQ ID NO: 223808 - RNA, 20 nt, Human
gcaguggcagccugcucugc

SEQ ID NO: 223809 - RNA, 19 nt, Human
gccccgggcugugccaccc

SEQ ID NO: 223810 - RNA, 20 nt, Human
gccugacacccacacccucc

SEQ ID NO: 223811 - RNA, 19 nt, Human
gccugcucugcugcucugc

SEQ ID NO: 223812 - RNA, 20 nt, Human
gccuggaggggccgggcggg

SEQ ID NO: 223813 - RNA, 20 nt, Human
gccuggaggggccgggcggg

SEQ ID NO: 223814 - RNA, 19 nt, Human
gccuugggggggucuagag

SEQ ID NO: 223815 - RNA, 19 nt, Human
gccuugggggggucuagag

SEQ ID NO: 223816 - RNA, 24 nt, Human
gcugucgucacugcggccgccugg

SEQ ID NO: 223817 - RNA, 23 nt, Human
ggcgagugggaggccgaaagaga

SEQ ID NO: 223818 - RNA, 20 nt, Human
ggcgccgggccagcuccacu

SEQ ID NO: 223819 - RNA, 20 nt, Human
ggcgccgggccagcuccacu

SEQ ID NO: 223820 - RNA, 19 nt, Human
ggcucgauggggcaugugc

SEQ ID NO: 223821 - RNA, 23 nt, Human
ggcuugggucuggggaccgggcu

SEQ ID NO: 223822 - RNA, 27 nt, Human
gggccggggccagggaggaggcggaga

SEQ ID NO: 223823 - RNA, 27 nt, Human
gggccggggccagggaggaggcggaga

SEQ ID NO: 223824 - RNA, 19 nt, Human
ggggacccucggccugggg

SEQ ID NO: 223825 - RNA, 20 nt, Human
gggggucuagagauggaugg

SEQ ID NO: 223826 - RNA, 23 nt, Human
ggggucuagagauggauggaagu

SEQ ID NO: 223827 - RNA, 23 nt, Human
ggggucuagagauggauggaagu

SEQ ID NO: 223828 - RNA, 23 nt, Human
gggucacgggaggccagaggugc

SEQ ID NO: 223829 - RNA, 23 nt, Human
ggucgugguccacaggucccggc

SEQ ID NO: 223830 - RNA, 19 nt, Human
gugaggaaagagaggaggg

SEQ ID NO: 223831 - RNA, 22 nt, Human
gugaggauuuccagagcuucau

SEQ ID NO: 223832 - RNA, 24 nt, Human
guggcagaggagccggagaggggu

SEQ ID NO: 223833 - RNA, 19 nt, Human
guguggccagcggcagggc

SEQ ID NO: 223834 - RNA, 22 nt, Human
guucaaacgacagcccuccacc

SEQ ID NO: 223835 - RNA, 22 nt, Human
guuccagcacggccucgccggu

SEQ ID NO: 223836 - RNA, 18 nt, Human
uacacacccaaagaucca

SEQ ID NO: 223837 - RNA, 20 nt, Human
uaugcacgcucuccucgucc

SEQ ID NO: 223838 - RNA, 23 nt, Human
uauugagugaugacauugaggaa

SEQ ID NO: 223839 - RNA, 23 nt, Human
uccacagacaucccucuggcugg

SEQ ID NO: 223840 - RNA, 19 nt, Human
uccagagcuucauucucca

SEQ ID NO: 223841 - RNA, 25 nt, Human
uccaggcagagacgcgggccugaga

SEQ ID NO: 223842 - RNA, 19 nt, Human
uccauggagcugccgcggu

SEQ ID NO: 223843 - RNA, 24 nt, Human
uccccuacacacccaaagauccau

SEQ ID NO: 223844 - RNA, 23 nt, Human
uccccugccucucccucccugca

SEQ ID NO: 223845 - RNA, 23 nt, Human
ucccucuggcuggacacacccag

SEQ ID NO: 223846 - RNA, 24 nt, Human
uccuccaugguucugccccaacgg

SEQ ID NO: 223847 - RNA, 25 nt, Human
uccuccucuauccccuacacaccca

SEQ ID NO: 223848 - RNA, 20 nt, Human
ucgagacgagaagggaguca

SEQ ID NO: 223849 - RNA, 18 nt, Human
ucuagagauggauggaag

SEQ ID NO: 223850 - RNA, 18 nt, Human
ucuagagauggauggaag

SEQ ID NO: 223851 - RNA, 23 nt, Human
ucuauccccuacacacccaaaga

SEQ ID NO: 223852 - RNA, 25 nt, Human
ucuauccccuacacacccaaagauc

SEQ ID NO: 223853 - RNA, 21 nt, Human
ucuccagccuuccccuuaccu

SEQ ID NO: 223854 - RNA, 24 nt, Human
ucuccuccaggcagagacgcgggc

SEQ ID NO: 223855 - RNA, 18 nt, Human
ucucucuccccugccucu

SEQ ID NO: 223856 - RNA, 22 nt, Human
ucugccccaacggacccagacg

SEQ ID NO: 223857 - RNA, 19 nt, Human
ugagcuggccugacaccca

SEQ ID NO: 223858 - RNA, 19 nt, Human
ugaugcaggcuuugaggac

SEQ ID NO: 223859 - RNA, 19 nt, Human
ugaugcaggcuuugaggac

SEQ ID NO: 223860 - RNA, 21 nt, Human
ugcccggggacccucggccug

SEQ ID NO: 223861 - RNA, 22 nt, Human
ugccucucccucccugcacccc

SEQ ID NO: 223862 - RNA, 21 nt, Human
uggcacggggcugguucgggu

SEQ ID NO: 223863 - RNA, 23 nt, Human
uggcagaggagccggagaggggu

SEQ ID NO: 223864 - RNA, 24 nt, Human
uggugaggauuuccagagcuucau

SEQ ID NO: 223865 - RNA, 27 nt, Human
uguccuucucccccagauugauuucca

SEQ ID NO: 223866 - RNA, 24 nt, Human
uucaugcaucgacucuuuuauuuc

SEQ ID NO: 223867 - RNA, 19 nt, Human
uuccagagcuucauucucc

SEQ ID NO: 223868 - RNA, 20 nt, Human
uuccuccaugguucugcccc

SEQ ID NO: 223869 - RNA, 22 nt, Human
uuccuccaugguucugccccaa

SEQ ID NO: 223870 - RNA, 18 nt, Human
uuuccauggagcugccgc

SEQ ID NO: 223871 - RNA, 21 nt, Human
uuuggucaaacaagccaggca

SEQ ID NO: 223872 - RNA, 20 nt, Human
aaaaaauaacaaaaacauuc

SEQ ID NO: 223873 - RNA, 22 nt, Human
aaaauaacaaaaacauucagga

SEQ ID NO: 223874 - RNA, 28 nt, Human
aaacaaaaaauaacaaaaacauucagga

SEQ ID NO: 223875 - RNA, 19 nt, Human
aaacagcugaggccccaga

SEQ ID NO: 223876 - RNA, 23 nt, Human
aaacagcugaggccccagaccuc

SEQ ID NO: 223877 - RNA, 24 nt, Human
aaagacccugcaggcaaggccucc

SEQ ID NO: 223878 - RNA, 18 nt, Human
aaagccucuccuagcccc

SEQ ID NO: 223879 - RNA, 26 nt, Human
aacagcaguuuguuuaaaaaauaaaa

SEQ ID NO: 223880 - RNA, 25 nt, Human
aagaacacaggacuugacucugggc

SEQ ID NO: 223881 - RNA, 22 nt, Human
aaggccuccucagggucagucc

SEQ ID NO: 223882 - RNA, 20 nt, Human
aagggcagaaccagccagag

SEQ ID NO: 223883 - RNA, 20 nt, Human
aauaacaaaaacauucagga

SEQ ID NO: 223884 - RNA, 20 nt, Human
acagggaaggagaagacagc

SEQ ID NO: 223885 - RNA, 21 nt, Human
accaggggccaggcgucccgg

SEQ ID NO: 223886 - RNA, 22 nt, Human
acccugcccucaucuccucacu

SEQ ID NO: 223887 - RNA, 20 nt, Human
acggaaacaccugaccccac

SEQ ID NO: 223888 - RNA, 19 nt, Human
acucaccccccgcaagcac

SEQ ID NO: 223889 - RNA, 19 nt, Human
agaaagccucuccuagccc

SEQ ID NO: 223890 - RNA, 21 nt, Human
agaagacagcaggauugggag

SEQ ID NO: 223891 - RNA, 23 nt, Human
agacacuagaucucccaauccuu

SEQ ID NO: 223892 - RNA, 23 nt, Human
agacagggaacacagcucugggc

SEQ ID NO: 223893 - RNA, 23 nt, Human
agaggccaucaaagguggggugg

SEQ ID NO: 223894 - RNA, 23 nt, Human
agccaggguaugguucagcugga

SEQ ID NO: 223895 - RNA, 24 nt, Human
aggccccuggccccccacucccag

SEQ ID NO: 223896 - RNA, 21 nt, Human
agggugaggggggaagaggcc

SEQ ID NO: 223897 - RNA, 24 nt, Human
aguuccgaggcugccccccccacc

SEQ ID NO: 223898 - RNA, 21 nt, Human
auugaguugcagggcaggagg

SEQ ID NO: 223899 - RNA, 25 nt, Human
caaaaaauaacaaaaacauucagga

SEQ ID NO: 223900 - RNA, 20 nt, Human
caaaaacauucaggacacag

SEQ ID NO: 223901 - RNA, 22 nt, Human
caaccagcaacaacaugguuca

SEQ ID NO: 223902 - RNA, 21 nt, Human
caccagcggggcugaaagggc

SEQ ID NO: 223903 - RNA, 20 nt, Human
caccgcuccccggacagagu

SEQ ID NO: 223904 - RNA, 19 nt, Human
cacucacgcggcccggggu

SEQ ID NO: 223905 - RNA, 25 nt, Human
cacucccaccuccagcagccuccac

SEQ ID NO: 223906 - RNA, 19 nt, Human
cagauuccagguauauaaa

SEQ ID NO: 223907 - RNA, 18 nt, Human
cagcgggcagggugugca

SEQ ID NO: 223908 - RNA, 22 nt, Human
cagcucccuggccaccagcccu

SEQ ID NO: 223909 - RNA, 19 nt, Human
cagugggccagccccaggg

SEQ ID NO: 223910 - RNA, 19 nt, Human
caguuccgaggcugccccc

SEQ ID NO: 223911 - RNA, 22 nt, Human
ccacagccaggguaugguucag

SEQ ID NO: 223912 - RNA, 19 nt, Human
ccaccaaauggugagacaa

SEQ ID NO: 223913 - RNA, 21 nt, Human
cccacaguaguggggcagaag

SEQ ID NO: 223914 - RNA, 23 nt, Human
cccaggccccaggcccacauagg

SEQ ID NO: 223915 - RNA, 25 nt, Human
cccagggggcuggugggaggggaag

SEQ ID NO: 223916 - RNA, 20 nt, Human
cccaugcucugcuacucucc

SEQ ID NO: 223917 - RNA, 25 nt, Human
ccccacgcacagcgguaccuccccc

SEQ ID NO: 223918 - RNA, 19 nt, Human
ccccagaccucagagaacc

SEQ ID NO: 223919 - RNA, 18 nt, Human
ccccaggccccaggccca

SEQ ID NO: 223920 - RNA, 20 nt, Human
ccccgcaagcaccgcucccc

SEQ ID NO: 223921 - RNA, 18 nt, Human
cccgcaagcaccgcuccc

SEQ ID NO: 223922 - RNA, 22 nt, Human
cccgcccuccagccucugaaaa

SEQ ID NO: 223923 - RNA, 21 nt, Human
cccggcuuccaguaacccaug

SEQ ID NO: 223924 - RNA, 23 nt, Human
cccgggcauacaucuagcugagg

SEQ ID NO: 223925 - RNA, 19 nt, Human
cccuggccaccagcccuag

SEQ ID NO: 223926 - RNA, 20 nt, Human
ccgaggcugccccccccacc

SEQ ID NO: 223927 - RNA, 28 nt, Human
ccuggccaccagcccuagcagucccggc

SEQ ID NO: 223928 - RNA, 18 nt, Human
ccuggggccagcgggcag

SEQ ID NO: 223929 - RNA, 24 nt, Human
cggccgccuccuagagaaagccuc

SEQ ID NO: 223930 - RNA, 22 nt, Human
cggcuuccaguaacccaugcuc

SEQ ID NO: 223931 - RNA, 22 nt, Human
cggcuuccaguaacccaugcuc

SEQ ID NO: 223932 - RNA, 24 nt, Human
cgggaagaacacaggacuugacuc

SEQ ID NO: 223933 - RNA, 21 nt, Human
cgggacacccuagggugaggg

SEQ ID NO: 223934 - RNA, 18 nt, Human
cggggugggcgaacacca

SEQ ID NO: 223935 - RNA, 21 nt, Human
cuaccaguccgcccgcccucc

SEQ ID NO: 223936 - RNA, 23 nt, Human
cucaguguccccuucuccaccuc

SEQ ID NO: 223937 - RNA, 19 nt, Human
cuccagcagccuccacccc

SEQ ID NO: 223938 - RNA, 24 nt, Human
cucccuccuaccacuugggggccc

SEQ ID NO: 223939 - RNA, 21 nt, Human
cucccuggccaccagcccuag

SEQ ID NO: 223940 - RNA, 21 nt, Human
cugaagccaacaacagauucc

SEQ ID NO: 223941 - RNA, 22 nt, Human
cugaagccaacaacagauuccc

SEQ ID NO: 223942 - RNA, 22 nt, Human
cugcaggcaaggccuccucagg

SEQ ID NO: 223943 - RNA, 22 nt, Human
cuggaccgcggaugcguaagga

SEQ ID NO: 223944 - RNA, 20 nt, Human
cuggugggaggggaaggcgg

SEQ ID NO: 223945 - RNA, 19 nt, Human
cuugcuuccugcccggccu

SEQ ID NO: 223946 - RNA, 21 nt, Human
cuugggggcccacagaaagcc

SEQ ID NO: 223947 - RNA, 22 nt, Human
gaaggccccuggccccccacuc

SEQ ID NO: 223948 - RNA, 19 nt, Human
gacccugcucuuuaaccac

SEQ ID NO: 223949 - RNA, 19 nt, Human
gaccugagacagggaacac

SEQ ID NO: 223950 - RNA, 24 nt, Human
gacuugcuuccugcccggccucca

SEQ ID NO: 223951 - RNA, 18 nt, Human
gagaagacagcaggauug

SEQ ID NO: 223952 - RNA, 24 nt, Human
gagacagggaacacagcucugggc

SEQ ID NO: 223953 - RNA, 24 nt, Human
gaggcugcuccuuuucaggccccu

SEQ ID NO: 223954 - RNA, 20 nt, Human
gcaggcaaggccuccucagg

SEQ ID NO: 223955 - RNA, 23 nt, Human
gccaagcucaggacagaugcccc

SEQ ID NO: 223956 - RNA, 19 nt, Human
gccagccccagggggcugg

SEQ ID NO: 223957 - RNA, 18 nt, Human
gcccaauugaguugcagg

SEQ ID NO: 223958 - RNA, 26 nt, Human
gcgggcgggcccugcuccugcugugg

SEQ ID NO: 223959 - RNA, 19 nt, Human
gcggggagcugcguggggc

SEQ ID NO: 223960 - RNA, 18 nt, Human
gcugccccccccaccagg

SEQ ID NO: 223961 - RNA, 25 nt, Human
gcuggagaacagaggcccugucccg

SEQ ID NO: 223962 - RNA, 22 nt, Human
ggacuuguuuccaggcccugug

SEQ ID NO: 223963 - RNA, 19 nt, Human
ggaggugggcucuggcccc

SEQ ID NO: 223964 - RNA, 19 nt, Human
ggcagaaccagccagagcu

SEQ ID NO: 223965 - RNA, 24 nt, Human
ggcaggagggcagacacuagaucu

SEQ ID NO: 223966 - RNA, 23 nt, Human
ggcagugagguccuuguucaggg

SEQ ID NO: 223967 - RNA, 21 nt, Human
ggccccuggccccccacuccc

SEQ ID NO: 223968 - RNA, 18 nt, Human
ggcccuugacaucauggc

SEQ ID NO: 223969 - RNA, 20 nt, Human
ggcccuugacaucauggccu

SEQ ID NO: 223970 - RNA, 19 nt, Human
ggcuagagaagugggggug

SEQ ID NO: 223971 - RNA, 20 nt, Human
ggcuggugggaggggaaggc

SEQ ID NO: 223972 - RNA, 18 nt, Human
gggaaggagaagacagca

SEQ ID NO: 223973 - RNA, 20 nt, Human
gggcagaaccagccagagcu

SEQ ID NO: 223974 - RNA, 24 nt, Human
gggcagugagguccuuguucaggg

SEQ ID NO: 223975 - RNA, 18 nt, Human
gggggcccacagaaagcc

SEQ ID NO: 223976 - RNA, 20 nt, Human
guccccuucuccaccucugc

SEQ ID NO: 223977 - RNA, 21 nt, Human
gugggccgcuucuccacgcgu

SEQ ID NO: 223978 - RNA, 25 nt, Human
gugguacggaaacaccugaccccac

SEQ ID NO: 223979 - RNA, 19 nt, Human
guuuguuuaaaaaauaaaa

SEQ ID NO: 223980 - RNA, 25 nt, Human
uaaaaaauaaaacaaaaaauaacaa

SEQ ID NO: 223981 - RNA, 20 nt, Human
uaguggggcagaaggcagag

SEQ ID NO: 223982 - RNA, 19 nt, Human
ucaggacagaugcccccac

SEQ ID NO: 223983 - RNA, 19 nt, Human
ucaggccccugcugggugg

SEQ ID NO: 223984 - RNA, 23 nt, Human
ucaguguccccuucuccaccucu

SEQ ID NO: 223985 - RNA, 18 nt, Human
uccccggacagaguugcu

SEQ ID NO: 223986 - RNA, 23 nt, Human
ucugccacugcuugaccugagac

SEQ ID NO: 223987 - RNA, 20 nt, Human
ugaaaacagcuguuugaauu

SEQ ID NO: 223988 - RNA, 23 nt, Human
ugaaaacagcuguuugaauuugg

SEQ ID NO: 223989 - RNA, 18 nt, Human
ugaccccacgcacagcgg

SEQ ID NO: 223990 - RNA, 18 nt, Human
ugaggaccccaggcccca

SEQ ID NO: 223991 - RNA, 22 nt, Human
ugaggggggaagaggccaucaa

SEQ ID NO: 223992 - RNA, 25 nt, Human
ugaggggggaagaggccaucaaagg

SEQ ID NO: 223993 - RNA, 21 nt, Human
ugaugacuugcuuccugcccg

SEQ ID NO: 223994 - RNA, 24 nt, Human
ugcagcucccuggccaccagcccu

SEQ ID NO: 223995 - RNA, 18 nt, Human
ugcuuccugcccggccuc

SEQ ID NO: 223996 - RNA, 21 nt, Human
uggaugccccuuccugcuuuu

SEQ ID NO: 223997 - RNA, 21 nt, Human
uggccccccacucccaguucc

SEQ ID NO: 223998 - RNA, 21 nt, Human
ugggccagccccagggggcug

SEQ ID NO: 223999 - RNA, 24 nt, Human
ugggccagccccagggggcuggug

SEQ ID NO: 224000 - RNA, 19 nt, Human
uggggcagaaggcagagag

SEQ ID NO: 224001 - RNA, 24 nt, Human
ugggggcccacagaaagccuugcg

SEQ ID NO: 224002 - RNA, 23 nt, Human
ugggggugugggcacgugcccau

SEQ ID NO: 224003 - RNA, 18 nt, Human
uggguggcggccucugca

SEQ ID NO: 224004 - RNA, 18 nt, Human
uguaguaggugcccgacc

SEQ ID NO: 224005 - RNA, 21 nt, Human
uuccaguaacccaugcucugc

SEQ ID NO: 224006 - RNA, 27 nt, Human
uuuucaggccccugcuggguggcggcc

SEQ ID NO: 224007 - RNA, 21 nt, Human
uuuuuuuuuuuuuuuugccug

SEQ ID NO: 224008 - RNA, 18 nt, Human
uuuuuuuuuuuuuuuuug

SEQ ID NO: 224009 - RNA, 24 nt, Human
aaagugcuggguguauaggcguga

SEQ ID NO: 224010 - RNA, 24 nt, Human
aacuucuuccugccuauuucucau

SEQ ID NO: 224011 - RNA, 20 nt, Human
aagcuccauaagggcaguuc

SEQ ID NO: 224012 - RNA, 24 nt, Human
aaguagccaggaucacaggcaugc

SEQ ID NO: 224013 - RNA, 18 nt, Human
acaaaggagagacggugg

SEQ ID NO: 224014 - RNA, 22 nt, Human
acagacggaacaugaaagagaa

SEQ ID NO: 224015 - RNA, 18 nt, Human
acccaagccuggcagagg

SEQ ID NO: 224016 - RNA, 21 nt, Human
acccaccgggaccccgcgagc

SEQ ID NO: 224017 - RNA, 22 nt, Human
accccgcgagcccuggguggcc

SEQ ID NO: 224018 - RNA, 23 nt, Human
accucagccucugaaguagccag

SEQ ID NO: 224019 - RNA, 20 nt, Human
acugcaagcuccauaagggc

SEQ ID NO: 224020 - RNA, 19 nt, Human
acugcagccucaaacuccu

SEQ ID NO: 224021 - RNA, 28 nt, Human
agagaacaagguuauguuggucgacugg

SEQ ID NO: 224022 - RNA, 25 nt, Human
agagagacacaguguaaagaggaug

SEQ ID NO: 224023 - RNA, 21 nt, Human
agauaaggaaacaaaaucaga

SEQ ID NO: 224024 - RNA, 21 nt, Human
agcacacaggagggguuuagg

SEQ ID NO: 224025 - RNA, 19 nt, Human
agccaccacacucagccug

SEQ ID NO: 224026 - RNA, 20 nt, Human
agccucaaacuccuggccuc

SEQ ID NO: 224027 - RNA, 20 nt, Human
agccuuccaaagugcugggu

SEQ ID NO: 224028 - RNA, 23 nt, Human
aggaucacaggcaugcaccacca

SEQ ID NO: 224029 - RNA, 20 nt, Human
aggcaugcaccaccacaccc

SEQ ID NO: 224030 - RNA, 21 nt, Human
aggcgugagccaccacacuca

SEQ ID NO: 224031 - RNA, 18 nt, Human
aggcucagagacgggcag

SEQ ID NO: 224032 - RNA, 25 nt, Human
agucuaucgcccaggccuacaccag

SEQ ID NO: 224033 - RNA, 22 nt, Human
aguguaaagaggaugagagaaa

SEQ ID NO: 224034 - RNA, 18 nt, Human
auaacucacugcagccuc

SEQ ID NO: 224035 - RNA, 22 nt, Human
caaaggagagacgguggacggc

SEQ ID NO: 224036 - RNA, 24 nt, Human
caaagugcuggguguauaggcgug

SEQ ID NO: 224037 - RNA, 23 nt, Human
caaccaggcugauuccagggcac

SEQ ID NO: 224038 - RNA, 27 nt, Human
caagcgauccuccuuccucagccuucc

SEQ ID NO: 224039 - RNA, 20 nt, Human
caagugauccuuccaccuca

SEQ ID NO: 224040 - RNA, 27 nt, Human
cacacccaagccuggcagaggcugccc

SEQ ID NO: 224041 - RNA, 22 nt, Human
cacacucagccugaaauccuuu

SEQ ID NO: 224042 - RNA, 19 nt, Human
caccacacucagccugaaa

SEQ ID NO: 224043 - RNA, 19 nt, Human
cacccaccgggaccccgcg

SEQ ID NO: 224044 - RNA, 20 nt, Human
cacccaccgggaccccgcga

SEQ ID NO: 224045 - RNA, 22 nt, Human
caccucaccuccuccauuaaag

SEQ ID NO: 224046 - RNA, 21 nt, Human
caccucagccucugaaguagc

SEQ ID NO: 224047 - RNA, 22 nt, Human
caccugagaaaaaugagucaac

SEQ ID NO: 224048 - RNA, 19 nt, Human
cacucugucccgcaggcug

SEQ ID NO: 224049 - RNA, 24 nt, Human
cacucugucccgcaggcuggagug

SEQ ID NO: 224050 - RNA, 24 nt, Human
cacuguguugccuaggcuagucuc

SEQ ID NO: 224051 - RNA, 24 nt, Human
cagauaaggaaacaaaaucagaga

SEQ ID NO: 224052 - RNA, 20 nt, Human
cagcccaguagaaucagcag

SEQ ID NO: 224053 - RNA, 24 nt, Human
cagccucaaacuccuggccucaag

SEQ ID NO: 224054 - RNA, 21 nt, Human
caggaucacaggcaugcacca

SEQ ID NO: 224055 - RNA, 19 nt, Human
caggccaggcacacccaag

SEQ ID NO: 224056 - RNA, 23 nt, Human
caugaaagagaaugagaaacaga

SEQ ID NO: 224057 - RNA, 23 nt, Human
caugcaccaccacacccagcuaa

SEQ ID NO: 224058 - RNA, 22 nt, Human
ccaaagugcuggguguauaggc

SEQ ID NO: 224059 - RNA, 22 nt, Human
ccaaagugcuggguguauaggc

SEQ ID NO: 224060 - RNA, 24 nt, Human
ccaaagugcuggguguauaggcgu

SEQ ID NO: 224061 - RNA, 21 nt, Human
ccaccgggaccccgcgagccc

SEQ ID NO: 224062 - RNA, 18 nt, Human
ccaggccaggcacaccca

SEQ ID NO: 224063 - RNA, 23 nt, Human
ccaggggucccuccauggguccu

SEQ ID NO: 224064 - RNA, 18 nt, Human
cccacagcccaguagaau

SEQ ID NO: 224065 - RNA, 19 nt, Human
cccaguggagcccgggaca

SEQ ID NO: 224066 - RNA, 18 nt, Human
ccgggaccccgcgagccc

SEQ ID NO: 224067 - RNA, 21 nt, Human
ccuccauggguccugcucccu

SEQ ID NO: 224068 - RNA, 20 nt, Human
ccucccaugccauucagauc

SEQ ID NO: 224069 - RNA, 19 nt, Human
ccuccuuccucagccuucc

SEQ ID NO: 224070 - RNA, 26 nt, Human
ccuccuuccucagccuuccaaagugc

SEQ ID NO: 224071 - RNA, 25 nt, Human
ccugcucccuggagacaccugagaa

SEQ ID NO: 224072 - RNA, 18 nt, Human
ccuggccucaagcgaucc

SEQ ID NO: 224073 - RNA, 20 nt, Human
ccuggccucaagcgauccuc

SEQ ID NO: 224074 - RNA, 22 nt, Human
ccuggccucaagugauccuucc

SEQ ID NO: 224075 - RNA, 24 nt, Human
ccuggccucaagugauccuuccac

SEQ ID NO: 224076 - RNA, 23 nt, Human
ccuuccaccucagccucugaagu

SEQ ID NO: 224077 - RNA, 18 nt, Human
cgccuggaccccucaguc

SEQ ID NO: 224078 - RNA, 20 nt, Human
cgggacauggggacagggag

SEQ ID NO: 224079 - RNA, 21 nt, Human
cuagcacagggccagcacaca

SEQ ID NO: 224080 - RNA, 24 nt, Human
cucaagcgauccuccuuccucagc

SEQ ID NO: 224081 - RNA, 24 nt, Human
cucaagugauccuuccaccucagc

SEQ ID NO: 224082 - RNA, 24 nt, Human
cucacucugucccgcaggcuggag

SEQ ID NO: 224083 - RNA, 21 nt, Human
cucacugcagccucaaacucc

SEQ ID NO: 224084 - RNA, 24 nt, Human
cucacugcagccucaaacuccugg

SEQ ID NO: 224085 - RNA, 19 nt, Human
cuccagcacugucuagcac

SEQ ID NO: 224086 - RNA, 21 nt, Human
cucucucucuuucucuuucuu

SEQ ID NO: 224087 - RNA, 22 nt, Human
cugcagccucaaacuccuggcc

SEQ ID NO: 224088 - RNA, 20 nt, Human
cuggccucaagugauccuuc

SEQ ID NO: 224089 - RNA, 18 nt, Human
cuguguugccuaggcuag

SEQ ID NO: 224090 - RNA, 28 nt, Human
cuuccaucuuucccuuucuccucugaag

SEQ ID NO: 224091 - RNA, 22 nt, Human
cuucccauuuggcagcugagga

SEQ ID NO: 224092 - RNA, 18 nt, Human
cuuucccuuucuuucuuu

SEQ ID NO: 224093 - RNA, 24 nt, Human
cuuucuuucuuucucucucuuucu

SEQ ID NO: 224094 - RNA, 22 nt, Human
cuuucuuucuuucucucuuucu

SEQ ID NO: 224095 - RNA, 18 nt, Human
cuuucuuucuuucuuucu

SEQ ID NO: 224096 - RNA, 20 nt, Human
cuuucuuucuuucuuucucu

SEQ ID NO: 224097 - RNA, 20 nt, Human
cuuucuuucuuucuuucucu

SEQ ID NO: 224098 - RNA, 18 nt, Human
gaaaucaaggcucagaga

SEQ ID NO: 224099 - RNA, 20 nt, Human
gagaaaggacagagaacaag

SEQ ID NO: 224100 - RNA, 21 nt, Human
gagacagcaagagggaaagac

SEQ ID NO: 224101 - RNA, 25 nt, Human
gagacagcaagagggaaagacagag

SEQ ID NO: 224102 - RNA, 22 nt, Human
gauaaggaaacaaaaucagaga

SEQ ID NO: 224103 - RNA, 20 nt, Human
gaugaucaccauuuuacaga

SEQ ID NO: 224104 - RNA, 21 nt, Human
gaugcugggaaacaaaggaga

SEQ ID NO: 224105 - RNA, 23 nt, Human
gaugcugggaaacaaaggagaga

SEQ ID NO: 224106 - RNA, 20 nt, Human
gccaucacugucuggggaca

SEQ ID NO: 224107 - RNA, 19 nt, Human
gcuagucucaaacuccugg

SEQ ID NO: 224108 - RNA, 23 nt, Human
gcuagucucaaacuccuggccuc

SEQ ID NO: 224109 - RNA, 21 nt, Human
gcuggagugcagcagugccag

SEQ ID NO: 224110 - RNA, 27 nt, Human
ggaaacaaaggagagacgguggacggc

SEQ ID NO: 224111 - RNA, 22 nt, Human
ggaucacaggcaugcaccacca

SEQ ID NO: 224112 - RNA, 22 nt, Human
ggccccgcugacguggcccccg

SEQ ID NO: 224113 - RNA, 24 nt, Human
ggccucaagugauccuuccaccuc

SEQ ID NO: 224114 - RNA, 19 nt, Human
gggaaagacagaggcagcg

SEQ ID NO: 224115 - RNA, 23 nt, Human
gggucccuccauggguccugcuc

SEQ ID NO: 224116 - RNA, 21 nt, Human
ggguccugcucccuggagaca

SEQ ID NO: 224117 - RNA, 18 nt, Human
gguccugcucccuggaga

SEQ ID NO: 224118 - RNA, 19 nt, Human
uaaggaaacaaaaucagag

SEQ ID NO: 224119 - RNA, 22 nt, Human
uacagauaaggaaacaaaauca

SEQ ID NO: 224120 - RNA, 22 nt, Human
uauaggcgugagccaccacacu

SEQ ID NO: 224121 - RNA, 22 nt, Human
uaugaugaucaccauuuuacag

SEQ ID NO: 224122 - RNA, 24 nt, Human
ucacugcagccucaaacuccuggc

SEQ ID NO: 224123 - RNA, 20 nt, Human
ucagagagguagugugacug

SEQ ID NO: 224124 - RNA, 21 nt, Human
ucagaucugggcugggguccu

SEQ ID NO: 224125 - RNA, 21 nt, Human
ucagccucugaaguagccagg

SEQ ID NO: 224126 - RNA, 18 nt, Human
uccaggcuggauugggcc

SEQ ID NO: 224127 - RNA, 21 nt, Human
ucccauuuggcagcugaggaa

SEQ ID NO: 224128 - RNA, 20 nt, Human
ucccugacuuuccaggcugg

SEQ ID NO: 224129 - RNA, 22 nt, Human
ucccuggagacaccugagaaaa

SEQ ID NO: 224130 - RNA, 21 nt, Human
uccuccuuccucagccuucca

SEQ ID NO: 224131 - RNA, 19 nt, Human
uccuuccucagccuuccaa

SEQ ID NO: 224132 - RNA, 24 nt, Human
ucucacucugucccgcaggcugga

SEQ ID NO: 224133 - RNA, 18 nt, Human
ucuccagcacugucuagc

SEQ ID NO: 224134 - RNA, 24 nt, Human
ucugucccgcaggcuggagugcag

SEQ ID NO: 224135 - RNA, 23 nt, Human
ucuuacuuuucuuucuuuuucuu

SEQ ID NO: 224136 - RNA, 23 nt, Human
ucuuacuuuucuuucuuuuucuu

SEQ ID NO: 224137 - RNA, 19 nt, Human
ucuuucucucucucucucc

SEQ ID NO: 224138 - RNA, 20 nt, Human
ucuuucucuuucuuuuuccu

SEQ ID NO: 224139 - RNA, 20 nt, Human
ucuuucuuucucucucuuuc

SEQ ID NO: 224140 - RNA, 21 nt, Human
ucuuucuuucucucuuucuuu

SEQ ID NO: 224141 - RNA, 20 nt, Human
ucuuucuuucuuucuuucuc

SEQ ID NO: 224142 - RNA, 20 nt, Human
ucuuucuuucuuucuuucuc

SEQ ID NO: 224143 - RNA, 19 nt, Human
ugagaaacagagacagcaa

SEQ ID NO: 224144 - RNA, 19 nt, Human
ugagauaaggccucacugu

SEQ ID NO: 224145 - RNA, 21 nt, Human
ugaggaaaucaaggcucagag

SEQ ID NO: 224146 - RNA, 21 nt, Human
ugccaggcugcugaggaagag

SEQ ID NO: 224147 - RNA, 21 nt, Human
ugccugaaaugaggucugagc

SEQ ID NO: 224148 - RNA, 21 nt, Human
ugcugcccuucacaucccagc

SEQ ID NO: 224149 - RNA, 24 nt, Human
ugcugugcucguggacauuccugu

SEQ ID NO: 224150 - RNA, 23 nt, Human
uggaccccucagucccaggccag

SEQ ID NO: 224151 - RNA, 18 nt, Human
uggccucaagcgauccuc

SEQ ID NO: 224152 - RNA, 19 nt, Human
uggccucaagcgauccucc

SEQ ID NO: 224153 - RNA, 20 nt, Human
uggccucaagcgauccuccu

SEQ ID NO: 224154 - RNA, 21 nt, Human
uggccucaagugauccuucca

SEQ ID NO: 224155 - RNA, 24 nt, Human
uggccucaagugauccuuccaccu

SEQ ID NO: 224156 - RNA, 23 nt, Human
ugggcugggguccuaugucuguu

SEQ ID NO: 224157 - RNA, 24 nt, Human
uggguguauaggcgugagccacca

SEQ ID NO: 224158 - RNA, 22 nt, Human
uggugucaugguuaagggcagc

SEQ ID NO: 224159 - RNA, 24 nt, Human
uguugagauaaggccucacugugu

SEQ ID NO: 224160 - RNA, 22 nt, Human
uguugccuaggcuagucucaaa

SEQ ID NO: 224161 - RNA, 20 nt, Human
uuccucagccuuccaaagug

SEQ ID NO: 224162 - RNA, 21 nt, Human
uuccucagccuuccaaagugc

SEQ ID NO: 224163 - RNA, 20 nt, Human
uucuuucuuuuucuuucucu

SEQ ID NO: 224164 - RNA, 20 nt, Human
uugggauuugagcucaaccg

SEQ ID NO: 224165 - RNA, 23 nt, Human
uuuuccuuccuuccuuccaucuu

SEQ ID NO: 224166 - RNA, 19 nt, Human
uuuuuagauuuugugguug

SEQ ID NO: 224167 - RNA, 18 nt, Human
aaccuggggaggagaagg

SEQ ID NO: 224168 - RNA, 19 nt, Human
aacuggcaccacucacccc

SEQ ID NO: 224169 - RNA, 21 nt, Human
aagaacuuccccauggcacgg

SEQ ID NO: 224170 - RNA, 21 nt, Human
aagaacuuccccauggcacgg

SEQ ID NO: 224171 - RNA, 21 nt, Human
aagaacuuccccauggcacgg

SEQ ID NO: 224172 - RNA, 25 nt, Human
aagcaaguaacccccuucucaacgc

SEQ ID NO: 224173 - RNA, 25 nt, Human
aagcaaguaacccccuucucaacgc

SEQ ID NO: 224174 - RNA, 20 nt, Human
aagcaggggcuuguccugaa

SEQ ID NO: 224175 - RNA, 20 nt, Human
aagcaggggcuuguccugaa

SEQ ID NO: 224176 - RNA, 20 nt, Human
aagcaggggcuuguccugaa

SEQ ID NO: 224177 - RNA, 19 nt, Human
aaggcccagccccccagug

SEQ ID NO: 224178 - RNA, 22 nt, Human
aaggcccagccccccagugauu

SEQ ID NO: 224179 - RNA, 22 nt, Human
acccuucccagguccuggaggc

SEQ ID NO: 224180 - RNA, 24 nt, Human
accuggggaggagaaggugcuggg

SEQ ID NO: 224181 - RNA, 19 nt, Human
agcagcugggauggugggg

SEQ ID NO: 224182 - RNA, 20 nt, Human
aggcaccugggaggggcugg

SEQ ID NO: 224183 - RNA, 21 nt, Human
aggcaccugggaggggcuggg

SEQ ID NO: 224184 - RNA, 18 nt, Human
agggcggggccaggagga

SEQ ID NO: 224185 - RNA, 20 nt, Human
aggggcugggcagggcgggg

SEQ ID NO: 224186 - RNA, 18 nt, Human
augauuaacaguaucccc

SEQ ID NO: 224187 - RNA, 18 nt, Human
augauuaacaguaucccc

SEQ ID NO: 224188 - RNA, 22 nt, Human
caacuggcaccacucacccccu

SEQ ID NO: 224189 - RNA, 18 nt, Human
caaguaaccuggggagga

SEQ ID NO: 224190 - RNA, 21 nt, Human
caccacucacccccuucucaa

SEQ ID NO: 224191 - RNA, 18 nt, Human
cacccuucccagguccug

SEQ ID NO: 224192 - RNA, 23 nt, Human
cacccuucccagguccuggaggc

SEQ ID NO: 224193 - RNA, 25 nt, Human
cacuccuggcugcuuccuccucagg

SEQ ID NO: 224194 - RNA, 25 nt, Human
cacuccuggcugcuuccuccucagg

SEQ ID NO: 224195 - RNA, 25 nt, Human
cacuccuggcugcuuccuccucagg

SEQ ID NO: 224196 - RNA, 25 nt, Human
cacuccuggcugcuuccuccucagg

SEQ ID NO: 224197 - RNA, 22 nt, Human
cagagccaguucauccugcccc

SEQ ID NO: 224198 - RNA, 22 nt, Human
cagagccaguucauccugcccc

SEQ ID NO: 224199 - RNA, 22 nt, Human
cagagccaguucauccugcccc

SEQ ID NO: 224200 - RNA, 22 nt, Human
cagagcucuucgacuaccccuc

SEQ ID NO: 224201 - RNA, 18 nt, Human
cagcgcagugacuugccc

SEQ ID NO: 224202 - RNA, 18 nt, Human
caggaggaggugcugugu

SEQ ID NO: 224203 - RNA, 21 nt, Human
caggcaccugggaggggcugg

SEQ ID NO: 224204 - RNA, 24 nt, Human
cagggcggggccaggaggaggugc

SEQ ID NO: 224205 - RNA, 19 nt, Human
ccacucacccccuucucaa

SEQ ID NO: 224206 - RNA, 21 nt, Human
cccccagugauuuaugggagu

SEQ ID NO: 224207 - RNA, 22 nt, Human
ccccccagugauuuaugggagu

SEQ ID NO: 224208 - RNA, 22 nt, Human
ccccgcccaccucccagcgcag

SEQ ID NO: 224209 - RNA, 20 nt, Human
cccugaggccucccgcccac

SEQ ID NO: 224210 - RNA, 20 nt, Human
cccugaggccucccgcccac

SEQ ID NO: 224211 - RNA, 20 nt, Human
cccugaggccucccgcccac

SEQ ID NO: 224212 - RNA, 20 nt, Human
cccugaggccucccgcccac

SEQ ID NO: 224213 - RNA, 22 nt, Human
ccgcggcuccaucuccagauuc

SEQ ID NO: 224214 - RNA, 22 nt, Human
ccgcggcuccaucuccagauuc

SEQ ID NO: 224215 - RNA, 22 nt, Human
ccgcggcuccaucuccagauuc

SEQ ID NO: 224216 - RNA, 22 nt, Human
ccgcggcuccaucuccagauuc

SEQ ID NO: 224217 - RNA, 18 nt, Human
ccucaggugccgccaccu

SEQ ID NO: 224218 - RNA, 18 nt, Human
ccucaggugccgccaccu

SEQ ID NO: 224219 - RNA, 18 nt, Human
ccucaggugccgccaccu

SEQ ID NO: 224220 - RNA, 18 nt, Human
ccucaggugccgccaccu

SEQ ID NO: 224221 - RNA, 20 nt, Human
ccucccagcgcagugacuug

SEQ ID NO: 224222 - RNA, 21 nt, Human
ccuccucaggugccgccaccu

SEQ ID NO: 224223 - RNA, 21 nt, Human
ccuccucaggugccgccaccu

SEQ ID NO: 224224 - RNA, 21 nt, Human
ccuccucaggugccgccaccu

SEQ ID NO: 224225 - RNA, 21 nt, Human
ccuccucaggugccgccaccu

SEQ ID NO: 224226 - RNA, 21 nt, Human
ccugaagcuggggccgcgggc

SEQ ID NO: 224227 - RNA, 21 nt, Human
ccugaagcuggggccgcgggc

SEQ ID NO: 224228 - RNA, 21 nt, Human
ccugaagcuggggccgcgggc

SEQ ID NO: 224229 - RNA, 24 nt, Human
ccuggcugcuuccuccucaggugc

SEQ ID NO: 224230 - RNA, 23 nt, Human
cgccaccuuacggagcugaacuc

SEQ ID NO: 224231 - RNA, 23 nt, Human
cgccaccuuacggagcugaacuc

SEQ ID NO: 224232 - RNA, 23 nt, Human
cgccaccuuacggagcugaacuc

SEQ ID NO: 224233 - RNA, 23 nt, Human
cgccaccuuacggagcugaacuc

SEQ ID NO: 224234 - RNA, 27 nt, Human
cuagaagcaaguaacccccuucucaac

SEQ ID NO: 224235 - RNA, 27 nt, Human
cuagaagcaaguaacccccuucucaac

SEQ ID NO: 224236 - RNA, 24 nt, Human
cucacccccuucucaacgcugcca

SEQ ID NO: 224237 - RNA, 24 nt, Human
cuccaccugcaaggcccagccccc

SEQ ID NO: 224238 - RNA, 24 nt, Human
cugcaucacccuucccagguccug

SEQ ID NO: 224239 - RNA, 22 nt, Human
cuucccagguccuggaggcaag

SEQ ID NO: 224240 - RNA, 25 nt, Human
cuuccccagccacuccuggcugcuu

SEQ ID NO: 224241 - RNA, 25 nt, Human
cuuccccagccacuccuggcugcuu

SEQ ID NO: 224242 - RNA, 26 nt, Human
cuuccccagccacuccuggcugcuuc

SEQ ID NO: 224243 - RNA, 26 nt, Human
cuuccccagccacuccuggcugcuuc

SEQ ID NO: 224244 - RNA, 19 nt, Human
gcaccugggaggggcuggg

SEQ ID NO: 224245 - RNA, 19 nt, Human
gccuggguucuggugaugc

SEQ ID NO: 224246 - RNA, 20 nt, Human
gcggggccaggaggagguga

SEQ ID NO: 224247 - RNA, 23 nt, Human
gcugccaccagagcucuucgacu

SEQ ID NO: 224248 - RNA, 20 nt, Human
gcuggggugugaacaggagg

SEQ ID NO: 224249 - RNA, 21 nt, Human
gcuggggugugaacaggaggg

SEQ ID NO: 224250 - RNA, 19 nt, Human
ggaggagaaggugcugggg

SEQ ID NO: 224251 - RNA, 22 nt, Human
ggauggcugggguggcuggggu

SEQ ID NO: 224252 - RNA, 20 nt, Human
ggcagggugcucagagccag

SEQ ID NO: 224253 - RNA, 20 nt, Human
ggcagggugcucagagccag

SEQ ID NO: 224254 - RNA, 20 nt, Human
ggcagggugcucagagccag

SEQ ID NO: 224255 - RNA, 20 nt, Human
ggccaggaggaggugcugug

SEQ ID NO: 224256 - RNA, 18 nt, Human
ggcugggcagggcggggc

SEQ ID NO: 224257 - RNA, 22 nt, Human
gggacccggcugggauggcugg

SEQ ID NO: 224258 - RNA, 19 nt, Human
gggaggggcugggcagggc

SEQ ID NO: 224259 - RNA, 21 nt, Human
gggcagggcggggccaggagg

SEQ ID NO: 224260 - RNA, 19 nt, Human
ggggcugggcagggcgggg

SEQ ID NO: 224261 - RNA, 21 nt, Human
ggugcugugggaacuggcggc

SEQ ID NO: 224262 - RNA, 19 nt, Human
guccugaagcuggggccgc

SEQ ID NO: 224263 - RNA, 19 nt, Human
guccugaagcuggggccgc

SEQ ID NO: 224264 - RNA, 19 nt, Human
guccugaagcuggggccgc

SEQ ID NO: 224265 - RNA, 19 nt, Human
gugcuggggcagcgccugg

SEQ ID NO: 224266 - RNA, 18 nt, Human
uaacaguauccccugagg

SEQ ID NO: 224267 - RNA, 18 nt, Human
uaacaguauccccugagg

SEQ ID NO: 224268 - RNA, 18 nt, Human
uaacaguauccccugagg

SEQ ID NO: 224269 - RNA, 18 nt, Human
uaacaguauccccugagg

SEQ ID NO: 224270 - RNA, 21 nt, Human
uaacaguauccccugaggccu

SEQ ID NO: 224271 - RNA, 21 nt, Human
uaacaguauccccugaggccu

SEQ ID NO: 224272 - RNA, 21 nt, Human
uaacaguauccccugaggccu

SEQ ID NO: 224273 - RNA, 19 nt, Human
uaugauuaacaguaucccc

SEQ ID NO: 224274 - RNA, 19 nt, Human
uaugauuaacaguaucccc

SEQ ID NO: 224275 - RNA, 19 nt, Human
ucacccuucccagguccug

SEQ ID NO: 224276 - RNA, 19 nt, Human
ucagagccaguucauccug

SEQ ID NO: 224277 - RNA, 19 nt, Human
ucagagccaguucauccug

SEQ ID NO: 224278 - RNA, 19 nt, Human
ucagagccaguucauccug

SEQ ID NO: 224279 - RNA, 22 nt, Human
ucaggcaccugggaggggcugg

SEQ ID NO: 224280 - RNA, 23 nt, Human
ucaggcaccugggaggggcuggg

SEQ ID NO: 224281 - RNA, 28 nt, Human
uccaucuccagauucuuccccagccacu

SEQ ID NO: 224282 - RNA, 28 nt, Human
uccaucuccagauucuuccccagccacu

SEQ ID NO: 224283 - RNA, 28 nt, Human
uccaucuccagauucuuccccagccacu

SEQ ID NO: 224284 - RNA, 28 nt, Human
uccaucuccagauucuuccccagccacu

SEQ ID NO: 224285 - RNA, 20 nt, Human
ucccagguccuggaggcaag

SEQ ID NO: 224286 - RNA, 24 nt, Human
ucccagguccuggaggcaagacau

SEQ ID NO: 224287 - RNA, 26 nt, Human
ucccagguccuggaggcaagacauuu

SEQ ID NO: 224288 - RNA, 20 nt, Human
uccccgcccaccucccagcg

SEQ ID NO: 224289 - RNA, 21 nt, Human
ucccgcccacccucaccgcgg

SEQ ID NO: 224290 - RNA, 21 nt, Human
ucccgcccacccucaccgcgg

SEQ ID NO: 224291 - RNA, 21 nt, Human
ucccgcccacccucaccgcgg

SEQ ID NO: 224292 - RNA, 21 nt, Human
ucccgcccacccucaccgcgg

SEQ ID NO: 224293 - RNA, 18 nt, Human
uccuagaagcaaguaacc

SEQ ID NO: 224294 - RNA, 18 nt, Human
uccuagaagcaaguaacc

SEQ ID NO: 224295 - RNA, 18 nt, Human
uccuagaagcaaguaacc

SEQ ID NO: 224296 - RNA, 18 nt, Human
uccuccucaggugccgcc

SEQ ID NO: 224297 - RNA, 18 nt, Human
uccuccucaggugccgcc

SEQ ID NO: 224298 - RNA, 18 nt, Human
uccuccucaggugccgcc

SEQ ID NO: 224299 - RNA, 25 nt, Human
uccuggcugcuuccuccucaggugc

SEQ ID NO: 224300 - RNA, 25 nt, Human
uccuggcugcuuccuccucaggugc

SEQ ID NO: 224301 - RNA, 25 nt, Human
uccuggcugcuuccuccucaggugc

SEQ ID NO: 224302 - RNA, 23 nt, Human
ucgacuaccccucccacgccgug

SEQ ID NO: 224303 - RNA, 24 nt, Human
ucuuccccagccacuccuggcugc

SEQ ID NO: 224304 - RNA, 24 nt, Human
ucuuccccagccacuccuggcugc

SEQ ID NO: 224305 - RNA, 24 nt, Human
ucuuccccagccacuccuggcugc

SEQ ID NO: 224306 - RNA, 24 nt, Human
ucuuccccagccacuccuggcugc

SEQ ID NO: 224307 - RNA, 23 nt, Human
ugaagaacuuccccauggcacgg

SEQ ID NO: 224308 - RNA, 23 nt, Human
ugaagaacuuccccauggcacgg

SEQ ID NO: 224309 - RNA, 23 nt, Human
ugaagaacuuccccauggcacgg

SEQ ID NO: 224310 - RNA, 18 nt, Human
ugcucagagccaguucau

SEQ ID NO: 224311 - RNA, 18 nt, Human
ugcucagagccaguucau

SEQ ID NO: 224312 - RNA, 18 nt, Human
ugcucagagccaguucau

SEQ ID NO: 224313 - RNA, 20 nt, Human
uggagugaggucccuccacc

SEQ ID NO: 224314 - RNA, 19 nt, Human
uggcaccacucacccccuu

SEQ ID NO: 224315 - RNA, 19 nt, Human
uggccaagaguccuagaag

SEQ ID NO: 224316 - RNA, 19 nt, Human
uggccaagaguccuagaag

SEQ ID NO: 224317 - RNA, 19 nt, Human
uggccaagaguccuagaag

SEQ ID NO: 224318 - RNA, 19 nt, Human
uggcugggguggcuggggu

SEQ ID NO: 224319 - RNA, 21 nt, Human
uggcugggguggcuggggugu

SEQ ID NO: 224320 - RNA, 21 nt, Human
uggcugggguggcuggggugu

SEQ ID NO: 224321 - RNA, 22 nt, Human
uggcuggggugugaacaggagg

SEQ ID NO: 224322 - RNA, 24 nt, Human
ugggaggggcugggcagggcgggg

SEQ ID NO: 224323 - RNA, 27 nt, Human
ugggaggggcugggcagggcggggccc

SEQ ID NO: 224324 - RNA, 22 nt, Human
uggggccgcgggcggcagggug

SEQ ID NO: 224325 - RNA, 22 nt, Human
uggggccgcgggcggcagggug

SEQ ID NO: 224326 - RNA, 26 nt, Human
ugugaacaggagggaggugagcugca

SEQ ID NO: 224327 - RNA, 20 nt, Human
uguggguggcugggacccgg

SEQ ID NO: 224328 - RNA, 22 nt, Human
uuaacaguauccccugaggccu

SEQ ID NO: 224329 - RNA, 22 nt, Human
uuccuccucaggugccgccagu

SEQ ID NO: 224330 - RNA, 24 nt, Human
uuuuucguugcucauuuuaugauu

SEQ ID NO: 224331 - RNA, 25 nt, Human
uuuuucguugcucauuuuaugauua

SEQ ID NO: 224332 - RNA, 25 nt, Human
uuuuucguugcucauuuuaugauua

SEQ ID NO: 224333 - RNA, 25 nt, Human
uuuuucguugcucauuuuaugauua

SEQ ID NO: 224334 - RNA, 19 nt, Human
uuuuuuuuuuuuuuucguu

SEQ ID NO: 224335 - RNA, 19 nt, Human
uuuuuuuuuuuuuuucguu

SEQ ID NO: 224336 - RNA, 19 nt, Human
uuuuuuuuuuuuuuucguu

SEQ ID NO: 224337 - RNA, 20 nt, Human
uuuuuuuuuuuuuuuuucgg

SEQ ID NO: 224338 - RNA, 21 nt, Human
uuuuuuuuuuuuuuuuucguu

SEQ ID NO: 224339 - RNA, 20 nt, Human
aaggagccggcgcggggggc

SEQ ID NO: 224340 - RNA, 23 nt, Human
acccagcauccacggacgccucu

SEQ ID NO: 224341 - RNA, 20 nt, Human
agcauccacggacgccucuc

SEQ ID NO: 224342 - RNA, 22 nt, Human
aggcagaaaucccgaagccgug

SEQ ID NO: 224343 - RNA, 19 nt, Human
auccacggacgccucucuu

SEQ ID NO: 224344 - RNA, 23 nt, Human
caugucccgcaggcucacagccg

SEQ ID NO: 224345 - RNA, 18 nt, Human
cccgcaggcucacagccu

SEQ ID NO: 224346 - RNA, 19 nt, Human
ccgcaggcucacagccgcg

SEQ ID NO: 224347 - RNA, 23 nt, Human
cgcccagcacagcagagguccac

SEQ ID NO: 224348 - RNA, 23 nt, Human
uccacuugagaaggcagaaauug

SEQ ID NO: 224349 - RNA, 19 nt, Human
ucccgcaggcucacagccg

SEQ ID NO: 224350 - RNA, 21 nt, Human
ucccgcaggcucacagccgcg

SEQ ID NO: 224351 - RNA, 22 nt, Human
accacaugcacacuaucauaca

SEQ ID NO: 224352 - RNA, 23 nt, Human
ccacaugcacacuaucauacaua

SEQ ID NO: 224353 - RNA, 27 nt, Human
ccacaugcacacuaucauacauauggu

SEQ ID NO: 224354 - RNA, 19 nt, Human
cccccagaaucauaaauaa

SEQ ID NO: 224355 - RNA, 20 nt, Human
ccccccagaaucauaaauaa

SEQ ID NO: 224356 - RNA, 21 nt, Human
cuuuggguuauuuucccccca

SEQ ID NO: 224357 - RNA, 18 nt, Human
uaacuuugggcccguccu

SEQ ID NO: 224358 - RNA, 24 nt, Human
uaucauacauaugcaaauaugugu

SEQ ID NO: 224359 - RNA, 23 nt, Human
uaugguggugaaauaaaaaugac

SEQ ID NO: 224360 - RNA, 22 nt, Human
uggaaacaccaacuggggaaau

SEQ ID NO: 224361 - RNA, 22 nt, Human
ugucuggagcaugccuuugggu

SEQ ID NO: 224362 - RNA, 20 nt, Human
uuugcuguugugcucaaggg

SEQ ID NO: 224363 - RNA, 19 nt, Human
aaacaaagaagggaggcuc

SEQ ID NO: 224364 - RNA, 24 nt, Human
aaacaaagaagggaggcucgcugg

SEQ ID NO: 224365 - RNA, 22 nt, Human
aacuggcuggccuuauggccuc

SEQ ID NO: 224366 - RNA, 24 nt, Human
aagugguauggcauggauggaugg

SEQ ID NO: 224367 - RNA, 22 nt, Human
acagguaauagagagcuagaac

SEQ ID NO: 224368 - RNA, 21 nt, Human
accccaaaagaggccacagag

SEQ ID NO: 224369 - RNA, 21 nt, Human
accgcuuugagacaacaggga

SEQ ID NO: 224370 - RNA, 18 nt, Human
agaagacagcguggauug

SEQ ID NO: 224371 - RNA, 18 nt, Human
agcagcccugggggccca

SEQ ID NO: 224372 - RNA, 23 nt, Human
agcuucugggggaggauggguac

SEQ ID NO: 224373 - RNA, 23 nt, Human
auggccuccaaggcauuggggag

SEQ ID NO: 224374 - RNA, 23 nt, Human
cagcaggaaguuuggccuccccg

SEQ ID NO: 224375 - RNA, 19 nt, Human
cagcguggauuggacugga

SEQ ID NO: 224376 - RNA, 24 nt, Human
cccccaccccaaaagaggccacag

SEQ ID NO: 224377 - RNA, 18 nt, Human
ccccgcccccaccccaaa

SEQ ID NO: 224378 - RNA, 20 nt, Human
cccugggggcccagccaguc

SEQ ID NO: 224379 - RNA, 21 nt, Human
cuggggacagcuucuggggga

SEQ ID NO: 224380 - RNA, 23 nt, Human
gagacaacagggagaacucaggc

SEQ ID NO: 224381 - RNA, 18 nt, Human
gagcaggcaaugacuuca

SEQ ID NO: 224382 - RNA, 20 nt, Human
gcaacagaagacagcgugga

SEQ ID NO: 224383 - RNA, 20 nt, Human
gcacagaggugacgaucauc

SEQ ID NO: 224384 - RNA, 21 nt, Human
gcccccaccccaaaagaggcc

SEQ ID NO: 224385 - RNA, 23 nt, Human
gcccccaccccaaaagaggccac

SEQ ID NO: 224386 - RNA, 21 nt, Human
gcuggccuuauggccuccaag

SEQ ID NO: 224387 - RNA, 24 nt, Human
ggauuucucaaagguuaguccugc

SEQ ID NO: 224388 - RNA, 21 nt, Human
ggcagguggagaaggcauugu

SEQ ID NO: 224389 - RNA, 21 nt, Human
ggccacagagcuucagcagga

SEQ ID NO: 224390 - RNA, 21 nt, Human
gggacagcuucugggggagga

SEQ ID NO: 224391 - RNA, 21 nt, Human
gggagggcagguggagaaggc

SEQ ID NO: 224392 - RNA, 19 nt, Human
ggggagcagcccugggggc

SEQ ID NO: 224393 - RNA, 19 nt, Human
gggucuugagcagcagaca

SEQ ID NO: 224394 - RNA, 18 nt, Human
guauggcauggauggaug

SEQ ID NO: 224395 - RNA, 18 nt, Human
uauccuagaaaauaguaa

SEQ ID NO: 224396 - RNA, 19 nt, Human
uaugagucaguugaguggg

SEQ ID NO: 224397 - RNA, 21 nt, Human
uauuagagaauucaaacaaag

SEQ ID NO: 224398 - RNA, 21 nt, Human
ucgcuggggacagcuucuggg

SEQ ID NO: 224399 - RNA, 22 nt, Human
ucugccuggacccccgccccca

SEQ ID NO: 224400 - RNA, 19 nt, Human
ucuugagcagcagacaguu

SEQ ID NO: 224401 - RNA, 21 nt, Human
ugacuucacaaaaggauuucu

SEQ ID NO: 224402 - RNA, 26 nt, Human
ugagacaacagggagaacucaggcac

SEQ ID NO: 224403 - RNA, 19 nt, Human
ugagcaggcaaugacuuca

SEQ ID NO: 224404 - RNA, 19 nt, Human
uggaagagugggagggcag

SEQ ID NO: 224405 - RNA, 23 nt, Human
uggaagagugggagggcaggugg

SEQ ID NO: 224406 - RNA, 21 nt, Human
uggacccccgcccccacccca

SEQ ID NO: 224407 - RNA, 19 nt, Human
uggauuggacuggaagagu

SEQ ID NO: 224408 - RNA, 21 nt, Human
ugggggaggauggguaccgcu

SEQ ID NO: 224409 - RNA, 23 nt, Human
ugggggaggauggguaccgcuuu

SEQ ID NO: 224410 - RNA, 19 nt, Human
ugggggcagugaucauuua

SEQ ID NO: 224411 - RNA, 24 nt, Human
ugggucuugagcagcagacaguuu

SEQ ID NO: 224412 - RNA, 23 nt, Human
uugagcagcagacaguuucuuuc

SEQ ID NO: 224413 - RNA, 21 nt, Human
aaaaguucacauuuggaauua

SEQ ID NO: 224414 - RNA, 19 nt, Human
aaaggcagcauauccacca

SEQ ID NO: 224415 - RNA, 21 nt, Human
aacagcguccugaacaggguu

SEQ ID NO: 224416 - RNA, 20 nt, Human
aauuuguuuacauucuccuu

SEQ ID NO: 224417 - RNA, 20 nt, Human
acucaaaaaguucacauuug

SEQ ID NO: 224418 - RNA, 22 nt, Human
agacaggcauaauuagguccuc

SEQ ID NO: 224419 - RNA, 22 nt, Human
agacaucugaaggccagcacuu

SEQ ID NO: 224420 - RNA, 24 nt, Human
agcaaaggaugagauacauucucg

SEQ ID NO: 224421 - RNA, 20 nt, Human
ccaccagaauuucuggccac

SEQ ID NO: 224422 - RNA, 19 nt, Human
cccuccuucuccuccucuc

SEQ ID NO: 224423 - RNA, 19 nt, Human
cccuucauuucuucucucc

SEQ ID NO: 224424 - RNA, 22 nt, Human
ccucaugcaagucuguagagau

SEQ ID NO: 224425 - RNA, 19 nt, Human
ccucucacccuccuucucc

SEQ ID NO: 224426 - RNA, 21 nt, Human
cucaaaaaguucacauuugga

SEQ ID NO: 224427 - RNA, 20 nt, Human
cugcccaguccacucagaau

SEQ ID NO: 224428 - RNA, 18 nt, Human
cuucucuccucucuccac

SEQ ID NO: 224429 - RNA, 26 nt, Human
gugccugcaaaccugcuccagcaaag

SEQ ID NO: 224430 - RNA, 24 nt, Human
guuuaaucaauaacuagagaaugu

SEQ ID NO: 224431 - RNA, 23 nt, Human
uaagaaauguugccucaugcaag

SEQ ID NO: 224432 - RNA, 20 nt, Human
uaagugucccuucauuucuu

SEQ ID NO: 224433 - RNA, 21 nt, Human
uaagugucccuucauuucuuc

SEQ ID NO: 224434 - RNA, 20 nt, Human
ucauuucuucucuccucucu

SEQ ID NO: 224435 - RNA, 25 nt, Human
uccaccaccagaauuucuggccacu

SEQ ID NO: 224436 - RNA, 19 nt, Human
ucccacaugaaaauaugau

SEQ ID NO: 224437 - RNA, 21 nt, Human
uccuuugaauuccacaugaaa

SEQ ID NO: 224438 - RNA, 28 nt, Human
ucucuccucucuccacugugccugcaaa

SEQ ID NO: 224439 - RNA, 21 nt, Human
ucuucucuccucucuccacug

SEQ ID NO: 224440 - RNA, 22 nt, Human
ugaaaagaaugacucaaaaagu

SEQ ID NO: 224441 - RNA, 18 nt, Human
ugacucaaaaaguucaca

SEQ ID NO: 224442 - RNA, 18 nt, Human
ugcuccucucacccuccu

SEQ ID NO: 224443 - RNA, 23 nt, Human
uggaaaggcagcauauccaccac

SEQ ID NO: 224444 - RNA, 23 nt, Human
uggaauuaacagcguccugaaca

SEQ ID NO: 224445 - RNA, 21 nt, Human
uguagcaaacaagccuaagaa

SEQ ID NO: 224446 - RNA, 18 nt, Human
ugugccugcaaaccugcc

SEQ ID NO: 224447 - RNA, 19 nt, Human
ugugccugcaaaccugcuc

SEQ ID NO: 224448 - RNA, 25 nt, Human
uguuggaaaggcagcauauccaacc

SEQ ID NO: 224449 - RNA, 21 nt, Human
uucuggccacugcccaguccc

SEQ ID NO: 224450 - RNA, 18 nt, Human
uugcuccucucacccucc

SEQ ID NO: 224451 - RNA, 23 nt, Human
uugucauggcuucuuugcuccuc

SEQ ID NO: 224452 - RNA, 22 nt, Human
uuuggaauuaacagcguccuga

SEQ ID NO: 224453 - RNA, 24 nt, Human
agcgcccccugccagccuccgccc

SEQ ID NO: 224454 - RNA, 23 nt, Human
agcgcgcgagaacaaaggggccg

SEQ ID NO: 224455 - RNA, 21 nt, Human
agcuucuguacuuugcuuucu

SEQ ID NO: 224456 - RNA, 18 nt, Human
aggaaacacagguuccgc

SEQ ID NO: 224457 - RNA, 23 nt, Human
caaaggggccgaggccagcgacg

SEQ ID NO: 224458 - RNA, 20 nt, Human
caccgccgccgccgcgcgac

SEQ ID NO: 224459 - RNA, 19 nt, Human
cagagccuccugcacccuc

SEQ ID NO: 224460 - RNA, 20 nt, Human
cagccccccagccgccgccu

SEQ ID NO: 224461 - RNA, 18 nt, Human
cagcgccccccagccccc

SEQ ID NO: 224462 - RNA, 18 nt, Human
cagcuuccagcgcccccu

SEQ ID NO: 224463 - RNA, 22 nt, Human
ccagcgcccccugccagccucc

SEQ ID NO: 224464 - RNA, 19 nt, Human
ccccagccgccgccugggc

SEQ ID NO: 224465 - RNA, 23 nt, Human
cccccagccgccgccugggcccc

SEQ ID NO: 224466 - RNA, 18 nt, Human
ccccccgcccccucccgc

SEQ ID NO: 224467 - RNA, 20 nt, Human
cccccgcccccucccgcccc

SEQ ID NO: 224468 - RNA, 24 nt, Human
cccccggcgccgagcccgacugcc

SEQ ID NO: 224469 - RNA, 19 nt, Human
ccccgcccccucccgcccc

SEQ ID NO: 224470 - RNA, 21 nt, Human
ccccgcccccucccgcccccg

SEQ ID NO: 224471 - RNA, 23 nt, Human
ccccggcgccgagcccgacugcc

SEQ ID NO: 224472 - RNA, 22 nt, Human
ccccugccagccuccgcccccc

SEQ ID NO: 224473 - RNA, 24 nt, Human
ccccugccagccuccgccccccgc

SEQ ID NO: 224474 - RNA, 18 nt, Human
cccggcgccgagcccgac

SEQ ID NO: 224475 - RNA, 24 nt, Human
cccggcgccgagcccgacugccuc

SEQ ID NO: 224476 - RNA, 19 nt, Human
ccgccgccaccgccgccgc

SEQ ID NO: 224477 - RNA, 22 nt, Human
ccgccgccaccgccgccgccgc

SEQ ID NO: 224478 - RNA, 25 nt, Human
ccgccgccaccgccgccgccgcgcg

SEQ ID NO: 224479 - RNA, 23 nt, Human
ccgccgccgccaccgccgccgcc

SEQ ID NO: 224480 - RNA, 24 nt, Human
ccgccgccgccaccgccgccgccg

SEQ ID NO: 224481 - RNA, 19 nt, Human
ccgccgccugggccccgcg

SEQ ID NO: 224482 - RNA, 19 nt, Human
ccucccgcccccggcgccg

SEQ ID NO: 224483 - RNA, 22 nt, Human
ccucccgcccccggcgccgagc

SEQ ID NO: 224484 - RNA, 20 nt, Human
ccuccgccccccgcacucuc

SEQ ID NO: 224485 - RNA, 21 nt, Human
cgagcccgacugccucgggcg

SEQ ID NO: 224486 - RNA, 22 nt, Human
cgccaggaaacacagguuccgc

SEQ ID NO: 224487 - RNA, 21 nt, Human
cgcccccugccagccuccgcc

SEQ ID NO: 224488 - RNA, 25 nt, Human
cgccugggccccgcggugcagcagc

SEQ ID NO: 224489 - RNA, 22 nt, Human
cggcagcgccccccagcccccc

SEQ ID NO: 224490 - RNA, 19 nt, Human
cggcggcggcggcggcagc

SEQ ID NO: 224491 - RNA, 21 nt, Human
cggcggcggcggcggcagcgc

SEQ ID NO: 224492 - RNA, 19 nt, Human
cguggcccuguccaucucc

SEQ ID NO: 224493 - RNA, 19 nt, Human
cuccccccgcccccucccg

SEQ ID NO: 224494 - RNA, 21 nt, Human
cuccccccgcccccucccgcc

SEQ ID NO: 224495 - RNA, 20 nt, Human
cuccgccccccgcacucucc

SEQ ID NO: 224496 - RNA, 21 nt, Human
cugccagccuccgccccccgc

SEQ ID NO: 224497 - RNA, 19 nt, Human
gccaggaaacacagguucc

SEQ ID NO: 224498 - RNA, 20 nt, Human
gcccccggcggcggcggcgg

SEQ ID NO: 224499 - RNA, 21 nt, Human
gcgacagcaggggagugggcg

SEQ ID NO: 224500 - RNA, 18 nt, Human
gcggcgagggggagcgcg

SEQ ID NO: 224501 - RNA, 19 nt, Human
ggaaacacagguuccgcag

SEQ ID NO: 224502 - RNA, 21 nt, Human
ggcggcggcggcggcagcgcc

SEQ ID NO: 224503 - RNA, 23 nt, Human
gggagugggcggcgagggggagc

SEQ ID NO: 224504 - RNA, 19 nt, Human
gggccgaggccagcgacgc

SEQ ID NO: 224505 - RNA, 23 nt, Human
ggggagugggcggcgagggggag

SEQ ID NO: 224506 - RNA, 20 nt, Human
uagcauaaaucauaaugguu

SEQ ID NO: 224507 - RNA, 23 nt, Human
ucggcggcuggcgugcucccccc

SEQ ID NO: 224508 - RNA, 21 nt, Human
ucguggcccuguccaucuccu

SEQ ID NO: 224509 - RNA, 19 nt, Human
ugaguacagcuucuguacu

SEQ ID NO: 224510 - RNA, 19 nt, Human
ugccagccuccgccccccg

SEQ ID NO: 224511 - RNA, 22 nt, Human
ugccagccuccgccccccgcac

SEQ ID NO: 224512 - RNA, 19 nt, Human
ugcgccaggaaacacaggg

SEQ ID NO: 224513 - RNA, 19 nt, Human
ugcuacagcagauggaaua

SEQ ID NO: 224514 - RNA, 20 nt, Human
uggaauacaagcuuugaggu

SEQ ID NO: 224515 - RNA, 22 nt, Human
uggcgugcuccccccgcccccu

SEQ ID NO: 224516 - RNA, 23 nt, Human
uguuucuguugccacugagggau

SEQ ID NO: 224517 - RNA, 21 nt, Human
uuccaagucuuccaguugugc

SEQ ID NO: 224518 - RNA, 19 nt, Human
uugcuuucuacaagccucc

SEQ ID NO: 224519 - RNA, 18 nt, Human
accauaugauggcaaaaa

SEQ ID NO: 224520 - RNA, 23 nt, Human
agcagcagcagcagcaggacgag

SEQ ID NO: 224521 - RNA, 20 nt, Human
aggaggugcggguccggaag

SEQ ID NO: 224522 - RNA, 19 nt, Human
caccggaggaggcgcagcu

SEQ ID NO: 224523 - RNA, 20 nt, Human
cagaacccggauaacgcugg

SEQ ID NO: 224524 - RNA, 23 nt, Human
cagcagcaggacgagcccgacag

SEQ ID NO: 224525 - RNA, 18 nt, Human
cagcagggacagguuauc

SEQ ID NO: 224526 - RNA, 22 nt, Human
cagcagggacagguuaucuccc

SEQ ID NO: 224527 - RNA, 23 nt, Human
caggaggaacaaucuauauagca

SEQ ID NO: 224528 - RNA, 20 nt, Human
ccccgccgccggggcaccgg

SEQ ID NO: 224529 - RNA, 20 nt, Human
cccgcccccgccgccggggc

SEQ ID NO: 224530 - RNA, 23 nt, Human
cccgccgccggggcaccggagga

SEQ ID NO: 224531 - RNA, 23 nt, Human
cccgccgccggggcaccggagga

SEQ ID NO: 224532 - RNA, 19 nt, Human
ccggcgcgacgagcagcag

SEQ ID NO: 224533 - RNA, 20 nt, Human
cgccgccgggcgaggaggug

SEQ ID NO: 224534 - RNA, 21 nt, Human
cgccuggggcugguggugcug

SEQ ID NO: 224535 - RNA, 24 nt, Human
cgccuggggcugguggugcuggug

SEQ ID NO: 224536 - RNA, 20 nt, Human
cgcggagcccagacugccga

SEQ ID NO: 224537 - RNA, 18 nt, Human
cggaggaggcgcagcugu

SEQ ID NO: 224538 - RNA, 24 nt, Human
cggaggcaugggcugcugccgccg

SEQ ID NO: 224539 - RNA, 19 nt, Human
cgggugguggugguggugc

SEQ ID NO: 224540 - RNA, 29 nt, Human
cuauauagcaauaauaggugcauucccuu

SEQ ID NO: 224541 - RNA, 23 nt, Human
cugcaggcuguggcacugguggu

SEQ ID NO: 224542 - RNA, 18 nt, Human
cuggggcugguggugcug

SEQ ID NO: 224543 - RNA, 22 nt, Human
cuggggcugguggugcuggugg

SEQ ID NO: 224544 - RNA, 21 nt, Human
gcagcagcaggacgagcccga

SEQ ID NO: 224545 - RNA, 21 nt, Human
gcgagagcgggggcgcggagg

SEQ ID NO: 224546 - RNA, 27 nt, Human
gcgccuggggcuggugguggcgucgcg

SEQ ID NO: 224547 - RNA, 18 nt, Human
gcugcccguggggcuggc

SEQ ID NO: 224548 - RNA, 22 nt, Human
ggacagguuaucucccgccccc

SEQ ID NO: 224549 - RNA, 20 nt, Human
ggcuggcggcgggcugcagg

SEQ ID NO: 224550 - RNA, 22 nt, Human
gggcuuuacaauaaaagcuaaa

SEQ ID NO: 224551 - RNA, 19 nt, Human
ggggcuggcggcgggcugc

SEQ ID NO: 224552 - RNA, 20 nt, Human
ggugcggguccggaaggcgc

SEQ ID NO: 224553 - RNA, 22 nt, Human
gugguggugcgagagcgggggc

SEQ ID NO: 224554 - RNA, 23 nt, Human
uacaauaaaagcuaaaauauuga

SEQ ID NO: 224555 - RNA, 21 nt, Human
uacaggaggaacaaucuauau

SEQ ID NO: 224556 - RNA, 22 nt, Human
ucacauugagcuggcugccccg

SEQ ID NO: 224557 - RNA, 21 nt, Human
ucacucauuuuggccuaaaac

SEQ ID NO: 224558 - RNA, 27 nt, Human
ucccgcccccgccgccggggcaccgga

SEQ ID NO: 224559 - RNA, 25 nt, Human
ucucccgcccccgccgccggggcac

SEQ ID NO: 224560 - RNA, 24 nt, Human
ugccccggcgcgacgagcagcagc

SEQ ID NO: 224561 - RNA, 18 nt, Human
uggcauggcuggacggcg

SEQ ID NO: 224562 - RNA, 19 nt, Human
uggccuaaaacuuaguguu

SEQ ID NO: 224563 - RNA, 21 nt, Human
ugugcaucugaaagaaaaaaa

SEQ ID NO: 224564 - RNA, 23 nt, Human
aacccucccucccagcggacccc

SEQ ID NO: 224565 - RNA, 24 nt, Human
aacucugcagcaagggcccugcca

SEQ ID NO: 224566 - RNA, 19 nt, Human
aagaagagggggugaaaga

SEQ ID NO: 224567 - RNA, 19 nt, Human
aagcacgcugaaugaacau

SEQ ID NO: 224568 - RNA, 18 nt, Human
aagcgaccaggagagagu

SEQ ID NO: 224569 - RNA, 22 nt, Human
acaagcccccaccccaaagcca

SEQ ID NO: 224570 - RNA, 28 nt, Human
acacaacccucccucccagcggaccccu

SEQ ID NO: 224571 - RNA, 20 nt, Human
acccagaggcuuccguagac

SEQ ID NO: 224572 - RNA, 21 nt, Human
acccucccucccagcggaccc

SEQ ID NO: 224573 - RNA, 18 nt, Human
acccucgcuccaaagaug

SEQ ID NO: 224574 - RNA, 18 nt, Human
agaaagaagaggggguga

SEQ ID NO: 224575 - RNA, 26 nt, Human
agacaaaaggaaaggagaggggaccc

SEQ ID NO: 224576 - RNA, 18 nt, Human
agcaggaggggagcuugg

SEQ ID NO: 224577 - RNA, 24 nt, Human
aggaggggagcuuggagaaagaag

SEQ ID NO: 224578 - RNA, 18 nt, Human
aggcuuccguagacaaaa

SEQ ID NO: 224579 - RNA, 20 nt, Human
agggagggagagcaggaggg

SEQ ID NO: 224580 - RNA, 24 nt, Human
agggagggagagcaggaggggagc

SEQ ID NO: 224581 - RNA, 19 nt, Human
aucuccucuucccgcuccc

SEQ ID NO: 224582 - RNA, 24 nt, Human
caagcccccaccccaaagccaccc

SEQ ID NO: 224583 - RNA, 18 nt, Human
caagggcccugccagagg

SEQ ID NO: 224584 - RNA, 19 nt, Human
caagggcccugccagaggc

SEQ ID NO: 224585 - RNA, 22 nt, Human
caaguugugggcagcucucuuu

SEQ ID NO: 224586 - RNA, 23 nt, Human
cacaagcccccaccccaaagcca

SEQ ID NO: 224587 - RNA, 25 nt, Human
caccccaaagccacccucgcuccaa

SEQ ID NO: 224588 - RNA, 29 nt, Human
cacccucgcuccaaagauguccucaaaga

SEQ ID NO: 224589 - RNA, 27 nt, Human
cagcggaccccucuucuggacugguuu

SEQ ID NO: 224590 - RNA, 18 nt, Human
caguaucuuggcuccagu

SEQ ID NO: 224591 - RNA, 18 nt, Human
cauccaaucucccccacc

SEQ ID NO: 224592 - RNA, 20 nt, Human
cauccaaucucccccaccag

SEQ ID NO: 224593 - RNA, 22 nt, Human
caucccccaagccugacacaac

SEQ ID NO: 224594 - RNA, 25 nt, Human
caucccccaagccugacacaacccu

SEQ ID NO: 224595 - RNA, 18 nt, Human
caucugacccccaccccc

SEQ ID NO: 224596 - RNA, 21 nt, Human
ccaccccaaagccacccucgc

SEQ ID NO: 224597 - RNA, 20 nt, Human
ccagaggcuuccguagacaa

SEQ ID NO: 224598 - RNA, 23 nt, Human
ccagcggaccccucuucuggacu

SEQ ID NO: 224599 - RNA, 21 nt, Human
ccaucccccaagccugacaca

SEQ ID NO: 224600 - RNA, 23 nt, Human
ccauggcgaagagcccauccccc

SEQ ID NO: 224601 - RNA, 19 nt, Human
cccaaagccacccucgcuc

SEQ ID NO: 224602 - RNA, 21 nt, Human
cccaccccccgcgugaagacc

SEQ ID NO: 224603 - RNA, 26 nt, Human
cccaccccccgcgugaagaccugaga

SEQ ID NO: 224604 - RNA, 18 nt, Human
cccagcggaccccucuuc

SEQ ID NO: 224605 - RNA, 21 nt, Human
ccccaaagccacccucgcucc

SEQ ID NO: 224606 - RNA, 21 nt, Human
ccccaccccaaagccacccuc

SEQ ID NO: 224607 - RNA, 23 nt, Human
ccuaaacagagauuagauuucug

SEQ ID NO: 224608 - RNA, 20 nt, Human
ccucccagcggaccccucuu

SEQ ID NO: 224609 - RNA, 21 nt, Human
ccucgcuccaaagauguccuc

SEQ ID NO: 224610 - RNA, 25 nt, Human
cgaagagcccaucccccaagccuga

SEQ ID NO: 224611 - RNA, 19 nt, Human
cuccaguccucucuuuggc

SEQ ID NO: 224612 - RNA, 18 nt, Human
cuccucuucccgcuccca

SEQ ID NO: 224613 - RNA, 19 nt, Human
cuggucugaauguuucuug

SEQ ID NO: 224614 - RNA, 23 nt, Human
gagaaagaagagggggugaaaga

SEQ ID NO: 224615 - RNA, 24 nt, Human
gagcuuggagaaagaagagggggu

SEQ ID NO: 224616 - RNA, 23 nt, Human
gauggcaaagcgaccaggagaga

SEQ ID NO: 224617 - RNA, 24 nt, Human
gcuugcuucgguucucuggggcug

SEQ ID NO: 224618 - RNA, 21 nt, Human
ggagcuuggagaaagaagagg

SEQ ID NO: 224619 - RNA, 20 nt, Human
ggcagcucucuuuuacuuuu

SEQ ID NO: 224620 - RNA, 22 nt, Human
ggcauccaaucucccccaccag

SEQ ID NO: 224621 - RNA, 19 nt, Human
ucacccagaggcuuccgua

SEQ ID NO: 224622 - RNA, 19 nt, Human
ucccccaagccugacacaa

SEQ ID NO: 224623 - RNA, 19 nt, Human
ucccccaccaguaucuugg

SEQ ID NO: 224624 - RNA, 19 nt, Human
ucccucccagcggaccccu

SEQ ID NO: 224625 - RNA, 24 nt, Human
ucccugcagcacaagcccccaccc

SEQ ID NO: 224626 - RNA, 21 nt, Human
ucucuggggcugccuggaguc

SEQ ID NO: 224627 - RNA, 23 nt, Human
ucuucccgcucccaaguagaggc

SEQ ID NO: 224628 - RNA, 25 nt, Human
ugaaagaacucucucaggagguggu

SEQ ID NO: 224629 - RNA, 23 nt, Human
ugaagaccugagauugagcgugg

SEQ ID NO: 224630 - RNA, 19 nt, Human
ugacacaacccucccuccc

SEQ ID NO: 224631 - RNA, 22 nt, Human
ugcuucgguucucuggggcugc

SEQ ID NO: 224632 - RNA, 18 nt, Human
uggcaaagcgaccaggag

SEQ ID NO: 224633 - RNA, 21 nt, Human
uggcaaguugugggcagcucu

SEQ ID NO: 224634 - RNA, 22 nt, Human
ugguuucgcuguuggcuacuuc

SEQ ID NO: 224635 - RNA, 21 nt, Human
uguauugggcagggagggaga

SEQ ID NO: 224636 - RNA, 21 nt, Human
uuaauuagcucggucucucuu

SEQ ID NO: 224637 - RNA, 24 nt, Human
uucagugcaucugacccccacccc

SEQ ID NO: 224638 - RNA, 22 nt, Human
uucccugcagcacaagccccca

SEQ ID NO: 224639 - RNA, 24 nt, Human
uucccuggucugaauguuucuuga

SEQ ID NO: 224640 - RNA, 20 nt, Human
uucgaguauaucuguuuugg

SEQ ID NO: 224641 - RNA, 19 nt, Human
uugcuucgguucucugggg

SEQ ID NO: 224642 - RNA, 21 nt, Human
aagccaacccacuccaagccg

SEQ ID NO: 224643 - RNA, 18 nt, Human
acacacagacacacgaug

SEQ ID NO: 224644 - RNA, 22 nt, Human
acacaccucuacucaccacacc

SEQ ID NO: 224645 - RNA, 22 nt, Human
accaggugcucucugcagcucu

SEQ ID NO: 224646 - RNA, 23 nt, Human
acccacuuuagccagcguccccu

SEQ ID NO: 224647 - RNA, 19 nt, Human
acucaccacacccagacac

SEQ ID NO: 224648 - RNA, 21 nt, Human
acugaagccucccagaauccu

SEQ ID NO: 224649 - RNA, 19 nt, Human
agaauaaggaggggcuagg

SEQ ID NO: 224650 - RNA, 22 nt, Human
agaauaaggaggggcuagggug

SEQ ID NO: 224651 - RNA, 23 nt, Human
agauaagagcagaggcuggugag

SEQ ID NO: 224652 - RNA, 22 nt, Human
agccccgccccagccucauacc

SEQ ID NO: 224653 - RNA, 18 nt, Human
aggcagggcggggagggg

SEQ ID NO: 224654 - RNA, 23 nt, Human
aggcuggugaguuacacuucuuc

SEQ ID NO: 224655 - RNA, 22 nt, Human
aggggcaggggaggccccaggg

SEQ ID NO: 224656 - RNA, 22 nt, Human
agggggaggcuccccagcuccc

SEQ ID NO: 224657 - RNA, 18 nt, Human
caacccacuccaagccag

SEQ ID NO: 224658 - RNA, 21 nt, Human
caccuccagccccgccccagc

SEQ ID NO: 224659 - RNA, 23 nt, Human
caccuccagccccgccccagccu

SEQ ID NO: 224660 - RNA, 22 nt, Human
cacgcacagggcagccacugug

SEQ ID NO: 224661 - RNA, 19 nt, Human
cacuucuuccuccccacca

SEQ ID NO: 224662 - RNA, 22 nt, Human
cagaauccuggauccgggcccc

SEQ ID NO: 224663 - RNA, 18 nt, Human
cagcaagccaacccacuc

SEQ ID NO: 224664 - RNA, 20 nt, Human
cagcaagccaacccacuccu

SEQ ID NO: 224665 - RNA, 23 nt, Human
cagggacccaggaguccugccuc

SEQ ID NO: 224666 - RNA, 19 nt, Human
cagggcggggaggggcagg

SEQ ID NO: 224667 - RNA, 23 nt, Human
ccacguggauaaagacacacaca

SEQ ID NO: 224668 - RNA, 20 nt, Human
ccacuccaagccagggcccc

SEQ ID NO: 224669 - RNA, 22 nt, Human
ccagccccgccccagccucaua

SEQ ID NO: 224670 - RNA, 23 nt, Human
ccagccccgccccagccucauac

SEQ ID NO: 224671 - RNA, 18 nt, Human
ccaucagcaagccaaccc

SEQ ID NO: 224672 - RNA, 20 nt, Human
cccaccuggggccucaggug

SEQ ID NO: 224673 - RNA, 21 nt, Human
ccccagccucauacccaguuc

SEQ ID NO: 224674 - RNA, 21 nt, Human
cccccaccucgcagcacgcac

SEQ ID NO: 224675 - RNA, 20 nt, Human
cccccggggucuuggggcuc

SEQ ID NO: 224676 - RNA, 26 nt, Human
ccccgccccagccucauaccgguucc

SEQ ID NO: 224677 - RNA, 21 nt, Human
ccccuaguacccucuuuccca

SEQ ID NO: 224678 - RNA, 21 nt, Human
ccuaguacccucuuucccagg

SEQ ID NO: 224679 - RNA, 18 nt, Human
cgccccagccucauaccc

SEQ ID NO: 224680 - RNA, 23 nt, Human
cgccccagccucauacccaguuc

SEQ ID NO: 224681 - RNA, 23 nt, Human
cgccugcacuuguaacugagagc

SEQ ID NO: 224682 - RNA, 20 nt, Human
cuccagccccgccccagccu

SEQ ID NO: 224683 - RNA, 23 nt, Human
cucgcagcacgcacagggcagcc

SEQ ID NO: 224684 - RNA, 19 nt, Human
cuggaggucguccauagca

SEQ ID NO: 224685 - RNA, 23 nt, Human
cuugcacuugaggugcuuuguuc

SEQ ID NO: 224686 - RNA, 20 nt, Human
gagcagaggcuggugaguua

SEQ ID NO: 224687 - RNA, 21 nt, Human
gaggggcaggggaggccccag

SEQ ID NO: 224688 - RNA, 22 nt, Human
gaguguuuuugaugaggguaug

SEQ ID NO: 224689 - RNA, 20 nt, Human
ggaggcuccccagcuccccc

SEQ ID NO: 224690 - RNA, 20 nt, Human
ggcagagcaagaaagagacg

SEQ ID NO: 224691 - RNA, 18 nt, Human
ggcaggggaggccccagg

SEQ ID NO: 224692 - RNA, 19 nt, Human
ggcaggggaggccccaggg

SEQ ID NO: 224693 - RNA, 20 nt, Human
ggccagcgguaacugaagcc

SEQ ID NO: 224694 - RNA, 20 nt, Human
gggcaggggaggccccaggg

SEQ ID NO: 224695 - RNA, 21 nt, Human
gggcaggggaggccccagggu

SEQ ID NO: 224696 - RNA, 26 nt, Human
gggccccuaguacccucuuucccagg

SEQ ID NO: 224697 - RNA, 24 nt, Human
gggcggggaggggcaggggaggcc

SEQ ID NO: 224698 - RNA, 20 nt, Human
ggggcaggggaggccccagg

SEQ ID NO: 224699 - RNA, 22 nt, Human
ggggcucagccagcuuccugcc

SEQ ID NO: 224700 - RNA, 18 nt, Human
ggucuguacuuugugaca

SEQ ID NO: 224701 - RNA, 19 nt, Human
ggugcuuuguucagggcug

SEQ ID NO: 224702 - RNA, 19 nt, Human
gugggggugaccauguucc

SEQ ID NO: 224703 - RNA, 22 nt, Human
guuacacuucuuccuccccacc

SEQ ID NO: 224704 - RNA, 21 nt, Human
guucagggcugggucaggagu

SEQ ID NO: 224705 - RNA, 22 nt, Human
uaaggaggggcuaggguguguc

SEQ ID NO: 224706 - RNA, 19 nt, Human
uacccucuuucccagggac

SEQ ID NO: 224707 - RNA, 21 nt, Human
uacucaccacacccagacacc

SEQ ID NO: 224708 - RNA, 18 nt, Human
uacuuugugacacacacc

SEQ ID NO: 224709 - RNA, 23 nt, Human
uagccagcguccccuccagcagc

SEQ ID NO: 224710 - RNA, 22 nt, Human
ucaccacacccagacaccgaag

SEQ ID NO: 224711 - RNA, 26 nt, Human
ucggccagcgguaacugaagccuccc

SEQ ID NO: 224712 - RNA, 19 nt, Human
ucgucagccugcucugcug

SEQ ID NO: 224713 - RNA, 21 nt, Human
ucuacucaccacacccagaca

SEQ ID NO: 224714 - RNA, 19 nt, Human
ugagaauaaggaggggcua

SEQ ID NO: 224715 - RNA, 27 nt, Human
ugagaguguuuuugaugaggguaugca

SEQ ID NO: 224716 - RNA, 24 nt, Human
ugaggugcuuuguucagggcuggg

SEQ ID NO: 224717 - RNA, 27 nt, Human
ugcaggucgucagccugcucugcuggc

SEQ ID NO: 224718 - RNA, 25 nt, Human
ugcccagggucccccaccucgcagc

SEQ ID NO: 224719 - RNA, 21 nt, Human
uggcagagacgauguccacca

SEQ ID NO: 224720 - RNA, 19 nt, Human
uggggaguggugacggcca

SEQ ID NO: 224721 - RNA, 19 nt, Human
uuacacuucuuccucccca

SEQ ID NO: 224722 - RNA, 23 nt, Human
uucccaccuggggccucagguga

SEQ ID NO: 224723 - RNA, 22 nt, Human
uugcacuugaggugcuuuguuc

SEQ ID NO: 224724 - RNA, 28 nt, Human
uugcaggucgucagccugcucugcuggc

SEQ ID NO: 224725 - RNA, 21 nt, Human
uuucccagggacccaggaguc

SEQ ID NO: 224726 - RNA, 23 nt, Human
aaacacagauccaaaucaccaca

SEQ ID NO: 224727 - RNA, 19 nt, Human
aaggaaccccuguccugug

SEQ ID NO: 224728 - RNA, 18 nt, Human
acagauccaaaucaccac

SEQ ID NO: 224729 - RNA, 22 nt, Human
agcugggggcucaggagcaguc

SEQ ID NO: 224730 - RNA, 18 nt, Human
aggaagagcuggcagucu

SEQ ID NO: 224731 - RNA, 21 nt, Human
aggcagggcuccucuccagcu

SEQ ID NO: 224732 - RNA, 19 nt, Human
agggguuggaggcgggagc

SEQ ID NO: 224733 - RNA, 18 nt, Human
augggucagcauuuccug

SEQ ID NO: 224734 - RNA, 21 nt, Human
auugccgguggcccuguaguc

SEQ ID NO: 224735 - RNA, 23 nt, Human
caagcagggugggccugcacuca

SEQ ID NO: 224736 - RNA, 25 nt, Human
cacacugugaaacucauuaaaacac

SEQ ID NO: 224737 - RNA, 22 nt, Human
cacagauccaaaucaccacaaa

SEQ ID NO: 224738 - RNA, 20 nt, Human
caccaugugggggccagggc

SEQ ID NO: 224739 - RNA, 20 nt, Human
caggaagagguggccuugcu

SEQ ID NO: 224740 - RNA, 21 nt, Human
caggcccuccaaaugggcucc

SEQ ID NO: 224741 - RNA, 20 nt, Human
cagugaugucaacaucacca

SEQ ID NO: 224742 - RNA, 19 nt, Human
ccaagcagggugggccugc

SEQ ID NO: 224743 - RNA, 21 nt, Human
ccagaaggaaccccuguccug

SEQ ID NO: 224744 - RNA, 19 nt, Human
ccagacacacacaugugca

SEQ ID NO: 224745 - RNA, 26 nt, Human
ccagacacacacaugugcaggcgcaa

SEQ ID NO: 224746 - RNA, 22 nt, Human
ccaggcccaggcccuccaaaug

SEQ ID NO: 224747 - RNA, 18 nt, Human
ccaggcccggcaccagug

SEQ ID NO: 224748 - RNA, 23 nt, Human
ccagguggggccacucuuggccu

SEQ ID NO: 224749 - RNA, 18 nt, Human
ccccagccccauccccuc

SEQ ID NO: 224750 - RNA, 21 nt, Human
cccccacaccggccaggaaga

SEQ ID NO: 224751 - RNA, 25 nt, Human
cccggcaccagugccauccuacacu

SEQ ID NO: 224752 - RNA, 18 nt, Human
cccuccaaaugggcuccu

SEQ ID NO: 224753 - RNA, 22 nt, Human
cccuccugcuggaagcuggggg

SEQ ID NO: 224754 - RNA, 21 nt, Human
ccuacacuccagacacacaca

SEQ ID NO: 224755 - RNA, 27 nt, Human
ccuacacuccagacacacacaugugca

SEQ ID NO: 224756 - RNA, 23 nt, Human
ccucaggaagcccccugggccaa

SEQ ID NO: 224757 - RNA, 22 nt, Human
ccuccugcuggaagcugggggc

SEQ ID NO: 224758 - RNA, 18 nt, Human
ccuggauuugaggcuggg

SEQ ID NO: 224759 - RNA, 24 nt, Human
ccuggccauacaugggccaggccc

SEQ ID NO: 224760 - RNA, 18 nt, Human
cggcucagcagcuggcaa

SEQ ID NO: 224761 - RNA, 23 nt, Human
cgucuacaacuuccagccggugg

SEQ ID NO: 224762 - RNA, 27 nt, Human
cuccccucaggaagcccccugggccaa

SEQ ID NO: 224763 - RNA, 25 nt, Human
cuccugcuggaagcugggggcucag

SEQ ID NO: 224764 - RNA, 21 nt, Human
cuuccuggccauacaugggcc

SEQ ID NO: 224765 - RNA, 19 nt, Human
cuuggccuccccucucacu

SEQ ID NO: 224766 - RNA, 19 nt, Human
gauguaaugcccagaagga

SEQ ID NO: 224767 - RNA, 23 nt, Human
gcaccagugccauccuacacucc

SEQ ID NO: 224768 - RNA, 22 nt, Human
gccugugccuggcaggguccug

SEQ ID NO: 224769 - RNA, 22 nt, Human
gggaaauggugagacugucccu

SEQ ID NO: 224770 - RNA, 20 nt, Human
gggguugcucugucuccccu

SEQ ID NO: 224771 - RNA, 26 nt, Human
uaaaacacagauccaaaucaccacaa

SEQ ID NO: 224772 - RNA, 21 nt, Human
uaggaaaagcuugcacaauua

SEQ ID NO: 224773 - RNA, 22 nt, Human
uaggaaaagcuugcacaauuaa

SEQ ID NO: 224774 - RNA, 19 nt, Human
uaggaagagcuggcagucu

SEQ ID NO: 224775 - RNA, 18 nt, Human
uaggagguggccuccuuc

SEQ ID NO: 224776 - RNA, 21 nt, Human
uccacagucuccugcccaugg

SEQ ID NO: 224777 - RNA, 19 nt, Human
ucccccagccccauccccu

SEQ ID NO: 224778 - RNA, 21 nt, Human
ucccgggccucucacagcccc

SEQ ID NO: 224779 - RNA, 18 nt, Human
uccugcccugccugugcc

SEQ ID NO: 224780 - RNA, 21 nt, Human
uccugcuggaagcugggggcu

SEQ ID NO: 224781 - RNA, 24 nt, Human
ucuaugcgauguaaugcccagaag

SEQ ID NO: 224782 - RNA, 21 nt, Human
ucuccacagucuccugcccau

SEQ ID NO: 224783 - RNA, 22 nt, Human
ugagagugagggagccaggccc

SEQ ID NO: 224784 - RNA, 19 nt, Human
ugaggcugggguccagggg

SEQ ID NO: 224785 - RNA, 20 nt, Human
ugaggcugggguccaggggu

SEQ ID NO: 224786 - RNA, 21 nt, Human
ugaggcugggguccagggguu

SEQ ID NO: 224787 - RNA, 24 nt, Human
ugagggagccaggcccaggcccuc

SEQ ID NO: 224788 - RNA, 21 nt, Human
ugccacugggucccaaccacc

SEQ ID NO: 224789 - RNA, 24 nt, Human
ugccauccuacacuccagacacac

SEQ ID NO: 224790 - RNA, 20 nt, Human
ugcccagaaggaaccccugu

SEQ ID NO: 224791 - RNA, 22 nt, Human
ugcccugccacugggucccaac

SEQ ID NO: 224792 - RNA, 19 nt, Human
ugccugugccuggcagggu

SEQ ID NO: 224793 - RNA, 19 nt, Human
ugcuggaagcugggggcuc

SEQ ID NO: 224794 - RNA, 18 nt, Human
uggcugcugggacugggc

SEQ ID NO: 224795 - RNA, 22 nt, Human
uggcuggcugcugggacugggc

SEQ ID NO: 224796 - RNA, 23 nt, Human
ugggccugcacucagccugugcu

SEQ ID NO: 224797 - RNA, 20 nt, Human
ugggggccagggcgcuuggg

SEQ ID NO: 224798 - RNA, 23 nt, Human
ugugcaggcgcaaagacagugcc

SEQ ID NO: 224799 - RNA, 20 nt, Human
ugugggggccagggcgcuug

SEQ ID NO: 224800 - RNA, 22 nt, Human
ugugggggccagggcgcuuggg

SEQ ID NO: 224801 - RNA, 19 nt, Human
uuccagccggugggacgcu

SEQ ID NO: 224802 - RNA, 18 nt, Human
uucccgggccucucacag

SEQ ID NO: 224803 - RNA, 18 nt, Human
aaagggccccagaggguu

SEQ ID NO: 224804 - RNA, 19 nt, Human
aaaggucacugccaggagc

SEQ ID NO: 224805 - RNA, 19 nt, Human
aaaggucacugccaggagc

SEQ ID NO: 224806 - RNA, 20 nt, Human
aaccucggaggcaccgugcu

SEQ ID NO: 224807 - RNA, 19 nt, Human
acagcggccggccacaccc

SEQ ID NO: 224808 - RNA, 22 nt, Human
accccaccgggacccaaggccg

SEQ ID NO: 224809 - RNA, 21 nt, Human
accccgucaucacucccgccc

SEQ ID NO: 224810 - RNA, 25 nt, Human
accucggaggcaccgugcugaggag

SEQ ID NO: 224811 - RNA, 23 nt, Human
agaguggacagggcagccuugcu

SEQ ID NO: 224812 - RNA, 24 nt, Human
agcccaggccccccggccgggagc

SEQ ID NO: 224813 - RNA, 23 nt, Human
aggccgcagguccucaccaaaca

SEQ ID NO: 224814 - RNA, 24 nt, Human
agggccccagaggguucccgccuc

SEQ ID NO: 224815 - RNA, 18 nt, Human
caaaaccucggaggcacc

SEQ ID NO: 224816 - RNA, 22 nt, Human
cacaugggccccuccagggccc

SEQ ID NO: 224817 - RNA, 18 nt, Human
caccccgucaucacuccc

SEQ ID NO: 224818 - RNA, 21 nt, Human
cacccuucccgccacacucag

SEQ ID NO: 224819 - RNA, 18 nt, Human
caccgugcugaggagggc

SEQ ID NO: 224820 - RNA, 23 nt, Human
cagaggguucccgccucaaaacc

SEQ ID NO: 224821 - RNA, 18 nt, Human
cagccuugcuccugcacg

SEQ ID NO: 224822 - RNA, 21 nt, Human
caggagcccccauccuucagc

SEQ ID NO: 224823 - RNA, 19 nt, Human
caguuacuguaagaaaagg

SEQ ID NO: 224824 - RNA, 19 nt, Human
ccacgcuggcaacaccccg

SEQ ID NO: 224825 - RNA, 26 nt, Human
ccagaggguucccgccucaaaaccuc

SEQ ID NO: 224826 - RNA, 22 nt, Human
cccacaugggccccuccagggc

SEQ ID NO: 224827 - RNA, 19 nt, Human
cccagcccaggccccccgg

SEQ ID NO: 224828 - RNA, 21 nt, Human
cccaggccccccggccgggag

SEQ ID NO: 224829 - RNA, 20 nt, Human
cccauccuucagcccacaug

SEQ ID NO: 224830 - RNA, 18 nt, Human
ccccagcccaggcccccc

SEQ ID NO: 224831 - RNA, 20 nt, Human
ccccauccuucagcccacau

SEQ ID NO: 224832 - RNA, 20 nt, Human
cccccauccuucagcccaca

SEQ ID NO: 224833 - RNA, 21 nt, Human
ccccgucaucacucccgcccc

SEQ ID NO: 224834 - RNA, 21 nt, Human
ccccuccagggcccacccuuc

SEQ ID NO: 224835 - RNA, 24 nt, Human
ccgcgcgcggagacgcugcggcca

SEQ ID NO: 224836 - RNA, 18 nt, Human
ccgggacccaaggccgca

SEQ ID NO: 224837 - RNA, 24 nt, Human
ccuccagggcccacccuucccgcc

SEQ ID NO: 224838 - RNA, 21 nt, Human
ccugcacgcugcuccuggagc

SEQ ID NO: 224839 - RNA, 22 nt, Human
ccugcccuuugugccuccccug

SEQ ID NO: 224840 - RNA, 19 nt, Human
ccuggagccacagggcccu

SEQ ID NO: 224841 - RNA, 22 nt, Human
ccuggagccacagggcccugcc

SEQ ID NO: 224842 - RNA, 21 nt, Human
ccuucagcccacaugggcccc

SEQ ID NO: 224843 - RNA, 21 nt, Human
cgccuguagcugcccggaaac

SEQ ID NO: 224844 - RNA, 18 nt, Human
cgcgggccccagcccagg

SEQ ID NO: 224845 - RNA, 19 nt, Human
cugccgggcuugggccgcg

SEQ ID NO: 224846 - RNA, 21 nt, Human
gagccacagggcccugcccag

SEQ ID NO: 224847 - RNA, 21 nt, Human
gcccacaugggccccuccagg

SEQ ID NO: 224848 - RNA, 20 nt, Human
gcccugcccagcccuccagc

SEQ ID NO: 224849 - RNA, 21 nt, Human
gggccccuccagggcccaccc

SEQ ID NO: 224850 - RNA, 21 nt, Human
gggcggagcgcggggggcggc

SEQ ID NO: 224851 - RNA, 19 nt, Human
gggcggcgcgggccccagc

SEQ ID NO: 224852 - RNA, 19 nt, Human
ggggcggagcgcggggggc

SEQ ID NO: 224853 - RNA, 23 nt, Human
ggggcggagcgcggggggcggcg

SEQ ID NO: 224854 - RNA, 20 nt, Human
ggguucccgccucaaaaccu

SEQ ID NO: 224855 - RNA, 20 nt, Human
guccucagggaacaggccug

SEQ ID NO: 224856 - RNA, 23 nt, Human
gugcugaggagggccgcgggcgg

SEQ ID NO: 224857 - RNA, 20 nt, Human
uaagaaaagggccccagagg

SEQ ID NO: 224858 - RNA, 23 nt, Human
uacuguaagaaaagggccccaga

SEQ ID NO: 224859 - RNA, 18 nt, Human
ucaccaaacaggcccgcc

SEQ ID NO: 224860 - RNA, 19 nt, Human
ucagcccacaugggccccu

SEQ ID NO: 224861 - RNA, 18 nt, Human
uccucaccaaacaggccc

SEQ ID NO: 224862 - RNA, 24 nt, Human
uccugcacgcugcuccuggagcca

SEQ ID NO: 224863 - RNA, 26 nt, Human
uccugcacgcugcuccuggagccaca

SEQ ID NO: 224864 - RNA, 20 nt, Human
ugagcagaguggacagggca

SEQ ID NO: 224865 - RNA, 21 nt, Human
ugccaggagcccccauccuuc

SEQ ID NO: 224866 - RNA, 19 nt, Human
ugcccggaaaccccaccgg

SEQ ID NO: 224867 - RNA, 21 nt, Human
ugcccggaaaccccaccggga

SEQ ID NO: 224868 - RNA, 22 nt, Human
uggaaaauaacuuuuguaaaag

SEQ ID NO: 224869 - RNA, 21 nt, Human
ugugccuccccugggcucggc

SEQ ID NO: 224870 - RNA, 24 nt, Human
uucccgccucaaaaccucggaggc

SEQ ID NO: 224871 - RNA, 20 nt, Human
uugcuccugcacgcugcucc

SEQ ID NO: 224872 - RNA, 19 nt, Human
aggcaaaggcgggcccccu

SEQ ID NO: 224873 - RNA, 23 nt, Human
aggcaaaggcgggcccccugggg

SEQ ID NO: 224874 - RNA, 18 nt, Human
aggcagggggucaggggg

SEQ ID NO: 224875 - RNA, 19 nt, Human
aggccaggcagggggucag

SEQ ID NO: 224876 - RNA, 22 nt, Human
agggggucagggggucacaucc

SEQ ID NO: 224877 - RNA, 19 nt, Human
auccgcgcgccccucccca

SEQ ID NO: 224878 - RNA, 23 nt, Human
cacccacccccaaaagcaggcaa

SEQ ID NO: 224879 - RNA, 23 nt, Human
cacccccaaaagcaggcaaaggc

SEQ ID NO: 224880 - RNA, 22 nt, Human
ccccacccacccccaaaagcag

SEQ ID NO: 224881 - RNA, 24 nt, Human
cccccaaaagcaggcaaaggcggg

SEQ ID NO: 224882 - RNA, 18 nt, Human
cccgccggccgcuucgcc

SEQ ID NO: 224883 - RNA, 22 nt, Human
cccuccccacccacccccaaaa

SEQ ID NO: 224884 - RNA, 23 nt, Human
cccuccccacccacccccaaaag

SEQ ID NO: 224885 - RNA, 23 nt, Human
ccuccccacccacccccaaaagc

SEQ ID NO: 224886 - RNA, 19 nt, Human
ccuggggggcaggggaggc

SEQ ID NO: 224887 - RNA, 21 nt, Human
ccuucuccgcugcugcucuua

SEQ ID NO: 224888 - RNA, 20 nt, Human
cgccccuccccacccacccc

SEQ ID NO: 224889 - RNA, 20 nt, Human
cgccuucuccgcugcugcuc

SEQ ID NO: 224890 - RNA, 23 nt, Human
cgcgccccuccccacccaccccc

SEQ ID NO: 224891 - RNA, 18 nt, Human
cggcggcugcaagcccgg

SEQ ID NO: 224892 - RNA, 24 nt, Human
cugccucgcccccgccggccgcuu

SEQ ID NO: 224893 - RNA, 20 nt, Human
cugcugcucugggaagaagg

SEQ ID NO: 224894 - RNA, 21 nt, Human
gaggcggcggcggcggcugca

SEQ ID NO: 224895 - RNA, 19 nt, Human
gauccgcgcgccccucccc

SEQ ID NO: 224896 - RNA, 21 nt, Human
gcaggggaggccaggcagggg

SEQ ID NO: 224897 - RNA, 23 nt, Human
gccaggcagggggucaggggguc

SEQ ID NO: 224898 - RNA, 19 nt, Human
gccccuccccacccacccc

SEQ ID NO: 224899 - RNA, 20 nt, Human
gccucgcccccgccggccgc

SEQ ID NO: 224900 - RNA, 22 nt, Human
gcggcggcggcggcugcaagcc

SEQ ID NO: 224901 - RNA, 19 nt, Human
gcgggcccccuggggggca

SEQ ID NO: 224902 - RNA, 19 nt, Human
gcucggggugcgugaacga

SEQ ID NO: 224903 - RNA, 18 nt, Human
gugaacgaggcggcggcg

SEQ ID NO: 224904 - RNA, 22 nt, Human
uaagaguaagugaacuauacaa

SEQ ID NO: 224905 - RNA, 21 nt, Human
uacaaggaggggucagccagu

SEQ ID NO: 224906 - RNA, 28 nt, Human
uccgcgcgccccuccccacccaccccca

SEQ ID NO: 224907 - RNA, 26 nt, Human
ucgcccccgccggccgcuucgccuuc

SEQ ID NO: 224908 - RNA, 22 nt, Human
ucuacauuacaaggagggguca

SEQ ID NO: 224909 - RNA, 20 nt, Human
ugauccgcgcgccccucccc

SEQ ID NO: 224910 - RNA, 19 nt, Human
ugcucugggaagaaggggc

SEQ ID NO: 224911 - RNA, 24 nt, Human
cagagggcagucggagcgccaggg

SEQ ID NO: 224912 - RNA, 20 nt, Human
cccgggcacgguccggggcg

SEQ ID NO: 224913 - RNA, 21 nt, Human
cgggcugggggcgccggggcc

SEQ ID NO: 224914 - RNA, 24 nt, Human
ggcgggggcgcgcucggggcgcuc

SEQ ID NO: 224915 - RNA, 21 nt, Human
uaccacgcccacucaggcagc

SEQ ID NO: 224916 - RNA, 24 nt, Human
ucaauacugcguguggucucucuc

SEQ ID NO: 224917 - RNA, 24 nt, Human
aaaaacgauucuaaaaacuguaaa

SEQ ID NO: 224918 - RNA, 22 nt, Human
aaacacaaaccuauaaccaaua

SEQ ID NO: 224919 - RNA, 19 nt, Human
aaacacacaagaaauacca

SEQ ID NO: 224920 - RNA, 21 nt, Human
aaacaggagcacgacaacuca

SEQ ID NO: 224921 - RNA, 22 nt, Human
aaaugcugggagugacacuucu

SEQ ID NO: 224922 - RNA, 21 nt, Human
aacacacagccuguacagauc

SEQ ID NO: 224923 - RNA, 20 nt, Human
aacccaacaacguucaccuc

SEQ ID NO: 224924 - RNA, 20 nt, Human
aaccucagaaacaggagcac

SEQ ID NO: 224925 - RNA, 22 nt, Human
aagaugauuggugcacccaugc

SEQ ID NO: 224926 - RNA, 24 nt, Human
aagucaaguuuuccagcuuucaca

SEQ ID NO: 224927 - RNA, 18 nt, Human
aauggaaagauuugaacu

SEQ ID NO: 224928 - RNA, 21 nt, Human
acaagaacacaaagccuucug

SEQ ID NO: 224929 - RNA, 18 nt, Human
acacaaagccuucugaua

SEQ ID NO: 224930 - RNA, 21 nt, Human
acaccaccaucgugcacgucu

SEQ ID NO: 224931 - RNA, 19 nt, Human
acaccauaaccauaaggug

SEQ ID NO: 224932 - RNA, 20 nt, Human
acaccugggagcacgggugc

SEQ ID NO: 224933 - RNA, 24 nt, Human
acagccuguacagaucaccacuau

SEQ ID NO: 224934 - RNA, 21 nt, Human
acaggagcacgacaacucaua

SEQ ID NO: 224935 - RNA, 19 nt, Human
acauacuauauccuagaag

SEQ ID NO: 224936 - RNA, 18 nt, Human
accaccagguuuccaugu

SEQ ID NO: 224937 - RNA, 20 nt, Human
acccaauaccaucagccuug

SEQ ID NO: 224938 - RNA, 21 nt, Human
acccagagaggcaggaacccg

SEQ ID NO: 224939 - RNA, 18 nt, Human
acccagucaccccccaug

SEQ ID NO: 224940 - RNA, 27 nt, Human
acgacaacucauagacaguacugggcc

SEQ ID NO: 224941 - RNA, 22 nt, Human
acuaaguaacauucucuaaaga

SEQ ID NO: 224942 - RNA, 21 nt, Human
agaaaacacaaaccuauaacc

SEQ ID NO: 224943 - RNA, 20 nt, Human
agaacucacacgacaaccuc

SEQ ID NO: 224944 - RNA, 26 nt, Human
agacaacacgaccuuacuccuaaaca

SEQ ID NO: 224945 - RNA, 21 nt, Human
agacagccaccucccagccuc

SEQ ID NO: 224946 - RNA, 23 nt, Human
aggagcacgacaacucauagaca

SEQ ID NO: 224947 - RNA, 18 nt, Human
aggagcauuuuggaggag

SEQ ID NO: 224948 - RNA, 24 nt, Human
aggcaacaaaaguauuuaagcuac

SEQ ID NO: 224949 - RNA, 19 nt, Human
aggcaggaacccgcgccgc

SEQ ID NO: 224950 - RNA, 22 nt, Human
aguaucaucuucaaucaacuga

SEQ ID NO: 224951 - RNA, 21 nt, Human
agucacccuaggaaacaagga

SEQ ID NO: 224952 - RNA, 25 nt, Human
auaaugaaagccaccuggaaaacca

SEQ ID NO: 224953 - RNA, 21 nt, Human
auggaacaauaaugaaagcca

SEQ ID NO: 224954 - RNA, 19 nt, Human
auggugucagacacaccac

SEQ ID NO: 224955 - RNA, 21 nt, Human
caacacgaccuuacuccuaaa

SEQ ID NO: 224956 - RNA, 18 nt, Human
caacugaaacacaaaagg

SEQ ID NO: 224957 - RNA, 25 nt, Human
caagaggagcaggagcauuuuggag

SEQ ID NO: 224958 - RNA, 21 nt, Human
caagaggcagcucagcaaugu

SEQ ID NO: 224959 - RNA, 22 nt, Human
cacaaaaggaccucuuaagaag

SEQ ID NO: 224960 - RNA, 22 nt, Human
cacaccaccaucgugcacgucu

SEQ ID NO: 224961 - RNA, 21 nt, Human
cacaccacccucuaaaaacga

SEQ ID NO: 224962 - RNA, 21 nt, Human
caccagauaaaugcaagucau

SEQ ID NO: 224963 - RNA, 24 nt, Human
caccagccaaaucuaaguguucca

SEQ ID NO: 224964 - RNA, 23 nt, Human
caccauaaccauaaggugccuuu

SEQ ID NO: 224965 - RNA, 23 nt, Human
caccucccagccucccacaagcc

SEQ ID NO: 224966 - RNA, 22 nt, Human
cagaaaacacaaaccuauaacc

SEQ ID NO: 224967 - RNA, 21 nt, Human
cagcacuuccaaaaugcacau

SEQ ID NO: 224968 - RNA, 18 nt, Human
cagcugccgaaggcucac

SEQ ID NO: 224969 - RNA, 21 nt, Human
cagcugccgaaggcucacagg

SEQ ID NO: 224970 - RNA, 18 nt, Human
cagcuggaaacaagucau

SEQ ID NO: 224971 - RNA, 18 nt, Human
caggacacaaguggcuag

SEQ ID NO: 224972 - RNA, 22 nt, Human
cagugcagccugugucaaugcu

SEQ ID NO: 224973 - RNA, 28 nt, Human
caucuuaaaaaauaaauauuucaaaaac

SEQ ID NO: 224974 - RNA, 20 nt, Human
caugcaagccacggaacuac

SEQ ID NO: 224975 - RNA, 24 nt, Human
caugcuguuaaaacacacaagaaa

SEQ ID NO: 224976 - RNA, 21 nt, Human
cauucaauaaaucacccacac

SEQ ID NO: 224977 - RNA, 22 nt, Human
ccacaagccuccaguccaaugg

SEQ ID NO: 224978 - RNA, 24 nt, Human
ccacaccaccaucgugcacgucua

SEQ ID NO: 224979 - RNA, 24 nt, Human
ccaccagguuuccaugucauggca

SEQ ID NO: 224980 - RNA, 24 nt, Human
ccacccagagaggcaggaacccgc

SEQ ID NO: 224981 - RNA, 20 nt, Human
ccagagaggcaggaacccgc

SEQ ID NO: 224982 - RNA, 21 nt, Human
ccagggcuggaagcaccagcc

SEQ ID NO: 224983 - RNA, 20 nt, Human
cccacuggcauugaaaacaa

SEQ ID NO: 224984 - RNA, 18 nt, Human
cccagucaccccccauga

SEQ ID NO: 224985 - RNA, 21 nt, Human
cccagucaccccccaugaaag

SEQ ID NO: 224986 - RNA, 25 nt, Human
cccagucaccccccaugaaaggcag

SEQ ID NO: 224987 - RNA, 23 nt, Human
cccgcggccgaggccggcgggaa

SEQ ID NO: 224988 - RNA, 20 nt, Human
ccgcccgcagcugccgaagg

SEQ ID NO: 224989 - RNA, 20 nt, Human
ccgccgccgcccgcagcugc

SEQ ID NO: 224990 - RNA, 22 nt, Human
ccgcugccugcuggcggugcgu

SEQ ID NO: 224991 - RNA, 19 nt, Human
ccggauccgcgcgccccuc

SEQ ID NO: 224992 - RNA, 22 nt, Human
ccucacccacccagagaggcag

SEQ ID NO: 224993 - RNA, 24 nt, Human
ccuccaguccaauggaaagauuug

SEQ ID NO: 224994 - RNA, 21 nt, Human
ccucccagccucccacaagcc

SEQ ID NO: 224995 - RNA, 22 nt, Human
ccugcuggcggugcgugcgcgg

SEQ ID NO: 224996 - RNA, 24 nt, Human
cgacaaccucagaaacaggagcac

SEQ ID NO: 224997 - RNA, 18 nt, Human
cgcccgcgccgcgcgggg

SEQ ID NO: 224998 - RNA, 24 nt, Human
cgccgccgccgcccgcagcugccg

SEQ ID NO: 224999 - RNA, 20 nt, Human
cgcgccccucacccacccag

SEQ ID NO: 225000 - RNA, 20 nt, Human
cgcgcgccccucacccaccc

SEQ ID NO: 225001 - RNA, 23 nt, Human
cggccgcccgcgccgcgcggggg

SEQ ID NO: 225002 - RNA, 24 nt, Human
cuacccagucaccccccaugaaag

SEQ ID NO: 225003 - RNA, 18 nt, Human
cuaccuuacgagcuacaa

SEQ ID NO: 225004 - RNA, 24 nt, Human
cucauagacaguacugggccacaa

SEQ ID NO: 225005 - RNA, 21 nt, Human
cuccaacgaaaggcaccagau

SEQ ID NO: 225006 - RNA, 24 nt, Human
cuccaggguuuaagccagccgggu

SEQ ID NO: 225007 - RNA, 20 nt, Human
cucccacuuaucugaaacca

SEQ ID NO: 225008 - RNA, 22 nt, Human
cucccagccucccacaagccuc

SEQ ID NO: 225009 - RNA, 19 nt, Human
cucucccugguuagcuuca

SEQ ID NO: 225010 - RNA, 18 nt, Human
cucuuaagaagaggccca

SEQ ID NO: 225011 - RNA, 23 nt, Human
cugccugcuggcggugcgugcgc

SEQ ID NO: 225012 - RNA, 25 nt, Human
cuuucacaucugcaaaggguaacca

SEQ ID NO: 225013 - RNA, 18 nt, Human
gaaacaagucaucuccag

SEQ ID NO: 225014 - RNA, 18 nt, Human
gaaacuuccccaacccgc

SEQ ID NO: 225015 - RNA, 19 nt, Human
gaaacuuccccaacccgcg

SEQ ID NO: 225016 - RNA, 23 nt, Human
gacauuuuaugaacuagcaguuu

SEQ ID NO: 225017 - RNA, 19 nt, Human
gacccaauaccaucagccu

SEQ ID NO: 225018 - RNA, 21 nt, Human
gaccccuggguucuauugccu

SEQ ID NO: 225019 - RNA, 18 nt, Human
gacuaaaagaaacugcug

SEQ ID NO: 225020 - RNA, 20 nt, Human
gcagccugugucaaugcuug

SEQ ID NO: 225021 - RNA, 19 nt, Human
gcagcugccgaaggcucac

SEQ ID NO: 225022 - RNA, 18 nt, Human
gccaccucccagccuccc

SEQ ID NO: 225023 - RNA, 18 nt, Human
gccagaggcacaagaggc

SEQ ID NO: 225024 - RNA, 23 nt, Human
gccucuacccagucaccccccau

SEQ ID NO: 225025 - RNA, 21 nt, Human
gccuuguuccuugcuuccacu

SEQ ID NO: 225026 - RNA, 23 nt, Human
gccuuguuccuugcuuccacuuu

SEQ ID NO: 225027 - RNA, 21 nt, Human
gcggccgaggccggcgggaaa

SEQ ID NO: 225028 - RNA, 20 nt, Human
gcucccggagcccccucucu

SEQ ID NO: 225029 - RNA, 24 nt, Human
ggaaagauuugaacugggggcucc

SEQ ID NO: 225030 - RNA, 19 nt, Human
ggaaauacauuucucuaca

SEQ ID NO: 225031 - RNA, 24 nt, Human
ggagacagccaccucccagccucc

SEQ ID NO: 225032 - RNA, 18 nt, Human
ggagaggaagauuauuuc

SEQ ID NO: 225033 - RNA, 18 nt, Human
ggauguagacacuaggag

SEQ ID NO: 225034 - RNA, 18 nt, Human
ggccacaagcacuagaau

SEQ ID NO: 225035 - RNA, 25 nt, Human
gggauuccuccaacgaaaggcacca

SEQ ID NO: 225036 - RNA, 23 nt, Human
gggccggcgggcgggggccgccg

SEQ ID NO: 225037 - RNA, 19 nt, Human
ggugcgagugugugcgccc

SEQ ID NO: 225038 - RNA, 19 nt, Human
gguuguucuuucucccacu

SEQ ID NO: 225039 - RNA, 18 nt, Human
guaaauguuaugccuucc

SEQ ID NO: 225040 - RNA, 21 nt, Human
uaaaaacaacuuagagacuug

SEQ ID NO: 225041 - RNA, 22 nt, Human
uaaaacacacaagaaauaccag

SEQ ID NO: 225042 - RNA, 22 nt, Human
uaacuaaguaacauucucuaaa

SEQ ID NO: 225043 - RNA, 23 nt, Human
uaagauccuugccacaccuccaa

SEQ ID NO: 225044 - RNA, 18 nt, Human
uacaacauacuauauccu

SEQ ID NO: 225045 - RNA, 20 nt, Human
uacaagagauguuaaaaaga

SEQ ID NO: 225046 - RNA, 23 nt, Human
uacaagagauguuaaaaagauag

SEQ ID NO: 225047 - RNA, 27 nt, Human
uaccaggcucagugacccaauaccauc

SEQ ID NO: 225048 - RNA, 19 nt, Human
uacugggccacaagcacua

SEQ ID NO: 225049 - RNA, 20 nt, Human
uagaggaacccagguucccc

SEQ ID NO: 225050 - RNA, 20 nt, Human
uagcaacccaacaacguuca

SEQ ID NO: 225051 - RNA, 18 nt, Human
uagcauucuggguguacu

SEQ ID NO: 225052 - RNA, 22 nt, Human
uagugagacuuuaggggagagg

SEQ ID NO: 225053 - RNA, 23 nt, Human
uauagaggaacccagguucccca

SEQ ID NO: 225054 - RNA, 21 nt, Human
uauauaaguauauauguaugu

SEQ ID NO: 225055 - RNA, 22 nt, Human
uauauaaguauauauguaugua

SEQ ID NO: 225056 - RNA, 25 nt, Human
uaucugaaaccaccacuugaaaaac

SEQ ID NO: 225057 - RNA, 23 nt, Human
uaugcccacgaugcaaagaccag

SEQ ID NO: 225058 - RNA, 19 nt, Human
uauuugagugcuaagauaa

SEQ ID NO: 225059 - RNA, 20 nt, Human
ucaauacaaguuuggaagcu

SEQ ID NO: 225060 - RNA, 18 nt, Human
ucacagcuggaaacaagu

SEQ ID NO: 225061 - RNA, 24 nt, Human
ucacccacccagagaggcaggaac

SEQ ID NO: 225062 - RNA, 23 nt, Human
ucauagacaguacugggccacaa

SEQ ID NO: 225063 - RNA, 20 nt, Human
ucccaacccagcacuuccaa

SEQ ID NO: 225064 - RNA, 21 nt, Human
ucccagccucccacaagccuc

SEQ ID NO: 225065 - RNA, 18 nt, Human
ucccggagcccccucucc

SEQ ID NO: 225066 - RNA, 22 nt, Human
ucccugggucaccauucagucu

SEQ ID NO: 225067 - RNA, 20 nt, Human
ucgucucccuucaauacaag

SEQ ID NO: 225068 - RNA, 21 nt, Human
ucuccaguuucuacucugucc

SEQ ID NO: 225069 - RNA, 21 nt, Human
ucucccuaacacaucuguucu

SEQ ID NO: 225070 - RNA, 18 nt, Human
ucugacagccugguugcc

SEQ ID NO: 225071 - RNA, 21 nt, Human
ucugacuaaauucugcuugga

SEQ ID NO: 225072 - RNA, 19 nt, Human
ucuguaagaagucaugcug

SEQ ID NO: 225073 - RNA, 19 nt, Human
ugaaaaauaacucugcucc

SEQ ID NO: 225074 - RNA, 23 nt, Human
ugaaaacaauaaccuucaaaugc

SEQ ID NO: 225075 - RNA, 22 nt, Human
ugaaaacccuggauagcuccau

SEQ ID NO: 225076 - RNA, 21 nt, Human
ugaaagccaccuggaaaacca

SEQ ID NO: 225077 - RNA, 26 nt, Human
ugaaagugacugaguuauucugccuu

SEQ ID NO: 225078 - RNA, 20 nt, Human
ugaagccccucucccuaaca

SEQ ID NO: 225079 - RNA, 23 nt, Human
ugaagccccucucccuaacacau

SEQ ID NO: 225080 - RNA, 22 nt, Human
ugacccaauaccaucagccuug

SEQ ID NO: 225081 - RNA, 24 nt, Human
ugacuaaauucugcuuggaaauaa

SEQ ID NO: 225082 - RNA, 24 nt, Human
ugagaugaacaucaguguacaucg

SEQ ID NO: 225083 - RNA, 22 nt, Human
ugagauuuuguuuucacaugac

SEQ ID NO: 225084 - RNA, 19 nt, Human
ugagcaaaaucucaucaua

SEQ ID NO: 225085 - RNA, 20 nt, Human
ugaggaagacaacacgaccc

SEQ ID NO: 225086 - RNA, 24 nt, Human
ugaguaaagguccaguugggcaag

SEQ ID NO: 225087 - RNA, 18 nt, Human
ugccugggcugugccaga

SEQ ID NO: 225088 - RNA, 21 nt, Human
ugccugggcugugccagaggc

SEQ ID NO: 225089 - RNA, 24 nt, Human
ugccugggcugugccagaggcaca

SEQ ID NO: 225090 - RNA, 19 nt, Human
ugcgagugugugcgcccgg

SEQ ID NO: 225091 - RNA, 18 nt, Human
ugcucagaccccuggguu

SEQ ID NO: 225092 - RNA, 18 nt, Human
ugcugggagugacacuuc

SEQ ID NO: 225093 - RNA, 22 nt, Human
uggaaagauuugaacugggggc

SEQ ID NO: 225094 - RNA, 18 nt, Human
uggaacaauaaugaaagc

SEQ ID NO: 225095 - RNA, 22 nt, Human
uggcagaaaacacaaaccuaua

SEQ ID NO: 225096 - RNA, 20 nt, Human
uggcaggaacuccagggcaa

SEQ ID NO: 225097 - RNA, 21 nt, Human
uggccucuacccagucacccc

SEQ ID NO: 225098 - RNA, 22 nt, Human
uggccucuacccagucaccccc

SEQ ID NO: 225099 - RNA, 18 nt, Human
ugggaauuagcuccaggg

SEQ ID NO: 225100 - RNA, 20 nt, Human
ugggagugacacuucucuca

SEQ ID NO: 225101 - RNA, 19 nt, Human
ugggguggagggugacaag

SEQ ID NO: 225102 - RNA, 25 nt, Human
ugguuagauguuaucuagcaagguc

SEQ ID NO: 225103 - RNA, 19 nt, Human
uguucuugggaaaaaaauu

SEQ ID NO: 225104 - RNA, 18 nt, Human
uuacuccuaaacaucuua

SEQ ID NO: 225105 - RNA, 21 nt, Human
uuacuccuaaacaucuuaaaa

SEQ ID NO: 225106 - RNA, 18 nt, Human
uuaucugacuaaauucug

SEQ ID NO: 225107 - RNA, 24 nt, Human
uucaaaaacaugcuaauaucuuag

SEQ ID NO: 225108 - RNA, 18 nt, Human
uuccuggucagcggccau

SEQ ID NO: 225109 - RNA, 22 nt, Human
uuccuugugggaauuagcucca

SEQ ID NO: 225110 - RNA, 22 nt, Human
uucuaaagaugauuggugcacc

SEQ ID NO: 225111 - RNA, 21 nt, Human
uucuggguguacucaucuggc

SEQ ID NO: 225112 - RNA, 23 nt, Human
uuggaugaaaacccuggauagcu

SEQ ID NO: 225113 - RNA, 19 nt, Human
uuugaugagcuuucagagu

SEQ ID NO: 225114 - RNA, 24 nt, Human
uuuuacaacucuuuccuuucuccu

SEQ ID NO: 225115 - RNA, 20 nt, Human
aaacaggcacaaacaccccc

SEQ ID NO: 225116 - RNA, 20 nt, Human
aaacaggcacaaacaccccc

SEQ ID NO: 225117 - RNA, 18 nt, Human
aaagcuguguuaaccuaa

SEQ ID NO: 225118 - RNA, 23 nt, Human
aaggauaagagaaacaggcacaa

SEQ ID NO: 225119 - RNA, 24 nt, Human
aaugucgggaaaggauaagagaaa

SEQ ID NO: 225120 - RNA, 20 nt, Human
acacgcucugccuucauccu

SEQ ID NO: 225121 - RNA, 18 nt, Human
acagaaugaugcauaagc

SEQ ID NO: 225122 - RNA, 19 nt, Human
acaggcacaaacacccccg

SEQ ID NO: 225123 - RNA, 20 nt, Human
acccaauaccauuuaucuua

SEQ ID NO: 225124 - RNA, 22 nt, Human
acccaauaccauuuaucuuaua

SEQ ID NO: 225125 - RNA, 18 nt, Human
agagugcuggcuggcaag

SEQ ID NO: 225126 - RNA, 23 nt, Human
aggccaaagcaaucacuggaaaa

SEQ ID NO: 225127 - RNA, 21 nt, Human
agggagaagaggaagaucagg

SEQ ID NO: 225128 - RNA, 22 nt, Human
caaaaagaagggaagaauccug

SEQ ID NO: 225129 - RNA, 18 nt, Human
caagaagcucugcccuuc

SEQ ID NO: 225130 - RNA, 19 nt, Human
cacagagaaaaauaaagac

SEQ ID NO: 225131 - RNA, 22 nt, Human
cacagagaaaaauaaagacaau

SEQ ID NO: 225132 - RNA, 22 nt, Human
caugagcauggauuuacaugca

SEQ ID NO: 225133 - RNA, 22 nt, Human
ccaauaccauuuaucuuauauu

SEQ ID NO: 225134 - RNA, 23 nt, Human
ccugccgccgcggcggcgaggag

SEQ ID NO: 225135 - RNA, 24 nt, Human
cgcugcagggaucaggccucgcgg

SEQ ID NO: 225136 - RNA, 19 nt, Human
cucucuuguaaaaaauaaa

SEQ ID NO: 225137 - RNA, 24 nt, Human
cugaaagguacacccugagaauua

SEQ ID NO: 225138 - RNA, 27 nt, Human
cuugagguggagaugccacacgcucug

SEQ ID NO: 225139 - RNA, 21 nt, Human
gaaacaggcacaaacaccccc

SEQ ID NO: 225140 - RNA, 23 nt, Human
gaaacaggcacaaacacccccgc

SEQ ID NO: 225141 - RNA, 24 nt, Human
gaacaugagcauggauuuacaugc

SEQ ID NO: 225142 - RNA, 18 nt, Human
gagaugccacacgcucug

SEQ ID NO: 225143 - RNA, 20 nt, Human
gagaugccacacgcucugcc

SEQ ID NO: 225144 - RNA, 23 nt, Human
gcggcggcgaggagagcggggug

SEQ ID NO: 225145 - RNA, 22 nt, Human
ggauaagagaaacaggcacaaa

SEQ ID NO: 225146 - RNA, 18 nt, Human
ggcaagggagaagaggaa

SEQ ID NO: 225147 - RNA, 18 nt, Human
ggccaaagcaaucacugg

SEQ ID NO: 225148 - RNA, 23 nt, Human
guggugcacauaggcauuuggug

SEQ ID NO: 225149 - RNA, 21 nt, Human
uaaaugauuuuaacgaaccca

SEQ ID NO: 225150 - RNA, 20 nt, Human
uaacgaacccacugagguuu

SEQ ID NO: 225151 - RNA, 23 nt, Human
uaagagaaacaggcacaaacacc

SEQ ID NO: 225152 - RNA, 28 nt, Human
uccauguuuagaacaugagccggggucc

SEQ ID NO: 225153 - RNA, 23 nt, Human
uccuguucucugguuguacaggc

SEQ ID NO: 225154 - RNA, 21 nt, Human
ucucugguuguacaggccaaa

SEQ ID NO: 225155 - RNA, 24 nt, Human
ucugcccuucucagcacacuggaa

SEQ ID NO: 225156 - RNA, 21 nt, Human
ugacaaacacagaaugaugcu

SEQ ID NO: 225157 - RNA, 18 nt, Human
ugaguaaaugacaaacac

SEQ ID NO: 225158 - RNA, 19 nt, Human
ugaguaaaugacaaacaca

SEQ ID NO: 225159 - RNA, 24 nt, Human
ugcauugucucauuuuguggaucu

SEQ ID NO: 225160 - RNA, 24 nt, Human
ugccacacgcucugccuucauccu

SEQ ID NO: 225161 - RNA, 19 nt, Human
uggcugaaagguacacccu

SEQ ID NO: 225162 - RNA, 26 nt, Human
uuacaugcaugucgucucagucagcu

SEQ ID NO: 225163 - RNA, 20 nt, Human
uucagaacaaggcauuuaau

SEQ ID NO: 225164 - RNA, 18 nt, Human
uugagguggagaugccac

SEQ ID NO: 225165 - RNA, 27 nt, Human
uuuuuuuuuuuuuuccauacugaauua

SEQ ID NO: 225166 - RNA, 19 nt, Human
aaaaggacagaacaagggc

SEQ ID NO: 225167 - RNA, 22 nt, Human
aaaaggacagaacaagggcaaa

SEQ ID NO: 225168 - RNA, 18 nt, Human
aaccuucuaaaaccagaa

SEQ ID NO: 225169 - RNA, 30 nt, Human
aaccuucuaaaaccagaaaccccgucugaa

SEQ ID NO: 225170 - RNA, 20 nt, Human
aaugacaucaauugcugaaa

SEQ ID NO: 225171 - RNA, 19 nt, Human
acacagcuucacauugaac

SEQ ID NO: 225172 - RNA, 18 nt, Human
accccaugcccaccucca

SEQ ID NO: 225173 - RNA, 23 nt, Human
accccaugcccaccuccaccaga

SEQ ID NO: 225174 - RNA, 24 nt, Human
accuccaccagagcaaacacaaug

SEQ ID NO: 225175 - RNA, 24 nt, Human
acuuccugcugguggaaagaacaa

SEQ ID NO: 225176 - RNA, 20 nt, Human
agaacagaccccaugcccac

SEQ ID NO: 225177 - RNA, 18 nt, Human
agaccccaugcccaccuc

SEQ ID NO: 225178 - RNA, 21 nt, Human
agaggaaacgcagcgaccaca

SEQ ID NO: 225179 - RNA, 24 nt, Human
agggggaagaacaaaaggguaaaa

SEQ ID NO: 225180 - RNA, 21 nt, Human
aguggguuggggacaggggga

SEQ ID NO: 225181 - RNA, 18 nt, Human
aucaggacagauaugagg

SEQ ID NO: 225182 - RNA, 21 nt, Human
caaagcaagguaacguuaguc

SEQ ID NO: 225183 - RNA, 19 nt, Human
caacucgaagaacacgcaa

SEQ ID NO: 225184 - RNA, 21 nt, Human
cacacacugaccgcucucccg

SEQ ID NO: 225185 - RNA, 22 nt, Human
cacauugaaccucccgcauuca

SEQ ID NO: 225186 - RNA, 21 nt, Human
cagacggacuuucugcggcgc

SEQ ID NO: 225187 - RNA, 22 nt, Human
cagacuauaaauauaugugcca

SEQ ID NO: 225188 - RNA, 23 nt, Human
cagcaggggcaugauaaugcuuu

SEQ ID NO: 225189 - RNA, 20 nt, Human
caggcagaggaaacgcagcg

SEQ ID NO: 225190 - RNA, 22 nt, Human
cauaaacagacuauaaauauau

SEQ ID NO: 225191 - RNA, 21 nt, Human
ccccaugcccaccuccaccag

SEQ ID NO: 225192 - RNA, 18 nt, Human
cccgcagcgcaggacagu

SEQ ID NO: 225193 - RNA, 23 nt, Human
cccgcagcgcaggacaguugagc

SEQ ID NO: 225194 - RNA, 20 nt, Human
ccuccaccagagcaaacaca

SEQ ID NO: 225195 - RNA, 21 nt, Human
ccucuuggauagacucagccc

SEQ ID NO: 225196 - RNA, 26 nt, Human
cgaagaacacgcaaccuucuaaaacc

SEQ ID NO: 225197 - RNA, 22 nt, Human
cgcagcgaccacacacugaccg

SEQ ID NO: 225198 - RNA, 22 nt, Human
cggcggcugcaggggcgucugc

SEQ ID NO: 225199 - RNA, 20 nt, Human
cuaaacccauggugagaccc

SEQ ID NO: 225200 - RNA, 25 nt, Human
cucagcccugcaaauccuucccauc

SEQ ID NO: 225201 - RNA, 24 nt, Human
cucgagccgggcgaaaugcccaga

SEQ ID NO: 225202 - RNA, 24 nt, Human
cugaaacuuugacaccacacacag

SEQ ID NO: 225203 - RNA, 21 nt, Human
cugagcagaccucucauguga

SEQ ID NO: 225204 - RNA, 20 nt, Human
cugcgggugccgguaggaga

SEQ ID NO: 225205 - RNA, 22 nt, Human
cuucaaaaucugagcagaccuc

SEQ ID NO: 225206 - RNA, 18 nt, Human
gaaaugcccagaacucgg

SEQ ID NO: 225207 - RNA, 24 nt, Human
gaacaacacuucaaaaucugagca

SEQ ID NO: 225208 - RNA, 22 nt, Human
gaacacgcaaccuucuaaaacc

SEQ ID NO: 225209 - RNA, 22 nt, Human
gaacagaccccaugcccaccuc

SEQ ID NO: 225210 - RNA, 21 nt, Human
gaccgcucucccggggucccg

SEQ ID NO: 225211 - RNA, 19 nt, Human
gagaguggguuggggacag

SEQ ID NO: 225212 - RNA, 19 nt, Human
gagccgggcgaaaugccca

SEQ ID NO: 225213 - RNA, 20 nt, Human
gagccgggcgaaaugcccag

SEQ ID NO: 225214 - RNA, 24 nt, Human
gcaaccuucuaaaaccagaaaccc

SEQ ID NO: 225215 - RNA, 19 nt, Human
gcagaggaaacgcagcgac

SEQ ID NO: 225216 - RNA, 23 nt, Human
gcagaggaaacgcagcgaccaca

SEQ ID NO: 225217 - RNA, 23 nt, Human
ggagaagacacagacacauucuu

SEQ ID NO: 225218 - RNA, 22 nt, Human
ggcgaaaugcccagaacucggg

SEQ ID NO: 225219 - RNA, 20 nt, Human
ggcgcaggcagaggaaacgc

SEQ ID NO: 225220 - RNA, 18 nt, Human
gggacagggggaagaaca

SEQ ID NO: 225221 - RNA, 21 nt, Human
gggacagggggaagaacaaaa

SEQ ID NO: 225222 - RNA, 22 nt, Human
gggcuuggcaaggagacagcua

SEQ ID NO: 225223 - RNA, 19 nt, Human
gugagacccgcagcagggg

SEQ ID NO: 225224 - RNA, 19 nt, Human
uagaagacuggcucccugc

SEQ ID NO: 225225 - RNA, 24 nt, Human
ucaaaaucugagcagaccucucau

SEQ ID NO: 225226 - RNA, 27 nt, Human
ucacacuaugguaccaaacaaaaaaca

SEQ ID NO: 225227 - RNA, 19 nt, Human
uccagaagaaaccagaagc

SEQ ID NO: 225228 - RNA, 27 nt, Human
ucccugcaguccgagguccuuuuucug

SEQ ID NO: 225229 - RNA, 22 nt, Human
uccuggggcuuggcaaggagac

SEQ ID NO: 225230 - RNA, 21 nt, Human
ucgaagaacacgcaaccuucu

SEQ ID NO: 225231 - RNA, 18 nt, Human
ucgggagccgguucuuuc

SEQ ID NO: 225232 - RNA, 21 nt, Human
ucucaugugauguccgggagu

SEQ ID NO: 225233 - RNA, 21 nt, Human
ucugcgggugccgguaggaga

SEQ ID NO: 225234 - RNA, 19 nt, Human
ucuugggucacaagccucu

SEQ ID NO: 225235 - RNA, 23 nt, Human
ugaaaaaagaggaucaggucaac

SEQ ID NO: 225236 - RNA, 26 nt, Human
ugaaacuuugacaccacacacagcuu

SEQ ID NO: 225237 - RNA, 21 nt, Human
ugaaccucccgcauucagucu

SEQ ID NO: 225238 - RNA, 20 nt, Human
ugagacccgcagcaggggca

SEQ ID NO: 225239 - RNA, 19 nt, Human
ugagcagaccucucaugug

SEQ ID NO: 225240 - RNA, 19 nt, Human
ugaggauggggccauugcu

SEQ ID NO: 225241 - RNA, 22 nt, Human
ugcagucagaacucuucaacac

SEQ ID NO: 225242 - RNA, 18 nt, Human
ugcccggcgcaggcagag

SEQ ID NO: 225243 - RNA, 18 nt, Human
ugccgguaggagaggaua

SEQ ID NO: 225244 - RNA, 20 nt, Human
uggaaagaacaacacuucaa

SEQ ID NO: 225245 - RNA, 18 nt, Human
uggaacucgcggcacccc

SEQ ID NO: 225246 - RNA, 21 nt, Human
uggaguagaggccaaauaacu

SEQ ID NO: 225247 - RNA, 22 nt, Human
uggauagacucagcccugcaaa

SEQ ID NO: 225248 - RNA, 21 nt, Human
uggcuaauaaucauucagaga

SEQ ID NO: 225249 - RNA, 23 nt, Human
uggcucccugcaguccgaggucc

SEQ ID NO: 225250 - RNA, 22 nt, Human
uggguugcggggugagaguggg

SEQ ID NO: 225251 - RNA, 20 nt, Human
uggguuggggacagggggaa

SEQ ID NO: 225252 - RNA, 23 nt, Human
ugucuagagaaggaggcgcggag

SEQ ID NO: 225253 - RNA, 21 nt, Human
uuaaaugaaugaaaaaagagg

SEQ ID NO: 225254 - RNA, 22 nt, Human
uuaaaugaaugaaaaaagagga

SEQ ID NO: 225255 - RNA, 21 nt, Human
uucacauugaaccucccgcau

SEQ ID NO: 225256 - RNA, 23 nt, Human
aaacaccccccgccccaguuccu

SEQ ID NO: 225257 - RNA, 25 nt, Human
aagcagaaaggaaaucuugcucuga

SEQ ID NO: 225258 - RNA, 18 nt, Human
aaggaaaucuugcucuga

SEQ ID NO: 225259 - RNA, 23 nt, Human
aagugccagcuuuuauuuuugga

SEQ ID NO: 225260 - RNA, 22 nt, Human
agaauccuuccugguuccacuc

SEQ ID NO: 225261 - RNA, 23 nt, Human
cacucuaggagcugauucggagg

SEQ ID NO: 225262 - RNA, 18 nt, Human
ccuugauccuggagaagg

SEQ ID NO: 225263 - RNA, 22 nt, Human
cgccccaguuccuugauccugg

SEQ ID NO: 225264 - RNA, 19 nt, Human
cucuuucgccuugucccca

SEQ ID NO: 225265 - RNA, 25 nt, Human
cugcugcucuuucgccuuggugaca

SEQ ID NO: 225266 - RNA, 18 nt, Human
gagcugauucggaggacu

SEQ ID NO: 225267 - RNA, 20 nt, Human
ggaacagaagcagaaaggaa

SEQ ID NO: 225268 - RNA, 21 nt, Human
ggagguguuggucgauauuuc

SEQ ID NO: 225269 - RNA, 24 nt, Human
ggguccaggaaacaccccccgccc

SEQ ID NO: 225270 - RNA, 19 nt, Human
guggcuccagaauccuucc

SEQ ID NO: 225271 - RNA, 19 nt, Human
uccaggaaacaccccccgc

SEQ ID NO: 225272 - RNA, 24 nt, Human
uccccagacacacaggacuggccu

SEQ ID NO: 225273 - RNA, 27 nt, Human
uccccagacacacaggacuggccucug

SEQ ID NO: 225274 - RNA, 21 nt, Human
uccuugauccuggagaagggg

SEQ ID NO: 225275 - RNA, 23 nt, Human
uggaacagaagcagaaaggaaau

SEQ ID NO: 225276 - RNA, 19 nt, Human
uggccucuggguggagccu

SEQ ID NO: 225277 - RNA, 20 nt, Human
uuggaacagaagcagaaagg

SEQ ID NO: 225278 - RNA, 21 nt, Human
uuggaacagaagcagaaagga

SEQ ID NO: 225279 - RNA, 24 nt, Human
uuuaagagacaagcggaagccaag

SEQ ID NO: 225280 - RNA, 19 nt, Human
uuuuuuuuuuuuuaagaga

SEQ ID NO: 225281 - RNA, 20 nt, Human
uuuuuuuuuuuuuuuuuaag

SEQ ID NO: 225282 - RNA, 25 nt, Human
aaacacaaucaaauauaaagaacaa

SEQ ID NO: 225283 - RNA, 23 nt, Human
aacaagaauucuuuagugaugaa

SEQ ID NO: 225284 - RNA, 19 nt, Human
aaguauuugauucauucca

SEQ ID NO: 225285 - RNA, 24 nt, Human
acacagcccagcaaagggggaacc

SEQ ID NO: 225286 - RNA, 19 nt, Human
acauacacaaauguguccc

SEQ ID NO: 225287 - RNA, 19 nt, Human
accaauaggcagcugaagg

SEQ ID NO: 225288 - RNA, 19 nt, Human
agcaccuugccuuccagga

SEQ ID NO: 225289 - RNA, 18 nt, Human
aguguuaauaagcuaugg

SEQ ID NO: 225290 - RNA, 23 nt, Human
aucuucuucuuccuuuucuauug

SEQ ID NO: 225291 - RNA, 20 nt, Human
cacaaaugaaaaugguggcc

SEQ ID NO: 225292 - RNA, 22 nt, Human
caccaacagcuacuuagcaauc

SEQ ID NO: 225293 - RNA, 21 nt, Human
caggaauacaccguugagucc

SEQ ID NO: 225294 - RNA, 22 nt, Human
cccuuuuauuguauaaggaugu

SEQ ID NO: 225295 - RNA, 18 nt, Human
cuuggaucuucuucuucc

SEQ ID NO: 225296 - RNA, 22 nt, Human
cuuuaguguuaauaagcuaugg

SEQ ID NO: 225297 - RNA, 23 nt, Human
gaagacugcuuaccucagccuuc

SEQ ID NO: 225298 - RNA, 25 nt, Human
gaucuucuucuuccuuuucuauugg

SEQ ID NO: 225299 - RNA, 20 nt, Human
gauuuuaaaacauuuucccu

SEQ ID NO: 225300 - RNA, 19 nt, Human
ggaaauucuuacuuuaauc

SEQ ID NO: 225301 - RNA, 23 nt, Human
uaaaaacaacagcuacaagaaau

SEQ ID NO: 225302 - RNA, 23 nt, Human
uaaaacacuaagauuccacaaga

SEQ ID NO: 225303 - RNA, 25 nt, Human
uaagaaaaaaaaaaaaacuuugacg

SEQ ID NO: 225304 - RNA, 21 nt, Human
uacacagcccagcaaaggaaa

SEQ ID NO: 225305 - RNA, 19 nt, Human
uacaccguugaguccugug

SEQ ID NO: 225306 - RNA, 20 nt, Human
uacacugcacaaaugaaaau

SEQ ID NO: 225307 - RNA, 21 nt, Human
uaguauauguugucauguacu

SEQ ID NO: 225308 - RNA, 20 nt, Human
uauaaagaacaauuugcagu

SEQ ID NO: 225309 - RNA, 23 nt, Human
uauccagaccuuauuuaccaaua

SEQ ID NO: 225310 - RNA, 20 nt, Human
ucaaacuuguaccaccaaca

SEQ ID NO: 225311 - RNA, 21 nt, Human
ucagaagacugcuuaccucag

SEQ ID NO: 225312 - RNA, 22 nt, Human
ucaguuaagaaaaaaaaaaaaa

SEQ ID NO: 225313 - RNA, 26 nt, Human
ucaguuaagaaaaaaaaaaaaacuuu

SEQ ID NO: 225314 - RNA, 20 nt, Human
ucuaaaaacaacagcuacaa

SEQ ID NO: 225315 - RNA, 23 nt, Human
ucuccuauaagaaacagugaaac

SEQ ID NO: 225316 - RNA, 19 nt, Human
ucuucuuccuuuucuauug

SEQ ID NO: 225317 - RNA, 24 nt, Human
ugaacaccuuugaucuauuguuuc

SEQ ID NO: 225318 - RNA, 25 nt, Human
ugaauagaaaaauacacugcacaaa

SEQ ID NO: 225319 - RNA, 22 nt, Human
uggaagagaccaaaauaaaacu

SEQ ID NO: 225320 - RNA, 22 nt, Human
uuggaucuucuucuuccuuuuc

SEQ ID NO: 225321 - RNA, 27 nt, Human
uuugcuaaaaaucaguuaagaaaaaaa

SEQ ID NO: 225322 - RNA, 24 nt, Human
uuuucuauuggucacugcuuguac

SEQ ID NO: 225323 - RNA, 23 nt, Human
aaagcccuuuacauuauaugcuc

SEQ ID NO: 225324 - RNA, 18 nt, Human
aaccuggacgccaggcug

SEQ ID NO: 225325 - RNA, 21 nt, Human
accccugccccccacuggccu

SEQ ID NO: 225326 - RNA, 19 nt, Human
acgccaggcuggauggagg

SEQ ID NO: 225327 - RNA, 21 nt, Human
agaggagaagcuggcucugag

SEQ ID NO: 225328 - RNA, 18 nt, Human
agaguccuccccacagcu

SEQ ID NO: 225329 - RNA, 21 nt, Human
aggcgcaccccugccccccac

SEQ ID NO: 225330 - RNA, 26 nt, Human
auggacacaaagagggaggaucgaag

SEQ ID NO: 225331 - RNA, 22 nt, Human
auggugugugaggagccggcac

SEQ ID NO: 225332 - RNA, 19 nt, Human
caaccuggacgccaggcug

SEQ ID NO: 225333 - RNA, 20 nt, Human
cacaauaauucuguagccaa

SEQ ID NO: 225334 - RNA, 21 nt, Human
cacagcuugcaucuguccccu

SEQ ID NO: 225335 - RNA, 18 nt, Human
cagagccucucccugugg

SEQ ID NO: 225336 - RNA, 20 nt, Human
cagcaacacucuguauccug

SEQ ID NO: 225337 - RNA, 21 nt, Human
cagccagagcaguucagacau

SEQ ID NO: 225338 - RNA, 18 nt, Human
cagcgguguggacuccca

SEQ ID NO: 225339 - RNA, 18 nt, Human
cagcuugcaucugucccc

SEQ ID NO: 225340 - RNA, 19 nt, Human
caggacacaggcagagucc

SEQ ID NO: 225341 - RNA, 22 nt, Human
caggacacaggcagaguccucc

SEQ ID NO: 225342 - RNA, 24 nt, Human
caggcuggauggaggggagaaggc

SEQ ID NO: 225343 - RNA, 22 nt, Human
ccacagcuugcaucuguccccu

SEQ ID NO: 225344 - RNA, 21 nt, Human
ccagccauccccccagagccu

SEQ ID NO: 225345 - RNA, 25 nt, Human
ccagccauccccccagagccucucc

SEQ ID NO: 225346 - RNA, 18 nt, Human
ccagggcagagcuggugg

SEQ ID NO: 225347 - RNA, 19 nt, Human
cccccagagccucucccug

SEQ ID NO: 225348 - RNA, 22 nt, Human
cccccagccauccccccagagc

SEQ ID NO: 225349 - RNA, 21 nt, Human
ccuaaggugauaugcagcuaa

SEQ ID NO: 225350 - RNA, 20 nt, Human
ccuuacccacccuauauugg

SEQ ID NO: 225351 - RNA, 24 nt, Human
cgcccuuaauuccaaggugggcuc

SEQ ID NO: 225352 - RNA, 19 nt, Human
cucacaauaauucuguagc

SEQ ID NO: 225353 - RNA, 20 nt, Human
cucacaauaauucuguagcc

SEQ ID NO: 225354 - RNA, 22 nt, Human
cucacaauaauucuguagccaa

SEQ ID NO: 225355 - RNA, 19 nt, Human
cucuagcccaggcagcccc

SEQ ID NO: 225356 - RNA, 21 nt, Human
cugaacagggcaaccuggacg

SEQ ID NO: 225357 - RNA, 18 nt, Human
cuggacaaugaagacccc

SEQ ID NO: 225358 - RNA, 21 nt, Human
cuucugagcugugggaauaga

SEQ ID NO: 225359 - RNA, 19 nt, Human
cuuucaggcucuggggcag

SEQ ID NO: 225360 - RNA, 23 nt, Human
gaagcuggcucugaggaagauuu

SEQ ID NO: 225361 - RNA, 18 nt, Human
gaauggacacaaagaggg

SEQ ID NO: 225362 - RNA, 24 nt, Human
gacacaggcagaguccuccccaca

SEQ ID NO: 225363 - RNA, 22 nt, Human
gagcaguucagacauugagagg

SEQ ID NO: 225364 - RNA, 21 nt, Human
gcacaacgcagggccccgaag

SEQ ID NO: 225365 - RNA, 21 nt, Human
gcagaguccuccccacagcuu

SEQ ID NO: 225366 - RNA, 22 nt, Human
gcagaguccuccccacagcuug

SEQ ID NO: 225367 - RNA, 20 nt, Human
ggaauggacacaaagaggga

SEQ ID NO: 225368 - RNA, 19 nt, Human
ggacaaugaagaccccauc

SEQ ID NO: 225369 - RNA, 23 nt, Human
gggaauggacacaaagagggagg

SEQ ID NO: 225370 - RNA, 18 nt, Human
gggcagggcagaggaggc

SEQ ID NO: 225371 - RNA, 18 nt, Human
gugggaauagagucugca

SEQ ID NO: 225372 - RNA, 23 nt, Human
uaaggugauaugcagcuaauuaa

SEQ ID NO: 225373 - RNA, 19 nt, Human
uagcccaggcagccccucc

SEQ ID NO: 225374 - RNA, 19 nt, Human
ucccagcuucugagcugug

SEQ ID NO: 225375 - RNA, 19 nt, Human
ucccccagccaucccccca

SEQ ID NO: 225376 - RNA, 19 nt, Human
ucugagcugugggaauaga

SEQ ID NO: 225377 - RNA, 20 nt, Human
ucugcacaacgcagggcccc

SEQ ID NO: 225378 - RNA, 22 nt, Human
ugaacagggcaaccuggacgcu

SEQ ID NO: 225379 - RNA, 19 nt, Human
ugaacagggcaaccuggag

SEQ ID NO: 225380 - RNA, 24 nt, Human
ugagacuuucaggcucuggggcag

SEQ ID NO: 225381 - RNA, 21 nt, Human
ugagaggagaagcuggcucug

SEQ ID NO: 225382 - RNA, 19 nt, Human
uggacaaugaagaccccau

SEQ ID NO: 225383 - RNA, 24 nt, Human
uggacgccaggcuggauggagggg

SEQ ID NO: 225384 - RNA, 24 nt, Human
ugguggcaagcccagggcacuucu

SEQ ID NO: 225385 - RNA, 22 nt, Human
uggugggcagggcagaggaggc

SEQ ID NO: 225386 - RNA, 21 nt, Human
aaaaaaaaaaaaaacaccgca

SEQ ID NO: 225387 - RNA, 18 nt, Human
aaaaaaaacaagcaagga

SEQ ID NO: 225388 - RNA, 22 nt, Human
aaaaaaacaagcaaggaaaaca

SEQ ID NO: 225389 - RNA, 24 nt, Human
aaaaaaacaagcaaggaaaacaga

SEQ ID NO: 225390 - RNA, 27 nt, Human
aaaaacaagcaaggaaaaccgguaccc

SEQ ID NO: 225391 - RNA, 19 nt, Human
aaaaacacacucacacaca

SEQ ID NO: 225392 - RNA, 24 nt, Human
aaaaacacacucacacacaagacu

SEQ ID NO: 225393 - RNA, 21 nt, Human
aaagggggaaggggcggagag

SEQ ID NO: 225394 - RNA, 23 nt, Human
aacgucagauagcacuuuaauau

SEQ ID NO: 225395 - RNA, 22 nt, Human
aagaaagagaggagaaagaaaa

SEQ ID NO: 225396 - RNA, 22 nt, Human
aagcucacaacuaaaccuucag

SEQ ID NO: 225397 - RNA, 18 nt, Human
aaggggaagggguggggc

SEQ ID NO: 225398 - RNA, 19 nt, Human
aaguaugcuguaaauggau

SEQ ID NO: 225399 - RNA, 25 nt, Human
aaucccacccucccuggcacugguu

SEQ ID NO: 225400 - RNA, 23 nt, Human
acaauacugaaagcuaccacuac

SEQ ID NO: 225401 - RNA, 22 nt, Human
acaccgagcccucccucccccu

SEQ ID NO: 225402 - RNA, 22 nt, Human
acagcaaaaagguccguauaga

SEQ ID NO: 225403 - RNA, 22 nt, Human
acauaacuauguacacggccuu

SEQ ID NO: 225404 - RNA, 23 nt, Human
acuuuuuuuuuuuuuuuuuuuug

SEQ ID NO: 225405 - RNA, 18 nt, Human
agaaaacuugaagcuuuc

SEQ ID NO: 225406 - RNA, 22 nt, Human
agaaagaaaagggggaaggggc

SEQ ID NO: 225407 - RNA, 18 nt, Human
agagaggagaaagaaaag

SEQ ID NO: 225408 - RNA, 19 nt, Human
agagaggggaagaaagaga

SEQ ID NO: 225409 - RNA, 20 nt, Human
agaggggaagaaagagagga

SEQ ID NO: 225410 - RNA, 23 nt, Human
agaggggaggagggacggggagc

SEQ ID NO: 225411 - RNA, 20 nt, Human
aggagaaagaaaagggggaa

SEQ ID NO: 225412 - RNA, 22 nt, Human
aggagaaagaaaagggggaagg

SEQ ID NO: 225413 - RNA, 21 nt, Human
aggggcggagagaggggagga

SEQ ID NO: 225414 - RNA, 20 nt, Human
agucugugugagccaugcag

SEQ ID NO: 225415 - RNA, 21 nt, Human
aucucuuuacaauacugaaag

SEQ ID NO: 225416 - RNA, 18 nt, Human
augugcacugagucuaua

SEQ ID NO: 225417 - RNA, 25 nt, Human
caaaaaacacacucacacacaagac

SEQ ID NO: 225418 - RNA, 20 nt, Human
caauacugaaagcuaccacu

SEQ ID NO: 225419 - RNA, 18 nt, Human
cacaaaaucugaagcuca

SEQ ID NO: 225420 - RNA, 22 nt, Human
cacacaaaaaaaaauugacacc

SEQ ID NO: 225421 - RNA, 23 nt, Human
cacccucuaacucgcgauggcuc

SEQ ID NO: 225422 - RNA, 20 nt, Human
caccgagcccucccuccccc

SEQ ID NO: 225423 - RNA, 21 nt, Human
cagacaccaccacccgucccc

SEQ ID NO: 225424 - RNA, 23 nt, Human
caggauaaacagcaaaaaggucc

SEQ ID NO: 225425 - RNA, 24 nt, Human
caguagacaagauauauuguauuu

SEQ ID NO: 225426 - RNA, 18 nt, Human
caucuuacccuuuugcau

SEQ ID NO: 225427 - RNA, 21 nt, Human
cauucauugcauaguugaagg

SEQ ID NO: 225428 - RNA, 23 nt, Human
ccacacaaaaaaaaauugacacc

SEQ ID NO: 225429 - RNA, 26 nt, Human
ccacacaaaaaaaaauugacaccgag

SEQ ID NO: 225430 - RNA, 21 nt, Human
ccaccacccguccccugauuu

SEQ ID NO: 225431 - RNA, 22 nt, Human
cccagucugugugagccaugca

SEQ ID NO: 225432 - RNA, 30 nt, Human
ccccaccgcccccgcuacaauuaucaucca

SEQ ID NO: 225433 - RNA, 22 nt, Human
ccccagagcccacaagcggcaa

SEQ ID NO: 225434 - RNA, 18 nt, Human
cccccagagcccacaagc

SEQ ID NO: 225435 - RNA, 24 nt, Human
cccccagagcccacaagcggcaac

SEQ ID NO: 225436 - RNA, 18 nt, Human
cccccccaccgcccccgc

SEQ ID NO: 225437 - RNA, 23 nt, Human
cccccccaccgcccccgcuacaa

SEQ ID NO: 225438 - RNA, 21 nt, Human
cccccccagucugugugagcc

SEQ ID NO: 225439 - RNA, 20 nt, Human
cccgccacaggcuacggccg

SEQ ID NO: 225440 - RNA, 22 nt, Human
cccgccacaggcuacggccgca

SEQ ID NO: 225441 - RNA, 20 nt, Human
cccucccucccccuucacgg

SEQ ID NO: 225442 - RNA, 25 nt, Human
cccucccucccccuucacggcuucc

SEQ ID NO: 225443 - RNA, 23 nt, Human
cccucuaacucgcgauggcuccc

SEQ ID NO: 225444 - RNA, 20 nt, Human
ccgaggagggcgcgggggag

SEQ ID NO: 225445 - RNA, 18 nt, Human
ccuggugucugccuaggg

SEQ ID NO: 225446 - RNA, 21 nt, Human
ccuucccaccucaucugaaag

SEQ ID NO: 225447 - RNA, 19 nt, Human
cgccccgaggagggcgcgg

SEQ ID NO: 225448 - RNA, 21 nt, Human
cuccggggcuacacuuucccc

SEQ ID NO: 225449 - RNA, 24 nt, Human
cugggcuaaaagaucugaaaaauc

SEQ ID NO: 225450 - RNA, 18 nt, Human
cuuaaaaaaaaaaaaaaa

SEQ ID NO: 225451 - RNA, 24 nt, Human
cuuuuuuuuuuuuuuuuuuuuggg

SEQ ID NO: 225452 - RNA, 21 nt, Human
gaaaaggcuccuuugaguuag

SEQ ID NO: 225453 - RNA, 18 nt, Human
gaaagaagggagagaggg

SEQ ID NO: 225454 - RNA, 23 nt, Human
gaagaaagagaggagaaagaaaa

SEQ ID NO: 225455 - RNA, 18 nt, Human
gagcccacaagcggcaac

SEQ ID NO: 225456 - RNA, 20 nt, Human
gaggagcccaaguguggggc

SEQ ID NO: 225457 - RNA, 23 nt, Human
gaggggaggagggacggggagcg

SEQ ID NO: 225458 - RNA, 23 nt, Human
gauagcacuuuaauauacuagaa

SEQ ID NO: 225459 - RNA, 18 nt, Human
gcaugauggauggcgugg

SEQ ID NO: 225460 - RNA, 22 nt, Human
gccaucuuucacccucuaacuc

SEQ ID NO: 225461 - RNA, 21 nt, Human
gccccgaggagggcgcggggg

SEQ ID NO: 225462 - RNA, 19 nt, Human
gccugggguccaauuugca

SEQ ID NO: 225463 - RNA, 23 nt, Human
gcgggcuuuugugaaaagcccga

SEQ ID NO: 225464 - RNA, 21 nt, Human
ggaaaacagagucauaucacg

SEQ ID NO: 225465 - RNA, 21 nt, Human
ggaaacgugcaccuuacaucc

SEQ ID NO: 225466 - RNA, 22 nt, Human
ggagagaggggaggagggacgg

SEQ ID NO: 225467 - RNA, 23 nt, Human
gucugugugagccaugcaggagu

SEQ ID NO: 225468 - RNA, 21 nt, Human
guugcuucacuuuucuuuuca

SEQ ID NO: 225469 - RNA, 21 nt, Human
uaacucgcgauggcuccacaa

SEQ ID NO: 225470 - RNA, 23 nt, Human
uaaguaaaucucauuacaaaacg

SEQ ID NO: 225471 - RNA, 21 nt, Human
uaaguuccagccuggggucca

SEQ ID NO: 225472 - RNA, 21 nt, Human
uaaguuugcaaauagcacauu

SEQ ID NO: 225473 - RNA, 21 nt, Human
uacaaggggaagggguggggc

SEQ ID NO: 225474 - RNA, 22 nt, Human
uagaucucucugcuuauuagaa

SEQ ID NO: 225475 - RNA, 19 nt, Human
uaggguuucuucuuccucg

SEQ ID NO: 225476 - RNA, 20 nt, Human
uaugaaauaggacacacuaa

SEQ ID NO: 225477 - RNA, 23 nt, Human
ucaaaaaacacacucacacacaa

SEQ ID NO: 225478 - RNA, 18 nt, Human
ucacaacuaaaccuucag

SEQ ID NO: 225479 - RNA, 21 nt, Human
ucaucuucacuguuuugguuc

SEQ ID NO: 225480 - RNA, 21 nt, Human
ucauugcauaguugaaggguu

SEQ ID NO: 225481 - RNA, 20 nt, Human
uccaauuugcaaaacaggau

SEQ ID NO: 225482 - RNA, 21 nt, Human
uccacaagguugaccuguuac

SEQ ID NO: 225483 - RNA, 21 nt, Human
ucccagacuugaucaccagcu

SEQ ID NO: 225484 - RNA, 18 nt, Human
ucccccccaccgcccccg

SEQ ID NO: 225485 - RNA, 24 nt, Human
ucugcuuauuagaaacaauggucu

SEQ ID NO: 225486 - RNA, 19 nt, Human
ugaaaaaaaacaagcaagg

SEQ ID NO: 225487 - RNA, 19 nt, Human
ugaagagacauuaagauug

SEQ ID NO: 225488 - RNA, 19 nt, Human
ugagaacauaugacugggc

SEQ ID NO: 225489 - RNA, 21 nt, Human
ugaggugugugugaagucacu

SEQ ID NO: 225490 - RNA, 20 nt, Human
ugcaaaaacaggauaacaac

SEQ ID NO: 225491 - RNA, 21 nt, Human
ugcuuauuagaaacaaugguc

SEQ ID NO: 225492 - RNA, 21 nt, Human
ugggagcagcgccgagcaaag

SEQ ID NO: 225493 - RNA, 25 nt, Human
uuacauaacuauguacacggccuuc

SEQ ID NO: 225494 - RNA, 19 nt, Human
uuacauuacacaagaaggc

SEQ ID NO: 225495 - RNA, 26 nt, Human
uucaaaaugugcacugagucuauaca

SEQ ID NO: 225496 - RNA, 23 nt, Human
uuccaguguacauauuccuugca

SEQ ID NO: 225497 - RNA, 22 nt, Human
uucuccguuugaaaaaaaacaa

SEQ ID NO: 225498 - RNA, 24 nt, Human
uugacaccgagcccucccuccccc

SEQ ID NO: 225499 - RNA, 19 nt, Human
uugcaaaaacaggauaaca

SEQ ID NO: 225500 - RNA, 21 nt, Human
uuuuuuuuuuuuuuuuugcaa

SEQ ID NO: 225501 - RNA, 20 nt, Human
aaaagcaagcccacaggccc

SEQ ID NO: 225502 - RNA, 20 nt, Human
aaaagcaugacugaaacccu

SEQ ID NO: 225503 - RNA, 22 nt, Human
aaacagcaaagcagaagggacc

SEQ ID NO: 225504 - RNA, 24 nt, Human
aaacaggcagcguggucauugucc

SEQ ID NO: 225505 - RNA, 19 nt, Human
aaagacacacaaguugugc

SEQ ID NO: 225506 - RNA, 26 nt, Human
aaagagccuuaacuaggaagacaaac

SEQ ID NO: 225507 - RNA, 25 nt, Human
aagacagacgaugccccacugcaga

SEQ ID NO: 225508 - RNA, 19 nt, Human
aagcaaaccaggggcuggg

SEQ ID NO: 225509 - RNA, 24 nt, Human
aagcaugacugaaacccuggggac

SEQ ID NO: 225510 - RNA, 20 nt, Human
aagcugccaaaguucccugc

SEQ ID NO: 225511 - RNA, 24 nt, Human
aagugcuuaaaacaugaagaacaa

SEQ ID NO: 225512 - RNA, 22 nt, Human
acaaacagcuccagacugaagc

SEQ ID NO: 225513 - RNA, 18 nt, Human
acagcccacagcagugcu

SEQ ID NO: 225514 - RNA, 21 nt, Human
acagcuccagacugaagcaga

SEQ ID NO: 225515 - RNA, 28 nt, Human
acauggcacucgccccacaaacagcucc

SEQ ID NO: 225516 - RNA, 20 nt, Human
acccaaugacccccaaaagc

SEQ ID NO: 225517 - RNA, 21 nt, Human
accccgcccaccaaaggcaca

SEQ ID NO: 225518 - RNA, 21 nt, Human
acccugcagcaacacagaguu

SEQ ID NO: 225519 - RNA, 20 nt, Human
acuaggaagacaaacagcaa

SEQ ID NO: 225520 - RNA, 21 nt, Human
agacaaacagcaaagcagaac

SEQ ID NO: 225521 - RNA, 18 nt, Human
agacucaggacauggcag

SEQ ID NO: 225522 - RNA, 19 nt, Human
agagggcaggcagcaauag

SEQ ID NO: 225523 - RNA, 18 nt, Human
agcaaagcagaaccaugc

SEQ ID NO: 225524 - RNA, 20 nt, Human
agcagggcagccccaggccu

SEQ ID NO: 225525 - RNA, 24 nt, Human
aggaagguugagggagcagcaacu

SEQ ID NO: 225526 - RNA, 23 nt, Human
aggcaggagggagaggagcaagg

SEQ ID NO: 225527 - RNA, 24 nt, Human
aggcaggugggaaagacccagggc

SEQ ID NO: 225528 - RNA, 19 nt, Human
aggggcuuuccuccaugug

SEQ ID NO: 225529 - RNA, 24 nt, Human
aggggucagggagcagccugaagc

SEQ ID NO: 225530 - RNA, 26 nt, Human
agggugccccaagcugccaaaguucc

SEQ ID NO: 225531 - RNA, 21 nt, Human
aggucagggccagggcuggga

SEQ ID NO: 225532 - RNA, 20 nt, Human
agguggucaagagcucgaaa

SEQ ID NO: 225533 - RNA, 22 nt, Human
aguggauacuuuucucagauuu

SEQ ID NO: 225534 - RNA, 18 nt, Human
aguugugcacagaaccug

SEQ ID NO: 225535 - RNA, 26 nt, Human
auacuagaagccccuccaaccggagg

SEQ ID NO: 225536 - RNA, 24 nt, Human
aucaccccccauuuuugcuaauuc

SEQ ID NO: 225537 - RNA, 21 nt, Human
auccuugggggauaauaaagu

SEQ ID NO: 225538 - RNA, 19 nt, Human
aucuggacaggcaacaaga

SEQ ID NO: 225539 - RNA, 24 nt, Human
augaaaacaggcaggugggaaaga

SEQ ID NO: 225540 - RNA, 24 nt, Human
caaaagcaagcccacaggcccucu

SEQ ID NO: 225541 - RNA, 22 nt, Human
caaaagcaugacugaaacccug

SEQ ID NO: 225542 - RNA, 21 nt, Human
caaagcagaaccaugccugcu

SEQ ID NO: 225543 - RNA, 18 nt, Human
caaaggacagauacuuca

SEQ ID NO: 225544 - RNA, 26 nt, Human
caaaucauaagcagucccaagcccca

SEQ ID NO: 225545 - RNA, 22 nt, Human
caaggcaagacagacgaugccc

SEQ ID NO: 225546 - RNA, 23 nt, Human
caaggcaagacagacgaugcccc

SEQ ID NO: 225547 - RNA, 22 nt, Human
caaugacccccaaaagcaugac

SEQ ID NO: 225548 - RNA, 22 nt, Human
cacagaaccugaugccuccaaa

SEQ ID NO: 225549 - RNA, 19 nt, Human
cagaagggacaggcugaga

SEQ ID NO: 225550 - RNA, 19 nt, Human
cagacagacaucacccaga

SEQ ID NO: 225551 - RNA, 22 nt, Human
cagcagccccaguugaggcagg

SEQ ID NO: 225552 - RNA, 23 nt, Human
cagccugaagcacacacaucauc

SEQ ID NO: 225553 - RNA, 19 nt, Human
cagcgccccgcccccugcc

SEQ ID NO: 225554 - RNA, 19 nt, Human
cagcuccagacugaagcag

SEQ ID NO: 225555 - RNA, 20 nt, Human
caggaccuggugacaaaccc

SEQ ID NO: 225556 - RNA, 26 nt, Human
caggcccucuccugaagaaguggugg

SEQ ID NO: 225557 - RNA, 19 nt, Human
cagucccaagccccagccu

SEQ ID NO: 225558 - RNA, 21 nt, Human
caguggauacuuuucucagau

SEQ ID NO: 225559 - RNA, 22 nt, Human
cauaagcagucccaagccccag

SEQ ID NO: 225560 - RNA, 23 nt, Human
caucaacaaggacccugggcuuc

SEQ ID NO: 225561 - RNA, 20 nt, Human
caucacccagagggcacgug

SEQ ID NO: 225562 - RNA, 19 nt, Human
ccaaaagcaagcccacagg

SEQ ID NO: 225563 - RNA, 18 nt, Human
ccaagccaggcaagcccc

SEQ ID NO: 225564 - RNA, 21 nt, Human
ccacacauucccaugugacac

SEQ ID NO: 225565 - RNA, 19 nt, Human
ccagacaaugagagugagc

SEQ ID NO: 225566 - RNA, 21 nt, Human
ccaggccugccugcccgccug

SEQ ID NO: 225567 - RNA, 18 nt, Human
ccaggggcugggccaaag

SEQ ID NO: 225568 - RNA, 28 nt, Human
ccauguguggcgcuccucugcuccaucc

SEQ ID NO: 225569 - RNA, 22 nt, Human
cccacaaacagcuccagacuga

SEQ ID NO: 225570 - RNA, 22 nt, Human
ccccaagcugccaaaguucccu

SEQ ID NO: 225571 - RNA, 19 nt, Human
ccccacaaacagcuccaga

SEQ ID NO: 225572 - RNA, 19 nt, Human
ccccaggccugccugcccg

SEQ ID NO: 225573 - RNA, 19 nt, Human
cccccaaaagcaugacuga

SEQ ID NO: 225574 - RNA, 23 nt, Human
cccccaaaagcaugacugaaacc

SEQ ID NO: 225575 - RNA, 18 nt, Human
cccccugccccgccccgc

SEQ ID NO: 225576 - RNA, 23 nt, Human
cccccugccccgccccgcgcccg

SEQ ID NO: 225577 - RNA, 22 nt, Human
ccccgccccgcgcccgccgccc

SEQ ID NO: 225578 - RNA, 20 nt, Human
ccccgcgcccgccgccccaa

SEQ ID NO: 225579 - RNA, 22 nt, Human
ccccugccccgccccgcgcccc

SEQ ID NO: 225580 - RNA, 24 nt, Human
ccccugccccgccccgcgcccgcc

SEQ ID NO: 225581 - RNA, 21 nt, Human
ccccugcgccccacacauucc

SEQ ID NO: 225582 - RNA, 23 nt, Human
ccccugcgccccacacauuccca

SEQ ID NO: 225583 - RNA, 22 nt, Human
cccgcccccugccccgccccgc

SEQ ID NO: 225584 - RNA, 19 nt, Human
cccgccccugcgccccaca

SEQ ID NO: 225585 - RNA, 19 nt, Human
ccgcacccgccccugcgcc

SEQ ID NO: 225586 - RNA, 21 nt, Human
ccgcacccgccccugcgcccc

SEQ ID NO: 225587 - RNA, 19 nt, Human
ccgccccgcgcccgccgcc

SEQ ID NO: 225588 - RNA, 20 nt, Human
ccgccccgcgcccgccgccc

SEQ ID NO: 225589 - RNA, 20 nt, Human
ccgcgcccgccgccccaacc

SEQ ID NO: 225590 - RNA, 19 nt, Human
ccggccgccgccuccccgc

SEQ ID NO: 225591 - RNA, 18 nt, Human
ccuccccgccucaccggg

SEQ ID NO: 225592 - RNA, 21 nt, Human
ccuccuggggguagggugagg

SEQ ID NO: 225593 - RNA, 19 nt, Human
cgccgccgcagcugcgggc

SEQ ID NO: 225594 - RNA, 20 nt, Human
cggccgccgccuccccgccu

SEQ ID NO: 225595 - RNA, 22 nt, Human
cuaauacccaaugacccccaaa

SEQ ID NO: 225596 - RNA, 23 nt, Human
cuaccauguuuucuacaagcaaa

SEQ ID NO: 225597 - RNA, 23 nt, Human
cuagaagccccuccagggacugg

SEQ ID NO: 225598 - RNA, 23 nt, Human
cucacuaagcuguuaaguauccu

SEQ ID NO: 225599 - RNA, 20 nt, Human
cuccauguguggcgcuccuc

SEQ ID NO: 225600 - RNA, 18 nt, Human
cucccucuuccaggcaag

SEQ ID NO: 225601 - RNA, 21 nt, Human
cuccgcacccgccccugcgcc

SEQ ID NO: 225602 - RNA, 22 nt, Human
cucgccccacaaacagcuccag

SEQ ID NO: 225603 - RNA, 22 nt, Human
cugaaacccuggggaccagugg

SEQ ID NO: 225604 - RNA, 18 nt, Human
cugaugccuccaaaggga

SEQ ID NO: 225605 - RNA, 23 nt, Human
cugcucccugcccaacccaccug

SEQ ID NO: 225606 - RNA, 20 nt, Human
cuggccgcgggccgcgccgc

SEQ ID NO: 225607 - RNA, 20 nt, Human
cuuaaaacaugaagaacaag

SEQ ID NO: 225608 - RNA, 19 nt, Human
gacccagggcucccaaaga

SEQ ID NO: 225609 - RNA, 24 nt, Human
gagaagaaacaucaacaaggaccc

SEQ ID NO: 225610 - RNA, 18 nt, Human
gagcagggcagccccagg

SEQ ID NO: 225611 - RNA, 22 nt, Human
gagcucgaaaagcaaaaaggug

SEQ ID NO: 225612 - RNA, 21 nt, Human
gagguggucaagagcucgaaa

SEQ ID NO: 225613 - RNA, 20 nt, Human
gaugagagaguucaggagga

SEQ ID NO: 225614 - RNA, 26 nt, Human
gcaaagcagaaccaugccugcucccu

SEQ ID NO: 225615 - RNA, 19 nt, Human
gcaacaagaauagacaugg

SEQ ID NO: 225616 - RNA, 22 nt, Human
gcacagaaccugaugccuccaa

SEQ ID NO: 225617 - RNA, 23 nt, Human
gcagcagacagacaucacccaga

SEQ ID NO: 225618 - RNA, 24 nt, Human
gcagccugaagcacacacaucauc

SEQ ID NO: 225619 - RNA, 20 nt, Human
gcagcuuaauggauggaugg

SEQ ID NO: 225620 - RNA, 24 nt, Human
gccccacugcagaugagagaguuc

SEQ ID NO: 225621 - RNA, 21 nt, Human
gccccagccuggagggaccua

SEQ ID NO: 225622 - RNA, 22 nt, Human
gccccgcgcccgccgccccaac

SEQ ID NO: 225623 - RNA, 23 nt, Human
gcgaggucuggccgagccggugc

SEQ ID NO: 225624 - RNA, 18 nt, Human
gcgcuccucugcuccauc

SEQ ID NO: 225625 - RNA, 19 nt, Human
gcucuugccuccucacuaa

SEQ ID NO: 225626 - RNA, 22 nt, Human
ggaagacagcaggaagguugag

SEQ ID NO: 225627 - RNA, 20 nt, Human
ggagaggucgacauccaggg

SEQ ID NO: 225628 - RNA, 25 nt, Human
ggagggaaaugaaggggauggggcu

SEQ ID NO: 225629 - RNA, 19 nt, Human
gggcagccccaggccugcc

SEQ ID NO: 225630 - RNA, 25 nt, Human
gggcugggccgggccgaccggccgc

SEQ ID NO: 225631 - RNA, 22 nt, Human
ggugcucucuccgcacccgccc

SEQ ID NO: 225632 - RNA, 21 nt, Human
gucuaguauggcuaaguccug

SEQ ID NO: 225633 - RNA, 24 nt, Human
uaacuaggaagacaaacagcaaag

SEQ ID NO: 225634 - RNA, 20 nt, Human
uaacucacagacaaacaggc

SEQ ID NO: 225635 - RNA, 23 nt, Human
uaaguauccuucuucagcaccuc

SEQ ID NO: 225636 - RNA, 20 nt, Human
uacacauuggagguggucaa

SEQ ID NO: 225637 - RNA, 21 nt, Human
uacccaaugacccccaaaagc

SEQ ID NO: 225638 - RNA, 25 nt, Human
uaggagaagaaacaucaacaaggaa

SEQ ID NO: 225639 - RNA, 18 nt, Human
ucaaacccugcagcaaca

SEQ ID NO: 225640 - RNA, 20 nt, Human
ucaggacauggcagagacug

SEQ ID NO: 225641 - RNA, 21 nt, Human
ucauccaccacuguccacaug

SEQ ID NO: 225642 - RNA, 24 nt, Human
uccaaaaguucaaacccugcagca

SEQ ID NO: 225643 - RNA, 24 nt, Human
uccagacugaagcagacucaggac

SEQ ID NO: 225644 - RNA, 18 nt, Human
uccaggcaagcugacugg

SEQ ID NO: 225645 - RNA, 19 nt, Human
uccaugccaacccuccugg

SEQ ID NO: 225646 - RNA, 21 nt, Human
ucccaaaggcauagugggacc

SEQ ID NO: 225647 - RNA, 25 nt, Human
ucccaagccccagccuggagggacc

SEQ ID NO: 225648 - RNA, 21 nt, Human
ucccagauuacugcaucaagc

SEQ ID NO: 225649 - RNA, 24 nt, Human
ucccaguaauacuagaagccccuc

SEQ ID NO: 225650 - RNA, 19 nt, Human
ucccugcagaugccuuggg

SEQ ID NO: 225651 - RNA, 23 nt, Human
uccgcacccgccccugcgcccca

SEQ ID NO: 225652 - RNA, 24 nt, Human
uccuaaguauaggugucucccaaa

SEQ ID NO: 225653 - RNA, 21 nt, Human
ucgccccacaaacagcuccag

SEQ ID NO: 225654 - RNA, 24 nt, Human
ucuacaagcaaaccaggggcuggg

SEQ ID NO: 225655 - RNA, 18 nt, Human
ucucuccgcacccgcccc

SEQ ID NO: 225656 - RNA, 19 nt, Human
ucugucuugggggaagagu

SEQ ID NO: 225657 - RNA, 23 nt, Human
ugaagaagugguggucccagagg

SEQ ID NO: 225658 - RNA, 21 nt, Human
ugaauaaagcccagaggaauc

SEQ ID NO: 225659 - RNA, 20 nt, Human
ugacccccaaaagcaugacu

SEQ ID NO: 225660 - RNA, 18 nt, Human
ugagagaguucaggagga

SEQ ID NO: 225661 - RNA, 23 nt, Human
ugagggagcagcaacuuggccag

SEQ ID NO: 225662 - RNA, 23 nt, Human
ugccaaaguucccugcagaugcc

SEQ ID NO: 225663 - RNA, 19 nt, Human
ugcccaacccaccugcaac

SEQ ID NO: 225664 - RNA, 19 nt, Human
ugccccaagcugccaaagu

SEQ ID NO: 225665 - RNA, 21 nt, Human
ugccugaggccuuccaaaagc

SEQ ID NO: 225666 - RNA, 19 nt, Human
ugcucucaggggaaugggu

SEQ ID NO: 225667 - RNA, 21 nt, Human
ugcucugucuugggggaagag

SEQ ID NO: 225668 - RNA, 18 nt, Human
uggagggaaaugaagggg

SEQ ID NO: 225669 - RNA, 19 nt, Human
uggcacucgccccacaaac

SEQ ID NO: 225670 - RNA, 21 nt, Human
uggcaucuggacaggcaacaa

SEQ ID NO: 225671 - RNA, 25 nt, Human
uggcuaggagaagaaacaucaacaa

SEQ ID NO: 225672 - RNA, 22 nt, Human
ugggaaagacccagggcuccca

SEQ ID NO: 225673 - RNA, 20 nt, Human
ugggguugagggaggggaag

SEQ ID NO: 225674 - RNA, 25 nt, Human
uguuuuauucuucauaaagugcuua

SEQ ID NO: 225675 - RNA, 19 nt, Human
uucaaacccugcagcaaca

SEQ ID NO: 225676 - RNA, 18 nt, Human
uucauaaagugcuuaaaa

SEQ ID NO: 225677 - RNA, 21 nt, Human
uuccagcagccccaguugagg

SEQ ID NO: 225678 - RNA, 25 nt, Human
uugaccccgcccaccaaaggcacau

SEQ ID NO: 225679 - RNA, 21 nt, Human
uuugcuaauucagggugcccc

SEQ ID NO: 225680 - RNA, 18 nt, Human
aaacagacuugcucuccg

SEQ ID NO: 225681 - RNA, 23 nt, Human
aaggaaucacagauuugaugaaa

SEQ ID NO: 225682 - RNA, 19 nt, Human
aagggccucugggguugac

SEQ ID NO: 225683 - RNA, 21 nt, Human
aauuggcaguauuuuuucuua

SEQ ID NO: 225684 - RNA, 24 nt, Human
auuggcaguauuuuuucuuaauga

SEQ ID NO: 225685 - RNA, 19 nt, Human
cacuuugggaaaacuggua

SEQ ID NO: 225686 - RNA, 19 nt, Human
caggaagugagccugcuuc

SEQ ID NO: 225687 - RNA, 20 nt, Human
ccacuggucuuauaauuuca

SEQ ID NO: 225688 - RNA, 20 nt, Human
ccaugugccagguaaaaaaa

SEQ ID NO: 225689 - RNA, 21 nt, Human
cugaacacuucauucaacacc

SEQ ID NO: 225690 - RNA, 19 nt, Human
ugaaucuuuccuaccaagu

SEQ ID NO: 225691 - RNA, 23 nt, Human
ugaaucuuuccuaccaaguuguu

SEQ ID NO: 225692 - RNA, 23 nt, Human
ugauccuuauccaucugaacacu

SEQ ID NO: 225693 - RNA, 24 nt, Human
ugcuaccagaacacuuugggaaaa

SEQ ID NO: 225694 - RNA, 27 nt, Human
uuaauuggcaguauuuuuucuuaauga

SEQ ID NO: 225695 - RNA, 23 nt, Human
uuuuuuuuuuuuuuuuugauaug

SEQ ID NO: 225696 - RNA, 27 nt, Human
uuuuuuuuuuuuuuuuuuuuuuugggg

SEQ ID NO: 225697 - RNA, 21 nt, Human
aaaaaagaaaagaguacagag

SEQ ID NO: 225698 - RNA, 24 nt, Human
aaaaagagacagaggggaaaaaaa

SEQ ID NO: 225699 - RNA, 23 nt, Human
aaacagagaaaagaaaaaaaaag

SEQ ID NO: 225700 - RNA, 23 nt, Human
aacuguaccaccaccaucacuaa

SEQ ID NO: 225701 - RNA, 26 nt, Human
aagaaaaaaaaaguauguugucuuga

SEQ ID NO: 225702 - RNA, 24 nt, Human
aagcagcuggaauuacaggcaugu

SEQ ID NO: 225703 - RNA, 25 nt, Human
aagcagcuggaauuacaggcaugug

SEQ ID NO: 225704 - RNA, 19 nt, Human
aaguaguuaagccacagga

SEQ ID NO: 225705 - RNA, 23 nt, Human
aagugcuuggauuacaggcguga

SEQ ID NO: 225706 - RNA, 22 nt, Human
aaugccaaaagcagaacugaga

SEQ ID NO: 225707 - RNA, 24 nt, Human
aauuacaggcaugugccaccauac

SEQ ID NO: 225708 - RNA, 20 nt, Human
aauuccaacuguaccaccac

SEQ ID NO: 225709 - RNA, 22 nt, Human
acaaacagagaaaagaaaaaaa

SEQ ID NO: 225710 - RNA, 23 nt, Human
acagagaaaagaaaaaaaaagua

SEQ ID NO: 225711 - RNA, 19 nt, Human
acauuggccaggcuggucu

SEQ ID NO: 225712 - RNA, 20 nt, Human
accagaaagugaaacacucc

SEQ ID NO: 225713 - RNA, 22 nt, Human
accaucacuaaugccaaaagca

SEQ ID NO: 225714 - RNA, 19 nt, Human
acccaggcuggagugcaau

SEQ ID NO: 225715 - RNA, 20 nt, Human
acgggguuucaucacauugg

SEQ ID NO: 225716 - RNA, 24 nt, Human
acgggguuucaucacauuggccag

SEQ ID NO: 225717 - RNA, 21 nt, Human
acugucccaggcccacugaaa

SEQ ID NO: 225718 - RNA, 23 nt, Human
agagaaaaaacagugggcaggaa

SEQ ID NO: 225719 - RNA, 19 nt, Human
agcaucccaccgccugcug

SEQ ID NO: 225720 - RNA, 23 nt, Human
aggcgugagccacugugcccggc

SEQ ID NO: 225721 - RNA, 18 nt, Human
agguggucaugaugggga

SEQ ID NO: 225722 - RNA, 24 nt, Human
agugcaauagcgcgaucuuggcuc

SEQ ID NO: 225723 - RNA, 18 nt, Human
auccuuggcauuucccuu

SEQ ID NO: 225724 - RNA, 18 nt, Human
augccguaaaaagcccca

SEQ ID NO: 225725 - RNA, 22 nt, Human
augugugugugugugugugugu

SEQ ID NO: 225726 - RNA, 22 nt, Human
augugugugugugugugugugu

SEQ ID NO: 225727 - RNA, 25 nt, Human
caaaaagagacagaggggaaaaaaa

SEQ ID NO: 225728 - RNA, 20 nt, Human
caaaagcagaacugagacac

SEQ ID NO: 225729 - RNA, 19 nt, Human
caaaaggaagccaaaguac

SEQ ID NO: 225730 - RNA, 25 nt, Human
caaaaggaagccaaaguacacccac

SEQ ID NO: 225731 - RNA, 28 nt, Human
caagcaguucuccugccucaggcuccca

SEQ ID NO: 225732 - RNA, 18 nt, Human
cacauuggccaggcuggu

SEQ ID NO: 225733 - RNA, 20 nt, Human
cacauuggccaggcuggucu

SEQ ID NO: 225734 - RNA, 24 nt, Human
cacauuggccaggcuggucuugaa

SEQ ID NO: 225735 - RNA, 19 nt, Human
caccaccaucacuaaugcc

SEQ ID NO: 225736 - RNA, 24 nt, Human
cacccacaauaauuuggagauuca

SEQ ID NO: 225737 - RNA, 24 nt, Human
cacggccaaacccugggguccccu

SEQ ID NO: 225738 - RNA, 21 nt, Human
cacugcaaccucugccuccug

SEQ ID NO: 225739 - RNA, 23 nt, Human
cacugcaaccucugccuccuggg

SEQ ID NO: 225740 - RNA, 19 nt, Human
cagagguggucaugauggg

SEQ ID NO: 225741 - RNA, 19 nt, Human
cagcacaagaaaaaagaaa

SEQ ID NO: 225742 - RNA, 23 nt, Human
cagccaaguuuccucagccgcgc

SEQ ID NO: 225743 - RNA, 27 nt, Human
caucacauuggccaggcuggucuugaa

SEQ ID NO: 225744 - RNA, 23 nt, Human
caucacggcccacggccaaaccc

SEQ ID NO: 225745 - RNA, 22 nt, Human
cauuggccaggcuggucuugaa

SEQ ID NO: 225746 - RNA, 21 nt, Human
cauuucccuucacacaaaguc

SEQ ID NO: 225747 - RNA, 26 nt, Human
cauuucccuucacacaaagucaagag

SEQ ID NO: 225748 - RNA, 19 nt, Human
ccaaaagcagaacugagac

SEQ ID NO: 225749 - RNA, 24 nt, Human
ccaagcagcuggaauuacaggcau

SEQ ID NO: 225750 - RNA, 23 nt, Human
ccaagugcuuggauuacaggcgu

SEQ ID NO: 225751 - RNA, 19 nt, Human
cccaacuuugacucagaau

SEQ ID NO: 225752 - RNA, 24 nt, Human
cccaagugcuuggauuacaggcgu

SEQ ID NO: 225753 - RNA, 21 nt, Human
ccgccugcugccaucacggcc

SEQ ID NO: 225754 - RNA, 20 nt, Human
ccuagaaaagagcuucccuc

SEQ ID NO: 225755 - RNA, 24 nt, Human
ccucucgucuccucucuaccagua

SEQ ID NO: 225756 - RNA, 19 nt, Human
ccucugccuccuggguuca

SEQ ID NO: 225757 - RNA, 24 nt, Human
ccucugccuccuggguucaagcag

SEQ ID NO: 225758 - RNA, 20 nt, Human
ccugggguccccugaagucc

SEQ ID NO: 225759 - RNA, 23 nt, Human
ccuggguucaagcaguucuccug

SEQ ID NO: 225760 - RNA, 29 nt, Human
cgacuaauuuuguauuuuuaguagagacg

SEQ ID NO: 225761 - RNA, 20 nt, Human
cgcggcgcgcgggggcgcgg

SEQ ID NO: 225762 - RNA, 20 nt, Human
cgcgggggcgcggggggccg

SEQ ID NO: 225763 - RNA, 21 nt, Human
cggccaaacccuggggucccc

SEQ ID NO: 225764 - RNA, 19 nt, Human
cgggagagcuagaaaagug

SEQ ID NO: 225765 - RNA, 24 nt, Human
cgggguuucaucacauuggccagg

SEQ ID NO: 225766 - RNA, 24 nt, Human
cucacugcaaccucugccuccugg

SEQ ID NO: 225767 - RNA, 24 nt, Human
cuccugaucucgugaucugcccgc

SEQ ID NO: 225768 - RNA, 21 nt, Human
cuccuggguucaagcaguucu

SEQ ID NO: 225769 - RNA, 19 nt, Human
cucgugaucugcccgccuc

SEQ ID NO: 225770 - RNA, 20 nt, Human
cucugucacccaggcuggag

SEQ ID NO: 225771 - RNA, 19 nt, Human
cugcaaccucugccuccug

SEQ ID NO: 225772 - RNA, 23 nt, Human
cugcaaccucugccuccuggguu

SEQ ID NO: 225773 - RNA, 24 nt, Human
cugcaaccucugccuccuggguuc

SEQ ID NO: 225774 - RNA, 24 nt, Human
cugcccgccucggccuccccaagu

SEQ ID NO: 225775 - RNA, 24 nt, Human
cugggguccccugaaguccaccag

SEQ ID NO: 225776 - RNA, 18 nt, Human
cugucacccaggcuggag

SEQ ID NO: 225777 - RNA, 20 nt, Human
cuuggauuacaggcgugagc

SEQ ID NO: 225778 - RNA, 24 nt, Human
gaaguuacagccaaguuuccucag

SEQ ID NO: 225779 - RNA, 20 nt, Human
gagacgggguuucaucacau

SEQ ID NO: 225780 - RNA, 24 nt, Human
gagacgggguuucaucacauuggc

SEQ ID NO: 225781 - RNA, 24 nt, Human
gaucucgugaucugcccgccucgg

SEQ ID NO: 225782 - RNA, 18 nt, Human
gauuacaggcgugagcca

SEQ ID NO: 225783 - RNA, 19 nt, Human
gauuacaggcgugagccac

SEQ ID NO: 225784 - RNA, 21 nt, Human
gauuacaggcgugagccacug

SEQ ID NO: 225785 - RNA, 22 nt, Human
gcaguccagaaauaaagaauca

SEQ ID NO: 225786 - RNA, 22 nt, Human
gcaucccaccgccugcugccau

SEQ ID NO: 225787 - RNA, 22 nt, Human
gccacccaagaaaaauuaaagu

SEQ ID NO: 225788 - RNA, 19 nt, Human
gccgcgcugcagaccgacg

SEQ ID NO: 225789 - RNA, 18 nt, Human
gcgcgggggcgcgggggg

SEQ ID NO: 225790 - RNA, 21 nt, Human
gcucacugcaaccucugccuc

SEQ ID NO: 225791 - RNA, 27 nt, Human
gcucugucacccaggcuggagugcaau

SEQ ID NO: 225792 - RNA, 24 nt, Human
ggaaaugcagggauuagccauggc

SEQ ID NO: 225793 - RNA, 22 nt, Human
ggaagccaaaguacacccacaa

SEQ ID NO: 225794 - RNA, 22 nt, Human
ggaagccaaaguacacccacaa

SEQ ID NO: 225795 - RNA, 20 nt, Human
ggaauccugcugugaggagc

SEQ ID NO: 225796 - RNA, 20 nt, Human
ggauuacaggcgugagccac

SEQ ID NO: 225797 - RNA, 20 nt, Human
ggauuacaggcgugagccac

SEQ ID NO: 225798 - RNA, 24 nt, Human
ggcuggucuugaacuccugaucuc

SEQ ID NO: 225799 - RNA, 23 nt, Human
gggguuucaucacauuggccagg

SEQ ID NO: 225800 - RNA, 24 nt, Human
gucuugcucugucacccaggcugg

SEQ ID NO: 225801 - RNA, 24 nt, Human
gugaucugcccgccucggccuccc

SEQ ID NO: 225802 - RNA, 21 nt, Human
gugugugugugugugugugug

SEQ ID NO: 225803 - RNA, 24 nt, Human
uaagccacccaagaaaaauuaaag

SEQ ID NO: 225804 - RNA, 23 nt, Human
uacaggcaugugccaccauaccc

SEQ ID NO: 225805 - RNA, 23 nt, Human
uacaggcgugagccacugugccc

SEQ ID NO: 225806 - RNA, 23 nt, Human
uacaggcgugagccacugugccc

SEQ ID NO: 225807 - RNA, 22 nt, Human
uaccaccaccaucacuaaugcc

SEQ ID NO: 225808 - RNA, 23 nt, Human
uaguagagacgggguuucaucac

SEQ ID NO: 225809 - RNA, 24 nt, Human
uaguagagacgggguuucaucaca

SEQ ID NO: 225810 - RNA, 24 nt, Human
uaucaccagaaagugaaacacucc

SEQ ID NO: 225811 - RNA, 18 nt, Human
uaugugugugugugugug

SEQ ID NO: 225812 - RNA, 23 nt, Human
uaugugugugugugugugugugu

SEQ ID NO: 225813 - RNA, 24 nt, Human
uaugugugugugugugugugugug

SEQ ID NO: 225814 - RNA, 18 nt, Human
ucacccaggcuggagugc

SEQ ID NO: 225815 - RNA, 22 nt, Human
ucacuaccaccuuuucccugaa

SEQ ID NO: 225816 - RNA, 24 nt, Human
ucacugcaaccucugccuccuggg

SEQ ID NO: 225817 - RNA, 25 nt, Human
ucacugcaaccucugccuccugggu

SEQ ID NO: 225818 - RNA, 26 nt, Human
ucacugcaaccucugccuccuggguu

SEQ ID NO: 225819 - RNA, 21 nt, Human
uccaacuguaccaccaccauc

SEQ ID NO: 225820 - RNA, 21 nt, Human
uccauaauuaugccguaaaaa

SEQ ID NO: 225821 - RNA, 24 nt, Human
uccccaagugcuuggauuacaggc

SEQ ID NO: 225822 - RNA, 20 nt, Human
uccccugaaguccaccagaa

SEQ ID NO: 225823 - RNA, 23 nt, Human
uccccugaaguccaccagaagca

SEQ ID NO: 225824 - RNA, 21 nt, Human
uccugcugugaggagcuacaa

SEQ ID NO: 225825 - RNA, 19 nt, Human
uccuggguucaagcaguuc

SEQ ID NO: 225826 - RNA, 21 nt, Human
uccuggguucaagcaguucuc

SEQ ID NO: 225827 - RNA, 24 nt, Human
uccuggguucaagcaguucuccug

SEQ ID NO: 225828 - RNA, 23 nt, Human
ucgaaggcgagugagggcacucg

SEQ ID NO: 225829 - RNA, 24 nt, Human
ucuaccaguaaauaaaaauuccau

SEQ ID NO: 225830 - RNA, 23 nt, Human
ucucagguucuaaaaaggccaga

SEQ ID NO: 225831 - RNA, 23 nt, Human
ucuccugccucaggcucccaagc

SEQ ID NO: 225832 - RNA, 22 nt, Human
ucucucgaaggcgagugagggc

SEQ ID NO: 225833 - RNA, 24 nt, Human
ucugucacccaggcuggagugcaa

SEQ ID NO: 225834 - RNA, 19 nt, Human
ucuugaacuccugaucucg

SEQ ID NO: 225835 - RNA, 23 nt, Human
ucuugcucugucacccaggcugg

SEQ ID NO: 225836 - RNA, 24 nt, Human
ucuugcucugucacccaggcugga

SEQ ID NO: 225837 - RNA, 22 nt, Human
ugaaaaacaaaggugccuggug

SEQ ID NO: 225838 - RNA, 20 nt, Human
ugaaaaagccucucgucucc

SEQ ID NO: 225839 - RNA, 23 nt, Human
ugacagcagcacagacaucagag

SEQ ID NO: 225840 - RNA, 22 nt, Human
ugaggcagagucuugcucuguc

SEQ ID NO: 225841 - RNA, 20 nt, Human
ugagggcacucggcagaguu

SEQ ID NO: 225842 - RNA, 21 nt, Human
ugccucaggcucccaagcagc

SEQ ID NO: 225843 - RNA, 24 nt, Human
ugccucaggcucccaagcagcugg

SEQ ID NO: 225844 - RNA, 18 nt, Human
ugccuggugacagcagca

SEQ ID NO: 225845 - RNA, 18 nt, Human
uggaauuacaggcaugug

SEQ ID NO: 225846 - RNA, 21 nt, Human
uggaauuacaggcaugugcca

SEQ ID NO: 225847 - RNA, 22 nt, Human
uggaauuacaggcaugugccac

SEQ ID NO: 225848 - RNA, 24 nt, Human
uggaauuacaggcaugugccacca

SEQ ID NO: 225849 - RNA, 23 nt, Human
uggagugcaauagcgcgaucuug

SEQ ID NO: 225850 - RNA, 24 nt, Human
uggagugcaauagcgcgaucuugg

SEQ ID NO: 225851 - RNA, 20 nt, Human
uggauuacaggcgugagcca

SEQ ID NO: 225852 - RNA, 23 nt, Human
uggauuacaggcgugagccacug

SEQ ID NO: 225853 - RNA, 24 nt, Human
uggccaggcuggucuugaacuccu

SEQ ID NO: 225854 - RNA, 21 nt, Human
uguauuuuuaguagagacggg

SEQ ID NO: 225855 - RNA, 20 nt, Human
ugucacccaggcuggagugc

SEQ ID NO: 225856 - RNA, 22 nt, Human
ugucacccaggcuggagugcaa

SEQ ID NO: 225857 - RNA, 19 nt, Human
ugucuccucccuuagucuc

SEQ ID NO: 225858 - RNA, 20 nt, Human
ugucuugaaaaacaaagguu

SEQ ID NO: 225859 - RNA, 21 nt, Human
uguguaugugugugugugugu

SEQ ID NO: 225860 - RNA, 26 nt, Human
uguguaugugugugugugugugugug

SEQ ID NO: 225861 - RNA, 18 nt, Human
ugugugugugugugugug

SEQ ID NO: 225862 - RNA, 18 nt, Human
ugugugugugugugugug

SEQ ID NO: 225863 - RNA, 18 nt, Human
ugugugugugugugugug

SEQ ID NO: 225864 - RNA, 18 nt, Human
ugugugugugugugugug

SEQ ID NO: 225865 - RNA, 18 nt, Human
ugugugugugugugugug

SEQ ID NO: 225866 - RNA, 18 nt, Human
ugugugugugugugugug

SEQ ID NO: 225867 - RNA, 18 nt, Human
ugugugugugugugugug

SEQ ID NO: 225868 - RNA, 18 nt, Human
ugugugugugugugugug

SEQ ID NO: 225869 - RNA, 21 nt, Human
ugugugugugugugugugugu

SEQ ID NO: 225870 - RNA, 21 nt, Human
ugugugugugugugugugugu

SEQ ID NO: 225871 - RNA, 21 nt, Human
ugugugugugugugugugugu

SEQ ID NO: 225872 - RNA, 21 nt, Human
ugugugugugugugugugugu

SEQ ID NO: 225873 - RNA, 21 nt, Human
ugugugugugugugugugugu

SEQ ID NO: 225874 - RNA, 21 nt, Human
ugugugugugugugugugugu

SEQ ID NO: 225875 - RNA, 21 nt, Human
ugugugugugugugugugugu

SEQ ID NO: 225876 - RNA, 21 nt, Human
ugugugugugugugugugugu

SEQ ID NO: 225877 - RNA, 21 nt, Human
ugugugugugugugugugugu

SEQ ID NO: 225878 - RNA, 21 nt, Human
ugugugugugugugugugugu

SEQ ID NO: 225879 - RNA, 21 nt, Human
ugugugugugugugugugugu

SEQ ID NO: 225880 - RNA, 22 nt, Human
ugugugugugugugugugugug

SEQ ID NO: 225881 - RNA, 22 nt, Human
ugugugugugugugugugugug

SEQ ID NO: 225882 - RNA, 22 nt, Human
ugugugugugugugugugugug

SEQ ID NO: 225883 - RNA, 22 nt, Human
ugugugugugugugugugugug

SEQ ID NO: 225884 - RNA, 18 nt, Human
uuaguagagacgggguuu

SEQ ID NO: 225885 - RNA, 20 nt, Human
uuaguagagacgggguuuca

SEQ ID NO: 225886 - RNA, 21 nt, Human
uuaguagagacgggguuucau

SEQ ID NO: 225887 - RNA, 24 nt, Human
uuaguagagacgggguuucaucac

SEQ ID NO: 225888 - RNA, 25 nt, Human
uuaguagagacgggguuucaucaca

SEQ ID NO: 225889 - RNA, 21 nt, Human
uucaagcaguucuccugccuc

SEQ ID NO: 225890 - RNA, 25 nt, Human
uucacacaaagucaagagcagccac

SEQ ID NO: 225891 - RNA, 25 nt, Human
uuccauaauuaugccguaaaaagcc

SEQ ID NO: 225892 - RNA, 19 nt, Human
uuccucagccgcgcugcag

SEQ ID NO: 225893 - RNA, 23 nt, Human
uucuccugccucaggcucccaag

SEQ ID NO: 225894 - RNA, 20 nt, Human
uucuuuugaaguuacagcca

SEQ ID NO: 225895 - RNA, 24 nt, Human
uugcucugucacccaggcuggagu

SEQ ID NO: 225896 - RNA, 22 nt, Human
uuggauuacaggcgugagccac

SEQ ID NO: 225897 - RNA, 24 nt, Human
uuggauuacaggcgugagccacug

SEQ ID NO: 225898 - RNA, 23 nt, Human
uuguauuuuuaguagagacgggg

SEQ ID NO: 225899 - RNA, 19 nt, Human
uugucuguguaugugugug

SEQ ID NO: 225900 - RNA, 19 nt, Human
uuuuguauuuuuaguagag

SEQ ID NO: 225901 - RNA, 20 nt, Human
uuuuguauuuuuaguagaga

SEQ ID NO: 225902 - RNA, 23 nt, Human
uuuuuaguagagacgggguuuca

SEQ ID NO: 225903 - RNA, 19 nt, Human
aaacugacaaggaucucca

SEQ ID NO: 225904 - RNA, 28 nt, Human
aaagaaaaugcuaagaaaaauuauaauc

SEQ ID NO: 225905 - RNA, 24 nt, Human
aaaguaaaucacuauuuguguaaa

SEQ ID NO: 225906 - RNA, 24 nt, Human
aaauagaaaauaaaacugacaagg

SEQ ID NO: 225907 - RNA, 22 nt, Human
aaggcacaaagcaggaaaagug

SEQ ID NO: 225908 - RNA, 20 nt, Human
acaaagcaggaaaagugagc

SEQ ID NO: 225909 - RNA, 21 nt, Human
acugaguuaaaaggaaaugcu

SEQ ID NO: 225910 - RNA, 18 nt, Human
caaauggcccuuacagcu

SEQ ID NO: 225911 - RNA, 20 nt, Human
caaauggcccuuacagcuga

SEQ ID NO: 225912 - RNA, 22 nt, Human
cgcaaaggauuuaaaacugcuc

SEQ ID NO: 225913 - RNA, 22 nt, Human
cugcaaaauuaacuagucacac

SEQ ID NO: 225914 - RNA, 19 nt, Human
cuuaaucaaggcacaaagc

SEQ ID NO: 225915 - RNA, 19 nt, Human
gcacagcugucucuaggag

SEQ ID NO: 225916 - RNA, 25 nt, Human
ggcacaaagcaggaaaagugagcac

SEQ ID NO: 225917 - RNA, 21 nt, Human
guccagcagcuauauccacug

SEQ ID NO: 225918 - RNA, 25 nt, Human
uacaaugacaaggaauguaauuuuu

SEQ ID NO: 225919 - RNA, 21 nt, Human
ucaaauggcccuuacagcuga

SEQ ID NO: 225920 - RNA, 23 nt, Human
ucaaugauauggcacauccugca

SEQ ID NO: 225921 - RNA, 24 nt, Human
ucaguagccuuaaucaaggcacaa

SEQ ID NO: 225922 - RNA, 25 nt, Human
uccacagacacuuaaaauuccaaac

SEQ ID NO: 225923 - RNA, 21 nt, Human
uccuuuagcagcaaaugccgg

SEQ ID NO: 225924 - RNA, 25 nt, Human
ugaaggacaaaacauuuuccacaga

SEQ ID NO: 225925 - RNA, 18 nt, Human
ugacaaggaucuccaaaa

SEQ ID NO: 225926 - RNA, 20 nt, Human
ugacaaggaucuccaaaagu

SEQ ID NO: 225927 - RNA, 26 nt, Human
ugaugagguaugcaugcacgcagugu

SEQ ID NO: 225928 - RNA, 18 nt, Human
uggcucuggauugagucc

SEQ ID NO: 225929 - RNA, 24 nt, Human
uguguaaaugaaacaaaaugcuuc

SEQ ID NO: 225930 - RNA, 20 nt, Human
uuuacaaugacaaggaaugu

SEQ ID NO: 225931 - RNA, 23 nt, Human
uuuuccacagacacuuaaaauuc

SEQ ID NO: 225932 - RNA, 24 nt, Human
uuuuuuuuuuuuuuuuuucuucag

SEQ ID NO: 225933 - RNA, 22 nt, Human
aaaaaggagauaagccgcugga

SEQ ID NO: 225934 - RNA, 24 nt, Human
aaagugccaggauuacaggcauga

SEQ ID NO: 225935 - RNA, 18 nt, Human
aaaugcuguuuccgcccu

SEQ ID NO: 225936 - RNA, 18 nt, Human
aacaggcaaauucuuagu

SEQ ID NO: 225937 - RNA, 24 nt, Human
aaccucaggugguccacccaccuc

SEQ ID NO: 225938 - RNA, 20 nt, Human
aaccuccgccucccaggccc

SEQ ID NO: 225939 - RNA, 21 nt, Human
aagaaggguuacuaaaaagga

SEQ ID NO: 225940 - RNA, 18 nt, Human
aagaaguaaaguuugauc

SEQ ID NO: 225941 - RNA, 23 nt, Human
aagcagaaauuggaagaggggac

SEQ ID NO: 225942 - RNA, 19 nt, Human
aaggugcaccaguguggca

SEQ ID NO: 225943 - RNA, 21 nt, Human
acaaaacaggcccacugcaga

SEQ ID NO: 225944 - RNA, 23 nt, Human
acaagaacaggcaccuauucaag

SEQ ID NO: 225945 - RNA, 21 nt, Human
acagacaaaaggcaacaacug

SEQ ID NO: 225946 - RNA, 19 nt, Human
acauugcacuuaguaccuc

SEQ ID NO: 225947 - RNA, 24 nt, Human
accauguuggccaggcuggucucg

SEQ ID NO: 225948 - RNA, 25 nt, Human
acccaccucggccucccaaagugcc

SEQ ID NO: 225949 - RNA, 23 nt, Human
accucggccucccaaagugccag

SEQ ID NO: 225950 - RNA, 21 nt, Human
accugagucgccaccuuccug

SEQ ID NO: 225951 - RNA, 18 nt, Human
acgggguuccaccauguu

SEQ ID NO: 225952 - RNA, 24 nt, Human
acgggguuccaccauguuggccag

SEQ ID NO: 225953 - RNA, 19 nt, Human
acuaaaaaggagauaagcc

SEQ ID NO: 225954 - RNA, 18 nt, Human
acucugucacccaggcug

SEQ ID NO: 225955 - RNA, 24 nt, Human
acucugucacccaggcuggaaugc

SEQ ID NO: 225956 - RNA, 25 nt, Human
agaaagggagcacaggggaaggggg

SEQ ID NO: 225957 - RNA, 21 nt, Human
agaagaaggcaagggggaagg

SEQ ID NO: 225958 - RNA, 21 nt, Human
agaagugucaauucaaaaugu

SEQ ID NO: 225959 - RNA, 23 nt, Human
agaggcaugcaccaccacaccag

SEQ ID NO: 225960 - RNA, 24 nt, Human
agccgcuggacaacagaucuccau

SEQ ID NO: 225961 - RNA, 24 nt, Human
agcgggcggcggcggcggcggcgg

SEQ ID NO: 225962 - RNA, 23 nt, Human
aggacuagaggcaugcaccacca

SEQ ID NO: 225963 - RNA, 23 nt, Human
aggauuacaggcaugagucacca

SEQ ID NO: 225964 - RNA, 24 nt, Human
aggcaagggggaaggaagcaaggu

SEQ ID NO: 225965 - RNA, 19 nt, Human
agggagccacaguucuagg

SEQ ID NO: 225966 - RNA, 20 nt, Human
aggggaagggggagaagaag

SEQ ID NO: 225967 - RNA, 24 nt, Human
agggggaaggaagcaaggucacug

SEQ ID NO: 225968 - RNA, 19 nt, Human
agggggagaagaaggcaag

SEQ ID NO: 225969 - RNA, 24 nt, Human
aggugguccacccaccucggccuc

SEQ ID NO: 225970 - RNA, 22 nt, Human
aguacagacgggguuccaccau

SEQ ID NO: 225971 - RNA, 23 nt, Human
auaaaaugaagcucugaaucuca

SEQ ID NO: 225972 - RNA, 25 nt, Human
aucacacagcuauucuucaccagca

SEQ ID NO: 225973 - RNA, 19 nt, Human
aucucaagaaaauaugagg

SEQ ID NO: 225974 - RNA, 18 nt, Human
aucuguuaugucuucccu

SEQ ID NO: 225975 - RNA, 26 nt, Human
augcaccaccacaccaggcaaaccuu

SEQ ID NO: 225976 - RNA, 20 nt, Human
auuguucaacaagaagggag

SEQ ID NO: 225977 - RNA, 20 nt, Human
caaaacaggcccacugcaga

SEQ ID NO: 225978 - RNA, 24 nt, Human
caaagugccaggauuacaggcaug

SEQ ID NO: 225979 - RNA, 23 nt, Human
caaccuccgccucccaggcccaa

SEQ ID NO: 225980 - RNA, 24 nt, Human
caaccuccgccucccaggcccaag

SEQ ID NO: 225981 - RNA, 28 nt, Human
caagcgauucucgugccucagccucccg

SEQ ID NO: 225982 - RNA, 24 nt, Human
caaggaacuaaaacuuacaaacca

SEQ ID NO: 225983 - RNA, 22 nt, Human
caauacagacaaaaggcaacaa

SEQ ID NO: 225984 - RNA, 24 nt, Human
caauacagacaaaaggcaacaacc

SEQ ID NO: 225985 - RNA, 18 nt, Human
caccacaccaggcaaacc

SEQ ID NO: 225986 - RNA, 21 nt, Human
caccauguuggccaggcuggu

SEQ ID NO: 225987 - RNA, 24 nt, Human
caccauguuggccaggcuggucuc

SEQ ID NO: 225988 - RNA, 22 nt, Human
cacccaccucggccucccaaag

SEQ ID NO: 225989 - RNA, 23 nt, Human
cacccaccucggccucccaaagu

SEQ ID NO: 225990 - RNA, 20 nt, Human
cacguguaaccagcagaaaa

SEQ ID NO: 225991 - RNA, 23 nt, Human
cacucugucacccaggcuggaau

SEQ ID NO: 225992 - RNA, 24 nt, Human
cacucugucacccaggcuggaaug

SEQ ID NO: 225993 - RNA, 21 nt, Human
cacugagcaggucccaaaggc

SEQ ID NO: 225994 - RNA, 21 nt, Human
cacugcaaccuccgccuccca

SEQ ID NO: 225995 - RNA, 21 nt, Human
cagaaugcuaagacauugcag

SEQ ID NO: 225996 - RNA, 22 nt, Human
cagcaucuuaggcucugccugg

SEQ ID NO: 225997 - RNA, 26 nt, Human
cagcaucuuaggcucugccuggaggg

SEQ ID NO: 225998 - RNA, 19 nt, Human
cagcuccuucccucaacuc

SEQ ID NO: 225999 - RNA, 24 nt, Human
caggauuacaggcaugagucacca

SEQ ID NO: 226000 - RNA, 18 nt, Human
caggauuccuuugcuucc

SEQ ID NO: 226001 - RNA, 22 nt, Human
caggggaagggggagaagaagg

SEQ ID NO: 226002 - RNA, 24 nt, Human
caugcaccaccacaccaggcaaac

SEQ ID NO: 226003 - RNA, 28 nt, Human
caugcaccaccacaccaggcaaaccuuu

SEQ ID NO: 226004 - RNA, 24 nt, Human
cauguuggccaggcuggucucgaa

SEQ ID NO: 226005 - RNA, 24 nt, Human
ccaaagugccaggauuacaggcau

SEQ ID NO: 226006 - RNA, 22 nt, Human
cccacacaaggauguucagagu

SEQ ID NO: 226007 - RNA, 19 nt, Human
cccacacacacuuaugagc

SEQ ID NO: 226008 - RNA, 22 nt, Human
cccacaugggaaugcuuccagc

SEQ ID NO: 226009 - RNA, 20 nt, Human
cccugggaacugagcagcug

SEQ ID NO: 226010 - RNA, 24 nt, Human
ccgccucccaggcccaagcgauuc

SEQ ID NO: 226011 - RNA, 24 nt, Human
ccuaaccucaggugguccacccac

SEQ ID NO: 226012 - RNA, 21 nt, Human
cgagccgaaagcgggcggcgg

SEQ ID NO: 226013 - RNA, 20 nt, Human
cgggcggcggcggcggcggc

SEQ ID NO: 226014 - RNA, 24 nt, Human
cgggguuccaccauguuggccagg

SEQ ID NO: 226015 - RNA, 26 nt, Human
cuaaaacuuacaaaccaaacuaguaa

SEQ ID NO: 226016 - RNA, 19 nt, Human
cucacugagcaggucccaa

SEQ ID NO: 226017 - RNA, 24 nt, Human
cucacugcaaccuccgccucccag

SEQ ID NO: 226018 - RNA, 25 nt, Human
cucgugccucagccucccgaguagc

SEQ ID NO: 226019 - RNA, 25 nt, Human
cucucacacccacacacacuuauga

SEQ ID NO: 226020 - RNA, 23 nt, Human
cugcaaccuccgccucccaggcc

SEQ ID NO: 226021 - RNA, 20 nt, Human
cugcuaaggugacuccugau

SEQ ID NO: 226022 - RNA, 21 nt, Human
cuuacagacuuaggucuuuga

SEQ ID NO: 226023 - RNA, 19 nt, Human
gaacacaggcaccaucgug

SEQ ID NO: 226024 - RNA, 21 nt, Human
gaaccccuggcucagccauuc

SEQ ID NO: 226025 - RNA, 21 nt, Human
gaauccucucugcagcuuuuc

SEQ ID NO: 226026 - RNA, 22 nt, Human
gacacauucacagaacacaggc

SEQ ID NO: 226027 - RNA, 22 nt, Human
gacaggauggucaugguuuuga

SEQ ID NO: 226028 - RNA, 23 nt, Human
gacaggauggucaugguuuugag

SEQ ID NO: 226029 - RNA, 19 nt, Human
gagagaggagagaaaggga

SEQ ID NO: 226030 - RNA, 24 nt, Human
gagaugcuaauuaaaagauguuuc

SEQ ID NO: 226031 - RNA, 23 nt, Human
gagcagcugaguuaaaauauaac

SEQ ID NO: 226032 - RNA, 19 nt, Human
gagcaggucccaaaggcaa

SEQ ID NO: 226033 - RNA, 21 nt, Human
gagccgaaagcgggcggcggc

SEQ ID NO: 226034 - RNA, 24 nt, Human
gaguagccaggacuagaggcaugc

SEQ ID NO: 226035 - RNA, 18 nt, Human
gauuacaggcaugaguca

SEQ ID NO: 226036 - RNA, 21 nt, Human
gauuacaggcaugagucacca

SEQ ID NO: 226037 - RNA, 24 nt, Human
gauuacaggcaugagucaccauac

SEQ ID NO: 226038 - RNA, 21 nt, Human
gauucucgugccucagccucc

SEQ ID NO: 226039 - RNA, 20 nt, Human
gcaaccuccgccucccaggc

SEQ ID NO: 226040 - RNA, 26 nt, Human
gcagagacagccuccuuucuuccaca

SEQ ID NO: 226041 - RNA, 18 nt, Human
gcccaccuggggccugga

SEQ ID NO: 226042 - RNA, 18 nt, Human
gcccgagccgaaagcggg

SEQ ID NO: 226043 - RNA, 24 nt, Human
gcgauucucgugccucagccuccc

SEQ ID NO: 226044 - RNA, 20 nt, Human
gcggcggcggcggcggcggc

SEQ ID NO: 226045 - RNA, 20 nt, Human
gcggcggcggcggcggcggc

SEQ ID NO: 226046 - RNA, 20 nt, Human
gcggcggcggcggcggcggc

SEQ ID NO: 226047 - RNA, 20 nt, Human
gcggcggcggcggcggcggc

SEQ ID NO: 226048 - RNA, 20 nt, Human
gcggcggcggcggcggcggc

SEQ ID NO: 226049 - RNA, 20 nt, Human
gcggcggcggcggcggcggc

SEQ ID NO: 226050 - RNA, 23 nt, Human
gcggcggcggcggcggcggcggc

SEQ ID NO: 226051 - RNA, 23 nt, Human
gcggcggcggcggcggcggcggc

SEQ ID NO: 226052 - RNA, 24 nt, Human
gcggcggcggcggcggcggcggcg

SEQ ID NO: 226053 - RNA, 24 nt, Human
gcggcggcggcggcggcggcggcg

SEQ ID NO: 226054 - RNA, 24 nt, Human
gcggcggcggcggcggcggcggcg

SEQ ID NO: 226055 - RNA, 23 nt, Human
gcggcggcggcggcggcgggggc

SEQ ID NO: 226056 - RNA, 24 nt, Human
gcggcggcggcggcgggggcggcg

SEQ ID NO: 226057 - RNA, 19 nt, Human
ggauuacaggcaugaguca

SEQ ID NO: 226058 - RNA, 22 nt, Human
ggauuacaggcaugagucacca

SEQ ID NO: 226059 - RNA, 22 nt, Human
ggcagaccuggagacucacugu

SEQ ID NO: 226060 - RNA, 23 nt, Human
ggcggcggcggcggcggcggcgg

SEQ ID NO: 226061 - RNA, 23 nt, Human
ggcggcggcggcggcggcggcgg

SEQ ID NO: 226062 - RNA, 23 nt, Human
ggcggcggcggcggcggcggcgg

SEQ ID NO: 226063 - RNA, 23 nt, Human
ggcggcggcggcggcggcggcgg

SEQ ID NO: 226064 - RNA, 23 nt, Human
ggcggcggcggcggcggcggcgg

SEQ ID NO: 226065 - RNA, 18 nt, Human
gggcggcgaaccccuggc

SEQ ID NO: 226066 - RNA, 19 nt, Human
gggcggcggcggcggcggc

SEQ ID NO: 226067 - RNA, 24 nt, Human
gggcggcggcggcggcggcggcgg

SEQ ID NO: 226068 - RNA, 23 nt, Human
gggguuccaccauguuggccagg

SEQ ID NO: 226069 - RNA, 22 nt, Human
gugccucagccucccgaguagc

SEQ ID NO: 226070 - RNA, 24 nt, Human
gugguccacccaccucggccuccc

SEQ ID NO: 226071 - RNA, 26 nt, Human
guucaaccagauuaaguugguugauc

SEQ ID NO: 226072 - RNA, 18 nt, Human
guucuuggucucugucuc

SEQ ID NO: 226073 - RNA, 18 nt, Human
uaacucaaggcccaccug

SEQ ID NO: 226074 - RNA, 22 nt, Human
uacagacgggguuccaccaugu

SEQ ID NO: 226075 - RNA, 23 nt, Human
uacaggcaugagucaccauaccc

SEQ ID NO: 226076 - RNA, 24 nt, Human
uaguacagacgggguuccaccaug

SEQ ID NO: 226077 - RNA, 27 nt, Human
uaucgcacuuuaccuuacccaugacaa

SEQ ID NO: 226078 - RNA, 19 nt, Human
ucaagaaaauaugagggaa

SEQ ID NO: 226079 - RNA, 23 nt, Human
ucacagaacacaggcaccaucgu

SEQ ID NO: 226080 - RNA, 19 nt, Human
ucacccaggcuggaaugca

SEQ ID NO: 226081 - RNA, 26 nt, Human
ucacccaggcuggaaugcaguagugu

SEQ ID NO: 226082 - RNA, 19 nt, Human
ucacugcaaccuccgccuc

SEQ ID NO: 226083 - RNA, 24 nt, Human
ucacugcaaccuccgccucccagg

SEQ ID NO: 226084 - RNA, 25 nt, Human
ucacugcaaccuccgccucccaggc

SEQ ID NO: 226085 - RNA, 26 nt, Human
ucacugcaaccuccgccucccaggcc

SEQ ID NO: 226086 - RNA, 20 nt, Human
ucagaaggcaaaugcuguuu

SEQ ID NO: 226087 - RNA, 18 nt, Human
ucagagaaggcaaaggga

SEQ ID NO: 226088 - RNA, 19 nt, Human
ucagccauuccccgcugcc

SEQ ID NO: 226089 - RNA, 24 nt, Human
ucagccauuccccgcugccccgga

SEQ ID NO: 226090 - RNA, 21 nt, Human
ucagccucccgaguagccagg

SEQ ID NO: 226091 - RNA, 23 nt, Human
ucaggggaacaguucugaguuug

SEQ ID NO: 226092 - RNA, 18 nt, Human
uccacaaaacaggcccac

SEQ ID NO: 226093 - RNA, 22 nt, Human
uccacaaaacaggcccacugca

SEQ ID NO: 226094 - RNA, 18 nt, Human
uccagaaaugugcccugg

SEQ ID NO: 226095 - RNA, 19 nt, Human
ucccaaaggcagauccacu

SEQ ID NO: 226096 - RNA, 24 nt, Human
ucccaaagugccaggauuacaggc

SEQ ID NO: 226097 - RNA, 21 nt, Human
ucccaggcccaagcgauucuc

SEQ ID NO: 226098 - RNA, 19 nt, Human
ucccgaguagccaggacua

SEQ ID NO: 226099 - RNA, 19 nt, Human
ucccuacaagaacaggcac

SEQ ID NO: 226100 - RNA, 24 nt, Human
ucuauaccaauauggaacaaaacg

SEQ ID NO: 226101 - RNA, 23 nt, Human
ucucacucugucacccaggcugg

SEQ ID NO: 226102 - RNA, 24 nt, Human
ucucacucugucacccaggcugga

SEQ ID NO: 226103 - RNA, 26 nt, Human
ucucacucugucacccaggcuggaau

SEQ ID NO: 226104 - RNA, 27 nt, Human
ucucacucugucacccaggcuggaaug

SEQ ID NO: 226105 - RNA, 21 nt, Human
ucucaggaugcuacgguccug

SEQ ID NO: 226106 - RNA, 24 nt, Human
ucugucacccaggcuggaaugcag

SEQ ID NO: 226107 - RNA, 23 nt, Human
ucuuccacaaaacaggcccacug

SEQ ID NO: 226108 - RNA, 23 nt, Human
ugaaggcaggcaggauuccuuug

SEQ ID NO: 226109 - RNA, 24 nt, Human
ugaaucauucagaagcagaaauug

SEQ ID NO: 226110 - RNA, 18 nt, Human
ugacaugguguauggaca

SEQ ID NO: 226111 - RNA, 21 nt, Human
ugacaugguguauggacaugg

SEQ ID NO: 226112 - RNA, 19 nt, Human
ugacuccugauucugcccu

SEQ ID NO: 226113 - RNA, 22 nt, Human
ugagaagugucaauucaaaaug

SEQ ID NO: 226114 - RNA, 20 nt, Human
ugaggcaccgugccagcaag

SEQ ID NO: 226115 - RNA, 21 nt, Human
ugcaaagaggccaccgcuucu

SEQ ID NO: 226116 - RNA, 24 nt, Human
ugcaccaccacaccaggcaaaccu

SEQ ID NO: 226117 - RNA, 24 nt, Human
ugccaggauuacaggcaugaguca

SEQ ID NO: 226118 - RNA, 18 nt, Human
ugccucagccucccgagu

SEQ ID NO: 226119 - RNA, 24 nt, Human
ugccucagccucccgaguagccag

SEQ ID NO: 226120 - RNA, 22 nt, Human
uggacacauucacagaacacag

SEQ ID NO: 226121 - RNA, 24 nt, Human
uggccaggcuggucucgaaguccu

SEQ ID NO: 226122 - RNA, 22 nt, Human
ugggaaugcuuccagccuggau

SEQ ID NO: 226123 - RNA, 23 nt, Human
ugggccgaauccucucugcagcu

SEQ ID NO: 226124 - RNA, 24 nt, Human
ugguccacccaccucggccuccca

SEQ ID NO: 226125 - RNA, 19 nt, Human
uguaaagaacaggcuagaa

SEQ ID NO: 226126 - RNA, 19 nt, Human
uuaaaauauaacucaaggc

SEQ ID NO: 226127 - RNA, 24 nt, Human
uuaguacagacgggguuccaccau

SEQ ID NO: 226128 - RNA, 21 nt, Human
uucaaacaggcaaauucuuag

SEQ ID NO: 226129 - RNA, 21 nt, Human
uucaacaagaagggagcccca

SEQ ID NO: 226130 - RNA, 21 nt, Human
uucacagaacacaggcaccau

SEQ ID NO: 226131 - RNA, 21 nt, Human
uuccaccauguuggccaggcu

SEQ ID NO: 226132 - RNA, 21 nt, Human
uuggaagagauuuccucacug

SEQ ID NO: 226133 - RNA, 19 nt, Human
uuucucauuucucccuaca

SEQ ID NO: 226134 - RNA, 19 nt, Human
uuugacaggauggucaugg

SEQ ID NO: 226135 - RNA, 20 nt, Human
aaacacgcacacaaacacgc

SEQ ID NO: 226136 - RNA, 22 nt, Human
aaacacgcacacaaacacgcac

SEQ ID NO: 226137 - RNA, 22 nt, Human
aaagagcguacgcagugaccac

SEQ ID NO: 226138 - RNA, 25 nt, Human
aaauuuacuuaucacuugagauacc

SEQ ID NO: 226139 - RNA, 23 nt, Human
aacaaaggaauccaguggaggga

SEQ ID NO: 226140 - RNA, 28 nt, Human
aacacgcacacaaacacgcacacacaua

SEQ ID NO: 226141 - RNA, 24 nt, Human
aagcagucucccagucccagaaag

SEQ ID NO: 226142 - RNA, 23 nt, Human
aagcuggaaaagauugugccugg

SEQ ID NO: 226143 - RNA, 21 nt, Human
aaggagcccaagaggcugaau

SEQ ID NO: 226144 - RNA, 20 nt, Human
aaucaaauauuugauacacc

SEQ ID NO: 226145 - RNA, 24 nt, Human
aauccaguggagggacuuccguug

SEQ ID NO: 226146 - RNA, 19 nt, Human
acagaugaagggaaaaagc

SEQ ID NO: 226147 - RNA, 20 nt, Human
acauacacacauacacaaaa

SEQ ID NO: 226148 - RNA, 21 nt, Human
accaagcagucucccaguccc

SEQ ID NO: 226149 - RNA, 22 nt, Human
accaagcagucucccaguccca

SEQ ID NO: 226150 - RNA, 19 nt, Human
accaccucccacacccccc

SEQ ID NO: 226151 - RNA, 21 nt, Human
acccagcugcaggugcauuuc

SEQ ID NO: 226152 - RNA, 18 nt, Human
acccccgccaccaccucc

SEQ ID NO: 226153 - RNA, 20 nt, Human
accucugaucugaauccuga

SEQ ID NO: 226154 - RNA, 23 nt, Human
acgcacacacauacacacauaca

SEQ ID NO: 226155 - RNA, 21 nt, Human
acgcagccuggaggucccccu

SEQ ID NO: 226156 - RNA, 22 nt, Human
acggggucuaggcagcugcagg

SEQ ID NO: 226157 - RNA, 19 nt, Human
acuccugguggcccuguuc

SEQ ID NO: 226158 - RNA, 25 nt, Human
acuccugucccagccacagucgaac

SEQ ID NO: 226159 - RNA, 22 nt, Human
agagaaagagagacagagagac

SEQ ID NO: 226160 - RNA, 20 nt, Human
agcaaauggcaagugggugg

SEQ ID NO: 226161 - RNA, 21 nt, Human
aggacaggagcaaauggcaag

SEQ ID NO: 226162 - RNA, 19 nt, Human
aggcagcugcagggagaaa

SEQ ID NO: 226163 - RNA, 19 nt, Human
auaaaggaggcgaagaaga

SEQ ID NO: 226164 - RNA, 24 nt, Human
aucugucagucucaugguuucacc

SEQ ID NO: 226165 - RNA, 23 nt, Human
augacuccucggaggggacagaa

SEQ ID NO: 226166 - RNA, 21 nt, Human
caaaaccgcaggcaggagcuc

SEQ ID NO: 226167 - RNA, 25 nt, Human
cacaaaaccgcaggcaggagcuccu

SEQ ID NO: 226168 - RNA, 20 nt, Human
cacacacauacacacauaca

SEQ ID NO: 226169 - RNA, 22 nt, Human
cacaguucccauccaagguggg

SEQ ID NO: 226170 - RNA, 26 nt, Human
cacaugcacgcacacgcacacgcacc

SEQ ID NO: 226171 - RNA, 25 nt, Human
caccaccucccacaccccccauuuc

SEQ ID NO: 226172 - RNA, 21 nt, Human
caccucccacaccccccauuu

SEQ ID NO: 226173 - RNA, 25 nt, Human
cacgcacacacauacacacauacac

SEQ ID NO: 226174 - RNA, 27 nt, Human
cacgcacacgcacacgcaccaagcggc

SEQ ID NO: 226175 - RNA, 31 nt, Human
cacgcacacgcacaugcacgcacacgcacag

SEQ ID NO: 226176 - RNA, 28 nt, Human
cacgcacaugcacgcacacgcacacgca

SEQ ID NO: 226177 - RNA, 18 nt, Human
cagccucggacugggggg

SEQ ID NO: 226178 - RNA, 25 nt, Human
caggcgagggcaucuccccaacacg

SEQ ID NO: 226179 - RNA, 25 nt, Human
caugcacgcacacgcacacgcacca

SEQ ID NO: 226180 - RNA, 21 nt, Human
cauuucagcucaacagaaauu

SEQ ID NO: 226181 - RNA, 20 nt, Human
ccaagugaugaaugagguga

SEQ ID NO: 226182 - RNA, 19 nt, Human
ccagaaagugcucaggggc

SEQ ID NO: 226183 - RNA, 21 nt, Human
ccagaaagugcucaggggcug

SEQ ID NO: 226184 - RNA, 23 nt, Human
ccauccgaagccaaggggacaga

SEQ ID NO: 226185 - RNA, 22 nt, Human
ccaucugccagauucucacccc

SEQ ID NO: 226186 - RNA, 20 nt, Human
cccaacgacagcacucuuca

SEQ ID NO: 226187 - RNA, 18 nt, Human
ccccaacgacagcacucu

SEQ ID NO: 226188 - RNA, 25 nt, Human
cccccaggcgcacgucuucaauccg

SEQ ID NO: 226189 - RNA, 20 nt, Human
cccccgagccccuccgcagc

SEQ ID NO: 226190 - RNA, 21 nt, Human
cccguccuccaaaauauacac

SEQ ID NO: 226191 - RNA, 18 nt, Human
cccugcgcucaggccacc

SEQ ID NO: 226192 - RNA, 23 nt, Human
cccuguggagguaaacacgcaca

SEQ ID NO: 226193 - RNA, 25 nt, Human
ccucagggaacaccaagcagucucc

SEQ ID NO: 226194 - RNA, 25 nt, Human
ccugaaggaaagagaauaacccccg

SEQ ID NO: 226195 - RNA, 20 nt, Human
ccugcccccgagccccuccg

SEQ ID NO: 226196 - RNA, 22 nt, Human
cgaagcaggcaggagcagccuc

SEQ ID NO: 226197 - RNA, 21 nt, Human
cgaccauaccuugggcccagc

SEQ ID NO: 226198 - RNA, 23 nt, Human
cgaccauaccuugggcccagccu

SEQ ID NO: 226199 - RNA, 19 nt, Human
cgagaaagaggucaguggg

SEQ ID NO: 226200 - RNA, 20 nt, Human
cgauguguccaagugaugaa

SEQ ID NO: 226201 - RNA, 21 nt, Human
cgcacacaaacacgcacacac

SEQ ID NO: 226202 - RNA, 24 nt, Human
cgcacacaaacacgcacacacaua

SEQ ID NO: 226203 - RNA, 22 nt, Human
cgcacacacauacacacauaca

SEQ ID NO: 226204 - RNA, 20 nt, Human
cgcaggcaggagcuccuccu

SEQ ID NO: 226205 - RNA, 22 nt, Human
cgcgaauaaauaacaugaauua

SEQ ID NO: 226206 - RNA, 20 nt, Human
cugcccccgagccccuccgc

SEQ ID NO: 226207 - RNA, 20 nt, Human
cugcucgcuaggucgggauc

SEQ ID NO: 226208 - RNA, 21 nt, Human
cuuccugcccccgagccccuc

SEQ ID NO: 226209 - RNA, 21 nt, Human
gaaauuccuccauccgaagcc

SEQ ID NO: 226210 - RNA, 22 nt, Human
gaagggcaugagcuauguuggu

SEQ ID NO: 226211 - RNA, 18 nt, Human
gaauaaauaacaugaauu

SEQ ID NO: 226212 - RNA, 21 nt, Human
gaaugacauugacuccuccca

SEQ ID NO: 226213 - RNA, 20 nt, Human
gacagaaacaaaggaaucca

SEQ ID NO: 226214 - RNA, 22 nt, Human
gacguccgcgaauaaauaacau

SEQ ID NO: 226215 - RNA, 18 nt, Human
gagaaagaggucaguggg

SEQ ID NO: 226216 - RNA, 20 nt, Human
gaggggacagaaacaaagga

SEQ ID NO: 226217 - RNA, 25 nt, Human
gcacacaaacacgcacacacauaca

SEQ ID NO: 226218 - RNA, 29 nt, Human
gcacacacauacacacauacacaaaaccg

SEQ ID NO: 226219 - RNA, 24 nt, Human
gccaccaccucccacaccccccau

SEQ ID NO: 226220 - RNA, 20 nt, Human
gccaccuggugaauuucuac

SEQ ID NO: 226221 - RNA, 23 nt, Human
gcccccgagccccuccgcagccu

SEQ ID NO: 226222 - RNA, 21 nt, Human
gcucgcuaggucgggaucagc

SEQ ID NO: 226223 - RNA, 22 nt, Human
gcuggggccugcaagcugcugg

SEQ ID NO: 226224 - RNA, 22 nt, Human
gcuguuccauuuccugcagguu

SEQ ID NO: 226225 - RNA, 24 nt, Human
ggaaggacaggagcaaauggcaag

SEQ ID NO: 226226 - RNA, 26 nt, Human
ggagaagauggagguuauggagugcg

SEQ ID NO: 226227 - RNA, 22 nt, Human
ggagcuccuccuccgaccauac

SEQ ID NO: 226228 - RNA, 19 nt, Human
ggcccagacggcucaggcg

SEQ ID NO: 226229 - RNA, 21 nt, Human
gggacugucuucucaggcacu

SEQ ID NO: 226230 - RNA, 24 nt, Human
gggcaugagcuauguuggugaggu

SEQ ID NO: 226231 - RNA, 21 nt, Human
gggcuggggccugcaagcugc

SEQ ID NO: 226232 - RNA, 24 nt, Human
gguaacaggcaaagcuggaaaaga

SEQ ID NO: 226233 - RNA, 22 nt, Human
gucaggaugucucuuguccgcg

SEQ ID NO: 226234 - RNA, 22 nt, Human
uaaaaagccagucaaugaacau

SEQ ID NO: 226235 - RNA, 22 nt, Human
uaaauaaagaccauagcaacac

SEQ ID NO: 226236 - RNA, 19 nt, Human
uaacaggcaaagcuggaaa

SEQ ID NO: 226237 - RNA, 19 nt, Human
uaacccccgccaccaccuc

SEQ ID NO: 226238 - RNA, 21 nt, Human
uaacccccgccaccaccuccc

SEQ ID NO: 226239 - RNA, 26 nt, Human
uaacccccgccaccaccucccacacc

SEQ ID NO: 226240 - RNA, 20 nt, Human
uaaggaguaucccccuagga

SEQ ID NO: 226241 - RNA, 22 nt, Human
uacacaaaaccgcaggcaggac

SEQ ID NO: 226242 - RNA, 23 nt, Human
uacacacauacacaaaaccgcag

SEQ ID NO: 226243 - RNA, 18 nt, Human
uaccuagagacauuuugg

SEQ ID NO: 226244 - RNA, 23 nt, Human
uaccuagagacauuuugggccau

SEQ ID NO: 226245 - RNA, 25 nt, Human
uagcaacacacgagaauuugguccu

SEQ ID NO: 226246 - RNA, 22 nt, Human
ucaaucaaauauuugauacacc

SEQ ID NO: 226247 - RNA, 18 nt, Human
ucaccccaacgacagcag

SEQ ID NO: 226248 - RNA, 21 nt, Human
ucagaaacagggguaacaggc

SEQ ID NO: 226249 - RNA, 18 nt, Human
ucagacccaagcuugauc

SEQ ID NO: 226250 - RNA, 24 nt, Human
uccaaaauauacacuuaaaaagcc

SEQ ID NO: 226251 - RNA, 20 nt, Human
uccacaaacgagaaagaggu

SEQ ID NO: 226252 - RNA, 20 nt, Human
ucccagccacagucgaaccu

SEQ ID NO: 226253 - RNA, 21 nt, Human
ucccagccacagucgaaccuc

SEQ ID NO: 226254 - RNA, 21 nt, Human
ucccagucccagaaagugcuc

SEQ ID NO: 226255 - RNA, 19 nt, Human
ucccccugcgcucaggcca

SEQ ID NO: 226256 - RNA, 19 nt, Human
uccucagggaacaccaagc

SEQ ID NO: 226257 - RNA, 20 nt, Human
uccucggaggggacagaaac

SEQ ID NO: 226258 - RNA, 21 nt, Human
uccugagucucaaauaaucuc

SEQ ID NO: 226259 - RNA, 24 nt, Human
uccugcccccgagccccuccgcag

SEQ ID NO: 226260 - RNA, 30 nt, Human
ucucaccccugcacacacgcacacgcacag

SEQ ID NO: 226261 - RNA, 23 nt, Human
ucucaggcacuggcuaccuuccc

SEQ ID NO: 226262 - RNA, 19 nt, Human
ucugccagauucucacccc

SEQ ID NO: 226263 - RNA, 22 nt, Human
ugaaaauggggaguugccuuga

SEQ ID NO: 226264 - RNA, 19 nt, Human
ugaagcagaaaugacagug

SEQ ID NO: 226265 - RNA, 22 nt, Human
ugaagggcaugagcuauguugg

SEQ ID NO: 226266 - RNA, 20 nt, Human
ugaauuucuacacacaacuc

SEQ ID NO: 226267 - RNA, 20 nt, Human
ugacaagacaaugcaaaggc

SEQ ID NO: 226268 - RNA, 22 nt, Human
ugacaagacaaugcaaaggcga

SEQ ID NO: 226269 - RNA, 19 nt, Human
ugagggaggugugacaaga

SEQ ID NO: 226270 - RNA, 25 nt, Human
ugcacacacgcacacgcacaugcac

SEQ ID NO: 226271 - RNA, 25 nt, Human
ugcacacacgcacacgcacaugcag

SEQ ID NO: 226272 - RNA, 20 nt, Human
ugcagguuccaaggcgaugg

SEQ ID NO: 226273 - RNA, 20 nt, Human
ugcauuguuaauuguugucc

SEQ ID NO: 226274 - RNA, 21 nt, Human
ugccccaucccaggagucuau

SEQ ID NO: 226275 - RNA, 24 nt, Human
ugcccccgagccccuccgcagccu

SEQ ID NO: 226276 - RNA, 18 nt, Human
ugcuauaagacugugagg

SEQ ID NO: 226277 - RNA, 22 nt, Human
uggagaguggggcuguguccac

SEQ ID NO: 226278 - RNA, 26 nt, Human
ugggagaagauggagguuauggagug

SEQ ID NO: 226279 - RNA, 21 nt, Human
uggggccugcaagcugcuggc

SEQ ID NO: 226280 - RNA, 21 nt, Human
uggguagaaaagggacugucu

SEQ ID NO: 226281 - RNA, 23 nt, Human
ugucugaggcucagaaaguggag

SEQ ID NO: 226282 - RNA, 23 nt, Human
ugugacagaugaagggaaaaagc

SEQ ID NO: 226283 - RNA, 24 nt, Human
uguuuuauauauauauuuauauau

SEQ ID NO: 226284 - RNA, 20 nt, Human
uuauauauuacauauguccc

SEQ ID NO: 226285 - RNA, 24 nt, Human
uuaugaccucuucacccguccucc

SEQ ID NO: 226286 - RNA, 23 nt, Human
uucagcucaacagaaauuccucc

SEQ ID NO: 226287 - RNA, 23 nt, Human
uucauauucuaggaacuggagac

SEQ ID NO: 226288 - RNA, 19 nt, Human
uuccuuuauugucaacugc

SEQ ID NO: 226289 - RNA, 19 nt, Human
uugaaaauggggaguugcc

SEQ ID NO: 226290 - RNA, 24 nt, Human
uugauacaccaaaauuaaaaggag

SEQ ID NO: 226291 - RNA, 24 nt, Human
uuguuguccuaaauaaagaccaua

SEQ ID NO: 226292 - RNA, 22 nt, Human
aacaacagggguuggggaggga

SEQ ID NO: 226293 - RNA, 18 nt, Human
aagaagaaacauucaccc

SEQ ID NO: 226294 - RNA, 18 nt, Human
acagaguugagggcgccc

SEQ ID NO: 226295 - RNA, 20 nt, Human
agaaacauucacccuccucc

SEQ ID NO: 226296 - RNA, 20 nt, Human
agaagagagacauagcagca

SEQ ID NO: 226297 - RNA, 20 nt, Human
agauacuugagaauaagaca

SEQ ID NO: 226298 - RNA, 20 nt, Human
agcagcccuuccauuuuacc

SEQ ID NO: 226299 - RNA, 18 nt, Human
aguagaugagaaagaaga

SEQ ID NO: 226300 - RNA, 19 nt, Human
aguaucagagaccacaggu

SEQ ID NO: 226301 - RNA, 20 nt, Human
caacaacagggguuggggag

SEQ ID NO: 226302 - RNA, 24 nt, Human
cacccuccucccuauugccccaaa

SEQ ID NO: 226303 - RNA, 20 nt, Human
cagaguacaaagagauacag

SEQ ID NO: 226304 - RNA, 24 nt, Human
cccuuccauuuuaccuucugugcu

SEQ ID NO: 226305 - RNA, 24 nt, Human
ccggcguggggcugggacucuucu

SEQ ID NO: 226306 - RNA, 23 nt, Human
cggcguggggcugggacucuucu

SEQ ID NO: 226307 - RNA, 21 nt, Human
cucagcagaggccgaggcgga

SEQ ID NO: 226308 - RNA, 18 nt, Human
gaaacauucacccuccuc

SEQ ID NO: 226309 - RNA, 18 nt, Human
gagaauaagacagaagag

SEQ ID NO: 226310 - RNA, 22 nt, Human
gaggacaggugcucagucucug

SEQ ID NO: 226311 - RNA, 21 nt, Human
gcagcccuuccauuuuaccuu

SEQ ID NO: 226312 - RNA, 21 nt, Human
gccccaaauaaggaagguaga

SEQ ID NO: 226313 - RNA, 20 nt, Human
gcguggggcugggacucuuc

SEQ ID NO: 226314 - RNA, 21 nt, Human
gcguggggcugggacucuucu

SEQ ID NO: 226315 - RNA, 20 nt, Human
gcucagucucuggggacaga

SEQ ID NO: 226316 - RNA, 20 nt, Human
gcugcagggguggugugugc

SEQ ID NO: 226317 - RNA, 26 nt, Human
ggcugcagggguggugugugcuccag

SEQ ID NO: 226318 - RNA, 20 nt, Human
ggggcugggacucuucuugg

SEQ ID NO: 226319 - RNA, 19 nt, Human
ggguuggggagggaguuag

SEQ ID NO: 226320 - RNA, 24 nt, Human
ggucacaacccucuagcucccauu

SEQ ID NO: 226321 - RNA, 21 nt, Human
gguggugugugcuccagagga

SEQ ID NO: 226322 - RNA, 22 nt, Human
guggggcugggacucuucuugg

SEQ ID NO: 226323 - RNA, 30 nt, Human
gugugugcauguuugugugcgugugugcgg

SEQ ID NO: 226324 - RNA, 18 nt, Human
uaagacagaagagagaca

SEQ ID NO: 226325 - RNA, 24 nt, Human
uaagagaagacaucaaacauagua

SEQ ID NO: 226326 - RNA, 24 nt, Human
uacaaagagauacagaguaaguaa

SEQ ID NO: 226327 - RNA, 20 nt, Human
uacucagugacuaacaccac

SEQ ID NO: 226328 - RNA, 21 nt, Human
uagcagcccuuccauuuuacc

SEQ ID NO: 226329 - RNA, 24 nt, Human
uaguacaguccaacaacagggguu

SEQ ID NO: 226330 - RNA, 24 nt, Human
ucacccuccucccuauugccccaa

SEQ ID NO: 226331 - RNA, 19 nt, Human
uccauuuuaccuucugugc

SEQ ID NO: 226332 - RNA, 21 nt, Human
ucugugaccucuacucaguga

SEQ ID NO: 226333 - RNA, 19 nt, Human
ugcagccguggguguggga

SEQ ID NO: 226334 - RNA, 26 nt, Human
ugcgugugugcauguuugugugcgug

SEQ ID NO: 226335 - RNA, 23 nt, Human
ugggcugcagggguggugugugc

SEQ ID NO: 226336 - RNA, 22 nt, Human
ugguagccggcguggggcuggg

SEQ ID NO: 226337 - RNA, 22 nt, Human
ugugcgugugugcgugugugua

SEQ ID NO: 226338 - RNA, 22 nt, Human
ugugugcaugcgugugugcaug

SEQ ID NO: 226339 - RNA, 25 nt, Human
ugugugcaugcgugugugcauguuu

SEQ ID NO: 226340 - RNA, 19 nt, Human
ugugugcauguuugugugc

SEQ ID NO: 226341 - RNA, 22 nt, Human
ugugugcgugugugcgugugug

SEQ ID NO: 226342 - RNA, 24 nt, Human
ugugugcgugugugcgugugugua

SEQ ID NO: 226343 - RNA, 24 nt, Human
ugugugugcaugcgugugugcaug

SEQ ID NO: 226344 - RNA, 21 nt, Human
ugugugugugcaugcgugugu

SEQ ID NO: 226345 - RNA, 23 nt, Human
ugugugugugcaugcgugugugc

SEQ ID NO: 226346 - RNA, 24 nt, Human
ugugugugugcaugcgugugugca

SEQ ID NO: 226347 - RNA, 26 nt, Human
uuagcagcccuuccauuuuaccuucu

SEQ ID NO: 226348 - RNA, 25 nt, Human
uucacccuccucccuauugccccaa

SEQ ID NO: 226349 - RNA, 24 nt, Human
uuccauuuuaccuucugugcuaua

SEQ ID NO: 226350 - RNA, 23 nt, Human
uuugugugugugcaugcgugugu

SEQ ID NO: 226351 - RNA, 22 nt, Human
aaacuguccuuuuucccuccua

SEQ ID NO: 226352 - RNA, 22 nt, Human
aaagacuaaauuuaagacacga

SEQ ID NO: 226353 - RNA, 20 nt, Human
aaugacugcuugauaccaug

SEQ ID NO: 226354 - RNA, 21 nt, Human
acaggccagguauaauuuaua

SEQ ID NO: 226355 - RNA, 22 nt, Human
acauacacaaaaaauacaaaaa

SEQ ID NO: 226356 - RNA, 21 nt, Human
acuguccuuuuucccuccuaa

SEQ ID NO: 226357 - RNA, 18 nt, Human
agaugccaaaauugcacu

SEQ ID NO: 226358 - RNA, 23 nt, Human
agcuguacaggccagguauaauu

SEQ ID NO: 226359 - RNA, 26 nt, Human
augccaaaauugcacucuaguugugu

SEQ ID NO: 226360 - RNA, 24 nt, Human
auggcagccauggcggcggcagcg

SEQ ID NO: 226361 - RNA, 24 nt, Human
auggcggcggcagcggcggcggca

SEQ ID NO: 226362 - RNA, 20 nt, Human
auggcggcggcagcggcggg

SEQ ID NO: 226363 - RNA, 22 nt, Human
auugcacucuaguuguguuggg

SEQ ID NO: 226364 - RNA, 21 nt, Human
cacaaaaaauacaaaaaguac

SEQ ID NO: 226365 - RNA, 21 nt, Human
cacaguaaagacuaaauuuaa

SEQ ID NO: 226366 - RNA, 23 nt, Human
cagcggcggcggcaccggggagg

SEQ ID NO: 226367 - RNA, 25 nt, Human
caguaaagacuaaauuuaagacacg

SEQ ID NO: 226368 - RNA, 25 nt, Human
cgcagccggggccgcggccgggagc

SEQ ID NO: 226369 - RNA, 20 nt, Human
cggcagccguuaacccuaau

SEQ ID NO: 226370 - RNA, 22 nt, Human
cggcggcaccggggagagcguc

SEQ ID NO: 226371 - RNA, 28 nt, Human
cggcggcagcggcggcggcaccggggag

SEQ ID NO: 226372 - RNA, 19 nt, Human
cggcuccucagcguccccc

SEQ ID NO: 226373 - RNA, 21 nt, Human
cuccuaagaugccaaaauugc

SEQ ID NO: 226374 - RNA, 18 nt, Human
gaagagccggcgccggca

SEQ ID NO: 226375 - RNA, 24 nt, Human
gauuacuuuuuaacaccugugggu

SEQ ID NO: 226376 - RNA, 20 nt, Human
gccggcagccguuaacccua

SEQ ID NO: 226377 - RNA, 21 nt, Human
ggcggcagcggcggcggcacc

SEQ ID NO: 226378 - RNA, 27 nt, Human
ggggagccgggacuugaagagccggcg

SEQ ID NO: 226379 - RNA, 21 nt, Human
gguggaggcggccggggagcc

SEQ ID NO: 226380 - RNA, 20 nt, Human
uaaacauacacaaaaaauac

SEQ ID NO: 226381 - RNA, 25 nt, Human
uaaacauacacaaaaaauacaaaaa

SEQ ID NO: 226382 - RNA, 21 nt, Human
uaaagacuaaauuuaagacac

SEQ ID NO: 226383 - RNA, 26 nt, Human
uacaagaagaguagguaggaaacagc

SEQ ID NO: 226384 - RNA, 26 nt, Human
uacacaaaaaauacaaaaaguacagu

SEQ ID NO: 226385 - RNA, 18 nt, Human
uacaguccuauaagguag

SEQ ID NO: 226386 - RNA, 21 nt, Human
uagcuuggcacaguaaagacu

SEQ ID NO: 226387 - RNA, 22 nt, Human
ucacuuccgauccaucauggcc

SEQ ID NO: 226388 - RNA, 19 nt, Human
uccccggguggaggcggcc

SEQ ID NO: 226389 - RNA, 24 nt, Human
uccuaagaugccaaaauugcacuc

SEQ ID NO: 226390 - RNA, 24 nt, Human
uuaacccuaaugcucacuuccgau

SEQ ID NO: 226391 - RNA, 24 nt, Human
aaaaaaaaaauggaaacuguaggg

SEQ ID NO: 226392 - RNA, 22 nt, Human
aaaacaaauagcagcacaguca

SEQ ID NO: 226393 - RNA, 25 nt, Human
aaaagaccugaaacugguguacugc

SEQ ID NO: 226394 - RNA, 22 nt, Human
aaaaucacccuggaaagaaucu

SEQ ID NO: 226395 - RNA, 22 nt, Human
aaacaaaacauacauaaacaaa

SEQ ID NO: 226396 - RNA, 20 nt, Human
aaacauacauaaacaaagug

SEQ ID NO: 226397 - RNA, 22 nt, Human
aaacucuacacagcucaaaaga

SEQ ID NO: 226398 - RNA, 24 nt, Human
aaagaaugaaaaaaauuuaaacaa

SEQ ID NO: 226399 - RNA, 20 nt, Human
aacaaauaaauuaagucaaa

SEQ ID NO: 226400 - RNA, 24 nt, Human
aacacacaucugcaguacacagga

SEQ ID NO: 226401 - RNA, 18 nt, Human
aacaugauaggauaggag

SEQ ID NO: 226402 - RNA, 28 nt, Human
aacauucuccuaauuuaccaauccacca

SEQ ID NO: 226403 - RNA, 20 nt, Human
aagcaaacauaucaacaagg

SEQ ID NO: 226404 - RNA, 19 nt, Human
aagcagcucggaggugaau

SEQ ID NO: 226405 - RNA, 19 nt, Human
aagcuucagggcacagugc

SEQ ID NO: 226406 - RNA, 23 nt, Human
aauguuucccuuugaaacaugaa

SEQ ID NO: 226407 - RNA, 23 nt, Human
aauuuuguacaagaaauguuugg

SEQ ID NO: 226408 - RNA, 21 nt, Human
acaaagugcaacauuuaacaa

SEQ ID NO: 226409 - RNA, 23 nt, Human
acacacacacacacacacacaca

SEQ ID NO: 226410 - RNA, 23 nt, Human
acacacacacacacacacacaca

SEQ ID NO: 226411 - RNA, 23 nt, Human
acacacacacacacacacacaca

SEQ ID NO: 226412 - RNA, 23 nt, Human
acacacacacacacacacacaca

SEQ ID NO: 226413 - RNA, 23 nt, Human
acacacacacacacacacacaca

SEQ ID NO: 226414 - RNA, 23 nt, Human
acacacacacacacacacacaca

SEQ ID NO: 226415 - RNA, 23 nt, Human
acacacacacacacacacacaca

SEQ ID NO: 226416 - RNA, 23 nt, Human
acacacacacacacacacacaca

SEQ ID NO: 226417 - RNA, 23 nt, Human
acacacauacacacacacacaca

SEQ ID NO: 226418 - RNA, 21 nt, Human
acacagcucaaaagaccugaa

SEQ ID NO: 226419 - RNA, 20 nt, Human
acaccccggaggccgagucg

SEQ ID NO: 226420 - RNA, 24 nt, Human
acagaaacucuacacagcucaaaa

SEQ ID NO: 226421 - RNA, 19 nt, Human
acagaaugcccuauucccc

SEQ ID NO: 226422 - RNA, 21 nt, Human
acagauccaaagaugugacca

SEQ ID NO: 226423 - RNA, 20 nt, Human
acaggaaaccagacaguuga

SEQ ID NO: 226424 - RNA, 18 nt, Human
acccagggaaaaaucacc

SEQ ID NO: 226425 - RNA, 22 nt, Human
acccccaaauuugucaaaacaa

SEQ ID NO: 226426 - RNA, 19 nt, Human
agaaaccacccaacacccc

SEQ ID NO: 226427 - RNA, 20 nt, Human
agaccaugaucaucugccuc

SEQ ID NO: 226428 - RNA, 25 nt, Human
agagaggaaguagugaggagagggg

SEQ ID NO: 226429 - RNA, 24 nt, Human
agaugggacagugcacugcccaga

SEQ ID NO: 226430 - RNA, 26 nt, Human
agcaagcagcucggaggugaauuuua

SEQ ID NO: 226431 - RNA, 26 nt, Human
agggagggggcacggggauggguggg

SEQ ID NO: 226432 - RNA, 18 nt, Human
agucaaaagcugcauaua

SEQ ID NO: 226433 - RNA, 25 nt, Human
aguggaucuucugcaaccaucuccu

SEQ ID NO: 226434 - RNA, 24 nt, Human
aguucccagacauaaaucuugaua

SEQ ID NO: 226435 - RNA, 21 nt, Human
auccugcagauaaagauuauu

SEQ ID NO: 226436 - RNA, 18 nt, Human
aucgcgagcccggccggc

SEQ ID NO: 226437 - RNA, 24 nt, Human
auuguucugucuacuaccugcugu

SEQ ID NO: 226438 - RNA, 18 nt, Human
auuuaaggauccauuuga

SEQ ID NO: 226439 - RNA, 20 nt, Human
caaaucagaagcaaacauau

SEQ ID NO: 226440 - RNA, 18 nt, Human
caacuggaaguaaggguu

SEQ ID NO: 226441 - RNA, 22 nt, Human
caagaaguagcaugaaauauaa

SEQ ID NO: 226442 - RNA, 24 nt, Human
caagagccaaaaaccauuacugac

SEQ ID NO: 226443 - RNA, 23 nt, Human
caaugaacaguauuuaaaacuga

SEQ ID NO: 226444 - RNA, 18 nt, Human
cacacacacacacacaca

SEQ ID NO: 226445 - RNA, 20 nt, Human
cacacacacacacacacaca

SEQ ID NO: 226446 - RNA, 20 nt, Human
cacacacacacacacacaca

SEQ ID NO: 226447 - RNA, 20 nt, Human
cacacacacacacacacaca

SEQ ID NO: 226448 - RNA, 20 nt, Human
cacacacacacacacacaca

SEQ ID NO: 226449 - RNA, 20 nt, Human
cacacacacacacacacaca

SEQ ID NO: 226450 - RNA, 20 nt, Human
cacacacacacacacacaca

SEQ ID NO: 226451 - RNA, 20 nt, Human
cacacacacacacacacaca

SEQ ID NO: 226452 - RNA, 20 nt, Human
cacacacacacacacacaca

SEQ ID NO: 226453 - RNA, 20 nt, Human
cacacacacacacacacaca

SEQ ID NO: 226454 - RNA, 20 nt, Human
cacacacacacacacacaca

SEQ ID NO: 226455 - RNA, 20 nt, Human
cacacacacacacacacaca

SEQ ID NO: 226456 - RNA, 22 nt, Human
cacacacacacacacacacaca

SEQ ID NO: 226457 - RNA, 22 nt, Human
cacacacacacacacacacaca

SEQ ID NO: 226458 - RNA, 24 nt, Human
cacagaaacucuacacagcucaaa

SEQ ID NO: 226459 - RNA, 21 nt, Human
cacggggauggguggggggcc

SEQ ID NO: 226460 - RNA, 21 nt, Human
cagaaaccacccaacaccccg

SEQ ID NO: 226461 - RNA, 26 nt, Human
cagaaaccacccaacaccccggaggc

SEQ ID NO: 226462 - RNA, 23 nt, Human
cagaaacucuacacagcucaaaa

SEQ ID NO: 226463 - RNA, 18 nt, Human
cagauccaaagaugugac

SEQ ID NO: 226464 - RNA, 18 nt, Human
cagcaauacccacucaag

SEQ ID NO: 226465 - RNA, 18 nt, Human
cagcacagucaguuuccc

SEQ ID NO: 226466 - RNA, 21 nt, Human
caggaaccacccagaaaccac

SEQ ID NO: 226467 - RNA, 19 nt, Human
caguacacaggacacacuu

SEQ ID NO: 226468 - RNA, 23 nt, Human
cauauaaaccaucuggcuguucu

SEQ ID NO: 226469 - RNA, 21 nt, Human
ccacccagaaaccacccaaca

SEQ ID NO: 226470 - RNA, 25 nt, Human
ccacccagaaaccacccaacacccc

SEQ ID NO: 226471 - RNA, 25 nt, Human
ccaggaaccacccagaaaccaccca

SEQ ID NO: 226472 - RNA, 25 nt, Human
cccaaaucagaagcaaacauaucaa

SEQ ID NO: 226473 - RNA, 19 nt, Human
cccaccugcccgcgaccac

SEQ ID NO: 226474 - RNA, 20 nt, Human
cccccaaauuugucaaaacc

SEQ ID NO: 226475 - RNA, 19 nt, Human
ccccccggcccaccugccc

SEQ ID NO: 226476 - RNA, 21 nt, Human
ccccucaaaccccccggacaa

SEQ ID NO: 226477 - RNA, 19 nt, Human
ccccugcccagcgcccccc

SEQ ID NO: 226478 - RNA, 21 nt, Human
ccgccccugcccagcgccccc

SEQ ID NO: 226479 - RNA, 22 nt, Human
ccgcuccggccccuccggcugc

SEQ ID NO: 226480 - RNA, 18 nt, Human
ccggccugcccuggcccu

SEQ ID NO: 226481 - RNA, 20 nt, Human
ccggcugagcagccccggcc

SEQ ID NO: 226482 - RNA, 19 nt, Human
ccucucucuccuuauuccc

SEQ ID NO: 226483 - RNA, 23 nt, Human
ccugcagccuccgacgacgcuuc

SEQ ID NO: 226484 - RNA, 21 nt, Human
ccuggcccugccccgccccug

SEQ ID NO: 226485 - RNA, 24 nt, Human
ccuggcccugccccgccccugccc

SEQ ID NO: 226486 - RNA, 22 nt, Human
cgcuccggccccuccggcugca

SEQ ID NO: 226487 - RNA, 18 nt, Human
cggccggcugagcagccc

SEQ ID NO: 226488 - RNA, 22 nt, Human
cucaaacaacauucuccuaauu

SEQ ID NO: 226489 - RNA, 21 nt, Human
cuccacccucugccuuuccca

SEQ ID NO: 226490 - RNA, 22 nt, Human
cuccaggaaccacccagaaacc

SEQ ID NO: 226491 - RNA, 24 nt, Human
cuccccucaaaccccccggacaag

SEQ ID NO: 226492 - RNA, 20 nt, Human
cuccggcugcagaccggccu

SEQ ID NO: 226493 - RNA, 24 nt, Human
cucucucuccuuauuccccaccaa

SEQ ID NO: 226494 - RNA, 19 nt, Human
cugcagccuccgacgacgc

SEQ ID NO: 226495 - RNA, 24 nt, Human
cuggaaagaaucuaaaacaaucua

SEQ ID NO: 226496 - RNA, 25 nt, Human
gaaaucuucccuccacccucugccu

SEQ ID NO: 226497 - RNA, 23 nt, Human
gaacaugguccugauauaauaac

SEQ ID NO: 226498 - RNA, 19 nt, Human
gaaugcccuauuccccuua

SEQ ID NO: 226499 - RNA, 20 nt, Human
gaccaugaucaucugccucc

SEQ ID NO: 226500 - RNA, 21 nt, Human
gaccaugaucaucugccucca

SEQ ID NO: 226501 - RNA, 22 nt, Human
gagcacacaucuguacacacag

SEQ ID NO: 226502 - RNA, 25 nt, Human
gagcagccccggccgcuccgagccc

SEQ ID NO: 226503 - RNA, 22 nt, Human
gaguacccauacaucuucauuu

SEQ ID NO: 226504 - RNA, 21 nt, Human
gcaaaaccugccccacaagga

SEQ ID NO: 226505 - RNA, 21 nt, Human
gcacugcccagaggaggcucc

SEQ ID NO: 226506 - RNA, 18 nt, Human
gccagcucacucaucuug

SEQ ID NO: 226507 - RNA, 20 nt, Human
gccggggccgggaacgacga

SEQ ID NO: 226508 - RNA, 21 nt, Human
gcuacauucuagacaaacauu

SEQ ID NO: 226509 - RNA, 24 nt, Human
ggcuagacaaugaagugaaaucuu

SEQ ID NO: 226510 - RNA, 21 nt, Human
gggaacgacgagggaggaggc

SEQ ID NO: 226511 - RNA, 18 nt, Human
gggcacggggaugggugg

SEQ ID NO: 226512 - RNA, 23 nt, Human
gggcacggggauggguggggggc

SEQ ID NO: 226513 - RNA, 19 nt, Human
ggggauggguggggggccg

SEQ ID NO: 226514 - RNA, 21 nt, Human
ggggauggguggggggccggg

SEQ ID NO: 226515 - RNA, 27 nt, Human
ggggccggggccgggaacgacgaggga

SEQ ID NO: 226516 - RNA, 18 nt, Human
ggggggccggggccggga

SEQ ID NO: 226517 - RNA, 20 nt, Human
ggggggccggggccgggaac

SEQ ID NO: 226518 - RNA, 18 nt, Human
ggguggggggccggggcc

SEQ ID NO: 226519 - RNA, 21 nt, Human
gguagggagggggcacgggga

SEQ ID NO: 226520 - RNA, 19 nt, Human
guaaaauggaacuacaagc

SEQ ID NO: 226521 - RNA, 20 nt, Human
gucuuugggguaauuuguuu

SEQ ID NO: 226522 - RNA, 19 nt, Human
gugccaaagaaagaauuca

SEQ ID NO: 226523 - RNA, 21 nt, Human
guuucuuuagcuugcucaaga

SEQ ID NO: 226524 - RNA, 19 nt, Human
uaaauucugauuucuuaau

SEQ ID NO: 226525 - RNA, 21 nt, Human
uaacaaaagcaaagugugcag

SEQ ID NO: 226526 - RNA, 22 nt, Human
uaacaaaagcaaagugugcagc

SEQ ID NO: 226527 - RNA, 20 nt, Human
uacacacauacacacacaca

SEQ ID NO: 226528 - RNA, 22 nt, Human
uaguaaguggaucuucugcaac

SEQ ID NO: 226529 - RNA, 18 nt, Human
uaguugcugcagguucaa

SEQ ID NO: 226530 - RNA, 20 nt, Human
uauaaaaaaaaaauggaaac

SEQ ID NO: 226531 - RNA, 26 nt, Human
uauaaaccaccauucuccccucaaac

SEQ ID NO: 226532 - RNA, 22 nt, Human
uauuaccugauaagcuuugcaa

SEQ ID NO: 226533 - RNA, 21 nt, Human
uauuccccaccaaaaacaaaa

SEQ ID NO: 226534 - RNA, 23 nt, Human
uauuucuucauuuaucccaauau

SEQ ID NO: 226535 - RNA, 19 nt, Human
ucaauagaauuugucgucc

SEQ ID NO: 226536 - RNA, 18 nt, Human
ucaaugcacaguucuuag

SEQ ID NO: 226537 - RNA, 21 nt, Human
ucaauuuccaaacaaaaagua

SEQ ID NO: 226538 - RNA, 23 nt, Human
ucaauuuuauuuuccacuuuuag

SEQ ID NO: 226539 - RNA, 19 nt, Human
ucagaagcaaacauaucaa

SEQ ID NO: 226540 - RNA, 21 nt, Human
ucaguaguaaguggaucuucu

SEQ ID NO: 226541 - RNA, 21 nt, Human
uccaaaugucuccugcccugc

SEQ ID NO: 226542 - RNA, 19 nt, Human
uccccaccaaaaacaaaac

SEQ ID NO: 226543 - RNA, 22 nt, Human
uccccaccaaaaacaaaacaua

SEQ ID NO: 226544 - RNA, 18 nt, Human
uccccuuauaucugcaca

SEQ ID NO: 226545 - RNA, 21 nt, Human
ucccuccacccucugccuuuc

SEQ ID NO: 226546 - RNA, 18 nt, Human
ucggugguaaugguucuc

SEQ ID NO: 226547 - RNA, 22 nt, Human
ucuaaaaaccugaaaauugcac

SEQ ID NO: 226548 - RNA, 22 nt, Human
ucuacagaaugcccuauucccc

SEQ ID NO: 226549 - RNA, 21 nt, Human
ucuaguaauugacaaaaacac

SEQ ID NO: 226550 - RNA, 18 nt, Human
ucucccgaaggcuuccuu

SEQ ID NO: 226551 - RNA, 21 nt, Human
ucuggcuguucucuuagagca

SEQ ID NO: 226552 - RNA, 23 nt, Human
ugaaaaaaauuuaaacaaaugca

SEQ ID NO: 226553 - RNA, 23 nt, Human
ugaaacaugaaagugccaagcaa

SEQ ID NO: 226554 - RNA, 28 nt, Human
ugaaaucuucccuccacccucugccuuu

SEQ ID NO: 226555 - RNA, 21 nt, Human
ugaacaguauuuaaaacugau

SEQ ID NO: 226556 - RNA, 23 nt, Human
ugacaaaaacacauuuggcauua

SEQ ID NO: 226557 - RNA, 19 nt, Human
ugacaugcuacguggaguc

SEQ ID NO: 226558 - RNA, 22 nt, Human
ugaggcagaccaugaucaucug

SEQ ID NO: 226559 - RNA, 20 nt, Human
ugcaaaaccugccccacaag

SEQ ID NO: 226560 - RNA, 27 nt, Human
ugccaaagaaagaauucauauaaacag

SEQ ID NO: 226561 - RNA, 22 nt, Human
ugcccagcgccccccggcccac

SEQ ID NO: 226562 - RNA, 19 nt, Human
ugccccgccccugcccagc

SEQ ID NO: 226563 - RNA, 24 nt, Human
ugcccuggcccugccccgccccug

SEQ ID NO: 226564 - RNA, 24 nt, Human
uggaaugauguuggauuucuucag

SEQ ID NO: 226565 - RNA, 21 nt, Human
uggcuguucucuuagagcauc

SEQ ID NO: 226566 - RNA, 21 nt, Human
uggugccaaagaaagaauuca

SEQ ID NO: 226567 - RNA, 23 nt, Human
ugguuucuuuagcuugcucaaga

SEQ ID NO: 226568 - RNA, 23 nt, Human
uguacacacagaaacucuacaca

SEQ ID NO: 226569 - RNA, 24 nt, Human
uguagggggggaaaaauaaaggaa

SEQ ID NO: 226570 - RNA, 24 nt, Human
uuauuccccaccaaaaacaaaaca

SEQ ID NO: 226571 - RNA, 19 nt, Human
uucaagaaguagcaugaaa

SEQ ID NO: 226572 - RNA, 22 nt, Human
uucauggagcggcgcuuacuuc

SEQ ID NO: 226573 - RNA, 19 nt, Human
uuggugauuaauguagucc

SEQ ID NO: 226574 - RNA, 21 nt, Human
uuggugccaaagaaagaauuc

SEQ ID NO: 226575 - RNA, 21 nt, Human
uuuaaugugaaagcuacugua

SEQ ID NO: 226576 - RNA, 21 nt, Human
uuuacauuuaaaguacaggga

SEQ ID NO: 226577 - RNA, 19 nt, Human
uuuagaaguagaaacgggg

SEQ ID NO: 226578 - RNA, 19 nt, Human
uuugaacccuauagcagca

SEQ ID NO: 226579 - RNA, 18 nt, Human
uuugcaaaaccugcccca

SEQ ID NO: 226580 - RNA, 25 nt, Human
uuugcagcauuuucagcacuucuga

SEQ ID NO: 226581 - RNA, 19 nt, Human
aaaacaaacacagacccac

SEQ ID NO: 226582 - RNA, 19 nt, Human
aaacaaacacagacccaca

SEQ ID NO: 226583 - RNA, 23 nt, Human
aaaguacccucacacccagaggc

SEQ ID NO: 226584 - RNA, 24 nt, Human
aagauccaaaauuaacccaacccc

SEQ ID NO: 226585 - RNA, 22 nt, Human
aagccuccagcuccucccacag

SEQ ID NO: 226586 - RNA, 24 nt, Human
agccuccagcuccucccacagcuu

SEQ ID NO: 226587 - RNA, 23 nt, Human
agcugagauuacacauggaaaca

SEQ ID NO: 226588 - RNA, 23 nt, Human
aguagcuuuucagcauucaguuu

SEQ ID NO: 226589 - RNA, 24 nt, Human
auaaaaacaaacacagacccacaa

SEQ ID NO: 226590 - RNA, 21 nt, Human
auccaaaauuaacccaaccca

SEQ ID NO: 226591 - RNA, 24 nt, Human
caaacacagacccacaauaacauc

SEQ ID NO: 226592 - RNA, 24 nt, Human
cacagcuucugugccccaaaacac

SEQ ID NO: 226593 - RNA, 19 nt, Human
cacccagaggcgaugacag

SEQ ID NO: 226594 - RNA, 21 nt, Human
cagacccgcccagagucgccu

SEQ ID NO: 226595 - RNA, 22 nt, Human
cagcagcggcgcugugguuacc

SEQ ID NO: 226596 - RNA, 21 nt, Human
cagcggcagcggcguggagag

SEQ ID NO: 226597 - RNA, 21 nt, Human
cagcggcguggagaggauggg

SEQ ID NO: 226598 - RNA, 27 nt, Human
cagcuaacaacauauaaaaauaaaaac

SEQ ID NO: 226599 - RNA, 26 nt, Human
ccagaggcgaugacaguccugaggcc

SEQ ID NO: 226600 - RNA, 21 nt, Human
ccagucuaguagcuuuucagc

SEQ ID NO: 226601 - RNA, 24 nt, Human
cccaaaacacuggagcggcccaga

SEQ ID NO: 226602 - RNA, 20 nt, Human
ccccaaaacacuggagcggc

SEQ ID NO: 226603 - RNA, 26 nt, Human
cgacgcaugcgcuugcucugcaccuc

SEQ ID NO: 226604 - RNA, 19 nt, Human
cgcccagagucgccuaagc

SEQ ID NO: 226605 - RNA, 23 nt, Human
cgccuaagccgggccgucacgac

SEQ ID NO: 226606 - RNA, 22 nt, Human
cggcagcggcagcggcguggag

SEQ ID NO: 226607 - RNA, 22 nt, Human
cuccagcuccucccacagcuuc

SEQ ID NO: 226608 - RNA, 23 nt, Human
cugcaaggcggggcagcagcggc

SEQ ID NO: 226609 - RNA, 22 nt, Human
gaagccuccagcuccucccaca

SEQ ID NO: 226610 - RNA, 19 nt, Human
gacgguggccaaaguaccc

SEQ ID NO: 226611 - RNA, 20 nt, Human
gagaggaugggguaucuuga

SEQ ID NO: 226612 - RNA, 20 nt, Human
gaggaugggguaucuugaga

SEQ ID NO: 226613 - RNA, 18 nt, Human
gcagcagcggcgcugugg

SEQ ID NO: 226614 - RNA, 25 nt, Human
gcagcuaacaacauauaaaaauaaa

SEQ ID NO: 226615 - RNA, 23 nt, Human
ggagaggaugggguaucuugaga

SEQ ID NO: 226616 - RNA, 21 nt, Human
ggcggcagcggcagcggcgug

SEQ ID NO: 226617 - RNA, 19 nt, Human
gggcagcagcggcgcugug

SEQ ID NO: 226618 - RNA, 23 nt, Human
uaaaaauaaaaacaaacacagac

SEQ ID NO: 226619 - RNA, 19 nt, Human
uaccacggugaagccucca

SEQ ID NO: 226620 - RNA, 24 nt, Human
uaccacggugaagccuccagcucc

SEQ ID NO: 226621 - RNA, 22 nt, Human
uacccucacacccagaggcgau

SEQ ID NO: 226622 - RNA, 21 nt, Human
uagcuuuucagcauucaguuu

SEQ ID NO: 226623 - RNA, 21 nt, Human
uccagcuccucccacagcuuc

SEQ ID NO: 226624 - RNA, 22 nt, Human
ugccccaaaacacuggagcggg

SEQ ID NO: 226625 - RNA, 22 nt, Human
ugguuugaugagugaacaaugu

SEQ ID NO: 226626 - RNA, 25 nt, Human
uuaacagaagacagaggggcugggg

SEQ ID NO: 226627 - RNA, 26 nt, Human
uugaugagugaacaaugucaguauca

SEQ ID NO: 226628 - RNA, 22 nt, Human
aagagcagccacccccgccuuu

SEQ ID NO: 226629 - RNA, 20 nt, Human
aagcugaggagaggggccga

SEQ ID NO: 226630 - RNA, 20 nt, Human
acccgcuggcugccucugcc

SEQ ID NO: 226631 - RNA, 19 nt, Human
agaaucccccacccgcugg

SEQ ID NO: 226632 - RNA, 24 nt, Human
agaaucccccacccgcuggcugcc

SEQ ID NO: 226633 - RNA, 23 nt, Human
agccauaaacacagcacggcccc

SEQ ID NO: 226634 - RNA, 19 nt, Human
agccggccuggcggaggca

SEQ ID NO: 226635 - RNA, 21 nt, Human
agcuucuccuucagguguucu

SEQ ID NO: 226636 - RNA, 22 nt, Human
aggcagcuccacgccgccgccu

SEQ ID NO: 226637 - RNA, 19 nt, Human
aggcuccucgcccaccccc

SEQ ID NO: 226638 - RNA, 19 nt, Human
agggggcuggccagcucug

SEQ ID NO: 226639 - RNA, 21 nt, Human
auaaacacagcacggccccgu

SEQ ID NO: 226640 - RNA, 20 nt, Human
auccccggcucgggcuccgg

SEQ ID NO: 226641 - RNA, 20 nt, Human
caccaggcagccggccuggc

SEQ ID NO: 226642 - RNA, 21 nt, Human
caccaggcagccggccuggcg

SEQ ID NO: 226643 - RNA, 20 nt, Human
cacccgcuggcugccucugc

SEQ ID NO: 226644 - RNA, 20 nt, Human
cacggccccguggcgggagg

SEQ ID NO: 226645 - RNA, 24 nt, Human
cacucucgccucuaccuccggggg

SEQ ID NO: 226646 - RNA, 18 nt, Human
cagcagggacaggccagu

SEQ ID NO: 226647 - RNA, 20 nt, Human
cagccggccuggcggaggca

SEQ ID NO: 226648 - RNA, 24 nt, Human
caggcaggugagcgagcagcagaa

SEQ ID NO: 226649 - RNA, 18 nt, Human
ccacccccgccuuuccgc

SEQ ID NO: 226650 - RNA, 24 nt, Human
ccacgcuaagggcucggcacugag

SEQ ID NO: 226651 - RNA, 26 nt, Human
ccagaggcuccucgcccacccccuaa

SEQ ID NO: 226652 - RNA, 21 nt, Human
ccagcugcgggaacccuccuu

SEQ ID NO: 226653 - RNA, 19 nt, Human
ccaguccccaugguucuug

SEQ ID NO: 226654 - RNA, 21 nt, Human
ccaguccccaugguucuuggg

SEQ ID NO: 226655 - RNA, 21 nt, Human
cccacccccuaaggagggggc

SEQ ID NO: 226656 - RNA, 18 nt, Human
cccacucuccacaggccc

SEQ ID NO: 226657 - RNA, 23 nt, Human
cccagaggcuccucgcccacccc

SEQ ID NO: 226658 - RNA, 23 nt, Human
cccagcugcgggaacccuccuug

SEQ ID NO: 226659 - RNA, 21 nt, Human
ccccagcugcgggaacccucc

SEQ ID NO: 226660 - RNA, 18 nt, Human
cccgcucgcgccccuccc

SEQ ID NO: 226661 - RNA, 28 nt, Human
cccggcccacucuccacaggccccgcag

SEQ ID NO: 226662 - RNA, 22 nt, Human
ccgccuccuccucggccagccc

SEQ ID NO: 226663 - RNA, 22 nt, Human
ccggcccacucuccacaggccc

SEQ ID NO: 226664 - RNA, 20 nt, Human
ccggcccggcccgccggcag

SEQ ID NO: 226665 - RNA, 23 nt, Human
ccuccacacucccgcccuccuca

SEQ ID NO: 226666 - RNA, 18 nt, Human
ccucggccagcccgcucg

SEQ ID NO: 226667 - RNA, 22 nt, Human
ccugccaggaagagcagccacc

SEQ ID NO: 226668 - RNA, 21 nt, Human
ccugggccuggcuaaugagcu

SEQ ID NO: 226669 - RNA, 18 nt, Human
ccuugaaggagaggggcg

SEQ ID NO: 226670 - RNA, 20 nt, Human
ccuugaaggagaggggcggg

SEQ ID NO: 226671 - RNA, 21 nt, Human
cgagagaccagcgagccaggc

SEQ ID NO: 226672 - RNA, 21 nt, Human
cgcccggggcucggcccggcc

SEQ ID NO: 226673 - RNA, 21 nt, Human
cgccucuaccuccgggggucc

SEQ ID NO: 226674 - RNA, 19 nt, Human
cggccgggcuggcuggggc

SEQ ID NO: 226675 - RNA, 18 nt, Human
cggugccccccagcucag

SEQ ID NO: 226676 - RNA, 20 nt, Human
cucagagccacagccgagag

SEQ ID NO: 226677 - RNA, 19 nt, Human
cuccacacucccgcccucc

SEQ ID NO: 226678 - RNA, 20 nt, Human
cuccacgccgccgccuccuc

SEQ ID NO: 226679 - RNA, 24 nt, Human
cuccuucagguguucuaccugcag

SEQ ID NO: 226680 - RNA, 19 nt, Human
cuggcuaaugagcuucucc

SEQ ID NO: 226681 - RNA, 19 nt, Human
cuggcuggggcuggggcgg

SEQ ID NO: 226682 - RNA, 24 nt, Human
cuucugaacauguuucucaucuuu

SEQ ID NO: 226683 - RNA, 19 nt, Human
cuuugaggggagacggggc

SEQ ID NO: 226684 - RNA, 25 nt, Human
gcacuggaguccucgucaaccggag

SEQ ID NO: 226685 - RNA, 22 nt, Human
gccagcccgcucgcgccccucc

SEQ ID NO: 226686 - RNA, 24 nt, Human
gcccaguucucaaccuccccgggc

SEQ ID NO: 226687 - RNA, 19 nt, Human
gcgcccggggcucggcccg

SEQ ID NO: 226688 - RNA, 23 nt, Human
gcuggcugccucugccagccaua

SEQ ID NO: 226689 - RNA, 20 nt, Human
ggaggcaggauccaggcguc

SEQ ID NO: 226690 - RNA, 20 nt, Human
ggcaggugagcgagcagcag

SEQ ID NO: 226691 - RNA, 21 nt, Human
ggcccaguucgcugauggccc

SEQ ID NO: 226692 - RNA, 20 nt, Human
ggcggccgggcuggcugggg

SEQ ID NO: 226693 - RNA, 21 nt, Human
gggcugggcgagcugcacuuc

SEQ ID NO: 226694 - RNA, 23 nt, Human
ggggcccaguucgcugauggccc

SEQ ID NO: 226695 - RNA, 25 nt, Human
guucuugggucugcccagaggcucc

SEQ ID NO: 226696 - RNA, 21 nt, Human
uaaaaauggcuaagcuuccaa

SEQ ID NO: 226697 - RNA, 24 nt, Human
uaaugagcuucuccuucagguguu

SEQ ID NO: 226698 - RNA, 18 nt, Human
ucagagccacagccgaga

SEQ ID NO: 226699 - RNA, 26 nt, Human
ucagagccacagccgagagacaccgu

SEQ ID NO: 226700 - RNA, 23 nt, Human
uccacacucccgcccuccucacg

SEQ ID NO: 226701 - RNA, 21 nt, Human
uccucggggcaccaggcagcc

SEQ ID NO: 226702 - RNA, 20 nt, Human
uccuugaaggagaggggcgg

SEQ ID NO: 226703 - RNA, 18 nt, Human
ucggcacugagcuagggc

SEQ ID NO: 226704 - RNA, 25 nt, Human
ucuccaagucggugccccccagcuc

SEQ ID NO: 226705 - RNA, 25 nt, Human
ucuccacaggccccgcagcgagggc

SEQ ID NO: 226706 - RNA, 22 nt, Human
ucugcccagaggcuccucgccc

SEQ ID NO: 226707 - RNA, 21 nt, Human
ucuuugaggggagacggggca

SEQ ID NO: 226708 - RNA, 18 nt, Human
ugagcgagcagcagaauc

SEQ ID NO: 226709 - RNA, 22 nt, Human
ugagcuagggcugggcgagcug

SEQ ID NO: 226710 - RNA, 22 nt, Human
ugccaggaagagcagccacccc

SEQ ID NO: 226711 - RNA, 22 nt, Human
ugcccagaggcuccucgcccac

SEQ ID NO: 226712 - RNA, 20 nt, Human
uggcuaagcuuccaaaaguu

SEQ ID NO: 226713 - RNA, 22 nt, Human
uggcucccagguuccacguccu

SEQ ID NO: 226714 - RNA, 23 nt, Human
uucagagggaagaaaauucgaga

SEQ ID NO: 226715 - RNA, 19 nt, Human
uuccggggccagcccaguc

SEQ ID NO: 226716 - RNA, 23 nt, Human
uuuuguguaaaaaggcuucuuuu

SEQ ID NO: 226717 - RNA, 24 nt, Human
uuuuuuuuuuuguguaaaaaggcu

SEQ ID NO: 226718 - RNA, 19 nt, Human
uuuuuuuuuuuuuuugugu

SEQ ID NO: 226719 - RNA, 19 nt, Human
uuuuuuuuuuuuuuuuugu

SEQ ID NO: 226720 - RNA, 20 nt, Human
uuuuuuuuuuuuuuuuuugg

SEQ ID NO: 226721 - RNA, 18 nt, Human
aaugccuuggcgaacacc

SEQ ID NO: 226722 - RNA, 25 nt, Human
caaaggaaacaaaaauaacaaggac

SEQ ID NO: 226723 - RNA, 24 nt, Human
caguaauauuuucaaaaaccuguu

SEQ ID NO: 226724 - RNA, 20 nt, Human
caucaaguaaauuacaaagg

SEQ ID NO: 226725 - RNA, 26 nt, Human
cucauaaugccuuggcgaacaccaau

SEQ ID NO: 226726 - RNA, 20 nt, Human
uagagucucauaaugccuug

SEQ ID NO: 226727 - RNA, 27 nt, Human
uauacaguaauauuuucaaaaaccugu

SEQ ID NO: 226728 - RNA, 21 nt, Human
ugaacaacuauacaguaauau

SEQ ID NO: 226729 - RNA, 28 nt, Human
ugaagauauaaacucaucaaguaaauua

SEQ ID NO: 226730 - RNA, 19 nt, Human
uuacaaaggaaacaaaaau

SEQ ID NO: 226731 - RNA, 21 nt, Human
aacccugaccucuuuuuuuuu

SEQ ID NO: 226732 - RNA, 22 nt, Human
acccagaggcagagacaggagc

SEQ ID NO: 226733 - RNA, 21 nt, Human
accuuggguuuuggaaaaaga

SEQ ID NO: 226734 - RNA, 20 nt, Human
agaggcugccacugcuuucc

SEQ ID NO: 226735 - RNA, 23 nt, Human
aggacuggggcauggggcggggu

SEQ ID NO: 226736 - RNA, 19 nt, Human
agggugucugccagcacuu

SEQ ID NO: 226737 - RNA, 24 nt, Human
auauuugugguguaaaccccagag

SEQ ID NO: 226738 - RNA, 23 nt, Human
cacaaaucuguggacagcacacc

SEQ ID NO: 226739 - RNA, 26 nt, Human
cacagcuucacauugugaaggaggcc

SEQ ID NO: 226740 - RNA, 19 nt, Human
cacaggcccccuuccuggu

SEQ ID NO: 226741 - RNA, 18 nt, Human
cacccaugugacugcagg

SEQ ID NO: 226742 - RNA, 19 nt, Human
cagaccccaccaccuccug

SEQ ID NO: 226743 - RNA, 26 nt, Human
caugacccagaggcagagacaggagc

SEQ ID NO: 226744 - RNA, 23 nt, Human
ccacugcuuuccuggggagcuug

SEQ ID NO: 226745 - RNA, 20 nt, Human
cccaugugacugcagggcag

SEQ ID NO: 226746 - RNA, 27 nt, Human
ccccaccaccuccuguuggguuaucug

SEQ ID NO: 226747 - RNA, 24 nt, Human
ccccagaggcugccacugcuuucc

SEQ ID NO: 226748 - RNA, 18 nt, Human
ccgcucuguccuggguga

SEQ ID NO: 226749 - RNA, 21 nt, Human
ccuuggcgccacugcacccac

SEQ ID NO: 226750 - RNA, 18 nt, Human
cggggcugugggaagggu

SEQ ID NO: 226751 - RNA, 18 nt, Human
cggggugcggagggccug

SEQ ID NO: 226752 - RNA, 21 nt, Human
cgucagaccccaccaccuccu

SEQ ID NO: 226753 - RNA, 21 nt, Human
cuaggccccuacagccucggc

SEQ ID NO: 226754 - RNA, 27 nt, Human
cuuccugguuaagguuuuuuuuuugcu

SEQ ID NO: 226755 - RNA, 19 nt, Human
gagggccuggagagaggcc

SEQ ID NO: 226756 - RNA, 21 nt, Human
ggacuggggcauggggcgggg

SEQ ID NO: 226757 - RNA, 23 nt, Human
ggacuucuaggccccuacagccu

SEQ ID NO: 226758 - RNA, 21 nt, Human
gggagaaggggaacaggcagg

SEQ ID NO: 226759 - RNA, 21 nt, Human
gggcauggggcggggugcgga

SEQ ID NO: 226760 - RNA, 22 nt, Human
gggcggggugcggagggccugg

SEQ ID NO: 226761 - RNA, 20 nt, Human
gggcuggaccacagcggggc

SEQ ID NO: 226762 - RNA, 22 nt, Human
ggggaacaggcaggggugggaa

SEQ ID NO: 226763 - RNA, 26 nt, Human
ggguuuuggaaaaagauugcauagcu

SEQ ID NO: 226764 - RNA, 20 nt, Human
guguuggggaggcaggcagg

SEQ ID NO: 226765 - RNA, 28 nt, Human
ucacaggcccccuuccugguuaagguuu

SEQ ID NO: 226766 - RNA, 23 nt, Human
ucagaccccaccaccuccuguug

SEQ ID NO: 226767 - RNA, 18 nt, Human
ucccggggcuggaccaca

SEQ ID NO: 226768 - RNA, 19 nt, Human
uccuaaccuucacaggccc

SEQ ID NO: 226769 - RNA, 19 nt, Human
uccuaaccuucacaggccc

SEQ ID NO: 226770 - RNA, 18 nt, Human
uccugggugaccagggug

SEQ ID NO: 226771 - RNA, 26 nt, Human
ucuuggggggguggggagcauuucug

SEQ ID NO: 226772 - RNA, 20 nt, Human
ugacccagaggcagagacag

SEQ ID NO: 226773 - RNA, 19 nt, Human
ugacugcagggcaggaugg

SEQ ID NO: 226774 - RNA, 19 nt, Human
ugccacugcuuuccugggg

SEQ ID NO: 226775 - RNA, 25 nt, Human
ugcggagggccuggagagaggccau

SEQ ID NO: 226776 - RNA, 19 nt, Human
uggacagcacaccagugag

SEQ ID NO: 226777 - RNA, 24 nt, Human
uggacuucuaggccccuacagccu

SEQ ID NO: 226778 - RNA, 21 nt, Human
uggagagaggccauggguccc

SEQ ID NO: 226779 - RNA, 20 nt, Human
uggaguaggaaaggacuggg

SEQ ID NO: 226780 - RNA, 26 nt, Human
uggggggguggggagcauuucuggag

SEQ ID NO: 226781 - RNA, 22 nt, Human
uggguuuuggaaaaagauugca

SEQ ID NO: 226782 - RNA, 20 nt, Human
uuggcgccacugcacccaca

SEQ ID NO: 226783 - RNA, 19 nt, Human
uuugcugaaagggccacag

SEQ ID NO: 226784 - RNA, 21 nt, Human
uuuucccucuugggggggugg

SEQ ID NO: 226785 - RNA, 20 nt, Human
uuuuccgcucuguccugggu

SEQ ID NO: 226786 - RNA, 18 nt, Human
acugcugacagaagacug

SEQ ID NO: 226787 - RNA, 19 nt, Human
agaacugugggcuaagcaa

SEQ ID NO: 226788 - RNA, 20 nt, Human
gagaggcacauucagauuug

SEQ ID NO: 226789 - RNA, 20 nt, Human
gagccucuuguauguuugga

SEQ ID NO: 226790 - RNA, 23 nt, Human
gagggagccucuuguauguuugg

SEQ ID NO: 226791 - RNA, 19 nt, Human
ggagccucuuguauguuug

SEQ ID NO: 226792 - RNA, 22 nt, Human
ggaguguguuuuuucuccagca

SEQ ID NO: 226793 - RNA, 20 nt, Human
gggcuaagcaaaggagugug

SEQ ID NO: 226794 - RNA, 24 nt, Human
gucaagugaaauggagaacugugg

SEQ ID NO: 226795 - RNA, 18 nt, Human
guggaacagcaugaggga

SEQ ID NO: 226796 - RNA, 19 nt, Human
uauuugaaggauggaaaac

SEQ ID NO: 226797 - RNA, 21 nt, Human
uauuugaaggauggaaaacua

SEQ ID NO: 226798 - RNA, 21 nt, Human
ucagauuccagcugcugguac

SEQ ID NO: 226799 - RNA, 21 nt, Human
ucagugugauugcagccucaa

SEQ ID NO: 226800 - RNA, 19 nt, Human
ucuccagcaggcagugggg

SEQ ID NO: 226801 - RNA, 22 nt, Human
ucuuguauguuuggaauuguga

SEQ ID NO: 226802 - RNA, 18 nt, Human
ugaaauggagaacugugg

SEQ ID NO: 226803 - RNA, 19 nt, Human
ugacagaagacugaaagcu

SEQ ID NO: 226804 - RNA, 24 nt, Human
ugacagaagacugaaagcuagucu

SEQ ID NO: 226805 - RNA, 22 nt, Human
uggaacaacacgugucuaagug

SEQ ID NO: 226806 - RNA, 23 nt, Human
ugugaguuccucagugugauugc

SEQ ID NO: 226807 - RNA, 20 nt, Human
uuguauguuuggaauuguga

SEQ ID NO: 226808 - RNA, 21 nt, Human
uuguauguuuggaauugugag

SEQ ID NO: 226809 - RNA, 18 nt, Human
acugcugacagaagacug

SEQ ID NO: 226810 - RNA, 19 nt, Human
agaacugugggcuaagcaa

SEQ ID NO: 226811 - RNA, 18 nt, Human
caagugaaauggagaacu

SEQ ID NO: 226812 - RNA, 20 nt, Human
gagaggcacauucagauuug

SEQ ID NO: 226813 - RNA, 20 nt, Human
gagccucuuguauguuugga

SEQ ID NO: 226814 - RNA, 23 nt, Human
gagggagccucuuguauguuugg

SEQ ID NO: 226815 - RNA, 19 nt, Human
ggagccucuuguauguuug

SEQ ID NO: 226816 - RNA, 22 nt, Human
ggaguguguuuuuucuccagca

SEQ ID NO: 226817 - RNA, 20 nt, Human
gggcuaagcaaaggagugug

SEQ ID NO: 226818 - RNA, 18 nt, Human
guggaacagcaugaggga

SEQ ID NO: 226819 - RNA, 19 nt, Human
uauuugaaggauggaaaac

SEQ ID NO: 226820 - RNA, 21 nt, Human
uauuugaaggauggaaaacua

SEQ ID NO: 226821 - RNA, 21 nt, Human
ucagauuccagcugcugguac

SEQ ID NO: 226822 - RNA, 21 nt, Human
ucagugugauugcagccucaa

SEQ ID NO: 226823 - RNA, 19 nt, Human
ucuccagcaggcagugggg

SEQ ID NO: 226824 - RNA, 22 nt, Human
ucuuguauguuuggaauuguga

SEQ ID NO: 226825 - RNA, 18 nt, Human
ugaaauggagaacugugg

SEQ ID NO: 226826 - RNA, 19 nt, Human
ugacagaagacugaaagcu

SEQ ID NO: 226827 - RNA, 24 nt, Human
ugacagaagacugaaagcuagucu

SEQ ID NO: 226828 - RNA, 22 nt, Human
uggaacaacacgugucuaagug

SEQ ID NO: 226829 - RNA, 23 nt, Human
ugugaguuccucagugugauugc

SEQ ID NO: 226830 - RNA, 18 nt, Human
uguggugugaggaagagc

SEQ ID NO: 226831 - RNA, 20 nt, Human
uuguauguuuggaauuguga

SEQ ID NO: 226832 - RNA, 21 nt, Human
uuguauguuuggaauugugag

SEQ ID NO: 226833 - RNA, 20 nt, Human
acugcugacagaaggcugaa

SEQ ID NO: 226834 - RNA, 19 nt, Human
agacaggcggccgcgcccc

SEQ ID NO: 226835 - RNA, 20 nt, Human
gagccucuuguauguuugga

SEQ ID NO: 226836 - RNA, 23 nt, Human
gagggagccucuuguauguuugg

SEQ ID NO: 226837 - RNA, 19 nt, Human
ggagccucuuguauguuug

SEQ ID NO: 226838 - RNA, 20 nt, Human
gggcuaagcaaaggagugug

SEQ ID NO: 226839 - RNA, 18 nt, Human
guggaacagcaugaggga

SEQ ID NO: 226840 - RNA, 19 nt, Human
uauuugaaggagggaaaac

SEQ ID NO: 226841 - RNA, 21 nt, Human
uauuugaaggagggaaaacua

SEQ ID NO: 226842 - RNA, 22 nt, Human
uauuugaaggagggaaaacuac

SEQ ID NO: 226843 - RNA, 21 nt, Human
ucagauuccagcugcugguac

SEQ ID NO: 226844 - RNA, 21 nt, Human
ucagugugauugcagccucaa

SEQ ID NO: 226845 - RNA, 23 nt, Human
ucucuccagcaggcaguggggac

SEQ ID NO: 226846 - RNA, 22 nt, Human
ucuuguauguuuggaauuguga

SEQ ID NO: 226847 - RNA, 22 nt, Human
uggaacagcacgugucuaagug

SEQ ID NO: 226848 - RNA, 23 nt, Human
ugugaguuccucagugugauugc

SEQ ID NO: 226849 - RNA, 18 nt, Human
uguggugugaggaagagc

SEQ ID NO: 226850 - RNA, 20 nt, Human
uuguauguuuggaauuguga

SEQ ID NO: 226851 - RNA, 21 nt, Human
uuguauguuuggaauugugag

SEQ ID NO: 226852 - RNA, 18 nt, Human
agagacaggcaccagauu

SEQ ID NO: 226853 - RNA, 21 nt, Human
agaggagagaacuacacugaa

SEQ ID NO: 226854 - RNA, 22 nt, Human
aggaguguguuuucucugcagc

SEQ ID NO: 226855 - RNA, 23 nt, Human
gacauugguaagcaagagacagg

SEQ ID NO: 226856 - RNA, 22 nt, Human
gagagccucuuguauguuugga

SEQ ID NO: 226857 - RNA, 24 nt, Human
gugaugcucuaagauggagacuca

SEQ ID NO: 226858 - RNA, 18 nt, Human
guggaacagcacgaggga

SEQ ID NO: 226859 - RNA, 25 nt, Human
uaagguuugcugaugccaaccacag

SEQ ID NO: 226860 - RNA, 18 nt, Human
uauaagguuugcugaugc

SEQ ID NO: 226861 - RNA, 21 nt, Human
ucagugugauugcagccucaa

SEQ ID NO: 226862 - RNA, 22 nt, Human
ucucugcagcaggcagugggga

SEQ ID NO: 226863 - RNA, 22 nt, Human
ucuuguauguuuggaauuguga

SEQ ID NO: 226864 - RNA, 18 nt, Human
ugaggaagagugaugcuc

SEQ ID NO: 226865 - RNA, 22 nt, Human
ugaggaagagugaugcucuaag

SEQ ID NO: 226866 - RNA, 22 nt, Human
uggaacagcacgugucuaagug

SEQ ID NO: 226867 - RNA, 23 nt, Human
ugugaguuccucagugugauugc

SEQ ID NO: 226868 - RNA, 19 nt, Human
uuauaagguuugcugaugc

SEQ ID NO: 226869 - RNA, 21 nt, Human
uuggagaggugggccaggggu

SEQ ID NO: 226870 - RNA, 20 nt, Human
uuguauguuuggaauuguga

SEQ ID NO: 226871 - RNA, 21 nt, Human
uuguauguuuggaauugugag

SEQ ID NO: 226872 - RNA, 23 nt, Human
aagcaagagagaggcauguucag

SEQ ID NO: 226873 - RNA, 19 nt, Human
agacaggcggccgcgcccc

SEQ ID NO: 226874 - RNA, 20 nt, Human
ccgcgccccagcucagcuca

SEQ ID NO: 226875 - RNA, 22 nt, Human
cgccccagcucagcucagcagc

SEQ ID NO: 226876 - RNA, 19 nt, Human
gagccucuuguaugucugg

SEQ ID NO: 226877 - RNA, 23 nt, Human
gagggagccucuuguaugucugg

SEQ ID NO: 226878 - RNA, 22 nt, Human
gcaagagagaggcauguucaga

SEQ ID NO: 226879 - RNA, 18 nt, Human
ggagccucuuguaugucu

SEQ ID NO: 226880 - RNA, 20 nt, Human
gggcuaagcaaaggagugug

SEQ ID NO: 226881 - RNA, 18 nt, Human
gugaaacagcaugaggga

SEQ ID NO: 226882 - RNA, 20 nt, Human
uauuugaaaaggagacagcu

SEQ ID NO: 226883 - RNA, 21 nt, Human
ucagugugauugcagccucaa

SEQ ID NO: 226884 - RNA, 18 nt, Human
ucaguuggagaggugggc

SEQ ID NO: 226885 - RNA, 21 nt, Human
ucaguuggagaggugggcagg

SEQ ID NO: 226886 - RNA, 22 nt, Human
ucucuccagcaggcagugggga

SEQ ID NO: 226887 - RNA, 19 nt, Human
ugaaaaggagacagcuaca

SEQ ID NO: 226888 - RNA, 23 nt, Human
ugugaguuccucagugugauugc

SEQ ID NO: 226889 - RNA, 18 nt, Human
uguggugugaggaagagc

SEQ ID NO: 226890 - RNA, 23 nt, Human
agaagacaacuuuggaucugggc

SEQ ID NO: 226891 - RNA, 23 nt, Human
cgagugauuuuucucugugugaa

SEQ ID NO: 226892 - RNA, 20 nt, Human
uauguacaugcugguaucug

SEQ ID NO: 226893 - RNA, 24 nt, Human
ucagaagggcgagugauuuuucuc

SEQ ID NO: 226894 - RNA, 19 nt, Human
ucagcauuuggaaguucua

SEQ ID NO: 226895 - RNA, 18 nt, Human
ucuguugggggugucuug

SEQ ID NO: 226896 - RNA, 24 nt, Human
uuggaaguucuauguacaugcugg

SEQ ID NO: 226897 - RNA, 23 nt, Human
aagcaagagagaggcauguucag

SEQ ID NO: 226898 - RNA, 23 nt, Human
agaagacaacuuuggaucugggc

SEQ ID NO: 226899 - RNA, 20 nt, Human
gagccucuuguauguuugga

SEQ ID NO: 226900 - RNA, 26 nt, Human
gagcgaugcccuaagaugaagacuga

SEQ ID NO: 226901 - RNA, 22 nt, Human
gagugauuucucucugugugaa

SEQ ID NO: 226902 - RNA, 22 nt, Human
gcaagagagaggcauguucaga

SEQ ID NO: 226903 - RNA, 19 nt, Human
ggagccucuuguauguuug

SEQ ID NO: 226904 - RNA, 23 nt, Human
ggcagacauguuuauuugaaggc

SEQ ID NO: 226905 - RNA, 20 nt, Human
gggcuaagcaaaggagugug

SEQ ID NO: 226906 - RNA, 20 nt, Human
uauguacaugcugguaucug

SEQ ID NO: 226907 - RNA, 19 nt, Human
uauuugaaggcgggaaaac

SEQ ID NO: 226908 - RNA, 21 nt, Human
uauuugaaggcgggaaaacua

SEQ ID NO: 226909 - RNA, 24 nt, Human
ucagaagggcgagugauuucucuc

SEQ ID NO: 226910 - RNA, 21 nt, Human
ucagauuccagcugcugguac

SEQ ID NO: 226911 - RNA, 19 nt, Human
ucagcauuuggaaguucua

SEQ ID NO: 226912 - RNA, 21 nt, Human
ucagugugauugcagccucag

SEQ ID NO: 226913 - RNA, 23 nt, Human
ucucuccagcaggcaguggggac

SEQ ID NO: 226914 - RNA, 18 nt, Human
ucuguugggggugucuug

SEQ ID NO: 226915 - RNA, 22 nt, Human
ucuuguauguuuggaauuguga

SEQ ID NO: 226916 - RNA, 22 nt, Human
uggaacagcacgugucuaagug

SEQ ID NO: 226917 - RNA, 23 nt, Human
ugugaguuccucagugugauugc

SEQ ID NO: 226918 - RNA, 24 nt, Human
uuggaaguucuauguacaugcugg

SEQ ID NO: 226919 - RNA, 20 nt, Human
uuguauguuuggaauuguga

SEQ ID NO: 226920 - RNA, 21 nt, Human
uuguauguuuggaauugugag

SEQ ID NO: 226921 - RNA, 24 nt, Human
uuuuacugcuggcagaaggcugaa

SEQ ID NO: 226922 - RNA, 23 nt, Human
aagcaagagagaggcauguucag

SEQ ID NO: 226923 - RNA, 23 nt, Human
agaagacaacuuuggaucugggc

SEQ ID NO: 226924 - RNA, 19 nt, Human
agacaggcgaccgcgcccc

SEQ ID NO: 226925 - RNA, 19 nt, Human
cccuaagaugaagacugau

SEQ ID NO: 226926 - RNA, 23 nt, Human
cgagugauuuuucucugugugaa

SEQ ID NO: 226927 - RNA, 26 nt, Human
gagcgaugcccuaagaugaagacuga

SEQ ID NO: 226928 - RNA, 22 nt, Human
gcaagagagaggcauguucaga

SEQ ID NO: 226929 - RNA, 20 nt, Human
uauguacaugcugguaucug

SEQ ID NO: 226930 - RNA, 24 nt, Human
ucagaagggcgagugauuuuucuc

SEQ ID NO: 226931 - RNA, 21 nt, Human
ucagauuccagcugcugguac

SEQ ID NO: 226932 - RNA, 19 nt, Human
ucagcauuuggaaguucua

SEQ ID NO: 226933 - RNA, 23 nt, Human
ucucuccagcaggcaguggggac

SEQ ID NO: 226934 - RNA, 18 nt, Human
ucuguugggggugucuug

SEQ ID NO: 226935 - RNA, 24 nt, Human
uuggaaguucuauguacaugcugg

SEQ ID NO: 226936 - RNA, 23 nt, Human
aagcaagagagaggcauguucag

SEQ ID NO: 226937 - RNA, 21 nt, Human
agaggagagagcuacacugaa

SEQ ID NO: 226938 - RNA, 22 nt, Human
aggaguguguuuucucugcagc

SEQ ID NO: 226939 - RNA, 24 nt, Human
aggcaguggcgaccuuaggcauuu

SEQ ID NO: 226940 - RNA, 22 nt, Human
auaaauuuuacugaugacagaa

SEQ ID NO: 226941 - RNA, 19 nt, Human
caagugaaauagauaccuu

SEQ ID NO: 226942 - RNA, 18 nt, Human
cauuggaucuggcaaccu

SEQ ID NO: 226943 - RNA, 23 nt, Human
ccuugugggcuaagcaaaggagu

SEQ ID NO: 226944 - RNA, 20 nt, Human
gagccucuuguauguuugga

SEQ ID NO: 226945 - RNA, 23 nt, Human
gagggagccucuuguauguuugg

SEQ ID NO: 226946 - RNA, 20 nt, Human
gaugacagaaggcugaaaga

SEQ ID NO: 226947 - RNA, 22 nt, Human
gcaagagagaggcauguucaga

SEQ ID NO: 226948 - RNA, 20 nt, Human
gggcuaagcaaaggagugug

SEQ ID NO: 226949 - RNA, 18 nt, Human
guggaacagcaugaggga

SEQ ID NO: 226950 - RNA, 21 nt, Human
ucagugugauugcagccucaa

SEQ ID NO: 226951 - RNA, 22 nt, Human
ucuuguauguuuggaauuguga

SEQ ID NO: 226952 - RNA, 21 nt, Human
ugaaagauagucugaggggag

SEQ ID NO: 226953 - RNA, 20 nt, Human
ugaaauagauaccuuguggg

SEQ ID NO: 226954 - RNA, 24 nt, Human
ugacagaaggcugaaagauagucu

SEQ ID NO: 226955 - RNA, 22 nt, Human
uggaacagcaaguguguaagug

SEQ ID NO: 226956 - RNA, 23 nt, Human
ugugaguuccucagugugauugc

SEQ ID NO: 226957 - RNA, 20 nt, Human
uuguauguuuggaauuguga

SEQ ID NO: 226958 - RNA, 21 nt, Human
uuguauguuuggaauugugag

SEQ ID NO: 226959 - RNA, 24 nt, Human
augcucugacuccuuuggggucug

SEQ ID NO: 226960 - RNA, 20 nt, Human
ccccaccccgcccccgcccc

SEQ ID NO: 226961 - RNA, 21 nt, Human
cccccaccccgcccccgcccc

SEQ ID NO: 226962 - RNA, 19 nt, Human
ccccccaccccgcccccgc

SEQ ID NO: 226963 - RNA, 21 nt, Human
cccccccaccccgcccccgcc

SEQ ID NO: 226964 - RNA, 25 nt, Human
cccccccaccccgcccccgccccgc

SEQ ID NO: 226965 - RNA, 18 nt, Human
cccccgccccgcaugcuc

SEQ ID NO: 226966 - RNA, 19 nt, Human
cccccucccuuagcccuac

SEQ ID NO: 226967 - RNA, 22 nt, Human
ccccgcaugcucugacuccuuu

SEQ ID NO: 226968 - RNA, 21 nt, Human
ccgccccgcaugcucugacuc

SEQ ID NO: 226969 - RNA, 21 nt, Human
ccuacgucccccccaccccgc

SEQ ID NO: 226970 - RNA, 19 nt, Human
ccucggguuggaagcucca

SEQ ID NO: 226971 - RNA, 24 nt, Human
ccuggcugggugaauguccagagg

SEQ ID NO: 226972 - RNA, 20 nt, Human
cgcccccgccccgcaugcuc

SEQ ID NO: 226973 - RNA, 22 nt, Human
cgucccccccaccccgcccccg

SEQ ID NO: 226974 - RNA, 19 nt, Human
cucaguccuggccugggca

SEQ ID NO: 226975 - RNA, 23 nt, Human
cucaguccuggccugggcaggag

SEQ ID NO: 226976 - RNA, 21 nt, Human
gccucaguccuggccugggca

SEQ ID NO: 226977 - RNA, 22 nt, Human
gccucggguuggaagcuccagc

SEQ ID NO: 226978 - RNA, 23 nt, Human
gugaauguccagagggugggcag

SEQ ID NO: 226979 - RNA, 21 nt, Human
uagcccuacgucccccccacc

SEQ ID NO: 226980 - RNA, 23 nt, Human
ucccccccaccccgcccccgccc

SEQ ID NO: 226981 - RNA, 23 nt, Human
ucugaggugacgagaccaccugg

SEQ ID NO: 226982 - RNA, 18 nt, Human
ugagaagagccagguccu

SEQ ID NO: 226983 - RNA, 23 nt, Human
ugagaagagccagguccuagaag

SEQ ID NO: 226984 - RNA, 22 nt, Human
ugcucugacuccuuuggggucu

SEQ ID NO: 226985 - RNA, 18 nt, Human
aaaagacauugacaaaac

SEQ ID NO: 226986 - RNA, 26 nt, Human
aaaauaaccaucauggaagccaaaag

SEQ ID NO: 226987 - RNA, 23 nt, Human
aaaggacccucuuggacucaggg

SEQ ID NO: 226988 - RNA, 18 nt, Human
aacacaaccccaaaaucu

SEQ ID NO: 226989 - RNA, 19 nt, Human
aagggggaaaccauaaagg

SEQ ID NO: 226990 - RNA, 18 nt, Human
aauagaaacacaaaggaa

SEQ ID NO: 226991 - RNA, 23 nt, Human
acacacauacaaacguacauaca

SEQ ID NO: 226992 - RNA, 20 nt, Human
accauauuuuugggcagaau

SEQ ID NO: 226993 - RNA, 21 nt, Human
agaaagacaggauugcagugg

SEQ ID NO: 226994 - RNA, 18 nt, Human
agacaggauugcaguggg

SEQ ID NO: 226995 - RNA, 19 nt, Human
agacaggauugcagugggg

SEQ ID NO: 226996 - RNA, 24 nt, Human
aggaauaaaacacguggaacacca

SEQ ID NO: 226997 - RNA, 25 nt, Human
aggcaacauaccugaaucccugaag

SEQ ID NO: 226998 - RNA, 26 nt, Human
aggcaacauaccugaaucuuucaaga

SEQ ID NO: 226999 - RNA, 19 nt, Human
auaaaacacguggaacacc

SEQ ID NO: 227000 - RNA, 21 nt, Human
auaccugaaucuuucaagaca

SEQ ID NO: 227001 - RNA, 24 nt, Human
auucugaagcugauaggcuuguuc

SEQ ID NO: 227002 - RNA, 21 nt, Human
caacacaaccccaaaaucugu

SEQ ID NO: 227003 - RNA, 25 nt, Human
caagacaaaacucucaaugaagugc

SEQ ID NO: 227004 - RNA, 23 nt, Human
caaggacucaugggcuugggaau

SEQ ID NO: 227005 - RNA, 23 nt, Human
caaguugaaagaaaagaaaauaa

SEQ ID NO: 227006 - RNA, 31 nt, Human
cacacauacaaacguacauacacauauauag

SEQ ID NO: 227007 - RNA, 21 nt, Human
cacaguucucuaaauguaguc

SEQ ID NO: 227008 - RNA, 18 nt, Human
cacguggaacaccaacau

SEQ ID NO: 227009 - RNA, 18 nt, Human
cagaaagacaggauugca

SEQ ID NO: 227010 - RNA, 18 nt, Human
cagaauaaguucaucagc

SEQ ID NO: 227011 - RNA, 20 nt, Human
cagggcaaaaauaccccucc

SEQ ID NO: 227012 - RNA, 20 nt, Human
caguccauaccucccucucu

SEQ ID NO: 227013 - RNA, 24 nt, Human
cagugcaaaugguuacuuccagau

SEQ ID NO: 227014 - RNA, 22 nt, Human
cauaccucccucucuuuuucca

SEQ ID NO: 227015 - RNA, 20 nt, Human
cauugaguacaaugccauuc

SEQ ID NO: 227016 - RNA, 24 nt, Human
ccaggcuacagucuaaaggguaaa

SEQ ID NO: 227017 - RNA, 27 nt, Human
cccaguccauaccucccucucuuuuuc

SEQ ID NO: 227018 - RNA, 19 nt, Human
ccugaaucuuucaagacaa

SEQ ID NO: 227019 - RNA, 20 nt, Human
ccugaaucuuucaagacaac

SEQ ID NO: 227020 - RNA, 28 nt, Human
cuacacacauacaaacguacauacacau

SEQ ID NO: 227021 - RNA, 18 nt, Human
cuauuuaaaaaccagguc

SEQ ID NO: 227022 - RNA, 21 nt, Human
cucaugcagugguccacagaa

SEQ ID NO: 227023 - RNA, 18 nt, Human
cuguuuccuucaaacuua

SEQ ID NO: 227024 - RNA, 23 nt, Human
gaaaggacucuggcccccagucc

SEQ ID NO: 227025 - RNA, 19 nt, Human
gacaacacaaccccaaaau

SEQ ID NO: 227026 - RNA, 23 nt, Human
gauaacggccacaguucucuaaa

SEQ ID NO: 227027 - RNA, 24 nt, Human
gcagaauuggagaagccuuggaaa

SEQ ID NO: 227028 - RNA, 26 nt, Human
gcaguguuuucccacuccugugggag

SEQ ID NO: 227029 - RNA, 18 nt, Human
ggaaaggacucuggcccc

SEQ ID NO: 227030 - RNA, 20 nt, Human
gggaggccuucucuccaauu

SEQ ID NO: 227031 - RNA, 20 nt, Human
ggugacaacacaaccccaaa

SEQ ID NO: 227032 - RNA, 21 nt, Human
gucaauagaaacacaaaggaa

SEQ ID NO: 227033 - RNA, 21 nt, Human
gugcuggcuagggaggccuuc

SEQ ID NO: 227034 - RNA, 21 nt, Human
uaaaggacccucuuggacuca

SEQ ID NO: 227035 - RNA, 18 nt, Human
uaagauggcaguguuuuc

SEQ ID NO: 227036 - RNA, 20 nt, Human
uacaagaauaauauccaggc

SEQ ID NO: 227037 - RNA, 27 nt, Human
uacauaagaauccaaacuaagauggca

SEQ ID NO: 227038 - RNA, 21 nt, Human
uaccugaaucuuucaagacaa

SEQ ID NO: 227039 - RNA, 24 nt, Human
uaccugaaucuuucaagacaacac

SEQ ID NO: 227040 - RNA, 23 nt, Human
uagaugcguauauacaagugcug

SEQ ID NO: 227041 - RNA, 24 nt, Human
uaguauaaaagcucaugcaguggu

SEQ ID NO: 227042 - RNA, 18 nt, Human
uauagaugcguauauaca

SEQ ID NO: 227043 - RNA, 20 nt, Human
uaucaucauacuacuaugga

SEQ ID NO: 227044 - RNA, 23 nt, Human
uauccuggaguuggaugcaaguu

SEQ ID NO: 227045 - RNA, 22 nt, Human
uauggaagcuucugguaagcua

SEQ ID NO: 227046 - RNA, 18 nt, Human
uauugggcagugaggaag

SEQ ID NO: 227047 - RNA, 20 nt, Human
uauugggcagugaggaaggg

SEQ ID NO: 227048 - RNA, 23 nt, Human
uauugggcagugaggaaggggag

SEQ ID NO: 227049 - RNA, 20 nt, Human
ucagaauguuuucuguucau

SEQ ID NO: 227050 - RNA, 22 nt, Human
ucagacaaaguauggcaagaca

SEQ ID NO: 227051 - RNA, 22 nt, Human
ucagcuaaaagaggagauuuug

SEQ ID NO: 227052 - RNA, 22 nt, Human
ucaugguagaagcuacguugcu

SEQ ID NO: 227053 - RNA, 20 nt, Human
uccaggcuacagucuaaagg

SEQ ID NO: 227054 - RNA, 25 nt, Human
uccauaccucccucucuuuuuccaa

SEQ ID NO: 227055 - RNA, 22 nt, Human
ucccucucuuuuuccaaaucag

SEQ ID NO: 227056 - RNA, 20 nt, Human
ucuaaggaacagguacagua

SEQ ID NO: 227057 - RNA, 19 nt, Human
ucuagacagcuaugugaaa

SEQ ID NO: 227058 - RNA, 21 nt, Human
ucucuugggugacaacacaac

SEQ ID NO: 227059 - RNA, 23 nt, Human
ucucuugggugacaacacaaccc

SEQ ID NO: 227060 - RNA, 23 nt, Human
ugaaaagaaacaagagcaguacu

SEQ ID NO: 227061 - RNA, 25 nt, Human
ugaaaagaaacaagagcaguacuaa

SEQ ID NO: 227062 - RNA, 24 nt, Human
ugacaaaacucucaaugaagugcc

SEQ ID NO: 227063 - RNA, 21 nt, Human
ugagacaguagcauuauggaa

SEQ ID NO: 227064 - RNA, 26 nt, Human
ugauguucuguuuuccacauaaagga

SEQ ID NO: 227065 - RNA, 21 nt, Human
uggaaaggacucuggccccca

SEQ ID NO: 227066 - RNA, 19 nt, Human
uggaugcaaguugaaagaa

SEQ ID NO: 227067 - RNA, 20 nt, Human
uggcaagacaaaacucucaa

SEQ ID NO: 227068 - RNA, 21 nt, Human
uggcaguguuuucccacuccu

SEQ ID NO: 227069 - RNA, 25 nt, Human
uggcaguguuuucccacuccugugg

SEQ ID NO: 227070 - RNA, 22 nt, Human
uggcccccaguccauaccuccc

SEQ ID NO: 227071 - RNA, 23 nt, Human
uggccuaugucucauucccagca

SEQ ID NO: 227072 - RNA, 28 nt, Human
ugucuacacacauacaaacguacauaca

SEQ ID NO: 227073 - RNA, 18 nt, Human
uguuuuguuuuguuuuua

SEQ ID NO: 227074 - RNA, 19 nt, Human
uuacuaccauuuauucagg

SEQ ID NO: 227075 - RNA, 18 nt, Human
uuguucacacuuggggau

SEQ ID NO: 227076 - RNA, 19 nt, Human
uuuguucacacuuggggau

SEQ ID NO: 227077 - RNA, 18 nt, Human
uuuguuuuguuuuguuuu

SEQ ID NO: 227078 - RNA, 21 nt, Human
uuuugggcagaauuggagaag

SEQ ID NO: 227079 - RNA, 18 nt, Human
aaaauagaguccugcucc

SEQ ID NO: 227080 - RNA, 20 nt, Human
aagcaaacaugaacuguuac

SEQ ID NO: 227081 - RNA, 22 nt, Human
aagcaaacaugaacuguuacua

SEQ ID NO: 227082 - RNA, 19 nt, Human
agaacagauaaagaugugg

SEQ ID NO: 227083 - RNA, 25 nt, Human
agcgcccucuccacugucccugcuu

SEQ ID NO: 227084 - RNA, 19 nt, Human
agcggcggcagauaguccu

SEQ ID NO: 227085 - RNA, 23 nt, Human
aggcagcgcugcgauccagcaca

SEQ ID NO: 227086 - RNA, 19 nt, Human
auagaguccugcuccaugc

SEQ ID NO: 227087 - RNA, 22 nt, Human
auagaguccugcuccaugcaag

SEQ ID NO: 227088 - RNA, 22 nt, Human
cagcgcugcgauccagcacaaa

SEQ ID NO: 227089 - RNA, 21 nt, Human
cccugcuucccgcagcgcuuc

SEQ ID NO: 227090 - RNA, 25 nt, Human
cgaacagcggcggcagauaguccuu

SEQ ID NO: 227091 - RNA, 23 nt, Human
cucuccacugucccugcuucccg

SEQ ID NO: 227092 - RNA, 24 nt, Human
cucuccacugucccugcuucccgc

SEQ ID NO: 227093 - RNA, 22 nt, Human
cuggagcuccagcauauugcac

SEQ ID NO: 227094 - RNA, 21 nt, Human
gcuccagcauauugcacgaac

SEQ ID NO: 227095 - RNA, 22 nt, Human
gcuccagcauauugcacgaaca

SEQ ID NO: 227096 - RNA, 20 nt, Human
ggaaaggcagcgcugcgauc

SEQ ID NO: 227097 - RNA, 21 nt, Human
gguagcaagaacagauaaaga

SEQ ID NO: 227098 - RNA, 18 nt, Human
uauugcacgaacagcggc

SEQ ID NO: 227099 - RNA, 23 nt, Human
ucuggagcuccagcauauugcac

SEQ ID NO: 227100 - RNA, 19 nt, Human
uuaaaauagaguccugcuc

SEQ ID NO: 227101 - RNA, 20 nt, Human
uuaaaauagaguccugcucc

SEQ ID NO: 227102 - RNA, 18 nt, Human
uucuggagccaugcaaau

SEQ ID NO: 227103 - RNA, 19 nt, Human
uuucuggagccaugcaaau

SEQ ID NO: 227104 - RNA, 22 nt, Human
aaaaagagaacaaauucaggca

SEQ ID NO: 227105 - RNA, 26 nt, Human
aaaaauuaauaaagauacuaacuaua

SEQ ID NO: 227106 - RNA, 22 nt, Human
aaacauaaaauagaccucagag

SEQ ID NO: 227107 - RNA, 25 nt, Human
aaacauaaaauagaccucagagauc

SEQ ID NO: 227108 - RNA, 24 nt, Human
aaagcuuaucuuucaugaaaaaau

SEQ ID NO: 227109 - RNA, 19 nt, Human
aagaaacuagucuaacaaa

SEQ ID NO: 227110 - RNA, 20 nt, Human
accagauugcuuuugaaccu

SEQ ID NO: 227111 - RNA, 18 nt, Human
agaugccagugagacaga

SEQ ID NO: 227112 - RNA, 22 nt, Human
aggcaaaaaguugcaggcagau

SEQ ID NO: 227113 - RNA, 19 nt, Human
aggcauuauuauggcagcu

SEQ ID NO: 227114 - RNA, 21 nt, Human
aguaaaacuaguucaaagcua

SEQ ID NO: 227115 - RNA, 18 nt, Human
aucaugcuuuugaagacu

SEQ ID NO: 227116 - RNA, 22 nt, Human
caaaaagagaacaaauucaggc

SEQ ID NO: 227117 - RNA, 20 nt, Human
cacaacacuuagaggugcaa

SEQ ID NO: 227118 - RNA, 20 nt, Human
cagaaguagcagcaaaaaca

SEQ ID NO: 227119 - RNA, 24 nt, Human
ccagaaaaacauuaaauuuagaag

SEQ ID NO: 227120 - RNA, 23 nt, Human
cccauuucaaaaccucugucaua

SEQ ID NO: 227121 - RNA, 19 nt, Human
cuagucuaacaaacgggaa

SEQ ID NO: 227122 - RNA, 22 nt, Human
cuccuuuccuccaccuagagcc

SEQ ID NO: 227123 - RNA, 19 nt, Human
gaaauuacaguacagcuaa

SEQ ID NO: 227124 - RNA, 23 nt, Human
gaauagaaaguagugucacuguu

SEQ ID NO: 227125 - RNA, 21 nt, Human
gacccugugucagugagguug

SEQ ID NO: 227126 - RNA, 19 nt, Human
gcaauuacuacuuccagaa

SEQ ID NO: 227127 - RNA, 25 nt, Human
uaaaauacacauuuccauaauuugc

SEQ ID NO: 227128 - RNA, 25 nt, Human
uaaaauagaccucagagaucacaga

SEQ ID NO: 227129 - RNA, 20 nt, Human
uaagcacuuuuuccuccuuu

SEQ ID NO: 227130 - RNA, 23 nt, Human
uaauaagcacuuuuuccuccuuu

SEQ ID NO: 227131 - RNA, 24 nt, Human
uaauaaugacaaaggaaaguuuca

SEQ ID NO: 227132 - RNA, 24 nt, Human
uacaguacagcuaaagaauagaaa

SEQ ID NO: 227133 - RNA, 23 nt, Human
uacauaaaauaaacuugauucuc

SEQ ID NO: 227134 - RNA, 18 nt, Human
uacuguauuucacaauug

SEQ ID NO: 227135 - RNA, 22 nt, Human
uaugugcaaggcccucaacaag

SEQ ID NO: 227136 - RNA, 20 nt, Human
uauuugauagaagcauugcu

SEQ ID NO: 227137 - RNA, 19 nt, Human
ucacaggauucauguuugu

SEQ ID NO: 227138 - RNA, 20 nt, Human
uccaaguaugucauuaacca

SEQ ID NO: 227139 - RNA, 22 nt, Human
uccacagaaguagcagcaaaaa

SEQ ID NO: 227140 - RNA, 23 nt, Human
ugaaaaaaucauaccucuaaaga

SEQ ID NO: 227141 - RNA, 21 nt, Human
ugaaagaaggcaaaaaguugc

SEQ ID NO: 227142 - RNA, 20 nt, Human
ugagugauuauuucauccuu

SEQ ID NO: 227143 - RNA, 23 nt, Human
ugaugugucugcauaauuauuuc

SEQ ID NO: 227144 - RNA, 19 nt, Human
ugguguauaaucagauuaa

SEQ ID NO: 227145 - RNA, 19 nt, Human
uguaaaacuaucaacucaa

SEQ ID NO: 227146 - RNA, 18 nt, Human
ugucugaaaaucagcaag

SEQ ID NO: 227147 - RNA, 25 nt, Human
uguuacagaaauuauagugccuguc

SEQ ID NO: 227148 - RNA, 22 nt, Human
uuacuugguacauaacuuucua

SEQ ID NO: 227149 - RNA, 25 nt, Human
uucaaaaugaaugaauagaaaaaug

SEQ ID NO: 227150 - RNA, 24 nt, Human
uucaaauuucugcacaaauguugc

SEQ ID NO: 227151 - RNA, 20 nt, Human
uuccuaaucuugucauucaa

SEQ ID NO: 227152 - RNA, 25 nt, Human
uuccugaagagcccaauaucacagg

SEQ ID NO: 227153 - RNA, 22 nt, Human
uucuagaagucaaauguaugaa

SEQ ID NO: 227154 - RNA, 19 nt, Human
uucucuagcauccaauuuu

SEQ ID NO: 227155 - RNA, 22 nt, Human
uugcaauuacuacuuccagaaa

SEQ ID NO: 227156 - RNA, 20 nt, Human
uuucacaauugcuuuaugcu

SEQ ID NO: 227157 - RNA, 23 nt, Human
uuuuacaaugaacauauauuacu

SEQ ID NO: 227158 - RNA, 20 nt, Human
uuuuacgaucaccuaugccc

SEQ ID NO: 227159 - RNA, 18 nt, Human
cccugggccucaagccuc

SEQ ID NO: 227160 - RNA, 22 nt, Human
ccuccucuuccucggcugccuc

SEQ ID NO: 227161 - RNA, 21 nt, Human
gcuggugcccacccugggccu

SEQ ID NO: 227162 - RNA, 18 nt, Human
ucaagccuccucuuccuc

SEQ ID NO: 227163 - RNA, 22 nt, Human
uggcuggugcccacccugggcc

SEQ ID NO: 227164 - RNA, 19 nt, Human
uggugcccacccugggccu

SEQ ID NO: 227165 - RNA, 21 nt, Human
aaggaaaggccagggacucac

SEQ ID NO: 227166 - RNA, 22 nt, Human
accugaggugaaaaaaauuguu

SEQ ID NO: 227167 - RNA, 19 nt, Human
agggacucacgagggggug

SEQ ID NO: 227168 - RNA, 18 nt, Human
aucaaguucucucucuuc

SEQ ID NO: 227169 - RNA, 24 nt, Human
caaaaggaaaggccagggacucac

SEQ ID NO: 227170 - RNA, 20 nt, Human
caaguucucucucuucuuuc

SEQ ID NO: 227171 - RNA, 24 nt, Human
caccugaggugaaaaaaauuguuu

SEQ ID NO: 227172 - RNA, 21 nt, Human
cucacgagggggugggagcgg

SEQ ID NO: 227173 - RNA, 23 nt, Human
gaaaaaaauuguuuuuucgugga

SEQ ID NO: 227174 - RNA, 23 nt, Human
gaaaggccagggacucacgaggg

SEQ ID NO: 227175 - RNA, 24 nt, Human
gcugcgggcuggggccggcggcgg

SEQ ID NO: 227176 - RNA, 20 nt, Human
ggccagggacucacgagggg

SEQ ID NO: 227177 - RNA, 23 nt, Human
ggcggcggugcucuugcugcgag

SEQ ID NO: 227178 - RNA, 24 nt, Human
uacaaaaggaaaggccagggacuc

SEQ ID NO: 227179 - RNA, 21 nt, Human
ucacgagggggugggagcggc

SEQ ID NO: 227180 - RNA, 22 nt, Human
ugggagcggcugcucauggcug

SEQ ID NO: 227181 - RNA, 18 nt, Human
uuacuuugacaccugagg

SEQ ID NO: 227182 - RNA, 27 nt, Human
uucucucucuucuuucuuauuacaaaa

SEQ ID NO: 227183 - RNA, 24 nt, Human
aaaacccaaaaccccaaauuggcc

SEQ ID NO: 227184 - RNA, 18 nt, Human
aaaacgaagccaaaaccc

SEQ ID NO: 227185 - RNA, 22 nt, Human
aaacgaagccaaaacccaaaac

SEQ ID NO: 227186 - RNA, 25 nt, Human
aaacgaagccaaaacccaaaacccc

SEQ ID NO: 227187 - RNA, 22 nt, Human
aacgaagccaaaacccaaaacc

SEQ ID NO: 227188 - RNA, 22 nt, Human
aacgcaaaaauagacaaucagc

SEQ ID NO: 227189 - RNA, 23 nt, Human
aagcgucuuuuuuaaaaaguucc

SEQ ID NO: 227190 - RNA, 24 nt, Human
acccaaaaccccaaauuggccgag

SEQ ID NO: 227191 - RNA, 23 nt, Human
accccaaagucaacgaagagaaa

SEQ ID NO: 227192 - RNA, 19 nt, Human
acucgccagguggcugccu

SEQ ID NO: 227193 - RNA, 18 nt, Human
agaaaaaacgaagccaaa

SEQ ID NO: 227194 - RNA, 19 nt, Human
agagaaaaaacgaagccaa

SEQ ID NO: 227195 - RNA, 18 nt, Human
agcgcgcgcggccauggg

SEQ ID NO: 227196 - RNA, 23 nt, Human
agugugggucauauccacugucu

SEQ ID NO: 227197 - RNA, 27 nt, Human
caaaacccaaaaccccaaauuggccga

SEQ ID NO: 227198 - RNA, 19 nt, Human
ccgugggcgcaggggcugu

SEQ ID NO: 227199 - RNA, 24 nt, Human
cgaagagaaaaaacgaagccaaaa

SEQ ID NO: 227200 - RNA, 24 nt, Human
cgaagcagcuggggcaccugaacc

SEQ ID NO: 227201 - RNA, 24 nt, Human
cgguggccgggcugcgcucucuuc

SEQ ID NO: 227202 - RNA, 19 nt, Human
cuggucggcggcgcagggc

SEQ ID NO: 227203 - RNA, 20 nt, Human
cuguggccggggcggugggc

SEQ ID NO: 227204 - RNA, 23 nt, Human
cuuuguauacaaaaguucuuaga

SEQ ID NO: 227205 - RNA, 24 nt, Human
gaaaaaacgaagccaaaacccaaa

SEQ ID NO: 227206 - RNA, 19 nt, Human
gaagccaaaacccaaaacc

SEQ ID NO: 227207 - RNA, 24 nt, Human
gaagcgucuuuuuuaaaaaguucc

SEQ ID NO: 227208 - RNA, 18 nt, Human
gagcgcgcgcggccaugg

SEQ ID NO: 227209 - RNA, 18 nt, Human
gcagcccgaagcagcugg

SEQ ID NO: 227210 - RNA, 19 nt, Human
gccaaaacccaaaacccca

SEQ ID NO: 227211 - RNA, 18 nt, Human
gcgggccacgggcgggug

SEQ ID NO: 227212 - RNA, 20 nt, Human
ggcccagaagguccucggca

SEQ ID NO: 227213 - RNA, 22 nt, Human
gggcccagaagguccucggcag

SEQ ID NO: 227214 - RNA, 22 nt, Human
gggcgcgggccacgggcgggug

SEQ ID NO: 227215 - RNA, 30 nt, Human
ucccccaccacugucgcggucgccucgauu

SEQ ID NO: 227216 - RNA, 22 nt, Human
ugaaccccaaagucaacgaaga

SEQ ID NO: 227217 - RNA, 21 nt, Human
uggccgagauccuucuucuuu

SEQ ID NO: 227218 - RNA, 19 nt, Human
uggccggggcggugggcgg

SEQ ID NO: 227219 - RNA, 19 nt, Human
uggcugccguggcgcggag

SEQ ID NO: 227220 - RNA, 19 nt, Human
ugugggggcccagaagguc

SEQ ID NO: 227221 - RNA, 28 nt, Human
aaaaggaaaaaaaaaaaucaaugcagga

SEQ ID NO: 227222 - RNA, 18 nt, Human
aaugcaggagagggagag

SEQ ID NO: 227223 - RNA, 23 nt, Human
acagugcagacgacugccaggaa

SEQ ID NO: 227224 - RNA, 21 nt, Human
acuaaaaaggaaaaaaaaaaa

SEQ ID NO: 227225 - RNA, 19 nt, Human
agaggaggugagagaggag

SEQ ID NO: 227226 - RNA, 22 nt, Human
agagggagagaggaggugagag

SEQ ID NO: 227227 - RNA, 20 nt, Human
aggcagacauccaguggccc

SEQ ID NO: 227228 - RNA, 19 nt, Human
agugagugggguggaugga

SEQ ID NO: 227229 - RNA, 22 nt, Human
augugugugugugugugugugu

SEQ ID NO: 227230 - RNA, 23 nt, Human
auguguguguguguguguguguu

SEQ ID NO: 227231 - RNA, 20 nt, Human
caguggcccuuuuguuuugu

SEQ ID NO: 227232 - RNA, 25 nt, Human
caugacaguguguaugugugugggu

SEQ ID NO: 227233 - RNA, 18 nt, Human
ccaauagugcugaaguaa

SEQ ID NO: 227234 - RNA, 23 nt, Human
ccugaaguccagcccccugccuc

SEQ ID NO: 227235 - RNA, 18 nt, Human
cuugcugaguucaccugg

SEQ ID NO: 227236 - RNA, 21 nt, Human
gaaacccucccccgaacacag

SEQ ID NO: 227237 - RNA, 18 nt, Human
gaaguccagcccccugcc

SEQ ID NO: 227238 - RNA, 18 nt, Human
gacaguguguaugugugu

SEQ ID NO: 227239 - RNA, 18 nt, Human
gagagaggagcgagugag

SEQ ID NO: 227240 - RNA, 20 nt, Human
gagcgagugaguggggugga

SEQ ID NO: 227241 - RNA, 21 nt, Human
gaggugagagaggagcgagug

SEQ ID NO: 227242 - RNA, 24 nt, Human
gcaauggguccccgccugaagucc

SEQ ID NO: 227243 - RNA, 18 nt, Human
gcugcugccgggcaaaac

SEQ ID NO: 227244 - RNA, 20 nt, Human
ggaaaaggggacuucuccac

SEQ ID NO: 227245 - RNA, 19 nt, Human
ggagagggagagaggaggu

SEQ ID NO: 227246 - RNA, 18 nt, Human
ggagcgagugaguggggu

SEQ ID NO: 227247 - RNA, 21 nt, Human
gggaaauaauuccaauagugc

SEQ ID NO: 227248 - RNA, 18 nt, Human
gggcucuaaucacuccag

SEQ ID NO: 227249 - RNA, 21 nt, Human
gguggauggagagaggcaucc

SEQ ID NO: 227250 - RNA, 18 nt, Human
gugcaugacaguguguau

SEQ ID NO: 227251 - RNA, 18 nt, Human
guggauggagagaggcau

SEQ ID NO: 227252 - RNA, 22 nt, Human
guguguauaugugugugugugu

SEQ ID NO: 227253 - RNA, 22 nt, Human
guguguguauauguguguguug

SEQ ID NO: 227254 - RNA, 19 nt, Human
uauaugugugugugugugu

SEQ ID NO: 227255 - RNA, 24 nt, Human
uauaugugugugugugugugugag

SEQ ID NO: 227256 - RNA, 23 nt, Human
uauaugugugugugugugugugu

SEQ ID NO: 227257 - RNA, 28 nt, Human
uaugugugugggucugugagugugugua

SEQ ID NO: 227258 - RNA, 18 nt, Human
uaugugugugugugugug

SEQ ID NO: 227259 - RNA, 23 nt, Human
uaugugugugugugugugugugu

SEQ ID NO: 227260 - RNA, 24 nt, Human
uaugugugugugugugugugugug

SEQ ID NO: 227261 - RNA, 24 nt, Human
ucaacuaaaaaggaaaaaaaaaaa

SEQ ID NO: 227262 - RNA, 19 nt, Human
ucaaugcaggagagggaga

SEQ ID NO: 227263 - RNA, 24 nt, Human
uccacgggaguaacaauucccuuc

SEQ ID NO: 227264 - RNA, 19 nt, Human
ucugcgaggcaaugggucc

SEQ ID NO: 227265 - RNA, 23 nt, Human
ugaaauaagccccucggacugcc

SEQ ID NO: 227266 - RNA, 24 nt, Human
ugaaguaagcagccagucugcccc

SEQ ID NO: 227267 - RNA, 22 nt, Human
ugagugcaugacaguguguaug

SEQ ID NO: 227268 - RNA, 24 nt, Human
ugaguguguguauaugugugugug

SEQ ID NO: 227269 - RNA, 20 nt, Human
ugcaugacaguguguaugug

SEQ ID NO: 227270 - RNA, 20 nt, Human
ugccaggaaaaggggacuuc

SEQ ID NO: 227271 - RNA, 23 nt, Human
ugccaggaaaaggggacuucucc

SEQ ID NO: 227272 - RNA, 24 nt, Human
ugccaggaaaaggggacuucucca

SEQ ID NO: 227273 - RNA, 20 nt, Human
uggagagaggcauccagcgu

SEQ ID NO: 227274 - RNA, 19 nt, Human
uggcaacagcgggaaauaa

SEQ ID NO: 227275 - RNA, 21 nt, Human
uggcucaccccccaagaaggc

SEQ ID NO: 227276 - RNA, 21 nt, Human
uguauaugugugugugugugu

SEQ ID NO: 227277 - RNA, 23 nt, Human
ugugaguguguguauaugugugu

SEQ ID NO: 227278 - RNA, 19 nt, Human
uguguauaugugugugugu

SEQ ID NO: 227279 - RNA, 21 nt, Human
uguguauaugugugugugugu

SEQ ID NO: 227280 - RNA, 22 nt, Human
uguguauaugugugugugugug

SEQ ID NO: 227281 - RNA, 21 nt, Human
uguguaugugugugggucugu

SEQ ID NO: 227282 - RNA, 22 nt, Human
ugugugggucugugagugugug

SEQ ID NO: 227283 - RNA, 26 nt, Human
ugugugggucugugaguguguguaua

SEQ ID NO: 227284 - RNA, 19 nt, Human
uguguguauaugugugugu

SEQ ID NO: 227285 - RNA, 23 nt, Human
uguguguauaugugugugugugu

SEQ ID NO: 227286 - RNA, 31 nt, Human
uguguguauaugugugugugugugugugugg

SEQ ID NO: 227287 - RNA, 19 nt, Human
uguguguguguacagaggu

SEQ ID NO: 227288 - RNA, 21 nt, Human
uguguguguguguguguacag

SEQ ID NO: 227289 - RNA, 18 nt, Human
ugugugugugugugugug

SEQ ID NO: 227290 - RNA, 18 nt, Human
ugugugugugugugugug

SEQ ID NO: 227291 - RNA, 18 nt, Human
ugugugugugugugugug

SEQ ID NO: 227292 - RNA, 22 nt, Human
ugugugugugugugugugugua

SEQ ID NO: 227293 - RNA, 19 nt, Human
uuagacacuagccgaugcc

SEQ ID NO: 227294 - RNA, 20 nt, Human
uuguuucagucaacuaaaaa

SEQ ID NO: 227295 - RNA, 20 nt, Human
uuuguuuuguuuuguuucag

SEQ ID NO: 227296 - RNA, 24 nt, Human
aaaacaagagaaaaauuggaaaga

SEQ ID NO: 227297 - RNA, 19 nt, Human
aaacaaagcucucaagcau

SEQ ID NO: 227298 - RNA, 23 nt, Human
aaacaagagaaaaauuggaaaga

SEQ ID NO: 227299 - RNA, 25 nt, Human
aaagaaaaaaaagaggaggagaagg

SEQ ID NO: 227300 - RNA, 24 nt, Human
aaagugcugagauuacagguguga

SEQ ID NO: 227301 - RNA, 18 nt, Human
aaauggcccaugguaggg

SEQ ID NO: 227302 - RNA, 24 nt, Human
aacccaaaaaucaggggccggcag

SEQ ID NO: 227303 - RNA, 25 nt, Human
aagcaauccuccugccucagccucc

SEQ ID NO: 227304 - RNA, 21 nt, Human
aagcucucaagcauccaaccc

SEQ ID NO: 227305 - RNA, 27 nt, Human
aaggagaaaguggaaaagaagggaccc

SEQ ID NO: 227306 - RNA, 26 nt, Human
aagugcugagauuacaggugugagcc

SEQ ID NO: 227307 - RNA, 24 nt, Human
acucaugccguccuccgggaggcu

SEQ ID NO: 227308 - RNA, 23 nt, Human
acuggucuugaacucccaaccuc

SEQ ID NO: 227309 - RNA, 26 nt, Human
agaaaacaagagaaaaauuggaaaga

SEQ ID NO: 227310 - RNA, 18 nt, Human
agagcagggggggauggg

SEQ ID NO: 227311 - RNA, 22 nt, Human
agauuacaggugugagccacca

SEQ ID NO: 227312 - RNA, 19 nt, Human
aggaggagaaggacaagaa

SEQ ID NO: 227313 - RNA, 18 nt, Human
aggagggggggucgaaag

SEQ ID NO: 227314 - RNA, 23 nt, Human
agguccuccguuccccuuuuacc

SEQ ID NO: 227315 - RNA, 20 nt, Human
auaagaguucuagaaaacaa

SEQ ID NO: 227316 - RNA, 21 nt, Human
auccuccugccucagccuccc

SEQ ID NO: 227317 - RNA, 21 nt, Human
caaacucagaaaccaaauccc

SEQ ID NO: 227318 - RNA, 24 nt, Human
caaagugcugagauuacaggugug

SEQ ID NO: 227319 - RNA, 20 nt, Human
caaccucaagcaauccuccu

SEQ ID NO: 227320 - RNA, 24 nt, Human
caagagagcuguuccccucacacc

SEQ ID NO: 227321 - RNA, 22 nt, Human
caagcaauccuccugccucagc

SEQ ID NO: 227322 - RNA, 27 nt, Human
caagcaauccuccugccucagccuccc

SEQ ID NO: 227323 - RNA, 27 nt, Human
caagcaauccuccugccucagccuccc

SEQ ID NO: 227324 - RNA, 23 nt, Human
caagggaaacaaagcucucaagc

SEQ ID NO: 227325 - RNA, 22 nt, Human
caauucaguuccggccaagccc

SEQ ID NO: 227326 - RNA, 23 nt, Human
cagaaaccaaaucccuguaaauc

SEQ ID NO: 227327 - RNA, 25 nt, Human
cagcgcagcuucucuagugugaccu

SEQ ID NO: 227328 - RNA, 19 nt, Human
caggugugagccaccaggc

SEQ ID NO: 227329 - RNA, 18 nt, Human
cagugggcugcuucaacc

SEQ ID NO: 227330 - RNA, 22 nt, Human
cauccaacccaaaaaucagggg

SEQ ID NO: 227331 - RNA, 20 nt, Human
cauguugcccagacuggucu

SEQ ID NO: 227332 - RNA, 24 nt, Human
cauguugcccagacuggucuugaa

SEQ ID NO: 227333 - RNA, 21 nt, Human
ccaaagugcugagauuacagg

SEQ ID NO: 227334 - RNA, 21 nt, Human
ccaaagugcugagauuacagg

SEQ ID NO: 227335 - RNA, 24 nt, Human
ccaaagugcugagauuacaggugu

SEQ ID NO: 227336 - RNA, 23 nt, Human
ccaacccaaaaaucaggggccgg

SEQ ID NO: 227337 - RNA, 28 nt, Human
ccagcucucuuuuccuccagucuccuca

SEQ ID NO: 227338 - RNA, 23 nt, Human
ccauaugcaagcugaagucaaag

SEQ ID NO: 227339 - RNA, 21 nt, Human
ccauguugcccagacuggucu

SEQ ID NO: 227340 - RNA, 19 nt, Human
cccaaccucagcacacgac

SEQ ID NO: 227341 - RNA, 22 nt, Human
cccccacuccccuauuucuccc

SEQ ID NO: 227342 - RNA, 19 nt, Human
ccccccugcagcuuuuccu

SEQ ID NO: 227343 - RNA, 19 nt, Human
ccuccguuccccuuuuacc

SEQ ID NO: 227344 - RNA, 24 nt, Human
ccugaaggagaaaguggaaaagaa

SEQ ID NO: 227345 - RNA, 26 nt, Human
cgaaaggggagggagucgauucagac

SEQ ID NO: 227346 - RNA, 23 nt, Human
cgcugggccgaaguggccagagc

SEQ ID NO: 227347 - RNA, 24 nt, Human
cucaagcaauccuccugccucagc

SEQ ID NO: 227348 - RNA, 21 nt, Human
cucccaaagugcugagauuac

SEQ ID NO: 227349 - RNA, 19 nt, Human
cugaaguguccagaacuca

SEQ ID NO: 227350 - RNA, 23 nt, Human
cugccucagccucccaaagugcu

SEQ ID NO: 227351 - RNA, 24 nt, Human
cugccucagccucccaaagugcug

SEQ ID NO: 227352 - RNA, 19 nt, Human
cuggaauuccgugaaggua

SEQ ID NO: 227353 - RNA, 19 nt, Human
cuuggacaaaaauaaagug

SEQ ID NO: 227354 - RNA, 18 nt, Human
gaaaagaaaaaaaagagg

SEQ ID NO: 227355 - RNA, 23 nt, Human
gagucgauucagacccagcuggg

SEQ ID NO: 227356 - RNA, 18 nt, Human
gauuacaggugugagcca

SEQ ID NO: 227357 - RNA, 24 nt, Human
gauuacaggugugagccaccaggc

SEQ ID NO: 227358 - RNA, 22 nt, Human
gccacucucggaacaagggaaa

SEQ ID NO: 227359 - RNA, 26 nt, Human
gcuucaaccccauaugcaagcugaag

SEQ ID NO: 227360 - RNA, 19 nt, Human
ggaaaagaaaaaaaagagg

SEQ ID NO: 227361 - RNA, 20 nt, Human
ggaaaagaaaaaaaagagga

SEQ ID NO: 227362 - RNA, 21 nt, Human
gggggggucgaaaggggaggg

SEQ ID NO: 227363 - RNA, 19 nt, Human
guagaauaugaagagcccc

SEQ ID NO: 227364 - RNA, 24 nt, Human
gucgaaaggggagggagucgauuc

SEQ ID NO: 227365 - RNA, 19 nt, Human
uaaaaagaauccucccccc

SEQ ID NO: 227366 - RNA, 23 nt, Human
uaaaaagaauccuccccccugca

SEQ ID NO: 227367 - RNA, 18 nt, Human
uaaaagaaguaaaaggag

SEQ ID NO: 227368 - RNA, 19 nt, Human
uaaaagaaguaaaaggagg

SEQ ID NO: 227369 - RNA, 18 nt, Human
uaagaagcagaagcacca

SEQ ID NO: 227370 - RNA, 18 nt, Human
uacaggugugagccacca

SEQ ID NO: 227371 - RNA, 22 nt, Human
uacaggugugagccaccaggcu

SEQ ID NO: 227372 - RNA, 21 nt, Human
uagaaaacaagagaaaaauug

SEQ ID NO: 227373 - RNA, 25 nt, Human
uaggaaaaauguccuauuucagagc

SEQ ID NO: 227374 - RNA, 20 nt, Human
ucacuagcugaggacuccug

SEQ ID NO: 227375 - RNA, 19 nt, Human
ucagacccagcugggccac

SEQ ID NO: 227376 - RNA, 25 nt, Human
ucagcacacgaccaggaaagauacc

SEQ ID NO: 227377 - RNA, 23 nt, Human
ucccaaagugcugagauuacagg

SEQ ID NO: 227378 - RNA, 22 nt, Human
uccgggcuggaaaaugaggagg

SEQ ID NO: 227379 - RNA, 20 nt, Human
uccuccguuccccuuuuacc

SEQ ID NO: 227380 - RNA, 24 nt, Human
uccuccguuccccuuuuaccucua

SEQ ID NO: 227381 - RNA, 27 nt, Human
uccuccugccucagccucccaaagugc

SEQ ID NO: 227382 - RNA, 21 nt, Human
ucgaaaggggagggagucgau

SEQ ID NO: 227383 - RNA, 22 nt, Human
ucgcugggccgaaguggccaga

SEQ ID NO: 227384 - RNA, 19 nt, Human
ucggaacaagggaaacaaa

SEQ ID NO: 227385 - RNA, 19 nt, Human
ucucaagcauccaacccaa

SEQ ID NO: 227386 - RNA, 24 nt, Human
ucucaagcauccaacccaaaaauc

SEQ ID NO: 227387 - RNA, 21 nt, Human
ucugaaaaccaaacuuuaaga

SEQ ID NO: 227388 - RNA, 19 nt, Human
ugaaacacuuuaaauggcc

SEQ ID NO: 227389 - RNA, 24 nt, Human
ugaacucccaaccucaagcaaucc

SEQ ID NO: 227390 - RNA, 18 nt, Human
ugagauuacaggugugag

SEQ ID NO: 227391 - RNA, 19 nt, Human
ugagauuacaggugugagc

SEQ ID NO: 227392 - RNA, 22 nt, Human
ugagauuacaggugugagccac

SEQ ID NO: 227393 - RNA, 23 nt, Human
ugagauuacaggugugagccacc

SEQ ID NO: 227394 - RNA, 24 nt, Human
ugagauuacaggugugagccacca

SEQ ID NO: 227395 - RNA, 18 nt, Human
ugagcugaucgcaagaga

SEQ ID NO: 227396 - RNA, 19 nt, Human
ugaggagggggggucgaaa

SEQ ID NO: 227397 - RNA, 19 nt, Human
ugaguuuuugccauguugc

SEQ ID NO: 227398 - RNA, 24 nt, Human
ugccauguugcccagacuggucuu

SEQ ID NO: 227399 - RNA, 27 nt, Human
ugccauguugcccagacuggucuugaa

SEQ ID NO: 227400 - RNA, 20 nt, Human
ugccucaaacucagaaacca

SEQ ID NO: 227401 - RNA, 24 nt, Human
ugccucagccucccaaagugcuga

SEQ ID NO: 227402 - RNA, 24 nt, Human
ugcugagauuacaggugugagcca

SEQ ID NO: 227403 - RNA, 18 nt, Human
uggaaaagaaaaaaaaga

SEQ ID NO: 227404 - RNA, 18 nt, Human
ugugccucaaacucagaa

SEQ ID NO: 227405 - RNA, 20 nt, Human
ugugccucaaacucagaaac

SEQ ID NO: 227406 - RNA, 20 nt, Human
uguuaugcucuuuccauuua

SEQ ID NO: 227407 - RNA, 20 nt, Human
uuaaaaccuuuugagugugg

SEQ ID NO: 227408 - RNA, 24 nt, Human
uuaccaaucaacuacuuguuaugc

SEQ ID NO: 227409 - RNA, 22 nt, Human
uucagagcagggggggauggga

SEQ ID NO: 227410 - RNA, 21 nt, Human
uuccuuggacaaaaauaaagu

SEQ ID NO: 227411 - RNA, 19 nt, Human
uugaaacacuuuaaauggc

SEQ ID NO: 227412 - RNA, 18 nt, Human
uuguucacagccuugagu

SEQ ID NO: 227413 - RNA, 23 nt, Human
uuuugccauguugcccagacugg

SEQ ID NO: 227414 - RNA, 21 nt, Human
aaagcccaauaauuacacugc

SEQ ID NO: 227415 - RNA, 20 nt, Human
aaauauuggucucuccuuuc

SEQ ID NO: 227416 - RNA, 18 nt, Human
aacauaaggcaaaagccc

SEQ ID NO: 227417 - RNA, 21 nt, Human
aaccauucccgaacuaacuaa

SEQ ID NO: 227418 - RNA, 24 nt, Human
aacucaacauaaggcaaaagccca

SEQ ID NO: 227419 - RNA, 23 nt, Human
aagaaaaaacaagccuuugguaa

SEQ ID NO: 227420 - RNA, 24 nt, Human
aagcaaagcaaaaugguaagccua

SEQ ID NO: 227421 - RNA, 22 nt, Human
aagccgcgcguuucagccgugg

SEQ ID NO: 227422 - RNA, 21 nt, Human
aaucauaaacacuccaacuua

SEQ ID NO: 227423 - RNA, 20 nt, Human
acaacccuuaggcuggagau

SEQ ID NO: 227424 - RNA, 19 nt, Human
acucuuggcaaucucuugg

SEQ ID NO: 227425 - RNA, 21 nt, Human
agagccagaagacgcuaggug

SEQ ID NO: 227426 - RNA, 25 nt, Human
agagcgcagagagaaagagccccaa

SEQ ID NO: 227427 - RNA, 18 nt, Human
agaguucagugucuggag

SEQ ID NO: 227428 - RNA, 18 nt, Human
agauacugucagaugaaa

SEQ ID NO: 227429 - RNA, 21 nt, Human
aggacagcggggcccgggggc

SEQ ID NO: 227430 - RNA, 24 nt, Human
aggagcagaggcaggacugggacg

SEQ ID NO: 227431 - RNA, 21 nt, Human
aggcaaaagcccaauaauuac

SEQ ID NO: 227432 - RNA, 22 nt, Human
aggcaaaagcccaauaauuaca

SEQ ID NO: 227433 - RNA, 18 nt, Human
aggcaaaaggcuggcagc

SEQ ID NO: 227434 - RNA, 23 nt, Human
aggcagaagcagguuuguuugaa

SEQ ID NO: 227435 - RNA, 19 nt, Human
aggcaggagcagaggcagg

SEQ ID NO: 227436 - RNA, 22 nt, Human
aggugggggaggacagcggggc

SEQ ID NO: 227437 - RNA, 20 nt, Human
aguagggaaggugguggcgu

SEQ ID NO: 227438 - RNA, 24 nt, Human
caaacauguggcuuaaaauaaugu

SEQ ID NO: 227439 - RNA, 19 nt, Human
caaagcaaaaugguaagcc

SEQ ID NO: 227440 - RNA, 22 nt, Human
caaauuaccaauaaccauuccc

SEQ ID NO: 227441 - RNA, 18 nt, Human
caacaucaguagguaacg

SEQ ID NO: 227442 - RNA, 19 nt, Human
caacugcucaagaaaaaac

SEQ ID NO: 227443 - RNA, 19 nt, Human
cacugcaucuuuggcucag

SEQ ID NO: 227444 - RNA, 25 nt, Human
cagagagaaagagccccaagucucg

SEQ ID NO: 227445 - RNA, 18 nt, Human
caugcaauggauauauau

SEQ ID NO: 227446 - RNA, 23 nt, Human
cauucagaaucacuagcuuccau

SEQ ID NO: 227447 - RNA, 23 nt, Human
cauuguguaauguuuccacuuug

SEQ ID NO: 227448 - RNA, 22 nt, Human
ccaggcgaaggcuggagcgcag

SEQ ID NO: 227449 - RNA, 19 nt, Human
ccaugcuuacacugaacuc

SEQ ID NO: 227450 - RNA, 20 nt, Human
ccgggggcggaggaagaggc

SEQ ID NO: 227451 - RNA, 21 nt, Human
ccguggucggguccgcaggac

SEQ ID NO: 227452 - RNA, 21 nt, Human
ccugcgccccugucccuggcc

SEQ ID NO: 227453 - RNA, 23 nt, Human
ccuguauaaguuuaauguuuucu

SEQ ID NO: 227454 - RNA, 22 nt, Human
cgaacuaacuaacauauggcca

SEQ ID NO: 227455 - RNA, 26 nt, Human
cgcucugccaggcgaaggcuggagcg

SEQ ID NO: 227456 - RNA, 22 nt, Human
cggcugcagcuggauacaccuc

SEQ ID NO: 227457 - RNA, 18 nt, Human
cggguggcucugagaaag

SEQ ID NO: 227458 - RNA, 22 nt, Human
cucaagaaaaaacaagccuuug

SEQ ID NO: 227459 - RNA, 27 nt, Human
cucaagaaaaaacaagccuuugguaac

SEQ ID NO: 227460 - RNA, 19 nt, Human
cugcaccccuagagccaga

SEQ ID NO: 227461 - RNA, 19 nt, Human
gaaggcaaaaggcuggcag

SEQ ID NO: 227462 - RNA, 18 nt, Human
gacaccaccaggcaggag

SEQ ID NO: 227463 - RNA, 18 nt, Human
gagauccuuguucuugaa

SEQ ID NO: 227464 - RNA, 20 nt, Human
gagauccuuguucuugaaga

SEQ ID NO: 227465 - RNA, 21 nt, Human
gcaaagcaaaaugguaagccu

SEQ ID NO: 227466 - RNA, 18 nt, Human
gcugcgcgcucugccagg

SEQ ID NO: 227467 - RNA, 24 nt, Human
gcuggagcgcagacggcaaagccg

SEQ ID NO: 227468 - RNA, 18 nt, Human
ggggaggacagcggggcc

SEQ ID NO: 227469 - RNA, 25 nt, Human
gugggacaacccuuaggcuggagau

SEQ ID NO: 227470 - RNA, 20 nt, Human
uaaggacauuguguaauguu

SEQ ID NO: 227471 - RNA, 21 nt, Human
uaaggcaaaagcccaauaauu

SEQ ID NO: 227472 - RNA, 19 nt, Human
uacagagauccuuguucuu

SEQ ID NO: 227473 - RNA, 19 nt, Human
uagcuuccaugcuuacacu

SEQ ID NO: 227474 - RNA, 19 nt, Human
uagguaacgcuacagagau

SEQ ID NO: 227475 - RNA, 21 nt, Human
uauggccagacauuuuuccug

SEQ ID NO: 227476 - RNA, 28 nt, Human
uauucuguuugaucuacuaacucuuuca

SEQ ID NO: 227477 - RNA, 19 nt, Human
uccagcaaguaaaaucuuu

SEQ ID NO: 227478 - RNA, 25 nt, Human
uccgcaggaccugggcguggggaca

SEQ ID NO: 227479 - RNA, 20 nt, Human
uccucgaugcccgcgcgaga

SEQ ID NO: 227480 - RNA, 21 nt, Human
ucggguccgcaggaccugggc

SEQ ID NO: 227481 - RNA, 19 nt, Human
ucuagcaauaaucauaaac

SEQ ID NO: 227482 - RNA, 23 nt, Human
ucugcaccccuagagccagaaga

SEQ ID NO: 227483 - RNA, 18 nt, Human
ucugccaggcgaaggcug

SEQ ID NO: 227484 - RNA, 21 nt, Human
ucugucuucuacucuuggcaa

SEQ ID NO: 227485 - RNA, 23 nt, Human
ugaaugcaagauacaagcaugaa

SEQ ID NO: 227486 - RNA, 26 nt, Human
ugagaauaugaagucugccuucuuuc

SEQ ID NO: 227487 - RNA, 21 nt, Human
ugauuaguaggacaguuuguu

SEQ ID NO: 227488 - RNA, 19 nt, Human
ugccauagacuauaaaaug

SEQ ID NO: 227489 - RNA, 21 nt, Human
ugggacaacccuuaggcugga

SEQ ID NO: 227490 - RNA, 22 nt, Human
ugggaugcgcuuguggcagagc

SEQ ID NO: 227491 - RNA, 18 nt, Human
ugucuggagagcgcagag

SEQ ID NO: 227492 - RNA, 19 nt, Human
uguguuaaaaaagcaaagc

SEQ ID NO: 227493 - RNA, 19 nt, Human
uguuugaauaaagcauaau

SEQ ID NO: 227494 - RNA, 27 nt, Human
uuaaaauaauguacagaucaauguaac

SEQ ID NO: 227495 - RNA, 21 nt, Human
uuaauggaucauauguuuucu

SEQ ID NO: 227496 - RNA, 20 nt, Human
uugaagaguuuucaucucug

SEQ ID NO: 227497 - RNA, 19 nt, Human
uuggcucaguguguuaaaa

SEQ ID NO: 227498 - RNA, 18 nt, Human
uuguguaauguuuccacu

SEQ ID NO: 227499 - RNA, 20 nt, Human
uuuuuuuuuuaaaugcaaau

SEQ ID NO: 227500 - RNA, 20 nt, Human
aaaagcaaacaguguauccc

SEQ ID NO: 227501 - RNA, 18 nt, Human
aaaauacacaccaaaaca

SEQ ID NO: 227502 - RNA, 23 nt, Human
aaacaugaccaagauuaaacuaa

SEQ ID NO: 227503 - RNA, 22 nt, Human
aaagcaacuguugucuaaagac

SEQ ID NO: 227504 - RNA, 20 nt, Human
aaagugagauuaauugaaga

SEQ ID NO: 227505 - RNA, 21 nt, Human
aagaccaugcaaauucaauug

SEQ ID NO: 227506 - RNA, 21 nt, Human
aagcaaacaguguaucccuca

SEQ ID NO: 227507 - RNA, 20 nt, Human
acacaccaaaacaugaccaa

SEQ ID NO: 227508 - RNA, 23 nt, Human
acauuacuucauccuccuucaca

SEQ ID NO: 227509 - RNA, 19 nt, Human
agaaaaagccuacacggug

SEQ ID NO: 227510 - RNA, 20 nt, Human
agaaagacauguuuugguca

SEQ ID NO: 227511 - RNA, 25 nt, Human
agaaagacauguuuuggucauuuuu

SEQ ID NO: 227512 - RNA, 18 nt, Human
agaacgcaggcaccgacc

SEQ ID NO: 227513 - RNA, 23 nt, Human
auuuucaguuccugguauacaga

SEQ ID NO: 227514 - RNA, 19 nt, Human
cacagccagcaccauucca

SEQ ID NO: 227515 - RNA, 26 nt, Human
caccugcggcggcggcccccgcggcc

SEQ ID NO: 227516 - RNA, 18 nt, Human
cagaacgcaggcaccgac

SEQ ID NO: 227517 - RNA, 20 nt, Human
cagaacgcaggcaccgacca

SEQ ID NO: 227518 - RNA, 26 nt, Human
cauauagacacacauuuauaugcaca

SEQ ID NO: 227519 - RNA, 20 nt, Human
cccccgcggccauggcccgc

SEQ ID NO: 227520 - RNA, 21 nt, Human
cccccgcggccauggcccgcu

SEQ ID NO: 227521 - RNA, 19 nt, Human
ccgcgcgccaccaccugcc

SEQ ID NO: 227522 - RNA, 18 nt, Human
ccgcucggccgggcgcgc

SEQ ID NO: 227523 - RNA, 18 nt, Human
ccugcggcggcggccccc

SEQ ID NO: 227524 - RNA, 21 nt, Human
cgccggcacugcccgcccgcc

SEQ ID NO: 227525 - RNA, 21 nt, Human
cggcccccgcggccauggccc

SEQ ID NO: 227526 - RNA, 18 nt, Human
cggcucccgcgcucgccc

SEQ ID NO: 227527 - RNA, 18 nt, Human
cuacacggugcuucuacc

SEQ ID NO: 227528 - RNA, 19 nt, Human
cucgggcuucagaacgcag

SEQ ID NO: 227529 - RNA, 23 nt, Human
cucuccucaccgcgcgccaccac

SEQ ID NO: 227530 - RNA, 19 nt, Human
cugcaguaauguucaugcc

SEQ ID NO: 227531 - RNA, 20 nt, Human
cugcugagacuuaaagugca

SEQ ID NO: 227532 - RNA, 21 nt, Human
cuuauauuguauuuuaaaaag

SEQ ID NO: 227533 - RNA, 22 nt, Human
gaaaauaauaaauaagcauaac

SEQ ID NO: 227534 - RNA, 22 nt, Human
gaacuagucuuuaugaaagcaa

SEQ ID NO: 227535 - RNA, 19 nt, Human
gauaagaacuagucuuuau

SEQ ID NO: 227536 - RNA, 22 nt, Human
gccccggagggggcgccgcgcu

SEQ ID NO: 227537 - RNA, 18 nt, Human
gcccgagugcggggcggc

SEQ ID NO: 227538 - RNA, 21 nt, Human
gccgagccgcguuccauccgc

SEQ ID NO: 227539 - RNA, 20 nt, Human
gucacuucacaaauacuugu

SEQ ID NO: 227540 - RNA, 18 nt, Human
uaaaggaaagcauauaga

SEQ ID NO: 227541 - RNA, 21 nt, Human
uaagaaaaaaauuaaaaauac

SEQ ID NO: 227542 - RNA, 22 nt, Human
uagcagcuaaauuuauacacac

SEQ ID NO: 227543 - RNA, 22 nt, Human
uauacaaacuuuuauucaaagu

SEQ ID NO: 227544 - RNA, 19 nt, Human
ucaaaaaccugcaguaaug

SEQ ID NO: 227545 - RNA, 21 nt, Human
ucaaagauuuucaguuccugg

SEQ ID NO: 227546 - RNA, 22 nt, Human
ucaaguguguuacaccaggucc

SEQ ID NO: 227547 - RNA, 19 nt, Human
ucaccgcgcgccaccaccu

SEQ ID NO: 227548 - RNA, 23 nt, Human
ucagaaguggcauuuaaaguguu

SEQ ID NO: 227549 - RNA, 20 nt, Human
ucagcugcugcucauugcag

SEQ ID NO: 227550 - RNA, 18 nt, Human
ucagucacuucacaaaua

SEQ ID NO: 227551 - RNA, 23 nt, Human
ucugaucaacacacauggcuacu

SEQ ID NO: 227552 - RNA, 18 nt, Human
ucuguagucauucaaggu

SEQ ID NO: 227553 - RNA, 20 nt, Human
ucuucaguaucugaggccua

SEQ ID NO: 227554 - RNA, 18 nt, Human
ucuuuuuuuuuuuuuuuu

SEQ ID NO: 227555 - RNA, 21 nt, Human
ugcaguaauguucaugccaaa

SEQ ID NO: 227556 - RNA, 26 nt, Human
ugcucauugcagaaaaagccuacacg

SEQ ID NO: 227557 - RNA, 19 nt, Human
uuauauucauguaaucaaa

SEQ ID NO: 227558 - RNA, 21 nt, Human
uuuaugaaagcaacuguuguc

SEQ ID NO: 227559 - RNA, 22 nt, Human
uuuuuuuuuuuuuuuucuuuuu

SEQ ID NO: 227560 - RNA, 22 nt, Human
aaaaaaaaaaaaaaagacacaa

SEQ ID NO: 227561 - RNA, 20 nt, Human
aaaaaaaaaaaaaaggcuca

SEQ ID NO: 227562 - RNA, 20 nt, Human
aaaaaaaaagacacaaucaa

SEQ ID NO: 227563 - RNA, 19 nt, Human
aaacaagaaguacaacaag

SEQ ID NO: 227564 - RNA, 18 nt, Human
aaagcucucaccaagcuc

SEQ ID NO: 227565 - RNA, 21 nt, Human
aaaguacauaagugggugugg

SEQ ID NO: 227566 - RNA, 21 nt, Human
aacagccacgcagagaacacc

SEQ ID NO: 227567 - RNA, 23 nt, Human
aacuggaauaugaguuugcucag

SEQ ID NO: 227568 - RNA, 24 nt, Human
aacuguguaugcacucggggaucc

SEQ ID NO: 227569 - RNA, 19 nt, Human
aagaaaaagaagacaagga

SEQ ID NO: 227570 - RNA, 18 nt, Human
aagaagacaaggacauua

SEQ ID NO: 227571 - RNA, 21 nt, Human
aagcaaguugaauccagucac

SEQ ID NO: 227572 - RNA, 23 nt, Human
aagcaaguugaauccagucacca

SEQ ID NO: 227573 - RNA, 20 nt, Human
aaggguccucuauugccacu

SEQ ID NO: 227574 - RNA, 21 nt, Human
aaucuaugacaucaaagacca

SEQ ID NO: 227575 - RNA, 19 nt, Human
aaucucauaaccaaacaug

SEQ ID NO: 227576 - RNA, 23 nt, Human
aaucucauaaccaaacauggcac

SEQ ID NO: 227577 - RNA, 22 nt, Human
aauucuggguaccuuguuguuc

SEQ ID NO: 227578 - RNA, 23 nt, Human
acaaaacagagccuggaguagag

SEQ ID NO: 227579 - RNA, 24 nt, Human
acaaaacagagccuggaguagaga

SEQ ID NO: 227580 - RNA, 19 nt, Human
acaaauuacuccaugcccc

SEQ ID NO: 227581 - RNA, 20 nt, Human
acaagcagccguggccaccc

SEQ ID NO: 227582 - RNA, 26 nt, Human
acacaagacuuccccugcuuaugccu

SEQ ID NO: 227583 - RNA, 23 nt, Human
acacacacacacacacacacaca

SEQ ID NO: 227584 - RNA, 20 nt, Human
acacaccgaaacaagucuca

SEQ ID NO: 227585 - RNA, 24 nt, Human
acagagccuuuaaaaacuccaacu

SEQ ID NO: 227586 - RNA, 20 nt, Human
acauaacaccucccaggccu

SEQ ID NO: 227587 - RNA, 22 nt, Human
acccacacagacauacacauuc

SEQ ID NO: 227588 - RNA, 23 nt, Human
accccagccucauccccaucaca

SEQ ID NO: 227589 - RNA, 24 nt, Human
acuccaaaaaaaaaaaaaaagaca

SEQ ID NO: 227590 - RNA, 19 nt, Human
acugcgaugaacaacacca

SEQ ID NO: 227591 - RNA, 18 nt, Human
agacaagaugcucccaaa

SEQ ID NO: 227592 - RNA, 20 nt, Human
agacaagaugcucccaaaaa

SEQ ID NO: 227593 - RNA, 19 nt, Human
agagcacucaacuaaaaca

SEQ ID NO: 227594 - RNA, 18 nt, Human
agaucccaaccccagccu

SEQ ID NO: 227595 - RNA, 21 nt, Human
agauggagagaugccauuggg

SEQ ID NO: 227596 - RNA, 25 nt, Human
agcacagggaacccauuugucccuu

SEQ ID NO: 227597 - RNA, 19 nt, Human
agcuaggugcaaaugggga

SEQ ID NO: 227598 - RNA, 28 nt, Human
aggaagccucaaauccaaggcccacuga

SEQ ID NO: 227599 - RNA, 18 nt, Human
aggauggagugcacaugg

SEQ ID NO: 227600 - RNA, 22 nt, Human
aggcuucucugaagagcuaguu

SEQ ID NO: 227601 - RNA, 18 nt, Human
agggagggagacaugagg

SEQ ID NO: 227602 - RNA, 20 nt, Human
aguggugggggaggggcagg

SEQ ID NO: 227603 - RNA, 23 nt, Human
aucagaucccaaccccagccuca

SEQ ID NO: 227604 - RNA, 21 nt, Human
auccagcagcaaaggccucaa

SEQ ID NO: 227605 - RNA, 18 nt, Human
augcccccucaaaugccc

SEQ ID NO: 227606 - RNA, 22 nt, Human
auggcugaugcuauauccauga

SEQ ID NO: 227607 - RNA, 19 nt, Human
auuaaacugggauaauaag

SEQ ID NO: 227608 - RNA, 23 nt, Human
auuacuccaugcccccucaaaug

SEQ ID NO: 227609 - RNA, 20 nt, Human
caaaacaaagcccaaaggug

SEQ ID NO: 227610 - RNA, 25 nt, Human
caaaacaaagcccaaaggugcugcc

SEQ ID NO: 227611 - RNA, 26 nt, Human
caaaacaaagcccaaaggugcugccc

SEQ ID NO: 227612 - RNA, 24 nt, Human
caaaacagagccuggaguagagac

SEQ ID NO: 227613 - RNA, 21 nt, Human
caaagcucucaccaagcuccc

SEQ ID NO: 227614 - RNA, 27 nt, Human
caacacaggcacaaaucuaucuuuggg

SEQ ID NO: 227615 - RNA, 20 nt, Human
cacacacacacacacacaca

SEQ ID NO: 227616 - RNA, 20 nt, Human
cacacacacacacacacaca

SEQ ID NO: 227617 - RNA, 20 nt, Human
cacacacacacacacacaca

SEQ ID NO: 227618 - RNA, 22 nt, Human
cacacacacacacacacacaca

SEQ ID NO: 227619 - RNA, 25 nt, Human
cacacagacacaccgaaacaagucu

SEQ ID NO: 227620 - RNA, 26 nt, Human
cacacagacauacacauucagugucu

SEQ ID NO: 227621 - RNA, 23 nt, Human
cacagcagcacagacccucccaa

SEQ ID NO: 227622 - RNA, 20 nt, Human
cacaggguaccaggcucagu

SEQ ID NO: 227623 - RNA, 24 nt, Human
cacuggcugggaagacuucggggu

SEQ ID NO: 227624 - RNA, 21 nt, Human
cagaaguccaacaucaggauu

SEQ ID NO: 227625 - RNA, 20 nt, Human
cagaggagagcgguucucac

SEQ ID NO: 227626 - RNA, 19 nt, Human
cagcacaacuuuaagguuu

SEQ ID NO: 227627 - RNA, 23 nt, Human
cagcagcaaaggccucaagcuau

SEQ ID NO: 227628 - RNA, 18 nt, Human
cagccguggccacccuaa

SEQ ID NO: 227629 - RNA, 18 nt, Human
cagggucuguauuguccc

SEQ ID NO: 227630 - RNA, 23 nt, Human
caguaguaaagaaauccaguaga

SEQ ID NO: 227631 - RNA, 25 nt, Human
caguagugggguucuuggggguugg

SEQ ID NO: 227632 - RNA, 20 nt, Human
caucaaagaccaauggccua

SEQ ID NO: 227633 - RNA, 25 nt, Human
cauccaauguccaucugaaucacac

SEQ ID NO: 227634 - RNA, 24 nt, Human
caucugcuuccuguaggagaacuc

SEQ ID NO: 227635 - RNA, 22 nt, Human
caugugcuuaacaucagaaaga

SEQ ID NO: 227636 - RNA, 20 nt, Human
cauuccaucagcuuccaacc

SEQ ID NO: 227637 - RNA, 23 nt, Human
cauuuuacacauaauaugcaaau

SEQ ID NO: 227638 - RNA, 19 nt, Human
ccaaaaacagaaaacauga

SEQ ID NO: 227639 - RNA, 18 nt, Human
ccagaacacuucugagua

SEQ ID NO: 227640 - RNA, 21 nt, Human
ccagagaacugccccucucac

SEQ ID NO: 227641 - RNA, 24 nt, Human
ccagcagaccagugggaaaucuga

SEQ ID NO: 227642 - RNA, 23 nt, Human
ccaucagcuuccaacccacagcc

SEQ ID NO: 227643 - RNA, 21 nt, Human
cccaagcaaguugaauccagu

SEQ ID NO: 227644 - RNA, 18 nt, Human
cccacagaaagcagacuc

SEQ ID NO: 227645 - RNA, 19 nt, Human
cccagcagaccagugggaa

SEQ ID NO: 227646 - RNA, 23 nt, Human
ccccacuucauagugagaccaga

SEQ ID NO: 227647 - RNA, 19 nt, Human
ccccagccucauccccauc

SEQ ID NO: 227648 - RNA, 28 nt, Human
cccccacagaaagcagacuccaaaaaaa

SEQ ID NO: 227649 - RNA, 18 nt, Human
cccccucaaaugcccgcu

SEQ ID NO: 227650 - RNA, 21 nt, Human
ccccucaaaugcccgcuccuc

SEQ ID NO: 227651 - RNA, 18 nt, Human
cccuggaauagggggaaa

SEQ ID NO: 227652 - RNA, 18 nt, Human
ccgcuccucaagaugcuu

SEQ ID NO: 227653 - RNA, 20 nt, Human
ccggaagacgacacauaaaa

SEQ ID NO: 227654 - RNA, 25 nt, Human
cucacagcagcacagacccucccaa

SEQ ID NO: 227655 - RNA, 24 nt, Human
cucaccccccaacuuagagaaaca

SEQ ID NO: 227656 - RNA, 18 nt, Human
cuccaaaaaaaaaaaaaa

SEQ ID NO: 227657 - RNA, 26 nt, Human
cuccaaaaaaaaaaaaaaagacacaa

SEQ ID NO: 227658 - RNA, 27 nt, Human
cuccaaaaaaaaaaaaaaagacacaau

SEQ ID NO: 227659 - RNA, 22 nt, Human
cucggggauccuaguucuguuc

SEQ ID NO: 227660 - RNA, 23 nt, Human
cugaucagcaacagugauucagc

SEQ ID NO: 227661 - RNA, 25 nt, Human
cugcugaacuguguaugcacucggg

SEQ ID NO: 227662 - RNA, 23 nt, Human
cugcuggcucuccugcuugguca

SEQ ID NO: 227663 - RNA, 23 nt, Human
cuguguaugcacucggggauccu

SEQ ID NO: 227664 - RNA, 25 nt, Human
gaaacaccaaaacaaagcccaaagg

SEQ ID NO: 227665 - RNA, 20 nt, Human
gaaaucucuuccauucccaa

SEQ ID NO: 227666 - RNA, 18 nt, Human
gaacucaaggaaaaacag

SEQ ID NO: 227667 - RNA, 22 nt, Human
gaagugcugcuggcucuccugc

SEQ ID NO: 227668 - RNA, 21 nt, Human
gaauaauuuacaaucucauaa

SEQ ID NO: 227669 - RNA, 22 nt, Human
gacugcguuuuaaaauucagca

SEQ ID NO: 227670 - RNA, 19 nt, Human
gaggaugggggagcgaaua

SEQ ID NO: 227671 - RNA, 19 nt, Human
gaguaugugcugggggggc

SEQ ID NO: 227672 - RNA, 21 nt, Human
gaguaugugcugggggggcag

SEQ ID NO: 227673 - RNA, 20 nt, Human
gcaaagcucucaccaagcuc

SEQ ID NO: 227674 - RNA, 21 nt, Human
gcaaagcucucaccaagcucc

SEQ ID NO: 227675 - RNA, 21 nt, Human
gcccggccucacccccacaga

SEQ ID NO: 227676 - RNA, 22 nt, Human
gccuggaguagagacauagcuc

SEQ ID NO: 227677 - RNA, 21 nt, Human
gcugcuggcucuccugcuugg

SEQ ID NO: 227678 - RNA, 24 nt, Human
ggaaaaacagugagcugagaagca

SEQ ID NO: 227679 - RNA, 23 nt, Human
ggaaaaccuaaaaguaggacccu

SEQ ID NO: 227680 - RNA, 23 nt, Human
ggagcauggaggcaauuuaaaug

SEQ ID NO: 227681 - RNA, 20 nt, Human
ggcaucugugggcagcuaga

SEQ ID NO: 227682 - RNA, 18 nt, Human
gggacaaauccagaagag

SEQ ID NO: 227683 - RNA, 24 nt, Human
gggcaguaagaggcuucaucuacc

SEQ ID NO: 227684 - RNA, 19 nt, Human
gggcugggggaugccaauc

SEQ ID NO: 227685 - RNA, 18 nt, Human
ggggaggggaggaugggg

SEQ ID NO: 227686 - RNA, 18 nt, Human
ggguuggggagagggugc

SEQ ID NO: 227687 - RNA, 22 nt, Human
gguauuuuuaaaaaaaaaaaaa

SEQ ID NO: 227688 - RNA, 20 nt, Human
guagcccagucguaucagaa

SEQ ID NO: 227689 - RNA, 21 nt, Human
gugcugccuggggaugucaag

SEQ ID NO: 227690 - RNA, 24 nt, Human
gugcugcuggcucuccugcuuggu

SEQ ID NO: 227691 - RNA, 18 nt, Human
guggagggacccuucccc

SEQ ID NO: 227692 - RNA, 20 nt, Human
uaaaaaaaaaaaaaaggcuc

SEQ ID NO: 227693 - RNA, 20 nt, Human
uaaaaauucuggguaccuug

SEQ ID NO: 227694 - RNA, 20 nt, Human
uaaauacacaaaacagagcc

SEQ ID NO: 227695 - RNA, 18 nt, Human
uaaauggcaccuguccca

SEQ ID NO: 227696 - RNA, 21 nt, Human
uaacagccacgcagagaacac

SEQ ID NO: 227697 - RNA, 19 nt, Human
uaaguauaaauggggacug

SEQ ID NO: 227698 - RNA, 22 nt, Human
uacaaucucauaaccaaacaug

SEQ ID NO: 227699 - RNA, 20 nt, Human
uacacacacacacacacaca

SEQ ID NO: 227700 - RNA, 25 nt, Human
uacaguaaauacacaaaguggcuca

SEQ ID NO: 227701 - RNA, 22 nt, Human
uacaucagaucccaaccccagc

SEQ ID NO: 227702 - RNA, 19 nt, Human
uacauuugaggaaauguuu

SEQ ID NO: 227703 - RNA, 21 nt, Human
uaccacgugaccagcacaaac

SEQ ID NO: 227704 - RNA, 21 nt, Human
uaccuaugcaauauguuguac

SEQ ID NO: 227705 - RNA, 18 nt, Human
uaccuggugaugaagaga

SEQ ID NO: 227706 - RNA, 23 nt, Human
uagaaacacagcacagcugaaca

SEQ ID NO: 227707 - RNA, 28 nt, Human
uagaaacaccaaaacaaagcccaaaggu

SEQ ID NO: 227708 - RNA, 20 nt, Human
uagcagaaaaugaggucagu

SEQ ID NO: 227709 - RNA, 19 nt, Human
uagcccagucguaucagaa

SEQ ID NO: 227710 - RNA, 19 nt, Human
uaggagaacucaaggaaaa

SEQ ID NO: 227711 - RNA, 24 nt, Human
uagggagggagacaugaggugaaa

SEQ ID NO: 227712 - RNA, 20 nt, Human
uaguaaagaaauccaguaga

SEQ ID NO: 227713 - RNA, 21 nt, Human
uauacagucccuaacagccac

SEQ ID NO: 227714 - RNA, 25 nt, Human
uaugccagaaauuucagcaugagca

SEQ ID NO: 227715 - RNA, 25 nt, Human
uauugccacugaaaaugaggggagg

SEQ ID NO: 227716 - RNA, 20 nt, Human
ucaaagaccaauggccuaaa

SEQ ID NO: 227717 - RNA, 20 nt, Human
ucaaaugcccgcuccucaag

SEQ ID NO: 227718 - RNA, 20 nt, Human
ucaagaaacaccagugacug

SEQ ID NO: 227719 - RNA, 18 nt, Human
ucacaaagugccaagggc

SEQ ID NO: 227720 - RNA, 27 nt, Human
ucacacacgcucaccccccaacuuaga

SEQ ID NO: 227721 - RNA, 18 nt, Human
ucacugagucccaugacg

SEQ ID NO: 227722 - RNA, 22 nt, Human
ucagucccuagcaauucaagaa

SEQ ID NO: 227723 - RNA, 21 nt, Human
uccaaaaacagaaaacaugac

SEQ ID NO: 227724 - RNA, 22 nt, Human
uccagaagagaggucucuguga

SEQ ID NO: 227725 - RNA, 24 nt, Human
uccaggcaaacagagccuuuaaaa

SEQ ID NO: 227726 - RNA, 18 nt, Human
uccagucaccaagguccu

SEQ ID NO: 227727 - RNA, 19 nt, Human
ucccaaccccagccucauc

SEQ ID NO: 227728 - RNA, 22 nt, Human
ucccaaccccagccucaucccc

SEQ ID NO: 227729 - RNA, 23 nt, Human
ucccaaccccagccucaucccca

SEQ ID NO: 227730 - RNA, 22 nt, Human
ucccaugacgaaggcugcacag

SEQ ID NO: 227731 - RNA, 20 nt, Human
ucccuguagaaacaccaaaa

SEQ ID NO: 227732 - RNA, 20 nt, Human
ucuacacacacacacacaca

SEQ ID NO: 227733 - RNA, 23 nt, Human
ucucuuccauucccaaaugcugg

SEQ ID NO: 227734 - RNA, 18 nt, Human
ucugugggcagcuagagc

SEQ ID NO: 227735 - RNA, 23 nt, Human
ucuuccaggucccccaaagcugg

SEQ ID NO: 227736 - RNA, 21 nt, Human
ugaaaaugaggggaggggagg

SEQ ID NO: 227737 - RNA, 23 nt, Human
ugaauccagucaccaagguccug

SEQ ID NO: 227738 - RNA, 18 nt, Human
ugaauggcauacaucaga

SEQ ID NO: 227739 - RNA, 21 nt, Human
ugagaagcacagggaacccau

SEQ ID NO: 227740 - RNA, 21 nt, Human
ugagaagcacagggaacccau

SEQ ID NO: 227741 - RNA, 19 nt, Human
ugagaccagagcacucaac

SEQ ID NO: 227742 - RNA, 20 nt, Human
ugaggaaauguuucuucagc

SEQ ID NO: 227743 - RNA, 18 nt, Human
ugaggggaggggaggaug

SEQ ID NO: 227744 - RNA, 22 nt, Human
ugcaaauggcagauaaauacac

SEQ ID NO: 227745 - RNA, 18 nt, Human
ugcugaacuguguaugca

SEQ ID NO: 227746 - RNA, 21 nt, Human
ugcugugaauaauuaaacugg

SEQ ID NO: 227747 - RNA, 24 nt, Human
uggaagugcugcuggcuccgaccc

SEQ ID NO: 227748 - RNA, 21 nt, Human
uggaggagggugaccucuuau

SEQ ID NO: 227749 - RNA, 20 nt, Human
uggcaucugugggcagcuag

SEQ ID NO: 227750 - RNA, 18 nt, Human
ugggaaaaccuaaaagua

SEQ ID NO: 227751 - RNA, 22 nt, Human
ugggguucuuggggguugggga

SEQ ID NO: 227752 - RNA, 19 nt, Human
ugggucuggaggaggguga

SEQ ID NO: 227753 - RNA, 22 nt, Human
uggugaugaagagauagcaggu

SEQ ID NO: 227754 - RNA, 22 nt, Human
uguagggagggagacaugaggu

SEQ ID NO: 227755 - RNA, 23 nt, Human
uuaaauacaaauuacuccaugcc

SEQ ID NO: 227756 - RNA, 21 nt, Human
uucacaagcagccguggccac

SEQ ID NO: 227757 - RNA, 19 nt, Human
uucaccaccgcaaucagau

SEQ ID NO: 227758 - RNA, 20 nt, Human
uucagcuauugcuguaacug

SEQ ID NO: 227759 - RNA, 19 nt, Human
uucagugucuucaguuuuc

SEQ ID NO: 227760 - RNA, 25 nt, Human
uuccaacccacagccagguagaguu

SEQ ID NO: 227761 - RNA, 24 nt, Human
uucuuggggguuggggagagggug

SEQ ID NO: 227762 - RNA, 21 nt, Human
uugaccacugucacaaagugc

SEQ ID NO: 227763 - RNA, 18 nt, Human
uuugucccuuauucuagc

SEQ ID NO: 227764 - RNA, 22 nt, Human
uuuguuuuucaguguuacccga

SEQ ID NO: 227765 - RNA, 18 nt, Human
uuuuccuguuuuuguuuu

SEQ ID NO: 227766 - RNA, 18 nt, Human
agagguguccaggggcca

SEQ ID NO: 227767 - RNA, 22 nt, Human
gagguguccaggggccagcagg

SEQ ID NO: 227768 - RNA, 21 nt, Human
gggguaggggacagggcuggg

SEQ ID NO: 227769 - RNA, 23 nt, Human
uacuggggguaggggacagggcu

SEQ ID NO: 227770 - RNA, 18 nt, Human
uggggguaggggacaggg

SEQ ID NO: 227771 - RNA, 23 nt, Human
uggggguaggggacagggcuggg

SEQ ID NO: 227772 - RNA, 21 nt, Human
aaacgcccccuuuucaucccu

SEQ ID NO: 227773 - RNA, 24 nt, Human
agaggcugggugaugaccggcuuc

SEQ ID NO: 227774 - RNA, 20 nt, Human
aggggcccuggaauacaggc

SEQ ID NO: 227775 - RNA, 18 nt, Human
cacacagcggggaguggc

SEQ ID NO: 227776 - RNA, 20 nt, Human
cacguccccagcaaggcuag

SEQ ID NO: 227777 - RNA, 22 nt, Human
cacuccugggucccagauuccu

SEQ ID NO: 227778 - RNA, 18 nt, Human
cagugcccgaaacgcccc

SEQ ID NO: 227779 - RNA, 20 nt, Human
cagugcccgaaacgcccccu

SEQ ID NO: 227780 - RNA, 23 nt, Human
ccagugcccgaaacgcccccuuu

SEQ ID NO: 227781 - RNA, 20 nt, Human
cccgaaacgcccccuuuuca

SEQ ID NO: 227782 - RNA, 21 nt, Human
cuccugggucccagauuccug

SEQ ID NO: 227783 - RNA, 22 nt, Human
gaaacgcccccuuuucaucccu

SEQ ID NO: 227784 - RNA, 24 nt, Human
gaauggggauaggugggggaauga

SEQ ID NO: 227785 - RNA, 19 nt, Human
gagaauggggauagguggg

SEQ ID NO: 227786 - RNA, 20 nt, Human
gaggaagaggauggacgaug

SEQ ID NO: 227787 - RNA, 20 nt, Human
ggagaguucagccgacuggg

SEQ ID NO: 227788 - RNA, 20 nt, Human
gggaaugaggugagagggga

SEQ ID NO: 227789 - RNA, 24 nt, Human
gggaggggcccuggaauacaggcu

SEQ ID NO: 227790 - RNA, 28 nt, Human
gggauaggugggggaaugaggugagagg

SEQ ID NO: 227791 - RNA, 22 nt, Human
ggggauaggugggggaaugagg

SEQ ID NO: 227792 - RNA, 20 nt, Human
gggggaaugaggugagaggg

SEQ ID NO: 227793 - RNA, 20 nt, Human
guucccauuuugcagaugag

SEQ ID NO: 227794 - RNA, 21 nt, Human
uacaggcuucucccagugccc

SEQ ID NO: 227795 - RNA, 24 nt, Human
ucccaggcgcggggagaggguuca

SEQ ID NO: 227796 - RNA, 24 nt, Human
ucccggugccaagaaggcuuccca

SEQ ID NO: 227797 - RNA, 21 nt, Human
uccgggucccggugccaagaa

SEQ ID NO: 227798 - RNA, 23 nt, Human
uccugggucccagauuccugcuc

SEQ ID NO: 227799 - RNA, 21 nt, Human
ugaggaaacugagguucagag

SEQ ID NO: 227800 - RNA, 24 nt, Human
ugaggaaacugagguucagagagg

SEQ ID NO: 227801 - RNA, 24 nt, Human
ugagguucagagagggcacuuggc

SEQ ID NO: 227802 - RNA, 23 nt, Human
ugcccaaagucacacagcgggga

SEQ ID NO: 227803 - RNA, 22 nt, Human
uggcagaggaagucagguuggg

SEQ ID NO: 227804 - RNA, 19 nt, Human
uggcuucucuggaauaaac

SEQ ID NO: 227805 - RNA, 27 nt, Human
ugggaggggcccuggaauacaggcuuc

SEQ ID NO: 227806 - RNA, 20 nt, Human
ugggaggggcccuggaauag

SEQ ID NO: 227807 - RNA, 18 nt, Human
uggggaggaagaggaugg

SEQ ID NO: 227808 - RNA, 25 nt, Human
uggggaggaagaggauggacgaugg

SEQ ID NO: 227809 - RNA, 19 nt, Human
uguggagggcggcagaggu

SEQ ID NO: 227810 - RNA, 23 nt, Human
uuagagguguggagggcggcaga

SEQ ID NO: 227811 - RNA, 18 nt, Human
uucacguccccagcaagg

SEQ ID NO: 227812 - RNA, 19 nt, Human
uuccugcauuucagcuuca

SEQ ID NO: 227813 - RNA, 22 nt, Human
uuccugcauuucagcuucagaa

SEQ ID NO: 227814 - RNA, 22 nt, Human
uuggaacuggcuuccgugggga

SEQ ID NO: 227815 - RNA, 24 nt, Human
uuuacauacacauguuauaucaua

SEQ ID NO: 227816 - RNA, 19 nt, Human
uuuuuuuuuuuuuuuuuaa

SEQ ID NO: 227817 - RNA, 18 nt, Human
acacugggaauaaggagc

SEQ ID NO: 227818 - RNA, 23 nt, Human
agagaccugggccauugucuggg

SEQ ID NO: 227819 - RNA, 25 nt, Human
auggugacaggauggaagccgguac

SEQ ID NO: 227820 - RNA, 19 nt, Human
cacugggaauaaggagcag

SEQ ID NO: 227821 - RNA, 19 nt, Human
cgggaggggagggcagggc

SEQ ID NO: 227822 - RNA, 20 nt, Human
cuggguugggacauucaggu

SEQ ID NO: 227823 - RNA, 24 nt, Human
gaauaaggagcagagaagggcuaa

SEQ ID NO: 227824 - RNA, 26 nt, Human
gagagaccugggccauugucuggguu

SEQ ID NO: 227825 - RNA, 18 nt, Human
gaucgggaggggagggca

SEQ ID NO: 227826 - RNA, 18 nt, Human
gcuaagcagaccauguga

SEQ ID NO: 227827 - RNA, 20 nt, Human
ggaucgggaggggagggcag

SEQ ID NO: 227828 - RNA, 21 nt, Human
ggaucgggaggggagggcagg

SEQ ID NO: 227829 - RNA, 20 nt, Human
gggaauaaggagcagagaag

SEQ ID NO: 227830 - RNA, 23 nt, Human
uaagaaugugccacagacagaac

SEQ ID NO: 227831 - RNA, 20 nt, Human
uaagcagaccaugugaggaa

SEQ ID NO: 227832 - RNA, 20 nt, Human
ucagggaugcaacaucuggg

SEQ ID NO: 227833 - RNA, 22 nt, Human
uccgggaucgggaggggagggc

SEQ ID NO: 227834 - RNA, 21 nt, Human
ugaggaagucauggugacagg

SEQ ID NO: 227835 - RNA, 21 nt, Human
ugaucugggcucauagaagcc

SEQ ID NO: 227836 - RNA, 18 nt, Human
ugcaagccuggcagugcc

SEQ ID NO: 227837 - RNA, 21 nt, Human
ugccacagacagaacguucag

SEQ ID NO: 227838 - RNA, 22 nt, Human
ugccugaaugcuucugaaacau

SEQ ID NO: 227839 - RNA, 24 nt, Human
uggaacacugggaauaaggagcag

SEQ ID NO: 227840 - RNA, 19 nt, Human
ugggagacugcaagccugg

SEQ ID NO: 227841 - RNA, 18 nt, Human
uggguugggacauucagg

SEQ ID NO: 227842 - RNA, 24 nt, Human
ugucaaggaugguccauuuauagg

SEQ ID NO: 227843 - RNA, 21 nt, Human
uucagguggugaucugggcuc

SEQ ID NO: 227844 - RNA, 19 nt, Human
acuagagguagggguggga

SEQ ID NO: 227845 - RNA, 18 nt, Human
agguaggggugggacagg

SEQ ID NO: 227846 - RNA, 21 nt, Human
agguaggggugggacaggggc

SEQ ID NO: 227847 - RNA, 19 nt, Human
agguguccacggccaggug

SEQ ID NO: 227848 - RNA, 23 nt, Human
cggccagguggugaguuuggggc

SEQ ID NO: 227849 - RNA, 24 nt, Human
gcugacacagguguccacggccag

SEQ ID NO: 227850 - RNA, 20 nt, Human
ggccagguggugaguuuggg

SEQ ID NO: 227851 - RNA, 21 nt, Human
uugagguggacuuaaauuuac

SEQ ID NO: 227852 - RNA, 21 nt, Human
uuuuuuuuuuugagguggacu

SEQ ID NO: 227853 - RNA, 22 nt, Human
uuuuuuuuuuuuuugaggugga

SEQ ID NO: 227854 - RNA, 18 nt, Human
uuuuuuuuuuuuuuuuug

SEQ ID NO: 227855 - RNA, 23 nt, Human
uuuuuuuuuuuuuuuuuuugagg

SEQ ID NO: 227856 - RNA, 22 nt, Human
aauaacacagacaccccauccu

SEQ ID NO: 227857 - RNA, 21 nt, Human
acaugucacucuccacucucu

SEQ ID NO: 227858 - RNA, 21 nt, Human
agaaacacucuggucuacacc

SEQ ID NO: 227859 - RNA, 19 nt, Human
agaacuggggaggcuugag

SEQ ID NO: 227860 - RNA, 19 nt, Human
caaauaacacagacacccc

SEQ ID NO: 227861 - RNA, 20 nt, Human
caacccuggaccucacaccu

SEQ ID NO: 227862 - RNA, 20 nt, Human
caauacaccuccccccauag

SEQ ID NO: 227863 - RNA, 18 nt, Human
cacagacaccccauccua

SEQ ID NO: 227864 - RNA, 24 nt, Human
caccccauccuaucuguguccuca

SEQ ID NO: 227865 - RNA, 21 nt, Human
caggacacagagaggacaaaa

SEQ ID NO: 227866 - RNA, 22 nt, Human
cauccccaucccaugccaaagg

SEQ ID NO: 227867 - RNA, 18 nt, Human
cauggccaguauucccca

SEQ ID NO: 227868 - RNA, 23 nt, Human
ccacaaauaacacagacacccca

SEQ ID NO: 227869 - RNA, 21 nt, Human
ccaggggguccagucccucuc

SEQ ID NO: 227870 - RNA, 25 nt, Human
cccacaaauaacacagacaccccau

SEQ ID NO: 227871 - RNA, 23 nt, Human
cccaugccaaaggaagacccucc

SEQ ID NO: 227872 - RNA, 23 nt, Human
ccccacaaauaacacagacaccc

SEQ ID NO: 227873 - RNA, 22 nt, Human
ccuggaccucacaccuaaggac

SEQ ID NO: 227874 - RNA, 23 nt, Human
cuaaggacaaaggucaguagaac

SEQ ID NO: 227875 - RNA, 24 nt, Human
cucacagccuucucuaggcuuccc

SEQ ID NO: 227876 - RNA, 20 nt, Human
cucuccuuacuucaucccca

SEQ ID NO: 227877 - RNA, 24 nt, Human
cucuuucaucucuguaccccacaa

SEQ ID NO: 227878 - RNA, 19 nt, Human
cugcucagugcuucaugga

SEQ ID NO: 227879 - RNA, 18 nt, Human
cugcugauuucuuuuccu

SEQ ID NO: 227880 - RNA, 21 nt, Human
gacccucccuccuuggcucac

SEQ ID NO: 227881 - RNA, 20 nt, Human
gaucccaccccucuuucauc

SEQ ID NO: 227882 - RNA, 22 nt, Human
ggaucccaccccucuuucaucu

SEQ ID NO: 227883 - RNA, 22 nt, Human
gggugcaggugguaagcuuggg

SEQ ID NO: 227884 - RNA, 19 nt, Human
guaccccacaaauaacaca

SEQ ID NO: 227885 - RNA, 18 nt, Human
uaacacagacaccccauc

SEQ ID NO: 227886 - RNA, 19 nt, Human
uaacacagacaccccaucc

SEQ ID NO: 227887 - RNA, 19 nt, Human
uccagcuucugcucagugc

SEQ ID NO: 227888 - RNA, 21 nt, Human
ucccaugccaaaggaagaccc

SEQ ID NO: 227889 - RNA, 21 nt, Human
uccuuacuucauccccauccc

SEQ ID NO: 227890 - RNA, 22 nt, Human
ucugaggguugucuggaggacu

SEQ ID NO: 227891 - RNA, 18 nt, Human
ucugcugauuucuuuucc

SEQ ID NO: 227892 - RNA, 23 nt, Human
ucuggucuacaccugugucugcu

SEQ ID NO: 227893 - RNA, 25 nt, Human
ugccuccagcuucugcucagugcuu

SEQ ID NO: 227894 - RNA, 21 nt, Human
ugucugcugauuucuuuuccu

SEQ ID NO: 227895 - RNA, 23 nt, Human
uucagcuccauccuugcugugag

SEQ ID NO: 227896 - RNA, 23 nt, Human
uucucuaggcuucccagugccuc

SEQ ID NO: 227897 - RNA, 19 nt, Human
uuuucagcuccauccuugc

SEQ ID NO: 227898 - RNA, 19 nt, Human
cacuguguacagggagagu

SEQ ID NO: 227899 - RNA, 23 nt, Human
ccuggaccccugggucugaggga

SEQ ID NO: 227900 - RNA, 21 nt, Human
ccuggaccucugggucugggg

SEQ ID NO: 227901 - RNA, 23 nt, Human
ccuggacuccugggccugaggga

SEQ ID NO: 227902 - RNA, 18 nt, Human
ccuugguuugagggagga

SEQ ID NO: 227903 - RNA, 19 nt, Human
cugagggaggaggggcugg

SEQ ID NO: 227904 - RNA, 18 nt, Human
cuggaucuaggggaaagg

SEQ ID NO: 227905 - RNA, 18 nt, Human
cugggucugagggaggag

SEQ ID NO: 227906 - RNA, 22 nt, Human
gaacagauauuccugaauuccu

SEQ ID NO: 227907 - RNA, 18 nt, Human
gaggaggggcuggggggu

SEQ ID NO: 227908 - RNA, 19 nt, Human
gccugagggaggaggggcu

SEQ ID NO: 227909 - RNA, 24 nt, Human
ggaaggagggguugggggcuugga

SEQ ID NO: 227910 - RNA, 21 nt, Human
ggacaaaaaaugaaaaaccaa

SEQ ID NO: 227911 - RNA, 22 nt, Human
ggaggaggggcugggaccugga

SEQ ID NO: 227912 - RNA, 18 nt, Human
gggaggaggggcuggggg

SEQ ID NO: 227913 - RNA, 19 nt, Human
gggaggaggggcugggggg

SEQ ID NO: 227914 - RNA, 19 nt, Human
gggaggaggggcugggggg

SEQ ID NO: 227915 - RNA, 19 nt, Human
gggccugagggaggagggg

SEQ ID NO: 227916 - RNA, 21 nt, Human
gggcugggaccuggaccucug

SEQ ID NO: 227917 - RNA, 21 nt, Human
gggggccuggacuccugggcc

SEQ ID NO: 227918 - RNA, 21 nt, Human
gggguugggggcuuggaccuc

SEQ ID NO: 227919 - RNA, 19 nt, Human
gggucugagggaggagggg

SEQ ID NO: 227920 - RNA, 19 nt, Human
gggucugagggaggagggg

SEQ ID NO: 227921 - RNA, 19 nt, Human
gggucugagggaggagggg

SEQ ID NO: 227922 - RNA, 19 nt, Human
gggucugagggaggagggg

SEQ ID NO: 227923 - RNA, 19 nt, Human
gggucugagggaggagggg

SEQ ID NO: 227924 - RNA, 18 nt, Human
gguaagguugggucaacg

SEQ ID NO: 227925 - RNA, 20 nt, Human
ggucuggggaaggagggguu

SEQ ID NO: 227926 - RNA, 21 nt, Human
gguugggggccuggaccccug

SEQ ID NO: 227927 - RNA, 19 nt, Human
gucugagggaggaggggcu

SEQ ID NO: 227928 - RNA, 19 nt, Human
gucugagggaggaggggcu

SEQ ID NO: 227929 - RNA, 19 nt, Human
gucugagggaggaggggcu

SEQ ID NO: 227930 - RNA, 19 nt, Human
gucugagggaggaggggcu

SEQ ID NO: 227931 - RNA, 19 nt, Human
guuugagggaggaggggcu

SEQ ID NO: 227932 - RNA, 20 nt, Human
uccugggccugagggaggag

SEQ ID NO: 227933 - RNA, 20 nt, Human
uccugggucugagggaggag

SEQ ID NO: 227934 - RNA, 20 nt, Human
uccugggucugagggaggag

SEQ ID NO: 227935 - RNA, 20 nt, Human
uccugggucugagggaggag

SEQ ID NO: 227936 - RNA, 23 nt, Human
ucuuagacuuuauuucuggaucu

SEQ ID NO: 227937 - RNA, 23 nt, Human
ugagggaggaggggcuggacucc

SEQ ID NO: 227938 - RNA, 24 nt, Human
ugagggaggaggggcuggacuccu

SEQ ID NO: 227939 - RNA, 21 nt, Human
ugagggaggaggggcugggaa

SEQ ID NO: 227940 - RNA, 23 nt, Human
ugagggaggaggggcugggaccu

SEQ ID NO: 227941 - RNA, 21 nt, Human
ugagggaggaggggcugggga

SEQ ID NO: 227942 - RNA, 23 nt, Human
ugagggaggaggggcuggggggu

SEQ ID NO: 227943 - RNA, 20 nt, Human
uggggaaggagggguugggg

SEQ ID NO: 227944 - RNA, 20 nt, Human
ugggggccuggacuccuggg

SEQ ID NO: 227945 - RNA, 22 nt, Human
ugggggccuggacuccugggcc

SEQ ID NO: 227946 - RNA, 22 nt, Human
ugggggcuuggaccucugaguc

SEQ ID NO: 227947 - RNA, 23 nt, Human
uucuggaucuaggggaaagggac

SEQ ID NO: 227948 - RNA, 19 nt, Human
uugggggucaauuucaugg

SEQ ID NO: 227949 - RNA, 18 nt, Human
aaguagagaggaaccaca

SEQ ID NO: 227950 - RNA, 24 nt, Human
acaccucuccuuccuuccugcuga

SEQ ID NO: 227951 - RNA, 23 nt, Human
agacgcaacccccgcccuggaca

SEQ ID NO: 227952 - RNA, 23 nt, Human
agagaugaacauucucaacaucu

SEQ ID NO: 227953 - RNA, 21 nt, Human
aggaaugagggucugaaagga

SEQ ID NO: 227954 - RNA, 18 nt, Human
agggcaaggaggggacag

SEQ ID NO: 227955 - RNA, 19 nt, Human
caccaggucucacuugccc

SEQ ID NO: 227956 - RNA, 18 nt, Human
caccucuccuuccuuccu

SEQ ID NO: 227957 - RNA, 24 nt, Human
cacuauagaauucagaagauagga

SEQ ID NO: 227958 - RNA, 20 nt, Human
cacugcgcugagacccaggc

SEQ ID NO: 227959 - RNA, 18 nt, Human
caggacgcacagacaccu

SEQ ID NO: 227960 - RNA, 24 nt, Human
cagggcaaggaggggacagagaaa

SEQ ID NO: 227961 - RNA, 18 nt, Human
cccccagguagggggugg

SEQ ID NO: 227962 - RNA, 19 nt, Human
cccccagguaggggguggg

SEQ ID NO: 227963 - RNA, 19 nt, Human
cccugagcuugaggaugaa

SEQ ID NO: 227964 - RNA, 20 nt, Human
ccugcugagccacccucacc

SEQ ID NO: 227965 - RNA, 25 nt, Human
cucaccaggucucacuugcccuguc

SEQ ID NO: 227966 - RNA, 18 nt, Human
cugcgcugagacccaggc

SEQ ID NO: 227967 - RNA, 18 nt, Human
cugcugagccacccucac

SEQ ID NO: 227968 - RNA, 20 nt, Human
cugcugagccacccucacca

SEQ ID NO: 227969 - RNA, 19 nt, Human
cugugccuuccccucgugc

SEQ ID NO: 227970 - RNA, 19 nt, Human
gagagacacggucagccca

SEQ ID NO: 227971 - RNA, 23 nt, Human
ggaaccacaaggacgggccacca

SEQ ID NO: 227972 - RNA, 21 nt, Human
ggacaguuuuggaaauuguuc

SEQ ID NO: 227973 - RNA, 22 nt, Human
gggaaggaaugagggucugaaa

SEQ ID NO: 227974 - RNA, 18 nt, Human
gggagauugagacgcaac

SEQ ID NO: 227975 - RNA, 21 nt, Human
gggucaggggcuggagagaug

SEQ ID NO: 227976 - RNA, 18 nt, Human
ucccccagguagggggug

SEQ ID NO: 227977 - RNA, 19 nt, Human
ucccugcagcaggugggga

SEQ ID NO: 227978 - RNA, 21 nt, Human
ucucugggaaggaaugagggu

SEQ ID NO: 227979 - RNA, 25 nt, Human
ucugggaaggaaugagggucugaaa

SEQ ID NO: 227980 - RNA, 20 nt, Human
ugcccugucccccagguagg

SEQ ID NO: 227981 - RNA, 18 nt, Human
ugcgcugagacccaggca

SEQ ID NO: 227982 - RNA, 21 nt, Human
ugggugcaggacgcacagaca

SEQ ID NO: 227983 - RNA, 21 nt, Human
ugggugcaggacgcacagaca

SEQ ID NO: 227984 - RNA, 28 nt, Human
uuggaaauuguucccaggguucaacuag

SEQ ID NO: 227985 - RNA, 22 nt, Human
uuuuuuuuuuuuccacuucuca

SEQ ID NO: 227986 - RNA, 22 nt, Human
uuuuuuuuuuuuuuuuccacuu

SEQ ID NO: 227987 - RNA, 20 nt, Human
agagccuggggagcuucugg

SEQ ID NO: 227988 - RNA, 24 nt, Human
cagaauccaggggcggggucaccu

SEQ ID NO: 227989 - RNA, 23 nt, Human
ccccaguacuucaguucucugcc

SEQ ID NO: 227990 - RNA, 18 nt, Human
ccuccuccuucuccuccu

SEQ ID NO: 227991 - RNA, 19 nt, Human
ccugcacuagagccugggg

SEQ ID NO: 227992 - RNA, 18 nt, Human
cuccaccuccugcuccuc

SEQ ID NO: 227993 - RNA, 23 nt, Human
cugagccccaggaugugaugccc

SEQ ID NO: 227994 - RNA, 23 nt, Human
cugauucggacccaguggaggag

SEQ ID NO: 227995 - RNA, 21 nt, Human
cuuccagaauccaggggcggg

SEQ ID NO: 227996 - RNA, 22 nt, Human
cuucuccuccugcacuagagcc

SEQ ID NO: 227997 - RNA, 20 nt, Human
gaggaggccccaguacuuca

SEQ ID NO: 227998 - RNA, 21 nt, Human
uaacugggaaucuccaccucc

SEQ ID NO: 227999 - RNA, 22 nt, Human
uaacugggaaucuccaccuccu

SEQ ID NO: 228000 - RNA, 22 nt, Human
uagagccuggggagcuucuggg

SEQ ID NO: 228001 - RNA, 23 nt, Human
ucagcccuugcugccuaugaucu

SEQ ID NO: 228002 - RNA, 19 nt, Human
uccagaauccaggggcggg

SEQ ID NO: 228003 - RNA, 23 nt, Human
ucccacaggggucugagccccag

SEQ ID NO: 228004 - RNA, 19 nt, Human
ucuccaccuccugcuccuc

SEQ ID NO: 228005 - RNA, 20 nt, Human
ucuccuccugcacuagagcc

SEQ ID NO: 228006 - RNA, 20 nt, Human
ugauccaguccagguagcgg

SEQ ID NO: 228007 - RNA, 21 nt, Human
ugucggaccucccacaggggu

SEQ ID NO: 228008 - RNA, 22 nt, Human
uugcugccuaugaucuucuuga

SEQ ID NO: 228009 - RNA, 18 nt, Human
agccccugguuacggcgu

SEQ ID NO: 228010 - RNA, 24 nt, Human
aggaugcaaagaagaugccacucu

SEQ ID NO: 228011 - RNA, 22 nt, Human
cuuucaccauuuuauuucacaa

SEQ ID NO: 228012 - RNA, 20 nt, Human
gaagaugccacucuccaugc

SEQ ID NO: 228013 - RNA, 19 nt, Human
gacauuguccucagcagcu

SEQ ID NO: 228014 - RNA, 22 nt, Human
gcuuugcagaugaggacccccc

SEQ ID NO: 228015 - RNA, 20 nt, Human
uacggcgugcugaaagcggg

SEQ ID NO: 228016 - RNA, 24 nt, Human
ucuccaugcuuugcagaugaggac

SEQ ID NO: 228017 - RNA, 20 nt, Human
ugacuugaacucagguugua

SEQ ID NO: 228018 - RNA, 21 nt, Human
uugcagaugaggaccccccuc

SEQ ID NO: 228019 - RNA, 22 nt, Human
aaaaaugcacauucuccucucc

SEQ ID NO: 228020 - RNA, 19 nt, Human
aaaagcaaugauuuauaau

SEQ ID NO: 228021 - RNA, 21 nt, Human
aagaaaacauuccauuuucac

SEQ ID NO: 228022 - RNA, 24 nt, Human
agaaaauagagucuauucucuucc

SEQ ID NO: 228023 - RNA, 21 nt, Human
aggaagaaagauggcaucuga

SEQ ID NO: 228024 - RNA, 21 nt, Human
aucugugcuaugcaguggugc

SEQ ID NO: 228025 - RNA, 21 nt, Human
cauucuuguugaggucaaaaa

SEQ ID NO: 228026 - RNA, 20 nt, Human
ccacagauacaauuguacgu

SEQ ID NO: 228027 - RNA, 24 nt, Human
cgaaucagagaaaauagagucuau

SEQ ID NO: 228028 - RNA, 19 nt, Human
cucaaaagagaaaaucucc

SEQ ID NO: 228029 - RNA, 22 nt, Human
gaucuuuaaagucauaguccaa

SEQ ID NO: 228030 - RNA, 21 nt, Human
gcacauucuccucucccagaa

SEQ ID NO: 228031 - RNA, 19 nt, Human
guccaaaauaauuuucuuu

SEQ ID NO: 228032 - RNA, 26 nt, Human
uaagaagguaaguuuugcauucaaau

SEQ ID NO: 228033 - RNA, 22 nt, Human
uacuuucccuuucaucauauga

SEQ ID NO: 228034 - RNA, 23 nt, Human
uauuaugggaaacaaaaaaagaa

SEQ ID NO: 228035 - RNA, 23 nt, Human
uccucucccagaagaaaaacgca

SEQ ID NO: 228036 - RNA, 18 nt, Human
ucuccaggaagaaagaug

SEQ ID NO: 228037 - RNA, 24 nt, Human
ucuccaggaagaaagauggcaucu

SEQ ID NO: 228038 - RNA, 21 nt, Human
ugaagaauuaacuaaguccca

SEQ ID NO: 228039 - RNA, 22 nt, Human
ugaaugcaaucaauaguugcca

SEQ ID NO: 228040 - RNA, 18 nt, Human
uucauaaaucugagauug

SEQ ID NO: 228041 - RNA, 21 nt, Human
uuccacuuacuuucccuuuca

SEQ ID NO: 228042 - RNA, 23 nt, Human
uucuccucucccagaagaaaaac

SEQ ID NO: 228043 - RNA, 23 nt, Human
uuggcgcacaccgaaucagagaa

SEQ ID NO: 228044 - RNA, 20 nt, Human
uaagaacaaacucucaauuc

SEQ ID NO: 228045 - RNA, 19 nt, Human
aaaggcauaaauccaagac

SEQ ID NO: 228046 - RNA, 19 nt, Human
aaaggcauaaauccaagac

SEQ ID NO: 228047 - RNA, 20 nt, Human
aaagucacacauccuuuagu

SEQ ID NO: 228048 - RNA, 20 nt, Human
aaagucacacauccuuuagu

SEQ ID NO: 228049 - RNA, 23 nt, Human
aaauccaagacaagaacaaacaa

SEQ ID NO: 228050 - RNA, 23 nt, Human
aaauccaagacaagaacaaacaa

SEQ ID NO: 228051 - RNA, 19 nt, Human
aaaugcuaggaugucugua

SEQ ID NO: 228052 - RNA, 26 nt, Human
aaccaucaccacuacugaaauuuaga

SEQ ID NO: 228053 - RNA, 21 nt, Human
aaccucccucagacauuggca

SEQ ID NO: 228054 - RNA, 23 nt, Human
accacaaauaccauguugagcaa

SEQ ID NO: 228055 - RNA, 22 nt, Human
agacaagaacaaacaaugccug

SEQ ID NO: 228056 - RNA, 22 nt, Human
agacaagaacaaacaaugccug

SEQ ID NO: 228057 - RNA, 21 nt, Human
auacaauuuaucugaugcacu

SEQ ID NO: 228058 - RNA, 19 nt, Human
auaccauguugagcaaaau

SEQ ID NO: 228059 - RNA, 26 nt, Human
caaaaugagcccgacacaaaugcuag

SEQ ID NO: 228060 - RNA, 22 nt, Human
caaauaccauguugagcaaaau

SEQ ID NO: 228061 - RNA, 20 nt, Human
caaaugcuaggaugucugua

SEQ ID NO: 228062 - RNA, 22 nt, Human
caagaacaaacaaugccugcaa

SEQ ID NO: 228063 - RNA, 24 nt, Human
caagaacaaacaaugccugcaauc

SEQ ID NO: 228064 - RNA, 22 nt, Human
caagacaagaacaaacaaugcc

SEQ ID NO: 228065 - RNA, 22 nt, Human
caagacaagaacaaacaaugcc

SEQ ID NO: 228066 - RNA, 27 nt, Human
cacaaauaccauguugagcaaaaugag

SEQ ID NO: 228067 - RNA, 21 nt, Human
cacgacacaaaguaacguucu

SEQ ID NO: 228068 - RNA, 18 nt, Human
ccaagacaagaacaaaca

SEQ ID NO: 228069 - RNA, 18 nt, Human
ccaagacaagaacaaaca

SEQ ID NO: 228070 - RNA, 20 nt, Human
ccccagaaagucacacaucc

SEQ ID NO: 228071 - RNA, 20 nt, Human
ccccagaaagucacacaucc

SEQ ID NO: 228072 - RNA, 22 nt, Human
ccugcaaucuucgcagacugcc

SEQ ID NO: 228073 - RNA, 21 nt, Human
cgacacaaaugcuaggauguc

SEQ ID NO: 228074 - RNA, 26 nt, Human
cguguacaaagcauacauuucaugca

SEQ ID NO: 228075 - RNA, 25 nt, Human
cuauaagcugacucacauaacaugc

SEQ ID NO: 228076 - RNA, 20 nt, Human
gacacaaaugcuaggauguc

SEQ ID NO: 228077 - RNA, 19 nt, Human
gagcaaaaugagcccgaca

SEQ ID NO: 228078 - RNA, 21 nt, Human
gaugcacugcaaaugcaaacg

SEQ ID NO: 228079 - RNA, 20 nt, Human
guacucuucuguccccagaa

SEQ ID NO: 228080 - RNA, 20 nt, Human
guacucuucuguccccagaa

SEQ ID NO: 228081 - RNA, 18 nt, Human
guagauuucucaucaacg

SEQ ID NO: 228082 - RNA, 23 nt, Human
guggaaaaaguagauuucucauc

SEQ ID NO: 228083 - RNA, 18 nt, Human
gugugaugucagggacug

SEQ ID NO: 228084 - RNA, 18 nt, Human
gugugaugucagggacug

SEQ ID NO: 228085 - RNA, 18 nt, Human
uaccauguugagcaaaau

SEQ ID NO: 228086 - RNA, 18 nt, Human
uagcuuuauugaaguguc

SEQ ID NO: 228087 - RNA, 21 nt, Human
uaguggagaggccagguuagu

SEQ ID NO: 228088 - RNA, 21 nt, Human
uaguggagaggccagguuagu

SEQ ID NO: 228089 - RNA, 20 nt, Human
uauauucgcagaguuacaac

SEQ ID NO: 228090 - RNA, 18 nt, Human
uauuucuauuuuaagaaa

SEQ ID NO: 228091 - RNA, 25 nt, Human
ucaucuccuauuucaaccucccuca

SEQ ID NO: 228092 - RNA, 18 nt, Human
uccaagacaagaacaaac

SEQ ID NO: 228093 - RNA, 18 nt, Human
uccaagacaagaacaaac

SEQ ID NO: 228094 - RNA, 18 nt, Human
uccaagacaagaacaaac

SEQ ID NO: 228095 - RNA, 18 nt, Human
uccaagacaagaacaaac

SEQ ID NO: 228096 - RNA, 19 nt, Human
uccaagacaagaacaaaca

SEQ ID NO: 228097 - RNA, 19 nt, Human
uccaagacaagaacaaaca

SEQ ID NO: 228098 - RNA, 20 nt, Human
uccuauuucaaccucccuca

SEQ ID NO: 228099 - RNA, 22 nt, Human
ucuccauggguuugacuguucu

SEQ ID NO: 228100 - RNA, 25 nt, Human
ucuucgcagacugcccugugaaggc

SEQ ID NO: 228101 - RNA, 21 nt, Human
ugagcccgacacaaaugcuag

SEQ ID NO: 228102 - RNA, 22 nt, Human
ugcacugcaaaugcaaacgcuu

SEQ ID NO: 228103 - RNA, 21 nt, Human
uggaaaaaguagauuucucau

SEQ ID NO: 228104 - RNA, 19 nt, Human
uucgcagaguuacaaccau

SEQ ID NO: 228105 - RNA, 19 nt, Human
uuuucaucacgacacaaag

SEQ ID NO: 228106 - RNA, 19 nt, Human
aaaugcuaggaugucugua

SEQ ID NO: 228107 - RNA, 26 nt, Human
aaccaucaccacuacugaaauuuaga

SEQ ID NO: 228108 - RNA, 19 nt, Human
aagcagacuggaguucuuc

SEQ ID NO: 228109 - RNA, 23 nt, Human
accacaaauaccauguugagcaa

SEQ ID NO: 228110 - RNA, 19 nt, Human
auaccauguugagcaaaau

SEQ ID NO: 228111 - RNA, 21 nt, Human
auguacaaagcauacauuuca

SEQ ID NO: 228112 - RNA, 26 nt, Human
caaaaugagcccgacacaaaugcuag

SEQ ID NO: 228113 - RNA, 22 nt, Human
caaauaccauguugagcaaaau

SEQ ID NO: 228114 - RNA, 27 nt, Human
cacaaauaccauguugagcaaaaugag

SEQ ID NO: 228115 - RNA, 21 nt, Human
cacgacacaaagaaacguucu

SEQ ID NO: 228116 - RNA, 24 nt, Human
caggccagcaaacucucuucccaa

SEQ ID NO: 228117 - RNA, 26 nt, Human
cauguacaaagcauacauuucaugca

SEQ ID NO: 228118 - RNA, 25 nt, Human
cuauaagcugacucacauaacaugc

SEQ ID NO: 228119 - RNA, 20 nt, Human
gaagugucauguacaaagca

SEQ ID NO: 228120 - RNA, 20 nt, Human
gacacaaaugcuaggauguc

SEQ ID NO: 228121 - RNA, 19 nt, Human
gagcaaaaugagcccgaca

SEQ ID NO: 228122 - RNA, 18 nt, Human
uaccauguugagcaaaau

SEQ ID NO: 228123 - RNA, 20 nt, Human
uauauucgcagaguuacaac

SEQ ID NO: 228124 - RNA, 25 nt, Human
uauuucuauuuuaagaaauauaaaa

SEQ ID NO: 228125 - RNA, 19 nt, Human
ucacgacacaaagaaacgu

SEQ ID NO: 228126 - RNA, 27 nt, Human
ucaucuccuauuucaaccucccugaga

SEQ ID NO: 228127 - RNA, 19 nt, Human
ucgaaguacaggccagcaa

SEQ ID NO: 228128 - RNA, 22 nt, Human
ucuccauggguuugacuguucu

SEQ ID NO: 228129 - RNA, 21 nt, Human
ugagcccgacacaaaugcuag

SEQ ID NO: 228130 - RNA, 22 nt, Human
uuuagaauuuuuguaucagagc

SEQ ID NO: 228131 - RNA, 26 nt, Human
uuucuauuuuaagaaauauaaaaugu

SEQ ID NO: 228132 - RNA, 26 nt, Human
aaucccagcaacuugggaggccaaga

SEQ ID NO: 228133 - RNA, 21 nt, Human
ggcuugugucaguaaucccag

SEQ ID NO: 228134 - RNA, 23 nt, Human
gguggcuugugucaguaauccca

SEQ ID NO: 228135 - RNA, 24 nt, Human
gguggcuugugucaguaaucccag

SEQ ID NO: 228136 - RNA, 19 nt, Human
guaaucccagcaacuuggg

SEQ ID NO: 228137 - RNA, 24 nt, Human
guggcuugugucaguaaucccagc

SEQ ID NO: 228138 - RNA, 18 nt, Human
gugugaugugagggacug

SEQ ID NO: 228139 - RNA, 25 nt, Human
uaaaacaucaucuaguuaaaauagg

SEQ ID NO: 228140 - RNA, 22 nt, Human
uggcuugugucaguaaucccag

SEQ ID NO: 228141 - RNA, 24 nt, Human
uggcuugugucaguaaucccagca

SEQ ID NO: 228142 - RNA, 24 nt, Human
ugugagggacugugcucuaugaua

SEQ ID NO: 228143 - RNA, 23 nt, Human
uuaaaacacaagcuaaaugguac

SEQ ID NO: 228144 - RNA, 21 nt, Human
caugaaaagcaaaacuggaaa

SEQ ID NO: 228145 - RNA, 23 nt, Human
cauggguuuccaugaaaagcaaa

SEQ ID NO: 228146 - RNA, 27 nt, Human
ccaugaaaagcaaaacuggaaauaacc

SEQ ID NO: 228147 - RNA, 21 nt, Human
cuuuuaguaaaguguugaaac

SEQ ID NO: 228148 - RNA, 22 nt, Human
cuuuuuuuuuuuuuuuuuuggg

SEQ ID NO: 228149 - RNA, 26 nt, Human
cuuuuuuuuuuuuuuuuuugguuuuu

SEQ ID NO: 228150 - RNA, 22 nt, Human
gccgccuuuuuuuuuuuuuuuu

SEQ ID NO: 228151 - RNA, 24 nt, Human
gccuuuuuuuuuuuuuuuuuuggu

SEQ ID NO: 228152 - RNA, 23 nt, Human
ggcaaacugcauguguuggaggc

SEQ ID NO: 228153 - RNA, 23 nt, Human
ggccgccuuuuuuuuuuuuuuuu

SEQ ID NO: 228154 - RNA, 21 nt, Human
gguacuaauuuccuaaaguuu

SEQ ID NO: 228155 - RNA, 18 nt, Human
gugugaugucagggacug

SEQ ID NO: 228156 - RNA, 24 nt, Human
guugaauacuacacagacuuaaaa

SEQ ID NO: 228157 - RNA, 18 nt, Human
uagaagcauggguuucca

SEQ ID NO: 228158 - RNA, 25 nt, Human
uaugaaguaaauauauguauaaaca

SEQ ID NO: 228159 - RNA, 20 nt, Human
uauuuugacaggaucccugg

SEQ ID NO: 228160 - RNA, 23 nt, Human
ugauaaaaacauuuauagaagca

SEQ ID NO: 228161 - RNA, 24 nt, Human
uggaaauaaccaaaugugcauuaa

SEQ ID NO: 228162 - RNA, 24 nt, Human
uucuuuauauuuauuuugugauaa

SEQ ID NO: 228163 - RNA, 18 nt, Human
acuaugcuccagccuggg

SEQ ID NO: 228164 - RNA, 23 nt, Human
acuaugcuccagccugggcagug

SEQ ID NO: 228165 - RNA, 19 nt, Human
acucuccaccuucucugcc

SEQ ID NO: 228166 - RNA, 24 nt, Human
acuguaucauuguuaguaauguug

SEQ ID NO: 228167 - RNA, 24 nt, Human
acuuuuucagaaagaacagcguug

SEQ ID NO: 228168 - RNA, 21 nt, Human
agaagcaguagaaucacaagc

SEQ ID NO: 228169 - RNA, 23 nt, Human
agaauuagcaagaauguaaauaa

SEQ ID NO: 228170 - RNA, 19 nt, Human
agcaaaaauagagaaugaa

SEQ ID NO: 228171 - RNA, 23 nt, Human
agccugggcaacauagcaagacc

SEQ ID NO: 228172 - RNA, 24 nt, Human
agccugggcaacauagcaagaccu

SEQ ID NO: 228173 - RNA, 22 nt, Human
agccugggcagugugaguuaaa

SEQ ID NO: 228174 - RNA, 23 nt, Human
aggaguucaagaccagccugggc

SEQ ID NO: 228175 - RNA, 24 nt, Human
aggcugagucaggaggaucacuug

SEQ ID NO: 228176 - RNA, 24 nt, Human
agucaggaggaucacuugagcuug

SEQ ID NO: 228177 - RNA, 20 nt, Human
aucuugccacuaugcuccag

SEQ ID NO: 228178 - RNA, 24 nt, Human
aucuugccacuaugcuccagccug

SEQ ID NO: 228179 - RNA, 23 nt, Human
augaucuugccacuaugcuccag

SEQ ID NO: 228180 - RNA, 21 nt, Human
caacauagcaagaccuugucu

SEQ ID NO: 228181 - RNA, 26 nt, Human
caacauagcaagaccuugucuugaca

SEQ ID NO: 228182 - RNA, 22 nt, Human
caccuucucugccccaagaagg

SEQ ID NO: 228183 - RNA, 19 nt, Human
caccuucucugccccaagg

SEQ ID NO: 228184 - RNA, 20 nt, Human
cacuaugcuccagccugggc

SEQ ID NO: 228185 - RNA, 24 nt, Human
cacuaugcuccagccugggcagug

SEQ ID NO: 228186 - RNA, 18 nt, Human
cauagcaagaccuugucu

SEQ ID NO: 228187 - RNA, 21 nt, Human
cauagcaagaccuugucuuga

SEQ ID NO: 228188 - RNA, 21 nt, Human
cauuuuauagacuccagaagu

SEQ ID NO: 228189 - RNA, 21 nt, Human
ccacuaugcuccagccugggc

SEQ ID NO: 228190 - RNA, 22 nt, Human
ccacuaugcuccagccugggca

SEQ ID NO: 228191 - RNA, 22 nt, Human
ccacuaugcuccagccugggca

SEQ ID NO: 228192 - RNA, 22 nt, Human
ccacuaugcuccagccugggca

SEQ ID NO: 228193 - RNA, 23 nt, Human
ccacuaugcuccagccugggcag

SEQ ID NO: 228194 - RNA, 22 nt, Human
ccugcaguccuagcuacuuggg

SEQ ID NO: 228195 - RNA, 21 nt, Human
ccugggcaacauagcaagacc

SEQ ID NO: 228196 - RNA, 23 nt, Human
cgauguguacuuuuucagaaaga

SEQ ID NO: 228197 - RNA, 22 nt, Human
cgauguguacuuuuucaggggc

SEQ ID NO: 228198 - RNA, 18 nt, Human
cuucucugccccaagaaa

SEQ ID NO: 228199 - RNA, 24 nt, Human
cuugaaucaucuauuggugagaca

SEQ ID NO: 228200 - RNA, 22 nt, Human
gccacuaugcuccagccugggc

SEQ ID NO: 228201 - RNA, 24 nt, Human
gccacuaugcuccagccugggcag

SEQ ID NO: 228202 - RNA, 20 nt, Human
guugaagcugagcuggagau

SEQ ID NO: 228203 - RNA, 26 nt, Human
uaaaugauguucuugaaucccugaag

SEQ ID NO: 228204 - RNA, 23 nt, Human
uaagaagcaguagaaucacaagc

SEQ ID NO: 228205 - RNA, 21 nt, Human
uagcaaaaauagagaaugaaa

SEQ ID NO: 228206 - RNA, 20 nt, Human
uagcaagaccuugucuugac

SEQ ID NO: 228207 - RNA, 24 nt, Human
ucacauacaugacaauuguauaug

SEQ ID NO: 228208 - RNA, 19 nt, Human
ucagaaagaacagcguuga

SEQ ID NO: 228209 - RNA, 21 nt, Human
uccaccuucucugccccaaga

SEQ ID NO: 228210 - RNA, 22 nt, Human
ugcaaugagcuaugaucuugcc

SEQ ID NO: 228211 - RNA, 24 nt, Human
ugccugcaguccuagcuacuuggg

SEQ ID NO: 228212 - RNA, 19 nt, Human
ugcuccagccugggcagug

SEQ ID NO: 228213 - RNA, 19 nt, Human
ugggaggcugagucaggag

SEQ ID NO: 228214 - RNA, 24 nt, Human
ugggaggcugagucaggaggauca

SEQ ID NO: 228215 - RNA, 23 nt, Human
uguguaauaaaacuacauugaau

SEQ ID NO: 228216 - RNA, 19 nt, Human
uuaguaauguugggucuuu

SEQ ID NO: 228217 - RNA, 18 nt, Human
uugaagcugagcuggaga

SEQ ID NO: 228218 - RNA, 22 nt, Human
uugaggccaggaguucaagacc

SEQ ID NO: 228219 - RNA, 25 nt, Human
uugggaggcugagucaggaggauca

SEQ ID NO: 228220 - RNA, 23 nt, Human
uuuagcaaaaauagagaaugaaa

SEQ ID NO: 228221 - RNA, 23 nt, Human
aaaacgcaagauacagaaaaaca

SEQ ID NO: 228222 - RNA, 24 nt, Human
aagccuggaaacaaaguuaauucu

SEQ ID NO: 228223 - RNA, 19 nt, Human
aagcgacgaauaaaaaucc

SEQ ID NO: 228224 - RNA, 24 nt, Human
aagggagaagagauuuuggcauuu

SEQ ID NO: 228225 - RNA, 23 nt, Human
aauguguguguauacagguaugu

SEQ ID NO: 228226 - RNA, 20 nt, Human
aauuuuguuuaggaccuuau

SEQ ID NO: 228227 - RNA, 20 nt, Human
agaaaaacaggcauaauuug

SEQ ID NO: 228228 - RNA, 21 nt, Human
agaguagcaaaagccuggagg

SEQ ID NO: 228229 - RNA, 21 nt, Human
agugaagaguagcaaaagccu

SEQ ID NO: 228230 - RNA, 22 nt, Human
agugaagaguagcaaaagccug

SEQ ID NO: 228231 - RNA, 21 nt, Human
cgaugauggagggagaaggga

SEQ ID NO: 228232 - RNA, 18 nt, Human
cugagugaagaguagcaa

SEQ ID NO: 228233 - RNA, 19 nt, Human
gacaaaaggguaaaaaaug

SEQ ID NO: 228234 - RNA, 26 nt, Human
gaugauggagggagaagggagaagag

SEQ ID NO: 228235 - RNA, 25 nt, Human
uaaaauaagcgacgaauaaaaaucc

SEQ ID NO: 228236 - RNA, 19 nt, Human
uaagcgacgaauaaaaauc

SEQ ID NO: 228237 - RNA, 19 nt, Human
uagcaaaagccuggaaaca

SEQ ID NO: 228238 - RNA, 25 nt, Human
ugagugaauguguguguauacaggu

SEQ ID NO: 228239 - RNA, 18 nt, Human
ugugagugaaugugugug

SEQ ID NO: 228240 - RNA, 19 nt, Human
ugugagugaaugugugugu

SEQ ID NO: 228241 - RNA, 22 nt, Human
ugugagugaauguguguguaua

SEQ ID NO: 228242 - RNA, 22 nt, Human
uucaggauguuuauuguagcug

SEQ ID NO: 228243 - RNA, 23 nt, Human
uuugaaguguacauuuuaguuug

SEQ ID NO: 228244 - RNA, 24 nt, Human
aaagagaaaaagauuauaauccag

SEQ ID NO: 228245 - RNA, 26 nt, Human
aaauagcuaggacuacagguacacac

SEQ ID NO: 228246 - RNA, 20 nt, Human
aauagucacugaacguaagc

SEQ ID NO: 228247 - RNA, 19 nt, Human
aaucauagcucacugcagc

SEQ ID NO: 228248 - RNA, 25 nt, Human
accucagcuucccaaauagcuagga

SEQ ID NO: 228249 - RNA, 23 nt, Human
acuaugaaagauaaagagaaaaa

SEQ ID NO: 228250 - RNA, 19 nt, Human
acugcagccucaaacuccu

SEQ ID NO: 228251 - RNA, 25 nt, Human
agaaaaaaaacaaaaucaguuaaga

SEQ ID NO: 228252 - RNA, 26 nt, Human
agaaaaaaaacaaaaucaguuaagaa

SEQ ID NO: 228253 - RNA, 22 nt, Human
agagauggagucuugcucuauc

SEQ ID NO: 228254 - RNA, 20 nt, Human
aggaucaucaacacuacaga

SEQ ID NO: 228255 - RNA, 21 nt, Human
agguacacaccagcaugccag

SEQ ID NO: 228256 - RNA, 23 nt, Human
aguacaguggcacaaucauagcu

SEQ ID NO: 228257 - RNA, 18 nt, Human
auagcucacugcagccuc

SEQ ID NO: 228258 - RNA, 18 nt, Human
auugguucauucaaccac

SEQ ID NO: 228259 - RNA, 25 nt, Human
caaacuccugggcucaagcgacccu

SEQ ID NO: 228260 - RNA, 24 nt, Human
caaacucuacugaggagaaauaau

SEQ ID NO: 228261 - RNA, 27 nt, Human
caagcgacccucccaccucagcuuccc

SEQ ID NO: 228262 - RNA, 28 nt, Human
caagcgacccucccaccucagcuuccca

SEQ ID NO: 228263 - RNA, 20 nt, Human
caccucagcuucccaaauag

SEQ ID NO: 228264 - RNA, 28 nt, Human
cagaaaaaaaacaaaaucaguuaagacc

SEQ ID NO: 228265 - RNA, 24 nt, Human
cagccucaaacuccugggcucaag

SEQ ID NO: 228266 - RNA, 27 nt, Human
cauucaaccacauauaugcauacucag

SEQ ID NO: 228267 - RNA, 22 nt, Human
ccacaauuuauauucucacauu

SEQ ID NO: 228268 - RNA, 20 nt, Human
cccaccucagcuucccaaau

SEQ ID NO: 228269 - RNA, 22 nt, Human
cccaggcuggaguacaguggca

SEQ ID NO: 228270 - RNA, 24 nt, Human
ccucccaccucagcuucccaaaua

SEQ ID NO: 228271 - RNA, 20 nt, Human
ccugggcucaagcgacccuc

SEQ ID NO: 228272 - RNA, 24 nt, Human
cucaagcgacccucccaccucagc

SEQ ID NO: 228273 - RNA, 21 nt, Human
cucacugcagccucaaacucc

SEQ ID NO: 228274 - RNA, 24 nt, Human
cucacugcagccucaaacuccugg

SEQ ID NO: 228275 - RNA, 23 nt, Human
cuccugggcucaagcgacccucc

SEQ ID NO: 228276 - RNA, 25 nt, Human
cuccugggcucaagcgacccuccca

SEQ ID NO: 228277 - RNA, 23 nt, Human
cugcagccucaaacuccugggcu

SEQ ID NO: 228278 - RNA, 23 nt, Human
gaaaagauacaaucacacauugg

SEQ ID NO: 228279 - RNA, 23 nt, Human
gcgacccucccaccucagcuucc

SEQ ID NO: 228280 - RNA, 19 nt, Human
gcuggaguacaguggcaca

SEQ ID NO: 228281 - RNA, 19 nt, Human
ggacuacagguacacacca

SEQ ID NO: 228282 - RNA, 24 nt, Human
gucuugcucuaucucccaggcugg

SEQ ID NO: 228283 - RNA, 28 nt, Human
uaaaaaaacuaugaaagauaaagagaaa

SEQ ID NO: 228284 - RNA, 18 nt, Human
uacaaucacacauugguu

SEQ ID NO: 228285 - RNA, 24 nt, Human
uagcucacugcagccucaaacucc

SEQ ID NO: 228286 - RNA, 21 nt, Human
uaggacuacagguacacacca

SEQ ID NO: 228287 - RNA, 19 nt, Human
uauagugguagauaagaua

SEQ ID NO: 228288 - RNA, 25 nt, Human
uaugcaggucaaacagucacauaau

SEQ ID NO: 228289 - RNA, 24 nt, Human
ucacugcagccucaaacuccuggg

SEQ ID NO: 228290 - RNA, 20 nt, Human
uccaaacucuacugaggaga

SEQ ID NO: 228291 - RNA, 23 nt, Human
ucccaggcuggaguacaguggca

SEQ ID NO: 228292 - RNA, 21 nt, Human
uccucuaugaaaaugccuuau

SEQ ID NO: 228293 - RNA, 21 nt, Human
uccugggcucaagcgacccuc

SEQ ID NO: 228294 - RNA, 19 nt, Human
ucuaucucccaggcuggag

SEQ ID NO: 228295 - RNA, 23 nt, Human
ucuugcucuaucucccaggcugg

SEQ ID NO: 228296 - RNA, 24 nt, Human
ucuugcucuaucucccaggcugga

SEQ ID NO: 228297 - RNA, 19 nt, Human
uggaguacaguggcacaau

SEQ ID NO: 228298 - RNA, 20 nt, Human
uggcacaaucauagcucacu

SEQ ID NO: 228299 - RNA, 23 nt, Human
uggcacaaucauagcucacugca

SEQ ID NO: 228300 - RNA, 21 nt, Human
uuaaaaaaacuaugaaagaua

SEQ ID NO: 228301 - RNA, 24 nt, Human
uucccaaauagcuaggacuacagg

SEQ ID NO: 228302 - RNA, 25 nt, Human
uuuuuaauucauccauuuauuuauu

SEQ ID NO: 228303 - RNA, 25 nt, Human
uuuuuuuuuuuuagagauggagucu

SEQ ID NO: 228304 - RNA, 23 nt, Human
aaaaaacaacuuaaaucagcuca

SEQ ID NO: 228305 - RNA, 22 nt, Human
aaaaagaaauccucuuguugga

SEQ ID NO: 228306 - RNA, 25 nt, Human
aaaaauucuucaccuaauuaaagag

SEQ ID NO: 228307 - RNA, 22 nt, Human
aaaacaaauucuuuuaauucaa

SEQ ID NO: 228308 - RNA, 24 nt, Human
aaaacccuuuccuguccuucacuu

SEQ ID NO: 228309 - RNA, 21 nt, Human
aaaauaccaugguagccccag

SEQ ID NO: 228310 - RNA, 18 nt, Human
aaaaugcaccccccaacc

SEQ ID NO: 228311 - RNA, 18 nt, Human
aaacagauagaugauaau

SEQ ID NO: 228312 - RNA, 20 nt, Human
aaacucugccaggaagagcc

SEQ ID NO: 228313 - RNA, 21 nt, Human
aaagaggaguuucagagacaa

SEQ ID NO: 228314 - RNA, 21 nt, Human
aacagaaccuugugguccagc

SEQ ID NO: 228315 - RNA, 22 nt, Human
aaccccacauccacaccugcua

SEQ ID NO: 228316 - RNA, 19 nt, Human
aagagguugaacaaaaaca

SEQ ID NO: 228317 - RNA, 22 nt, Human
aaguugucuccccuuguuuccu

SEQ ID NO: 228318 - RNA, 22 nt, Human
aaucaaauauggcaauggaaac

SEQ ID NO: 228319 - RNA, 20 nt, Human
acaaaaaacaacuuaaauca

SEQ ID NO: 228320 - RNA, 24 nt, Human
acaugaggccaggaguuugagacu

SEQ ID NO: 228321 - RNA, 20 nt, Human
accaccagaggaaucuacaa

SEQ ID NO: 228322 - RNA, 21 nt, Human
acgacagcgacaaaaccaaug

SEQ ID NO: 228323 - RNA, 24 nt, Human
acuccagccuggucaacagaguga

SEQ ID NO: 228324 - RNA, 24 nt, Human
acugcacuccagccuggucaacag

SEQ ID NO: 228325 - RNA, 24 nt, Human
acugcacuccagccuggucaacag

SEQ ID NO: 228326 - RNA, 20 nt, Human
acugucgcguacacaugugu

SEQ ID NO: 228327 - RNA, 21 nt, Human
acuuugggaggcugagguggg

SEQ ID NO: 228328 - RNA, 22 nt, Human
agaaagauggggacaggccaaa

SEQ ID NO: 228329 - RNA, 25 nt, Human
agaccaccaccagaggaaucuacaa

SEQ ID NO: 228330 - RNA, 20 nt, Human
agagguugcagugaacccag

SEQ ID NO: 228331 - RNA, 21 nt, Human
agaucccuuuugcagcuucug

SEQ ID NO: 228332 - RNA, 23 nt, Human
agccuggucaacagagugagacc

SEQ ID NO: 228333 - RNA, 24 nt, Human
agccuggucaacagagugagaccu

SEQ ID NO: 228334 - RNA, 19 nt, Human
aggcagagguugcagugaa

SEQ ID NO: 228335 - RNA, 24 nt, Human
aggcugaagugggaggauugcuug

SEQ ID NO: 228336 - RNA, 21 nt, Human
aggcugaggugggcagaucac

SEQ ID NO: 228337 - RNA, 22 nt, Human
aggugggcagaucacaugaggg

SEQ ID NO: 228338 - RNA, 20 nt, Human
agguguugagucaaugcugu

SEQ ID NO: 228339 - RNA, 19 nt, Human
aguggugaaucacugucag

SEQ ID NO: 228340 - RNA, 18 nt, Human
auaguauuuuuuucccca

SEQ ID NO: 228341 - RNA, 21 nt, Human
auaguauuuuuuuccccaacu

SEQ ID NO: 228342 - RNA, 24 nt, Human
aucucaccacugcacuccagccug

SEQ ID NO: 228343 - RNA, 21 nt, Human
auggcaacgaaagauggggcc

SEQ ID NO: 228344 - RNA, 20 nt, Human
auugcaauuaacauacagag

SEQ ID NO: 228345 - RNA, 19 nt, Human
auugcuugagcccaggagg

SEQ ID NO: 228346 - RNA, 19 nt, Human
auuguugcuucugcucgug

SEQ ID NO: 228347 - RNA, 19 nt, Human
caagacccggucucuacug

SEQ ID NO: 228348 - RNA, 20 nt, Human
caauguuuguugaugacauu

SEQ ID NO: 228349 - RNA, 21 nt, Human
cacaccugcuaacaaacaaaa

SEQ ID NO: 228350 - RNA, 20 nt, Human
caccccccaaccaguaauug

SEQ ID NO: 228351 - RNA, 18 nt, Human
caccuaguagaugcccac

SEQ ID NO: 228352 - RNA, 22 nt, Human
cacuccagccuggucaacagag

SEQ ID NO: 228353 - RNA, 24 nt, Human
cacuccagccuggucaacagagug

SEQ ID NO: 228354 - RNA, 18 nt, Human
cacugcacuccagccugg

SEQ ID NO: 228355 - RNA, 21 nt, Human
cacugcacuccagccugguca

SEQ ID NO: 228356 - RNA, 22 nt, Human
cacugcacuccagccuggucaa

SEQ ID NO: 228357 - RNA, 24 nt, Human
cacugcacuccagccuggucaaca

SEQ ID NO: 228358 - RNA, 24 nt, Human
cagaucacaugaggccaggaguuu

SEQ ID NO: 228359 - RNA, 23 nt, Human
cagcgguggcucacaacucuaau

SEQ ID NO: 228360 - RNA, 23 nt, Human
caggaagagccuuaucuguuuuu

SEQ ID NO: 228361 - RNA, 21 nt, Human
caguaauugcaauuaacauac

SEQ ID NO: 228362 - RNA, 22 nt, Human
caugaggccaggaguuugagac

SEQ ID NO: 228363 - RNA, 20 nt, Human
ccacauauauauuacauaua

SEQ ID NO: 228364 - RNA, 26 nt, Human
ccacauccacaccugcuaacaaacaa

SEQ ID NO: 228365 - RNA, 19 nt, Human
ccacugcacuccagccugg

SEQ ID NO: 228366 - RNA, 19 nt, Human
ccacugcacuccagccugg

SEQ ID NO: 228367 - RNA, 20 nt, Human
ccacugcacuccagccuggu

SEQ ID NO: 228368 - RNA, 23 nt, Human
ccacugcacuccagccuggucaa

SEQ ID NO: 228369 - RNA, 20 nt, Human
ccagcagcuggaagugaaau

SEQ ID NO: 228370 - RNA, 21 nt, Human
cccacauccacaccugcuaac

SEQ ID NO: 228371 - RNA, 21 nt, Human
ccccuuguuuccuuuccauuc

SEQ ID NO: 228372 - RNA, 18 nt, Human
cccuuguuuccuuuccau

SEQ ID NO: 228373 - RNA, 25 nt, Human
cgaaaauaccuuacuguaaaaauaa

SEQ ID NO: 228374 - RNA, 23 nt, Human
cgacuacuauaacaagcaacccc

SEQ ID NO: 228375 - RNA, 22 nt, Human
cuacuauaacaagcaaccccaa

SEQ ID NO: 228376 - RNA, 21 nt, Human
cucugccaggaagagccuuau

SEQ ID NO: 228377 - RNA, 24 nt, Human
cuguacuuugggaggcugaggugg

SEQ ID NO: 228378 - RNA, 18 nt, Human
cuguccuaugcagucauu

SEQ ID NO: 228379 - RNA, 20 nt, Human
cuugucagccuggagaccac

SEQ ID NO: 228380 - RNA, 19 nt, Human
cuuguuuccuuuccauucu

SEQ ID NO: 228381 - RNA, 23 nt, Human
cuuugggaggcugaggugggcag

SEQ ID NO: 228382 - RNA, 24 nt, Human
cuuuguaggaaugaagaauggcaa

SEQ ID NO: 228383 - RNA, 25 nt, Human
gaaccaaagaaaacauuucacuaaa

SEQ ID NO: 228384 - RNA, 21 nt, Human
gaagcggaaaggaggccaaga

SEQ ID NO: 228385 - RNA, 24 nt, Human
gaagugggaggauugcuugagccc

SEQ ID NO: 228386 - RNA, 23 nt, Human
gacaaagaggaguuucagagaca

SEQ ID NO: 228387 - RNA, 22 nt, Human
gagcaugaccacauaaccccac

SEQ ID NO: 228388 - RNA, 19 nt, Human
gaggagaagcggaaaggag

SEQ ID NO: 228389 - RNA, 19 nt, Human
gaggccugcuaaagaccua

SEQ ID NO: 228390 - RNA, 24 nt, Human
gaucacaugaggccaggaguuuga

SEQ ID NO: 228391 - RNA, 24 nt, Human
gcacuccagccuggucaacagagu

SEQ ID NO: 228392 - RNA, 18 nt, Human
gcagagaggagaagcgga

SEQ ID NO: 228393 - RNA, 19 nt, Human
gcagcauggcaagacccgg

SEQ ID NO: 228394 - RNA, 24 nt, Human
gcccaggaggcagagguugcagug

SEQ ID NO: 228395 - RNA, 23 nt, Human
gccugggcagcauggcaagaccc

SEQ ID NO: 228396 - RNA, 22 nt, Human
gcguacacaugugugaaguagc

SEQ ID NO: 228397 - RNA, 22 nt, Human
ggagaagcggaaaggaggccaa

SEQ ID NO: 228398 - RNA, 25 nt, Human
ggcagaucacaugaggccaggaguu

SEQ ID NO: 228399 - RNA, 19 nt, Human
gugaacccagaucucacca

SEQ ID NO: 228400 - RNA, 20 nt, Human
gugggaaaauaaaaugaguu

SEQ ID NO: 228401 - RNA, 18 nt, Human
guugcuucugcucgugcc

SEQ ID NO: 228402 - RNA, 18 nt, Human
guuuccuuuccauucugg

SEQ ID NO: 228403 - RNA, 19 nt, Human
uaaaaugcaccccccaacc

SEQ ID NO: 228404 - RNA, 18 nt, Human
uaaagaaaaggcaugauu

SEQ ID NO: 228405 - RNA, 24 nt, Human
uaaauuacucuauuuuccaaaaca

SEQ ID NO: 228406 - RNA, 27 nt, Human
uaaccccacauccacaccugcuaacaa

SEQ ID NO: 228407 - RNA, 20 nt, Human
uaaucauguuugaaggauuu

SEQ ID NO: 228408 - RNA, 20 nt, Human
uaauccagauuagugcccaa

SEQ ID NO: 228409 - RNA, 21 nt, Human
uaauuuaugaauaaaacccuu

SEQ ID NO: 228410 - RNA, 18 nt, Human
uaccugcccucauagaaa

SEQ ID NO: 228411 - RNA, 19 nt, Human
uaccugcccucauagaaag

SEQ ID NO: 228412 - RNA, 21 nt, Human
uagaaugacucaaccugagug

SEQ ID NO: 228413 - RNA, 24 nt, Human
uagagauagauagauagauagaua

SEQ ID NO: 228414 - RNA, 22 nt, Human
uagauagauagauagauagaua

SEQ ID NO: 228415 - RNA, 22 nt, Human
uagauagauagauagauagaua

SEQ ID NO: 228416 - RNA, 22 nt, Human
uagauagauagauagauagaua

SEQ ID NO: 228417 - RNA, 22 nt, Human
uagauagauagauagauagaua

SEQ ID NO: 228418 - RNA, 22 nt, Human
uagauagauagauagauagaua

SEQ ID NO: 228419 - RNA, 22 nt, Human
uagauagauagauagauagaua

SEQ ID NO: 228420 - RNA, 22 nt, Human
uagauagauagauagauagaua

SEQ ID NO: 228421 - RNA, 22 nt, Human
uagauagauagauagauagaug

SEQ ID NO: 228422 - RNA, 25 nt, Human
uagauagauagauagaugauagaua

SEQ ID NO: 228423 - RNA, 25 nt, Human
uagauagauagauagaugauagaua

SEQ ID NO: 228424 - RNA, 18 nt, Human
uaguauuuuuuuccccaa

SEQ ID NO: 228425 - RNA, 21 nt, Human
uauaacaagcaaccccaacau

SEQ ID NO: 228426 - RNA, 25 nt, Human
uauaacaagcaaccccaacauuuca

SEQ ID NO: 228427 - RNA, 24 nt, Human
uauaucugaucaaguuaucaagga

SEQ ID NO: 228428 - RNA, 23 nt, Human
uaucugaucaaguuaucaaggag

SEQ ID NO: 228429 - RNA, 18 nt, Human
uauuugaaggugggaaaa

SEQ ID NO: 228430 - RNA, 20 nt, Human
uauuugaaggugggaaaaua

SEQ ID NO: 228431 - RNA, 18 nt, Human
ucaaugcuguugcgaguc

SEQ ID NO: 228432 - RNA, 18 nt, Human
ucagugaauuaauacaga

SEQ ID NO: 228433 - RNA, 19 nt, Human
ucaguugacgacagcgaca

SEQ ID NO: 228434 - RNA, 21 nt, Human
uccaaaguugauguaauccaa

SEQ ID NO: 228435 - RNA, 22 nt, Human
uccacaccugcuaacaaacaaa

SEQ ID NO: 228436 - RNA, 21 nt, Human
uccacuuuauuuuuucucugc

SEQ ID NO: 228437 - RNA, 23 nt, Human
uccagccuggucaacagagugag

SEQ ID NO: 228438 - RNA, 24 nt, Human
uccagccuggucaacagagugaga

SEQ ID NO: 228439 - RNA, 23 nt, Human
uccauauauucaacauuuauuuc

SEQ ID NO: 228440 - RNA, 23 nt, Human
uccccuuguuuccuuuccauucu

SEQ ID NO: 228441 - RNA, 20 nt, Human
ucccugaggcaucuagggcc

SEQ ID NO: 228442 - RNA, 23 nt, Human
uccuuauuuccauuucugguuuu

SEQ ID NO: 228443 - RNA, 24 nt, Human
ucucuaauuauagcacaguggcug

SEQ ID NO: 228444 - RNA, 20 nt, Human
ucugagugacucagcagccu

SEQ ID NO: 228445 - RNA, 25 nt, Human
ucuguccuaugcagucauuuaggaa

SEQ ID NO: 228446 - RNA, 25 nt, Human
ugaaaaagaaauccucuuguuggaa

SEQ ID NO: 228447 - RNA, 20 nt, Human
ugaaaugcagaucagaccca

SEQ ID NO: 228448 - RNA, 22 nt, Human
ugaagugggaggauugcuugag

SEQ ID NO: 228449 - RNA, 24 nt, Human
ugaagugggaggauugcuugagcc

SEQ ID NO: 228450 - RNA, 23 nt, Human
ugacaaagaggaguuucagagac

SEQ ID NO: 228451 - RNA, 19 nt, Human
ugagcaugaccacauaacc

SEQ ID NO: 228452 - RNA, 19 nt, Human
ugaggugggcagaucacau

SEQ ID NO: 228453 - RNA, 26 nt, Human
ugaggugggcagaucacaugaggcca

SEQ ID NO: 228454 - RNA, 21 nt, Human
ugauaauacuuauauuugaag

SEQ ID NO: 228455 - RNA, 20 nt, Human
ugccccuacagacucaaagc

SEQ ID NO: 228456 - RNA, 19 nt, Human
uggaccgacuacuauaaca

SEQ ID NO: 228457 - RNA, 22 nt, Human
uggacucuauucagugucaugu

SEQ ID NO: 228458 - RNA, 22 nt, Human
ugggaggcugaagugggaggau

SEQ ID NO: 228459 - RNA, 24 nt, Human
ugggaggcugaagugggaggauug

SEQ ID NO: 228460 - RNA, 20 nt, Human
ugggaggcugaggugggcag

SEQ ID NO: 228461 - RNA, 24 nt, Human
ugggaggcugaggugggcagauca

SEQ ID NO: 228462 - RNA, 21 nt, Human
ugggcagaucacaugaggcca

SEQ ID NO: 228463 - RNA, 24 nt, Human
ugggcagaucacaugaggccagga

SEQ ID NO: 228464 - RNA, 21 nt, Human
ugguagccccagcuauuuggg

SEQ ID NO: 228465 - RNA, 23 nt, Human
uguaauguagggaagcugcaugu

SEQ ID NO: 228466 - RNA, 20 nt, Human
uguggcacacgaugggcauc

SEQ ID NO: 228467 - RNA, 24 nt, Human
ugugugaaguagcuagaacauacc

SEQ ID NO: 228468 - RNA, 18 nt, Human
uguuggaaacaaaagacg

SEQ ID NO: 228469 - RNA, 21 nt, Human
uuaaucauguuugaaggauuu

SEQ ID NO: 228470 - RNA, 22 nt, Human
uugacgacagcgacaaaaccaa

SEQ ID NO: 228471 - RNA, 24 nt, Human
uugcuugagcccaggaggcagagg

SEQ ID NO: 228472 - RNA, 20 nt, Human
uugggaggcugaagugggag

SEQ ID NO: 228473 - RNA, 25 nt, Human
uugggaggcugaggugggcagauca

SEQ ID NO: 228474 - RNA, 22 nt, Human
uuuaaaaugcaccccccaacca

SEQ ID NO: 228475 - RNA, 18 nt, Human
uuucccuacaaacugaac

SEQ ID NO: 228476 - RNA, 22 nt, Human
uuugagauuugcucauuccccu

SEQ ID NO: 228477 - RNA, 24 nt, Human
uuugcucauuccccuguauuuccc

SEQ ID NO: 228478 - RNA, 22 nt, Human
uuuucuuuguuuuguuguuucu

SEQ ID NO: 228479 - RNA, 24 nt, Human
uuuuucuuucccuacaaacugaac

SEQ ID NO: 228480 - RNA, 18 nt, Human
aucccaucuuucuucuug

SEQ ID NO: 228481 - RNA, 19 nt, Human
cccaucuuucuucuugucc

SEQ ID NO: 228482 - RNA, 24 nt, Human
ccucucaagguugcuggcagaggu

SEQ ID NO: 228483 - RNA, 20 nt, Human
gcugagggaugguuucaacc

SEQ ID NO: 228484 - RNA, 18 nt, Human
ggagcugagggaugguuu

SEQ ID NO: 228485 - RNA, 18 nt, Human
uaacaaucucccucuagg

SEQ ID NO: 228486 - RNA, 20 nt, Human
ucccaucuuucuucuugucc

SEQ ID NO: 228487 - RNA, 22 nt, Human
ucucaagguugcuggcagaggu

SEQ ID NO: 228488 - RNA, 19 nt, Human
ugccuggagugaagauucu

SEQ ID NO: 228489 - RNA, 21 nt, Human
ugcuggcagaggugguugggg

SEQ ID NO: 228490 - RNA, 25 nt, Human
uggcagaggugguuggggcuauggu

SEQ ID NO: 228491 - RNA, 22 nt, Human
ugguuggggcuaugugccugga

SEQ ID NO: 228492 - RNA, 18 nt, Human
uguccuuccucucaaggu

SEQ ID NO: 228493 - RNA, 21 nt, Human
accacgccgcaccagggcacc

SEQ ID NO: 228494 - RNA, 26 nt, Human
accagcuuaggcccagccccagcccc

SEQ ID NO: 228495 - RNA, 24 nt, Human
aggggccucccugccgcccuggcc

SEQ ID NO: 228496 - RNA, 19 nt, Human
cacagccccgcggcuccuc

SEQ ID NO: 228497 - RNA, 20 nt, Human
caccagggcaccagcuuagg

SEQ ID NO: 228498 - RNA, 20 nt, Human
cagccccagccccaagguca

SEQ ID NO: 228499 - RNA, 18 nt, Human
cagcuccgggccacacuc

SEQ ID NO: 228500 - RNA, 19 nt, Human
caggagaaaugagugagcg

SEQ ID NO: 228501 - RNA, 19 nt, Human
caggggccucccugccgcc

SEQ ID NO: 228502 - RNA, 24 nt, Human
ccagcuuaggcccagccccagccc

SEQ ID NO: 228503 - RNA, 22 nt, Human
ccaggggccucccugccgcccu

SEQ ID NO: 228504 - RNA, 19 nt, Human
cccaaggucacgccagccu

SEQ ID NO: 228505 - RNA, 18 nt, Human
cccagccagucccgcucg

SEQ ID NO: 228506 - RNA, 30 nt, Human
cccagccccagccccaaggucacgccagcc

SEQ ID NO: 228507 - RNA, 21 nt, Human
cccgcagcauccucggccacc

SEQ ID NO: 228508 - RNA, 24 nt, Human
cccgcagcauccucggccacccac

SEQ ID NO: 228509 - RNA, 18 nt, Human
cccggccaggggccuccc

SEQ ID NO: 228510 - RNA, 24 nt, Human
ccgccccgcagcauccucggccac

SEQ ID NO: 228511 - RNA, 20 nt, Human
ccgccgggcgcgcgcgcgga

SEQ ID NO: 228512 - RNA, 18 nt, Human
ccgcgcucucucgcgcug

SEQ ID NO: 228513 - RNA, 24 nt, Human
ccugccgcccuggcugucccgggc

SEQ ID NO: 228514 - RNA, 19 nt, Human
cgccgccgggcgcgcgcgc

SEQ ID NO: 228515 - RNA, 23 nt, Human
cgcgcugucagcaccuggagcgc

SEQ ID NO: 228516 - RNA, 21 nt, Human
cggccacccacgcgcuguccc

SEQ ID NO: 228517 - RNA, 22 nt, Human
cgugggcccagcucaugcccca

SEQ ID NO: 228518 - RNA, 22 nt, Human
cucccugccgcccuggcugucc

SEQ ID NO: 228519 - RNA, 20 nt, Human
cugugcgccgagcccgccuc

SEQ ID NO: 228520 - RNA, 27 nt, Human
cuuaggcccagccccagccccaagguc

SEQ ID NO: 228521 - RNA, 23 nt, Human
gagcacagccccgcggcuccucg

SEQ ID NO: 228522 - RNA, 26 nt, Human
gagcacagccccgcggcuccucgcac

SEQ ID NO: 228523 - RNA, 19 nt, Human
gagggccgcgcucucucgc

SEQ ID NO: 228524 - RNA, 22 nt, Human
gcccagccccagccccaagguc

SEQ ID NO: 228525 - RNA, 19 nt, Human
gccgggcgcgcgcgcggag

SEQ ID NO: 228526 - RNA, 19 nt, Human
gcggggccaggucgggguc

SEQ ID NO: 228527 - RNA, 18 nt, Human
ggcgccggagcuaccgcc

SEQ ID NO: 228528 - RNA, 21 nt, Human
ggcuccucgcaccagcagccc

SEQ ID NO: 228529 - RNA, 19 nt, Human
ucccauccuggagcggggc

SEQ ID NO: 228530 - RNA, 20 nt, Human
ucccgggccagcuccgggcc

SEQ ID NO: 228531 - RNA, 23 nt, Human
ucgccuugcuccugagggccgcg

SEQ ID NO: 228532 - RNA, 23 nt, Human
uggagcggggccaggucgggguc

SEQ ID NO: 228533 - RNA, 19 nt, Human
ugggagagaccacgccgca

SEQ ID NO: 228534 - RNA, 24 nt, Human
uugcuccugagggccgcgcucucu

SEQ ID NO: 228535 - RNA, 19 nt, Human
aaacaagcaacaacaaaaa

SEQ ID NO: 228536 - RNA, 24 nt, Human
aaagugcugggauuacaggcauga

SEQ ID NO: 228537 - RNA, 24 nt, Human
aagcaauccacccgccucagccuc

SEQ ID NO: 228538 - RNA, 23 nt, Human
aagcugaaacaucucaacuucca

SEQ ID NO: 228539 - RNA, 26 nt, Human
aagugauucucgugccucagccuccc

SEQ ID NO: 228540 - RNA, 19 nt, Human
aagugcugggauuacaggc

SEQ ID NO: 228541 - RNA, 21 nt, Human
aagugcugggauuacaggcau

SEQ ID NO: 228542 - RNA, 26 nt, Human
aagugcugggauuacaggcaugagcc

SEQ ID NO: 228543 - RNA, 20 nt, Human
accacauuuauuaaccaugg

SEQ ID NO: 228544 - RNA, 25 nt, Human
acccgccucagccucccaaagugcu

SEQ ID NO: 228545 - RNA, 20 nt, Human
acgagguuuugccacguugg

SEQ ID NO: 228546 - RNA, 24 nt, Human
acgagguuuugccacguuggccag

SEQ ID NO: 228547 - RNA, 19 nt, Human
acuaaacucaucgugagca

SEQ ID NO: 228548 - RNA, 21 nt, Human
acuuaauaauauacaagaaaa

SEQ ID NO: 228549 - RNA, 21 nt, Human
agcaauccacccgccucagcc

SEQ ID NO: 228550 - RNA, 19 nt, Human
aggacagauguuggugaua

SEQ ID NO: 228551 - RNA, 18 nt, Human
aggagaaagcgaaauagg

SEQ ID NO: 228552 - RNA, 21 nt, Human
aggagaaagcgaaauagggaa

SEQ ID NO: 228553 - RNA, 18 nt, Human
agggagaaagugagccga

SEQ ID NO: 228554 - RNA, 22 nt, Human
agguuuugccacguuggccagg

SEQ ID NO: 228555 - RNA, 23 nt, Human
aguagcugggauuacaggagugu

SEQ ID NO: 228556 - RNA, 18 nt, Human
agugcugggauuacaggc

SEQ ID NO: 228557 - RNA, 18 nt, Human
aucucaacuuccagaaau

SEQ ID NO: 228558 - RNA, 19 nt, Human
auuacaggagugugccacc

SEQ ID NO: 228559 - RNA, 22 nt, Human
auucuuuguacauauuccuucu

SEQ ID NO: 228560 - RNA, 24 nt, Human
caaagugcugggauuacaggcaug

SEQ ID NO: 228561 - RNA, 21 nt, Human
caaaucccaaaugaaacccaa

SEQ ID NO: 228562 - RNA, 22 nt, Human
caagucauagcaagaaaaaaaa

SEQ ID NO: 228563 - RNA, 22 nt, Human
caagugauucucgugccucagc

SEQ ID NO: 228564 - RNA, 22 nt, Human
cacauuuggggcaacaaguuuu

SEQ ID NO: 228565 - RNA, 24 nt, Human
caccacgcccggcuaauuuuuaac

SEQ ID NO: 228566 - RNA, 23 nt, Human
cacccgccucagccucccaaagu

SEQ ID NO: 228567 - RNA, 24 nt, Human
cacguuggccaggcuggucucaaa

SEQ ID NO: 228568 - RNA, 22 nt, Human
cacugcaaccccgcuuccuggg

SEQ ID NO: 228569 - RNA, 26 nt, Human
caguagcugggauuacaggagugugc

SEQ ID NO: 228570 - RNA, 23 nt, Human
ccaaagugcugggauuacaggca

SEQ ID NO: 228571 - RNA, 24 nt, Human
ccaaagugcugggauuacaggcau

SEQ ID NO: 228572 - RNA, 20 nt, Human
ccaccacgcccggcuaauuu

SEQ ID NO: 228573 - RNA, 26 nt, Human
ccacccgccucagccucccaaagugc

SEQ ID NO: 228574 - RNA, 19 nt, Human
ccacguuggccaggcuggu

SEQ ID NO: 228575 - RNA, 22 nt, Human
ccacguuggccaggcuggucuc

SEQ ID NO: 228576 - RNA, 24 nt, Human
ccauuagucagaugucuggguggu

SEQ ID NO: 228577 - RNA, 24 nt, Human
cccaaagugcugggauuacaggca

SEQ ID NO: 228578 - RNA, 19 nt, Human
cccaggcuggaguguagug

SEQ ID NO: 228579 - RNA, 23 nt, Human
ccccaguagcugggauuacagga

SEQ ID NO: 228580 - RNA, 24 nt, Human
ccgccucagccucccaaagugcug

SEQ ID NO: 228581 - RNA, 22 nt, Human
ccugggcucaagcaauccaccc

SEQ ID NO: 228582 - RNA, 20 nt, Human
ccuggguucaagugauucuc

SEQ ID NO: 228583 - RNA, 24 nt, Human
cgccucagccucccaaagugcugg

SEQ ID NO: 228584 - RNA, 20 nt, Human
cgcugcguggccuggaggac

SEQ ID NO: 228585 - RNA, 23 nt, Human
cucacugcaaccccgcuuccugg

SEQ ID NO: 228586 - RNA, 24 nt, Human
cucagccuccccaguagcugggau

SEQ ID NO: 228587 - RNA, 23 nt, Human
cucgugccucagccuccccagua

SEQ ID NO: 228588 - RNA, 20 nt, Human
cucuguugcccaggcuggag

SEQ ID NO: 228589 - RNA, 22 nt, Human
cugcaaccccgcuuccuggguu

SEQ ID NO: 228590 - RNA, 23 nt, Human
cugcaaccccgcuuccuggguuc

SEQ ID NO: 228591 - RNA, 21 nt, Human
cuuccuggguucaagugauuc

SEQ ID NO: 228592 - RNA, 19 nt, Human
cuuuguacauauuccuucu

SEQ ID NO: 228593 - RNA, 21 nt, Human
gaaacaucucaacuuccagaa

SEQ ID NO: 228594 - RNA, 18 nt, Human
gauuacaggagugugcca

SEQ ID NO: 228595 - RNA, 18 nt, Human
gauuacaggcaugagcca

SEQ ID NO: 228596 - RNA, 22 nt, Human
gauuacaggcaugagccaccgc

SEQ ID NO: 228597 - RNA, 22 nt, Human
gauuacaggcaugagccaccgc

SEQ ID NO: 228598 - RNA, 21 nt, Human
gauucucgugccucagccucc

SEQ ID NO: 228599 - RNA, 24 nt, Human
gcaauccacccgccucagccuccc

SEQ ID NO: 228600 - RNA, 24 nt, Human
gcccaggcuggaguguaguggugu

SEQ ID NO: 228601 - RNA, 22 nt, Human
gcgcugugaggggcggaggggc

SEQ ID NO: 228602 - RNA, 27 nt, Human
gcggaccugggcgcugugaggggcggc

SEQ ID NO: 228603 - RNA, 25 nt, Human
gcucuguugcccaggcuggagugua

SEQ ID NO: 228604 - RNA, 22 nt, Human
ggagaaagcgaaauagggaagu

SEQ ID NO: 228605 - RNA, 22 nt, Human
ggauuacaggcaugagccaccg

SEQ ID NO: 228606 - RNA, 24 nt, Human
gggcgcugugaggggcggaggggc

SEQ ID NO: 228607 - RNA, 24 nt, Human
gggcucaagcaauccacccgccuc

SEQ ID NO: 228608 - RNA, 24 nt, Human
gugauucucgugccucagccuccc

SEQ ID NO: 228609 - RNA, 23 nt, Human
gugccucagccuccccaguagcu

SEQ ID NO: 228610 - RNA, 25 nt, Human
uaaaaauaaaauugccaacccccaa

SEQ ID NO: 228611 - RNA, 24 nt, Human
uaacagagacgagguuuugccacg

SEQ ID NO: 228612 - RNA, 18 nt, Human
uaaccacuaaaaaggugu

SEQ ID NO: 228613 - RNA, 24 nt, Human
uacaaacaagcaacaacaaaaagu

SEQ ID NO: 228614 - RNA, 23 nt, Human
uacaggagugugccaccacgccc

SEQ ID NO: 228615 - RNA, 23 nt, Human
uacaggcaugagccaccgcgccc

SEQ ID NO: 228616 - RNA, 19 nt, Human
uacauguacacauuguauu

SEQ ID NO: 228617 - RNA, 22 nt, Human
uaccuuuggcucacugcaaccc

SEQ ID NO: 228618 - RNA, 18 nt, Human
uagcaagaaaaaaaacau

SEQ ID NO: 228619 - RNA, 18 nt, Human
uagucagaugucugggug

SEQ ID NO: 228620 - RNA, 24 nt, Human
uauacaaacaagcaacaacaaaaa

SEQ ID NO: 228621 - RNA, 20 nt, Human
ucaaaaauaccagaguccua

SEQ ID NO: 228622 - RNA, 20 nt, Human
ucacugcaaccccgcuuccu

SEQ ID NO: 228623 - RNA, 23 nt, Human
ucacugcaaccccgcuuccuggg

SEQ ID NO: 228624 - RNA, 24 nt, Human
ucacugcaaccccgcuuccugggu

SEQ ID NO: 228625 - RNA, 18 nt, Human
ucagccuccccaguagcu

SEQ ID NO: 228626 - RNA, 20 nt, Human
ucagccuccccaguagcugg

SEQ ID NO: 228627 - RNA, 23 nt, Human
ucaucauguaaacaaaagaauau

SEQ ID NO: 228628 - RNA, 21 nt, Human
uccacccgccucagccuccca

SEQ ID NO: 228629 - RNA, 23 nt, Human
uccagaaauaugguugccagauc

SEQ ID NO: 228630 - RNA, 24 nt, Human
ucccaaagugcugggauuacaggc

SEQ ID NO: 228631 - RNA, 18 nt, Human
uccugggcucaagcaauc

SEQ ID NO: 228632 - RNA, 19 nt, Human
uccugggcucaagcaaucc

SEQ ID NO: 228633 - RNA, 20 nt, Human
uccuggguucaagugauucu

SEQ ID NO: 228634 - RNA, 21 nt, Human
uccuggguucaagugauucuc

SEQ ID NO: 228635 - RNA, 24 nt, Human
uccuggguucaagugauucucgug

SEQ ID NO: 228636 - RNA, 20 nt, Human
ucuaaacuuuacacacuaaa

SEQ ID NO: 228637 - RNA, 21 nt, Human
ucuagggaggaugcaagaaaa

SEQ ID NO: 228638 - RNA, 23 nt, Human
ucucaaacuccugggcucaagca

SEQ ID NO: 228639 - RNA, 22 nt, Human
ucuugcucuguugcccaggcug

SEQ ID NO: 228640 - RNA, 23 nt, Human
ucuugcucuguugcccaggcugg

SEQ ID NO: 228641 - RNA, 24 nt, Human
ucuugcucuguugcccaggcugga

SEQ ID NO: 228642 - RNA, 20 nt, Human
ugaaaaauaaaaagggagaa

SEQ ID NO: 228643 - RNA, 19 nt, Human
ugagaagaguacaguucuu

SEQ ID NO: 228644 - RNA, 24 nt, Human
ugccacguuggccaggcuggucuc

SEQ ID NO: 228645 - RNA, 27 nt, Human
ugccacguuggccaggcuggucucaaa

SEQ ID NO: 228646 - RNA, 21 nt, Human
ugcccaggcuggaguguagug

SEQ ID NO: 228647 - RNA, 24 nt, Human
ugcccaggcuggaguguaguggug

SEQ ID NO: 228648 - RNA, 21 nt, Human
ugccucagccuccccaguagc

SEQ ID NO: 228649 - RNA, 24 nt, Human
ugccucagccuccccaguagcugg

SEQ ID NO: 228650 - RNA, 24 nt, Human
uggccaggcuggucucaaacuccu

SEQ ID NO: 228651 - RNA, 22 nt, Human
uggccuggaggaccgacugcac

SEQ ID NO: 228652 - RNA, 22 nt, Human
ugggauuacaggagugugccac

SEQ ID NO: 228653 - RNA, 24 nt, Human
ugggauuacaggagugugccacca

SEQ ID NO: 228654 - RNA, 18 nt, Human
ugggauuacaggcaugag

SEQ ID NO: 228655 - RNA, 19 nt, Human
ugggauuacaggcaugagc

SEQ ID NO: 228656 - RNA, 21 nt, Human
ugggauuacaggcaugagcca

SEQ ID NO: 228657 - RNA, 22 nt, Human
ugggauuacaggcaugagccac

SEQ ID NO: 228658 - RNA, 23 nt, Human
ugggauuacaggcaugagccacc

SEQ ID NO: 228659 - RNA, 24 nt, Human
ugggauuacaggcaugagccaccg

SEQ ID NO: 228660 - RNA, 24 nt, Human
ugggauuacaggcaugagccaccg

SEQ ID NO: 228661 - RNA, 23 nt, Human
uggguucaagugauucucgugcc

SEQ ID NO: 228662 - RNA, 23 nt, Human
ugguuuggugaaaaauaaaaagg

SEQ ID NO: 228663 - RNA, 24 nt, Human
uguaccuuuggcucacugcaaccc

SEQ ID NO: 228664 - RNA, 19 nt, Human
ugugaggggcggaggggcu

SEQ ID NO: 228665 - RNA, 19 nt, Human
uguugcccaggcuggagug

SEQ ID NO: 228666 - RNA, 19 nt, Human
uuagguauuauccaucgcu

SEQ ID NO: 228667 - RNA, 23 nt, Human
uucaagugauucucgugccucag

SEQ ID NO: 228668 - RNA, 20 nt, Human
uucaucauguaaacaaaaga

SEQ ID NO: 228669 - RNA, 24 nt, Human
uugcccaggcuggaguguaguggu

SEQ ID NO: 228670 - RNA, 24 nt, Human
uugcucuguugcccaggcuggagu

SEQ ID NO: 228671 - RNA, 23 nt, Human
uuguacauauuccuucuguuuug

SEQ ID NO: 228672 - RNA, 24 nt, Human
uuuggugaaaaauaaaaagggaga

SEQ ID NO: 228673 - RNA, 20 nt, Human
uuuguagcucuacaaauggu

SEQ ID NO: 228674 - RNA, 19 nt, Human
uuuugugaacucugucagg

SEQ ID NO: 228675 - RNA, 23 nt, Human
uuuugugaacucugucaggguga

SEQ ID NO: 228676 - RNA, 20 nt, Human
aaaaaaaaccaaacuauucu

SEQ ID NO: 228677 - RNA, 19 nt, Human
aaagcacccuccagcaacc

SEQ ID NO: 228678 - RNA, 23 nt, Human
aaagcacccuccagcaacccucc

SEQ ID NO: 228679 - RNA, 18 nt, Human
aagcacccuccagcaacc

SEQ ID NO: 228680 - RNA, 22 nt, Human
aagcaggguagagaacucgcac

SEQ ID NO: 228681 - RNA, 23 nt, Human
acacacacacacacacacacaca

SEQ ID NO: 228682 - RNA, 23 nt, Human
acacacacacacacacacacaca

SEQ ID NO: 228683 - RNA, 23 nt, Human
acacacacacacacacacacaca

SEQ ID NO: 228684 - RNA, 23 nt, Human
acacacacacacacacacacaca

SEQ ID NO: 228685 - RNA, 23 nt, Human
acacacacacacacacacacaca

SEQ ID NO: 228686 - RNA, 23 nt, Human
acacacacacacacacacacaca

SEQ ID NO: 228687 - RNA, 23 nt, Human
acacacacacacacacacacaca

SEQ ID NO: 228688 - RNA, 23 nt, Human
acacacacacacacacacacaca

SEQ ID NO: 228689 - RNA, 23 nt, Human
acacacacacacacacacacaca

SEQ ID NO: 228690 - RNA, 28 nt, Human
acacacacacacacacacacacagaucu

SEQ ID NO: 228691 - RNA, 33 nt, Human
acauagggacacacacacacacacacacacagu

SEQ ID NO: 228692 - RNA, 26 nt, Human
acccaauaaagcacccuccagcaacc

SEQ ID NO: 228693 - RNA, 21 nt, Human
acucgcguucucucgcccgcu

SEQ ID NO: 228694 - RNA, 19 nt, Human
auaaagcacccuccagcaa

SEQ ID NO: 228695 - RNA, 21 nt, Human
caacccucccaccccucaccc

SEQ ID NO: 228696 - RNA, 20 nt, Human
cacacacacacacacacaca

SEQ ID NO: 228697 - RNA, 20 nt, Human
cacacacacacacacacaca

SEQ ID NO: 228698 - RNA, 20 nt, Human
cacacacacacacacacaca

SEQ ID NO: 228699 - RNA, 20 nt, Human
cacacacacacacacacaca

SEQ ID NO: 228700 - RNA, 20 nt, Human
cacacacacacacacacaca

SEQ ID NO: 228701 - RNA, 20 nt, Human
cacacacacacacacacaca

SEQ ID NO: 228702 - RNA, 20 nt, Human
cacacacacacacacacaca

SEQ ID NO: 228703 - RNA, 20 nt, Human
cacacacacacacacacaca

SEQ ID NO: 228704 - RNA, 20 nt, Human
cacacacacacacacacaca

SEQ ID NO: 228705 - RNA, 20 nt, Human
cacacacacacacacacaca

SEQ ID NO: 228706 - RNA, 20 nt, Human
cacacacacacacacacaca

SEQ ID NO: 228707 - RNA, 20 nt, Human
cacacacacacacacacaca

SEQ ID NO: 228708 - RNA, 20 nt, Human
cacacacacacacacacaca

SEQ ID NO: 228709 - RNA, 20 nt, Human
cacacacacacacacacaca

SEQ ID NO: 228710 - RNA, 20 nt, Human
cacacacacacacacacaca

SEQ ID NO: 228711 - RNA, 22 nt, Human
cacacacacacacacacacaca

SEQ ID NO: 228712 - RNA, 22 nt, Human
cacacacacacacacacacaca

SEQ ID NO: 228713 - RNA, 22 nt, Human
cacacacacacacacacacaca

SEQ ID NO: 228714 - RNA, 22 nt, Human
cacacacacacacacacacaca

SEQ ID NO: 228715 - RNA, 22 nt, Human
cacacacacacacacacacaca

SEQ ID NO: 228716 - RNA, 26 nt, Human
cacacacacacacacacacacacaca

SEQ ID NO: 228717 - RNA, 26 nt, Human
cacacacacacacacacacacacaca

SEQ ID NO: 228718 - RNA, 26 nt, Human
cacacacacacacacacacacacaca

SEQ ID NO: 228719 - RNA, 26 nt, Human
cacacacacacacacacacacacaca

SEQ ID NO: 228720 - RNA, 26 nt, Human
cacacacacacacacacacacacaca

SEQ ID NO: 228721 - RNA, 26 nt, Human
cacacacacacacacacacacacaca

SEQ ID NO: 228722 - RNA, 26 nt, Human
cacacacacacacacacacacacaca

SEQ ID NO: 228723 - RNA, 26 nt, Human
cacacacacacacacacacacacaca

SEQ ID NO: 228724 - RNA, 26 nt, Human
cacacacacacacacacacacacaca

SEQ ID NO: 228725 - RNA, 26 nt, Human
cacacacacacacacacacacacaca

SEQ ID NO: 228726 - RNA, 26 nt, Human
caccucggucccacacgcgccggggg

SEQ ID NO: 228727 - RNA, 19 nt, Human
cagcaacccucccaccccu

SEQ ID NO: 228728 - RNA, 19 nt, Human
cagcaacccucccaccccu

SEQ ID NO: 228729 - RNA, 20 nt, Human
cagcaacccucccaccccuc

SEQ ID NO: 228730 - RNA, 26 nt, Human
ccacccaauaaagcacccuccagcaa

SEQ ID NO: 228731 - RNA, 19 nt, Human
cccaccccucacccgauac

SEQ ID NO: 228732 - RNA, 20 nt, Human
ccccgcgccacacccgccac

SEQ ID NO: 228733 - RNA, 22 nt, Human
ccccgcgccacacccgccacuu

SEQ ID NO: 228734 - RNA, 26 nt, Human
ccgcuaccagccccgcgccacacccg

SEQ ID NO: 228735 - RNA, 24 nt, Human
ccuccacccaauaaagcacccucc

SEQ ID NO: 228736 - RNA, 19 nt, Human
cuccagcaacccucccacc

SEQ ID NO: 228737 - RNA, 25 nt, Human
cuccagcaacccucccaccccucac

SEQ ID NO: 228738 - RNA, 19 nt, Human
cugggugccggggauccug

SEQ ID NO: 228739 - RNA, 31 nt, Human
gacauagggacacacacacacacacacacag

SEQ ID NO: 228740 - RNA, 19 nt, Human
gagaacucgcacggcuccg

SEQ ID NO: 228741 - RNA, 22 nt, Human
gcaacccucccaccccucaccc

SEQ ID NO: 228742 - RNA, 18 nt, Human
gccccgcgccacacccgc

SEQ ID NO: 228743 - RNA, 22 nt, Human
uaaaaaaaaaaccaaacuauuc

SEQ ID NO: 228744 - RNA, 22 nt, Human
uaaagcacccuccagcaacccu

SEQ ID NO: 228745 - RNA, 26 nt, Human
uaaagcacccuccagcaacccuccca

SEQ ID NO: 228746 - RNA, 31 nt, Human
uagggacacacacacacacacacacacacag

SEQ ID NO: 228747 - RNA, 22 nt, Human
uccacccaauaaagcacccucc

SEQ ID NO: 228748 - RNA, 20 nt, Human
uccagcaacccucccacccc

SEQ ID NO: 228749 - RNA, 26 nt, Human
uccagcaacccucccaccccucaccc

SEQ ID NO: 228750 - RNA, 25 nt, Human
ucccaccccucacccgauacauaga

SEQ ID NO: 228751 - RNA, 25 nt, Human
uccggccgcuaccagccccgcgcca

SEQ ID NO: 228752 - RNA, 28 nt, Human
uggugcccuccacccaauaaagcacccu

SEQ ID NO: 228753 - RNA, 19 nt, Human
aacacaagccccaccaacc

SEQ ID NO: 228754 - RNA, 18 nt, Human
aagcaaggacaagaaaca

SEQ ID NO: 228755 - RNA, 20 nt, Human
aaggccaggacggcuccaga

SEQ ID NO: 228756 - RNA, 22 nt, Human
cacaagccccaccaaccccagc

SEQ ID NO: 228757 - RNA, 19 nt, Human
caggacggcuccagaccca

SEQ ID NO: 228758 - RNA, 18 nt, Human
cauuauaaagcaaggaca

SEQ ID NO: 228759 - RNA, 18 nt, Human
ccaugucagcugggaagg

SEQ ID NO: 228760 - RNA, 20 nt, Human
ccccaccaaccccagccugc

SEQ ID NO: 228761 - RNA, 26 nt, Human
ccccaccaaccccagccugccgccug

SEQ ID NO: 228762 - RNA, 21 nt, Human
cuccagacccaggccuggccu

SEQ ID NO: 228763 - RNA, 22 nt, Human
cugaagcugaccugagguccau

SEQ ID NO: 228764 - RNA, 22 nt, Human
ggaaggccaggacggcuccaga

SEQ ID NO: 228765 - RNA, 23 nt, Human
ggacaagaaacacaguuuuagga

SEQ ID NO: 228766 - RNA, 21 nt, Human
uaaacacaagccccaccaacc

SEQ ID NO: 228767 - RNA, 24 nt, Human
uaaacacaagccccaccaacccca

SEQ ID NO: 228768 - RNA, 21 nt, Human
uauaaagcaaggacaagaaac

SEQ ID NO: 228769 - RNA, 23 nt, Human
uauaaagcaaggacaagaaacac

SEQ ID NO: 228770 - RNA, 18 nt, Human
ugaaaccuguuuauuucu

SEQ ID NO: 228771 - RNA, 21 nt, Human
ugaaaccuguuuauuucuaag

SEQ ID NO: 228772 - RNA, 19 nt, Human
ugggaaggccaggacggcu

SEQ ID NO: 228773 - RNA, 25 nt, Human
ugggaaggccaggacggcuccagac

SEQ ID NO: 228774 - RNA, 30 nt, Human
uuaauuaaacacaagccccaccaaccccaa

SEQ ID NO: 228775 - RNA, 18 nt, Human
uuccugagagaaaagagu

SEQ ID NO: 228776 - RNA, 22 nt, Human
cacaacacgggguuauacaaaa

SEQ ID NO: 228777 - RNA, 23 nt, Human
aaaagaccaaagagaagcaaaag

SEQ ID NO: 228778 - RNA, 25 nt, Human
aaaagaccaaagagaagcaguggga

SEQ ID NO: 228779 - RNA, 25 nt, Human
aaaaucccaaaguuacuuucaaaag

SEQ ID NO: 228780 - RNA, 20 nt, Human
aaacaguauuauggaaaaca

SEQ ID NO: 228781 - RNA, 18 nt, Human
aaagagaagcaaaagcga

SEQ ID NO: 228782 - RNA, 21 nt, Human
aaaguauguguuaucugccag

SEQ ID NO: 228783 - RNA, 22 nt, Human
aagaaaaagggagccacauuaa

SEQ ID NO: 228784 - RNA, 19 nt, Human
aagcaaaagcgauacaaau

SEQ ID NO: 228785 - RNA, 18 nt, Human
aagcaaaugagcgcaaac

SEQ ID NO: 228786 - RNA, 22 nt, Human
aaggaugcuacauuaaaggaau

SEQ ID NO: 228787 - RNA, 21 nt, Human
acaagaaaaagggagccacau

SEQ ID NO: 228788 - RNA, 20 nt, Human
acaguacuagcaggagauga

SEQ ID NO: 228789 - RNA, 19 nt, Human
acuguuuuuauuuugugug

SEQ ID NO: 228790 - RNA, 25 nt, Human
agaaacacagccccuaguuacacug

SEQ ID NO: 228791 - RNA, 20 nt, Human
agaaguuagcuccaugagga

SEQ ID NO: 228792 - RNA, 22 nt, Human
agagagccggagguuuuccaga

SEQ ID NO: 228793 - RNA, 25 nt, Human
agcaggagaugaaauaaaagggacc

SEQ ID NO: 228794 - RNA, 24 nt, Human
aggaaacaaugagguuauaagauc

SEQ ID NO: 228795 - RNA, 22 nt, Human
aggaaagaaaaccauccaaucu

SEQ ID NO: 228796 - RNA, 26 nt, Human
aggaaagaaaaccauccaaucucagu

SEQ ID NO: 228797 - RNA, 19 nt, Human
aggaccacaaagccugaaa

SEQ ID NO: 228798 - RNA, 21 nt, Human
aggcaagcaaaugagcgcaaa

SEQ ID NO: 228799 - RNA, 21 nt, Human
aggggaaaagcaccuagggug

SEQ ID NO: 228800 - RNA, 20 nt, Human
auccaaggguucacugugga

SEQ ID NO: 228801 - RNA, 19 nt, Human
auuagaaucgagcugcacc

SEQ ID NO: 228802 - RNA, 22 nt, Human
caaauuaauaugugccccucuc

SEQ ID NO: 228803 - RNA, 23 nt, Human
caacaggucuaaacaucucccuu

SEQ ID NO: 228804 - RNA, 22 nt, Human
cacaguacuagcaggagaugaa

SEQ ID NO: 228805 - RNA, 23 nt, Human
cacaguacuagcaggagaugaaa

SEQ ID NO: 228806 - RNA, 23 nt, Human
caccagguaauccaaggguucac

SEQ ID NO: 228807 - RNA, 19 nt, Human
cagaaggcagauacuguuu

SEQ ID NO: 228808 - RNA, 26 nt, Human
cagcaacagaaaugaaccacuuccaa

SEQ ID NO: 228809 - RNA, 21 nt, Human
cagcaugaaaagauuagaauc

SEQ ID NO: 228810 - RNA, 19 nt, Human
caggugcgcaaggcaagca

SEQ ID NO: 228811 - RNA, 21 nt, Human
caggugcgcaaggcaagcaaa

SEQ ID NO: 228812 - RNA, 28 nt, Human
cauuccugacaacuagaaagcacauugc

SEQ ID NO: 228813 - RNA, 25 nt, Human
ccacaaagccugaaacagcggaccc

SEQ ID NO: 228814 - RNA, 22 nt, Human
ccacgccgccccgccccgccua

SEQ ID NO: 228815 - RNA, 19 nt, Human
ccccucuccuuucugcucu

SEQ ID NO: 228816 - RNA, 27 nt, Human
ccgauggcgaucacaccagggcuccuu

SEQ ID NO: 228817 - RNA, 18 nt, Human
ccgccccgccuagccucg

SEQ ID NO: 228818 - RNA, 26 nt, Human
ccgccgccgcgccacgccgccccgcc

SEQ ID NO: 228819 - RNA, 18 nt, Human
ccgccgcgccacgccgcc

SEQ ID NO: 228820 - RNA, 22 nt, Human
ccgcgccacgccgccccgcccc

SEQ ID NO: 228821 - RNA, 28 nt, Human
ccuugaucaggaccacaaagccugaaac

SEQ ID NO: 228822 - RNA, 23 nt, Human
cgcaaacaguauuauggaaaaca

SEQ ID NO: 228823 - RNA, 18 nt, Human
cgccacgccgccccgccc

SEQ ID NO: 228824 - RNA, 25 nt, Human
cuaagacacaaaagaccaaagagaa

SEQ ID NO: 228825 - RNA, 27 nt, Human
cuaauguaagugcggaucuccaaagcc

SEQ ID NO: 228826 - RNA, 23 nt, Human
cucauaccagcaacagaaaugaa

SEQ ID NO: 228827 - RNA, 20 nt, Human
cuuucugcucuaagggaauc

SEQ ID NO: 228828 - RNA, 23 nt, Human
gaaggcugaaggugagggagugg

SEQ ID NO: 228829 - RNA, 18 nt, Human
gacacaaaagaccaaaga

SEQ ID NO: 228830 - RNA, 24 nt, Human
gaguccucuuuuauucccccacaa

SEQ ID NO: 228831 - RNA, 25 nt, Human
gcaacagaaaugaaccacuuccaaa

SEQ ID NO: 228832 - RNA, 21 nt, Human
gcacauucacugaaggcugaa

SEQ ID NO: 228833 - RNA, 19 nt, Human
gccacgccgccccgccccg

SEQ ID NO: 228834 - RNA, 20 nt, Human
gccccgccuagccucgaccg

SEQ ID NO: 228835 - RNA, 22 nt, Human
ggagucaaaguguuaauucuuc

SEQ ID NO: 228836 - RNA, 18 nt, Human
gugccccucuccuuucug

SEQ ID NO: 228837 - RNA, 23 nt, Human
guguauauucccauaacucuaau

SEQ ID NO: 228838 - RNA, 23 nt, Human
uaaaagagagugggccguucugg

SEQ ID NO: 228839 - RNA, 20 nt, Human
uaagacacaaaagaccaaag

SEQ ID NO: 228840 - RNA, 22 nt, Human
uaagggaaucuacaaaccagua

SEQ ID NO: 228841 - RNA, 22 nt, Human
uaauaugugccccucuccuuuc

SEQ ID NO: 228842 - RNA, 19 nt, Human
uagaaaaagccaccaggua

SEQ ID NO: 228843 - RNA, 22 nt, Human
uagaaagcacauucacugaagg

SEQ ID NO: 228844 - RNA, 23 nt, Human
uauuagaaggguauuccaccaca

SEQ ID NO: 228845 - RNA, 19 nt, Human
uauuauggaaaacauuuga

SEQ ID NO: 228846 - RNA, 21 nt, Human
uauucccccacaagaaaaagg

SEQ ID NO: 228847 - RNA, 19 nt, Human
uccaaggguucacugugga

SEQ ID NO: 228848 - RNA, 24 nt, Human
uccucuuuuauucccccacaagaa

SEQ ID NO: 228849 - RNA, 23 nt, Human
ucuaagacacaaaagaccaaaga

SEQ ID NO: 228850 - RNA, 23 nt, Human
ucugaaguauacacaacaggucu

SEQ ID NO: 228851 - RNA, 18 nt, Human
uggaagaacucaugaaaa

SEQ ID NO: 228852 - RNA, 23 nt, Human
uggaagaacucaugaaaaguacu

SEQ ID NO: 228853 - RNA, 18 nt, Human
uguggaagaacucaugaa

SEQ ID NO: 228854 - RNA, 18 nt, Human
uguuaaagggaaugagga

SEQ ID NO: 228855 - RNA, 21 nt, Human
uuaaauuacaggauaugguuu

SEQ ID NO: 228856 - RNA, 19 nt, Human
uucaagauaaagauuuagu

SEQ ID NO: 228857 - RNA, 21 nt, Human
uucgaaauccucauaccagca

SEQ ID NO: 228858 - RNA, 19 nt, Human
uucuaagacacaaaagacc

SEQ ID NO: 228859 - RNA, 21 nt, Human
auaccaaagugucuugaucca

SEQ ID NO: 228860 - RNA, 23 nt, Human
auccacagcgcaccauuuuccaa

SEQ ID NO: 228861 - RNA, 18 nt, Human
cacagcgcaccauuuucc

SEQ ID NO: 228862 - RNA, 23 nt, Human
cauaugcauuuacaguccaugug

SEQ ID NO: 228863 - RNA, 24 nt, Human
ccugcggcugcggcggcggcggcg

SEQ ID NO: 228864 - RNA, 24 nt, Human
cggcggcggcggcgaaucuuggag

SEQ ID NO: 228865 - RNA, 23 nt, Human
cuaaaacaguuuaggaaaucaug

SEQ ID NO: 228866 - RNA, 21 nt, Human
cugcaguugucagccuguggc

SEQ ID NO: 228867 - RNA, 26 nt, Human
cugcggcggcggcggcggcgaaucuu

SEQ ID NO: 228868 - RNA, 27 nt, Human
gccuuuuguugcuguuguucuuaucau

SEQ ID NO: 228869 - RNA, 22 nt, Human
gcggcggcggcgaaucuuggag

SEQ ID NO: 228870 - RNA, 23 nt, Human
gcggcugcggcggcggcggcggc

SEQ ID NO: 228871 - RNA, 23 nt, Human
gcugcgcgcggcuccggcggcgg

SEQ ID NO: 228872 - RNA, 18 nt, Human
ggcaccagggaacaggga

SEQ ID NO: 228873 - RNA, 22 nt, Human
ggcaccagggaacagggaaaaa

SEQ ID NO: 228874 - RNA, 21 nt, Human
ggcggcggcggcggcgaaucu

SEQ ID NO: 228875 - RNA, 20 nt, Human
ggcugcggcggcggcggcgg

SEQ ID NO: 228876 - RNA, 21 nt, Human
guggugcuucauauugaaugu

SEQ ID NO: 228877 - RNA, 22 nt, Human
uaccaaagugucuugauccaca

SEQ ID NO: 228878 - RNA, 21 nt, Human
uauaugcaucauaccaaagug

SEQ ID NO: 228879 - RNA, 22 nt, Human
ucagugggcagcugacauguca

SEQ ID NO: 228880 - RNA, 19 nt, Human
ucaguuccaccaaugaaaa

SEQ ID NO: 228881 - RNA, 21 nt, Human
uccacauaaagaauaugaaaa

SEQ ID NO: 228882 - RNA, 21 nt, Human
uccaugugauagugacuuuug

SEQ ID NO: 228883 - RNA, 18 nt, Human
uggagccuuuuguugcug

SEQ ID NO: 228884 - RNA, 22 nt, Human
uggagccuuuuguugcuguugu

SEQ ID NO: 228885 - RNA, 24 nt, Human
ugucaguuccaccaaugaaaauca

SEQ ID NO: 228886 - RNA, 20 nt, Human
uguggaggacaaugauggag

SEQ ID NO: 228887 - RNA, 22 nt, Human
uucaauaaccaaguuucuuguu

SEQ ID NO: 228888 - RNA, 20 nt, Human
uuccaaaggaguaucagugg

SEQ ID NO: 228889 - RNA, 21 nt, Human
uuccaaaggaguaucaguggg

SEQ ID NO: 228890 - RNA, 18 nt, Human
uucuaaacuggagacugc

SEQ ID NO: 228891 - RNA, 20 nt, Human
uuggagccuuuuguugcugu

SEQ ID NO: 228892 - RNA, 24 nt, Human
uuuuuugugucaguuccaccaaug

SEQ ID NO: 228893 - RNA, 22 nt, Human
auacacacacacauauauauau

SEQ ID NO: 228894 - RNA, 20 nt, Human
auauguauauauauauauau

SEQ ID NO: 228895 - RNA, 30 nt, Human
aucaaaccuuuuuauauauauguauauauu

SEQ ID NO: 228896 - RNA, 18 nt, Human
auguauauauauauauau

SEQ ID NO: 228897 - RNA, 19 nt, Human
auguauauauauauauaua

SEQ ID NO: 228898 - RNA, 18 nt, Human
cacacacacauauauaua

SEQ ID NO: 228899 - RNA, 24 nt, Human
ccuuuuuauauauauguauauauu

SEQ ID NO: 228900 - RNA, 24 nt, Human
cugcauuguaccuaacuuccacag

SEQ ID NO: 228901 - RNA, 28 nt, Human
gaucaaaccuuuuuauauauauguauau

SEQ ID NO: 228902 - RNA, 19 nt, Human
guauauauauauauauaua

SEQ ID NO: 228903 - RNA, 21 nt, Human
guauauauauauauauauaca

SEQ ID NO: 228904 - RNA, 18 nt, Human
uaccuaacuuccacaaca

SEQ ID NO: 228905 - RNA, 25 nt, Human
uauauacacacacacauauauauau

SEQ ID NO: 228906 - RNA, 31 nt, Human
uauauauauauacacacacacauauauauag

SEQ ID NO: 228907 - RNA, 20 nt, Human
uauauauauguauauauaua

SEQ ID NO: 228908 - RNA, 23 nt, Human
uauauauauguauauauauauau

SEQ ID NO: 228909 - RNA, 18 nt, Human
uauauauguauauauaua

SEQ ID NO: 228910 - RNA, 22 nt, Human
uauauguauauauauauauaua

SEQ ID NO: 228911 - RNA, 18 nt, Human
uauguauauauauauaua

SEQ ID NO: 228912 - RNA, 22 nt, Human
uauguauauauauauauauaua

SEQ ID NO: 228913 - RNA, 18 nt, Human
uguauauauauauauaua

SEQ ID NO: 228914 - RNA, 20 nt, Human
uuuuuuuuuuuugauggauc

SEQ ID NO: 228915 - RNA, 20 nt, Human
uuuuuuuuuuuuuugaugga

SEQ ID NO: 228916 - RNA, 18 nt, Human
uuuuuuuuuuuuuuuuug

SEQ ID NO: 228917 - RNA, 22 nt, Human
uuuuuuuuuuuuuuuuugaugg

SEQ ID NO: 228918 - RNA, 23 nt, Human
acagcgcugcuguuggcggcugc

SEQ ID NO: 228919 - RNA, 22 nt, Human
acucacucauccucucauuccc

SEQ ID NO: 228920 - RNA, 19 nt, Human
acucauccucucauuccca

SEQ ID NO: 228921 - RNA, 20 nt, Human
agcauccgugcacacuccuc

SEQ ID NO: 228922 - RNA, 21 nt, Human
agcucagagcgcgcuggugcu

SEQ ID NO: 228923 - RNA, 27 nt, Human
agggugggguggggggcgggggucacc

SEQ ID NO: 228924 - RNA, 20 nt, Human
cagcauccgugcacacuccu

SEQ ID NO: 228925 - RNA, 18 nt, Human
cagcucagagcgcgcugg

SEQ ID NO: 228926 - RNA, 19 nt, Human
cauucagcauccgugcacc

SEQ ID NO: 228927 - RNA, 24 nt, Human
ccaaacauucagcauccgugcaca

SEQ ID NO: 228928 - RNA, 20 nt, Human
ccucacucacucauccucuc

SEQ ID NO: 228929 - RNA, 19 nt, Human
ccuuacuuccucccuccaa

SEQ ID NO: 228930 - RNA, 21 nt, Human
cgcugcuguuggcggcugcgg

SEQ ID NO: 228931 - RNA, 24 nt, Human
cggcucgaacuggggauggggguu

SEQ ID NO: 228932 - RNA, 19 nt, Human
cucacucauccucucauuc

SEQ ID NO: 228933 - RNA, 22 nt, Human
cucacucauccucucauuccca

SEQ ID NO: 228934 - RNA, 20 nt, Human
cucauccucucauucccaaa

SEQ ID NO: 228935 - RNA, 19 nt, Human
cuccccuuccucuccucuu

SEQ ID NO: 228936 - RNA, 20 nt, Human
cugcuguuggcggcugcggc

SEQ ID NO: 228937 - RNA, 20 nt, Human
cuguuggcggcugcggcugc

SEQ ID NO: 228938 - RNA, 22 nt, Human
gccucacucacucauccucuca

SEQ ID NO: 228939 - RNA, 31 nt, Human
gcggagguggcggcggcggcgacuccuccuu

SEQ ID NO: 228940 - RNA, 25 nt, Human
gcggcgggggagggacccugggggc

SEQ ID NO: 228941 - RNA, 18 nt, Human
gcuguuggcggcugcggc

SEQ ID NO: 228942 - RNA, 19 nt, Human
ggcggagguggcggcggcg

SEQ ID NO: 228943 - RNA, 22 nt, Human
ggcggagguggcggcggcggcg

SEQ ID NO: 228944 - RNA, 20 nt, Human
ggcucugucuggguagucgg

SEQ ID NO: 228945 - RNA, 25 nt, Human
gggaagggagggugggguggggggc

SEQ ID NO: 228946 - RNA, 20 nt, Human
gggagggugggguggggggc

SEQ ID NO: 228947 - RNA, 22 nt, Human
gggauggggguugggggucggg

SEQ ID NO: 228948 - RNA, 19 nt, Human
gggcugcuggcggcggggg

SEQ ID NO: 228949 - RNA, 19 nt, Human
ggggagggacccugggggc

SEQ ID NO: 228950 - RNA, 19 nt, Human
ggggcagcucagagcgcgc

SEQ ID NO: 228951 - RNA, 19 nt, Human
ggggguugggggucgggug

SEQ ID NO: 228952 - RNA, 26 nt, Human
ggggucgggugggaagggaggguggg

SEQ ID NO: 228953 - RNA, 19 nt, Human
gggguugggggucgggugg

SEQ ID NO: 228954 - RNA, 23 nt, Human
gggugggaagggaggguggggug

SEQ ID NO: 228955 - RNA, 22 nt, Human
gggugggguggggggcgggggu

SEQ ID NO: 228956 - RNA, 26 nt, Human
ucaagccucacucacucauccucuca

SEQ ID NO: 228957 - RNA, 23 nt, Human
ucacucauccucucauucccaaa

SEQ ID NO: 228958 - RNA, 18 nt, Human
ucacuuccagguuuuuca

SEQ ID NO: 228959 - RNA, 23 nt, Human
uccgugcacacuccucacuucca

SEQ ID NO: 228960 - RNA, 20 nt, Human
uccucuccucuucccuuacu

SEQ ID NO: 228961 - RNA, 23 nt, Human
ucuucccuuacuuccucccucca

SEQ ID NO: 228962 - RNA, 22 nt, Human
ugcuguuggcggcugcggcugc

SEQ ID NO: 228963 - RNA, 19 nt, Human
uggggauggggguuggggg

SEQ ID NO: 228964 - RNA, 21 nt, Human
uggggggcgggggucaccaca

SEQ ID NO: 228965 - RNA, 23 nt, Human
ugggggucgggugggaagggagg

SEQ ID NO: 228966 - RNA, 18 nt, Human
uggggguugggggucggg

SEQ ID NO: 228967 - RNA, 18 nt, Human
ugggguggggggcggggg

SEQ ID NO: 228968 - RNA, 19 nt, Human
ugggguggggggcgggggu

SEQ ID NO: 228969 - RNA, 24 nt, Human
ugggguggggggcgggggucacca

SEQ ID NO: 228970 - RNA, 24 nt, Human
uggguagucgguccggcuccccuu

SEQ ID NO: 228971 - RNA, 19 nt, Human
uguuaugguuuucuacgaa

SEQ ID NO: 228972 - RNA, 22 nt, Human
uucccuuacuuccucccuccaa

SEQ ID NO: 228973 - RNA, 20 nt, Human
uugggggucgggugggaagg

SEQ ID NO: 228974 - RNA, 21 nt, Human
uuuuucucuuuuccaagaugg

SEQ ID NO: 228975 - RNA, 22 nt, Human
aacaccucccucccgccccucc

SEQ ID NO: 228976 - RNA, 24 nt, Human
aacaccucccucccgccccuccca

SEQ ID NO: 228977 - RNA, 18 nt, Human
accucccucccgccccuc

SEQ ID NO: 228978 - RNA, 18 nt, Human
agacugaaggaccccuaa

SEQ ID NO: 228979 - RNA, 21 nt, Human
aucccagagcccucgggcggc

SEQ ID NO: 228980 - RNA, 20 nt, Human
cauuuucccugggugcagag

SEQ ID NO: 228981 - RNA, 21 nt, Human
cauuuucccugggugcagagg

SEQ ID NO: 228982 - RNA, 21 nt, Human
cccagagcccucgggcggcuc

SEQ ID NO: 228983 - RNA, 19 nt, Human
cccgccccucccaguaggg

SEQ ID NO: 228984 - RNA, 18 nt, Human
cccugggugcagaggcuc

SEQ ID NO: 228985 - RNA, 18 nt, Human
ccucgggcggcucggccu

SEQ ID NO: 228986 - RNA, 20 nt, Human
gcucccuuauagucuccaag

SEQ ID NO: 228987 - RNA, 27 nt, Human
uaacuggagacauauuuccacccacaa

SEQ ID NO: 228988 - RNA, 23 nt, Human
uaauacagugacggcaacaccuc

SEQ ID NO: 228989 - RNA, 24 nt, Human
uacagugacggcaacaccucccuc

SEQ ID NO: 228990 - RNA, 22 nt, Human
uggagacauauuuccacccaca

SEQ ID NO: 228991 - RNA, 23 nt, Human
uggagacauauuuccacccacaa

SEQ ID NO: 228992 - RNA, 28 nt, Human
uuaauacagugacggcaacaccucccuc

SEQ ID NO: 228993 - RNA, 22 nt, Human
uuuuugcuucuucacauccacu

SEQ ID NO: 228994 - RNA, 18 nt, Human
uuuuuuuuuuuuuuugcu

SEQ ID NO: 228995 - RNA, 19 nt, Human
uuuuuuuuuuuuuuugcuu

SEQ ID NO: 228996 - RNA, 25 nt, Human
aaaaccccaagacagaaaucuuagg

SEQ ID NO: 228997 - RNA, 25 nt, Human
aaaaccccaagacagaaaucuuagg

SEQ ID NO: 228998 - RNA, 22 nt, Human
aacugcaugcaccaaaaacccc

SEQ ID NO: 228999 - RNA, 22 nt, Human
aacugcaugcaccaaaaacccc

SEQ ID NO: 229000 - RNA, 21 nt, Human
aagcuucauuaauuuguuuca

SEQ ID NO: 229001 - RNA, 21 nt, Human
aagcuucauuaauuuguuuca

SEQ ID NO: 229002 - RNA, 19 nt, Human
accugggagccgcugagcc

SEQ ID NO: 229003 - RNA, 21 nt, Human
accugggagccgcugagccuc

SEQ ID NO: 229004 - RNA, 24 nt, Human
accuuugugaacaguguaacuuua

SEQ ID NO: 229005 - RNA, 24 nt, Human
accuuugugaacaguguaacuuua

SEQ ID NO: 229006 - RNA, 27 nt, Human
acucugggaauacuggcacuucgagga

SEQ ID NO: 229007 - RNA, 27 nt, Human
acucugggaauacuggcacuucgagga

SEQ ID NO: 229008 - RNA, 18 nt, Human
acuucgaggaaaaaaaaa

SEQ ID NO: 229009 - RNA, 18 nt, Human
acuucgaggaaaaaaaaa

SEQ ID NO: 229010 - RNA, 24 nt, Human
agacagaaaucuuagguauucagu

SEQ ID NO: 229011 - RNA, 24 nt, Human
agacagaaaucuuagguauucagu

SEQ ID NO: 229012 - RNA, 21 nt, Human
auggagcaggaaaaaaauuag

SEQ ID NO: 229013 - RNA, 24 nt, Human
auggagcaggaaaaaaauuaggua

SEQ ID NO: 229014 - RNA, 21 nt, Human
augugacuagauaaaacacag

SEQ ID NO: 229015 - RNA, 21 nt, Human
augugacuagauaaaacacag

SEQ ID NO: 229016 - RNA, 22 nt, Human
auuacacacuuugucuuugacu

SEQ ID NO: 229017 - RNA, 19 nt, Human
auucaguuucuuuuucaca

SEQ ID NO: 229018 - RNA, 19 nt, Human
auucaguuucuuuuucaca

SEQ ID NO: 229019 - RNA, 25 nt, Human
caaaaaccccaagacagaaaucuua

SEQ ID NO: 229020 - RNA, 25 nt, Human
caaaaaccccaagacagaaaucuua

SEQ ID NO: 229021 - RNA, 25 nt, Human
caacugcaugcaccaaaaaccccaa

SEQ ID NO: 229022 - RNA, 25 nt, Human
caacugcaugcaccaaaaaccccaa

SEQ ID NO: 229023 - RNA, 22 nt, Human
cacacuugguaagaaaaauaag

SEQ ID NO: 229024 - RNA, 22 nt, Human
cacacuugguaagaaaaauaag

SEQ ID NO: 229025 - RNA, 21 nt, Human
cacagaauagggaugauucaa

SEQ ID NO: 229026 - RNA, 21 nt, Human
cacagaauagggaugauucaa

SEQ ID NO: 229027 - RNA, 21 nt, Human
caccuucgccgccgccacugc

SEQ ID NO: 229028 - RNA, 23 nt, Human
cagcaggccucucucccgcaccu

SEQ ID NO: 229029 - RNA, 23 nt, Human
ccacugccgccgccgcugcugcc

SEQ ID NO: 229030 - RNA, 24 nt, Human
ccacugccgccgccgcugcugccu

SEQ ID NO: 229031 - RNA, 27 nt, Human
ccgccacugccgccgccgcugcugccg

SEQ ID NO: 229032 - RNA, 21 nt, Human
ccgccgccaccuucgccgccg

SEQ ID NO: 229033 - RNA, 23 nt, Human
ccgccgccacugccgccgccgcu

SEQ ID NO: 229034 - RNA, 19 nt, Human
ccgccgccgccuucagugc

SEQ ID NO: 229035 - RNA, 24 nt, Human
ccgccgccgcugcugccuccgccg

SEQ ID NO: 229036 - RNA, 24 nt, Human
ccgccgcugcugccuccgccgccg

SEQ ID NO: 229037 - RNA, 20 nt, Human
ccgcugcugccuccgccgcc

SEQ ID NO: 229038 - RNA, 22 nt, Human
ccgcugcugccuccgccgccgc

SEQ ID NO: 229039 - RNA, 20 nt, Human
ccucuggccccgccgccgcc

SEQ ID NO: 229040 - RNA, 20 nt, Human
ccucuggccccgccgccgcc

SEQ ID NO: 229041 - RNA, 24 nt, Human
cgaaauggcgggggccgggaguac

SEQ ID NO: 229042 - RNA, 26 nt, Human
cuaauagcaguggaaaggagacaaaa

SEQ ID NO: 229043 - RNA, 26 nt, Human
cuaauagcaguggaaaggagacaaaa

SEQ ID NO: 229044 - RNA, 20 nt, Human
cugccgccgccgcugcugcc

SEQ ID NO: 229045 - RNA, 20 nt, Human
cugcugccuccgccgccgcg

SEQ ID NO: 229046 - RNA, 21 nt, Human
cuucgccgccgccacugccgc

SEQ ID NO: 229047 - RNA, 22 nt, Human
gaaggcaucaucaacacccaga

SEQ ID NO: 229048 - RNA, 20 nt, Human
gagcaggaaaaaaauuaggu

SEQ ID NO: 229049 - RNA, 20 nt, Human
gagcaggaaaaaaauuaggu

SEQ ID NO: 229050 - RNA, 22 nt, Human
gccgccgccgcugcugccuccg

SEQ ID NO: 229051 - RNA, 25 nt, Human
uaacuuuacauucaucagggaugac

SEQ ID NO: 229052 - RNA, 25 nt, Human
uaacuuuacauucaucagggaugac

SEQ ID NO: 229053 - RNA, 18 nt, Human
uaagaaguaaucaacugc

SEQ ID NO: 229054 - RNA, 18 nt, Human
uaagaaguaaucaacugc

SEQ ID NO: 229055 - RNA, 18 nt, Human
uaauauuuuggggagagu

SEQ ID NO: 229056 - RNA, 18 nt, Human
uaauauuuuggggagagu

SEQ ID NO: 229057 - RNA, 23 nt, Human
uagggaugauucaaaagcuucau

SEQ ID NO: 229058 - RNA, 23 nt, Human
uagggaugauucaaaagcuucau

SEQ ID NO: 229059 - RNA, 24 nt, Human
ucgccgccgccacugccgccgccg

SEQ ID NO: 229060 - RNA, 23 nt, Human
ucuggccccgccgccgccuucag

SEQ ID NO: 229061 - RNA, 22 nt, Human
ugacuaauagcaguggaaagga

SEQ ID NO: 229062 - RNA, 22 nt, Human
ugacuaauagcaguggaaagga

SEQ ID NO: 229063 - RNA, 21 nt, Human
ugagccucuggccccgccgcc

SEQ ID NO: 229064 - RNA, 22 nt, Human
ugcaccaaaaaccccaagacag

SEQ ID NO: 229065 - RNA, 22 nt, Human
ugcaccaaaaaccccaagacag

SEQ ID NO: 229066 - RNA, 25 nt, Human
ugcaugcaccaaaaaccccaagaca

SEQ ID NO: 229067 - RNA, 25 nt, Human
ugcaugcaccaaaaaccccaagaca

SEQ ID NO: 229068 - RNA, 18 nt, Human
uggaaaggagacaaaacc

SEQ ID NO: 229069 - RNA, 18 nt, Human
uggaaaggagacaaaacc

SEQ ID NO: 229070 - RNA, 19 nt, Human
uggaaaggagacaaaaccu

SEQ ID NO: 229071 - RNA, 19 nt, Human
uggaaaggagacaaaaccu

SEQ ID NO: 229072 - RNA, 25 nt, Human
uuaaaauaagcauuuaagguaaaag

SEQ ID NO: 229073 - RNA, 25 nt, Human
uuaaaauaagcauuuaagguaaaag

SEQ ID NO: 229074 - RNA, 24 nt, Human
uuaagguaaaagcuaacagucugc

SEQ ID NO: 229075 - RNA, 24 nt, Human
uuaagguaaaagcuaacagucugc

SEQ ID NO: 229076 - RNA, 20 nt, Human
aaaacagcacagagauaaga

SEQ ID NO: 229077 - RNA, 21 nt, Human
aaaaccaaaacagcacagaga

SEQ ID NO: 229078 - RNA, 21 nt, Human
aagagcugggggaauaggaug

SEQ ID NO: 229079 - RNA, 19 nt, Human
acagcacagagauaagaug

SEQ ID NO: 229080 - RNA, 27 nt, Human
acagcacagagauaagaugcuaaggag

SEQ ID NO: 229081 - RNA, 23 nt, Human
accucuccacaaaagaaaaacaa

SEQ ID NO: 229082 - RNA, 21 nt, Human
acugcugaacuguuucucagg

SEQ ID NO: 229083 - RNA, 18 nt, Human
agagcugggggaauagga

SEQ ID NO: 229084 - RNA, 20 nt, Human
agcagaaaagaaagagcugg

SEQ ID NO: 229085 - RNA, 21 nt, Human
agcauauuuguuagugaugcu

SEQ ID NO: 229086 - RNA, 18 nt, Human
agggaaagaacaaagcag

SEQ ID NO: 229087 - RNA, 19 nt, Human
aggggacugagauugccac

SEQ ID NO: 229088 - RNA, 22 nt, Human
aucugaaaacuucauugggaaa

SEQ ID NO: 229089 - RNA, 23 nt, Human
cacaaaacacccauccagguuag

SEQ ID NO: 229090 - RNA, 22 nt, Human
cagcaaaacaaggaaaugggga

SEQ ID NO: 229091 - RNA, 24 nt, Human
cagcaaaacaaggaaauggggagu

SEQ ID NO: 229092 - RNA, 22 nt, Human
ccucuccacaaaagaaaaacaa

SEQ ID NO: 229093 - RNA, 18 nt, Human
cucacaaaacacccaucc

SEQ ID NO: 229094 - RNA, 18 nt, Human
cugggggaauaggaugag

SEQ ID NO: 229095 - RNA, 19 nt, Human
gaaaaacaacuugcuuaca

SEQ ID NO: 229096 - RNA, 19 nt, Human
gcagaaaagaaagagcugg

SEQ ID NO: 229097 - RNA, 23 nt, Human
gcuaaggagcuguccacacccug

SEQ ID NO: 229098 - RNA, 23 nt, Human
ggaaacagcagaaaagaaagagc

SEQ ID NO: 229099 - RNA, 18 nt, Human
ggagcaagguagaguaag

SEQ ID NO: 229100 - RNA, 20 nt, Human
uaagaccucuccacaaaaga

SEQ ID NO: 229101 - RNA, 22 nt, Human
uacaaaaccaaaacagcacaga

SEQ ID NO: 229102 - RNA, 20 nt, Human
uagagcuaaugaaacagagg

SEQ ID NO: 229103 - RNA, 24 nt, Human
ucgaccucggucuugccaagcaua

SEQ ID NO: 229104 - RNA, 19 nt, Human
ugaucugaaaacuucauug

SEQ ID NO: 229105 - RNA, 23 nt, Human
ugccacugaucugaaaacuucau

SEQ ID NO: 229106 - RNA, 24 nt, Human
ugcuuugaaaugucaugugggugg

SEQ ID NO: 229107 - RNA, 23 nt, Human
uggcuggcuuaaggaggugcuuu

SEQ ID NO: 229108 - RNA, 21 nt, Human
aaaacaccuuguagacaccuu

SEQ ID NO: 229109 - RNA, 22 nt, Human
aaccacaaaacaccuuguagac

SEQ ID NO: 229110 - RNA, 26 nt, Human
aagaagaaauacggaaaccacaaaac

SEQ ID NO: 229111 - RNA, 22 nt, Human
acaaaacaccuuguagacaccu

SEQ ID NO: 229112 - RNA, 19 nt, Human
acggaaaccacaaaacacc

SEQ ID NO: 229113 - RNA, 24 nt, Human
agaagaaauacggaaaccacaaaa

SEQ ID NO: 229114 - RNA, 21 nt, Human
caaccguagaugaaagaacuc

SEQ ID NO: 229115 - RNA, 18 nt, Human
ccguagaugaaagaacuc

SEQ ID NO: 229116 - RNA, 19 nt, Human
cucuaccgucgggcgccac

SEQ ID NO: 229117 - RNA, 22 nt, Human
gaaauacggaaaccacaaaaca

SEQ ID NO: 229118 - RNA, 19 nt, Human
gaagaaauacggaaaccac

SEQ ID NO: 229119 - RNA, 23 nt, Human
gcaucaguaagaaaguuuauuga

SEQ ID NO: 229120 - RNA, 19 nt, Human
gccaccucuucaauaauug

SEQ ID NO: 229121 - RNA, 20 nt, Human
uaaagaacacuuucugguaa

SEQ ID NO: 229122 - RNA, 19 nt, Human
uacggaaaccacaaaacac

SEQ ID NO: 229123 - RNA, 19 nt, Human
ugaaaagaagaaauacgga

SEQ ID NO: 229124 - RNA, 18 nt, Human
ugaaagaacucuaccguc

SEQ ID NO: 229125 - RNA, 27 nt, Human
uucaugcaguuuaauaguaguguuucu

SEQ ID NO: 229126 - RNA, 18 nt, Human
aaaaaggauucaauguga

SEQ ID NO: 229127 - RNA, 18 nt, Human
aaaugacuugugacugaa

SEQ ID NO: 229128 - RNA, 21 nt, Human
aagaaaauggaacagacaaaa

SEQ ID NO: 229129 - RNA, 24 nt, Human
acaaagaccaacaugaccaaaaug

SEQ ID NO: 229130 - RNA, 19 nt, Human
agacaaaaauagggauuga

SEQ ID NO: 229131 - RNA, 23 nt, Human
agggauugaaguaauacagcaug

SEQ ID NO: 229132 - RNA, 23 nt, Human
auggaacagacaaaaauagggau

SEQ ID NO: 229133 - RNA, 21 nt, Human
caacaugaccaaaaugacuug

SEQ ID NO: 229134 - RNA, 21 nt, Human
cagacaaaaauagggauugaa

SEQ ID NO: 229135 - RNA, 23 nt, Human
gaaaauauuccggguuaccagaa

SEQ ID NO: 229136 - RNA, 21 nt, Human
uacuccaguuguccagaagga

SEQ ID NO: 229137 - RNA, 19 nt, Human
ucagaagggcaaaaaggau

SEQ ID NO: 229138 - RNA, 21 nt, Human
uccaaagaaaauggaacagac

SEQ ID NO: 229139 - RNA, 24 nt, Human
ucguuaaaagacuacuccaguugu

SEQ ID NO: 229140 - RNA, 22 nt, Human
ugaaguaauacagcauguuacu

SEQ ID NO: 229141 - RNA, 19 nt, Human
uggaacagacaaaaauagg

SEQ ID NO: 229142 - RNA, 19 nt, Human
uguccagaaggauauaagg

SEQ ID NO: 229143 - RNA, 23 nt, Human
uuacaaagaccaacaugaccaaa

SEQ ID NO: 229144 - RNA, 18 nt, Human
uuacucugaaaggaauaa

SEQ ID NO: 229145 - RNA, 20 nt, Human
uuguccagaaggauauaagg

SEQ ID NO: 229146 - RNA, 26 nt, Human
agagaagagcacagagggcccaccau

SEQ ID NO: 229147 - RNA, 19 nt, Human
agcaggauugagagcaggu

SEQ ID NO: 229148 - RNA, 19 nt, Human
aggcagauuuaaggccuac

SEQ ID NO: 229149 - RNA, 19 nt, Human
agggacugagccuuggguc

SEQ ID NO: 229150 - RNA, 20 nt, Human
cagaggcacuagaagucgug

SEQ ID NO: 229151 - RNA, 19 nt, Human
cagcagccccuccucucuc

SEQ ID NO: 229152 - RNA, 21 nt, Human
ccagcagccccuccucucucc

SEQ ID NO: 229153 - RNA, 18 nt, Human
ccucugggugcugaagac

SEQ ID NO: 229154 - RNA, 18 nt, Human
cugagccuuggguccagc

SEQ ID NO: 229155 - RNA, 18 nt, Human
cugccggcucucuccucc

SEQ ID NO: 229156 - RNA, 19 nt, Human
gagccuuggguccagcagc

SEQ ID NO: 229157 - RNA, 19 nt, Human
ggugcugaagacagaggga

SEQ ID NO: 229158 - RNA, 21 nt, Human
gucagagaggagagagauccg

SEQ ID NO: 229159 - RNA, 26 nt, Human
ucagaagugcggcgaccagaggccga

SEQ ID NO: 229160 - RNA, 23 nt, Human
uccgaccggaagagaagagcaca

SEQ ID NO: 229161 - RNA, 22 nt, Human
uccucugggugcugaagacaga

SEQ ID NO: 229162 - RNA, 18 nt, Human
uccugagagcagagggac

SEQ ID NO: 229163 - RNA, 23 nt, Human
ugagagcagagggacugagccuu

SEQ ID NO: 229164 - RNA, 22 nt, Human
ugagccuuggguccagcagccc

SEQ ID NO: 229165 - RNA, 24 nt, Human
ugcugaagacagagggaggggacc

SEQ ID NO: 229166 - RNA, 23 nt, Human
ugguaacagaggcacuagaaguc

SEQ ID NO: 229167 - RNA, 24 nt, Human
uuagagguggugguaacagaggca

SEQ ID NO: 229168 - RNA, 18 nt, Human
aagcaggguccagcugug

SEQ ID NO: 229169 - RNA, 18 nt, Human
auugccaggaggggguga

SEQ ID NO: 229170 - RNA, 18 nt, Human
ugccaggagggggugagg

SEQ ID NO: 229171 - RNA, 20 nt, Human
aaacccaagaggugcuggca

SEQ ID NO: 229172 - RNA, 21 nt, Human
aaacccaagaggugcuggcag

SEQ ID NO: 229173 - RNA, 21 nt, Human
acacaauacagcugcaucucc

SEQ ID NO: 229174 - RNA, 18 nt, Human
agaagguggggagaggca

SEQ ID NO: 229175 - RNA, 22 nt, Human
agaggcagagggggaauagagc

SEQ ID NO: 229176 - RNA, 20 nt, Human
aggcagagggggaauagagg

SEQ ID NO: 229177 - RNA, 20 nt, Human
agggacccuuuucagcucuc

SEQ ID NO: 229178 - RNA, 20 nt, Human
auagagcgcaugcaaagccc

SEQ ID NO: 229179 - RNA, 26 nt, Human
caaagcccugaaauaaaagaccgagg

SEQ ID NO: 229180 - RNA, 21 nt, Human
cccaagaggugcuggcaggag

SEQ ID NO: 229181 - RNA, 18 nt, Human
cccucuggccaguccucc

SEQ ID NO: 229182 - RNA, 18 nt, Human
cucuggccaguccuccac

SEQ ID NO: 229183 - RNA, 24 nt, Human
cucuggccaguccuccacuuggcc

SEQ ID NO: 229184 - RNA, 20 nt, Human
cugaaauaaaagaccgaggg

SEQ ID NO: 229185 - RNA, 19 nt, Human
cugaaggcagggacuggag

SEQ ID NO: 229186 - RNA, 18 nt, Human
gaagguggggagaggcag

SEQ ID NO: 229187 - RNA, 20 nt, Human
gacuggaguuugcaugugca

SEQ ID NO: 229188 - RNA, 20 nt, Human
gagaggcagagggggaauag

SEQ ID NO: 229189 - RNA, 20 nt, Human
gagaguggggaguggcaagg

SEQ ID NO: 229190 - RNA, 24 nt, Human
gagcccgugaguucucagcaaacc

SEQ ID NO: 229191 - RNA, 20 nt, Human
gagggggaauagagcgcaug

SEQ ID NO: 229192 - RNA, 25 nt, Human
gcaaagcccugaaauaaaagaccga

SEQ ID NO: 229193 - RNA, 22 nt, Human
gcaggcccucuggccaguccuc

SEQ ID NO: 229194 - RNA, 18 nt, Human
gcccucuggccaguccuc

SEQ ID NO: 229195 - RNA, 21 nt, Human
gcuggagcccgugaguucuca

SEQ ID NO: 229196 - RNA, 19 nt, Human
ggcagagggggaauagagc

SEQ ID NO: 229197 - RNA, 24 nt, Human
uaaaagaccgagggacccuuuuca

SEQ ID NO: 229198 - RNA, 18 nt, Human
uacagcugcaucuccuug

SEQ ID NO: 229199 - RNA, 21 nt, Human
ucagcaaacccaagaggugcu

SEQ ID NO: 229200 - RNA, 24 nt, Human
ucagcaaacccaagaggugcuggc

SEQ ID NO: 229201 - RNA, 24 nt, Human
uccuugcuccaaagaaggugggga

SEQ ID NO: 229202 - RNA, 23 nt, Human
ucuccuugcuccaaagaaggugg

SEQ ID NO: 229203 - RNA, 21 nt, Human
ugcaggcccucuggccagucc

SEQ ID NO: 229204 - RNA, 19 nt, Human
uggggagaggcagaggggg

SEQ ID NO: 229205 - RNA, 24 nt, Human
uguuacacaauacagcugcagcgg

SEQ ID NO: 229206 - RNA, 18 nt, Human
uucucagcaaacccaaga

SEQ ID NO: 229207 - RNA, 26 nt, Human
aagccaccacccaagccagcacccaa

SEQ ID NO: 229208 - RNA, 19 nt, Human
aagccaccaccgaagccag

SEQ ID NO: 229209 - RNA, 24 nt, Human
aagccaccaccgaagccagcacca

SEQ ID NO: 229210 - RNA, 24 nt, Human
aagccaccgccauagccgcccccc

SEQ ID NO: 229211 - RNA, 32 nt, Human
aagccagcacccaagccaccaccgaagccagg

SEQ ID NO: 229212 - RNA, 22 nt, Human
aagcugcugcugcugccgaagc

SEQ ID NO: 229213 - RNA, 20 nt, Human
accacccaagccagcaccca

SEQ ID NO: 229214 - RNA, 18 nt, Human
acugcaggagcccuucau

SEQ ID NO: 229215 - RNA, 21 nt, Human
acugcaggagcccuucaugga

SEQ ID NO: 229216 - RNA, 23 nt, Human
agaaagucagcuuuauuagccca

SEQ ID NO: 229217 - RNA, 19 nt, Human
agcaaagccaccacccaag

SEQ ID NO: 229218 - RNA, 23 nt, Human
agcgagcgagcaguuggcugaaa

SEQ ID NO: 229219 - RNA, 18 nt, Human
agcuggugggcaggaggc

SEQ ID NO: 229220 - RNA, 23 nt, Human
agcuggugggcaggaggcugugg

SEQ ID NO: 229221 - RNA, 21 nt, Human
aggagcagggagacagcuggg

SEQ ID NO: 229222 - RNA, 22 nt, Human
agggucagcucguccaacaccc

SEQ ID NO: 229223 - RNA, 24 nt, Human
aggugaggccagcuggugggcagg

SEQ ID NO: 229224 - RNA, 22 nt, Human
auccucccccaaagccacuagu

SEQ ID NO: 229225 - RNA, 25 nt, Human
auggaucuggaggaggugaacuggu

SEQ ID NO: 229226 - RNA, 18 nt, Human
caagccagcacccaagcc

SEQ ID NO: 229227 - RNA, 19 nt, Human
caccaaggccaccaccaua

SEQ ID NO: 229228 - RNA, 23 nt, Human
caccaaggccaccaccauauccu

SEQ ID NO: 229229 - RNA, 24 nt, Human
caccaccagcaaagccaccacccc

SEQ ID NO: 229230 - RNA, 22 nt, Human
caccacccaagccagcacccaa

SEQ ID NO: 229231 - RNA, 23 nt, Human
caccagaagcccaucaccaccag

SEQ ID NO: 229232 - RNA, 22 nt, Human
cacccaagccaccaccgaagcc

SEQ ID NO: 229233 - RNA, 20 nt, Human
caccgccauagccgcccccc

SEQ ID NO: 229234 - RNA, 19 nt, Human
caccucacugcggcugcuc

SEQ ID NO: 229235 - RNA, 20 nt, Human
cacuugguccugaagucauc

SEQ ID NO: 229236 - RNA, 31 nt, Human
cagcaccaaggccaccaccauauccuccccc

SEQ ID NO: 229237 - RNA, 25 nt, Human
cagcacccaagccaccaccgaagcc

SEQ ID NO: 229238 - RNA, 24 nt, Human
cagcuggugggcaggaggcugugg

SEQ ID NO: 229239 - RNA, 18 nt, Human
caggcccuggaacacccu

SEQ ID NO: 229240 - RNA, 20 nt, Human
cagggccagcucgugcucuc

SEQ ID NO: 229241 - RNA, 23 nt, Human
cauggucaccuucucacugccca

SEQ ID NO: 229242 - RNA, 22 nt, Human
ccaccaccauauccucccccaa

SEQ ID NO: 229243 - RNA, 23 nt, Human
ccaccacccaagccagcacccaa

SEQ ID NO: 229244 - RNA, 22 nt, Human
ccaccaccgaagccagcaccaa

SEQ ID NO: 229245 - RNA, 21 nt, Human
ccacgccaggugcggcauccg

SEQ ID NO: 229246 - RNA, 25 nt, Human
ccagaagcccaucaccaccagcaaa

SEQ ID NO: 229247 - RNA, 20 nt, Human
ccagcacccaagccaccacc

SEQ ID NO: 229248 - RNA, 22 nt, Human
ccagcacccaagccaccaccga

SEQ ID NO: 229249 - RNA, 21 nt, Human
ccaggacagaggagaugcggc

SEQ ID NO: 229250 - RNA, 22 nt, Human
cccaaaggagaagcgagagaag

SEQ ID NO: 229251 - RNA, 19 nt, Human
cccaccagaagcccaucac

SEQ ID NO: 229252 - RNA, 25 nt, Human
cccaucaccaccagcaaagccacca

SEQ ID NO: 229253 - RNA, 19 nt, Human
cccccaaaggagaagcgag

SEQ ID NO: 229254 - RNA, 20 nt, Human
ccccccagcccgcaggcucc

SEQ ID NO: 229255 - RNA, 22 nt, Human
ccccccagcccgcaggcucccc

SEQ ID NO: 229256 - RNA, 26 nt, Human
ccccccagcccgcaggcucccccaaa

SEQ ID NO: 229257 - RNA, 18 nt, Human
cccgcaggcucccccaaa

SEQ ID NO: 229258 - RNA, 22 nt, Human
ccgaugcugcccccgauacugc

SEQ ID NO: 229259 - RNA, 22 nt, Human
ccggucugaccucgcagagcaa

SEQ ID NO: 229260 - RNA, 25 nt, Human
ccuuccaucuccaucuccaggucag

SEQ ID NO: 229261 - RNA, 22 nt, Human
cgagagaaggagacacacaggc

SEQ ID NO: 229262 - RNA, 23 nt, Human
cgagagaaggagacacacaggcc

SEQ ID NO: 229263 - RNA, 21 nt, Human
cucgugcucucacuugguccu

SEQ ID NO: 229264 - RNA, 21 nt, Human
cucuguaccaguucacugcug

SEQ ID NO: 229265 - RNA, 19 nt, Human
cucugugguugugcuuugc

SEQ ID NO: 229266 - RNA, 23 nt, Human
cuucaggccuuccaucuccaucu

SEQ ID NO: 229267 - RNA, 18 nt, Human
cuuuauuagcccaucacc

SEQ ID NO: 229268 - RNA, 18 nt, Human
gaagccagcaccaaggcc

SEQ ID NO: 229269 - RNA, 22 nt, Human
gaagcccaucaccaccagcaaa

SEQ ID NO: 229270 - RNA, 19 nt, Human
gagcagggagacagcuggg

SEQ ID NO: 229271 - RNA, 22 nt, Human
gaggugaacugguggcugcagg

SEQ ID NO: 229272 - RNA, 21 nt, Human
gaggugaggccagcugguggg

SEQ ID NO: 229273 - RNA, 24 nt, Human
gcccuggaacacccucuggagcuc

SEQ ID NO: 229274 - RNA, 25 nt, Human
gcuccgucaccucacugcggcugcu

SEQ ID NO: 229275 - RNA, 24 nt, Human
gcucgugcucucacuugguccuga

SEQ ID NO: 229276 - RNA, 18 nt, Human
ggagacagcugggaacug

SEQ ID NO: 229277 - RNA, 18 nt, Human
ggcaggaggcugugguag

SEQ ID NO: 229278 - RNA, 23 nt, Human
gggagacagcugggaacugcacu

SEQ ID NO: 229279 - RNA, 19 nt, Human
gggcauggcaggacccucc

SEQ ID NO: 229280 - RNA, 20 nt, Human
ggggcauggcaggacccucc

SEQ ID NO: 229281 - RNA, 23 nt, Human
ggugggcaggaggcugugguaga

SEQ ID NO: 229282 - RNA, 20 nt, Human
gugccaaggagggaggugag

SEQ ID NO: 229283 - RNA, 19 nt, Human
gugguugugcuuugccauc

SEQ ID NO: 229284 - RNA, 22 nt, Human
uagccgccccccagcccgcagg

SEQ ID NO: 229285 - RNA, 19 nt, Human
uaggaggccaggcggucac

SEQ ID NO: 229286 - RNA, 23 nt, Human
uaggugcugggggcauggcagga

SEQ ID NO: 229287 - RNA, 21 nt, Human
uauccucccccaaagccacua

SEQ ID NO: 229288 - RNA, 25 nt, Human
ucaccaccagcaaagccaccaccca

SEQ ID NO: 229289 - RNA, 22 nt, Human
ucacuuccaggucggcguuggc

SEQ ID NO: 229290 - RNA, 19 nt, Human
ucagguccacgccaggugc

SEQ ID NO: 229291 - RNA, 18 nt, Human
ucaguccuggccaggguc

SEQ ID NO: 229292 - RNA, 21 nt, Human
ucaguccuggccagggucagc

SEQ ID NO: 229293 - RNA, 19 nt, Human
uccacagucagccgcaggg

SEQ ID NO: 229294 - RNA, 23 nt, Human
uccagguaggaggccaggcgguc

SEQ ID NO: 229295 - RNA, 24 nt, Human
ucccccaaaggagaagcgagagaa

SEQ ID NO: 229296 - RNA, 22 nt, Human
uccugaagucaucagcugccag

SEQ ID NO: 229297 - RNA, 18 nt, Human
ucucacuugguccugaag

SEQ ID NO: 229298 - RNA, 25 nt, Human
ugcaaaaugggcugcgcauucucaa

SEQ ID NO: 229299 - RNA, 21 nt, Human
ugccgaagccaccgccauagc

SEQ ID NO: 229300 - RNA, 19 nt, Human
ugcggcugcucuguaccag

SEQ ID NO: 229301 - RNA, 23 nt, Human
ugcucaucgugccaaggagggag

SEQ ID NO: 229302 - RNA, 19 nt, Human
ugcugggggcauggcagga

SEQ ID NO: 229303 - RNA, 25 nt, Human
ugucaaucugcaaaaugggcugcgc

SEQ ID NO: 229304 - RNA, 23 nt, Human
uucaggccuuccaucuccaucuc

SEQ ID NO: 229305 - RNA, 23 nt, Human
uugaaguagggacuguagucuuu

SEQ ID NO: 229306 - RNA, 20 nt, Human
uugguccugaagucaucagc

SEQ ID NO: 229307 - RNA, 18 nt, Human
aagcagggggcugaggcu

SEQ ID NO: 229308 - RNA, 21 nt, Human
aggcaggcacacaggagaagg

SEQ ID NO: 229309 - RNA, 23 nt, Human
caggcacacaggagaagggcugg

SEQ ID NO: 229310 - RNA, 19 nt, Human
cugcucccugccuccuggg

SEQ ID NO: 229311 - RNA, 18 nt, Human
gaagcauggggaagggac

SEQ ID NO: 229312 - RNA, 21 nt, Human
gaagcauggggaagggacuga

SEQ ID NO: 229313 - RNA, 23 nt, Human
ggcaaggaagcauggggaaggga

SEQ ID NO: 229314 - RNA, 25 nt, Human
ggggcugaggcuggaggauaccgug

SEQ ID NO: 229315 - RNA, 24 nt, Human
guggcggcggcaggaggcaggcac

SEQ ID NO: 229316 - RNA, 21 nt, Human
uggggaagggacugaagcagg

SEQ ID NO: 229317 - RNA, 22 nt, Human
uggggcagauggggcggcugcu

SEQ ID NO: 229318 - RNA, 20 nt, Human
aaggacaggacucaggcuuu

SEQ ID NO: 229319 - RNA, 23 nt, Human
agagagaaaggacaggacucagg

SEQ ID NO: 229320 - RNA, 21 nt, Human
gagaaaggacaggacucaggc

SEQ ID NO: 229321 - RNA, 18 nt, Human
gccuccugcuccccaaag

SEQ ID NO: 229322 - RNA, 18 nt, Human
ggacaggacucaggcuuu

SEQ ID NO: 229323 - RNA, 23 nt, Human
ggacaggacucaggcuuugcgga

SEQ ID NO: 229324 - RNA, 20 nt, Human
uguccggggagagagaaagg

SEQ ID NO: 229325 - RNA, 23 nt, Human
aaaggacagcagaagccccagag

SEQ ID NO: 229326 - RNA, 25 nt, Human
caaaggacagcagaagccccagagc

SEQ ID NO: 229327 - RNA, 19 nt, Human
cagaagacacccuccaaag

SEQ ID NO: 229328 - RNA, 23 nt, Human
caggagaagagccggggguaagg

SEQ ID NO: 229329 - RNA, 19 nt, Human
cccaucccucuacccagaa

SEQ ID NO: 229330 - RNA, 19 nt, Human
cccuuccuucccaucccuc

SEQ ID NO: 229331 - RNA, 21 nt, Human
ccggggguaagggucccuucc

SEQ ID NO: 229332 - RNA, 23 nt, Human
ccuucccaucccucuacccagaa

SEQ ID NO: 229333 - RNA, 25 nt, Human
cucuacccagaagacacccuccaaa

SEQ ID NO: 229334 - RNA, 19 nt, Human
gcggagcacggacggagca

SEQ ID NO: 229335 - RNA, 21 nt, Human
ggagaagagccggggguaagg

SEQ ID NO: 229336 - RNA, 20 nt, Human
uccaaaggacagcagaagcc

SEQ ID NO: 229337 - RNA, 19 nt, Human
ucccaucccucuacccaga

SEQ ID NO: 229338 - RNA, 19 nt, Human
ucccaucccucuacccaga

SEQ ID NO: 229339 - RNA, 19 nt, Human
aaagugccaucagagauaa

SEQ ID NO: 229340 - RNA, 21 nt, Human
aacacauuuccccccagcacu

SEQ ID NO: 229341 - RNA, 22 nt, Human
aagaucuuucaaaaacuguaug

SEQ ID NO: 229342 - RNA, 19 nt, Human
aagcacaaaccuagacagc

SEQ ID NO: 229343 - RNA, 22 nt, Human
acacagaaacacauuucccccc

SEQ ID NO: 229344 - RNA, 21 nt, Human
accacagcacuuccgaaagca

SEQ ID NO: 229345 - RNA, 18 nt, Human
agacagcacagauuccgc

SEQ ID NO: 229346 - RNA, 19 nt, Human
agagucggugguggugggg

SEQ ID NO: 229347 - RNA, 22 nt, Human
agugccaucagagauaaaugac

SEQ ID NO: 229348 - RNA, 25 nt, Human
aucuggaaaaugggcaaugcaaagg

SEQ ID NO: 229349 - RNA, 24 nt, Human
caaaccuagacagcacagauuccg

SEQ ID NO: 229350 - RNA, 20 nt, Human
caacagaauacacaucugga

SEQ ID NO: 229351 - RNA, 26 nt, Human
caagaggagcuauauacacagaaaca

SEQ ID NO: 229352 - RNA, 20 nt, Human
cacagauuccgccccagaac

SEQ ID NO: 229353 - RNA, 20 nt, Human
cagaacacagaggcgucacu

SEQ ID NO: 229354 - RNA, 25 nt, Human
cagaauacacaucuggaaaaugggc

SEQ ID NO: 229355 - RNA, 19 nt, Human
cagaccacagcacuuccga

SEQ ID NO: 229356 - RNA, 20 nt, Human
cagauuccgccccagaacac

SEQ ID NO: 229357 - RNA, 19 nt, Human
ccagaacacagaggcguca

SEQ ID NO: 229358 - RNA, 20 nt, Human
ccagaacacagaggcgucac

SEQ ID NO: 229359 - RNA, 23 nt, Human
cccagaacacagaggcgucacug

SEQ ID NO: 229360 - RNA, 22 nt, Human
ccccagaacacagaggcgucac

SEQ ID NO: 229361 - RNA, 22 nt, Human
cccccagaccacagcacuuccg

SEQ ID NO: 229362 - RNA, 19 nt, Human
cuuccgaaagcagagugga

SEQ ID NO: 229363 - RNA, 22 nt, Human
gcacaaaccuagacagcacaga

SEQ ID NO: 229364 - RNA, 22 nt, Human
uaacugguuuggagagaagauc

SEQ ID NO: 229365 - RNA, 23 nt, Human
uaacugguuuggagagaagaucu

SEQ ID NO: 229366 - RNA, 19 nt, Human
uagaagcacaaaccuagac

SEQ ID NO: 229367 - RNA, 23 nt, Human
uauuaugaagacccccagaccac

SEQ ID NO: 229368 - RNA, 23 nt, Human
ucggugguggugggggcucaucu

SEQ ID NO: 229369 - RNA, 19 nt, Human
ucuggguugggagagucgg

SEQ ID NO: 229370 - RNA, 24 nt, Human
ugacaaaaauuuaacuugcugcca

SEQ ID NO: 229371 - RNA, 18 nt, Human
uggcuagaagcacaaacc

SEQ ID NO: 229372 - RNA, 25 nt, Human
uggguccucaacagaauacacaucu

SEQ ID NO: 229373 - RNA, 21 nt, Human
uggguugggagagucgguggu

SEQ ID NO: 229374 - RNA, 20 nt, Human
agcggaggggaggcgcugga

SEQ ID NO: 229375 - RNA, 21 nt, Human
aggccacagccuuccagcgca

SEQ ID NO: 229376 - RNA, 24 nt, Human
cacaccuggacaaucacaggcugg

SEQ ID NO: 229377 - RNA, 21 nt, Human
cccagggaggggacuccgggg

SEQ ID NO: 229378 - RNA, 18 nt, Human
gacagaccggaggggcgg

SEQ ID NO: 229379 - RNA, 20 nt, Human
gcgcagagccgcguucuugg

SEQ ID NO: 229380 - RNA, 20 nt, Human
gcgccuaggccacaccugga

SEQ ID NO: 229381 - RNA, 24 nt, Human
ggccggggaucuggaaggaggagc

SEQ ID NO: 229382 - RNA, 21 nt, Human
gggaggcgcuggaguggcugc

SEQ ID NO: 229383 - RNA, 23 nt, Human
gggcggagggggcugugugcuuc

SEQ ID NO: 229384 - RNA, 20 nt, Human
ugaaauucucgugacugggc

SEQ ID NO: 229385 - RNA, 19 nt, Human
uggcgccuaggccacaccu

SEQ ID NO: 229386 - RNA, 19 nt, Human
uggggagcggaggggaggc

SEQ ID NO: 229387 - RNA, 19 nt, Human
uggggagcggaggggaggc

SEQ ID NO: 229388 - RNA, 20 nt, Human
ugggggcguggggagcggag

SEQ ID NO: 229389 - RNA, 18 nt, Human
uguagugagcaucccacc

SEQ ID NO: 229390 - RNA, 24 nt, Human
uucucgugacugggcuuggccggg

SEQ ID NO: 229391 - RNA, 23 nt, Human
aaagcauuuuauugaagauucac

SEQ ID NO: 229392 - RNA, 20 nt, Human
aagccccugccugggcccag

SEQ ID NO: 229393 - RNA, 27 nt, Human
acaccccaucacccauccucucacccc

SEQ ID NO: 229394 - RNA, 20 nt, Human
accaaacuccaagaggcaga

SEQ ID NO: 229395 - RNA, 18 nt, Human
acuaagugguucucaucc

SEQ ID NO: 229396 - RNA, 19 nt, Human
agcgcacagccugccaccu

SEQ ID NO: 229397 - RNA, 21 nt, Human
agcuggacacagugagcugca

SEQ ID NO: 229398 - RNA, 19 nt, Human
agugaaggaagcacagaga

SEQ ID NO: 229399 - RNA, 19 nt, Human
aucacacuacucucuggga

SEQ ID NO: 229400 - RNA, 20 nt, Human
auguccuggagcagcagggc

SEQ ID NO: 229401 - RNA, 22 nt, Human
caagcccauccuucccgcaccc

SEQ ID NO: 229402 - RNA, 20 nt, Human
cacagcaccucccuccucca

SEQ ID NO: 229403 - RNA, 18 nt, Human
cacccauccucucacccc

SEQ ID NO: 229404 - RNA, 19 nt, Human
cacccauccucucacccca

SEQ ID NO: 229405 - RNA, 22 nt, Human
cacccauccucucaccccacag

SEQ ID NO: 229406 - RNA, 24 nt, Human
caccccaucacccauccucucacc

SEQ ID NO: 229407 - RNA, 22 nt, Human
cagaagccccugccugggccca

SEQ ID NO: 229408 - RNA, 22 nt, Human
cagagaagugacagggcccagg

SEQ ID NO: 229409 - RNA, 20 nt, Human
cagcacagaagaucauccug

SEQ ID NO: 229410 - RNA, 21 nt, Human
cagcgcuccaggcccacaccc

SEQ ID NO: 229411 - RNA, 24 nt, Human
caucucgcuaggcucacagcaccu

SEQ ID NO: 229412 - RNA, 24 nt, Human
cauuuucuucucugcccaugggag

SEQ ID NO: 229413 - RNA, 20 nt, Human
ccacuguaccuccaucucgc

SEQ ID NO: 229414 - RNA, 24 nt, Human
ccagaaaagacaccccaucaccca

SEQ ID NO: 229415 - RNA, 21 nt, Human
ccaggcccacacccacuguac

SEQ ID NO: 229416 - RNA, 19 nt, Human
ccaggugggucaccaggcc

SEQ ID NO: 229417 - RNA, 25 nt, Human
cccacacccacuguaccuccaucuc

SEQ ID NO: 229418 - RNA, 23 nt, Human
cccacagaauguggaguuagaca

SEQ ID NO: 229419 - RNA, 18 nt, Human
cccagcgcuccaggccca

SEQ ID NO: 229420 - RNA, 22 nt, Human
ccccacagaauguggaguuaga

SEQ ID NO: 229421 - RNA, 26 nt, Human
ccccagagacagaggauggaggugaa

SEQ ID NO: 229422 - RNA, 19 nt, Human
ccccaucacccauccucuc

SEQ ID NO: 229423 - RNA, 22 nt, Human
cccugccugggcccagcgcucc

SEQ ID NO: 229424 - RNA, 26 nt, Human
ccuccagaaaagacaccccaucaccc

SEQ ID NO: 229425 - RNA, 21 nt, Human
ccugaacuggugccccagggc

SEQ ID NO: 229426 - RNA, 22 nt, Human
cguugagcaugucacuaaacac

SEQ ID NO: 229427 - RNA, 18 nt, Human
cuccaagaggcagagucc

SEQ ID NO: 229428 - RNA, 21 nt, Human
cugccugggcccagcgcucca

SEQ ID NO: 229429 - RNA, 18 nt, Human
cugggagcuaucagagaa

SEQ ID NO: 229430 - RNA, 19 nt, Human
cugggcccagcuggacaca

SEQ ID NO: 229431 - RNA, 20 nt, Human
gaagccccugccugggccca

SEQ ID NO: 229432 - RNA, 19 nt, Human
gacacagugagcugcaggg

SEQ ID NO: 229433 - RNA, 18 nt, Human
gagccccagagacagagg

SEQ ID NO: 229434 - RNA, 24 nt, Human
gaugagccccagagacagaggaug

SEQ ID NO: 229435 - RNA, 21 nt, Human
gcauaaagggaaaaaucugaa

SEQ ID NO: 229436 - RNA, 19 nt, Human
gcauuggacugggaaggga

SEQ ID NO: 229437 - RNA, 18 nt, Human
gcccaggccggugagugc

SEQ ID NO: 229438 - RNA, 19 nt, Human
gcccaggccggugagugcu

SEQ ID NO: 229439 - RNA, 20 nt, Human
gcccaugggaggugagaggu

SEQ ID NO: 229440 - RNA, 23 nt, Human
gcucacagcaccucccuccucca

SEQ ID NO: 229441 - RNA, 19 nt, Human
ggagaugacacuccugguc

SEQ ID NO: 229442 - RNA, 22 nt, Human
gggaagggacauaugugacccc

SEQ ID NO: 229443 - RNA, 23 nt, Human
gggucaccaggcccaaaucaaga

SEQ ID NO: 229444 - RNA, 18 nt, Human
uaagagggaaugagagga

SEQ ID NO: 229445 - RNA, 21 nt, Human
uaagagggaaugagaggagua

SEQ ID NO: 229446 - RNA, 24 nt, Human
uaagaugagccccagagacagagg

SEQ ID NO: 229447 - RNA, 25 nt, Human
uaagugguucucauccuaagcuugc

SEQ ID NO: 229448 - RNA, 18 nt, Human
uacuaguaagaugagccc

SEQ ID NO: 229449 - RNA, 18 nt, Human
uagaaugggacacuaagu

SEQ ID NO: 229450 - RNA, 24 nt, Human
ucacccauccucucaccccacaga

SEQ ID NO: 229451 - RNA, 25 nt, Human
ucacccauccucucaccccacagaa

SEQ ID NO: 229452 - RNA, 20 nt, Human
ucaccccacagaauguggag

SEQ ID NO: 229453 - RNA, 23 nt, Human
uccagaaaagacaccccaucacc

SEQ ID NO: 229454 - RNA, 22 nt, Human
uccuaaucagaagccccugccu

SEQ ID NO: 229455 - RNA, 19 nt, Human
uccuccagaaaagacaccc

SEQ ID NO: 229456 - RNA, 20 nt, Human
uccuggggcagagagagccc

SEQ ID NO: 229457 - RNA, 19 nt, Human
ucugaaacaucucugggcu

SEQ ID NO: 229458 - RNA, 23 nt, Human
ugacaaaagcauuuuauugaaga

SEQ ID NO: 229459 - RNA, 18 nt, Human
ugacagggcccaggccgg

SEQ ID NO: 229460 - RNA, 18 nt, Human
ugcagagagcgagcuggg

SEQ ID NO: 229461 - RNA, 21 nt, Human
uggagaugacacuccuggucu

SEQ ID NO: 229462 - RNA, 20 nt, Human
ugggagaaccugaacuggug

SEQ ID NO: 229463 - RNA, 21 nt, Human
ugggcccagcgcuccaggccc

SEQ ID NO: 229464 - RNA, 18 nt, Human
uggggcagagagagccca

SEQ ID NO: 229465 - RNA, 20 nt, Human
uggggcagagagagcccaug

SEQ ID NO: 229466 - RNA, 24 nt, Human
uggggcagagagagcccccccgag

SEQ ID NO: 229467 - RNA, 19 nt, Human
uguagauggauaauacagg

SEQ ID NO: 229468 - RNA, 22 nt, Human
uuccaggugggucaccaggccc

SEQ ID NO: 229469 - RNA, 20 nt, Human
uucucugcccaugggaggug

SEQ ID NO: 229470 - RNA, 26 nt, Human
uugcagggccaagugcugccgggugu

SEQ ID NO: 229471 - RNA, 18 nt, Human
aacacauucuggagguag

SEQ ID NO: 229472 - RNA, 18 nt, Human
acgggagaccaggggcug

SEQ ID NO: 229473 - RNA, 21 nt, Human
agguggcucuguuacccagga

SEQ ID NO: 229474 - RNA, 18 nt, Human
cacuuggaaggcagugac

SEQ ID NO: 229475 - RNA, 19 nt, Human
cagcaggacgcagaaggug

SEQ ID NO: 229476 - RNA, 19 nt, Human
cagcaggggccaugcugug

SEQ ID NO: 229477 - RNA, 23 nt, Human
ccaggaacggugaugcccccuuu

SEQ ID NO: 229478 - RNA, 19 nt, Human
gaggugcuggagagaacag

SEQ ID NO: 229479 - RNA, 21 nt, Human
ggaggugcuggagagaacaga

SEQ ID NO: 229480 - RNA, 19 nt, Human
ggauucuguuuugaugauu

SEQ ID NO: 229481 - RNA, 21 nt, Human
gguggcucuguuacccaggaa

SEQ ID NO: 229482 - RNA, 18 nt, Human
gugucagcaggggccaug

SEQ ID NO: 229483 - RNA, 19 nt, Human
ucuagacuacucuccagaa

SEQ ID NO: 229484 - RNA, 18 nt, Human
ucucgugucagcaggggc

SEQ ID NO: 229485 - RNA, 22 nt, Human
ugcccccuuuuuaucccuucca

SEQ ID NO: 229486 - RNA, 19 nt, Human
ugccuagaagaggcaaucu

SEQ ID NO: 229487 - RNA, 23 nt, Human
ugcugcacuuggaaggcagugac

SEQ ID NO: 229488 - RNA, 25 nt, Human
ugggaggugcuggagagaacagagc

SEQ ID NO: 229489 - RNA, 22 nt, Human
ugggauugggguggggauucug

SEQ ID NO: 229490 - RNA, 18 nt, Human
ugggcugggcgagagagg

SEQ ID NO: 229491 - RNA, 18 nt, Human
ugggguggggauucuguu

SEQ ID NO: 229492 - RNA, 20 nt, Human
agagagagagaagaagugag

SEQ ID NO: 229493 - RNA, 22 nt, Human
caggcuuuguacaucauaggac

SEQ ID NO: 229494 - RNA, 20 nt, Human
ccaggagaugagagagcuga

SEQ ID NO: 229495 - RNA, 23 nt, Human
ccccuggcaauuuucugcaauga

SEQ ID NO: 229496 - RNA, 28 nt, Human
ccucagagauagaacacuggaggcaagg

SEQ ID NO: 229497 - RNA, 23 nt, Human
cugcagccagagaggggccugag

SEQ ID NO: 229498 - RNA, 20 nt, Human
cuggcaauuuucugcaauga

SEQ ID NO: 229499 - RNA, 21 nt, Human
gagagagagagaagaagugag

SEQ ID NO: 229500 - RNA, 19 nt, Human
ggcucugcagccagagagg

SEQ ID NO: 229501 - RNA, 24 nt, Human
gggacagcaggggagacuggaggc

SEQ ID NO: 229502 - RNA, 21 nt, Human
uaacagugaagcuccaguggu

SEQ ID NO: 229503 - RNA, 24 nt, Human
uacaucaugauguaaaaucagagg

SEQ ID NO: 229504 - RNA, 19 nt, Human
uagaacacuggaggcaaga

SEQ ID NO: 229505 - RNA, 21 nt, Human
uagagaguuugagagccagug

SEQ ID NO: 229506 - RNA, 19 nt, Human
uccccagcucuaccuggga

SEQ ID NO: 229507 - RNA, 20 nt, Human
ugagagagcugaggagagug

SEQ ID NO: 229508 - RNA, 18 nt, Human
ugaggagagggcucugca

SEQ ID NO: 229509 - RNA, 18 nt, Human
ugcucagaugguauagag

SEQ ID NO: 229510 - RNA, 24 nt, Human
ugcucagccucagagauagaacac

SEQ ID NO: 229511 - RNA, 23 nt, Human
uggaaguuguucugaaauaagcc

SEQ ID NO: 229512 - RNA, 22 nt, Human
uuaguaacagugaagcuccagu

SEQ ID NO: 229513 - RNA, 21 nt, Human
uucacaacacuuauaaguuag

SEQ ID NO: 229514 - RNA, 22 nt, Human
uucuuauaaugcucagccucag

SEQ ID NO: 229515 - RNA, 19 nt, Human
aacagaacaaaagaaggca

SEQ ID NO: 229516 - RNA, 23 nt, Human
aauaauacgggaacuaaaaagga

SEQ ID NO: 229517 - RNA, 24 nt, Human
acacugcaagagaagaucaggacc

SEQ ID NO: 229518 - RNA, 21 nt, Human
acagaacaaaagaaggcaaag

SEQ ID NO: 229519 - RNA, 22 nt, Human
acccgggagggcaggggagacu

SEQ ID NO: 229520 - RNA, 21 nt, Human
agaacaaaagaaggcaaagag

SEQ ID NO: 229521 - RNA, 19 nt, Human
agaaggcaaagagagcagg

SEQ ID NO: 229522 - RNA, 18 nt, Human
agacugcaucagaaggua

SEQ ID NO: 229523 - RNA, 25 nt, Human
agagcugugggacugagagcuggcg

SEQ ID NO: 229524 - RNA, 20 nt, Human
agcuauaaugggcaggaugg

SEQ ID NO: 229525 - RNA, 23 nt, Human
agcucaguggaacagguauugau

SEQ ID NO: 229526 - RNA, 23 nt, Human
aggcaaagagagcagagaaagca

SEQ ID NO: 229527 - RNA, 21 nt, Human
aggggccugagagcugugggg

SEQ ID NO: 229528 - RNA, 22 nt, Human
caacagaacaaaagaaggcaaa

SEQ ID NO: 229529 - RNA, 22 nt, Human
cacuugccauucagggacacug

SEQ ID NO: 229530 - RNA, 19 nt, Human
cagcucuacccgggagggc

SEQ ID NO: 229531 - RNA, 18 nt, Human
cucugcugccagagaggg

SEQ ID NO: 229532 - RNA, 23 nt, Human
cugcugccagagaggggccugag

SEQ ID NO: 229533 - RNA, 22 nt, Human
gacugagagcuggcggcacgac

SEQ ID NO: 229534 - RNA, 19 nt, Human
gagcugugggacugagagc

SEQ ID NO: 229535 - RNA, 19 nt, Human
gaucaggacaacugacuug

SEQ ID NO: 229536 - RNA, 21 nt, Human
ggacugagagcuggcggcacg

SEQ ID NO: 229537 - RNA, 19 nt, Human
ggcaggggagacuggaggc

SEQ ID NO: 229538 - RNA, 19 nt, Human
ggcucugcugccagagagg

SEQ ID NO: 229539 - RNA, 24 nt, Human
guaagcaacaggagcucaguggaa

SEQ ID NO: 229540 - RNA, 23 nt, Human
ucaacagaacaaaagaaggcaaa

SEQ ID NO: 229541 - RNA, 18 nt, Human
ucugcagcuggaccuaga

SEQ ID NO: 229542 - RNA, 20 nt, Human
ucugcagcuggaccuagacu

SEQ ID NO: 229543 - RNA, 21 nt, Human
ugaggagagggcucugcugcc

SEQ ID NO: 229544 - RNA, 21 nt, Human
ugcaagagaagaucaggacaa

SEQ ID NO: 229545 - RNA, 21 nt, Human
ugcaagagaagaucaggacac

SEQ ID NO: 229546 - RNA, 20 nt, Human
ugccagagaggggccugaga

SEQ ID NO: 229547 - RNA, 22 nt, Human
cgggauggaccuagcggcgggc

SEQ ID NO: 229548 - RNA, 18 nt, Human
cuagcggcgggcgaggag

SEQ ID NO: 229549 - RNA, 19 nt, Human
gguggcugggccgggaugg

SEQ ID NO: 229550 - RNA, 19 nt, Human
aggcaggaguggaggcagg

SEQ ID NO: 229551 - RNA, 21 nt, Human
aggcaggcgggccgaaccagg

SEQ ID NO: 229552 - RNA, 23 nt, Human
agggguaggcugggaggggcugc

SEQ ID NO: 229553 - RNA, 25 nt, Human
agguaguaaacuccccaggugggcc

SEQ ID NO: 229554 - RNA, 23 nt, Human
ccaggugggcugagggcuagggc

SEQ ID NO: 229555 - RNA, 24 nt, Human
ccuccuucccaggcucuggggcag

SEQ ID NO: 229556 - RNA, 24 nt, Human
cuacccugcauagcggccuccuuc

SEQ ID NO: 229557 - RNA, 18 nt, Human
cugggaggggcugccgca

SEQ ID NO: 229558 - RNA, 19 nt, Human
gggccgaaccaggcggaga

SEQ ID NO: 229559 - RNA, 25 nt, Human
gggcuagggcugagccucagguggg

SEQ ID NO: 229560 - RNA, 31 nt, Human
guccccagguaguaaacuccccaggugggcc

SEQ ID NO: 229561 - RNA, 18 nt, Human
guggaggcaggcgggccg

SEQ ID NO: 229562 - RNA, 22 nt, Human
uagcggccuccuucccaggcuc

SEQ ID NO: 229563 - RNA, 22 nt, Human
uccccaggugggcugagggcua

SEQ ID NO: 229564 - RNA, 19 nt, Human
uggaccaaaaaaaaaaagc

SEQ ID NO: 229565 - RNA, 20 nt, Human
uucccaggcucuggggcagc

SEQ ID NO: 229566 - RNA, 20 nt, Human
uuggcagagcuagcugaggu

SEQ ID NO: 229567 - RNA, 24 nt, Human
uuuuguagcuggaggcaugggcaa

SEQ ID NO: 229568 - RNA, 18 nt, Human
aagccagaggcacauaug

SEQ ID NO: 229569 - RNA, 18 nt, Human
accccaggccagagagag

SEQ ID NO: 229570 - RNA, 18 nt, Human
acccugaaggcaucaaag

SEQ ID NO: 229571 - RNA, 28 nt, Human
acccugaaggcaucaaagccaagcaggg

SEQ ID NO: 229572 - RNA, 22 nt, Human
agcaccccaggccagagagagg

SEQ ID NO: 229573 - RNA, 24 nt, Human
aggguuggaagccaauggaaagcc

SEQ ID NO: 229574 - RNA, 23 nt, Human
caggccagagagaggaaagaggu

SEQ ID NO: 229575 - RNA, 20 nt, Human
ccaagcaggguuggaagcca

SEQ ID NO: 229576 - RNA, 23 nt, Human
cgaaaggaagccuuuugucucau

SEQ ID NO: 229577 - RNA, 18 nt, Human
cugaaggcaucaaagcca

SEQ ID NO: 229578 - RNA, 22 nt, Human
cuuguugccagcuauuccugau

SEQ ID NO: 229579 - RNA, 21 nt, Human
gaaaggaagccuuuugucuca

SEQ ID NO: 229580 - RNA, 18 nt, Human
gaagcagugauaggagug

SEQ ID NO: 229581 - RNA, 25 nt, Human
gaagccaauggaaagccagaggcac

SEQ ID NO: 229582 - RNA, 18 nt, Human
gcucagcuggggcugggc

SEQ ID NO: 229583 - RNA, 21 nt, Human
gggcacaggggcuuguugcca

SEQ ID NO: 229584 - RNA, 23 nt, Human
gggcaggagaaguuuacagaggc

SEQ ID NO: 229585 - RNA, 21 nt, Human
uaugccaagucaguucagucc

SEQ ID NO: 229586 - RNA, 19 nt, Human
ugagaagcagugauaggag

SEQ ID NO: 229587 - RNA, 20 nt, Human
ugccaagucaguucaguccc

SEQ ID NO: 229588 - RNA, 21 nt, Human
ugcucagcuggggcugggcag

SEQ ID NO: 229589 - RNA, 22 nt, Human
ugcucagcuggggcugggcagg

SEQ ID NO: 229590 - RNA, 25 nt, Human
uggaaagccagaggcacauaugcca

SEQ ID NO: 229591 - RNA, 25 nt, Human
ugucaggauccaauaagcaggcuuc

SEQ ID NO: 229592 - RNA, 21 nt, Human
uugagaagcagugauaggagu

SEQ ID NO: 229593 - RNA, 20 nt, Human
aggaacagacccccaggaag

SEQ ID NO: 229594 - RNA, 24 nt, Human
aggaaggaacagacccccaggaaa

SEQ ID NO: 229595 - RNA, 22 nt, Human
aggcuuugggugaguuucuugg

SEQ ID NO: 229596 - RNA, 22 nt, Human
agugcugggagggagggaggga

SEQ ID NO: 229597 - RNA, 22 nt, Human
cauaggaaggaacagaccccca

SEQ ID NO: 229598 - RNA, 22 nt, Human
cccccaggaaggaaagggugag

SEQ ID NO: 229599 - RNA, 19 nt, Human
cccugcauccuugcuccuc

SEQ ID NO: 229600 - RNA, 18 nt, Human
ccuuacgcgggcaacucc

SEQ ID NO: 229601 - RNA, 28 nt, Human
cgggcaacuccagccaugcaaaugaugu

SEQ ID NO: 229602 - RNA, 22 nt, Human
cugggcccugcauccuugcucc

SEQ ID NO: 229603 - RNA, 25 nt, Human
gcuuugggugaguuucuuggcugcc

SEQ ID NO: 229604 - RNA, 19 nt, Human
ggaggcuacaggcuuuggg

SEQ ID NO: 229605 - RNA, 26 nt, Human
ggcuuugggugaguuucuuggcugcc

SEQ ID NO: 229606 - RNA, 19 nt, Human
uaaaagggaggcccacugg

SEQ ID NO: 229607 - RNA, 20 nt, Human
uaggaaggaacagaccccca

SEQ ID NO: 229608 - RNA, 23 nt, Human
ucacagcucuggaguccugggcc

SEQ ID NO: 229609 - RNA, 18 nt, Human
uccucuggcauucccuag

SEQ ID NO: 229610 - RNA, 24 nt, Human
uccugggcccugcauccuugcucc

SEQ ID NO: 229611 - RNA, 23 nt, Human
uccuugcuccucuggcauucccu

SEQ ID NO: 229612 - RNA, 22 nt, Human
ugaagacagagucuaaauucuc

SEQ ID NO: 229613 - RNA, 23 nt, Human
ugccuuacgcgggcaacuccagc

SEQ ID NO: 229614 - RNA, 18 nt, Human
uggcugaagacagagucu

SEQ ID NO: 229615 - RNA, 24 nt, Human
uuacgcgggcaacuccagccaugc

SEQ ID NO: 229616 - RNA, 18 nt, Human
uucaggccccuuuuguug

SEQ ID NO: 229617 - RNA, 19 nt, Human
uuuuuuuuuuuuuugccaa

SEQ ID NO: 229618 - RNA, 23 nt, Human
uuuuuuuuuuuuuuuugccaagg

SEQ ID NO: 229619 - RNA, 18 nt, Human
uuuuuuuuuuuuuuuuug

SEQ ID NO: 229620 - RNA, 22 nt, Human
uuuuuuuuuuuuuuuuugccaa

SEQ ID NO: 229621 - RNA, 23 nt, Human
aaaaagaggcaguuuugaaguga

SEQ ID NO: 229622 - RNA, 25 nt, Human
aacacacgcucuuugaggcagcaca

SEQ ID NO: 229623 - RNA, 22 nt, Human
agaaacaucaccaaagagaaca

SEQ ID NO: 229624 - RNA, 20 nt, Human
agcacagacaaccagaaaca

SEQ ID NO: 229625 - RNA, 20 nt, Human
aggcugcccagccccaggcc

SEQ ID NO: 229626 - RNA, 23 nt, Human
cacagacaaccagaaacaucacc

SEQ ID NO: 229627 - RNA, 19 nt, Human
caccaaagagaacaguuca

SEQ ID NO: 229628 - RNA, 20 nt, Human
cagcacagacaaccagaaac

SEQ ID NO: 229629 - RNA, 22 nt, Human
cagcacagacaaccagaaacau

SEQ ID NO: 229630 - RNA, 26 nt, Human
ccacugaauaccaggcugcccagccc

SEQ ID NO: 229631 - RNA, 21 nt, Human
ccagaaacaucaccaaagaga

SEQ ID NO: 229632 - RNA, 22 nt, Human
ggcccugcucuucugguggcca

SEQ ID NO: 229633 - RNA, 24 nt, Human
ggcccugcucuucugguggccacc

SEQ ID NO: 229634 - RNA, 26 nt, Human
uaccaggcugcccagccccaggcccu

SEQ ID NO: 229635 - RNA, 21 nt, Human
ucaccaaagagaacaguucac

SEQ ID NO: 229636 - RNA, 18 nt, Human
ucagagcuuguugcaggu

SEQ ID NO: 229637 - RNA, 20 nt, Human
ucagggucuuccuugcugac

SEQ ID NO: 229638 - RNA, 23 nt, Human
uccucagccacagcuaccuggau

SEQ ID NO: 229639 - RNA, 21 nt, Human
ucuccucagccacagcuaccu

SEQ ID NO: 229640 - RNA, 18 nt, Human
ugaagugaugagggcuua

SEQ ID NO: 229641 - RNA, 24 nt, Human
uugcugaccggggcuggcccugcu

SEQ ID NO: 229642 - RNA, 22 nt, Human
ggugcagggagggaguguccag

SEQ ID NO: 229643 - RNA, 25 nt, Human
aaaaaggaaaacaggaaaugcagua

SEQ ID NO: 229644 - RNA, 22 nt, Human
aaacaaacaggcucgacccuca

SEQ ID NO: 229645 - RNA, 23 nt, Human
aaacaaacaggcucgacccucaa

SEQ ID NO: 229646 - RNA, 24 nt, Human
aaacaaacaggcucgacccucaac

SEQ ID NO: 229647 - RNA, 21 nt, Human
aacaggaaggaguuguccaga

SEQ ID NO: 229648 - RNA, 19 nt, Human
aacaggaaggaguuguccg

SEQ ID NO: 229649 - RNA, 22 nt, Human
aagaaaaaaggaaaacaggaaa

SEQ ID NO: 229650 - RNA, 26 nt, Human
acaggaaggaguuguccagacauugg

SEQ ID NO: 229651 - RNA, 24 nt, Human
agaaaaaaggaaaacaggaaaugc

SEQ ID NO: 229652 - RNA, 23 nt, Human
agaaacaaacaggcucgacccuc

SEQ ID NO: 229653 - RNA, 25 nt, Human
agaaacaaacaggcucgacccucaa

SEQ ID NO: 229654 - RNA, 21 nt, Human
agaggcaagaugagguuucuu

SEQ ID NO: 229655 - RNA, 20 nt, Human
agcugagcuccagaaaaguc

SEQ ID NO: 229656 - RNA, 25 nt, Human
aggaaggaguuguccagacauugga

SEQ ID NO: 229657 - RNA, 18 nt, Human
aggcaagaugagguuucu

SEQ ID NO: 229658 - RNA, 22 nt, Human
auuccagagaaugccaaagaaa

SEQ ID NO: 229659 - RNA, 20 nt, Human
cagagaaaugaaguuuauug

SEQ ID NO: 229660 - RNA, 24 nt, Human
caggaaacaccuuaaguaguaacu

SEQ ID NO: 229661 - RNA, 18 nt, Human
caggaaaugcaguaguac

SEQ ID NO: 229662 - RNA, 18 nt, Human
ccagagaaugccaaagaa

SEQ ID NO: 229663 - RNA, 20 nt, Human
gaaguugaugaugugugucu

SEQ ID NO: 229664 - RNA, 21 nt, Human
gcuugggucaggaaagcuuuu

SEQ ID NO: 229665 - RNA, 24 nt, Human
gcuugggucaggaaagcuuuucag

SEQ ID NO: 229666 - RNA, 19 nt, Human
ggaaaugcaguaguacguu

SEQ ID NO: 229667 - RNA, 20 nt, Human
uagaaacaaacaggcucgac

SEQ ID NO: 229668 - RNA, 18 nt, Human
uagaaauaacauagaggc

SEQ ID NO: 229669 - RNA, 24 nt, Human
uagaggcaagaugagguuucuuga

SEQ ID NO: 229670 - RNA, 20 nt, Human
ugagcuccagaaaagucagg

SEQ ID NO: 229671 - RNA, 23 nt, Human
ugccaaagaaaaaaggaaaacag

SEQ ID NO: 229672 - RNA, 21 nt, Human
ugugugucuuugcuuggguca

SEQ ID NO: 229673 - RNA, 28 nt, Human
uuagaaacaaacaggcucgacccucaac

SEQ ID NO: 229674 - RNA, 23 nt, Human
uuccagagaaugccaaagaaaaa

SEQ ID NO: 229675 - RNA, 18 nt, Human
aagacucaucuccaccac

SEQ ID NO: 229676 - RNA, 21 nt, Human
accagucucauaaaauaggag

SEQ ID NO: 229677 - RNA, 22 nt, Human
acccuggcacccauugaaauga

SEQ ID NO: 229678 - RNA, 23 nt, Human
agacccuggcacccauugaaaug

SEQ ID NO: 229679 - RNA, 20 nt, Human
agccauggccaucuggguca

SEQ ID NO: 229680 - RNA, 19 nt, Human
aggcaucaggggccugagc

SEQ ID NO: 229681 - RNA, 25 nt, Human
aggccagacaccccaaagcagagaa

SEQ ID NO: 229682 - RNA, 21 nt, Human
auugauaggucucugaggcca

SEQ ID NO: 229683 - RNA, 21 nt, Human
cagaauccaccggaacagcac

SEQ ID NO: 229684 - RNA, 22 nt, Human
cagagaagcagcuccuuacccc

SEQ ID NO: 229685 - RNA, 18 nt, Human
cagcaccuagaaggaaaa

SEQ ID NO: 229686 - RNA, 21 nt, Human
cagcaccuagaaggaaaaccu

SEQ ID NO: 229687 - RNA, 23 nt, Human
cagccagacccugggccugggcu

SEQ ID NO: 229688 - RNA, 22 nt, Human
ccacuggccccuccugggcucu

SEQ ID NO: 229689 - RNA, 19 nt, Human
ccagacaccccaaagcaga

SEQ ID NO: 229690 - RNA, 21 nt, Human
ccagugggcauugguuggccu

SEQ ID NO: 229691 - RNA, 21 nt, Human
ccccacuggccccuccugggc

SEQ ID NO: 229692 - RNA, 21 nt, Human
cgaguggagcccccacuggcc

SEQ ID NO: 229693 - RNA, 22 nt, Human
cucaucuccaccaccccacauc

SEQ ID NO: 229694 - RNA, 26 nt, Human
cugagaacagagacccuggcacccau

SEQ ID NO: 229695 - RNA, 19 nt, Human
cuuuucagccagacccugg

SEQ ID NO: 229696 - RNA, 19 nt, Human
gacaccccaaagcagagaa

SEQ ID NO: 229697 - RNA, 22 nt, Human
gagaacagagacccuggcaccc

SEQ ID NO: 229698 - RNA, 19 nt, Human
gagcccccacuggccccuc

SEQ ID NO: 229699 - RNA, 23 nt, Human
ggaggcagccugagaacagagac

SEQ ID NO: 229700 - RNA, 22 nt, Human
uaaguuuggguagaggccaagu

SEQ ID NO: 229701 - RNA, 25 nt, Human
uagaaggaaaaccugacccaggagg

SEQ ID NO: 229702 - RNA, 21 nt, Human
uagggcauguauuugcagaaa

SEQ ID NO: 229703 - RNA, 23 nt, Human
ucaagacucaucuccaccacccc

SEQ ID NO: 229704 - RNA, 23 nt, Human
ucacugggaagaccaagucccug

SEQ ID NO: 229705 - RNA, 21 nt, Human
ucugaggccagacaccccaaa

SEQ ID NO: 229706 - RNA, 23 nt, Human
ucugaggccagacaccccaaagc

SEQ ID NO: 229707 - RNA, 18 nt, Human
ugacaggcucugagaaac

SEQ ID NO: 229708 - RNA, 19 nt, Human
ugacccaggaggcagccug

SEQ ID NO: 229709 - RNA, 19 nt, Human
ugaggaguugagaccuuug

SEQ ID NO: 229710 - RNA, 21 nt, Human
ugaggaguugagaccuuuggg

SEQ ID NO: 229711 - RNA, 23 nt, Human
ugaugaggaguugagaccuuugg

SEQ ID NO: 229712 - RNA, 23 nt, Human
uggagcccccacuggccccuccu

SEQ ID NO: 229713 - RNA, 21 nt, Human
ugugaaaauuuaccagucuca

SEQ ID NO: 229714 - RNA, 20 nt, Human
uuccugugaaaauuuaccag

SEQ ID NO: 229715 - RNA, 25 nt, Human
uucuccucauuaaaguuaacaccac

SEQ ID NO: 229716 - RNA, 20 nt, Human
aagaagagacaccaggaaaa

SEQ ID NO: 229717 - RNA, 21 nt, Human
aagcaauguugacaaaucuga

SEQ ID NO: 229718 - RNA, 23 nt, Human
aagccuccucuccucccaacccu

SEQ ID NO: 229719 - RNA, 23 nt, Human
accaggaaaaauaauugcuuuca

SEQ ID NO: 229720 - RNA, 23 nt, Human
agacugaagccuccucuccuccc

SEQ ID NO: 229721 - RNA, 22 nt, Human
agccuccucuccucccaacccu

SEQ ID NO: 229722 - RNA, 22 nt, Human
aggagguuuauugaccauuuaa

SEQ ID NO: 229723 - RNA, 24 nt, Human
caacaaacaccagcaguugauuca

SEQ ID NO: 229724 - RNA, 18 nt, Human
ccugggcggguguuggcu

SEQ ID NO: 229725 - RNA, 22 nt, Human
ccugggcggguguuggcuccag

SEQ ID NO: 229726 - RNA, 18 nt, Human
cucuuccauaucagguua

SEQ ID NO: 229727 - RNA, 19 nt, Human
cugaagccuccucuccucc

SEQ ID NO: 229728 - RNA, 18 nt, Human
cugaggcugcacaggagc

SEQ ID NO: 229729 - RNA, 21 nt, Human
gaugccucuuggcucuuccau

SEQ ID NO: 229730 - RNA, 21 nt, Human
ggugggaagucagagacucac

SEQ ID NO: 229731 - RNA, 19 nt, Human
guuacucagcugcugaguu

SEQ ID NO: 229732 - RNA, 21 nt, Human
uaccaagaagagacaccagga

SEQ ID NO: 229733 - RNA, 19 nt, Human
uaccaugagaaguuccuca

SEQ ID NO: 229734 - RNA, 25 nt, Human
ucccaacccuuuuauaccccauccu

SEQ ID NO: 229735 - RNA, 22 nt, Human
uccucccaacccuuuuauaccc

SEQ ID NO: 229736 - RNA, 19 nt, Human
ugcagggaacccaguuaca

SEQ ID NO: 229737 - RNA, 21 nt, Human
uggugccaucauccuguuacu

SEQ ID NO: 229738 - RNA, 23 nt, Human
uuacaacauuuuagcaacaacca

SEQ ID NO: 229739 - RNA, 19 nt, Human
uuagggaaaaugccucagu

SEQ ID NO: 229740 - RNA, 18 nt, Human
uugaccuccugccuugau

SEQ ID NO: 229741 - RNA, 23 nt, Human
uuggcuccagugcuuugaccucc

SEQ ID NO: 229742 - RNA, 24 nt, Human
aaacaacccaagaaaugugggaaa

SEQ ID NO: 229743 - RNA, 24 nt, Human
aacuuuccuguuggucaguggugu

SEQ ID NO: 229744 - RNA, 24 nt, Human
aagaagcaaaguuauagccaucag

SEQ ID NO: 229745 - RNA, 23 nt, Human
aauguuagaaacaacccaagaaa

SEQ ID NO: 229746 - RNA, 18 nt, Human
acccugaaguagagaaaa

SEQ ID NO: 229747 - RNA, 21 nt, Human
acccugaaguagagaaaacuc

SEQ ID NO: 229748 - RNA, 23 nt, Human
agacugaagccuccucuccuccc

SEQ ID NO: 229749 - RNA, 18 nt, Human
agauagggaggcaggagg

SEQ ID NO: 229750 - RNA, 23 nt, Human
aggaacagaaaggccaguguggc

SEQ ID NO: 229751 - RNA, 18 nt, Human
aggagaagggaauuagaa

SEQ ID NO: 229752 - RNA, 22 nt, Human
aggauuugauacaaggaaaguu

SEQ ID NO: 229753 - RNA, 20 nt, Human
aggcaggaggauaggagaag

SEQ ID NO: 229754 - RNA, 18 nt, Human
aucauacuuagcaaaucu

SEQ ID NO: 229755 - RNA, 20 nt, Human
cauagcaagaagcuauggaa

SEQ ID NO: 229756 - RNA, 20 nt, Human
ccaggcugccaauguuagaa

SEQ ID NO: 229757 - RNA, 23 nt, Human
ccccagagagaaggaagagcagg

SEQ ID NO: 229758 - RNA, 23 nt, Human
cccugguaucucauagccuuugg

SEQ ID NO: 229759 - RNA, 18 nt, Human
ccugggcggguguuggcu

SEQ ID NO: 229760 - RNA, 22 nt, Human
ccuuaugccucuccaauccaga

SEQ ID NO: 229761 - RNA, 18 nt, Human
cuccaggcauguccaagg

SEQ ID NO: 229762 - RNA, 21 nt, Human
cucuuuggguaucccucgccu

SEQ ID NO: 229763 - RNA, 19 nt, Human
cugaagccuccucuccucc

SEQ ID NO: 229764 - RNA, 18 nt, Human
cugaggcugcacaggagc

SEQ ID NO: 229765 - RNA, 23 nt, Human
cuggagagucagaauuuauagag

SEQ ID NO: 229766 - RNA, 19 nt, Human
gagggggaagagcacccca

SEQ ID NO: 229767 - RNA, 21 nt, Human
gaugggaggucagaagcuuuu

SEQ ID NO: 229768 - RNA, 24 nt, Human
gccccuguggguccacaggaauug

SEQ ID NO: 229769 - RNA, 21 nt, Human
gccuccucuccucccagcccu

SEQ ID NO: 229770 - RNA, 20 nt, Human
gcugcaauccagccacugag

SEQ ID NO: 229771 - RNA, 24 nt, Human
ggaaaucucagacagugaagucug

SEQ ID NO: 229772 - RNA, 19 nt, Human
ggggaagagcaccccagag

SEQ ID NO: 229773 - RNA, 19 nt, Human
guuacucagcugcugaguu

SEQ ID NO: 229774 - RNA, 21 nt, Human
uaaggagggggaagagcaccc

SEQ ID NO: 229775 - RNA, 22 nt, Human
uacaauucugauucuauuuccc

SEQ ID NO: 229776 - RNA, 21 nt, Human
uacagaaaguuagaagccaga

SEQ ID NO: 229777 - RNA, 23 nt, Human
uagaaaagacagggucagguaca

SEQ ID NO: 229778 - RNA, 23 nt, Human
uauagagaaaaaagagagaaauu

SEQ ID NO: 229779 - RNA, 23 nt, Human
ucauagccuuuggacaggccuau

SEQ ID NO: 229780 - RNA, 23 nt, Human
uccaagauagggaggcaggagga

SEQ ID NO: 229781 - RNA, 22 nt, Human
uccucccagcccuuuuauaccc

SEQ ID NO: 229782 - RNA, 21 nt, Human
ucuggagagucagaauuuaua

SEQ ID NO: 229783 - RNA, 22 nt, Human
ugaaccacugagacugaagccu

SEQ ID NO: 229784 - RNA, 23 nt, Human
ugaagugcaagugcaauuuuaaa

SEQ ID NO: 229785 - RNA, 21 nt, Human
ugccaauguuagaaacaaccc

SEQ ID NO: 229786 - RNA, 23 nt, Human
ugggaaaaccaagagcaggaaag

SEQ ID NO: 229787 - RNA, 27 nt, Human
uggguaucccucgccuuagccagcccc

SEQ ID NO: 229788 - RNA, 26 nt, Human
ugguaaggaagguagagaguaugaag

SEQ ID NO: 229789 - RNA, 21 nt, Human
uggugccaucauccuguuacu

SEQ ID NO: 229790 - RNA, 19 nt, Human
uguugggcugaggcugcac

SEQ ID NO: 229791 - RNA, 18 nt, Human
uuauaaggagggggaaga

SEQ ID NO: 229792 - RNA, 22 nt, Human
uucaggagaaaguacuagaaaa

SEQ ID NO: 229793 - RNA, 18 nt, Human
uugaccuccugccuugau

SEQ ID NO: 229794 - RNA, 23 nt, Human
uuggcuccaaugcuuugaccucc

SEQ ID NO: 229795 - RNA, 22 nt, Human
uuuauagagaaaaaagagagaa

SEQ ID NO: 229796 - RNA, 23 nt, Human
uuuauagagaaaaaagagagaaa

SEQ ID NO: 229797 - RNA, 23 nt, Human
uuuauggauguguccacucugga

SEQ ID NO: 229798 - RNA, 27 nt, Human
aaagaugccuggggccugggacuugag

SEQ ID NO: 229799 - RNA, 19 nt, Human
aagagcagaggaggaaggg

SEQ ID NO: 229800 - RNA, 18 nt, Human
aagaugccuggggccugg

SEQ ID NO: 229801 - RNA, 22 nt, Human
agaggacaggauaggggaccug

SEQ ID NO: 229802 - RNA, 19 nt, Human
agaggaggaaggggagagg

SEQ ID NO: 229803 - RNA, 23 nt, Human
aggcaggaaggcaguugccgugg

SEQ ID NO: 229804 - RNA, 19 nt, Human
cacugugggguggcagagc

SEQ ID NO: 229805 - RNA, 24 nt, Human
cagcggacuucuuucuaggguggc

SEQ ID NO: 229806 - RNA, 20 nt, Human
ccuggcccuuccugcuccug

SEQ ID NO: 229807 - RNA, 19 nt, Human
ccugggacuugaguugggg

SEQ ID NO: 229808 - RNA, 22 nt, Human
cuccugaggccccuuccuaugg

SEQ ID NO: 229809 - RNA, 24 nt, Human
cugcuccugaggccccuuccuaug

SEQ ID NO: 229810 - RNA, 18 nt, Human
cuuccugcuccugaggcc

SEQ ID NO: 229811 - RNA, 22 nt, Human
gagcacuucuccaggcgccuga

SEQ ID NO: 229812 - RNA, 18 nt, Human
gcaaagaugccuggggcc

SEQ ID NO: 229813 - RNA, 23 nt, Human
ggcaaagaugccuggggccuggg

SEQ ID NO: 229814 - RNA, 20 nt, Human
ugagcacuucuccaggcgcc

SEQ ID NO: 229815 - RNA, 24 nt, Human
ugcagaggacaggauaggggaccc

SEQ ID NO: 229816 - RNA, 18 nt, Human
uggcagagcccagaagug

SEQ ID NO: 229817 - RNA, 22 nt, Human
ugggacuugaguugggggggua

SEQ ID NO: 229818 - RNA, 21 nt, Human
ugggaggggucuuucaaagug

SEQ ID NO: 229819 - RNA, 24 nt, Human
ugguccuggcccuuccugcuccug

SEQ ID NO: 229820 - RNA, 19 nt, Human
ugugaggccaggaguggga

SEQ ID NO: 229821 - RNA, 18 nt, Human
uuccuaugggugccagcg

SEQ ID NO: 229822 - RNA, 20 nt, Human
uugaaacacagaucaagagc

SEQ ID NO: 229823 - RNA, 21 nt, Human
uuucuaggguggccuuuccca

SEQ ID NO: 229824 - RNA, 21 nt, Human
uuuuuuuuuuuuuuuuuggcu

SEQ ID NO: 229825 - RNA, 20 nt, Human
uuuuuuuuuuuuuuuuuugg

SEQ ID NO: 229826 - RNA, 24 nt, Human
aaaaaaacagaagguaggaggaag

SEQ ID NO: 229827 - RNA, 21 nt, Human
aaaaacagaagguaggaggaa

SEQ ID NO: 229828 - RNA, 24 nt, Human
aaacacagagugaaacaaagacaa

SEQ ID NO: 229829 - RNA, 21 nt, Human
aaacagaagguaggaggaaga

SEQ ID NO: 229830 - RNA, 29 nt, Human
aaacagaagguaggaggaagagggacccc

SEQ ID NO: 229831 - RNA, 20 nt, Human
acaaagacaaaggagaaggc

SEQ ID NO: 229832 - RNA, 19 nt, Human
acaggcgcuggcggaggcg

SEQ ID NO: 229833 - RNA, 19 nt, Human
agagugacggcgacaggcg

SEQ ID NO: 229834 - RNA, 22 nt, Human
aggaagaaaaagaugaauccuc

SEQ ID NO: 229835 - RNA, 24 nt, Human
aggcaaaagcacaugggcagaguc

SEQ ID NO: 229836 - RNA, 21 nt, Human
caaagacaaaggagaaggcag

SEQ ID NO: 229837 - RNA, 21 nt, Human
caagaccaaugcauacaugaa

SEQ ID NO: 229838 - RNA, 22 nt, Human
cacacgcgugggccugucccuc

SEQ ID NO: 229839 - RNA, 24 nt, Human
ccauggcgccucccggcccucccc

SEQ ID NO: 229840 - RNA, 18 nt, Human
cccggagcggacgugggg

SEQ ID NO: 229841 - RNA, 20 nt, Human
cccggcccuccccggacucc

SEQ ID NO: 229842 - RNA, 23 nt, Human
cccgggcccucccccguuccucc

SEQ ID NO: 229843 - RNA, 27 nt, Human
ccugcgaccggggauggcucccggagc

SEQ ID NO: 229844 - RNA, 21 nt, Human
cggcgacaggcgcuggcggag

SEQ ID NO: 229845 - RNA, 21 nt, Human
cgggcccucccccguuccucc

SEQ ID NO: 229846 - RNA, 23 nt, Human
cgggcccucccccguuccuccaa

SEQ ID NO: 229847 - RNA, 21 nt, Human
cuggcggaggcggcagccucc

SEQ ID NO: 229848 - RNA, 21 nt, Human
cuuugaggaagagcucaggca

SEQ ID NO: 229849 - RNA, 18 nt, Human
gagguucugaggauggag

SEQ ID NO: 229850 - RNA, 21 nt, Human
gccucccggcccuccccggac

SEQ ID NO: 229851 - RNA, 20 nt, Human
gcggacguggggagagcgcu

SEQ ID NO: 229852 - RNA, 22 nt, Human
ggcgcuggcggaggcggcagcc

SEQ ID NO: 229853 - RNA, 20 nt, Human
ggcggcgcguucuccuggcg

SEQ ID NO: 229854 - RNA, 20 nt, Human
gggaggccggcgcgggcggc

SEQ ID NO: 229855 - RNA, 22 nt, Human
uacaugaaaaaaaaaacagaag

SEQ ID NO: 229856 - RNA, 23 nt, Human
uccacaggcaaaagcacaugggc

SEQ ID NO: 229857 - RNA, 25 nt, Human
uccacaggcaaaagcacaugggcag

SEQ ID NO: 229858 - RNA, 23 nt, Human
uccaggguccgcgucuccauucc

SEQ ID NO: 229859 - RNA, 23 nt, Human
uccauuccacaggcaaaagcaca

SEQ ID NO: 229860 - RNA, 23 nt, Human
ucgcagagucauagaaccacuau

SEQ ID NO: 229861 - RNA, 22 nt, Human
ucuccauuccacaggcaaaagc

SEQ ID NO: 229862 - RNA, 19 nt, Human
ugaaaaaaaaaacagaagg

SEQ ID NO: 229863 - RNA, 24 nt, Human
ugaaaaaaaaaacagaagguagga

SEQ ID NO: 229864 - RNA, 24 nt, Human
ugagggcagccccggaaggagaug

SEQ ID NO: 229865 - RNA, 22 nt, Human
ugcauacaugaaaaaaaaaaca

SEQ ID NO: 229866 - RNA, 19 nt, Human
uggaaacacagagugaaac

SEQ ID NO: 229867 - RNA, 26 nt, Human
uggaaacacagagugaaacaaagaca

SEQ ID NO: 229868 - RNA, 19 nt, Human
uggcggaggcggcagccuc

SEQ ID NO: 229869 - RNA, 25 nt, Human
uucccgggcccucccccguuccucc

SEQ ID NO: 229870 - RNA, 25 nt, Human
uuuuggggaagagaggagguucuga

SEQ ID NO: 229871 - RNA, 20 nt, Human
uuuuuuuuuuuuuuuuuugg

SEQ ID NO: 229872 - RNA, 18 nt, Human
aaaaguguuuucuugagu

SEQ ID NO: 229873 - RNA, 21 nt, Human
acucugaaggugucuacagag

SEQ ID NO: 229874 - RNA, 25 nt, Human
auuugugacgccauuacaaaaaccg

SEQ ID NO: 229875 - RNA, 19 nt, Human
ccuauaaaacccugugcgg

SEQ ID NO: 229876 - RNA, 18 nt, Human
cuaacaaggauuagaaaa

SEQ ID NO: 229877 - RNA, 21 nt, Human
cugugcggccgggaaaggaga

SEQ ID NO: 229878 - RNA, 20 nt, Human
gaguuggcuuuuuuuuuccu

SEQ ID NO: 229879 - RNA, 27 nt, Human
guaaaacaguguacaacaucaguauua

SEQ ID NO: 229880 - RNA, 21 nt, Human
uacaaugccuuuuuuauccuc

SEQ ID NO: 229881 - RNA, 24 nt, Human
uagaaaagacaaaacucuguucag

SEQ ID NO: 229882 - RNA, 18 nt, Human
uauuauaaaacuaaacuc

SEQ ID NO: 229883 - RNA, 19 nt, Human
ucuaacaaggauuagaaaa

SEQ ID NO: 229884 - RNA, 25 nt, Human
ucuaacaaggauuagaaaagacaaa

SEQ ID NO: 229885 - RNA, 22 nt, Human
ucuacagaguuggcuuuuuuuu

SEQ ID NO: 229886 - RNA, 24 nt, Human
ucuguucaguguuucugacaaagu

SEQ ID NO: 229887 - RNA, 23 nt, Human
ugaaaacauaaauaaggcuuuaa

SEQ ID NO: 229888 - RNA, 18 nt, Human
ugacgccauuacaaaaac

SEQ ID NO: 229889 - RNA, 19 nt, Human
ugcggccgggaaaggagac

SEQ ID NO: 229890 - RNA, 21 nt, Human
aaaacagcacccaaaggcccc

SEQ ID NO: 229891 - RNA, 18 nt, Human
aaaagacagcagauggug

SEQ ID NO: 229892 - RNA, 21 nt, Human
aaaccacagccucucugccca

SEQ ID NO: 229893 - RNA, 21 nt, Human
aagaaaagacagcagauggug

SEQ ID NO: 229894 - RNA, 19 nt, Human
aagacagcauuucggagac

SEQ ID NO: 229895 - RNA, 23 nt, Human
acagcauuucggagacccuuucg

SEQ ID NO: 229896 - RNA, 19 nt, Human
accacagccucucugccca

SEQ ID NO: 229897 - RNA, 21 nt, Human
accccaccaugucugccccca

SEQ ID NO: 229898 - RNA, 25 nt, Human
acccugguccugaggagaccccacc

SEQ ID NO: 229899 - RNA, 20 nt, Human
agaaaagacagcagauggug

SEQ ID NO: 229900 - RNA, 18 nt, Human
agacagcagauggugggg

SEQ ID NO: 229901 - RNA, 19 nt, Human
agagcagcgugugcccagg

SEQ ID NO: 229902 - RNA, 20 nt, Human
agauggccuccccugccccc

SEQ ID NO: 229903 - RNA, 25 nt, Human
agcaagaaagacagcauuucggaga

SEQ ID NO: 229904 - RNA, 18 nt, Human
agcaaguucuccucugcc

SEQ ID NO: 229905 - RNA, 23 nt, Human
aggagaccccaccaugucugccc

SEQ ID NO: 229906 - RNA, 24 nt, Human
aggcuggcuggggaguggcugggg

SEQ ID NO: 229907 - RNA, 20 nt, Human
agugacggaggccacuugga

SEQ ID NO: 229908 - RNA, 19 nt, Human
aguggcugggggaggggga

SEQ ID NO: 229909 - RNA, 19 nt, Human
caaaacagcacccaaaggc

SEQ ID NO: 229910 - RNA, 26 nt, Human
caagaaagacagcauuucggagaccc

SEQ ID NO: 229911 - RNA, 22 nt, Human
caccccuacuucuucuccccca

SEQ ID NO: 229912 - RNA, 24 nt, Human
caccccuacuucuucucccccaaa

SEQ ID NO: 229913 - RNA, 24 nt, Human
cagcaaguucuccucugccccaac

SEQ ID NO: 229914 - RNA, 22 nt, Human
cagcauuucggagacccuuucg

SEQ ID NO: 229915 - RNA, 22 nt, Human
caugucugcccccagucaggga

SEQ ID NO: 229916 - RNA, 24 nt, Human
ccaucccgguuggagcagagauug

SEQ ID NO: 229917 - RNA, 23 nt, Human
cccaacuccagccucccaugggc

SEQ ID NO: 229918 - RNA, 19 nt, Human
cccaggaaggggugcagcu

SEQ ID NO: 229919 - RNA, 21 nt, Human
ccccaaaccacagccucucug

SEQ ID NO: 229920 - RNA, 19 nt, Human
ccccaacuccagccuccca

SEQ ID NO: 229921 - RNA, 19 nt, Human
cccccaaaccacagccucu

SEQ ID NO: 229922 - RNA, 20 nt, Human
cccccaaaccacagccucuc

SEQ ID NO: 229923 - RNA, 19 nt, Human
cccccagucagggagcaag

SEQ ID NO: 229924 - RNA, 24 nt, Human
cccugguccugaggagaccccacc

SEQ ID NO: 229925 - RNA, 24 nt, Human
cggccagugggcagugggaggagg

SEQ ID NO: 229926 - RNA, 21 nt, Human
cggccauggggugggcugggc

SEQ ID NO: 229927 - RNA, 23 nt, Human
cggcgggaagaggcggugcugcc

SEQ ID NO: 229928 - RNA, 18 nt, Human
cggcucccaucccgguug

SEQ ID NO: 229929 - RNA, 20 nt, Human
cgggugguaggaaggggauc

SEQ ID NO: 229930 - RNA, 19 nt, Human
cuggcaaaacagcacccaa

SEQ ID NO: 229931 - RNA, 20 nt, Human
cuggcaaaacagcacccaaa

SEQ ID NO: 229932 - RNA, 19 nt, Human
cuucucccccaaaccacag

SEQ ID NO: 229933 - RNA, 19 nt, Human
gaguggggggacucugggc

SEQ ID NO: 229934 - RNA, 20 nt, Human
gcaaaacagcacccaaaggc

SEQ ID NO: 229935 - RNA, 23 nt, Human
gcccaagcuggggcagagcagcg

SEQ ID NO: 229936 - RNA, 19 nt, Human
ggagcagagauggcaaaga

SEQ ID NO: 229937 - RNA, 18 nt, Human
ggaggaggugugcccgcc

SEQ ID NO: 229938 - RNA, 22 nt, Human
ggaggggccuggaucccaaggc

SEQ ID NO: 229939 - RNA, 18 nt, Human
ggccaggggcacagcauc

SEQ ID NO: 229940 - RNA, 18 nt, Human
ggccagugggcaguggga

SEQ ID NO: 229941 - RNA, 20 nt, Human
ggcggcgggaagaggcggug

SEQ ID NO: 229942 - RNA, 19 nt, Human
ggcuggggaguggcugggg

SEQ ID NO: 229943 - RNA, 21 nt, Human
gggaguggggggacucugggc

SEQ ID NO: 229944 - RNA, 21 nt, Human
gggcggcgggaagaggcggug

SEQ ID NO: 229945 - RNA, 20 nt, Human
gggggacucugggcucucca

SEQ ID NO: 229946 - RNA, 26 nt, Human
gugcugccagagugcgaugcugggag

SEQ ID NO: 229947 - RNA, 18 nt, Human
gugggcagugggaggagg

SEQ ID NO: 229948 - RNA, 24 nt, Human
guggggggacucugggcucuccag

SEQ ID NO: 229949 - RNA, 20 nt, Human
ucccagccaggcuggcuggg

SEQ ID NO: 229950 - RNA, 18 nt, Human
ucccaucccgguuggagc

SEQ ID NO: 229951 - RNA, 19 nt, Human
ucccccaaaccacagccuc

SEQ ID NO: 229952 - RNA, 18 nt, Human
ucccgguuggagcagaga

SEQ ID NO: 229953 - RNA, 19 nt, Human
ucccgguuggagcagagau

SEQ ID NO: 229954 - RNA, 22 nt, Human
ucccgguuggagcagagauggc

SEQ ID NO: 229955 - RNA, 23 nt, Human
ucuccagauggccuccccugccc

SEQ ID NO: 229956 - RNA, 19 nt, Human
ugcccaagcuggggcagag

SEQ ID NO: 229957 - RNA, 21 nt, Human
ugcccaagcuggggcagagca

SEQ ID NO: 229958 - RNA, 22 nt, Human
ugcccaggaaggggugcagcuu

SEQ ID NO: 229959 - RNA, 23 nt, Human
ugccccaacuccagccucccaug

SEQ ID NO: 229960 - RNA, 18 nt, Human
ugcuggagagggaggggc

SEQ ID NO: 229961 - RNA, 24 nt, Human
ugcugggaguggggggacucuggg

SEQ ID NO: 229962 - RNA, 21 nt, Human
uggcuggggaguggcuggggg

SEQ ID NO: 229963 - RNA, 24 nt, Human
uggcuggggaguggcugggggagg

SEQ ID NO: 229964 - RNA, 21 nt, Human
uggcugggggagggggaaggu

SEQ ID NO: 229965 - RNA, 18 nt, Human
ugggagaucugcccaagc

SEQ ID NO: 229966 - RNA, 18 nt, Human
ugggcggcgggaagaggc

SEQ ID NO: 229967 - RNA, 18 nt, Human
uggggaccgggugguagg

SEQ ID NO: 229968 - RNA, 19 nt, Human
uggggaguggcugggggag

SEQ ID NO: 229969 - RNA, 24 nt, Human
ugguaggaaggggauccgaggcag

SEQ ID NO: 229970 - RNA, 18 nt, Human
ugugguggguaccgaagg

SEQ ID NO: 229971 - RNA, 22 nt, Human
uucuccucugccccaacuccag

SEQ ID NO: 229972 - RNA, 24 nt, Human
uuggagcagagauggcaaagaaaa

SEQ ID NO: 229973 - RNA, 24 nt, Human
uuggagcagagauggcaaagaaaa

SEQ ID NO: 229974 - RNA, 25 nt, Human
uuggagcagagauggcaaagaaaag

SEQ ID NO: 229975 - RNA, 18 nt, Human
aaaaaaggaacagggaca

SEQ ID NO: 229976 - RNA, 19 nt, Human
aaccacagcuuuaaggggu

SEQ ID NO: 229977 - RNA, 21 nt, Human
aaggagcuggcugagucuugc

SEQ ID NO: 229978 - RNA, 23 nt, Human
agacaggugacucuggaguucuu

SEQ ID NO: 229979 - RNA, 21 nt, Human
agcagaggucucugggcagga

SEQ ID NO: 229980 - RNA, 19 nt, Human
agcagggagacggggcaca

SEQ ID NO: 229981 - RNA, 22 nt, Human
agccaccaccuuaaugugagaa

SEQ ID NO: 229982 - RNA, 18 nt, Human
agccggccagggaaggga

SEQ ID NO: 229983 - RNA, 24 nt, Human
agcucauaggagccaugaggucca

SEQ ID NO: 229984 - RNA, 18 nt, Human
aggagccaugagguccag

SEQ ID NO: 229985 - RNA, 21 nt, Human
aggagccaugagguccagagc

SEQ ID NO: 229986 - RNA, 23 nt, Human
aggcaaaaaaggaacagggacaa

SEQ ID NO: 229987 - RNA, 23 nt, Human
agggacccuggccaaacagaucc

SEQ ID NO: 229988 - RNA, 22 nt, Human
agggaggggagaaccaagcagg

SEQ ID NO: 229989 - RNA, 23 nt, Human
auccacaggcaaaaaaggaacag

SEQ ID NO: 229990 - RNA, 19 nt, Human
caaacagauccacaggcaa

SEQ ID NO: 229991 - RNA, 21 nt, Human
caaacagauccacaggcaaaa

SEQ ID NO: 229992 - RNA, 18 nt, Human
cacaggcaaaaaaggaac

SEQ ID NO: 229993 - RNA, 24 nt, Human
cacaggcaaaaaaggaacagggac

SEQ ID NO: 229994 - RNA, 26 nt, Human
cacaggcaaaaaaggaacagggacaa

SEQ ID NO: 229995 - RNA, 21 nt, Human
cacuugugcugugaccugggc

SEQ ID NO: 229996 - RNA, 18 nt, Human
cagcccaggccggcccgg

SEQ ID NO: 229997 - RNA, 20 nt, Human
cagcuccuucuccccuggcc

SEQ ID NO: 229998 - RNA, 19 nt, Human
caggacauaggccccauag

SEQ ID NO: 229999 - RNA, 18 nt, Human
cagggagacggggcacag

SEQ ID NO: 230000 - RNA, 19 nt, Human
caggucugucuuggcgggg

SEQ ID NO: 230001 - RNA, 20 nt, Human
ccacaggcaaaaaaggaaca

SEQ ID NO: 230002 - RNA, 20 nt, Human
ccaggcugauguuccuagcu

SEQ ID NO: 230003 - RNA, 19 nt, Human
ccccagggacaaagauggg

SEQ ID NO: 230004 - RNA, 23 nt, Human
ccccagggacccuggccaaacag

SEQ ID NO: 230005 - RNA, 19 nt, Human
cccccgcgcgccccggccg

SEQ ID NO: 230006 - RNA, 20 nt, Human
cccccgcgcgccccggccgc

SEQ ID NO: 230007 - RNA, 21 nt, Human
cccccgcgcgccccggccgcg

SEQ ID NO: 230008 - RNA, 21 nt, Human
ccccgcguggccgcccgcgcc

SEQ ID NO: 230009 - RNA, 19 nt, Human
ccccuccccuuccagccca

SEQ ID NO: 230010 - RNA, 21 nt, Human
ccccuggccagagcgggccuc

SEQ ID NO: 230011 - RNA, 22 nt, Human
cccgccggccgccgccucaccu

SEQ ID NO: 230012 - RNA, 20 nt, Human
cccgcgcgccccggccgcgc

SEQ ID NO: 230013 - RNA, 21 nt, Human
cccgcgcgccccggccgcgcu

SEQ ID NO: 230014 - RNA, 26 nt, Human
ccgcccgcgccccgccggccgccgcc

SEQ ID NO: 230015 - RNA, 27 nt, Human
ccgcccgcgccccgccggccgccgccu

SEQ ID NO: 230016 - RNA, 22 nt, Human
ccgcgcuccgauuugccgaccc

SEQ ID NO: 230017 - RNA, 18 nt, Human
ccucaccuggcgccccuc

SEQ ID NO: 230018 - RNA, 21 nt, Human
ccugaccccagggacccuggc

SEQ ID NO: 230019 - RNA, 23 nt, Human
ccugccgcagggugagaaagucc

SEQ ID NO: 230020 - RNA, 18 nt, Human
cgccccuccccuuccagc

SEQ ID NO: 230021 - RNA, 19 nt, Human
cgccggccgccgccucacc

SEQ ID NO: 230022 - RNA, 21 nt, Human
cucacccccgcgcgccccggc

SEQ ID NO: 230023 - RNA, 20 nt, Human
cucuuacaccugagaguaaa

SEQ ID NO: 230024 - RNA, 24 nt, Human
gacaaagccgcauugauugcagcc

SEQ ID NO: 230025 - RNA, 18 nt, Human
gagcaggaaggagcagag

SEQ ID NO: 230026 - RNA, 26 nt, Human
gagcauggggguggggguuggagggg

SEQ ID NO: 230027 - RNA, 24 nt, Human
gagguccagagcaugggggugggg

SEQ ID NO: 230028 - RNA, 23 nt, Human
gaugugggcgucccagacaaagc

SEQ ID NO: 230029 - RNA, 20 nt, Human
gcaaaaaaggaacagggaca

SEQ ID NO: 230030 - RNA, 22 nt, Human
gcaaaaaaggaacagggacaau

SEQ ID NO: 230031 - RNA, 20 nt, Human
gccgacccgggaauggccuc

SEQ ID NO: 230032 - RNA, 22 nt, Human
ggaacagggacaaugagaggaa

SEQ ID NO: 230033 - RNA, 21 nt, Human
ggaagacgcacggcagcuccu

SEQ ID NO: 230034 - RNA, 18 nt, Human
ggaaggaggguaggccug

SEQ ID NO: 230035 - RNA, 22 nt, Human
ggaagggaggggagaaccaagc

SEQ ID NO: 230036 - RNA, 19 nt, Human
ggccgcgaggccgcaagca

SEQ ID NO: 230037 - RNA, 18 nt, Human
ggcugggaaggagcuggc

SEQ ID NO: 230038 - RNA, 18 nt, Human
ggcugggaaggagcuggc

SEQ ID NO: 230039 - RNA, 21 nt, Human
ggcugggagcaggccccaggg

SEQ ID NO: 230040 - RNA, 20 nt, Human
gggaauggccucugggaugu

SEQ ID NO: 230041 - RNA, 18 nt, Human
gggagccgaugagacagg

SEQ ID NO: 230042 - RNA, 19 nt, Human
gggguggggguuggagggg

SEQ ID NO: 230043 - RNA, 22 nt, Human
gugcugaugugcacuugugcug

SEQ ID NO: 230044 - RNA, 18 nt, Human
uaaggucucaucagucuc

SEQ ID NO: 230045 - RNA, 23 nt, Human
uagaaagcaaggccuccagagag

SEQ ID NO: 230046 - RNA, 24 nt, Human
uaucagauccuuccugagaacagg

SEQ ID NO: 230047 - RNA, 20 nt, Human
ucaccaugcuccaagcucau

SEQ ID NO: 230048 - RNA, 19 nt, Human
uccacaggcaaaaaaggaa

SEQ ID NO: 230049 - RNA, 23 nt, Human
ucccagccccaagaggcugggcu

SEQ ID NO: 230050 - RNA, 20 nt, Human
ucucugggcaggacauaggc

SEQ ID NO: 230051 - RNA, 23 nt, Human
ucugcuagaaagcaaggccucca

SEQ ID NO: 230052 - RNA, 22 nt, Human
ugagaagaggggggaugaggaa

SEQ ID NO: 230053 - RNA, 18 nt, Human
ugaggaaaaugaugaucc

SEQ ID NO: 230054 - RNA, 21 nt, Human
ugauugcagcccaggccggcc

SEQ ID NO: 230055 - RNA, 18 nt, Human
uggccaaacagauccaca

SEQ ID NO: 230056 - RNA, 21 nt, Human
uggccaaacagauccacaggc

SEQ ID NO: 230057 - RNA, 19 nt, Human
uggccagagcgggccucag

SEQ ID NO: 230058 - RNA, 21 nt, Human
uggccgcccgcgccccgccgg

SEQ ID NO: 230059 - RNA, 24 nt, Human
uggcugggagcaggccccagggac

SEQ ID NO: 230060 - RNA, 18 nt, Human
ugggaaggagcuggcuga

SEQ ID NO: 230061 - RNA, 24 nt, Human
ugggaaggagcuggcugagucuug

SEQ ID NO: 230062 - RNA, 20 nt, Human
ugggagccgaugagacaggu

SEQ ID NO: 230063 - RNA, 18 nt, Human
uggggguggggguuggag

SEQ ID NO: 230064 - RNA, 21 nt, Human
ugugcacuugugcugugaccu

SEQ ID NO: 230065 - RNA, 21 nt, Human
ugugggcgucccagacaaagc

SEQ ID NO: 230066 - RNA, 18 nt, Human
uguggggaaggaggguag

SEQ ID NO: 230067 - RNA, 20 nt, Human
uuccugaccccagggacccu

SEQ ID NO: 230068 - RNA, 20 nt, Human
uugcagcccaggccggcccg

SEQ ID NO: 230069 - RNA, 18 nt, Human
uugguugguucuagauuc

SEQ ID NO: 230070 - RNA, 19 nt, Human
uuuuuuuuuuuuuuucuaa

SEQ ID NO: 230071 - RNA, 21 nt, Human
accagagcccacucuggcccc

SEQ ID NO: 230072 - RNA, 19 nt, Human
accgcagucuauaaaugcu

SEQ ID NO: 230073 - RNA, 18 nt, Human
agcacaguguccaaaaac

SEQ ID NO: 230074 - RNA, 22 nt, Human
aguagcacaguguccaaaaacg

SEQ ID NO: 230075 - RNA, 18 nt, Human
augcuguggcugggaguu

SEQ ID NO: 230076 - RNA, 24 nt, Human
cacucuggccccagggugaggucc

SEQ ID NO: 230077 - RNA, 21 nt, Human
ccgccgcuaccgccgccgccg

SEQ ID NO: 230078 - RNA, 22 nt, Human
ccgccgcuaccgccgccgccga

SEQ ID NO: 230079 - RNA, 23 nt, Human
ccgccgcuaccgccgccgccgag

SEQ ID NO: 230080 - RNA, 20 nt, Human
uaccgccgccgccgaggcuc

SEQ ID NO: 230081 - RNA, 19 nt, Human
ucaguagcacaguguccaa

SEQ ID NO: 230082 - RNA, 24 nt, Human
ugggaggugucagcgucgccgccg

SEQ ID NO: 230083 - RNA, 24 nt, Human
uguccaaaaacguugagccaucug

SEQ ID NO: 230084 - RNA, 23 nt, Human
aaggaggucagaaaaggaaaggg

SEQ ID NO: 230085 - RNA, 22 nt, Human
agaagaagggagaccaggagag

SEQ ID NO: 230086 - RNA, 20 nt, Human
agaagggagaccaggagagg

SEQ ID NO: 230087 - RNA, 22 nt, Human
agaagggagaccaggagagggc

SEQ ID NO: 230088 - RNA, 26 nt, Human
agaagggagaccaggagagggccuug

SEQ ID NO: 230089 - RNA, 24 nt, Human
agagagggagguggaggaaggggu

SEQ ID NO: 230090 - RNA, 21 nt, Human
agagggagguggaggaagggg

SEQ ID NO: 230091 - RNA, 22 nt, Human
agagggagguggaggaaggggu

SEQ ID NO: 230092 - RNA, 19 nt, Human
agagggccuuggagagagg

SEQ ID NO: 230093 - RNA, 21 nt, Human
agccugaggaggugggggcgg

SEQ ID NO: 230094 - RNA, 22 nt, Human
aggaaagggggcaguggugggg

SEQ ID NO: 230095 - RNA, 24 nt, Human
aggaaagggggcaguggugggggg

SEQ ID NO: 230096 - RNA, 20 nt, Human
aggccggaauccagaggaaa

SEQ ID NO: 230097 - RNA, 24 nt, Human
agggagguggaggaagggguuccc

SEQ ID NO: 230098 - RNA, 22 nt, Human
agggccuuggagagaggguggg

SEQ ID NO: 230099 - RNA, 22 nt, Human
agggggcagugguggggggugg

SEQ ID NO: 230100 - RNA, 19 nt, Human
ccggaauccagaggaaagc

SEQ ID NO: 230101 - RNA, 18 nt, Human
ccguucugcuggucucug

SEQ ID NO: 230102 - RNA, 24 nt, Human
ccuauggucugggcagcgcugagc

SEQ ID NO: 230103 - RNA, 21 nt, Human
cgucguggcugggaugccguu

SEQ ID NO: 230104 - RNA, 18 nt, Human
cuagaagaagggagacca

SEQ ID NO: 230105 - RNA, 24 nt, Human
cuccaaaaggaggucagaaaagga

SEQ ID NO: 230106 - RNA, 18 nt, Human
cugggccuucaccccugu

SEQ ID NO: 230107 - RNA, 23 nt, Human
cuuggagagaggguggggaggga

SEQ ID NO: 230108 - RNA, 22 nt, Human
gccggaauccagaggaaagcug

SEQ ID NO: 230109 - RNA, 26 nt, Human
ggacugggcugcugagaucugcuggc

SEQ ID NO: 230110 - RNA, 18 nt, Human
ggagagaggguggggagg

SEQ ID NO: 230111 - RNA, 22 nt, Human
ggccgucguggcugggaugccg

SEQ ID NO: 230112 - RNA, 23 nt, Human
ggccgucguggcugggaugccgu

SEQ ID NO: 230113 - RNA, 18 nt, Human
gggccuuggagagagggu

SEQ ID NO: 230114 - RNA, 25 nt, Human
ggggcaguggugggggguggggggu

SEQ ID NO: 230115 - RNA, 21 nt, Human
gggugggggguaaaggagaag

SEQ ID NO: 230116 - RNA, 18 nt, Human
ggguucuagaagaaggga

SEQ ID NO: 230117 - RNA, 19 nt, Human
gguggggggugggggguaa

SEQ ID NO: 230118 - RNA, 18 nt, Human
ucagaaaaggaaaggggg

SEQ ID NO: 230119 - RNA, 25 nt, Human
ugagaucugcuggcugccucagcuc

SEQ ID NO: 230120 - RNA, 18 nt, Human
ugaggaggugggggcggg

SEQ ID NO: 230121 - RNA, 21 nt, Human
ugcugagaucugcuggcugcc

SEQ ID NO: 230122 - RNA, 24 nt, Human
uggaaagcugggcagaucaggcag

SEQ ID NO: 230123 - RNA, 24 nt, Human
uggcggacagcagacagagcaaag

SEQ ID NO: 230124 - RNA, 19 nt, Human
uggggagggaugaccagag

SEQ ID NO: 230125 - RNA, 22 nt, Human
uggggggugggggguaaaggag

SEQ ID NO: 230126 - RNA, 22 nt, Human
uggucucugggccuucaccccu

SEQ ID NO: 230127 - RNA, 18 nt, Human
ugucccagggaacagagc

SEQ ID NO: 230128 - RNA, 20 nt, Human
aaauaacugagaaacagucu

SEQ ID NO: 230129 - RNA, 18 nt, Human
aacccagagaacugggcu

SEQ ID NO: 230130 - RNA, 19 nt, Human
aacccagagaacugggcuu

SEQ ID NO: 230131 - RNA, 21 nt, Human
aagaggaauccaacaggaagc

SEQ ID NO: 230132 - RNA, 21 nt, Human
acacagcccgggcuguccucu

SEQ ID NO: 230133 - RNA, 19 nt, Human
accaccuggcuaacgaacc

SEQ ID NO: 230134 - RNA, 18 nt, Human
accuccagucuccagcuc

SEQ ID NO: 230135 - RNA, 23 nt, Human
agaaacagccagggaacuguagc

SEQ ID NO: 230136 - RNA, 25 nt, Human
agaacaggcaggugacuuuagcugg

SEQ ID NO: 230137 - RNA, 28 nt, Human
agaacaggcaggugacuuuagcuggguc

SEQ ID NO: 230138 - RNA, 20 nt, Human
aggucccagcagugcagccu

SEQ ID NO: 230139 - RNA, 21 nt, Human
aggugcagaggccaggugggu

SEQ ID NO: 230140 - RNA, 18 nt, Human
cagcagugcagccuggcc

SEQ ID NO: 230141 - RNA, 22 nt, Human
cagccuggcggccgaggacugg

SEQ ID NO: 230142 - RNA, 19 nt, Human
cagcugagcauacgucacc

SEQ ID NO: 230143 - RNA, 24 nt, Human
caggaccaggccuggggcugccag

SEQ ID NO: 230144 - RNA, 25 nt, Human
cagucuccagcucuugucuccagga

SEQ ID NO: 230145 - RNA, 18 nt, Human
ccaggacagcugccuggc

SEQ ID NO: 230146 - RNA, 26 nt, Human
ccuggggcugccagaugugaggccuu

SEQ ID NO: 230147 - RNA, 21 nt, Human
cgauuguagaagggaccaccu

SEQ ID NO: 230148 - RNA, 23 nt, Human
cuaagaggaaaaauaaaagugaa

SEQ ID NO: 230149 - RNA, 19 nt, Human
cuaugcacccaggaccagg

SEQ ID NO: 230150 - RNA, 19 nt, Human
cugcagccagggccgaggu

SEQ ID NO: 230151 - RNA, 21 nt, Human
cuggggucacuggagguucac

SEQ ID NO: 230152 - RNA, 20 nt, Human
cugggucucuggaaauaacu

SEQ ID NO: 230153 - RNA, 21 nt, Human
cuguagcugggccuuuagaac

SEQ ID NO: 230154 - RNA, 18 nt, Human
cuguccaaggagcugcuc

SEQ ID NO: 230155 - RNA, 18 nt, Human
cuucucaggaaguccauu

SEQ ID NO: 230156 - RNA, 21 nt, Human
cuugucugcuguccucucuag

SEQ ID NO: 230157 - RNA, 23 nt, Human
cuuuagcugggucucuggaaaca

SEQ ID NO: 230158 - RNA, 18 nt, Human
gagaacugggcuuggcuc

SEQ ID NO: 230159 - RNA, 23 nt, Human
gcucgauuguagaagggaccacc

SEQ ID NO: 230160 - RNA, 20 nt, Human
gugugagggcccaguggucc

SEQ ID NO: 230161 - RNA, 20 nt, Human
uaaaaagaaaacgcugacac

SEQ ID NO: 230162 - RNA, 21 nt, Human
uaaagcacaacccagagaacu

SEQ ID NO: 230163 - RNA, 22 nt, Human
uaaagcacaacccagagaacug

SEQ ID NO: 230164 - RNA, 20 nt, Human
uaacugagaaacagucuguu

SEQ ID NO: 230165 - RNA, 19 nt, Human
uagaaacagccagggaacu

SEQ ID NO: 230166 - RNA, 19 nt, Human
uagaacaucaacagccagg

SEQ ID NO: 230167 - RNA, 21 nt, Human
uagaacaucaacagccagguc

SEQ ID NO: 230168 - RNA, 20 nt, Human
uagaagggaccaccuggcua

SEQ ID NO: 230169 - RNA, 21 nt, Human
ucaauuaaauuuuaaaaagaa

SEQ ID NO: 230170 - RNA, 21 nt, Human
ucacagcagacaccuaggaca

SEQ ID NO: 230171 - RNA, 22 nt, Human
ucccucacucagcuuugaacaa

SEQ ID NO: 230172 - RNA, 18 nt, Human
ucccugcagccagggccg

SEQ ID NO: 230173 - RNA, 21 nt, Human
ucuagaacaucaacagccagg

SEQ ID NO: 230174 - RNA, 21 nt, Human
ucuccaggacagcugccuggc

SEQ ID NO: 230175 - RNA, 24 nt, Human
ucucuggaaacagucaggugaaua

SEQ ID NO: 230176 - RNA, 19 nt, Human
ucuguccaaggagcugcuc

SEQ ID NO: 230177 - RNA, 22 nt, Human
ugacacguuuucguaaguccug

SEQ ID NO: 230178 - RNA, 22 nt, Human
ugagaaacagucuguccaagga

SEQ ID NO: 230179 - RNA, 23 nt, Human
ugcugguuagaaaccuccagucu

SEQ ID NO: 230180 - RNA, 18 nt, Human
uggcaacggcugcauacg

SEQ ID NO: 230181 - RNA, 24 nt, Human
uggcuggcuuucuagaugaagagg

SEQ ID NO: 230182 - RNA, 23 nt, Human
uguagaagggaccaccuggcuaa

SEQ ID NO: 230183 - RNA, 20 nt, Human
uguagcugggucucuggaaa

SEQ ID NO: 230184 - RNA, 20 nt, Human
uguggacuguggggacacag

SEQ ID NO: 230185 - RNA, 21 nt, Human
uuaaaaagaaaacgcugacac

SEQ ID NO: 230186 - RNA, 27 nt, Human
uuaaauuuuaaaaagaaaacgcugaca

SEQ ID NO: 230187 - RNA, 18 nt, Human
uuagaaaccuccagucuc

SEQ ID NO: 230188 - RNA, 24 nt, Human
agaaagaaacaaacugagguggca

SEQ ID NO: 230189 - RNA, 24 nt, Human
aggcacugaguaagggucuagagc

SEQ ID NO: 230190 - RNA, 22 nt, Human
aggcaucccuggaaaauagucu

SEQ ID NO: 230191 - RNA, 21 nt, Human
aggcucagagacagauaagcu

SEQ ID NO: 230192 - RNA, 19 nt, Human
agggaagagguauuccagg

SEQ ID NO: 230193 - RNA, 23 nt, Human
aucccuggaaaauagucuucaag

SEQ ID NO: 230194 - RNA, 25 nt, Human
cagaaagaaacaaacugagguggca

SEQ ID NO: 230195 - RNA, 26 nt, Human
cagaaagaaacaaacugagguggcau

SEQ ID NO: 230196 - RNA, 19 nt, Human
cuagagcucagugcaccac

SEQ ID NO: 230197 - RNA, 19 nt, Human
gaacagaaagaaacaaacu

SEQ ID NO: 230198 - RNA, 21 nt, Human
gggcccaaggcucagagacag

SEQ ID NO: 230199 - RNA, 23 nt, Human
gugaaagugccaucgaaggcacu

SEQ ID NO: 230200 - RNA, 20 nt, Human
gugcuguagugaaagugcca

SEQ ID NO: 230201 - RNA, 21 nt, Human
uaagcuuugggggaacagaaa

SEQ ID NO: 230202 - RNA, 19 nt, Human
ucccuggaaaauagucuuc

SEQ ID NO: 230203 - RNA, 22 nt, Human
ucccuggaaaauagucuucaag

SEQ ID NO: 230204 - RNA, 20 nt, Human
ugaguaagggucuagagcuc

SEQ ID NO: 230205 - RNA, 24 nt, Human
ugaguaagggucuagagcucagug

SEQ ID NO: 230206 - RNA, 21 nt, Human
ugcaccacucaggcaucccug

SEQ ID NO: 230207 - RNA, 19 nt, Human
ugcuguagugaaagugcca

SEQ ID NO: 230208 - RNA, 21 nt, Human
uguggagugggcaggggugcc

SEQ ID NO: 230209 - RNA, 19 nt, Human
auauacuuguuuugacaga

SEQ ID NO: 230210 - RNA, 18 nt, Human
ggagccagaggagucgcu

SEQ ID NO: 230211 - RNA, 19 nt, Human
guuuuacuugauauacuug

SEQ ID NO: 230212 - RNA, 19 nt, Human
uauguacaugcacaaauua

SEQ ID NO: 230213 - RNA, 22 nt, Human
uguuuugacagacucuuccugg

SEQ ID NO: 230214 - RNA, 24 nt, Human
aaaccugucugguuuguguccuaa

SEQ ID NO: 230215 - RNA, 20 nt, Human
cacauguagcacugaaugcc

SEQ ID NO: 230216 - RNA, 21 nt, Human
gcauuggguaaucagugcuuu

SEQ ID NO: 230217 - RNA, 19 nt, Human
gggagggaggugcauuggg

SEQ ID NO: 230218 - RNA, 25 nt, Human
uaccaaaaacauucugugcauaaca

SEQ ID NO: 230219 - RNA, 18 nt, Human
ugcauuggguaaucagug

SEQ ID NO: 230220 - RNA, 21 nt, Human
uggggagggaggugcauuggg

SEQ ID NO: 230221 - RNA, 24 nt, Human
uuuuuuaucuucaagaaaugggau

SEQ ID NO: 230222 - RNA, 23 nt, Human
aaauauccggucccugaugauuc

SEQ ID NO: 230223 - RNA, 19 nt, Human
accuugauaacuucagcua

SEQ ID NO: 230224 - RNA, 19 nt, Human
caaguaaguuugccucucc

SEQ ID NO: 230225 - RNA, 23 nt, Human
caauacaaguaaguuugccucuc

SEQ ID NO: 230226 - RNA, 18 nt, Human
cagcgcuaggccaccucc

SEQ ID NO: 230227 - RNA, 22 nt, Human
caguagugcucuuccagggcuc

SEQ ID NO: 230228 - RNA, 22 nt, Human
ccagcgcuaggccaccuccucu

SEQ ID NO: 230229 - RNA, 18 nt, Human
ccagggcucgggcgcugu

SEQ ID NO: 230230 - RNA, 18 nt, Human
cgaaggaagaguuacugu

SEQ ID NO: 230231 - RNA, 23 nt, Human
cgcaaccagcagaguacggcauc

SEQ ID NO: 230232 - RNA, 22 nt, Human
gagguggcugcgcaaccagcag

SEQ ID NO: 230233 - RNA, 24 nt, Human
gcuuauuuucccuccucuccgugu

SEQ ID NO: 230234 - RNA, 21 nt, Human
ggauuggggugagccccgcca

SEQ ID NO: 230235 - RNA, 20 nt, Human
ggcugcgcaaccagcagagu

SEQ ID NO: 230236 - RNA, 23 nt, Human
gggcgcugugggucuccguaggu

SEQ ID NO: 230237 - RNA, 24 nt, Human
guaagucucuucaaaauaaagaaa

SEQ ID NO: 230238 - RNA, 18 nt, Human
uacggcaucaaaaggcag

SEQ ID NO: 230239 - RNA, 20 nt, Human
uacggcaucaaaaggcagag

SEQ ID NO: 230240 - RNA, 23 nt, Human
uacugauagaccaaacaaaaggg

SEQ ID NO: 230241 - RNA, 18 nt, Human
ucccuggccguucgggac

SEQ ID NO: 230242 - RNA, 21 nt, Human
uccgugugcaguaucccgagg

SEQ ID NO: 230243 - RNA, 22 nt, Human
ugccucgcuuauuuucccuccu

SEQ ID NO: 230244 - RNA, 20 nt, Human
uggaagaaaggugaaucuga

SEQ ID NO: 230245 - RNA, 22 nt, Human
uggaagaaaggugaaucugaga

SEQ ID NO: 230246 - RNA, 19 nt, Human
ugugcaaguguuuauuugg

SEQ ID NO: 230247 - RNA, 18 nt, Human
ugugugcaaguguuuauu

SEQ ID NO: 230248 - RNA, 26 nt, Human
uucaagguuaagaauccaaaugagaa

SEQ ID NO: 230249 - RNA, 23 nt, Human
uuugggcagcugugcucugucau

SEQ ID NO: 230250 - RNA, 18 nt, Human
aaaauggguggaagggcc

SEQ ID NO: 230251 - RNA, 22 nt, Human
cacaaggggcggugugaggcag

SEQ ID NO: 230252 - RNA, 21 nt, Human
cagcugcaggggccugaccag

SEQ ID NO: 230253 - RNA, 19 nt, Human
caggggccugaccaggggc

SEQ ID NO: 230254 - RNA, 19 nt, Human
ccagugaugauuggugaca

SEQ ID NO: 230255 - RNA, 27 nt, Human
ccagugaugauuggugacaaaucucuc

SEQ ID NO: 230256 - RNA, 20 nt, Human
ccugaccaggggccgggguu

SEQ ID NO: 230257 - RNA, 19 nt, Human
cggcuccgggccgcguccc

SEQ ID NO: 230258 - RNA, 22 nt, Human
uaagaagcuauaacuuaaacca

SEQ ID NO: 230259 - RNA, 20 nt, Human
uccccgagcuccagggacag

SEQ ID NO: 230260 - RNA, 21 nt, Human
uggaagggccaaauauaaaaa

SEQ ID NO: 230261 - RNA, 23 nt, Human
uggaagggccaaauauaaaaaca

SEQ ID NO: 230262 - RNA, 22 nt, Human
uucagaaacaagaucugucacc

SEQ ID NO: 230263 - RNA, 26 nt, Human
aacucauacaaaaugugauuaaaaac

SEQ ID NO: 230264 - RNA, 19 nt, Human
agaaaguuuagccuuggga

SEQ ID NO: 230265 - RNA, 25 nt, Human
aggaacagagggaggcgccgguacc

SEQ ID NO: 230266 - RNA, 18 nt, Human
ccaaagaagggaauuaga

SEQ ID NO: 230267 - RNA, 24 nt, Human
cccccgagcccaaagaagggaauu

SEQ ID NO: 230268 - RNA, 18 nt, Human
ccccgagcccaaagaagg

SEQ ID NO: 230269 - RNA, 19 nt, Human
ccccgagcccaaagaaggg

SEQ ID NO: 230270 - RNA, 19 nt, Human
cccugcuccgggagccccc

SEQ ID NO: 230271 - RNA, 22 nt, Human
ccgggugaggucccggucccac

SEQ ID NO: 230272 - RNA, 23 nt, Human
cggcagaggaguggagaagacgc

SEQ ID NO: 230273 - RNA, 21 nt, Human
gagaagacgcccgccgagccg

SEQ ID NO: 230274 - RNA, 18 nt, Human
gagccggggcugaagggg

SEQ ID NO: 230275 - RNA, 22 nt, Human
gcgacgcgagcucucgcccugc

SEQ ID NO: 230276 - RNA, 19 nt, Human
gcugaaggggcgggcggcc

SEQ ID NO: 230277 - RNA, 23 nt, Human
ggagagccggggcugaaggggcg

SEQ ID NO: 230278 - RNA, 19 nt, Human
ggcagaggaguggagaaga

SEQ ID NO: 230279 - RNA, 22 nt, Human
ggggcgccucuuuuguuugaaa

SEQ ID NO: 230280 - RNA, 19 nt, Human
guaguuguuuuaccuuguu

SEQ ID NO: 230281 - RNA, 19 nt, Human
uaccuuguucaccucagcc

SEQ ID NO: 230282 - RNA, 21 nt, Human
uaccuuguucaccucagccau

SEQ ID NO: 230283 - RNA, 27 nt, Human
uaccuuguucaccucagccauuuuuua

SEQ ID NO: 230284 - RNA, 22 nt, Human
ucccugcagccacggggacgcg

SEQ ID NO: 230285 - RNA, 18 nt, Human
ucgcugcggggcuggggc

SEQ ID NO: 230286 - RNA, 18 nt, Human
ucucgcccugcuccggga

SEQ ID NO: 230287 - RNA, 19 nt, Human
ugggaggaacagagggagg

SEQ ID NO: 230288 - RNA, 21 nt, Human
ugggaggaacagagggaggcg

SEQ ID NO: 230289 - RNA, 18 nt, Human
uugggaggaacagaggga

SEQ ID NO: 230290 - RNA, 20 nt, Human
uuugaagagcauuaagucag

SEQ ID NO: 230291 - RNA, 21 nt, Human
accccaacccuaccccuuccc

SEQ ID NO: 230292 - RNA, 22 nt, Human
acccuaccccuucccuccggaa

SEQ ID NO: 230293 - RNA, 26 nt, Human
agacaugcauguggggcagugcuagg

SEQ ID NO: 230294 - RNA, 26 nt, Human
agagcgcccccaccccaacccuaccc

SEQ ID NO: 230295 - RNA, 24 nt, Human
aggccggagcggauucugggaagg

SEQ ID NO: 230296 - RNA, 25 nt, Human
aggccggagcggauucugggaagga

SEQ ID NO: 230297 - RNA, 22 nt, Human
aggugaacggucucggcccgag

SEQ ID NO: 230298 - RNA, 21 nt, Human
cagcggucccuccgacagcuu

SEQ ID NO: 230299 - RNA, 25 nt, Human
cagugcauaggcagacaugcaugug

SEQ ID NO: 230300 - RNA, 21 nt, Human
ccagcggucccuccgacagcu

SEQ ID NO: 230301 - RNA, 27 nt, Human
cccaacccuaccccuucccuccggaaa

SEQ ID NO: 230302 - RNA, 19 nt, Human
cccuaccccuucccuccgg

SEQ ID NO: 230303 - RNA, 27 nt, Human
ccuccaggcccucugucccggcucacc

SEQ ID NO: 230304 - RNA, 18 nt, Human
ccucugucaguucccagg

SEQ ID NO: 230305 - RNA, 18 nt, Human
cggcaggaaggaaaggcc

SEQ ID NO: 230306 - RNA, 18 nt, Human
cgugucaacucugccugu

SEQ ID NO: 230307 - RNA, 22 nt, Human
cucugccugugggucuuuggcc

SEQ ID NO: 230308 - RNA, 19 nt, Human
gcccccaccccaacccuac

SEQ ID NO: 230309 - RNA, 18 nt, Human
gcggcaggaaggaaaggc

SEQ ID NO: 230310 - RNA, 20 nt, Human
ggauaaggggaggugaacgg

SEQ ID NO: 230311 - RNA, 18 nt, Human
uaggcagacaugcaugug

SEQ ID NO: 230312 - RNA, 26 nt, Human
ucccuccaggcccucugucaguuccc

SEQ ID NO: 230313 - RNA, 21 nt, Human
ugcauguggggcagugcuagg

SEQ ID NO: 230314 - RNA, 20 nt, Human
ugccugugggucuuuggccu

SEQ ID NO: 230315 - RNA, 22 nt, Human
ugggaaggagcgcaacaccggu

SEQ ID NO: 230316 - RNA, 24 nt, Human
ugggggcccugccgggccaagagc

SEQ ID NO: 230317 - RNA, 22 nt, Human
aaccaaaagcaaaggcggcaga

SEQ ID NO: 230318 - RNA, 19 nt, Human
aagauuuuuauuuggcuuu

SEQ ID NO: 230319 - RNA, 25 nt, Human
auuccaacccaaucugcccccaacc

SEQ ID NO: 230320 - RNA, 22 nt, Human
caaaagcaaaggcggcagauga

SEQ ID NO: 230321 - RNA, 22 nt, Human
caaccaaaagcaaaggcggcag

SEQ ID NO: 230322 - RNA, 21 nt, Human
caacccaaucugcccccaacc

SEQ ID NO: 230323 - RNA, 19 nt, Human
caaucugcccccaaccaaa

SEQ ID NO: 230324 - RNA, 20 nt, Human
cagcuuccuugacuugagag

SEQ ID NO: 230325 - RNA, 21 nt, Human
caugccaaucuccaccaucuu

SEQ ID NO: 230326 - RNA, 23 nt, Human
ccaaucuccaccaucuuugucug

SEQ ID NO: 230327 - RNA, 19 nt, Human
cccagcccagcuuccuuga

SEQ ID NO: 230328 - RNA, 21 nt, Human
cccccaaccaaaagcaaaggc

SEQ ID NO: 230329 - RNA, 21 nt, Human
ccuugcuguguguucugccgu

SEQ ID NO: 230330 - RNA, 22 nt, Human
cugcccccaaccaaaagcaaag

SEQ ID NO: 230331 - RNA, 26 nt, Human
gccaauggggugauccccagaaagga

SEQ ID NO: 230332 - RNA, 22 nt, Human
gcccccaaccaaaagcaaaggc

SEQ ID NO: 230333 - RNA, 20 nt, Human
gcucagcugcagcucagggu

SEQ ID NO: 230334 - RNA, 23 nt, Human
ggauacugcccagcccagcuucc

SEQ ID NO: 230335 - RNA, 19 nt, Human
ggggcaacgggcuggaagc

SEQ ID NO: 230336 - RNA, 21 nt, Human
uaaguuuuugugcuuggucca

SEQ ID NO: 230337 - RNA, 22 nt, Human
uccccagaaaggaccuuuccuu

SEQ ID NO: 230338 - RNA, 23 nt, Human
ugcccccaaccaaaagcaaaggc

SEQ ID NO: 230339 - RNA, 21 nt, Human
uggaaagcauuccaacccaau

SEQ ID NO: 230340 - RNA, 21 nt, Human
uggggcaacgggcuggaagcu

SEQ ID NO: 230341 - RNA, 21 nt, Human
ugguccaggauuccuccccag

SEQ ID NO: 230342 - RNA, 22 nt, Human
aaaacacaaaacauucacacaa

SEQ ID NO: 230343 - RNA, 24 nt, Human
aaaagcacugauggauggcuaccg

SEQ ID NO: 230344 - RNA, 19 nt, Human
aaaaggaaaccaaaccaaa

SEQ ID NO: 230345 - RNA, 27 nt, Human
aaacaaaacacaaaacaagccuuucgg

SEQ ID NO: 230346 - RNA, 22 nt, Human
aaacaggaagugggaucaucaa

SEQ ID NO: 230347 - RNA, 24 nt, Human
aaacaggaagugggaucaucaaga

SEQ ID NO: 230348 - RNA, 25 nt, Human
aaacuagcuuggcagucaaucuuca

SEQ ID NO: 230349 - RNA, 19 nt, Human
aaagggcauuucucccuca

SEQ ID NO: 230350 - RNA, 21 nt, Human
aaauaaaauacuguuuuucuu

SEQ ID NO: 230351 - RNA, 20 nt, Human
aacuaauaaaaaagcuguaa

SEQ ID NO: 230352 - RNA, 22 nt, Human
aacucugguauaucccaagcag

SEQ ID NO: 230353 - RNA, 20 nt, Human
aacuuaccuauccagcucca

SEQ ID NO: 230354 - RNA, 23 nt, Human
aagauggaaacaucagaagaaaa

SEQ ID NO: 230355 - RNA, 19 nt, Human
aaggaaaccaaaccaaacc

SEQ ID NO: 230356 - RNA, 21 nt, Human
aaguuaaaaggaaaccaaacc

SEQ ID NO: 230357 - RNA, 18 nt, Human
aaucacaaagugcaggaa

SEQ ID NO: 230358 - RNA, 23 nt, Human
agaaaagcaaauaacaaaaagaa

SEQ ID NO: 230359 - RNA, 19 nt, Human
agaagaacaaauggauaca

SEQ ID NO: 230360 - RNA, 19 nt, Human
agaagccagcagagugaaa

SEQ ID NO: 230361 - RNA, 19 nt, Human
agaauggagaugcugcaaa

SEQ ID NO: 230362 - RNA, 18 nt, Human
agagugucauucuagaaa

SEQ ID NO: 230363 - RNA, 19 nt, Human
agcaaagugaacagagugu

SEQ ID NO: 230364 - RNA, 22 nt, Human
agcauggauaaacaaaacacaa

SEQ ID NO: 230365 - RNA, 24 nt, Human
aggagaaaagcaaauaacaaaaag

SEQ ID NO: 230366 - RNA, 19 nt, Human
aggaggaagggggugugug

SEQ ID NO: 230367 - RNA, 22 nt, Human
aggaggaaggggguguguggcc

SEQ ID NO: 230368 - RNA, 21 nt, Human
aggaucaaaaguugagaagcc

SEQ ID NO: 230369 - RNA, 18 nt, Human
aggcaagggcaccggcgc

SEQ ID NO: 230370 - RNA, 18 nt, Human
aggcaagggcaccggcgc

SEQ ID NO: 230371 - RNA, 28 nt, Human
aggcacaauucuuuggaguacaauccaa

SEQ ID NO: 230372 - RNA, 23 nt, Human
agguuaggaucaucaggacugca

SEQ ID NO: 230373 - RNA, 18 nt, Human
agguuucuuuccccccac

SEQ ID NO: 230374 - RNA, 23 nt, Human
auaauuaauagcaccaguguguc

SEQ ID NO: 230375 - RNA, 21 nt, Human
augcugccuuccagcccuaaa

SEQ ID NO: 230376 - RNA, 25 nt, Human
caaaacacaaaacauucacacaaaa

SEQ ID NO: 230377 - RNA, 23 nt, Human
caaaauguacucccuuauaaaac

SEQ ID NO: 230378 - RNA, 20 nt, Human
caaagugcaggaacucgaua

SEQ ID NO: 230379 - RNA, 19 nt, Human
caacagaagaacaaaugga

SEQ ID NO: 230380 - RNA, 22 nt, Human
caacagaagaacaaauggauac

SEQ ID NO: 230381 - RNA, 25 nt, Human
caagggcaccggcgcguuggagacc

SEQ ID NO: 230382 - RNA, 21 nt, Human
cacaaaacauucacacaaaaa

SEQ ID NO: 230383 - RNA, 22 nt, Human
cacacuguggucuuaaaaccac

SEQ ID NO: 230384 - RNA, 24 nt, Human
cacacuguggucuuaaaaccacag

SEQ ID NO: 230385 - RNA, 19 nt, Human
caccaggauuuggcaaaca

SEQ ID NO: 230386 - RNA, 19 nt, Human
cacccaaacuagcuuggca

SEQ ID NO: 230387 - RNA, 22 nt, Human
caccccagccccugcuacgcaa

SEQ ID NO: 230388 - RNA, 18 nt, Human
caccccggagagcaaggc

SEQ ID NO: 230389 - RNA, 24 nt, Human
caccuaccccgggagcagccugca

SEQ ID NO: 230390 - RNA, 24 nt, Human
cacucuguggccucacaacugccc

SEQ ID NO: 230391 - RNA, 22 nt, Human
cacuguuccugaugcccuaagu

SEQ ID NO: 230392 - RNA, 21 nt, Human
cagcagaggagugggggucug

SEQ ID NO: 230393 - RNA, 21 nt, Human
cagcauacaugggcucacacg

SEQ ID NO: 230394 - RNA, 21 nt, Human
cagcuccaacaauugccaaaa

SEQ ID NO: 230395 - RNA, 23 nt, Human
caguccucuugcugcaaccuuga

SEQ ID NO: 230396 - RNA, 24 nt, Human
cauggauaaacaaaacacaaaaca

SEQ ID NO: 230397 - RNA, 23 nt, Human
cauuuuauuaaccaccccggaga

SEQ ID NO: 230398 - RNA, 19 nt, Human
ccacuaggaaacuccacgg

SEQ ID NO: 230399 - RNA, 21 nt, Human
ccacugcccccgcgccccgcc

SEQ ID NO: 230400 - RNA, 23 nt, Human
cccccaccccagccccugcuacg

SEQ ID NO: 230401 - RNA, 20 nt, Human
ccccccaccccagccccugc

SEQ ID NO: 230402 - RNA, 19 nt, Human
cccccgcgccccgccuccg

SEQ ID NO: 230403 - RNA, 24 nt, Human
cccccggaggccgcuucgcugcuu

SEQ ID NO: 230404 - RNA, 22 nt, Human
ccccgccuccgcgcuucccuca

SEQ ID NO: 230405 - RNA, 22 nt, Human
ccgaccacugcccccgcgcccc

SEQ ID NO: 230406 - RNA, 23 nt, Human
ccgacccccgacuuccgagcgcg

SEQ ID NO: 230407 - RNA, 20 nt, Human
ccgggagcagccugcacucc

SEQ ID NO: 230408 - RNA, 21 nt, Human
ccucaccuaccccgggagcag

SEQ ID NO: 230409 - RNA, 21 nt, Human
ccucuucagcaaacuuuccua

SEQ ID NO: 230410 - RNA, 22 nt, Human
cgacccccgacuuccgagcgcg

SEQ ID NO: 230411 - RNA, 24 nt, Human
cgccuagcggcgucccccggaggc

SEQ ID NO: 230412 - RNA, 19 nt, Human
cucagucaaaauguacucc

SEQ ID NO: 230413 - RNA, 18 nt, Human
cucccucauuccuggcua

SEQ ID NO: 230414 - RNA, 22 nt, Human
cuccgcgccgacccccgacuuc

SEQ ID NO: 230415 - RNA, 21 nt, Human
cucuagaagggagggaaggag

SEQ ID NO: 230416 - RNA, 20 nt, Human
cucucccagucuacccacca

SEQ ID NO: 230417 - RNA, 21 nt, Human
cugaaaaauguaaucuuugug

SEQ ID NO: 230418 - RNA, 24 nt, Human
cugccauaguagaagaggccuggg

SEQ ID NO: 230419 - RNA, 23 nt, Human
cugcuugagccugggggcccagg

SEQ ID NO: 230420 - RNA, 24 nt, Human
cugcuugagccugggggcccaggg

SEQ ID NO: 230421 - RNA, 24 nt, Human
cuguggccucacaacugccccccu

SEQ ID NO: 230422 - RNA, 19 nt, Human
gaacaaauggauacacggg

SEQ ID NO: 230423 - RNA, 18 nt, Human
gaaggaagaggggcagga

SEQ ID NO: 230424 - RNA, 22 nt, Human
gaccacugcccccgcgccccgc

SEQ ID NO: 230425 - RNA, 23 nt, Human
gcaacagcacaccacaucuccug

SEQ ID NO: 230426 - RNA, 23 nt, Human
gcaaggcuguagaguaaggcaaa

SEQ ID NO: 230427 - RNA, 24 nt, Human
gcagcagaggagugggggucugaa

SEQ ID NO: 230428 - RNA, 24 nt, Human
gcagcagaggagugggggucugaa

SEQ ID NO: 230429 - RNA, 23 nt, Human
gccccgccuccgcgcuucccuca

SEQ ID NO: 230430 - RNA, 21 nt, Human
gcgguggcggcggcucgcgcc

SEQ ID NO: 230431 - RNA, 18 nt, Human
gcugcaaacacaaggcac

SEQ ID NO: 230432 - RNA, 28 nt, Human
ggagaagccagcagagugaaagcucagg

SEQ ID NO: 230433 - RNA, 24 nt, Human
ggauaaacaaaacacaaaacauuc

SEQ ID NO: 230434 - RNA, 19 nt, Human
ggcaggagaugcagaugca

SEQ ID NO: 230435 - RNA, 19 nt, Human
ggcagucaaucuucagucc

SEQ ID NO: 230436 - RNA, 25 nt, Human
ggcauuucucccucauuccuggcua

SEQ ID NO: 230437 - RNA, 19 nt, Human
ggcgcgggcgguggcggcg

SEQ ID NO: 230438 - RNA, 19 nt, Human
ggcgguggcggcggcucgc

SEQ ID NO: 230439 - RNA, 18 nt, Human
gggcgguggcggcggcuc

SEQ ID NO: 230440 - RNA, 19 nt, Human
gggcgguggcggcggcucg

SEQ ID NO: 230441 - RNA, 25 nt, Human
gggcgguggcggcggcucgcgccgg

SEQ ID NO: 230442 - RNA, 24 nt, Human
gguauucagauacuugugccagug

SEQ ID NO: 230443 - RNA, 24 nt, Human
uaaaaaauaaaauucugcuuaaaa

SEQ ID NO: 230444 - RNA, 21 nt, Human
uaaaaaauauaccacacaggu

SEQ ID NO: 230445 - RNA, 22 nt, Human
uaaaagcacugauggauggcua

SEQ ID NO: 230446 - RNA, 22 nt, Human
uaaaaggaaaccaaaccaaacc

SEQ ID NO: 230447 - RNA, 20 nt, Human
uaaaauacagauaacuggag

SEQ ID NO: 230448 - RNA, 22 nt, Human
uaagguaucaucuuguaaagaa

SEQ ID NO: 230449 - RNA, 20 nt, Human
uaaguuacaccaccucuccc

SEQ ID NO: 230450 - RNA, 19 nt, Human
uacaccaccucucccaguc

SEQ ID NO: 230451 - RNA, 26 nt, Human
uaccuuuggcacaggauguuuauuuc

SEQ ID NO: 230452 - RNA, 24 nt, Human
uagaagaggccugggagaagccag

SEQ ID NO: 230453 - RNA, 21 nt, Human
uagcaguauaauaaucccugu

SEQ ID NO: 230454 - RNA, 24 nt, Human
uagcggcgucccccggaggccgcu

SEQ ID NO: 230455 - RNA, 19 nt, Human
uagguuucuuuccccccac

SEQ ID NO: 230456 - RNA, 24 nt, Human
uauaugaaucucaaagguggguug

SEQ ID NO: 230457 - RNA, 19 nt, Human
uaucagcugcccaaagauc

SEQ ID NO: 230458 - RNA, 18 nt, Human
ucaaaauguacucccuua

SEQ ID NO: 230459 - RNA, 23 nt, Human
ucagucaaaauguacucccuuau

SEQ ID NO: 230460 - RNA, 19 nt, Human
ucauuccuggcuaguccca

SEQ ID NO: 230461 - RNA, 19 nt, Human
uccacaguuggaauuccaa

SEQ ID NO: 230462 - RNA, 20 nt, Human
ucccaagcagauggaaacag

SEQ ID NO: 230463 - RNA, 18 nt, Human
uccccccaccccagcccc

SEQ ID NO: 230464 - RNA, 25 nt, Human
ucccuauuucuucuguguaaguucc

SEQ ID NO: 230465 - RNA, 24 nt, Human
uccucacgcaaaucagagggaagu

SEQ ID NO: 230466 - RNA, 18 nt, Human
ucuaaaugaccaauaccu

SEQ ID NO: 230467 - RNA, 22 nt, Human
ucugccagauacuuaacacuag

SEQ ID NO: 230468 - RNA, 19 nt, Human
ugaaauacugagugcaagu

SEQ ID NO: 230469 - RNA, 21 nt, Human
ugaaaugaacuagccaggaaa

SEQ ID NO: 230470 - RNA, 19 nt, Human
ugacgugaaaacuuugcaa

SEQ ID NO: 230471 - RNA, 24 nt, Human
ugagacugaggagguucugcugga

SEQ ID NO: 230472 - RNA, 21 nt, Human
ugagcaaagugaacagagugu

SEQ ID NO: 230473 - RNA, 18 nt, Human
ugagugcaaguauuugcc

SEQ ID NO: 230474 - RNA, 24 nt, Human
ugcaacagcacaccacaucuccug

SEQ ID NO: 230475 - RNA, 21 nt, Human
ugccaaaaagggcauuucucc

SEQ ID NO: 230476 - RNA, 24 nt, Human
ugccagauacuuaacacuaguucc

SEQ ID NO: 230477 - RNA, 23 nt, Human
ugcuggaucgaugagacagggga

SEQ ID NO: 230478 - RNA, 19 nt, Human
ugcuugagccugggggccc

SEQ ID NO: 230479 - RNA, 23 nt, Human
uggaaacaucagaagaaaacugg

SEQ ID NO: 230480 - RNA, 18 nt, Human
uggacagcagcagaggag

SEQ ID NO: 230481 - RNA, 21 nt, Human
uggaguacaauccaaagaacu

SEQ ID NO: 230482 - RNA, 24 nt, Human
uggaguacaauccaaagaacucua

SEQ ID NO: 230483 - RNA, 27 nt, Human
uggcagggaacugucacacugugguca

SEQ ID NO: 230484 - RNA, 19 nt, Human
uggccugagacuugcugga

SEQ ID NO: 230485 - RNA, 21 nt, Human
uggcggcggcucgcgccggag

SEQ ID NO: 230486 - RNA, 18 nt, Human
ugucaagaccuuagggau

SEQ ID NO: 230487 - RNA, 24 nt, Human
uguccuacacucauaauagcuaaa

SEQ ID NO: 230488 - RNA, 25 nt, Human
uguggccugagacuugcuggaguga

SEQ ID NO: 230489 - RNA, 18 nt, Human
uuccuuguucuauagcau

SEQ ID NO: 230490 - RNA, 21 nt, Human
uugcauaguguuaaaggcuau

SEQ ID NO: 230491 - RNA, 18 nt, Human
uugguaggaggaaggggg

SEQ ID NO: 230492 - RNA, 18 nt, Human
uuuccccccaccccagcc

SEQ ID NO: 230493 - RNA, 20 nt, Human
uuuuucuucuguuuugucaa

SEQ ID NO: 230494 - RNA, 26 nt, Human
aaaacucaagugcccccuccggccgg

SEQ ID NO: 230495 - RNA, 21 nt, Human
aaacaggguccaguaaaugua

SEQ ID NO: 230496 - RNA, 24 nt, Human
aaagugcuagaauuacaggcguga

SEQ ID NO: 230497 - RNA, 23 nt, Human
aacccccucuucaagcuuuccuc

SEQ ID NO: 230498 - RNA, 22 nt, Human
aaccugccuucucucuaacccc

SEQ ID NO: 230499 - RNA, 23 nt, Human
aagaaaugugcacaacccagagc

SEQ ID NO: 230500 - RNA, 20 nt, Human
aaggaugaauggagggaugg

SEQ ID NO: 230501 - RNA, 19 nt, Human
aagugcccccaugggaggg

SEQ ID NO: 230502 - RNA, 19 nt, Human
aagugcccccaugggaggg

SEQ ID NO: 230503 - RNA, 26 nt, Human
aagugcuagaauuacaggcgugagcc

SEQ ID NO: 230504 - RNA, 24 nt, Human
aaucaacucuaugagggcagagac

SEQ ID NO: 230505 - RNA, 23 nt, Human
aaugcuugucuuccucacuagac

SEQ ID NO: 230506 - RNA, 21 nt, Human
aauggauggaaagauggaugg

SEQ ID NO: 230507 - RNA, 18 nt, Human
aauuacaggcgugagcca

SEQ ID NO: 230508 - RNA, 21 nt, Human
aauuacaggcgugagccacca

SEQ ID NO: 230509 - RNA, 23 nt, Human
acaccacuugugacaaacaaagu

SEQ ID NO: 230510 - RNA, 18 nt, Human
acaggguuucaccauguu

SEQ ID NO: 230511 - RNA, 21 nt, Human
acaggguuucaccauguuggc

SEQ ID NO: 230512 - RNA, 24 nt, Human
acaggguuucaccauguuggccag

SEQ ID NO: 230513 - RNA, 18 nt, Human
accauguuggccaggcug

SEQ ID NO: 230514 - RNA, 25 nt, Human
acccgcuucagucucccaaagugcu

SEQ ID NO: 230515 - RNA, 21 nt, Human
acucugaucagcaagaagcuu

SEQ ID NO: 230516 - RNA, 22 nt, Human
agaaaugugcacaacccagagc

SEQ ID NO: 230517 - RNA, 21 nt, Human
agacuaugucaccacuguccc

SEQ ID NO: 230518 - RNA, 23 nt, Human
agagcaguggugcaaucuuggcu

SEQ ID NO: 230519 - RNA, 24 nt, Human
agagcaguggugcaaucuuggcuc

SEQ ID NO: 230520 - RNA, 23 nt, Human
agccccuggcacacaguagguac

SEQ ID NO: 230521 - RNA, 22 nt, Human
aggcagcaccauagucuuccca

SEQ ID NO: 230522 - RNA, 22 nt, Human
aguagagacaggguuucaccau

SEQ ID NO: 230523 - RNA, 18 nt, Human
aguagcuggaauuacagg

SEQ ID NO: 230524 - RNA, 23 nt, Human
aguagguacucaauaaauauaug

SEQ ID NO: 230525 - RNA, 21 nt, Human
aucacuuugaaaccgaaaaag

SEQ ID NO: 230526 - RNA, 24 nt, Human
auuuuuguacuuuuaguagagaca

SEQ ID NO: 230527 - RNA, 24 nt, Human
caaagugcuagaauuacaggcgug

SEQ ID NO: 230528 - RNA, 21 nt, Human
caaauguccccaucccaccca

SEQ ID NO: 230529 - RNA, 24 nt, Human
caacaauaucuuaaguagucucaa

SEQ ID NO: 230530 - RNA, 23 nt, Human
caagcaccauagcucugaauggg

SEQ ID NO: 230531 - RNA, 20 nt, Human
caagcgauucuccugccuca

SEQ ID NO: 230532 - RNA, 24 nt, Human
caauaaacaccacuugugacaaac

SEQ ID NO: 230533 - RNA, 24 nt, Human
caccacauccagcuaauuuuugua

SEQ ID NO: 230534 - RNA, 23 nt, Human
caccauagcucugaaugggccug

SEQ ID NO: 230535 - RNA, 21 nt, Human
caccauguuggccaggcuggu

SEQ ID NO: 230536 - RNA, 23 nt, Human
caccauguuggccaggcuggucu

SEQ ID NO: 230537 - RNA, 24 nt, Human
caccauguuggccaggcuggucuu

SEQ ID NO: 230538 - RNA, 27 nt, Human
caccauguuggccaggcuggucuucaa

SEQ ID NO: 230539 - RNA, 22 nt, Human
cacucuguucugacauuaggaa

SEQ ID NO: 230540 - RNA, 21 nt, Human
cacuguaaccuccgccuccug

SEQ ID NO: 230541 - RNA, 23 nt, Human
cacuguaaccuccgccuccuggg

SEQ ID NO: 230542 - RNA, 19 nt, Human
cacuugugacaaacaaagu

SEQ ID NO: 230543 - RNA, 22 nt, Human
cagagugacagcuggaaugcaa

SEQ ID NO: 230544 - RNA, 21 nt, Human
cagcaagaagcuugcagagga

SEQ ID NO: 230545 - RNA, 24 nt, Human
cagcaccauagucuucccagccaa

SEQ ID NO: 230546 - RNA, 21 nt, Human
cagcuugaaaauggagaacau

SEQ ID NO: 230547 - RNA, 24 nt, Human
caggguuucaccauguuggccagg

SEQ ID NO: 230548 - RNA, 21 nt, Human
caguggugauguuauuccucu

SEQ ID NO: 230549 - RNA, 18 nt, Human
cauggcucccgagcccug

SEQ ID NO: 230550 - RNA, 23 nt, Human
cauguuggccaggcuggucuuca

SEQ ID NO: 230551 - RNA, 19 nt, Human
ccaaaacucaagugccccc

SEQ ID NO: 230552 - RNA, 22 nt, Human
ccaaagugcuagaauuacaggc

SEQ ID NO: 230553 - RNA, 24 nt, Human
ccaaagugcuagaauuacaggcgu

SEQ ID NO: 230554 - RNA, 22 nt, Human
ccaacacugcucacuucuucca

SEQ ID NO: 230555 - RNA, 21 nt, Human
ccaccuggccaugggaucagg

SEQ ID NO: 230556 - RNA, 19 nt, Human
ccagaacuugaagguggca

SEQ ID NO: 230557 - RNA, 23 nt, Human
ccagcaagcaccauagcucugaa

SEQ ID NO: 230558 - RNA, 18 nt, Human
ccagcaauucccacuggu

SEQ ID NO: 230559 - RNA, 24 nt, Human
cccaagaaccucaguugagaaaua

SEQ ID NO: 230560 - RNA, 21 nt, Human
cccaccaccacauccagcuaa

SEQ ID NO: 230561 - RNA, 19 nt, Human
ccccaucccacccacucac

SEQ ID NO: 230562 - RNA, 28 nt, Human
cccucuucaagcuuuccuccacucggcu

SEQ ID NO: 230563 - RNA, 24 nt, Human
ccgccuccuggguucaagcgauuc

SEQ ID NO: 230564 - RNA, 24 nt, Human
ccgcuucagucucccaaagugcua

SEQ ID NO: 230565 - RNA, 19 nt, Human
ccuccgccuccuggguuca

SEQ ID NO: 230566 - RNA, 24 nt, Human
ccuccuggguucaagcgauucucc

SEQ ID NO: 230567 - RNA, 19 nt, Human
ccucugcuuaaaacugucc

SEQ ID NO: 230568 - RNA, 20 nt, Human
ccucugcuuaaaacugucca

SEQ ID NO: 230569 - RNA, 22 nt, Human
ccugaccucgggugauccaccc

SEQ ID NO: 230570 - RNA, 18 nt, Human
ccugagaucuguauccca

SEQ ID NO: 230571 - RNA, 23 nt, Human
ccugaguagcuggaauuacaggc

SEQ ID NO: 230572 - RNA, 23 nt, Human
ccuggguucaagcgauucuccug

SEQ ID NO: 230573 - RNA, 25 nt, Human
ccuugccaaaacucaagugccccca

SEQ ID NO: 230574 - RNA, 20 nt, Human
cgaaaguuaucugggccugg

SEQ ID NO: 230575 - RNA, 21 nt, Human
cgcccaccaccacauccagcu

SEQ ID NO: 230576 - RNA, 24 nt, Human
cucacuguaaccuccgccuccugg

SEQ ID NO: 230577 - RNA, 26 nt, Human
cuccugaccucgggugauccacccgc

SEQ ID NO: 230578 - RNA, 19 nt, Human
cuccugccucagacuccug

SEQ ID NO: 230579 - RNA, 21 nt, Human
cuccuggguucaagcgauucu

SEQ ID NO: 230580 - RNA, 23 nt, Human
cugccucagacuccugaguagcu

SEQ ID NO: 230581 - RNA, 24 nt, Human
cugguuccuccagcaauucccacu

SEQ ID NO: 230582 - RNA, 24 nt, Human
cuuaaaacuguccacuggcuucuc

SEQ ID NO: 230583 - RNA, 19 nt, Human
cuucaagcuuuccuccacu

SEQ ID NO: 230584 - RNA, 22 nt, Human
cuugccaaaacucaagugcccc

SEQ ID NO: 230585 - RNA, 24 nt, Human
cuugccaaaacucaagugccccca

SEQ ID NO: 230586 - RNA, 24 nt, Human
cuuuuaguagagacaggguuucac

SEQ ID NO: 230587 - RNA, 18 nt, Human
cuuuuuuuuuuuuuuuug

SEQ ID NO: 230588 - RNA, 18 nt, Human
gaaauauuuauggcagcu

SEQ ID NO: 230589 - RNA, 27 nt, Human
gaaggauggauggagguaauggauggg

SEQ ID NO: 230590 - RNA, 19 nt, Human
gaauuacaggcgugagcca

SEQ ID NO: 230591 - RNA, 24 nt, Human
gaccucgggugauccacccgcuuc

SEQ ID NO: 230592 - RNA, 18 nt, Human
gagacuccccuuugcugg

SEQ ID NO: 230593 - RNA, 19 nt, Human
gagcaaagcccuggagcau

SEQ ID NO: 230594 - RNA, 20 nt, Human
gagcaaagcccuggagcaug

SEQ ID NO: 230595 - RNA, 25 nt, Human
gaguagcuggaauuacaggcgccca

SEQ ID NO: 230596 - RNA, 23 nt, Human
gcaaagucaaaguuuuuuccuuu

SEQ ID NO: 230597 - RNA, 21 nt, Human
gcaccauagucuucccagcca

SEQ ID NO: 230598 - RNA, 19 nt, Human
gcaggcaccagcaagcacc

SEQ ID NO: 230599 - RNA, 19 nt, Human
gcaggcaccagcaagcacc

SEQ ID NO: 230600 - RNA, 23 nt, Human
gcauggagcuggaagguuguggg

SEQ ID NO: 230601 - RNA, 21 nt, Human
gccaaaacucaagugccccca

SEQ ID NO: 230602 - RNA, 23 nt, Human
gcccacagaccuuuacccccaag

SEQ ID NO: 230603 - RNA, 18 nt, Human
gcccaccaccacauccag

SEQ ID NO: 230604 - RNA, 23 nt, Human
gcuggucuucaacuccugaccuc

SEQ ID NO: 230605 - RNA, 25 nt, Human
ggcaccagcaagcaccauagcucug

SEQ ID NO: 230606 - RNA, 24 nt, Human
ggcuggucuucaacuccugaccuc

SEQ ID NO: 230607 - RNA, 22 nt, Human
ggguuucaccauguuggccagg

SEQ ID NO: 230608 - RNA, 23 nt, Human
ggugauccacccgcuucagucuc

SEQ ID NO: 230609 - RNA, 20 nt, Human
ggugcaauaagacaaccacc

SEQ ID NO: 230610 - RNA, 20 nt, Human
gucgcugcccggcgccucgg

SEQ ID NO: 230611 - RNA, 20 nt, Human
gugacccaucuuagcaacgg

SEQ ID NO: 230612 - RNA, 24 nt, Human
gugauccacccgcuucagucuccc

SEQ ID NO: 230613 - RNA, 23 nt, Human
uaaaaacacuuucaggaaaaucc

SEQ ID NO: 230614 - RNA, 26 nt, Human
uaaacaccacuugugacaaacaaagu

SEQ ID NO: 230615 - RNA, 18 nt, Human
uaagacaaccaccuggcc

SEQ ID NO: 230616 - RNA, 20 nt, Human
uaauaaaaaugcaaucucua

SEQ ID NO: 230617 - RNA, 24 nt, Human
uaauuuuuguacuuuuaguagaga

SEQ ID NO: 230618 - RNA, 23 nt, Human
uacaggcgugagccaccacaccc

SEQ ID NO: 230619 - RNA, 20 nt, Human
uacccauuaaacauguucaa

SEQ ID NO: 230620 - RNA, 24 nt, Human
uagaauuacaggcgugagccacca

SEQ ID NO: 230621 - RNA, 24 nt, Human
uagaauuacaggcgugagccacca

SEQ ID NO: 230622 - RNA, 22 nt, Human
uagacaaucaacucuaugaggg

SEQ ID NO: 230623 - RNA, 22 nt, Human
uagagacaggguuucaccaugu

SEQ ID NO: 230624 - RNA, 20 nt, Human
uagcuggaauuacaggcgcc

SEQ ID NO: 230625 - RNA, 22 nt, Human
uaggaaaugcuuuaauaaaaau

SEQ ID NO: 230626 - RNA, 24 nt, Human
uaguagagacaggguuucaccaug

SEQ ID NO: 230627 - RNA, 26 nt, Human
uaguagagacaggguuucaccauguu

SEQ ID NO: 230628 - RNA, 21 nt, Human
uagugaguguucuggagcaaa

SEQ ID NO: 230629 - RNA, 20 nt, Human
uaucauaacucaacagucug

SEQ ID NO: 230630 - RNA, 23 nt, Human
uaucccaacagcacuuguccaaa

SEQ ID NO: 230631 - RNA, 25 nt, Human
ucaacuccugaccucgggugaucca

SEQ ID NO: 230632 - RNA, 19 nt, Human
ucaagcgauucuccugccu

SEQ ID NO: 230633 - RNA, 23 nt, Human
ucacuguaaccuccgccuccugg

SEQ ID NO: 230634 - RNA, 24 nt, Human
ucacuguaaccuccgccuccuggg

SEQ ID NO: 230635 - RNA, 25 nt, Human
ucacuguaaccuccgccuccugggu

SEQ ID NO: 230636 - RNA, 27 nt, Human
ucacuguaaccuccgccuccuggguuc

SEQ ID NO: 230637 - RNA, 22 nt, Human
ucagucucccaaagugcuagaa

SEQ ID NO: 230638 - RNA, 22 nt, Human
uccaaggaaauacagaagcaag

SEQ ID NO: 230639 - RNA, 21 nt, Human
uccacccgcuucagucuccca

SEQ ID NO: 230640 - RNA, 24 nt, Human
ucccaaagugcuagaauuacaggc

SEQ ID NO: 230641 - RNA, 18 nt, Human
ucccagccaagguggaag

SEQ ID NO: 230642 - RNA, 19 nt, Human
ucccagccaagguggaagu

SEQ ID NO: 230643 - RNA, 22 nt, Human
uccucugcuuaaaacuguccac

SEQ ID NO: 230644 - RNA, 24 nt, Human
uccugaguagcuggaauuacaggc

SEQ ID NO: 230645 - RNA, 21 nt, Human
uccuggguucaagcgauucuc

SEQ ID NO: 230646 - RNA, 24 nt, Human
uccuggguucaagcgauucuccug

SEQ ID NO: 230647 - RNA, 24 nt, Human
uccuugaucauucucacacccagu

SEQ ID NO: 230648 - RNA, 18 nt, Human
uccuuuuuuuuuuuuuuu

SEQ ID NO: 230649 - RNA, 21 nt, Human
ucucaaccugccuucucucua

SEQ ID NO: 230650 - RNA, 24 nt, Human
ucuccgcugcaggggucgcugccc

SEQ ID NO: 230651 - RNA, 18 nt, Human
ucucuaaguugccauggc

SEQ ID NO: 230652 - RNA, 18 nt, Human
ucuggagcaaagcccugg

SEQ ID NO: 230653 - RNA, 24 nt, Human
ucuucaauuauuucaacaauaucu

SEQ ID NO: 230654 - RNA, 19 nt, Human
ucuugcucuguuccccagg

SEQ ID NO: 230655 - RNA, 23 nt, Human
ucuugcucuguuccccaggcugg

SEQ ID NO: 230656 - RNA, 24 nt, Human
ucuugcucuguuccccaggcugga

SEQ ID NO: 230657 - RNA, 22 nt, Human
ugaccucgggugauccacccgc

SEQ ID NO: 230658 - RNA, 24 nt, Human
ugaccucgggugauccacccgcuu

SEQ ID NO: 230659 - RNA, 26 nt, Human
ugagaaaauaagauaaaauacauuga

SEQ ID NO: 230660 - RNA, 20 nt, Human
ugagcaaagagguugcaaac

SEQ ID NO: 230661 - RNA, 19 nt, Human
ugaggcaauaguauuuuac

SEQ ID NO: 230662 - RNA, 21 nt, Human
ugcaauagguguucagugacc

SEQ ID NO: 230663 - RNA, 21 nt, Human
ugcaaucuuggcucacuguaa

SEQ ID NO: 230664 - RNA, 22 nt, Human
ugccaaaacucaagugccccca

SEQ ID NO: 230665 - RNA, 24 nt, Human
ugccaaaacucaagugcccccaug

SEQ ID NO: 230666 - RNA, 21 nt, Human
ugccucagacuccugaguagc

SEQ ID NO: 230667 - RNA, 24 nt, Human
ugccucagacuccugaguagcugg

SEQ ID NO: 230668 - RNA, 24 nt, Human
ugccucugguuccuccagcaauuc

SEQ ID NO: 230669 - RNA, 24 nt, Human
ugcuagaauuacaggcgugagcca

SEQ ID NO: 230670 - RNA, 21 nt, Human
ugcucuguuccccaggcugga

SEQ ID NO: 230671 - RNA, 22 nt, Human
ugcucuguuccccaggcuggag

SEQ ID NO: 230672 - RNA, 24 nt, Human
uggaagugccucugguuccuccag

SEQ ID NO: 230673 - RNA, 21 nt, Human
uggaauuacaggcgcccacca

SEQ ID NO: 230674 - RNA, 24 nt, Human
uggaauuacaggcgcccaccacca

SEQ ID NO: 230675 - RNA, 24 nt, Human
uggagagcaguggugcaaucuugg

SEQ ID NO: 230676 - RNA, 19 nt, Human
uggcaggcaccagcaagca

SEQ ID NO: 230677 - RNA, 22 nt, Human
uggcaggcaccagcaagcacca

SEQ ID NO: 230678 - RNA, 24 nt, Human
uggccaggcuggucuucaacuccu

SEQ ID NO: 230679 - RNA, 18 nt, Human
ugggagggucuugcaaca

SEQ ID NO: 230680 - RNA, 23 nt, Human
uggguucaagcgauucuccugcc

SEQ ID NO: 230681 - RNA, 23 nt, Human
uggugcaaucuuggcucacugua

SEQ ID NO: 230682 - RNA, 24 nt, Human
uuaaguagucucaaccugccuucu

SEQ ID NO: 230683 - RNA, 24 nt, Human
uuaguagagacaggguuucaccau

SEQ ID NO: 230684 - RNA, 20 nt, Human
uucaaauguccccaucccac

SEQ ID NO: 230685 - RNA, 21 nt, Human
uucaagcgauucuccugccuc

SEQ ID NO: 230686 - RNA, 23 nt, Human
uucaagcgauucuccugccucag

SEQ ID NO: 230687 - RNA, 25 nt, Human
uucaagcgauucuccugccucagac

SEQ ID NO: 230688 - RNA, 20 nt, Human
uucacaucuucccagccacc

SEQ ID NO: 230689 - RNA, 20 nt, Human
uucaggaaaauccaaggaaa

SEQ ID NO: 230690 - RNA, 18 nt, Human
uuccuccacucggcugcc

SEQ ID NO: 230691 - RNA, 22 nt, Human
uuccuccacucggcugcccuag

SEQ ID NO: 230692 - RNA, 23 nt, Human
uuccuuuuuuuuuuuuuuuugag

SEQ ID NO: 230693 - RNA, 24 nt, Human
uuucaccauguuggccaggcuggu

SEQ ID NO: 230694 - RNA, 20 nt, Human
uuuuuguacuuuuaguagag

SEQ ID NO: 230695 - RNA, 23 nt, Human
uuuuuuuuuuuuugagacagucu

SEQ ID NO: 230696 - RNA, 24 nt, Human
aagaagccacagacagaaucggca

SEQ ID NO: 230697 - RNA, 21 nt, Human
aggugggggagugugugccgg

SEQ ID NO: 230698 - RNA, 24 nt, Human
aggugggggagugugugccgggga

SEQ ID NO: 230699 - RNA, 18 nt, Human
caagggcaccgacgccgc

SEQ ID NO: 230700 - RNA, 18 nt, Human
caagggcaccgacgccgc

SEQ ID NO: 230701 - RNA, 20 nt, Human
cagaaucggcagggagugug

SEQ ID NO: 230702 - RNA, 22 nt, Human
cagcagccggcuccggggaaug

SEQ ID NO: 230703 - RNA, 18 nt, Human
ccccugggucauguaaac

SEQ ID NO: 230704 - RNA, 23 nt, Human
gcagggaagaagccacagacaga

SEQ ID NO: 230705 - RNA, 22 nt, Human
gcagggagugugacuauccaca

SEQ ID NO: 230706 - RNA, 22 nt, Human
gcaggggugagagugugcacuc

SEQ ID NO: 230707 - RNA, 20 nt, Human
ggaagaagccacagacagaa

SEQ ID NO: 230708 - RNA, 20 nt, Human
gugggggagugugugccggg

SEQ ID NO: 230709 - RNA, 19 nt, Human
gugggguagugugcacccc

SEQ ID NO: 230710 - RNA, 18 nt, Human
ugccggggaucugggcag

SEQ ID NO: 230711 - RNA, 20 nt, Human
ugggggagugugugccgggg

SEQ ID NO: 230712 - RNA, 19 nt, Human
ugggucauguaaacagcag

SEQ ID NO: 230713 - RNA, 25 nt, Human
ugucuguaugggcacaccugugggg

SEQ ID NO: 230714 - RNA, 18 nt, Human
aaaaaagugccagcccuu

SEQ ID NO: 230715 - RNA, 19 nt, Human
aagaagcccgcccgaauuc

SEQ ID NO: 230716 - RNA, 22 nt, Human
aagccacggcaaaacaucagga

SEQ ID NO: 230717 - RNA, 19 nt, Human
aagcggcacccccaccccc

SEQ ID NO: 230718 - RNA, 22 nt, Human
aaugaagaaaccaaacaccaga

SEQ ID NO: 230719 - RNA, 27 nt, Human
aaugaagaaaccaaacaccagaacccu

SEQ ID NO: 230720 - RNA, 21 nt, Human
acagcggcacccccacccccu

SEQ ID NO: 230721 - RNA, 21 nt, Human
acagcggcacccccaccccuc

SEQ ID NO: 230722 - RNA, 22 nt, Human
accaaacaccagaacccuaaac

SEQ ID NO: 230723 - RNA, 22 nt, Human
accagacgcaagagcccggcca

SEQ ID NO: 230724 - RNA, 19 nt, Human
agagagcacccccacccuc

SEQ ID NO: 230725 - RNA, 23 nt, Human
agagagcacccccacccucaaaa

SEQ ID NO: 230726 - RNA, 25 nt, Human
agagagcacccccacccucaaaauc

SEQ ID NO: 230727 - RNA, 25 nt, Human
agagcacccccacccucaaaauccu

SEQ ID NO: 230728 - RNA, 20 nt, Human
agagcagcacccccaccccc

SEQ ID NO: 230729 - RNA, 21 nt, Human
agccaauuuagagcggcaccc

SEQ ID NO: 230730 - RNA, 23 nt, Human
agcuggucccgugucgugacaca

SEQ ID NO: 230731 - RNA, 20 nt, Human
caaacaccagaacccuaaac

SEQ ID NO: 230732 - RNA, 24 nt, Human
caauccccaagccacggcaaaaca

SEQ ID NO: 230733 - RNA, 18 nt, Human
cacagcgcagaacaggau

SEQ ID NO: 230734 - RNA, 23 nt, Human
cacagcgcagaacaggaucaccc

SEQ ID NO: 230735 - RNA, 23 nt, Human
caccagaacccuaaacucaauga

SEQ ID NO: 230736 - RNA, 20 nt, Human
cacccccacccucaaaaucc

SEQ ID NO: 230737 - RNA, 22 nt, Human
cacccccucagagagagcaccc

SEQ ID NO: 230738 - RNA, 21 nt, Human
cacccucaaaauccuacuuug

SEQ ID NO: 230739 - RNA, 18 nt, Human
cagaaagugugccucccc

SEQ ID NO: 230740 - RNA, 21 nt, Human
cagagagagcggcacccccac

SEQ ID NO: 230741 - RNA, 21 nt, Human
cagagagagcggcacccccac

SEQ ID NO: 230742 - RNA, 24 nt, Human
cagagguuucccuuuguaaggcuu

SEQ ID NO: 230743 - RNA, 21 nt, Human
cagcacccccacccccucaga

SEQ ID NO: 230744 - RNA, 22 nt, Human
cagcgaagaagcccgcccgaau

SEQ ID NO: 230745 - RNA, 21 nt, Human
cagcgcagaacaggaucaccc

SEQ ID NO: 230746 - RNA, 19 nt, Human
cagcggcacccccaccccc

SEQ ID NO: 230747 - RNA, 24 nt, Human
cagcggcacccccaccccucagag

SEQ ID NO: 230748 - RNA, 24 nt, Human
caggacccuaagcccagagaaagg

SEQ ID NO: 230749 - RNA, 22 nt, Human
caggagaacgcaccgaucucac

SEQ ID NO: 230750 - RNA, 24 nt, Human
caguaaagaaugaagaaaccaaac

SEQ ID NO: 230751 - RNA, 27 nt, Human
ccacuggaacgaggccgccagccacgu

SEQ ID NO: 230752 - RNA, 26 nt, Human
cccaagccacggcaaaacaucaggag

SEQ ID NO: 230753 - RNA, 24 nt, Human
cccagagaaaggaacagaggcccc

SEQ ID NO: 230754 - RNA, 25 nt, Human
cccccaccccucagacagcggcacc

SEQ ID NO: 230755 - RNA, 21 nt, Human
ccccucagacagcggcacccc

SEQ ID NO: 230756 - RNA, 23 nt, Human
ccccucagagaaagcggcacccc

SEQ ID NO: 230757 - RNA, 24 nt, Human
ccccucagagaaagcggcaccccc

SEQ ID NO: 230758 - RNA, 23 nt, Human
ccccucagagacagcggcacccc

SEQ ID NO: 230759 - RNA, 23 nt, Human
ccccucagagagagcggcacccc

SEQ ID NO: 230760 - RNA, 23 nt, Human
ccccucagagagagcggcacccc

SEQ ID NO: 230761 - RNA, 23 nt, Human
ccccucggagagagcagcacccc

SEQ ID NO: 230762 - RNA, 25 nt, Human
ccccugcagcugcugugccugcgug

SEQ ID NO: 230763 - RNA, 22 nt, Human
cccuaagcccagagaaaggaac

SEQ ID NO: 230764 - RNA, 23 nt, Human
cccucagagagagcacccccacc

SEQ ID NO: 230765 - RNA, 21 nt, Human
cccugcagcugcugugccugc

SEQ ID NO: 230766 - RNA, 20 nt, Human
ccguguacaauccccaagcc

SEQ ID NO: 230767 - RNA, 23 nt, Human
ccucaaaauccuacuuugguaaa

SEQ ID NO: 230768 - RNA, 22 nt, Human
ccucagagacagcggcaccccc

SEQ ID NO: 230769 - RNA, 21 nt, Human
cggagagagcagcacccccac

SEQ ID NO: 230770 - RNA, 18 nt, Human
cucagagacagcggcacc

SEQ ID NO: 230771 - RNA, 19 nt, Human
gaacaggaucacccgaaug

SEQ ID NO: 230772 - RNA, 21 nt, Human
gacagcggcauuccaccccuc

SEQ ID NO: 230773 - RNA, 20 nt, Human
gagcacccccacccucaaaa

SEQ ID NO: 230774 - RNA, 24 nt, Human
gagcacccccacccucaaaauccu

SEQ ID NO: 230775 - RNA, 19 nt, Human
gagccaauuuagagcggca

SEQ ID NO: 230776 - RNA, 21 nt, Human
gagcggcacccccaccccuca

SEQ ID NO: 230777 - RNA, 21 nt, Human
gagcggcacccccaccccuca

SEQ ID NO: 230778 - RNA, 21 nt, Human
gaucacccgaaugucaacaga

SEQ ID NO: 230779 - RNA, 24 nt, Human
gaucacccgaaugucaacagaaga

SEQ ID NO: 230780 - RNA, 21 nt, Human
gcacccccaccccucagagac

SEQ ID NO: 230781 - RNA, 19 nt, Human
gcagcacccccacccccuc

SEQ ID NO: 230782 - RNA, 22 nt, Human
gcagcgaagaagcccgcccgaa

SEQ ID NO: 230783 - RNA, 20 nt, Human
gccacgugucgcgcguccug

SEQ ID NO: 230784 - RNA, 18 nt, Human
gccggguacggugcggag

SEQ ID NO: 230785 - RNA, 19 nt, Human
gcggcacccccacccccuc

SEQ ID NO: 230786 - RNA, 19 nt, Human
gcggcacccccacccccuc

SEQ ID NO: 230787 - RNA, 22 nt, Human
gcggguggucugugcgcagugc

SEQ ID NO: 230788 - RNA, 18 nt, Human
gcugcagacauuagagac

SEQ ID NO: 230789 - RNA, 23 nt, Human
ggaacgaggccgccagccacgug

SEQ ID NO: 230790 - RNA, 20 nt, Human
gucuuaggauuuucccucuc

SEQ ID NO: 230791 - RNA, 19 nt, Human
uaaaaaagugccagcccuu

SEQ ID NO: 230792 - RNA, 20 nt, Human
uaaaaaagugccagcccuug

SEQ ID NO: 230793 - RNA, 18 nt, Human
uagagcggcacccccacc

SEQ ID NO: 230794 - RNA, 22 nt, Human
uagagcggcacccccaccccuc

SEQ ID NO: 230795 - RNA, 18 nt, Human
uaguaaaugcugcaagau

SEQ ID NO: 230796 - RNA, 18 nt, Human
uccccaagccacggcaaa

SEQ ID NO: 230797 - RNA, 24 nt, Human
ucuggaguuccucugucuuaggau

SEQ ID NO: 230798 - RNA, 24 nt, Human
ucugucuuaggauuuucccucucu

SEQ ID NO: 230799 - RNA, 22 nt, Human
ucugugcgcagugcgcgcgaga

SEQ ID NO: 230800 - RNA, 23 nt, Human
ugaacugaagccgcuccagacac

SEQ ID NO: 230801 - RNA, 25 nt, Human
ugcagaaagugugccuccccuuccu

SEQ ID NO: 230802 - RNA, 20 nt, Human
ugccgccacuggaacgagga

SEQ ID NO: 230803 - RNA, 21 nt, Human
uuaaagcugaacugaagccgc

SEQ ID NO: 230804 - RNA, 21 nt, Human
uucgacaggacccuaagccca

SEQ ID NO: 230805 - RNA, 22 nt, Human
uuucgauaguuacucuguugug

SEQ ID NO: 230806 - RNA, 23 nt, Human
uuugcagaaagugugccuccccu

SEQ ID NO: 230807 - RNA, 23 nt, Human
aaaaaaaaaacacgaaaaaacaa

SEQ ID NO: 230808 - RNA, 23 nt, Human
aaaaaacacgaaaaaacaacccc

SEQ ID NO: 230809 - RNA, 20 nt, Human
aaaaacaaccccacaggaac

SEQ ID NO: 230810 - RNA, 24 nt, Human
aaaaacacccaaaaccagauagag

SEQ ID NO: 230811 - RNA, 24 nt, Human
aaaaaccaaagucaggcaguggga

SEQ ID NO: 230812 - RNA, 19 nt, Human
aaaaaucacacacacacac

SEQ ID NO: 230813 - RNA, 31 nt, Human
aaaaaucacacacacacacacacacacacag

SEQ ID NO: 230814 - RNA, 24 nt, Human
aaaacaaccccacaggaaccuucc

SEQ ID NO: 230815 - RNA, 25 nt, Human
aaaacacccaaaaccagauagagcg

SEQ ID NO: 230816 - RNA, 19 nt, Human
aaacagacaggcaaauauc

SEQ ID NO: 230817 - RNA, 18 nt, Human
aaaccaaagucaggcaac

SEQ ID NO: 230818 - RNA, 21 nt, Human
aaagcauuuauugcuaagaac

SEQ ID NO: 230819 - RNA, 24 nt, Human
aaagugcugggauuacaggcguga

SEQ ID NO: 230820 - RNA, 22 nt, Human
aaauaucuaaagauaccauaca

SEQ ID NO: 230821 - RNA, 22 nt, Human
aacaacagcugcaacaccaggg

SEQ ID NO: 230822 - RNA, 22 nt, Human
aagaacauaauaauaccagccc

SEQ ID NO: 230823 - RNA, 18 nt, Human
aagagcacugaugaccac

SEQ ID NO: 230824 - RNA, 19 nt, Human
aagagcacugaugaccacc

SEQ ID NO: 230825 - RNA, 24 nt, Human
aagagcacugaugaccaccgacca

SEQ ID NO: 230826 - RNA, 19 nt, Human
aagugcugggauuacaggc

SEQ ID NO: 230827 - RNA, 19 nt, Human
aagugcugggauuacaggc

SEQ ID NO: 230828 - RNA, 26 nt, Human
aagugcugggauuacaggcgugagcc

SEQ ID NO: 230829 - RNA, 23 nt, Human
aauguuggaaggcuaaagagaaa

SEQ ID NO: 230830 - RNA, 24 nt, Human
acaaaaaucacacacacacacaca

SEQ ID NO: 230831 - RNA, 20 nt, Human
acacacacacacacacaaaa

SEQ ID NO: 230832 - RNA, 28 nt, Human
acacacacacacacacacacaaaaagag

SEQ ID NO: 230833 - RNA, 23 nt, Human
acacacacacacacacacacaca

SEQ ID NO: 230834 - RNA, 23 nt, Human
acacacacacacacacacacaca

SEQ ID NO: 230835 - RNA, 23 nt, Human
acacacacacacacacacacaca

SEQ ID NO: 230836 - RNA, 23 nt, Human
acacacacacacacacacacaca

SEQ ID NO: 230837 - RNA, 22 nt, Human
acacacacacacacacacacag

SEQ ID NO: 230838 - RNA, 21 nt, Human
acaugaaaaacacccaaaacc

SEQ ID NO: 230839 - RNA, 20 nt, Human
accaguagugaaaugacauu

SEQ ID NO: 230840 - RNA, 23 nt, Human
accaguuucuuuauacaaaugcu

SEQ ID NO: 230841 - RNA, 18 nt, Human
accauguuggccaggcug

SEQ ID NO: 230842 - RNA, 25 nt, Human
acccacuucggccucccaaagugcu

SEQ ID NO: 230843 - RNA, 22 nt, Human
accccgcagagcaggcggcgac

SEQ ID NO: 230844 - RNA, 21 nt, Human
accuuaaaacauugcacguug

SEQ ID NO: 230845 - RNA, 23 nt, Human
agaaaaaacauggaaaguauuua

SEQ ID NO: 230846 - RNA, 18 nt, Human
agacaauuuucucauuuu

SEQ ID NO: 230847 - RNA, 18 nt, Human
agagcacugaugaccacc

SEQ ID NO: 230848 - RNA, 30 nt, Human
agaugggguuucaccauguuggccaggcuu

SEQ ID NO: 230849 - RNA, 24 nt, Human
aggcucgcuggaccugggucaaga

SEQ ID NO: 230850 - RNA, 23 nt, Human
agggaaaaggcucgcuggaccug

SEQ ID NO: 230851 - RNA, 18 nt, Human
aguaacugggauuacagg

SEQ ID NO: 230852 - RNA, 23 nt, Human
aguaacugggauuacaggcgccc

SEQ ID NO: 230853 - RNA, 18 nt, Human
agucaggaaucugaucuu

SEQ ID NO: 230854 - RNA, 21 nt, Human
agucaggaaucugaucuugag

SEQ ID NO: 230855 - RNA, 20 nt, Human
agugauccacccacuucggc

SEQ ID NO: 230856 - RNA, 24 nt, Human
agugauucuccugccucagccucc

SEQ ID NO: 230857 - RNA, 24 nt, Human
agugcaauggugcgcucuuggcuc

SEQ ID NO: 230858 - RNA, 18 nt, Human
agugcugggauuacaggc

SEQ ID NO: 230859 - RNA, 20 nt, Human
aguuuuuuuaaaaaaaagau

SEQ ID NO: 230860 - RNA, 21 nt, Human
auagagaugggguuucaccau

SEQ ID NO: 230861 - RNA, 22 nt, Human
auagagaugggguuucaccaug

SEQ ID NO: 230862 - RNA, 22 nt, Human
aucacacacacacacacacaca

SEQ ID NO: 230863 - RNA, 19 nt, Human
augaaaaacacccaaaacc

SEQ ID NO: 230864 - RNA, 18 nt, Human
augggguuucaccauguu

SEQ ID NO: 230865 - RNA, 22 nt, Human
augggguuucaccauguuggcc

SEQ ID NO: 230866 - RNA, 21 nt, Human
auuaucucuaaagcaccuaaa

SEQ ID NO: 230867 - RNA, 19 nt, Human
auuugcucagccauucccc

SEQ ID NO: 230868 - RNA, 18 nt, Human
caaaaaaaaaaaacacga

SEQ ID NO: 230869 - RNA, 19 nt, Human
caaaaagagcaaaaggagc

SEQ ID NO: 230870 - RNA, 19 nt, Human
caaaaugcugggauugaua

SEQ ID NO: 230871 - RNA, 19 nt, Human
caaacaaaaaucacacaca

SEQ ID NO: 230872 - RNA, 24 nt, Human
caaagugcugggauuacaggcgug

SEQ ID NO: 230873 - RNA, 24 nt, Human
caacaacagcugcaacaccaggga

SEQ ID NO: 230874 - RNA, 22 nt, Human
caacacacaccaaaaaaguucu

SEQ ID NO: 230875 - RNA, 25 nt, Human
caagagcacugaugaccaccgacca

SEQ ID NO: 230876 - RNA, 18 nt, Human
caagcuggaaacaagacc

SEQ ID NO: 230877 - RNA, 20 nt, Human
caagugauucuccugccuca

SEQ ID NO: 230878 - RNA, 22 nt, Human
caagugauucuccugccucagc

SEQ ID NO: 230879 - RNA, 18 nt, Human
cacaaaacugaacacaaa

SEQ ID NO: 230880 - RNA, 23 nt, Human
cacaaaacugaacacaaagcacc

SEQ ID NO: 230881 - RNA, 20 nt, Human
cacacacaaaaagagcaaaa

SEQ ID NO: 230882 - RNA, 27 nt, Human
cacacacacacaaaaagagcaaaagga

SEQ ID NO: 230883 - RNA, 22 nt, Human
cacacacacacacacaaaaaga

SEQ ID NO: 230884 - RNA, 20 nt, Human
cacacacacacacacacaca

SEQ ID NO: 230885 - RNA, 20 nt, Human
cacacacacacacacacaca

SEQ ID NO: 230886 - RNA, 20 nt, Human
cacacacacacacacacaca

SEQ ID NO: 230887 - RNA, 20 nt, Human
cacacacacacacacacaca

SEQ ID NO: 230888 - RNA, 20 nt, Human
cacacacacacacacacaca

SEQ ID NO: 230889 - RNA, 20 nt, Human
cacacacacacacacacaca

SEQ ID NO: 230890 - RNA, 20 nt, Human
cacacacacacacacacaca

SEQ ID NO: 230891 - RNA, 20 nt, Human
cacacacacacacacacaca

SEQ ID NO: 230892 - RNA, 22 nt, Human
cacacacacacacacacacaca

SEQ ID NO: 230893 - RNA, 22 nt, Human
cacacacacacacacacacaca

SEQ ID NO: 230894 - RNA, 22 nt, Human
cacacacacacacacacacaca

SEQ ID NO: 230895 - RNA, 23 nt, Human
cacacacacacacacacacacaa

SEQ ID NO: 230896 - RNA, 26 nt, Human
cacacacacacacacacacacacaca

SEQ ID NO: 230897 - RNA, 26 nt, Human
cacacacacacacacacacacacaca

SEQ ID NO: 230898 - RNA, 26 nt, Human
cacacacacacacacacacacacaca

SEQ ID NO: 230899 - RNA, 26 nt, Human
cacacacacacacacacacacacaca

SEQ ID NO: 230900 - RNA, 23 nt, Human
cacaccaaaaaaguucuccuaga

SEQ ID NO: 230901 - RNA, 20 nt, Human
cacaucuuuugcuguaaaaa

SEQ ID NO: 230902 - RNA, 21 nt, Human
caccauguuggccaggcuggu

SEQ ID NO: 230903 - RNA, 24 nt, Human
caccauguuggccaggcuggucuc

SEQ ID NO: 230904 - RNA, 27 nt, Human
caccauguuggccaggcuggucucaaa

SEQ ID NO: 230905 - RNA, 23 nt, Human
caccgaccacagccuugcaaaag

SEQ ID NO: 230906 - RNA, 21 nt, Human
caccgcaaccucugccucccg

SEQ ID NO: 230907 - RNA, 23 nt, Human
caccgcaaccucugccucccggg

SEQ ID NO: 230908 - RNA, 24 nt, Human
cagaacaccaguagugaaaugaca

SEQ ID NO: 230909 - RNA, 21 nt, Human
cagaggccaauuuaugagcac

SEQ ID NO: 230910 - RNA, 18 nt, Human
cagcauucagucagugcc

SEQ ID NO: 230911 - RNA, 21 nt, Human
cagccccuguucaaaucuacu

SEQ ID NO: 230912 - RNA, 21 nt, Human
cagccuugcaaaagccaggaa

SEQ ID NO: 230913 - RNA, 21 nt, Human
caggcgcccaccaccaugccc

SEQ ID NO: 230914 - RNA, 24 nt, Human
cagggaaaaaaaaucucuuuuuca

SEQ ID NO: 230915 - RNA, 23 nt, Human
cauaucaauuuuaagaagcaaag

SEQ ID NO: 230916 - RNA, 20 nt, Human
caugcaacugccuauauaug

SEQ ID NO: 230917 - RNA, 24 nt, Human
cauguuggccaggcuggucucaaa

SEQ ID NO: 230918 - RNA, 21 nt, Human
cauuucuuaagaaaaagaaaa

SEQ ID NO: 230919 - RNA, 25 nt, Human
ccaaaaccagauagagcguuacccc

SEQ ID NO: 230920 - RNA, 22 nt, Human
ccaaagugcugggauuacaggc

SEQ ID NO: 230921 - RNA, 22 nt, Human
ccaaagugcugggauuacaggc

SEQ ID NO: 230922 - RNA, 24 nt, Human
ccaaagugcugggauuacaggcgu

SEQ ID NO: 230923 - RNA, 20 nt, Human
ccaccacaaaaaaaaaaaac

SEQ ID NO: 230924 - RNA, 21 nt, Human
ccaggaccaguaaauaugaca

SEQ ID NO: 230925 - RNA, 22 nt, Human
cccaccacaaaaaaaaaaaaca

SEQ ID NO: 230926 - RNA, 24 nt, Human
cccaccacaaaaaaaaaaaacacg

SEQ ID NO: 230927 - RNA, 18 nt, Human
cccaugcuaggcaugcaa

SEQ ID NO: 230928 - RNA, 19 nt, Human
cccgaguaacugggauuac

SEQ ID NO: 230929 - RNA, 24 nt, Human
cccgaguaacugggauuacaggcg

SEQ ID NO: 230930 - RNA, 23 nt, Human
cccggguucaagugauucuccuc

SEQ ID NO: 230931 - RNA, 23 nt, Human
cccggguucaagugauucuccug

SEQ ID NO: 230932 - RNA, 26 nt, Human
cccucaauuggcacuggcaagcaauu

SEQ ID NO: 230933 - RNA, 22 nt, Human
ccgaguaacugggauuacaggc

SEQ ID NO: 230934 - RNA, 18 nt, Human
ccgcaaccucugccuccc

SEQ ID NO: 230935 - RNA, 19 nt, Human
ccgcaaccucugccucccg

SEQ ID NO: 230936 - RNA, 23 nt, Human
ccgcaaccucugccucccggguu

SEQ ID NO: 230937 - RNA, 24 nt, Human
ccgcaaccucugccucccggguuc

SEQ ID NO: 230938 - RNA, 22 nt, Human
ccucaagugauccacccacuuc

SEQ ID NO: 230939 - RNA, 24 nt, Human
ccucccggguucaagugauucucc

SEQ ID NO: 230940 - RNA, 18 nt, Human
ccuggccucaagugaucc

SEQ ID NO: 230941 - RNA, 24 nt, Human
ccuggccucaagugauccacccac

SEQ ID NO: 230942 - RNA, 18 nt, Human
cgaaaaaacaaccccaca

SEQ ID NO: 230943 - RNA, 23 nt, Human
cgaaaaaacaaccccacaggaac

SEQ ID NO: 230944 - RNA, 18 nt, Human
cgcagagcaggcggcgac

SEQ ID NO: 230945 - RNA, 21 nt, Human
cgcuggaccugggucaagagc

SEQ ID NO: 230946 - RNA, 20 nt, Human
cuaaaacaugaaaaacaccc

SEQ ID NO: 230947 - RNA, 24 nt, Human
cucaagugauccacccacuucggc

SEQ ID NO: 230948 - RNA, 24 nt, Human
cucaccgcaaccucugccucccgg

SEQ ID NO: 230949 - RNA, 20 nt, Human
cucccggguucaagugauuc

SEQ ID NO: 230950 - RNA, 23 nt, Human
cuccuggccucaagugauccacc

SEQ ID NO: 230951 - RNA, 27 nt, Human
cuccuggccucaagugauccacccacu

SEQ ID NO: 230952 - RNA, 19 nt, Human
cucuaaagcaccuaaaaaa

SEQ ID NO: 230953 - RNA, 24 nt, Human
cugauagagaugggguuucaccau

SEQ ID NO: 230954 - RNA, 19 nt, Human
cugcaaacaaaaaucacac

SEQ ID NO: 230955 - RNA, 23 nt, Human
cugccucagccucccgaguaacu

SEQ ID NO: 230956 - RNA, 23 nt, Human
cugccucccggguucaagugauu

SEQ ID NO: 230957 - RNA, 24 nt, Human
cuggagugcaauggugcgcucuug

SEQ ID NO: 230958 - RNA, 20 nt, Human
cuuuugcuguaaaaauaaca

SEQ ID NO: 230959 - RNA, 18 nt, Human
gaaaaaacaaccccacag

SEQ ID NO: 230960 - RNA, 18 nt, Human
gaaaaaacaaccccacag

SEQ ID NO: 230961 - RNA, 20 nt, Human
gaaaaaacaaccccacagga

SEQ ID NO: 230962 - RNA, 24 nt, Human
gaccaacuuuuaauggauuaagau

SEQ ID NO: 230963 - RNA, 20 nt, Human
gagaugggguuucaccaugu

SEQ ID NO: 230964 - RNA, 24 nt, Human
gagaugggguuucaccauguuggc

SEQ ID NO: 230965 - RNA, 19 nt, Human
gagcaaguacaaauccacg

SEQ ID NO: 230966 - RNA, 26 nt, Human
gaggcacauaaucccaccacaaaaaa

SEQ ID NO: 230967 - RNA, 24 nt, Human
gauuacaggcgcccaccaccaugc

SEQ ID NO: 230968 - RNA, 18 nt, Human
gauuacaggcgugagccg

SEQ ID NO: 230969 - RNA, 21 nt, Human
gauuacaggcgugagccgcca

SEQ ID NO: 230970 - RNA, 22 nt, Human
gauuacaggcgugagccgccac

SEQ ID NO: 230971 - RNA, 18 nt, Human
gcaagcuggaaacaagac

SEQ ID NO: 230972 - RNA, 21 nt, Human
gcucaccgcaaccucugccuc

SEQ ID NO: 230973 - RNA, 20 nt, Human
gcuggaccugggucaagagc

SEQ ID NO: 230974 - RNA, 23 nt, Human
gcuggucucaaacuccuggccuc

SEQ ID NO: 230975 - RNA, 18 nt, Human
ggaggcacauaaucccac

SEQ ID NO: 230976 - RNA, 20 nt, Human
ggccagggcuucuuaagaua

SEQ ID NO: 230977 - RNA, 24 nt, Human
ggcggcgacggcggcgacggcggc

SEQ ID NO: 230978 - RNA, 24 nt, Human
ggcuggucucaaacuccuggccuc

SEQ ID NO: 230979 - RNA, 22 nt, Human
gggguuucaccauguuggccag

SEQ ID NO: 230980 - RNA, 22 nt, Human
ggguucaagugauucuccugcc

SEQ ID NO: 230981 - RNA, 18 nt, Human
ggguuucaccauguuggc

SEQ ID NO: 230982 - RNA, 24 nt, Human
gugauccacccacuucggccuccc

SEQ ID NO: 230983 - RNA, 24 nt, Human
gugauucuccugccucagccuccc

SEQ ID NO: 230984 - RNA, 23 nt, Human
guuugaaaucccccauaccaccc

SEQ ID NO: 230985 - RNA, 22 nt, Human
uaaaacauugcacguugauguu

SEQ ID NO: 230986 - RNA, 24 nt, Human
uaaaauacaaaaauauucacugaa

SEQ ID NO: 230987 - RNA, 24 nt, Human
uaaaauacccaugcuaggcaugca

SEQ ID NO: 230988 - RNA, 22 nt, Human
uaaagauaccauacaucaacua

SEQ ID NO: 230989 - RNA, 26 nt, Human
uaaauuaaaaacgauuuugaaaaauu

SEQ ID NO: 230990 - RNA, 21 nt, Human
uaacgaauaauaacaacgaaa

SEQ ID NO: 230991 - RNA, 19 nt, Human
uaacugggauuacaggcgc

SEQ ID NO: 230992 - RNA, 19 nt, Human
uaagauaaaaccaagacuu

SEQ ID NO: 230993 - RNA, 22 nt, Human
uaagcugauuaaagagaacaac

SEQ ID NO: 230994 - RNA, 21 nt, Human
uaaguuaaccugcaaacaaaa

SEQ ID NO: 230995 - RNA, 18 nt, Human
uaaucugaauguagaaac

SEQ ID NO: 230996 - RNA, 24 nt, Human
uaauggauuaagauaaaaccaaga

SEQ ID NO: 230997 - RNA, 24 nt, Human
uaauuuuuuguauuucugauagag

SEQ ID NO: 230998 - RNA, 22 nt, Human
uaccauaacgaauaauaacaac

SEQ ID NO: 230999 - RNA, 19 nt, Human
uagaagcagcaagaaauau

SEQ ID NO: 231000 - RNA, 23 nt, Human
uagaagcagcaagaaauauuuga

SEQ ID NO: 231001 - RNA, 22 nt, Human
uagagaugggguuucaccaugu

SEQ ID NO: 231002 - RNA, 24 nt, Human
uagcuaaguuaaccugcaaacaaa

SEQ ID NO: 231003 - RNA, 22 nt, Human
uaggugguacacgguaauuuga

SEQ ID NO: 231004 - RNA, 24 nt, Human
uauauauauauauaugucugugug

SEQ ID NO: 231005 - RNA, 22 nt, Human
uauauauaugucugugugugug

SEQ ID NO: 231006 - RNA, 20 nt, Human
uauauaugugugcauauaua

SEQ ID NO: 231007 - RNA, 22 nt, Human
uauauaugugugcauauauaua

SEQ ID NO: 231008 - RNA, 20 nt, Human
uauaugucugugugugugua

SEQ ID NO: 231009 - RNA, 24 nt, Human
uauaugugugcauauauauauaua

SEQ ID NO: 231010 - RNA, 27 nt, Human
uauaugugugcauauauauauauauau

SEQ ID NO: 231011 - RNA, 18 nt, Human
uaugagcacaaaguacua

SEQ ID NO: 231012 - RNA, 23 nt, Human
uauuuuauucuuauaauggccaa

SEQ ID NO: 231013 - RNA, 18 nt, Human
uauuuugcuuucuccuau

SEQ ID NO: 231014 - RNA, 21 nt, Human
ucaagagcacugaugaccacc

SEQ ID NO: 231015 - RNA, 19 nt, Human
ucaagugauucuccugccu

SEQ ID NO: 231016 - RNA, 18 nt, Human
ucaaucagguugcagauu

SEQ ID NO: 231017 - RNA, 24 nt, Human
ucaccgcaaccucugccucccggg

SEQ ID NO: 231018 - RNA, 25 nt, Human
ucaccgcaaccucugccucccgggu

SEQ ID NO: 231019 - RNA, 19 nt, Human
ucagugccaugcauugugc

SEQ ID NO: 231020 - RNA, 24 nt, Human
ucccaaagugcugggauuacaggc

SEQ ID NO: 231021 - RNA, 24 nt, Human
ucccgaguaacugggauuacaggc

SEQ ID NO: 231022 - RNA, 21 nt, Human
ucccggguucaagugauucuc

SEQ ID NO: 231023 - RNA, 24 nt, Human
ucccggguucaagugauucuccug

SEQ ID NO: 231024 - RNA, 20 nt, Human
ucgcccaaggcuggagugcc

SEQ ID NO: 231025 - RNA, 22 nt, Human
ucuaaagcaccuaaaaaaugga

SEQ ID NO: 231026 - RNA, 18 nt, Human
ucucaaaaugcugggauu

SEQ ID NO: 231027 - RNA, 22 nt, Human
ucucagaccacaaaacugaaca

SEQ ID NO: 231028 - RNA, 24 nt, Human
ucuccugccucagccucccgagua

SEQ ID NO: 231029 - RNA, 18 nt, Human
ugaaaaacacccaaaacc

SEQ ID NO: 231030 - RNA, 18 nt, Human
ugaaaaacacccaaaacc

SEQ ID NO: 231031 - RNA, 19 nt, Human
ugaaaacacugaaauacua

SEQ ID NO: 231032 - RNA, 20 nt, Human
ugaaaucccccauaccaccc

SEQ ID NO: 231033 - RNA, 23 nt, Human
ugaacacaaagcacgugaauuaa

SEQ ID NO: 231034 - RNA, 24 nt, Human
ugauagagaugggguuucaccaug

SEQ ID NO: 231035 - RNA, 19 nt, Human
ugaugggcauuuauaccac

SEQ ID NO: 231036 - RNA, 20 nt, Human
ugauucuccugccucagccu

SEQ ID NO: 231037 - RNA, 22 nt, Human
ugcagcucgcuguagcucuaag

SEQ ID NO: 231038 - RNA, 24 nt, Human
ugccucagccucccgaguaacugg

SEQ ID NO: 231039 - RNA, 20 nt, Human
ugcugggauuacaggcguga

SEQ ID NO: 231040 - RNA, 22 nt, Human
uggaaacaagaccaacuuuuaa

SEQ ID NO: 231041 - RNA, 22 nt, Human
uggaauagucuuauauauugca

SEQ ID NO: 231042 - RNA, 21 nt, Human
uggagugcaauggugcgcucu

SEQ ID NO: 231043 - RNA, 24 nt, Human
uggagugcaauggugcgcucuugg

SEQ ID NO: 231044 - RNA, 24 nt, Human
uggccaggcuggucucaaacuccu

SEQ ID NO: 231045 - RNA, 22 nt, Human
uggccucaagugauccacccac

SEQ ID NO: 231046 - RNA, 22 nt, Human
ugggaggcacauaaucccacca

SEQ ID NO: 231047 - RNA, 21 nt, Human
ugggauuacaggcgcccacca

SEQ ID NO: 231048 - RNA, 24 nt, Human
ugggauuacaggcgcccaccacca

SEQ ID NO: 231049 - RNA, 25 nt, Human
ugggauuacaggcgcccaccaccau

SEQ ID NO: 231050 - RNA, 18 nt, Human
ugggauuacaggcgugag

SEQ ID NO: 231051 - RNA, 19 nt, Human
ugggauuacaggcgugagc

SEQ ID NO: 231052 - RNA, 21 nt, Human
ugggauuacaggcgugagccg

SEQ ID NO: 231053 - RNA, 22 nt, Human
ugggauuacaggcgugagccgc

SEQ ID NO: 231054 - RNA, 23 nt, Human
ugggauuacaggcgugagccgcc

SEQ ID NO: 231055 - RNA, 24 nt, Human
ugggauuacaggcgugagccgcca

SEQ ID NO: 231056 - RNA, 24 nt, Human
ugggguuucaccauguuggccagg

SEQ ID NO: 231057 - RNA, 18 nt, Human
ugucgcccaaggcuggag

SEQ ID NO: 231058 - RNA, 23 nt, Human
ugucgcccaaggcuggagugcaa

SEQ ID NO: 231059 - RNA, 18 nt, Human
ugugcauauauauauaua

SEQ ID NO: 231060 - RNA, 20 nt, Human
ugugcauauauauauauaua

SEQ ID NO: 231061 - RNA, 22 nt, Human
ugugcauauauauauauauaug

SEQ ID NO: 231062 - RNA, 18 nt, Human
ugugugcauauauauaua

SEQ ID NO: 231063 - RNA, 18 nt, Human
ugugugcauauauauaua

SEQ ID NO: 231064 - RNA, 20 nt, Human
ugugugcauauauauauaua

SEQ ID NO: 231065 - RNA, 22 nt, Human
ugugugcauauauauauauaua

SEQ ID NO: 231066 - RNA, 22 nt, Human
ugugugcauauauauauauaua

SEQ ID NO: 231067 - RNA, 24 nt, Human
ugugugcauauauauauauauaug

SEQ ID NO: 231068 - RNA, 20 nt, Human
uguucaacucaacuaccugc

SEQ ID NO: 231069 - RNA, 24 nt, Human
uguuuuguuuugaagauggaguuu

SEQ ID NO: 231070 - RNA, 23 nt, Human
uguuuuguuuuguuuugaagaug

SEQ ID NO: 231071 - RNA, 25 nt, Human
uguuuuguuuuguuuuguuuugauu

SEQ ID NO: 231072 - RNA, 21 nt, Human
uuaaaguuucaacauaucaau

SEQ ID NO: 231073 - RNA, 21 nt, Human
uuaaauuaaaaacgauuuuga

SEQ ID NO: 231074 - RNA, 24 nt, Human
uuaauauuugcucagccauuccaa

SEQ ID NO: 231075 - RNA, 24 nt, Human
uuagaaaagcauuuauugcuaaga

SEQ ID NO: 231076 - RNA, 23 nt, Human
uuauaauggccauguuaauaagu

SEQ ID NO: 231077 - RNA, 21 nt, Human
uucaagugauucuccugccuc

SEQ ID NO: 231078 - RNA, 23 nt, Human
uucaagugauucuccugccucag

SEQ ID NO: 231079 - RNA, 24 nt, Human
uucaagugauucuccugccucagc

SEQ ID NO: 231080 - RNA, 22 nt, Human
uucaggcuaaacaaagaacaaa

SEQ ID NO: 231081 - RNA, 19 nt, Human
uucggccucccaaagugcu

SEQ ID NO: 231082 - RNA, 18 nt, Human
uucuccuauaaacauuag

SEQ ID NO: 231083 - RNA, 19 nt, Human
uuggauuuuaagcugauua

SEQ ID NO: 231084 - RNA, 19 nt, Human
uuguacuugcuuuuuucuu

SEQ ID NO: 231085 - RNA, 20 nt, Human
uuguuuguuuguuuuguuuu

SEQ ID NO: 231086 - RNA, 24 nt, Human
uuucaccauguuggccaggcuggu

SEQ ID NO: 231087 - RNA, 24 nt, Human
uuucucauuuucuagugaauggga

SEQ ID NO: 231088 - RNA, 24 nt, Human
uuucugauagagaugggguuucac

SEQ ID NO: 231089 - RNA, 19 nt, Human
uuuguuuuguuuuguuuug

SEQ ID NO: 231090 - RNA, 21 nt, Human
uuuugaacaaguuugucucca

SEQ ID NO: 231091 - RNA, 24 nt, Human
uuuugguuaagaugcaaguuuugu

SEQ ID NO: 231092 - RNA, 21 nt, Human
uuuuuguauuucugauagaga

SEQ ID NO: 231093 - RNA, 24 nt, Human
uuuuuuguauuucugauagagaug

SEQ ID NO: 231094 - RNA, 21 nt, Human
aaccauuuuuccaugcugcuu

SEQ ID NO: 231095 - RNA, 23 nt, Human
ucccuuuaaguuacgacgggaau

SEQ ID NO: 231096 - RNA, 20 nt, Human
uuccaugcugcuuaagagcc

SEQ ID NO: 231097 - RNA, 21 nt, Human
aaaaccugauucuguggucuc

SEQ ID NO: 231098 - RNA, 19 nt, Human
aaaagaccaaaguucagau

SEQ ID NO: 231099 - RNA, 22 nt, Human
aaaaggccccguuuugcaaccc

SEQ ID NO: 231100 - RNA, 20 nt, Human
aaaaugaaccaccuagagaa

SEQ ID NO: 231101 - RNA, 24 nt, Human
aaacagaaguagaauacuguacaa

SEQ ID NO: 231102 - RNA, 20 nt, Human
aaacaggagauaauaggagg

SEQ ID NO: 231103 - RNA, 23 nt, Human
aaagagacaaaacaagccaggca

SEQ ID NO: 231104 - RNA, 22 nt, Human
aagagacaaaacaagccaggca

SEQ ID NO: 231105 - RNA, 19 nt, Human
aagaguuccaaaaaacuca

SEQ ID NO: 231106 - RNA, 26 nt, Human
aagcauaaauacaacaaauagcauac

SEQ ID NO: 231107 - RNA, 19 nt, Human
aagugcgccucccgcgucc

SEQ ID NO: 231108 - RNA, 20 nt, Human
aaguuuugaaaagcuuaaaa

SEQ ID NO: 231109 - RNA, 21 nt, Human
aaucaguugcaaagagacaaa

SEQ ID NO: 231110 - RNA, 21 nt, Human
aauugucugcccuccaguugg

SEQ ID NO: 231111 - RNA, 21 nt, Human
accaugaagguuuuugaugcc

SEQ ID NO: 231112 - RNA, 18 nt, Human
accauguuguuaggggau

SEQ ID NO: 231113 - RNA, 24 nt, Human
accauguuguuaggggauugucuc

SEQ ID NO: 231114 - RNA, 25 nt, Human
acuaccauguuguuaggggauuguc

SEQ ID NO: 231115 - RNA, 24 nt, Human
acugugaucaagucuucucuggcu

SEQ ID NO: 231116 - RNA, 18 nt, Human
agaaaauugucugcccuc

SEQ ID NO: 231117 - RNA, 19 nt, Human
agaaagaguagaagcugau

SEQ ID NO: 231118 - RNA, 20 nt, Human
agagagccacaugacucagg

SEQ ID NO: 231119 - RNA, 22 nt, Human
agagcaugcacaugcuuaccag

SEQ ID NO: 231120 - RNA, 23 nt, Human
agauaagagaugaugguauugag

SEQ ID NO: 231121 - RNA, 24 nt, Human
agcaagcccggauaaaaaggcccc

SEQ ID NO: 231122 - RNA, 24 nt, Human
agcauacauauaaaauugugccag

SEQ ID NO: 231123 - RNA, 24 nt, Human
aggaaauguuaauaaagaaaguaa

SEQ ID NO: 231124 - RNA, 21 nt, Human
aggaagaaauggaaauuaaag

SEQ ID NO: 231125 - RNA, 23 nt, Human
aggaagcugauccuggaaacuga

SEQ ID NO: 231126 - RNA, 18 nt, Human
aggcagagcaugcacaug

SEQ ID NO: 231127 - RNA, 23 nt, Human
aggcagggcaucguaagaucaga

SEQ ID NO: 231128 - RNA, 20 nt, Human
aguauucccuuucucaucuc

SEQ ID NO: 231129 - RNA, 26 nt, Human
agucagaaaauugucugcccuccagu

SEQ ID NO: 231130 - RNA, 22 nt, Human
agugccaacuuacacaagugac

SEQ ID NO: 231131 - RNA, 22 nt, Human
auaagauuuccuccaaguucug

SEQ ID NO: 231132 - RNA, 22 nt, Human
auaguauucccuuucucaucuc

SEQ ID NO: 231133 - RNA, 18 nt, Human
auuggcuuccugaucuua

SEQ ID NO: 231134 - RNA, 22 nt, Human
caaaacaagccaggcaaaggca

SEQ ID NO: 231135 - RNA, 21 nt, Human
caaaacacuugaacagaauuu

SEQ ID NO: 231136 - RNA, 23 nt, Human
caagagagcugugaaauaggcac

SEQ ID NO: 231137 - RNA, 21 nt, Human
caccgccguccaugguaucua

SEQ ID NO: 231138 - RNA, 22 nt, Human
caccuagagaaaagcaagucag

SEQ ID NO: 231139 - RNA, 19 nt, Human
cacgcccgcgacuugaagc

SEQ ID NO: 231140 - RNA, 19 nt, Human
cagaauuuucacaaugauc

SEQ ID NO: 231141 - RNA, 19 nt, Human
cagacuguuauuguuagcu

SEQ ID NO: 231142 - RNA, 18 nt, Human
cagaguggacugaaaucc

SEQ ID NO: 231143 - RNA, 19 nt, Human
caggccacaccgccgucca

SEQ ID NO: 231144 - RNA, 25 nt, Human
caguuugcuuuauaauuagagaaac

SEQ ID NO: 231145 - RNA, 25 nt, Human
ccacgcccgcgacuugaagcaagug

SEQ ID NO: 231146 - RNA, 24 nt, Human
ccagccuuucccauuaaaugacaa

SEQ ID NO: 231147 - RNA, 23 nt, Human
ccaugaagguuuuugaugccaaa

SEQ ID NO: 231148 - RNA, 18 nt, Human
ccccguuuugcaaccccg

SEQ ID NO: 231149 - RNA, 19 nt, Human
ccucccgcguccugaagcc

SEQ ID NO: 231150 - RNA, 22 nt, Human
ccugccuugaaaucuuccuggg

SEQ ID NO: 231151 - RNA, 24 nt, Human
cuaaacaggagauaauaggagacu

SEQ ID NO: 231152 - RNA, 19 nt, Human
cucaggccacaccgccguc

SEQ ID NO: 231153 - RNA, 21 nt, Human
cucaggccacaccgccgucca

SEQ ID NO: 231154 - RNA, 18 nt, Human
cucccgcguccugaagcc

SEQ ID NO: 231155 - RNA, 18 nt, Human
cugaaaaaagcuaacaaa

SEQ ID NO: 231156 - RNA, 18 nt, Human
cugccuugaaaucuuccu

SEQ ID NO: 231157 - RNA, 20 nt, Human
cuugaugaccuuugacaacc

SEQ ID NO: 231158 - RNA, 21 nt, Human
cuuucaaaaugaaccaccuag

SEQ ID NO: 231159 - RNA, 19 nt, Human
gaaccaccuagagaaaagc

SEQ ID NO: 231160 - RNA, 19 nt, Human
gaagcugaugagucaaaac

SEQ ID NO: 231161 - RNA, 22 nt, Human
gaagcugaugagucaaaacacu

SEQ ID NO: 231162 - RNA, 18 nt, Human
gcauauucauacauagaa

SEQ ID NO: 231163 - RNA, 19 nt, Human
gcuaccugcaggaaccagu

SEQ ID NO: 231164 - RNA, 24 nt, Human
gggcaucguaagaucagacaaaaa

SEQ ID NO: 231165 - RNA, 22 nt, Human
guaaguuuugaaaagcuuaaaa

SEQ ID NO: 231166 - RNA, 19 nt, Human
guucuucucccugccuuga

SEQ ID NO: 231167 - RNA, 22 nt, Human
uaaagcauauucauacauagaa

SEQ ID NO: 231168 - RNA, 20 nt, Human
uaaaguagcuaguaaaaggc

SEQ ID NO: 231169 - RNA, 19 nt, Human
uaaauaauaaaggacuaca

SEQ ID NO: 231170 - RNA, 24 nt, Human
uaaauacaacaaauagcauacaua

SEQ ID NO: 231171 - RNA, 19 nt, Human
uaaauucugaaaaaagcua

SEQ ID NO: 231172 - RNA, 19 nt, Human
uaaccugaggacauaguag

SEQ ID NO: 231173 - RNA, 24 nt, Human
uaacuaaaccaaaugagcuuuauu

SEQ ID NO: 231174 - RNA, 18 nt, Human
uaagaagccuaguauaaa

SEQ ID NO: 231175 - RNA, 21 nt, Human
uacaaacuagaacugaaacaa

SEQ ID NO: 231176 - RNA, 19 nt, Human
uacaauuuagugaaaagac

SEQ ID NO: 231177 - RNA, 24 nt, Human
uacacacucaguggggauuugguu

SEQ ID NO: 231178 - RNA, 19 nt, Human
uaccaaagagucagcacua

SEQ ID NO: 231179 - RNA, 29 nt, Human
uaccauguuguuaggggauugucucagcg

SEQ ID NO: 231180 - RNA, 19 nt, Human
uagaaacagaaacauguga

SEQ ID NO: 231181 - RNA, 21 nt, Human
uagagaaacaguucgucuaca

SEQ ID NO: 231182 - RNA, 18 nt, Human
uaggagacugcuaccugc

SEQ ID NO: 231183 - RNA, 18 nt, Human
uagugccaacuuacacaa

SEQ ID NO: 231184 - RNA, 25 nt, Human
uauauucauaaacuuaaauaagauu

SEQ ID NO: 231185 - RNA, 22 nt, Human
ucacuguaaaaacccaaguuaa

SEQ ID NO: 231186 - RNA, 22 nt, Human
ucagaaaauugucugcccucca

SEQ ID NO: 231187 - RNA, 24 nt, Human
ucagcguuguaggcuuugcugaau

SEQ ID NO: 231188 - RNA, 23 nt, Human
ucaggauuaaagacugacaacuc

SEQ ID NO: 231189 - RNA, 18 nt, Human
ucagucagaguggacuga

SEQ ID NO: 231190 - RNA, 22 nt, Human
ucagucagaguggacugaaauc

SEQ ID NO: 231191 - RNA, 22 nt, Human
uccacuuuuaccuaaaacucua

SEQ ID NO: 231192 - RNA, 19 nt, Human
ucccacgcccgcgacuuga

SEQ ID NO: 231193 - RNA, 20 nt, Human
ucccauuaaaugacaacaua

SEQ ID NO: 231194 - RNA, 18 nt, Human
ucccgcguccugaagccc

SEQ ID NO: 231195 - RNA, 22 nt, Human
ucccugaauaucccaaacaguu

SEQ ID NO: 231196 - RNA, 23 nt, Human
ucccugaauaucccaaacaguuu

SEQ ID NO: 231197 - RNA, 19 nt, Human
uccuggaagcauuuagucg

SEQ ID NO: 231198 - RNA, 24 nt, Human
ucuuggaauuuuucuccuggaagc

SEQ ID NO: 231199 - RNA, 21 nt, Human
ugaaaaaagcuaacaaaauca

SEQ ID NO: 231200 - RNA, 21 nt, Human
ugaaaaacacacauauuuaaa

SEQ ID NO: 231201 - RNA, 22 nt, Human
ugaaaagaccaaaguucagaua

SEQ ID NO: 231202 - RNA, 22 nt, Human
ugaaaagcuuaaaaaaaaacca

SEQ ID NO: 231203 - RNA, 26 nt, Human
ugaaaguauguuuaccucuaguccaa

SEQ ID NO: 231204 - RNA, 20 nt, Human
ugaacacugcuugaugaccu

SEQ ID NO: 231205 - RNA, 22 nt, Human
ugaacucuggauaauaccuccu

SEQ ID NO: 231206 - RNA, 20 nt, Human
ugaagguuuuauuaccuagu

SEQ ID NO: 231207 - RNA, 24 nt, Human
ugaccuuugacaaccuuugaaggu

SEQ ID NO: 231208 - RNA, 21 nt, Human
ugacucccacaagcuuagcau

SEQ ID NO: 231209 - RNA, 26 nt, Human
ugcaaaaucaguugcaaagagacaaa

SEQ ID NO: 231210 - RNA, 24 nt, Human
ugcaggaaccaguacacacucagu

SEQ ID NO: 231211 - RNA, 19 nt, Human
ugccuuaccgacaaaaaca

SEQ ID NO: 231212 - RNA, 19 nt, Human
ugcuuggagaacugugauc

SEQ ID NO: 231213 - RNA, 21 nt, Human
uggaaagcaacggaagcacuu

SEQ ID NO: 231214 - RNA, 21 nt, Human
uggaacacuaggcauaaaugg

SEQ ID NO: 231215 - RNA, 19 nt, Human
ugggaaagauuuuuaaaga

SEQ ID NO: 231216 - RNA, 20 nt, Human
uguaugccuuaccgacaaaa

SEQ ID NO: 231217 - RNA, 18 nt, Human
ugugaaaaaucagaccuu

SEQ ID NO: 231218 - RNA, 18 nt, Human
ugugaaaaaucagaccuu

SEQ ID NO: 231219 - RNA, 21 nt, Human
uguucuaagcaugaacucugg

SEQ ID NO: 231220 - RNA, 22 nt, Human
uuacagaacauagaaauacaua

SEQ ID NO: 231221 - RNA, 23 nt, Human
uucucaucuccccuuuuuaaaca

SEQ ID NO: 231222 - RNA, 19 nt, Human
uucucccugccuugaaauc

SEQ ID NO: 231223 - RNA, 18 nt, Human
uugaauacugaaaaacac

SEQ ID NO: 231224 - RNA, 21 nt, Human
uugaauacugaaaaacacaca

SEQ ID NO: 231225 - RNA, 22 nt, Human
uuugcaauuucuaaauuacuau

SEQ ID NO: 231226 - RNA, 22 nt, Human
uuuucuaggaaccaacuucugg

SEQ ID NO: 231227 - RNA, 21 nt, Human
aaagaguggaaaaccccaggg

SEQ ID NO: 231228 - RNA, 23 nt, Human
aagaaagaggcauuuccucaugu

SEQ ID NO: 231229 - RNA, 26 nt, Human
aagcguuggagcucaaagagugagcu

SEQ ID NO: 231230 - RNA, 20 nt, Human
aagcuggaaggugaauucau

SEQ ID NO: 231231 - RNA, 22 nt, Human
acaagacacaggaagauaggaa

SEQ ID NO: 231232 - RNA, 20 nt, Human
acagccagcugcuagcugcc

SEQ ID NO: 231233 - RNA, 22 nt, Human
accugaauucuccuuuccauuc

SEQ ID NO: 231234 - RNA, 23 nt, Human
agauaggaaaugcagaaggagga

SEQ ID NO: 231235 - RNA, 24 nt, Human
agccagcugcuagcugccagcaca

SEQ ID NO: 231236 - RNA, 18 nt, Human
agcugccagcacagcuaa

SEQ ID NO: 231237 - RNA, 19 nt, Human
aggaaaugcagaaggagga

SEQ ID NO: 231238 - RNA, 21 nt, Human
aggaaaugcagaaggaggagg

SEQ ID NO: 231239 - RNA, 24 nt, Human
aggggcuggauggacgcugggugg

SEQ ID NO: 231240 - RNA, 18 nt, Human
aguaacuuugaugugaug

SEQ ID NO: 231241 - RNA, 24 nt, Human
auucugaggaagcuggaaggugaa

SEQ ID NO: 231242 - RNA, 18 nt, Human
caagaaaagcccuggaug

SEQ ID NO: 231243 - RNA, 21 nt, Human
cacagccagcugcuagcugcc

SEQ ID NO: 231244 - RNA, 19 nt, Human
caccccucccacuuuaacc

SEQ ID NO: 231245 - RNA, 20 nt, Human
cagccaagacagacggacuc

SEQ ID NO: 231246 - RNA, 25 nt, Human
caggggcuggauggacgcugggugg

SEQ ID NO: 231247 - RNA, 19 nt, Human
caugcacaagacacaggaa

SEQ ID NO: 231248 - RNA, 25 nt, Human
ccaagacagacggacuccagaaugc

SEQ ID NO: 231249 - RNA, 22 nt, Human
cccaccccucccacuuuaaccu

SEQ ID NO: 231250 - RNA, 24 nt, Human
cccaggcagcauuuuauucugagg

SEQ ID NO: 231251 - RNA, 22 nt, Human
ccggagaggugaggacaggggc

SEQ ID NO: 231252 - RNA, 23 nt, Human
ccucauguuuaacaagcguugga

SEQ ID NO: 231253 - RNA, 21 nt, Human
ccucucuacccaccccuccca

SEQ ID NO: 231254 - RNA, 23 nt, Human
cgucagagaauuuccagccaaga

SEQ ID NO: 231255 - RNA, 24 nt, Human
cuaaauccucucuacccaccccuc

SEQ ID NO: 231256 - RNA, 21 nt, Human
cuccuuuccauuccagcugcc

SEQ ID NO: 231257 - RNA, 21 nt, Human
cugaggaagcuggaaggugaa

SEQ ID NO: 231258 - RNA, 21 nt, Human
gaacuucuaaauccucucuac

SEQ ID NO: 231259 - RNA, 22 nt, Human
gaagauaggaaaugcagaagga

SEQ ID NO: 231260 - RNA, 20 nt, Human
gaaggaggaggaggugccgg

SEQ ID NO: 231261 - RNA, 24 nt, Human
gagacauggaaauucuaggggguu

SEQ ID NO: 231262 - RNA, 19 nt, Human
gaggugaggacaggggcug

SEQ ID NO: 231263 - RNA, 19 nt, Human
gaguggaaggagaagggag

SEQ ID NO: 231264 - RNA, 19 nt, Human
gaugauguggaugaagaaa

SEQ ID NO: 231265 - RNA, 23 nt, Human
gcacugcaaacacagccagcugc

SEQ ID NO: 231266 - RNA, 21 nt, Human
ggagaagggaggcugggugcc

SEQ ID NO: 231267 - RNA, 21 nt, Human
ggcuggauggacgcugggugg

SEQ ID NO: 231268 - RNA, 18 nt, Human
ggggcuggauggacgcug

SEQ ID NO: 231269 - RNA, 25 nt, Human
gugccggagaggugaggacaggggc

SEQ ID NO: 231270 - RNA, 20 nt, Human
uaaauccucucuacccaccc

SEQ ID NO: 231271 - RNA, 24 nt, Human
uagaugauguggaugaagaaacca

SEQ ID NO: 231272 - RNA, 26 nt, Human
uccagccaagacagacggacuccaga

SEQ ID NO: 231273 - RNA, 18 nt, Human
uccagcugccuccaagac

SEQ ID NO: 231274 - RNA, 18 nt, Human
uccgugucagccacugac

SEQ ID NO: 231275 - RNA, 23 nt, Human
uccucucuacccaccccucccac

SEQ ID NO: 231276 - RNA, 26 nt, Human
ucucugaaagaguggaaaaccccagg

SEQ ID NO: 231277 - RNA, 23 nt, Human
ugacaauaucaggagaauugcuu

SEQ ID NO: 231278 - RNA, 21 nt, Human
ugacuugaaccagagaagaac

SEQ ID NO: 231279 - RNA, 20 nt, Human
ugagcuugggagccuguccu

SEQ ID NO: 231280 - RNA, 21 nt, Human
uggaaggagaagggaggcugg

SEQ ID NO: 231281 - RNA, 21 nt, Human
uggaaggugaauucaugaagg

SEQ ID NO: 231282 - RNA, 21 nt, Human
uggacgcuggguggaaggcag

SEQ ID NO: 231283 - RNA, 21 nt, Human
uggccaagaaaagcccuggau

SEQ ID NO: 231284 - RNA, 24 nt, Human
uucuaaauccucucuacccacccc

SEQ ID NO: 231285 - RNA, 18 nt, Human
uucugaggaagcuggaag

SEQ ID NO: 231286 - RNA, 19 nt, Human
uugcacugcaaacacagcc

SEQ ID NO: 231287 - RNA, 23 nt, Human
uuuuauucugaggaagcuggaag

SEQ ID NO: 231288 - RNA, 18 nt, Human
uuuuuuuuuuuuuccuug

SEQ ID NO: 231289 - RNA, 19 nt, Human
aaaaaagcagauuaugagg

SEQ ID NO: 231290 - RNA, 22 nt, Human
aaccaagcauuguugggcugaa

SEQ ID NO: 231291 - RNA, 22 nt, Human
aagcaaaaaagcagauuaugag

SEQ ID NO: 231292 - RNA, 24 nt, Human
aagcagauuaugaggcagcuccac

SEQ ID NO: 231293 - RNA, 19 nt, Human
aagcaggcacaggagggcu

SEQ ID NO: 231294 - RNA, 21 nt, Human
aauggccaaucgucuaaacaa

SEQ ID NO: 231295 - RNA, 18 nt, Human
acaaccgccaugacccca

SEQ ID NO: 231296 - RNA, 23 nt, Human
accccccgacaguccccagagac

SEQ ID NO: 231297 - RNA, 30 nt, Human
agagacccugccuccguggccuccaccucu

SEQ ID NO: 231298 - RNA, 23 nt, Human
aggcacaggagggcuguuggggc

SEQ ID NO: 231299 - RNA, 20 nt, Human
agggaagcaggcacaggagg

SEQ ID NO: 231300 - RNA, 21 nt, Human
auucuaaaugacucaugguug

SEQ ID NO: 231301 - RNA, 29 nt, Human
caaaccuccccagcugccacaaccgccau

SEQ ID NO: 231302 - RNA, 22 nt, Human
caaccgccaugaccccaguggc

SEQ ID NO: 231303 - RNA, 24 nt, Human
cacaggcccugcaggaggagcagg

SEQ ID NO: 231304 - RNA, 21 nt, Human
cacccaggccacaggggccac

SEQ ID NO: 231305 - RNA, 25 nt, Human
cagaacagauucgccuaugacugaa

SEQ ID NO: 231306 - RNA, 21 nt, Human
cagauuguccugccagggagg

SEQ ID NO: 231307 - RNA, 20 nt, Human
cagcagaacaauuguguguu

SEQ ID NO: 231308 - RNA, 24 nt, Human
cagccacacugaccacagagcaac

SEQ ID NO: 231309 - RNA, 18 nt, Human
cagcucacaggcccugca

SEQ ID NO: 231310 - RNA, 27 nt, Human
cagggucagugcccacaaggggguugc

SEQ ID NO: 231311 - RNA, 20 nt, Human
caguccccagagacccugcc

SEQ ID NO: 231312 - RNA, 25 nt, Human
ccaaaccuccccagcugccacaacc

SEQ ID NO: 231313 - RNA, 30 nt, Human
ccaaagcaaaaaagcagauuaugaggcagg

SEQ ID NO: 231314 - RNA, 22 nt, Human
ccacaaccgccaugaccccagu

SEQ ID NO: 231315 - RNA, 20 nt, Human
ccaccucugggucagcuccc

SEQ ID NO: 231316 - RNA, 22 nt, Human
ccguggccuccaccucuggguc

SEQ ID NO: 231317 - RNA, 19 nt, Human
ccucccagcacuggggcug

SEQ ID NO: 231318 - RNA, 21 nt, Human
ccucugagacacugaagggga

SEQ ID NO: 231319 - RNA, 27 nt, Human
cuaaaugacucaugguuggcuaauuga

SEQ ID NO: 231320 - RNA, 24 nt, Human
cuauuuauaaaucaaugcaauaga

SEQ ID NO: 231321 - RNA, 18 nt, Human
cuugcagagccuucuccc

SEQ ID NO: 231322 - RNA, 25 nt, Human
gaaacuuccucccugucgcacacaa

SEQ ID NO: 231323 - RNA, 20 nt, Human
gaagggacuguuuuaugaug

SEQ ID NO: 231324 - RNA, 21 nt, Human
gaauggauggccagcgacagc

SEQ ID NO: 231325 - RNA, 23 nt, Human
gacccugccuccguggccuccac

SEQ ID NO: 231326 - RNA, 20 nt, Human
gauuacauauauuuauauau

SEQ ID NO: 231327 - RNA, 18 nt, Human
gcagggcagagaagggga

SEQ ID NO: 231328 - RNA, 23 nt, Human
gccuaaagcguugacccaguugu

SEQ ID NO: 231329 - RNA, 18 nt, Human
ggagcaggccagcgaggg

SEQ ID NO: 231330 - RNA, 20 nt, Human
ggagggcccacccaggccac

SEQ ID NO: 231331 - RNA, 18 nt, Human
ggccagcgacagccuggc

SEQ ID NO: 231332 - RNA, 21 nt, Human
gggaagcaggcacaggagggc

SEQ ID NO: 231333 - RNA, 21 nt, Human
guccccuccucugagacacug

SEQ ID NO: 231334 - RNA, 18 nt, Human
gucuaaacaagugucaga

SEQ ID NO: 231335 - RNA, 21 nt, Human
guggcagggucagugcccaca

SEQ ID NO: 231336 - RNA, 23 nt, Human
uacugaacugacaaguggguuuu

SEQ ID NO: 231337 - RNA, 27 nt, Human
uagaauggccaaucgucuaaacaagug

SEQ ID NO: 231338 - RNA, 20 nt, Human
uauaggggguaacuaauuaa

SEQ ID NO: 231339 - RNA, 22 nt, Human
ucacuaaaaugacuccuuucau

SEQ ID NO: 231340 - RNA, 25 nt, Human
ucccagcacuggggcuggggcggag

SEQ ID NO: 231341 - RNA, 21 nt, Human
uccccagagacccugccuccg

SEQ ID NO: 231342 - RNA, 19 nt, Human
uccccagcugccacaaccg

SEQ ID NO: 231343 - RNA, 19 nt, Human
ucccucuguaccccccgac

SEQ ID NO: 231344 - RNA, 25 nt, Human
ucccucuguaccccccgacaguccc

SEQ ID NO: 231345 - RNA, 21 nt, Human
uccguggccuccaccucuggg

SEQ ID NO: 231346 - RNA, 20 nt, Human
ucgccagaguuggcauccag

SEQ ID NO: 231347 - RNA, 21 nt, Human
ugaaauaacuguuauuuccug

SEQ ID NO: 231348 - RNA, 19 nt, Human
ugaauuaaaugguuuggag

SEQ ID NO: 231349 - RNA, 23 nt, Human
ugacaaacucaccaacuuuagaa

SEQ ID NO: 231350 - RNA, 20 nt, Human
ugaccacagagcaacugaau

SEQ ID NO: 231351 - RNA, 20 nt, Human
ugacugaacuaaccuguggg

SEQ ID NO: 231352 - RNA, 21 nt, Human
ugagacacugaaggggaaaga

SEQ ID NO: 231353 - RNA, 18 nt, Human
ugagcagcucacaggccc

SEQ ID NO: 231354 - RNA, 22 nt, Human
ugaugacaacucuucagcagaa

SEQ ID NO: 231355 - RNA, 21 nt, Human
ugccacaaccgccaugacccc

SEQ ID NO: 231356 - RNA, 21 nt, Human
ugccagggagcucuugcagag

SEQ ID NO: 231357 - RNA, 21 nt, Human
ugccuggagcagggcagagaa

SEQ ID NO: 231358 - RNA, 21 nt, Human
ugcuaugcagccacacugacc

SEQ ID NO: 231359 - RNA, 23 nt, Human
uggcagggucagugcccacaagg

SEQ ID NO: 231360 - RNA, 22 nt, Human
uugaagggacuguuuuaugaug

SEQ ID NO: 231361 - RNA, 18 nt, Human
uugcuuggcugaacugau

SEQ ID NO: 231362 - RNA, 19 nt, Human
uuugucaguugcuuggcug

SEQ ID NO: 231363 - RNA, 24 nt, Human
uuuuacugaacugacaaguggguu

SEQ ID NO: 231364 - RNA, 21 nt, Human
aaaaaguccagugucuccuca

SEQ ID NO: 231365 - RNA, 21 nt, Human
aaaaauaaacaaaacccccaa

SEQ ID NO: 231366 - RNA, 18 nt, Human
aaacaaaacaaaacagga

SEQ ID NO: 231367 - RNA, 23 nt, Human
aaacaaaacaggagugacuuugg

SEQ ID NO: 231368 - RNA, 25 nt, Human
aaacaaaccgaaaaagcauggcuca

SEQ ID NO: 231369 - RNA, 19 nt, Human
aaacacaauauuaauauug

SEQ ID NO: 231370 - RNA, 18 nt, Human
aaacagcccagcagaggg

SEQ ID NO: 231371 - RNA, 19 nt, Human
aaacccccaaagaaaaaca

SEQ ID NO: 231372 - RNA, 24 nt, Human
aaacccccaaagaaaaacaaaaca

SEQ ID NO: 231373 - RNA, 21 nt, Human
aaauaaaaacaaaccgaaaaa

SEQ ID NO: 231374 - RNA, 21 nt, Human
aacagcgaguggcacuucccc

SEQ ID NO: 231375 - RNA, 23 nt, Human
aaccccaccuccaggacccucug

SEQ ID NO: 231376 - RNA, 18 nt, Human
aacccccaaagaaaaaca

SEQ ID NO: 231377 - RNA, 19 nt, Human
aagcaggcaagaaccagag

SEQ ID NO: 231378 - RNA, 20 nt, Human
aagcauccagaacauccuaa

SEQ ID NO: 231379 - RNA, 21 nt, Human
aagcauccagaacauccuaaa

SEQ ID NO: 231380 - RNA, 18 nt, Human
aagcauggcucaauuuug

SEQ ID NO: 231381 - RNA, 26 nt, Human
aaugcaggguuguggggcagagaggg

SEQ ID NO: 231382 - RNA, 18 nt, Human
acaaaacaaaacaggagu

SEQ ID NO: 231383 - RNA, 26 nt, Human
acaaaacccccaaagaaaaacaaaac

SEQ ID NO: 231384 - RNA, 24 nt, Human
acagugaagcaggcaagaaccaga

SEQ ID NO: 231385 - RNA, 21 nt, Human
acccccaaagaaaaacaaaac

SEQ ID NO: 231386 - RNA, 27 nt, Human
acccccaaagaaaaacaaaacaaaaca

SEQ ID NO: 231387 - RNA, 23 nt, Human
acuccaccucccgcgcuccaagc

SEQ ID NO: 231388 - RNA, 25 nt, Human
acucucuuggccgugacugccgcca

SEQ ID NO: 231389 - RNA, 21 nt, Human
agaaaaacaaaacaaaacagg

SEQ ID NO: 231390 - RNA, 22 nt, Human
aggacccucugguuacaauguc

SEQ ID NO: 231391 - RNA, 19 nt, Human
aguggugggcuucuuggug

SEQ ID NO: 231392 - RNA, 23 nt, Human
auaaaaacaaaccgaaaaagcau

SEQ ID NO: 231393 - RNA, 19 nt, Human
auccagaacauccuaaagc

SEQ ID NO: 231394 - RNA, 19 nt, Human
auccagaacauccuaaagc

SEQ ID NO: 231395 - RNA, 18 nt, Human
auccuaaagcccugcccu

SEQ ID NO: 231396 - RNA, 18 nt, Human
augaaucagucacugcca

SEQ ID NO: 231397 - RNA, 22 nt, Human
caaaacaaaacaggagugacuu

SEQ ID NO: 231398 - RNA, 24 nt, Human
caaaacaaaacaggagugacuuug

SEQ ID NO: 231399 - RNA, 22 nt, Human
caaaacccccaaagaaaaacaa

SEQ ID NO: 231400 - RNA, 24 nt, Human
caaaacccccaaagaaaaacaaaa

SEQ ID NO: 231401 - RNA, 25 nt, Human
caaaacccccaaagaaaaacaaaac

SEQ ID NO: 231402 - RNA, 23 nt, Human
caacucaauacaaacagcccagc

SEQ ID NO: 231403 - RNA, 21 nt, Human
caagaaccagaggaacccaau

SEQ ID NO: 231404 - RNA, 20 nt, Human
caccucccgcgcuccaagcc

SEQ ID NO: 231405 - RNA, 20 nt, Human
caccucccgcgcuccaagcc

SEQ ID NO: 231406 - RNA, 20 nt, Human
cacugcugauagaggguggu

SEQ ID NO: 231407 - RNA, 18 nt, Human
cagaacauccuaaagccc

SEQ ID NO: 231408 - RNA, 24 nt, Human
cagcagaggguagggcauuaacuc

SEQ ID NO: 231409 - RNA, 24 nt, Human
cagcgaguggcacuuccccuacag

SEQ ID NO: 231410 - RNA, 18 nt, Human
cagggucccggcaggcgc

SEQ ID NO: 231411 - RNA, 18 nt, Human
cagggucccggcaggcgc

SEQ ID NO: 231412 - RNA, 19 nt, Human
cagggucccggcaggcgcu

SEQ ID NO: 231413 - RNA, 19 nt, Human
cagggucccggcaggcgcu

SEQ ID NO: 231414 - RNA, 21 nt, Human
caggguuguggggcagagagg

SEQ ID NO: 231415 - RNA, 23 nt, Human
caggucccaaagggagacugagg

SEQ ID NO: 231416 - RNA, 20 nt, Human
cauccagaacauccuaaagc

SEQ ID NO: 231417 - RNA, 19 nt, Human
caugaaucagucacugcca

SEQ ID NO: 231418 - RNA, 27 nt, Human
cauugcaacucaauacaaacagcccag

SEQ ID NO: 231419 - RNA, 28 nt, Human
cauugcaacucaauacaaacagcccagu

SEQ ID NO: 231420 - RNA, 22 nt, Human
ccaaagaaaaacaaaacaaaac

SEQ ID NO: 231421 - RNA, 23 nt, Human
ccaaagaaaaacaaaacaaaaca

SEQ ID NO: 231422 - RNA, 25 nt, Human
ccaaagaaaaacaaaacaaaacagg

SEQ ID NO: 231423 - RNA, 27 nt, Human
ccagaacauccuaaagcccugcccuga

SEQ ID NO: 231424 - RNA, 21 nt, Human
ccagccccaaaaauaaacaaa

SEQ ID NO: 231425 - RNA, 21 nt, Human
ccagcuacauugcagggcaaa

SEQ ID NO: 231426 - RNA, 18 nt, Human
ccagugucuccucaaucu

SEQ ID NO: 231427 - RNA, 18 nt, Human
cccaaagaaaaacaaaac

SEQ ID NO: 231428 - RNA, 24 nt, Human
cccaucaaccccaccuccaggacc

SEQ ID NO: 231429 - RNA, 23 nt, Human
ccccaaaaauaaacaaaaccccc

SEQ ID NO: 231430 - RNA, 25 nt, Human
ccccaaagaaaaacaaaacaaaaca

SEQ ID NO: 231431 - RNA, 22 nt, Human
cccccaaagaaaaacaaaacaa

SEQ ID NO: 231432 - RNA, 24 nt, Human
cccccaaagaaaaacaaaacaaaa

SEQ ID NO: 231433 - RNA, 18 nt, Human
ccccgcaugggcaggggc

SEQ ID NO: 231434 - RNA, 18 nt, Human
ccccgcaugggcaggggc

SEQ ID NO: 231435 - RNA, 24 nt, Human
ccccgcaugggcaggggccugggu

SEQ ID NO: 231436 - RNA, 24 nt, Human
ccccgcaugggcaggggccugggu

SEQ ID NO: 231437 - RNA, 18 nt, Human
ccccuagaacccugacuu

SEQ ID NO: 231438 - RNA, 23 nt, Human
ccccuagaacccugacuucccuu

SEQ ID NO: 231439 - RNA, 22 nt, Human
ccccuggauucuggagaguagg

SEQ ID NO: 231440 - RNA, 21 nt, Human
cccggcccgggggacucuucc

SEQ ID NO: 231441 - RNA, 21 nt, Human
cccggcccgggggacucuucc

SEQ ID NO: 231442 - RNA, 22 nt, Human
cccggcccgggggacucuuccg

SEQ ID NO: 231443 - RNA, 22 nt, Human
cccuacagcaugucucccccua

SEQ ID NO: 231444 - RNA, 22 nt, Human
cccucguaauuccgcagucccc

SEQ ID NO: 231445 - RNA, 19 nt, Human
cccuucuuccucuuccucc

SEQ ID NO: 231446 - RNA, 19 nt, Human
cccuucuuccucuuccucc

SEQ ID NO: 231447 - RNA, 24 nt, Human
cccuugauuucccauucuugaaga

SEQ ID NO: 231448 - RNA, 28 nt, Human
ccgccggggccgacuccaccucccgcgc

SEQ ID NO: 231449 - RNA, 28 nt, Human
ccgccggggccgacuccaccucccgcgc

SEQ ID NO: 231450 - RNA, 23 nt, Human
ccgcugccuggagcugcucccgg

SEQ ID NO: 231451 - RNA, 23 nt, Human
ccgcugccuggagcugcucccgg

SEQ ID NO: 231452 - RNA, 22 nt, Human
ccuacccuuggacaggucccaa

SEQ ID NO: 231453 - RNA, 20 nt, Human
ccuccaggacccucugguua

SEQ ID NO: 231454 - RNA, 19 nt, Human
ccuccggggccgcugccug

SEQ ID NO: 231455 - RNA, 19 nt, Human
ccuccggggccgcugccug

SEQ ID NO: 231456 - RNA, 18 nt, Human
ccugacuucccuuucucc

SEQ ID NO: 231457 - RNA, 21 nt, Human
ccugacuucccuuucucccca

SEQ ID NO: 231458 - RNA, 22 nt, Human
cgaauaaccccuagaacccuga

SEQ ID NO: 231459 - RNA, 23 nt, Human
cgacaggugcuuuacaaacggcu

SEQ ID NO: 231460 - RNA, 21 nt, Human
cgauucgucccuucagggcaa

SEQ ID NO: 231461 - RNA, 21 nt, Human
cgauucgucccuucagggcaa

SEQ ID NO: 231462 - RNA, 18 nt, Human
cgccuacgaggcgcaggg

SEQ ID NO: 231463 - RNA, 18 nt, Human
cgccuacgaggcgcaggg

SEQ ID NO: 231464 - RNA, 18 nt, Human
cgugacugccgccaggca

SEQ ID NO: 231465 - RNA, 24 nt, Human
cucccggcccgggggacucuuccg

SEQ ID NO: 231466 - RNA, 23 nt, Human
cucucagaaguggcaaucccuaa

SEQ ID NO: 231467 - RNA, 23 nt, Human
cucucagaaguggcaaucccuaa

SEQ ID NO: 231468 - RNA, 20 nt, Human
cugacuucccuuucucccca

SEQ ID NO: 231469 - RNA, 21 nt, Human
cugccaauagaaaaugugacc

SEQ ID NO: 231470 - RNA, 19 nt, Human
cuuccugggccacugcuga

SEQ ID NO: 231471 - RNA, 19 nt, Human
gaaaguucuucgaaaggcc

SEQ ID NO: 231472 - RNA, 21 nt, Human
gaauaaccccuagaacccuga

SEQ ID NO: 231473 - RNA, 24 nt, Human
gacuccaccucccgcgcuccaagc

SEQ ID NO: 231474 - RNA, 18 nt, Human
gauaaauaaaaacaaacc

SEQ ID NO: 231475 - RNA, 20 nt, Human
gcagagagggacuggcugga

SEQ ID NO: 231476 - RNA, 23 nt, Human
gcugcauagcuaaccucugggaa

SEQ ID NO: 231477 - RNA, 18 nt, Human
ggacaggucccaaaggga

SEQ ID NO: 231478 - RNA, 23 nt, Human
ggagcaugaaguccucggccucc

SEQ ID NO: 231479 - RNA, 23 nt, Human
ggagcaugaaguccucggccucc

SEQ ID NO: 231480 - RNA, 18 nt, Human
ggagcugcucccggcccg

SEQ ID NO: 231481 - RNA, 18 nt, Human
ggagcugcucccggcccg

SEQ ID NO: 231482 - RNA, 18 nt, Human
ggcaggggccugggucag

SEQ ID NO: 231483 - RNA, 21 nt, Human
ggccugggucagccucggguu

SEQ ID NO: 231484 - RNA, 21 nt, Human
ggccugggucagccucggguu

SEQ ID NO: 231485 - RNA, 18 nt, Human
gggcagggccugcccgcg

SEQ ID NO: 231486 - RNA, 18 nt, Human
gggcagggccugcccgcg

SEQ ID NO: 231487 - RNA, 20 nt, Human
gggcaggggccugggucagc

SEQ ID NO: 231488 - RNA, 19 nt, Human
gggccugggucagccucgg

SEQ ID NO: 231489 - RNA, 19 nt, Human
gggccugggucagccucgg

SEQ ID NO: 231490 - RNA, 21 nt, Human
ggucagggucccggcaggcgc

SEQ ID NO: 231491 - RNA, 21 nt, Human
ggucagggucccggcaggcgc

SEQ ID NO: 231492 - RNA, 18 nt, Human
gguuguggggcagagagg

SEQ ID NO: 231493 - RNA, 25 nt, Human
gugaagcaggcaagaaccagaggaa

SEQ ID NO: 231494 - RNA, 19 nt, Human
gugaaucuucagaacuggg

SEQ ID NO: 231495 - RNA, 24 nt, Human
uaaacaaaacccccaaagaaaaac

SEQ ID NO: 231496 - RNA, 25 nt, Human
uaaacaaaacccccaaagaaaaaca

SEQ ID NO: 231497 - RNA, 23 nt, Human
uaaagaaaauggguaaaaagucc

SEQ ID NO: 231498 - RNA, 24 nt, Human
uaaccccuagaacccugacuuccc

SEQ ID NO: 231499 - RNA, 21 nt, Human
uagaucaucgguuugcccucc

SEQ ID NO: 231500 - RNA, 18 nt, Human
uagguucuuggccgugac

SEQ ID NO: 231501 - RNA, 22 nt, Human
uaugaugggaagcauaauuauu

SEQ ID NO: 231502 - RNA, 21 nt, Human
uauuaaaaagcauccagaaca

SEQ ID NO: 231503 - RNA, 21 nt, Human
uccacagugaagcaggcaaga

SEQ ID NO: 231504 - RNA, 23 nt, Human
uccacagugaagcaggcaagaac

SEQ ID NO: 231505 - RNA, 18 nt, Human
ucccauccacagugaagc

SEQ ID NO: 231506 - RNA, 24 nt, Human
ucccuucuuccucuuccuccgggg

SEQ ID NO: 231507 - RNA, 27 nt, Human
ucccuucuuccucuuccuccggggcca

SEQ ID NO: 231508 - RNA, 22 nt, Human
uccuaaagcccugcccugaucu

SEQ ID NO: 231509 - RNA, 22 nt, Human
ucgcuggucacauugcaacuca

SEQ ID NO: 231510 - RNA, 19 nt, Human
ucuaggugggcugcauagc

SEQ ID NO: 231511 - RNA, 22 nt, Human
ucucuuggccgugacugccgcc

SEQ ID NO: 231512 - RNA, 18 nt, Human
ucuguagugagggcagcu

SEQ ID NO: 231513 - RNA, 27 nt, Human
ucuguagugagggcagcuuggcugggc

SEQ ID NO: 231514 - RNA, 23 nt, Human
ugaaguccucggccucccucaua

SEQ ID NO: 231515 - RNA, 23 nt, Human
ugaaguccucggccucccucaua

SEQ ID NO: 231516 - RNA, 20 nt, Human
ugagcacugucccuucuucc

SEQ ID NO: 231517 - RNA, 20 nt, Human
ugagcacugucccuucuucc

SEQ ID NO: 231518 - RNA, 19 nt, Human
ugcauagcuaaccucuggg

SEQ ID NO: 231519 - RNA, 23 nt, Human
ugccagccccaaaaauaaacaaa

SEQ ID NO: 231520 - RNA, 19 nt, Human
ugcccugaucuuguggcuu

SEQ ID NO: 231521 - RNA, 19 nt, Human
ugccuggagcugcucccgg

SEQ ID NO: 231522 - RNA, 19 nt, Human
ugccuggagcugcucccgg

SEQ ID NO: 231523 - RNA, 19 nt, Human
ugggaaugcaggguugugg

SEQ ID NO: 231524 - RNA, 21 nt, Human
ugggucagccucggguugggu

SEQ ID NO: 231525 - RNA, 21 nt, Human
ugggucagccucggguugggu

SEQ ID NO: 231526 - RNA, 21 nt, Human
ugguagaggcagcugauuuuc

SEQ ID NO: 231527 - RNA, 29 nt, Human
ugguagaggcagcugauuuuccucccggg

SEQ ID NO: 231528 - RNA, 22 nt, Human
uguaaacacaauauuaauauug

SEQ ID NO: 231529 - RNA, 20 nt, Human
uguggcuuugcaguaagaug

SEQ ID NO: 231530 - RNA, 21 nt, Human
uguggggcagagagggacugg

SEQ ID NO: 231531 - RNA, 20 nt, Human
ugugugaaggugaagguggu

SEQ ID NO: 231532 - RNA, 22 nt, Human
uuaaauaucggccgaagaugcu

SEQ ID NO: 231533 - RNA, 22 nt, Human
uuaauauugaagauuaaagaaa

SEQ ID NO: 231534 - RNA, 20 nt, Human
uucuuaauguagguucuugg

SEQ ID NO: 231535 - RNA, 24 nt, Human
uucuugaagagacucaucuaggug

SEQ ID NO: 231536 - RNA, 21 nt, Human
uucuuggccgugacugccgcc

SEQ ID NO: 231537 - RNA, 21 nt, Human
uugaauuugaaggccgggccc

SEQ ID NO: 231538 - RNA, 26 nt, Human
aagaaaccaggauaaaucuccaaugg

SEQ ID NO: 231539 - RNA, 20 nt, Human
aaguacaccucauaaaagga

SEQ ID NO: 231540 - RNA, 24 nt, Human
acacccaaagaaagggaaaaaaaa

SEQ ID NO: 231541 - RNA, 18 nt, Human
acccuggcgaccuccaca

SEQ ID NO: 231542 - RNA, 21 nt, Human
agccaaucaguagacacaauc

SEQ ID NO: 231543 - RNA, 22 nt, Human
agcuaacuccauaaaugaauau

SEQ ID NO: 231544 - RNA, 31 nt, Human
cacuuuuauguucaucuuaaaaaccagaaag

SEQ ID NO: 231545 - RNA, 25 nt, Human
caucaugaaguucucuucauuuaaa

SEQ ID NO: 231546 - RNA, 19 nt, Human
caucuuaaaaaccagaaac

SEQ ID NO: 231547 - RNA, 24 nt, Human
cuuuucuuuuuuuaaaaaaaauac

SEQ ID NO: 231548 - RNA, 18 nt, Human
ggacacccaaagaaaggg

SEQ ID NO: 231549 - RNA, 23 nt, Human
guaguaguauuccuaagaaacca

SEQ ID NO: 231550 - RNA, 19 nt, Human
uaaaaagcuguuagguaca

SEQ ID NO: 231551 - RNA, 19 nt, Human
uaacuccauaaaugaauau

SEQ ID NO: 231552 - RNA, 22 nt, Human
uaagaaaccaggauaaaucucc

SEQ ID NO: 231553 - RNA, 21 nt, Human
uaauuaaagcuuuaaaaaguc

SEQ ID NO: 231554 - RNA, 22 nt, Human
uacugcuuauaaacuauugaua

SEQ ID NO: 231555 - RNA, 21 nt, Human
uagaaaugaaaucaaucuauu

SEQ ID NO: 231556 - RNA, 25 nt, Human
uagcaacaauuuguuuuuuaaaaag

SEQ ID NO: 231557 - RNA, 21 nt, Human
uagguccagccuaagguucug

SEQ ID NO: 231558 - RNA, 18 nt, Human
uagguccaggaaucaaag

SEQ ID NO: 231559 - RNA, 20 nt, Human
uauuccuaagaaaccaggag

SEQ ID NO: 231560 - RNA, 24 nt, Human
ucucuucauuuaaaaaaaaaaaaa

SEQ ID NO: 231561 - RNA, 18 nt, Human
uuggacacccaaagaaag

SEQ ID NO: 231562 - RNA, 20 nt, Human
aaaccaggauuagccuaaug

SEQ ID NO: 231563 - RNA, 22 nt, Human
aacaaugguggcauugccaucu

SEQ ID NO: 231564 - RNA, 18 nt, Human
aacugcugaacugcaggg

SEQ ID NO: 231565 - RNA, 20 nt, Human
aagagaccauucacuaccau

SEQ ID NO: 231566 - RNA, 18 nt, Human
acaggcucuggcugcggc

SEQ ID NO: 231567 - RNA, 20 nt, Human
acccccuccucaguagcuca

SEQ ID NO: 231568 - RNA, 18 nt, Human
agaccauucacuaccauc

SEQ ID NO: 231569 - RNA, 18 nt, Human
agagaccauucacuacca

SEQ ID NO: 231570 - RNA, 18 nt, Human
agauucuccccuaccuuc

SEQ ID NO: 231571 - RNA, 21 nt, Human
agcaguuccaaguggcuggca

SEQ ID NO: 231572 - RNA, 22 nt, Human
aggaaccagcacugccugccuu

SEQ ID NO: 231573 - RNA, 24 nt, Human
aggaaguggugccuugccugggaa

SEQ ID NO: 231574 - RNA, 24 nt, Human
aggcagagccauuucccagauccg

SEQ ID NO: 231575 - RNA, 18 nt, Human
aggggcacugcuccuucc

SEQ ID NO: 231576 - RNA, 21 nt, Human
agucaagacauuugucuuuuc

SEQ ID NO: 231577 - RNA, 24 nt, Human
agugguggggacacaggcagagga

SEQ ID NO: 231578 - RNA, 21 nt, Human
auauuucuccuuugcccagcu

SEQ ID NO: 231579 - RNA, 22 nt, Human
auccagccugaaggcaaagaga

SEQ ID NO: 231580 - RNA, 19 nt, Human
auccagcugggguugggga

SEQ ID NO: 231581 - RNA, 20 nt, Human
aucccaggccuggaaggagg

SEQ ID NO: 231582 - RNA, 19 nt, Human
caacccccuccucaguagc

SEQ ID NO: 231583 - RNA, 19 nt, Human
caacccccuccucaguagc

SEQ ID NO: 231584 - RNA, 22 nt, Human
caccggaggcaacaucuggggg

SEQ ID NO: 231585 - RNA, 19 nt, Human
cacugccgggccacggacc

SEQ ID NO: 231586 - RNA, 21 nt, Human
cacugcuccuuccugcuccca

SEQ ID NO: 231587 - RNA, 22 nt, Human
cacugcuccuuccugcucccac

SEQ ID NO: 231588 - RNA, 23 nt, Human
cacugcuccuuccugcucccacc

SEQ ID NO: 231589 - RNA, 19 nt, Human
cagcaccaggccacacuac

SEQ ID NO: 231590 - RNA, 19 nt, Human
cagcagugucucugauggc

SEQ ID NO: 231591 - RNA, 18 nt, Human
cagcucaccuucacccca

SEQ ID NO: 231592 - RNA, 23 nt, Human
caguguggguggggggugagggg

SEQ ID NO: 231593 - RNA, 22 nt, Human
caucuggggcccacaugagccc

SEQ ID NO: 231594 - RNA, 19 nt, Human
cauugcaccugaguccugc

SEQ ID NO: 231595 - RNA, 18 nt, Human
cauuugucuuuucccuuc

SEQ ID NO: 231596 - RNA, 18 nt, Human
ccacagcaggccugggag

SEQ ID NO: 231597 - RNA, 23 nt, Human
ccacagcaggccugggaggcaca

SEQ ID NO: 231598 - RNA, 19 nt, Human
ccaccagcagugucucuga

SEQ ID NO: 231599 - RNA, 25 nt, Human
ccagcagugucucugauggcuuccc

SEQ ID NO: 231600 - RNA, 20 nt, Human
ccauuccuggccaucuuccc

SEQ ID NO: 231601 - RNA, 23 nt, Human
ccauuccuggccaucuucccaac

SEQ ID NO: 231602 - RNA, 21 nt, Human
cccacaugagcccucuggggc

SEQ ID NO: 231603 - RNA, 20 nt, Human
cccagauccgcaggcuuccu

SEQ ID NO: 231604 - RNA, 18 nt, Human
ccugaguccugcaguucc

SEQ ID NO: 231605 - RNA, 22 nt, Human
cucacaggcucuggcugcggcc

SEQ ID NO: 231606 - RNA, 21 nt, Human
cucaccuucaccccagcacca

SEQ ID NO: 231607 - RNA, 22 nt, Human
cucuguggugagcuugcucuuc

SEQ ID NO: 231608 - RNA, 18 nt, Human
cugcaugacagagcuggg

SEQ ID NO: 231609 - RNA, 23 nt, Human
cugccugccuuuugauucaaagc

SEQ ID NO: 231610 - RNA, 19 nt, Human
cugcggccuccucuacucc

SEQ ID NO: 231611 - RNA, 19 nt, Human
cugcuccuuccugcuccca

SEQ ID NO: 231612 - RNA, 23 nt, Human
cugcuccuuccugcucccaccag

SEQ ID NO: 231613 - RNA, 20 nt, Human
cugguuccacuucacuacac

SEQ ID NO: 231614 - RNA, 19 nt, Human
gacuugcugcuccucauuc

SEQ ID NO: 231615 - RNA, 21 nt, Human
gagcuugcucuuccuaauaac

SEQ ID NO: 231616 - RNA, 20 nt, Human
gcugaacugcagggggacca

SEQ ID NO: 231617 - RNA, 22 nt, Human
ggacacaggcagaggaaccagc

SEQ ID NO: 231618 - RNA, 18 nt, Human
ggaggcacauccagcugg

SEQ ID NO: 231619 - RNA, 20 nt, Human
ggcuuccuggcugcucgagg

SEQ ID NO: 231620 - RNA, 19 nt, Human
gggccucaguuccacuccu

SEQ ID NO: 231621 - RNA, 20 nt, Human
ggguggggggugaggggcag

SEQ ID NO: 231622 - RNA, 19 nt, Human
gguggggggugaggggcag

SEQ ID NO: 231623 - RNA, 22 nt, Human
gguuggggaggacaggccugca

SEQ ID NO: 231624 - RNA, 21 nt, Human
gugaggggcaggauguccaac

SEQ ID NO: 231625 - RNA, 21 nt, Human
uacccaagggagugguuauga

SEQ ID NO: 231626 - RNA, 21 nt, Human
uaccugcaguguggguggggg

SEQ ID NO: 231627 - RNA, 20 nt, Human
uagauucuccccuaccuucc

SEQ ID NO: 231628 - RNA, 25 nt, Human
uagauuucuggcauuauaaaauggc

SEQ ID NO: 231629 - RNA, 23 nt, Human
ucagaagaucccuguguccauuu

SEQ ID NO: 231630 - RNA, 24 nt, Human
ucauaagccggaguaaaucccaga

SEQ ID NO: 231631 - RNA, 21 nt, Human
uccccuaccuucccucauuaa

SEQ ID NO: 231632 - RNA, 19 nt, Human
ucccuacugggcugcggug

SEQ ID NO: 231633 - RNA, 20 nt, Human
uccugcaguuccucaggcug

SEQ ID NO: 231634 - RNA, 22 nt, Human
ucuaccugcagugugggugggg

SEQ ID NO: 231635 - RNA, 21 nt, Human
ucuggggcccacaugagcccu

SEQ ID NO: 231636 - RNA, 22 nt, Human
ugaguccugcaguuccucaggc

SEQ ID NO: 231637 - RNA, 22 nt, Human
ugcccagcucaccuucacccca

SEQ ID NO: 231638 - RNA, 24 nt, Human
ugcccagcucaccuucaccccagc

SEQ ID NO: 231639 - RNA, 18 nt, Human
ugcgguggggcucugagg

SEQ ID NO: 231640 - RNA, 20 nt, Human
ugcgguggggcucugagguu

SEQ ID NO: 231641 - RNA, 20 nt, Human
ugcugacuucacauaaaacc

SEQ ID NO: 231642 - RNA, 20 nt, Human
ugcugcuccucauucaugug

SEQ ID NO: 231643 - RNA, 24 nt, Human
ugggaggcacauccagcugggguu

SEQ ID NO: 231644 - RNA, 19 nt, Human
ugggaucagauggccuccu

SEQ ID NO: 231645 - RNA, 23 nt, Human
uggggcucugagguugggaccag

SEQ ID NO: 231646 - RNA, 21 nt, Human
uucaccccagcaccaggccac

SEQ ID NO: 231647 - RNA, 21 nt, Human
uuggacaccggaggcaacauc

SEQ ID NO: 231648 - RNA, 18 nt, Human
uugucuuuucccuucccc

SEQ ID NO: 231649 - RNA, 19 nt, Human
uuucuggcauuauaaaaug

SEQ ID NO: 231650 - RNA, 25 nt, Human
aaagaagagcacggagaugggcgac

SEQ ID NO: 231651 - RNA, 25 nt, Human
aagcgcccccggggccgccgcccaa

SEQ ID NO: 231652 - RNA, 21 nt, Human
aagcggcgcccagcagcuccg

SEQ ID NO: 231653 - RNA, 18 nt, Human
accagcagcagcgaggcc

SEQ ID NO: 231654 - RNA, 19 nt, Human
accccgacagcgcgacggg

SEQ ID NO: 231655 - RNA, 18 nt, Human
accggcccgggguccgcg

SEQ ID NO: 231656 - RNA, 18 nt, Human
acgggggcggggccgagg

SEQ ID NO: 231657 - RNA, 18 nt, Human
agaggagcagaguuggag

SEQ ID NO: 231658 - RNA, 23 nt, Human
agccugggggcacccuggggcuc

SEQ ID NO: 231659 - RNA, 22 nt, Human
aggcaggaugagggggcggggu

SEQ ID NO: 231660 - RNA, 21 nt, Human
aggcggcaggggcccgggggc

SEQ ID NO: 231661 - RNA, 23 nt, Human
agggcagcagcagggccaggagg

SEQ ID NO: 231662 - RNA, 20 nt, Human
aggggcagggguccuggggg

SEQ ID NO: 231663 - RNA, 19 nt, Human
augggcgacaggcgcgcgg

SEQ ID NO: 231664 - RNA, 24 nt, Human
caagcgcccccggggccgccgccc

SEQ ID NO: 231665 - RNA, 25 nt, Human
caccagcagcagcgaggccucggcc

SEQ ID NO: 231666 - RNA, 18 nt, Human
cacuggcggccccagggc

SEQ ID NO: 231667 - RNA, 19 nt, Human
cagaguuggagggggugga

SEQ ID NO: 231668 - RNA, 21 nt, Human
cagcagcagcgaggccucggc

SEQ ID NO: 231669 - RNA, 19 nt, Human
cagcagcgaggccucggcc

SEQ ID NO: 231670 - RNA, 22 nt, Human
cagcagggcaggucggcggcuc

SEQ ID NO: 231671 - RNA, 21 nt, Human
cagggcaaugccccgcggccg

SEQ ID NO: 231672 - RNA, 20 nt, Human
cagggccaggaggaggaggg

SEQ ID NO: 231673 - RNA, 23 nt, Human
ccacucagggcaaugccccgcgg

SEQ ID NO: 231674 - RNA, 21 nt, Human
ccaggaggaggaggagguggu

SEQ ID NO: 231675 - RNA, 22 nt, Human
cccaagcggcgcccagcagcuc

SEQ ID NO: 231676 - RNA, 21 nt, Human
cccccagcuccuccacguggc

SEQ ID NO: 231677 - RNA, 19 nt, Human
cccccggggccgccgccca

SEQ ID NO: 231678 - RNA, 23 nt, Human
ccccggguuagcggcagccgcac

SEQ ID NO: 231679 - RNA, 26 nt, Human
cccgcggccgagacaggccggggucc

SEQ ID NO: 231680 - RNA, 26 nt, Human
cccgcggccgagacaggcuccgaggc

SEQ ID NO: 231681 - RNA, 23 nt, Human
cccgcuugcgccacgcucagcuc

SEQ ID NO: 231682 - RNA, 23 nt, Human
cccugcccgccccggguuagcgg

SEQ ID NO: 231683 - RNA, 22 nt, Human
cccuggcccgcuugcgccacgc

SEQ ID NO: 231684 - RNA, 22 nt, Human
cccuggggcucaucgcgcaguc

SEQ ID NO: 231685 - RNA, 23 nt, Human
cccuggggcucaucgcgcagucc

SEQ ID NO: 231686 - RNA, 18 nt, Human
ccgcacucguccaccacc

SEQ ID NO: 231687 - RNA, 20 nt, Human
ccgcagggaccuugcugcgg

SEQ ID NO: 231688 - RNA, 23 nt, Human
ccgccgccgccgccgcgaaacgc

SEQ ID NO: 231689 - RNA, 28 nt, Human
ccgccgccgccgcgaaacgcagcuccag

SEQ ID NO: 231690 - RNA, 20 nt, Human
ccgcgcccgcgcccuggccc

SEQ ID NO: 231691 - RNA, 19 nt, Human
ccgcgucccugcccgcccc

SEQ ID NO: 231692 - RNA, 24 nt, Human
ccggagccugggggcacccugggg

SEQ ID NO: 231693 - RNA, 24 nt, Human
ccggggcugccgccgccgccgccg

SEQ ID NO: 231694 - RNA, 22 nt, Human
ccgggugggcgcaccgcggucc

SEQ ID NO: 231695 - RNA, 18 nt, Human
ccugggggcacccugggg

SEQ ID NO: 231696 - RNA, 19 nt, Human
ccuggggggcguggccggg

SEQ ID NO: 231697 - RNA, 20 nt, Human
ccuggggggcguggccggga

SEQ ID NO: 231698 - RNA, 25 nt, Human
ccuggucuccugggggucccggcgu

SEQ ID NO: 231699 - RNA, 18 nt, Human
cgagggcagcagcagggc

SEQ ID NO: 231700 - RNA, 20 nt, Human
cgagggucaccagcagcagc

SEQ ID NO: 231701 - RNA, 23 nt, Human
cgcacgauguuuccggcgacccc

SEQ ID NO: 231702 - RNA, 24 nt, Human
cgcacucguccaccaccauguccu

SEQ ID NO: 231703 - RNA, 23 nt, Human
cgcccgcgguagccgacggagcc

SEQ ID NO: 231704 - RNA, 20 nt, Human
cgccgugcccgucgccugcg

SEQ ID NO: 231705 - RNA, 25 nt, Human
cgcgacgggcagcgcgcacugaccc

SEQ ID NO: 231706 - RNA, 22 nt, Human
cgcgccgcggccgggccagggg

SEQ ID NO: 231707 - RNA, 18 nt, Human
cgcgcgcagcacagcgug

SEQ ID NO: 231708 - RNA, 22 nt, Human
cgcggaagcucacguacagccg

SEQ ID NO: 231709 - RNA, 21 nt, Human
cgcggccgagacaggcuccga

SEQ ID NO: 231710 - RNA, 21 nt, Human
cgcgggcacgcagcagggcag

SEQ ID NO: 231711 - RNA, 20 nt, Human
cgcgugcaugagcgcgcgca

SEQ ID NO: 231712 - RNA, 26 nt, Human
cggaagcucacguacagccgccgcgc

SEQ ID NO: 231713 - RNA, 23 nt, Human
cggagccugggggcacccugggg

SEQ ID NO: 231714 - RNA, 19 nt, Human
cggccgagacaggcuccga

SEQ ID NO: 231715 - RNA, 19 nt, Human
cggcgucgcgccgcggccg

SEQ ID NO: 231716 - RNA, 19 nt, Human
cggcucgggcgcucagcgg

SEQ ID NO: 231717 - RNA, 18 nt, Human
cuagagccuggagcaggc

SEQ ID NO: 231718 - RNA, 21 nt, Human
cucagcucccagccgcccucc

SEQ ID NO: 231719 - RNA, 24 nt, Human
cuccacguggcacgguugcagggu

SEQ ID NO: 231720 - RNA, 19 nt, Human
cuccggggcugccgccgcc

SEQ ID NO: 231721 - RNA, 22 nt, Human
cucguccaccaccauguccuca

SEQ ID NO: 231722 - RNA, 24 nt, Human
cugagggcggggccgguguccccg

SEQ ID NO: 231723 - RNA, 19 nt, Human
gaccagagagugcgcaggg

SEQ ID NO: 231724 - RNA, 18 nt, Human
gacccagcggugccagcc

SEQ ID NO: 231725 - RNA, 18 nt, Human
gaccuggucuccuggggg

SEQ ID NO: 231726 - RNA, 22 nt, Human
gacuguccacucagggcaaugc

SEQ ID NO: 231727 - RNA, 22 nt, Human
gagacaggcuccgaggcccggg

SEQ ID NO: 231728 - RNA, 20 nt, Human
gagcagcaccggcccggggu

SEQ ID NO: 231729 - RNA, 21 nt, Human
gagcgcgcgcagcacagcgug

SEQ ID NO: 231730 - RNA, 24 nt, Human
gaggagcagaguuggagggggugg

SEQ ID NO: 231731 - RNA, 18 nt, Human
gaggaggaggagguggug

SEQ ID NO: 231732 - RNA, 20 nt, Human
gaggaggaggaggugguggc

SEQ ID NO: 231733 - RNA, 18 nt, Human
gaggggcagggguccugg

SEQ ID NO: 231734 - RNA, 18 nt, Human
gcaaugccccgcggccga

SEQ ID NO: 231735 - RNA, 18 nt, Human
gcagcagcagggccagga

SEQ ID NO: 231736 - RNA, 21 nt, Human
gcccgggugggcgcaccgcgg

SEQ ID NO: 231737 - RNA, 18 nt, Human
gcccgucgccugcgcccg

SEQ ID NO: 231738 - RNA, 20 nt, Human
gccggguccacgggggcggg

SEQ ID NO: 231739 - RNA, 24 nt, Human
gccugcgcccgcccgcgguagccg

SEQ ID NO: 231740 - RNA, 19 nt, Human
gcgagcccaagcggcgccc

SEQ ID NO: 231741 - RNA, 18 nt, Human
gcgcacuggcggccccag

SEQ ID NO: 231742 - RNA, 18 nt, Human
gcgcgcgggcacgcagca

SEQ ID NO: 231743 - RNA, 19 nt, Human
gcgcggcgcgaugacccag

SEQ ID NO: 231744 - RNA, 18 nt, Human
gcggagcagcaccggccc

SEQ ID NO: 231745 - RNA, 18 nt, Human
gcggcaggggcccggggg

SEQ ID NO: 231746 - RNA, 21 nt, Human
gcuccgaggcccgggugggcg

SEQ ID NO: 231747 - RNA, 24 nt, Human
ggaaauggaggcaggaugaggggg

SEQ ID NO: 231748 - RNA, 20 nt, Human
ggaggaggaggagguggugg

SEQ ID NO: 231749 - RNA, 18 nt, Human
ggcagggguccugggggg

SEQ ID NO: 231750 - RNA, 18 nt, Human
ggcagggguccugggggg

SEQ ID NO: 231751 - RNA, 19 nt, Human
ggcagggguccuggggggc

SEQ ID NO: 231752 - RNA, 21 nt, Human
ggcccgcuugcgccacgcuca

SEQ ID NO: 231753 - RNA, 22 nt, Human
gggaaccggccggagccugggg

SEQ ID NO: 231754 - RNA, 25 nt, Human
gggcgcgggucaggggcagcgaggg

SEQ ID NO: 231755 - RNA, 22 nt, Human
gggcggccaaggacggggagcg

SEQ ID NO: 231756 - RNA, 25 nt, Human
gggcggcggcugggccugggggcaa

SEQ ID NO: 231757 - RNA, 19 nt, Human
ggggcggggucccagggga

SEQ ID NO: 231758 - RNA, 20 nt, Human
gggguccuggggggcguggc

SEQ ID NO: 231759 - RNA, 20 nt, Human
guccuggggggcguggccgg

SEQ ID NO: 231760 - RNA, 22 nt, Human
guugagcgccggcggccccccg

SEQ ID NO: 231761 - RNA, 23 nt, Human
uagaggagcagaguuggaggggg

SEQ ID NO: 231762 - RNA, 19 nt, Human
ucaaagaagagcacggaga

SEQ ID NO: 231763 - RNA, 22 nt, Human
uccacagccgacaggucgaaga

SEQ ID NO: 231764 - RNA, 18 nt, Human
ucccugcccgccccgggu

SEQ ID NO: 231765 - RNA, 19 nt, Human
uccgcgcgcacuggcggcc

SEQ ID NO: 231766 - RNA, 21 nt, Human
uccgcgcgcacuggcggcccc

SEQ ID NO: 231767 - RNA, 21 nt, Human
ucgaaacaggcgccacaugac

SEQ ID NO: 231768 - RNA, 24 nt, Human
ucgcgcaguccuagagccuggagc

SEQ ID NO: 231769 - RNA, 21 nt, Human
ugagcgcgcgcagcacagcgu

SEQ ID NO: 231770 - RNA, 20 nt, Human
uggggccggguccacggggg

SEQ ID NO: 231771 - RNA, 23 nt, Human
ugucaaagaagagcacggagaug

SEQ ID NO: 231772 - RNA, 21 nt, Human
uguccccggaggggcaggggu

SEQ ID NO: 231773 - RNA, 19 nt, Human
aaaaacaauggcgaagacc

SEQ ID NO: 231774 - RNA, 21 nt, Human
aaaagcaguagaaaggaugac

SEQ ID NO: 231775 - RNA, 21 nt, Human
aaacagcuggggccaaauucu

SEQ ID NO: 231776 - RNA, 26 nt, Human
aaccccuacccacagagagcugaggg

SEQ ID NO: 231777 - RNA, 23 nt, Human
aacucccaucauggaauugaaga

SEQ ID NO: 231778 - RNA, 25 nt, Human
aagaaggcaggauagagcuccagug

SEQ ID NO: 231779 - RNA, 23 nt, Human
aagaggccagagaaaggaggagg

SEQ ID NO: 231780 - RNA, 25 nt, Human
aagaggccagagaaaggaggaggca

SEQ ID NO: 231781 - RNA, 21 nt, Human
aagugacccuauagcgcaggg

SEQ ID NO: 231782 - RNA, 22 nt, Human
acaagcaaggagggaggaugca

SEQ ID NO: 231783 - RNA, 23 nt, Human
acagaauauaaccaacguccccc

SEQ ID NO: 231784 - RNA, 19 nt, Human
acccuggcucuggagguca

SEQ ID NO: 231785 - RNA, 20 nt, Human
acgaugguuguuauugagga

SEQ ID NO: 231786 - RNA, 19 nt, Human
agaaagguuagccuugguc

SEQ ID NO: 231787 - RNA, 20 nt, Human
agaacucuccucucacuuuc

SEQ ID NO: 231788 - RNA, 19 nt, Human
agaagagggaagggggaag

SEQ ID NO: 231789 - RNA, 20 nt, Human
agaauauaaccaacgucccc

SEQ ID NO: 231790 - RNA, 20 nt, Human
agagggaagggggaagaggc

SEQ ID NO: 231791 - RNA, 21 nt, Human
agagggaagggggaagaggcc

SEQ ID NO: 231792 - RNA, 21 nt, Human
agcuuaaagugacccuauagc

SEQ ID NO: 231793 - RNA, 22 nt, Human
aggagggaggaugcagagaacu

SEQ ID NO: 231794 - RNA, 21 nt, Human
aggcaaacagcuggggccaaa

SEQ ID NO: 231795 - RNA, 22 nt, Human
aggcccagaagauaugcagcag

SEQ ID NO: 231796 - RNA, 18 nt, Human
agggaagggggaagaggg

SEQ ID NO: 231797 - RNA, 19 nt, Human
caaaagcaguagaaaggau

SEQ ID NO: 231798 - RNA, 21 nt, Human
caacccuccgcucccggcccc

SEQ ID NO: 231799 - RNA, 19 nt, Human
cacagccgcguccacgccc

SEQ ID NO: 231800 - RNA, 19 nt, Human
caccagggugcaaugcagg

SEQ ID NO: 231801 - RNA, 18 nt, Human
cacccuccuccuacccuc

SEQ ID NO: 231802 - RNA, 18 nt, Human
cagaagauaugcagcagc

SEQ ID NO: 231803 - RNA, 20 nt, Human
cagaaugaggcccacagauu

SEQ ID NO: 231804 - RNA, 18 nt, Human
cagaccccaacccuccgc

SEQ ID NO: 231805 - RNA, 20 nt, Human
cagcccaagggccgggaggc

SEQ ID NO: 231806 - RNA, 20 nt, Human
caggauccagaagggcagga

SEQ ID NO: 231807 - RNA, 25 nt, Human
ccaacccuccgcucccggccccaca

SEQ ID NO: 231808 - RNA, 26 nt, Human
ccagaccccaacccuccgcucccggc

SEQ ID NO: 231809 - RNA, 23 nt, Human
ccauuaacaguacauuuuggucu

SEQ ID NO: 231810 - RNA, 20 nt, Human
cccacagccgcguccacgcc

SEQ ID NO: 231811 - RNA, 25 nt, Human
cccauuaacaguacauuuuggucua

SEQ ID NO: 231812 - RNA, 22 nt, Human
ccccaacccuccgcucccggcc

SEQ ID NO: 231813 - RNA, 28 nt, Human
ccccacagccgcguccacgcccgucacc

SEQ ID NO: 231814 - RNA, 20 nt, Human
ccccagagcuuaaagugacc

SEQ ID NO: 231815 - RNA, 19 nt, Human
cccccuaccuggggauagg

SEQ ID NO: 231816 - RNA, 22 nt, Human
ccccuucgccccggcgcgggag

SEQ ID NO: 231817 - RNA, 23 nt, Human
cccgagcccagccgggaaaaaaa

SEQ ID NO: 231818 - RNA, 22 nt, Human
cccgcccgccggcccgcgcccg

SEQ ID NO: 231819 - RNA, 18 nt, Human
cccgcccucgcccucccu

SEQ ID NO: 231820 - RNA, 19 nt, Human
cccgcgccucuccucccuc

SEQ ID NO: 231821 - RNA, 27 nt, Human
ccgcccgcccgccggcccgcgcccgcc

SEQ ID NO: 231822 - RNA, 21 nt, Human
ccgccggcgccgccgccgccg

SEQ ID NO: 231823 - RNA, 24 nt, Human
ccgccggcgccgccgccgccgccc

SEQ ID NO: 231824 - RNA, 25 nt, Human
ccgcgcccgcccucgcccucccucc

SEQ ID NO: 231825 - RNA, 19 nt, Human
ccucaaaagcaguagaaag

SEQ ID NO: 231826 - RNA, 21 nt, Human
ccuccuccuacccucaauucu

SEQ ID NO: 231827 - RNA, 21 nt, Human
ccucuccucccucuuccgccc

SEQ ID NO: 231828 - RNA, 24 nt, Human
ccuggcuccccgcgccucuccucc

SEQ ID NO: 231829 - RNA, 24 nt, Human
cgagcaguccccaguacagccccc

SEQ ID NO: 231830 - RNA, 22 nt, Human
cucacuuucuccuuuuucccca

SEQ ID NO: 231831 - RNA, 20 nt, Human
cucccccagcugcagccucc

SEQ ID NO: 231832 - RNA, 25 nt, Human
cuccucccucuuccgcccgcccgcc

SEQ ID NO: 231833 - RNA, 21 nt, Human
cucgcccucccuccuccgcca

SEQ ID NO: 231834 - RNA, 24 nt, Human
cucugagcucucuguuucuucccg

SEQ ID NO: 231835 - RNA, 23 nt, Human
cucugcgcugcggcugccccuuc

SEQ ID NO: 231836 - RNA, 21 nt, Human
cugagcucucuguuucuuccc

SEQ ID NO: 231837 - RNA, 21 nt, Human
cuggcuccccgcgccucuccu

SEQ ID NO: 231838 - RNA, 22 nt, Human
gacaauaaggcacaacccuggc

SEQ ID NO: 231839 - RNA, 22 nt, Human
gacgaugaagauguuguugcag

SEQ ID NO: 231840 - RNA, 22 nt, Human
gacgggaggggagggcggggcg

SEQ ID NO: 231841 - RNA, 22 nt, Human
gagcagcccaagggccgggagg

SEQ ID NO: 231842 - RNA, 18 nt, Human
gcaaugcaggauccagaa

SEQ ID NO: 231843 - RNA, 19 nt, Human
gccagagaaaggaggaggc

SEQ ID NO: 231844 - RNA, 19 nt, Human
gccagccgccggcgccgcc

SEQ ID NO: 231845 - RNA, 23 nt, Human
gccccgaggccuggcuccccgcg

SEQ ID NO: 231846 - RNA, 22 nt, Human
gccggcccgcgcccgcccucgc

SEQ ID NO: 231847 - RNA, 18 nt, Human
gcugcagccuccuccccc

SEQ ID NO: 231848 - RNA, 25 nt, Human
gcuuugguuucuggcccaaguuagg

SEQ ID NO: 231849 - RNA, 20 nt, Human
ggaagggggaagaggccaga

SEQ ID NO: 231850 - RNA, 19 nt, Human
ggccgggaggcugggcgug

SEQ ID NO: 231851 - RNA, 18 nt, Human
ggcggggccggggccgcu

SEQ ID NO: 231852 - RNA, 23 nt, Human
ggcugggcgugacgggaggggag

SEQ ID NO: 231853 - RNA, 19 nt, Human
gggccgggaggcugggcgu

SEQ ID NO: 231854 - RNA, 26 nt, Human
gggcgggccucugcgcugcggcugcc

SEQ ID NO: 231855 - RNA, 23 nt, Human
guaguuccuuggcuuuaugcauu

SEQ ID NO: 231856 - RNA, 18 nt, Human
guggccauuggcuagggg

SEQ ID NO: 231857 - RNA, 19 nt, Human
uaaccaacgucccccuacc

SEQ ID NO: 231858 - RNA, 19 nt, Human
uaccuggggauaggcuggu

SEQ ID NO: 231859 - RNA, 18 nt, Human
uagaaaggaugacuuggc

SEQ ID NO: 231860 - RNA, 19 nt, Human
uagaaaggaugacuuggcg

SEQ ID NO: 231861 - RNA, 18 nt, Human
uagcgcagggagcggggu

SEQ ID NO: 231862 - RNA, 22 nt, Human
ucaaaggcaaacagcuggggcc

SEQ ID NO: 231863 - RNA, 22 nt, Human
ucaauucauuugugucauagag

SEQ ID NO: 231864 - RNA, 20 nt, Human
ucccccagcugcagccuccu

SEQ ID NO: 231865 - RNA, 19 nt, Human
uccccgcgccucuccuccc

SEQ ID NO: 231866 - RNA, 23 nt, Human
uccgaggccccgaggccuggcuc

SEQ ID NO: 231867 - RNA, 24 nt, Human
ucucacuuucuccuuuuuccccag

SEQ ID NO: 231868 - RNA, 18 nt, Human
ucuccucucacuuucucc

SEQ ID NO: 231869 - RNA, 21 nt, Human
ucucuguuucuucccggucac

SEQ ID NO: 231870 - RNA, 23 nt, Human
ucugcgcugcggcugccccuucg

SEQ ID NO: 231871 - RNA, 24 nt, Human
ugaaaugcuaggugcuagccguaa

SEQ ID NO: 231872 - RNA, 18 nt, Human
ugaagagaagagggaagg

SEQ ID NO: 231873 - RNA, 19 nt, Human
ugagguaggcccagaagau

SEQ ID NO: 231874 - RNA, 25 nt, Human
ugagguaggcccagaagauaugcag

SEQ ID NO: 231875 - RNA, 21 nt, Human
ugcgcugcggcugccccuucg

SEQ ID NO: 231876 - RNA, 20 nt, Human
ugcuagccguaauucuggcu

SEQ ID NO: 231877 - RNA, 19 nt, Human
uggaguaaugguucaguca

SEQ ID NO: 231878 - RNA, 21 nt, Human
uggcagagguaggguaagggu

SEQ ID NO: 231879 - RNA, 20 nt, Human
uggcgaagacgaugaagaug

SEQ ID NO: 231880 - RNA, 22 nt, Human
ugggacaauaaggcacaacccu

SEQ ID NO: 231881 - RNA, 19 nt, Human
ugggugacaagcaaggagg

SEQ ID NO: 231882 - RNA, 22 nt, Human
ugugcacccuccuccuacccuc

SEQ ID NO: 231883 - RNA, 27 nt, Human
uuaaaaccaaaaccccaaauauuuaau

SEQ ID NO: 231884 - RNA, 24 nt, Human
uuaugugcacccuccuccuacccu

SEQ ID NO: 231885 - RNA, 21 nt, Human
uuccccagagcuuaaagugac

SEQ ID NO: 231886 - RNA, 18 nt, Human
uucuaccagcuuuccagu

SEQ ID NO: 231887 - RNA, 24 nt, Human
aagaaaaaauggauauaaacaaaa

SEQ ID NO: 231888 - RNA, 26 nt, Human
aaguaaucgacggacuaauuuaaaac

SEQ ID NO: 231889 - RNA, 20 nt, Human
aauacaaauguagaaaauaa

SEQ ID NO: 231890 - RNA, 24 nt, Human
agcccucggcuucccuauuggccu

SEQ ID NO: 231891 - RNA, 18 nt, Human
aggcagcgaguggugggg

SEQ ID NO: 231892 - RNA, 21 nt, Human
ccccgggcggcggcgguggcg

SEQ ID NO: 231893 - RNA, 22 nt, Human
ccgggccucucgcgccgggaga

SEQ ID NO: 231894 - RNA, 20 nt, Human
ccgggcggcggcgguggcgu

SEQ ID NO: 231895 - RNA, 20 nt, Human
cggcucccgggccucucgcg

SEQ ID NO: 231896 - RNA, 20 nt, Human
cuccgggacccugaccuggg

SEQ ID NO: 231897 - RNA, 24 nt, Human
gcggcggcgguggcguggacggcg

SEQ ID NO: 231898 - RNA, 18 nt, Human
ggagcugcugcuggcccc

SEQ ID NO: 231899 - RNA, 24 nt, Human
ggccccgcagggacgggggagccc

SEQ ID NO: 231900 - RNA, 27 nt, Human
gggcgcggucuacacccucggggggaa

SEQ ID NO: 231901 - RNA, 18 nt, Human
gggcggcggcgguggcgg

SEQ ID NO: 231902 - RNA, 26 nt, Human
gggggagccccgggcggcggcggugg

SEQ ID NO: 231903 - RNA, 19 nt, Human
gguccugaaaagccuauug

SEQ ID NO: 231904 - RNA, 18 nt, Human
gguggcguggacggcgac

SEQ ID NO: 231905 - RNA, 24 nt, Human
guuuucuuggugaagagcagaauu

SEQ ID NO: 231906 - RNA, 18 nt, Human
uaaaacaaaacagcccuc

SEQ ID NO: 231907 - RNA, 24 nt, Human
uagagaaccuaaaauuuuccaaag

SEQ ID NO: 231908 - RNA, 27 nt, Human
uagagaaccuaaaauuuuccaaagucu

SEQ ID NO: 231909 - RNA, 20 nt, Human
uauaaacaaaauaagugcuc

SEQ ID NO: 231910 - RNA, 23 nt, Human
uauagagaaccuaaaauuuucca

SEQ ID NO: 231911 - RNA, 21 nt, Human
uauuuaaaaaaaaaaacuguc

SEQ ID NO: 231912 - RNA, 25 nt, Human
ucccgggccucucgcgccgggagga

SEQ ID NO: 231913 - RNA, 26 nt, Human
uccugaaaagccuauugaccauuggg

SEQ ID NO: 231914 - RNA, 18 nt, Human
ugaaaagccuauugaaag

SEQ ID NO: 231915 - RNA, 18 nt, Human
ugaagagcagaauuucaa

SEQ ID NO: 231916 - RNA, 23 nt, Human
ugaagauuaucacucucuccagg

SEQ ID NO: 231917 - RNA, 18 nt, Human
ugaccugggaggcagcga

SEQ ID NO: 231918 - RNA, 21 nt, Human
ugagggcaccggcuccgggac

SEQ ID NO: 231919 - RNA, 22 nt, Human
ugauuugucaaaguuaaucccu

SEQ ID NO: 231920 - RNA, 23 nt, Human
uggagcugcugcuggccccgcag

SEQ ID NO: 231921 - RNA, 22 nt, Human
uggcuggagcugcugcuggccc

SEQ ID NO: 231922 - RNA, 23 nt, Human
ugugagggcaccggcuccgggac

SEQ ID NO: 231923 - RNA, 22 nt, Human
uugaaagcgaugcugaguccug

SEQ ID NO: 231924 - RNA, 23 nt, Human
uuuucaaaaguguccuguuuggg

SEQ ID NO: 231925 - RNA, 27 nt, Human
uuuugaaaauguucuuuccuuccauuu

SEQ ID NO: 231926 - RNA, 18 nt, Human
uuuuuuuuuuuuuuuucg

SEQ ID NO: 231927 - RNA, 21 nt, Human
uuuuuuuuuuuuuuuuucguu

SEQ ID NO: 231928 - RNA, 22 nt, Human
aaaaaauacaguauaaacugca

SEQ ID NO: 231929 - RNA, 21 nt, Human
aaaagaaaaaaaaaaguacag

SEQ ID NO: 231930 - RNA, 23 nt, Human
aaacacggcuauauuaaaagauc

SEQ ID NO: 231931 - RNA, 21 nt, Human
aaacaugucaaaaacaaacuu

SEQ ID NO: 231932 - RNA, 23 nt, Human
aaauaaacaugucaaaaacaaac

SEQ ID NO: 231933 - RNA, 19 nt, Human
aagcaaaauaaaaaaacug

SEQ ID NO: 231934 - RNA, 21 nt, Human
acaaugacaauuucacuaaaa

SEQ ID NO: 231935 - RNA, 19 nt, Human
acaccgcggagcguggaac

SEQ ID NO: 231936 - RNA, 21 nt, Human
acauucaaaauacuguacaaa

SEQ ID NO: 231937 - RNA, 23 nt, Human
accauauauuacaaaaaacuaag

SEQ ID NO: 231938 - RNA, 21 nt, Human
acccugucagugcaacaaaag

SEQ ID NO: 231939 - RNA, 21 nt, Human
accgaaacacaacuugaccug

SEQ ID NO: 231940 - RNA, 18 nt, Human
agaaaagcaaaauaaaaa

SEQ ID NO: 231941 - RNA, 18 nt, Human
agaaaagccagaagagca

SEQ ID NO: 231942 - RNA, 23 nt, Human
agaaaccauaaacaucaauagca

SEQ ID NO: 231943 - RNA, 24 nt, Human
agaugcaguagaaaauccccaaca

SEQ ID NO: 231944 - RNA, 21 nt, Human
aucacuuuucacuuucagcau

SEQ ID NO: 231945 - RNA, 22 nt, Human
augaacuuuuaaaaagucaaaa

SEQ ID NO: 231946 - RNA, 24 nt, Human
auguacuuuaaauggaacaguguu

SEQ ID NO: 231947 - RNA, 24 nt, Human
caaaaaaacaucaaaauuugaaaa

SEQ ID NO: 231948 - RNA, 20 nt, Human
caaaaaaaucugaagucacc

SEQ ID NO: 231949 - RNA, 26 nt, Human
caaaaagaaaaaaaaaaguacagacc

SEQ ID NO: 231950 - RNA, 18 nt, Human
cacacuauguuuauuaca

SEQ ID NO: 231951 - RNA, 21 nt, Human
cagaaaacgccaccacuuucu

SEQ ID NO: 231952 - RNA, 24 nt, Human
cagaaaccauaaacaucaauagca

SEQ ID NO: 231953 - RNA, 21 nt, Human
caguuguuuuuaagacagcac

SEQ ID NO: 231954 - RNA, 24 nt, Human
cauaaaaaauacaguauaaacugc

SEQ ID NO: 231955 - RNA, 22 nt, Human
cauuuuauuuucaacuuaaaac

SEQ ID NO: 231956 - RNA, 25 nt, Human
ccccaacaccgcggagcguggaaca

SEQ ID NO: 231957 - RNA, 24 nt, Human
ccugacucaaaaagaaaaaaaaaa

SEQ ID NO: 231958 - RNA, 22 nt, Human
ccugcaauugagguagcaaagc

SEQ ID NO: 231959 - RNA, 22 nt, Human
cgaaacacaacuugaccugcaa

SEQ ID NO: 231960 - RNA, 23 nt, Human
cgaaacacaacuugaccugcaac

SEQ ID NO: 231961 - RNA, 25 nt, Human
cgaaacacaacuugaccugcaaccu

SEQ ID NO: 231962 - RNA, 20 nt, Human
cuagaauuuaauugcuaaag

SEQ ID NO: 231963 - RNA, 20 nt, Human
cucaaaaagaaaaaaaaaag

SEQ ID NO: 231964 - RNA, 25 nt, Human
cuucaugacugcauuaacauaagcu

SEQ ID NO: 231965 - RNA, 23 nt, Human
cuucuauacaauagugaaugaau

SEQ ID NO: 231966 - RNA, 25 nt, Human
gaaaagccaacuggcaaaaaaacau

SEQ ID NO: 231967 - RNA, 21 nt, Human
gaaaauccccaacaccgcgga

SEQ ID NO: 231968 - RNA, 26 nt, Human
gggcucuuuucauuaccagggaaaga

SEQ ID NO: 231969 - RNA, 20 nt, Human
guagaaaagccagaagagca

SEQ ID NO: 231970 - RNA, 23 nt, Human
guugcuacauuuuauuuucaacu

SEQ ID NO: 231971 - RNA, 25 nt, Human
uaaaaaaacugcuugcacacauuag

SEQ ID NO: 231972 - RNA, 24 nt, Human
uaaaaagucaaaaauauauaaaaa

SEQ ID NO: 231973 - RNA, 21 nt, Human
uaaaagaaacgacuuuaaccc

SEQ ID NO: 231974 - RNA, 23 nt, Human
uaaacuaaaagaaacgacuuuaa

SEQ ID NO: 231975 - RNA, 24 nt, Human
uaaauauaaaggauacauaaaaaa

SEQ ID NO: 231976 - RNA, 18 nt, Human
uaacagcaucuucuauac

SEQ ID NO: 231977 - RNA, 19 nt, Human
uaagaaaagccaacuggca

SEQ ID NO: 231978 - RNA, 20 nt, Human
uaagcuaaguuacauacacu

SEQ ID NO: 231979 - RNA, 23 nt, Human
uaauucacauuacuuuacaaaau

SEQ ID NO: 231980 - RNA, 22 nt, Human
uacaaaaaaaucugaagucacc

SEQ ID NO: 231981 - RNA, 18 nt, Human
uagaaaauccccaacacc

SEQ ID NO: 231982 - RNA, 20 nt, Human
uagaaaauccccaacaccgc

SEQ ID NO: 231983 - RNA, 18 nt, Human
uagcugauauccagaaau

SEQ ID NO: 231984 - RNA, 22 nt, Human
uauuuuguagaaaagccagaag

SEQ ID NO: 231985 - RNA, 26 nt, Human
uauuuuguagaaaagccagaagagca

SEQ ID NO: 231986 - RNA, 22 nt, Human
uccuuuaagcagugucugcuaa

SEQ ID NO: 231987 - RNA, 23 nt, Human
ucuccuuuaagcagugucugcua

SEQ ID NO: 231988 - RNA, 24 nt, Human
ugagguuaagccaacugcuacaaa

SEQ ID NO: 231989 - RNA, 21 nt, Human
ugccaaauaaacaugucaaaa

SEQ ID NO: 231990 - RNA, 20 nt, Human
uguagaaaagccagaagagc

SEQ ID NO: 231991 - RNA, 18 nt, Human
uguuuauuacauuccccu

SEQ ID NO: 231992 - RNA, 24 nt, Human
uuaaaacccaaacauacacacuau

SEQ ID NO: 231993 - RNA, 23 nt, Human
uuaauugaaccccaaaaugcuga

SEQ ID NO: 231994 - RNA, 20 nt, Human
uuagugaauuugcuacuguu

SEQ ID NO: 231995 - RNA, 24 nt, Human
uuccuccccaaaagcuuccuuggu

SEQ ID NO: 231996 - RNA, 26 nt, Human
uuccuccccaaaagcuuccuuggugc

SEQ ID NO: 231997 - RNA, 18 nt, Human
uugaaccccaaaaugcug

SEQ ID NO: 231998 - RNA, 25 nt, Human
uuuguuaaaaagacaguuaguccug

SEQ ID NO: 231999 - RNA, 18 nt, Human
uuuucagauuaaggguug

SEQ ID NO: 232000 - RNA, 21 nt, Human
uuuuguagaaaagccagaaga

SEQ ID NO: 232001 - RNA, 18 nt, Human
agaggcggcugccaggag

SEQ ID NO: 232002 - RNA, 21 nt, Human
agagggaagaggcggcugcca

SEQ ID NO: 232003 - RNA, 19 nt, Human
aggaggcgggaguggcaga

SEQ ID NO: 232004 - RNA, 22 nt, Human
agggaagaggcggcugccagga

SEQ ID NO: 232005 - RNA, 19 nt, Human
cagcggcggguggaaggag

SEQ ID NO: 232006 - RNA, 19 nt, Human
cagcggcggguggaaggag

SEQ ID NO: 232007 - RNA, 18 nt, Human
cccucggcgguccggucc

SEQ ID NO: 232008 - RNA, 18 nt, Human
cgagagggaagaggcggc

SEQ ID NO: 232009 - RNA, 19 nt, Human
cgagggcuuccggggcggc

SEQ ID NO: 232010 - RNA, 19 nt, Human
cggacggcgcgggccaggc

SEQ ID NO: 232011 - RNA, 24 nt, Human
cggcccggccggccagccuggguu

SEQ ID NO: 232012 - RNA, 19 nt, Human
cggcgcgggccaggcagcg

SEQ ID NO: 232013 - RNA, 21 nt, Human
cggguggaaggaggccgcacu

SEQ ID NO: 232014 - RNA, 22 nt, Human
gacaggggaggaggcgggagug

SEQ ID NO: 232015 - RNA, 23 nt, Human
gagccgaguccggggacagggga

SEQ ID NO: 232016 - RNA, 19 nt, Human
gaggcgggaguggcagagg

SEQ ID NO: 232017 - RNA, 20 nt, Human
gaguggcagaggagguccca

SEQ ID NO: 232018 - RNA, 20 nt, Human
gcccagggcggcggaagacc

SEQ ID NO: 232019 - RNA, 21 nt, Human
gcccagggcggcggaagaccc

SEQ ID NO: 232020 - RNA, 24 nt, Human
gcggcucgggcgcggggaccagcc

SEQ ID NO: 232021 - RNA, 20 nt, Human
gcugguggcggccggcccgg

SEQ ID NO: 232022 - RNA, 21 nt, Human
ggagcccagggcggcggaaga

SEQ ID NO: 232023 - RNA, 18 nt, Human
ggccggccagccuggguu

SEQ ID NO: 232024 - RNA, 19 nt, Human
ggcgcgggccaggcagcgg

SEQ ID NO: 232025 - RNA, 22 nt, Human
ggcggaggccgcugguggcggc

SEQ ID NO: 232026 - RNA, 20 nt, Human
guggcggccggcccggccgg

SEQ ID NO: 232027 - RNA, 22 nt, Human
uggaaggaggccgcacugggca

SEQ ID NO: 232028 - RNA, 18 nt, Human
uggcagaggaggucccag

SEQ ID NO: 232029 - RNA, 21 nt, Human
uuuuuuuuuuuggggagaacc

SEQ ID NO: 232030 - RNA, 23 nt, Human
aggagagggggcgcagggcaggg

SEQ ID NO: 232031 - RNA, 23 nt, Human
aggagagggggcgcagggcaggg

SEQ ID NO: 232032 - RNA, 23 nt, Human
aggagccaagguguccccugccc

SEQ ID NO: 232033 - RNA, 22 nt, Human
aggcggggggugguaggaaggg

SEQ ID NO: 232034 - RNA, 22 nt, Human
aggcggggggugguaggaaggg

SEQ ID NO: 232035 - RNA, 23 nt, Human
agggcagggggaaggcggggggu

SEQ ID NO: 232036 - RNA, 23 nt, Human
agggcagggggaaggcggggggu

SEQ ID NO: 232037 - RNA, 21 nt, Human
cagccgcguucugcaggggug

SEQ ID NO: 232038 - RNA, 21 nt, Human
cagccgcguucugcaggggug

SEQ ID NO: 232039 - RNA, 20 nt, Human
cagggcagggggaaggcggg

SEQ ID NO: 232040 - RNA, 20 nt, Human
cagggcagggggaaggcggg

SEQ ID NO: 232041 - RNA, 21 nt, Human
cuccggagucugaguccacgg

SEQ ID NO: 232042 - RNA, 18 nt, Human
cuggauggugccguccuu

SEQ ID NO: 232043 - RNA, 18 nt, Human
cuggauggugccguccuu

SEQ ID NO: 232044 - RNA, 18 nt, Human
gcgcagggcagggggaag

SEQ ID NO: 232045 - RNA, 18 nt, Human
gcgcagggcagggggaag

SEQ ID NO: 232046 - RNA, 21 nt, Human
gcggggggugguaggaagggg

SEQ ID NO: 232047 - RNA, 21 nt, Human
gcggggggugguaggaagggg

SEQ ID NO: 232048 - RNA, 19 nt, Human
ggggaaggcgggggguggu

SEQ ID NO: 232049 - RNA, 19 nt, Human
ggggaaggcgggggguggu

SEQ ID NO: 232050 - RNA, 22 nt, Human
guccuuggcugcugaggagcca

SEQ ID NO: 232051 - RNA, 19 nt, Human
guccuugggcugcugagga

SEQ ID NO: 232052 - RNA, 20 nt, Human
ucugcagggguggggagcuu

SEQ ID NO: 232053 - RNA, 20 nt, Human
ucugcagggguggggagcuu

SEQ ID NO: 232054 - RNA, 20 nt, Human
ucuuuauggagaaccaggag

SEQ ID NO: 232055 - RNA, 20 nt, Human
ucuuuauggagaaccaggag

SEQ ID NO: 232056 - RNA, 18 nt, Human
ugaggagccaaggugucc

SEQ ID NO: 232057 - RNA, 19 nt, Human
ugguaggaaggggugcaga

SEQ ID NO: 232058 - RNA, 19 nt, Human
ugguaggaaggggugcaga

SEQ ID NO: 232059 - RNA, 21 nt, Human
ugguaggaaggggugcagcca

SEQ ID NO: 232060 - RNA, 21 nt, Human
ugguaggaaggggugcagcca

SEQ ID NO: 232061 - RNA, 20 nt, Human
uucugcagggguggggagcu

SEQ ID NO: 232062 - RNA, 20 nt, Human
uucugcagggguggggagcu

SEQ ID NO: 232063 - RNA, 18 nt, Human
aaaccaaccaauuuguau

SEQ ID NO: 232064 - RNA, 18 nt, Human
aaaccuauauauaggagg

SEQ ID NO: 232065 - RNA, 23 nt, Human
aaagucaugggaggcaggguagg

SEQ ID NO: 232066 - RNA, 21 nt, Human
aaccaaccaauuuguauucag

SEQ ID NO: 232067 - RNA, 22 nt, Human
aagcaaauaaaucaagaauaga

SEQ ID NO: 232068 - RNA, 18 nt, Human
aagcgagaaggguaccug

SEQ ID NO: 232069 - RNA, 19 nt, Human
aaguggcccagagacaagg

SEQ ID NO: 232070 - RNA, 27 nt, Human
aaucaucugaggcuacaguaaguucaa

SEQ ID NO: 232071 - RNA, 26 nt, Human
aaugacaaaucaucagccaggaaaga

SEQ ID NO: 232072 - RNA, 22 nt, Human
acagaaagaggggcuugcaaca

SEQ ID NO: 232073 - RNA, 23 nt, Human
acaggagaggcuacuuggcugca

SEQ ID NO: 232074 - RNA, 20 nt, Human
accaauuuguauucagaagc

SEQ ID NO: 232075 - RNA, 18 nt, Human
accaccacuaaagaagau

SEQ ID NO: 232076 - RNA, 24 nt, Human
accuaugagaccugcucaaauuca

SEQ ID NO: 232077 - RNA, 22 nt, Human
accucauugauggagcuuuuca

SEQ ID NO: 232078 - RNA, 22 nt, Human
acuccaaguggcccagagacaa

SEQ ID NO: 232079 - RNA, 19 nt, Human
agacaaggaccgccagaag

SEQ ID NO: 232080 - RNA, 24 nt, Human
agacuccugagacuucaacagcuu

SEQ ID NO: 232081 - RNA, 24 nt, Human
agagacaaggaccgccagaagaga

SEQ ID NO: 232082 - RNA, 21 nt, Human
aggaaaggcucugaugaugag

SEQ ID NO: 232083 - RNA, 20 nt, Human
aggaagaggggacagaaaga

SEQ ID NO: 232084 - RNA, 26 nt, Human
aggcaggaagugacuagaagggaccc

SEQ ID NO: 232085 - RNA, 18 nt, Human
aggcaggguaggaagagg

SEQ ID NO: 232086 - RNA, 21 nt, Human
agggcaggugugauguuuccc

SEQ ID NO: 232087 - RNA, 19 nt, Human
aggggacagaaagaggggc

SEQ ID NO: 232088 - RNA, 24 nt, Human
agguaacagaucuugcaggaaaaa

SEQ ID NO: 232089 - RNA, 20 nt, Human
agucaugggaggcaggguag

SEQ ID NO: 232090 - RNA, 21 nt, Human
augaggcuuacuucugcaggc

SEQ ID NO: 232091 - RNA, 19 nt, Human
auggccugacaacaaucag

SEQ ID NO: 232092 - RNA, 22 nt, Human
caaaaauacugguuaugggcug

SEQ ID NO: 232093 - RNA, 26 nt, Human
caaucugaagucaaaaccaaccaauu

SEQ ID NO: 232094 - RNA, 20 nt, Human
caccgccucccacccagccc

SEQ ID NO: 232095 - RNA, 23 nt, Human
cacugccaaggaacagauccaga

SEQ ID NO: 232096 - RNA, 24 nt, Human
cagaagcagcaaaaauacugguuu

SEQ ID NO: 232097 - RNA, 23 nt, Human
caggaaccccuucuuucugaucu

SEQ ID NO: 232098 - RNA, 23 nt, Human
caucugugccgggcagucaggag

SEQ ID NO: 232099 - RNA, 20 nt, Human
cauugguucacaauggccug

SEQ ID NO: 232100 - RNA, 19 nt, Human
ccacccagccccauuggcc

SEQ ID NO: 232101 - RNA, 22 nt, Human
ccacugcagcuucuauccuugg

SEQ ID NO: 232102 - RNA, 18 nt, Human
cccccggaaggcaugguu

SEQ ID NO: 232103 - RNA, 20 nt, Human
cccuggaguuuagggguggc

SEQ ID NO: 232104 - RNA, 18 nt, Human
ccgccucccacccagccc

SEQ ID NO: 232105 - RNA, 22 nt, Human
ccucccacccagccccauuggc

SEQ ID NO: 232106 - RNA, 22 nt, Human
ccuggcccucaucuugaacaaa

SEQ ID NO: 232107 - RNA, 19 nt, Human
ccugggaggcggagggggg

SEQ ID NO: 232108 - RNA, 18 nt, Human
cgccagaagagaugggcc

SEQ ID NO: 232109 - RNA, 18 nt, Human
cuaaagaagauaccucau

SEQ ID NO: 232110 - RNA, 22 nt, Human
cugccaaggaacagauccagag

SEQ ID NO: 232111 - RNA, 26 nt, Human
cuuucugaguccacugccaaggaaca

SEQ ID NO: 232112 - RNA, 22 nt, Human
cuuucuuccugggaggcggagg

SEQ ID NO: 232113 - RNA, 20 nt, Human
gagcaaagucaugggaggca

SEQ ID NO: 232114 - RNA, 20 nt, Human
gaggaaaggcucugaugaug

SEQ ID NO: 232115 - RNA, 19 nt, Human
gaggagcaaagucauggga

SEQ ID NO: 232116 - RNA, 18 nt, Human
gaggggacagaaagaggg

SEQ ID NO: 232117 - RNA, 19 nt, Human
gaugacauuugggacucca

SEQ ID NO: 232118 - RNA, 20 nt, Human
gaugaggcuuacuucugcag

SEQ ID NO: 232119 - RNA, 19 nt, Human
gauguuuccccuccuggcc

SEQ ID NO: 232120 - RNA, 24 nt, Human
gccacauguuggcuuucugagucc

SEQ ID NO: 232121 - RNA, 26 nt, Human
gcccccccggaaggcaugguuccaaa

SEQ ID NO: 232122 - RNA, 18 nt, Human
gcugaaggcucuagaggg

SEQ ID NO: 232123 - RNA, 23 nt, Human
ggagcaaagucaugggaggcagg

SEQ ID NO: 232124 - RNA, 22 nt, Human
ggaggagccacauguuggcuuu

SEQ ID NO: 232125 - RNA, 19 nt, Human
ggcugggaggagccacaug

SEQ ID NO: 232126 - RNA, 19 nt, Human
ggugcuauugauuggcaca

SEQ ID NO: 232127 - RNA, 19 nt, Human
guuuagggggaaauugcuc

SEQ ID NO: 232128 - RNA, 22 nt, Human
uaaguucaaucugaagucaaaa

SEQ ID NO: 232129 - RNA, 18 nt, Human
uacaggagaggcuacuug

SEQ ID NO: 232130 - RNA, 23 nt, Human
uaccaaaaaaguaaacauugaua

SEQ ID NO: 232131 - RNA, 20 nt, Human
uaccacaguaacuagaucuu

SEQ ID NO: 232132 - RNA, 21 nt, Human
uaccuggaaaauaacuucuuu

SEQ ID NO: 232133 - RNA, 21 nt, Human
uacuguucugguuuugcuuug

SEQ ID NO: 232134 - RNA, 20 nt, Human
uagagugucaccaaguugaa

SEQ ID NO: 232135 - RNA, 19 nt, Human
uagguguguguguauguga

SEQ ID NO: 232136 - RNA, 19 nt, Human
ucacaaggcaggaagugac

SEQ ID NO: 232137 - RNA, 21 nt, Human
ucuugcaggaaaaaagcuguc

SEQ ID NO: 232138 - RNA, 23 nt, Human
ucuuucuuuuccucuagauuuuc

SEQ ID NO: 232139 - RNA, 20 nt, Human
ugaagucaaaaccaaccaau

SEQ ID NO: 232140 - RNA, 19 nt, Human
ugacaaaucaucagccagg

SEQ ID NO: 232141 - RNA, 23 nt, Human
ugacagguauuagccauaccaca

SEQ ID NO: 232142 - RNA, 20 nt, Human
ugaccaggaaccccuucuuu

SEQ ID NO: 232143 - RNA, 23 nt, Human
ugacuagaaugacaaaucaucag

SEQ ID NO: 232144 - RNA, 22 nt, Human
ugaugacauuugggacuccagu

SEQ ID NO: 232145 - RNA, 19 nt, Human
ugauggagcuuuucaccau

SEQ ID NO: 232146 - RNA, 22 nt, Human
ugcaacagaucaaaugcugacc

SEQ ID NO: 232147 - RNA, 19 nt, Human
ugcaccgccucccacccag

SEQ ID NO: 232148 - RNA, 22 nt, Human
ugcaccgccucccacccagccc

SEQ ID NO: 232149 - RNA, 21 nt, Human
ugccaaggaacagauccagag

SEQ ID NO: 232150 - RNA, 21 nt, Human
ugccuggagaggcagaacccu

SEQ ID NO: 232151 - RNA, 22 nt, Human
uggcccagagacaaggaccgcc

SEQ ID NO: 232152 - RNA, 22 nt, Human
uggccuguugcuuuuuagccuu

SEQ ID NO: 232153 - RNA, 21 nt, Human
ugggaggagccacauguuggc

SEQ ID NO: 232154 - RNA, 24 nt, Human
ugggaggagccacauguuggcuuu

SEQ ID NO: 232155 - RNA, 18 nt, Human
ugggaggcaggguaggaa

SEQ ID NO: 232156 - RNA, 22 nt, Human
ugggaggcaggguaggaagagg

SEQ ID NO: 232157 - RNA, 23 nt, Human
ugggaggcggaggggggaaauca

SEQ ID NO: 232158 - RNA, 23 nt, Human
uggguguguggucacaaggcagg

SEQ ID NO: 232159 - RNA, 23 nt, Human
uguaugugaguaggggugcuauu

SEQ ID NO: 232160 - RNA, 19 nt, Human
uuaguuauagcuccaugcc

SEQ ID NO: 232161 - RNA, 21 nt, Human
uuccugggaggcggagggggg

SEQ ID NO: 232162 - RNA, 19 nt, Human
uugauggagcuuuucacca

SEQ ID NO: 232163 - RNA, 21 nt, Human
uugauuccgauuccauuacac

SEQ ID NO: 232164 - RNA, 27 nt, Human
acccuguggaacaccccuguuggaggg

SEQ ID NO: 232165 - RNA, 26 nt, Human
agagaagcucaaauccagagcucgga

SEQ ID NO: 232166 - RNA, 22 nt, Human
aggcaggaggacgguucauuug

SEQ ID NO: 232167 - RNA, 28 nt, Human
cacccaugggcagagaagcucaaaucca

SEQ ID NO: 232168 - RNA, 22 nt, Human
ccagaaagcaacggcuuccucu

SEQ ID NO: 232169 - RNA, 19 nt, Human
ccucugcgaacaaauaugg

SEQ ID NO: 232170 - RNA, 21 nt, Human
cgggaagaagcucacaagcug

SEQ ID NO: 232171 - RNA, 21 nt, Human
gaacaccccuguuggagccga

SEQ ID NO: 232172 - RNA, 22 nt, Human
guucauggggagggguucaguu

SEQ ID NO: 232173 - RNA, 21 nt, Human
uacccuguggaacaccccugu

SEQ ID NO: 232174 - RNA, 22 nt, Human
uacccuguggaacaccccuguu

SEQ ID NO: 232175 - RNA, 18 nt, Human
ucaaauccagagcucgga

SEQ ID NO: 232176 - RNA, 21 nt, Human
ucacaagcugagcaugggcgc

SEQ ID NO: 232177 - RNA, 19 nt, Human
ugagcaugggcgcuucacc

SEQ ID NO: 232178 - RNA, 25 nt, Human
ugccguagccagaucccagaaagca

SEQ ID NO: 232179 - RNA, 23 nt, Human
uguccauugaccaaggcugauug

SEQ ID NO: 232180 - RNA, 19 nt, Human
uguuuguccauugaccaag

SEQ ID NO: 232181 - RNA, 23 nt, Human
uuucugccguagccagaucccag

SEQ ID NO: 232182 - RNA, 26 nt, Human
aaacuuaaaacagcccuguuaaguuc

SEQ ID NO: 232183 - RNA, 28 nt, Human
aaucauucaagauuaaagucaucucuaa

SEQ ID NO: 232184 - RNA, 23 nt, Human
cacagacccacuagaccaguauc

SEQ ID NO: 232185 - RNA, 21 nt, Human
cagcagagucuaagacccuaa

SEQ ID NO: 232186 - RNA, 22 nt, Human
cucccuuaacaacccuuaacaa

SEQ ID NO: 232187 - RNA, 28 nt, Human
cuucucaaaugcccaaaugaacucugag

SEQ ID NO: 232188 - RNA, 18 nt, Human
gaguugauuucuucuuau

SEQ ID NO: 232189 - RNA, 21 nt, Human
gcaauggaguugauuucuucu

SEQ ID NO: 232190 - RNA, 21 nt, Human
gggcaggagaugauauugcag

SEQ ID NO: 232191 - RNA, 19 nt, Human
uaagugguucacagaccca

SEQ ID NO: 232192 - RNA, 24 nt, Human
uaaguucaauuaagugguucacag

SEQ ID NO: 232193 - RNA, 24 nt, Human
uagggagagcuugcagaagggcag

SEQ ID NO: 232194 - RNA, 22 nt, Human
ucagcaagucgaaaucauucaa

SEQ ID NO: 232195 - RNA, 23 nt, Human
ucccuuaacaacccuuaacaacu

SEQ ID NO: 232196 - RNA, 27 nt, Human
ucuggaaaacacaagaugugaagcuag

SEQ ID NO: 232197 - RNA, 22 nt, Human
ugcaauggaguugauuucuucu

SEQ ID NO: 232198 - RNA, 22 nt, Human
ugguucacagacccacuagacc

SEQ ID NO: 232199 - RNA, 23 nt, Human
uuuuugcucccuuaacaacccuu

SEQ ID NO: 232200 - RNA, 19 nt, Human
aaaaaacuuggagcuggga

SEQ ID NO: 232201 - RNA, 20 nt, Human
aaaaaacuuggagcugggau

SEQ ID NO: 232202 - RNA, 20 nt, Human
aaccugggagaacugagggg

SEQ ID NO: 232203 - RNA, 24 nt, Human
aaguggcagcagggaggaggggcc

SEQ ID NO: 232204 - RNA, 22 nt, Human
acucaaacacacacgcagcgcc

SEQ ID NO: 232205 - RNA, 21 nt, Human
acuuugaggaacaaccuggga

SEQ ID NO: 232206 - RNA, 23 nt, Human
agaggccaggcccagcccagggc

SEQ ID NO: 232207 - RNA, 23 nt, Human
agcagggaggaggggcccagagc

SEQ ID NO: 232208 - RNA, 20 nt, Human
aggcagagcacuggguggcc

SEQ ID NO: 232209 - RNA, 21 nt, Human
aggggggaaaggcguugccgu

SEQ ID NO: 232210 - RNA, 24 nt, Human
agggguggggcagguaggcagagc

SEQ ID NO: 232211 - RNA, 23 nt, Human
augaguacccccucccccuaaaa

SEQ ID NO: 232212 - RNA, 22 nt, Human
caacgaagccccguaacuuuaa

SEQ ID NO: 232213 - RNA, 19 nt, Human
caagcccagaggaguccug

SEQ ID NO: 232214 - RNA, 25 nt, Human
cacucacucacacucgcacacucaa

SEQ ID NO: 232215 - RNA, 22 nt, Human
cacugggccgggggccgggggc

SEQ ID NO: 232216 - RNA, 23 nt, Human
cacugggggggcaaaucuuggca

SEQ ID NO: 232217 - RNA, 18 nt, Human
cagccucggcccgccccg

SEQ ID NO: 232218 - RNA, 19 nt, Human
caggagaggcaggacccgg

SEQ ID NO: 232219 - RNA, 21 nt, Human
caggagaggcaggacccggca

SEQ ID NO: 232220 - RNA, 24 nt, Human
cccccuaaaaggcucuguagaggc

SEQ ID NO: 232221 - RNA, 21 nt, Human
ccccguaacuuuaagucccua

SEQ ID NO: 232222 - RNA, 19 nt, Human
cccgcccgcccuccccagg

SEQ ID NO: 232223 - RNA, 19 nt, Human
cccucuauuaccagcugcc

SEQ ID NO: 232224 - RNA, 21 nt, Human
cccugaagcggguggauggag

SEQ ID NO: 232225 - RNA, 21 nt, Human
cccuggggcugugaggggugg

SEQ ID NO: 232226 - RNA, 23 nt, Human
ccgcacaaagacucgcacgcaca

SEQ ID NO: 232227 - RNA, 21 nt, Human
ccgccgccgccucuugcugcc

SEQ ID NO: 232228 - RNA, 22 nt, Human
ccgccgccgccucuugcugccu

SEQ ID NO: 232229 - RNA, 26 nt, Human
ccggcacucacacucacucacacucg

SEQ ID NO: 232230 - RNA, 19 nt, Human
ccuccgagcagcccgcccg

SEQ ID NO: 232231 - RNA, 25 nt, Human
ccucuugcugccucugccuccgagc

SEQ ID NO: 232232 - RNA, 20 nt, Human
ccuggggggcggggggccgc

SEQ ID NO: 232233 - RNA, 21 nt, Human
ccuucucggcucuccccgccg

SEQ ID NO: 232234 - RNA, 20 nt, Human
cgcacgcacagccucggccc

SEQ ID NO: 232235 - RNA, 24 nt, Human
cgccggccgcacaaagacucgcac

SEQ ID NO: 232236 - RNA, 20 nt, Human
cggcucuccccgccgccgcc

SEQ ID NO: 232237 - RNA, 18 nt, Human
cuccccaggccaccgggc

SEQ ID NO: 232238 - RNA, 21 nt, Human
cucccccuaaaaggcucugua

SEQ ID NO: 232239 - RNA, 24 nt, Human
cuccgagcagcccgcccgcccucc

SEQ ID NO: 232240 - RNA, 20 nt, Human
cuguagaggccaggcccagc

SEQ ID NO: 232241 - RNA, 19 nt, Human
cugucuucugcucccuggg

SEQ ID NO: 232242 - RNA, 26 nt, Human
cuucucggcucuccccgccgccgccu

SEQ ID NO: 232243 - RNA, 25 nt, Human
gacccggcacucacacucacucaca

SEQ ID NO: 232244 - RNA, 19 nt, Human
gagcagcccgcccgcccuc

SEQ ID NO: 232245 - RNA, 19 nt, Human
gcaagguuucccucaacaa

SEQ ID NO: 232246 - RNA, 19 nt, Human
gcagcagggaggaggggcc

SEQ ID NO: 232247 - RNA, 21 nt, Human
gcccgcccuccccaggccacc

SEQ ID NO: 232248 - RNA, 19 nt, Human
gcccuccccaggccaccgg

SEQ ID NO: 232249 - RNA, 19 nt, Human
gcccugggggguggucagg

SEQ ID NO: 232250 - RNA, 21 nt, Human
ggagcgacugcaagcccagag

SEQ ID NO: 232251 - RNA, 19 nt, Human
ggaggaggggcccagagcu

SEQ ID NO: 232252 - RNA, 22 nt, Human
ggauaaguggcagcagggagga

SEQ ID NO: 232253 - RNA, 18 nt, Human
ggauggaaggggggaaag

SEQ ID NO: 232254 - RNA, 23 nt, Human
ggcaggacccggcacucacacuc

SEQ ID NO: 232255 - RNA, 20 nt, Human
ggcccagagcuuuaccccuc

SEQ ID NO: 232256 - RNA, 19 nt, Human
ggccuggggggcggggggc

SEQ ID NO: 232257 - RNA, 19 nt, Human
gggaggaggggcccagagc

SEQ ID NO: 232258 - RNA, 19 nt, Human
gggauggaaggggggaaag

SEQ ID NO: 232259 - RNA, 20 nt, Human
ggggggaaaggcguugccgu

SEQ ID NO: 232260 - RNA, 18 nt, Human
guauagacaaccccaggc

SEQ ID NO: 232261 - RNA, 20 nt, Human
ucacacucacucacacucgc

SEQ ID NO: 232262 - RNA, 22 nt, Human
ucagcagcucaugucccgagug

SEQ ID NO: 232263 - RNA, 24 nt, Human
uccccaggccaccgggccccucug

SEQ ID NO: 232264 - RNA, 18 nt, Human
uccccgccgccgccucuu

SEQ ID NO: 232265 - RNA, 20 nt, Human
uccccgccgccgccucuugc

SEQ ID NO: 232266 - RNA, 25 nt, Human
uccccgccgccgccucuugcugccu

SEQ ID NO: 232267 - RNA, 24 nt, Human
ucccugaagcggguggauggaggc

SEQ ID NO: 232268 - RNA, 21 nt, Human
ucccuggggcugugaggggug

SEQ ID NO: 232269 - RNA, 23 nt, Human
ucccuggggcugugagggguggg

SEQ ID NO: 232270 - RNA, 21 nt, Human
ucgcacgcacagccucggccc

SEQ ID NO: 232271 - RNA, 21 nt, Human
ucuccccgccgccgccucuug

SEQ ID NO: 232272 - RNA, 18 nt, Human
ucuccuccuccuccuucu

SEQ ID NO: 232273 - RNA, 19 nt, Human
ucugcugggggcaccagga

SEQ ID NO: 232274 - RNA, 23 nt, Human
ugacggggggacaacuucagcag

SEQ ID NO: 232275 - RNA, 20 nt, Human
ugcccugggggguggucagg

SEQ ID NO: 232276 - RNA, 22 nt, Human
ugccucugccuccgagcagccc

SEQ ID NO: 232277 - RNA, 19 nt, Human
uggcagcagggaggagggg

SEQ ID NO: 232278 - RNA, 22 nt, Human
ugggauaaguggcagcagggag

SEQ ID NO: 232279 - RNA, 19 nt, Human
ugggccgggggccgggggc

SEQ ID NO: 232280 - RNA, 24 nt, Human
uggggggcggggggccgcggggag

SEQ ID NO: 232281 - RNA, 19 nt, Human
uguuugcaagguuucccuc

SEQ ID NO: 232282 - RNA, 21 nt, Human
uugcugccucugccuccgagc

SEQ ID NO: 232283 - RNA, 22 nt, Human
uuugaggaacaaccugggagaa

SEQ ID NO: 232284 - RNA, 18 nt, Human
aaauagauauuugcaugg

SEQ ID NO: 232285 - RNA, 24 nt, Human
aacacaguuuauuauuggcacacu

SEQ ID NO: 232286 - RNA, 22 nt, Human
aagaaauauacuauaaaaagaa

SEQ ID NO: 232287 - RNA, 23 nt, Human
aagcugauuuuuuugucuuuucu

SEQ ID NO: 232288 - RNA, 18 nt, Human
aaggccuccaagaaaggg

SEQ ID NO: 232289 - RNA, 23 nt, Human
aaugaaagaaaacauaaagaaaa

SEQ ID NO: 232290 - RNA, 24 nt, Human
aaugaaagaaaacauaaagaaaaa

SEQ ID NO: 232291 - RNA, 19 nt, Human
acggagccacugugccuuu

SEQ ID NO: 232292 - RNA, 18 nt, Human
acugcccacaaaaccaau

SEQ ID NO: 232293 - RNA, 22 nt, Human
agaagaugcgcuagaguuuucu

SEQ ID NO: 232294 - RNA, 21 nt, Human
agguacaauuagaaaacacac

SEQ ID NO: 232295 - RNA, 22 nt, Human
auauuaaugagauccugagcac

SEQ ID NO: 232296 - RNA, 25 nt, Human
augaaagaaaacauaaagaaaaaaa

SEQ ID NO: 232297 - RNA, 21 nt, Human
auuuauggacaauauggccuu

SEQ ID NO: 232298 - RNA, 20 nt, Human
caagaaagggucauggaagc

SEQ ID NO: 232299 - RNA, 19 nt, Human
cacacggagccacugugcc

SEQ ID NO: 232300 - RNA, 20 nt, Human
caguggauucuggugccgau

SEQ ID NO: 232301 - RNA, 18 nt, Human
ccauaaaagaaccaggug

SEQ ID NO: 232302 - RNA, 22 nt, Human
cccaaaaacgaaaaguccccau

SEQ ID NO: 232303 - RNA, 25 nt, Human
ccugugaaggccuccaagaaagggu

SEQ ID NO: 232304 - RNA, 23 nt, Human
cuguguucuucccaguacaaagu

SEQ ID NO: 232305 - RNA, 20 nt, Human
gaaagaaaacauaaagaaaa

SEQ ID NO: 232306 - RNA, 23 nt, Human
gaaagaaaacauaaagaaaaaaa

SEQ ID NO: 232307 - RNA, 20 nt, Human
gcugggcccucuuagcuguu

SEQ ID NO: 232308 - RNA, 18 nt, Human
ggauuacauggcuugaaa

SEQ ID NO: 232309 - RNA, 21 nt, Human
gggcuguguucuucccaguac

SEQ ID NO: 232310 - RNA, 24 nt, Human
uaaaaagaaaggauggucaacuca

SEQ ID NO: 232311 - RNA, 22 nt, Human
uaaaaaggaaauucaacacaaa

SEQ ID NO: 232312 - RNA, 24 nt, Human
uaacacacggagccacugugccuu

SEQ ID NO: 232313 - RNA, 23 nt, Human
uacaaaauaucauacaagaaaua

SEQ ID NO: 232314 - RNA, 24 nt, Human
uacacuggaguugcccaaaaacga

SEQ ID NO: 232315 - RNA, 18 nt, Human
uacauggcuugaaaauau

SEQ ID NO: 232316 - RNA, 19 nt, Human
uaccugugaaggccuccaa

SEQ ID NO: 232317 - RNA, 21 nt, Human
uaccugugaaggccuccaaga

SEQ ID NO: 232318 - RNA, 18 nt, Human
uaucucuucuguuuccuc

SEQ ID NO: 232319 - RNA, 20 nt, Human
uauuaaacugcccacaaaag

SEQ ID NO: 232320 - RNA, 23 nt, Human
uauuggcacacuuaucaguaaag

SEQ ID NO: 232321 - RNA, 22 nt, Human
ucaauuagaaaaaaagaaagaa

SEQ ID NO: 232322 - RNA, 25 nt, Human
ucaauuagaaaaaaagaaagaagaa

SEQ ID NO: 232323 - RNA, 26 nt, Human
uccccauaaaagaaccaggugagagc

SEQ ID NO: 232324 - RNA, 18 nt, Human
ucuccuguaaguaaagau

SEQ ID NO: 232325 - RNA, 25 nt, Human
ucuccuguaaguaaagauuugcaau

SEQ ID NO: 232326 - RNA, 22 nt, Human
ugaaaaaaaugacauuucuugu

SEQ ID NO: 232327 - RNA, 23 nt, Human
ugagauccugagcacugagcauu

SEQ ID NO: 232328 - RNA, 23 nt, Human
ugcaagucaaaaagcagaaaaua

SEQ ID NO: 232329 - RNA, 18 nt, Human
ugcccaaaaacgaaaagu

SEQ ID NO: 232330 - RNA, 18 nt, Human
ugcccaaugaaagaaaac

SEQ ID NO: 232331 - RNA, 19 nt, Human
uggauucuggugccgauca

SEQ ID NO: 232332 - RNA, 22 nt, Human
uggcacacuuaucaguaaagca

SEQ ID NO: 232333 - RNA, 25 nt, Human
uugcauggaaaaguuuuuaucucuu

SEQ ID NO: 232334 - RNA, 24 nt, Human
uuguuucagcacuugggcuaaauu

SEQ ID NO: 232335 - RNA, 20 nt, Human
uuucuuguuucagcacuugg

SEQ ID NO: 232336 - RNA, 18 nt, Human
uuuucuuuuuuuacugaa

SEQ ID NO: 232337 - RNA, 24 nt, Human
aaaaauccaaaacaggagugagga

SEQ ID NO: 232338 - RNA, 27 nt, Human
aaacaggagugaggacagaagggaccc

SEQ ID NO: 232339 - RNA, 26 nt, Human
aaacaugcaaagagaaaaauccaaaa

SEQ ID NO: 232340 - RNA, 18 nt, Human
aaaggaacauuugaaaag

SEQ ID NO: 232341 - RNA, 22 nt, Human
aacacuuccuuuuuuggugagg

SEQ ID NO: 232342 - RNA, 21 nt, Human
aacccaaagccuuuaaaaaaa

SEQ ID NO: 232343 - RNA, 25 nt, Human
aacccaaagccuuuaaaaaaaucuc

SEQ ID NO: 232344 - RNA, 19 nt, Human
aacgaacccuuaaagcuaa

SEQ ID NO: 232345 - RNA, 19 nt, Human
aagcaaguguaucgcuuug

SEQ ID NO: 232346 - RNA, 18 nt, Human
aagcgacuacacuguuuc

SEQ ID NO: 232347 - RNA, 19 nt, Human
acacaccacagagcaaaac

SEQ ID NO: 232348 - RNA, 21 nt, Human
acacaccacagagcaaaacug

SEQ ID NO: 232349 - RNA, 26 nt, Human
acaccacagagcaaaacuggaaaaac

SEQ ID NO: 232350 - RNA, 20 nt, Human
acacucaugcuaacgaaccc

SEQ ID NO: 232351 - RNA, 18 nt, Human
acaggccaccaagccuau

SEQ ID NO: 232352 - RNA, 24 nt, Human
acgaacccuuaaagcuaaacaaag

SEQ ID NO: 232353 - RNA, 24 nt, Human
acguccgggcucccaagaagguuu

SEQ ID NO: 232354 - RNA, 20 nt, Human
acuucaauaaauacuuaaau

SEQ ID NO: 232355 - RNA, 22 nt, Human
agaaaaauccaaaacaggagug

SEQ ID NO: 232356 - RNA, 22 nt, Human
agaagaaacaucagccucccga

SEQ ID NO: 232357 - RNA, 19 nt, Human
agagcccuuccuggagccc

SEQ ID NO: 232358 - RNA, 23 nt, Human
agcaguuaacacaauuguacaaa

SEQ ID NO: 232359 - RNA, 22 nt, Human
agccuauucugccauccuguuu

SEQ ID NO: 232360 - RNA, 19 nt, Human
aggccaaagacaacccaaa

SEQ ID NO: 232361 - RNA, 19 nt, Human
aggggcuuccugcagcuag

SEQ ID NO: 232362 - RNA, 21 nt, Human
aguguaucgcuuugggaaagc

SEQ ID NO: 232363 - RNA, 23 nt, Human
auacauuuucaaaauauuggccc

SEQ ID NO: 232364 - RNA, 18 nt, Human
augcaaaugcacgaucug

SEQ ID NO: 232365 - RNA, 21 nt, Human
augcucccugggggagacugg

SEQ ID NO: 232366 - RNA, 23 nt, Human
caaacaugcaaagagaaaaaucc

SEQ ID NO: 232367 - RNA, 24 nt, Human
caaaggccaaagacaacccaaagc

SEQ ID NO: 232368 - RNA, 19 nt, Human
caaaugcacgaucugugua

SEQ ID NO: 232369 - RNA, 22 nt, Human
caagcucucagcuaugacucua

SEQ ID NO: 232370 - RNA, 24 nt, Human
caagugccugcuucaaugccaugu

SEQ ID NO: 232371 - RNA, 23 nt, Human
cacaccacagagcaaaacuggaa

SEQ ID NO: 232372 - RNA, 21 nt, Human
cacacgacuggacacucaugc

SEQ ID NO: 232373 - RNA, 21 nt, Human
caccuucucacagauccaaag

SEQ ID NO: 232374 - RNA, 22 nt, Human
cagagcaaaacuggaaaaaccc

SEQ ID NO: 232375 - RNA, 23 nt, Human
cagcaggagcagcuccgggccuc

SEQ ID NO: 232376 - RNA, 24 nt, Human
cagcugcucuaagcucuguccucc

SEQ ID NO: 232377 - RNA, 22 nt, Human
ccaaaacaggagugaggacaac

SEQ ID NO: 232378 - RNA, 21 nt, Human
ccaacucuacuuucccaucac

SEQ ID NO: 232379 - RNA, 23 nt, Human
ccacagagcaaaacuggaaaaac

SEQ ID NO: 232380 - RNA, 18 nt, Human
ccagagcccuuccuggag

SEQ ID NO: 232381 - RNA, 19 nt, Human
ccaguggcucccagaagac

SEQ ID NO: 232382 - RNA, 22 nt, Human
cccagaguuugggcaugugagc

SEQ ID NO: 232383 - RNA, 24 nt, Human
ccccucagaagaaacaucagccuc

SEQ ID NO: 232384 - RNA, 18 nt, Human
ccucaagaccagccccug

SEQ ID NO: 232385 - RNA, 25 nt, Human
ccugagccagagcccuuccuggagc

SEQ ID NO: 232386 - RNA, 22 nt, Human
ccugcagcgagugcuguuuggc

SEQ ID NO: 232387 - RNA, 28 nt, Human
ccugcagcuagggacauagccggggucc

SEQ ID NO: 232388 - RNA, 22 nt, Human
ccuuaaagcuaaacaaaggcca

SEQ ID NO: 232389 - RNA, 22 nt, Human
cgcagaaugcuucagauucucc

SEQ ID NO: 232390 - RNA, 21 nt, Human
cuaacgaacccuuaaagcuaa

SEQ ID NO: 232391 - RNA, 18 nt, Human
cuagaucaacucagcuca

SEQ ID NO: 232392 - RNA, 25 nt, Human
cuccccauuccccucagaagaaaca

SEQ ID NO: 232393 - RNA, 21 nt, Human
cuccgggccucgucagcacag

SEQ ID NO: 232394 - RNA, 24 nt, Human
cuccucuggugaccaaagcaagug

SEQ ID NO: 232395 - RNA, 22 nt, Human
cucuaagcucuguccuccucug

SEQ ID NO: 232396 - RNA, 25 nt, Human
cucuccccauuccccucagaagaaa

SEQ ID NO: 232397 - RNA, 18 nt, Human
cugcuuccuucucccuca

SEQ ID NO: 232398 - RNA, 22 nt, Human
cuggagcccuggcaauugccca

SEQ ID NO: 232399 - RNA, 20 nt, Human
cugucucucugucucucuuc

SEQ ID NO: 232400 - RNA, 21 nt, Human
cugucugcaaccugagccaga

SEQ ID NO: 232401 - RNA, 18 nt, Human
cuuggauuaauaacuagc

SEQ ID NO: 232402 - RNA, 22 nt, Human
cuuugggaaagcugcuuguugc

SEQ ID NO: 232403 - RNA, 25 nt, Human
gaaaaauccaaaacaggagugagga

SEQ ID NO: 232404 - RNA, 19 nt, Human
gagacugguggcuucgugc

SEQ ID NO: 232405 - RNA, 26 nt, Human
gaugcagaccugaaggugggaggucc

SEQ ID NO: 232406 - RNA, 21 nt, Human
gcaaagagaaaaauccaaaac

SEQ ID NO: 232407 - RNA, 22 nt, Human
gcacacgacuggacacucaugc

SEQ ID NO: 232408 - RNA, 21 nt, Human
gcagcaggagcagcuccgggc

SEQ ID NO: 232409 - RNA, 21 nt, Human
gcgacuacacuguuuccaacc

SEQ ID NO: 232410 - RNA, 20 nt, Human
gcucucagcuaugacucuaa

SEQ ID NO: 232411 - RNA, 18 nt, Human
gcugcuuccuucucccuc

SEQ ID NO: 232412 - RNA, 18 nt, Human
gcuuccucucucucccca

SEQ ID NO: 232413 - RNA, 24 nt, Human
ggacagaauagagugaguuggaag

SEQ ID NO: 232414 - RNA, 20 nt, Human
ggagacgucauaagugagca

SEQ ID NO: 232415 - RNA, 21 nt, Human
ggagacugguggcuucgugcc

SEQ ID NO: 232416 - RNA, 21 nt, Human
uaaaaaaaucucucacacacc

SEQ ID NO: 232417 - RNA, 23 nt, Human
uaaacaaaggccaaagacaaccc

SEQ ID NO: 232418 - RNA, 24 nt, Human
uaaagcuaaacaaaggccaaagac

SEQ ID NO: 232419 - RNA, 21 nt, Human
uaacaagcucucagcuaugac

SEQ ID NO: 232420 - RNA, 24 nt, Human
uaacgaacccuuaaagcuaaacaa

SEQ ID NO: 232421 - RNA, 23 nt, Human
uaaguuuguucaaggucugaagu

SEQ ID NO: 232422 - RNA, 20 nt, Human
uaauacauucccauaaaaca

SEQ ID NO: 232423 - RNA, 18 nt, Human
uagcuaacaagcucucag

SEQ ID NO: 232424 - RNA, 23 nt, Human
uagcuagaucaacucagcucaua

SEQ ID NO: 232425 - RNA, 18 nt, Human
uagcuagcugcuuccuuc

SEQ ID NO: 232426 - RNA, 18 nt, Human
uaggggcuuccugcagcu

SEQ ID NO: 232427 - RNA, 22 nt, Human
uaguaauggaauaacacuuccu

SEQ ID NO: 232428 - RNA, 23 nt, Human
uaugcaaaugcacgaucugugua

SEQ ID NO: 232429 - RNA, 21 nt, Human
ucacacaccacagagcaaaac

SEQ ID NO: 232430 - RNA, 19 nt, Human
ucagcaaccuccuuguccc

SEQ ID NO: 232431 - RNA, 20 nt, Human
uccaaagguaggaagggccc

SEQ ID NO: 232432 - RNA, 18 nt, Human
ucccagaagacaucucuc

SEQ ID NO: 232433 - RNA, 22 nt, Human
ucccuuccagcaguuaacacaa

SEQ ID NO: 232434 - RNA, 24 nt, Human
ucucugucucucuucuuuuccaca

SEQ ID NO: 232435 - RNA, 19 nt, Human
ucugaacuaugcaaaugca

SEQ ID NO: 232436 - RNA, 19 nt, Human
ucugucucucuucuuuucc

SEQ ID NO: 232437 - RNA, 19 nt, Human
ucuuggaauucugcucuaa

SEQ ID NO: 232438 - RNA, 18 nt, Human
ugagaaacauccacgcaa

SEQ ID NO: 232439 - RNA, 20 nt, Human
ugaggaaagcccaauggguc

SEQ ID NO: 232440 - RNA, 23 nt, Human
ugaggaaagcccaaugggucuua

SEQ ID NO: 232441 - RNA, 18 nt, Human
ugaggacagaauagagug

SEQ ID NO: 232442 - RNA, 20 nt, Human
ugaguuggaagagagccuaa

SEQ ID NO: 232443 - RNA, 24 nt, Human
ugaugcagaccugaaggugggagg

SEQ ID NO: 232444 - RNA, 24 nt, Human
ugcaaagagaaaaauccaaaacag

SEQ ID NO: 232445 - RNA, 22 nt, Human
ugcagaccugaaggugggaggu

SEQ ID NO: 232446 - RNA, 23 nt, Human
ugcaucugucccuuccagcaguu

SEQ ID NO: 232447 - RNA, 21 nt, Human
ugcuuuguauucaccuucuca

SEQ ID NO: 232448 - RNA, 18 nt, Human
uggagaagagacagguaa

SEQ ID NO: 232449 - RNA, 21 nt, Human
uggccaaaacagcaaaugcau

SEQ ID NO: 232450 - RNA, 24 nt, Human
uggugaggaaagcccaaugggucu

SEQ ID NO: 232451 - RNA, 18 nt, Human
uguacagaagaaaaaacc

SEQ ID NO: 232452 - RNA, 26 nt, Human
uguauucaccuucucacagauccaaa

SEQ ID NO: 232453 - RNA, 20 nt, Human
uucaccuucucacagaucca

SEQ ID NO: 232454 - RNA, 22 nt, Human
uuccaaccacagaaucuaagcu

SEQ ID NO: 232455 - RNA, 21 nt, Human
uuccacaggccaccaagccua

SEQ ID NO: 232456 - RNA, 18 nt, Human
uuccucaagaccagcccc

SEQ ID NO: 232457 - RNA, 21 nt, Human
uugaaaaggaugaugcagacc

SEQ ID NO: 232458 - RNA, 21 nt, Human
uugaaggccccucuacuucaa

SEQ ID NO: 232459 - RNA, 19 nt, Human
uuggaagagagccuaaaua

SEQ ID NO: 232460 - RNA, 21 nt, Human
agacagugaaaugauaugaca

SEQ ID NO: 232461 - RNA, 20 nt, Human
aggaguugauguuuuuccca

SEQ ID NO: 232462 - RNA, 21 nt, Human
aguggugcgucagagguggca

SEQ ID NO: 232463 - RNA, 20 nt, Human
aucccaggaugugacucacu

SEQ ID NO: 232464 - RNA, 21 nt, Human
caacaugcacaaccuccaccu

SEQ ID NO: 232465 - RNA, 21 nt, Human
caagacaugauauuggauuua

SEQ ID NO: 232466 - RNA, 18 nt, Human
caaggggcaaaugcagua

SEQ ID NO: 232467 - RNA, 20 nt, Human
cacacgguaaacauccaccu

SEQ ID NO: 232468 - RNA, 19 nt, Human
caucaggauauagcugugg

SEQ ID NO: 232469 - RNA, 24 nt, Human
cauucuuauuucuaacuucaggag

SEQ ID NO: 232470 - RNA, 27 nt, Human
ccaucuuaaaauauuacugcuuuaauc

SEQ ID NO: 232471 - RNA, 22 nt, Human
cuccaccuagaauccuguugua

SEQ ID NO: 232472 - RNA, 21 nt, Human
cuggaucccaggaugugacuc

SEQ ID NO: 232473 - RNA, 24 nt, Human
cuucaggaguugauguuuuuccca

SEQ ID NO: 232474 - RNA, 20 nt, Human
gacagugaaaugauaugaca

SEQ ID NO: 232475 - RNA, 20 nt, Human
gaguugauguuuuucccagu

SEQ ID NO: 232476 - RNA, 26 nt, Human
uaaaaaggacaacaugcacaaccucc

SEQ ID NO: 232477 - RNA, 22 nt, Human
uaaucacagaucagauaaaaag

SEQ ID NO: 232478 - RNA, 19 nt, Human
uacugcuuuaaucacagau

SEQ ID NO: 232479 - RNA, 20 nt, Human
uggaagaauuaugcacaaga

SEQ ID NO: 232480 - RNA, 22 nt, Human
uggaagaauuaugcacaagaca

SEQ ID NO: 232481 - RNA, 18 nt, Human
uggaucccaggaugugac

SEQ ID NO: 232482 - RNA, 28 nt, Human
uggaucccaggaugugacucacugggaa

SEQ ID NO: 232483 - RNA, 20 nt, Human
uggcaguggugcgucagagg

SEQ ID NO: 232484 - RNA, 28 nt, Human
uguacacuacugauauaguucacaaaau

SEQ ID NO: 232485 - RNA, 21 nt, Human
uuacugcuuuaaucacagauc

SEQ ID NO: 232486 - RNA, 22 nt, Human
uuauaugguaauguacacuacu

SEQ ID NO: 232487 - RNA, 24 nt, Human
aaauggccagccagcuuggggagc

SEQ ID NO: 232488 - RNA, 19 nt, Human
aagaagaucaaagcaaacu

SEQ ID NO: 232489 - RNA, 20 nt, Human
aagaucaaagcaaacuguga

SEQ ID NO: 232490 - RNA, 20 nt, Human
aagcauaggcuuugauucug

SEQ ID NO: 232491 - RNA, 23 nt, Human
accucugcuuccugccuaacuaa

SEQ ID NO: 232492 - RNA, 22 nt, Human
agaaggaggcuuagccccagaa

SEQ ID NO: 232493 - RNA, 20 nt, Human
agauccugaucaccgcccag

SEQ ID NO: 232494 - RNA, 21 nt, Human
agaugguguaugggggccuug

SEQ ID NO: 232495 - RNA, 21 nt, Human
agcaauggcaacagaugaaga

SEQ ID NO: 232496 - RNA, 24 nt, Human
agcaauggcaacagaugaagagga

SEQ ID NO: 232497 - RNA, 22 nt, Human
agcaccuccacacacagcagca

SEQ ID NO: 232498 - RNA, 22 nt, Human
agcaccuccacacacagcagca

SEQ ID NO: 232499 - RNA, 26 nt, Human
agcucagauugcaagcauuaaaccaa

SEQ ID NO: 232500 - RNA, 22 nt, Human
aggggucagaggcacagaaacu

SEQ ID NO: 232501 - RNA, 20 nt, Human
agggguuccugaaaugucug

SEQ ID NO: 232502 - RNA, 20 nt, Human
aggugggaggcaugccuggg

SEQ ID NO: 232503 - RNA, 23 nt, Human
aguuucuucaucuccaaaauggg

SEQ ID NO: 232504 - RNA, 21 nt, Human
augagcagaauauacuugccc

SEQ ID NO: 232505 - RNA, 28 nt, Human
caagauggugucccagauagagcugaag

SEQ ID NO: 232506 - RNA, 21 nt, Human
cacaaaguacauagccaauga

SEQ ID NO: 232507 - RNA, 18 nt, Human
cacacacagcagcaaaau

SEQ ID NO: 232508 - RNA, 22 nt, Human
cacacacagcagcaaaauggcc

SEQ ID NO: 232509 - RNA, 22 nt, Human
cacacagcagcaaaauggccag

SEQ ID NO: 232510 - RNA, 21 nt, Human
cagauagagcugaagaaggca

SEQ ID NO: 232511 - RNA, 21 nt, Human
cagauugcaagcauuaaacca

SEQ ID NO: 232512 - RNA, 22 nt, Human
cagauugcaagcauuaaaccaa

SEQ ID NO: 232513 - RNA, 24 nt, Human
cagcagcaauggcaacagaugaag

SEQ ID NO: 232514 - RNA, 25 nt, Human
cagcgccccgggcccuggagggagg

SEQ ID NO: 232515 - RNA, 18 nt, Human
caguguguguccuuggga

SEQ ID NO: 232516 - RNA, 23 nt, Human
ccagaggucuucuucauccuucu

SEQ ID NO: 232517 - RNA, 22 nt, Human
ccagggaaucuccugguugcug

SEQ ID NO: 232518 - RNA, 19 nt, Human
cccugggacuucccuccac

SEQ ID NO: 232519 - RNA, 19 nt, Human
ccggcgccggucucgaguu

SEQ ID NO: 232520 - RNA, 20 nt, Human
ccuccacacacagcagcaaa

SEQ ID NO: 232521 - RNA, 24 nt, Human
ccuucuucuucuucuucuucuuuu

SEQ ID NO: 232522 - RNA, 19 nt, Human
cuaaacaggcagugauggu

SEQ ID NO: 232523 - RNA, 24 nt, Human
cugaaucuggcaaggcuuucccau

SEQ ID NO: 232524 - RNA, 18 nt, Human
cugacagcgccccgggcc

SEQ ID NO: 232525 - RNA, 23 nt, Human
cugcgugcgucuccuccggcgcc

SEQ ID NO: 232526 - RNA, 20 nt, Human
cuucucuggcugcuggcccc

SEQ ID NO: 232527 - RNA, 20 nt, Human
cuucuucuucuucuucuucu

SEQ ID NO: 232528 - RNA, 20 nt, Human
cuucuucuucuucuuuuucu

SEQ ID NO: 232529 - RNA, 24 nt, Human
cuucuugcuuugcguugucagggg

SEQ ID NO: 232530 - RNA, 20 nt, Human
cuucuugguguuuggucaag

SEQ ID NO: 232531 - RNA, 20 nt, Human
cuucuuguucuucucuggcu

SEQ ID NO: 232532 - RNA, 22 nt, Human
cuuuuucuucuuguucuucucu

SEQ ID NO: 232533 - RNA, 21 nt, Human
gaggacucccaggcagauggu

SEQ ID NO: 232534 - RNA, 20 nt, Human
gaugguguuguagaugccuu

SEQ ID NO: 232535 - RNA, 24 nt, Human
gcacaggugaggggucagaggcac

SEQ ID NO: 232536 - RNA, 18 nt, Human
gcaggcccaggaggacuc

SEQ ID NO: 232537 - RNA, 18 nt, Human
gcagguccugggcucaaa

SEQ ID NO: 232538 - RNA, 19 nt, Human
gccacugacagcaccucca

SEQ ID NO: 232539 - RNA, 18 nt, Human
gcccuggagggaggugug

SEQ ID NO: 232540 - RNA, 22 nt, Human
ggagaagacaaagucagcugcg

SEQ ID NO: 232541 - RNA, 19 nt, Human
ggagggagguguggguucc

SEQ ID NO: 232542 - RNA, 22 nt, Human
gggguuccugaaaugucugugu

SEQ ID NO: 232543 - RNA, 26 nt, Human
ggucucgaguuuuuuuuuuuuuuuuu

SEQ ID NO: 232544 - RNA, 19 nt, Human
gugguuuauggaauagaug

SEQ ID NO: 232545 - RNA, 23 nt, Human
gugugucuguaucaagacacaca

SEQ ID NO: 232546 - RNA, 22 nt, Human
uaaacaaucacugaacacccgc

SEQ ID NO: 232547 - RNA, 19 nt, Human
uaacuaaacaggcagugau

SEQ ID NO: 232548 - RNA, 25 nt, Human
uagaguuagaaauaggaaagcaugc

SEQ ID NO: 232549 - RNA, 19 nt, Human
uaggaaauuguauauaugu

SEQ ID NO: 232550 - RNA, 23 nt, Human
uauuccucuuccagcuuuggguu

SEQ ID NO: 232551 - RNA, 23 nt, Human
uauuccucuuccagcuuuggguu

SEQ ID NO: 232552 - RNA, 22 nt, Human
uauuucagggguuccugaaaug

SEQ ID NO: 232553 - RNA, 18 nt, Human
ucaaagcaaacugugauc

SEQ ID NO: 232554 - RNA, 20 nt, Human
uccacacacagcagcaaaau

SEQ ID NO: 232555 - RNA, 19 nt, Human
uccacacacagcagcaacc

SEQ ID NO: 232556 - RNA, 19 nt, Human
ucccugggacuucccucca

SEQ ID NO: 232557 - RNA, 21 nt, Human
ucuccugguugcugccccguc

SEQ ID NO: 232558 - RNA, 24 nt, Human
ucucgaguuuuuuuuuuuuuuuuu

SEQ ID NO: 232559 - RNA, 26 nt, Human
ucucggccagaacugcuuuccuggag

SEQ ID NO: 232560 - RNA, 23 nt, Human
ucuuguucuucucuggcugcugg

SEQ ID NO: 232561 - RNA, 25 nt, Human
ucuuuuucuucuuguucuucucugg

SEQ ID NO: 232562 - RNA, 22 nt, Human
ugacagcaccuccacacacagc

SEQ ID NO: 232563 - RNA, 22 nt, Human
ugacagcaccuccacacacagc

SEQ ID NO: 232564 - RNA, 21 nt, Human
ugcaugugggguaugccagag

SEQ ID NO: 232565 - RNA, 22 nt, Human
ugccaagacaguauccaagaaa

SEQ ID NO: 232566 - RNA, 19 nt, Human
ugcccacguaccugcuacc

SEQ ID NO: 232567 - RNA, 19 nt, Human
ugccccgucugacagcgcc

SEQ ID NO: 232568 - RNA, 19 nt, Human
ugcguugucaggggaucuc

SEQ ID NO: 232569 - RNA, 28 nt, Human
ugcuaccugaauuugugugugugugugu

SEQ ID NO: 232570 - RNA, 18 nt, Human
uggaauagaugguguaug

SEQ ID NO: 232571 - RNA, 22 nt, Human
uggcaacagaugaagaggagug

SEQ ID NO: 232572 - RNA, 19 nt, Human
uggguuugggcaugccacu

SEQ ID NO: 232573 - RNA, 19 nt, Human
uggguuugggcaugccacu

SEQ ID NO: 232574 - RNA, 24 nt, Human
uggugucccagauagagcugaaga

SEQ ID NO: 232575 - RNA, 21 nt, Human
uggugugucuguaucaagaca

SEQ ID NO: 232576 - RNA, 23 nt, Human
ugguguuguagaugccuucuugg

SEQ ID NO: 232577 - RNA, 23 nt, Human
ugguguuuggucaagaugguguc

SEQ ID NO: 232578 - RNA, 18 nt, Human
ugguugccucugcacccu

SEQ ID NO: 232579 - RNA, 19 nt, Human
ugugagcccaaauucacau

SEQ ID NO: 232580 - RNA, 19 nt, Human
ugugaugaucaccaagagu

SEQ ID NO: 232581 - RNA, 20 nt, Human
ugugcuuugcauguggggua

SEQ ID NO: 232582 - RNA, 21 nt, Human
uguguguguguguguuacgug

SEQ ID NO: 232583 - RNA, 23 nt, Human
uguguguguguuacgugcaugug

SEQ ID NO: 232584 - RNA, 21 nt, Human
uguguuacgugcaugugcaca

SEQ ID NO: 232585 - RNA, 24 nt, Human
uucacauauugaagaagaucaaag

SEQ ID NO: 232586 - RNA, 21 nt, Human
uucagauccugaucaccgccc

SEQ ID NO: 232587 - RNA, 19 nt, Human
uucauccuucuucuucuuc

SEQ ID NO: 232588 - RNA, 18 nt, Human
uugagucucaguuucuuc

SEQ ID NO: 232589 - RNA, 21 nt, Human
uugcugguuaggaaauuguau

SEQ ID NO: 232590 - RNA, 20 nt, Human
uuggguuugggcaugccacu

SEQ ID NO: 232591 - RNA, 20 nt, Human
uuggguuugggcaugccacu

SEQ ID NO: 232592 - RNA, 21 nt, Human
uuguauauaugugucugaauc

SEQ ID NO: 232593 - RNA, 18 nt, Human
uuucuucaucuccaaaau

SEQ ID NO: 232594 - RNA, 23 nt, Human
uuuuuuuuuuuuuuuuucacacu

SEQ ID NO: 232595 - RNA, 18 nt, Human
uuuuuuuuuuuuuuuuug

SEQ ID NO: 232596 - RNA, 21 nt, Human
aaaaauacaccaacgacaguu

SEQ ID NO: 232597 - RNA, 22 nt, Human
accagaaaaauacaccaacgac

SEQ ID NO: 232598 - RNA, 22 nt, Human
accagaaaaauacaccaacgac

SEQ ID NO: 232599 - RNA, 28 nt, Human
cacagccugcuaucuucuguucuccaaa

SEQ ID NO: 232600 - RNA, 19 nt, Human
caccagaaaaauacaccaa

SEQ ID NO: 232601 - RNA, 19 nt, Human
caccagaaaaauacaccaa

SEQ ID NO: 232602 - RNA, 22 nt, Human
cagaaaaauacaccaacgacag

SEQ ID NO: 232603 - RNA, 28 nt, Human
cagaaaaauacaccaacgacaguugagg

SEQ ID NO: 232604 - RNA, 20 nt, Human
ccuuugaaggaaggcacaga

SEQ ID NO: 232605 - RNA, 20 nt, Human
uaagaucaaugaaaauacuu

SEQ ID NO: 232606 - RNA, 19 nt, Human
ucaguacagaugacccaca

SEQ ID NO: 232607 - RNA, 21 nt, Human
uggagaacaaaugcuuucuug

SEQ ID NO: 232608 - RNA, 23 nt, Human
aaaaaauccccacuaucuguaca

SEQ ID NO: 232609 - RNA, 18 nt, Human
aaacacguugacuccuga

SEQ ID NO: 232610 - RNA, 24 nt, Human
aaaccaaaaucccaacccaagcca

SEQ ID NO: 232611 - RNA, 24 nt, Human
aaagugcugggauuacaggcguga

SEQ ID NO: 232612 - RNA, 24 nt, Human
aaagugcugggauuacaggcguga

SEQ ID NO: 232613 - RNA, 19 nt, Human
aaaucccaacccaagccau

SEQ ID NO: 232614 - RNA, 23 nt, Human
aaaugccaaauguacacagugua

SEQ ID NO: 232615 - RNA, 25 nt, Human
aacacacacgacagaaaacagugca

SEQ ID NO: 232616 - RNA, 19 nt, Human
aaccaaaaucccaacccaa

SEQ ID NO: 232617 - RNA, 20 nt, Human
aaccuccaccuccugggcuc

SEQ ID NO: 232618 - RNA, 24 nt, Human
aaguagcugggaucacaggcacgu

SEQ ID NO: 232619 - RNA, 25 nt, Human
aaguagcugggaucacaggcacgug

SEQ ID NO: 232620 - RNA, 19 nt, Human
aagugcugggauuacaggc

SEQ ID NO: 232621 - RNA, 19 nt, Human
aagugcugggauuacaggc

SEQ ID NO: 232622 - RNA, 19 nt, Human
aagugcugggauuacaggc

SEQ ID NO: 232623 - RNA, 19 nt, Human
aagugcugggauuacaggc

SEQ ID NO: 232624 - RNA, 24 nt, Human
acaaagugcaaacauaacaaaaaa

SEQ ID NO: 232625 - RNA, 19 nt, Human
acaggaaaggaagaaacca

SEQ ID NO: 232626 - RNA, 23 nt, Human
acaggugcccaccaccgcgcccg

SEQ ID NO: 232627 - RNA, 21 nt, Human
acauacccaucaacgacaaga

SEQ ID NO: 232628 - RNA, 24 nt, Human
accaauauacaaagugcaaacaua

SEQ ID NO: 232629 - RNA, 25 nt, Human
acccgccucggccucccaaagugcu

SEQ ID NO: 232630 - RNA, 22 nt, Human
accucagccucgccaugccugg

SEQ ID NO: 232631 - RNA, 18 nt, Human
acgggguuucaccuuguu

SEQ ID NO: 232632 - RNA, 20 nt, Human
acgggguuucaccuuguuag

SEQ ID NO: 232633 - RNA, 25 nt, Human
acuauguugcccaggcuggaaagca

SEQ ID NO: 232634 - RNA, 22 nt, Human
acugaacaaauacagcaaccag

SEQ ID NO: 232635 - RNA, 20 nt, Human
acugcaguggcgcaaucucg

SEQ ID NO: 232636 - RNA, 24 nt, Human
acugcaguggcgcaaucucggcuc

SEQ ID NO: 232637 - RNA, 24 nt, Human
agaaaccaaaaucccaacccaagc

SEQ ID NO: 232638 - RNA, 21 nt, Human
agagauggggucuuacuaugu

SEQ ID NO: 232639 - RNA, 23 nt, Human
agccucaaaugccugagcucaaa

SEQ ID NO: 232640 - RNA, 18 nt, Human
aggcgauccuccugccuc

SEQ ID NO: 232641 - RNA, 18 nt, Human
aggcuggagugcaguggc

SEQ ID NO: 232642 - RNA, 18 nt, Human
aguagcugggacuacagg

SEQ ID NO: 232643 - RNA, 23 nt, Human
agugcaaaauaauaacacaaaug

SEQ ID NO: 232644 - RNA, 20 nt, Human
agugcaguggcucgaucaug

SEQ ID NO: 232645 - RNA, 23 nt, Human
agugcaguggcucgaucauggcu

SEQ ID NO: 232646 - RNA, 18 nt, Human
agugcugggauuacaggc

SEQ ID NO: 232647 - RNA, 18 nt, Human
agugcugggauuacaggc

SEQ ID NO: 232648 - RNA, 24 nt, Human
auauauguguguauauauauauau

SEQ ID NO: 232649 - RNA, 22 nt, Human
aucccaucccaacacacacgac

SEQ ID NO: 232650 - RNA, 24 nt, Human
aucuguugcccaggcuggagugca

SEQ ID NO: 232651 - RNA, 24 nt, Human
augauccacccgccucggccuccc

SEQ ID NO: 232652 - RNA, 24 nt, Human
auguguguauauauauauauaagu

SEQ ID NO: 232653 - RNA, 21 nt, Human
auucuccugccucagccuccc

SEQ ID NO: 232654 - RNA, 24 nt, Human
caaagugcugggauuacaggcgug

SEQ ID NO: 232655 - RNA, 24 nt, Human
caaagugcugggauuacaggcgug

SEQ ID NO: 232656 - RNA, 19 nt, Human
caacacacacgacagaaaa

SEQ ID NO: 232657 - RNA, 20 nt, Human
caaccuccaccuccugggcu

SEQ ID NO: 232658 - RNA, 23 nt, Human
caaccuccaccuccugggcucag

SEQ ID NO: 232659 - RNA, 21 nt, Human
caagauuggggaagugaaugg

SEQ ID NO: 232660 - RNA, 22 nt, Human
cacaccauucuccugccucagc

SEQ ID NO: 232661 - RNA, 22 nt, Human
cacacgacagaaaacagugcaa

SEQ ID NO: 232662 - RNA, 24 nt, Human
cacaggcacgugccaccauaccca

SEQ ID NO: 232663 - RNA, 23 nt, Human
cacccgccucggccucccaaagu

SEQ ID NO: 232664 - RNA, 24 nt, Human
caccuccugggcucaggcgauccu

SEQ ID NO: 232665 - RNA, 22 nt, Human
caccugugucuggccaaauuca

SEQ ID NO: 232666 - RNA, 24 nt, Human
caccuuguuagccaggauggucuc

SEQ ID NO: 232667 - RNA, 22 nt, Human
cacgcgggagucugacggaggc

SEQ ID NO: 232668 - RNA, 21 nt, Human
cacugcaaccuccaccuccug

SEQ ID NO: 232669 - RNA, 23 nt, Human
cacugcaaccuccaccuccuggg

SEQ ID NO: 232670 - RNA, 23 nt, Human
cacugggggggacacaguguuuu

SEQ ID NO: 232671 - RNA, 20 nt, Human
cagaggcaauaacccccuac

SEQ ID NO: 232672 - RNA, 22 nt, Human
cagcucagccucccaaagugcu

SEQ ID NO: 232673 - RNA, 24 nt, Human
cagcucagccucccaaagugcugg

SEQ ID NO: 232674 - RNA, 22 nt, Human
caggcgauccuccugccucagc

SEQ ID NO: 232675 - RNA, 20 nt, Human
caggcuacaaaaaccuucua

SEQ ID NO: 232676 - RNA, 19 nt, Human
caggugcccaccaccgcgc

SEQ ID NO: 232677 - RNA, 21 nt, Human
caggugcccaccaccgcgccc

SEQ ID NO: 232678 - RNA, 23 nt, Human
caucuguugcccaggcuggagug

SEQ ID NO: 232679 - RNA, 22 nt, Human
ccaaagugcugggauuacaggc

SEQ ID NO: 232680 - RNA, 22 nt, Human
ccaaagugcugggauuacaggc

SEQ ID NO: 232681 - RNA, 22 nt, Human
ccaaagugcugggauuacaggc

SEQ ID NO: 232682 - RNA, 22 nt, Human
ccaaagugcugggauuacaggc

SEQ ID NO: 232683 - RNA, 24 nt, Human
ccaaagugcugggauuacaggcgu

SEQ ID NO: 232684 - RNA, 24 nt, Human
ccaaagugcugggauuacaggcgu

SEQ ID NO: 232685 - RNA, 24 nt, Human
ccaacuccugaacucaagugaucc

SEQ ID NO: 232686 - RNA, 24 nt, Human
ccaccuccugggcucaggcgaucc

SEQ ID NO: 232687 - RNA, 20 nt, Human
cccaacccaagccauugcau

SEQ ID NO: 232688 - RNA, 19 nt, Human
cccaaguagcugggaucac

SEQ ID NO: 232689 - RNA, 23 nt, Human
cccgaguagcugggacuacaggu

SEQ ID NO: 232690 - RNA, 24 nt, Human
cccgaguagcugggacuacaggug

SEQ ID NO: 232691 - RNA, 19 nt, Human
cccgcgauugcacucgggg

SEQ ID NO: 232692 - RNA, 24 nt, Human
ccgaaaccagaaaggcuuaucacg

SEQ ID NO: 232693 - RNA, 19 nt, Human
ccuccaccuccugggcuca

SEQ ID NO: 232694 - RNA, 30 nt, Human
ccucccaccucagccucgccaugccuggcc

SEQ ID NO: 232695 - RNA, 24 nt, Human
ccuccugggcucaggcgauccucc

SEQ ID NO: 232696 - RNA, 21 nt, Human
ccugaacucaagugauccagc

SEQ ID NO: 232697 - RNA, 20 nt, Human
ccugaccucaugauccaccc

SEQ ID NO: 232698 - RNA, 20 nt, Human
ccugagcucaaaccauccuc

SEQ ID NO: 232699 - RNA, 20 nt, Human
ccugcacugggggggacaca

SEQ ID NO: 232700 - RNA, 23 nt, Human
ccugccucagccucccgaguagc

SEQ ID NO: 232701 - RNA, 18 nt, Human
ccuggcugucuagcaagg

SEQ ID NO: 232702 - RNA, 19 nt, Human
ccugggugcaggccacgug

SEQ ID NO: 232703 - RNA, 22 nt, Human
cgaagccuguucugccucccag

SEQ ID NO: 232704 - RNA, 23 nt, Human
cgaagccuguucugccucccaga

SEQ ID NO: 232705 - RNA, 21 nt, Human
cgcccaggccagacugcggac

SEQ ID NO: 232706 - RNA, 24 nt, Human
cgccucggccucccaaagugcugg

SEQ ID NO: 232707 - RNA, 20 nt, Human
cgcucugucgcccaggccag

SEQ ID NO: 232708 - RNA, 18 nt, Human
cgcuuuguugcucaggcc

SEQ ID NO: 232709 - RNA, 20 nt, Human
cggcgaggucucaggaaggg

SEQ ID NO: 232710 - RNA, 24 nt, Human
cgggguuucaccuuguuagccagg

SEQ ID NO: 232711 - RNA, 26 nt, Human
cucaaaccauccucccaccucagccu

SEQ ID NO: 232712 - RNA, 24 nt, Human
cucacugcaaccuccaccuccugg

SEQ ID NO: 232713 - RNA, 27 nt, Human
cucacugcaaccuccaccuccugggcu

SEQ ID NO: 232714 - RNA, 24 nt, Human
cucagccucccaaguagcugggau

SEQ ID NO: 232715 - RNA, 24 nt, Human
cucagccucccgaguagcugggac

SEQ ID NO: 232716 - RNA, 22 nt, Human
cucaggccuggucuccaacucc

SEQ ID NO: 232717 - RNA, 19 nt, Human
cucccagaugaauaaauau

SEQ ID NO: 232718 - RNA, 24 nt, Human
cuccugaccucaugauccacccgc

SEQ ID NO: 232719 - RNA, 19 nt, Human
cuccugaguuuagggguuu

SEQ ID NO: 232720 - RNA, 19 nt, Human
cucgcagccucugccaggc

SEQ ID NO: 232721 - RNA, 23 nt, Human
cucugucgcccaggccagacugc

SEQ ID NO: 232722 - RNA, 19 nt, Human
cucuuauccuucacaggaa

SEQ ID NO: 232723 - RNA, 24 nt, Human
cugcaaccuccaccuccugggcuc

SEQ ID NO: 232724 - RNA, 23 nt, Human
cugccucagccucccaaguagcu

SEQ ID NO: 232725 - RNA, 23 nt, Human
cugccucagccucccgaguagcu

SEQ ID NO: 232726 - RNA, 25 nt, Human
gaagaaaccaaaaucccaacccaag

SEQ ID NO: 232727 - RNA, 22 nt, Human
gaccucaugauccacccgccuc

SEQ ID NO: 232728 - RNA, 28 nt, Human
gaccugcuguguccuagcuggaaacccu

SEQ ID NO: 232729 - RNA, 20 nt, Human
gagacgggguuucaccuugu

SEQ ID NO: 232730 - RNA, 19 nt, Human
gaucauggcucacugcaac

SEQ ID NO: 232731 - RNA, 20 nt, Human
gaucucgcuuuguugcucag

SEQ ID NO: 232732 - RNA, 22 nt, Human
gaugggcaccaggcuggugucc

SEQ ID NO: 232733 - RNA, 18 nt, Human
gauuacaggcgugaggca

SEQ ID NO: 232734 - RNA, 25 nt, Human
gauuacaggcgugaggcaccugugu

SEQ ID NO: 232735 - RNA, 19 nt, Human
gauuacaggcgugaggcca

SEQ ID NO: 232736 - RNA, 23 nt, Human
gauuacaggcgugaggccacugc

SEQ ID NO: 232737 - RNA, 23 nt, Human
gauuacaggcgugaggccacugc

SEQ ID NO: 232738 - RNA, 22 nt, Human
gcaauaacccccuacacagggc

SEQ ID NO: 232739 - RNA, 21 nt, Human
gcaugguuuuuuuuuguuuug

SEQ ID NO: 232740 - RNA, 21 nt, Human
gccagacugcggacugcagug

SEQ ID NO: 232741 - RNA, 19 nt, Human
gcccaggcuggaaagcagu

SEQ ID NO: 232742 - RNA, 24 nt, Human
gcccaggcuggaaagcaguggcau

SEQ ID NO: 232743 - RNA, 19 nt, Human
gcccaggcuggagugcagu

SEQ ID NO: 232744 - RNA, 23 nt, Human
gcccggcuaauuuuuuguauuuu

SEQ ID NO: 232745 - RNA, 20 nt, Human
gccucagccucccaaguagc

SEQ ID NO: 232746 - RNA, 24 nt, Human
gcgauccuccugccucagccuccc

SEQ ID NO: 232747 - RNA, 23 nt, Human
gcuggagugcaguggcucgauca

SEQ ID NO: 232748 - RNA, 25 nt, Human
gcuucccggguucacaccauucucc

SEQ ID NO: 232749 - RNA, 22 nt, Human
ggaucucgcuuuguugcucagg

SEQ ID NO: 232750 - RNA, 25 nt, Human
ggcaggcaaugcuuuggucuucucu

SEQ ID NO: 232751 - RNA, 20 nt, Human
ggcaggggcgggacuccagg

SEQ ID NO: 232752 - RNA, 19 nt, Human
ggcuggagugcaguggcuc

SEQ ID NO: 232753 - RNA, 19 nt, Human
gggccugacauccccugcc

SEQ ID NO: 232754 - RNA, 22 nt, Human
gggcucaggcgauccuccugcc

SEQ ID NO: 232755 - RNA, 22 nt, Human
gggucuuacuauguugcccagg

SEQ ID NO: 232756 - RNA, 24 nt, Human
gggugaccggugacucaggcucug

SEQ ID NO: 232757 - RNA, 20 nt, Human
ggucucgaucuccugaccuc

SEQ ID NO: 232758 - RNA, 19 nt, Human
gugggucaugauucggggg

SEQ ID NO: 232759 - RNA, 24 nt, Human
uaaacacauacccaucaacgacaa

SEQ ID NO: 232760 - RNA, 18 nt, Human
uaaccgggugucucaggc

SEQ ID NO: 232761 - RNA, 19 nt, Human
uaaccgggugucucaggca

SEQ ID NO: 232762 - RNA, 19 nt, Human
uaaccuggcugucuagcaa

SEQ ID NO: 232763 - RNA, 21 nt, Human
uaaggaagguacaaacccacc

SEQ ID NO: 232764 - RNA, 24 nt, Human
uaauuuuuuguauuuuuaguagag

SEQ ID NO: 232765 - RNA, 25 nt, Human
uaauuuuuuguauuuuuaguagaga

SEQ ID NO: 232766 - RNA, 23 nt, Human
uacaaacccaccucgaaagacac

SEQ ID NO: 232767 - RNA, 22 nt, Human
uacauaaagaagaggcauuuca

SEQ ID NO: 232768 - RNA, 19 nt, Human
uacuauguugcccaggcug

SEQ ID NO: 232769 - RNA, 25 nt, Human
uacuauguugcccaggcuggaaagc

SEQ ID NO: 232770 - RNA, 22 nt, Human
uagagaugggaucucgcuuugu

SEQ ID NO: 232771 - RNA, 24 nt, Human
uagggucuucaucuguugcccagg

SEQ ID NO: 232772 - RNA, 21 nt, Human
uaguagagacgggguuucacc

SEQ ID NO: 232773 - RNA, 24 nt, Human
uaguagagacgggguuucaccuug

SEQ ID NO: 232774 - RNA, 26 nt, Human
uaguagagacgggguuucaccuuguu

SEQ ID NO: 232775 - RNA, 22 nt, Human
uauauauguguguauauauaua

SEQ ID NO: 232776 - RNA, 20 nt, Human
uauauguguguauauauaua

SEQ ID NO: 232777 - RNA, 21 nt, Human
uaucuguacagggacgcauuu

SEQ ID NO: 232778 - RNA, 22 nt, Human
uauguguguauauauauauaua

SEQ ID NO: 232779 - RNA, 18 nt, Human
uauguugcccaggcugga

SEQ ID NO: 232780 - RNA, 23 nt, Human
uauguugcccaggcuggaaagca

SEQ ID NO: 232781 - RNA, 25 nt, Human
ucaaaccauccucccaccucagccu

SEQ ID NO: 232782 - RNA, 24 nt, Human
ucaccuuguuagccaggauggucu

SEQ ID NO: 232783 - RNA, 20 nt, Human
ucacgacagccucaaaugcc

SEQ ID NO: 232784 - RNA, 22 nt, Human
ucacgguggagagaaacucaaa

SEQ ID NO: 232785 - RNA, 23 nt, Human
ucacugcaaccuccaccuccugg

SEQ ID NO: 232786 - RNA, 24 nt, Human
ucacugcaaccuccaccuccuggg

SEQ ID NO: 232787 - RNA, 25 nt, Human
ucacugcaaccuccaccuccugggc

SEQ ID NO: 232788 - RNA, 27 nt, Human
ucacugcaaccuccaccuccugggcuc

SEQ ID NO: 232789 - RNA, 23 nt, Human
ucacugcaagcuccgcuucccgg

SEQ ID NO: 232790 - RNA, 24 nt, Human
ucacugcaagcuccgcuucccggg

SEQ ID NO: 232791 - RNA, 21 nt, Human
ucagaaagaaccugaaguccc

SEQ ID NO: 232792 - RNA, 18 nt, Human
ucagccagaucauuuccg

SEQ ID NO: 232793 - RNA, 18 nt, Human
ucagccucccaaagugcu

SEQ ID NO: 232794 - RNA, 18 nt, Human
ucagccucccaaguagcu

SEQ ID NO: 232795 - RNA, 20 nt, Human
ucagccucccaaguagcugg

SEQ ID NO: 232796 - RNA, 23 nt, Human
ucagccucccgaguagcugggac

SEQ ID NO: 232797 - RNA, 24 nt, Human
ucaucuguugcccaggcuggagug

SEQ ID NO: 232798 - RNA, 24 nt, Human
ucauugacacgggcuuucccuggc

SEQ ID NO: 232799 - RNA, 24 nt, Human
ucccaaagugcugggauuacaggc

SEQ ID NO: 232800 - RNA, 24 nt, Human
ucccaaagugcugggauuacaggc

SEQ ID NO: 232801 - RNA, 24 nt, Human
ucccaaguagcugggaucacaggc

SEQ ID NO: 232802 - RNA, 21 nt, Human
uccccccgggccuguuucucu

SEQ ID NO: 232803 - RNA, 20 nt, Human
uccccugcccuuucaucuuc

SEQ ID NO: 232804 - RNA, 22 nt, Human
uccccugcccuuucaucuucca

SEQ ID NO: 232805 - RNA, 23 nt, Human
ucccgaguagcugggacuacagg

SEQ ID NO: 232806 - RNA, 24 nt, Human
ucccgaguagcugggacuacaggu

SEQ ID NO: 232807 - RNA, 20 nt, Human
ucccggguucacaccauucu

SEQ ID NO: 232808 - RNA, 21 nt, Human
ucccggguucacaccauucuc

SEQ ID NO: 232809 - RNA, 24 nt, Human
ucccggguucacaccauucuccug

SEQ ID NO: 232810 - RNA, 20 nt, Human
ucccggucaaccugccccuc

SEQ ID NO: 232811 - RNA, 23 nt, Human
ucccuggggacaauugccaaucc

SEQ ID NO: 232812 - RNA, 27 nt, Human
uccuccugccucagccucccaaguagc

SEQ ID NO: 232813 - RNA, 21 nt, Human
uccugggcucaggcgauccuc

SEQ ID NO: 232814 - RNA, 24 nt, Human
uccugggcucaggcgauccuccug

SEQ ID NO: 232815 - RNA, 18 nt, Human
ucggccucccaaagugcu

SEQ ID NO: 232816 - RNA, 24 nt, Human
ucuccugccucagccucccgagua

SEQ ID NO: 232817 - RNA, 18 nt, Human
ucucgcucugucgcccag

SEQ ID NO: 232818 - RNA, 18 nt, Human
ucucgcucugucgcccag

SEQ ID NO: 232819 - RNA, 19 nt, Human
ucucgcucugucgcccagg

SEQ ID NO: 232820 - RNA, 23 nt, Human
ucucgcucugucgcccaggccag

SEQ ID NO: 232821 - RNA, 24 nt, Human
ucucgcucugucgcccaggccaga

SEQ ID NO: 232822 - RNA, 24 nt, Human
ucucgcuuuguugcucaggccugg

SEQ ID NO: 232823 - RNA, 19 nt, Human
ucucugggccugacauccc

SEQ ID NO: 232824 - RNA, 21 nt, Human
ucucuuauccuucacaggaaa

SEQ ID NO: 232825 - RNA, 23 nt, Human
ucugccaggcagugucccgaccc

SEQ ID NO: 232826 - RNA, 19 nt, Human
ucugucuuugaauaaaaca

SEQ ID NO: 232827 - RNA, 18 nt, Human
ucuguugcccaggcugga

SEQ ID NO: 232828 - RNA, 24 nt, Human
ucuguugcccaggcuggagugcag

SEQ ID NO: 232829 - RNA, 23 nt, Human
ucuuacuauguugcccaggcugg

SEQ ID NO: 232830 - RNA, 24 nt, Human
ucuuacuauguugcccaggcugga

SEQ ID NO: 232831 - RNA, 23 nt, Human
ucuucaucuguugcccaggcugg

SEQ ID NO: 232832 - RNA, 24 nt, Human
ucuucaucuguugcccaggcugga

SEQ ID NO: 232833 - RNA, 19 nt, Human
ugaaagccacuugcuucuc

SEQ ID NO: 232834 - RNA, 22 nt, Human
ugaaauagggucuucaucuguu

SEQ ID NO: 232835 - RNA, 21 nt, Human
ugaacucaagugauccagcuc

SEQ ID NO: 232836 - RNA, 21 nt, Human
ugaccggugacucaggcucug

SEQ ID NO: 232837 - RNA, 21 nt, Human
ugacucaggcucugccucugg

SEQ ID NO: 232838 - RNA, 22 nt, Human
ugagacggagucucgcucuguc

SEQ ID NO: 232839 - RNA, 19 nt, Human
ugaggcaccugugucuggc

SEQ ID NO: 232840 - RNA, 22 nt, Human
ugaggcagggccaggggguccc

SEQ ID NO: 232841 - RNA, 25 nt, Human
ugaggcagggccagggggucccguu

SEQ ID NO: 232842 - RNA, 19 nt, Human
ugaguuuagggguuuggcu

SEQ ID NO: 232843 - RNA, 24 nt, Human
ugcaaggagaccacgggaauggaa

SEQ ID NO: 232844 - RNA, 22 nt, Human
ugcacacaguccaguucgugca

SEQ ID NO: 232845 - RNA, 23 nt, Human
ugcaguggcgcaaucucggcuca

SEQ ID NO: 232846 - RNA, 23 nt, Human
ugccaaucccuugugacaucuuc

SEQ ID NO: 232847 - RNA, 21 nt, Human
ugcccaggcuggagugcagug

SEQ ID NO: 232848 - RNA, 22 nt, Human
ugcccaggcuggagugcagugg

SEQ ID NO: 232849 - RNA, 25 nt, Human
ugcccaggcuggagugcaguggcuc

SEQ ID NO: 232850 - RNA, 24 nt, Human
ugccucagccucccaaguagcugg

SEQ ID NO: 232851 - RNA, 24 nt, Human
ugccucagccucccgaguagcugg

SEQ ID NO: 232852 - RNA, 18 nt, Human
ugccucugggaaguggca

SEQ ID NO: 232853 - RNA, 24 nt, Human
ugcugggauuacaggcgugaggca

SEQ ID NO: 232854 - RNA, 24 nt, Human
ugcugggauuacaggcgugaggcc

SEQ ID NO: 232855 - RNA, 23 nt, Human
uggaagcacuaggugggcggaca

SEQ ID NO: 232856 - RNA, 20 nt, Human
uggagagaaauggagguguc

SEQ ID NO: 232857 - RNA, 19 nt, Human
uggagugcaguggcucgau

SEQ ID NO: 232858 - RNA, 24 nt, Human
uggagugcaguggcucgaucaugg

SEQ ID NO: 232859 - RNA, 18 nt, Human
uggcaggcaaugcuuugg

SEQ ID NO: 232860 - RNA, 18 nt, Human
uggcaggcaaugcuuugg

SEQ ID NO: 232861 - RNA, 23 nt, Human
uggcaggcaaugcuuuggucuuc

SEQ ID NO: 232862 - RNA, 18 nt, Human
uggccagaggccaugggc

SEQ ID NO: 232863 - RNA, 18 nt, Human
uggcuucccgcgauugca

SEQ ID NO: 232864 - RNA, 22 nt, Human
ugggaaguggcaucauuuggug

SEQ ID NO: 232865 - RNA, 21 nt, Human
ugggacuacaggugcccacca

SEQ ID NO: 232866 - RNA, 24 nt, Human
ugggacuacaggugcccaccaccg

SEQ ID NO: 232867 - RNA, 21 nt, Human
ugggaucacaggcacgugcca

SEQ ID NO: 232868 - RNA, 22 nt, Human
ugggaucacaggcacgugccac

SEQ ID NO: 232869 - RNA, 24 nt, Human
ugggaucacaggcacgugccacca

SEQ ID NO: 232870 - RNA, 24 nt, Human
ugggaucccaucccaacacacacg

SEQ ID NO: 232871 - RNA, 24 nt, Human
ugggaucucgcuuuguugcucagg

SEQ ID NO: 232872 - RNA, 18 nt, Human
ugggauuacaggcgugag

SEQ ID NO: 232873 - RNA, 18 nt, Human
ugggauuacaggcgugag

SEQ ID NO: 232874 - RNA, 19 nt, Human
ugggauuacaggcgugagg

SEQ ID NO: 232875 - RNA, 19 nt, Human
ugggauuacaggcgugagg

SEQ ID NO: 232876 - RNA, 21 nt, Human
ugggauuacaggcgugaggca

SEQ ID NO: 232877 - RNA, 22 nt, Human
ugggauuacaggcgugaggcac

SEQ ID NO: 232878 - RNA, 23 nt, Human
ugggauuacaggcgugaggcacc

SEQ ID NO: 232879 - RNA, 23 nt, Human
ugggauuacaggcgugaggcacc

SEQ ID NO: 232880 - RNA, 25 nt, Human
ugggauuacaggcgugaggcaccug

SEQ ID NO: 232881 - RNA, 22 nt, Human
ugggauuacaggcgugaggcca

SEQ ID NO: 232882 - RNA, 23 nt, Human
ugggauuacaggcgugaggccac

SEQ ID NO: 232883 - RNA, 23 nt, Human
ugggauuacaggcgugaggccac

SEQ ID NO: 232884 - RNA, 25 nt, Human
ugggauuacaggcgugaggccacug

SEQ ID NO: 232885 - RNA, 24 nt, Human
ugggcucaggcgauccuccugccu

SEQ ID NO: 232886 - RNA, 24 nt, Human
uggggucuuacuauguugcccagg

SEQ ID NO: 232887 - RNA, 19 nt, Human
ugggugggucaugauucgg

SEQ ID NO: 232888 - RNA, 21 nt, Human
uguccuagcuggaaacccugg

SEQ ID NO: 232889 - RNA, 20 nt, Human
ugucgcccaggccagacugc

SEQ ID NO: 232890 - RNA, 22 nt, Human
ugucuggccaaauucauuuuuu

SEQ ID NO: 232891 - RNA, 18 nt, Human
uguguauauauauauaua

SEQ ID NO: 232892 - RNA, 18 nt, Human
uguguauauauauauaua

SEQ ID NO: 232893 - RNA, 22 nt, Human
uguguauauauauauauaagug

SEQ ID NO: 232894 - RNA, 22 nt, Human
uguguauauauauauauaagug

SEQ ID NO: 232895 - RNA, 24 nt, Human
uguguauauauauauauaaguggc

SEQ ID NO: 232896 - RNA, 26 nt, Human
uguguccuagcuggaaacccuggcuu

SEQ ID NO: 232897 - RNA, 18 nt, Human
uuacaggcgugaggccac

SEQ ID NO: 232898 - RNA, 24 nt, Human
uuaguagagacgggguuucaccuu

SEQ ID NO: 232899 - RNA, 25 nt, Human
uuaguagagacgggguuucaccuug

SEQ ID NO: 232900 - RNA, 21 nt, Human
uucaggcuacaaaaaccuucu

SEQ ID NO: 232901 - RNA, 24 nt, Human
uucaucuguugcccaggcuggagu

SEQ ID NO: 232902 - RNA, 18 nt, Human
uucaucuuccauguuuga

SEQ ID NO: 232903 - RNA, 20 nt, Human
uucaucuuccauguuugagg

SEQ ID NO: 232904 - RNA, 24 nt, Human
uugcccaggcuggagugcaguggc

SEQ ID NO: 232905 - RNA, 24 nt, Human
uuguagagaugggaucucgcuuug

SEQ ID NO: 232906 - RNA, 23 nt, Human
uuguauuuuuaguagagacgggg

SEQ ID NO: 232907 - RNA, 28 nt, Human
uuuauauauauguguguauauauauauu

SEQ ID NO: 232908 - RNA, 20 nt, Human
uuuauuuauuuuuuuuauag

SEQ ID NO: 232909 - RNA, 25 nt, Human
uuuguagagaugggaucucgcuuug

SEQ ID NO: 232910 - RNA, 24 nt, Human
uuuuuaguagagacgggguuucac

SEQ ID NO: 232911 - RNA, 23 nt, Human
uuuuuguagagaugggaucucgc

SEQ ID NO: 232912 - RNA, 21 nt, Human
uuuuuguauuuuuaguagaga

SEQ ID NO: 232913 - RNA, 24 nt, Human
uuuuuuguauuuuuaguagagacg

SEQ ID NO: 232914 - RNA, 21 nt, Human
aaggggaccggagggcaaggg

SEQ ID NO: 232915 - RNA, 21 nt, Human
accagugcauaggaaaaaaga

SEQ ID NO: 232916 - RNA, 25 nt, Human
acuuccaagcacuuccgagugagug

SEQ ID NO: 232917 - RNA, 20 nt, Human
aggaaaaaagaagugucaac

SEQ ID NO: 232918 - RNA, 21 nt, Human
agggcagguggcagcagcagg

SEQ ID NO: 232919 - RNA, 24 nt, Human
caacaauuuggcugccaggcacac

SEQ ID NO: 232920 - RNA, 22 nt, Human
caauagcugggguucaggacac

SEQ ID NO: 232921 - RNA, 21 nt, Human
cagcagcagggcuaugggugg

SEQ ID NO: 232922 - RNA, 20 nt, Human
cagcagcagguaacuggagg

SEQ ID NO: 232923 - RNA, 21 nt, Human
cagcagggcuauggguggucu

SEQ ID NO: 232924 - RNA, 25 nt, Human
cagggcccucccccccgaggcccga

SEQ ID NO: 232925 - RNA, 20 nt, Human
ccaagcacuuccgagugagu

SEQ ID NO: 232926 - RNA, 21 nt, Human
ccaauagcugggguucaggac

SEQ ID NO: 232927 - RNA, 26 nt, Human
ccagccccgaccccagcagcagguaa

SEQ ID NO: 232928 - RNA, 27 nt, Human
cgugcagggcccucccccccgaggccc

SEQ ID NO: 232929 - RNA, 21 nt, Human
cuaaccaggcugaacggcccc

SEQ ID NO: 232930 - RNA, 23 nt, Human
cuauuccuggaacaaagacaagc

SEQ ID NO: 232931 - RNA, 23 nt, Human
cucggaguagguagaaaacuaac

SEQ ID NO: 232932 - RNA, 22 nt, Human
cugcagcaaucugguggggcag

SEQ ID NO: 232933 - RNA, 20 nt, Human
cugccaggcacaccgcgccc

SEQ ID NO: 232934 - RNA, 20 nt, Human
gagggaucccggggauggcc

SEQ ID NO: 232935 - RNA, 18 nt, Human
gagggcaagggggagagc

SEQ ID NO: 232936 - RNA, 19 nt, Human
gcagcagcagggcuauggg

SEQ ID NO: 232937 - RNA, 20 nt, Human
gcggguagguaaggggaccg

SEQ ID NO: 232938 - RNA, 21 nt, Human
ggagagcaguggcuccuggcg

SEQ ID NO: 232939 - RNA, 21 nt, Human
ggagggcaagggggagagcag

SEQ ID NO: 232940 - RNA, 20 nt, Human
ggcagcagcagggcuauggg

SEQ ID NO: 232941 - RNA, 21 nt, Human
gggaucccggggauggccagg

SEQ ID NO: 232942 - RNA, 21 nt, Human
gggugagggcugcggggaggg

SEQ ID NO: 232943 - RNA, 18 nt, Human
guggucugcgcaguuugu

SEQ ID NO: 232944 - RNA, 20 nt, Human
ucagggguuggugagcuguc

SEQ ID NO: 232945 - RNA, 23 nt, Human
uccagguaguauugaggagcuuc

SEQ ID NO: 232946 - RNA, 20 nt, Human
ucucugggaagauguaagcc

SEQ ID NO: 232947 - RNA, 23 nt, Human
ucucugggaagauguaagccugg

SEQ ID NO: 232948 - RNA, 24 nt, Human
ugaggagcugggcugagugcuugu

SEQ ID NO: 232949 - RNA, 21 nt, Human
ugaggcuccagccccgacccc

SEQ ID NO: 232950 - RNA, 23 nt, Human
ugaggcuccagccccgaccccag

SEQ ID NO: 232951 - RNA, 21 nt, Human
ugaguggaugugaaguggcca

SEQ ID NO: 232952 - RNA, 23 nt, Human
ugccaggcacaccgcgccccugc

SEQ ID NO: 232953 - RNA, 24 nt, Human
ugcggggaggggguggcggcgugc

SEQ ID NO: 232954 - RNA, 19 nt, Human
ugcguguccacggaggcgc

SEQ ID NO: 232955 - RNA, 22 nt, Human
uggaaggacaggacucggcucg

SEQ ID NO: 232956 - RNA, 18 nt, Human
uggcagcagcagggcuau

SEQ ID NO: 232957 - RNA, 23 nt, Human
uggcauuuuccagguugguccuc

SEQ ID NO: 232958 - RNA, 18 nt, Human
uggcggcgugcagggccc

SEQ ID NO: 232959 - RNA, 19 nt, Human
ugggaagauguaagccugg

SEQ ID NO: 232960 - RNA, 21 nt, Human
uggggcaggggaggacacucg

SEQ ID NO: 232961 - RNA, 21 nt, Human
uggguggucugcgcaguuugu

SEQ ID NO: 232962 - RNA, 20 nt, Human
uguaaaaccagugcauagga

SEQ ID NO: 232963 - RNA, 18 nt, Human
uguuuuguuuuuaaguac

SEQ ID NO: 232964 - RNA, 18 nt, Human
uuccagguaguauugagg

SEQ ID NO: 232965 - RNA, 27 nt, Human
uuuccagguaguauugaggagcugggc

SEQ ID NO: 232966 - RNA, 19 nt, Human
uuuuuuuuuucuuuuuuua

SEQ ID NO: 232967 - RNA, 21 nt, Human
aaaaaguuuaagaggauggag

SEQ ID NO: 232968 - RNA, 18 nt, Human
aagaggauggagcaaguc

SEQ ID NO: 232969 - RNA, 22 nt, Human
aagcaaccaguucacaugaaca

SEQ ID NO: 232970 - RNA, 21 nt, Human
acagaucaaagagcccgaagc

SEQ ID NO: 232971 - RNA, 22 nt, Human
auacaggcaugcaauguguaau

SEQ ID NO: 232972 - RNA, 19 nt, Human
caucagagugacaaugagu

SEQ ID NO: 232973 - RNA, 18 nt, Human
cuuugaagaauauucaag

SEQ ID NO: 232974 - RNA, 22 nt, Human
gacagaucaaagagcccgaagc

SEQ ID NO: 232975 - RNA, 26 nt, Human
gagcaagucaaguucuaauauuccau

SEQ ID NO: 232976 - RNA, 24 nt, Human
gaucaaagagcccgaagcaaccag

SEQ ID NO: 232977 - RNA, 23 nt, Human
gugagacacaaaaaguuuaagag

SEQ ID NO: 232978 - RNA, 21 nt, Human
uaaaaaauaaaaccacucaga

SEQ ID NO: 232979 - RNA, 20 nt, Human
uaauaaucaugucauggaaa

SEQ ID NO: 232980 - RNA, 20 nt, Human
uagaguugcccccacacucu

SEQ ID NO: 232981 - RNA, 21 nt, Human
uagaguugcccccacacucuc

SEQ ID NO: 232982 - RNA, 24 nt, Human
uagaucuuugggacugagaaaucu

SEQ ID NO: 232983 - RNA, 22 nt, Human
uccauggauagcuauuugauuu

SEQ ID NO: 232984 - RNA, 24 nt, Human
ucuaaaaaauaaaaccacucagau

SEQ ID NO: 232985 - RNA, 20 nt, Human
ucuuagaucuuugggacuga

SEQ ID NO: 232986 - RNA, 18 nt, Human
ucuuugggacugagaaau

SEQ ID NO: 232987 - RNA, 20 nt, Human
uggguacauagguguauaug

SEQ ID NO: 232988 - RNA, 21 nt, Human
uuuaagaggauggagcaaguc

SEQ ID NO: 232989 - RNA, 19 nt, Human
uuugugaacacaaauuucu

SEQ ID NO: 232990 - RNA, 22 nt, Human
aaaaaaagaaaaagaaaaagga

SEQ ID NO: 232991 - RNA, 25 nt, Human
aaaaaaagaaaagaagaaaacagaa

SEQ ID NO: 232992 - RNA, 26 nt, Human
aaaaaagaaaagaagaaaacagaaga

SEQ ID NO: 232993 - RNA, 21 nt, Human
aaaaagaaaaaggagccaccc

SEQ ID NO: 232994 - RNA, 21 nt, Human
aaaaaggagccacccacggug

SEQ ID NO: 232995 - RNA, 18 nt, Human
aaaagaaaaagaaaaagg

SEQ ID NO: 232996 - RNA, 20 nt, Human
aaaagaaaaagaaaaaggag

SEQ ID NO: 232997 - RNA, 24 nt, Human
aaaagaaagaaaaaugaagcagaa

SEQ ID NO: 232998 - RNA, 24 nt, Human
aaaagaagaaaacagaagaaaaaa

SEQ ID NO: 232999 - RNA, 22 nt, Human
aaacagaagaaaaaauaaacug

SEQ ID NO: 233000 - RNA, 23 nt, Human
aaacagaagaaaaaauaaacuga

SEQ ID NO: 233001 - RNA, 23 nt, Human
aaacagauacaaauacagaacau

SEQ ID NO: 233002 - RNA, 25 nt, Human
aaaucccacuaauuggcuaauaaaa

SEQ ID NO: 233003 - RNA, 18 nt, Human
aaaugcagccaaguuacc

SEQ ID NO: 233004 - RNA, 23 nt, Human
aacaagggggugauaaggaaaga

SEQ ID NO: 233005 - RNA, 22 nt, Human
aacucuuccaugaacuccucca

SEQ ID NO: 233006 - RNA, 19 nt, Human
aacuuggcucuugcaguag

SEQ ID NO: 233007 - RNA, 22 nt, Human
aagaaaagaagaaaacagaaga

SEQ ID NO: 233008 - RNA, 19 nt, Human
aagaagaaaacagaagaaa

SEQ ID NO: 233009 - RNA, 20 nt, Human
aagaagaaaacagaagaaaa

SEQ ID NO: 233010 - RNA, 20 nt, Human
aagaagaaaacagaagaaaa

SEQ ID NO: 233011 - RNA, 21 nt, Human
aaucuccgcuccgcuguggga

SEQ ID NO: 233012 - RNA, 21 nt, Human
acaggcaauucacagagaagc

SEQ ID NO: 233013 - RNA, 22 nt, Human
accccgcgaccccgcgucgccg

SEQ ID NO: 233014 - RNA, 25 nt, Human
agaaaaaugaagcagaaacaaagag

SEQ ID NO: 233015 - RNA, 19 nt, Human
agaaaagaaaagaaagaaa

SEQ ID NO: 233016 - RNA, 22 nt, Human
agaaaagaagaaaacagaagaa

SEQ ID NO: 233017 - RNA, 18 nt, Human
agaaacaaagagggaacc

SEQ ID NO: 233018 - RNA, 23 nt, Human
agaagccacuuaccagacaagcu

SEQ ID NO: 233019 - RNA, 27 nt, Human
agacagagggguaacucaagggugggg

SEQ ID NO: 233020 - RNA, 21 nt, Human
agagguccuggggucgcugcc

SEQ ID NO: 233021 - RNA, 18 nt, Human
agccggagcagcugccgc

SEQ ID NO: 233022 - RNA, 18 nt, Human
agcugccccacagccugc

SEQ ID NO: 233023 - RNA, 19 nt, Human
aggaggguccggcggcgcg

SEQ ID NO: 233024 - RNA, 20 nt, Human
aggaggguccggcggcgcgu

SEQ ID NO: 233025 - RNA, 18 nt, Human
aguagacgaaagaggggu

SEQ ID NO: 233026 - RNA, 26 nt, Human
auaaaaacagauacaaauacagaaca

SEQ ID NO: 233027 - RNA, 21 nt, Human
augugcuuuuacauuuccuuu

SEQ ID NO: 233028 - RNA, 19 nt, Human
caaacuggaaugacaaacg

SEQ ID NO: 233029 - RNA, 19 nt, Human
caacagcaggaaagacaga

SEQ ID NO: 233030 - RNA, 24 nt, Human
cagaaacaaagagggaacucuucc

SEQ ID NO: 233031 - RNA, 21 nt, Human
cagaagagguccuggggucgc

SEQ ID NO: 233032 - RNA, 21 nt, Human
cagccggagcagcugccgcgg

SEQ ID NO: 233033 - RNA, 19 nt, Human
caggaaagacagaggggua

SEQ ID NO: 233034 - RNA, 22 nt, Human
caggguaaaauugaugucagug

SEQ ID NO: 233035 - RNA, 24 nt, Human
ccacuggggugcugauggauagcu

SEQ ID NO: 233036 - RNA, 23 nt, Human
cccaaagugcagaggaggguccg

SEQ ID NO: 233037 - RNA, 19 nt, Human
cccacagccugcuagcauu

SEQ ID NO: 233038 - RNA, 18 nt, Human
ccccgaggccgaagggcc

SEQ ID NO: 233039 - RNA, 20 nt, Human
ccgaggccgaagggcacugg

SEQ ID NO: 233040 - RNA, 26 nt, Human
ccggcagccggagcagcugccgcggc

SEQ ID NO: 233041 - RNA, 18 nt, Human
cgcccgccccgaggccga

SEQ ID NO: 233042 - RNA, 24 nt, Human
cgccgggauuugcgcgcggagaac

SEQ ID NO: 233043 - RNA, 19 nt, Human
cggaagcggggcgggcgag

SEQ ID NO: 233044 - RNA, 21 nt, Human
cggccgccgcgcuuucccgcu

SEQ ID NO: 233045 - RNA, 18 nt, Human
cgugcagcaggacagcgg

SEQ ID NO: 233046 - RNA, 27 nt, Human
cucuccacuguaguuaccccggaugcc

SEQ ID NO: 233047 - RNA, 18 nt, Human
cugaaauagggcugccaa

SEQ ID NO: 233048 - RNA, 24 nt, Human
cugcaaaccagucugcugaacgca

SEQ ID NO: 233049 - RNA, 21 nt, Human
gaaaugaaaauucacugcaaa

SEQ ID NO: 233050 - RNA, 20 nt, Human
gacaggcaaaugcagccaag

SEQ ID NO: 233051 - RNA, 19 nt, Human
gaggaaaggagaguuggaa

SEQ ID NO: 233052 - RNA, 28 nt, Human
gcaacagcaggaaagacagagggguaac

SEQ ID NO: 233053 - RNA, 20 nt, Human
gccccgaggccgaagggcac

SEQ ID NO: 233054 - RNA, 18 nt, Human
gcccgaaucccggcggcc

SEQ ID NO: 233055 - RNA, 23 nt, Human
gccgccgcgcuuucccgcuucgg

SEQ ID NO: 233056 - RNA, 23 nt, Human
gcgcaacagcaggaaagacagag

SEQ ID NO: 233057 - RNA, 21 nt, Human
gcggaagcggggcgggcgagc

SEQ ID NO: 233058 - RNA, 21 nt, Human
gcugccuuggcuuugcacguu

SEQ ID NO: 233059 - RNA, 19 nt, Human
ggaacucuuccaugaacuc

SEQ ID NO: 233060 - RNA, 24 nt, Human
ggagcacgccuccccaaagugcag

SEQ ID NO: 233061 - RNA, 20 nt, Human
ggcgacuccgggggcgucug

SEQ ID NO: 233062 - RNA, 18 nt, Human
gggaggaaaggagaguug

SEQ ID NO: 233063 - RNA, 24 nt, Human
gggcggaagcggggcgggcgagcg

SEQ ID NO: 233064 - RNA, 21 nt, Human
gggcgucugcgcggcgcgcgc

SEQ ID NO: 233065 - RNA, 19 nt, Human
ggggaggaaaggagaguug

SEQ ID NO: 233066 - RNA, 23 nt, Human
ggggaucugggcagaagggcccc

SEQ ID NO: 233067 - RNA, 20 nt, Human
ggggcgggcgagcgcggggc

SEQ ID NO: 233068 - RNA, 27 nt, Human
ggugauaaggaaagaaaagggagggcc

SEQ ID NO: 233069 - RNA, 19 nt, Human
ggugcugauggauagcugg

SEQ ID NO: 233070 - RNA, 24 nt, Human
gugggaaaaaaagaaaaagaaaaa

SEQ ID NO: 233071 - RNA, 19 nt, Human
uaacaauucaagugcuggg

SEQ ID NO: 233072 - RNA, 19 nt, Human
uaacgaaacguccacuucc

SEQ ID NO: 233073 - RNA, 23 nt, Human
uaccaacagagugggguuuggcu

SEQ ID NO: 233074 - RNA, 26 nt, Human
uagcugguugcuggcuccaguugcgc

SEQ ID NO: 233075 - RNA, 23 nt, Human
uaggagaaaagaaaagaaagaaa

SEQ ID NO: 233076 - RNA, 22 nt, Human
ucaagggugggggaggaaagga

SEQ ID NO: 233077 - RNA, 23 nt, Human
ucaagggugggggaggaaaggag

SEQ ID NO: 233078 - RNA, 18 nt, Human
uccgcggaaacccucucc

SEQ ID NO: 233079 - RNA, 19 nt, Human
uccgcggaaacccucucca

SEQ ID NO: 233080 - RNA, 24 nt, Human
uccuggggucgcugccuuggcuuu

SEQ ID NO: 233081 - RNA, 24 nt, Human
ucuccgcggaaacccucuccacug

SEQ ID NO: 233082 - RNA, 22 nt, Human
ugaagggugggaaaaaaagaaa

SEQ ID NO: 233083 - RNA, 19 nt, Human
ugauaaggaaagaaaugaa

SEQ ID NO: 233084 - RNA, 20 nt, Human
ugcaagaugcucugggaagu

SEQ ID NO: 233085 - RNA, 20 nt, Human
ugcuaccaacagaguggggu

SEQ ID NO: 233086 - RNA, 23 nt, Human
ugcuagcauucucaugugcuuuu

SEQ ID NO: 233087 - RNA, 19 nt, Human
uggaaggguucgugcagca

SEQ ID NO: 233088 - RNA, 22 nt, Human
uggaaugacaaacguuaggaug

SEQ ID NO: 233089 - RNA, 18 nt, Human
ugggaaaaaaagaaaaag

SEQ ID NO: 233090 - RNA, 21 nt, Human
ugggaagugcacgcagauaug

SEQ ID NO: 233091 - RNA, 24 nt, Human
ugggaagugcacgcagauaugggg

SEQ ID NO: 233092 - RNA, 22 nt, Human
ugggcuuuuuacaacaaggggg

SEQ ID NO: 233093 - RNA, 22 nt, Human
uggggggagaaaagcugcucag

SEQ ID NO: 233094 - RNA, 19 nt, Human
uuaaaaaagcaaaaaaaaa

SEQ ID NO: 233095 - RNA, 21 nt, Human
uuuaaaagcucauagcuagca

SEQ ID NO: 233096 - RNA, 20 nt, Human
uuuaggagaaaagaaaagaa

SEQ ID NO: 233097 - RNA, 24 nt, Human
uuuaggagaaaagaaaagaaagaa

SEQ ID NO: 233098 - RNA, 25 nt, Human
uuuaggagaaaagaaaagaaagaaa

SEQ ID NO: 233099 - RNA, 23 nt, Human
uuuuuuuuuuuuuuuuuuaaaug

SEQ ID NO: 233100 - RNA, 21 nt, Human
aagcagcaggcacaggaaggg

SEQ ID NO: 233101 - RNA, 25 nt, Human
aagcaggaggagggcagccaugugg

SEQ ID NO: 233102 - RNA, 21 nt, Human
aagccagcuccaggcccacgg

SEQ ID NO: 233103 - RNA, 21 nt, Human
aaggcaaacugugccagagac

SEQ ID NO: 233104 - RNA, 20 nt, Human
aaggcauuccuuagcaacaa

SEQ ID NO: 233105 - RNA, 23 nt, Human
aagggccagagccagacgguggg

SEQ ID NO: 233106 - RNA, 22 nt, Human
aagggccgguaguugccgaagc

SEQ ID NO: 233107 - RNA, 21 nt, Human
aaggugaucccauccccaggc

SEQ ID NO: 233108 - RNA, 25 nt, Human
aauuccugcuuggcuuuacuagggg

SEQ ID NO: 233109 - RNA, 20 nt, Human
acacugcaguugccagggaa

SEQ ID NO: 233110 - RNA, 18 nt, Human
acuacccccacaacagaa

SEQ ID NO: 233111 - RNA, 22 nt, Human
acucaguauauucagagaagcc

SEQ ID NO: 233112 - RNA, 18 nt, Human
acugcagcugucaggaac

SEQ ID NO: 233113 - RNA, 19 nt, Human
agaagcuggagcaggggcc

SEQ ID NO: 233114 - RNA, 18 nt, Human
agacccuccucugcacuc

SEQ ID NO: 233115 - RNA, 22 nt, Human
agaccgcggccggccagcauca

SEQ ID NO: 233116 - RNA, 20 nt, Human
agagaagccgccaaggaugg

SEQ ID NO: 233117 - RNA, 21 nt, Human
agagggcagggaggacacccc

SEQ ID NO: 233118 - RNA, 18 nt, Human
agauguuaagguccaacc

SEQ ID NO: 233119 - RNA, 24 nt, Human
agccaugaaaagccuugaagggcu

SEQ ID NO: 233120 - RNA, 18 nt, Human
agccccugccagacccuc

SEQ ID NO: 233121 - RNA, 23 nt, Human
agcuaggcggccugagcagcccc

SEQ ID NO: 233122 - RNA, 21 nt, Human
agcuggaaggcggccagcgcc

SEQ ID NO: 233123 - RNA, 19 nt, Human
agcuggaggucagggcacg

SEQ ID NO: 233124 - RNA, 25 nt, Human
aggaagaggcuucccacucccagga

SEQ ID NO: 233125 - RNA, 20 nt, Human
aggaaggugggugggcuggg

SEQ ID NO: 233126 - RNA, 18 nt, Human
aggcaauggggaggccag

SEQ ID NO: 233127 - RNA, 23 nt, Human
aggcauuccuuagcaacaaugcc

SEQ ID NO: 233128 - RNA, 25 nt, Human
aggccaaggcaaacugugccagaga

SEQ ID NO: 233129 - RNA, 23 nt, Human
aggcugugugucccacaucugcu

SEQ ID NO: 233130 - RNA, 18 nt, Human
agggaaguugugguuauc

SEQ ID NO: 233131 - RNA, 18 nt, Human
agggaggguggcccagag

SEQ ID NO: 233132 - RNA, 22 nt, Human
agguggccucugggcagagggc

SEQ ID NO: 233133 - RNA, 18 nt, Human
agguggcucagauggaag

SEQ ID NO: 233134 - RNA, 21 nt, Human
agguuguggcagggacccagg

SEQ ID NO: 233135 - RNA, 21 nt, Human
agugguggucccgacgcagga

SEQ ID NO: 233136 - RNA, 19 nt, Human
auacuuugauuuuguagga

SEQ ID NO: 233137 - RNA, 21 nt, Human
augaagcagcaggcacaggaa

SEQ ID NO: 233138 - RNA, 18 nt, Human
augaagccuugguggccu

SEQ ID NO: 233139 - RNA, 24 nt, Human
caacaggcuguucccccagccgca

SEQ ID NO: 233140 - RNA, 22 nt, Human
caaggcaaacugugccagagac

SEQ ID NO: 233141 - RNA, 20 nt, Human
cacccccgggucugcuucag

SEQ ID NO: 233142 - RNA, 20 nt, Human
cagaauucccgggaccagcu

SEQ ID NO: 233143 - RNA, 22 nt, Human
cagacccuccucugcacuccuc

SEQ ID NO: 233144 - RNA, 21 nt, Human
cagagacacucugccugugag

SEQ ID NO: 233145 - RNA, 20 nt, Human
cagcaagggaggguggccca

SEQ ID NO: 233146 - RNA, 23 nt, Human
cagccaggcccccucccgacgcc

SEQ ID NO: 233147 - RNA, 24 nt, Human
cagccaggcccccucccgacgccu

SEQ ID NO: 233148 - RNA, 19 nt, Human
cagccccugccagacccuc

SEQ ID NO: 233149 - RNA, 22 nt, Human
cagcgcacccgccacgcacgug

SEQ ID NO: 233150 - RNA, 24 nt, Human
cagcggcccagcaggcggcagugg

SEQ ID NO: 233151 - RNA, 20 nt, Human
cagcggcggcggcccgggac

SEQ ID NO: 233152 - RNA, 24 nt, Human
cagcugcgcgggcgccccguccgu

SEQ ID NO: 233153 - RNA, 23 nt, Human
cagcugucaggaacacaagggca

SEQ ID NO: 233154 - RNA, 20 nt, Human
caggaacacaagggcagucu

SEQ ID NO: 233155 - RNA, 18 nt, Human
caggacccucuccaaggu

SEQ ID NO: 233156 - RNA, 21 nt, Human
cagugguggucccgacgcagg

SEQ ID NO: 233157 - RNA, 25 nt, Human
caguguccgcugcguggaggcugac

SEQ ID NO: 233158 - RNA, 26 nt, Human
caguguccgcugcguggcggcaccug

SEQ ID NO: 233159 - RNA, 22 nt, Human
caguugcaggcaggguauuuag

SEQ ID NO: 233160 - RNA, 24 nt, Human
cauccucucucuagcagcuggagg

SEQ ID NO: 233161 - RNA, 20 nt, Human
ccaaggaagggguggaguug

SEQ ID NO: 233162 - RNA, 23 nt, Human
ccagacccuccucugcacuccuc

SEQ ID NO: 233163 - RNA, 23 nt, Human
ccagccccgcacagcagcgcacc

SEQ ID NO: 233164 - RNA, 25 nt, Human
ccagcggcggcggcccgggaccgag

SEQ ID NO: 233165 - RNA, 24 nt, Human
ccaggcccacggccgcggcccaca

SEQ ID NO: 233166 - RNA, 24 nt, Human
ccagggcugccguuuuuuuuuuuu

SEQ ID NO: 233167 - RNA, 22 nt, Human
cccaagcccuggacacguagga

SEQ ID NO: 233168 - RNA, 18 nt, Human
cccaagcuccgaccccac

SEQ ID NO: 233169 - RNA, 22 nt, Human
cccagaagcuggagcaggggcc

SEQ ID NO: 233170 - RNA, 26 nt, Human
cccagccccggcccagaccgcggccg

SEQ ID NO: 233171 - RNA, 24 nt, Human
cccagcggggccccagggcugccu

SEQ ID NO: 233172 - RNA, 21 nt, Human
ccccagccgcaguccaagccu

SEQ ID NO: 233173 - RNA, 20 nt, Human
cccccaagcuccgaccccac

SEQ ID NO: 233174 - RNA, 23 nt, Human
cccccagccgcaguccaagcccc

SEQ ID NO: 233175 - RNA, 18 nt, Human
cccccgggucugcuucag

SEQ ID NO: 233176 - RNA, 21 nt, Human
cccccucucaccccuuccucc

SEQ ID NO: 233177 - RNA, 19 nt, Human
ccccgcacagcagcgcacc

SEQ ID NO: 233178 - RNA, 21 nt, Human
ccccgcacagcagcgcacccg

SEQ ID NO: 233179 - RNA, 19 nt, Human
ccccugccagacccuccuc

SEQ ID NO: 233180 - RNA, 20 nt, Human
cccggcccagaccgcggccg

SEQ ID NO: 233181 - RNA, 21 nt, Human
cccguccgugcucccagccgc

SEQ ID NO: 233182 - RNA, 22 nt, Human
cccugcacagcucuggcucuuc

SEQ ID NO: 233183 - RNA, 22 nt, Human
ccgaagcccacgcagcggccca

SEQ ID NO: 233184 - RNA, 21 nt, Human
ccgagcaccagcacguaagcc

SEQ ID NO: 233185 - RNA, 21 nt, Human
ccgccacgcacguguccguca

SEQ ID NO: 233186 - RNA, 19 nt, Human
ccgggaccagcuggcagag

SEQ ID NO: 233187 - RNA, 23 nt, Human
ccucucaccccuuccucccugca

SEQ ID NO: 233188 - RNA, 24 nt, Human
ccucugcacuccucugccuaaguc

SEQ ID NO: 233189 - RNA, 21 nt, Human
ccugccagacccuccucugca

SEQ ID NO: 233190 - RNA, 25 nt, Human
cgacagccccagcagugggaaacac

SEQ ID NO: 233191 - RNA, 22 nt, Human
cgccagugggguccccaugauc

SEQ ID NO: 233192 - RNA, 23 nt, Human
cgccccguccgugcucccagccg

SEQ ID NO: 233193 - RNA, 21 nt, Human
cgccggcggcaugaagcagcg

SEQ ID NO: 233194 - RNA, 21 nt, Human
cggcaccuggcuuuggcauug

SEQ ID NO: 233195 - RNA, 18 nt, Human
cggcccagcaggcggcag

SEQ ID NO: 233196 - RNA, 21 nt, Human
cggcccgggaccgagcaccag

SEQ ID NO: 233197 - RNA, 23 nt, Human
cgggccaggggucccagcggcgg

SEQ ID NO: 233198 - RNA, 19 nt, Human
cucccaggaccugccccca

SEQ ID NO: 233199 - RNA, 25 nt, Human
cucccaggaccugcccccaagcuuu

SEQ ID NO: 233200 - RNA, 19 nt, Human
cucucaccccuuccucccu

SEQ ID NO: 233201 - RNA, 19 nt, Human
cugagcagccccugccaga

SEQ ID NO: 233202 - RNA, 19 nt, Human
cugcaaggcccgggccagg

SEQ ID NO: 233203 - RNA, 21 nt, Human
cugcacagcucuggcucuucc

SEQ ID NO: 233204 - RNA, 21 nt, Human
cugcccccaagcuccgacccc

SEQ ID NO: 233205 - RNA, 18 nt, Human
cuggccccgcagcagcag

SEQ ID NO: 233206 - RNA, 23 nt, Human
cugucagacuugcuagggcagca

SEQ ID NO: 233207 - RNA, 23 nt, Human
cuuucuggggaggagacagcaac

SEQ ID NO: 233208 - RNA, 20 nt, Human
gaaagacacaaggaagaggc

SEQ ID NO: 233209 - RNA, 22 nt, Human
gaagcuuaugcuuccuuccaag

SEQ ID NO: 233210 - RNA, 23 nt, Human
gaauuugcccaaaacccacugcc

SEQ ID NO: 233211 - RNA, 22 nt, Human
gacgagggcccagcggggcccc

SEQ ID NO: 233212 - RNA, 21 nt, Human
gacugcagcugucaggaacac

SEQ ID NO: 233213 - RNA, 18 nt, Human
gagaguccacagcuaugg

SEQ ID NO: 233214 - RNA, 19 nt, Human
gagccagacgagggcccag

SEQ ID NO: 233215 - RNA, 18 nt, Human
gagccccacguugcccag

SEQ ID NO: 233216 - RNA, 27 nt, Human
gaggagggcagccauguggaggggcgu

SEQ ID NO: 233217 - RNA, 25 nt, Human
gaggccaggaagggccagagccaga

SEQ ID NO: 233218 - RNA, 24 nt, Human
gcaaagaaagggaauuugcccaaa

SEQ ID NO: 233219 - RNA, 21 nt, Human
gcacccgccacgcacgugucc

SEQ ID NO: 233220 - RNA, 18 nt, Human
gcagcggcccagcaggcg

SEQ ID NO: 233221 - RNA, 18 nt, Human
gcaguccaagccccuggg

SEQ ID NO: 233222 - RNA, 18 nt, Human
gccacagccaugaaaagc

SEQ ID NO: 233223 - RNA, 21 nt, Human
gcccagccccggcccagaccu

SEQ ID NO: 233224 - RNA, 18 nt, Human
gcccccaagcuccgaccc

SEQ ID NO: 233225 - RNA, 18 nt, Human
gccgaagcccacgcagcg

SEQ ID NO: 233226 - RNA, 24 nt, Human
gccgaagcccacgcagcggcccag

SEQ ID NO: 233227 - RNA, 19 nt, Human
gccgacagugcagggccca

SEQ ID NO: 233228 - RNA, 19 nt, Human
gcgcgggcgccccguccgu

SEQ ID NO: 233229 - RNA, 19 nt, Human
gcucagauggaagccaugg

SEQ ID NO: 233230 - RNA, 19 nt, Human
ggagugcuggggucccgag

SEQ ID NO: 233231 - RNA, 24 nt, Human
ggaugcugggauccgagcgcagga

SEQ ID NO: 233232 - RNA, 21 nt, Human
ggcaaggccaaggaaggggug

SEQ ID NO: 233233 - RNA, 20 nt, Human
ggcaccuggcuuuggcauug

SEQ ID NO: 233234 - RNA, 22 nt, Human
ggcagggaggacacccccgggu

SEQ ID NO: 233235 - RNA, 18 nt, Human
ggccucugggcagagggc

SEQ ID NO: 233236 - RNA, 24 nt, Human
ggcugccguuuuuuuuuuuuuuuu

SEQ ID NO: 233237 - RNA, 23 nt, Human
gggccagagccagacgagggccc

SEQ ID NO: 233238 - RNA, 18 nt, Human
ggguauuuagcuggggaa

SEQ ID NO: 233239 - RNA, 21 nt, Human
gguaaggacucuuucugggga

SEQ ID NO: 233240 - RNA, 23 nt, Human
ggugggcugggugguacaguuca

SEQ ID NO: 233241 - RNA, 24 nt, Human
guccgugcucccagccgcccaggg

SEQ ID NO: 233242 - RNA, 21 nt, Human
gucuggccccgcagcagcagc

SEQ ID NO: 233243 - RNA, 21 nt, Human
gugcaacacuuuauugggaaa

SEQ ID NO: 233244 - RNA, 18 nt, Human
gugcuggggucccgaggu

SEQ ID NO: 233245 - RNA, 18 nt, Human
uaagcccagccccggccc

SEQ ID NO: 233246 - RNA, 20 nt, Human
uacacacggugaccugucaa

SEQ ID NO: 233247 - RNA, 19 nt, Human
uacccagaagcuggagcag

SEQ ID NO: 233248 - RNA, 22 nt, Human
uagcaauacaguggcucccuca

SEQ ID NO: 233249 - RNA, 22 nt, Human
uagcaguaagcccagccccggc

SEQ ID NO: 233250 - RNA, 22 nt, Human
uaggcgggcaggggcaaggcca

SEQ ID NO: 233251 - RNA, 20 nt, Human
uaggguaggaaggugggugg

SEQ ID NO: 233252 - RNA, 21 nt, Human
uauuagggcagugguaacaaa

SEQ ID NO: 233253 - RNA, 19 nt, Human
ucacagaauucccgggacc

SEQ ID NO: 233254 - RNA, 20 nt, Human
ucccgacgccugcuaguguc

SEQ ID NO: 233255 - RNA, 22 nt, Human
ucccgugggggugucacuaccc

SEQ ID NO: 233256 - RNA, 18 nt, Human
ucccuagcaacacggggg

SEQ ID NO: 233257 - RNA, 20 nt, Human
ucccuagcaacacgggggca

SEQ ID NO: 233258 - RNA, 20 nt, Human
uccgagcgcaggaagagccc

SEQ ID NO: 233259 - RNA, 21 nt, Human
uccucugcacuccucugccua

SEQ ID NO: 233260 - RNA, 21 nt, Human
uccuuuagcaaccaaacucag

SEQ ID NO: 233261 - RNA, 24 nt, Human
ucgcagcagggccgacagugcagg

SEQ ID NO: 233262 - RNA, 22 nt, Human
ucgcagugauuauuggagaagu

SEQ ID NO: 233263 - RNA, 23 nt, Human
ucuaggugugggggccccccucu

SEQ ID NO: 233264 - RNA, 23 nt, Human
ucucuggauacccagaagcugga

SEQ ID NO: 233265 - RNA, 23 nt, Human
ucugccugugagcaacaugagcc

SEQ ID NO: 233266 - RNA, 20 nt, Human
ucuggacaauacuuugauuu

SEQ ID NO: 233267 - RNA, 21 nt, Human
ugagcagccccugccagaccc

SEQ ID NO: 233268 - RNA, 23 nt, Human
ugaguccuuuagcaaccaaacuc

SEQ ID NO: 233269 - RNA, 24 nt, Human
ugaguccuuuagcaaccaaacuca

SEQ ID NO: 233270 - RNA, 22 nt, Human
ugcaaagaaagggaauuugccc

SEQ ID NO: 233271 - RNA, 18 nt, Human
ugcaaggcccgggccagg

SEQ ID NO: 233272 - RNA, 23 nt, Human
ugccagacccuccucugcacucc

SEQ ID NO: 233273 - RNA, 25 nt, Human
ugcccaaaacccacugcccaggggc

SEQ ID NO: 233274 - RNA, 21 nt, Human
ugcugggauccgagcgcagga

SEQ ID NO: 233275 - RNA, 27 nt, Human
uggaggggcgugugggcucgggagugc

SEQ ID NO: 233276 - RNA, 20 nt, Human
uggcaaaggggcagcuaggc

SEQ ID NO: 233277 - RNA, 18 nt, Human
uggcccucuggcugucag

SEQ ID NO: 233278 - RNA, 22 nt, Human
ugggaaagauuuacacacggug

SEQ ID NO: 233279 - RNA, 19 nt, Human
ugggcugggugguacaguu

SEQ ID NO: 233280 - RNA, 23 nt, Human
uggggaggagacagcagccuggu

SEQ ID NO: 233281 - RNA, 23 nt, Human
ugggguccccaugaucuuuguug

SEQ ID NO: 233282 - RNA, 24 nt, Human
uguaggcgggcaggggcaaggcca

SEQ ID NO: 233283 - RNA, 22 nt, Human
ugucauaggccaagcgaugaga

SEQ ID NO: 233284 - RNA, 18 nt, Human
uucacagaauucccggga

SEQ ID NO: 233285 - RNA, 24 nt, Human
uucacgguugcuagggagauguuc

SEQ ID NO: 233286 - RNA, 18 nt, Human
uucccacucccaggaccu

SEQ ID NO: 233287 - RNA, 18 nt, Human
uucccccagccgcagucc

SEQ ID NO: 233288 - RNA, 21 nt, Human
uuccuggucgcagugauuauu

SEQ ID NO: 233289 - RNA, 21 nt, Human
uuccuuagcaacaaugccuag

SEQ ID NO: 233290 - RNA, 21 nt, Human
uuuagaaaaaccuucaauucc

SEQ ID NO: 233291 - RNA, 20 nt, Human
uuuuuuuuuuuuaacaaguc

SEQ ID NO: 233292 - RNA, 18 nt, Human
uuuuuuuuuuuuucuuug

SEQ ID NO: 233293 - RNA, 24 nt, Human
uuuuuuuuuuuuuuuuuuaacaag

SEQ ID NO: 233294 - RNA, 21 nt, Human
aaacauuccccaccccugggg

SEQ ID NO: 233295 - RNA, 26 nt, Human
aaagaacccaccacacaaauguuauu

SEQ ID NO: 233296 - RNA, 21 nt, Human
aaagaccacucccuagcaguc

SEQ ID NO: 233297 - RNA, 24 nt, Human
aaagugcugggauuacaggcguga

SEQ ID NO: 233298 - RNA, 18 nt, Human
aacacugugauguaacau

SEQ ID NO: 233299 - RNA, 22 nt, Human
aagagccuggagaagcuggugc

SEQ ID NO: 233300 - RNA, 21 nt, Human
aagcgauucuccugucucagc

SEQ ID NO: 233301 - RNA, 23 nt, Human
aaggaccccugcucugaagaucg

SEQ ID NO: 233302 - RNA, 19 nt, Human
aagugcugggauuacaggc

SEQ ID NO: 233303 - RNA, 19 nt, Human
aagugcugggauuacaggc

SEQ ID NO: 233304 - RNA, 26 nt, Human
aagugcugggauuacaggcgugagcc

SEQ ID NO: 233305 - RNA, 21 nt, Human
aauuagccauugugccagguu

SEQ ID NO: 233306 - RNA, 19 nt, Human
aauucacaucccucaccuc

SEQ ID NO: 233307 - RNA, 19 nt, Human
acacaccaaaccuuccaac

SEQ ID NO: 233308 - RNA, 21 nt, Human
acacaccaaaccuuccaacaa

SEQ ID NO: 233309 - RNA, 23 nt, Human
acaccaaaccuuccaacaaaaca

SEQ ID NO: 233310 - RNA, 19 nt, Human
accaaggaccccugcucug

SEQ ID NO: 233311 - RNA, 22 nt, Human
accauguuggccaggaugcucg

SEQ ID NO: 233312 - RNA, 22 nt, Human
accccucugcccucucugaaau

SEQ ID NO: 233313 - RNA, 18 nt, Human
accuugugauccccccac

SEQ ID NO: 233314 - RNA, 24 nt, Human
accuugugauccccccaccuuggc

SEQ ID NO: 233315 - RNA, 18 nt, Human
acgggguuucaccauguu

SEQ ID NO: 233316 - RNA, 23 nt, Human
acgggguuucaccauguuggcca

SEQ ID NO: 233317 - RNA, 24 nt, Human
acgggguuucaccauguuggccag

SEQ ID NO: 233318 - RNA, 19 nt, Human
acucuccgccucccagguu

SEQ ID NO: 233319 - RNA, 24 nt, Human
acuuuuguguuuuuaguagagacg

SEQ ID NO: 233320 - RNA, 23 nt, Human
agaaaacacauucuagauccuuc

SEQ ID NO: 233321 - RNA, 22 nt, Human
agacaagaacuacaauuuggca

SEQ ID NO: 233322 - RNA, 27 nt, Human
agaccccuggcccuggcugaccccaag

SEQ ID NO: 233323 - RNA, 27 nt, Human
agagccuggagaagcugggaccaaagu

SEQ ID NO: 233324 - RNA, 25 nt, Human
aggccggagugcaguggcgcgaucu

SEQ ID NO: 233325 - RNA, 18 nt, Human
agggcaacaccauugcaa

SEQ ID NO: 233326 - RNA, 24 nt, Human
agucacaguagaaaugaaaccagu

SEQ ID NO: 233327 - RNA, 18 nt, Human
agugcaagcaggguuccc

SEQ ID NO: 233328 - RNA, 23 nt, Human
agugcaguggcgcgaucuuggcu

SEQ ID NO: 233329 - RNA, 24 nt, Human
agugcaguggcgcgaucuuggcuc

SEQ ID NO: 233330 - RNA, 18 nt, Human
agugcugggauuacaggc

SEQ ID NO: 233331 - RNA, 18 nt, Human
aguggcugggacuacagg

SEQ ID NO: 233332 - RNA, 19 nt, Human
aguggcugggacuacaggc

SEQ ID NO: 233333 - RNA, 22 nt, Human
aguggcuuagaggagucaggga

SEQ ID NO: 233334 - RNA, 21 nt, Human
aucagcuucuccaggcucuuu

SEQ ID NO: 233335 - RNA, 20 nt, Human
auccaccacccacuguguga

SEQ ID NO: 233336 - RNA, 21 nt, Human
aucccugagggcaggccucaa

SEQ ID NO: 233337 - RNA, 24 nt, Human
aucucgcucugucaucaggccgga

SEQ ID NO: 233338 - RNA, 21 nt, Human
caaagcaucagcuucuccagg

SEQ ID NO: 233339 - RNA, 24 nt, Human
caaagugcugggauuacaggcgug

SEQ ID NO: 233340 - RNA, 18 nt, Human
caacaaaacaggcuucuc

SEQ ID NO: 233341 - RNA, 23 nt, Human
caacaccauugcaaacacuguga

SEQ ID NO: 233342 - RNA, 18 nt, Human
caagccccaaauaggaac

SEQ ID NO: 233343 - RNA, 18 nt, Human
caagccccaaauaggaag

SEQ ID NO: 233344 - RNA, 18 nt, Human
caccauguuggccaggau

SEQ ID NO: 233345 - RNA, 22 nt, Human
caccauguuggccaggaugcuc

SEQ ID NO: 233346 - RNA, 18 nt, Human
caccgcacccggccaaac

SEQ ID NO: 233347 - RNA, 20 nt, Human
cacucaaaauggguucagcu

SEQ ID NO: 233348 - RNA, 22 nt, Human
cacuccuuccaaagaacccacc

SEQ ID NO: 233349 - RNA, 19 nt, Human
cacugugugauagcaaaaa

SEQ ID NO: 233350 - RNA, 19 nt, Human
cagcaggaugguggcagac

SEQ ID NO: 233351 - RNA, 24 nt, Human
caggaccaccugcuaaaggaguuu

SEQ ID NO: 233352 - RNA, 21 nt, Human
caggcgcccgccaccacgcuc

SEQ ID NO: 233353 - RNA, 19 nt, Human
cagggaaauugacagaguc

SEQ ID NO: 233354 - RNA, 23 nt, Human
cagggccagaaacuucucuccag

SEQ ID NO: 233355 - RNA, 18 nt, Human
cagggggugccuggccag

SEQ ID NO: 233356 - RNA, 18 nt, Human
caguagaaaugaaaccag

SEQ ID NO: 233357 - RNA, 19 nt, Human
caguggcgcgaucuuggcu

SEQ ID NO: 233358 - RNA, 18 nt, Human
cauccugguggccuggcc

SEQ ID NO: 233359 - RNA, 18 nt, Human
caugaaaaacauccuaag

SEQ ID NO: 233360 - RNA, 24 nt, Human
ccaaaccuccucuuucaucuuccu

SEQ ID NO: 233361 - RNA, 18 nt, Human
ccaaacuuuuuuuuuuuu

SEQ ID NO: 233362 - RNA, 22 nt, Human
ccaaagaacccaccacacaaau

SEQ ID NO: 233363 - RNA, 22 nt, Human
ccaaagugcugggauuacaggc

SEQ ID NO: 233364 - RNA, 22 nt, Human
ccaaagugcugggauuacaggc

SEQ ID NO: 233365 - RNA, 24 nt, Human
ccaaagugcugggauuacaggcgu

SEQ ID NO: 233366 - RNA, 24 nt, Human
ccacuggaguaaaaaccccccaag

SEQ ID NO: 233367 - RNA, 27 nt, Human
ccagaauaaaaugcagaauaaauaaag

SEQ ID NO: 233368 - RNA, 24 nt, Human
cccaaacauuccccaccccugggu

SEQ ID NO: 233369 - RNA, 20 nt, Human
cccaaagagccuggagaagc

SEQ ID NO: 233370 - RNA, 23 nt, Human
cccagguuuaagcgauucuccug

SEQ ID NO: 233371 - RNA, 26 nt, Human
ccccccaccuuggccucccaaagugc

SEQ ID NO: 233372 - RNA, 21 nt, Human
ccccugggcacggccccccuc

SEQ ID NO: 233373 - RNA, 23 nt, Human
cccgaguggcugggacuacaggc

SEQ ID NO: 233374 - RNA, 24 nt, Human
cccgaguggcugggacuacaggcg

SEQ ID NO: 233375 - RNA, 21 nt, Human
cccgccaccacgcucagcuaa

SEQ ID NO: 233376 - RNA, 20 nt, Human
cccucagcucauaccauuuc

SEQ ID NO: 233377 - RNA, 19 nt, Human
cccuccugucucuucuuuc

SEQ ID NO: 233378 - RNA, 27 nt, Human
ccgccucccagguuuaagcgauucuuu

SEQ ID NO: 233379 - RNA, 24 nt, Human
ccuccagugggaagggcauccugg

SEQ ID NO: 233380 - RNA, 24 nt, Human
ccucccagguuuaagcgauucucc

SEQ ID NO: 233381 - RNA, 18 nt, Human
ccucucugaaaucacccc

SEQ ID NO: 233382 - RNA, 21 nt, Human
ccuggagaagcuggugcuuug

SEQ ID NO: 233383 - RNA, 20 nt, Human
ccugguccuuggagauccac

SEQ ID NO: 233384 - RNA, 19 nt, Human
ccugguggccuggccuggg

SEQ ID NO: 233385 - RNA, 22 nt, Human
ccuucaaacucuaccucgaaac

SEQ ID NO: 233386 - RNA, 19 nt, Human
ccuuggugggaaucccaga

SEQ ID NO: 233387 - RNA, 19 nt, Human
cgaaacuccucuuuuccag

SEQ ID NO: 233388 - RNA, 18 nt, Human
cgagagaacuaacuggag

SEQ ID NO: 233389 - RNA, 22 nt, Human
cgagucacucaaaauggguuca

SEQ ID NO: 233390 - RNA, 18 nt, Human
cgcaagaucccugagggc

SEQ ID NO: 233391 - RNA, 24 nt, Human
cggagugcaguggcgcgaucuugg

SEQ ID NO: 233392 - RNA, 18 nt, Human
cucaaaauggguucagcu

SEQ ID NO: 233393 - RNA, 24 nt, Human
cucaccuccuucaaacucuaccuc

SEQ ID NO: 233394 - RNA, 22 nt, Human
cucagccucccgaguggcuggg

SEQ ID NO: 233395 - RNA, 24 nt, Human
cucagccucccgaguggcugggac

SEQ ID NO: 233396 - RNA, 21 nt, Human
cucuuugcuggguggaccccc

SEQ ID NO: 233397 - RNA, 21 nt, Human
cugcccucucugaaaucaccc

SEQ ID NO: 233398 - RNA, 22 nt, Human
cugcccucucugaaaucacccc

SEQ ID NO: 233399 - RNA, 21 nt, Human
cuggugcuuugcuucaaaucc

SEQ ID NO: 233400 - RNA, 23 nt, Human
cugucucagccucccgaguggcu

SEQ ID NO: 233401 - RNA, 21 nt, Human
cuuaccacugccccaacaaau

SEQ ID NO: 233402 - RNA, 24 nt, Human
cuuccaaagaacccaccacacaaa

SEQ ID NO: 233403 - RNA, 27 nt, Human
cuugugauccccccaccuuggccuccc

SEQ ID NO: 233404 - RNA, 22 nt, Human
cuuugcuucaaauccauccaga

SEQ ID NO: 233405 - RNA, 20 nt, Human
cuuuuguguuuuuaguagag

SEQ ID NO: 233406 - RNA, 23 nt, Human
gaaauugacagaguccuggauaa

SEQ ID NO: 233407 - RNA, 19 nt, Human
gaagaucgcagucaccagu

SEQ ID NO: 233408 - RNA, 21 nt, Human
gaccuugugauccccccaccu

SEQ ID NO: 233409 - RNA, 24 nt, Human
gacggaaucucgcucugucaucag

SEQ ID NO: 233410 - RNA, 24 nt, Human
gagacgggguuucaccauguuggc

SEQ ID NO: 233411 - RNA, 19 nt, Human
gagcuuaccacugccccaa

SEQ ID NO: 233412 - RNA, 19 nt, Human
gaucccugagggcaggccu

SEQ ID NO: 233413 - RNA, 26 nt, Human
gaucucacuccuuccaaagaacccac

SEQ ID NO: 233414 - RNA, 18 nt, Human
gauuacaggcgugagcca

SEQ ID NO: 233415 - RNA, 22 nt, Human
gauuacaggcgugagccaccgc

SEQ ID NO: 233416 - RNA, 23 nt, Human
gauuacaggcgugagccaccgca

SEQ ID NO: 233417 - RNA, 21 nt, Human
gauucuccugucucagccucc

SEQ ID NO: 233418 - RNA, 19 nt, Human
gcaaaaggcuuaagacacc

SEQ ID NO: 233419 - RNA, 22 nt, Human
gcagcccacucuuugcugggug

SEQ ID NO: 233420 - RNA, 21 nt, Human
gccaggccucacaaccccccu

SEQ ID NO: 233421 - RNA, 19 nt, Human
gccggagugcaguggcgcg

SEQ ID NO: 233422 - RNA, 24 nt, Human
gcgauucuccugucucagccuccc

SEQ ID NO: 233423 - RNA, 21 nt, Human
gcgcgaucuuggcucacugua

SEQ ID NO: 233424 - RNA, 21 nt, Human
gcugaccccaaagagccugga

SEQ ID NO: 233425 - RNA, 18 nt, Human
ggaguccuggcacucgcc

SEQ ID NO: 233426 - RNA, 23 nt, Human
ggagugcaguggcgcgaucuugg

SEQ ID NO: 233427 - RNA, 19 nt, Human
ggccuggccuggggagucc

SEQ ID NO: 233428 - RNA, 22 nt, Human
gggauuggaaacugcacuccag

SEQ ID NO: 233429 - RNA, 18 nt, Human
ggggucagccagggccag

SEQ ID NO: 233430 - RNA, 23 nt, Human
gggguuucaccauguuggccagg

SEQ ID NO: 233431 - RNA, 22 nt, Human
ggguuucaccauguuggccagg

SEQ ID NO: 233432 - RNA, 24 nt, Human
gguuucaccauguuggccaggaug

SEQ ID NO: 233433 - RNA, 21 nt, Human
guaauuuuggccuugcuuggg

SEQ ID NO: 233434 - RNA, 23 nt, Human
guagagacgggguuucaccaugu

SEQ ID NO: 233435 - RNA, 19 nt, Human
gucacaguagaaaugaaac

SEQ ID NO: 233436 - RNA, 23 nt, Human
gugcucagucuuaaaguuaacug

SEQ ID NO: 233437 - RNA, 19 nt, Human
guggauguggucuucaugg

SEQ ID NO: 233438 - RNA, 24 nt, Human
guucccugugggccccugggcacg

SEQ ID NO: 233439 - RNA, 26 nt, Human
uaacucacugcucacacuuuuaccuc

SEQ ID NO: 233440 - RNA, 24 nt, Human
uaacuuuuguguuuuuaguagaga

SEQ ID NO: 233441 - RNA, 22 nt, Human
uaagacggaaucucgcucuguc

SEQ ID NO: 233442 - RNA, 19 nt, Human
uacaggcgcccgccaccac

SEQ ID NO: 233443 - RNA, 23 nt, Human
uacaggcgugagccaccgcaccc

SEQ ID NO: 233444 - RNA, 20 nt, Human
uaccuggcucacguaaugcu

SEQ ID NO: 233445 - RNA, 22 nt, Human
uagagacgggguuucaccaugu

SEQ ID NO: 233446 - RNA, 18 nt, Human
uagcagucggagaaagcc

SEQ ID NO: 233447 - RNA, 24 nt, Human
uaguagagacgggguuucaccaug

SEQ ID NO: 233448 - RNA, 25 nt, Human
uaguagagacgggguuucaccaugu

SEQ ID NO: 233449 - RNA, 19 nt, Human
ucacacuuuuaccucugcc

SEQ ID NO: 233450 - RNA, 19 nt, Human
ucacaucccucaccuccuu

SEQ ID NO: 233451 - RNA, 18 nt, Human
ucacuccaugauaggaaa

SEQ ID NO: 233452 - RNA, 18 nt, Human
ucacuccuuccaaagaac

SEQ ID NO: 233453 - RNA, 23 nt, Human
ucacuguacucuccgccucccag

SEQ ID NO: 233454 - RNA, 24 nt, Human
ucacuguacucuccgccucccagg

SEQ ID NO: 233455 - RNA, 18 nt, Human
ucagaaaacacauucuag

SEQ ID NO: 233456 - RNA, 24 nt, Human
ucagacaagaacuacaauuuggca

SEQ ID NO: 233457 - RNA, 19 nt, Human
ucagccagacccaucuaug

SEQ ID NO: 233458 - RNA, 23 nt, Human
ucagccucccgaguggcugggac

SEQ ID NO: 233459 - RNA, 23 nt, Human
ucaggccggagugcaguggcgcg

SEQ ID NO: 233460 - RNA, 24 nt, Human
uccaaaggcucugccuaccccucu

SEQ ID NO: 233461 - RNA, 19 nt, Human
uccacacaccaaaccuucc

SEQ ID NO: 233462 - RNA, 21 nt, Human
uccacacaccaaaccuuccaa

SEQ ID NO: 233463 - RNA, 19 nt, Human
uccagaaagcgcucggucu

SEQ ID NO: 233464 - RNA, 24 nt, Human
ucccaaagugcugggauuacaggc

SEQ ID NO: 233465 - RNA, 24 nt, Human
ucccagaugcagcccacucuuugc

SEQ ID NO: 233466 - RNA, 19 nt, Human
ucccaggauggcuucuugg

SEQ ID NO: 233467 - RNA, 21 nt, Human
ucccagguuuaagcgauucuc

SEQ ID NO: 233468 - RNA, 24 nt, Human
ucccagguuuaagcgauucuccug

SEQ ID NO: 233469 - RNA, 19 nt, Human
uccccccaccuuggccucc

SEQ ID NO: 233470 - RNA, 24 nt, Human
ucccgaguggcugggacuacaggc

SEQ ID NO: 233471 - RNA, 23 nt, Human
ucccugagggcaggccucaaucu

SEQ ID NO: 233472 - RNA, 19 nt, Human
uccugucucuucuuucucu

SEQ ID NO: 233473 - RNA, 24 nt, Human
ucuccacacaccaaaccuuccaac

SEQ ID NO: 233474 - RNA, 18 nt, Human
ucuccagggggugccugg

SEQ ID NO: 233475 - RNA, 26 nt, Human
ucuccugucucagccucccgaguggc

SEQ ID NO: 233476 - RNA, 23 nt, Human
ucucgcucugucaucaggccgga

SEQ ID NO: 233477 - RNA, 22 nt, Human
ucugaaaucaccccuggucaca

SEQ ID NO: 233478 - RNA, 22 nt, Human
ucugcccaaacauuccccaccc

SEQ ID NO: 233479 - RNA, 20 nt, Human
ucugcccucucugaaaucac

SEQ ID NO: 233480 - RNA, 22 nt, Human
ucugcccucucugaaaucaccc

SEQ ID NO: 233481 - RNA, 18 nt, Human
ucugccuaccccucugcc

SEQ ID NO: 233482 - RNA, 27 nt, Human
ugaaaaacauccuaagcaauugcagaa

SEQ ID NO: 233483 - RNA, 18 nt, Human
ugaccuugugaucccccc

SEQ ID NO: 233484 - RNA, 18 nt, Human
ugagcaaaaggcuuaaga

SEQ ID NO: 233485 - RNA, 18 nt, Human
ugagcaaaaggcuuaaga

SEQ ID NO: 233486 - RNA, 25 nt, Human
ugagccaaucagacaagaacuacaa

SEQ ID NO: 233487 - RNA, 23 nt, Human
ugagugcgguuugaccacuggga

SEQ ID NO: 233488 - RNA, 21 nt, Human
ugauaggaaagaccacucccu

SEQ ID NO: 233489 - RNA, 22 nt, Human
ugcaagccccaaauaggaacac

SEQ ID NO: 233490 - RNA, 22 nt, Human
ugcaguggcgcgaucuuggcuc

SEQ ID NO: 233491 - RNA, 24 nt, Human
ugcugggauuacaggcgugagcca

SEQ ID NO: 233492 - RNA, 21 nt, Human
ugcugucaacugcaccaugca

SEQ ID NO: 233493 - RNA, 22 nt, Human
uggaagaguggcuuagaggagu

SEQ ID NO: 233494 - RNA, 25 nt, Human
uggaauucucagagggaaccuuguu

SEQ ID NO: 233495 - RNA, 19 nt, Human
uggagagccaccuuugcca

SEQ ID NO: 233496 - RNA, 21 nt, Human
uggccaggaugcucgccaucu

SEQ ID NO: 233497 - RNA, 24 nt, Human
uggccuggccuggggaguccuggc

SEQ ID NO: 233498 - RNA, 19 nt, Human
uggcugaccccaaagagcc

SEQ ID NO: 233499 - RNA, 23 nt, Human
uggcuguuauggucuuauguauu

SEQ ID NO: 233500 - RNA, 19 nt, Human
ugggaagggcauccuggug

SEQ ID NO: 233501 - RNA, 21 nt, Human
ugggaagggcauccugguggc

SEQ ID NO: 233502 - RNA, 21 nt, Human
ugggacuacaggcgcccgcca

SEQ ID NO: 233503 - RNA, 22 nt, Human
ugggacuacaggcgcccgccac

SEQ ID NO: 233504 - RNA, 24 nt, Human
ugggacuacaggcgcccgccacca

SEQ ID NO: 233505 - RNA, 19 nt, Human
ugggauuacaggcgugagc

SEQ ID NO: 233506 - RNA, 21 nt, Human
ugggauuacaggcgugagcca

SEQ ID NO: 233507 - RNA, 22 nt, Human
ugggauuacaggcgugagccac

SEQ ID NO: 233508 - RNA, 23 nt, Human
ugggauuacaggcgugagccacc

SEQ ID NO: 233509 - RNA, 24 nt, Human
ugggauuacaggcgugagccaccg

SEQ ID NO: 233510 - RNA, 18 nt, Human
ugggauuggaaacugcac

SEQ ID NO: 233511 - RNA, 22 nt, Human
ugggccccugggcacggccccc

SEQ ID NO: 233512 - RNA, 24 nt, Human
ugggugcagacaccuacauaugac

SEQ ID NO: 233513 - RNA, 23 nt, Human
ugguccugccaccuguuggcugu

SEQ ID NO: 233514 - RNA, 19 nt, Human
uggucuucauggaacuccu

SEQ ID NO: 233515 - RNA, 18 nt, Human
ugguggcagaccccaaac

SEQ ID NO: 233516 - RNA, 23 nt, Human
ugguggcagaccccaaaccuccu

SEQ ID NO: 233517 - RNA, 24 nt, Human
ugguggccuggccuggggaguccu

SEQ ID NO: 233518 - RNA, 24 nt, Human
ugucucagccucccgaguggcugg

SEQ ID NO: 233519 - RNA, 20 nt, Human
ugugggccccugggcacggc

SEQ ID NO: 233520 - RNA, 20 nt, Human
uguguugcugggaguuccug

SEQ ID NO: 233521 - RNA, 21 nt, Human
uguuacaaagugcaagcaggg

SEQ ID NO: 233522 - RNA, 24 nt, Human
uguuauggucuuauguauuuucuu

SEQ ID NO: 233523 - RNA, 18 nt, Human
uuaguagagacgggguuu

SEQ ID NO: 233524 - RNA, 22 nt, Human
uuaguagagacgggguuucacc

SEQ ID NO: 233525 - RNA, 24 nt, Human
uuaguagagacgggguuucaccau

SEQ ID NO: 233526 - RNA, 21 nt, Human
uuauggucuuauguauuuucu

SEQ ID NO: 233527 - RNA, 21 nt, Human
uucaagcaaaaggaggcuuag

SEQ ID NO: 233528 - RNA, 19 nt, Human
uuccaaagaacccaccaca

SEQ ID NO: 233529 - RNA, 19 nt, Human
uuccagcuuguguugcugg

SEQ ID NO: 233530 - RNA, 24 nt, Human
uuggaagaguggcuuagaggaguc

SEQ ID NO: 233531 - RNA, 18 nt, Human
uuggccucccaaagugcu

SEQ ID NO: 233532 - RNA, 20 nt, Human
uuuaagacggaaucucgcuc

SEQ ID NO: 233533 - RNA, 23 nt, Human
uuuaagcgauucuccugucucag

SEQ ID NO: 233534 - RNA, 24 nt, Human
uuuaagcgauucuccugucucagc

SEQ ID NO: 233535 - RNA, 19 nt, Human
uuucaccauguuggccagg

SEQ ID NO: 233536 - RNA, 20 nt, Human
uuucaccauguuggccagga

SEQ ID NO: 233537 - RNA, 24 nt, Human
uuuguguuuuuaguagagacgggg

SEQ ID NO: 233538 - RNA, 24 nt, Human
uuuuuaguagagacgggguuucac

SEQ ID NO: 233539 - RNA, 27 nt, Human
aaguacacccauaauccucuaaggcac

SEQ ID NO: 233540 - RNA, 20 nt, Human
acucugguuucuuuucucuc

SEQ ID NO: 233541 - RNA, 21 nt, Human
acuucagagaaguacacccau

SEQ ID NO: 233542 - RNA, 21 nt, Human
agaaguacacccauaauccuc

SEQ ID NO: 233543 - RNA, 23 nt, Human
agagaaguacacccauaauccuc

SEQ ID NO: 233544 - RNA, 26 nt, Human
cacccacaacuauaaucuauuacacu

SEQ ID NO: 233545 - RNA, 22 nt, Human
cagccugcccaagccagaccgg

SEQ ID NO: 233546 - RNA, 19 nt, Human
cauaagaaaagucagucca

SEQ ID NO: 233547 - RNA, 24 nt, Human
cccgggcagccugcccaagccaga

SEQ ID NO: 233548 - RNA, 27 nt, Human
cucugguuucuuuucucucucccaccc

SEQ ID NO: 233549 - RNA, 19 nt, Human
gcccaagccagaccggcuc

SEQ ID NO: 233550 - RNA, 25 nt, Human
gcccgggcagccugcccaagccaga

SEQ ID NO: 233551 - RNA, 18 nt, Human
ggccgcggcugcuuccgg

SEQ ID NO: 233552 - RNA, 21 nt, Human
ggccgcggcugcuuccggcuu

SEQ ID NO: 233553 - RNA, 19 nt, Human
gggccgcggcugcuuccgg

SEQ ID NO: 233554 - RNA, 23 nt, Human
uaaggcacaucccagcauaagaa

SEQ ID NO: 233555 - RNA, 20 nt, Human
ugcccaagccagaccggcuc

SEQ ID NO: 233556 - RNA, 25 nt, Human
ugcuuccggcuuccugccacggccc

SEQ ID NO: 233557 - RNA, 19 nt, Human
uuccugccacggcccgggc

SEQ ID NO: 233558 - RNA, 18 nt, Human
uuggacucugguuucuuu

SEQ ID NO: 233559 - RNA, 21 nt, Human
aaaauauuagaugagccacug

SEQ ID NO: 233560 - RNA, 25 nt, Human
aaauaacugaaagcugaaaccucuu

SEQ ID NO: 233561 - RNA, 24 nt, Human
aaauauuaguuaaggaucuaaaac

SEQ ID NO: 233562 - RNA, 19 nt, Human
aaaucuagaaaucaagguc

SEQ ID NO: 233563 - RNA, 23 nt, Human
aaaugcgcuucagagccccacca

SEQ ID NO: 233564 - RNA, 21 nt, Human
aaccgcacgugagaaccagca

SEQ ID NO: 233565 - RNA, 22 nt, Human
aagaaccccaaaugcgcuucag

SEQ ID NO: 233566 - RNA, 25 nt, Human
aagaaccccaaaugcgcuucagagc

SEQ ID NO: 233567 - RNA, 19 nt, Human
aagccgagaaagagcuccg

SEQ ID NO: 233568 - RNA, 25 nt, Human
aaggagcccaggggccugagccugc

SEQ ID NO: 233569 - RNA, 19 nt, Human
acagugaauccacugcagc

SEQ ID NO: 233570 - RNA, 20 nt, Human
acccagagggcacagggcaa

SEQ ID NO: 233571 - RNA, 21 nt, Human
accccaaaugcgcuucagagc

SEQ ID NO: 233572 - RNA, 25 nt, Human
accugcccacgcccuggccagccug

SEQ ID NO: 233573 - RNA, 24 nt, Human
agacugaaucuccauggaaugaug

SEQ ID NO: 233574 - RNA, 21 nt, Human
agcagggagacgucacucucc

SEQ ID NO: 233575 - RNA, 18 nt, Human
agccacugagaaucacca

SEQ ID NO: 233576 - RNA, 18 nt, Human
aggaggauggaggugcca

SEQ ID NO: 233577 - RNA, 19 nt, Human
aggcauugucugagugcag

SEQ ID NO: 233578 - RNA, 20 nt, Human
aggccguggcagccacacca

SEQ ID NO: 233579 - RNA, 21 nt, Human
agggagacgucacucuccaga

SEQ ID NO: 233580 - RNA, 20 nt, Human
agggguuccgggauuccaga

SEQ ID NO: 233581 - RNA, 22 nt, Human
auccagacacgauucuguggag

SEQ ID NO: 233582 - RNA, 22 nt, Human
aucgcccucacggcccuugcca

SEQ ID NO: 233583 - RNA, 18 nt, Human
cacaaugacccacaucca

SEQ ID NO: 233584 - RNA, 25 nt, Human
cacaaugacccacauccaacugaaa

SEQ ID NO: 233585 - RNA, 22 nt, Human
caccacaaagcaaucgcccuca

SEQ ID NO: 233586 - RNA, 23 nt, Human
caccucugucuccacaaugaccc

SEQ ID NO: 233587 - RNA, 19 nt, Human
cagcacucccagcagggag

SEQ ID NO: 233588 - RNA, 20 nt, Human
cagcagccagcucugugugg

SEQ ID NO: 233589 - RNA, 21 nt, Human
cagcugccucuggagccagga

SEQ ID NO: 233590 - RNA, 24 nt, Human
caggaggccguggcagccacacca

SEQ ID NO: 233591 - RNA, 25 nt, Human
caggggccugagccugcaacacugc

SEQ ID NO: 233592 - RNA, 21 nt, Human
caugggggcgccuuccugccu

SEQ ID NO: 233593 - RNA, 23 nt, Human
ccacaccacaguguggauccaga

SEQ ID NO: 233594 - RNA, 18 nt, Human
ccacugcagcccccgugg

SEQ ID NO: 233595 - RNA, 19 nt, Human
ccaggcugugucuccugac

SEQ ID NO: 233596 - RNA, 22 nt, Human
ccaggggaugcccugugccgga

SEQ ID NO: 233597 - RNA, 23 nt, Human
ccagggugacggcacagcaggag

SEQ ID NO: 233598 - RNA, 23 nt, Human
cccaagccaggcucaucccugac

SEQ ID NO: 233599 - RNA, 21 nt, Human
ccccaggggaugcccugugcc

SEQ ID NO: 233600 - RNA, 24 nt, Human
cccugugccggauccucaugccuc

SEQ ID NO: 233601 - RNA, 25 nt, Human
ccggcaccagcggcggccuuguccc

SEQ ID NO: 233602 - RNA, 20 nt, Human
ccucacggcccuugccaggg

SEQ ID NO: 233603 - RNA, 20 nt, Human
ccucuggaagccaacugucc

SEQ ID NO: 233604 - RNA, 21 nt, Human
ccucugucuccacaaugaccc

SEQ ID NO: 233605 - RNA, 21 nt, Human
cgagaaagagcuccgauacac

SEQ ID NO: 233606 - RNA, 24 nt, Human
cggcggcgcuucagacccggcccg

SEQ ID NO: 233607 - RNA, 21 nt, Human
cguccggaggcgcggggcggg

SEQ ID NO: 233608 - RNA, 21 nt, Human
cucaaaccucacauuagaagc

SEQ ID NO: 233609 - RNA, 23 nt, Human
cucagcgcccgccgcuggccagg

SEQ ID NO: 233610 - RNA, 22 nt, Human
cucuucccuggggacagggcag

SEQ ID NO: 233611 - RNA, 18 nt, Human
cugaaggagcccaggggc

SEQ ID NO: 233612 - RNA, 19 nt, Human
cugaccuuaaaaagaugag

SEQ ID NO: 233613 - RNA, 21 nt, Human
cugaccuuaaaaagaugagug

SEQ ID NO: 233614 - RNA, 22 nt, Human
cuggggacagggcagcacaguc

SEQ ID NO: 233615 - RNA, 24 nt, Human
gaagccccaggggaugcccugugc

SEQ ID NO: 233616 - RNA, 21 nt, Human
gaaggagcccaggggccugag

SEQ ID NO: 233617 - RNA, 21 nt, Human
gaauggaggcaucuucagccc

SEQ ID NO: 233618 - RNA, 22 nt, Human
gacacagccggcugggcaggag

SEQ ID NO: 233619 - RNA, 23 nt, Human
gacacagugaauccacugcagcc

SEQ ID NO: 233620 - RNA, 18 nt, Human
gaggaggccaggcugugu

SEQ ID NO: 233621 - RNA, 23 nt, Human
gaggcggcuggccucggacggga

SEQ ID NO: 233622 - RNA, 20 nt, Human
gauggcagacaccucugucu

SEQ ID NO: 233623 - RNA, 21 nt, Human
gcacagcagccagcucugugu

SEQ ID NO: 233624 - RNA, 20 nt, Human
gccaggaggccguggcagcc

SEQ ID NO: 233625 - RNA, 23 nt, Human
ggagacgucacucuccagaggcc

SEQ ID NO: 233626 - RNA, 18 nt, Human
ggagcccaggggccugag

SEQ ID NO: 233627 - RNA, 24 nt, Human
ggcaggaggauggagguggggacc

SEQ ID NO: 233628 - RNA, 26 nt, Human
gggcaggaggauggagguggggaccc

SEQ ID NO: 233629 - RNA, 21 nt, Human
gggccccucagcgcccgccgc

SEQ ID NO: 233630 - RNA, 18 nt, Human
ggggaggccaccccaccc

SEQ ID NO: 233631 - RNA, 20 nt, Human
gucccggcacagacguccgg

SEQ ID NO: 233632 - RNA, 22 nt, Human
uaaaaagaugagugugacacaa

SEQ ID NO: 233633 - RNA, 23 nt, Human
uaaaaagaugagugugacacaga

SEQ ID NO: 233634 - RNA, 21 nt, Human
uaaggaucuaaaacaaacuuc

SEQ ID NO: 233635 - RNA, 23 nt, Human
uaugcuuggaggccccuggaggu

SEQ ID NO: 233636 - RNA, 22 nt, Human
uauuuugucaaguuucuuuaau

SEQ ID NO: 233637 - RNA, 18 nt, Human
ucaagguccacaggcgaa

SEQ ID NO: 233638 - RNA, 22 nt, Human
ucaucccugacacagugaaucc

SEQ ID NO: 233639 - RNA, 22 nt, Human
uccacaaugacccacauccaac

SEQ ID NO: 233640 - RNA, 18 nt, Human
ucccuggggacagggcag

SEQ ID NO: 233641 - RNA, 24 nt, Human
uccucaaggacccggcaccagcgg

SEQ ID NO: 233642 - RNA, 22 nt, Human
uccugacgccccugaggguggg

SEQ ID NO: 233643 - RNA, 19 nt, Human
ucgccgucccggcggcgcu

SEQ ID NO: 233644 - RNA, 20 nt, Human
ucuaaaacaaacuucucaaa

SEQ ID NO: 233645 - RNA, 21 nt, Human
ucuccauggaaugaugaaaau

SEQ ID NO: 233646 - RNA, 23 nt, Human
ucucuucccuggggacagggcag

SEQ ID NO: 233647 - RNA, 18 nt, Human
ucuucagcccugaggagg

SEQ ID NO: 233648 - RNA, 18 nt, Human
ugaaggagcccaggggcc

SEQ ID NO: 233649 - RNA, 19 nt, Human
ugacacagccggcugggca

SEQ ID NO: 233650 - RNA, 19 nt, Human
ugaccuuaaaaagaugagu

SEQ ID NO: 233651 - RNA, 22 nt, Human
ugacggcacagcaggaggacag

SEQ ID NO: 233652 - RNA, 21 nt, Human
ugagaagggcaugcugcugug

SEQ ID NO: 233653 - RNA, 22 nt, Human
ugagacugaggccacacacaug

SEQ ID NO: 233654 - RNA, 21 nt, Human
ugagggugggcacagcagcca

SEQ ID NO: 233655 - RNA, 18 nt, Human
ugccaggaaccaaccuga

SEQ ID NO: 233656 - RNA, 22 nt, Human
ugccucuggagccaggaggccg

SEQ ID NO: 233657 - RNA, 19 nt, Human
ugccuuggcccggcccagc

SEQ ID NO: 233658 - RNA, 29 nt, Human
ugcgcugccuccuucuccgcggcggaacg

SEQ ID NO: 233659 - RNA, 28 nt, Human
uggaggccccuggagguaccgguagacc

SEQ ID NO: 233660 - RNA, 19 nt, Human
ugggaaacucugugccaau

SEQ ID NO: 233661 - RNA, 21 nt, Human
uggggacagggcagcacaguc

SEQ ID NO: 233662 - RNA, 20 nt, Human
uucagagccccaccaacccc

SEQ ID NO: 233663 - RNA, 20 nt, Human
uugacacugaaaucuagaaa

SEQ ID NO: 233664 - RNA, 22 nt, Human
uugccaggaaccaaccugaccu

SEQ ID NO: 233665 - RNA, 18 nt, Human
uugcugaaggagcccagg

SEQ ID NO: 233666 - RNA, 18 nt, Human
uuggcccggcccagcugc

SEQ ID NO: 233667 - RNA, 18 nt, Human
aaaagagcucugucauga

SEQ ID NO: 233668 - RNA, 20 nt, Human
aaagaagccauuucucaaag

SEQ ID NO: 233669 - RNA, 22 nt, Human
aacagcacaccucgucucccuu

SEQ ID NO: 233670 - RNA, 19 nt, Human
aagaaacccucaccuaaua

SEQ ID NO: 233671 - RNA, 24 nt, Human
aagaugggcagacugggacagcca

SEQ ID NO: 233672 - RNA, 22 nt, Human
aagccgcuggucccagagccaa

SEQ ID NO: 233673 - RNA, 19 nt, Human
aagcggcagagggcugggc

SEQ ID NO: 233674 - RNA, 20 nt, Human
aagugucaaugccugaccug

SEQ ID NO: 233675 - RNA, 22 nt, Human
acaugauugugcagcccuagga

SEQ ID NO: 233676 - RNA, 28 nt, Human
acccagaguaggaggcugcggcaucuuc

SEQ ID NO: 233677 - RNA, 18 nt, Human
accgcagccugccugcgu

SEQ ID NO: 233678 - RNA, 21 nt, Human
agaaagacaggaggacacaga

SEQ ID NO: 233679 - RNA, 25 nt, Human
agaaagacaggaggacacagacugg

SEQ ID NO: 233680 - RNA, 24 nt, Human
agaccagcacacagugggcaucuc

SEQ ID NO: 233681 - RNA, 21 nt, Human
agagcagccaggacaccuggg

SEQ ID NO: 233682 - RNA, 20 nt, Human
agagcgcugucucuggagga

SEQ ID NO: 233683 - RNA, 18 nt, Human
agagcucugucaugaccc

SEQ ID NO: 233684 - RNA, 22 nt, Human
agaggaaacugaggggcccgga

SEQ ID NO: 233685 - RNA, 23 nt, Human
agaggacuucagugggagacccc

SEQ ID NO: 233686 - RNA, 19 nt, Human
agcaccucggcuuuucccu

SEQ ID NO: 233687 - RNA, 20 nt, Human
agcaggagugucgggggugu

SEQ ID NO: 233688 - RNA, 23 nt, Human
agcccaccccuuccugggcccag

SEQ ID NO: 233689 - RNA, 24 nt, Human
agccgggccaggcgagccggcgcg

SEQ ID NO: 233690 - RNA, 18 nt, Human
agccguaugaccugggac

SEQ ID NO: 233691 - RNA, 20 nt, Human
agcgcaggggagggacaggg

SEQ ID NO: 233692 - RNA, 22 nt, Human
aggaaauaagaggugcagaagg

SEQ ID NO: 233693 - RNA, 23 nt, Human
aggaaggguggggagggaugggg

SEQ ID NO: 233694 - RNA, 23 nt, Human
aggaauugcaguggggcucaggg

SEQ ID NO: 233695 - RNA, 24 nt, Human
aggagggugggaaccgggugagaa

SEQ ID NO: 233696 - RNA, 19 nt, Human
aggagguggaggagggugg

SEQ ID NO: 233697 - RNA, 23 nt, Human
aggccacaugauugugcagcccu

SEQ ID NO: 233698 - RNA, 20 nt, Human
aggcccgccacucgcuagcc

SEQ ID NO: 233699 - RNA, 18 nt, Human
agggagggcuugggaggg

SEQ ID NO: 233700 - RNA, 21 nt, Human
agggcuugggaggggguacac

SEQ ID NO: 233701 - RNA, 20 nt, Human
aggggcccggaggagaggag

SEQ ID NO: 233702 - RNA, 20 nt, Human
aggguggggagggauggggc

SEQ ID NO: 233703 - RNA, 26 nt, Human
agguggaggagggugggaaccggguc

SEQ ID NO: 233704 - RNA, 18 nt, Human
aucucacccgugccccca

SEQ ID NO: 233705 - RNA, 19 nt, Human
augagaaagacaggaggac

SEQ ID NO: 233706 - RNA, 24 nt, Human
auggcguauguacaagcggcagag

SEQ ID NO: 233707 - RNA, 24 nt, Human
augggcagacugggacagccaucc

SEQ ID NO: 233708 - RNA, 23 nt, Human
caaaacuucaaaugcuucugcaa

SEQ ID NO: 233709 - RNA, 23 nt, Human
caagaaacccucaccuaauagca

SEQ ID NO: 233710 - RNA, 18 nt, Human
caaggcagacggagcucc

SEQ ID NO: 233711 - RNA, 18 nt, Human
cacacacaccacccgcca

SEQ ID NO: 233712 - RNA, 22 nt, Human
cacaguaacuuuccacuggccu

SEQ ID NO: 233713 - RNA, 20 nt, Human
cacagugggcaucucacccg

SEQ ID NO: 233714 - RNA, 24 nt, Human
cacagugggcaucucacccgugcc

SEQ ID NO: 233715 - RNA, 25 nt, Human
cacccaggccaaaaaugugaagggc

SEQ ID NO: 233716 - RNA, 23 nt, Human
cacccccccucaggacccagagu

SEQ ID NO: 233717 - RNA, 19 nt, Human
cacuggagggcagcaaagu

SEQ ID NO: 233718 - RNA, 19 nt, Human
cagacugggacagccaucc

SEQ ID NO: 233719 - RNA, 19 nt, Human
cagaguaggaggcugcggc

SEQ ID NO: 233720 - RNA, 21 nt, Human
cagauggggcuggccuggcag

SEQ ID NO: 233721 - RNA, 20 nt, Human
cagccccacccaggccaaaa

SEQ ID NO: 233722 - RNA, 18 nt, Human
cagcugccuggcgggugg

SEQ ID NO: 233723 - RNA, 21 nt, Human
cagcuguguccccuacccccu

SEQ ID NO: 233724 - RNA, 19 nt, Human
caggagcccgcuggcagug

SEQ ID NO: 233725 - RNA, 19 nt, Human
cagggaagggaacaggugc

SEQ ID NO: 233726 - RNA, 19 nt, Human
caguggggcucagggcucu

SEQ ID NO: 233727 - RNA, 19 nt, Human
cauccugcccacccacucc

SEQ ID NO: 233728 - RNA, 21 nt, Human
caucguucggcaaaagaaaac

SEQ ID NO: 233729 - RNA, 26 nt, Human
caucucacccgugcccccaaugccuu

SEQ ID NO: 233730 - RNA, 22 nt, Human
ccacccaggccaaaaaugugaa

SEQ ID NO: 233731 - RNA, 24 nt, Human
ccacccaggcccaggggcaagcgu

SEQ ID NO: 233732 - RNA, 23 nt, Human
ccacucagagccuuccuguaucc

SEQ ID NO: 233733 - RNA, 22 nt, Human
ccagauccugcccccaaccucc

SEQ ID NO: 233734 - RNA, 23 nt, Human
ccagcccaccccuuccugggccc

SEQ ID NO: 233735 - RNA, 21 nt, Human
ccagccccacccaggccaaaa

SEQ ID NO: 233736 - RNA, 23 nt, Human
ccagccggagggcccaaucacac

SEQ ID NO: 233737 - RNA, 18 nt, Human
ccauccugcccacccacu

SEQ ID NO: 233738 - RNA, 19 nt, Human
ccauccugcccacccacuc

SEQ ID NO: 233739 - RNA, 21 nt, Human
cccagccccacccaggccaaa

SEQ ID NO: 233740 - RNA, 22 nt, Human
cccauccugacucccucggaag

SEQ ID NO: 233741 - RNA, 21 nt, Human
cccaucugcagcuuccagaag

SEQ ID NO: 233742 - RNA, 24 nt, Human
ccccaaccuccagccacaugggcc

SEQ ID NO: 233743 - RNA, 22 nt, Human
ccccacccaggcccaggggcaa

SEQ ID NO: 233744 - RNA, 25 nt, Human
cccccaagcuuuuggcacucagccc

SEQ ID NO: 233745 - RNA, 23 nt, Human
cccccaguguggccuccugguuc

SEQ ID NO: 233746 - RNA, 19 nt, Human
cccccugcccucaccuccu

SEQ ID NO: 233747 - RNA, 21 nt, Human
cccccugcccucaccuccugc

SEQ ID NO: 233748 - RNA, 20 nt, Human
cccgccaguucuuggcuccu

SEQ ID NO: 233749 - RNA, 19 nt, Human
cccuacccccuuucuuaca

SEQ ID NO: 233750 - RNA, 20 nt, Human
cccuuggacccucaaaccca

SEQ ID NO: 233751 - RNA, 22 nt, Human
cccuuggacccucaaacccaga

SEQ ID NO: 233752 - RNA, 25 nt, Human
ccgaggaccugucccuccuccccca

SEQ ID NO: 233753 - RNA, 18 nt, Human
ccgcuggucccagagcca

SEQ ID NO: 233754 - RNA, 19 nt, Human
ccgggcccccaucugcagc

SEQ ID NO: 233755 - RNA, 26 nt, Human
ccucaaacccagaggagccuucagcc

SEQ ID NO: 233756 - RNA, 19 nt, Human
ccuccagccacaugggccc

SEQ ID NO: 233757 - RNA, 21 nt, Human
ccuccagguccaaaucccuag

SEQ ID NO: 233758 - RNA, 18 nt, Human
ccucggguuagggcugag

SEQ ID NO: 233759 - RNA, 21 nt, Human
ccugacccugcugccuacacu

SEQ ID NO: 233760 - RNA, 21 nt, Human
ccugagaucccagccgccugg

SEQ ID NO: 233761 - RNA, 21 nt, Human
ccugcccacccacuccaccug

SEQ ID NO: 233762 - RNA, 24 nt, Human
ccugcccagcuguguccccuaccc

SEQ ID NO: 233763 - RNA, 23 nt, Human
ccugcccccaaccuccagccaca

SEQ ID NO: 233764 - RNA, 26 nt, Human
ccugcccucaccuccugccccaaaag

SEQ ID NO: 233765 - RNA, 20 nt, Human
ccugccugcgucucuuccuu

SEQ ID NO: 233766 - RNA, 25 nt, Human
ccugccugcgucucuuccuuccucc

SEQ ID NO: 233767 - RNA, 22 nt, Human
ccugcgucucuuccuuccuccg

SEQ ID NO: 233768 - RNA, 18 nt, Human
ccuggauuggagauggaa

SEQ ID NO: 233769 - RNA, 18 nt, Human
cggcucagggagggcuug

SEQ ID NO: 233770 - RNA, 21 nt, Human
cggggcccccugcccucaccu

SEQ ID NO: 233771 - RNA, 21 nt, Human
cuacuucugacgccucuccug

SEQ ID NO: 233772 - RNA, 21 nt, Human
cuagcaacauccacugcagcc

SEQ ID NO: 233773 - RNA, 21 nt, Human
cucagccuuaggccuguggcc

SEQ ID NO: 233774 - RNA, 18 nt, Human
cucagggcucugccgggc

SEQ ID NO: 233775 - RNA, 23 nt, Human
cucccgggcccccaucugcagcc

SEQ ID NO: 233776 - RNA, 24 nt, Human
cuccuauugcccuuggccuccagg

SEQ ID NO: 233777 - RNA, 18 nt, Human
cuccugguucccucccca

SEQ ID NO: 233778 - RNA, 22 nt, Human
cucgguccugcaaccccaaaug

SEQ ID NO: 233779 - RNA, 21 nt, Human
cucucccaaaccaggcccugc

SEQ ID NO: 233780 - RNA, 21 nt, Human
cugaauaagcuucuaaauccc

SEQ ID NO: 233781 - RNA, 19 nt, Human
cugacccugcugccuacac

SEQ ID NO: 233782 - RNA, 20 nt, Human
cugcaauguuucuugaaagc

SEQ ID NO: 233783 - RNA, 18 nt, Human
cugcuaggcuucuccucc

SEQ ID NO: 233784 - RNA, 22 nt, Human
cuggcuguuagcaucagcugga

SEQ ID NO: 233785 - RNA, 18 nt, Human
cuggguggauuggcuccc

SEQ ID NO: 233786 - RNA, 19 nt, Human
cuggucccagagccaagag

SEQ ID NO: 233787 - RNA, 20 nt, Human
cuuggcuccuuuucucuuca

SEQ ID NO: 233788 - RNA, 22 nt, Human
cuuggcuucaggugggccaggg

SEQ ID NO: 233789 - RNA, 24 nt, Human
gaaaccagaaaucuugccucccag

SEQ ID NO: 233790 - RNA, 18 nt, Human
gaacaaaacuucaaaugc

SEQ ID NO: 233791 - RNA, 23 nt, Human
gaagaggaggagggcgaagccaa

SEQ ID NO: 233792 - RNA, 18 nt, Human
gaagccaagggagggucc

SEQ ID NO: 233793 - RNA, 20 nt, Human
gaccucaggaggccuggcug

SEQ ID NO: 233794 - RNA, 19 nt, Human
gagaaagacaggaggacac

SEQ ID NO: 233795 - RNA, 23 nt, Human
gaggaggagggcgaagccaaggg

SEQ ID NO: 233796 - RNA, 18 nt, Human
gaggccagagaugaggag

SEQ ID NO: 233797 - RNA, 22 nt, Human
gaggggcccggaggagaggagg

SEQ ID NO: 233798 - RNA, 19 nt, Human
gaguuggccacugcacaug

SEQ ID NO: 233799 - RNA, 19 nt, Human
gcaaccccaaaugccuccc

SEQ ID NO: 233800 - RNA, 22 nt, Human
gcaaccccaaaugccucccagg

SEQ ID NO: 233801 - RNA, 19 nt, Human
gccacccccccucaggacc

SEQ ID NO: 233802 - RNA, 20 nt, Human
gcccacccacuccaccugcc

SEQ ID NO: 233803 - RNA, 18 nt, Human
gcccagccccacccaggc

SEQ ID NO: 233804 - RNA, 22 nt, Human
gcccagccccacccaggccaaa

SEQ ID NO: 233805 - RNA, 18 nt, Human
gcccucaccuccugcccc

SEQ ID NO: 233806 - RNA, 20 nt, Human
gccuggaguuggccacugca

SEQ ID NO: 233807 - RNA, 19 nt, Human
gccuuaggccuguggcagc

SEQ ID NO: 233808 - RNA, 19 nt, Human
gcugccuggcggguggaga

SEQ ID NO: 233809 - RNA, 21 nt, Human
ggaaccagaaaccagaaaucu

SEQ ID NO: 233810 - RNA, 26 nt, Human
ggaaggguggggagggauggggcugg

SEQ ID NO: 233811 - RNA, 18 nt, Human
ggagaacuuggacaagua

SEQ ID NO: 233812 - RNA, 20 nt, Human
ggagaggagguggaggaggg

SEQ ID NO: 233813 - RNA, 19 nt, Human
ggagccccagggcaggccc

SEQ ID NO: 233814 - RNA, 24 nt, Human
ggaggaauugcaguggggcucagg

SEQ ID NO: 233815 - RNA, 21 nt, Human
ggaggagaggagguggaggag

SEQ ID NO: 233816 - RNA, 23 nt, Human
ggaggagaggagguggaggaggg

SEQ ID NO: 233817 - RNA, 23 nt, Human
ggaggccuggcuggggacgagcc

SEQ ID NO: 233818 - RNA, 20 nt, Human
ggauuggcuccccagcuccc

SEQ ID NO: 233819 - RNA, 20 nt, Human
ggcagagggcugggcugggc

SEQ ID NO: 233820 - RNA, 21 nt, Human
ggccauucacagcaagcagca

SEQ ID NO: 233821 - RNA, 24 nt, Human
ggcccagccccacccaggccaaaa

SEQ ID NO: 233822 - RNA, 26 nt, Human
ggcccuggcuguuagcaucagcugga

SEQ ID NO: 233823 - RNA, 18 nt, Human
ggcuccccagcucccacu

SEQ ID NO: 233824 - RNA, 18 nt, Human
ggcugaugagaagacagg

SEQ ID NO: 233825 - RNA, 22 nt, Human
ggcugaugagaagacagguccc

SEQ ID NO: 233826 - RNA, 18 nt, Human
ggcugcggcaucuucugc

SEQ ID NO: 233827 - RNA, 24 nt, Human
gggaaggggucccugaggcccggg

SEQ ID NO: 233828 - RNA, 18 nt, Human
gggagggauggggcuggg

SEQ ID NO: 233829 - RNA, 22 nt, Human
gggaggucugaggagagcucgg

SEQ ID NO: 233830 - RNA, 23 nt, Human
gggccauucacagcaagcagcag

SEQ ID NO: 233831 - RNA, 23 nt, Human
gggcccccugcccucaccuccug

SEQ ID NO: 233832 - RNA, 20 nt, Human
ggggagagagaagaggagga

SEQ ID NO: 233833 - RNA, 22 nt, Human
gggguguggcagcuggccuggg

SEQ ID NO: 233834 - RNA, 20 nt, Human
ggugacucucccaaaccagg

SEQ ID NO: 233835 - RNA, 23 nt, Human
ggugcggacacuggggaacuugc

SEQ ID NO: 233836 - RNA, 22 nt, Human
gguggcugaugagaagacaggu

SEQ ID NO: 233837 - RNA, 23 nt, Human
gucagauuccuggcugccuccag

SEQ ID NO: 233838 - RNA, 23 nt, Human
gugccucccgggcccccaucugc

SEQ ID NO: 233839 - RNA, 23 nt, Human
guggucucauuccggcccccacc

SEQ ID NO: 233840 - RNA, 21 nt, Human
guuugcuugaggcagcugugg

SEQ ID NO: 233841 - RNA, 19 nt, Human
uaagcuucuaaauccccag

SEQ ID NO: 233842 - RNA, 22 nt, Human
uacccuguuugcuugaggcagc

SEQ ID NO: 233843 - RNA, 24 nt, Human
uaggaaauaagaggugcagaaggg

SEQ ID NO: 233844 - RNA, 20 nt, Human
uaugcaaaaaucccaccccg

SEQ ID NO: 233845 - RNA, 24 nt, Human
ucacaccucacucagccuuaggcc

SEQ ID NO: 233846 - RNA, 23 nt, Human
ucacagaccccaggaaggugagg

SEQ ID NO: 233847 - RNA, 24 nt, Human
ucacagcaagcagcagacagcaca

SEQ ID NO: 233848 - RNA, 19 nt, Human
ucagcuggauggcuuccaa

SEQ ID NO: 233849 - RNA, 22 nt, Human
uccacugcagccgggccaggcg

SEQ ID NO: 233850 - RNA, 21 nt, Human
ucccagacucgugugugccuc

SEQ ID NO: 233851 - RNA, 23 nt, Human
uccccuacccccuuucuuacaaa

SEQ ID NO: 233852 - RNA, 23 nt, Human
uccccugcccuuccuacuucuga

SEQ ID NO: 233853 - RNA, 20 nt, Human
ucccgcccuauccuggcuau

SEQ ID NO: 233854 - RNA, 21 nt, Human
ucccgcccuauccuggcuaug

SEQ ID NO: 233855 - RNA, 19 nt, Human
ucccugaggcccggguggc

SEQ ID NO: 233856 - RNA, 19 nt, Human
ucccugaggcccggguggc

SEQ ID NO: 233857 - RNA, 24 nt, Human
ucccugaggcccggguggccgcuu

SEQ ID NO: 233858 - RNA, 19 nt, Human
ucccuggagcugugucugc

SEQ ID NO: 233859 - RNA, 26 nt, Human
uccugcaaccccaaaugccucccagg

SEQ ID NO: 233860 - RNA, 22 nt, Human
uccugcccacccacuccaccug

SEQ ID NO: 233861 - RNA, 19 nt, Human
uccugccccaaaagagcuc

SEQ ID NO: 233862 - RNA, 20 nt, Human
uccugggcccagccccaccc

SEQ ID NO: 233863 - RNA, 18 nt, Human
ucuccagucagucacaga

SEQ ID NO: 233864 - RNA, 20 nt, Human
ucuccugguguuucaggauu

SEQ ID NO: 233865 - RNA, 20 nt, Human
ucugacgccucuccuggugu

SEQ ID NO: 233866 - RNA, 28 nt, Human
ucugcagcuuccagaagaggacuucagu

SEQ ID NO: 233867 - RNA, 23 nt, Human
ugaaagcugggaguaggaagggu

SEQ ID NO: 233868 - RNA, 19 nt, Human
ugacaggaaggguuuagga

SEQ ID NO: 233869 - RNA, 21 nt, Human
ugacucccucggaaggaagag

SEQ ID NO: 233870 - RNA, 24 nt, Human
ugacucccucggaaggaagaguag

SEQ ID NO: 233871 - RNA, 21 nt, Human
ugagaaagacaggaggacaca

SEQ ID NO: 233872 - RNA, 23 nt, Human
ugagaaagucaguggagagaaau

SEQ ID NO: 233873 - RNA, 19 nt, Human
ugagaggaugugggucucg

SEQ ID NO: 233874 - RNA, 20 nt, Human
ugagaggaugugggucucgg

SEQ ID NO: 233875 - RNA, 23 nt, Human
ugaggagagcucgggccagaucc

SEQ ID NO: 233876 - RNA, 22 nt, Human
ugaggcccggguggccgcuugg

SEQ ID NO: 233877 - RNA, 23 nt, Human
ugaggcuaggaaccagaaaccag

SEQ ID NO: 233878 - RNA, 19 nt, Human
ugaggggcccggaggagag

SEQ ID NO: 233879 - RNA, 21 nt, Human
ugaggggcccggaggagagga

SEQ ID NO: 233880 - RNA, 19 nt, Human
ugaggucagggaagggaac

SEQ ID NO: 233881 - RNA, 22 nt, Human
ugaggucagggaagggaacagg

SEQ ID NO: 233882 - RNA, 20 nt, Human
ugaugagaagacaggucugg

SEQ ID NO: 233883 - RNA, 23 nt, Human
ugcaaagaagccauuucucaaau

SEQ ID NO: 233884 - RNA, 20 nt, Human
ugcaguggggcucagggcuc

SEQ ID NO: 233885 - RNA, 25 nt, Human
ugcccacccacuccaccugcccagc

SEQ ID NO: 233886 - RNA, 22 nt, Human
ugcccggcuuccccagcucugc

SEQ ID NO: 233887 - RNA, 19 nt, Human
ugcccucagggacucagga

SEQ ID NO: 233888 - RNA, 20 nt, Human
ugccucccgggcccccaucu

SEQ ID NO: 233889 - RNA, 23 nt, Human
ugccugcgucucuuccuuccucc

SEQ ID NO: 233890 - RNA, 21 nt, Human
ugcgauggauuaauuuagacc

SEQ ID NO: 233891 - RNA, 23 nt, Human
ugcuagccacucagagccuuccu

SEQ ID NO: 233892 - RNA, 19 nt, Human
uggaacaaaacuucaaaug

SEQ ID NO: 233893 - RNA, 21 nt, Human
uggaggagggugggaaccggg

SEQ ID NO: 233894 - RNA, 18 nt, Human
uggcagauggaaaaacug

SEQ ID NO: 233895 - RNA, 24 nt, Human
uggcaggagaguggggugcugggg

SEQ ID NO: 233896 - RNA, 21 nt, Human
uggccuccagguccaaauccc

SEQ ID NO: 233897 - RNA, 23 nt, Human
uggccuccagguccaaaucccuu

SEQ ID NO: 233898 - RNA, 20 nt, Human
uggccuccugguucccuccc

SEQ ID NO: 233899 - RNA, 19 nt, Human
uggccugggucccuggagc

SEQ ID NO: 233900 - RNA, 23 nt, Human
uggcuccccagcucccacuuccc

SEQ ID NO: 233901 - RNA, 21 nt, Human
uggcuggggacgagccagcaa

SEQ ID NO: 233902 - RNA, 23 nt, Human
ugggaaccgggugagaaagucag

SEQ ID NO: 233903 - RNA, 21 nt, Human
ugggacuuggcuucagguggg

SEQ ID NO: 233904 - RNA, 21 nt, Human
ugggaguaggaagggugggga

SEQ ID NO: 233905 - RNA, 19 nt, Human
ugggcccagccccacccag

SEQ ID NO: 233906 - RNA, 19 nt, Human
uggggagggauggggcugg

SEQ ID NO: 233907 - RNA, 22 nt, Human
uggggagggauggggcugggaa

SEQ ID NO: 233908 - RNA, 18 nt, Human
uggggcagggagggcucc

SEQ ID NO: 233909 - RNA, 19 nt, Human
uggggcuggccuggcagcu

SEQ ID NO: 233910 - RNA, 18 nt, Human
ugggucccuggagcugug

SEQ ID NO: 233911 - RNA, 23 nt, Human
ugguucccuccccacaggcgccc

SEQ ID NO: 233912 - RNA, 25 nt, Human
ugucaugacccgggagggccggcgc

SEQ ID NO: 233913 - RNA, 24 nt, Human
ugugcagcccuaggaggaauugca

SEQ ID NO: 233914 - RNA, 19 nt, Human
uucaggaaagacgggaggc

SEQ ID NO: 233915 - RNA, 18 nt, Human
uuccagacagcaagaaac

SEQ ID NO: 233916 - RNA, 21 nt, Human
uuccauguggcagauggaaaa

SEQ ID NO: 233917 - RNA, 20 nt, Human
uuccggacagucagauuccu

SEQ ID NO: 233918 - RNA, 19 nt, Human
uuccggcccccacccaggc

SEQ ID NO: 233919 - RNA, 22 nt, Human
uuccuguuccccugcccuuccu

SEQ ID NO: 233920 - RNA, 24 nt, Human
uuccuuaaucuugcauuccuguuc

SEQ ID NO: 233921 - RNA, 21 nt, Human
uugcugcacacacaccacccg

SEQ ID NO: 233922 - RNA, 27 nt, Human
uuggcccugacccugcugccgguuccg

SEQ ID NO: 233923 - RNA, 18 nt, Human
aaaaaaacagcacaguaa

SEQ ID NO: 233924 - RNA, 23 nt, Human
aaaaaacagcacaguaaaaaaau

SEQ ID NO: 233925 - RNA, 20 nt, Human
aaaaaauacugucacaauau

SEQ ID NO: 233926 - RNA, 21 nt, Human
aaaaacaacaagaaacacagc

SEQ ID NO: 233927 - RNA, 27 nt, Human
aacaagaacacccuacuuuuuacccau

SEQ ID NO: 233928 - RNA, 20 nt, Human
aagacccucccccaccccca

SEQ ID NO: 233929 - RNA, 20 nt, Human
aagagcaccuuuauucacag

SEQ ID NO: 233930 - RNA, 21 nt, Human
aagcaaaaaacaagaacaccc

SEQ ID NO: 233931 - RNA, 23 nt, Human
aagcaaaaaacaagaacacccua

SEQ ID NO: 233932 - RNA, 23 nt, Human
aagccacagcguccaggccagga

SEQ ID NO: 233933 - RNA, 21 nt, Human
aauauuuacagacacgcccac

SEQ ID NO: 233934 - RNA, 23 nt, Human
acacacacacacacgcacacgca

SEQ ID NO: 233935 - RNA, 19 nt, Human
acacacccacacaaagagc

SEQ ID NO: 233936 - RNA, 22 nt, Human
acacccacacaaagagcaaaac

SEQ ID NO: 233937 - RNA, 23 nt, Human
acacccacacaaagagcaaaacc

SEQ ID NO: 233938 - RNA, 20 nt, Human
acgcacccccagacccagcc

SEQ ID NO: 233939 - RNA, 19 nt, Human
acuguuugcccagcuggac

SEQ ID NO: 233940 - RNA, 21 nt, Human
aggacgucaccauagcaacaa

SEQ ID NO: 233941 - RNA, 22 nt, Human
aggcccugcagcccacuggccc

SEQ ID NO: 233942 - RNA, 23 nt, Human
auaaaauaagacccucccccacc

SEQ ID NO: 233943 - RNA, 20 nt, Human
auauuuacagacacgcccac

SEQ ID NO: 233944 - RNA, 19 nt, Human
aucauagccacucacacac

SEQ ID NO: 233945 - RNA, 30 nt, Human
augcaguacacacacacacacacgcacacg

SEQ ID NO: 233946 - RNA, 22 nt, Human
caaaaaacaagaacacccuacu

SEQ ID NO: 233947 - RNA, 24 nt, Human
caaaaaacaagaacacccuacuuu

SEQ ID NO: 233948 - RNA, 22 nt, Human
caaagagaaaaacaacaagaaa

SEQ ID NO: 233949 - RNA, 22 nt, Human
caacaacacuucaauucccuga

SEQ ID NO: 233950 - RNA, 21 nt, Human
caacaagaaacacagcccacg

SEQ ID NO: 233951 - RNA, 22 nt, Human
caagaaacacagcccacgggac

SEQ ID NO: 233952 - RNA, 23 nt, Human
caagaacacccuacuuuuuaccc

SEQ ID NO: 233953 - RNA, 23 nt, Human
caagcaaaaaacaagaacacccu

SEQ ID NO: 233954 - RNA, 26 nt, Human
cacacacacacacacgcacacgcaca

SEQ ID NO: 233955 - RNA, 28 nt, Human
cacacacacacacgcacacgcacacgca

SEQ ID NO: 233956 - RNA, 25 nt, Human
cacacacacgcacacgcacacgcac

SEQ ID NO: 233957 - RNA, 28 nt, Human
cacacgcacacgcacacgcacaggcacg

SEQ ID NO: 233958 - RNA, 20 nt, Human
caccauagcaacaacacuuc

SEQ ID NO: 233959 - RNA, 21 nt, Human
caccauagcaacaacacuuca

SEQ ID NO: 233960 - RNA, 20 nt, Human
cacccacacaaagagcaaaa

SEQ ID NO: 233961 - RNA, 18 nt, Human
cacccccacccucccaag

SEQ ID NO: 233962 - RNA, 23 nt, Human
cacccccacccucccaagcaaaa

SEQ ID NO: 233963 - RNA, 22 nt, Human
cacccuacuuuuuacccauccc

SEQ ID NO: 233964 - RNA, 20 nt, Human
cacccucccaagcaaaaaac

SEQ ID NO: 233965 - RNA, 24 nt, Human
cacgcacacgcacaggcacggccc

SEQ ID NO: 233966 - RNA, 23 nt, Human
cacuucagcuuuaaaaacaaaga

SEQ ID NO: 233967 - RNA, 18 nt, Human
cagacccagccuccccug

SEQ ID NO: 233968 - RNA, 21 nt, Human
cagacccagccuccccugcaa

SEQ ID NO: 233969 - RNA, 21 nt, Human
cagcacagagcuuguggucag

SEQ ID NO: 233970 - RNA, 22 nt, Human
cagcgcaacagggucccugggc

SEQ ID NO: 233971 - RNA, 23 nt, Human
cagcguccaggccaggaggaagg

SEQ ID NO: 233972 - RNA, 21 nt, Human
cauggcucagugagucguacu

SEQ ID NO: 233973 - RNA, 19 nt, Human
ccacagagcagaacugccc

SEQ ID NO: 233974 - RNA, 22 nt, Human
ccacccucccaagcaaaaaaca

SEQ ID NO: 233975 - RNA, 20 nt, Human
ccacugggggcuucgugggg

SEQ ID NO: 233976 - RNA, 20 nt, Human
ccaugcugggcccagcgggg

SEQ ID NO: 233977 - RNA, 20 nt, Human
cccaagcaaaaaacaagaac

SEQ ID NO: 233978 - RNA, 20 nt, Human
cccaagcaaaaaacaagagg

SEQ ID NO: 233979 - RNA, 19 nt, Human
cccacacaaagagcaaaac

SEQ ID NO: 233980 - RNA, 24 nt, Human
cccacgggacaggugagccaugcu

SEQ ID NO: 233981 - RNA, 21 nt, Human
cccauccccuuucaaaaaaaa

SEQ ID NO: 233982 - RNA, 23 nt, Human
cccauccccuuucaaaaaaaaca

SEQ ID NO: 233983 - RNA, 22 nt, Human
ccccagacccagccuccccugc

SEQ ID NO: 233984 - RNA, 18 nt, Human
cccccacccccacccucc

SEQ ID NO: 233985 - RNA, 19 nt, Human
cccccacccccacccuccc

SEQ ID NO: 233986 - RNA, 24 nt, Human
cccucccaagcaaaaaacaagaac

SEQ ID NO: 233987 - RNA, 23 nt, Human
ccuccaagcaggcccugcagccc

SEQ ID NO: 233988 - RNA, 22 nt, Human
ccuccacagagcagaacugccc

SEQ ID NO: 233989 - RNA, 28 nt, Human
ccucccaagcaaaaaacaagaacacccu

SEQ ID NO: 233990 - RNA, 18 nt, Human
ccucccccacccccaccc

SEQ ID NO: 233991 - RNA, 24 nt, Human
ccucugaggaggccuggaagacuc

SEQ ID NO: 233992 - RNA, 24 nt, Human
ccuuccuccaagcaggcccugcag

SEQ ID NO: 233993 - RNA, 24 nt, Human
cgaaugccgaggccagggcagcgc

SEQ ID NO: 233994 - RNA, 25 nt, Human
cucacacacccacacaaagagcaaa

SEQ ID NO: 233995 - RNA, 21 nt, Human
cucccccacccccacccuccc

SEQ ID NO: 233996 - RNA, 25 nt, Human
cucccccacccccacccucccaagc

SEQ ID NO: 233997 - RNA, 19 nt, Human
cuggaacugggcgguggcu

SEQ ID NO: 233998 - RNA, 19 nt, Human
cuggaagacuccccacuca

SEQ ID NO: 233999 - RNA, 20 nt, Human
cuggacagccagccacuggg

SEQ ID NO: 234000 - RNA, 21 nt, Human
cuggcccucggagcagaggca

SEQ ID NO: 234001 - RNA, 18 nt, Human
cuuuccuagcuaugucuu

SEQ ID NO: 234002 - RNA, 18 nt, Human
gacccagccuccccugca

SEQ ID NO: 234003 - RNA, 21 nt, Human
gacccucccccacccccaccc

SEQ ID NO: 234004 - RNA, 23 nt, Human
gagaaaaacaacaagaaacacag

SEQ ID NO: 234005 - RNA, 23 nt, Human
gagcauggcucagugagucguac

SEQ ID NO: 234006 - RNA, 19 nt, Human
gagguggcagcuacacagg

SEQ ID NO: 234007 - RNA, 21 nt, Human
gaguggccuccgacacacaaa

SEQ ID NO: 234008 - RNA, 18 nt, Human
gaucauagccacucacac

SEQ ID NO: 234009 - RNA, 22 nt, Human
gcaaagagcaccuuuauucaca

SEQ ID NO: 234010 - RNA, 18 nt, Human
gcaacagggucccugggc

SEQ ID NO: 234011 - RNA, 23 nt, Human
gcaguacacacacacacacacgc

SEQ ID NO: 234012 - RNA, 31 nt, Human
gcaugcaguacacacacacacacacgcacag

SEQ ID NO: 234013 - RNA, 20 nt, Human
gcccgccccuccacagagcc

SEQ ID NO: 234014 - RNA, 25 nt, Human
ggaugggagguuccagaugcuggaa

SEQ ID NO: 234015 - RNA, 19 nt, Human
ggcagggaugggagguucc

SEQ ID NO: 234016 - RNA, 22 nt, Human
ggcagggaugggagguuccaga

SEQ ID NO: 234017 - RNA, 32 nt, Human
ggcaugcaguacacacacacacacacgcagug

SEQ ID NO: 234018 - RNA, 25 nt, Human
gggcagcgcaacagggucccugggc

SEQ ID NO: 234019 - RNA, 18 nt, Human
gggcagggaugggagguu

SEQ ID NO: 234020 - RNA, 23 nt, Human
gggcagggaugggagguuccaga

SEQ ID NO: 234021 - RNA, 23 nt, Human
uaaauacacagagugccagacag

SEQ ID NO: 234022 - RNA, 25 nt, Human
uaagauaaaauaagacccucccccc

SEQ ID NO: 234023 - RNA, 24 nt, Human
uacacaggaggagggcagggaugg

SEQ ID NO: 234024 - RNA, 19 nt, Human
uaccaggggcgcccaggga

SEQ ID NO: 234025 - RNA, 21 nt, Human
uaccaggggcgcccagggauu

SEQ ID NO: 234026 - RNA, 21 nt, Human
uacugucacaauauuuacaga

SEQ ID NO: 234027 - RNA, 24 nt, Human
uacuuggggcuaugacacaggggc

SEQ ID NO: 234028 - RNA, 24 nt, Human
uagcuguagaaagauccaaaaauc

SEQ ID NO: 234029 - RNA, 22 nt, Human
ucacacacccacacaaagagca

SEQ ID NO: 234030 - RNA, 24 nt, Human
ucacacacccacacaaagagcaaa

SEQ ID NO: 234031 - RNA, 18 nt, Human
uccacgcagcagcuggac

SEQ ID NO: 234032 - RNA, 23 nt, Human
uccccacucagaagagcugggag

SEQ ID NO: 234033 - RNA, 18 nt, Human
ucccccacccccacccuc

SEQ ID NO: 234034 - RNA, 24 nt, Human
ucccccacccccacccucccaagc

SEQ ID NO: 234035 - RNA, 20 nt, Human
ucccugagaacuuuucccuu

SEQ ID NO: 234036 - RNA, 18 nt, Human
uccuuccuccaagcaggc

SEQ ID NO: 234037 - RNA, 25 nt, Human
ugcaaagagaaaaacaacaagaaac

SEQ ID NO: 234038 - RNA, 22 nt, Human
ugcaaagagcaccuuuauucac

SEQ ID NO: 234039 - RNA, 24 nt, Human
ugcugggcccagcggggagguggc

SEQ ID NO: 234040 - RNA, 18 nt, Human
uggccuccgacacacaaa

SEQ ID NO: 234041 - RNA, 22 nt, Human
uggccuccgacacacaaauccu

SEQ ID NO: 234042 - RNA, 24 nt, Human
uucacagcaaaaggacgucaccau

SEQ ID NO: 234043 - RNA, 23 nt, Human
uucuccacgcagcagcuggacaa

SEQ ID NO: 234044 - RNA, 19 nt, Human
uuggcuucuguuuuuucug

SEQ ID NO: 234045 - RNA, 18 nt, Human
uuuacccauccccuuuca

SEQ ID NO: 234046 - RNA, 22 nt, Human
uuugcaaagagaaaaacaacaa

SEQ ID NO: 234047 - RNA, 24 nt, Human
uuuggagaggagauuaaaugcuga

SEQ ID NO: 234048 - RNA, 21 nt, Human
caccagcugucagaaggacuc

SEQ ID NO: 234049 - RNA, 22 nt, Human
gcaccagcugucagaaggacuc

SEQ ID NO: 234050 - RNA, 22 nt, Human
gccuuuauugggggccaugggc

SEQ ID NO: 234051 - RNA, 19 nt, Human
gggggccaugggcuggcug

SEQ ID NO: 234052 - RNA, 18 nt, Human
ugggggccaugggcuggc

SEQ ID NO: 234053 - RNA, 22 nt, Human
ugggggccaugggcuggcugau

SEQ ID NO: 234054 - RNA, 19 nt, Human
uugggggccaugggcuggc

SEQ ID NO: 234055 - RNA, 18 nt, Human
agauucuuuuuuuuuuuu

SEQ ID NO: 234056 - RNA, 20 nt, Human
gauucuuuuuuuuuuuuuuu

SEQ ID NO: 234057 - RNA, 25 nt, Human
uaaguagaugacuuacaagagggau

SEQ ID NO: 234058 - RNA, 19 nt, Human
uagaugacuuacaagaggg

SEQ ID NO: 234059 - RNA, 20 nt, Human
ucuuuuuuuuuuuuuuuaau

SEQ ID NO: 234060 - RNA, 20 nt, Human
uuagauucuuuuuuuuuuuu

SEQ ID NO: 234061 - RNA, 19 nt, Human
uucuuuuuuuuuuuuuuua

SEQ ID NO: 234062 - RNA, 24 nt, Human
uucuuuuuuuuuuuuuuuaaucug

SEQ ID NO: 234063 - RNA, 23 nt, Human
uuuagauucuuuuuuuuuuuuuu

SEQ ID NO: 234064 - RNA, 20 nt, Human
uuuuuuuaaucugccccuuu

SEQ ID NO: 234065 - RNA, 18 nt, Human
uuuuuuuuuaaucugccc

SEQ ID NO: 234066 - RNA, 22 nt, Human
uuuuuuuuuuuaaucugccccu

SEQ ID NO: 234067 - RNA, 27 nt, Human
uuuuuuuuuuuuuuuaaucugccccuu

SEQ ID NO: 234068 - RNA, 19 nt, Human
aaacuggugaggugguggg

SEQ ID NO: 234069 - RNA, 18 nt, Human
aaggacugguagggguag

SEQ ID NO: 234070 - RNA, 20 nt, Human
aauggugcgaucugagccgc

SEQ ID NO: 234071 - RNA, 18 nt, Human
acccagaagccucuccca

SEQ ID NO: 234072 - RNA, 23 nt, Human
agaccagugacaagggcagacug

SEQ ID NO: 234073 - RNA, 27 nt, Human
agagaggaaggaagccgaggaggggag

SEQ ID NO: 234074 - RNA, 20 nt, Human
agcagcucuggauggugggg

SEQ ID NO: 234075 - RNA, 18 nt, Human
aggaagccgaggagggga

SEQ ID NO: 234076 - RNA, 20 nt, Human
aggaagccgaggaggggagc

SEQ ID NO: 234077 - RNA, 19 nt, Human
aggaaggaagccgaggagg

SEQ ID NO: 234078 - RNA, 21 nt, Human
aguuggucagguagaaggggc

SEQ ID NO: 234079 - RNA, 18 nt, Human
caggagaagccguaguuc

SEQ ID NO: 234080 - RNA, 24 nt, Human
ccacgccgucuaguccacaccugg

SEQ ID NO: 234081 - RNA, 19 nt, Human
ccagaagccucucccagua

SEQ ID NO: 234082 - RNA, 27 nt, Human
ccagauccuggcugcgguagcugcaac

SEQ ID NO: 234083 - RNA, 25 nt, Human
ccaggacagggagcucguccgagga

SEQ ID NO: 234084 - RNA, 21 nt, Human
cgccagacuuggugaggccca

SEQ ID NO: 234085 - RNA, 20 nt, Human
cuccugguggacccuagugg

SEQ ID NO: 234086 - RNA, 19 nt, Human
cuguggggggaucccagag

SEQ ID NO: 234087 - RNA, 24 nt, Human
gagcaggagaagccguaguuccag

SEQ ID NO: 234088 - RNA, 24 nt, Human
gagccugcagugagggcguccugg

SEQ ID NO: 234089 - RNA, 21 nt, Human
gagcgcucaggugaguagggc

SEQ ID NO: 234090 - RNA, 22 nt, Human
gagguggugggagaacuccugg

SEQ ID NO: 234091 - RNA, 20 nt, Human
gcagcucuggauggugggga

SEQ ID NO: 234092 - RNA, 25 nt, Human
gccgaggaggggagccugcagugag

SEQ ID NO: 234093 - RNA, 21 nt, Human
ggaagaggaagcugggguguu

SEQ ID NO: 234094 - RNA, 20 nt, Human
ggaaggacugguagggguag

SEQ ID NO: 234095 - RNA, 22 nt, Human
ggaaggacugguagggguagua

SEQ ID NO: 234096 - RNA, 23 nt, Human
ggaaucgcagccuuccagcccuc

SEQ ID NO: 234097 - RNA, 20 nt, Human
ggaucccagagcaaccucga

SEQ ID NO: 234098 - RNA, 19 nt, Human
gggcguccugggguucucc

SEQ ID NO: 234099 - RNA, 19 nt, Human
guagaccagggaccaggac

SEQ ID NO: 234100 - RNA, 19 nt, Human
gugcucuucgagcuguugg

SEQ ID NO: 234101 - RNA, 18 nt, Human
uaccaccuggaaacuggu

SEQ ID NO: 234102 - RNA, 20 nt, Human
ucagaccagugacaagggca

SEQ ID NO: 234103 - RNA, 21 nt, Human
ucccagagcaaccucgagggc

SEQ ID NO: 234104 - RNA, 25 nt, Human
ucgcagccuuccagcccucgaaauc

SEQ ID NO: 234105 - RNA, 19 nt, Human
ucuccgguucucaccaccu

SEQ ID NO: 234106 - RNA, 21 nt, Human
ugacccagaagccucucccag

SEQ ID NO: 234107 - RNA, 18 nt, Human
ugaggcccaggacaggga

SEQ ID NO: 234108 - RNA, 23 nt, Human
ugagguggugggagaacuccugg

SEQ ID NO: 234109 - RNA, 19 nt, Human
ugcaacggccguguggagc

SEQ ID NO: 234110 - RNA, 20 nt, Human
ugcagagaggaaggaagccg

SEQ ID NO: 234111 - RNA, 22 nt, Human
ugcuuaccaccuggaaacuggu

SEQ ID NO: 234112 - RNA, 20 nt, Human
uggaugguggggagguagac

SEQ ID NO: 234113 - RNA, 21 nt, Human
uggugcuuaccaccuggaaac

SEQ ID NO: 234114 - RNA, 21 nt, Human
ugguggacccuaguggaagcc

SEQ ID NO: 234115 - RNA, 19 nt, Human
uguuguggagucuggaagg

SEQ ID NO: 234116 - RNA, 24 nt, Human
gccccgggcccgccugggcuucug

SEQ ID NO: 234117 - RNA, 22 nt, Human
gccccgggccgccugggcuucc

SEQ ID NO: 234118 - RNA, 23 nt, Human
gccccgggccgccugggcuucug

SEQ ID NO: 234119 - RNA, 22 nt, Human
agaaaauauccccaaccaugaa

SEQ ID NO: 234120 - RNA, 25 nt, Human
aggaguccaccccuuuccucugccu

SEQ ID NO: 234121 - RNA, 26 nt, Human
agucgagaaaauauccccaaccauga

SEQ ID NO: 234122 - RNA, 20 nt, Human
auaaaagguaacuucccaca

SEQ ID NO: 234123 - RNA, 20 nt, Human
caccccuuuccucugccucu

SEQ ID NO: 234124 - RNA, 18 nt, Human
cagagaccugcagcugau

SEQ ID NO: 234125 - RNA, 20 nt, Human
caugaauaaauaaauggaaa

SEQ ID NO: 234126 - RNA, 23 nt, Human
cauuuuauuuggcaguuguuucu

SEQ ID NO: 234127 - RNA, 18 nt, Human
cccaaccaugaacagggc

SEQ ID NO: 234128 - RNA, 24 nt, Human
cccacaucacuggacuggacaguu

SEQ ID NO: 234129 - RNA, 27 nt, Human
cuaagaacaggucacauaggaguccac

SEQ ID NO: 234130 - RNA, 19 nt, Human
ggaagagaccugugaggua

SEQ ID NO: 234131 - RNA, 24 nt, Human
ggaguccaccccuuuccucugccu

SEQ ID NO: 234132 - RNA, 23 nt, Human
gucgagaaaauauccccaaccau

SEQ ID NO: 234133 - RNA, 22 nt, Human
uacacaucuucacugcaaagaa

SEQ ID NO: 234134 - RNA, 21 nt, Human
ucacauaggaguccaccccuu

SEQ ID NO: 234135 - RNA, 20 nt, Human
ucuugcucuaagaacagguc

SEQ ID NO: 234136 - RNA, 20 nt, Human
ugauucgugagcuucuccuc

SEQ ID NO: 234137 - RNA, 22 nt, Human
uggcagccacagaauuuggugu

SEQ ID NO: 234138 - RNA, 24 nt, Human
uguaucucugcuuuuucaaaacag

SEQ ID NO: 234139 - RNA, 21 nt, Human
uuaaacgcuuauuuacacauc

SEQ ID NO: 234140 - RNA, 19 nt, Human
uucauuugcaagugugaua

SEQ ID NO: 234141 - RNA, 24 nt, Human
aaacaacaaaccuccuagaaagca

SEQ ID NO: 234142 - RNA, 20 nt, Human
aacaaaccuccuagaaagca

SEQ ID NO: 234143 - RNA, 21 nt, Human
aacucgcggcggcucgcagcc

SEQ ID NO: 234144 - RNA, 23 nt, Human
aacucgcggcggcucgcagccuc

SEQ ID NO: 234145 - RNA, 19 nt, Human
aagcaaucaaaaaucauca

SEQ ID NO: 234146 - RNA, 25 nt, Human
aauacaaaagcaaucaaaaaucauc

SEQ ID NO: 234147 - RNA, 19 nt, Human
agaaaagacuggggaagca

SEQ ID NO: 234148 - RNA, 20 nt, Human
agaagguccuggagcgagcc

SEQ ID NO: 234149 - RNA, 20 nt, Human
agaauaaagacuccuuuuga

SEQ ID NO: 234150 - RNA, 21 nt, Human
aggcaaaacaacaaaccuccu

SEQ ID NO: 234151 - RNA, 26 nt, Human
aggcaaaacaacaaaccuccuagaaa

SEQ ID NO: 234152 - RNA, 18 nt, Human
aguucaauugcagacacc

SEQ ID NO: 234153 - RNA, 24 nt, Human
auuuucuaaaaacaguuuuccauu

SEQ ID NO: 234154 - RNA, 22 nt, Human
caaaagcaaucaaaaaucauca

SEQ ID NO: 234155 - RNA, 19 nt, Human
caacaaaccuccuagaaag

SEQ ID NO: 234156 - RNA, 18 nt, Human
cacacagucgguggggcg

SEQ ID NO: 234157 - RNA, 18 nt, Human
cacagucgguggggcgcu

SEQ ID NO: 234158 - RNA, 26 nt, Human
caccugcagaauuaaauacaaaagca

SEQ ID NO: 234159 - RNA, 19 nt, Human
cacuuggaaaagcuuccag

SEQ ID NO: 234160 - RNA, 20 nt, Human
cacuuggaaaagcuuccagg

SEQ ID NO: 234161 - RNA, 19 nt, Human
cagaauuaaauacaaaagc

SEQ ID NO: 234162 - RNA, 19 nt, Human
caggagggcccgagcagcg

SEQ ID NO: 234163 - RNA, 22 nt, Human
caggagggcccgagcagcggag

SEQ ID NO: 234164 - RNA, 19 nt, Human
caucuugugaagaaggucc

SEQ ID NO: 234165 - RNA, 22 nt, Human
ccccaugagcuuccugcuccuc

SEQ ID NO: 234166 - RNA, 19 nt, Human
ccgugguggcagugguggc

SEQ ID NO: 234167 - RNA, 20 nt, Human
cgagcccuggagcgggggcu

SEQ ID NO: 234168 - RNA, 18 nt, Human
cgguggggcgcucacacu

SEQ ID NO: 234169 - RNA, 20 nt, Human
cucaaaacuaacaggcaaaa

SEQ ID NO: 234170 - RNA, 25 nt, Human
cucgcggcggcucgcagccucccuc

SEQ ID NO: 234171 - RNA, 18 nt, Human
gaaagcaaauaugacccu

SEQ ID NO: 234172 - RNA, 24 nt, Human
gaccgugguggcagugguggcggc

SEQ ID NO: 234173 - RNA, 18 nt, Human
gagcuuuucccacccuaa

SEQ ID NO: 234174 - RNA, 21 nt, Human
gagugaccgcggugguggcgc

SEQ ID NO: 234175 - RNA, 18 nt, Human
gcaaaacaacaaaccucc

SEQ ID NO: 234176 - RNA, 21 nt, Human
gcuacagaagcccccaugagc

SEQ ID NO: 234177 - RNA, 22 nt, Human
ggagcgggggcuccccaggagg

SEQ ID NO: 234178 - RNA, 23 nt, Human
ggcagugguggcggcggcggcgg

SEQ ID NO: 234179 - RNA, 18 nt, Human
ggcuacagaagcccccau

SEQ ID NO: 234180 - RNA, 26 nt, Human
ggcuugcggcccucuucaauaaaauc

SEQ ID NO: 234181 - RNA, 19 nt, Human
gggggcuccccaggagggc

SEQ ID NO: 234182 - RNA, 18 nt, Human
gugaccgcggugguggcg

SEQ ID NO: 234183 - RNA, 25 nt, Human
guggcggcggcggcggugagugacc

SEQ ID NO: 234184 - RNA, 19 nt, Human
gugguggcggcggcggcgg

SEQ ID NO: 234185 - RNA, 25 nt, Human
gugguggcggcggcggcggugagug

SEQ ID NO: 234186 - RNA, 25 nt, Human
uaacaggcaaaacaacaaaccuccu

SEQ ID NO: 234187 - RNA, 21 nt, Human
ucagaaaagacuggggaagca

SEQ ID NO: 234188 - RNA, 20 nt, Human
ucagaauaaagacuccuuuu

SEQ ID NO: 234189 - RNA, 22 nt, Human
uccaccucuccagucucugauc

SEQ ID NO: 234190 - RNA, 18 nt, Human
ucucacuccaccucucca

SEQ ID NO: 234191 - RNA, 18 nt, Human
uggcagugguggcggcgg

SEQ ID NO: 234192 - RNA, 19 nt, Human
uggggcgcucacacuugga

SEQ ID NO: 234193 - RNA, 21 nt, Human
ugguggcggcggcggcgguga

SEQ ID NO: 234194 - RNA, 19 nt, Human
uguggcaggcgaccguggu

SEQ ID NO: 234195 - RNA, 22 nt, Human
uucuaaaaacaguuuuccauuu

SEQ ID NO: 234196 - RNA, 21 nt, Human
uuggggcuugcggcccucuuc

SEQ ID NO: 234197 - RNA, 22 nt, Human
uuuuuuuuuuuuuuuuuggguu

SEQ ID NO: 234198 - RNA, 23 nt, Human
uuuuuuuuuuuuuuuuuuugggu

SEQ ID NO: 234199 - RNA, 24 nt, Human
uuuuuuuuuuuuuuuuuuuuuggg

SEQ ID NO: 234200 - RNA, 19 nt, Human
aacccuccaccccuucacu

SEQ ID NO: 234201 - RNA, 23 nt, Human
aacccuccaccccuucacugucu

SEQ ID NO: 234202 - RNA, 25 nt, Human
aacccuccaccccuucacugucuuu

SEQ ID NO: 234203 - RNA, 18 nt, Human
aaguccaggucucugguc

SEQ ID NO: 234204 - RNA, 21 nt, Human
acaggcccgccagcgaacacg

SEQ ID NO: 234205 - RNA, 18 nt, Human
acaugacaaggaagaggc

SEQ ID NO: 234206 - RNA, 21 nt, Human
acccaaguacugccaggaagc

SEQ ID NO: 234207 - RNA, 23 nt, Human
accgggggcagggggacaggccc

SEQ ID NO: 234208 - RNA, 20 nt, Human
acugcacugcggccagagug

SEQ ID NO: 234209 - RNA, 21 nt, Human
acugcacugcggccagaguga

SEQ ID NO: 234210 - RNA, 24 nt, Human
agacaaaaguccaggucucugguc

SEQ ID NO: 234211 - RNA, 23 nt, Human
agaggggaagagaagaaugggga

SEQ ID NO: 234212 - RNA, 20 nt, Human
agcagcaccgaugccuccga

SEQ ID NO: 234213 - RNA, 23 nt, Human
agcagcaccgaugccuccgaccc

SEQ ID NO: 234214 - RNA, 18 nt, Human
aggaaaugccagucaagg

SEQ ID NO: 234215 - RNA, 21 nt, Human
aggcagaguggggaggccccg

SEQ ID NO: 234216 - RNA, 21 nt, Human
agggaagagaggggaagagaa

SEQ ID NO: 234217 - RNA, 22 nt, Human
agggagggggacuucccauagg

SEQ ID NO: 234218 - RNA, 19 nt, Human
agggcaggcagagugggga

SEQ ID NO: 234219 - RNA, 19 nt, Human
agggcaucgacugaggcua

SEQ ID NO: 234220 - RNA, 21 nt, Human
agggccacggugaagcccagg

SEQ ID NO: 234221 - RNA, 19 nt, Human
agggggagagaggaaaggg

SEQ ID NO: 234222 - RNA, 20 nt, Human
aggucucugguccacagcuu

SEQ ID NO: 234223 - RNA, 23 nt, Human
aggugaucaguggagccagggac

SEQ ID NO: 234224 - RNA, 22 nt, Human
agguggcgcguagggcaggcag

SEQ ID NO: 234225 - RNA, 22 nt, Human
aguggcccggcagccuagcccc

SEQ ID NO: 234226 - RNA, 23 nt, Human
caaggugaagcugaggaaggcca

SEQ ID NO: 234227 - RNA, 23 nt, Human
caccccuucacugucuuuacuuc

SEQ ID NO: 234228 - RNA, 19 nt, Human
cacgggaaaucaccuucca

SEQ ID NO: 234229 - RNA, 22 nt, Human
cacggugaagcccagggcugcu

SEQ ID NO: 234230 - RNA, 19 nt, Human
cacugcacugcggccagag

SEQ ID NO: 234231 - RNA, 20 nt, Human
cacugcacugcggccagagu

SEQ ID NO: 234232 - RNA, 18 nt, Human
cagcagcaccgaugccuc

SEQ ID NO: 234233 - RNA, 24 nt, Human
cagcagcaccgaugccuccgaccc

SEQ ID NO: 234234 - RNA, 18 nt, Human
cagccuagccccgucucc

SEQ ID NO: 234235 - RNA, 24 nt, Human
ccacagcuucagacaugacaagga

SEQ ID NO: 234236 - RNA, 18 nt, Human
ccaggaagccaguggccc

SEQ ID NO: 234237 - RNA, 22 nt, Human
cccagggcugcuggcugacccu

SEQ ID NO: 234238 - RNA, 20 nt, Human
ccgacccaaguacugccagg

SEQ ID NO: 234239 - RNA, 22 nt, Human
ccuagccccgucucccagcggg

SEQ ID NO: 234240 - RNA, 18 nt, Human
ccuaggaccccugcucga

SEQ ID NO: 234241 - RNA, 20 nt, Human
ccugcaaucgcaccuaccac

SEQ ID NO: 234242 - RNA, 26 nt, Human
ccugccagugccaggcagccuaggac

SEQ ID NO: 234243 - RNA, 24 nt, Human
ccuucacugucuuuacuucccuca

SEQ ID NO: 234244 - RNA, 23 nt, Human
cgacugaggcuagaaggccacag

SEQ ID NO: 234245 - RNA, 21 nt, Human
cgagggggagagaggaaaggg

SEQ ID NO: 234246 - RNA, 19 nt, Human
cggagacgcugcacugcac

SEQ ID NO: 234247 - RNA, 19 nt, Human
cggccagagugagcagcag

SEQ ID NO: 234248 - RNA, 23 nt, Human
cggcggccagcccugccagugcc

SEQ ID NO: 234249 - RNA, 22 nt, Human
cucccacugaggccaggggcag

SEQ ID NO: 234250 - RNA, 20 nt, Human
cugcuggcugacccucaggu

SEQ ID NO: 234251 - RNA, 25 nt, Human
cuuccaggccuuucucugugagguc

SEQ ID NO: 234252 - RNA, 19 nt, Human
gagaggaaagggaagagag

SEQ ID NO: 234253 - RNA, 25 nt, Human
gaggggaagagaagaauggggaggg

SEQ ID NO: 234254 - RNA, 23 nt, Human
gaggugaucaguggagccaggga

SEQ ID NO: 234255 - RNA, 21 nt, Human
gccuaggaccccugcucgaac

SEQ ID NO: 234256 - RNA, 21 nt, Human
gcggccagcccugccagugcc

SEQ ID NO: 234257 - RNA, 20 nt, Human
ggaagagaagaauggggagg

SEQ ID NO: 234258 - RNA, 23 nt, Human
ggggaagagaagaauggggaggg

SEQ ID NO: 234259 - RNA, 19 nt, Human
ggugauggucacaggagag

SEQ ID NO: 234260 - RNA, 22 nt, Human
uaccacaaacuugaccgggggc

SEQ ID NO: 234261 - RNA, 25 nt, Human
uacuucccucauuucccuuaagcag

SEQ ID NO: 234262 - RNA, 22 nt, Human
ucaaggugaagcugaggaaggc

SEQ ID NO: 234263 - RNA, 20 nt, Human
ucccuuaagcagacaaaagu

SEQ ID NO: 234264 - RNA, 23 nt, Human
ucucccacugaggccaggggcug

SEQ ID NO: 234265 - RNA, 19 nt, Human
ugaagcugaggaaggccaa

SEQ ID NO: 234266 - RNA, 21 nt, Human
ugaggucucccuguccacugu

SEQ ID NO: 234267 - RNA, 18 nt, Human
ugccaggcagccuaggac

SEQ ID NO: 234268 - RNA, 18 nt, Human
ugccaggcagccuaggac

SEQ ID NO: 234269 - RNA, 25 nt, Human
ugcggccagagugagcagcagcacc

SEQ ID NO: 234270 - RNA, 21 nt, Human
uggcugacccucagguggcgc

SEQ ID NO: 234271 - RNA, 19 nt, Human
ugguccacagcuucagaca

SEQ ID NO: 234272 - RNA, 20 nt, Human
ugguuguauuuguuuuagaa

SEQ ID NO: 234273 - RNA, 21 nt, Human
uuaaugguacauggaacacau

SEQ ID NO: 234274 - RNA, 18 nt, Human
aaucuucucagcaguccu

SEQ ID NO: 234275 - RNA, 18 nt, Human
acuuuguuguuuguuucu

SEQ ID NO: 234276 - RNA, 21 nt, Human
caaaaaaaaaagucaaaagca

SEQ ID NO: 234277 - RNA, 20 nt, Human
gaguaguugugagcucuauu

SEQ ID NO: 234278 - RNA, 19 nt, Human
ggacaaaaaaaaaagucaa

SEQ ID NO: 234279 - RNA, 22 nt, Human
uaacaauuacaugucuaaagga

SEQ ID NO: 234280 - RNA, 21 nt, Human
uauauuuauugccacccaaaa

SEQ ID NO: 234281 - RNA, 19 nt, Human
uauccaggucaacauacac

SEQ ID NO: 234282 - RNA, 23 nt, Human
ucuuguuauuguugcuguuguua

SEQ ID NO: 234283 - RNA, 22 nt, Human
uggacaaaaaaaaaagucaaaa

SEQ ID NO: 234284 - RNA, 24 nt, Human
uuauuguugcuguuguuaauuaca

SEQ ID NO: 234285 - RNA, 21 nt, Human
uuccauggacaaaaaaaaaag

SEQ ID NO: 234286 - RNA, 20 nt, Human
uuguuguuuguuucuguuau

SEQ ID NO: 234287 - RNA, 25 nt, Human
uuuuuuuuuuuuuuuuuagucauuu

SEQ ID NO: 234288 - RNA, 18 nt, Human
aagaaagcgagggcgcag

SEQ ID NO: 234289 - RNA, 18 nt, Human
agccgugggggcagccau

SEQ ID NO: 234290 - RNA, 19 nt, Human
agggaaugucaagaaagcg

SEQ ID NO: 234291 - RNA, 27 nt, Human
auaaaaauuaccagcccagagcuugga

SEQ ID NO: 234292 - RNA, 21 nt, Human
auuuuguauuugcaaaagcug

SEQ ID NO: 234293 - RNA, 19 nt, Human
cacgugagacaaaagaguc

SEQ ID NO: 234294 - RNA, 24 nt, Human
cagccgugggggcagccaugcugg

SEQ ID NO: 234295 - RNA, 23 nt, Human
ccaccggauccaccacgugagac

SEQ ID NO: 234296 - RNA, 20 nt, Human
guaaagaauuauauuuugua

SEQ ID NO: 234297 - RNA, 18 nt, Human
guggccuggggaagagag

SEQ ID NO: 234298 - RNA, 22 nt, Human
ucauaaaaauuaccagcccaga

SEQ ID NO: 234299 - RNA, 22 nt, Human
uccaccacgugagacaaaagag

SEQ ID NO: 234300 - RNA, 22 nt, Human
agaagccuuuauugugggagga

SEQ ID NO: 234301 - RNA, 22 nt, Human
gcuccaggagucgggauggacu

SEQ ID NO: 234302 - RNA, 25 nt, Human
ggaggaucggggugucagggcuccc

SEQ ID NO: 234303 - RNA, 20 nt, Human
uauugugggaggaucggggu

SEQ ID NO: 234304 - RNA, 21 nt, Human
ugggaggaucggggugucagg

SEQ ID NO: 234305 - RNA, 18 nt, Human
ugugggaggaucggggug

SEQ ID NO: 234306 - RNA, 20 nt, Human
aaacaaaaugcacugagaca

SEQ ID NO: 234307 - RNA, 24 nt, Human
aagcaggaaaacaaaaugcacuga

SEQ ID NO: 234308 - RNA, 25 nt, Human
acaaauaguuuuuacguguggcagu

SEQ ID NO: 234309 - RNA, 22 nt, Human
acagauagaacuuucuguggug

SEQ ID NO: 234310 - RNA, 18 nt, Human
agguagaggucucuugcc

SEQ ID NO: 234311 - RNA, 23 nt, Human
agguaggaagcaggaaaacaaaa

SEQ ID NO: 234312 - RNA, 23 nt, Human
caaacuaccugaggaaaaagccc

SEQ ID NO: 234313 - RNA, 19 nt, Human
cacguagccauugagaacu

SEQ ID NO: 234314 - RNA, 20 nt, Human
ccccuuauuuuaaauuucug

SEQ ID NO: 234315 - RNA, 30 nt, Human
cuaaaaauaaauaauuuccuaaauccaacc

SEQ ID NO: 234316 - RNA, 22 nt, Human
cucucaacuucauauuuaugcc

SEQ ID NO: 234317 - RNA, 23 nt, Human
cuuaauguuucacuaagcaaaua

SEQ ID NO: 234318 - RNA, 22 nt, Human
gaaaaaaagauaugcaaaauac

SEQ ID NO: 234319 - RNA, 18 nt, Human
gaaaacaaaaugcacuga

SEQ ID NO: 234320 - RNA, 21 nt, Human
gaaugcaauacaaauuacgaa

SEQ ID NO: 234321 - RNA, 24 nt, Human
gaguguguuuuucaaacuaccuga

SEQ ID NO: 234322 - RNA, 19 nt, Human
ggaaaacaaaaugcacuga

SEQ ID NO: 234323 - RNA, 19 nt, Human
guuuuucaaacuaccugag

SEQ ID NO: 234324 - RNA, 19 nt, Human
uaacucagcacauuuguag

SEQ ID NO: 234325 - RNA, 21 nt, Human
uaagcaaauaggcugaaaugu

SEQ ID NO: 234326 - RNA, 26 nt, Human
uacaaauuacgaaaaugaaaaaaaga

SEQ ID NO: 234327 - RNA, 18 nt, Human
uaccugaggaaaaagccc

SEQ ID NO: 234328 - RNA, 19 nt, Human
uaccugaggaaaaagccuu

SEQ ID NO: 234329 - RNA, 18 nt, Human
uauagaaugcaauacaaa

SEQ ID NO: 234330 - RNA, 18 nt, Human
uauucugugucugugcug

SEQ ID NO: 234331 - RNA, 21 nt, Human
ucacuaagcaaauaggcugaa

SEQ ID NO: 234332 - RNA, 22 nt, Human
ucuauaauagaacagauagaac

SEQ ID NO: 234333 - RNA, 24 nt, Human
ugagaacuugacguagccauugag

SEQ ID NO: 234334 - RNA, 22 nt, Human
uuacgaaaaugaaaaaaagaua

SEQ ID NO: 234335 - RNA, 23 nt, Human
uugacguagccauugagaacuug

SEQ ID NO: 234336 - RNA, 21 nt, Human
uugagaacuugaaacguagug

SEQ ID NO: 234337 - RNA, 23 nt, Human
aagccaaaacucgcaccaggaaa

SEQ ID NO: 234338 - RNA, 23 nt, Human
aaguagagcccaggggaugacuc

SEQ ID NO: 234339 - RNA, 19 nt, Human
cagccggggaguccggggc

SEQ ID NO: 234340 - RNA, 18 nt, Human
cagcgagaacggcggcgg

SEQ ID NO: 234341 - RNA, 26 nt, Human
cagcgagaacggcggcgggaacggaa

SEQ ID NO: 234342 - RNA, 19 nt, Human
ccaggaaaucaaaguaggg

SEQ ID NO: 234343 - RNA, 21 nt, Human
ccccagucucuccaaaaagag

SEQ ID NO: 234344 - RNA, 20 nt, Human
ccgagcucggguugcgagga

SEQ ID NO: 234345 - RNA, 21 nt, Human
ccgggcuggagcgcgccgccu

SEQ ID NO: 234346 - RNA, 19 nt, Human
cucaggcgggagagaaugc

SEQ ID NO: 234347 - RNA, 21 nt, Human
cucaggcgggagagaaugcga

SEQ ID NO: 234348 - RNA, 18 nt, Human
cuccaaaaagaggacaca

SEQ ID NO: 234349 - RNA, 18 nt, Human
cugcucagagcccgcgga

SEQ ID NO: 234350 - RNA, 22 nt, Human
gcagccggggaguccggggccc

SEQ ID NO: 234351 - RNA, 20 nt, Human
gccccgggcuggagcgcgcc

SEQ ID NO: 234352 - RNA, 21 nt, Human
gccccgggcuggagcgcgccg

SEQ ID NO: 234353 - RNA, 23 nt, Human
ggcggcgggaacggaaauaaaua

SEQ ID NO: 234354 - RNA, 27 nt, Human
gggaacggaaauaaauaaauaaaaacg

SEQ ID NO: 234355 - RNA, 18 nt, Human
gggcuggagcgcgccgcc

SEQ ID NO: 234356 - RNA, 19 nt, Human
gugcagccggggaguccgg

SEQ ID NO: 234357 - RNA, 23 nt, Human
uaaaaacggagaagaagaagacg

SEQ ID NO: 234358 - RNA, 21 nt, Human
uccccagucucuccaaaaaga

SEQ ID NO: 234359 - RNA, 27 nt, Human
uccccagucucuccaaaaagaggacac

SEQ ID NO: 234360 - RNA, 23 nt, Human
ucgggccugggggcgucucagug

SEQ ID NO: 234361 - RNA, 21 nt, Human
ugcagccggggaguccggggc

SEQ ID NO: 234362 - RNA, 18 nt, Human
ugcgaggaaagcgccggg

SEQ ID NO: 234363 - RNA, 22 nt, Human
ugcucagagcccgcggaggagu

SEQ ID NO: 234364 - RNA, 24 nt, Human
uucuguacaaccacgaacuccgca

SEQ ID NO: 234365 - RNA, 21 nt, Human
aaaaggaaugaacuaaugaua

SEQ ID NO: 234366 - RNA, 19 nt, Human
aaacagaauauacaaugug

SEQ ID NO: 234367 - RNA, 20 nt, Human
aaauacacuuggaauucaac

SEQ ID NO: 234368 - RNA, 21 nt, Human
aacaagucauccaaaguaugg

SEQ ID NO: 234369 - RNA, 21 nt, Human
aagaagccagauaaaacagaa

SEQ ID NO: 234370 - RNA, 23 nt, Human
aagaagccagauaaaacagaaua

SEQ ID NO: 234371 - RNA, 19 nt, Human
aauaaaaggaaugaacuaa

SEQ ID NO: 234372 - RNA, 22 nt, Human
aauauacagagaaaaagaggga

SEQ ID NO: 234373 - RNA, 21 nt, Human
acaccgcugcauuagccgggc

SEQ ID NO: 234374 - RNA, 18 nt, Human
agacugggagggaggggc

SEQ ID NO: 234375 - RNA, 20 nt, Human
agacugggagggaggggcua

SEQ ID NO: 234376 - RNA, 19 nt, Human
aggaagacugggagggagg

SEQ ID NO: 234377 - RNA, 21 nt, Human
agggaauggguaaaaucacug

SEQ ID NO: 234378 - RNA, 27 nt, Human
auaaaacagaauauacaaugugugauu

SEQ ID NO: 234379 - RNA, 22 nt, Human
caaugugugauuccaauuauau

SEQ ID NO: 234380 - RNA, 19 nt, Human
caguauuccuaaggcacgu

SEQ ID NO: 234381 - RNA, 26 nt, Human
cugggagggaggggcuacaugaggaa

SEQ ID NO: 234382 - RNA, 18 nt, Human
cuuuuggguaugaugaau

SEQ ID NO: 234383 - RNA, 21 nt, Human
gguaaggaagacugggaggga

SEQ ID NO: 234384 - RNA, 18 nt, Human
guccacaaaacuguacag

SEQ ID NO: 234385 - RNA, 21 nt, Human
uaaaacaguauuccuaaggca

SEQ ID NO: 234386 - RNA, 22 nt, Human
uaaaaucacugguguaucccua

SEQ ID NO: 234387 - RNA, 19 nt, Human
uacagagaaaaagagggag

SEQ ID NO: 234388 - RNA, 24 nt, Human
uagcagcuuuauuugcaauagcca

SEQ ID NO: 234389 - RNA, 22 nt, Human
uagccaaaaucuagaaacaacc

SEQ ID NO: 234390 - RNA, 21 nt, Human
ucaguccacaaaacuguacag

SEQ ID NO: 234391 - RNA, 21 nt, Human
uccacaccgcugcauuagccg

SEQ ID NO: 234392 - RNA, 23 nt, Human
uccacaccgcugcauuagccggg

SEQ ID NO: 234393 - RNA, 21 nt, Human
uccuuugucuguuguggugau

SEQ ID NO: 234394 - RNA, 23 nt, Human
ucgcucaguccacaaaacuguac

SEQ ID NO: 234395 - RNA, 23 nt, Human
ugaaaauacagaagcucuagcca

SEQ ID NO: 234396 - RNA, 18 nt, Human
ugaacaagucauccaaag

SEQ ID NO: 234397 - RNA, 24 nt, Human
ugaacaagucauccaaaguaugga

SEQ ID NO: 234398 - RNA, 18 nt, Human
ugaauguucauagcagcu

SEQ ID NO: 234399 - RNA, 21 nt, Human
ugcaauagccaaaaucuagaa

SEQ ID NO: 234400 - RNA, 18 nt, Human
ugccuggugggguggaga

SEQ ID NO: 234401 - RNA, 21 nt, Human
ugccuggugggguggagaggu

SEQ ID NO: 234402 - RNA, 21 nt, Human
uggugggguggagagguaagg

SEQ ID NO: 234403 - RNA, 20 nt, Human
uguuguuuuuuuuguuuuuu

SEQ ID NO: 234404 - RNA, 21 nt, Human
uuguuguuuuuuuuguuuuuu

SEQ ID NO: 234405 - RNA, 20 nt, Human
uuuuuuuuguacaugaaugu

SEQ ID NO: 234406 - RNA, 24 nt, Human
acgccaccccgcaauagccccgaa

SEQ ID NO: 234407 - RNA, 20 nt, Human
cccgcaauagccccgaaccu

SEQ ID NO: 234408 - RNA, 23 nt, Human
ccgccgcccggcgucgccacucu

SEQ ID NO: 234409 - RNA, 21 nt, Human
ccggcguccaagcgacuccgg

SEQ ID NO: 234410 - RNA, 25 nt, Human
ccgggcccagcgacgccaccccgca

SEQ ID NO: 234411 - RNA, 19 nt, Human
cuccgggugcugcugggcg

SEQ ID NO: 234412 - RNA, 21 nt, Human
gacgccaccccgcaauagccc

SEQ ID NO: 234413 - RNA, 22 nt, Human
uccaagcgacuccgggugcugc

SEQ ID NO: 234414 - RNA, 22 nt, Human
aagcagaacagcaggggagaga

SEQ ID NO: 234415 - RNA, 18 nt, Human
acaggcuggccggccccc

SEQ ID NO: 234416 - RNA, 19 nt, Human
acuccacaggcuggccggc

SEQ ID NO: 234417 - RNA, 23 nt, Human
agacccaacaagccagugucccu

SEQ ID NO: 234418 - RNA, 22 nt, Human
agcaaaguucccaaaggccaag

SEQ ID NO: 234419 - RNA, 20 nt, Human
agccaggggggcagguaggg

SEQ ID NO: 234420 - RNA, 24 nt, Human
aggcauugugugagacacaccagu

SEQ ID NO: 234421 - RNA, 22 nt, Human
agguaggguggggaggagagaa

SEQ ID NO: 234422 - RNA, 20 nt, Human
aucacagucaccuugugcua

SEQ ID NO: 234423 - RNA, 21 nt, Human
caagccaggggggcagguagg

SEQ ID NO: 234424 - RNA, 26 nt, Human
caagccccuaagcagaacagcagggg

SEQ ID NO: 234425 - RNA, 23 nt, Human
caaugcccuaguguggucucaca

SEQ ID NO: 234426 - RNA, 18 nt, Human
caccaguuggagcaaagu

SEQ ID NO: 234427 - RNA, 25 nt, Human
cagaacagcaggggagagacccaac

SEQ ID NO: 234428 - RNA, 21 nt, Human
ccaaagcacugagcagccaag

SEQ ID NO: 234429 - RNA, 21 nt, Human
ccaagcaggccgcuggaguca

SEQ ID NO: 234430 - RNA, 20 nt, Human
ccccccgccaguccccaggg

SEQ ID NO: 234431 - RNA, 19 nt, Human
cccccuccccccgccaguc

SEQ ID NO: 234432 - RNA, 20 nt, Human
ccgcgucgacgaggcauugu

SEQ ID NO: 234433 - RNA, 25 nt, Human
ccugugcuguguucugagaugaguc

SEQ ID NO: 234434 - RNA, 22 nt, Human
cgaaagccagcgagucgcaguc

SEQ ID NO: 234435 - RNA, 21 nt, Human
cggagcgaaagccagcgaguc

SEQ ID NO: 234436 - RNA, 25 nt, Human
cggcccccuccccccgccagucccc

SEQ ID NO: 234437 - RNA, 22 nt, Human
cuaggccauuacccccugugcu

SEQ ID NO: 234438 - RNA, 24 nt, Human
cuaucacagucaccuugugcuacc

SEQ ID NO: 234439 - RNA, 20 nt, Human
cucacagccuucuaggaauc

SEQ ID NO: 234440 - RNA, 19 nt, Human
cucuuuugauccuugaaga

SEQ ID NO: 234441 - RNA, 20 nt, Human
cuggagucacgguggaagcc

SEQ ID NO: 234442 - RNA, 22 nt, Human
cuugaagauauucucucaagcc

SEQ ID NO: 234443 - RNA, 20 nt, Human
gagucugcucucccacugcu

SEQ ID NO: 234444 - RNA, 18 nt, Human
gccccuaagcagaacagc

SEQ ID NO: 234445 - RNA, 20 nt, Human
gcuaccaaagcacugagcag

SEQ ID NO: 234446 - RNA, 19 nt, Human
ggaagccgggcccuccgcu

SEQ ID NO: 234447 - RNA, 23 nt, Human
guccccagucuguuuccaauccc

SEQ ID NO: 234448 - RNA, 23 nt, Human
gucugcucucccacugcuucccc

SEQ ID NO: 234449 - RNA, 20 nt, Human
gugcuguguucugagaugag

SEQ ID NO: 234450 - RNA, 25 nt, Human
uaaaaccccaagcaggccgcuggag

SEQ ID NO: 234451 - RNA, 26 nt, Human
uaauaauuaaaaccccaagcaggccg

SEQ ID NO: 234452 - RNA, 20 nt, Human
uagcucgauucagaaauuuc

SEQ ID NO: 234453 - RNA, 23 nt, Human
uaggaaucagcggaggacuucca

SEQ ID NO: 234454 - RNA, 25 nt, Human
ucaaaauaauaauuaaaaccccaag

SEQ ID NO: 234455 - RNA, 18 nt, Human
ucaagccaggggggcagg

SEQ ID NO: 234456 - RNA, 23 nt, Human
ucaagccaggggggcagguaggg

SEQ ID NO: 234457 - RNA, 22 nt, Human
ucccaaaggccaagggggccuc

SEQ ID NO: 234458 - RNA, 19 nt, Human
ucccacugcuuccccaggg

SEQ ID NO: 234459 - RNA, 20 nt, Human
uuacccccugugcuguguuc

SEQ ID NO: 234460 - RNA, 26 nt, Human
uucaaaauaauaauuaaaaccccaag

SEQ ID NO: 234461 - RNA, 21 nt, Human
uugaaaauaauggaaauucac

SEQ ID NO: 234462 - RNA, 24 nt, Human
uuggagcaaaguucccaaaggcca

SEQ ID NO: 234463 - RNA, 21 nt, Human
acagagcaaaaaaaacaaggc

SEQ ID NO: 234464 - RNA, 23 nt, Human
agagagaacccccgagggacacc

SEQ ID NO: 234465 - RNA, 21 nt, Human
agcagcugcagggcgagucug

SEQ ID NO: 234466 - RNA, 20 nt, Human
agccgaggagcagcugccag

SEQ ID NO: 234467 - RNA, 21 nt, Human
caaaaaaaacaaggcaucagu

SEQ ID NO: 234468 - RNA, 20 nt, Human
cagccgaggagcagcugcca

SEQ ID NO: 234469 - RNA, 20 nt, Human
cagcugccaguugagugcgg

SEQ ID NO: 234470 - RNA, 19 nt, Human
cauaucuaaauuggcuaca

SEQ ID NO: 234471 - RNA, 26 nt, Human
cccccgagggacacccacgucuccca

SEQ ID NO: 234472 - RNA, 20 nt, Human
ccccgggggccgagcgcggg

SEQ ID NO: 234473 - RNA, 23 nt, Human
cccggaguggggugguggggggc

SEQ ID NO: 234474 - RNA, 26 nt, Human
cccuccgcugcccuucgccucuuguc

SEQ ID NO: 234475 - RNA, 20 nt, Human
cccucgggccugccgggccc

SEQ ID NO: 234476 - RNA, 19 nt, Human
ccgcugcccuucgccucuu

SEQ ID NO: 234477 - RNA, 20 nt, Human
ccgcugcccuucgccucuug

SEQ ID NO: 234478 - RNA, 29 nt, Human
ccgguggcggaggcgccggcacuuucccc

SEQ ID NO: 234479 - RNA, 19 nt, Human
cgaggagcagcugccaguu

SEQ ID NO: 234480 - RNA, 22 nt, Human
cgagggacacccacgucuccca

SEQ ID NO: 234481 - RNA, 19 nt, Human
cucaucuuugucuggucgc

SEQ ID NO: 234482 - RNA, 19 nt, Human
cugcagggcgagucugguc

SEQ ID NO: 234483 - RNA, 22 nt, Human
cuggcgcugggcugcccggagu

SEQ ID NO: 234484 - RNA, 18 nt, Human
cuguccggacagagcaaa

SEQ ID NO: 234485 - RNA, 20 nt, Human
cuucggccgccuugcccucc

SEQ ID NO: 234486 - RNA, 19 nt, Human
gagaacccccgagggacac

SEQ ID NO: 234487 - RNA, 22 nt, Human
gagcaaaaaaaacaaggcauca

SEQ ID NO: 234488 - RNA, 19 nt, Human
gaguauugacuuugguccc

SEQ ID NO: 234489 - RNA, 20 nt, Human
ggacagagcaaaaaaaacaa

SEQ ID NO: 234490 - RNA, 18 nt, Human
ggacccgagagagaaccc

SEQ ID NO: 234491 - RNA, 21 nt, Human
ggagaguacuggcggugggcu

SEQ ID NO: 234492 - RNA, 19 nt, Human
ggagaugggggucggcccc

SEQ ID NO: 234493 - RNA, 23 nt, Human
ggaguauugacuuuggucccaag

SEQ ID NO: 234494 - RNA, 19 nt, Human
ggagugggguggugggggg

SEQ ID NO: 234495 - RNA, 22 nt, Human
ggcccccgggggccgagcgcgg

SEQ ID NO: 234496 - RNA, 25 nt, Human
ggcggugggcugaggcuccuggaga

SEQ ID NO: 234497 - RNA, 18 nt, Human
ggcugaggcuccuggaga

SEQ ID NO: 234498 - RNA, 18 nt, Human
ggggcggggcccccgggg

SEQ ID NO: 234499 - RNA, 19 nt, Human
gggggucggccccccucgg

SEQ ID NO: 234500 - RNA, 24 nt, Human
uagcauaucuaaauuggcuacagc

SEQ ID NO: 234501 - RNA, 18 nt, Human
uccggaccaagacucagc

SEQ ID NO: 234502 - RNA, 22 nt, Human
ugcucgcgguugcugggagagu

SEQ ID NO: 234503 - RNA, 21 nt, Human
ugcugggagaguacuggcggu

SEQ ID NO: 234504 - RNA, 22 nt, Human
uggccuggcgcugggcugcccg

SEQ ID NO: 234505 - RNA, 18 nt, Human
uggcggugggcugaggcu

SEQ ID NO: 234506 - RNA, 19 nt, Human
ugggagaguacuggcggug

SEQ ID NO: 234507 - RNA, 19 nt, Human
ugggccccuggcccucggg

SEQ ID NO: 234508 - RNA, 19 nt, Human
uggggugguggggggcggg

SEQ ID NO: 234509 - RNA, 25 nt, Human
uggggugguggggggcggguggcgu

SEQ ID NO: 234510 - RNA, 22 nt, Human
ugguuucaggaggcugcuucgg

SEQ ID NO: 234511 - RNA, 23 nt, Human
uguccggacagagcaaaaaaaac

SEQ ID NO: 234512 - RNA, 23 nt, Human
uucggccgccuugcccucccuuu

SEQ ID NO: 234513 - RNA, 19 nt, Human
uugaguauuagcuuguacc

SEQ ID NO: 234514 - RNA, 18 nt, Human
uugcccucccuuugggcc

SEQ ID NO: 234515 - RNA, 18 nt, Human
uugguuucaggaggcugc

SEQ ID NO: 234516 - RNA, 20 nt, Human
uuucaagcgguccggauccu

SEQ ID NO: 234517 - RNA, 25 nt, Human
aaauaaucugucaguaugaaacauc

SEQ ID NO: 234518 - RNA, 23 nt, Human
aacacugcucugagcagcugccc

SEQ ID NO: 234519 - RNA, 20 nt, Human
aacuuggaggccggcagccc

SEQ ID NO: 234520 - RNA, 26 nt, Human
aagaagccagaacacugcucugagca

SEQ ID NO: 234521 - RNA, 21 nt, Human
aagcaagacagaaaggcaccc

SEQ ID NO: 234522 - RNA, 18 nt, Human
aaggaggacgauggggac

SEQ ID NO: 234523 - RNA, 18 nt, Human
acaaggacagggugggcc

SEQ ID NO: 234524 - RNA, 21 nt, Human
acacacuaugucuacucugga

SEQ ID NO: 234525 - RNA, 20 nt, Human
acacgcuaaagcaagucaca

SEQ ID NO: 234526 - RNA, 18 nt, Human
accaucaucuugucggag

SEQ ID NO: 234527 - RNA, 19 nt, Human
accccaaccccaggccuca

SEQ ID NO: 234528 - RNA, 20 nt, Human
accccaccuuccuggggucu

SEQ ID NO: 234529 - RNA, 20 nt, Human
accccaggccucaggaccug

SEQ ID NO: 234530 - RNA, 23 nt, Human
acccuccaccccaaccccaggcc

SEQ ID NO: 234531 - RNA, 22 nt, Human
acggugggcccacggagcuagc

SEQ ID NO: 234532 - RNA, 22 nt, Human
acucccacucaggccuccccau

SEQ ID NO: 234533 - RNA, 22 nt, Human
acugucuugcccacugcuccag

SEQ ID NO: 234534 - RNA, 20 nt, Human
agaaacccagcucccggccu

SEQ ID NO: 234535 - RNA, 22 nt, Human
agaaaggcacccggccucucca

SEQ ID NO: 234536 - RNA, 22 nt, Human
agacccugacccuaaguucugc

SEQ ID NO: 234537 - RNA, 18 nt, Human
agacccuggccaucccag

SEQ ID NO: 234538 - RNA, 23 nt, Human
agagcuguuucacgcaaaggcuc

SEQ ID NO: 234539 - RNA, 21 nt, Human
agaggcagcauggggacacag

SEQ ID NO: 234540 - RNA, 24 nt, Human
agaugccggcaguuuucagagguu

SEQ ID NO: 234541 - RNA, 22 nt, Human
aggcccccacaucuggacccaa

SEQ ID NO: 234542 - RNA, 19 nt, Human
agggccgcaaggugggccu

SEQ ID NO: 234543 - RNA, 21 nt, Human
aggugugguccacaccagcag

SEQ ID NO: 234544 - RNA, 21 nt, Human
aguaggggauggggguggagc

SEQ ID NO: 234545 - RNA, 24 nt, Human
agucacaguaggggaugggggugg

SEQ ID NO: 234546 - RNA, 19 nt, Human
caaagggacaaguagaggc

SEQ ID NO: 234547 - RNA, 22 nt, Human
caaagugagugaaaaguaccau

SEQ ID NO: 234548 - RNA, 19 nt, Human
caacuccgggccgcacccu

SEQ ID NO: 234549 - RNA, 26 nt, Human
caaggccccccacucccacucaggcc

SEQ ID NO: 234550 - RNA, 19 nt, Human
cacaagaccucccagggcc

SEQ ID NO: 234551 - RNA, 24 nt, Human
caccccaaccccaggccucaggac

SEQ ID NO: 234552 - RNA, 18 nt, Human
cacccuccaccccaaccc

SEQ ID NO: 234553 - RNA, 21 nt, Human
cacccuccaccccaaccccag

SEQ ID NO: 234554 - RNA, 24 nt, Human
cacccuccaccccaaccccaggcc

SEQ ID NO: 234555 - RNA, 19 nt, Human
caccuccacaaaccccugc

SEQ ID NO: 234556 - RNA, 24 nt, Human
caccuccacaaaccccugcugcag

SEQ ID NO: 234557 - RNA, 21 nt, Human
cacgcgccauccagguaaagu

SEQ ID NO: 234558 - RNA, 23 nt, Human
cacugcucugagcagcugcccca

SEQ ID NO: 234559 - RNA, 21 nt, Human
cagaacacugcucugagcagc

SEQ ID NO: 234560 - RNA, 20 nt, Human
cagaaccucugcaccugacu

SEQ ID NO: 234561 - RNA, 24 nt, Human
cagagcuccaaccccacacacuau

SEQ ID NO: 234562 - RNA, 19 nt, Human
cagccacauccucgucuug

SEQ ID NO: 234563 - RNA, 22 nt, Human
cagccccugcagccuggacccu

SEQ ID NO: 234564 - RNA, 25 nt, Human
cagccuggacccugacacgcuaaag

SEQ ID NO: 234565 - RNA, 21 nt, Human
cagcuuccuggucugaguccc

SEQ ID NO: 234566 - RNA, 22 nt, Human
caggccccccgcaccgucuaug

SEQ ID NO: 234567 - RNA, 19 nt, Human
cagggaaaggugcaaagug

SEQ ID NO: 234568 - RNA, 19 nt, Human
cagggagaugaggugaugg

SEQ ID NO: 234569 - RNA, 19 nt, Human
cagggccgcaaggugggcc

SEQ ID NO: 234570 - RNA, 19 nt, Human
cagggccucagaugugagc

SEQ ID NO: 234571 - RNA, 23 nt, Human
caggggcaggguuguuccagggc

SEQ ID NO: 234572 - RNA, 19 nt, Human
cagguaaagugcuuagaga

SEQ ID NO: 234573 - RNA, 22 nt, Human
caucagacccuggccaucccag

SEQ ID NO: 234574 - RNA, 21 nt, Human
caucccagaggccccucucua

SEQ ID NO: 234575 - RNA, 19 nt, Human
ccacucgccuggccccagc

SEQ ID NO: 234576 - RNA, 23 nt, Human
ccagaggccccucucuaucuucc

SEQ ID NO: 234577 - RNA, 21 nt, Human
ccagccccaagcuaagccgga

SEQ ID NO: 234578 - RNA, 28 nt, Human
ccaggcccugcuaagcccuggcccuggc

SEQ ID NO: 234579 - RNA, 21 nt, Human
ccaggccucaggaccugccug

SEQ ID NO: 234580 - RNA, 21 nt, Human
ccagggccgcaaggugggccu

SEQ ID NO: 234581 - RNA, 19 nt, Human
cccaaccccaggccucagg

SEQ ID NO: 234582 - RNA, 23 nt, Human
cccacagcuuccuggucugaguc

SEQ ID NO: 234583 - RNA, 20 nt, Human
cccacaucucaacagccaca

SEQ ID NO: 234584 - RNA, 24 nt, Human
cccacaucucaacagccacauccu

SEQ ID NO: 234585 - RNA, 20 nt, Human
cccacgcuccccaguccaca

SEQ ID NO: 234586 - RNA, 24 nt, Human
cccacucccacucaggccucccca

SEQ ID NO: 234587 - RNA, 21 nt, Human
cccagaguggaguggacuggc

SEQ ID NO: 234588 - RNA, 27 nt, Human
cccagccccugcagccuggacccugac

SEQ ID NO: 234589 - RNA, 23 nt, Human
ccccaaccccaggccucaggacc

SEQ ID NO: 234590 - RNA, 21 nt, Human
ccccaacucugcugccuccuu

SEQ ID NO: 234591 - RNA, 26 nt, Human
ccccacucccacucaggccuccccau

SEQ ID NO: 234592 - RNA, 25 nt, Human
ccccagccacccuuggacaggcccc

SEQ ID NO: 234593 - RNA, 23 nt, Human
cccccacucccacucaggccucc

SEQ ID NO: 234594 - RNA, 22 nt, Human
cccccagucuaccccaccuucc

SEQ ID NO: 234595 - RNA, 23 nt, Human
ccccccagucuaccccaccuucc

SEQ ID NO: 234596 - RNA, 20 nt, Human
ccccgggugccagagcucca

SEQ ID NO: 234597 - RNA, 20 nt, Human
ccccggguggaaucagcaac

SEQ ID NO: 234598 - RNA, 18 nt, Human
ccccugcccuacccaccu

SEQ ID NO: 234599 - RNA, 25 nt, Human
ccccugcugcagguccagccaucag

SEQ ID NO: 234600 - RNA, 23 nt, Human
ccccugggcccugcugucucacc

SEQ ID NO: 234601 - RNA, 23 nt, Human
cccgcaccgucuauggguguccg

SEQ ID NO: 234602 - RNA, 19 nt, Human
cccuccaccccaaccccag

SEQ ID NO: 234603 - RNA, 21 nt, Human
cccuccaccccaaccccaggc

SEQ ID NO: 234604 - RNA, 21 nt, Human
cccucggggucugccagcagc

SEQ ID NO: 234605 - RNA, 23 nt, Human
cccugcccuacccaccuccacaa

SEQ ID NO: 234606 - RNA, 21 nt, Human
cccugcuaagcccuggcccug

SEQ ID NO: 234607 - RNA, 19 nt, Human
cccuggcgcuugugucggg

SEQ ID NO: 234608 - RNA, 19 nt, Human
cccugggccccagccaccc

SEQ ID NO: 234609 - RNA, 19 nt, Human
cccugggccccagccaccc

SEQ ID NO: 234610 - RNA, 22 nt, Human
ccgcucaggguuugagaagaag

SEQ ID NO: 234611 - RNA, 23 nt, Human
ccggccaggcccagguguggucc

SEQ ID NO: 234612 - RNA, 22 nt, Human
ccucaggaccugccugcacacu

SEQ ID NO: 234613 - RNA, 22 nt, Human
ccuccccugcucucagacugga

SEQ ID NO: 234614 - RNA, 24 nt, Human
ccuccucuugggagcaaugggcag

SEQ ID NO: 234615 - RNA, 20 nt, Human
ccucuccuccucccaguguc

SEQ ID NO: 234616 - RNA, 21 nt, Human
ccucuccuccucccagugucu

SEQ ID NO: 234617 - RNA, 20 nt, Human
ccugagacccugacccuaag

SEQ ID NO: 234618 - RNA, 21 nt, Human
ccuuccaucccagaggccccu

SEQ ID NO: 234619 - RNA, 22 nt, Human
ccuuugggauccuagccccucu

SEQ ID NO: 234620 - RNA, 20 nt, Human
cgacucagagccagggccgc

SEQ ID NO: 234621 - RNA, 22 nt, Human
cgcacccuccaccccaacccca

SEQ ID NO: 234622 - RNA, 23 nt, Human
cgcccaagaacagugugaaccag

SEQ ID NO: 234623 - RNA, 19 nt, Human
cgcgccauccagguaaagu

SEQ ID NO: 234624 - RNA, 20 nt, Human
cggcaaggcagagcuggacu

SEQ ID NO: 234625 - RNA, 22 nt, Human
cggggucugccagcagccccca

SEQ ID NO: 234626 - RNA, 21 nt, Human
cgugggcgggacugaaggcug

SEQ ID NO: 234627 - RNA, 20 nt, Human
cuaagcccuggcccuggcgc

SEQ ID NO: 234628 - RNA, 19 nt, Human
cuacccaccuccacaaacu

SEQ ID NO: 234629 - RNA, 21 nt, Human
cucaaguaccucugugugacc

SEQ ID NO: 234630 - RNA, 19 nt, Human
cuccaccccaaccccaggc

SEQ ID NO: 234631 - RNA, 19 nt, Human
cuccaccccaaccccaggc

SEQ ID NO: 234632 - RNA, 20 nt, Human
cuccaccccaaccccaggcc

SEQ ID NO: 234633 - RNA, 23 nt, Human
cuccagucccccucaaguaccuc

SEQ ID NO: 234634 - RNA, 21 nt, Human
cucccggccuggcagagcugu

SEQ ID NO: 234635 - RNA, 19 nt, Human
cucugagcuaccccagccc

SEQ ID NO: 234636 - RNA, 21 nt, Human
cucugcaccugacuuagcaac

SEQ ID NO: 234637 - RNA, 20 nt, Human
cucuggagagccggcaaggc

SEQ ID NO: 234638 - RNA, 21 nt, Human
cucugugugaccucacaagac

SEQ ID NO: 234639 - RNA, 18 nt, Human
cugcagccucccucuccu

SEQ ID NO: 234640 - RNA, 20 nt, Human
cugcagccucccucuccucc

SEQ ID NO: 234641 - RNA, 22 nt, Human
cugcccuacccaccuccacaaa

SEQ ID NO: 234642 - RNA, 20 nt, Human
cugcugcagguccagccauc

SEQ ID NO: 234643 - RNA, 18 nt, Human
cuggacccugacacgcua

SEQ ID NO: 234644 - RNA, 22 nt, Human
cuggagagccggcaaggcagag

SEQ ID NO: 234645 - RNA, 20 nt, Human
cuuccuggucugagucccag

SEQ ID NO: 234646 - RNA, 19 nt, Human
gaaggcuggaugccgggau

SEQ ID NO: 234647 - RNA, 23 nt, Human
gaaguccagcccacgcuccccag

SEQ ID NO: 234648 - RNA, 21 nt, Human
gaccaggcccugcuaagcccu

SEQ ID NO: 234649 - RNA, 21 nt, Human
gagcacugaggauggguccca

SEQ ID NO: 234650 - RNA, 22 nt, Human
gauggggguggagcaggagggc

SEQ ID NO: 234651 - RNA, 20 nt, Human
gauucagugaugcugugcag

SEQ ID NO: 234652 - RNA, 22 nt, Human
gcaaagugagugaaaaguacca

SEQ ID NO: 234653 - RNA, 18 nt, Human
gcagagcuggacuggcug

SEQ ID NO: 234654 - RNA, 19 nt, Human
gcagcugccccaacucugc

SEQ ID NO: 234655 - RNA, 28 nt, Human
gcaggaacaucuguaccaucugcaggga

SEQ ID NO: 234656 - RNA, 20 nt, Human
gcagggaagaucacggggaa

SEQ ID NO: 234657 - RNA, 23 nt, Human
gcaggggcaggguuguuccaggg

SEQ ID NO: 234658 - RNA, 21 nt, Human
gccaagcugccggacgggauc

SEQ ID NO: 234659 - RNA, 21 nt, Human
gcccacgcuccccaguccaca

SEQ ID NO: 234660 - RNA, 22 nt, Human
gccgcacccuccaccccaaccc

SEQ ID NO: 234661 - RNA, 18 nt, Human
gcuguucccuugcccugg

SEQ ID NO: 234662 - RNA, 20 nt, Human
ggaaaccucuaaggccgcac

SEQ ID NO: 234663 - RNA, 18 nt, Human
ggacaaguagaggcagaa

SEQ ID NO: 234664 - RNA, 21 nt, Human
ggacagggugggccacaagga

SEQ ID NO: 234665 - RNA, 19 nt, Human
ggacgggaucuggagggag

SEQ ID NO: 234666 - RNA, 19 nt, Human
ggaggaacuuggaggccgg

SEQ ID NO: 234667 - RNA, 22 nt, Human
ggcacaauaucugccaggaaca

SEQ ID NO: 234668 - RNA, 19 nt, Human
ggccuccagucccccucaa

SEQ ID NO: 234669 - RNA, 21 nt, Human
ggccugaagguggcuucucug

SEQ ID NO: 234670 - RNA, 18 nt, Human
gggaagaucacggggaag

SEQ ID NO: 234671 - RNA, 19 nt, Human
gggcagcaaaggcacagau

SEQ ID NO: 234672 - RNA, 21 nt, Human
gggcgcuauuucagaggcagc

SEQ ID NO: 234673 - RNA, 23 nt, Human
ggggacgauggggaggagagaca

SEQ ID NO: 234674 - RNA, 20 nt, Human
ggggccaaguccaggcuggg

SEQ ID NO: 234675 - RNA, 24 nt, Human
gggggcugguccacuccccugggc

SEQ ID NO: 234676 - RNA, 19 nt, Human
gggugggagugggaugggg

SEQ ID NO: 234677 - RNA, 18 nt, Human
ggugcaggggcaggguug

SEQ ID NO: 234678 - RNA, 18 nt, Human
guccacuccccugggccc

SEQ ID NO: 234679 - RNA, 19 nt, Human
gugauaauuugcugggggc

SEQ ID NO: 234680 - RNA, 21 nt, Human
uaaauaagggcccggagacau

SEQ ID NO: 234681 - RNA, 23 nt, Human
uaaauaauaaauaagggcccgga

SEQ ID NO: 234682 - RNA, 26 nt, Human
uaacuuggccacugaaagcaccaaga

SEQ ID NO: 234683 - RNA, 21 nt, Human
uaaggcaggaacaucuguacc

SEQ ID NO: 234684 - RNA, 23 nt, Human
uaggauaucauaauaaauagaaa

SEQ ID NO: 234685 - RNA, 24 nt, Human
ucagaaccucugcaccugacuuag

SEQ ID NO: 234686 - RNA, 18 nt, Human
ucaggccuccccauucuc

SEQ ID NO: 234687 - RNA, 22 nt, Human
ucagggacaaggaggacgaugg

SEQ ID NO: 234688 - RNA, 21 nt, Human
uccaaccccacacacuauguc

SEQ ID NO: 234689 - RNA, 19 nt, Human
uccacaaaccccugcugca

SEQ ID NO: 234690 - RNA, 24 nt, Human
uccacaaaccccugcugcaggucc

SEQ ID NO: 234691 - RNA, 21 nt, Human
uccacaaauuggcccagcccc

SEQ ID NO: 234692 - RNA, 24 nt, Human
uccacucgccuggccccagcacaa

SEQ ID NO: 234693 - RNA, 24 nt, Human
uccagcccacgcuccccaguccac

SEQ ID NO: 234694 - RNA, 20 nt, Human
uccaggcugggugggagagc

SEQ ID NO: 234695 - RNA, 24 nt, Human
ucccagaggaaggggcaccuucuu

SEQ ID NO: 234696 - RNA, 24 nt, Human
ucccagaggccccucucuaucuuc

SEQ ID NO: 234697 - RNA, 20 nt, Human
ucccauggggccaaguccag

SEQ ID NO: 234698 - RNA, 24 nt, Human
uccccgggugccagagcuccaacc

SEQ ID NO: 234699 - RNA, 30 nt, Human
ucccggccuggcagagcuguuucacgcaaa

SEQ ID NO: 234700 - RNA, 20 nt, Human
uccuggggucuggcccagcc

SEQ ID NO: 234701 - RNA, 18 nt, Human
uccuucccaggccugaag

SEQ ID NO: 234702 - RNA, 25 nt, Human
uccuuugggauccuagccccucugg

SEQ ID NO: 234703 - RNA, 19 nt, Human
ucucaacagccacauccuc

SEQ ID NO: 234704 - RNA, 23 nt, Human
ucucccagaggaaggggcaccuu

SEQ ID NO: 234705 - RNA, 21 nt, Human
ucugcugccuccuucccuccc

SEQ ID NO: 234706 - RNA, 23 nt, Human
ugacccuaaguucugcuguuccc

SEQ ID NO: 234707 - RNA, 25 nt, Human
ugagaucccucgguucacagcacac

SEQ ID NO: 234708 - RNA, 21 nt, Human
ugaggugaugggcgagucagc

SEQ ID NO: 234709 - RNA, 19 nt, Human
ugcaggguggacgccaagc

SEQ ID NO: 234710 - RNA, 21 nt, Human
ugcauccuggacaagggugag

SEQ ID NO: 234711 - RNA, 21 nt, Human
ugccccugcccuacccaccuc

SEQ ID NO: 234712 - RNA, 19 nt, Human
ugcccugggccccagccac

SEQ ID NO: 234713 - RNA, 21 nt, Human
ugcccuggggaccagagacgg

SEQ ID NO: 234714 - RNA, 18 nt, Human
ugccugggagcccagaca

SEQ ID NO: 234715 - RNA, 25 nt, Human
ugcugggggcugguccacuccccug

SEQ ID NO: 234716 - RNA, 28 nt, Human
ugcugggggcugguccacuccccugggc

SEQ ID NO: 234717 - RNA, 18 nt, Human
ugcugggugcaggggcag

SEQ ID NO: 234718 - RNA, 20 nt, Human
uggaaacuucugccagauug

SEQ ID NO: 234719 - RNA, 21 nt, Human
uggaaguuuccacucugcuca

SEQ ID NO: 234720 - RNA, 23 nt, Human
uggaaucagcaacucugguuucc

SEQ ID NO: 234721 - RNA, 21 nt, Human
uggaggaaaccucagaugccg

SEQ ID NO: 234722 - RNA, 22 nt, Human
uggaguggacuggccaggcacc

SEQ ID NO: 234723 - RNA, 21 nt, Human
uggcccacaucucaacagcca

SEQ ID NO: 234724 - RNA, 22 nt, Human
uggcccaccuaagucccaaccu

SEQ ID NO: 234725 - RNA, 18 nt, Human
uggcugggucagggugga

SEQ ID NO: 234726 - RNA, 20 nt, Human
uggcugggucaggguggaag

SEQ ID NO: 234727 - RNA, 20 nt, Human
ugggagugggaugggggugg

SEQ ID NO: 234728 - RNA, 21 nt, Human
ugggagugggauggggguggg

SEQ ID NO: 234729 - RNA, 22 nt, Human
ugggauggacagauggacaacu

SEQ ID NO: 234730 - RNA, 18 nt, Human
ugggauggggguggagca

SEQ ID NO: 234731 - RNA, 19 nt, Human
ugggauggggguggagcag

SEQ ID NO: 234732 - RNA, 24 nt, Human
ugggauggggguggagcaggaggg

SEQ ID NO: 234733 - RNA, 23 nt, Human
ugggcccugcugucucacccugu

SEQ ID NO: 234734 - RNA, 22 nt, Human
uggggacacagaaacaaggaca

SEQ ID NO: 234735 - RNA, 18 nt, Human
uggggacgauggggagga

SEQ ID NO: 234736 - RNA, 20 nt, Human
uggggccaaguccaggcugg

SEQ ID NO: 234737 - RNA, 18 nt, Human
ugguccacaccagcagau

SEQ ID NO: 234738 - RNA, 19 nt, Human
uggucugagucccaggcgu

SEQ ID NO: 234739 - RNA, 18 nt, Human
ugucuugcccacugcucc

SEQ ID NO: 234740 - RNA, 18 nt, Human
uguugaguagggaccagg

SEQ ID NO: 234741 - RNA, 20 nt, Human
uuccuggucugagucccagg

SEQ ID NO: 234742 - RNA, 24 nt, Human
uugcugggggcugguccacucccc

SEQ ID NO: 234743 - RNA, 28 nt, Human
uugcugggggcugguccacuccccuggg

SEQ ID NO: 234744 - RNA, 20 nt, Human
uuuccaggccucuccuccuc

SEQ ID NO: 234745 - RNA, 23 nt, Human
uuuccaggccucuccuccuccca

SEQ ID NO: 234746 - RNA, 21 nt, Human
aaaaaaaacaaacaaaaaaga

SEQ ID NO: 234747 - RNA, 25 nt, Human
aaaaaaaacaaacaaaaaagacaua

SEQ ID NO: 234748 - RNA, 20 nt, Human
aaaaaacaaacaaaaaagac

SEQ ID NO: 234749 - RNA, 21 nt, Human
aaaaaauaaugaaaaggcaag

SEQ ID NO: 234750 - RNA, 21 nt, Human
aaaaauaaugaaaaggcaagc

SEQ ID NO: 234751 - RNA, 30 nt, Human
aaacaaacaaaaaagacauaucuuauucgg

SEQ ID NO: 234752 - RNA, 27 nt, Human
aaacaaacaaccaaccaaaaaaaacaa

SEQ ID NO: 234753 - RNA, 21 nt, Human
aaacaacagaacagaaaacag

SEQ ID NO: 234754 - RNA, 19 nt, Human
aaagggcccggugccuugc

SEQ ID NO: 234755 - RNA, 21 nt, Human
aaauccacuuacaauuccacc

SEQ ID NO: 234756 - RNA, 18 nt, Human
aaccugagggcagggaaa

SEQ ID NO: 234757 - RNA, 18 nt, Human
aacuucaccuguuacuug

SEQ ID NO: 234758 - RNA, 19 nt, Human
aagcaaaaccuaucacagc

SEQ ID NO: 234759 - RNA, 18 nt, Human
aagcauucucucuuuagu

SEQ ID NO: 234760 - RNA, 19 nt, Human
aaugaaaaggcaagcaaaa

SEQ ID NO: 234761 - RNA, 21 nt, Human
acaaccaaccaaaaaaaacaa

SEQ ID NO: 234762 - RNA, 27 nt, Human
acaugaacuuucaguguaacuuaacau

SEQ ID NO: 234763 - RNA, 20 nt, Human
accaaaaaaaacaaacaaaa

SEQ ID NO: 234764 - RNA, 22 nt, Human
acuuuugccuuaaauaugaaaa

SEQ ID NO: 234765 - RNA, 25 nt, Human
agacaucgcuuaugagaaacaaggg

SEQ ID NO: 234766 - RNA, 18 nt, Human
agcaaaaccuaucacagc

SEQ ID NO: 234767 - RNA, 19 nt, Human
agcugaauccuagcaguua

SEQ ID NO: 234768 - RNA, 22 nt, Human
aggcaaauaaacuucaccuguu

SEQ ID NO: 234769 - RNA, 18 nt, Human
agggaaaauacaagauac

SEQ ID NO: 234770 - RNA, 23 nt, Human
agggugggcagaggaugcugugc

SEQ ID NO: 234771 - RNA, 20 nt, Human
aggugucaaagaucaccacu

SEQ ID NO: 234772 - RNA, 24 nt, Human
aggugucaaagaucaccacugccu

SEQ ID NO: 234773 - RNA, 24 nt, Human
aguuacuaagaaacagcccuuggg

SEQ ID NO: 234774 - RNA, 20 nt, Human
auaaagcucagaaauuuagc

SEQ ID NO: 234775 - RNA, 21 nt, Human
auaaugaaaaggcaagcaaaa

SEQ ID NO: 234776 - RNA, 23 nt, Human
auccauuauuugcaaauacauua

SEQ ID NO: 234777 - RNA, 22 nt, Human
caaaaaaaacaaacaaaaaaga

SEQ ID NO: 234778 - RNA, 22 nt, Human
caaaacacuaaaucgcugucac

SEQ ID NO: 234779 - RNA, 22 nt, Human
caaaguuuguaccccugagaca

SEQ ID NO: 234780 - RNA, 21 nt, Human
caacacuagcaguaagagcuu

SEQ ID NO: 234781 - RNA, 21 nt, Human
caaccaaccaaaaaaaacaaa

SEQ ID NO: 234782 - RNA, 24 nt, Human
caaccaaccaaaaaaaacaaacaa

SEQ ID NO: 234783 - RNA, 21 nt, Human
caacugaaauaauggaagcaa

SEQ ID NO: 234784 - RNA, 25 nt, Human
caauugcugcaccucgaacacaggu

SEQ ID NO: 234785 - RNA, 20 nt, Human
cacagaucauaaagcucaga

SEQ ID NO: 234786 - RNA, 18 nt, Human
cagaaaacaguugcggcg

SEQ ID NO: 234787 - RNA, 23 nt, Human
cagaacagaaaacaguugcggcg

SEQ ID NO: 234788 - RNA, 21 nt, Human
cagaggcucccuuucugagcu

SEQ ID NO: 234789 - RNA, 22 nt, Human
cagcccuuggguaacuguuccu

SEQ ID NO: 234790 - RNA, 20 nt, Human
caguaggcacagaaauaagc

SEQ ID NO: 234791 - RNA, 25 nt, Human
ccaaaaaaaacaaacaaaaaagaca

SEQ ID NO: 234792 - RNA, 22 nt, Human
ccacaaacaacagaacagaaaa

SEQ ID NO: 234793 - RNA, 21 nt, Human
cgaacacagguaugcccaugg

SEQ ID NO: 234794 - RNA, 26 nt, Human
cuagcaguuaaaaucaggauucauac

SEQ ID NO: 234795 - RNA, 22 nt, Human
cuccuaacaauacuucacagga

SEQ ID NO: 234796 - RNA, 18 nt, Human
cuccucaggaggaacgaa

SEQ ID NO: 234797 - RNA, 20 nt, Human
cuuacaauuccaccaaguau

SEQ ID NO: 234798 - RNA, 24 nt, Human
cuucugcuuuuccaagaaccacaa

SEQ ID NO: 234799 - RNA, 20 nt, Human
gaggaacauccaccagaagg

SEQ ID NO: 234800 - RNA, 24 nt, Human
gcaaugcagucaguccuggagggc

SEQ ID NO: 234801 - RNA, 21 nt, Human
gcugcaccucgaacacaggua

SEQ ID NO: 234802 - RNA, 26 nt, Human
gcugugcugaaggcaaucaauucugc

SEQ ID NO: 234803 - RNA, 18 nt, Human
ggaguaaacgucaggcaa

SEQ ID NO: 234804 - RNA, 23 nt, Human
guagguauuagccuugaaaugcu

SEQ ID NO: 234805 - RNA, 24 nt, Human
uaaaaaacaaacaaccaaccaaaa

SEQ ID NO: 234806 - RNA, 21 nt, Human
uaaaaaauaaugaaaaggcaa

SEQ ID NO: 234807 - RNA, 25 nt, Human
uaaaauacauaggcaaccugagggc

SEQ ID NO: 234808 - RNA, 19 nt, Human
uacauaggcaaccugaggg

SEQ ID NO: 234809 - RNA, 25 nt, Human
uacauaugagaaaaccacaaacaac

SEQ ID NO: 234810 - RNA, 19 nt, Human
uacuauguauguacaaaau

SEQ ID NO: 234811 - RNA, 23 nt, Human
uagaaaggaguaaacgucaggca

SEQ ID NO: 234812 - RNA, 20 nt, Human
uagaguacaugagaauucuu

SEQ ID NO: 234813 - RNA, 21 nt, Human
uagcaacacuagcaguaagag

SEQ ID NO: 234814 - RNA, 25 nt, Human
uagcugaauccuagcaguuaaaauc

SEQ ID NO: 234815 - RNA, 18 nt, Human
uaucacaaaauaaaauga

SEQ ID NO: 234816 - RNA, 20 nt, Human
ucagaugauaaaaaacaaac

SEQ ID NO: 234817 - RNA, 21 nt, Human
uccaaauuuccacagaucaua

SEQ ID NO: 234818 - RNA, 22 nt, Human
uccuucugcuuuuccaagaacc

SEQ ID NO: 234819 - RNA, 24 nt, Human
ucuuuggcuugaucacaaagagcu

SEQ ID NO: 234820 - RNA, 18 nt, Human
ugaaaagacucaugagug

SEQ ID NO: 234821 - RNA, 23 nt, Human
ugaaaaggcaagcaaaaccuauc

SEQ ID NO: 234822 - RNA, 19 nt, Human
ugaaggcaaucaauucugc

SEQ ID NO: 234823 - RNA, 23 nt, Human
ugaaggcaaucaauucugcacag

SEQ ID NO: 234824 - RNA, 22 nt, Human
ugagaaaaccacaaacaacaga

SEQ ID NO: 234825 - RNA, 23 nt, Human
ugagaaaaccacaaacaacagaa

SEQ ID NO: 234826 - RNA, 25 nt, Human
ugagaaaaccacaaacaacagaacc

SEQ ID NO: 234827 - RNA, 20 nt, Human
ugagauggcugacugaagug

SEQ ID NO: 234828 - RNA, 18 nt, Human
ugaggauucugagucacu

SEQ ID NO: 234829 - RNA, 19 nt, Human
ugauaaaaaacaaacaacc

SEQ ID NO: 234830 - RNA, 19 nt, Human
ugcaagugcaguucugcag

SEQ ID NO: 234831 - RNA, 18 nt, Human
uggcugacugaagugaca

SEQ ID NO: 234832 - RNA, 22 nt, Human
ugggaggaacauccaccagaag

SEQ ID NO: 234833 - RNA, 21 nt, Human
ugucaaagaucaccacugccu

SEQ ID NO: 234834 - RNA, 19 nt, Human
ugucacuguaucacaaaau

SEQ ID NO: 234835 - RNA, 26 nt, Human
ugucacuguaucacaaaauaaaauga

SEQ ID NO: 234836 - RNA, 21 nt, Human
uguggcaugaugaaaagacuc

SEQ ID NO: 234837 - RNA, 18 nt, Human
uguuugauaaccauuaua

SEQ ID NO: 234838 - RNA, 19 nt, Human
uuacuaagaaacagcccuu

SEQ ID NO: 234839 - RNA, 22 nt, Human
uuacuuggacauuuucucccug

SEQ ID NO: 234840 - RNA, 23 nt, Human
uuacuuggacauuuucucccuga

SEQ ID NO: 234841 - RNA, 20 nt, Human
uucaucuagaaaggaguaaa

SEQ ID NO: 234842 - RNA, 22 nt, Human
uugaaaugcuucuugaagguag

SEQ ID NO: 234843 - RNA, 22 nt, Human
uuuuuuuucgggauggcucuga

SEQ ID NO: 234844 - RNA, 26 nt, Human
uuuuuuuuuucgggauggcucugauu

SEQ ID NO: 234845 - RNA, 25 nt, Human
acaccccuccccugacucucaaaau

SEQ ID NO: 234846 - RNA, 20 nt, Human
agcacuuuucuucgucuguc

SEQ ID NO: 234847 - RNA, 24 nt, Human
aggcaauaauaacccugggguccg

SEQ ID NO: 234848 - RNA, 18 nt, Human
cacaccccuccccugacu

SEQ ID NO: 234849 - RNA, 25 nt, Human
cacaccccuccccugacucucaaaa

SEQ ID NO: 234850 - RNA, 20 nt, Human
cacccccucacacacacacc

SEQ ID NO: 234851 - RNA, 19 nt, Human
caccccuccccugacucuc

SEQ ID NO: 234852 - RNA, 24 nt, Human
cagacuccggaguaagccaccccc

SEQ ID NO: 234853 - RNA, 24 nt, Human
ccacagccugccacagcagauuug

SEQ ID NO: 234854 - RNA, 21 nt, Human
ccacccccucacacacacacc

SEQ ID NO: 234855 - RNA, 21 nt, Human
cccaggcccuaggagggcgag

SEQ ID NO: 234856 - RNA, 23 nt, Human
cccgggcaacacacucagauccg

SEQ ID NO: 234857 - RNA, 19 nt, Human
ccucacacacacaccccuc

SEQ ID NO: 234858 - RNA, 19 nt, Human
ccucacacacacaccccuc

SEQ ID NO: 234859 - RNA, 24 nt, Human
ccucacacacacaccccuccccug

SEQ ID NO: 234860 - RNA, 24 nt, Human
ccuuccuguccagcacuuuucuuc

SEQ ID NO: 234861 - RNA, 20 nt, Human
gcgcgccgcugcccgggcaa

SEQ ID NO: 234862 - RNA, 20 nt, Human
gcuaaaaagcaaaggcaaua

SEQ ID NO: 234863 - RNA, 20 nt, Human
ucccgcgcgccgcugcccgg

SEQ ID NO: 234864 - RNA, 23 nt, Human
ucccgcgcgccgcugcccgggca

SEQ ID NO: 234865 - RNA, 22 nt, Human
ugccacagcagauuugcuaaaa

SEQ ID NO: 234866 - RNA, 20 nt, Human
uuucuucgucugucagcugc

SEQ ID NO: 234867 - RNA, 18 nt, Human
aaaaagauggcaaaccca

SEQ ID NO: 234868 - RNA, 21 nt, Human
aaaaagauggcaaacccagca

SEQ ID NO: 234869 - RNA, 22 nt, Human
aaaacaaaaagauggcaaaccc

SEQ ID NO: 234870 - RNA, 20 nt, Human
aaacaaaaagauggcaaacc

SEQ ID NO: 234871 - RNA, 23 nt, Human
aaacaaaaagauggcaaacccag

SEQ ID NO: 234872 - RNA, 19 nt, Human
aaaggagaguauggccuga

SEQ ID NO: 234873 - RNA, 22 nt, Human
aaccagcaagacaaacugacuu

SEQ ID NO: 234874 - RNA, 20 nt, Human
aagaaaacaaaaagauggca

SEQ ID NO: 234875 - RNA, 21 nt, Human
aagaaaacaagguagguggca

SEQ ID NO: 234876 - RNA, 19 nt, Human
aagaagaucuugaaagcca

SEQ ID NO: 234877 - RNA, 22 nt, Human
aagagacaguggagaacuggug

SEQ ID NO: 234878 - RNA, 22 nt, Human
agaagcaagcccauucccccua

SEQ ID NO: 234879 - RNA, 20 nt, Human
agcacccagcucugaaagau

SEQ ID NO: 234880 - RNA, 18 nt, Human
agcugccucuccggcucc

SEQ ID NO: 234881 - RNA, 19 nt, Human
agcuguggcacccacagca

SEQ ID NO: 234882 - RNA, 21 nt, Human
aggcuuucuucucaggaagag

SEQ ID NO: 234883 - RNA, 23 nt, Human
agugauguuuucggaauaggcac

SEQ ID NO: 234884 - RNA, 25 nt, Human
cacccacagcaacuaauuccugguc

SEQ ID NO: 234885 - RNA, 18 nt, Human
cagcaagacaaacugacu

SEQ ID NO: 234886 - RNA, 23 nt, Human
cagcaagacaaacugacuucagc

SEQ ID NO: 234887 - RNA, 18 nt, Human
ccggcuccggcgcucacc

SEQ ID NO: 234888 - RNA, 18 nt, Human
ccugagggagagggaaga

SEQ ID NO: 234889 - RNA, 26 nt, Human
cuggaaugauagaacaggcuuucuuc

SEQ ID NO: 234890 - RNA, 22 nt, Human
cuuacaucacgccagugauguu

SEQ ID NO: 234891 - RNA, 24 nt, Human
cuuucuucucaggaagaggggaug

SEQ ID NO: 234892 - RNA, 20 nt, Human
uaaauuuugacuuggggcca

SEQ ID NO: 234893 - RNA, 19 nt, Human
uagguggcacgugaucuua

SEQ ID NO: 234894 - RNA, 23 nt, Human
ucggaauaggcacaguucuuuuc

SEQ ID NO: 234895 - RNA, 21 nt, Human
ucuccggcuccggcgcucacc

SEQ ID NO: 234896 - RNA, 25 nt, Human
ucugaaagaucuauuuaaaccagca

SEQ ID NO: 234897 - RNA, 19 nt, Human
ugacugggcuuuucccuuu

SEQ ID NO: 234898 - RNA, 20 nt, Human
ugacuuggggccagcagcug

SEQ ID NO: 234899 - RNA, 20 nt, Human
ugagucccugcagucucucc

SEQ ID NO: 234900 - RNA, 19 nt, Human
ugagugcacggaggguuug

SEQ ID NO: 234901 - RNA, 20 nt, Human
ugaucuuagauggcuucccu

SEQ ID NO: 234902 - RNA, 20 nt, Human
ugcacggaggguuuguggaa

SEQ ID NO: 234903 - RNA, 23 nt, Human
ugccuccagccugaguccagucc

SEQ ID NO: 234904 - RNA, 27 nt, Human
uggaaagaagaucuugaaagccaaaga

SEQ ID NO: 234905 - RNA, 18 nt, Human
uucucaggaagaggggau

SEQ ID NO: 234906 - RNA, 23 nt, Human
uuuuuuuuuuuuuuuuuuaacug

SEQ ID NO: 234907 - RNA, 18 nt, Human
aagagucugugacaucuu

SEQ ID NO: 234908 - RNA, 20 nt, Human
aagcaggcaauacaguucca

SEQ ID NO: 234909 - RNA, 21 nt, Human
aaucauugaauacuacauuca

SEQ ID NO: 234910 - RNA, 18 nt, Human
aggcagccaucaaagcgg

SEQ ID NO: 234911 - RNA, 26 nt, Human
augaaauuuucuccaagaaucuaaaa

SEQ ID NO: 234912 - RNA, 23 nt, Human
caaaaggaacgugagaugcaaca

SEQ ID NO: 234913 - RNA, 18 nt, Human
caaugagucugccagauc

SEQ ID NO: 234914 - RNA, 26 nt, Human
caaugagucugccagaucagaggcuu

SEQ ID NO: 234915 - RNA, 20 nt, Human
cacagcaucaggaggccagg

SEQ ID NO: 234916 - RNA, 20 nt, Human
caccuugaucauaaaaaauc

SEQ ID NO: 234917 - RNA, 22 nt, Human
cagcuguaaaaugagaucuuga

SEQ ID NO: 234918 - RNA, 21 nt, Human
caucaaagcggugaugaaucu

SEQ ID NO: 234919 - RNA, 19 nt, Human
cccagcuguaaaaugagau

SEQ ID NO: 234920 - RNA, 19 nt, Human
ccucugugaaccagagaau

SEQ ID NO: 234921 - RNA, 24 nt, Human
cuaaaaauucccugaagugucuga

SEQ ID NO: 234922 - RNA, 22 nt, Human
cugauuuuuucugcacguccuu

SEQ ID NO: 234923 - RNA, 19 nt, Human
gagcaucaugaaauuuucu

SEQ ID NO: 234924 - RNA, 18 nt, Human
gcacagcaucaggaggcc

SEQ ID NO: 234925 - RNA, 23 nt, Human
gcaucaugaaauuuucuccaaga

SEQ ID NO: 234926 - RNA, 23 nt, Human
uaaaaagagucugugacaucuuu

SEQ ID NO: 234927 - RNA, 21 nt, Human
uaaagcaggcaauacaguucc

SEQ ID NO: 234928 - RNA, 19 nt, Human
uaccucugugaaccagaga

SEQ ID NO: 234929 - RNA, 23 nt, Human
uacgcagguaaagcaggcaauac

SEQ ID NO: 234930 - RNA, 23 nt, Human
ucaaagcggugaugaaucuucuc

SEQ ID NO: 234931 - RNA, 24 nt, Human
ucccugaagugucugauuuuuucu

SEQ ID NO: 234932 - RNA, 23 nt, Human
ucuagauuucuauauggauauua

SEQ ID NO: 234933 - RNA, 20 nt, Human
ugagaugcaacaguuuguga

SEQ ID NO: 234934 - RNA, 23 nt, Human
uucaccuugaucauaaaaaauca

SEQ ID NO: 234935 - RNA, 24 nt, Human
uugaacacaaaucugcaaaaggaa

SEQ ID NO: 234936 - RNA, 23 nt, Human
uugugaggcagccaucaaagcgg

SEQ ID NO: 234937 - RNA, 20 nt, Human
uuuccugcgggguugccaug

SEQ ID NO: 234938 - RNA, 22 nt, Human
uuuuucuuucuuggcuuuggga

SEQ ID NO: 234939 - RNA, 23 nt, Human
aaauugucucccggaaccuccug

SEQ ID NO: 234940 - RNA, 19 nt, Human
agacucagaucagcagaga

SEQ ID NO: 234941 - RNA, 18 nt, Human
agguaucacauguuaaug

SEQ ID NO: 234942 - RNA, 23 nt, Human
aucagcccuaaauugucucccgg

SEQ ID NO: 234943 - RNA, 19 nt, Human
cagcccuaaauugucuccc

SEQ ID NO: 234944 - RNA, 23 nt, Human
caucagaucuguucccaaggcuc

SEQ ID NO: 234945 - RNA, 19 nt, Human
ccuaaauugucucccggaa

SEQ ID NO: 234946 - RNA, 21 nt, Human
ccuccagcccuggagaugcuu

SEQ ID NO: 234947 - RNA, 22 nt, Human
cuccagcccuggagaugcuuca

SEQ ID NO: 234948 - RNA, 21 nt, Human
cucccggaaccuccuggcauc

SEQ ID NO: 234949 - RNA, 21 nt, Human
cuucagggaagaccaaggucc

SEQ ID NO: 234950 - RNA, 22 nt, Human
gauuggcagacaguccagauaa

SEQ ID NO: 234951 - RNA, 24 nt, Human
ucagaucuguucccaaggcuccac

SEQ ID NO: 234952 - RNA, 23 nt, Human
uccaugcugcaggcagacucaga

SEQ ID NO: 234953 - RNA, 23 nt, Human
ucccaaggcuccaccacucugaa

SEQ ID NO: 234954 - RNA, 21 nt, Human
ucgcaucuggcuguguagcuc

SEQ ID NO: 234955 - RNA, 24 nt, Human
ucggugcauggcagucgucccucc

SEQ ID NO: 234956 - RNA, 20 nt, Human
ucucccggaaccuccuggca

SEQ ID NO: 234957 - RNA, 22 nt, Human
uggcagacaguccagauaacau

SEQ ID NO: 234958 - RNA, 18 nt, Human
ugucucccggaaccuccu

SEQ ID NO: 234959 - RNA, 23 nt, Human
uuccucccucuaaaaaugauugg

SEQ ID NO: 234960 - RNA, 21 nt, Human
aggacagagagacgcacaggg

SEQ ID NO: 234961 - RNA, 18 nt, Human
caggacagagagacgcac

SEQ ID NO: 234962 - RNA, 23 nt, Human
caucagaucugucccugaggcuc

SEQ ID NO: 234963 - RNA, 20 nt, Human
cgcugaaguaugcauugucc

SEQ ID NO: 234964 - RNA, 23 nt, Human
cuaggaaucaccccagacaguuu

SEQ ID NO: 234965 - RNA, 22 nt, Human
cugucccugaggcuccaccacg

SEQ ID NO: 234966 - RNA, 18 nt, Human
cugucucuagaaaugacc

SEQ ID NO: 234967 - RNA, 18 nt, Human
uagguccuagauuguccu

SEQ ID NO: 234968 - RNA, 18 nt, Human
ucaaauauugauugcugu

SEQ ID NO: 234969 - RNA, 19 nt, Human
ucaccccagacaguuuccu

SEQ ID NO: 234970 - RNA, 23 nt, Human
uccuuacacucaaauauugauug

SEQ ID NO: 234971 - RNA, 19 nt, Human
ugggaucaucagaucuguc

SEQ ID NO: 234972 - RNA, 23 nt, Human
aaaaaaaaaaaaaaaagaaagaa

SEQ ID NO: 234973 - RNA, 24 nt, Human
aaaaaaagaaagaaaagaaaagaa

SEQ ID NO: 234974 - RNA, 21 nt, Human
aaauguccacccaggacaccc

SEQ ID NO: 234975 - RNA, 23 nt, Human
aaguuggaaugaauauaauucuu

SEQ ID NO: 234976 - RNA, 24 nt, Human
aaucacuugaacccgagaggcgga

SEQ ID NO: 234977 - RNA, 24 nt, Human
acagagcaagacuccaucucaaaa

SEQ ID NO: 234978 - RNA, 22 nt, Human
acucaaacacccauuccucccu

SEQ ID NO: 234979 - RNA, 23 nt, Human
acugcauuccagccuggugacag

SEQ ID NO: 234980 - RNA, 25 nt, Human
acugcauuccagccuggugacagag

SEQ ID NO: 234981 - RNA, 19 nt, Human
agaaaagaaaagaaagaaa

SEQ ID NO: 234982 - RNA, 24 nt, Human
agaaagaaaagaaaagaaagaaaa

SEQ ID NO: 234983 - RNA, 21 nt, Human
agaaucacuugaacccgagag

SEQ ID NO: 234984 - RNA, 21 nt, Human
agccuggugacagagcaagac

SEQ ID NO: 234985 - RNA, 23 nt, Human
agccuggugacagagcaagacuc

SEQ ID NO: 234986 - RNA, 19 nt, Human
aggaccugacccucugugc

SEQ ID NO: 234987 - RNA, 18 nt, Human
aggcaggagaaucacuug

SEQ ID NO: 234988 - RNA, 24 nt, Human
aggcaggagaaucacuugaacccg

SEQ ID NO: 234989 - RNA, 19 nt, Human
aggcggagguugcagugag

SEQ ID NO: 234990 - RNA, 24 nt, Human
aggcggagguugcagugagcccag

SEQ ID NO: 234991 - RNA, 24 nt, Human
aggcugaggcaggagaaucacuug

SEQ ID NO: 234992 - RNA, 22 nt, Human
aucagauucgcuuccaaggcuc

SEQ ID NO: 234993 - RNA, 24 nt, Human
auugcgccacugcauuccagccug

SEQ ID NO: 234994 - RNA, 21 nt, Human
caagacuccaucucaaaaaaa

SEQ ID NO: 234995 - RNA, 18 nt, Human
cacugcauuccagccugg

SEQ ID NO: 234996 - RNA, 18 nt, Human
cacugcauuccagccugg

SEQ ID NO: 234997 - RNA, 23 nt, Human
cacugcauuccagccuggugaca

SEQ ID NO: 234998 - RNA, 24 nt, Human
cacugcauuccagccuggugacag

SEQ ID NO: 234999 - RNA, 23 nt, Human
cagaccagugucucugcacucaa

SEQ ID NO: 235000 - RNA, 24 nt, Human
cagugucucugcacucaaacaccc

SEQ ID NO: 235001 - RNA, 22 nt, Human
ccaaggcuccagcauucaaugg

SEQ ID NO: 235002 - RNA, 18 nt, Human
ccacccaggacacccagc

SEQ ID NO: 235003 - RNA, 18 nt, Human
ccacugcauuccagccug

SEQ ID NO: 235004 - RNA, 19 nt, Human
ccacugcauuccagccugg

SEQ ID NO: 235005 - RNA, 19 nt, Human
ccacugcauuccagccugg

SEQ ID NO: 235006 - RNA, 23 nt, Human
ccacugcauuccagccuggugac

SEQ ID NO: 235007 - RNA, 24 nt, Human
ccagaggcugaggcaggagaauca

SEQ ID NO: 235008 - RNA, 24 nt, Human
ccagauugcgccacugcauuccag

SEQ ID NO: 235009 - RNA, 18 nt, Human
ccaucagauucgcuucca

SEQ ID NO: 235010 - RNA, 25 nt, Human
ccaucucaaaaaaaaaaaaaaaaaa

SEQ ID NO: 235011 - RNA, 26 nt, Human
cccauuccucccucuagaaauugcca

SEQ ID NO: 235012 - RNA, 21 nt, Human
ccccagaccagugucucugca

SEQ ID NO: 235013 - RNA, 20 nt, Human
ccucuugacaggaccugacc

SEQ ID NO: 235014 - RNA, 21 nt, Human
ccuggugacagagcaagacuc

SEQ ID NO: 235015 - RNA, 18 nt, Human
cucaaaaaaaaaaaaaaa

SEQ ID NO: 235016 - RNA, 19 nt, Human
cuccaucucaaaaaaaaaa

SEQ ID NO: 235017 - RNA, 18 nt, Human
cucugcacucaaacaccc

SEQ ID NO: 235018 - RNA, 23 nt, Human
cucugcacucaaacacccauucc

SEQ ID NO: 235019 - RNA, 22 nt, Human
cuucaaauguccacccaggaca

SEQ ID NO: 235020 - RNA, 18 nt, Human
cuucccgaaccuccuagg

SEQ ID NO: 235021 - RNA, 23 nt, Human
gagaggcggagguugcagugagc

SEQ ID NO: 235022 - RNA, 23 nt, Human
gagguugcagugagcccagauug

SEQ ID NO: 235023 - RNA, 22 nt, Human
gcaggagaaucacuugaacccg

SEQ ID NO: 235024 - RNA, 23 nt, Human
gcauuccagccuggugacagagc

SEQ ID NO: 235025 - RNA, 22 nt, Human
ggagguugcagugagcccagau

SEQ ID NO: 235026 - RNA, 24 nt, Human
ggagguugcagugagcccagauug

SEQ ID NO: 235027 - RNA, 20 nt, Human
uacauuguuaaagguguugg

SEQ ID NO: 235028 - RNA, 22 nt, Human
ucaaaaaaaaaaaaaaaaaaaa

SEQ ID NO: 235029 - RNA, 23 nt, Human
ucaaaaaaaaaaaaaaaaaaaaa

SEQ ID NO: 235030 - RNA, 24 nt, Human
ucaaauguccacccaggacaccca

SEQ ID NO: 235031 - RNA, 19 nt, Human
ucaauggugcauuguucuc

SEQ ID NO: 235032 - RNA, 22 nt, Human
ucaauggugcauuguucucucu

SEQ ID NO: 235033 - RNA, 23 nt, Human
uccaucucaaaaaaaaaaaaaaa

SEQ ID NO: 235034 - RNA, 23 nt, Human
uccaugccacaggcagacucaga

SEQ ID NO: 235035 - RNA, 22 nt, Human
ucccacugcacugcucugugga

SEQ ID NO: 235036 - RNA, 23 nt, Human
ugacaggaccugacccucugugc

SEQ ID NO: 235037 - RNA, 22 nt, Human
ugagcccagauugcgccacugc

SEQ ID NO: 235038 - RNA, 20 nt, Human
ugaggcaggagaaucacuug

SEQ ID NO: 235039 - RNA, 24 nt, Human
ugaggcaggagaaucacuugaacc

SEQ ID NO: 235040 - RNA, 25 nt, Human
ugaggcaggagaaucacuugaaccc

SEQ ID NO: 235041 - RNA, 25 nt, Human
uggaaugaauauaauucuucaaaug

SEQ ID NO: 235042 - RNA, 23 nt, Human
uggaucaccccagaccagugucu

SEQ ID NO: 235043 - RNA, 21 nt, Human
uguagcccaggcugagcugca

SEQ ID NO: 235044 - RNA, 21 nt, Human
uucuucaaguuggaaugaaua

SEQ ID NO: 235045 - RNA, 24 nt, Human
uugaacccgagaggcggagguugc

SEQ ID NO: 235046 - RNA, 22 nt, Human
uugcagugagcccagauugcgc

SEQ ID NO: 235047 - RNA, 22 nt, Human
uuucagcccuggagaugcuuca

SEQ ID NO: 235048 - RNA, 20 nt, Human
aaaaccaauggagugcccac

SEQ ID NO: 235049 - RNA, 19 nt, Human
aaagugcuggaauuacagg

SEQ ID NO: 235050 - RNA, 24 nt, Human
aaagugcuggaauuacaggcguga

SEQ ID NO: 235051 - RNA, 22 nt, Human
aaauagcugggauuacaggcac

SEQ ID NO: 235052 - RNA, 25 nt, Human
aaauagcugggauuacaggcacugc

SEQ ID NO: 235053 - RNA, 19 nt, Human
aaccucugacucccugguu

SEQ ID NO: 235054 - RNA, 26 nt, Human
aagugcuggaauuacaggcgugagcc

SEQ ID NO: 235055 - RNA, 18 nt, Human
aauuacaggcgugagcca

SEQ ID NO: 235056 - RNA, 21 nt, Human
aauuacaggcgugagccaccg

SEQ ID NO: 235057 - RNA, 24 nt, Human
aauuacaggcgugagccaccgugc

SEQ ID NO: 235058 - RNA, 18 nt, Human
acaggguuucaccauguu

SEQ ID NO: 235059 - RNA, 20 nt, Human
acaggguuucaccauguugg

SEQ ID NO: 235060 - RNA, 21 nt, Human
acaggguuucaccauguuggc

SEQ ID NO: 235061 - RNA, 24 nt, Human
acaggguuucaccauguuggccaa

SEQ ID NO: 235062 - RNA, 25 nt, Human
acaggguuucaccauguuggccaag

SEQ ID NO: 235063 - RNA, 24 nt, Human
accauguuggccaagauggucucg

SEQ ID NO: 235064 - RNA, 24 nt, Human
agaagucuguugcuuuauuucaaa

SEQ ID NO: 235065 - RNA, 21 nt, Human
agagacaggguuucaccaugu

SEQ ID NO: 235066 - RNA, 23 nt, Human
agagcaguggugcgaucuuggcu

SEQ ID NO: 235067 - RNA, 22 nt, Human
aggagagacaggguuucaccau

SEQ ID NO: 235068 - RNA, 18 nt, Human
auaaaaccaauggagugc

SEQ ID NO: 235069 - RNA, 20 nt, Human
auaaaaccaauggagugccc

SEQ ID NO: 235070 - RNA, 21 nt, Human
auaaaaccaauggagugccca

SEQ ID NO: 235071 - RNA, 20 nt, Human
caaacuccagaaaguagagg

SEQ ID NO: 235072 - RNA, 24 nt, Human
caaagugcuggaauuacaggcgug

SEQ ID NO: 235073 - RNA, 23 nt, Human
caaauagcugggauuacaggcac

SEQ ID NO: 235074 - RNA, 22 nt, Human
caagcgauucuccugccucagc

SEQ ID NO: 235075 - RNA, 27 nt, Human
caagcgauucuccugccucagccuccc

SEQ ID NO: 235076 - RNA, 24 nt, Human
caccacauccagcuaauuuuugua

SEQ ID NO: 235077 - RNA, 22 nt, Human
caccauguuggccaagaugguc

SEQ ID NO: 235078 - RNA, 24 nt, Human
caccauguuggccaagauggucuc

SEQ ID NO: 235079 - RNA, 19 nt, Human
cacugccaccacauccagc

SEQ ID NO: 235080 - RNA, 20 nt, Human
cacugccaccacauccagcu

SEQ ID NO: 235081 - RNA, 19 nt, Human
cacuuuuucuuuucuuuuc

SEQ ID NO: 235082 - RNA, 21 nt, Human
cagggaagacccagguccaug

SEQ ID NO: 235083 - RNA, 24 nt, Human
caggguuucaccauguuggccaag

SEQ ID NO: 235084 - RNA, 22 nt, Human
ccaaagugcuggaauuacaggc

SEQ ID NO: 235085 - RNA, 24 nt, Human
ccaaagugcuggaauuacaggcgu

SEQ ID NO: 235086 - RNA, 19 nt, Human
ccacuuuuucuuuucuuuu

SEQ ID NO: 235087 - RNA, 23 nt, Human
cccaaauagcugggauuacaggc

SEQ ID NO: 235088 - RNA, 24 nt, Human
cccaaauagcugggauuacaggca

SEQ ID NO: 235089 - RNA, 18 nt, Human
ccccuaaaaguucccaga

SEQ ID NO: 235090 - RNA, 23 nt, Human
cccugguucaagcgauucuccug

SEQ ID NO: 235091 - RNA, 20 nt, Human
ccugggguagauccaggcug

SEQ ID NO: 235092 - RNA, 21 nt, Human
cgccaggcuggagagcagugg

SEQ ID NO: 235093 - RNA, 23 nt, Human
cuaauuuuuguauuuuuaggaga

SEQ ID NO: 235094 - RNA, 25 nt, Human
cucacugaaaccucugacucccugg

SEQ ID NO: 235095 - RNA, 22 nt, Human
cuccagcccuggagaugcuuca

SEQ ID NO: 235096 - RNA, 24 nt, Human
cucccaaauagcugggauuacagg

SEQ ID NO: 235097 - RNA, 23 nt, Human
cucccucugucgccaggcuggag

SEQ ID NO: 235098 - RNA, 23 nt, Human
cucccugguucaagcgauucucc

SEQ ID NO: 235099 - RNA, 24 nt, Human
cuccugaacucgugaucugcccgc

SEQ ID NO: 235100 - RNA, 23 nt, Human
cugccucagccucccaaauagcu

SEQ ID NO: 235101 - RNA, 24 nt, Human
cugggauuacaggcacugccacca

SEQ ID NO: 235102 - RNA, 26 nt, Human
cugggugggguccaaugguguccacu

SEQ ID NO: 235103 - RNA, 19 nt, Human
cuuuucuuuucuuuucugu

SEQ ID NO: 235104 - RNA, 19 nt, Human
gacuccauggagugugggg

SEQ ID NO: 235105 - RNA, 21 nt, Human
gauucuccugccucagccucc

SEQ ID NO: 235106 - RNA, 21 nt, Human
gcaguggugcgaucuuggcuc

SEQ ID NO: 235107 - RNA, 23 nt, Human
gccucggccucccaaagugcugg

SEQ ID NO: 235108 - RNA, 24 nt, Human
gcgauucuccugccucagccuccc

SEQ ID NO: 235109 - RNA, 24 nt, Human
gcucccaugcauuccagacuccau

SEQ ID NO: 235110 - RNA, 22 nt, Human
gcugggugggguccaauggugu

SEQ ID NO: 235111 - RNA, 21 nt, Human
gcuuucuccucauucuuagau

SEQ ID NO: 235112 - RNA, 20 nt, Human
ggagagacaggguuucacca

SEQ ID NO: 235113 - RNA, 22 nt, Human
ggagagacaggguuucaccaug

SEQ ID NO: 235114 - RNA, 18 nt, Human
ggcacugccaccacaucc

SEQ ID NO: 235115 - RNA, 24 nt, Human
gguuucaccauguuggccaagaug

SEQ ID NO: 235116 - RNA, 19 nt, Human
guagaggcgccauaaaacc

SEQ ID NO: 235117 - RNA, 24 nt, Human
gugaucugcccgccucggccuccc

SEQ ID NO: 235118 - RNA, 25 nt, Human
uaaaaccaauggagugcccacaagg

SEQ ID NO: 235119 - RNA, 18 nt, Human
uaaaugugcacaaagacc

SEQ ID NO: 235120 - RNA, 23 nt, Human
uacaggcacugccaccacaucca

SEQ ID NO: 235121 - RNA, 23 nt, Human
uacaggcgugagccaccgugccc

SEQ ID NO: 235122 - RNA, 24 nt, Human
uacaggcgugagccaccgugcccu

SEQ ID NO: 235123 - RNA, 24 nt, Human
uaggagagacaggguuucaccaug

SEQ ID NO: 235124 - RNA, 19 nt, Human
ucaagcgauucuccugccu

SEQ ID NO: 235125 - RNA, 20 nt, Human
ucagcagagacgcaucucgc

SEQ ID NO: 235126 - RNA, 18 nt, Human
ucagccucccaaauagcu

SEQ ID NO: 235127 - RNA, 20 nt, Human
ucagccucccaaauagcugg

SEQ ID NO: 235128 - RNA, 26 nt, Human
ucauuuccuacuuuuuuucuuuccua

SEQ ID NO: 235129 - RNA, 19 nt, Human
uccagaaaguagaggcgcc

SEQ ID NO: 235130 - RNA, 21 nt, Human
uccaggcugggugggguccaa

SEQ ID NO: 235131 - RNA, 23 nt, Human
uccaugcugcaggcagacucaga

SEQ ID NO: 235132 - RNA, 24 nt, Human
ucccaaagugcuggaauuacaggc

SEQ ID NO: 235133 - RNA, 24 nt, Human
ucccaaauagcugggauuacaggc

SEQ ID NO: 235134 - RNA, 23 nt, Human
ucccuccagcccuggagaugcuu

SEQ ID NO: 235135 - RNA, 19 nt, Human
ucccucugucgccaggcug

SEQ ID NO: 235136 - RNA, 21 nt, Human
ucccugguucaagcgauucuc

SEQ ID NO: 235137 - RNA, 24 nt, Human
ucccugguucaagcgauucuccug

SEQ ID NO: 235138 - RNA, 21 nt, Human
ucgcaucuggcugugccgccc

SEQ ID NO: 235139 - RNA, 18 nt, Human
ucggccucccaaagugcu

SEQ ID NO: 235140 - RNA, 24 nt, Human
ucggugcauggcagucgucccucc

SEQ ID NO: 235141 - RNA, 23 nt, Human
ucucccucugucgccaggcugga

SEQ ID NO: 235142 - RNA, 26 nt, Human
ucuccugccucagccucccaaauagc

SEQ ID NO: 235143 - RNA, 24 nt, Human
ucuggcugugccgcccaggcugag

SEQ ID NO: 235144 - RNA, 21 nt, Human
ucugucgccaggcuggagagc

SEQ ID NO: 235145 - RNA, 21 nt, Human
ucuugcuuucuccucauucuu

SEQ ID NO: 235146 - RNA, 21 nt, Human
ucuuuucuuuucuguuccucc

SEQ ID NO: 235147 - RNA, 18 nt, Human
ucuuuuuuuuuuuuuuuu

SEQ ID NO: 235148 - RNA, 19 nt, Human
ugaccccuaaaaguucccu

SEQ ID NO: 235149 - RNA, 22 nt, Human
ugagauggagucucccucuguc

SEQ ID NO: 235150 - RNA, 21 nt, Human
ugagugaccccuaaaaguucc

SEQ ID NO: 235151 - RNA, 23 nt, Human
ugagugaccccuaaaaguuccca

SEQ ID NO: 235152 - RNA, 21 nt, Human
ugauucaguuuaaugcacuuu

SEQ ID NO: 235153 - RNA, 22 nt, Human
ugcagaauugagugaccccuaa

SEQ ID NO: 235154 - RNA, 27 nt, Human
ugccucagccucccaaauagcugggau

SEQ ID NO: 235155 - RNA, 24 nt, Human
ugcuggaauuacaggcgugagcca

SEQ ID NO: 235156 - RNA, 18 nt, Human
uggaauuacaggcgugag

SEQ ID NO: 235157 - RNA, 21 nt, Human
uggaauuacaggcgugagcca

SEQ ID NO: 235158 - RNA, 22 nt, Human
uggaauuacaggcgugagccac

SEQ ID NO: 235159 - RNA, 23 nt, Human
uggaauuacaggcgugagccacc

SEQ ID NO: 235160 - RNA, 23 nt, Human
uggaauuacaggcgugagccacc

SEQ ID NO: 235161 - RNA, 24 nt, Human
uggaauuacaggcgugagccaccg

SEQ ID NO: 235162 - RNA, 24 nt, Human
uggaauuacaggcgugagccaccg

SEQ ID NO: 235163 - RNA, 21 nt, Human
uggagugcccacaaggggguc

SEQ ID NO: 235164 - RNA, 19 nt, Human
uggcucacugaaaccucug

SEQ ID NO: 235165 - RNA, 19 nt, Human
ugggauuacaggcacugcc

SEQ ID NO: 235166 - RNA, 20 nt, Human
ugggauuacaggcacugcca

SEQ ID NO: 235167 - RNA, 21 nt, Human
ugggauuacaggcacugccac

SEQ ID NO: 235168 - RNA, 23 nt, Human
ugggauuacaggcacugccacca

SEQ ID NO: 235169 - RNA, 23 nt, Human
ugguucaagcgauucuccugccu

SEQ ID NO: 235170 - RNA, 24 nt, Human
uuaggagagacaggguuucaccau

SEQ ID NO: 235171 - RNA, 21 nt, Human
uucaagcgauucuccugccuc

SEQ ID NO: 235172 - RNA, 23 nt, Human
uucaagcgauucuccugccucag

SEQ ID NO: 235173 - RNA, 24 nt, Human
uucaagcgauucuccugccucagc

SEQ ID NO: 235174 - RNA, 20 nt, Human
uugcuuucuccucauucuua

SEQ ID NO: 235175 - RNA, 19 nt, Human
uuucaccauguuggccaag

SEQ ID NO: 235176 - RNA, 20 nt, Human
uuucaccauguuggccaaga

SEQ ID NO: 235177 - RNA, 19 nt, Human
uuucuuuucuuuucuguuc

SEQ ID NO: 235178 - RNA, 24 nt, Human
uuuuuaggagagacaggguuucac

SEQ ID NO: 235179 - RNA, 18 nt, Human
uuuuuguauuuuuaggag

SEQ ID NO: 235180 - RNA, 23 nt, Human
uuuuuguauuuuuaggagagaca

SEQ ID NO: 235181 - RNA, 23 nt, Human
uuuuuuuuuuuuucuuucuuuuu

SEQ ID NO: 235182 - RNA, 24 nt, Human
uuuuuuuuuuuuuuuuuuaauuug

SEQ ID NO: 235183 - RNA, 18 nt, Human
agggguccaggcugacug

SEQ ID NO: 235184 - RNA, 21 nt, Human
aucuccucauggucuuuguua

SEQ ID NO: 235185 - RNA, 21 nt, Human
caaaguucccagcaucuccuc

SEQ ID NO: 235186 - RNA, 21 nt, Human
cagggaagacccagguccaug

SEQ ID NO: 235187 - RNA, 18 nt, Human
cauggucuuuguuagggg

SEQ ID NO: 235188 - RNA, 20 nt, Human
ccgugccuucagcaguccug

SEQ ID NO: 235189 - RNA, 21 nt, Human
ccuucuacugaguguggaguc

SEQ ID NO: 235190 - RNA, 22 nt, Human
cuccagcccuggagaugcuuca

SEQ ID NO: 235191 - RNA, 18 nt, Human
gagucugcguacccuccg

SEQ ID NO: 235192 - RNA, 20 nt, Human
ucagcagagacgcaucucgc

SEQ ID NO: 235193 - RNA, 19 nt, Human
ucagcaguccugagucucc

SEQ ID NO: 235194 - RNA, 20 nt, Human
ucagcaguccugagucuccc

SEQ ID NO: 235195 - RNA, 22 nt, Human
ucagcaguccugagucuccuuc

SEQ ID NO: 235196 - RNA, 18 nt, Human
ucauugguguccacuggg

SEQ ID NO: 235197 - RNA, 23 nt, Human
uccaugcugcaggcagacucaga

SEQ ID NO: 235198 - RNA, 20 nt, Human
ucccgugccuucagcagucc

SEQ ID NO: 235199 - RNA, 23 nt, Human
ucccuccagcccuggagaugcuu

SEQ ID NO: 235200 - RNA, 21 nt, Human
ucgcaucuggcugugccgccc

SEQ ID NO: 235201 - RNA, 24 nt, Human
ucggugcauggcagucgucccucc

SEQ ID NO: 235202 - RNA, 24 nt, Human
ucuggcugugccgcccaggcugag

SEQ ID NO: 235203 - RNA, 21 nt, Human
ugaguguggagucugcguacc

SEQ ID NO: 235204 - RNA, 18 nt, Human
uggaacgagacgaccugc

SEQ ID NO: 235205 - RNA, 22 nt, Human
uguuagggguccaggcugacug

SEQ ID NO: 235206 - RNA, 25 nt, Human
uguuagggguccaggcugacugggg

SEQ ID NO: 235207 - RNA, 19 nt, Human
aaguucccagcgucuccuc

SEQ ID NO: 235208 - RNA, 18 nt, Human
agggguccaggcugacug

SEQ ID NO: 235209 - RNA, 20 nt, Human
agggguccaggcugacuggg

SEQ ID NO: 235210 - RNA, 20 nt, Human
ccgugccuucagcaguccug

SEQ ID NO: 235211 - RNA, 18 nt, Human
cugggguucacugguguc

SEQ ID NO: 235212 - RNA, 18 nt, Human
guggggucugcguacccc

SEQ ID NO: 235213 - RNA, 19 nt, Human
ucagcaguccugagucucc

SEQ ID NO: 235214 - RNA, 20 nt, Human
ucagcaguccugagucuccc

SEQ ID NO: 235215 - RNA, 22 nt, Human
ucagcaguccugagucuccuuc

SEQ ID NO: 235216 - RNA, 20 nt, Human
ucccgugccuucagcagucc

SEQ ID NO: 235217 - RNA, 20 nt, Human
uccuucugcugagugugggg

SEQ ID NO: 235218 - RNA, 21 nt, Human
ucugcugaguguggggucugc

SEQ ID NO: 235219 - RNA, 19 nt, Human
ugagucuccuucugcugag

SEQ ID NO: 235220 - RNA, 22 nt, Human
uguuagggguccaggcugacug

SEQ ID NO: 235221 - RNA, 25 nt, Human
uucccagcgucuccucauggucugu

SEQ ID NO: 235222 - RNA, 23 nt, Human
aaaaaaaaguucauaccugcaga

SEQ ID NO: 235223 - RNA, 24 nt, Human
aaaaaaccaccaacaaaccuugcu

SEQ ID NO: 235224 - RNA, 26 nt, Human
aaaaaaccaccaacaaaccuugcuga

SEQ ID NO: 235225 - RNA, 23 nt, Human
aaaaaaccaguguggucaugaua

SEQ ID NO: 235226 - RNA, 19 nt, Human
aaaagcaaaaauagacaaa

SEQ ID NO: 235227 - RNA, 21 nt, Human
aaacacaagcaacaaaagcaa

SEQ ID NO: 235228 - RNA, 25 nt, Human
aaacagguauagugaucagugcaac

SEQ ID NO: 235229 - RNA, 18 nt, Human
aacaaaagcaaaaauaga

SEQ ID NO: 235230 - RNA, 22 nt, Human
aacaaaagcaaaaauagacaaa

SEQ ID NO: 235231 - RNA, 24 nt, Human
aacaaaauuccaaggucguuuucc

SEQ ID NO: 235232 - RNA, 20 nt, Human
aagaaaccaaaaacuaccgu

SEQ ID NO: 235233 - RNA, 21 nt, Human
aagagacaacucagaaauggg

SEQ ID NO: 235234 - RNA, 18 nt, Human
aagcaaagaaggaaacac

SEQ ID NO: 235235 - RNA, 21 nt, Human
aagcaaagaaggaaacacaca

SEQ ID NO: 235236 - RNA, 20 nt, Human
aagcaacagcaagaaaccaa

SEQ ID NO: 235237 - RNA, 22 nt, Human
aagcaacagcaagaaaccaaaa

SEQ ID NO: 235238 - RNA, 23 nt, Human
aagcuacagccaggaagacauca

SEQ ID NO: 235239 - RNA, 18 nt, Human
aaggaccccaaauagcca

SEQ ID NO: 235240 - RNA, 24 nt, Human
aaggaccccaaauagccaaaacaa

SEQ ID NO: 235241 - RNA, 19 nt, Human
aaugaagagacaacucaga

SEQ ID NO: 235242 - RNA, 21 nt, Human
aaugaagagacaacucagaaa

SEQ ID NO: 235243 - RNA, 21 nt, Human
acaaaauauucucagggaaaa

SEQ ID NO: 235244 - RNA, 20 nt, Human
acaaagcaacagcaagaaac

SEQ ID NO: 235245 - RNA, 22 nt, Human
acaaagcaacagcaagaaacca

SEQ ID NO: 235246 - RNA, 25 nt, Human
acaaagcaacagcaagaaaccaaaa

SEQ ID NO: 235247 - RNA, 20 nt, Human
acaagcaacaaaagcaaaaa

SEQ ID NO: 235248 - RNA, 18 nt, Human
acagggaggggaacaacc

SEQ ID NO: 235249 - RNA, 19 nt, Human
acuaaaacaaagcaacagc

SEQ ID NO: 235250 - RNA, 22 nt, Human
agcaagaaaccaaaaacuacuu

SEQ ID NO: 235251 - RNA, 19 nt, Human
agggaagaaggggauauca

SEQ ID NO: 235252 - RNA, 21 nt, Human
agggagggagagcaucagggg

SEQ ID NO: 235253 - RNA, 19 nt, Human
agggcggaugaugaaggga

SEQ ID NO: 235254 - RNA, 20 nt, Human
aggggaacaacacacacugg

SEQ ID NO: 235255 - RNA, 20 nt, Human
aggugcucagacaaaagcuu

SEQ ID NO: 235256 - RNA, 22 nt, Human
augaaaaggugcucagacaaaa

SEQ ID NO: 235257 - RNA, 22 nt, Human
augaaagcaaagaaggaaacac

SEQ ID NO: 235258 - RNA, 22 nt, Human
auggugaauugauccucaacaa

SEQ ID NO: 235259 - RNA, 22 nt, Human
caaagcaacagcaagaaaccaa

SEQ ID NO: 235260 - RNA, 23 nt, Human
caaagcaacagcaagaaaccaaa

SEQ ID NO: 235261 - RNA, 23 nt, Human
caaaggauaacaaaaaaccagug

SEQ ID NO: 235262 - RNA, 18 nt, Human
caaaguagcugaacaggc

SEQ ID NO: 235263 - RNA, 23 nt, Human
caaauggucagcagcuauaugaa

SEQ ID NO: 235264 - RNA, 22 nt, Human
caacaaaagcaaaaauagacaa

SEQ ID NO: 235265 - RNA, 24 nt, Human
caacagcaagaaaccaaaaacuac

SEQ ID NO: 235266 - RNA, 23 nt, Human
caagaaaccaaaaacuacuugaa

SEQ ID NO: 235267 - RNA, 21 nt, Human
caagaacaagagagggcaguc

SEQ ID NO: 235268 - RNA, 24 nt, Human
caagcaacaaaagcaaaaauagac

SEQ ID NO: 235269 - RNA, 21 nt, Human
cacucggcucagcugaacguc

SEQ ID NO: 235270 - RNA, 25 nt, Human
cagaaugaagagacaacucagaaau

SEQ ID NO: 235271 - RNA, 19 nt, Human
cagcaagaaaccaaaaacu

SEQ ID NO: 235272 - RNA, 23 nt, Human
cagcuuccaugccuucugggguc

SEQ ID NO: 235273 - RNA, 24 nt, Human
cagcuuccaugccuucuggggucc

SEQ ID NO: 235274 - RNA, 20 nt, Human
cagggaugaaagcaaagaag

SEQ ID NO: 235275 - RNA, 21 nt, Human
caucaggaaaaagagcuaaug

SEQ ID NO: 235276 - RNA, 25 nt, Human
caucaggaaaaagagcuaaugcaug

SEQ ID NO: 235277 - RNA, 21 nt, Human
cauggaacuggaauagaaaca

SEQ ID NO: 235278 - RNA, 24 nt, Human
ccaguguggucaugauauacuguc

SEQ ID NO: 235279 - RNA, 20 nt, Human
cccaaauauccuacaaagcu

SEQ ID NO: 235280 - RNA, 19 nt, Human
cccauauacaaaaaugggu

SEQ ID NO: 235281 - RNA, 25 nt, Human
cccugaaaacacaagcaacaaaagc

SEQ ID NO: 235282 - RNA, 19 nt, Human
cccuggaacuuuaaaaaaa

SEQ ID NO: 235283 - RNA, 18 nt, Human
ccucccaggggccccagc

SEQ ID NO: 235284 - RNA, 23 nt, Human
cuaccuauguaacaaagcugcag

SEQ ID NO: 235285 - RNA, 22 nt, Human
cucaaugcaauuccuaacaaaa

SEQ ID NO: 235286 - RNA, 22 nt, Human
cucccaggggccccagcugugc

SEQ ID NO: 235287 - RNA, 21 nt, Human
cugcaaacagaaugaagagac

SEQ ID NO: 235288 - RNA, 21 nt, Human
cugccuccuauuuuguuccug

SEQ ID NO: 235289 - RNA, 22 nt, Human
cuggaacuuuaaaaaaaaguuc

SEQ ID NO: 235290 - RNA, 21 nt, Human
cugggcauaugacacauccug

SEQ ID NO: 235291 - RNA, 23 nt, Human
cugggguccugagucuccauggc

SEQ ID NO: 235292 - RNA, 18 nt, Human
cugugcagcugggcauau

SEQ ID NO: 235293 - RNA, 24 nt, Human
cuucaagacguugguccgggcaac

SEQ ID NO: 235294 - RNA, 22 nt, Human
cuuguggggucugggucccccc

SEQ ID NO: 235295 - RNA, 21 nt, Human
gaaaacacaagcaacaaaagc

SEQ ID NO: 235296 - RNA, 26 nt, Human
gaacuaaaacaaagcaacagcaagaa

SEQ ID NO: 235297 - RNA, 23 nt, Human
gaguuuuugaaaauuaagcuauc

SEQ ID NO: 235298 - RNA, 24 nt, Human
gcagcaaaccaccauggcacaagc

SEQ ID NO: 235299 - RNA, 21 nt, Human
gcugacaguuuucuuucaccu

SEQ ID NO: 235300 - RNA, 19 nt, Human
gcugugcagcugggcauau

SEQ ID NO: 235301 - RNA, 20 nt, Human
ggaagaaggggauaucacac

SEQ ID NO: 235302 - RNA, 20 nt, Human
gguccuaggagaacugaguc

SEQ ID NO: 235303 - RNA, 21 nt, Human
gucaggggucugggcuggcug

SEQ ID NO: 235304 - RNA, 21 nt, Human
guuuccuuuucagguuuuggu

SEQ ID NO: 235305 - RNA, 20 nt, Human
uaaaacaaagcaacagcaag

SEQ ID NO: 235306 - RNA, 21 nt, Human
uaacaaaaaaccagugugguc

SEQ ID NO: 235307 - RNA, 19 nt, Human
uaagaguuugaaaaaacca

SEQ ID NO: 235308 - RNA, 19 nt, Human
uaauggguugauaggugca

SEQ ID NO: 235309 - RNA, 23 nt, Human
uacaaaaggaccccaaauagcca

SEQ ID NO: 235310 - RNA, 20 nt, Human
uacuugaaacaugggcaaag

SEQ ID NO: 235311 - RNA, 22 nt, Human
uagccaaaacaaucuugagcaa

SEQ ID NO: 235312 - RNA, 22 nt, Human
uagcugaacaggcauuucucaa

SEQ ID NO: 235313 - RNA, 21 nt, Human
uaugaugauucaguuuuucua

SEQ ID NO: 235314 - RNA, 27 nt, Human
uauggcccugaaaacacaagcaacaaa

SEQ ID NO: 235315 - RNA, 24 nt, Human
uauguaaggaacuaaaacaaagca

SEQ ID NO: 235316 - RNA, 19 nt, Human
uauuucaucuaucucaucu

SEQ ID NO: 235317 - RNA, 19 nt, Human
uccacagaaauagaaaaac

SEQ ID NO: 235318 - RNA, 19 nt, Human
ucccaacguucccggaauc

SEQ ID NO: 235319 - RNA, 19 nt, Human
ucccaggggccccagcugu

SEQ ID NO: 235320 - RNA, 23 nt, Human
ucccaggggccccagcugugcag

SEQ ID NO: 235321 - RNA, 19 nt, Human
uccuacaaagcuacagcca

SEQ ID NO: 235322 - RNA, 20 nt, Human
uccuacaaagcuacagccag

SEQ ID NO: 235323 - RNA, 22 nt, Human
uccuaggagaacugagucucca

SEQ ID NO: 235324 - RNA, 18 nt, Human
uccugagucuccauggcu

SEQ ID NO: 235325 - RNA, 20 nt, Human
ugaaaaaaccaccaacaaac

SEQ ID NO: 235326 - RNA, 19 nt, Human
ugaaaacacaagcaacaaa

SEQ ID NO: 235327 - RNA, 23 nt, Human
ugaaaacacaagcaacaaaagca

SEQ ID NO: 235328 - RNA, 24 nt, Human
ugaaaacacaagcaacaaaagcaa

SEQ ID NO: 235329 - RNA, 24 nt, Human
ugaaaacacaagcaacaaaagcaa

SEQ ID NO: 235330 - RNA, 22 nt, Human
ugaagaagaaugaaauugaacc

SEQ ID NO: 235331 - RNA, 18 nt, Human
ugagcaaagggaagaagg

SEQ ID NO: 235332 - RNA, 20 nt, Human
ugaggguaagcugugcagcu

SEQ ID NO: 235333 - RNA, 21 nt, Human
ugauugaguuuuugaaaauua

SEQ ID NO: 235334 - RNA, 21 nt, Human
ugcaaacagaaugaagagaca

SEQ ID NO: 235335 - RNA, 22 nt, Human
ugcaaacagaaugaagagacaa

SEQ ID NO: 235336 - RNA, 22 nt, Human
ugcagaaucaggugacucccaa

SEQ ID NO: 235337 - RNA, 20 nt, Human
uggaauagaaacagguagug

SEQ ID NO: 235338 - RNA, 24 nt, Human
uggcccugaaaacacaagcaacaa

SEQ ID NO: 235339 - RNA, 20 nt, Human
uggcuucuaaacagcuucuu

SEQ ID NO: 235340 - RNA, 18 nt, Human
ugggcauaugacacaucc

SEQ ID NO: 235341 - RNA, 22 nt, Human
uggggcuuguagugggagggcg

SEQ ID NO: 235342 - RNA, 22 nt, Human
ugguaucaacuuguuccuaguc

SEQ ID NO: 235343 - RNA, 19 nt, Human
uggugaauugauccucaac

SEQ ID NO: 235344 - RNA, 21 nt, Human
ugugugugugugucugugugu

SEQ ID NO: 235345 - RNA, 21 nt, Human
ugugugugugugugucugugu

SEQ ID NO: 235346 - RNA, 22 nt, Human
ugugugugugugugucugugug

SEQ ID NO: 235347 - RNA, 26 nt, Human
uuaugcaaguuugugugugugugugu

SEQ ID NO: 235348 - RNA, 21 nt, Human
uucuauuuauccuuauguuca

SEQ ID NO: 235349 - RNA, 20 nt, Human
uucuguaguuuccuuuucag

SEQ ID NO: 235350 - RNA, 22 nt, Human
uugguccgggcaagguuuuuuu

SEQ ID NO: 235351 - RNA, 21 nt, Human
uugugggaacauuuuugauua

SEQ ID NO: 235352 - RNA, 21 nt, Human
uuucagguuuugguaucaacu

SEQ ID NO: 235353 - RNA, 19 nt, Human
uuugcagaaucaggacgag

SEQ ID NO: 235354 - RNA, 25 nt, Human
uuugugugugugugugucugugugu

SEQ ID NO: 235355 - RNA, 20 nt, Human
uuuuuuuuuuuuuuuucugg

SEQ ID NO: 235356 - RNA, 18 nt, Human
agggguccaggcuggcug

SEQ ID NO: 235357 - RNA, 20 nt, Human
ccacuggacucagcugugca

SEQ ID NO: 235358 - RNA, 24 nt, Human
cuguggcuucauuucaaaaaugca

SEQ ID NO: 235359 - RNA, 21 nt, Human
guaugagaucugggucccccg

SEQ ID NO: 235360 - RNA, 23 nt, Human
guguccacugggggcagcuccug

SEQ ID NO: 235361 - RNA, 19 nt, Human
uagggguccaggcuggcug

SEQ ID NO: 235362 - RNA, 18 nt, Human
ucauugguguccacuggg

SEQ ID NO: 235363 - RNA, 22 nt, Human
ucccaggauguccugguggucu

SEQ ID NO: 235364 - RNA, 23 nt, Human
uccugugccuucuggagucucug

SEQ ID NO: 235365 - RNA, 27 nt, Human
ucuggagucucugagucuccuucuguu

SEQ ID NO: 235366 - RNA, 18 nt, Human
ugagaagucuguggcuuc

SEQ ID NO: 235367 - RNA, 26 nt, Human
ugagucccagaguucccaggaugucc

SEQ ID NO: 235368 - RNA, 20 nt, Human
ugagucuccuucuguugagu

SEQ ID NO: 235369 - RNA, 26 nt, Human
ugagucuccuucuguugaguaugaga

SEQ ID NO: 235370 - RNA, 22 nt, Human
uguuagggguccaggcuggcug

SEQ ID NO: 235371 - RNA, 19 nt, Human
aaccaggauuucaggccuc

SEQ ID NO: 235372 - RNA, 25 nt, Human
aggagucagccuccccccacaaacc

SEQ ID NO: 235373 - RNA, 21 nt, Human
aggccucuagacccuccuccu

SEQ ID NO: 235374 - RNA, 22 nt, Human
caaacccacaguccagaacuga

SEQ ID NO: 235375 - RNA, 22 nt, Human
cacaaacccacaguccagaacu

SEQ ID NO: 235376 - RNA, 20 nt, Human
cacaguccagaacugagccc

SEQ ID NO: 235377 - RNA, 28 nt, Human
cacuuuaacuuccagaugaaguuggggg

SEQ ID NO: 235378 - RNA, 20 nt, Human
cagaacugagcccccucauu

SEQ ID NO: 235379 - RNA, 20 nt, Human
cagcucccucccaugggccc

SEQ ID NO: 235380 - RNA, 20 nt, Human
caggccucuagacccuccuc

SEQ ID NO: 235381 - RNA, 18 nt, Human
cccacaaacccacagucc

SEQ ID NO: 235382 - RNA, 24 nt, Human
cccacaaacccacaguccagaacu

SEQ ID NO: 235383 - RNA, 19 nt, Human
cccacaguccagaacugag

SEQ ID NO: 235384 - RNA, 21 nt, Human
cccacaguccagaacugagcc

SEQ ID NO: 235385 - RNA, 19 nt, Human
ccuccuccucuucaguggc

SEQ ID NO: 235386 - RNA, 23 nt, Human
cuccccccacaaacccacagucc

SEQ ID NO: 235387 - RNA, 23 nt, Human
cugagcccccucauuccccuagg

SEQ ID NO: 235388 - RNA, 19 nt, Human
cugccaggcagacggggac

SEQ ID NO: 235389 - RNA, 24 nt, Human
ggccccagaaaguugcucuaaugg

SEQ ID NO: 235390 - RNA, 22 nt, Human
gucagccuccccccacaaaccc

SEQ ID NO: 235391 - RNA, 22 nt, Human
guccauuuuucuaacaaccugc

SEQ ID NO: 235392 - RNA, 19 nt, Human
ucagccuccccccacaaac

SEQ ID NO: 235393 - RNA, 18 nt, Human
ucagcucccucccauggg

SEQ ID NO: 235394 - RNA, 24 nt, Human
ucaguggccucacuuuaacuucca

SEQ ID NO: 235395 - RNA, 20 nt, Human
uccuccuccucuucaguggc

SEQ ID NO: 235396 - RNA, 21 nt, Human
ucuaacaaccugccaggcaga

SEQ ID NO: 235397 - RNA, 19 nt, Human
ugagcccccucauuccccu

SEQ ID NO: 235398 - RNA, 22 nt, Human
uucaguggccucacuuuaacuu

SEQ ID NO: 235399 - RNA, 24 nt, Human
uucucagcucccucccaugggccc

SEQ ID NO: 235400 - RNA, 18 nt, Human
aaaaaaaaaaauccuggu

SEQ ID NO: 235401 - RNA, 18 nt, Human
aaaaagaaaacccagaag

SEQ ID NO: 235402 - RNA, 19 nt, Human
aaaaagaaaacccagaagg

SEQ ID NO: 235403 - RNA, 22 nt, Human
aaaaagacaaaacaggagacgg

SEQ ID NO: 235404 - RNA, 19 nt, Human
aaaccuaaaaggcacaaug

SEQ ID NO: 235405 - RNA, 22 nt, Human
aaagcacacauuagagcuuccu

SEQ ID NO: 235406 - RNA, 24 nt, Human
aaaggcaccccccacaugcucaca

SEQ ID NO: 235407 - RNA, 20 nt, Human
aacacgugggcaaaaaaaaa

SEQ ID NO: 235408 - RNA, 26 nt, Human
aaccaaugaugaugcacagcgcggcc

SEQ ID NO: 235409 - RNA, 21 nt, Human
aaccacccaggcaguuucuga

SEQ ID NO: 235410 - RNA, 19 nt, Human
aaccccggcuccucauccc

SEQ ID NO: 235411 - RNA, 20 nt, Human
aaccucagaggacucagcug

SEQ ID NO: 235412 - RNA, 22 nt, Human
aagcagcagcagcaaccccggc

SEQ ID NO: 235413 - RNA, 23 nt, Human
aagcuaaaaacaggugcaagcga

SEQ ID NO: 235414 - RNA, 18 nt, Human
acagagaaaagcacuugg

SEQ ID NO: 235415 - RNA, 24 nt, Human
accaaaugagucaaaacauggccu

SEQ ID NO: 235416 - RNA, 28 nt, Human
acuccagagaaaaacagcgcaaacaaua

SEQ ID NO: 235417 - RNA, 19 nt, Human
acuuccaccccaggggcca

SEQ ID NO: 235418 - RNA, 22 nt, Human
agaaaaaaaagacaaaacagga

SEQ ID NO: 235419 - RNA, 23 nt, Human
agaaaaaaaagacaaaacaggag

SEQ ID NO: 235420 - RNA, 22 nt, Human
agaaaagaaaaaaaagacaaaa

SEQ ID NO: 235421 - RNA, 21 nt, Human
agaaaccaacgaaaugaauau

SEQ ID NO: 235422 - RNA, 21 nt, Human
agacaaaacaggagacggugg

SEQ ID NO: 235423 - RNA, 21 nt, Human
agagaaaaacaacugauugga

SEQ ID NO: 235424 - RNA, 26 nt, Human
agagaaaaacagcgcaaacacguggg

SEQ ID NO: 235425 - RNA, 18 nt, Human
agagaaaagcacuuggaa

SEQ ID NO: 235426 - RNA, 23 nt, Human
agaggacucagcugaaagagguu

SEQ ID NO: 235427 - RNA, 23 nt, Human
agauuccuaucuggcgccuucuc

SEQ ID NO: 235428 - RNA, 19 nt, Human
agccagugauuuccaacac

SEQ ID NO: 235429 - RNA, 22 nt, Human
agccccagcguucauggguuuu

SEQ ID NO: 235430 - RNA, 23 nt, Human
agccgggcccaaugaaaagccug

SEQ ID NO: 235431 - RNA, 21 nt, Human
aggaacucucccuccugcccc

SEQ ID NO: 235432 - RNA, 19 nt, Human
aggacucagcugaaagagg

SEQ ID NO: 235433 - RNA, 19 nt, Human
aggagaaaagaaaaaaaag

SEQ ID NO: 235434 - RNA, 25 nt, Human
aggagaaaagaaaaaaaagacaaaa

SEQ ID NO: 235435 - RNA, 23 nt, Human
aggcaaaagcacugaaucggauc

SEQ ID NO: 235436 - RNA, 25 nt, Human
aggcaccccccacaugcucacagga

SEQ ID NO: 235437 - RNA, 21 nt, Human
aggccaacauucuuagguuga

SEQ ID NO: 235438 - RNA, 20 nt, Human
agugaagggaaacaacuaaa

SEQ ID NO: 235439 - RNA, 19 nt, Human
auaaauacaaccccauuac

SEQ ID NO: 235440 - RNA, 21 nt, Human
augaaccaagacggcagaugg

SEQ ID NO: 235441 - RNA, 19 nt, Human
caaaaaaaaaaauccuggu

SEQ ID NO: 235442 - RNA, 22 nt, Human
caaacaaaucccagcuacuucu

SEQ ID NO: 235443 - RNA, 21 nt, Human
caaacauaaugccugugccaa

SEQ ID NO: 235444 - RNA, 19 nt, Human
caaaccacccaggcaguuu

SEQ ID NO: 235445 - RNA, 22 nt, Human
caaaggccuaagauggaggcug

SEQ ID NO: 235446 - RNA, 25 nt, Human
caagcgauguaccugcauggguucc

SEQ ID NO: 235447 - RNA, 22 nt, Human
caaguccaagaauugucaaaaa

SEQ ID NO: 235448 - RNA, 18 nt, Human
caccggaagcagcagcag

SEQ ID NO: 235449 - RNA, 21 nt, Human
cacugaaucggaucuauuccc

SEQ ID NO: 235450 - RNA, 21 nt, Human
cacuuggaaaauacacgcagg

SEQ ID NO: 235451 - RNA, 24 nt, Human
cagcagaaccucagaggacucagc

SEQ ID NO: 235452 - RNA, 20 nt, Human
cagcagcagcaaccccggcu

SEQ ID NO: 235453 - RNA, 24 nt, Human
cagcagcagcaaccccggcuccuc

SEQ ID NO: 235454 - RNA, 21 nt, Human
cagccugugaaaaagaaccaa

SEQ ID NO: 235455 - RNA, 19 nt, Human
caguccucuugcucugggu

SEQ ID NO: 235456 - RNA, 21 nt, Human
cauggcuuuuguguaagggcc

SEQ ID NO: 235457 - RNA, 23 nt, Human
cauuccaucagccacccaggacu

SEQ ID NO: 235458 - RNA, 24 nt, Human
ccaaugaugaugcacacccuggcu

SEQ ID NO: 235459 - RNA, 21 nt, Human
ccacccaggacucaacagcag

SEQ ID NO: 235460 - RNA, 20 nt, Human
ccacccaggcaguuucugaa

SEQ ID NO: 235461 - RNA, 22 nt, Human
ccacgccccacacugagcugga

SEQ ID NO: 235462 - RNA, 24 nt, Human
ccagaccuccucaaucauuccauc

SEQ ID NO: 235463 - RNA, 20 nt, Human
ccauggaaacaaggcgauga

SEQ ID NO: 235464 - RNA, 21 nt, Human
ccauggcaccaauucugugcu

SEQ ID NO: 235465 - RNA, 22 nt, Human
cccacuuccaccccaggggcca

SEQ ID NO: 235466 - RNA, 20 nt, Human
ccccaggggccaccggaagc

SEQ ID NO: 235467 - RNA, 21 nt, Human
ccccuaccccacuuccacccc

SEQ ID NO: 235468 - RNA, 20 nt, Human
cccugaccaguuggaguugg

SEQ ID NO: 235469 - RNA, 19 nt, Human
ccgcagccgauggcugggu

SEQ ID NO: 235470 - RNA, 24 nt, Human
ccuccugccccuccucuuccccua

SEQ ID NO: 235471 - RNA, 24 nt, Human
ccucugcagcccagcacccagucc

SEQ ID NO: 235472 - RNA, 21 nt, Human
ccugaaggaagagaaaggguu

SEQ ID NO: 235473 - RNA, 22 nt, Human
ccugccacgccccacacugagc

SEQ ID NO: 235474 - RNA, 21 nt, Human
ccugccgugaugucugcaagu

SEQ ID NO: 235475 - RNA, 33 nt, Human
cgaaaugaauauaauaacuuauccugaggcggu

SEQ ID NO: 235476 - RNA, 21 nt, Human
cggcagaugggggaauaacau

SEQ ID NO: 235477 - RNA, 22 nt, Human
cggccucugcagcccagcaccc

SEQ ID NO: 235478 - RNA, 22 nt, Human
cggccuuccaagucaccaacuc

SEQ ID NO: 235479 - RNA, 23 nt, Human
cggccuuccaagucaccaacucu

SEQ ID NO: 235480 - RNA, 21 nt, Human
cggcuccuguguccccggccu

SEQ ID NO: 235481 - RNA, 19 nt, Human
cuaaaaaaauuaaacagac

SEQ ID NO: 235482 - RNA, 19 nt, Human
cuaaaaggcacaaugaggc

SEQ ID NO: 235483 - RNA, 18 nt, Human
cuccucauccccugccgu

SEQ ID NO: 235484 - RNA, 24 nt, Human
cucuugagaacuccagagaaaaac

SEQ ID NO: 235485 - RNA, 19 nt, Human
cuggcuuugggaucugaaa

SEQ ID NO: 235486 - RNA, 23 nt, Human
cuucauggcuuuuguguaagggc

SEQ ID NO: 235487 - RNA, 20 nt, Human
cuuccccuaccccacuucca

SEQ ID NO: 235488 - RNA, 20 nt, Human
cuugccuuaaugcaauuaaa

SEQ ID NO: 235489 - RNA, 22 nt, Human
gaaaacccagaagggcuauuca

SEQ ID NO: 235490 - RNA, 20 nt, Human
gaaaauacacgcaggaggca

SEQ ID NO: 235491 - RNA, 20 nt, Human
gaaaauguggcaacagagaa

SEQ ID NO: 235492 - RNA, 24 nt, Human
gaaccaagacggcagaugggggaa

SEQ ID NO: 235493 - RNA, 18 nt, Human
gagcacuaaccacagaga

SEQ ID NO: 235494 - RNA, 22 nt, Human
gagccgggcccaaugaaaagcc

SEQ ID NO: 235495 - RNA, 21 nt, Human
gaguggucuugaaaucuugcc

SEQ ID NO: 235496 - RNA, 25 nt, Human
gaucacucugcccugaccaguugga

SEQ ID NO: 235497 - RNA, 19 nt, Human
gaucugaaauccggccaca

SEQ ID NO: 235498 - RNA, 18 nt, Human
gauuacgaauggauccuu

SEQ ID NO: 235499 - RNA, 22 nt, Human
gcagagugcacacaccggcucc

SEQ ID NO: 235500 - RNA, 24 nt, Human
gccauucugcagaagaacugaagc

SEQ ID NO: 235501 - RNA, 22 nt, Human
gcugccuuucuuuugcagcuuc

SEQ ID NO: 235502 - RNA, 21 nt, Human
gcuggcuuugggaucugaaau

SEQ ID NO: 235503 - RNA, 20 nt, Human
gcuucauuuaccccccugcc

SEQ ID NO: 235504 - RNA, 26 nt, Human
gcuucauuuaccccccugccacgccc

SEQ ID NO: 235505 - RNA, 21 nt, Human
ggacaggaggauuccuuuggu

SEQ ID NO: 235506 - RNA, 24 nt, Human
ggaguugggccugugugaagccag

SEQ ID NO: 235507 - RNA, 20 nt, Human
ggcaaaaaaaaaaauccugg

SEQ ID NO: 235508 - RNA, 22 nt, Human
ggcaggagagaaaccaacgaaa

SEQ ID NO: 235509 - RNA, 21 nt, Human
ggcagguaguguucaccuccc

SEQ ID NO: 235510 - RNA, 21 nt, Human
ggccuagaaguggagccgggc

SEQ ID NO: 235511 - RNA, 21 nt, Human
gggccaccggaagcagcagca

SEQ ID NO: 235512 - RNA, 21 nt, Human
ggguaggacuaaaugcccuuc

SEQ ID NO: 235513 - RNA, 18 nt, Human
gguacugaccucuggccu

SEQ ID NO: 235514 - RNA, 21 nt, Human
guaucugaguccagugugaaa

SEQ ID NO: 235515 - RNA, 21 nt, Human
gugaaaagaagccuuaaguca

SEQ ID NO: 235516 - RNA, 18 nt, Human
gugaacaucucuucaugg

SEQ ID NO: 235517 - RNA, 18 nt, Human
gugaagccagugauuucc

SEQ ID NO: 235518 - RNA, 22 nt, Human
gugccaagaauugggcaggaga

SEQ ID NO: 235519 - RNA, 24 nt, Human
guguaccuuauccugguuucuuca

SEQ ID NO: 235520 - RNA, 26 nt, Human
uaaaaugguauauucgcaaaccuauc

SEQ ID NO: 235521 - RNA, 23 nt, Human
uaaacuaauuacccaauuugcaa

SEQ ID NO: 235522 - RNA, 18 nt, Human
uaagaaaaccuaaaaggc

SEQ ID NO: 235523 - RNA, 19 nt, Human
uaagcuaaaaacaggugca

SEQ ID NO: 235524 - RNA, 18 nt, Human
uaaggcaaaagcacugaa

SEQ ID NO: 235525 - RNA, 21 nt, Human
uaccaaguccuuguguuuucu

SEQ ID NO: 235526 - RNA, 23 nt, Human
uaccccacuuccaccccaggggc

SEQ ID NO: 235527 - RNA, 19 nt, Human
uaggagaaaagaaaaaaaa

SEQ ID NO: 235528 - RNA, 18 nt, Human
uauauucgcaaaccuauc

SEQ ID NO: 235529 - RNA, 19 nt, Human
uaucugaguccagugugaa

SEQ ID NO: 235530 - RNA, 18 nt, Human
uaucuuaggauacaaagc

SEQ ID NO: 235531 - RNA, 20 nt, Human
ucaaacauaaugccugugcc

SEQ ID NO: 235532 - RNA, 18 nt, Human
ucaauaaaaaccucuccc

SEQ ID NO: 235533 - RNA, 22 nt, Human
ucaggguucacuuccccagccc

SEQ ID NO: 235534 - RNA, 21 nt, Human
ucauaccgcagccgauggcug

SEQ ID NO: 235535 - RNA, 22 nt, Human
uccagagaaaaacagcgcaaac

SEQ ID NO: 235536 - RNA, 25 nt, Human
uccccagccccagcguucauggguu

SEQ ID NO: 235537 - RNA, 19 nt, Human
ucccugguuaaaggaaagg

SEQ ID NO: 235538 - RNA, 20 nt, Human
uccucagcuccugccacccu

SEQ ID NO: 235539 - RNA, 20 nt, Human
uccugccacccuggggagcc

SEQ ID NO: 235540 - RNA, 22 nt, Human
uccugcugucauaccgcagccg

SEQ ID NO: 235541 - RNA, 19 nt, Human
uccuggccuaccaaguccu

SEQ ID NO: 235542 - RNA, 18 nt, Human
ucgcacacacaaaaacuc

SEQ ID NO: 235543 - RNA, 22 nt, Human
ucucucaguaugcgggcagcuc

SEQ ID NO: 235544 - RNA, 20 nt, Human
ucugcccugaccaguuggag

SEQ ID NO: 235545 - RNA, 22 nt, Human
ucuggccucagggaugugacuu

SEQ ID NO: 235546 - RNA, 18 nt, Human
ucuggcgccuucuccagg

SEQ ID NO: 235547 - RNA, 24 nt, Human
ucugugauuuggugaagcucugug

SEQ ID NO: 235548 - RNA, 23 nt, Human
ucuguggugagaugaaccaagac

SEQ ID NO: 235549 - RNA, 23 nt, Human
ucuguugcuaggauuucuaggac

SEQ ID NO: 235550 - RNA, 18 nt, Human
ucuucagugcagagagug

SEQ ID NO: 235551 - RNA, 21 nt, Human
ugaaaagaagccuuaagucau

SEQ ID NO: 235552 - RNA, 22 nt, Human
ugaaaauuucauuuaaaaaugu

SEQ ID NO: 235553 - RNA, 21 nt, Human
ugaaacaagcucaauaaaaac

SEQ ID NO: 235554 - RNA, 21 nt, Human
ugacagagacagguuaacaca

SEQ ID NO: 235555 - RNA, 24 nt, Human
ugaccagaccuccucaaucauucc

SEQ ID NO: 235556 - RNA, 22 nt, Human
ugagaugaaccaagacggcaga

SEQ ID NO: 235557 - RNA, 19 nt, Human
ugaggaaaauguggcaaca

SEQ ID NO: 235558 - RNA, 19 nt, Human
ugcaaacaaaucccagcua

SEQ ID NO: 235559 - RNA, 20 nt, Human
ugccaagaauugggcaggag

SEQ ID NO: 235560 - RNA, 24 nt, Human
ugccaguguguggcccuuccucag

SEQ ID NO: 235561 - RNA, 20 nt, Human
ugcuggagcauuuuccugag

SEQ ID NO: 235562 - RNA, 19 nt, Human
uggccuagaaguggagccg

SEQ ID NO: 235563 - RNA, 18 nt, Human
uggcugaagugacaucug

SEQ ID NO: 235564 - RNA, 22 nt, Human
uggcuucauuuaccccccugcc

SEQ ID NO: 235565 - RNA, 23 nt, Human
uggcuuugggaucugaaauccgg

SEQ ID NO: 235566 - RNA, 19 nt, Human
ugggaagagagggucccca

SEQ ID NO: 235567 - RNA, 20 nt, Human
uggguaagaaaaccuaaaag

SEQ ID NO: 235568 - RNA, 27 nt, Human
uguaaucacagauuuuuagagguaucc

SEQ ID NO: 235569 - RNA, 19 nt, Human
ugugaaaaagaaccaauga

SEQ ID NO: 235570 - RNA, 18 nt, Human
ugugaaacaagcucaaua

SEQ ID NO: 235571 - RNA, 22 nt, Human
uuaaaggaaaggcaccccccac

SEQ ID NO: 235572 - RNA, 24 nt, Human
uuaggagaguaaggauuugaaggg

SEQ ID NO: 235573 - RNA, 23 nt, Human
uucacacgugcuaggggcuccac

SEQ ID NO: 235574 - RNA, 21 nt, Human
uucccaaaagcccgucauuaa

SEQ ID NO: 235575 - RNA, 21 nt, Human
uuccucagcuccugccacccu

SEQ ID NO: 235576 - RNA, 22 nt, Human
uuccuuuggugcuaugaugcaa

SEQ ID NO: 235577 - RNA, 22 nt, Human
uucgcaaaccuaucugaaucac

SEQ ID NO: 235578 - RNA, 22 nt, Human
uucucaaaccacccaggcaguu

SEQ ID NO: 235579 - RNA, 18 nt, Human
uugcagaucaaacugggu

SEQ ID NO: 235580 - RNA, 20 nt, Human
uugcagaucaaacuggguug

SEQ ID NO: 235581 - RNA, 25 nt, Human
aaaaaaaagacccaaagcgagagaa

SEQ ID NO: 235582 - RNA, 25 nt, Human
aaaaaaaagacccaaagcgagagaa

SEQ ID NO: 235583 - RNA, 21 nt, Human
aaaaauaaaaucccaagcccc

SEQ ID NO: 235584 - RNA, 21 nt, Human
aaaagacccaaagcgagagaa

SEQ ID NO: 235585 - RNA, 21 nt, Human
aaaagacccaaagcgagagaa

SEQ ID NO: 235586 - RNA, 24 nt, Human
aaacaaaaaaaagacccaaagcga

SEQ ID NO: 235587 - RNA, 24 nt, Human
aaacaaaaaaaagacccaaagcga

SEQ ID NO: 235588 - RNA, 22 nt, Human
aaagaaacaaaaaaaagaccca

SEQ ID NO: 235589 - RNA, 22 nt, Human
aaagaaacaaaaaaaagaccca

SEQ ID NO: 235590 - RNA, 24 nt, Human
aaagaaacaaaaaaaagacccaaa

SEQ ID NO: 235591 - RNA, 24 nt, Human
aaagaaacaaaaaaaagacccaaa

SEQ ID NO: 235592 - RNA, 20 nt, Human
aaagcgagagaaggggcugu

SEQ ID NO: 235593 - RNA, 20 nt, Human
aaagcgagagaaggggcugu

SEQ ID NO: 235594 - RNA, 19 nt, Human
aaccucuguccagcugcuc

SEQ ID NO: 235595 - RNA, 19 nt, Human
aacugaggcaaagugacaa

SEQ ID NO: 235596 - RNA, 21 nt, Human
aagaaagaaacaaaaaaaaga

SEQ ID NO: 235597 - RNA, 21 nt, Human
aagaaagaaacaaaaaaaaga

SEQ ID NO: 235598 - RNA, 28 nt, Human
aagaaagaaacaaaaaaaagacccaaag

SEQ ID NO: 235599 - RNA, 28 nt, Human
aagaaagaaacaaaaaaaagacccaaag

SEQ ID NO: 235600 - RNA, 22 nt, Human
aagcaagaggggacagcccugc

SEQ ID NO: 235601 - RNA, 22 nt, Human
aagcaagaggggacagcccugc

SEQ ID NO: 235602 - RNA, 27 nt, Human
aagcagcccuugcccagcaccuccccg

SEQ ID NO: 235603 - RNA, 20 nt, Human
aagcucggggggcaguuugg

SEQ ID NO: 235604 - RNA, 18 nt, Human
acaaaaaaaagacccaaa

SEQ ID NO: 235605 - RNA, 18 nt, Human
acaaaaaaaagacccaaa

SEQ ID NO: 235606 - RNA, 21 nt, Human
acaaaauggcccucccacccc

SEQ ID NO: 235607 - RNA, 21 nt, Human
acaaaauggcccucccacccc

SEQ ID NO: 235608 - RNA, 20 nt, Human
acagcccugccaagacagag

SEQ ID NO: 235609 - RNA, 20 nt, Human
acagcccugccaagacagag

SEQ ID NO: 235610 - RNA, 24 nt, Human
accccgaugaacuugagcacguug

SEQ ID NO: 235611 - RNA, 24 nt, Human
acugccggagccggcuccucccca

SEQ ID NO: 235612 - RNA, 24 nt, Human
acugccggagccggcuccucccca

SEQ ID NO: 235613 - RNA, 21 nt, Human
acugugccuauccucucacug

SEQ ID NO: 235614 - RNA, 21 nt, Human
acugugccuauccucucacug

SEQ ID NO: 235615 - RNA, 24 nt, Human
agaaacaaaaaaaagacccaaagc

SEQ ID NO: 235616 - RNA, 24 nt, Human
agaaagaaacaaaaaaaagaccca

SEQ ID NO: 235617 - RNA, 24 nt, Human
agaaagaaacaaaaaaaagaccca

SEQ ID NO: 235618 - RNA, 27 nt, Human
agaaagaaacaaaaaaaagacccaaag

SEQ ID NO: 235619 - RNA, 27 nt, Human
agaaagaaacaaaaaaaagacccaaag

SEQ ID NO: 235620 - RNA, 24 nt, Human
agaaggcaagucagggccuggcuc

SEQ ID NO: 235621 - RNA, 20 nt, Human
agaggacagaggggcaugag

SEQ ID NO: 235622 - RNA, 20 nt, Human
agaggacagaggggcaugag

SEQ ID NO: 235623 - RNA, 20 nt, Human
agaggggcaugaggaggggc

SEQ ID NO: 235624 - RNA, 20 nt, Human
agaggggcaugaggaggggc

SEQ ID NO: 235625 - RNA, 18 nt, Human
agcacguugggguguucc

SEQ ID NO: 235626 - RNA, 24 nt, Human
agcacguugggguguuccaggcau

SEQ ID NO: 235627 - RNA, 19 nt, Human
agccuccagggagcuaugg

SEQ ID NO: 235628 - RNA, 19 nt, Human
agccuccagggagcuaugg

SEQ ID NO: 235629 - RNA, 19 nt, Human
aggagaagcaagaggggac

SEQ ID NO: 235630 - RNA, 19 nt, Human
aggagaagcaagaggggac

SEQ ID NO: 235631 - RNA, 24 nt, Human
aggcgggggcggagggcgcgggcc

SEQ ID NO: 235632 - RNA, 23 nt, Human
agggagcuauggaccagacaggu

SEQ ID NO: 235633 - RNA, 23 nt, Human
agggagcuauggaccagacaggu

SEQ ID NO: 235634 - RNA, 27 nt, Human
aggggacagcccugccaagacagaggu

SEQ ID NO: 235635 - RNA, 27 nt, Human
aggggacagcccugccaagacagaggu

SEQ ID NO: 235636 - RNA, 19 nt, Human
aggggcucugagaugacug

SEQ ID NO: 235637 - RNA, 19 nt, Human
aggggcucugagaugacug

SEQ ID NO: 235638 - RNA, 21 nt, Human
aggggcugagcugcuggugga

SEQ ID NO: 235639 - RNA, 21 nt, Human
aggggcugagcugcuggugga

SEQ ID NO: 235640 - RNA, 21 nt, Human
agguagucagggucugcguuc

SEQ ID NO: 235641 - RNA, 24 nt, Human
aguagggguugcccaccacggugu

SEQ ID NO: 235642 - RNA, 19 nt, Human
caaaaaaaagacccaaagc

SEQ ID NO: 235643 - RNA, 19 nt, Human
caaaaaaaagacccaaagc

SEQ ID NO: 235644 - RNA, 22 nt, Human
caaaaauaaaaucccaagcccc

SEQ ID NO: 235645 - RNA, 18 nt, Human
caaagcgagagaaggggc

SEQ ID NO: 235646 - RNA, 18 nt, Human
caaagcgagagaaggggc

SEQ ID NO: 235647 - RNA, 20 nt, Human
caacugaggcaaagugacaa

SEQ ID NO: 235648 - RNA, 18 nt, Human
caagacagagguuacagc

SEQ ID NO: 235649 - RNA, 18 nt, Human
caagacagagguuacagc

SEQ ID NO: 235650 - RNA, 23 nt, Human
cacagaaaaaacgcagaggacag

SEQ ID NO: 235651 - RNA, 23 nt, Human
cacagaaaaaacgcagaggacag

SEQ ID NO: 235652 - RNA, 19 nt, Human
cacauccaccuucucauca

SEQ ID NO: 235653 - RNA, 19 nt, Human
caccuugauagccuggccg

SEQ ID NO: 235654 - RNA, 20 nt, Human
cacgcucccucaagggaccc

SEQ ID NO: 235655 - RNA, 20 nt, Human
cacgcucccucaagggaccc

SEQ ID NO: 235656 - RNA, 20 nt, Human
cagaaaaaacgcagaggaca

SEQ ID NO: 235657 - RNA, 20 nt, Human
cagaaaaaacgcagaggaca

SEQ ID NO: 235658 - RNA, 20 nt, Human
cagccaccaccacauucuug

SEQ ID NO: 235659 - RNA, 20 nt, Human
cagccacuggggaccuccgc

SEQ ID NO: 235660 - RNA, 20 nt, Human
cagccacuggggaccuccgc

SEQ ID NO: 235661 - RNA, 19 nt, Human
cagcggcguguggaaaggg

SEQ ID NO: 235662 - RNA, 21 nt, Human
cagcggcguguggaaaggggc

SEQ ID NO: 235663 - RNA, 19 nt, Human
caggacgaucccaaaggaa

SEQ ID NO: 235664 - RNA, 21 nt, Human
cagggugggcaggcaguccgc

SEQ ID NO: 235665 - RNA, 23 nt, Human
caguguuccagcuucacaaagga

SEQ ID NO: 235666 - RNA, 22 nt, Human
caucucaggugccauccaguag

SEQ ID NO: 235667 - RNA, 25 nt, Human
cauggucccacgggccuguugggau

SEQ ID NO: 235668 - RNA, 25 nt, Human
cauggucccacgggccuguugggau

SEQ ID NO: 235669 - RNA, 20 nt, Human
ccaaaggagaacacauccac

SEQ ID NO: 235670 - RNA, 21 nt, Human
ccaaaggagaacacauccacc

SEQ ID NO: 235671 - RNA, 25 nt, Human
ccacaaaaauaaaaucccaagcccc

SEQ ID NO: 235672 - RNA, 25 nt, Human
ccacaaaaauaaaaucccaagcccc

SEQ ID NO: 235673 - RNA, 19 nt, Human
ccagagguggggacagggg

SEQ ID NO: 235674 - RNA, 19 nt, Human
ccagagguggggacagggg

SEQ ID NO: 235675 - RNA, 21 nt, Human
ccagagguggggacaggggca

SEQ ID NO: 235676 - RNA, 21 nt, Human
ccagagguggggacaggggca

SEQ ID NO: 235677 - RNA, 20 nt, Human
ccagccaguguuccagcuuc

SEQ ID NO: 235678 - RNA, 20 nt, Human
ccaguguuccagcuucacaa

SEQ ID NO: 235679 - RNA, 22 nt, Human
cccaaaggagaacacauccacc

SEQ ID NO: 235680 - RNA, 23 nt, Human
cccacccccgcccgccacaaaaa

SEQ ID NO: 235681 - RNA, 23 nt, Human
cccacccccgcccgccacaaaaa

SEQ ID NO: 235682 - RNA, 20 nt, Human
cccacgcacccaagcguuau

SEQ ID NO: 235683 - RNA, 20 nt, Human
cccacgcacccaagcguuau

SEQ ID NO: 235684 - RNA, 21 nt, Human
cccacugucccagcugagggc

SEQ ID NO: 235685 - RNA, 21 nt, Human
cccacugucccagcugagggc

SEQ ID NO: 235686 - RNA, 25 nt, Human
cccacugucccagcugagggccacc

SEQ ID NO: 235687 - RNA, 25 nt, Human
cccacugucccagcugagggccacc

SEQ ID NO: 235688 - RNA, 25 nt, Human
ccccuggcagcugcugcugcagccg

SEQ ID NO: 235689 - RNA, 25 nt, Human
ccccuggcagcugcugcugcagccg

SEQ ID NO: 235690 - RNA, 27 nt, Human
ccccuggcagcugcugcugcagccgua

SEQ ID NO: 235691 - RNA, 27 nt, Human
ccccuggcagcugcugcugcagccgua

SEQ ID NO: 235692 - RNA, 19 nt, Human
ccccuggggggaaaacggg

SEQ ID NO: 235693 - RNA, 23 nt, Human
ccccuggggggaaaacgggcccc

SEQ ID NO: 235694 - RNA, 19 nt, Human
cccucaagggacccccuuc

SEQ ID NO: 235695 - RNA, 19 nt, Human
cccucaagggacccccuuc

SEQ ID NO: 235696 - RNA, 22 nt, Human
cccucaagggacccccuucacc

SEQ ID NO: 235697 - RNA, 22 nt, Human
cccucaagggacccccuucacc

SEQ ID NO: 235698 - RNA, 20 nt, Human
cccucccacccccgcccgcc

SEQ ID NO: 235699 - RNA, 20 nt, Human
cccucccacccccgcccgcc

SEQ ID NO: 235700 - RNA, 19 nt, Human
cccuggcagcugcugcugc

SEQ ID NO: 235701 - RNA, 19 nt, Human
cccuggcagcugcugcugc

SEQ ID NO: 235702 - RNA, 22 nt, Human
cccuggggggaaaacgggcccc

SEQ ID NO: 235703 - RNA, 23 nt, Human
ccgcccgccacaaaaauaaaauc

SEQ ID NO: 235704 - RNA, 23 nt, Human
ccgcccgccacaaaaauaaaauc

SEQ ID NO: 235705 - RNA, 26 nt, Human
ccgcgccgguaggucucccagaaacc

SEQ ID NO: 235706 - RNA, 21 nt, Human
ccgcggaggaaucuggugggg

SEQ ID NO: 235707 - RNA, 21 nt, Human
ccgcggaggaaucuggugggg

SEQ ID NO: 235708 - RNA, 19 nt, Human
ccggccagggcaccgcagc

SEQ ID NO: 235709 - RNA, 19 nt, Human
ccggccagggcaccgcagc

SEQ ID NO: 235710 - RNA, 22 nt, Human
ccuagacacccccuggggggaa

SEQ ID NO: 235711 - RNA, 22 nt, Human
ccuagacacccccuggggggaa

SEQ ID NO: 235712 - RNA, 24 nt, Human
ccucccacccccgcccgccacaaa

SEQ ID NO: 235713 - RNA, 24 nt, Human
ccucccacccccgcccgccacaaa

SEQ ID NO: 235714 - RNA, 27 nt, Human
ccucccgcggaggaaucuggugggggu

SEQ ID NO: 235715 - RNA, 24 nt, Human
ccuccuggcccagccuccagggag

SEQ ID NO: 235716 - RNA, 24 nt, Human
ccuccuggcccagccuccagggag

SEQ ID NO: 235717 - RNA, 21 nt, Human
ccucuguccagcugcuccagc

SEQ ID NO: 235718 - RNA, 19 nt, Human
ccuugcccagcaccucccc

SEQ ID NO: 235719 - RNA, 20 nt, Human
ccuugggggagaggcccggg

SEQ ID NO: 235720 - RNA, 23 nt, Human
cgaagucagccaccaccacauuc

SEQ ID NO: 235721 - RNA, 21 nt, Human
cgccgccggcccggggaggcg

SEQ ID NO: 235722 - RNA, 26 nt, Human
cggccagggcaccgcagcuccacggc

SEQ ID NO: 235723 - RNA, 20 nt, Human
cgggaaggggcucugagaug

SEQ ID NO: 235724 - RNA, 21 nt, Human
cgggaaggggcucugagauga

SEQ ID NO: 235725 - RNA, 21 nt, Human
cgggaaggggcucugagauga

SEQ ID NO: 235726 - RNA, 19 nt, Human
cggggcccggcggggcugg

SEQ ID NO: 235727 - RNA, 22 nt, Human
cggggggcaguuuggggggcag

SEQ ID NO: 235728 - RNA, 19 nt, Human
cucaacugaggcaaaguga

SEQ ID NO: 235729 - RNA, 19 nt, Human
cucaacugaggcaaaguga

SEQ ID NO: 235730 - RNA, 20 nt, Human
cucaagggacccccuucacc

SEQ ID NO: 235731 - RNA, 20 nt, Human
cucaagggacccccuucacc

SEQ ID NO: 235732 - RNA, 22 nt, Human
cucgccgcgccgguaggucucc

SEQ ID NO: 235733 - RNA, 21 nt, Human
cucugcuuuggggguuuggag

SEQ ID NO: 235734 - RNA, 21 nt, Human
cucugcuuuggggguuuggag

SEQ ID NO: 235735 - RNA, 21 nt, Human
cugcggccguugaucaucuca

SEQ ID NO: 235736 - RNA, 19 nt, Human
cuggaacuuggccucugcc

SEQ ID NO: 235737 - RNA, 19 nt, Human
cuggaacuuggccucugcc

SEQ ID NO: 235738 - RNA, 18 nt, Human
cuguugggauuguuuucc

SEQ ID NO: 235739 - RNA, 18 nt, Human
cuguugggauuguuuucc

SEQ ID NO: 235740 - RNA, 20 nt, Human
cuugcggucuggcuucuuga

SEQ ID NO: 235741 - RNA, 23 nt, Human
cuuggccucugcccugaugugcg

SEQ ID NO: 235742 - RNA, 23 nt, Human
cuuggccucugcccugaugugcg

SEQ ID NO: 235743 - RNA, 20 nt, Human
gaaaacgggccccagacucc

SEQ ID NO: 235744 - RNA, 20 nt, Human
gaaaacgggccccagacucc

SEQ ID NO: 235745 - RNA, 21 nt, Human
gaagcaagaggggacagcccu

SEQ ID NO: 235746 - RNA, 21 nt, Human
gaagcaagaggggacagcccu

SEQ ID NO: 235747 - RNA, 23 nt, Human
gaaggcaagucagggccuggcuc

SEQ ID NO: 235748 - RNA, 23 nt, Human
gaaggcaagucagggccuggcuc

SEQ ID NO: 235749 - RNA, 24 nt, Human
gacaaaauggcccucccacccccg

SEQ ID NO: 235750 - RNA, 24 nt, Human
gacaaaauggcccucccacccccg

SEQ ID NO: 235751 - RNA, 19 nt, Human
gacagcccugccaagacag

SEQ ID NO: 235752 - RNA, 19 nt, Human
gacagcccugccaagacag

SEQ ID NO: 235753 - RNA, 19 nt, Human
gacccccuucacccugagg

SEQ ID NO: 235754 - RNA, 19 nt, Human
gacccccuucacccugagg

SEQ ID NO: 235755 - RNA, 20 nt, Human
gaccuccgccccaugggauc

SEQ ID NO: 235756 - RNA, 20 nt, Human
gaccuccgccccaugggauc

SEQ ID NO: 235757 - RNA, 18 nt, Human
gauggggguggguggguc

SEQ ID NO: 235758 - RNA, 20 nt, Human
gccacaaaaauaaaauccca

SEQ ID NO: 235759 - RNA, 20 nt, Human
gccacaaaaauaaaauccca

SEQ ID NO: 235760 - RNA, 19 nt, Human
gccacggcagagagaaggc

SEQ ID NO: 235761 - RNA, 19 nt, Human
gccacggcagagagaaggc

SEQ ID NO: 235762 - RNA, 19 nt, Human
gcccagccuccagggagcu

SEQ ID NO: 235763 - RNA, 19 nt, Human
gcccagccuccagggagcu

SEQ ID NO: 235764 - RNA, 18 nt, Human
gccccggagcgugccgcc

SEQ ID NO: 235765 - RNA, 19 nt, Human
gcccggggaggcgggggcg

SEQ ID NO: 235766 - RNA, 18 nt, Human
gcccugaugugcgcccuc

SEQ ID NO: 235767 - RNA, 18 nt, Human
gcccugaugugcgcccuc

SEQ ID NO: 235768 - RNA, 20 nt, Human
gccggccagggcaccgcagc

SEQ ID NO: 235769 - RNA, 20 nt, Human
gccggccagggcaccgcagc

SEQ ID NO: 235770 - RNA, 21 nt, Human
gccuugggggagaggcccggg

SEQ ID NO: 235771 - RNA, 22 nt, Human
gcgcacggugauggggaagaag

SEQ ID NO: 235772 - RNA, 22 nt, Human
gcgggggcggagggcgcgggcc

SEQ ID NO: 235773 - RNA, 20 nt, Human
gcucggggggcaguuugggg

SEQ ID NO: 235774 - RNA, 20 nt, Human
gcucugaggagaagccuggg

SEQ ID NO: 235775 - RNA, 20 nt, Human
gcucugaggagaagccuggg

SEQ ID NO: 235776 - RNA, 23 nt, Human
gcugccuccuggcccagccucca

SEQ ID NO: 235777 - RNA, 23 nt, Human
gcugccuccuggcccagccucca

SEQ ID NO: 235778 - RNA, 22 nt, Human
ggacaccggcggggaaaccggc

SEQ ID NO: 235779 - RNA, 19 nt, Human
ggacccccuucacccugag

SEQ ID NO: 235780 - RNA, 19 nt, Human
ggacccccuucacccugag

SEQ ID NO: 235781 - RNA, 22 nt, Human
ggagaggcccgggaaggggcuc

SEQ ID NO: 235782 - RNA, 22 nt, Human
ggagaggcccgggaaggggcuc

SEQ ID NO: 235783 - RNA, 19 nt, Human
ggagccuugggggagaggc

SEQ ID NO: 235784 - RNA, 19 nt, Human
ggagccuugggggagaggc

SEQ ID NO: 235785 - RNA, 19 nt, Human
ggauggggguggguggguc

SEQ ID NO: 235786 - RNA, 23 nt, Human
ggcagcggcguguggaaaggggc

SEQ ID NO: 235787 - RNA, 23 nt, Human
ggcagcggcguguggaaaggggc

SEQ ID NO: 235788 - RNA, 23 nt, Human
ggcagggagccuugggggagagg

SEQ ID NO: 235789 - RNA, 25 nt, Human
ggccagggcaccgcagcuccacggc

SEQ ID NO: 235790 - RNA, 19 nt, Human
ggcccucccacccccgccc

SEQ ID NO: 235791 - RNA, 19 nt, Human
ggcccucccacccccgccc

SEQ ID NO: 235792 - RNA, 21 nt, Human
ggcucugaggagaagccuggg

SEQ ID NO: 235793 - RNA, 21 nt, Human
ggcucugaggagaagccuggg

SEQ ID NO: 235794 - RNA, 21 nt, Human
gggaagaagcucggggggcag

SEQ ID NO: 235795 - RNA, 24 nt, Human
gggcagcggcguguggaaaggggc

SEQ ID NO: 235796 - RNA, 24 nt, Human
gggcagcggcguguggaaaggggc

SEQ ID NO: 235797 - RNA, 26 nt, Human
gggcagggagccuugggggagaggcc

SEQ ID NO: 235798 - RNA, 21 nt, Human
gggcaguuuggggggcaguag

SEQ ID NO: 235799 - RNA, 21 nt, Human
gggccgggccgggggcgccuc

SEQ ID NO: 235800 - RNA, 22 nt, Human
gggccuggcucugaggagaagc

SEQ ID NO: 235801 - RNA, 22 nt, Human
gggccuggcucugaggagaagc

SEQ ID NO: 235802 - RNA, 23 nt, Human
ggggaagaagcucggggggcagu

SEQ ID NO: 235803 - RNA, 26 nt, Human
gggggagaggcccgggaaggggcucu

SEQ ID NO: 235804 - RNA, 26 nt, Human
gggggagaggcccgggaaggggcucu

SEQ ID NO: 235805 - RNA, 18 nt, Human
gggggcggggcccggcgg

SEQ ID NO: 235806 - RNA, 23 nt, Human
gggggcggggcccggcggggcug

SEQ ID NO: 235807 - RNA, 21 nt, Human
ggggugggugggucccaccuc

SEQ ID NO: 235808 - RNA, 21 nt, Human
ggggugggugggucccaccuc

SEQ ID NO: 235809 - RNA, 21 nt, Human
guccacggggugggagaaggc

SEQ ID NO: 235810 - RNA, 20 nt, Human
guccaggaauccucgcacgu

SEQ ID NO: 235811 - RNA, 23 nt, Human
gugcagcugggccggcucugggc

SEQ ID NO: 235812 - RNA, 23 nt, Human
gugcagcugggccggcucugggc

SEQ ID NO: 235813 - RNA, 18 nt, Human
guggagguaggccauccc

SEQ ID NO: 235814 - RNA, 25 nt, Human
uaaaaaauagauuacacagaaaaaa

SEQ ID NO: 235815 - RNA, 25 nt, Human
uaaaaaauagauuacacagaaaaaa

SEQ ID NO: 235816 - RNA, 20 nt, Human
uaaaaucccaagccccuggc

SEQ ID NO: 235817 - RNA, 21 nt, Human
uaagaaagaaacaaaaaaaag

SEQ ID NO: 235818 - RNA, 22 nt, Human
uaagaaagaaacaaaaaaaaga

SEQ ID NO: 235819 - RNA, 21 nt, Human
uacacagaaaaaacgcagagg

SEQ ID NO: 235820 - RNA, 21 nt, Human
uacacagaaaaaacgcagagg

SEQ ID NO: 235821 - RNA, 24 nt, Human
uauuuuauuguucugcgucugggu

SEQ ID NO: 235822 - RNA, 24 nt, Human
uauuuuauuguucugcgucugggu

SEQ ID NO: 235823 - RNA, 18 nt, Human
uccacggggugggagaag

SEQ ID NO: 235824 - RNA, 21 nt, Human
uccauggguacuggcugucca

SEQ ID NO: 235825 - RNA, 23 nt, Human
uccauggugcggggcagguaguc

SEQ ID NO: 235826 - RNA, 20 nt, Human
ucccaaaggagaacacauca

SEQ ID NO: 235827 - RNA, 21 nt, Human
ucccaagccccuggcagcugc

SEQ ID NO: 235828 - RNA, 21 nt, Human
ucccaagccccuggcagcugc

SEQ ID NO: 235829 - RNA, 22 nt, Human
ucccacgcacccaagcguuaua

SEQ ID NO: 235830 - RNA, 22 nt, Human
ucccacgcacccaagcguuaua

SEQ ID NO: 235831 - RNA, 18 nt, Human
ucccucaagggacccccu

SEQ ID NO: 235832 - RNA, 18 nt, Human
ucccucaagggacccccu

SEQ ID NO: 235833 - RNA, 25 nt, Human
ucccucaagggacccccuucacccu

SEQ ID NO: 235834 - RNA, 25 nt, Human
ucccucaagggacccccuucacccu

SEQ ID NO: 235835 - RNA, 19 nt, Human
uccgcaggcccucaggcug

SEQ ID NO: 235836 - RNA, 19 nt, Human
uccucgcacguugaggcca

SEQ ID NO: 235837 - RNA, 22 nt, Human
uccuuggacgucacgguuccug

SEQ ID NO: 235838 - RNA, 22 nt, Human
uccuuggacgucacgguuccug

SEQ ID NO: 235839 - RNA, 20 nt, Human
ucuccagagguggggacagg

SEQ ID NO: 235840 - RNA, 26 nt, Human
ucucccagaaaccucuguccagcugc

SEQ ID NO: 235841 - RNA, 18 nt, Human
ugacaaaauggcccuccc

SEQ ID NO: 235842 - RNA, 18 nt, Human
ugacaaaauggcccuccc

SEQ ID NO: 235843 - RNA, 20 nt, Human
ugaggagaagccuggguccc

SEQ ID NO: 235844 - RNA, 20 nt, Human
ugaggagaagccuggguccc

SEQ ID NO: 235845 - RNA, 22 nt, Human
ugaggagaagccugggucccca

SEQ ID NO: 235846 - RNA, 22 nt, Human
ugaggagaagccugggucccca

SEQ ID NO: 235847 - RNA, 23 nt, Human
ugaggagaagccuggguccccac

SEQ ID NO: 235848 - RNA, 23 nt, Human
ugaggagaagccuggguccccac

SEQ ID NO: 235849 - RNA, 25 nt, Human
ugaggaggggcagggagccuugggg

SEQ ID NO: 235850 - RNA, 25 nt, Human
ugaggaggggcagggagccuugggg

SEQ ID NO: 235851 - RNA, 21 nt, Human
ugaggccaaaguccauggugc

SEQ ID NO: 235852 - RNA, 21 nt, Human
ugagucuucucguccaccaug

SEQ ID NO: 235853 - RNA, 21 nt, Human
ugauguacucagugaugaagu

SEQ ID NO: 235854 - RNA, 26 nt, Human
ugcaaggagaagcaagaggggacagc

SEQ ID NO: 235855 - RNA, 19 nt, Human
ugcuggggcagcggcgugu

SEQ ID NO: 235856 - RNA, 19 nt, Human
ugcuggggcagcggcgugu

SEQ ID NO: 235857 - RNA, 21 nt, Human
uggaccagacagguggagcgu

SEQ ID NO: 235858 - RNA, 21 nt, Human
uggaccagacagguggagcgu

SEQ ID NO: 235859 - RNA, 19 nt, Human
uggagguaggccaucccuu

SEQ ID NO: 235860 - RNA, 19 nt, Human
uggcagcugcugcugcagg

SEQ ID NO: 235861 - RNA, 19 nt, Human
uggcagcugcugcugcagg

SEQ ID NO: 235862 - RNA, 20 nt, Human
uggcccucccacccccgccc

SEQ ID NO: 235863 - RNA, 20 nt, Human
uggcccucccacccccgccc

SEQ ID NO: 235864 - RNA, 19 nt, Human
uggcuguccaugcucuuga

SEQ ID NO: 235865 - RNA, 28 nt, Human
uggcuuuaagaaagaaacaaaaaaaaga

SEQ ID NO: 235866 - RNA, 18 nt, Human
ugggaucagcccucucuc

SEQ ID NO: 235867 - RNA, 18 nt, Human
ugggaucagcccucucuc

SEQ ID NO: 235868 - RNA, 19 nt, Human
uggggcagcggcgugugga

SEQ ID NO: 235869 - RNA, 19 nt, Human
uggggcagcggcgugugga

SEQ ID NO: 235870 - RNA, 21 nt, Human
ugggggugggugggucccacc

SEQ ID NO: 235871 - RNA, 21 nt, Human
ugggggugggugggucccacc

SEQ ID NO: 235872 - RNA, 23 nt, Human
ugucccagcugagggccaccucc

SEQ ID NO: 235873 - RNA, 23 nt, Human
ugucccagcugagggccaccucc

SEQ ID NO: 235874 - RNA, 22 nt, Human
uguugggauuguuuuccagguu

SEQ ID NO: 235875 - RNA, 22 nt, Human
uguugggauuguuuuccagguu

SEQ ID NO: 235876 - RNA, 19 nt, Human
uugcccagcaccuccccgu

SEQ ID NO: 235877 - RNA, 19 nt, Human
uuguagagcaccccgauga

SEQ ID NO: 235878 - RNA, 21 nt, Human
uuugcucagccacuggggacc

SEQ ID NO: 235879 - RNA, 21 nt, Human
uuugcucagccacuggggacc

SEQ ID NO: 235880 - RNA, 25 nt, Human
aaaacagaauggauauaaugaccuu

SEQ ID NO: 235881 - RNA, 27 nt, Human
aaacaaaagaccugggaaagaaaaaca

SEQ ID NO: 235882 - RNA, 20 nt, Human
aacaaaagaccugggaaaga

SEQ ID NO: 235883 - RNA, 24 nt, Human
aagaaaaacaaguguuuuacagaa

SEQ ID NO: 235884 - RNA, 23 nt, Human
aagcauuguacuguuagugcagc

SEQ ID NO: 235885 - RNA, 20 nt, Human
aaggacaugaaaacugcgua

SEQ ID NO: 235886 - RNA, 20 nt, Human
aauauggacuucccaacaua

SEQ ID NO: 235887 - RNA, 22 nt, Human
acauuuucacaugacauaauca

SEQ ID NO: 235888 - RNA, 22 nt, Human
agaaaaacaaguguuuuacaga

SEQ ID NO: 235889 - RNA, 21 nt, Human
agacaaauauggacuucccaa

SEQ ID NO: 235890 - RNA, 21 nt, Human
agacuuuaaaaguuacaaagu

SEQ ID NO: 235891 - RNA, 19 nt, Human
agagcucaugaauauagau

SEQ ID NO: 235892 - RNA, 20 nt, Human
agcgggcuccaagaguacau

SEQ ID NO: 235893 - RNA, 22 nt, Human
aggcaaggacaugaaaacugcg

SEQ ID NO: 235894 - RNA, 21 nt, Human
auaaaaaaacaaaagaccugg

SEQ ID NO: 235895 - RNA, 21 nt, Human
auuucauuuaaccugagcaau

SEQ ID NO: 235896 - RNA, 21 nt, Human
caaaaugaaucccugagcuga

SEQ ID NO: 235897 - RNA, 27 nt, Human
caaaaugaaucccugagcugaguuugc

SEQ ID NO: 235898 - RNA, 18 nt, Human
caagaaaagcagacaaaa

SEQ ID NO: 235899 - RNA, 18 nt, Human
cacagcucaaguccagcu

SEQ ID NO: 235900 - RNA, 22 nt, Human
cacuggcuuccuauuccagccc

SEQ ID NO: 235901 - RNA, 27 nt, Human
cagcccuaauuaaagaaaaaauagcua

SEQ ID NO: 235902 - RNA, 20 nt, Human
cagugcaauuuguuuuugaa

SEQ ID NO: 235903 - RNA, 20 nt, Human
cauccgaaaacaucacguuc

SEQ ID NO: 235904 - RNA, 20 nt, Human
caugacauaaucauugacuu

SEQ ID NO: 235905 - RNA, 18 nt, Human
ccggacaguauuguaagg

SEQ ID NO: 235906 - RNA, 24 nt, Human
cuauauuaaccauuaacaagcauu

SEQ ID NO: 235907 - RNA, 18 nt, Human
cuaugguugagacacugg

SEQ ID NO: 235908 - RNA, 22 nt, Human
cuuaagucagugacagauuuac

SEQ ID NO: 235909 - RNA, 18 nt, Human
cuuccuauuccagcccua

SEQ ID NO: 235910 - RNA, 23 nt, Human
gcugcaagaaaagcagacaaaua

SEQ ID NO: 235911 - RNA, 18 nt, Human
guuuuugaagacgccgga

SEQ ID NO: 235912 - RNA, 21 nt, Human
uaaaaaaacaaaagaccuggg

SEQ ID NO: 235913 - RNA, 28 nt, Human
uaaaaaaacaaaagaccugggaaagaaa

SEQ ID NO: 235914 - RNA, 22 nt, Human
uaaccugagcaauuaaaacgug

SEQ ID NO: 235915 - RNA, 25 nt, Human
uaacgacaguagcgggcuccaagag

SEQ ID NO: 235916 - RNA, 18 nt, Human
uaaggcaaggacaugaaa

SEQ ID NO: 235917 - RNA, 20 nt, Human
uaaggcaaggacaugaaaac

SEQ ID NO: 235918 - RNA, 19 nt, Human
uaauuauaucagaaaaaca

SEQ ID NO: 235919 - RNA, 23 nt, Human
uauaaaacuaagacacaaaauga

SEQ ID NO: 235920 - RNA, 18 nt, Human
uaugaagggcaaaaaguc

SEQ ID NO: 235921 - RNA, 27 nt, Human
ucaauaacgacaguagcgggcuccaag

SEQ ID NO: 235922 - RNA, 18 nt, Human
ucauuuaaccugagcaau

SEQ ID NO: 235923 - RNA, 21 nt, Human
ucccaacauagggacgugaag

SEQ ID NO: 235924 - RNA, 19 nt, Human
ucccugagcugaguuugca

SEQ ID NO: 235925 - RNA, 21 nt, Human
ucucaugggcaaccacggggc

SEQ ID NO: 235926 - RNA, 23 nt, Human
ucuggagcuguccugccgggccg

SEQ ID NO: 235927 - RNA, 18 nt, Human
ugaagggcaaaaagucaa

SEQ ID NO: 235928 - RNA, 18 nt, Human
ugacuaugcaccugcugc

SEQ ID NO: 235929 - RNA, 21 nt, Human
ugacuuggugguacacagcuc

SEQ ID NO: 235930 - RNA, 18 nt, Human
ugcaagaaaagcagacaa

SEQ ID NO: 235931 - RNA, 23 nt, Human
ugcaagaaaagcagacaaauaug

SEQ ID NO: 235932 - RNA, 20 nt, Human
ugcaauuuguuuuugaagac

SEQ ID NO: 235933 - RNA, 19 nt, Human
uguccugccgggccgcugu

SEQ ID NO: 235934 - RNA, 24 nt, Human
uuaaccauuaacaagcauuguacu

SEQ ID NO: 235935 - RNA, 22 nt, Human
uuacagaaaugaagcaaacaca

SEQ ID NO: 235936 - RNA, 18 nt, Human
uuacuuuguccuaugaag

SEQ ID NO: 235937 - RNA, 18 nt, Human
uuugggugaaaaugaaca

SEQ ID NO: 235938 - RNA, 23 nt, Human
aaaccaaaccgaccugcaaggga

SEQ ID NO: 235939 - RNA, 23 nt, Human
aggaauaggaggggacuaugugc

SEQ ID NO: 235940 - RNA, 22 nt, Human
cacagcccgcguccccuuccgc

SEQ ID NO: 235941 - RNA, 25 nt, Human
cacccccgacuuaaguaaggcacag

SEQ ID NO: 235942 - RNA, 24 nt, Human
cagcagcagcagcaaaaggcagcg

SEQ ID NO: 235943 - RNA, 21 nt, Human
cagcuuucgggcccccgcccc

SEQ ID NO: 235944 - RNA, 25 nt, Human
ccacccagcccucucucuucacaga

SEQ ID NO: 235945 - RNA, 23 nt, Human
ccacuaaguaaugaacucugugc

SEQ ID NO: 235946 - RNA, 20 nt, Human
ccaguccccgucccugcggc

SEQ ID NO: 235947 - RNA, 20 nt, Human
cccccgccccgcccccuugc

SEQ ID NO: 235948 - RNA, 26 nt, Human
cccccgccccgcccccuugccacccc

SEQ ID NO: 235949 - RNA, 26 nt, Human
ccccgccccgcccccuugccaccccc

SEQ ID NO: 235950 - RNA, 19 nt, Human
ccgcccccuugccaccccc

SEQ ID NO: 235951 - RNA, 24 nt, Human
ccgcccccuugccacccccgacuu

SEQ ID NO: 235952 - RNA, 27 nt, Human
ccgccccgcccccuugccacccccgac

SEQ ID NO: 235953 - RNA, 24 nt, Human
ccggugugugugcgcgucccccuc

SEQ ID NO: 235954 - RNA, 18 nt, Human
cgccccgcccccuugcca

SEQ ID NO: 235955 - RNA, 21 nt, Human
cuaaguaaugaacucugugcc

SEQ ID NO: 235956 - RNA, 21 nt, Human
cuagcaucacuggucuuccuu

SEQ ID NO: 235957 - RNA, 20 nt, Human
cucaugauggcacuuccucu

SEQ ID NO: 235958 - RNA, 20 nt, Human
cucucucuucacagaucucu

SEQ ID NO: 235959 - RNA, 19 nt, Human
gcagcagcagcagcaaaag

SEQ ID NO: 235960 - RNA, 19 nt, Human
gggcccccgccccgccccc

SEQ ID NO: 235961 - RNA, 23 nt, Human
gugcgcgucccccuccccguggc

SEQ ID NO: 235962 - RNA, 20 nt, Human
guucuauccuucugggcucc

SEQ ID NO: 235963 - RNA, 22 nt, Human
uaaugaacucugugccucuuuc

SEQ ID NO: 235964 - RNA, 22 nt, Human
uaggaggggacuaugugccuag

SEQ ID NO: 235965 - RNA, 21 nt, Human
uccagguucuauccuucuggg

SEQ ID NO: 235966 - RNA, 26 nt, Human
ucccacccagcccucucucuucacag

SEQ ID NO: 235967 - RNA, 24 nt, Human
uccccguggcgagggucucagcuu

SEQ ID NO: 235968 - RNA, 21 nt, Human
ucccucacgggagauauugau

SEQ ID NO: 235969 - RNA, 19 nt, Human
ucugggcucccacccagcc

SEQ ID NO: 235970 - RNA, 20 nt, Human
ucugggcucccacccagccc

SEQ ID NO: 235971 - RNA, 20 nt, Human
ucuuccagguucuauccuuc

SEQ ID NO: 235972 - RNA, 23 nt, Human
ucuuccagguucuauccuucugg

SEQ ID NO: 235973 - RNA, 19 nt, Human
ucuuccuuuuuaaggcagc

SEQ ID NO: 235974 - RNA, 24 nt, Human
ugggaggauuaggaauaggagggg

SEQ ID NO: 235975 - RNA, 19 nt, Human
ugggcucccacccagcccu

SEQ ID NO: 235976 - RNA, 22 nt, Human
ugugugugcgcgucccccuccc

SEQ ID NO: 235977 - RNA, 21 nt, Human
uucacuccauccuagcaucac

SEQ ID NO: 235978 - RNA, 26 nt, Human
aaaaaaaggaaaaauacucugcaaag

SEQ ID NO: 235979 - RNA, 22 nt, Human
aaaaggaaaaauacucugcaaa

SEQ ID NO: 235980 - RNA, 19 nt, Human
aacauggugaaaccccauc

SEQ ID NO: 235981 - RNA, 20 nt, Human
aacauggugaaaccccaucu

SEQ ID NO: 235982 - RNA, 20 nt, Human
aacauggugaaaccccaucu

SEQ ID NO: 235983 - RNA, 21 nt, Human
aacauggugaaaccccaucuc

SEQ ID NO: 235984 - RNA, 20 nt, Human
aagaaaaaaaaaaaaaagga

SEQ ID NO: 235985 - RNA, 19 nt, Human
acagagcaagacuccgucu

SEQ ID NO: 235986 - RNA, 25 nt, Human
acagagcaagacuccgucuuuaaga

SEQ ID NO: 235987 - RNA, 23 nt, Human
accccaucucuacuaaaaauaca

SEQ ID NO: 235988 - RNA, 24 nt, Human
acugcacuccagccugggcgacag

SEQ ID NO: 235989 - RNA, 26 nt, Human
acugcacuccagccugggcgacagag

SEQ ID NO: 235990 - RNA, 23 nt, Human
agaaaaaaaaaaaaaaggaaaaa

SEQ ID NO: 235991 - RNA, 23 nt, Human
agaagaauggcgggaacccagaa

SEQ ID NO: 235992 - RNA, 24 nt, Human
agagauggggccacugcacuccag

SEQ ID NO: 235993 - RNA, 19 nt, Human
agcacuccagcuccgagca

SEQ ID NO: 235994 - RNA, 24 nt, Human
agcaggcgugguucuauguuaagg

SEQ ID NO: 235995 - RNA, 24 nt, Human
agccugggcgacagagcaagacuc

SEQ ID NO: 235996 - RNA, 23 nt, Human
agcugggcgugguggugggcgcc

SEQ ID NO: 235997 - RNA, 22 nt, Human
aggcagaagaauggcgggaacc

SEQ ID NO: 235998 - RNA, 18 nt, Human
aggcagugggcccccagg

SEQ ID NO: 235999 - RNA, 20 nt, Human
aggcagugggcccccagggc

SEQ ID NO: 236000 - RNA, 22 nt, Human
aggcagugggcccccagggcag

SEQ ID NO: 236001 - RNA, 24 nt, Human
aggcggggcuugcagugagcagag

SEQ ID NO: 236002 - RNA, 19 nt, Human
agggggggagguggcacag

SEQ ID NO: 236003 - RNA, 20 nt, Human
agugggcccccagggcagcc

SEQ ID NO: 236004 - RNA, 24 nt, Human
auggggccacugcacuccagccug

SEQ ID NO: 236005 - RNA, 23 nt, Human
cacuccagccugggcgacagagc

SEQ ID NO: 236006 - RNA, 21 nt, Human
cacuccagcuccgagcagggc

SEQ ID NO: 236007 - RNA, 19 nt, Human
cacugcacuccagccuggg

SEQ ID NO: 236008 - RNA, 20 nt, Human
cacugcacuccagccugggc

SEQ ID NO: 236009 - RNA, 22 nt, Human
cacugcacuccagccugggcga

SEQ ID NO: 236010 - RNA, 23 nt, Human
cacugcacuccagccugggcgac

SEQ ID NO: 236011 - RNA, 24 nt, Human
cacugcacuccagccugggcgaca

SEQ ID NO: 236012 - RNA, 27 nt, Human
cacugcacuccagccugggcgacagag

SEQ ID NO: 236013 - RNA, 25 nt, Human
cagaaaaaauuagcugggcguggug

SEQ ID NO: 236014 - RNA, 24 nt, Human
cagagcaagacuccgucuuuaaga

SEQ ID NO: 236015 - RNA, 24 nt, Human
cagcuacuugggaggcugaggcag

SEQ ID NO: 236016 - RNA, 19 nt, Human
caggcccacacccuggggc

SEQ ID NO: 236017 - RNA, 20 nt, Human
cagggcccagggucaggcgg

SEQ ID NO: 236018 - RNA, 20 nt, Human
caggucccaggcccacaccc

SEQ ID NO: 236019 - RNA, 22 nt, Human
ccaccuguccucuucccuaggc

SEQ ID NO: 236020 - RNA, 20 nt, Human
ccacugcacuccagccuggg

SEQ ID NO: 236021 - RNA, 21 nt, Human
ccacugcacuccagccugggc

SEQ ID NO: 236022 - RNA, 21 nt, Human
ccacugcacuccagccugggc

SEQ ID NO: 236023 - RNA, 24 nt, Human
ccacugcacuccagccugggcgac

SEQ ID NO: 236024 - RNA, 20 nt, Human
cccaccuguccucuucccua

SEQ ID NO: 236025 - RNA, 20 nt, Human
ccccaccuguccucuucccu

SEQ ID NO: 236026 - RNA, 21 nt, Human
ccccagggcagccaaaugccu

SEQ ID NO: 236027 - RNA, 23 nt, Human
ccccagggcagccaaaugccugc

SEQ ID NO: 236028 - RNA, 22 nt, Human
ccuggcuaacauggugaaaccc

SEQ ID NO: 236029 - RNA, 23 nt, Human
ccuggcuaacauggugaaacccc

SEQ ID NO: 236030 - RNA, 24 nt, Human
ccuggcuaacauggugaaacccca

SEQ ID NO: 236031 - RNA, 22 nt, Human
ccugggcgacagagcaagacuc

SEQ ID NO: 236032 - RNA, 21 nt, Human
ccuguagucccagcuacuugg

SEQ ID NO: 236033 - RNA, 24 nt, Human
cgagaccauccuggcuaacauggu

SEQ ID NO: 236034 - RNA, 23 nt, Human
cgccuguagucccagcuacuugg

SEQ ID NO: 236035 - RNA, 24 nt, Human
cgccuguagucccagcuacuuggg

SEQ ID NO: 236036 - RNA, 18 nt, Human
cuacuaaaaauacagaaa

SEQ ID NO: 236037 - RNA, 23 nt, Human
cuggcuaacauggugaaacccca

SEQ ID NO: 236038 - RNA, 18 nt, Human
gaacccagaaggcggggc

SEQ ID NO: 236039 - RNA, 24 nt, Human
gcacuccagccugggcgacagagc

SEQ ID NO: 236040 - RNA, 22 nt, Human
gcacuccagcuccgagcagggc

SEQ ID NO: 236041 - RNA, 22 nt, Human
gcagaagaauggcgggaaccca

SEQ ID NO: 236042 - RNA, 22 nt, Human
gccacugcacuccagccugggc

SEQ ID NO: 236043 - RNA, 24 nt, Human
gccacugcacuccagccugggcga

SEQ ID NO: 236044 - RNA, 23 nt, Human
gcccaggucccaggcccacaccc

SEQ ID NO: 236045 - RNA, 23 nt, Human
gccuguagucccagcuacuuggg

SEQ ID NO: 236046 - RNA, 24 nt, Human
gcuaacauggugaaaccccaucuc

SEQ ID NO: 236047 - RNA, 20 nt, Human
ggccaggcaggugccaggga

SEQ ID NO: 236048 - RNA, 22 nt, Human
ggcgugguggugggcgccugua

SEQ ID NO: 236049 - RNA, 18 nt, Human
gggcccagggucaggcgg

SEQ ID NO: 236050 - RNA, 18 nt, Human
ggggcuugcagugagcag

SEQ ID NO: 236051 - RNA, 24 nt, Human
ggggcuugcagugagcagagaugg

SEQ ID NO: 236052 - RNA, 24 nt, Human
gguggugggcgccuguagucccag

SEQ ID NO: 236053 - RNA, 23 nt, Human
gugagggggaaggauggugugug

SEQ ID NO: 236054 - RNA, 24 nt, Human
uaaaaauacagaaaaaauuagcug

SEQ ID NO: 236055 - RNA, 22 nt, Human
uaacauggugaaaccccaucuc

SEQ ID NO: 236056 - RNA, 24 nt, Human
uaacauggugaaaccccaucucua

SEQ ID NO: 236057 - RNA, 21 nt, Human
uaagaaaaaaaaaaaaaagga

SEQ ID NO: 236058 - RNA, 21 nt, Human
ucaggcgggacaggacagcag

SEQ ID NO: 236059 - RNA, 24 nt, Human
uccagccugggcgacagagcaaga

SEQ ID NO: 236060 - RNA, 22 nt, Human
ucucuacuaaaaauacagaaaa

SEQ ID NO: 236061 - RNA, 19 nt, Human
ugaaaccccaucucuacua

SEQ ID NO: 236062 - RNA, 24 nt, Human
ugaggcagaagaauggcgggaacc

SEQ ID NO: 236063 - RNA, 25 nt, Human
ugaggcagaagaauggcgggaaccc

SEQ ID NO: 236064 - RNA, 18 nt, Human
ugcagugagcagagaugg

SEQ ID NO: 236065 - RNA, 24 nt, Human
ugggaggcugaggcagaagaaugg

SEQ ID NO: 236066 - RNA, 27 nt, Human
ugggaggcugaggcagaagaauggcgg

SEQ ID NO: 236067 - RNA, 24 nt, Human
ugguggugggcgccuguaguccca

SEQ ID NO: 236068 - RNA, 22 nt, Human
uguggagggggggagguggcac

SEQ ID NO: 236069 - RNA, 20 nt, Human
uguuaaggggccaggcaggu

SEQ ID NO: 236070 - RNA, 18 nt, Human
uuagcugggcgugguggu

SEQ ID NO: 236071 - RNA, 22 nt, Human
uuagcugggcgugguggugggc

SEQ ID NO: 236072 - RNA, 24 nt, Human
uuagcugggcgugguggugggcgc

SEQ ID NO: 236073 - RNA, 22 nt, Human
uucccuaggcagugggccccca

SEQ ID NO: 236074 - RNA, 18 nt, Human
uugcagugagcagagaug

SEQ ID NO: 236075 - RNA, 25 nt, Human
uugcagugagcagagauggggccac

SEQ ID NO: 236076 - RNA, 18 nt, Human
uugggaggcugaggcaga

SEQ ID NO: 236077 - RNA, 25 nt, Human
uuuaagaaaaaaaaaaaaaaggaaa

SEQ ID NO: 236078 - RNA, 21 nt, Human
aaagauuaguuggggcuuugc

SEQ ID NO: 236079 - RNA, 22 nt, Human
aacagguaauauuagcaccaug

SEQ ID NO: 236080 - RNA, 20 nt, Human
auauaccuguugguauaaga

SEQ ID NO: 236081 - RNA, 19 nt, Human
cauuuuaaaauggaguuau

SEQ ID NO: 236082 - RNA, 19 nt, Human
uagcaccaugaaaacaggu

SEQ ID NO: 236083 - RNA, 19 nt, Human
uagcagugggagaacaggu

SEQ ID NO: 236084 - RNA, 24 nt, Human
uagcagugggagaacagguaauau

SEQ ID NO: 236085 - RNA, 23 nt, Human
ugucauuagcagugggagaacag

SEQ ID NO: 236086 - RNA, 21 nt, Human
uugcucauuuuaaaauggagu

SEQ ID NO: 236087 - RNA, 23 nt, Human
uuugcucauuuuaaaauggaguu

SEQ ID NO: 236088 - RNA, 26 nt, Human
aaaacuccuuccagucugaggcacuc

SEQ ID NO: 236089 - RNA, 24 nt, Human
aaaauaccuauaaaagccauucuc

SEQ ID NO: 236090 - RNA, 22 nt, Human
aagcucucagacaaaauauucu

SEQ ID NO: 236091 - RNA, 20 nt, Human
aaugaagaaacauucaagaa

SEQ ID NO: 236092 - RNA, 21 nt, Human
accugcaauauuggagacuua

SEQ ID NO: 236093 - RNA, 23 nt, Human
aggggguaacauucauauccagg

SEQ ID NO: 236094 - RNA, 22 nt, Human
agggguugcccccacuuuauuu

SEQ ID NO: 236095 - RNA, 18 nt, Human
caagugcuucacaauguc

SEQ ID NO: 236096 - RNA, 18 nt, Human
caauguuuaaacaguuau

SEQ ID NO: 236097 - RNA, 24 nt, Human
cagcuauauuuuccuccaaaauuu

SEQ ID NO: 236098 - RNA, 22 nt, Human
caggcaaaauaccuauaaaagc

SEQ ID NO: 236099 - RNA, 22 nt, Human
cagggguugcccccacuuuauu

SEQ ID NO: 236100 - RNA, 26 nt, Human
ccacccacaagguuuuuuaggcaaaa

SEQ ID NO: 236101 - RNA, 21 nt, Human
ccagaaguaugcacaaagaca

SEQ ID NO: 236102 - RNA, 23 nt, Human
ccaggccuuugauuaggaagucu

SEQ ID NO: 236103 - RNA, 20 nt, Human
cccagccagcaugaaguaac

SEQ ID NO: 236104 - RNA, 21 nt, Human
ccccauuggaaugaagaaaca

SEQ ID NO: 236105 - RNA, 27 nt, Human
ccuccaaaauuuccuuuaaaagugaag

SEQ ID NO: 236106 - RNA, 22 nt, Human
ccucuaaaaaagacuuugguua

SEQ ID NO: 236107 - RNA, 20 nt, Human
ccucuacuacagccuccuug

SEQ ID NO: 236108 - RNA, 18 nt, Human
cuguuuuucaaauuuugc

SEQ ID NO: 236109 - RNA, 25 nt, Human
cuuaaaauguuauuuacagacuguu

SEQ ID NO: 236110 - RNA, 20 nt, Human
gggaaaccugcaauauugga

SEQ ID NO: 236111 - RNA, 22 nt, Human
uaaaaggaaacaauuagaagua

SEQ ID NO: 236112 - RNA, 18 nt, Human
uaacaagugcuucacaau

SEQ ID NO: 236113 - RNA, 24 nt, Human
uaaccccagccagcaugaaguaac

SEQ ID NO: 236114 - RNA, 23 nt, Human
uaagaugaaaggacugcaggccc

SEQ ID NO: 236115 - RNA, 19 nt, Human
uaccagauccuuaaagcuc

SEQ ID NO: 236116 - RNA, 23 nt, Human
uagacagauuuacauacugugaa

SEQ ID NO: 236117 - RNA, 20 nt, Human
uaggcaaaaagcagcuauau

SEQ ID NO: 236118 - RNA, 18 nt, Human
uauaaaagccauucucag

SEQ ID NO: 236119 - RNA, 23 nt, Human
uaugcacaaagacauaaaaacuc

SEQ ID NO: 236120 - RNA, 18 nt, Human
ucacugaaauuuagacag

SEQ ID NO: 236121 - RNA, 21 nt, Human
uccaaaauuuccuuuaaaagu

SEQ ID NO: 236122 - RNA, 19 nt, Human
ucccucaaaacgacaucau

SEQ ID NO: 236123 - RNA, 19 nt, Human
ugaacagaauuaaauuugc

SEQ ID NO: 236124 - RNA, 22 nt, Human
ugaacagaauuaaauuugcauc

SEQ ID NO: 236125 - RNA, 22 nt, Human
ugaaugaauacauuaccaggca

SEQ ID NO: 236126 - RNA, 19 nt, Human
ugaccagaaauucacugaa

SEQ ID NO: 236127 - RNA, 22 nt, Human
ugcacaaagacauaaaaacucc

SEQ ID NO: 236128 - RNA, 23 nt, Human
ugcaucauacugaccagaaauuc

SEQ ID NO: 236129 - RNA, 20 nt, Human
ugcucagaggcugcaucaua

SEQ ID NO: 236130 - RNA, 18 nt, Human
ugggaggcaugagggcaa

SEQ ID NO: 236131 - RNA, 19 nt, Human
uguaaaccagaauguagug

SEQ ID NO: 236132 - RNA, 21 nt, Human
ugugguugucuuugcuuuaag

SEQ ID NO: 236133 - RNA, 22 nt, Human
uuccuccaaaauuuccuuuaaa

SEQ ID NO: 236134 - RNA, 23 nt, Human
uuucaagguuaaguuuacuaaca

SEQ ID NO: 236135 - RNA, 19 nt, Human
uuugugaauuuaaauccuc

SEQ ID NO: 236136 - RNA, 22 nt, Human
aaaaaagcacgcacauucuaca

SEQ ID NO: 236137 - RNA, 21 nt, Human
aaaagcacgcacauucuacag

SEQ ID NO: 236138 - RNA, 20 nt, Human
aaggaacuccauccuaagac

SEQ ID NO: 236139 - RNA, 24 nt, Human
acaucggacccuuaggauggucuc

SEQ ID NO: 236140 - RNA, 20 nt, Human
accaccacccaaccuagaau

SEQ ID NO: 236141 - RNA, 27 nt, Human
acccucaaggaucuaccaccacccaac

SEQ ID NO: 236142 - RNA, 25 nt, Human
agaaagaaaaggaacuccauccuaa

SEQ ID NO: 236143 - RNA, 20 nt, Human
auauaucuauauauaucuca

SEQ ID NO: 236144 - RNA, 24 nt, Human
auccuguggauucuggcugugggu

SEQ ID NO: 236145 - RNA, 20 nt, Human
auugcauucuggaaaacucc

SEQ ID NO: 236146 - RNA, 23 nt, Human
caaaaaagcacgcacauucuaca

SEQ ID NO: 236147 - RNA, 23 nt, Human
caaauuccacuugaaaaagaggc

SEQ ID NO: 236148 - RNA, 22 nt, Human
caacagaaagaaaaggaacucc

SEQ ID NO: 236149 - RNA, 24 nt, Human
caacagaaagaaaaggaacuccau

SEQ ID NO: 236150 - RNA, 20 nt, Human
cagaacgccauuugugucuu

SEQ ID NO: 236151 - RNA, 24 nt, Human
caggcagaggcgcgagggcgcgca

SEQ ID NO: 236152 - RNA, 21 nt, Human
ccagccugcuccuggaggagc

SEQ ID NO: 236153 - RNA, 22 nt, Human
ccucaaggaucuaccaccaccc

SEQ ID NO: 236154 - RNA, 25 nt, Human
ccucaaggaucuaccaccacccaac

SEQ ID NO: 236155 - RNA, 20 nt, Human
gaaaaagaggcaacaagcga

SEQ ID NO: 236156 - RNA, 22 nt, Human
gagcuccuguguccacaaaaaa

SEQ ID NO: 236157 - RNA, 19 nt, Human
ggccugggagggagcucug

SEQ ID NO: 236158 - RNA, 23 nt, Human
ucaaggaucuaccaccacccaac

SEQ ID NO: 236159 - RNA, 23 nt, Human
ucccagccugcuccuggaggagc

SEQ ID NO: 236160 - RNA, 22 nt, Human
uccuguggauucuggcuguggg

SEQ ID NO: 236161 - RNA, 21 nt, Human
ucggcacaccuggcucuccuu

SEQ ID NO: 236162 - RNA, 18 nt, Human
ucuccuucucggugggau

SEQ ID NO: 236163 - RNA, 25 nt, Human
ucuggaaaacuccucccagaguccu

SEQ ID NO: 236164 - RNA, 19 nt, Human
uggaaaacuccucccagag

SEQ ID NO: 236165 - RNA, 19 nt, Human
ugggaucccagccugcucc

SEQ ID NO: 236166 - RNA, 21 nt, Human
ugggauccuguggauucuggc

SEQ ID NO: 236167 - RNA, 22 nt, Human
ugggauccuguggauucuggcu

SEQ ID NO: 236168 - RNA, 24 nt, Human
ugggauccuguggauucuggcugu

SEQ ID NO: 236169 - RNA, 22 nt, Human
uucuacagcuaugcgauuugcu

SEQ ID NO: 236170 - RNA, 21 nt, Human
uucuuagaauauuuuugguuu

SEQ ID NO: 236171 - RNA, 21 nt, Human
uuguagcugggaaacaacaac

SEQ ID NO: 236172 - RNA, 24 nt, Human
uuuaucaugccaaaaaaaguuguu

SEQ ID NO: 236173 - RNA, 22 nt, Human
uuuuugguuuugaaacuacuga

SEQ ID NO: 236174 - RNA, 18 nt, Human
uuuuuuuuuuuuuuuuug

SEQ ID NO: 236175 - RNA, 23 nt, Human
uuuuuuuuuuuuuuuuuggaauu

SEQ ID NO: 236176 - RNA, 22 nt, Human
agucggagugcgccggccggcu

SEQ ID NO: 236177 - RNA, 27 nt, Human
cccccaggccuggcuggguggccccag

SEQ ID NO: 236178 - RNA, 18 nt, Human
cccggaaagggcgcgggg

SEQ ID NO: 236179 - RNA, 18 nt, Human
cggagucggagugcgccg

SEQ ID NO: 236180 - RNA, 21 nt, Human
gagugcgccggccggcuggcu

SEQ ID NO: 236181 - RNA, 21 nt, Human
gcacggggaggcuggggagag

SEQ ID NO: 236182 - RNA, 22 nt, Human
gcuugcuccuggcaggcguggg

SEQ ID NO: 236183 - RNA, 21 nt, Human
ggaaagggcgcggggcucggg

SEQ ID NO: 236184 - RNA, 19 nt, Human
ucggaccucgggaucuggg

SEQ ID NO: 236185 - RNA, 20 nt, Human
ucggaccucgggaucugggu

SEQ ID NO: 236186 - RNA, 19 nt, Human
ucgggaucuggguuggcug

SEQ ID NO: 236187 - RNA, 26 nt, Human
ugcccccaggccuggcuggguggccc

SEQ ID NO: 236188 - RNA, 21 nt, Human
uggggaucugggccgggcgcu

SEQ ID NO: 236189 - RNA, 19 nt, Human
ugguguaggugcggcuccc

SEQ ID NO: 236190 - RNA, 30 nt, Human
aaaaaaagaaaaaacacacauacaaaaaag

SEQ ID NO: 236191 - RNA, 19 nt, Human
aaaaaacacaacgaaugca

SEQ ID NO: 236192 - RNA, 22 nt, Human
aaaaacacaacgaaugcauuuu

SEQ ID NO: 236193 - RNA, 19 nt, Human
aaaaugcuuuuccccuccc

SEQ ID NO: 236194 - RNA, 24 nt, Human
aaacccuucccucccuccaccucc

SEQ ID NO: 236195 - RNA, 24 nt, Human
aacacacauacaaaaaaagucaaa

SEQ ID NO: 236196 - RNA, 18 nt, Human
aacccuucccucccucca

SEQ ID NO: 236197 - RNA, 23 nt, Human
aagaaaaaacacacauacaaaaa

SEQ ID NO: 236198 - RNA, 22 nt, Human
aagaaguaaccauaaaaccaag

SEQ ID NO: 236199 - RNA, 23 nt, Human
aaguaaccauaaaaccaaguuuu

SEQ ID NO: 236200 - RNA, 21 nt, Human
aagucaaaaaauuugaggaac

SEQ ID NO: 236201 - RNA, 23 nt, Human
aaguuacacuaucuuaaaaaaca

SEQ ID NO: 236202 - RNA, 18 nt, Human
acacuaucuuaaaaaaca

SEQ ID NO: 236203 - RNA, 19 nt, Human
acccuucccucccuccacc

SEQ ID NO: 236204 - RNA, 21 nt, Human
acuuucagugucaaaaaggaa

SEQ ID NO: 236205 - RNA, 24 nt, Human
agaaacccuucccucccuccaccu

SEQ ID NO: 236206 - RNA, 25 nt, Human
agaaacccuucccucccuccaccuc

SEQ ID NO: 236207 - RNA, 20 nt, Human
aggccaucagauuugcagcu

SEQ ID NO: 236208 - RNA, 26 nt, Human
aggccaucagauuugcagcuuaaaaa

SEQ ID NO: 236209 - RNA, 20 nt, Human
auaaaaauauucugugcuuc

SEQ ID NO: 236210 - RNA, 19 nt, Human
augcauuuuaauagagaaa

SEQ ID NO: 236211 - RNA, 24 nt, Human
auugccuucuuacaaaauuucuau

SEQ ID NO: 236212 - RNA, 25 nt, Human
caaaaaaagucaaaaaauuugagga

SEQ ID NO: 236213 - RNA, 22 nt, Human
cacccuccucaugaauuaagaa

SEQ ID NO: 236214 - RNA, 24 nt, Human
cccacccuccucaugaauuaagaa

SEQ ID NO: 236215 - RNA, 18 nt, Human
ccccucccucacagcacc

SEQ ID NO: 236216 - RNA, 27 nt, Human
cccuccccuccucauaagaacuuaaaa

SEQ ID NO: 236217 - RNA, 25 nt, Human
cccucccuccaccucccucccccaa

SEQ ID NO: 236218 - RNA, 27 nt, Human
cccucccuccaccucccucccccaccc

SEQ ID NO: 236219 - RNA, 21 nt, Human
cccuccucauaagaacuuaaa

SEQ ID NO: 236220 - RNA, 21 nt, Human
ccuccucaugaauuaagaauc

SEQ ID NO: 236221 - RNA, 20 nt, Human
cucccuccaccucccucccc

SEQ ID NO: 236222 - RNA, 20 nt, Human
gaaacccuucccucccucca

SEQ ID NO: 236223 - RNA, 24 nt, Human
uaagaacuuaaaaaaaaagaaaaa

SEQ ID NO: 236224 - RNA, 19 nt, Human
uaagagaagaaguaaccau

SEQ ID NO: 236225 - RNA, 23 nt, Human
uaagagaagaaguaaccauaaaa

SEQ ID NO: 236226 - RNA, 22 nt, Human
uagagaaacccuucccucccuc

SEQ ID NO: 236227 - RNA, 21 nt, Human
uagcagagaauaaugaagaga

SEQ ID NO: 236228 - RNA, 24 nt, Human
uauaaaaauauucugugcuucuga

SEQ ID NO: 236229 - RNA, 25 nt, Human
uauugccuucuuacaaaauuucuau

SEQ ID NO: 236230 - RNA, 19 nt, Human
ucaaaaaauuugaggaacc

SEQ ID NO: 236231 - RNA, 21 nt, Human
ugaaaaaugcuuuuccccucc

SEQ ID NO: 236232 - RNA, 22 nt, Human
ugaaaaaugcuuuuccccuccc

SEQ ID NO: 236233 - RNA, 21 nt, Human
ugaauuaagaaucuaagagaa

SEQ ID NO: 236234 - RNA, 19 nt, Human
ugagaaggcucugcacugu

SEQ ID NO: 236235 - RNA, 19 nt, Human
uggaauccaucauccagag

SEQ ID NO: 236236 - RNA, 25 nt, Human
ugguuuauuuacccuccccuccuca

SEQ ID NO: 236237 - RNA, 18 nt, Human
uguauggacaugauuucu

SEQ ID NO: 236238 - RNA, 21 nt, Human
uguauggacaugauuucuuuu

SEQ ID NO: 236239 - RNA, 24 nt, Human
uuacccuccccuccucauaagaac

SEQ ID NO: 236240 - RNA, 18 nt, Human
uucugugcuucugagaag

SEQ ID NO: 236241 - RNA, 20 nt, Human
uuugcagcuuaaaaauucac

SEQ ID NO: 236242 - RNA, 20 nt, Human
uuuguggaauccaucaucca

SEQ ID NO: 236243 - RNA, 18 nt, Human
aauggcucaauuugccca

SEQ ID NO: 236244 - RNA, 20 nt, Human
agagaagggggaaaagagga

SEQ ID NO: 236245 - RNA, 19 nt, Human
agagaugggggaaucucgu

SEQ ID NO: 236246 - RNA, 21 nt, Human
aggcaggugggcaggcgggca

SEQ ID NO: 236247 - RNA, 18 nt, Human
aggcucggccgggagaag

SEQ ID NO: 236248 - RNA, 19 nt, Human
agggagagggagagagaag

SEQ ID NO: 236249 - RNA, 22 nt, Human
caccuucuaaauggcucaauuu

SEQ ID NO: 236250 - RNA, 21 nt, Human
cacugguagaguggcuggcug

SEQ ID NO: 236251 - RNA, 19 nt, Human
cagauacaaaagcagucuc

SEQ ID NO: 236252 - RNA, 20 nt, Human
caggcgggcagauggacaga

SEQ ID NO: 236253 - RNA, 22 nt, Human
cauuacauuucucauaaaauaa

SEQ ID NO: 236254 - RNA, 18 nt, Human
ccuacuuuugugccuccg

SEQ ID NO: 236255 - RNA, 19 nt, Human
ccuagauugcacucagcua

SEQ ID NO: 236256 - RNA, 19 nt, Human
ccuggccccaggagggguc

SEQ ID NO: 236257 - RNA, 21 nt, Human
ccuggccccaggaggggucac

SEQ ID NO: 236258 - RNA, 23 nt, Human
cgacucggggcgcgcuuuggcgg

SEQ ID NO: 236259 - RNA, 21 nt, Human
cggagaaguucuaauguggca

SEQ ID NO: 236260 - RNA, 21 nt, Human
gagggagagggagagagaagg

SEQ ID NO: 236261 - RNA, 19 nt, Human
gccaggcaggugggcaggc

SEQ ID NO: 236262 - RNA, 21 nt, Human
gcgcuuuggcggggcggccgg

SEQ ID NO: 236263 - RNA, 18 nt, Human
ggagaagggcgccgacuc

SEQ ID NO: 236264 - RNA, 20 nt, Human
ggagaaguucuaauguggca

SEQ ID NO: 236265 - RNA, 18 nt, Human
ggaggccaggcgccgggc

SEQ ID NO: 236266 - RNA, 20 nt, Human
ggccaggcaggugggcaggc

SEQ ID NO: 236267 - RNA, 18 nt, Human
ggccgggagaagggcgcc

SEQ ID NO: 236268 - RNA, 21 nt, Human
ggcgccgacucggggcgcgcu

SEQ ID NO: 236269 - RNA, 20 nt, Human
gggcaggcgggcagauggac

SEQ ID NO: 236270 - RNA, 18 nt, Human
guggaggaggaagggcca

SEQ ID NO: 236271 - RNA, 25 nt, Human
uggcaacgacacagcuuucagccuc

SEQ ID NO: 236272 - RNA, 21 nt, Human
uguaauugcauuugauagcuc

SEQ ID NO: 236273 - RNA, 20 nt, Human
uuauauucaaagagaugggg

SEQ ID NO: 236274 - RNA, 20 nt, Human
uucaaagagaugggggaauc

SEQ ID NO: 236275 - RNA, 19 nt, Human
uucgcagauacaaaagcag

SEQ ID NO: 236276 - RNA, 23 nt, Human
uucucauaaaauaaauguuccca

SEQ ID NO: 236277 - RNA, 21 nt, Human
uuggcggggcggccgguccuc

SEQ ID NO: 236278 - RNA, 24 nt, Human
aaacaggggaguuaaaaagccagg

SEQ ID NO: 236279 - RNA, 21 nt, Human
aaagaugcccggggacucggg

SEQ ID NO: 236280 - RNA, 22 nt, Human
aagaaaaaaagaauggccacuc

SEQ ID NO: 236281 - RNA, 20 nt, Human
aagaaaucccuuaccccacc

SEQ ID NO: 236282 - RNA, 21 nt, Human
aagggggccaagaaaaaaaga

SEQ ID NO: 236283 - RNA, 20 nt, Human
aaggugucuaaaaacaguga

SEQ ID NO: 236284 - RNA, 26 nt, Human
aagugucagccccugaauuaugccac

SEQ ID NO: 236285 - RNA, 23 nt, Human
aaucccuuaccccacccucaaac

SEQ ID NO: 236286 - RNA, 20 nt, Human
aaucuguggaacuccucccc

SEQ ID NO: 236287 - RNA, 21 nt, Human
accccacccucaaacccccaa

SEQ ID NO: 236288 - RNA, 18 nt, Human
acucagacccucauccuc

SEQ ID NO: 236289 - RNA, 19 nt, Human
agacgaagaugccauggag

SEQ ID NO: 236290 - RNA, 19 nt, Human
aggaagaaaagaaaucaau

SEQ ID NO: 236291 - RNA, 23 nt, Human
agggggcggcggccuaggggcgg

SEQ ID NO: 236292 - RNA, 18 nt, Human
agugauugaaacagggga

SEQ ID NO: 236293 - RNA, 19 nt, Human
auggagacggcgucuucag

SEQ ID NO: 236294 - RNA, 23 nt, Human
caaacccccaaagugccuaagag

SEQ ID NO: 236295 - RNA, 21 nt, Human
caccgcgcucccuuccauccc

SEQ ID NO: 236296 - RNA, 19 nt, Human
cacgacaaauacuuugaua

SEQ ID NO: 236297 - RNA, 22 nt, Human
cagcauugcuuuaaauaauugu

SEQ ID NO: 236298 - RNA, 21 nt, Human
caggacccaaauccuaacuca

SEQ ID NO: 236299 - RNA, 27 nt, Human
caggacccaaauccuaacucagacccu

SEQ ID NO: 236300 - RNA, 22 nt, Human
cagugaacaccuccccaaagau

SEQ ID NO: 236301 - RNA, 23 nt, Human
ccccaaagaugcccggggacucu

SEQ ID NO: 236302 - RNA, 22 nt, Human
ccccaaagugccuaagagugaa

SEQ ID NO: 236303 - RNA, 18 nt, Human
ccccgggucgcggcgccc

SEQ ID NO: 236304 - RNA, 19 nt, Human
cccucauccuccuacucag

SEQ ID NO: 236305 - RNA, 23 nt, Human
ccgcccggccgcccggagccccc

SEQ ID NO: 236306 - RNA, 19 nt, Human
ccgccgccgccaccgcccg

SEQ ID NO: 236307 - RNA, 21 nt, Human
ccgccgccgccaccgcccggu

SEQ ID NO: 236308 - RNA, 18 nt, Human
ccgccgccgccgccgccg

SEQ ID NO: 236309 - RNA, 24 nt, Human
ccgccgccgccgccgccgucgccg

SEQ ID NO: 236310 - RNA, 18 nt, Human
ccgccgccgccgccgucg

SEQ ID NO: 236311 - RNA, 24 nt, Human
ccgccgccgccgccgucgccgccg

SEQ ID NO: 236312 - RNA, 25 nt, Human
ccgccgccgccgccgucgccgccgc

SEQ ID NO: 236313 - RNA, 27 nt, Human
ccgccgccgccgccgucgccgccgcuc

SEQ ID NO: 236314 - RNA, 21 nt, Human
ccgccgccgccgucgccgccg

SEQ ID NO: 236315 - RNA, 18 nt, Human
ccgccgucgccgccgcuc

SEQ ID NO: 236316 - RNA, 20 nt, Human
ccggccccgggucgcggcgc

SEQ ID NO: 236317 - RNA, 18 nt, Human
ccggcgagcucgccccuc

SEQ ID NO: 236318 - RNA, 22 nt, Human
ccggggcucggacccccucggg

SEQ ID NO: 236319 - RNA, 23 nt, Human
ccgucgccgccgcuccugccucc

SEQ ID NO: 236320 - RNA, 24 nt, Human
ccuaagaaaucccuuaccccaccc

SEQ ID NO: 236321 - RNA, 18 nt, Human
ccuacucagaauguggag

SEQ ID NO: 236322 - RNA, 21 nt, Human
ccucaaacccccaaagugccu

SEQ ID NO: 236323 - RNA, 23 nt, Human
ccugcaggacccaaauccuaacu

SEQ ID NO: 236324 - RNA, 24 nt, Human
ccugccccacggauaccuucuggg

SEQ ID NO: 236325 - RNA, 22 nt, Human
ccuuuuuccugccucuccacua

SEQ ID NO: 236326 - RNA, 18 nt, Human
cgagggcagagagggggc

SEQ ID NO: 236327 - RNA, 21 nt, Human
cgccgccgcuccugccuccgc

SEQ ID NO: 236328 - RNA, 21 nt, Human
cgccgccgucgccgccgcucc

SEQ ID NO: 236329 - RNA, 19 nt, Human
cgccggcuccgcgccgccc

SEQ ID NO: 236330 - RNA, 22 nt, Human
cggccccgggucgcggcgcccu

SEQ ID NO: 236331 - RNA, 23 nt, Human
cggcugagggcagguggggguau

SEQ ID NO: 236332 - RNA, 23 nt, Human
cggggauggugugcgcccgcccg

SEQ ID NO: 236333 - RNA, 23 nt, Human
cucaaaaugaaggugucuaaaaa

SEQ ID NO: 236334 - RNA, 26 nt, Human
cuccccucaaaaugaaggugucuaaa

SEQ ID NO: 236335 - RNA, 20 nt, Human
cucgggaggcccuggcaccc

SEQ ID NO: 236336 - RNA, 22 nt, Human
cucuccuuucuguccuucccuu

SEQ ID NO: 236337 - RNA, 20 nt, Human
cugccuccgcuugcucggcc

SEQ ID NO: 236338 - RNA, 18 nt, Human
cuucagugaacaccuccc

SEQ ID NO: 236339 - RNA, 24 nt, Human
cuucucgggaggcccuggcacccu

SEQ ID NO: 236340 - RNA, 21 nt, Human
cuucuuuucagagcaguuguu

SEQ ID NO: 236341 - RNA, 18 nt, Human
gaaaucccuuaccccacc

SEQ ID NO: 236342 - RNA, 21 nt, Human
gaacaccuccccaaagaugcc

SEQ ID NO: 236343 - RNA, 20 nt, Human
gaagaugccauggagacggc

SEQ ID NO: 236344 - RNA, 24 nt, Human
gacaaauacuuugauauaaucuag

SEQ ID NO: 236345 - RNA, 23 nt, Human
gacgaagaugccauggagacggc

SEQ ID NO: 236346 - RNA, 25 nt, Human
gagcucucucacaccagaugugcuc

SEQ ID NO: 236347 - RNA, 18 nt, Human
gcaaauccaggguuugga

SEQ ID NO: 236348 - RNA, 22 nt, Human
gcaagcgucaaagucacaacaa

SEQ ID NO: 236349 - RNA, 19 nt, Human
gccccuggcaccuuuccgg

SEQ ID NO: 236350 - RNA, 20 nt, Human
gcccggucccucucgcgcgc

SEQ ID NO: 236351 - RNA, 23 nt, Human
gcccuugugaauagcaaagccca

SEQ ID NO: 236352 - RNA, 22 nt, Human
gccuccgcuugcucggccuccg

SEQ ID NO: 236353 - RNA, 19 nt, Human
gccuugggaagggggccaa

SEQ ID NO: 236354 - RNA, 21 nt, Human
gcggggcuggccggcugccgg

SEQ ID NO: 236355 - RNA, 24 nt, Human
gcggggugccgggcggcgggggcg

SEQ ID NO: 236356 - RNA, 21 nt, Human
gcucaaggcccguugcuguuc

SEQ ID NO: 236357 - RNA, 23 nt, Human
ggccccgggucgcggcgcccugc

SEQ ID NO: 236358 - RNA, 21 nt, Human
gggagggaggcggggugccgg

SEQ ID NO: 236359 - RNA, 18 nt, Human
gggcagagagggggcggc

SEQ ID NO: 236360 - RNA, 21 nt, Human
gggcggcgggggcgcucccuu

SEQ ID NO: 236361 - RNA, 18 nt, Human
guuaaaaguugugguuuc

SEQ ID NO: 236362 - RNA, 23 nt, Human
guuccuuucuucugcuaaucaug

SEQ ID NO: 236363 - RNA, 22 nt, Human
uaaaaagccaggaagaaaagaa

SEQ ID NO: 236364 - RNA, 22 nt, Human
uaaaggucuaccauccccuaag

SEQ ID NO: 236365 - RNA, 18 nt, Human
uaagaaaucccuuacccc

SEQ ID NO: 236366 - RNA, 19 nt, Human
uaccccacccucaaacccc

SEQ ID NO: 236367 - RNA, 24 nt, Human
uaccccacccucaaacccccaaag

SEQ ID NO: 236368 - RNA, 21 nt, Human
uaccuucugggcuaauugccu

SEQ ID NO: 236369 - RNA, 24 nt, Human
uagcaagcccugcaggacccaaau

SEQ ID NO: 236370 - RNA, 19 nt, Human
ucaaggcccguugcuguuc

SEQ ID NO: 236371 - RNA, 21 nt, Human
ucacaccagaugugcucugcg

SEQ ID NO: 236372 - RNA, 19 nt, Human
ucagugaacaccuccccaa

SEQ ID NO: 236373 - RNA, 19 nt, Human
uccaggguuuggagggcug

SEQ ID NO: 236374 - RNA, 22 nt, Human
uccaggguuuggagggcugggc

SEQ ID NO: 236375 - RNA, 18 nt, Human
ucccggucccgccgccgc

SEQ ID NO: 236376 - RNA, 19 nt, Human
ucccuuaccccacccucaa

SEQ ID NO: 236377 - RNA, 18 nt, Human
uccuucucgggaggcccu

SEQ ID NO: 236378 - RNA, 24 nt, Human
uccuucugucaccuugaaguguca

SEQ ID NO: 236379 - RNA, 21 nt, Human
uccuuuuuccugccucuccac

SEQ ID NO: 236380 - RNA, 21 nt, Human
ucgccgccgcuccugccuccg

SEQ ID NO: 236381 - RNA, 24 nt, Human
ucgccgccgcuccugccuccgcuu

SEQ ID NO: 236382 - RNA, 20 nt, Human
ucgccggcuccgcgccgccc

SEQ ID NO: 236383 - RNA, 22 nt, Human
ucgcgcgcugucgccggcuccg

SEQ ID NO: 236384 - RNA, 25 nt, Human
ucgggcgccgccgccgccgccgccg

SEQ ID NO: 236385 - RNA, 26 nt, Human
ucgggcgccgccgccgccgccgccgg

SEQ ID NO: 236386 - RNA, 30 nt, Human
ucuaccauccccuaagaaaucccuuacccu

SEQ ID NO: 236387 - RNA, 22 nt, Human
ucucugccaggacacccagagg

SEQ ID NO: 236388 - RNA, 21 nt, Human
ucugucucuguuucauuuccu

SEQ ID NO: 236389 - RNA, 24 nt, Human
ugaaacaggggaguuaaaaagcca

SEQ ID NO: 236390 - RNA, 23 nt, Human
ugcaggacccaaauccuaacuca

SEQ ID NO: 236391 - RNA, 19 nt, Human
ugccggggcucggaccccc

SEQ ID NO: 236392 - RNA, 19 nt, Human
ugccugugccaucuccccu

SEQ ID NO: 236393 - RNA, 24 nt, Human
ugccugugccaucuccccucucug

SEQ ID NO: 236394 - RNA, 25 nt, Human
ugcuuugcaccuguuccuucucggg

SEQ ID NO: 236395 - RNA, 19 nt, Human
uggaggacagugauugaaa

SEQ ID NO: 236396 - RNA, 23 nt, Human
uggaugggcuguggccauaaguu

SEQ ID NO: 236397 - RNA, 18 nt, Human
uggcacccuagcaccugg

SEQ ID NO: 236398 - RNA, 21 nt, Human
uggccauaaguucucccucaa

SEQ ID NO: 236399 - RNA, 24 nt, Human
uggggagggaggcggggugccggg

SEQ ID NO: 236400 - RNA, 20 nt, Human
uggggguauuuccuucucaa

SEQ ID NO: 236401 - RNA, 18 nt, Human
uguuccuuucuucugcua

SEQ ID NO: 236402 - RNA, 24 nt, Human
uuccugccucuccacuagcuacug

SEQ ID NO: 236403 - RNA, 21 nt, Human
uugaaaaauaucuucuuuuca

SEQ ID NO: 236404 - RNA, 19 nt, Human
aaagaaggugcaauggcau

SEQ ID NO: 236405 - RNA, 20 nt, Human
aaagagcaaauagaauguug

SEQ ID NO: 236406 - RNA, 19 nt, Human
aaagauuuuuuuuuuucuu

SEQ ID NO: 236407 - RNA, 20 nt, Human
aagcaggaaaggagaggagg

SEQ ID NO: 236408 - RNA, 21 nt, Human
agauuuuuuuuuuucuucauu

SEQ ID NO: 236409 - RNA, 25 nt, Human
agcggcggcggacggugcggaggcc

SEQ ID NO: 236410 - RNA, 22 nt, Human
aggagaggagggggcuaagggc

SEQ ID NO: 236411 - RNA, 21 nt, Human
aggccggcaggcaggcgcacc

SEQ ID NO: 236412 - RNA, 21 nt, Human
aggcggcggcggcggcggcgc

SEQ ID NO: 236413 - RNA, 23 nt, Human
aggguacaaacucuggccagugc

SEQ ID NO: 236414 - RNA, 26 nt, Human
caacugcugcaaucgcugcugcaagu

SEQ ID NO: 236415 - RNA, 25 nt, Human
cacuuacaugcauacauacauugua

SEQ ID NO: 236416 - RNA, 19 nt, Human
cagcucccucccccucccc

SEQ ID NO: 236417 - RNA, 20 nt, Human
caggagcccucggcccgcgc

SEQ ID NO: 236418 - RNA, 18 nt, Human
caggcaggcgcacccagg

SEQ ID NO: 236419 - RNA, 19 nt, Human
cauguguuacugacagagc

SEQ ID NO: 236420 - RNA, 24 nt, Human
cccaagauguccucugguggaucu

SEQ ID NO: 236421 - RNA, 18 nt, Human
ccccccagcucccucccc

SEQ ID NO: 236422 - RNA, 23 nt, Human
cccccgcccccgcccgcgcuccc

SEQ ID NO: 236423 - RNA, 18 nt, Human
cccccgcccgcgcuccuc

SEQ ID NO: 236424 - RNA, 19 nt, Human
cccccuccccaagaugucc

SEQ ID NO: 236425 - RNA, 26 nt, Human
ccccgcccccgcccgcgcuccucccg

SEQ ID NO: 236426 - RNA, 25 nt, Human
ccccgcccgcgcuccucccgcuccu

SEQ ID NO: 236427 - RNA, 22 nt, Human
cccgcgcuccucccgcuccucc

SEQ ID NO: 236428 - RNA, 21 nt, Human
ccgcccccgcccgcgcuccuc

SEQ ID NO: 236429 - RNA, 19 nt, Human
ccgcccgcgcuccucccgc

SEQ ID NO: 236430 - RNA, 19 nt, Human
ccgcccgcgcuccucccgc

SEQ ID NO: 236431 - RNA, 21 nt, Human
ccgcccgcgcuccucccgcuc

SEQ ID NO: 236432 - RNA, 19 nt, Human
ccgcugccggggcuguugc

SEQ ID NO: 236433 - RNA, 24 nt, Human
ccuauauugcaauauugcgagagg

SEQ ID NO: 236434 - RNA, 23 nt, Human
ccuccuccuccuccgccgccgcc

SEQ ID NO: 236435 - RNA, 23 nt, Human
ccuccuccuccuccgccgccgcc

SEQ ID NO: 236436 - RNA, 21 nt, Human
cgaagccgcucggcuuccagg

SEQ ID NO: 236437 - RNA, 25 nt, Human
cgcagcggcagcaacugcugcaauc

SEQ ID NO: 236438 - RNA, 23 nt, Human
cgcccgcgcuccucccgcuccuc

SEQ ID NO: 236439 - RNA, 23 nt, Human
cgcucgcucccuccgcggcucuu

SEQ ID NO: 236440 - RNA, 22 nt, Human
cggcucggaggcggcggcggcg

SEQ ID NO: 236441 - RNA, 18 nt, Human
cggcucggcugagcuccc

SEQ ID NO: 236442 - RNA, 30 nt, Human
cucccccccagcucccucccccuccccaag

SEQ ID NO: 236443 - RNA, 21 nt, Human
cucccccuccccaagaugucc

SEQ ID NO: 236444 - RNA, 20 nt, Human
cuccucccgcuccuccuccu

SEQ ID NO: 236445 - RNA, 19 nt, Human
cuccuccuccuccuccgcc

SEQ ID NO: 236446 - RNA, 22 nt, Human
cucggaggcggcggcggcggcg

SEQ ID NO: 236447 - RNA, 18 nt, Human
cugagcucccugcaccuc

SEQ ID NO: 236448 - RNA, 23 nt, Human
cuggagccugcgccgcugccggg

SEQ ID NO: 236449 - RNA, 24 nt, Human
gaauguuguuaagguaaaacacag

SEQ ID NO: 236450 - RNA, 18 nt, Human
gagcagcugcaggagccc

SEQ ID NO: 236451 - RNA, 26 nt, Human
gagcggcggcggacggugcggaggcc

SEQ ID NO: 236452 - RNA, 22 nt, Human
gaggcggcggcggugaaaugcg

SEQ ID NO: 236453 - RNA, 20 nt, Human
gauggcagcggcggcucggc

SEQ ID NO: 236454 - RNA, 18 nt, Human
gcaaucaagacuaaagaa

SEQ ID NO: 236455 - RNA, 24 nt, Human
gcacccaggcgucgggggcugcgg

SEQ ID NO: 236456 - RNA, 18 nt, Human
gcaggaaaggagaggagg

SEQ ID NO: 236457 - RNA, 21 nt, Human
gcgcggcuucaggcgcggcgc

SEQ ID NO: 236458 - RNA, 25 nt, Human
gcgcggcuucaggcgcgggggaacc

SEQ ID NO: 236459 - RNA, 26 nt, Human
gcgcggcuucaggcgcgggggaacgc

SEQ ID NO: 236460 - RNA, 19 nt, Human
gcucuggggcggguugggg

SEQ ID NO: 236461 - RNA, 20 nt, Human
gcugcccggcucggaggcgg

SEQ ID NO: 236462 - RNA, 25 nt, Human
gcuguugcugcccggcucggaggcg

SEQ ID NO: 236463 - RNA, 18 nt, Human
ggagcggcggcggacggu

SEQ ID NO: 236464 - RNA, 20 nt, Human
ggaggcggcggcggcggcgg

SEQ ID NO: 236465 - RNA, 20 nt, Human
ggccggcaggcaggcgcacc

SEQ ID NO: 236466 - RNA, 18 nt, Human
ggcggccgggagcagaag

SEQ ID NO: 236467 - RNA, 20 nt, Human
ggcggcggcggcggcggcgc

SEQ ID NO: 236468 - RNA, 22 nt, Human
ggcggcggcggcggcggcgcug

SEQ ID NO: 236469 - RNA, 21 nt, Human
ggcggcuuuuuuuuuuuuuuu

SEQ ID NO: 236470 - RNA, 29 nt, Human
ggcucggaggcggcggcggcggcggcgac

SEQ ID NO: 236471 - RNA, 22 nt, Human
gggaguucucgcagaagcagga

SEQ ID NO: 236472 - RNA, 19 nt, Human
gggcggcuuuuuuuuuuuu

SEQ ID NO: 236473 - RNA, 19 nt, Human
gggggcugcggccggccgg

SEQ ID NO: 236474 - RNA, 20 nt, Human
ggguacaaacucuggccagu

SEQ ID NO: 236475 - RNA, 24 nt, Human
ggugacuugucuacugaagacaca

SEQ ID NO: 236476 - RNA, 21 nt, Human
ggugcuagcuacaaaggugac

SEQ ID NO: 236477 - RNA, 23 nt, Human
guugcugcccggcucggaggcgg

SEQ ID NO: 236478 - RNA, 19 nt, Human
uaaaacacaggguacaaac

SEQ ID NO: 236479 - RNA, 28 nt, Human
uaagggcggcuuuuuuuuuuuuuuuaaa

SEQ ID NO: 236480 - RNA, 23 nt, Human
uaagguaaaacacaggguacaaa

SEQ ID NO: 236481 - RNA, 25 nt, Human
uacaugcauacauacauuguauuuu

SEQ ID NO: 236482 - RNA, 19 nt, Human
uacugaagacacaugggau

SEQ ID NO: 236483 - RNA, 24 nt, Human
uagaauaucacaaaagccacaucu

SEQ ID NO: 236484 - RNA, 18 nt, Human
uagcaacauuaggacaaa

SEQ ID NO: 236485 - RNA, 19 nt, Human
ucaggcgcggcgcagcggc

SEQ ID NO: 236486 - RNA, 19 nt, Human
ucccccgcccggcggcccc

SEQ ID NO: 236487 - RNA, 18 nt, Human
ucccgcgcgcucgcucgc

SEQ ID NO: 236488 - RNA, 24 nt, Human
ucccgcuccuccuccuccuccgcc

SEQ ID NO: 236489 - RNA, 18 nt, Human
ucccucccccccagcucc

SEQ ID NO: 236490 - RNA, 26 nt, Human
uccgcggcucuuacacauguguuacu

SEQ ID NO: 236491 - RNA, 21 nt, Human
uccuccgccgccgccuuccuc

SEQ ID NO: 236492 - RNA, 23 nt, Human
uccuccuccgccgccgccuuccu

SEQ ID NO: 236493 - RNA, 23 nt, Human
ucgcucgcucccuccgcggcucu

SEQ ID NO: 236494 - RNA, 22 nt, Human
ucucccauuagcccagguucau

SEQ ID NO: 236495 - RNA, 24 nt, Human
ucugagaugaaggcacgcauucug

SEQ ID NO: 236496 - RNA, 26 nt, Human
ugaaaauaucacaaauaaaagauuuu

SEQ ID NO: 236497 - RNA, 22 nt, Human
ugcaauggcauggagcuggcac

SEQ ID NO: 236498 - RNA, 18 nt, Human
ugcccggcucggaggcgg

SEQ ID NO: 236499 - RNA, 25 nt, Human
ugccgggcggccgggagcagaagug

SEQ ID NO: 236500 - RNA, 20 nt, Human
ugcggccggccgggcccggc

SEQ ID NO: 236501 - RNA, 23 nt, Human
ugcugcaaucgcugcugcaaguu

SEQ ID NO: 236502 - RNA, 18 nt, Human
uggcagcggcggcucggc

SEQ ID NO: 236503 - RNA, 18 nt, Human
uggcauggagcuggcacu

SEQ ID NO: 236504 - RNA, 21 nt, Human
uggccucuagccggcucgcuc

SEQ ID NO: 236505 - RNA, 23 nt, Human
ugggcuggcggagcuggagggag

SEQ ID NO: 236506 - RNA, 21 nt, Human
ugguggaucuuuuuucauuuu

SEQ ID NO: 236507 - RNA, 20 nt, Human
uguugcugcccggcucggag

SEQ ID NO: 236508 - RNA, 25 nt, Human
uuacagagauacaauaaguguuuuu

SEQ ID NO: 236509 - RNA, 20 nt, Human
uuauuuuuucuuuuaaguuu

SEQ ID NO: 236510 - RNA, 22 nt, Human
uucauucuuuuuuuuuucuuug

SEQ ID NO: 236511 - RNA, 21 nt, Human
uuuuuuccaaauuuuuuuucu

SEQ ID NO: 236512 - RNA, 23 nt, Human
uuuuuuuuauuuuuucuuuuaag

SEQ ID NO: 236513 - RNA, 24 nt, Human
uuuuuuuucuuuuuuucauucuuu

SEQ ID NO: 236514 - RNA, 24 nt, Human
uuuuuuuuuuuauuuuuucuuuua

SEQ ID NO: 236515 - RNA, 25 nt, Human
uuuuuuuuuuuuuuuuuuuauuuuu

SEQ ID NO: 236516 - RNA, 19 nt, Human
acucugacuggagaaugga

SEQ ID NO: 236517 - RNA, 22 nt, Human
agggaggaagaggauuuaugag

SEQ ID NO: 236518 - RNA, 20 nt, Human
gaggaagaggauuuaugacu

SEQ ID NO: 236519 - RNA, 20 nt, Human
gcccccuccaggacggccug

SEQ ID NO: 236520 - RNA, 26 nt, Human
ggagcccccuccaggacggccugccu

SEQ ID NO: 236521 - RNA, 19 nt, Human
uuguaggggcggggcgugg

SEQ ID NO: 236522 - RNA, 24 nt, Human
aaaaaaagcaaaaaagacauacaa

SEQ ID NO: 236523 - RNA, 24 nt, Human
aaaaaaagcaaaaaagacauacaa

SEQ ID NO: 236524 - RNA, 21 nt, Human
aaaaggccacauacugaaaua

SEQ ID NO: 236525 - RNA, 21 nt, Human
aaaaggccacauacugaaaua

SEQ ID NO: 236526 - RNA, 27 nt, Human
aaaaggccugaggucagacagugggca

SEQ ID NO: 236527 - RNA, 27 nt, Human
aaaaggccugaggucagacagugggca

SEQ ID NO: 236528 - RNA, 23 nt, Human
aaaauacccucuucaaaacacca

SEQ ID NO: 236529 - RNA, 23 nt, Human
aaaauacccucuucaaaacacca

SEQ ID NO: 236530 - RNA, 25 nt, Human
aaacauaacaucaaaaaaggccaca

SEQ ID NO: 236531 - RNA, 24 nt, Human
aacauaacaucaaaaaaggccaca

SEQ ID NO: 236532 - RNA, 20 nt, Human
aagcaaaaaagacauacaac

SEQ ID NO: 236533 - RNA, 21 nt, Human
aagcaaaaaagacauacaaca

SEQ ID NO: 236534 - RNA, 21 nt, Human
aaguugcucccuucucuucua

SEQ ID NO: 236535 - RNA, 21 nt, Human
aauaauagguagaaggaagga

SEQ ID NO: 236536 - RNA, 21 nt, Human
aauaauagguagaaggaagga

SEQ ID NO: 236537 - RNA, 22 nt, Human
aauuucugaaggauaaguugcu

SEQ ID NO: 236538 - RNA, 22 nt, Human
acacggguccucucuuuuugca

SEQ ID NO: 236539 - RNA, 24 nt, Human
acccucuucaaaacaccacuaguu

SEQ ID NO: 236540 - RNA, 24 nt, Human
acccucuucaaaacaccacuaguu

SEQ ID NO: 236541 - RNA, 19 nt, Human
accuuaguaaagcuacugg

SEQ ID NO: 236542 - RNA, 19 nt, Human
accuuaguaaagcuacugg

SEQ ID NO: 236543 - RNA, 19 nt, Human
agaaaauagagcucccuuc

SEQ ID NO: 236544 - RNA, 19 nt, Human
agaaaauagagcucccuuc

SEQ ID NO: 236545 - RNA, 21 nt, Human
agcuacuggauaaaacauaac

SEQ ID NO: 236546 - RNA, 21 nt, Human
agcuacuggauaaaacauaac

SEQ ID NO: 236547 - RNA, 23 nt, Human
aguauacacuuuaaauauaugca

SEQ ID NO: 236548 - RNA, 23 nt, Human
aguauacacuuuaaauauaugca

SEQ ID NO: 236549 - RNA, 19 nt, Human
auaaaauacccucuucaaa

SEQ ID NO: 236550 - RNA, 19 nt, Human
auaaaauacccucuucaaa

SEQ ID NO: 236551 - RNA, 21 nt, Human
aucaaaaauaaacuuccuuau

SEQ ID NO: 236552 - RNA, 21 nt, Human
aucaaaaauaaacuuccuuau

SEQ ID NO: 236553 - RNA, 20 nt, Human
auccagacuguggcauaguu

SEQ ID NO: 236554 - RNA, 20 nt, Human
auccagacuguggcauaguu

SEQ ID NO: 236555 - RNA, 22 nt, Human
aucuacaugagcagcaaccacc

SEQ ID NO: 236556 - RNA, 22 nt, Human
aucuacaugagcagcaaccacc

SEQ ID NO: 236557 - RNA, 19 nt, Human
caaaaaagacauacaacac

SEQ ID NO: 236558 - RNA, 19 nt, Human
caaaaaagacauacaacac

SEQ ID NO: 236559 - RNA, 21 nt, Human
caaaaaaggccacauacugaa

SEQ ID NO: 236560 - RNA, 21 nt, Human
caaaaaaggccacauacugaa

SEQ ID NO: 236561 - RNA, 26 nt, Human
caaaaauacugguucuaccaagacua

SEQ ID NO: 236562 - RNA, 26 nt, Human
caaaaauacugguucuaccaagacua

SEQ ID NO: 236563 - RNA, 21 nt, Human
caaaacaccacuaacuagaaa

SEQ ID NO: 236564 - RNA, 21 nt, Human
caaaacaccacuaacuagaaa

SEQ ID NO: 236565 - RNA, 22 nt, Human
cacaggacuuugagaaggaagc

SEQ ID NO: 236566 - RNA, 25 nt, Human
cacauacaccuaagaaaaagacgac

SEQ ID NO: 236567 - RNA, 25 nt, Human
cacauacaccuaagaaaaagacgac

SEQ ID NO: 236568 - RNA, 24 nt, Human
caccuaagaaaaagacgacccacu

SEQ ID NO: 236569 - RNA, 24 nt, Human
caccuaagaaaaagacgacccacu

SEQ ID NO: 236570 - RNA, 21 nt, Human
cacuaacuagaaagucaaacu

SEQ ID NO: 236571 - RNA, 21 nt, Human
cacuaacuagaaagucaaacu

SEQ ID NO: 236572 - RNA, 22 nt, Human
cagaaaggcucaccaguuucug

SEQ ID NO: 236573 - RNA, 22 nt, Human
cagaaaggcucaccaguuucug

SEQ ID NO: 236574 - RNA, 18 nt, Human
cagagcaaaugcaauuau

SEQ ID NO: 236575 - RNA, 18 nt, Human
cagagcaaaugcaauuau

SEQ ID NO: 236576 - RNA, 19 nt, Human
caucaaaaaaggccacaua

SEQ ID NO: 236577 - RNA, 19 nt, Human
caucaaaaaaggccacaua

SEQ ID NO: 236578 - RNA, 20 nt, Human
caugagcagcaaccaccucu

SEQ ID NO: 236579 - RNA, 20 nt, Human
caugagcagcaaccaccucu

SEQ ID NO: 236580 - RNA, 18 nt, Human
cccuucucuucuacucuc

SEQ ID NO: 236581 - RNA, 19 nt, Human
ccucaaaaauauucguagg

SEQ ID NO: 236582 - RNA, 19 nt, Human
ccucaaaaauauucguagg

SEQ ID NO: 236583 - RNA, 22 nt, Human
ccugcuuuucaauuucuucucu

SEQ ID NO: 236584 - RNA, 20 nt, Human
cucaagaugcugaauucaac

SEQ ID NO: 236585 - RNA, 20 nt, Human
cucaagaugcugaauucaac

SEQ ID NO: 236586 - RNA, 20 nt, Human
cucccuucucuucuacucuc

SEQ ID NO: 236587 - RNA, 23 nt, Human
cugaaauauggcuaaaaggccug

SEQ ID NO: 236588 - RNA, 23 nt, Human
cugaaauauggcuaaaaggccug

SEQ ID NO: 236589 - RNA, 25 nt, Human
gacccacucguuaaaugcaucagca

SEQ ID NO: 236590 - RNA, 25 nt, Human
gacccacucguuaaaugcaucagca

SEQ ID NO: 236591 - RNA, 18 nt, Human
gagaagacaaagaggcug

SEQ ID NO: 236592 - RNA, 23 nt, Human
gcuucugacacagucauuguagg

SEQ ID NO: 236593 - RNA, 21 nt, Human
ggauaaaacauaacaucaaaa

SEQ ID NO: 236594 - RNA, 21 nt, Human
ggauaaaacauaacaucaaaa

SEQ ID NO: 236595 - RNA, 23 nt, Human
guaaagaaaauagagcucccuuc

SEQ ID NO: 236596 - RNA, 23 nt, Human
guaaagaaaauagagcucccuuc

SEQ ID NO: 236597 - RNA, 21 nt, Human
guagaaggaaggauacagaaa

SEQ ID NO: 236598 - RNA, 21 nt, Human
guagaaggaaggauacagaaa

SEQ ID NO: 236599 - RNA, 19 nt, Human
guagaaucuucuuugggaa

SEQ ID NO: 236600 - RNA, 19 nt, Human
guugcucccuucucuucua

SEQ ID NO: 236601 - RNA, 21 nt, Human
uaaaaaaaaagcaaaaaagac

SEQ ID NO: 236602 - RNA, 21 nt, Human
uaaaaaaaaagcaaaaaagac

SEQ ID NO: 236603 - RNA, 23 nt, Human
uaaauaaacaacaaaaauacugg

SEQ ID NO: 236604 - RNA, 23 nt, Human
uaaauaaacaacaaaaauacugg

SEQ ID NO: 236605 - RNA, 25 nt, Human
uaacuagaaagucaaacuagaucau

SEQ ID NO: 236606 - RNA, 25 nt, Human
uaacuagaaagucaaacuagaucau

SEQ ID NO: 236607 - RNA, 22 nt, Human
uaacuugcuucugacacaguca

SEQ ID NO: 236608 - RNA, 22 nt, Human
uaagaaaaagacgacccacucg

SEQ ID NO: 236609 - RNA, 22 nt, Human
uaagaaaaagacgacccacucg

SEQ ID NO: 236610 - RNA, 18 nt, Human
uaaucuaaagaggcaaaa

SEQ ID NO: 236611 - RNA, 23 nt, Human
uaaucuaaagaggcaaaaaaagu

SEQ ID NO: 236612 - RNA, 18 nt, Human
uacacggguccucucuuu

SEQ ID NO: 236613 - RNA, 21 nt, Human
uacauuacaauaaacagagca

SEQ ID NO: 236614 - RNA, 21 nt, Human
uacauuacaauaaacagagca

SEQ ID NO: 236615 - RNA, 18 nt, Human
uaccaagacuacaaugcu

SEQ ID NO: 236616 - RNA, 18 nt, Human
uaccaagacuacaaugcu

SEQ ID NO: 236617 - RNA, 22 nt, Human
uaccaagacuacaaugcuucua

SEQ ID NO: 236618 - RNA, 22 nt, Human
uaccaagacuacaaugcuucua

SEQ ID NO: 236619 - RNA, 25 nt, Human
ucaaaaauaaacuuccuuauuaaaa

SEQ ID NO: 236620 - RNA, 18 nt, Human
ucaaaacaccacuaacua

SEQ ID NO: 236621 - RNA, 18 nt, Human
ucaaaacaccacuaacua

SEQ ID NO: 236622 - RNA, 18 nt, Human
ucacuguugucuucuccu

SEQ ID NO: 236623 - RNA, 18 nt, Human
ucacuguugucuucuccu

SEQ ID NO: 236624 - RNA, 27 nt, Human
uccaaaaacauaacuuuaucaaaaaua

SEQ ID NO: 236625 - RNA, 27 nt, Human
uccaaaaacauaacuuuaucaaaaaua

SEQ ID NO: 236626 - RNA, 19 nt, Human
ucgaagguauacaccaugu

SEQ ID NO: 236627 - RNA, 19 nt, Human
ucgaagguauacaccaugu

SEQ ID NO: 236628 - RNA, 25 nt, Human
ucucaagaugcugaauucaacaggu

SEQ ID NO: 236629 - RNA, 25 nt, Human
ucucaagaugcugaauucaacaggu

SEQ ID NO: 236630 - RNA, 26 nt, Human
ucucacucugguaacuugcuucugac

SEQ ID NO: 236631 - RNA, 28 nt, Human
ucucucacucugguaacuugcuucugac

SEQ ID NO: 236632 - RNA, 18 nt, Human
ugaaaauaagcagcuuuc

SEQ ID NO: 236633 - RNA, 18 nt, Human
ugaaaauaagcagcuuuc

SEQ ID NO: 236634 - RNA, 19 nt, Human
ugaggucagacacauacac

SEQ ID NO: 236635 - RNA, 19 nt, Human
ugaggucagacacauacac

SEQ ID NO: 236636 - RNA, 24 nt, Human
ugcucccuucucuucuacucucuc

SEQ ID NO: 236637 - RNA, 19 nt, Human
uggauaaaacauaacauca

SEQ ID NO: 236638 - RNA, 19 nt, Human
uggauaaaacauaacauca

SEQ ID NO: 236639 - RNA, 22 nt, Human
uggcuaaaaggccugaggucag

SEQ ID NO: 236640 - RNA, 22 nt, Human
uggcuaaaaggccugaggucag

SEQ ID NO: 236641 - RNA, 19 nt, Human
ugucaaaguauacacuuua

SEQ ID NO: 236642 - RNA, 19 nt, Human
ugucaaaguauacacuuua

SEQ ID NO: 236643 - RNA, 21 nt, Human
uguuucaguaaacacauccag

SEQ ID NO: 236644 - RNA, 21 nt, Human
uguuucaguaaacacauccag

SEQ ID NO: 236645 - RNA, 24 nt, Human
uuacacggguccucucuuuuugca

SEQ ID NO: 236646 - RNA, 20 nt, Human
uuacuuagcaacauuucugg

SEQ ID NO: 236647 - RNA, 20 nt, Human
uuacuuagcaacauuucugg

SEQ ID NO: 236648 - RNA, 20 nt, Human
uuugagaaggaagcugaauu

SEQ ID NO: 236649 - RNA, 21 nt, Human
uuuuugcuuuauagauauucu

SEQ ID NO: 236650 - RNA, 23 nt, Human
aaaaaaaaaagaaaagugcauag

SEQ ID NO: 236651 - RNA, 22 nt, Human
aaacaauaaggagaaagccagg

SEQ ID NO: 236652 - RNA, 23 nt, Human
aaaccuacaggagggcccuucaa

SEQ ID NO: 236653 - RNA, 24 nt, Human
aaauagcauggguguuaguugaaa

SEQ ID NO: 236654 - RNA, 20 nt, Human
aacauggugaaacccugucu

SEQ ID NO: 236655 - RNA, 21 nt, Human
aacauggugaaacccugucuc

SEQ ID NO: 236656 - RNA, 25 nt, Human
aaccaggaagguggagguugcagug

SEQ ID NO: 236657 - RNA, 19 nt, Human
aagaagcagaccuaacccu

SEQ ID NO: 236658 - RNA, 25 nt, Human
aaggcggguggaucaccugagguca

SEQ ID NO: 236659 - RNA, 24 nt, Human
aaucgcuugaaccaggaaggugga

SEQ ID NO: 236660 - RNA, 18 nt, Human
aauuagccaggcauggug

SEQ ID NO: 236661 - RNA, 20 nt, Human
acauaaaaccauacauaaaa

SEQ ID NO: 236662 - RNA, 20 nt, Human
accccaacuccuuucucuaa

SEQ ID NO: 236663 - RNA, 24 nt, Human
acccugucucuacuaaaaauacaa

SEQ ID NO: 236664 - RNA, 20 nt, Human
acugcacuccagcccgguug

SEQ ID NO: 236665 - RNA, 27 nt, Human
acugcacuccagcccgguugacaagag

SEQ ID NO: 236666 - RNA, 18 nt, Human
agaaacuccaucucaaaa

SEQ ID NO: 236667 - RNA, 19 nt, Human
agaagccacugcugugagc

SEQ ID NO: 236668 - RNA, 25 nt, Human
agacaagccagcaugcuggcucaga

SEQ ID NO: 236669 - RNA, 20 nt, Human
agacaggagcucugggcccg

SEQ ID NO: 236670 - RNA, 22 nt, Human
agcaaaauuugcauuauucaag

SEQ ID NO: 236671 - RNA, 19 nt, Human
agcagaccugccaugugga

SEQ ID NO: 236672 - RNA, 24 nt, Human
agcagaccugccauguggacugac

SEQ ID NO: 236673 - RNA, 22 nt, Human
agccaggcaugguggcuggugc

SEQ ID NO: 236674 - RNA, 21 nt, Human
agcccgguugacaagagaaac

SEQ ID NO: 236675 - RNA, 22 nt, Human
agccuggccaacauggugaaac

SEQ ID NO: 236676 - RNA, 24 nt, Human
agccuggccaacauggugaaaccc

SEQ ID NO: 236677 - RNA, 20 nt, Human
agccuuguugcugaaggauc

SEQ ID NO: 236678 - RNA, 22 nt, Human
agcugaucuaaacucccaguuu

SEQ ID NO: 236679 - RNA, 29 nt, Human
aggaagguggagguugcagugacaacggu

SEQ ID NO: 236680 - RNA, 24 nt, Human
aggaagguggagguugcagugagc

SEQ ID NO: 236681 - RNA, 18 nt, Human
aggagauagauagauuuu

SEQ ID NO: 236682 - RNA, 21 nt, Human
aggcaggaaacccgggcucgg

SEQ ID NO: 236683 - RNA, 22 nt, Human
aggcaggaaacccgggcucgga

SEQ ID NO: 236684 - RNA, 21 nt, Human
aggcaugguggcuggugcuug

SEQ ID NO: 236685 - RNA, 21 nt, Human
aggccaaggcggguggaucac

SEQ ID NO: 236686 - RNA, 22 nt, Human
aggcggguggaucaccugaggu

SEQ ID NO: 236687 - RNA, 26 nt, Human
aggcggguggaucaccugaggucaga

SEQ ID NO: 236688 - RNA, 19 nt, Human
aggcugggcgcgguggcuc

SEQ ID NO: 236689 - RNA, 19 nt, Human
agggaucaugaugucuacu

SEQ ID NO: 236690 - RNA, 24 nt, Human
agguggagguugcagugagccaag

SEQ ID NO: 236691 - RNA, 24 nt, Human
aguggccacucaguggcaggugac

SEQ ID NO: 236692 - RNA, 21 nt, Human
aguggggugccugccccacaa

SEQ ID NO: 236693 - RNA, 19 nt, Human
auaaagccauauggauugc

SEQ ID NO: 236694 - RNA, 21 nt, Human
auaaugauacaagauggaucc

SEQ ID NO: 236695 - RNA, 21 nt, Human
auagauagauuuucaauccag

SEQ ID NO: 236696 - RNA, 20 nt, Human
aucagcugauuuugcuccca

SEQ ID NO: 236697 - RNA, 22 nt, Human
aucccagcacuuugggaggcca

SEQ ID NO: 236698 - RNA, 19 nt, Human
augaaaccuacaggagggc

SEQ ID NO: 236699 - RNA, 18 nt, Human
auggcucugcuggcaccc

SEQ ID NO: 236700 - RNA, 18 nt, Human
auguggucaucuguggug

SEQ ID NO: 236701 - RNA, 22 nt, Human
auuacauucacaaguucacacu

SEQ ID NO: 236702 - RNA, 20 nt, Human
auugcaccacugcacuccag

SEQ ID NO: 236703 - RNA, 19 nt, Human
caaaaaaggagccuaaaac

SEQ ID NO: 236704 - RNA, 24 nt, Human
caacauggugaaacccugucucua

SEQ ID NO: 236705 - RNA, 21 nt, Human
caagaacuacaucuguaaaca

SEQ ID NO: 236706 - RNA, 24 nt, Human
caaggcagguuaguugacuuaauu

SEQ ID NO: 236707 - RNA, 24 nt, Human
caaggcggguggaucaccugaggu

SEQ ID NO: 236708 - RNA, 18 nt, Human
cacugcacuccagcccgg

SEQ ID NO: 236709 - RNA, 25 nt, Human
cacugcacuccagcccgguugacaa

SEQ ID NO: 236710 - RNA, 24 nt, Human
cacugccagcucuggcccucaccc

SEQ ID NO: 236711 - RNA, 24 nt, Human
cagcacuuugggaggccaaggcgg

SEQ ID NO: 236712 - RNA, 24 nt, Human
cagcuacuugagaggucgaggcag

SEQ ID NO: 236713 - RNA, 19 nt, Human
cagcuguugaggccuggaa

SEQ ID NO: 236714 - RNA, 23 nt, Human
cauuuccgccgccagcgcuugac

SEQ ID NO: 236715 - RNA, 23 nt, Human
ccacaauggugcccaccccuuca

SEQ ID NO: 236716 - RNA, 20 nt, Human
ccacagaaucugaacuugca

SEQ ID NO: 236717 - RNA, 19 nt, Human
ccacugcacuccagcccgg

SEQ ID NO: 236718 - RNA, 19 nt, Human
ccacugcacuccagcccgg

SEQ ID NO: 236719 - RNA, 20 nt, Human
ccacugcacuccagcccggu

SEQ ID NO: 236720 - RNA, 23 nt, Human
ccacugcacuccagcccgguuga

SEQ ID NO: 236721 - RNA, 25 nt, Human
ccacugcacuccagcccgguugaca

SEQ ID NO: 236722 - RNA, 19 nt, Human
ccagaaaugaucaaaggca

SEQ ID NO: 236723 - RNA, 21 nt, Human
ccaggaagguggagguugcag

SEQ ID NO: 236724 - RNA, 27 nt, Human
ccagugacuuuccauaauaagcuuucu

SEQ ID NO: 236725 - RNA, 21 nt, Human
cccacaauggugcccaccccu

SEQ ID NO: 236726 - RNA, 21 nt, Human
ccccacaauggugcccacccc

SEQ ID NO: 236727 - RNA, 23 nt, Human
ccccacccucugaaagaccccaa

SEQ ID NO: 236728 - RNA, 20 nt, Human
cccccguuucugagccucca

SEQ ID NO: 236729 - RNA, 24 nt, Human
ccccgcccugggcgcguccucucc

SEQ ID NO: 236730 - RNA, 19 nt, Human
ccgcccugggcgcguccuc

SEQ ID NO: 236731 - RNA, 24 nt, Human
ccgccgucgccaccgcgggccgcg

SEQ ID NO: 236732 - RNA, 19 nt, Human
ccgggcccucgaaaucccg

SEQ ID NO: 236733 - RNA, 23 nt, Human
ccgggcccucgaaaucccgaggg

SEQ ID NO: 236734 - RNA, 24 nt, Human
ccgggcgggcagccgggcggaggg

SEQ ID NO: 236735 - RNA, 18 nt, Human
ccuaaagcugagaguaga

SEQ ID NO: 236736 - RNA, 21 nt, Human
ccuaaagcugagaguagaagc

SEQ ID NO: 236737 - RNA, 24 nt, Human
ccucaagggcagcuguugaggccu

SEQ ID NO: 236738 - RNA, 19 nt, Human
ccuccaaaucucugccaca

SEQ ID NO: 236739 - RNA, 23 nt, Human
ccucgaaaucccgagggggcggg

SEQ ID NO: 236740 - RNA, 22 nt, Human
ccugaggucagacauucgagac

SEQ ID NO: 236741 - RNA, 24 nt, Human
ccuggcaugaagacgucauauccc

SEQ ID NO: 236742 - RNA, 22 nt, Human
ccuggccaacauggugaaaccc

SEQ ID NO: 236743 - RNA, 24 nt, Human
ccuggccaacauggugaaacccug

SEQ ID NO: 236744 - RNA, 22 nt, Human
ccuguaaucccagcacuuuggg

SEQ ID NO: 236745 - RNA, 24 nt, Human
cgagaccagccuggccaacauggu

SEQ ID NO: 236746 - RNA, 23 nt, Human
cgcccccgggcccucgaaauccc

SEQ ID NO: 236747 - RNA, 23 nt, Human
cgccuguaaucccagcacuuugg

SEQ ID NO: 236748 - RNA, 20 nt, Human
cgcgccuguaaucccagcac

SEQ ID NO: 236749 - RNA, 24 nt, Human
cgcgccuguaaucccagcacuuug

SEQ ID NO: 236750 - RNA, 23 nt, Human
cggccgggcugagagacaggagc

SEQ ID NO: 236751 - RNA, 18 nt, Human
cggcuggggccuggucag

SEQ ID NO: 236752 - RNA, 19 nt, Human
cgggcucggaaaauggcca

SEQ ID NO: 236753 - RNA, 27 nt, Human
cggguggaucaccugaggucagacauu

SEQ ID NO: 236754 - RNA, 21 nt, Human
cuaaacucccaguuuccuaga

SEQ ID NO: 236755 - RNA, 21 nt, Human
cuaccuggugugccucuuggc

SEQ ID NO: 236756 - RNA, 22 nt, Human
cuacuggguaccuuuccugugc

SEQ ID NO: 236757 - RNA, 19 nt, Human
cuccaucucaaaaaaaaaa

SEQ ID NO: 236758 - RNA, 19 nt, Human
cucccacauaaagaaaggu

SEQ ID NO: 236759 - RNA, 22 nt, Human
cucgaaaucccgagggggcggg

SEQ ID NO: 236760 - RNA, 24 nt, Human
cucgcgccuguaaucccagcacuu

SEQ ID NO: 236761 - RNA, 21 nt, Human
cucucgguagaaguugccggc

SEQ ID NO: 236762 - RNA, 18 nt, Human
cugauuuugcucccacau

SEQ ID NO: 236763 - RNA, 22 nt, Human
cugcugugagccuggggguugu

SEQ ID NO: 236764 - RNA, 24 nt, Human
cuggccaacauggugaaacccugu

SEQ ID NO: 236765 - RNA, 19 nt, Human
cugucccgaggaugcagua

SEQ ID NO: 236766 - RNA, 21 nt, Human
gaagaagcagaccuaacccuc

SEQ ID NO: 236767 - RNA, 18 nt, Human
gaagcaaaaauuugaccu

SEQ ID NO: 236768 - RNA, 18 nt, Human
gaagcaggauuagaugug

SEQ ID NO: 236769 - RNA, 19 nt, Human
gacaagagaaacuccaucu

SEQ ID NO: 236770 - RNA, 24 nt, Human
gacauucgagaccagccuggccaa

SEQ ID NO: 236771 - RNA, 21 nt, Human
gagcggggcucaggcaggaaa

SEQ ID NO: 236772 - RNA, 22 nt, Human
gaggaugcaguagacaagccag

SEQ ID NO: 236773 - RNA, 18 nt, Human
gagguugcagugagccaa

SEQ ID NO: 236774 - RNA, 23 nt, Human
gagguugcagugagccaagauug

SEQ ID NO: 236775 - RNA, 24 nt, Human
gaucaccugaggucagacauucga

SEQ ID NO: 236776 - RNA, 24 nt, Human
gaucaccugaggucagacauucga

SEQ ID NO: 236777 - RNA, 20 nt, Human
gauugugugugcccaugugu

SEQ ID NO: 236778 - RNA, 20 nt, Human
gcagccgggcggaggcggug

SEQ ID NO: 236779 - RNA, 19 nt, Human
gcauagggaccccgggcag

SEQ ID NO: 236780 - RNA, 24 nt, Human
gccaacauggugaaacccugucuc

SEQ ID NO: 236781 - RNA, 19 nt, Human
gcccccgggcccucgaaau

SEQ ID NO: 236782 - RNA, 20 nt, Human
gccggcccauggcgucgcgc

SEQ ID NO: 236783 - RNA, 19 nt, Human
gcgccuguaaucccagcac

SEQ ID NO: 236784 - RNA, 23 nt, Human
gcgggcgggcccccgcccugggc

SEQ ID NO: 236785 - RNA, 19 nt, Human
gcucugcuggcacccaaga

SEQ ID NO: 236786 - RNA, 22 nt, Human
gcucuggcccucaccccaacuc

SEQ ID NO: 236787 - RNA, 20 nt, Human
gcuuguaaucccagcuacuu

SEQ ID NO: 236788 - RNA, 20 nt, Human
ggacuggaaggagaguggug

SEQ ID NO: 236789 - RNA, 22 nt, Human
ggagguugcagugagccaagau

SEQ ID NO: 236790 - RNA, 24 nt, Human
ggagguugcagugagccaagauug

SEQ ID NO: 236791 - RNA, 19 nt, Human
ggcagccgggcggaggcgg

SEQ ID NO: 236792 - RNA, 18 nt, Human
ggcaugguggcuggugcu

SEQ ID NO: 236793 - RNA, 23 nt, Human
ggcccggccggcccauggcgucg

SEQ ID NO: 236794 - RNA, 23 nt, Human
ggcgcgguggcucgcgccuguaa

SEQ ID NO: 236795 - RNA, 20 nt, Human
ggcucggaaaauggccagcg

SEQ ID NO: 236796 - RNA, 23 nt, Human
gggcgggcagccgggcggaggcg

SEQ ID NO: 236797 - RNA, 18 nt, Human
ggggacugggcauaggga

SEQ ID NO: 236798 - RNA, 24 nt, Human
ggugcuuguaaucccagcuacuug

SEQ ID NO: 236799 - RNA, 23 nt, Human
gguggcucgcgccuguaauccca

SEQ ID NO: 236800 - RNA, 24 nt, Human
gguggcucgcgccuguaaucccag

SEQ ID NO: 236801 - RNA, 24 nt, Human
gguggcuggugcuuguaaucccag

SEQ ID NO: 236802 - RNA, 24 nt, Human
gucaaaaaaggagccuaaaaccca

SEQ ID NO: 236803 - RNA, 21 nt, Human
gugaaacccugucucuacuaa

SEQ ID NO: 236804 - RNA, 23 nt, Human
guggcucgcgccuguaaucccag

SEQ ID NO: 236805 - RNA, 18 nt, Human
gugggaugugcugugccu

SEQ ID NO: 236806 - RNA, 19 nt, Human
gugggaugugcugugccua

SEQ ID NO: 236807 - RNA, 24 nt, Human
gugggguauuaaaggaguuucuca

SEQ ID NO: 236808 - RNA, 21 nt, Human
guguaggcugggcgcgguggc

SEQ ID NO: 236809 - RNA, 20 nt, Human
uaaaaauacaaaauuagcca

SEQ ID NO: 236810 - RNA, 22 nt, Human
uaaaaauacaaaauuagccagg

SEQ ID NO: 236811 - RNA, 23 nt, Human
uaaaaauacaaaauuagccaggc

SEQ ID NO: 236812 - RNA, 20 nt, Human
uaaggagaaagccaggugga

SEQ ID NO: 236813 - RNA, 20 nt, Human
uacaucuguaaacaauaagg

SEQ ID NO: 236814 - RNA, 20 nt, Human
uagguuaagaaacuguuaug

SEQ ID NO: 236815 - RNA, 19 nt, Human
uagucagagcugcuaaguu

SEQ ID NO: 236816 - RNA, 23 nt, Human
uauguagagaggcugcuaagaaa

SEQ ID NO: 236817 - RNA, 22 nt, Human
ucaauccagugaagcaguagcc

SEQ ID NO: 236818 - RNA, 18 nt, Human
ucaguccuaugaguuuua

SEQ ID NO: 236819 - RNA, 18 nt, Human
ucagugucaggucugcuu

SEQ ID NO: 236820 - RNA, 19 nt, Human
uccacugccagcucuggcc

SEQ ID NO: 236821 - RNA, 20 nt, Human
uccaucucaaaaaaaaaaaa

SEQ ID NO: 236822 - RNA, 23 nt, Human
uccaucucaaaaaaaaaaaagaa

SEQ ID NO: 236823 - RNA, 19 nt, Human
ucccgagggggcgggcggg

SEQ ID NO: 236824 - RNA, 22 nt, Human
ucgaggcagaaucgcuugaacc

SEQ ID NO: 236825 - RNA, 24 nt, Human
ucgcuugaaccaggaagguggagg

SEQ ID NO: 236826 - RNA, 22 nt, Human
ucucuacuaaaaauacaaaauu

SEQ ID NO: 236827 - RNA, 24 nt, Human
ucugcuggcacccaagagcagcug

SEQ ID NO: 236828 - RNA, 20 nt, Human
ucuuuggugcuggugacugu

SEQ ID NO: 236829 - RNA, 21 nt, Human
ugaaggaagggauggugccgg

SEQ ID NO: 236830 - RNA, 22 nt, Human
ugaauggcucugcuggcaccca

SEQ ID NO: 236831 - RNA, 18 nt, Human
ugaauggcucugcuggcc

SEQ ID NO: 236832 - RNA, 21 nt, Human
ugacagugucagugaaaaaga

SEQ ID NO: 236833 - RNA, 21 nt, Human
ugacuccacugucacugcccc

SEQ ID NO: 236834 - RNA, 20 nt, Human
ugacuuugaggaaauaaaga

SEQ ID NO: 236835 - RNA, 24 nt, Human
ugagagauguauguagagaggcug

SEQ ID NO: 236836 - RNA, 20 nt, Human
ugagccuccagacagguucu

SEQ ID NO: 236837 - RNA, 21 nt, Human
ugcaccacugcacuccagccc

SEQ ID NO: 236838 - RNA, 19 nt, Human
ugccugugcuccucaaggg

SEQ ID NO: 236839 - RNA, 22 nt, Human
ugcggccgggcugagagacagg

SEQ ID NO: 236840 - RNA, 19 nt, Human
ugcuuggagggcaccaagc

SEQ ID NO: 236841 - RNA, 22 nt, Human
ugcuuguaaucccagcuacuug

SEQ ID NO: 236842 - RNA, 23 nt, Human
ugcuuguaaucccagcuacuuga

SEQ ID NO: 236843 - RNA, 24 nt, Human
uggaucaccugaggucagacauuc

SEQ ID NO: 236844 - RNA, 24 nt, Human
uggccaacauggugaaacccuguc

SEQ ID NO: 236845 - RNA, 22 nt, Human
uggcucgcgccuguaaucccag

SEQ ID NO: 236846 - RNA, 24 nt, Human
uggcucgcgccuguaaucccagca

SEQ ID NO: 236847 - RNA, 20 nt, Human
uggcuggagggagggaacuu

SEQ ID NO: 236848 - RNA, 21 nt, Human
uggcuggugcuuguaauccca

SEQ ID NO: 236849 - RNA, 22 nt, Human
uggcuggugcuuguaaucccag

SEQ ID NO: 236850 - RNA, 24 nt, Human
uggcuggugcuuguaaucccagcu

SEQ ID NO: 236851 - RNA, 24 nt, Human
ugggaggccaaggcggguggauca

SEQ ID NO: 236852 - RNA, 21 nt, Human
ugggaugugcugugccuaugg

SEQ ID NO: 236853 - RNA, 24 nt, Human
ugguggcuggugcuuguaauccca

SEQ ID NO: 236854 - RNA, 21 nt, Human
ugguguaggcugggcgcggug

SEQ ID NO: 236855 - RNA, 24 nt, Human
uguaaacaauaaggagaaagccag

SEQ ID NO: 236856 - RNA, 21 nt, Human
uguaaucccagcuacuugaga

SEQ ID NO: 236857 - RNA, 24 nt, Human
ugucacugcccccguuucugagcc

SEQ ID NO: 236858 - RNA, 26 nt, Human
uguggacacagcagaccugccaugug

SEQ ID NO: 236859 - RNA, 20 nt, Human
uguggucaucuguggugugg

SEQ ID NO: 236860 - RNA, 25 nt, Human
uguuaauauacuugcaaguuccuuu

SEQ ID NO: 236861 - RNA, 25 nt, Human
uuaacagugucccuuaaaucuuucu

SEQ ID NO: 236862 - RNA, 18 nt, Human
uuagccaggcaugguggc

SEQ ID NO: 236863 - RNA, 18 nt, Human
uuaguccugaauagaaag

SEQ ID NO: 236864 - RNA, 24 nt, Human
uuaguugacuuaauucuuuggugc

SEQ ID NO: 236865 - RNA, 21 nt, Human
uucccccacccucugaaagac

SEQ ID NO: 236866 - RNA, 18 nt, Human
uucgagaccagccuggcc

SEQ ID NO: 236867 - RNA, 20 nt, Human
uucugacuacaaaaauagca

SEQ ID NO: 236868 - RNA, 24 nt, Human
uugaaccaggaagguggagguugc

SEQ ID NO: 236869 - RNA, 22 nt, Human
uugcagugagccaagauugcac

SEQ ID NO: 236870 - RNA, 19 nt, Human
uuuaggaaggacaguggcc

SEQ ID NO: 236871 - RNA, 23 nt, Human
uuuccgccgccagcgcuugacag

SEQ ID NO: 236872 - RNA, 22 nt, Human
aacuuggcagcgauccuggcuu

SEQ ID NO: 236873 - RNA, 23 nt, Human
aagcggcagagcccaagcuuaca

SEQ ID NO: 236874 - RNA, 24 nt, Human
aaugccaucuaucaauaagaagca

SEQ ID NO: 236875 - RNA, 18 nt, Human
acugugucaguaacuuuc

SEQ ID NO: 236876 - RNA, 25 nt, Human
agaacagaauuccaaaacaggguuu

SEQ ID NO: 236877 - RNA, 24 nt, Human
auaaauaacuacauacugcccaaa

SEQ ID NO: 236878 - RNA, 26 nt, Human
caaagacacuucagaaaagauggaug

SEQ ID NO: 236879 - RNA, 23 nt, Human
caacuuggcagcgauccuggcuu

SEQ ID NO: 236880 - RNA, 21 nt, Human
cagagcccaagcuuacaagcu

SEQ ID NO: 236881 - RNA, 21 nt, Human
caggguuuuuguccccaucug

SEQ ID NO: 236882 - RNA, 22 nt, Human
caguaacuuucuggauacugag

SEQ ID NO: 236883 - RNA, 22 nt, Human
cccaucuguguaucuucaaagu

SEQ ID NO: 236884 - RNA, 22 nt, Human
ccccugccgcggcuccuuacag

SEQ ID NO: 236885 - RNA, 22 nt, Human
cccgagcuuccuacuccgagag

SEQ ID NO: 236886 - RNA, 20 nt, Human
cccugagcuaacuagaacuc

SEQ ID NO: 236887 - RNA, 21 nt, Human
cgcccgagcuuccuacuccga

SEQ ID NO: 236888 - RNA, 24 nt, Human
cugaagugauggcggcucuuaggg

SEQ ID NO: 236889 - RNA, 22 nt, Human
cuuacaagcucucugaaugggc

SEQ ID NO: 236890 - RNA, 18 nt, Human
cuuggcagcgauccuggc

SEQ ID NO: 236891 - RNA, 21 nt, Human
gcaaaagcggcagagcccaag

SEQ ID NO: 236892 - RNA, 27 nt, Human
uaaauaacuacauacugcccaaagacc

SEQ ID NO: 236893 - RNA, 21 nt, Human
uaauaaauaacuacauacugc

SEQ ID NO: 236894 - RNA, 24 nt, Human
uacagccggagcgcccgagcuucc

SEQ ID NO: 236895 - RNA, 21 nt, Human
uacauacugcccaaagacacu

SEQ ID NO: 236896 - RNA, 18 nt, Human
uaccauauucuucagagc

SEQ ID NO: 236897 - RNA, 19 nt, Human
uacugugucaguaacuuuc

SEQ ID NO: 236898 - RNA, 25 nt, Human
uagaacagaauuccaaaacaggguu

SEQ ID NO: 236899 - RNA, 19 nt, Human
uaggguagaacuuuccuug

SEQ ID NO: 236900 - RNA, 21 nt, Human
ucagagcuaacuuuguaccac

SEQ ID NO: 236901 - RNA, 19 nt, Human
uccaaagagugcaaacaac

SEQ ID NO: 236902 - RNA, 18 nt, Human
ucccccugccgcggcucc

SEQ ID NO: 236903 - RNA, 23 nt, Human
ugaggaauagaacagaauuccaa

SEQ ID NO: 236904 - RNA, 18 nt, Human
uucaaaguagaaaaauua

SEQ ID NO: 236905 - RNA, 21 nt, Human
uucagaaaagauggaugaaaa

SEQ ID NO: 236906 - RNA, 22 nt, Human
uuccaaaacaggguuuuugucc

SEQ ID NO: 236907 - RNA, 22 nt, Human
uuuguccccaucuguguaucuu

SEQ ID NO: 236908 - RNA, 18 nt, Human
aacccaagucuuucaggc

SEQ ID NO: 236909 - RNA, 20 nt, Human
aacuucccucuaacuccucc

SEQ ID NO: 236910 - RNA, 23 nt, Human
aacuucccucuaacuccuccuac

SEQ ID NO: 236911 - RNA, 24 nt, Human
aagcccaagaagaaugaaucagga

SEQ ID NO: 236912 - RNA, 18 nt, Human
aaggccucaaagcuguaa

SEQ ID NO: 236913 - RNA, 20 nt, Human
aagucuuucaggcaguggaa

SEQ ID NO: 236914 - RNA, 24 nt, Human
aauuuucuucccauccaccaaggc

SEQ ID NO: 236915 - RNA, 18 nt, Human
acacaccagccacaaacu

SEQ ID NO: 236916 - RNA, 21 nt, Human
acuucccucuaacuccuccua

SEQ ID NO: 236917 - RNA, 18 nt, Human
agaaaauucucuaauuca

SEQ ID NO: 236918 - RNA, 22 nt, Human
agaaagauaaacucuccacagg

SEQ ID NO: 236919 - RNA, 19 nt, Human
agacaucccuggagcugcu

SEQ ID NO: 236920 - RNA, 20 nt, Human
agacaucccuggagcugcug

SEQ ID NO: 236921 - RNA, 23 nt, Human
agauagaaagugaacagacaaag

SEQ ID NO: 236922 - RNA, 27 nt, Human
agccacaaacucguaaauguucacgcu

SEQ ID NO: 236923 - RNA, 24 nt, Human
aggaacauuacugccuaugaaugu

SEQ ID NO: 236924 - RNA, 23 nt, Human
aggcaaagcucccauuaagccca

SEQ ID NO: 236925 - RNA, 20 nt, Human
aggccucaaagcuguaaaca

SEQ ID NO: 236926 - RNA, 18 nt, Human
auaauacacaagaacacc

SEQ ID NO: 236927 - RNA, 27 nt, Human
caaagcccaagaagaaugaaucaggaa

SEQ ID NO: 236928 - RNA, 19 nt, Human
caaagcuguaaacagcaga

SEQ ID NO: 236929 - RNA, 22 nt, Human
caaagugaaccuggagcagaga

SEQ ID NO: 236930 - RNA, 20 nt, Human
cacauuaaggcaacuguccu

SEQ ID NO: 236931 - RNA, 30 nt, Human
caccaaggccucaaagcuguaaacagcagg

SEQ ID NO: 236932 - RNA, 26 nt, Human
caccagccacaaacucguaaauguuc

SEQ ID NO: 236933 - RNA, 18 nt, Human
cacugucacuuuucugag

SEQ ID NO: 236934 - RNA, 21 nt, Human
cagcaaaagugauacuagagg

SEQ ID NO: 236935 - RNA, 18 nt, Human
cagcagccagggaaaccu

SEQ ID NO: 236936 - RNA, 22 nt, Human
caggucccaggcaaagcuccca

SEQ ID NO: 236937 - RNA, 18 nt, Human
caguggaccccugcaguc

SEQ ID NO: 236938 - RNA, 30 nt, Human
cauccccaucuccaaaaccacgcugggggg

SEQ ID NO: 236939 - RNA, 23 nt, Human
ccaaaaccacgcuggggguaugc

SEQ ID NO: 236940 - RNA, 23 nt, Human
ccaaagugaaccuggagcagaga

SEQ ID NO: 236941 - RNA, 24 nt, Human
ccaacaguuauaguucaacccaag

SEQ ID NO: 236942 - RNA, 18 nt, Human
ccaccaaggccucaaagc

SEQ ID NO: 236943 - RNA, 22 nt, Human
ccacccuucccuuuacugcacu

SEQ ID NO: 236944 - RNA, 19 nt, Human
ccauagauguugaaauaac

SEQ ID NO: 236945 - RNA, 21 nt, Human
ccaugagaaagauaaacucuc

SEQ ID NO: 236946 - RNA, 20 nt, Human
cccaucuccaaaaccacgcu

SEQ ID NO: 236947 - RNA, 19 nt, Human
ccccaacagugucaccucu

SEQ ID NO: 236948 - RNA, 22 nt, Human
ccccaacagugucaccucucac

SEQ ID NO: 236949 - RNA, 19 nt, Human
ccccugcagucucugucuu

SEQ ID NO: 236950 - RNA, 24 nt, Human
cccuggaaacccugggaggaacau

SEQ ID NO: 236951 - RNA, 19 nt, Human
ccucaagaaagggaauagg

SEQ ID NO: 236952 - RNA, 24 nt, Human
ccugguggcccugggagauggcuu

SEQ ID NO: 236953 - RNA, 21 nt, Human
cucccauuaagcccacccuuc

SEQ ID NO: 236954 - RNA, 19 nt, Human
cuccuacgcaagcuuacca

SEQ ID NO: 236955 - RNA, 23 nt, Human
cugcacuagaucagggccugacu

SEQ ID NO: 236956 - RNA, 21 nt, Human
cugcuuccagaggcagcuccu

SEQ ID NO: 236957 - RNA, 22 nt, Human
cuucccgagcgguccaugagaa

SEQ ID NO: 236958 - RNA, 24 nt, Human
gaaaauucucuaauucaagcauuc

SEQ ID NO: 236959 - RNA, 20 nt, Human
gaaccuggagcagagaagcg

SEQ ID NO: 236960 - RNA, 18 nt, Human
gacacaagggucaggaac

SEQ ID NO: 236961 - RNA, 21 nt, Human
gcaaagcucccauuaagccca

SEQ ID NO: 236962 - RNA, 20 nt, Human
gcacaaagcgcagagcccca

SEQ ID NO: 236963 - RNA, 18 nt, Human
gccaugcugggaaucuau

SEQ ID NO: 236964 - RNA, 21 nt, Human
gccucaaagcuguaaacagca

SEQ ID NO: 236965 - RNA, 24 nt, Human
ggaaaagaaagaucauauccaaag

SEQ ID NO: 236966 - RNA, 18 nt, Human
gggaacacaaagaaggcc

SEQ ID NO: 236967 - RNA, 21 nt, Human
gggcagguccuccacagggac

SEQ ID NO: 236968 - RNA, 22 nt, Human
gguucaggucccaggcaaagcu

SEQ ID NO: 236969 - RNA, 20 nt, Human
uaaacucuucagcagcaaaa

SEQ ID NO: 236970 - RNA, 20 nt, Human
uaaggcaacuguccuuagac

SEQ ID NO: 236971 - RNA, 18 nt, Human
uaauucaagcauucucuc

SEQ ID NO: 236972 - RNA, 23 nt, Human
uacaggcuagcaaagcccaagaa

SEQ ID NO: 236973 - RNA, 22 nt, Human
uacuucacacucuccggaaagc

SEQ ID NO: 236974 - RNA, 24 nt, Human
uaggaagagccaaauccauagaug

SEQ ID NO: 236975 - RNA, 18 nt, Human
uauaauacacaagaacac

SEQ ID NO: 236976 - RNA, 21 nt, Human
uauguugggaaaagaaagauc

SEQ ID NO: 236977 - RNA, 21 nt, Human
uauugauacaaguuauuuuaa

SEQ ID NO: 236978 - RNA, 24 nt, Human
ucaacuucccucuaacuccuccua

SEQ ID NO: 236979 - RNA, 23 nt, Human
ucaaugccaugcugggaaucuau

SEQ ID NO: 236980 - RNA, 20 nt, Human
ucagggccugacuuagagga

SEQ ID NO: 236981 - RNA, 24 nt, Human
uccaaagugaaccuggagcagaga

SEQ ID NO: 236982 - RNA, 19 nt, Human
uccaccaaggccucaaagc

SEQ ID NO: 236983 - RNA, 22 nt, Human
uccauagauguugaaauaacag

SEQ ID NO: 236984 - RNA, 20 nt, Human
ucccaucaaaugaccuggcu

SEQ ID NO: 236985 - RNA, 22 nt, Human
uccuagguacucgguaggacuc

SEQ ID NO: 236986 - RNA, 22 nt, Human
ucuaauucaagcauucucuaac

SEQ ID NO: 236987 - RNA, 19 nt, Human
ucucaaugccaugcuggga

SEQ ID NO: 236988 - RNA, 24 nt, Human
ucucaaugccaugcugggaaucua

SEQ ID NO: 236989 - RNA, 22 nt, Human
ucuucagcagcaaaaucagugu

SEQ ID NO: 236990 - RNA, 18 nt, Human
ugaucuugacauuacauu

SEQ ID NO: 236991 - RNA, 18 nt, Human
ugcuacaauuuucuuccc

SEQ ID NO: 236992 - RNA, 24 nt, Human
ugcuacaauuuucuucccauccaa

SEQ ID NO: 236993 - RNA, 21 nt, Human
ugcugcaaucuuuagucugua

SEQ ID NO: 236994 - RNA, 20 nt, Human
uggaaacccugggaggaaca

SEQ ID NO: 236995 - RNA, 24 nt, Human
uggauagaaacucaccauugcaga

SEQ ID NO: 236996 - RNA, 23 nt, Human
uggcaaaaaauaaagaguuauaa

SEQ ID NO: 236997 - RNA, 30 nt, Human
uggcaaaaaauaaagaguuauaauacacaa

SEQ ID NO: 236998 - RNA, 18 nt, Human
uggcccugggagauggcu

SEQ ID NO: 236999 - RNA, 22 nt, Human
uggcuacucauggggcucugca

SEQ ID NO: 237000 - RNA, 21 nt, Human
uggggaacacaaagaaggccg

SEQ ID NO: 237001 - RNA, 23 nt, Human
uguauccuggcuacucauggggc

SEQ ID NO: 237002 - RNA, 26 nt, Human
uguuaggcauccccaucuccaaaacc

SEQ ID NO: 237003 - RNA, 21 nt, Human
uguuucccuggaaacccuggg

SEQ ID NO: 237004 - RNA, 20 nt, Human
uuacugcacuagaucagggc

SEQ ID NO: 237005 - RNA, 19 nt, Human
uucauguuguuucccugga

SEQ ID NO: 237006 - RNA, 21 nt, Human
uucccauccaccaaggccuca

SEQ ID NO: 237007 - RNA, 21 nt, Human
uuguaguaaaucaggaguucc

SEQ ID NO: 237008 - RNA, 18 nt, Human
uuguguccagcagccagg

SEQ ID NO: 237009 - RNA, 21 nt, Human
uuuuuuuuuuuuuaaagggua

SEQ ID NO: 237010 - RNA, 23 nt, Human
uuuuuuuuuuuuuuuuuaaaggg

SEQ ID NO: 237011 - RNA, 19 nt, Human
aagcccaucggugccccug

SEQ ID NO: 237012 - RNA, 22 nt, Human
acuccuucgccuccgugguacc

SEQ ID NO: 237013 - RNA, 24 nt, Human
acuccuucgccuccgugguacccu

SEQ ID NO: 237014 - RNA, 22 nt, Human
agaaggaaggagagcccaaagc

SEQ ID NO: 237015 - RNA, 21 nt, Human
cagaaaccaaagaggcuaaac

SEQ ID NO: 237016 - RNA, 19 nt, Human
cagcagaacuagaugcagc

SEQ ID NO: 237017 - RNA, 18 nt, Human
ccccuggaaaacaccucc

SEQ ID NO: 237018 - RNA, 24 nt, Human
ccccuggaaaacaccuccaacucu

SEQ ID NO: 237019 - RNA, 24 nt, Human
ccggagagcucaauggcuucuucc

SEQ ID NO: 237020 - RNA, 21 nt, Human
ggagagcucaauggcuucuuc

SEQ ID NO: 237021 - RNA, 21 nt, Human
guacagaaaccaaagaggcua

SEQ ID NO: 237022 - RNA, 23 nt, Human
gucugagaaggaaggagagccca

SEQ ID NO: 237023 - RNA, 23 nt, Human
uacagaaaccaaagaggcuaaac

SEQ ID NO: 237024 - RNA, 21 nt, Human
ucugagaaggaaggagagccc

SEQ ID NO: 237025 - RNA, 20 nt, Human
uguacagaaaccaaagaggc

SEQ ID NO: 237026 - RNA, 18 nt, Human
aaacaguccaaacaaaaa

SEQ ID NO: 237027 - RNA, 26 nt, Human
aaauaaaaacggggcucaaaucacgg

SEQ ID NO: 237028 - RNA, 23 nt, Human
agaaaauaaaaacggggcucaaa

SEQ ID NO: 237029 - RNA, 27 nt, Human
aggcacugauuuauccauugggaggaa

SEQ ID NO: 237030 - RNA, 26 nt, Human
caaaucacgugagggaaggagaaauc

SEQ ID NO: 237031 - RNA, 19 nt, Human
caacggggagcggcgcgga

SEQ ID NO: 237032 - RNA, 21 nt, Human
cacagaaaauaaaaacggggc

SEQ ID NO: 237033 - RNA, 24 nt, Human
cacccuucccuuuccccuuucuca

SEQ ID NO: 237034 - RNA, 21 nt, Human
cacuguguuaauucacaaagu

SEQ ID NO: 237035 - RNA, 21 nt, Human
cacuucagaacaccaggcacu

SEQ ID NO: 237036 - RNA, 20 nt, Human
cagucaaggcggcugcucgg

SEQ ID NO: 237037 - RNA, 18 nt, Human
ccuggaaggcaacgggga

SEQ ID NO: 237038 - RNA, 22 nt, Human
cguggcacccuucccuuucccc

SEQ ID NO: 237039 - RNA, 23 nt, Human
cguggcucacagaaaauaaaaac

SEQ ID NO: 237040 - RNA, 24 nt, Human
cuggaaggcaacggggagcggcgc

SEQ ID NO: 237041 - RNA, 18 nt, Human
gaaaacaguccaaacaaa

SEQ ID NO: 237042 - RNA, 21 nt, Human
gagcggcgcggagucccggag

SEQ ID NO: 237043 - RNA, 23 nt, Human
guccuggaaggcaacggggagcg

SEQ ID NO: 237044 - RNA, 20 nt, Human
ucacuaaaguuccagcacuu

SEQ ID NO: 237045 - RNA, 21 nt, Human
ugaaaacaguccaaacaaaaa

SEQ ID NO: 237046 - RNA, 23 nt, Human
ugcuuuguuauugaaaacagucc

SEQ ID NO: 237047 - RNA, 22 nt, Human
uuacagaauugaaacacugugu

SEQ ID NO: 237048 - RNA, 19 nt, Human
uucaaaaggaacaugagaa

SEQ ID NO: 237049 - RNA, 18 nt, Human
uucccuuuccccuuucuc

SEQ ID NO: 237050 - RNA, 20 nt, Human
uugccagauugaccccgcuc

SEQ ID NO: 237051 - RNA, 21 nt, Human
uuugcacuacaauuucaaaag

SEQ ID NO: 237052 - RNA, 20 nt, Human
uuuguuguuuucuguucucu

SEQ ID NO: 237053 - RNA, 21 nt, Human
uuuugcacuacaauuucaaaa

SEQ ID NO: 237054 - RNA, 26 nt, Human
aacaacaaaacaacacuguagagaaa

SEQ ID NO: 237055 - RNA, 24 nt, Human
acaacaaaacaacacuguagagaa

SEQ ID NO: 237056 - RNA, 18 nt, Human
acacuguagagaaaagug

SEQ ID NO: 237057 - RNA, 22 nt, Human
aggggucagggcagggcagggg

SEQ ID NO: 237058 - RNA, 19 nt, Human
aguggcccccugggcgugc

SEQ ID NO: 237059 - RNA, 24 nt, Human
caacaacaaaacaacacuguagag

SEQ ID NO: 237060 - RNA, 18 nt, Human
caacacuguagagaaaag

SEQ ID NO: 237061 - RNA, 21 nt, Human
caaggccaaggggucagggca

SEQ ID NO: 237062 - RNA, 18 nt, Human
cacggccucgaggacagg

SEQ ID NO: 237063 - RNA, 20 nt, Human
caggaguggcccccugggcg

SEQ ID NO: 237064 - RNA, 20 nt, Human
cauggccagccccgcacugg

SEQ ID NO: 237065 - RNA, 20 nt, Human
cccacggccucgaggacagg

SEQ ID NO: 237066 - RNA, 19 nt, Human
cccagggcugcacgaggcu

SEQ ID NO: 237067 - RNA, 20 nt, Human
ccucgaggacaggaaggcuc

SEQ ID NO: 237068 - RNA, 20 nt, Human
ccuguggguugggggcuggg

SEQ ID NO: 237069 - RNA, 21 nt, Human
ccuguggguugggggcugggc

SEQ ID NO: 237070 - RNA, 26 nt, Human
ccuugucccgagcgggacggcuccuc

SEQ ID NO: 237071 - RNA, 22 nt, Human
cguccggaaucccugugguuuu

SEQ ID NO: 237072 - RNA, 18 nt, Human
cuccuugcuugccccagc

SEQ ID NO: 237073 - RNA, 18 nt, Human
gccaaggggucagggcag

SEQ ID NO: 237074 - RNA, 18 nt, Human
gcccccugggcgugcuuc

SEQ ID NO: 237075 - RNA, 21 nt, Human
gcccggggagcagggccugcu

SEQ ID NO: 237076 - RNA, 19 nt, Human
gccugugggccuuacaugg

SEQ ID NO: 237077 - RNA, 19 nt, Human
gcucucaggaguggccccc

SEQ ID NO: 237078 - RNA, 18 nt, Human
ggacagagaggcucucag

SEQ ID NO: 237079 - RNA, 20 nt, Human
ggcaggaccgccugugggcc

SEQ ID NO: 237080 - RNA, 18 nt, Human
gggaggcugcccggggag

SEQ ID NO: 237081 - RNA, 18 nt, Human
gggcagggcaggggcggu

SEQ ID NO: 237082 - RNA, 19 nt, Human
ggggucagggcagggcagg

SEQ ID NO: 237083 - RNA, 18 nt, Human
gguugggggcugggcccc

SEQ ID NO: 237084 - RNA, 23 nt, Human
guggguugggggcugggccccuc

SEQ ID NO: 237085 - RNA, 22 nt, Human
uaaaaaccaacaacaacaaaac

SEQ ID NO: 237086 - RNA, 24 nt, Human
uauggccaaaguauaaaaaauaaa

SEQ ID NO: 237087 - RNA, 26 nt, Human
uccaugcuggccuugucccgagcggg

SEQ ID NO: 237088 - RNA, 21 nt, Human
ucccacggccucgaggacagg

SEQ ID NO: 237089 - RNA, 21 nt, Human
ucccugaggccggcagggagg

SEQ ID NO: 237090 - RNA, 22 nt, Human
ugccccagcucuagcuuugucc

SEQ ID NO: 237091 - RNA, 18 nt, Human
ugccuguggguugggggc

SEQ ID NO: 237092 - RNA, 20 nt, Human
uggaaggggagagauuggcc

SEQ ID NO: 237093 - RNA, 24 nt, Human
uggacagagaggcucucaggaguc

SEQ ID NO: 237094 - RNA, 18 nt, Human
ugggccccucggcgggag

SEQ ID NO: 237095 - RNA, 19 nt, Human
uggggucuggcguccggaa

SEQ ID NO: 237096 - RNA, 21 nt, Human
uguccaugcuggccuuguccc

SEQ ID NO: 237097 - RNA, 19 nt, Human
uucucuucccacggccucg

SEQ ID NO: 237098 - RNA, 21 nt, Human
uuuauucagcccagaccuggg

SEQ ID NO: 237099 - RNA, 24 nt, Human
aaacacguggcaccauuaucuaug

SEQ ID NO: 237100 - RNA, 19 nt, Human
aagaggaggagaaaugggg

SEQ ID NO: 237101 - RNA, 19 nt, Human
aagcaccaagcguagguag

SEQ ID NO: 237102 - RNA, 20 nt, Human
aagcaccaagucugagcuca

SEQ ID NO: 237103 - RNA, 21 nt, Human
aaggggcccugcgcagcuggg

SEQ ID NO: 237104 - RNA, 23 nt, Human
aaucaaaaacccacagaauugga

SEQ ID NO: 237105 - RNA, 23 nt, Human
acaaaccccacccccccaaggcc

SEQ ID NO: 237106 - RNA, 23 nt, Human
acagaagcagcaggagcuuuuug

SEQ ID NO: 237107 - RNA, 18 nt, Human
accugucugugggccuca

SEQ ID NO: 237108 - RNA, 18 nt, Human
acuggcucuuggugcugc

SEQ ID NO: 237109 - RNA, 20 nt, Human
agacaggaguugaccacgca

SEQ ID NO: 237110 - RNA, 18 nt, Human
agaggaggagaaaugggg

SEQ ID NO: 237111 - RNA, 24 nt, Human
agauauucaaguuugcugaaaaug

SEQ ID NO: 237112 - RNA, 26 nt, Human
aggccccaagggucagguagcagccc

SEQ ID NO: 237113 - RNA, 22 nt, Human
agggucccuuuccuccugagcu

SEQ ID NO: 237114 - RNA, 19 nt, Human
aguaucuugaaaaacaagg

SEQ ID NO: 237115 - RNA, 24 nt, Human
auagcaccguugaaucaaaaaccc

SEQ ID NO: 237116 - RNA, 19 nt, Human
cacgaaggggcccugcgca

SEQ ID NO: 237117 - RNA, 20 nt, Human
cagaaaacacguggcaccau

SEQ ID NO: 237118 - RNA, 18 nt, Human
cagcugggagggacaggc

SEQ ID NO: 237119 - RNA, 23 nt, Human
ccaaaucagaaaacacguggcac

SEQ ID NO: 237120 - RNA, 18 nt, Human
ccacgguggucccccucc

SEQ ID NO: 237121 - RNA, 19 nt, Human
ccaggacccugguuauagc

SEQ ID NO: 237122 - RNA, 20 nt, Human
cccacagaauuggaacaaca

SEQ ID NO: 237123 - RNA, 21 nt, Human
cccacagaauuggaacaacag

SEQ ID NO: 237124 - RNA, 22 nt, Human
ccccacccccccaaggccuucu

SEQ ID NO: 237125 - RNA, 22 nt, Human
ccccccaaggccuucucaggcc

SEQ ID NO: 237126 - RNA, 18 nt, Human
ccgauggcuggagaaagc

SEQ ID NO: 237127 - RNA, 18 nt, Human
ccgcgcucuccacggugg

SEQ ID NO: 237128 - RNA, 25 nt, Human
ccgcuuccgccgccgcugagccccu

SEQ ID NO: 237129 - RNA, 22 nt, Human
cgagcagagggggcggcucugg

SEQ ID NO: 237130 - RNA, 23 nt, Human
cgauggcuggagaaagcaagcac

SEQ ID NO: 237131 - RNA, 21 nt, Human
cgcccugucacccaggacccu

SEQ ID NO: 237132 - RNA, 24 nt, Human
cuccagcagcucuguggacaaacc

SEQ ID NO: 237133 - RNA, 19 nt, Human
gagaaagcaagcaccaagc

SEQ ID NO: 237134 - RNA, 19 nt, Human
gagcagagggggcggcucu

SEQ ID NO: 237135 - RNA, 23 nt, Human
gcccugucacccaggacccuggg

SEQ ID NO: 237136 - RNA, 19 nt, Human
gccugaagacaggaguuga

SEQ ID NO: 237137 - RNA, 20 nt, Human
gcuccacugugucuguggug

SEQ ID NO: 237138 - RNA, 19 nt, Human
ggacaaaccccaccccccc

SEQ ID NO: 237139 - RNA, 21 nt, Human
ggagaaaugggguucggccug

SEQ ID NO: 237140 - RNA, 22 nt, Human
ggagggacaggcgggguacaga

SEQ ID NO: 237141 - RNA, 25 nt, Human
ggguggggguuguggagagggaagc

SEQ ID NO: 237142 - RNA, 25 nt, Human
ggugggggccgggcugggugagggc

SEQ ID NO: 237143 - RNA, 18 nt, Human
gucccuuuccuccugagc

SEQ ID NO: 237144 - RNA, 21 nt, Human
gucugugggccucaucccggu

SEQ ID NO: 237145 - RNA, 19 nt, Human
uacagaagcagcaggagcu

SEQ ID NO: 237146 - RNA, 21 nt, Human
uagcagccccccaugaaugau

SEQ ID NO: 237147 - RNA, 23 nt, Human
uaggggucuggacaggguggggg

SEQ ID NO: 237148 - RNA, 22 nt, Human
ucagaaaacacguggcaccauu

SEQ ID NO: 237149 - RNA, 20 nt, Human
uccaagggcccagaugucca

SEQ ID NO: 237150 - RNA, 22 nt, Human
uccgcaguggccgggcugggac

SEQ ID NO: 237151 - RNA, 24 nt, Human
ucuccgauggcuggaagugcguca

SEQ ID NO: 237152 - RNA, 23 nt, Human
ucuugaaaaacaagggguggggg

SEQ ID NO: 237153 - RNA, 20 nt, Human
ugaagacaggaguugaccac

SEQ ID NO: 237154 - RNA, 18 nt, Human
ugacaaccugucuguggg

SEQ ID NO: 237155 - RNA, 21 nt, Human
ugagcgcccugucacccagga

SEQ ID NO: 237156 - RNA, 25 nt, Human
ugagcgcccugucacccaggacccu

SEQ ID NO: 237157 - RNA, 18 nt, Human
ugagcucgguggcuugaa

SEQ ID NO: 237158 - RNA, 19 nt, Human
ugcucagugagcgcccugu

SEQ ID NO: 237159 - RNA, 19 nt, Human
uggaagagaggucuagaua

SEQ ID NO: 237160 - RNA, 21 nt, Human
uggacaaaccccaccccccca

SEQ ID NO: 237161 - RNA, 22 nt, Human
uggacaaaccccacccccccaa

SEQ ID NO: 237162 - RNA, 21 nt, Human
uggagaagagcgcggcuccac

SEQ ID NO: 237163 - RNA, 21 nt, Human
ugggagggucccuuuccuccu

SEQ ID NO: 237164 - RNA, 19 nt, Human
ugggggccgggcuggguga

SEQ ID NO: 237165 - RNA, 22 nt, Human
ugggggccgggcugggugaggg

SEQ ID NO: 237166 - RNA, 19 nt, Human
uggggguuguggagaggga

SEQ ID NO: 237167 - RNA, 23 nt, Human
uggggguuguggagagggaagca

SEQ ID NO: 237168 - RNA, 22 nt, Human
ugggguucggccugacccucuc

SEQ ID NO: 237169 - RNA, 18 nt, Human
ugucacccaggacccugg

SEQ ID NO: 237170 - RNA, 22 nt, Human
uguccaauauuaaaugccaaua

SEQ ID NO: 237171 - RNA, 22 nt, Human
uuccaaguuucaaguaugugua

SEQ ID NO: 237172 - RNA, 24 nt, Human
uugaaaaacaagggguggggguug

SEQ ID NO: 237173 - RNA, 21 nt, Human
uuggaacaacaggaagaugag

SEQ ID NO: 237174 - RNA, 21 nt, Human
aacuucugcuugacaguucca

SEQ ID NO: 237175 - RNA, 22 nt, Human
acccuaagggcugggagaagag

SEQ ID NO: 237176 - RNA, 20 nt, Human
agauacugacagcuggccuc

SEQ ID NO: 237177 - RNA, 23 nt, Human
aggggccaguggugguuugcaga

SEQ ID NO: 237178 - RNA, 21 nt, Human
cauggguuucuugguaagcuc

SEQ ID NO: 237179 - RNA, 18 nt, Human
ccucugaaggagggugaa

SEQ ID NO: 237180 - RNA, 20 nt, Human
ccucugaaggagggugaaaa

SEQ ID NO: 237181 - RNA, 21 nt, Human
cucggugcugggccugggagc

SEQ ID NO: 237182 - RNA, 25 nt, Human
cugagguaauggcagccucagaccc

SEQ ID NO: 237183 - RNA, 20 nt, Human
gcugacauggguuucuuggu

SEQ ID NO: 237184 - RNA, 24 nt, Human
ggaaggccuuggccgagcaggacc

SEQ ID NO: 237185 - RNA, 19 nt, Human
ggcugggagaagagugcug

SEQ ID NO: 237186 - RNA, 23 nt, Human
ucagaccccugccauuaggggcc

SEQ ID NO: 237187 - RNA, 19 nt, Human
ugacauggguuucuuggua

SEQ ID NO: 237188 - RNA, 21 nt, Human
ugcugacauggguuucuuggu

SEQ ID NO: 237189 - RNA, 23 nt, Human
uggccgagcaggacccuaagggc

SEQ ID NO: 237190 - RNA, 23 nt, Human
uuucuugguaagcuccugaggua

SEQ ID NO: 237191 - RNA, 18 nt, Human
aacacguucuuuuggcaa

SEQ ID NO: 237192 - RNA, 27 nt, Human
aagaauaaacaggggugaccgguaccc

SEQ ID NO: 237193 - RNA, 20 nt, Human
aaucuuaaaauaccuggcug

SEQ ID NO: 237194 - RNA, 19 nt, Human
aauguaaaagauuugcagu

SEQ ID NO: 237195 - RNA, 19 nt, Human
acacaccgagccagaggcc

SEQ ID NO: 237196 - RNA, 20 nt, Human
agaauaguucauuguacagu

SEQ ID NO: 237197 - RNA, 18 nt, Human
agggagcugcgucaggcc

SEQ ID NO: 237198 - RNA, 26 nt, Human
caagaauaaacaggggugacacacaa

SEQ ID NO: 237199 - RNA, 24 nt, Human
cagcagaaucuuaaaauaccuggc

SEQ ID NO: 237200 - RNA, 23 nt, Human
cagcuucaucaagaccaucaguc

SEQ ID NO: 237201 - RNA, 18 nt, Human
cauuucauaacaugugca

SEQ ID NO: 237202 - RNA, 21 nt, Human
ccccgaaacuuuuaguuuccg

SEQ ID NO: 237203 - RNA, 22 nt, Human
cuaacuuugucaaagcagaaca

SEQ ID NO: 237204 - RNA, 18 nt, Human
cuuuagccauuuuucaug

SEQ ID NO: 237205 - RNA, 25 nt, Human
gaaaaugaguagaacuuaccaugac

SEQ ID NO: 237206 - RNA, 20 nt, Human
gagaaccacaggucaagaga

SEQ ID NO: 237207 - RNA, 20 nt, Human
gcuggcaucucuuuucuuug

SEQ ID NO: 237208 - RNA, 21 nt, Human
ggccaauggugucuuuauuua

SEQ ID NO: 237209 - RNA, 18 nt, Human
ggucaagagucaucucuu

SEQ ID NO: 237210 - RNA, 19 nt, Human
uacccuagcaauagaacaa

SEQ ID NO: 237211 - RNA, 24 nt, Human
uaugaaauaaggccuguggcuuga

SEQ ID NO: 237212 - RNA, 19 nt, Human
ucaggaauaguaagguaca

SEQ ID NO: 237213 - RNA, 21 nt, Human
uccacacaccgagccagaggc

SEQ ID NO: 237214 - RNA, 22 nt, Human
ucucuaaacagcagcagaaucu

SEQ ID NO: 237215 - RNA, 26 nt, Human
ucucuucaagcagaguuugagggagc

SEQ ID NO: 237216 - RNA, 19 nt, Human
ucucuuuucuuuguaacaa

SEQ ID NO: 237217 - RNA, 23 nt, Human
ucuuuguaacaaauaauucacuu

SEQ ID NO: 237218 - RNA, 23 nt, Human
ugacaaaguguaagaaaaaacau

SEQ ID NO: 237219 - RNA, 18 nt, Human
ugaguagaacuuaccaug

SEQ ID NO: 237220 - RNA, 21 nt, Human
ugaguagaacuuaccaugaca

SEQ ID NO: 237221 - RNA, 23 nt, Human
ugaguagaacuuaccaugacaaa

SEQ ID NO: 237222 - RNA, 24 nt, Human
ugcauggaggagaaagaacgucug

SEQ ID NO: 237223 - RNA, 22 nt, Human
ugcccagugcccucuuugcccu

SEQ ID NO: 237224 - RNA, 23 nt, Human
uguauauacaaaguuuuuguaug

SEQ ID NO: 237225 - RNA, 22 nt, Human
uuaaaauuauuuuaaugacaau

SEQ ID NO: 237226 - RNA, 18 nt, Human
uucacagaacugcaaggu

SEQ ID NO: 237227 - RNA, 22 nt, Human
uucaguuggacacaaauguauu

SEQ ID NO: 237228 - RNA, 23 nt, Human
uuuacccuagcaauagaacaaaa

SEQ ID NO: 237229 - RNA, 23 nt, Human
uuucaucacuuuugugcaaggca

SEQ ID NO: 237230 - RNA, 23 nt, Human
uuugugcaaggcaugacauaacu

SEQ ID NO: 237231 - RNA, 21 nt, Human
aaaggcagcgucguaacuggc

SEQ ID NO: 237232 - RNA, 18 nt, Human
aaagggaaucugcacaug

SEQ ID NO: 237233 - RNA, 19 nt, Human
aaagugcucccuuccuauc

SEQ ID NO: 237234 - RNA, 23 nt, Human
aaccauuuggcaaaggcauccaa

SEQ ID NO: 237235 - RNA, 21 nt, Human
aaguaggauucauuuccauag

SEQ ID NO: 237236 - RNA, 22 nt, Human
aaugacagugguauagaaagaa

SEQ ID NO: 237237 - RNA, 18 nt, Human
aaugggugacaaccaggc

SEQ ID NO: 237238 - RNA, 22 nt, Human
acaaaucucacuuucagaagcc

SEQ ID NO: 237239 - RNA, 23 nt, Human
acaugcacauccguguuucuaca

SEQ ID NO: 237240 - RNA, 19 nt, Human
acccaggcuggagugcagu

SEQ ID NO: 237241 - RNA, 18 nt, Human
acucugucacccaggcug

SEQ ID NO: 237242 - RNA, 21 nt, Human
acucugucacccaggcuggag

SEQ ID NO: 237243 - RNA, 24 nt, Human
acucugucacccaggcuggagugc

SEQ ID NO: 237244 - RNA, 20 nt, Human
agcagguggccuugaauucu

SEQ ID NO: 237245 - RNA, 25 nt, Human
aggcguugcaaaguuaccaugagcu

SEQ ID NO: 237246 - RNA, 25 nt, Human
agguauauauuuuucucuaugccag

SEQ ID NO: 237247 - RNA, 22 nt, Human
agugaacaagcgcagaggaguu

SEQ ID NO: 237248 - RNA, 24 nt, Human
agugcaguagugcaagcucggcuc

SEQ ID NO: 237249 - RNA, 23 nt, Human
auucaaaauacugccuuaguaau

SEQ ID NO: 237250 - RNA, 18 nt, Human
auuugaguggaaaaagcu

SEQ ID NO: 237251 - RNA, 19 nt, Human
auuuuuaauaccugcaaaa

SEQ ID NO: 237252 - RNA, 24 nt, Human
caaauacagaucaaaugcaaauaa

SEQ ID NO: 237253 - RNA, 23 nt, Human
cacaaagauaaaccaacucguau

SEQ ID NO: 237254 - RNA, 19 nt, Human
cacacugucagcaccaccu

SEQ ID NO: 237255 - RNA, 19 nt, Human
cacagaaagaguaaaauuu

SEQ ID NO: 237256 - RNA, 21 nt, Human
cacuaaguaggauucauuucc

SEQ ID NO: 237257 - RNA, 24 nt, Human
cagcaaauacuguaaggggcccau

SEQ ID NO: 237258 - RNA, 24 nt, Human
cagcaggcugggccacugcugggu

SEQ ID NO: 237259 - RNA, 20 nt, Human
cagggugugcugcugcagag

SEQ ID NO: 237260 - RNA, 24 nt, Human
caguacaacacaaugaaguauuac

SEQ ID NO: 237261 - RNA, 22 nt, Human
cagugucaaacucauucaaaau

SEQ ID NO: 237262 - RNA, 20 nt, Human
cauauuugucuucaucacaa

SEQ ID NO: 237263 - RNA, 21 nt, Human
cauucaaaauacugccuuagu

SEQ ID NO: 237264 - RNA, 19 nt, Human
ccacacugucagcaccacc

SEQ ID NO: 237265 - RNA, 21 nt, Human
ccaggcucccagguggagcug

SEQ ID NO: 237266 - RNA, 25 nt, Human
ccagguauauauuuuucucuaugcc

SEQ ID NO: 237267 - RNA, 24 nt, Human
ccauccacaaggccaagucugagg

SEQ ID NO: 237268 - RNA, 18 nt, Human
cccaacuccuagccuaga

SEQ ID NO: 237269 - RNA, 22 nt, Human
cccaugagcuuauacuuaguuc

SEQ ID NO: 237270 - RNA, 20 nt, Human
cccccauucucgcagccaaa

SEQ ID NO: 237271 - RNA, 18 nt, Human
ccccccauucucgcagcc

SEQ ID NO: 237272 - RNA, 22 nt, Human
cccuucaucucucuucccuccu

SEQ ID NO: 237273 - RNA, 22 nt, Human
ccuacuuugccaaaaaccgugc

SEQ ID NO: 237274 - RNA, 20 nt, Human
ccucccauccucucucccuc

SEQ ID NO: 237275 - RNA, 24 nt, Human
ccucccauccucucucccucucca

SEQ ID NO: 237276 - RNA, 22 nt, Human
ccucgccucccauccucucucc

SEQ ID NO: 237277 - RNA, 20 nt, Human
cuacaacggaggcaacaacc

SEQ ID NO: 237278 - RNA, 20 nt, Human
cuagaaagugcucccuuccu

SEQ ID NO: 237279 - RNA, 18 nt, Human
cuaguucucagcaggcug

SEQ ID NO: 237280 - RNA, 21 nt, Human
cugccuggaugccaacugcau

SEQ ID NO: 237281 - RNA, 24 nt, Human
cugccuggaugccaacugcaugag

SEQ ID NO: 237282 - RNA, 19 nt, Human
cuggagcaggccggaaagg

SEQ ID NO: 237283 - RNA, 23 nt, Human
cuguuccuucccucaggcugccu

SEQ ID NO: 237284 - RNA, 24 nt, Human
cuuacucugucacccaggcuggag

SEQ ID NO: 237285 - RNA, 22 nt, Human
cuucacagcccuccccacugug

SEQ ID NO: 237286 - RNA, 21 nt, Human
cuugcccuucaucucucuucc

SEQ ID NO: 237287 - RNA, 19 nt, Human
gauuucuaucagagaccuc

SEQ ID NO: 237288 - RNA, 21 nt, Human
gcaaaggagaaaccgucugaa

SEQ ID NO: 237289 - RNA, 18 nt, Human
gcaggacuuuuuuuuuuu

SEQ ID NO: 237290 - RNA, 21 nt, Human
gcccccuacuuugccaaaaac

SEQ ID NO: 237291 - RNA, 21 nt, Human
gccccggucuugcccuucauc

SEQ ID NO: 237292 - RNA, 18 nt, Human
gcccucagacagccgccu

SEQ ID NO: 237293 - RNA, 22 nt, Human
gcgccaggcucccagguggagc

SEQ ID NO: 237294 - RNA, 21 nt, Human
gcucuguuucagggugcagug

SEQ ID NO: 237295 - RNA, 20 nt, Human
gcugcagagggcugccugga

SEQ ID NO: 237296 - RNA, 23 nt, Human
ggaaaugugcccccuacuuugcc

SEQ ID NO: 237297 - RNA, 26 nt, Human
ggagaaaccgucugaaccuuugcagg

SEQ ID NO: 237298 - RNA, 18 nt, Human
ggagauaugccaaugaaa

SEQ ID NO: 237299 - RNA, 22 nt, Human
ggcaacuuugaaaugugugguc

SEQ ID NO: 237300 - RNA, 22 nt, Human
ggggcccaccaacuacaacgga

SEQ ID NO: 237301 - RNA, 24 nt, Human
gucaggaccuggcucagcuuccau

SEQ ID NO: 237302 - RNA, 22 nt, Human
gugcaaaggagaaaccgucuga

SEQ ID NO: 237303 - RNA, 23 nt, Human
guguccacaugaaccauuuggca

SEQ ID NO: 237304 - RNA, 23 nt, Human
guugucuucuguuaagcaggugg

SEQ ID NO: 237305 - RNA, 22 nt, Human
uaaacaagugaaagaaucacaa

SEQ ID NO: 237306 - RNA, 22 nt, Human
uaaagcaaaaucuuuuaccaaa

SEQ ID NO: 237307 - RNA, 20 nt, Human
uaaccaaaggaauuaaagaa

SEQ ID NO: 237308 - RNA, 23 nt, Human
uaaggggcccauccacaaggcca

SEQ ID NO: 237309 - RNA, 21 nt, Human
uaauuugaguggaaaaagcua

SEQ ID NO: 237310 - RNA, 18 nt, Human
uacaacggaggcaacaac

SEQ ID NO: 237311 - RNA, 20 nt, Human
uacacaaagauaaaccaacu

SEQ ID NO: 237312 - RNA, 26 nt, Human
uacuuugccaaaaaccgugcacaucu

SEQ ID NO: 237313 - RNA, 18 nt, Human
uaucagagaccucagauc

SEQ ID NO: 237314 - RNA, 20 nt, Human
uaugccagccuugccagggc

SEQ ID NO: 237315 - RNA, 19 nt, Human
ucaaguccacacugucagc

SEQ ID NO: 237316 - RNA, 21 nt, Human
ucacauugaacuugacacaga

SEQ ID NO: 237317 - RNA, 22 nt, Human
ucacccaggcuggagugcagua

SEQ ID NO: 237318 - RNA, 19 nt, Human
ucacugcaaccucaggcag

SEQ ID NO: 237319 - RNA, 27 nt, Human
ucacugcaaccucaggcagggggcccu

SEQ ID NO: 237320 - RNA, 20 nt, Human
ucacuggguuauagucaugu

SEQ ID NO: 237321 - RNA, 18 nt, Human
ucauuuggcauaagugug

SEQ ID NO: 237322 - RNA, 23 nt, Human
uccacaaggccaagucugaggcc

SEQ ID NO: 237323 - RNA, 26 nt, Human
uccagccuugagccacaaaaacuggg

SEQ ID NO: 237324 - RNA, 23 nt, Human
ucccauccucucucccucuccag

SEQ ID NO: 237325 - RNA, 20 nt, Human
ucgcuggauggaaggaagcc

SEQ ID NO: 237326 - RNA, 19 nt, Human
ucuaugccagguauacagg

SEQ ID NO: 237327 - RNA, 19 nt, Human
ucuccuuuuucuucugauu

SEQ ID NO: 237328 - RNA, 23 nt, Human
ucuccuuuuucuucugauuuucu

SEQ ID NO: 237329 - RNA, 18 nt, Human
ucucugcugucaggccaa

SEQ ID NO: 237330 - RNA, 20 nt, Human
ucugcacaugcacauccgug

SEQ ID NO: 237331 - RNA, 24 nt, Human
ucugucacccaggcuggagugcag

SEQ ID NO: 237332 - RNA, 19 nt, Human
ucuuaaaugucugccauag

SEQ ID NO: 237333 - RNA, 23 nt, Human
ucuuacucugucacccaggcugg

SEQ ID NO: 237334 - RNA, 24 nt, Human
ucuuacucugucacccaggcugga

SEQ ID NO: 237335 - RNA, 22 nt, Human
ugaaagaaucacauucuguagg

SEQ ID NO: 237336 - RNA, 19 nt, Human
ugaacaagcgcagaggagu

SEQ ID NO: 237337 - RNA, 19 nt, Human
ugaauaaaugccuaucaca

SEQ ID NO: 237338 - RNA, 24 nt, Human
ugacucagaaauuccaaaagaagg

SEQ ID NO: 237339 - RNA, 20 nt, Human
ugagaaagagagaauaaggc

SEQ ID NO: 237340 - RNA, 20 nt, Human
ugagagugugacuuucugga

SEQ ID NO: 237341 - RNA, 18 nt, Human
ugagccuucacagcccuc

SEQ ID NO: 237342 - RNA, 20 nt, Human
ugagugcagcccauauacaa

SEQ ID NO: 237343 - RNA, 21 nt, Human
ugcaaaggagaaaccgucuga

SEQ ID NO: 237344 - RNA, 24 nt, Human
ugcaaagggaauucucuuugaaag

SEQ ID NO: 237345 - RNA, 23 nt, Human
ugccaaugaaauagacuaucuuu

SEQ ID NO: 237346 - RNA, 18 nt, Human
ugcccuucaucucucuuc

SEQ ID NO: 237347 - RNA, 19 nt, Human
uggaaaaagcuaaggaaaa

SEQ ID NO: 237348 - RNA, 23 nt, Human
uggaaaugugcccccuacuuugc

SEQ ID NO: 237349 - RNA, 18 nt, Human
uggagugcaguagugcaa

SEQ ID NO: 237350 - RNA, 24 nt, Human
uggagugcaguagugcaagcucgg

SEQ ID NO: 237351 - RNA, 18 nt, Human
uggcaagaggcugcuugg

SEQ ID NO: 237352 - RNA, 19 nt, Human
ugggccacugcuggguggc

SEQ ID NO: 237353 - RNA, 19 nt, Human
uggggcaggggagaaaugc

SEQ ID NO: 237354 - RNA, 25 nt, Human
uggggcaggggagaaaugcuucuca

SEQ ID NO: 237355 - RNA, 20 nt, Human
uggguuauagucauguacac

SEQ ID NO: 237356 - RNA, 20 nt, Human
uguaauuauuuuucuccaau

SEQ ID NO: 237357 - RNA, 23 nt, Human
ugucaggaccuggcucagcuucc

SEQ ID NO: 237358 - RNA, 27 nt, Human
uguucagaaggugguggcacuaacauu

SEQ ID NO: 237359 - RNA, 24 nt, Human
uuacucugucacccaggcuggagu

SEQ ID NO: 237360 - RNA, 23 nt, Human
uucagauaaaggccccugcucau

SEQ ID NO: 237361 - RNA, 23 nt, Human
uuccaaaagaaggucagucuaug

SEQ ID NO: 237362 - RNA, 22 nt, Human
uucuccuuuuucuucugauuuu

SEQ ID NO: 237363 - RNA, 24 nt, Human
uugaaacuauuuucuuaaaaccaa

SEQ ID NO: 237364 - RNA, 24 nt, Human
uuggagagcucccaacagaaguca

SEQ ID NO: 237365 - RNA, 23 nt, Human
uuucuaguucucagcaggcuggg

SEQ ID NO: 237366 - RNA, 24 nt, Human
uuuuuuuuuuuuuuuuugacaugg

SEQ ID NO: 237367 - RNA, 27 nt, Human
uuuuuuuuuuuuuuuuuuuuuuugggg

SEQ ID NO: 237368 - RNA, 23 nt, Human
aaaacacaacacaguacccaaaa

SEQ ID NO: 237369 - RNA, 22 nt, Human
aaacagaacccaggaucccuaa

SEQ ID NO: 237370 - RNA, 23 nt, Human
aaacaugugugcgacccacaaag

SEQ ID NO: 237371 - RNA, 21 nt, Human
aaagcaaauacgagacuuaga

SEQ ID NO: 237372 - RNA, 23 nt, Human
aaagcagaguuguugggggcggg

SEQ ID NO: 237373 - RNA, 20 nt, Human
aaagggccauuucaccaaug

SEQ ID NO: 237374 - RNA, 23 nt, Human
aacacaguacccaaaaacggagg

SEQ ID NO: 237375 - RNA, 21 nt, Human
aagcaaauacgagacuuagac

SEQ ID NO: 237376 - RNA, 22 nt, Human
aaugucauuuguaccaaauggc

SEQ ID NO: 237377 - RNA, 22 nt, Human
acaaaugucauuuguaccaaau

SEQ ID NO: 237378 - RNA, 20 nt, Human
acacaacacaguacccaaaa

SEQ ID NO: 237379 - RNA, 22 nt, Human
acagcccugguuacagaagcca

SEQ ID NO: 237380 - RNA, 21 nt, Human
accaagaccugggguugguuc

SEQ ID NO: 237381 - RNA, 22 nt, Human
accagcccagcaccugucucca

SEQ ID NO: 237382 - RNA, 26 nt, Human
accagcuacccucaacacagggccag

SEQ ID NO: 237383 - RNA, 22 nt, Human
acucgagggcaucucuuucaca

SEQ ID NO: 237384 - RNA, 18 nt, Human
acuguguggccggcucug

SEQ ID NO: 237385 - RNA, 33 nt, Human
agaaacuagucaaaaacucuuuaaaggacaaaa

SEQ ID NO: 237386 - RNA, 19 nt, Human
agaagagccagcugccuuc

SEQ ID NO: 237387 - RNA, 22 nt, Human
agaccugggguugguucugggc

SEQ ID NO: 237388 - RNA, 23 nt, Human
agagaauaaugacuuagagccca

SEQ ID NO: 237389 - RNA, 22 nt, Human
agagcaaaguuuccccucccuu

SEQ ID NO: 237390 - RNA, 22 nt, Human
agcaaagcaaauacgagacuua

SEQ ID NO: 237391 - RNA, 18 nt, Human
agcaguucagggacccug

SEQ ID NO: 237392 - RNA, 19 nt, Human
agccuuccuagguuuugcc

SEQ ID NO: 237393 - RNA, 24 nt, Human
agcgcucuucccaggaccccacuc

SEQ ID NO: 237394 - RNA, 19 nt, Human
agcugcuuuuuucuuccuu

SEQ ID NO: 237395 - RNA, 24 nt, Human
aggaugacugcccuccaacaacug

SEQ ID NO: 237396 - RNA, 18 nt, Human
aggcagcaagcagaggga

SEQ ID NO: 237397 - RNA, 22 nt, Human
aggccuccagccccaggcccag

SEQ ID NO: 237398 - RNA, 22 nt, Human
agggaagagccgauguuggacg

SEQ ID NO: 237399 - RNA, 24 nt, Human
agucagggacuuucaacucuccaa

SEQ ID NO: 237400 - RNA, 21 nt, Human
aguguuuugguccacucuuuu

SEQ ID NO: 237401 - RNA, 20 nt, Human
auacuugugagaccuguucu

SEQ ID NO: 237402 - RNA, 25 nt, Human
aucccucucugcucaggaaccacca

SEQ ID NO: 237403 - RNA, 18 nt, Human
augcugcaggaggaccag

SEQ ID NO: 237404 - RNA, 22 nt, Human
augcuuuccaaaggcccacacc

SEQ ID NO: 237405 - RNA, 20 nt, Human
auggggucucacagggcuag

SEQ ID NO: 237406 - RNA, 24 nt, Human
caaaacacaacacaguacccaaaa

SEQ ID NO: 237407 - RNA, 23 nt, Human
caaaagccaaagucacacacugc

SEQ ID NO: 237408 - RNA, 21 nt, Human
caaaagcucuggagcagcuua

SEQ ID NO: 237409 - RNA, 19 nt, Human
caaacugggaagaacuuca

SEQ ID NO: 237410 - RNA, 20 nt, Human
caaagcaaauacgagacuua

SEQ ID NO: 237411 - RNA, 24 nt, Human
caaagcucucauucuuccucuaaa

SEQ ID NO: 237412 - RNA, 21 nt, Human
cacaacacaguacccaaaaac

SEQ ID NO: 237413 - RNA, 24 nt, Human
cacacagacagcaaagcaaauacg

SEQ ID NO: 237414 - RNA, 23 nt, Human
cacacuguucuuuuucuucucug

SEQ ID NO: 237415 - RNA, 26 nt, Human
caccucaacugcccaguggaaacugg

SEQ ID NO: 237416 - RNA, 18 nt, Human
caccugucuccauccccu

SEQ ID NO: 237417 - RNA, 20 nt, Human
cacuguguggccggcucugc

SEQ ID NO: 237418 - RNA, 23 nt, Human
cacuguucuuuuucuucucuggc

SEQ ID NO: 237419 - RNA, 18 nt, Human
cagagaagaaacgugcac

SEQ ID NO: 237420 - RNA, 24 nt, Human
cagagcaaaacacaacacaguacc

SEQ ID NO: 237421 - RNA, 18 nt, Human
cagcacacagacagcaaa

SEQ ID NO: 237422 - RNA, 23 nt, Human
cagccccaggcccaguuccuccc

SEQ ID NO: 237423 - RNA, 20 nt, Human
caggaaccaccacguccugu

SEQ ID NO: 237424 - RNA, 21 nt, Human
caggccccacaguugcagggg

SEQ ID NO: 237425 - RNA, 26 nt, Human
cagggaaagacucaauuuuuaaccag

SEQ ID NO: 237426 - RNA, 22 nt, Human
caguaccauacauaugcaaaga

SEQ ID NO: 237427 - RNA, 21 nt, Human
caucacugacugggcccgcag

SEQ ID NO: 237428 - RNA, 21 nt, Human
caucaguaaauggagcuacca

SEQ ID NO: 237429 - RNA, 25 nt, Human
ccaauggagaccaagaccugggguu

SEQ ID NO: 237430 - RNA, 22 nt, Human
ccagaagcacccguccccgcug

SEQ ID NO: 237431 - RNA, 28 nt, Human
ccagcccagcaccugucuccauccccuu

SEQ ID NO: 237432 - RNA, 22 nt, Human
ccagugccuuuaagcaagcuuc

SEQ ID NO: 237433 - RNA, 24 nt, Human
cccacaccaggcagcaagcagagg

SEQ ID NO: 237434 - RNA, 22 nt, Human
cccacuuuuauuacagacauca

SEQ ID NO: 237435 - RNA, 23 nt, Human
cccaguuccucccuucuccuucc

SEQ ID NO: 237436 - RNA, 21 nt, Human
ccccggaagucuguuuuugcc

SEQ ID NO: 237437 - RNA, 20 nt, Human
ccccucccuuucuuacuuuc

SEQ ID NO: 237438 - RNA, 26 nt, Human
cccucccuuucuuacuuucaaacaaa

SEQ ID NO: 237439 - RNA, 19 nt, Human
ccgggccagcgcuucccag

SEQ ID NO: 237440 - RNA, 25 nt, Human
ccuagacugaacccucuaagaaggc

SEQ ID NO: 237441 - RNA, 22 nt, Human
ccuccagccccaggcccaguuc

SEQ ID NO: 237442 - RNA, 28 nt, Human
ccucccuaaaagcagaguuguugggaaa

SEQ ID NO: 237443 - RNA, 19 nt, Human
ccucccuucuccuuccagg

SEQ ID NO: 237444 - RNA, 19 nt, Human
ccugagcagcuggccuggg

SEQ ID NO: 237445 - RNA, 20 nt, Human
ccugagcagcuggccuggga

SEQ ID NO: 237446 - RNA, 18 nt, Human
ccugcaggggcggggguc

SEQ ID NO: 237447 - RNA, 20 nt, Human
cgagaccaccccgagcgcca

SEQ ID NO: 237448 - RNA, 21 nt, Human
cgagaccaccccgagcgccaa

SEQ ID NO: 237449 - RNA, 19 nt, Human
cuaggaaaauggcugaaau

SEQ ID NO: 237450 - RNA, 20 nt, Human
cucaacacagggccaggaga

SEQ ID NO: 237451 - RNA, 20 nt, Human
cuccagaagcacccgucccc

SEQ ID NO: 237452 - RNA, 19 nt, Human
cuccagccccaggcccagu

SEQ ID NO: 237453 - RNA, 18 nt, Human
cucugggaacaugagccu

SEQ ID NO: 237454 - RNA, 18 nt, Human
cugcaccugcagugccaa

SEQ ID NO: 237455 - RNA, 20 nt, Human
cugggaacaugagccuuccu

SEQ ID NO: 237456 - RNA, 23 nt, Human
cugggguugguucugggcuccug

SEQ ID NO: 237457 - RNA, 26 nt, Human
cuggugcaugggcccugcaggggcgg

SEQ ID NO: 237458 - RNA, 21 nt, Human
cugguuacagaagccaccuca

SEQ ID NO: 237459 - RNA, 18 nt, Human
cuguaucugcagaucccu

SEQ ID NO: 237460 - RNA, 23 nt, Human
cugucaagaaaaagaaacuaguc

SEQ ID NO: 237461 - RNA, 25 nt, Human
cuucucccccgcuucagcaucaccu

SEQ ID NO: 237462 - RNA, 21 nt, Human
cuucucugggaacaugagccu

SEQ ID NO: 237463 - RNA, 19 nt, Human
gaaaaagaaacuagucaaa

SEQ ID NO: 237464 - RNA, 23 nt, Human
gaaaaagaaacuagucaaaaacu

SEQ ID NO: 237465 - RNA, 18 nt, Human
gaaggcaaaggaggaugg

SEQ ID NO: 237466 - RNA, 19 nt, Human
gaaggcaaaggaggauggc

SEQ ID NO: 237467 - RNA, 20 nt, Human
gaccccuucaguguagcagg

SEQ ID NO: 237468 - RNA, 24 nt, Human
gacugaacccucuaagaaggccca

SEQ ID NO: 237469 - RNA, 23 nt, Human
gagaccaccccgagcgccaagcc

SEQ ID NO: 237470 - RNA, 25 nt, Human
gagcaaaacacaacacaguacccaa

SEQ ID NO: 237471 - RNA, 22 nt, Human
gagcuaccauguauauuuuagu

SEQ ID NO: 237472 - RNA, 20 nt, Human
gaugugagcucauuacaacc

SEQ ID NO: 237473 - RNA, 20 nt, Human
gauuacagggugugauccca

SEQ ID NO: 237474 - RNA, 21 nt, Human
gcaaaacacaacacaguaccc

SEQ ID NO: 237475 - RNA, 20 nt, Human
gcccaguuccucccuucucc

SEQ ID NO: 237476 - RNA, 19 nt, Human
gcugcagaccugccgagcc

SEQ ID NO: 237477 - RNA, 19 nt, Human
ggaccagcuccagaagcac

SEQ ID NO: 237478 - RNA, 21 nt, Human
gggaagcuuugcaugggagaa

SEQ ID NO: 237479 - RNA, 24 nt, Human
gggaagcuuugcaugggagaaggc

SEQ ID NO: 237480 - RNA, 21 nt, Human
gggaaggcugguaucugaggu

SEQ ID NO: 237481 - RNA, 23 nt, Human
gggaucccaggccuccagccccc

SEQ ID NO: 237482 - RNA, 23 nt, Human
gggcccugcaggggcgggggucc

SEQ ID NO: 237483 - RNA, 19 nt, Human
gggcggggguccugcccaa

SEQ ID NO: 237484 - RNA, 19 nt, Human
ggggcggggcgggguuugg

SEQ ID NO: 237485 - RNA, 20 nt, Human
ggguccugcccaacuuggcc

SEQ ID NO: 237486 - RNA, 21 nt, Human
guaauuggagggaagagccga

SEQ ID NO: 237487 - RNA, 20 nt, Human
gugaucccaaaagccaaagu

SEQ ID NO: 237488 - RNA, 23 nt, Human
uaaaaugaugcaauggaaggagg

SEQ ID NO: 237489 - RNA, 26 nt, Human
uaaaaugaugcaauggaaggaggccc

SEQ ID NO: 237490 - RNA, 19 nt, Human
uaagcugggggaagcuuug

SEQ ID NO: 237491 - RNA, 18 nt, Human
uacaaacacacucgaggg

SEQ ID NO: 237492 - RNA, 23 nt, Human
uacagaagccaccucaacugccc

SEQ ID NO: 237493 - RNA, 24 nt, Human
uagacagagcaaaacacaacacag

SEQ ID NO: 237494 - RNA, 23 nt, Human
uagcaggaaaugaggcgaccaga

SEQ ID NO: 237495 - RNA, 24 nt, Human
uagcaggaaaugaggcgaccagag

SEQ ID NO: 237496 - RNA, 20 nt, Human
uaggugaagcaaacuaaaaa

SEQ ID NO: 237497 - RNA, 22 nt, Human
uaucugaggucagcagaagagc

SEQ ID NO: 237498 - RNA, 18 nt, Human
uauuucucuaucucuaga

SEQ ID NO: 237499 - RNA, 18 nt, Human
ucaacucuccaaucugga

SEQ ID NO: 237500 - RNA, 20 nt, Human
ucacugaagauagcgcgagg

SEQ ID NO: 237501 - RNA, 22 nt, Human
ucagcgcucuucccaggacccc

SEQ ID NO: 237502 - RNA, 23 nt, Human
ucaguggcucuggugcaugggcc

SEQ ID NO: 237503 - RNA, 22 nt, Human
ucaguguagcaggaaaugaggg

SEQ ID NO: 237504 - RNA, 24 nt, Human
uccaaucuccuuugucccucgguu

SEQ ID NO: 237505 - RNA, 23 nt, Human
uccaaucuggaaaaauaaccacc

SEQ ID NO: 237506 - RNA, 20 nt, Human
uccacuacaacggcaggggc

SEQ ID NO: 237507 - RNA, 24 nt, Human
uccagaagcacccguccccgcugg

SEQ ID NO: 237508 - RNA, 24 nt, Human
ucccaaaagccaaagucacacacu

SEQ ID NO: 237509 - RNA, 20 nt, Human
ucccacuuuuauuacagaca

SEQ ID NO: 237510 - RNA, 24 nt, Human
ucccaggccuccagccccaggccc

SEQ ID NO: 237511 - RNA, 19 nt, Human
uccccgcuggggaaggcug

SEQ ID NO: 237512 - RNA, 21 nt, Human
uccccggaagucuguuuuugc

SEQ ID NO: 237513 - RNA, 24 nt, Human
uccuaacacuacagcaauaguaau

SEQ ID NO: 237514 - RNA, 22 nt, Human
uccugcccaacuuggcccacug

SEQ ID NO: 237515 - RNA, 24 nt, Human
ucugcucaggaaccaccacguccu

SEQ ID NO: 237516 - RNA, 24 nt, Human
ugaacauaauuauuaaaagagcaa

SEQ ID NO: 237517 - RNA, 18 nt, Human
ugaacaucaaacacugca

SEQ ID NO: 237518 - RNA, 21 nt, Human
ugacugcccuccaacaacuga

SEQ ID NO: 237519 - RNA, 20 nt, Human
ugagacacaaucaacuacaa

SEQ ID NO: 237520 - RNA, 25 nt, Human
ugagacacaaucaacuacaauguaa

SEQ ID NO: 237521 - RNA, 23 nt, Human
ugagaccuguucuucuggugagg

SEQ ID NO: 237522 - RNA, 19 nt, Human
ugagaggaggaugcucugu

SEQ ID NO: 237523 - RNA, 19 nt, Human
ugaucccaaaagccaaagu

SEQ ID NO: 237524 - RNA, 21 nt, Human
ugcauggcugcuguacuagaa

SEQ ID NO: 237525 - RNA, 23 nt, Human
ugccgagccugagcagcuggccu

SEQ ID NO: 237526 - RNA, 18 nt, Human
ugcuguggggagggggac

SEQ ID NO: 237527 - RNA, 23 nt, Human
uggaaagagcacuuacuucaggg

SEQ ID NO: 237528 - RNA, 21 nt, Human
uggaaggaggccccagcucac

SEQ ID NO: 237529 - RNA, 23 nt, Human
uggaguaacugagagaauaauga

SEQ ID NO: 237530 - RNA, 20 nt, Human
uggcucuggugcaugggccc

SEQ ID NO: 237531 - RNA, 18 nt, Human
ugggaaggcaaaggagga

SEQ ID NO: 237532 - RNA, 19 nt, Human
ugggagaaggcucaugugg

SEQ ID NO: 237533 - RNA, 20 nt, Human
uggggagggggaccaagccc

SEQ ID NO: 237534 - RNA, 26 nt, Human
ugucaagaaaaagaaacuagucaaaa

SEQ ID NO: 237535 - RNA, 18 nt, Human
ugucucugcauccgacaa

SEQ ID NO: 237536 - RNA, 21 nt, Human
uguggggaucuuuccccaaag

SEQ ID NO: 237537 - RNA, 21 nt, Human
ugugugcaggccccacaguug

SEQ ID NO: 237538 - RNA, 18 nt, Human
uguuccgggccagcgcuu

SEQ ID NO: 237539 - RNA, 20 nt, Human
uuaaacaauuaguccuuauc

SEQ ID NO: 237540 - RNA, 19 nt, Human
uuacuuucaaacaaaacca

SEQ ID NO: 237541 - RNA, 23 nt, Human
uuagagcccaaucugccugccau

SEQ ID NO: 237542 - RNA, 20 nt, Human
uuagccuauguacccacugg

SEQ ID NO: 237543 - RNA, 19 nt, Human
uuaguccuuaucaacuauu

SEQ ID NO: 237544 - RNA, 21 nt, Human
uucagcaucaccugccacuuc

SEQ ID NO: 237545 - RNA, 19 nt, Human
uucaucuugcaacaauugc

SEQ ID NO: 237546 - RNA, 21 nt, Human
uucccuugcuguggggagggg

SEQ ID NO: 237547 - RNA, 18 nt, Human
uuccuagguuuugccacu

SEQ ID NO: 237548 - RNA, 18 nt, Human
uuccuuuaaaaugaugca

SEQ ID NO: 237549 - RNA, 20 nt, Human
uucuucuggugaggacuaag

SEQ ID NO: 237550 - RNA, 20 nt, Human
uugggggcggggcgggguuu

SEQ ID NO: 237551 - RNA, 21 nt, Human
uuguugggggcggggcggggu

SEQ ID NO: 237552 - RNA, 20 nt, Human
uuucagcaagagggacuccu

SEQ ID NO: 237553 - RNA, 22 nt, Human
uuuuuagacagagcaaaacaca

SEQ ID NO: 237554 - RNA, 22 nt, Human
aaaauguaaagccagaacaucc

SEQ ID NO: 237555 - RNA, 21 nt, Human
aaacaccccaaacacugggua

SEQ ID NO: 237556 - RNA, 21 nt, Human
aaagaagggggagagagggau

SEQ ID NO: 237557 - RNA, 18 nt, Human
aaaguuacuuccuccacu

SEQ ID NO: 237558 - RNA, 21 nt, Human
aaauaaaauguaaagccagaa

SEQ ID NO: 237559 - RNA, 22 nt, Human
aaauaacuaacaaggguagggc

SEQ ID NO: 237560 - RNA, 24 nt, Human
aaauccacuuuugaaacaccccaa

SEQ ID NO: 237561 - RNA, 21 nt, Human
aaauccagaaauuuaaugaau

SEQ ID NO: 237562 - RNA, 19 nt, Human
aagcaugaccaagguaagc

SEQ ID NO: 237563 - RNA, 19 nt, Human
acaaaagagacgcacugga

SEQ ID NO: 237564 - RNA, 21 nt, Human
acaaugaccuuuccaauaugu

SEQ ID NO: 237565 - RNA, 22 nt, Human
accccaggaaccucuccacccu

SEQ ID NO: 237566 - RNA, 20 nt, Human
acucugcgcucaaacaauua

SEQ ID NO: 237567 - RNA, 25 nt, Human
agcaugaccaagguaagccuaaaaa

SEQ ID NO: 237568 - RNA, 21 nt, Human
agggggagagagggauuaagc

SEQ ID NO: 237569 - RNA, 19 nt, Human
caaaagagacgcacuggaa

SEQ ID NO: 237570 - RNA, 22 nt, Human
caaaagagacgcacuggaagua

SEQ ID NO: 237571 - RNA, 18 nt, Human
cacaacccaaauccagaa

SEQ ID NO: 237572 - RNA, 22 nt, Human
cacaacccaaauccagaaauuu

SEQ ID NO: 237573 - RNA, 23 nt, Human
cacaacccaaauccagaaauuua

SEQ ID NO: 237574 - RNA, 19 nt, Human
cacauccacacauguauuu

SEQ ID NO: 237575 - RNA, 19 nt, Human
cacaugccguucuuuguuc

SEQ ID NO: 237576 - RNA, 20 nt, Human
caggaaccucuccacccuuu

SEQ ID NO: 237577 - RNA, 24 nt, Human
ccaucacugauaaagacacauaca

SEQ ID NO: 237578 - RNA, 20 nt, Human
ccccaggaaccucuccaccc

SEQ ID NO: 237579 - RNA, 24 nt, Human
ccccauaaauugaauuagccacuu

SEQ ID NO: 237580 - RNA, 23 nt, Human
cccucuggaggagcugcaaggcg

SEQ ID NO: 237581 - RNA, 25 nt, Human
ccucuccacccuuuuacuuaguaaa

SEQ ID NO: 237582 - RNA, 22 nt, Human
ccuugaggaggaggaagagggg

SEQ ID NO: 237583 - RNA, 22 nt, Human
cuagaagugggcagcuuucccu

SEQ ID NO: 237584 - RNA, 23 nt, Human
cuauuuauaggcacgaucaucuc

SEQ ID NO: 237585 - RNA, 20 nt, Human
cucaaaggacaaaacagcac

SEQ ID NO: 237586 - RNA, 21 nt, Human
cuccgacauguuccaauacau

SEQ ID NO: 237587 - RNA, 19 nt, Human
cuccuaaaauaacuaacaa

SEQ ID NO: 237588 - RNA, 25 nt, Human
cugaagcaugaccaagguaagccua

SEQ ID NO: 237589 - RNA, 23 nt, Human
cugaaggacaacacacaugcaga

SEQ ID NO: 237590 - RNA, 20 nt, Human
cugauuccauuucuucacac

SEQ ID NO: 237591 - RNA, 25 nt, Human
cuuccuccacuucauucuucacaga

SEQ ID NO: 237592 - RNA, 19 nt, Human
gaagggggagagagggauu

SEQ ID NO: 237593 - RNA, 20 nt, Human
gcugagccggaggcuggaga

SEQ ID NO: 237594 - RNA, 20 nt, Human
gggggagagagggauuaagc

SEQ ID NO: 237595 - RNA, 19 nt, Human
ggucacaacccaaauccag

SEQ ID NO: 237596 - RNA, 18 nt, Human
guagaagagcauucugaa

SEQ ID NO: 237597 - RNA, 22 nt, Human
uaaaaacaacaaauaacaaccc

SEQ ID NO: 237598 - RNA, 21 nt, Human
uaaaauaacuaacaaggguag

SEQ ID NO: 237599 - RNA, 22 nt, Human
uaaauaaaauguaaagccagaa

SEQ ID NO: 237600 - RNA, 24 nt, Human
uaaaugcagauagccacaaugacc

SEQ ID NO: 237601 - RNA, 18 nt, Human
uaaucuugagacaaaaaa

SEQ ID NO: 237602 - RNA, 18 nt, Human
uacacauccacacaugua

SEQ ID NO: 237603 - RNA, 23 nt, Human
uaccccauaaauugaauuagcca

SEQ ID NO: 237604 - RNA, 18 nt, Human
uagaagugggcagcuuuc

SEQ ID NO: 237605 - RNA, 23 nt, Human
uauaauauaaucuugagacaaaa

SEQ ID NO: 237606 - RNA, 18 nt, Human
uauacguagaagagcauu

SEQ ID NO: 237607 - RNA, 23 nt, Human
uauguacaagcuccauuuacaca

SEQ ID NO: 237608 - RNA, 22 nt, Human
ucaguccgaaagauccagaauu

SEQ ID NO: 237609 - RNA, 18 nt, Human
uccaagccugaugauguu

SEQ ID NO: 237610 - RNA, 18 nt, Human
ucucaaaggacaaaacag

SEQ ID NO: 237611 - RNA, 20 nt, Human
ucucagagaaagggucgaag

SEQ ID NO: 237612 - RNA, 22 nt, Human
ucuggaccacauuccaauagca

SEQ ID NO: 237613 - RNA, 22 nt, Human
ucuuuuuuuuuucugcaccauu

SEQ ID NO: 237614 - RNA, 22 nt, Human
ugaaggacaacacacaugcaga

SEQ ID NO: 237615 - RNA, 18 nt, Human
ugagacaaaaaagaaggg

SEQ ID NO: 237616 - RNA, 18 nt, Human
ugaucgacuguuuucccu

SEQ ID NO: 237617 - RNA, 24 nt, Human
ugcuuaggaauccaccccaggaac

SEQ ID NO: 237618 - RNA, 18 nt, Human
uggagacuuagaguaaag

SEQ ID NO: 237619 - RNA, 19 nt, Human
uguagaagcucacacaaug

SEQ ID NO: 237620 - RNA, 23 nt, Human
uguuuuguaaaaguuacuuccuc

SEQ ID NO: 237621 - RNA, 19 nt, Human
uuaaaggggauggcagggc

SEQ ID NO: 237622 - RNA, 21 nt, Human
uuaaugcacccugggucacaa

SEQ ID NO: 237623 - RNA, 18 nt, Human
uucaacaccuacccagag

SEQ ID NO: 237624 - RNA, 22 nt, Human
uucuacuccgacauguuccaau

SEQ ID NO: 237625 - RNA, 20 nt, Human
uuggagacuuagaguaaagu

SEQ ID NO: 237626 - RNA, 18 nt, Human
aaaggagaagccacugga

SEQ ID NO: 237627 - RNA, 24 nt, Human
aaauggcccuguggaccaaaggga

SEQ ID NO: 237628 - RNA, 18 nt, Human
aaugugcugugcaccaug

SEQ ID NO: 237629 - RNA, 21 nt, Human
aggcagccacccuggggccug

SEQ ID NO: 237630 - RNA, 18 nt, Human
caagcuggagcagaaggg

SEQ ID NO: 237631 - RNA, 21 nt, Human
ccagcugcaaagaagggcugg

SEQ ID NO: 237632 - RNA, 20 nt, Human
cgucuaguuacuuauuuggc

SEQ ID NO: 237633 - RNA, 20 nt, Human
cuaggugccacaggggaccc

SEQ ID NO: 237634 - RNA, 18 nt, Human
cugcaaagaagggcuggg

SEQ ID NO: 237635 - RNA, 22 nt, Human
gacagaaaggagaagccacugg

SEQ ID NO: 237636 - RNA, 20 nt, Human
gcuggagcagaagggcaucu

SEQ ID NO: 237637 - RNA, 22 nt, Human
ggugagaggacaggaagaaaga

SEQ ID NO: 237638 - RNA, 18 nt, Human
guccuggcccagggagcu

SEQ ID NO: 237639 - RNA, 22 nt, Human
uagagaggcccagcugcaaaga

SEQ ID NO: 237640 - RNA, 20 nt, Human
uauagagaggcccagcugca

SEQ ID NO: 237641 - RNA, 18 nt, Human
ugacagaaaggagaagcc

SEQ ID NO: 237642 - RNA, 19 nt, Human
ugagcacuucuaaugugcu

SEQ ID NO: 237643 - RNA, 23 nt, Human
ugaguguaagagcugggagggcc

SEQ ID NO: 237644 - RNA, 18 nt, Human
ugcaaagaagggcuggga

SEQ ID NO: 237645 - RNA, 24 nt, Human
ugccuugucuuuucacggcagcca

SEQ ID NO: 237646 - RNA, 19 nt, Human
uggcccagggagcuuacaa

SEQ ID NO: 237647 - RNA, 25 nt, Human
ugggauauggagcucuaagggacca

SEQ ID NO: 237648 - RNA, 20 nt, Human
uuggcagugauuccgagguc

SEQ ID NO: 237649 - RNA, 20 nt, Human
aagcagcuguccacaccccc

SEQ ID NO: 237650 - RNA, 24 nt, Human
aaugaaaaaagcagaacacaggga

SEQ ID NO: 237651 - RNA, 24 nt, Human
acuguaagaaguacuccccuggga

SEQ ID NO: 237652 - RNA, 21 nt, Human
agaacacagggaaucagaaga

SEQ ID NO: 237653 - RNA, 20 nt, Human
aucuugucuugaaaucccac

SEQ ID NO: 237654 - RNA, 22 nt, Human
aucuugucuugaaaucccacug

SEQ ID NO: 237655 - RNA, 19 nt, Human
cagaagaccagguucuguc

SEQ ID NO: 237656 - RNA, 18 nt, Human
ccccugggaaagcagcug

SEQ ID NO: 237657 - RNA, 21 nt, Human
gcagaacacagggaaucagaa

SEQ ID NO: 237658 - RNA, 23 nt, Human
ggaaagcagcuguccacaccccc

SEQ ID NO: 237659 - RNA, 19 nt, Human
guggaacaaugaaaaaagc

SEQ ID NO: 237660 - RNA, 20 nt, Human
uaagaaguacuccccuggga

SEQ ID NO: 237661 - RNA, 22 nt, Human
ucucugagccucaaaguuccca

SEQ ID NO: 237662 - RNA, 22 nt, Human
ucugagccucaaaguucccacu

SEQ ID NO: 237663 - RNA, 21 nt, Human
ucugucuucugcucugucucu

SEQ ID NO: 237664 - RNA, 21 nt, Human
ugaaaaaagcagaacacaggg

SEQ ID NO: 237665 - RNA, 23 nt, Human
ugaaaaaagcagaacacagggaa

SEQ ID NO: 237666 - RNA, 20 nt, Human
ugcucugucucugagccuca

SEQ ID NO: 237667 - RNA, 18 nt, Human
ugucuugaaaucccacug

SEQ ID NO: 237668 - RNA, 23 nt, Human
aaaaacaaaaauacacugaagga

SEQ ID NO: 237669 - RNA, 22 nt, Human
aaaacaaaaauacacugaagga

SEQ ID NO: 237670 - RNA, 24 nt, Human
aaaauacacugaaggaagaugcaa

SEQ ID NO: 237671 - RNA, 19 nt, Human
aaaccuaagaaaaccagug

SEQ ID NO: 237672 - RNA, 18 nt, Human
aagaagaggaccgcaaag

SEQ ID NO: 237673 - RNA, 23 nt, Human
aagaugcucuugucucacaggcc

SEQ ID NO: 237674 - RNA, 27 nt, Human
aauuagagaagauaugaguagggccaa

SEQ ID NO: 237675 - RNA, 19 nt, Human
acccuuuccucuccucucu

SEQ ID NO: 237676 - RNA, 26 nt, Human
acuccaagugcuugauuggagaagag

SEQ ID NO: 237677 - RNA, 21 nt, Human
agaaacaaguaucaggaccaa

SEQ ID NO: 237678 - RNA, 24 nt, Human
agaaaccuaagaaaaccaguguug

SEQ ID NO: 237679 - RNA, 23 nt, Human
agacagugagccacagggcaaau

SEQ ID NO: 237680 - RNA, 23 nt, Human
agcagaaggucaguaacagaaaa

SEQ ID NO: 237681 - RNA, 18 nt, Human
aggaagaugcaaagagcu

SEQ ID NO: 237682 - RNA, 25 nt, Human
aguguuggcaugaauuaugcaagug

SEQ ID NO: 237683 - RNA, 19 nt, Human
augaugucaguacucaaag

SEQ ID NO: 237684 - RNA, 19 nt, Human
cacagcagugauuguaaga

SEQ ID NO: 237685 - RNA, 21 nt, Human
cacugaaggaagaugcaaaga

SEQ ID NO: 237686 - RNA, 20 nt, Human
caguacucaaaguuguccag

SEQ ID NO: 237687 - RNA, 19 nt, Human
ccucuugaaaaacaaaaau

SEQ ID NO: 237688 - RNA, 23 nt, Human
cuuuggcaugugcugaagaagag

SEQ ID NO: 237689 - RNA, 21 nt, Human
gaaaaacaaaaauacacugaa

SEQ ID NO: 237690 - RNA, 23 nt, Human
gaaaaacaaaaauacacugaagg

SEQ ID NO: 237691 - RNA, 19 nt, Human
gaaguuccuuuauuugcuc

SEQ ID NO: 237692 - RNA, 22 nt, Human
gagaagauaugaguagggccau

SEQ ID NO: 237693 - RNA, 20 nt, Human
gagagggagaaagagaauuu

SEQ ID NO: 237694 - RNA, 20 nt, Human
uagaagccuaaaaaauaaga

SEQ ID NO: 237695 - RNA, 18 nt, Human
uagagggacgagauagaa

SEQ ID NO: 237696 - RNA, 22 nt, Human
uauagaagccuaaaaaauaaga

SEQ ID NO: 237697 - RNA, 21 nt, Human
uccuacauccaagaugcucuu

SEQ ID NO: 237698 - RNA, 22 nt, Human
ucucacaggccgugaggaacag

SEQ ID NO: 237699 - RNA, 19 nt, Human
ucugaagaggcuauggauc

SEQ ID NO: 237700 - RNA, 19 nt, Human
ugaaaaacaaaaauacacu

SEQ ID NO: 237701 - RNA, 21 nt, Human
ugaaaaacaaaaauacacuga

SEQ ID NO: 237702 - RNA, 24 nt, Human
ugaaaaacaaaaauacacugaagg

SEQ ID NO: 237703 - RNA, 26 nt, Human
ugaaaaacaaaaauacacugaaggaa

SEQ ID NO: 237704 - RNA, 24 nt, Human
ugaaaccacaagccaguuuauuua

SEQ ID NO: 237705 - RNA, 18 nt, Human
ugaaggaagaugcaaaga

SEQ ID NO: 237706 - RNA, 21 nt, Human
ugcaaagagcuaaaaguggua

SEQ ID NO: 237707 - RNA, 19 nt, Human
aaaaaccacuaacacggua

SEQ ID NO: 237708 - RNA, 26 nt, Human
aaaaggaaaaaaauaaugaauuccag

SEQ ID NO: 237709 - RNA, 19 nt, Human
aaaguaaauuuacaguaaa

SEQ ID NO: 237710 - RNA, 24 nt, Human
aagcaauuuuaauaccugaaaugc

SEQ ID NO: 237711 - RNA, 25 nt, Human
aaggcaaaggaggacagcgaggccu

SEQ ID NO: 237712 - RNA, 18 nt, Human
acagauacucuauaauga

SEQ ID NO: 237713 - RNA, 21 nt, Human
acuaagccacuuuaaaauuau

SEQ ID NO: 237714 - RNA, 19 nt, Human
agaaagccuuuguucuugg

SEQ ID NO: 237715 - RNA, 24 nt, Human
agaauagguccagagaacaccuau

SEQ ID NO: 237716 - RNA, 26 nt, Human
agccgaacaguacaaggauuacagga

SEQ ID NO: 237717 - RNA, 19 nt, Human
agccuuuguucuugggcuu

SEQ ID NO: 237718 - RNA, 22 nt, Human
aggaaaacacagauuucuauaa

SEQ ID NO: 237719 - RNA, 22 nt, Human
aguacaaggauuacaggagaaa

SEQ ID NO: 237720 - RNA, 20 nt, Human
auaaagcaaucaagaacaag

SEQ ID NO: 237721 - RNA, 21 nt, Human
auacagaauacacacacugac

SEQ ID NO: 237722 - RNA, 22 nt, Human
auagauuggacuuacuuuuaca

SEQ ID NO: 237723 - RNA, 20 nt, Human
augagcuuauuuuuugacca

SEQ ID NO: 237724 - RNA, 21 nt, Human
caagugauacuauagugcuau

SEQ ID NO: 237725 - RNA, 27 nt, Human
cacacacacaugccaaauacccacaua

SEQ ID NO: 237726 - RNA, 18 nt, Human
cagaauacacacacugac

SEQ ID NO: 237727 - RNA, 21 nt, Human
cagauacucuauaaugaacac

SEQ ID NO: 237728 - RNA, 20 nt, Human
cagcagaaucaauuuacaug

SEQ ID NO: 237729 - RNA, 19 nt, Human
cagccgaacaguacaagga

SEQ ID NO: 237730 - RNA, 23 nt, Human
cauuaaaguacuauuugccaaua

SEQ ID NO: 237731 - RNA, 18 nt, Human
ccaaucuuaagaacgucc

SEQ ID NO: 237732 - RNA, 21 nt, Human
ccagaacacaguguuacgggu

SEQ ID NO: 237733 - RNA, 18 nt, Human
cccuccccauauucacuc

SEQ ID NO: 237734 - RNA, 18 nt, Human
ccuggcgaccggcucagc

SEQ ID NO: 237735 - RNA, 19 nt, Human
cguauuuccaagguuugga

SEQ ID NO: 237736 - RNA, 27 nt, Human
cuagaaaacaaaucugaaggcuuuuaa

SEQ ID NO: 237737 - RNA, 22 nt, Human
cucuacagauacucuauaauga

SEQ ID NO: 237738 - RNA, 21 nt, Human
cuuacuuuuacauucaccucu

SEQ ID NO: 237739 - RNA, 20 nt, Human
gaaaaaccacuaacacggua

SEQ ID NO: 237740 - RNA, 18 nt, Human
gaaggcaaaggaggacag

SEQ ID NO: 237741 - RNA, 18 nt, Human
gaaguaagucaagacuaa

SEQ ID NO: 237742 - RNA, 20 nt, Human
gauaauaaagcaaucaagaa

SEQ ID NO: 237743 - RNA, 22 nt, Human
gauaauaaagcaaucaagaaca

SEQ ID NO: 237744 - RNA, 21 nt, Human
gcaaaggaggacagcgaggcc

SEQ ID NO: 237745 - RNA, 19 nt, Human
ggaaggcaaaggaggacag

SEQ ID NO: 237746 - RNA, 22 nt, Human
ggauuacaggagaaaaaaaaac

SEQ ID NO: 237747 - RNA, 18 nt, Human
uaaaagacaacccaucca

SEQ ID NO: 237748 - RNA, 21 nt, Human
uaaaagacaacccauccaaua

SEQ ID NO: 237749 - RNA, 25 nt, Human
uaaaagacaacccauccaauaacau

SEQ ID NO: 237750 - RNA, 18 nt, Human
uaaaguagccacaguggc

SEQ ID NO: 237751 - RNA, 24 nt, Human
uacacacacugacauggggguaug

SEQ ID NO: 237752 - RNA, 19 nt, Human
uacaggaaaacacagauuu

SEQ ID NO: 237753 - RNA, 20 nt, Human
uacccacauaacuucaaucc

SEQ ID NO: 237754 - RNA, 24 nt, Human
uaccugaaaugcaagucuagcugu

SEQ ID NO: 237755 - RNA, 22 nt, Human
uagaauagguccagagaacacc

SEQ ID NO: 237756 - RNA, 23 nt, Human
uauuuauuucacacacacauggu

SEQ ID NO: 237757 - RNA, 23 nt, Human
uauuucacacacacaugccaaau

SEQ ID NO: 237758 - RNA, 19 nt, Human
ucagucuguguauauguga

SEQ ID NO: 237759 - RNA, 21 nt, Human
uccagaacacaguguuacggg

SEQ ID NO: 237760 - RNA, 22 nt, Human
ucucuuguggcuaucauuuuag

SEQ ID NO: 237761 - RNA, 18 nt, Human
ucugaacugccugagaag

SEQ ID NO: 237762 - RNA, 22 nt, Human
ugaaaugcaagucuagcugugg

SEQ ID NO: 237763 - RNA, 22 nt, Human
ugacugauuggccccgcccucc

SEQ ID NO: 237764 - RNA, 21 nt, Human
ugaggagagaggaaggcaaag

SEQ ID NO: 237765 - RNA, 24 nt, Human
ugaggagagaggaaggcaaaggag

SEQ ID NO: 237766 - RNA, 20 nt, Human
ugauuggccccgcccucccc

SEQ ID NO: 237767 - RNA, 23 nt, Human
ugcaaaaaaauuaauuauuugag

SEQ ID NO: 237768 - RNA, 28 nt, Human
ugccaaauacccacauaacuucaauccu

SEQ ID NO: 237769 - RNA, 18 nt, Human
ugcuugaaugcuuguuuu

SEQ ID NO: 237770 - RNA, 19 nt, Human
uggcuuuuaaugagggguc

SEQ ID NO: 237771 - RNA, 24 nt, Human
uggguucuacuuguuuggguuuua

SEQ ID NO: 237772 - RNA, 24 nt, Human
uguaauaacuaaaguuugcaaaaa

SEQ ID NO: 237773 - RNA, 23 nt, Human
uuaagauaauuuuaagugguuag

SEQ ID NO: 237774 - RNA, 25 nt, Human
uuaauaccugaaaugcaagucuagc

SEQ ID NO: 237775 - RNA, 24 nt, Human
uucacacacacaugccaaauaccc

SEQ ID NO: 237776 - RNA, 21 nt, Human
uugcugccuguaauaacuagu

SEQ ID NO: 237777 - RNA, 21 nt, Human
uuggccccgcccuccccauau

SEQ ID NO: 237778 - RNA, 21 nt, Human
uuuaauaccugaaaugcaagu

SEQ ID NO: 237779 - RNA, 23 nt, Human
uuuacauacuacuguggcauccu

SEQ ID NO: 237780 - RNA, 23 nt, Human
uuucucauauugcugaauucuac

SEQ ID NO: 237781 - RNA, 22 nt, Human
uuuugugauucuugacaguuaa

SEQ ID NO: 237782 - RNA, 24 nt, Human
aacccuucaccccacccccccgcu

SEQ ID NO: 237783 - RNA, 18 nt, Human
aacuaaaacacuccaucc

SEQ ID NO: 237784 - RNA, 21 nt, Human
aagucuccagcccugggaacc

SEQ ID NO: 237785 - RNA, 19 nt, Human
accccacccccccgcuuca

SEQ ID NO: 237786 - RNA, 24 nt, Human
acccccccgcuucacuccucgcug

SEQ ID NO: 237787 - RNA, 22 nt, Human
aggaggcggggagggggggugg

SEQ ID NO: 237788 - RNA, 27 nt, Human
aggaggcggggaggggggguggggggc

SEQ ID NO: 237789 - RNA, 19 nt, Human
aggcggggagggggggugg

SEQ ID NO: 237790 - RNA, 20 nt, Human
aggggcucacugaaggacuc

SEQ ID NO: 237791 - RNA, 22 nt, Human
agggggcaggaggcuuucuggg

SEQ ID NO: 237792 - RNA, 19 nt, Human
auggagcucugggggcucc

SEQ ID NO: 237793 - RNA, 24 nt, Human
auggggcgagaggggagagccuug

SEQ ID NO: 237794 - RNA, 19 nt, Human
caaacccuucaccccaccc

SEQ ID NO: 237795 - RNA, 21 nt, Human
caaacccuucaccccaccccc

SEQ ID NO: 237796 - RNA, 23 nt, Human
caaacccuucaccccaccccccc

SEQ ID NO: 237797 - RNA, 21 nt, Human
cacguccccaaaacggggcug

SEQ ID NO: 237798 - RNA, 24 nt, Human
cagcagccccuuccccucuggucc

SEQ ID NO: 237799 - RNA, 23 nt, Human
ccaggggaggggaggcuggagga

SEQ ID NO: 237800 - RNA, 21 nt, Human
cccaccuccuuggcgucccca

SEQ ID NO: 237801 - RNA, 19 nt, Human
ccccaagaacuaaaacacu

SEQ ID NO: 237802 - RNA, 22 nt, Human
ccccacccccccgcuucacucc

SEQ ID NO: 237803 - RNA, 23 nt, Human
ccccacccccccgcuucacuccu

SEQ ID NO: 237804 - RNA, 19 nt, Human
cccccgcuucacuccucgc

SEQ ID NO: 237805 - RNA, 18 nt, Human
cccccuuuuccuccuuuc

SEQ ID NO: 237806 - RNA, 19 nt, Human
cccccuuuuccuccuuucc

SEQ ID NO: 237807 - RNA, 20 nt, Human
cccccuuuuccuccuuuccc

SEQ ID NO: 237808 - RNA, 18 nt, Human
ccccuccuccuucucugu

SEQ ID NO: 237809 - RNA, 20 nt, Human
ccccuccuccuucucuguuc

SEQ ID NO: 237810 - RNA, 19 nt, Human
ccccucugguccugcuacu

SEQ ID NO: 237811 - RNA, 26 nt, Human
ccccuggaguuggggcuggggucccc

SEQ ID NO: 237812 - RNA, 25 nt, Human
ccccuggaguuggggcugggguuug

SEQ ID NO: 237813 - RNA, 21 nt, Human
cccgccuaccucacccagagc

SEQ ID NO: 237814 - RNA, 20 nt, Human
cccgggcgaagcucacagcc

SEQ ID NO: 237815 - RNA, 18 nt, Human
cccugaaggcagcauggg

SEQ ID NO: 237816 - RNA, 25 nt, Human
cccugccccgaaauccaaacccuuc

SEQ ID NO: 237817 - RNA, 21 nt, Human
ccgaaauccaaacccuucacc

SEQ ID NO: 237818 - RNA, 20 nt, Human
ccggcugcaaaaaugcacaa

SEQ ID NO: 237819 - RNA, 19 nt, Human
ccucagugcaugggccugg

SEQ ID NO: 237820 - RNA, 19 nt, Human
ccuccuuucccccuccucc

SEQ ID NO: 237821 - RNA, 18 nt, Human
ccugaaggcagcaugggg

SEQ ID NO: 237822 - RNA, 19 nt, Human
ccuggaguuggggcugggg

SEQ ID NO: 237823 - RNA, 23 nt, Human
ccuucaccccccccaguuggggg

SEQ ID NO: 237824 - RNA, 23 nt, Human
cggcggggccagggaagggcugg

SEQ ID NO: 237825 - RNA, 19 nt, Human
cggugggggcccuggagac

SEQ ID NO: 237826 - RNA, 21 nt, Human
cuaaaacacuccauccuuucc

SEQ ID NO: 237827 - RNA, 22 nt, Human
cuccggcugcaaaaaugcacaa

SEQ ID NO: 237828 - RNA, 19 nt, Human
cuccucagugcaugggccu

SEQ ID NO: 237829 - RNA, 24 nt, Human
cucgcucacauauaaaauguaauu

SEQ ID NO: 237830 - RNA, 24 nt, Human
cugaugcaagcagcagccccuucc

SEQ ID NO: 237831 - RNA, 18 nt, Human
cugcccgcuuucccuucc

SEQ ID NO: 237832 - RNA, 21 nt, Human
gaaauccaaacccuucacccc

SEQ ID NO: 237833 - RNA, 18 nt, Human
gaaccucggugggggccc

SEQ ID NO: 237834 - RNA, 19 nt, Human
gagccgccuccggcugcaa

SEQ ID NO: 237835 - RNA, 23 nt, Human
gcaaagaacucucccuucccaga

SEQ ID NO: 237836 - RNA, 19 nt, Human
gcagccccaagcccucccu

SEQ ID NO: 237837 - RNA, 25 nt, Human
gccccaagcccucccugccugucuc

SEQ ID NO: 237838 - RNA, 20 nt, Human
gccccgaaauccaaacccuu

SEQ ID NO: 237839 - RNA, 24 nt, Human
gccuccggcugcaaaaaugcacaa

SEQ ID NO: 237840 - RNA, 21 nt, Human
gcugacgggggugcgcccccu

SEQ ID NO: 237841 - RNA, 24 nt, Human
gcugcaccaccagcucucccagug

SEQ ID NO: 237842 - RNA, 22 nt, Human
gcuggggaggggcucacugaag

SEQ ID NO: 237843 - RNA, 22 nt, Human
ggaaggcugcaccaccagcucu

SEQ ID NO: 237844 - RNA, 23 nt, Human
ggagggccugcugacgggggugc

SEQ ID NO: 237845 - RNA, 21 nt, Human
ggcgagaggggagagccuugg

SEQ ID NO: 237846 - RNA, 22 nt, Human
ggcgagaggggagagccuuggc

SEQ ID NO: 237847 - RNA, 23 nt, Human
gggaaggcugcaccaccagcucu

SEQ ID NO: 237848 - RNA, 22 nt, Human
gggagcgggcaagcagggaugg

SEQ ID NO: 237849 - RNA, 23 nt, Human
gggaggaggcggggagggggggu

SEQ ID NO: 237850 - RNA, 18 nt, Human
gggguggggggcguggac

SEQ ID NO: 237851 - RNA, 18 nt, Human
guccccaggggaggggag

SEQ ID NO: 237852 - RNA, 22 nt, Human
guccugcuacuucucuccuuca

SEQ ID NO: 237853 - RNA, 26 nt, Human
guccugcuacuucucuccuucacccc

SEQ ID NO: 237854 - RNA, 21 nt, Human
gugcgcccccugccccgaaau

SEQ ID NO: 237855 - RNA, 20 nt, Human
uaaaacacuccauccuuucc

SEQ ID NO: 237856 - RNA, 25 nt, Human
uauucuuuccuucggcaaagcgcac

SEQ ID NO: 237857 - RNA, 21 nt, Human
ucacguccccaaaacggggcu

SEQ ID NO: 237858 - RNA, 22 nt, Human
uccaaacccuucaccccacccc

SEQ ID NO: 237859 - RNA, 21 nt, Human
uccagacaggggcagcaaaga

SEQ ID NO: 237860 - RNA, 22 nt, Human
uccccaaaacggggcugcccgc

SEQ ID NO: 237861 - RNA, 25 nt, Human
uccccgggcgaagcucacagcccca

SEQ ID NO: 237862 - RNA, 18 nt, Human
uccuccuuucccccuccu

SEQ ID NO: 237863 - RNA, 24 nt, Human
ucucauaggugccccuggaguugg

SEQ ID NO: 237864 - RNA, 22 nt, Human
ugaagagguagaguuccgagcc

SEQ ID NO: 237865 - RNA, 21 nt, Human
ugccaaggagcaggcagggag

SEQ ID NO: 237866 - RNA, 25 nt, Human
ugggaggaggcggggagggggggug

SEQ ID NO: 237867 - RNA, 19 nt, Human
ugggagggggguugagcau

SEQ ID NO: 237868 - RNA, 19 nt, Human
ugggcugaugcaagcagca

SEQ ID NO: 237869 - RNA, 20 nt, Human
ugggcugaugcaagcagcag

SEQ ID NO: 237870 - RNA, 18 nt, Human
ugggggcccuggagacag

SEQ ID NO: 237871 - RNA, 20 nt, Human
ugggggugccaaggagcagg

SEQ ID NO: 237872 - RNA, 24 nt, Human
uggugggaggguaggaggugcagc

SEQ ID NO: 237873 - RNA, 21 nt, Human
uguaaagaauucagcaaaaau

SEQ ID NO: 237874 - RNA, 18 nt, Human
uucccccuccuccuucuc

SEQ ID NO: 237875 - RNA, 20 nt, Human
uucccuuccuggguguggcc

SEQ ID NO: 237876 - RNA, 19 nt, Human
uucuggugggaggguagga

SEQ ID NO: 237877 - RNA, 23 nt, Human
uucuggugggaggguaggaggug

SEQ ID NO: 237878 - RNA, 18 nt, Human
uugccggcuugcucgcuc

SEQ ID NO: 237879 - RNA, 20 nt, Human
uuuaccagaggaagucucca

SEQ ID NO: 237880 - RNA, 21 nt, Human
uuuuacauuuauacauccggc

SEQ ID NO: 237881 - RNA, 24 nt, Human
uuuuacauuuauacauccggcggg

SEQ ID NO: 237882 - RNA, 18 nt, Human
aaaaagacacacaggaua

SEQ ID NO: 237883 - RNA, 22 nt, Human
aagacacacaggauaccuccac

SEQ ID NO: 237884 - RNA, 24 nt, Human
acagggaaaaauauauuuuuuuca

SEQ ID NO: 237885 - RNA, 22 nt, Human
accgcaccggcagcgccucugc

SEQ ID NO: 237886 - RNA, 23 nt, Human
cagacaacuucagugcaaagaua

SEQ ID NO: 237887 - RNA, 24 nt, Human
cagcagacaucuuuauuagcaaau

SEQ ID NO: 237888 - RNA, 28 nt, Human
caguaacaggauaaucuuuccaaaauuu

SEQ ID NO: 237889 - RNA, 19 nt, Human
caucuuuauuagcaaauuc

SEQ ID NO: 237890 - RNA, 26 nt, Human
ccgcaccggcagcgccucugcuagcg

SEQ ID NO: 237891 - RNA, 22 nt, Human
ccggccucgccguuccuucccc

SEQ ID NO: 237892 - RNA, 23 nt, Human
cuaauuauucccuaaauagcugg

SEQ ID NO: 237893 - RNA, 20 nt, Human
cuccaccuauaggcaaacag

SEQ ID NO: 237894 - RNA, 26 nt, Human
guaaaaaaagacacacaggauaccuc

SEQ ID NO: 237895 - RNA, 20 nt, Human
uaaaaaaagacacacaggaa

SEQ ID NO: 237896 - RNA, 21 nt, Human
uaacaggauaaucuuuccaaa

SEQ ID NO: 237897 - RNA, 21 nt, Human
uaccuccaccuauaggcaaac

SEQ ID NO: 237898 - RNA, 25 nt, Human
uagcaaauucaguaacaggauaauc

SEQ ID NO: 237899 - RNA, 22 nt, Human
uagcgaacgcuccuuuaggucu

SEQ ID NO: 237900 - RNA, 23 nt, Human
uaguauuaccuucagacaacuuc

SEQ ID NO: 237901 - RNA, 25 nt, Human
uauacaauauauuuauaguauuacc

SEQ ID NO: 237902 - RNA, 26 nt, Human
uauacaauauauuuauaguauuaccu

SEQ ID NO: 237903 - RNA, 21 nt, Human
uauuagcaaauucaguaacag

SEQ ID NO: 237904 - RNA, 26 nt, Human
ucaguaacaggauaaucuuuccaaaa

SEQ ID NO: 237905 - RNA, 25 nt, Human
uccaccuauaggcaaacagggaaaa

SEQ ID NO: 237906 - RNA, 20 nt, Human
uguuaacuuuuuucaucugu

SEQ ID NO: 237907 - RNA, 18 nt, Human
cccgcgggcgccgccucc

SEQ ID NO: 237908 - RNA, 24 nt, Human
ccgccuccugccccgcggcuccgg

SEQ ID NO: 237909 - RNA, 24 nt, Human
cggcucuggcucuggcugcggcuc

SEQ ID NO: 237910 - RNA, 22 nt, Human
cggggcuguggcggucaccagc

SEQ ID NO: 237911 - RNA, 23 nt, Human
cugccccgcggcuccggcuccgg

SEQ ID NO: 237912 - RNA, 21 nt, Human
gggcuagggcucgggcuccgg

SEQ ID NO: 237913 - RNA, 24 nt, Human
ugcggcuccggcucuggcucuggc

SEQ ID NO: 237914 - RNA, 22 nt, Human
uggcucuggcugcggcucgggc

SEQ ID NO: 237915 - RNA, 19 nt, Human
uggcugcggcucgggcucg

SEQ ID NO: 237916 - RNA, 19 nt, Human
uuccggcugcggcuccggc

SEQ ID NO: 237917 - RNA, 25 nt, Human
aaaaaaaccccacgaagaacagcua

SEQ ID NO: 237918 - RNA, 19 nt, Human
aaaaccccacgaagaacag

SEQ ID NO: 237919 - RNA, 25 nt, Human
aaacaaaaaaaccccacgaagaaca

SEQ ID NO: 237920 - RNA, 19 nt, Human
aaacaaacaaaaaaacccc

SEQ ID NO: 237921 - RNA, 22 nt, Human
aaacaaacaaaaaaaccccacg

SEQ ID NO: 237922 - RNA, 24 nt, Human
aaagcaaauuaggcaaaaaaacaa

SEQ ID NO: 237923 - RNA, 23 nt, Human
aacaaacaaaaaaaccccacgaa

SEQ ID NO: 237924 - RNA, 19 nt, Human
aaccugguuaauuugagca

SEQ ID NO: 237925 - RNA, 20 nt, Human
aaccugguuaauuugagcaa

SEQ ID NO: 237926 - RNA, 19 nt, Human
aacucaggaaacuuccccu

SEQ ID NO: 237927 - RNA, 20 nt, Human
aagaacagccugagccaccc

SEQ ID NO: 237928 - RNA, 24 nt, Human
aagauccuucccccuuuccaauca

SEQ ID NO: 237929 - RNA, 19 nt, Human
aagcggggccugcggugua

SEQ ID NO: 237930 - RNA, 19 nt, Human
aauaagauccuucccccuu

SEQ ID NO: 237931 - RNA, 20 nt, Human
aauguagaaacagcuccaga

SEQ ID NO: 237932 - RNA, 18 nt, Human
acaaacaaaaaaacccca

SEQ ID NO: 237933 - RNA, 24 nt, Human
acaaggcuuggucagaaaaagcaa

SEQ ID NO: 237934 - RNA, 20 nt, Human
accaggcugagacacgugcc

SEQ ID NO: 237935 - RNA, 18 nt, Human
acccacacccccaugucc

SEQ ID NO: 237936 - RNA, 19 nt, Human
acccacacccccauguccc

SEQ ID NO: 237937 - RNA, 19 nt, Human
acccccaugucccagcccc

SEQ ID NO: 237938 - RNA, 19 nt, Human
acuuuucuacuugcucuuc

SEQ ID NO: 237939 - RNA, 22 nt, Human
agaaaaagcaaauuaggcaaaa

SEQ ID NO: 237940 - RNA, 24 nt, Human
agaaaaagcaaauuaggcaaaaaa

SEQ ID NO: 237941 - RNA, 24 nt, Human
agacauucuaggaggaggaagaac

SEQ ID NO: 237942 - RNA, 22 nt, Human
agagacucagcccccaaggccu

SEQ ID NO: 237943 - RNA, 18 nt, Human
agccacaggcuugcuguc

SEQ ID NO: 237944 - RNA, 22 nt, Human
agcuagggagacguuuuagggc

SEQ ID NO: 237945 - RNA, 23 nt, Human
aggaggaggacaagcacacagaa

SEQ ID NO: 237946 - RNA, 25 nt, Human
aggcaggcagggaagagaauguggg

SEQ ID NO: 237947 - RNA, 20 nt, Human
aggcagggaagagaaugugg

SEQ ID NO: 237948 - RNA, 18 nt, Human
aguagccuugugauaggg

SEQ ID NO: 237949 - RNA, 19 nt, Human
agugguggcaccaggaggg

SEQ ID NO: 237950 - RNA, 23 nt, Human
aucccugucuuuacccacacccc

SEQ ID NO: 237951 - RNA, 21 nt, Human
augaaccaagugauggcaucc

SEQ ID NO: 237952 - RNA, 19 nt, Human
caacucaggaaacuucccc

SEQ ID NO: 237953 - RNA, 19 nt, Human
caagaauaauguccacugc

SEQ ID NO: 237954 - RNA, 21 nt, Human
caagucuccaaccugaucguu

SEQ ID NO: 237955 - RNA, 22 nt, Human
cacacccccaugucccagcccc

SEQ ID NO: 237956 - RNA, 20 nt, Human
caccacagucguugaccccg

SEQ ID NO: 237957 - RNA, 20 nt, Human
caccacagucguugaccccg

SEQ ID NO: 237958 - RNA, 18 nt, Human
caccccguagccacaggc

SEQ ID NO: 237959 - RNA, 21 nt, Human
cagauccaacuaccccccaaa

SEQ ID NO: 237960 - RNA, 19 nt, Human
cagaugcccauaccugcug

SEQ ID NO: 237961 - RNA, 23 nt, Human
cagcaauggaccagacacccaga

SEQ ID NO: 237962 - RNA, 22 nt, Human
cagcacugagaagcaggcacug

SEQ ID NO: 237963 - RNA, 18 nt, Human
cagccucuauccuucauc

SEQ ID NO: 237964 - RNA, 23 nt, Human
cagcgcccauuccaacacaggaa

SEQ ID NO: 237965 - RNA, 25 nt, Human
caggauggaguacaagaugugaggu

SEQ ID NO: 237966 - RNA, 24 nt, Human
caggcaggcagggaagagaauguu

SEQ ID NO: 237967 - RNA, 20 nt, Human
caggcugagacacgugcccu

SEQ ID NO: 237968 - RNA, 23 nt, Human
caugaaccaagugauggcauccc

SEQ ID NO: 237969 - RNA, 23 nt, Human
cauggaaacuaagccgucagaga

SEQ ID NO: 237970 - RNA, 18 nt, Human
ccacaggcuugcugucca

SEQ ID NO: 237971 - RNA, 19 nt, Human
ccaccccguagccacaggc

SEQ ID NO: 237972 - RNA, 20 nt, Human
ccagaaaguccaaucucucc

SEQ ID NO: 237973 - RNA, 19 nt, Human
ccagacacccagauccaac

SEQ ID NO: 237974 - RNA, 18 nt, Human
ccagaugcccauaccugc

SEQ ID NO: 237975 - RNA, 18 nt, Human
ccagccccugaugggcaa

SEQ ID NO: 237976 - RNA, 24 nt, Human
ccaguaucugcugcugaaaaggca

SEQ ID NO: 237977 - RNA, 21 nt, Human
cccacacccccaugucccagc

SEQ ID NO: 237978 - RNA, 23 nt, Human
cccacacccccaugucccagccc

SEQ ID NO: 237979 - RNA, 18 nt, Human
cccacauggaaacuaagc

SEQ ID NO: 237980 - RNA, 19 nt, Human
cccagauccaacuaccccc

SEQ ID NO: 237981 - RNA, 25 nt, Human
ccccaugucccagccccugaugggc

SEQ ID NO: 237982 - RNA, 21 nt, Human
cccccaaggccuaacauucac

SEQ ID NO: 237983 - RNA, 20 nt, Human
ccccuagaaauucuccccuc

SEQ ID NO: 237984 - RNA, 21 nt, Human
ccccuuagcugaggggacagc

SEQ ID NO: 237985 - RNA, 19 nt, Human
ccuagaaauucuccccucc

SEQ ID NO: 237986 - RNA, 24 nt, Human
ccugccacuucuaauuccuggggg

SEQ ID NO: 237987 - RNA, 22 nt, Human
cgcccauuccaacacaggaacu

SEQ ID NO: 237988 - RNA, 20 nt, Human
cuaacauucacucaagccac

SEQ ID NO: 237989 - RNA, 26 nt, Human
cuagaaauucuccccuccauucccag

SEQ ID NO: 237990 - RNA, 24 nt, Human
cucucagccucuauccuucauccc

SEQ ID NO: 237991 - RNA, 23 nt, Human
cucuucaucgcuguugucugcac

SEQ ID NO: 237992 - RNA, 21 nt, Human
cugggggagaagaggucuggg

SEQ ID NO: 237993 - RNA, 19 nt, Human
cuuccuucuucucucagcc

SEQ ID NO: 237994 - RNA, 21 nt, Human
cuugcucuuccuccccagacg

SEQ ID NO: 237995 - RNA, 22 nt, Human
gaaacagcuccagacauucuag

SEQ ID NO: 237996 - RNA, 21 nt, Human
gaagaacagccugagccaccc

SEQ ID NO: 237997 - RNA, 24 nt, Human
gaauguagaaacagcuccagacau

SEQ ID NO: 237998 - RNA, 20 nt, Human
gacaacuucugguuuuucuu

SEQ ID NO: 237999 - RNA, 25 nt, Human
gacacccagauccaacuacccccca

SEQ ID NO: 238000 - RNA, 19 nt, Human
gaggaggaggacaagcaca

SEQ ID NO: 238001 - RNA, 24 nt, Human
gcaaaaaaacaaacaaaaaaaccc

SEQ ID NO: 238002 - RNA, 21 nt, Human
gcaauggaccagacacccaga

SEQ ID NO: 238003 - RNA, 20 nt, Human
gcccaggauggaguacaaga

SEQ ID NO: 238004 - RNA, 23 nt, Human
gcccuggguuucccaagucucca

SEQ ID NO: 238005 - RNA, 18 nt, Human
gcugcaucagcacugaga

SEQ ID NO: 238006 - RNA, 18 nt, Human
gcugugggcuuucgucgc

SEQ ID NO: 238007 - RNA, 20 nt, Human
gcuuucgucgcuguugucac

SEQ ID NO: 238008 - RNA, 21 nt, Human
ggaacaguuauggggugggag

SEQ ID NO: 238009 - RNA, 22 nt, Human
ggcaaaaaaacaaacaaaaaaa

SEQ ID NO: 238010 - RNA, 22 nt, Human
ggccuaacauucacucaagcca

SEQ ID NO: 238011 - RNA, 22 nt, Human
ggcugauucuuccuucuucucu

SEQ ID NO: 238012 - RNA, 18 nt, Human
ggggaaaggggaggugga

SEQ ID NO: 238013 - RNA, 18 nt, Human
gguaaaauccaggucuaa

SEQ ID NO: 238014 - RNA, 20 nt, Human
ggucucuuccccagaauccc

SEQ ID NO: 238015 - RNA, 21 nt, Human
guauucucacaguucucuuca

SEQ ID NO: 238016 - RNA, 18 nt, Human
gugagucuaaggacccaa

SEQ ID NO: 238017 - RNA, 23 nt, Human
gugauggggcagagcgcaguccu

SEQ ID NO: 238018 - RNA, 23 nt, Human
guugaccccguugcacagcuucc

SEQ ID NO: 238019 - RNA, 19 nt, Human
uaaauaacuccagaaaguc

SEQ ID NO: 238020 - RNA, 23 nt, Human
uaaaucagugcucaaauagauag

SEQ ID NO: 238021 - RNA, 19 nt, Human
uaacauucacucaagccac

SEQ ID NO: 238022 - RNA, 20 nt, Human
uaaguguaauguggggaggc

SEQ ID NO: 238023 - RNA, 21 nt, Human
uaggaacaguuaugggguggg

SEQ ID NO: 238024 - RNA, 23 nt, Human
uaucauaaaguccuaaaauacug

SEQ ID NO: 238025 - RNA, 23 nt, Human
ucaaauagauacuuccucaaaua

SEQ ID NO: 238026 - RNA, 22 nt, Human
ucaacucaggaaacuuccccua

SEQ ID NO: 238027 - RNA, 20 nt, Human
ucagaacuggggcugacgcu

SEQ ID NO: 238028 - RNA, 19 nt, Human
uccaaucaagaaaaugcca

SEQ ID NO: 238029 - RNA, 21 nt, Human
uccaaucaagaaaaugccacu

SEQ ID NO: 238030 - RNA, 20 nt, Human
uccacuaacuuagaucccug

SEQ ID NO: 238031 - RNA, 23 nt, Human
ucccagaugcccauaccugcugg

SEQ ID NO: 238032 - RNA, 19 nt, Human
ucccagccccugaugggca

SEQ ID NO: 238033 - RNA, 19 nt, Human
ucccagccccuguuguucu

SEQ ID NO: 238034 - RNA, 20 nt, Human
ucccagccccuguuguucuc

SEQ ID NO: 238035 - RNA, 23 nt, Human
uccccuagaaauucuccccucca

SEQ ID NO: 238036 - RNA, 21 nt, Human
ucccugagcacuugagaaaga

SEQ ID NO: 238037 - RNA, 19 nt, Human
ucgcuguugucugcacagu

SEQ ID NO: 238038 - RNA, 21 nt, Human
ucuacuugcucuuccucccca

SEQ ID NO: 238039 - RNA, 21 nt, Human
ucucuaccuuccuacuccuua

SEQ ID NO: 238040 - RNA, 21 nt, Human
ucuuccuucuucucucagccu

SEQ ID NO: 238041 - RNA, 18 nt, Human
ugagaagcaggcacugag

SEQ ID NO: 238042 - RNA, 19 nt, Human
ugagggagagaggggucag

SEQ ID NO: 238043 - RNA, 25 nt, Human
ugagggagagaggggucaggaggua

SEQ ID NO: 238044 - RNA, 18 nt, Human
ugaggguacuggggaaag

SEQ ID NO: 238045 - RNA, 18 nt, Human
ugcccauaccugcugggc

SEQ ID NO: 238046 - RNA, 21 nt, Human
uggggcagagcgcaguccugg

SEQ ID NO: 238047 - RNA, 22 nt, Human
uggggcugacgcuacugagagc

SEQ ID NO: 238048 - RNA, 18 nt, Human
uggggugggaggaggagg

SEQ ID NO: 238049 - RNA, 19 nt, Human
uggggugggaggaggagga

SEQ ID NO: 238050 - RNA, 22 nt, Human
uggggugggaggaggaggagga

SEQ ID NO: 238051 - RNA, 24 nt, Human
uggggugggaggaggaggaggaca

SEQ ID NO: 238052 - RNA, 18 nt, Human
ugguaaacagcuccggug

SEQ ID NO: 238053 - RNA, 18 nt, Human
ugucaccacagucguuga

SEQ ID NO: 238054 - RNA, 26 nt, Human
uucccagccccuguuguucucuccug

SEQ ID NO: 238055 - RNA, 22 nt, Human
uuccugggggagaagaggucug

SEQ ID NO: 238056 - RNA, 21 nt, Human
uucucuucaucgcuguuguua

SEQ ID NO: 238057 - RNA, 24 nt, Human
uuggucagaaaaagcaaauuaggc

SEQ ID NO: 238058 - RNA, 22 nt, Human
uuuuauuuauucagcccuccca

SEQ ID NO: 238059 - RNA, 23 nt, Human
aaaguucucccagcccugcccac

SEQ ID NO: 238060 - RNA, 25 nt, Human
aaaguucucccagcccugcccaccc

SEQ ID NO: 238061 - RNA, 20 nt, Human
caaaguucucccagcccugc

SEQ ID NO: 238062 - RNA, 19 nt, Human
cccaccccaucacaguuca

SEQ ID NO: 238063 - RNA, 18 nt, Human
cgcgccgcgcucacucgg

SEQ ID NO: 238064 - RNA, 19 nt, Human
cggccggacgggcccgcgc

SEQ ID NO: 238065 - RNA, 23 nt, Human
cucccagcccugcccaccccauc

SEQ ID NO: 238066 - RNA, 21 nt, Human
gcccugcccaccccaucacag

SEQ ID NO: 238067 - RNA, 22 nt, Human
ggacgggcccgcgccgcgcuca

SEQ ID NO: 238068 - RNA, 22 nt, Human
uaaaacuauuuacaggggcaca

SEQ ID NO: 238069 - RNA, 19 nt, Human
uauuuguuccacuguacaa

SEQ ID NO: 238070 - RNA, 21 nt, Human
uucucccagcccugcccaccc

SEQ ID NO: 238071 - RNA, 24 nt, Human
uuuguucauauuuaaaacuauuua

SEQ ID NO: 238072 - RNA, 22 nt, Human
auggcacaagcagcaaaucugc

SEQ ID NO: 238073 - RNA, 27 nt, Human
cauuuuuacguuggaggcagucagagg

SEQ ID NO: 238074 - RNA, 20 nt, Human
ccuucucgcguucucuucuc

SEQ ID NO: 238075 - RNA, 21 nt, Human
uaauagcucccucccccccuc

SEQ ID NO: 238076 - RNA, 28 nt, Human
uaauagcucccucccccccuccagaucu

SEQ ID NO: 238077 - RNA, 18 nt, Human
ucaccggcgagggguggc

SEQ ID NO: 238078 - RNA, 23 nt, Human
ucagugaugccuuuauuauuccu

SEQ ID NO: 238079 - RNA, 26 nt, Human
ucagugaugccuuuauuauuccuguu

SEQ ID NO: 238080 - RNA, 20 nt, Human
ucccucccccccuccagauc

SEQ ID NO: 238081 - RNA, 18 nt, Human
ucuccaguauucccuacc

SEQ ID NO: 238082 - RNA, 29 nt, Human
ucucuaauagcucccucccccccuccagg

SEQ ID NO: 238083 - RNA, 20 nt, Human
ucucucaccggcgagggguu

SEQ ID NO: 238084 - RNA, 20 nt, Human
uggaggcagucagaggagga

SEQ ID NO: 238085 - RNA, 22 nt, Human
uggcacaagcagcaaaucugcu

SEQ ID NO: 238086 - RNA, 20 nt, Human
uggcacaagcagcaaaucuu

SEQ ID NO: 238087 - RNA, 22 nt, Human
ugggggaggcgaggagccgggg

SEQ ID NO: 238088 - RNA, 24 nt, Human
uguacaaauaucuccaguauuccc

SEQ ID NO: 238089 - RNA, 19 nt, Human
aaaaaacaaaugccccaaa

SEQ ID NO: 238090 - RNA, 22 nt, Human
aaaaacaaaugcccaaaaccua

SEQ ID NO: 238091 - RNA, 24 nt, Human
aaaaacaaaugcccaaaaccuaaa

SEQ ID NO: 238092 - RNA, 23 nt, Human
aaaaacaaaugccccaaaaccca

SEQ ID NO: 238093 - RNA, 20 nt, Human
aaaaagcccccccagcaacc

SEQ ID NO: 238094 - RNA, 21 nt, Human
aaaaagcccccccagcaaccu

SEQ ID NO: 238095 - RNA, 21 nt, Human
aaaacccaaaaaagccccccc

SEQ ID NO: 238096 - RNA, 19 nt, Human
aaaagcccccccagcaacc

SEQ ID NO: 238097 - RNA, 18 nt, Human
aaacaaaugccccaaaac

SEQ ID NO: 238098 - RNA, 23 nt, Human
aaacaugccaaaaauaaauacuc

SEQ ID NO: 238099 - RNA, 25 nt, Human
aaaccaaauuccugugugaacauaa

SEQ ID NO: 238100 - RNA, 20 nt, Human
aaagcaguaaaccaaauucc

SEQ ID NO: 238101 - RNA, 29 nt, Human
aaagcauaaucaucuuauuuacaaaaaaa

SEQ ID NO: 238102 - RNA, 22 nt, Human
aaagcccccccagcaaccaaac

SEQ ID NO: 238103 - RNA, 23 nt, Human
aaaggaaaugguagagaguaagg

SEQ ID NO: 238104 - RNA, 24 nt, Human
aaaggaaaugguagagaguaaggg

SEQ ID NO: 238105 - RNA, 19 nt, Human
aaaugcccaaaaccuaaaa

SEQ ID NO: 238106 - RNA, 19 nt, Human
aacacacacauacacacac

SEQ ID NO: 238107 - RNA, 22 nt, Human
aacaugccaaaaauaaauacuc

SEQ ID NO: 238108 - RNA, 21 nt, Human
aaccaugguaucuauuuccug

SEQ ID NO: 238109 - RNA, 25 nt, Human
aacccaaaaaagcccccccagcaac

SEQ ID NO: 238110 - RNA, 19 nt, Human
aacccaaguguccugaaag

SEQ ID NO: 238111 - RNA, 20 nt, Human
aagauauaccccuuguggac

SEQ ID NO: 238112 - RNA, 20 nt, Human
acaaaaaacaaaugcccaaa

SEQ ID NO: 238113 - RNA, 23 nt, Human
acaaaaaacaaaugccccaaaac

SEQ ID NO: 238114 - RNA, 23 nt, Human
acaaaccaugguaucuauuuccu

SEQ ID NO: 238115 - RNA, 31 nt, Human
acacacacauacacacacagagucugugugg

SEQ ID NO: 238116 - RNA, 25 nt, Human
acacacauacacacacagagucugg

SEQ ID NO: 238117 - RNA, 29 nt, Human
acacacauacacacacagagucugugugg

SEQ ID NO: 238118 - RNA, 28 nt, Human
acacacauacacauauaaacacacacaa

SEQ ID NO: 238119 - RNA, 33 nt, Human
acacauacacauauaaacacacacauacacagu

SEQ ID NO: 238120 - RNA, 19 nt, Human
accaucuuuaucuucaucc

SEQ ID NO: 238121 - RNA, 21 nt, Human
acccuucagggugcuucagag

SEQ ID NO: 238122 - RNA, 21 nt, Human
accuaaaaaagccccccagca

SEQ ID NO: 238123 - RNA, 20 nt, Human
accuucgccaaagccaagaa

SEQ ID NO: 238124 - RNA, 24 nt, Human
acuacauaauugcacaaaccaugg

SEQ ID NO: 238125 - RNA, 26 nt, Human
agaaacccauucauccagucauacac

SEQ ID NO: 238126 - RNA, 27 nt, Human
agaaacccauucauccagucauacacc

SEQ ID NO: 238127 - RNA, 18 nt, Human
agccaugggugagcugaa

SEQ ID NO: 238128 - RNA, 22 nt, Human
agccaugggugagcugaaaggc

SEQ ID NO: 238129 - RNA, 20 nt, Human
agcugaaaggcuuuuccuga

SEQ ID NO: 238130 - RNA, 21 nt, Human
aguagccauuccacgaauucc

SEQ ID NO: 238131 - RNA, 29 nt, Human
auacacauauaaacacacacauacacagu

SEQ ID NO: 238132 - RNA, 22 nt, Human
auagaacucaucugauuuuuaa

SEQ ID NO: 238133 - RNA, 22 nt, Human
auccagaguguagugcauggga

SEQ ID NO: 238134 - RNA, 21 nt, Human
auccagucauacaccauccag

SEQ ID NO: 238135 - RNA, 22 nt, Human
auccggaguguagugcauggga

SEQ ID NO: 238136 - RNA, 22 nt, Human
caaaaaacaaaugcccaaaacc

SEQ ID NO: 238137 - RNA, 23 nt, Human
caaaaaacaaaugccccaaaacc

SEQ ID NO: 238138 - RNA, 22 nt, Human
caaaaaagcccccccagcaacc

SEQ ID NO: 238139 - RNA, 30 nt, Human
caaagcauaaucaucuuauuuacaaaaaaa

SEQ ID NO: 238140 - RNA, 30 nt, Human; identical to SEQ ID NO: 238139

SEQ ID NO: 238141 - RNA, 26 nt, Human
caaaugcccaaaaccuaaaaaagccc

SEQ ID NO: 238142 - RNA, 22 nt, Human
caaaugccccaaaacccaaaaa

SEQ ID NO: 238143 - RNA, 18 nt, Human
cacaaaccaugguaucua

SEQ ID NO: 238144 - RNA, 24 nt, Human
cacaaaccaugguaucuauuuccu

SEQ ID NO: 238145 - RNA, 18 nt, Human
cacacacauacacauaua

SEQ ID NO: 238146 - RNA, 23 nt, Human
cacacacauacacauauaaacac

SEQ ID NO: 238147 - RNA, 21 nt, Human
cacacauacacauauaaacac

SEQ ID NO: 238148 - RNA, 21 nt, Human
cacauacacucacacagaccc

SEQ ID NO: 238149 - RNA, 20 nt, Human
cagagucuguguggugggcc

SEQ ID NO: 238150 - RNA, 21 nt, Human
cagcagccaugggugagcuga

SEQ ID NO: 238151 - RNA, 22 nt, Human
caguagccauuccacgaauucc

SEQ ID NO: 238152 - RNA, 22 nt, Human
caguagccauuccacgaauucc

SEQ ID NO: 238153 - RNA, 19 nt, Human
cauacacucacacagaccc

SEQ ID NO: 238154 - RNA, 24 nt, Human
cauacacucacacagacccauaua

SEQ ID NO: 238155 - RNA, 20 nt, Human
caucuuuaucuucauccaca

SEQ ID NO: 238156 - RNA, 23 nt, Human
ccaaaacccaaaaaagccccccc

SEQ ID NO: 238157 - RNA, 22 nt, Human
ccaaaaccuaaaaaagcccccc

SEQ ID NO: 238158 - RNA, 27 nt, Human
ccaaaaccuaaaaaagccccccagcaa

SEQ ID NO: 238159 - RNA, 22 nt, Human
cccaaaaaagcccccccagcaa

SEQ ID NO: 238160 - RNA, 19 nt, Human
cccaaaacccaaaaaagcc

SEQ ID NO: 238161 - RNA, 22 nt, Human
cccauauauagaaacccauuca

SEQ ID NO: 238162 - RNA, 21 nt, Human
ccccaaaacccaaaaaagccc

SEQ ID NO: 238163 - RNA, 25 nt, Human
ccccaaaacccaaaaaagccccccc

SEQ ID NO: 238164 - RNA, 21 nt, Human
ccccccagcaaccaaacaucu

SEQ ID NO: 238165 - RNA, 21 nt, Human
ccccccagcaaccaaacaucu

SEQ ID NO: 238166 - RNA, 24 nt, Human
cccccgccgccgccgccgccgccg

SEQ ID NO: 238167 - RNA, 24 nt, Human
cccccgccgccgccgccgccgccg

SEQ ID NO: 238168 - RNA, 26 nt, Human
cccccgccgccgccgccgccgccgcu

SEQ ID NO: 238169 - RNA, 19 nt, Human
ccccgccgccgccgccgcc

SEQ ID NO: 238170 - RNA, 21 nt, Human
ccccgccgccgccgccgccgc

SEQ ID NO: 238171 - RNA, 18 nt, Human
ccccgcgccgccgccgcc

SEQ ID NO: 238172 - RNA, 23 nt, Human
ccccuuguggacugugugaaaau

SEQ ID NO: 238173 - RNA, 19 nt, Human
cccgcgccgccgccgccgc

SEQ ID NO: 238174 - RNA, 20 nt, Human
cccugggcggccgccgccag

SEQ ID NO: 238175 - RNA, 21 nt, Human
ccgccccggcuccucggcugc

SEQ ID NO: 238176 - RNA, 20 nt, Human
ccgcccgccccggcuccucg

SEQ ID NO: 238177 - RNA, 23 nt, Human
ccgccgccgccgccgccgccgcu

SEQ ID NO: 238178 - RNA, 22 nt, Human
ccgccgccgccgccgccgcugc

SEQ ID NO: 238179 - RNA, 24 nt, Human
ccgccgccgccgccgccgcugccg

SEQ ID NO: 238180 - RNA, 27 nt, Human
ccgccgccgccgccgccgcugccgccc

SEQ ID NO: 238181 - RNA, 18 nt, Human
ccgccgccgccgcugccg

SEQ ID NO: 238182 - RNA, 24 nt, Human
ccgccgccgccgcugccgcccgcc

SEQ ID NO: 238183 - RNA, 21 nt, Human
ccgccgcgccccgcgcucccc

SEQ ID NO: 238184 - RNA, 20 nt, Human
ccgccgcgucucagcccucc

SEQ ID NO: 238185 - RNA, 18 nt, Human
ccgcgccgccgccgccgc

SEQ ID NO: 238186 - RNA, 21 nt, Human
ccugucacacacauacacaua

SEQ ID NO: 238187 - RNA, 25 nt, Human
cgccccggcuccucggcugcauuuc

SEQ ID NO: 238188 - RNA, 19 nt, Human
cgccgccgccgcugccgcc

SEQ ID NO: 238189 - RNA, 20 nt, Human
cgccgcgccccgcgcucccc

SEQ ID NO: 238190 - RNA, 22 nt, Human
cgccgcgccccgcgcuccccgc

SEQ ID NO: 238191 - RNA, 22 nt, Human
cgcggccccggcccugggcggc

SEQ ID NO: 238192 - RNA, 24 nt, Human
cguaugccauuuccccccacaaau

SEQ ID NO: 238193 - RNA, 20 nt, Human
cugaaaggcuuuuccugacu

SEQ ID NO: 238194 - RNA, 22 nt, Human
cugagcacucugguaccaugga

SEQ ID NO: 238195 - RNA, 21 nt, Human
gaccuucgccaaagccaagaa

SEQ ID NO: 238196 - RNA, 24 nt, Human
gaguugaaguguuuuuuuuuuuuu

SEQ ID NO: 238197 - RNA, 21 nt, Human
gccaaagccaagaaagcccug

SEQ ID NO: 238198 - RNA, 20 nt, Human
gccauuuccccccacaaaua

SEQ ID NO: 238199 - RNA, 21 nt, Human
gcccaaaaccuaaaaaagccc

SEQ ID NO: 238200 - RNA, 22 nt, Human
gcccaaaaccuaaaaaagcccc

SEQ ID NO: 238201 - RNA, 22 nt, Human
gccccaaaacccaaaaaagccc

SEQ ID NO: 238202 - RNA, 23 nt, Human
gccccaaaacccaaaaaagcccc

SEQ ID NO: 238203 - RNA, 31 nt, Human
gccccaaaacccaaaaaagcccccccagcag

SEQ ID NO: 238204 - RNA, 23 nt, Human
gcccccgccgccgccgccgccgg

SEQ ID NO: 238205 - RNA, 20 nt, Human
gccgccgcgccccgcgcucc

SEQ ID NO: 238206 - RNA, 18 nt, Human
gccgcugcccccgccgcc

SEQ ID NO: 238207 - RNA, 21 nt, Human
gccgcugcccccgccgccgcc

SEQ ID NO: 238208 - RNA, 22 nt, Human
gccgcugcccccgccgccgccg

SEQ ID NO: 238209 - RNA, 19 nt, Human
gcgccccgcgcuccccgcg

SEQ ID NO: 238210 - RNA, 18 nt, Human
gcugccgcccgccccggc

SEQ ID NO: 238211 - RNA, 19 nt, Human
gcuucagaggaaacuuacu

SEQ ID NO: 238212 - RNA, 24 nt, Human
gcuuuuccugacuuccuggggucu

SEQ ID NO: 238213 - RNA, 25 nt, Human
ggccgccgcgccccgcgcuccccgc

SEQ ID NO: 238214 - RNA, 24 nt, Human
gggcgcgcggccccggcccugggc

SEQ ID NO: 238215 - RNA, 23 nt, Human
guaugccauuuccccccacaaau

SEQ ID NO: 238216 - RNA, 21 nt, Human
uaaaaaagccccccagcaacc

SEQ ID NO: 238217 - RNA, 30 nt, Human
uaaacacacacauacacacacagagucugg

SEQ ID NO: 238218 - RNA, 23 nt, Human
uaaauaaucuaaaugggggaggg

SEQ ID NO: 238219 - RNA, 22 nt, Human
uaaauauccaauauaauauaau

SEQ ID NO: 238220 - RNA, 18 nt, Human
uaaaugaugaguaaggua

SEQ ID NO: 238221 - RNA, 28 nt, Human
uaaguaaccuauuuauuaccuuaaaaug

SEQ ID NO: 238222 - RNA, 22 nt, Human
uacaaaaaacaaaugccccaaa

SEQ ID NO: 238223 - RNA, 22 nt, Human
uacacauauaaacacacacaua

SEQ ID NO: 238224 - RNA, 24 nt, Human
uacacucacacagacccauauaua

SEQ ID NO: 238225 - RNA, 22 nt, Human
uacauagaaaaacucucacauc

SEQ ID NO: 238226 - RNA, 22 nt, Human
uacauagaaaaacucucacauc

SEQ ID NO: 238227 - RNA, 22 nt, Human
uagccagaggugaaaagauuug

SEQ ID NO: 238228 - RNA, 20 nt, Human
uaggagucacagcagccaug

SEQ ID NO: 238229 - RNA, 22 nt, Human
uauauagaaacccauucaucca

SEQ ID NO: 238230 - RNA, 21 nt, Human
uaugugcaucauguuagucag

SEQ ID NO: 238231 - RNA, 21 nt, Human
uaugugcaucauguuagucag

SEQ ID NO: 238232 - RNA, 21 nt, Human
uauuccaccaucuuuaucuuc

SEQ ID NO: 238233 - RNA, 25 nt, Human
ucacacacauacacauauaaacaca

SEQ ID NO: 238234 - RNA, 21 nt, Human
ucauccagucauacaccaucc

SEQ ID NO: 238235 - RNA, 23 nt, Human
ucauccagucauacaccauccag

SEQ ID NO: 238236 - RNA, 19 nt, Human
uccacagcauguccuagac

SEQ ID NO: 238237 - RNA, 23 nt, Human
uccaccaucuuuaucuucaucca

SEQ ID NO: 238238 - RNA, 23 nt, Human
uccagauuuccaaaggcuuuucu

SEQ ID NO: 238239 - RNA, 19 nt, Human
uccccgcgccgccgccgcc

SEQ ID NO: 238240 - RNA, 21 nt, Human
uccccgcgccgccgccgccgc

SEQ ID NO: 238241 - RNA, 19 nt, Human
uccuuuggauguuugcagu

SEQ ID NO: 238242 - RNA, 19 nt, Human
uccuuuggauguuugcagu

SEQ ID NO: 238243 - RNA, 21 nt, Human
ucgccaaagccaagaaagccc

SEQ ID NO: 238244 - RNA, 19 nt, Human
ucggcggcggggcgggcuc

SEQ ID NO: 238245 - RNA, 20 nt, Human
ugaaagaaauugaagaaguu

SEQ ID NO: 238246 - RNA, 19 nt, Human
ugaagaaguuacucaaaga

SEQ ID NO: 238247 - RNA, 22 nt, Human
ugacuuaagccaaaaauuaguu

SEQ ID NO: 238248 - RNA, 22 nt, Human
ugaucuggaaacgucuccacuu

SEQ ID NO: 238249 - RNA, 20 nt, Human
ugcccaaaaccuaaaaaagc

SEQ ID NO: 238250 - RNA, 20 nt, Human
ugccccaaaacccaaaaaag

SEQ ID NO: 238251 - RNA, 20 nt, Human
ugccccaaaacccaaaaaag

SEQ ID NO: 238252 - RNA, 22 nt, Human
ugccccaaaacccaaaaaagcc

SEQ ID NO: 238253 - RNA, 21 nt, Human
ugcccccgccgccgccgccgc

SEQ ID NO: 238254 - RNA, 20 nt, Human
ugguaccauggaaugucuga

SEQ ID NO: 238255 - RNA, 22 nt, Human
ugguaucuauuuccugauccag

SEQ ID NO: 238256 - RNA, 23 nt, Human
uguacacugaccuucgccaaagc

SEQ ID NO: 238257 - RNA, 21 nt, Human
ugucacacacauacacauaua

SEQ ID NO: 238258 - RNA, 26 nt, Human
ugucacacacauacacauauaaacac

SEQ ID NO: 238259 - RNA, 20 nt, Human
ugucuguacacugaccuucg

SEQ ID NO: 238260 - RNA, 20 nt, Human
uuacaaagcaguaaaccaaa

SEQ ID NO: 238261 - RNA, 22 nt, Human
uuacugaauucaacccaagugu

SEQ ID NO: 238262 - RNA, 21 nt, Human
uuagucagcaguagccauucc

SEQ ID NO: 238263 - RNA, 18 nt, Human
uuccucauggguagugca

SEQ ID NO: 238264 - RNA, 18 nt, Human
uuccucauggguagugca

SEQ ID NO: 238265 - RNA, 24 nt, Human
uuccugacuuccuggggucucagg

SEQ ID NO: 238266 - RNA, 23 nt, Human
uugcacaaaccaugguaucuauu

SEQ ID NO: 238267 - RNA, 23 nt, Human
uugccgcugcccccgccgccgcc

SEQ ID NO: 238268 - RNA, 19 nt, Human
uugcguaugccauuucccc

SEQ ID NO: 238269 - RNA, 21 nt, Human
uuuacaaaaaacaaaugcccc

SEQ ID NO: 238270 - RNA, 25 nt, Human
uuuccugucacacacauacacauag

SEQ ID NO: 238271 - RNA, 25 nt, Human
uuucugagcacucugguaccaugga

SEQ ID NO: 238272 - RNA, 21 nt, Human
aaaugcuaccaccaccaagcc

SEQ ID NO: 238273 - RNA, 23 nt, Human
acaauccuuccugccucgacacc

SEQ ID NO: 238274 - RNA, 18 nt, Human
acccgugccagccccagc

SEQ ID NO: 238275 - RNA, 21 nt, Human
cacggccaagagcccaggucc

SEQ ID NO: 238276 - RNA, 21 nt, Human
cacucuauuuuuuaaggacuc

SEQ ID NO: 238277 - RNA, 19 nt, Human
cagcagcuggacaucgagg

SEQ ID NO: 238278 - RNA, 18 nt, Human
ccacggaaaugccacggc

SEQ ID NO: 238279 - RNA, 21 nt, Human
ccccagccacccugacggcgg

SEQ ID NO: 238280 - RNA, 22 nt, Human
cccugccgggcugggcucccca

SEQ ID NO: 238281 - RNA, 21 nt, Human
cccugugucgcgacggcagcg

SEQ ID NO: 238282 - RNA, 18 nt, Human
ccuucagucagagcuggg

SEQ ID NO: 238283 - RNA, 18 nt, Human
ccuuccugccucgacacc

SEQ ID NO: 238284 - RNA, 19 nt, Human
cggccaagagcccaggucc

SEQ ID NO: 238285 - RNA, 24 nt, Human
cucgacacccgugccagccccagc

SEQ ID NO: 238286 - RNA, 23 nt, Human
cuuccugccucgacacccgugcc

SEQ ID NO: 238287 - RNA, 24 nt, Human
gagcccagguccuucacgcuggcc

SEQ ID NO: 238288 - RNA, 21 nt, Human
gccagccccagccacccugac

SEQ ID NO: 238289 - RNA, 21 nt, Human
gccucuucccugccgggcugg

SEQ ID NO: 238290 - RNA, 18 nt, Human
ggccaagagcccaggucc

SEQ ID NO: 238291 - RNA, 19 nt, Human
ggcugcagucaccagaaac

SEQ ID NO: 238292 - RNA, 22 nt, Human
guccacggaaaugccacggcca

SEQ ID NO: 238293 - RNA, 18 nt, Human
uccgguggcagaugugua

SEQ ID NO: 238294 - RNA, 24 nt, Human
ucgacacccgugccagccccagcc

SEQ ID NO: 238295 - RNA, 21 nt, Human
ugccucgacacccgugccagc

SEQ ID NO: 238296 - RNA, 18 nt, Human
ugcuaccaccaccaagcc

SEQ ID NO: 238297 - RNA, 24 nt, Human
ugcugaguggaagccaagccccuu

SEQ ID NO: 238298 - RNA, 23 nt, Human
uggacaucgagguccucacuggg

SEQ ID NO: 238299 - RNA, 25 nt, Human
aaaauaacaaaacacucucaucuga

SEQ ID NO: 238300 - RNA, 24 nt, Human
aaagugcugggauuacagguguga

SEQ ID NO: 238301 - RNA, 24 nt, Human
aaagugcugggauuauaggcguga

SEQ ID NO: 238302 - RNA, 24 nt, Human
aaccagccucgaacuccggaccuc

SEQ ID NO: 238303 - RNA, 19 nt, Human
aacuagaucuacccacgca

SEQ ID NO: 238304 - RNA, 22 nt, Human
aacuccggaccucaggugaucc

SEQ ID NO: 238305 - RNA, 25 nt, Human
aagugauuuucccaccucagccucc

SEQ ID NO: 238306 - RNA, 18 nt, Human
aagugcugggauuacagg

SEQ ID NO: 238307 - RNA, 19 nt, Human
aagugcugggauuacaggu

SEQ ID NO: 238308 - RNA, 19 nt, Human
aagugcugggauuauaggc

SEQ ID NO: 238309 - RNA, 19 nt, Human
aagugcugggauuauaggc

SEQ ID NO: 238310 - RNA, 24 nt, Human
aaucccaccucucccaaauucaaa

SEQ ID NO: 238311 - RNA, 28 nt, Human
aauuuuucaauucuccaguccauggagg

SEQ ID NO: 238312 - RNA, 24 nt, Human
acaaccugcuugccucagccuccc

SEQ ID NO: 238313 - RNA, 20 nt, Human
acacugcagccucgaccucc

SEQ ID NO: 238314 - RNA, 24 nt, Human
acacugcagccucgaccuccuggg

SEQ ID NO: 238315 - RNA, 18 nt, Human
acaggguuucacuauguu

SEQ ID NO: 238316 - RNA, 19 nt, Human
acaggguuucacuauguug

SEQ ID NO: 238317 - RNA, 24 nt, Human
acaggguuucacuauguuguuuag

SEQ ID NO: 238318 - RNA, 19 nt, Human
acccaggcuggagugcagu

SEQ ID NO: 238319 - RNA, 20 nt, Human
accucagccuccugaguagc

SEQ ID NO: 238320 - RNA, 23 nt, Human
accucagccuccugaguagcugg

SEQ ID NO: 238321 - RNA, 24 nt, Human
acuauguuguuuaggcuggucucg

SEQ ID NO: 238322 - RNA, 18 nt, Human
acucugucacccaggcug

SEQ ID NO: 238323 - RNA, 25 nt, Human
acucugucacccaggcuggagggca

SEQ ID NO: 238324 - RNA, 27 nt, Human
acucuguugcccaggcuggagugcaau

SEQ ID NO: 238325 - RNA, 19 nt, Human
acugaucacccugccauuu

SEQ ID NO: 238326 - RNA, 21 nt, Human
acugcaaccucugcuuccugg

SEQ ID NO: 238327 - RNA, 22 nt, Human
acugcaaccucugcuuccuggg

SEQ ID NO: 238328 - RNA, 24 nt, Human
acugcaacuccaccucccagguuc

SEQ ID NO: 238329 - RNA, 19 nt, Human
acugcagccucgaccuccu

SEQ ID NO: 238330 - RNA, 18 nt, Human
agcccagcccccacccaa

SEQ ID NO: 238331 - RNA, 18 nt, Human
agccuccugaguagcuag

SEQ ID NO: 238332 - RNA, 18 nt, Human
agccucgaccuccugggc

SEQ ID NO: 238333 - RNA, 24 nt, Human
agcgauucuccugccucagccucc

SEQ ID NO: 238334 - RNA, 23 nt, Human
aggaacuccuuaucaguguggac

SEQ ID NO: 238335 - RNA, 23 nt, Human
aggcgugagucaccgcgcccggc

SEQ ID NO: 238336 - RNA, 25 nt, Human
aggcuggagugcaauggugggaucu

SEQ ID NO: 238337 - RNA, 25 nt, Human
aggcuggagugcagucccaugaucu

SEQ ID NO: 238338 - RNA, 21 nt, Human
aggcuguuuacaccgcagagg

SEQ ID NO: 238339 - RNA, 22 nt, Human
aggcuguuuacaccgcagaggc

SEQ ID NO: 238340 - RNA, 20 nt, Human
agggcagugucacaaucaca

SEQ ID NO: 238341 - RNA, 24 nt, Human
aggugauccacccacuucggccuc

SEQ ID NO: 238342 - RNA, 20 nt, Human
aggugugagccaccgugccc

SEQ ID NO: 238343 - RNA, 23 nt, Human
aggugugagccaccgugcccggc

SEQ ID NO: 238344 - RNA, 22 nt, Human
aguagagaugggguuucgccau

SEQ ID NO: 238345 - RNA, 18 nt, Human
aguagcuaggauuacagg

SEQ ID NO: 238346 - RNA, 18 nt, Human
aguagcugggauuacggg

SEQ ID NO: 238347 - RNA, 24 nt, Human
agugauuuucccaccucagccucc

SEQ ID NO: 238348 - RNA, 23 nt, Human
agugcaauggugggaucucagcu

SEQ ID NO: 238349 - RNA, 24 nt, Human
agugcagucccaugaucucggcuc

SEQ ID NO: 238350 - RNA, 22 nt, Human
agugcugggauuauagguguga

SEQ ID NO: 238351 - RNA, 24 nt, Human
auagugcugggauuauagguguga

SEQ ID NO: 238352 - RNA, 22 nt, Human
aucccaccucucccaaauucaa

SEQ ID NO: 238353 - RNA, 18 nt, Human
augggcagauauuccagc

SEQ ID NO: 238354 - RNA, 20 nt, Human
augggguuucgccaugcugg

SEQ ID NO: 238355 - RNA, 24 nt, Human
augggguuucgucaugauguccaa

SEQ ID NO: 238356 - RNA, 18 nt, Human
augguagccacaugugug

SEQ ID NO: 238357 - RNA, 18 nt, Human
caaaacacucucaucuga

SEQ ID NO: 238358 - RNA, 24 nt, Human
caaagugcugggauuacaggugug

SEQ ID NO: 238359 - RNA, 24 nt, Human
caaagugcugggauuauaggcgug

SEQ ID NO: 238360 - RNA, 22 nt, Human
caacuccaccucccagguucaa

SEQ ID NO: 238361 - RNA, 24 nt, Human
caagaccacagaggagaugauuca

SEQ ID NO: 238362 - RNA, 22 nt, Human
caagcaauucuccugccucagc

SEQ ID NO: 238363 - RNA, 22 nt, Human
caagcgauucuccugccucagc

SEQ ID NO: 238364 - RNA, 24 nt, Human
caaggacgcugcagcccaugcugu

SEQ ID NO: 238365 - RNA, 22 nt, Human
caagugauuuucccaccucagc

SEQ ID NO: 238366 - RNA, 21 nt, Human
cacacugcagccucgaccucc

SEQ ID NO: 238367 - RNA, 24 nt, Human
cacacugcagccucgaccuccugg

SEQ ID NO: 238368 - RNA, 22 nt, Human
cacaggcacaugccaccacacc

SEQ ID NO: 238369 - RNA, 21 nt, Human
caccaucagccacaaccuguu

SEQ ID NO: 238370 - RNA, 22 nt, Human
cacccaucucggccucccaaag

SEQ ID NO: 238371 - RNA, 23 nt, Human
cacccaucucggccucccaaagu

SEQ ID NO: 238372 - RNA, 23 nt, Human
cacccugccauuuagugcuucuu

SEQ ID NO: 238373 - RNA, 19 nt, Human
caccgugcccggccaaagu

SEQ ID NO: 238374 - RNA, 19 nt, Human
caccucucccaaauucaaa

SEQ ID NO: 238375 - RNA, 20 nt, Human
caccuguugagaauaaaaug

SEQ ID NO: 238376 - RNA, 24 nt, Human
cacuauguuguuuaggcuggucuc

SEQ ID NO: 238377 - RNA, 22 nt, Human
cacucugucacccaggcuggag

SEQ ID NO: 238378 - RNA, 25 nt, Human
cacucugucacccaggcuggagggc

SEQ ID NO: 238379 - RNA, 24 nt, Human
cacucuguugcccaggcuggagug

SEQ ID NO: 238380 - RNA, 25 nt, Human
cacugaagacuucccaugaacagcc

SEQ ID NO: 238381 - RNA, 20 nt, Human
cacugcaacuccaccuccca

SEQ ID NO: 238382 - RNA, 23 nt, Human
cacugcagccucgaccuccuggg

SEQ ID NO: 238383 - RNA, 22 nt, Human
cacuuccucaacuagaucuacc

SEQ ID NO: 238384 - RNA, 22 nt, Human
cagcccagcccccacccaaauu

SEQ ID NO: 238385 - RNA, 19 nt, Human
cagccuccugaguagcuag

SEQ ID NO: 238386 - RNA, 20 nt, Human
cagccuccugaguagcuggg

SEQ ID NO: 238387 - RNA, 20 nt, Human
cagccuccugaguagcuggg

SEQ ID NO: 238388 - RNA, 24 nt, Human
cagccucgaccuccugggcucaag

SEQ ID NO: 238389 - RNA, 23 nt, Human
cagccuuuguuucuucaaggccu

SEQ ID NO: 238390 - RNA, 26 nt, Human
caggacccccagggugaccacucagg

SEQ ID NO: 238391 - RNA, 24 nt, Human
caggguuucacuauguuguuuagg

SEQ ID NO: 238392 - RNA, 22 nt, Human
cauagugcugggauuauaggug

SEQ ID NO: 238393 - RNA, 24 nt, Human
cauagugcugggauuauaggugug

SEQ ID NO: 238394 - RNA, 23 nt, Human
cauaugugacagugaaacaaggu

SEQ ID NO: 238395 - RNA, 24 nt, Human
caugccaccacaccuggcuaauuu

SEQ ID NO: 238396 - RNA, 24 nt, Human
caugcuggccaaaccagccucgaa

SEQ ID NO: 238397 - RNA, 18 nt, Human
cauggccaucuuggagga

SEQ ID NO: 238398 - RNA, 24 nt, Human
caugugaacuccaucccccaaccc

SEQ ID NO: 238399 - RNA, 20 nt, Human
ccaaaaaaacaaauaacuag

SEQ ID NO: 238400 - RNA, 20 nt, Human
ccaaagugcugggauuacag

SEQ ID NO: 238401 - RNA, 21 nt, Human
ccaaagugcugggauuacagg

SEQ ID NO: 238402 - RNA, 21 nt, Human
ccaaagugcugggauuacagg

SEQ ID NO: 238403 - RNA, 24 nt, Human
ccaaagugcugggauuacaggugu

SEQ ID NO: 238404 - RNA, 22 nt, Human
ccaaagugcugggauuauaggc

SEQ ID NO: 238405 - RNA, 24 nt, Human
ccaaagugcugggauuauaggcgu

SEQ ID NO: 238406 - RNA, 23 nt, Human
ccaccucagccuccugaguagcu

SEQ ID NO: 238407 - RNA, 22 nt, Human
ccacgcaccaucugagcaucuc

SEQ ID NO: 238408 - RNA, 22 nt, Human
ccacuggaugguacugggcaag

SEQ ID NO: 238409 - RNA, 21 nt, Human
ccauagugcugggauuauagg

SEQ ID NO: 238410 - RNA, 24 nt, Human
ccauagugcugggauuauaggugu

SEQ ID NO: 238411 - RNA, 21 nt, Human
cccaccacgcccggcuaauuu

SEQ ID NO: 238412 - RNA, 26 nt, Human
cccagccugggccuugaaccgguucc

SEQ ID NO: 238413 - RNA, 18 nt, Human
cccaggcuggagugcaau

SEQ ID NO: 238414 - RNA, 19 nt, Human
cccaggcuggagugcaaug

SEQ ID NO: 238415 - RNA, 20 nt, Human
cccagguucaagcgauucuc

SEQ ID NO: 238416 - RNA, 23 nt, Human
cccagguucaagcgauucuccug

SEQ ID NO: 238417 - RNA, 19 nt, Human
cccaugaacagccaggccc

SEQ ID NO: 238418 - RNA, 18 nt, Human
cccaugggcucccucugg

SEQ ID NO: 238419 - RNA, 24 nt, Human
ccggaccucaggugauccacccac

SEQ ID NO: 238420 - RNA, 24 nt, Human
ccucccagguucaagcgauucucc

SEQ ID NO: 238421 - RNA, 20 nt, Human
ccuccugggcucaagugauu

SEQ ID NO: 238422 - RNA, 20 nt, Human
ccucgaccuccugggcucaa

SEQ ID NO: 238423 - RNA, 22 nt, Human
ccucgaccuccugggcucaagu

SEQ ID NO: 238424 - RNA, 23 nt, Human
ccugaguagcuaggauuacaggc

SEQ ID NO: 238425 - RNA, 24 nt, Human
ccugaguagcuaggauuacaggca

SEQ ID NO: 238426 - RNA, 22 nt, Human
ccugaguagcugggauuacggg

SEQ ID NO: 238427 - RNA, 23 nt, Human
ccugaguagcugggauuacgggu

SEQ ID NO: 238428 - RNA, 24 nt, Human
ccugaguagcugggauuacgggug

SEQ ID NO: 238429 - RNA, 23 nt, Human
ccugccucagccuccugaguagc

SEQ ID NO: 238430 - RNA, 23 nt, Human
ccugccucagccuccugaguagc

SEQ ID NO: 238431 - RNA, 24 nt, Human
ccugccucagccuccugaguagcu

SEQ ID NO: 238432 - RNA, 18 nt, Human
ccugcuugccucagccuc

SEQ ID NO: 238433 - RNA, 21 nt, Human
ccugggccuugaacauuccua

SEQ ID NO: 238434 - RNA, 22 nt, Human
ccugggcucaagugauuuuccc

SEQ ID NO: 238435 - RNA, 23 nt, Human
ccuggguucaagcaauucuccug

SEQ ID NO: 238436 - RNA, 20 nt, Human
ccuuuguuucuucaaggccu

SEQ ID NO: 238437 - RNA, 27 nt, Human
cgccaugcuggccaaaccagccucgaa

SEQ ID NO: 238438 - RNA, 19 nt, Human
cucaaaauccuguucucaa

SEQ ID NO: 238439 - RNA, 23 nt, Human
cucaagugauuuucccaccucag

SEQ ID NO: 238440 - RNA, 24 nt, Human
cucaagugauuuucccaccucagc

SEQ ID NO: 238441 - RNA, 24 nt, Human
cucacucugucacccaggcuggag

SEQ ID NO: 238442 - RNA, 24 nt, Human
cucacucuguugcccaggcuggag

SEQ ID NO: 238443 - RNA, 23 nt, Human
cucacugcaacuccaccucccag

SEQ ID NO: 238444 - RNA, 24 nt, Human
cucagccuccugaguagcugggac

SEQ ID NO: 238445 - RNA, 24 nt, Human
cucagccuccugaguagcugggau

SEQ ID NO: 238446 - RNA, 18 nt, Human
cuccugaccucaugauuc

SEQ ID NO: 238447 - RNA, 24 nt, Human
cuccugaguagcuaggauuacagg

SEQ ID NO: 238448 - RNA, 24 nt, Human
cuccugaguagcugggaccacagg

SEQ ID NO: 238449 - RNA, 20 nt, Human
cucugucacccaggcuggag

SEQ ID NO: 238450 - RNA, 23 nt, Human
cucugucacccaggcuggagugc

SEQ ID NO: 238451 - RNA, 24 nt, Human
cucuuuucacaaucccuuuaucuu

SEQ ID NO: 238452 - RNA, 23 nt, Human
cugcaaccucugcuuccuggguu

SEQ ID NO: 238453 - RNA, 24 nt, Human
cugcaaccucugcuuccuggguuc

SEQ ID NO: 238454 - RNA, 23 nt, Human
cugcagccucgaccuccugggcu

SEQ ID NO: 238455 - RNA, 23 nt, Human
cugccucagccuccugaguagcu

SEQ ID NO: 238456 - RNA, 24 nt, Human
cuggagugcagucccaugaucucg

SEQ ID NO: 238457 - RNA, 21 nt, Human
cugggauuauaggugugagcc

SEQ ID NO: 238458 - RNA, 20 nt, Human
cugggcucaagugauuuucc

SEQ ID NO: 238459 - RNA, 22 nt, Human
cuguugagaauaaaauguuugg

SEQ ID NO: 238460 - RNA, 24 nt, Human
cuuccuggguucaagcaauucucc

SEQ ID NO: 238461 - RNA, 24 nt, Human
cuugccucagccucccauagugcu

SEQ ID NO: 238462 - RNA, 21 nt, Human
cuugcuaggaacuccuuauca

SEQ ID NO: 238463 - RNA, 21 nt, Human
gaacuccaucccccaaccccc

SEQ ID NO: 238464 - RNA, 24 nt, Human
gaccucaggugauccacccacuuc

SEQ ID NO: 238465 - RNA, 22 nt, Human
gaccucaugauucacccaucuc

SEQ ID NO: 238466 - RNA, 18 nt, Human
gagaugggguuucgccau

SEQ ID NO: 238467 - RNA, 24 nt, Human
gagaugggguuucgccaugcuggc

SEQ ID NO: 238468 - RNA, 18 nt, Human
gagaugggguuucgucau

SEQ ID NO: 238469 - RNA, 22 nt, Human
gagaugggguuucgucaugaug

SEQ ID NO: 238470 - RNA, 23 nt, Human
gagggcagugucacaaucacagc

SEQ ID NO: 238471 - RNA, 26 nt, Human
gaguagcuaggauuacaggcaacugc

SEQ ID NO: 238472 - RNA, 25 nt, Human
gaguagcugggaccacaggcacaug

SEQ ID NO: 238473 - RNA, 22 nt, Human
gaguagcugggauuacgggugc

SEQ ID NO: 238474 - RNA, 24 nt, Human
gauuacaggcaacugccaccaugc

SEQ ID NO: 238475 - RNA, 18 nt, Human
gauuacaggugugagcca

SEQ ID NO: 238476 - RNA, 21 nt, Human
gauuacaggugugagccacca

SEQ ID NO: 238477 - RNA, 22 nt, Human
gauuacaggugugagccaccac

SEQ ID NO: 238478 - RNA, 20 nt, Human
gauuauaggcgugagucacc

SEQ ID NO: 238479 - RNA, 18 nt, Human
gauuauaggugugagcca

SEQ ID NO: 238480 - RNA, 20 nt, Human
gauuauaggugugagccacc

SEQ ID NO: 238481 - RNA, 21 nt, Human
gauuauaggugugagccaccg

SEQ ID NO: 238482 - RNA, 23 nt, Human
gcaaaugaaccuggaaauaucaa

SEQ ID NO: 238483 - RNA, 21 nt, Human
gcaacuccaccucccagguuc

SEQ ID NO: 238484 - RNA, 19 nt, Human
gcccagcccccacccaaau

SEQ ID NO: 238485 - RNA, 23 nt, Human
gcccagcuaauuuuuuguauuuu

SEQ ID NO: 238486 - RNA, 19 nt, Human
gccccgaggggcgggcacu

SEQ ID NO: 238487 - RNA, 24 nt, Human
gcccggcccucuugucuucucuua

SEQ ID NO: 238488 - RNA, 19 nt, Human
gccuagauuguaccuacaa

SEQ ID NO: 238489 - RNA, 23 nt, Human
gcgauucuccugccucagccucc

SEQ ID NO: 238490 - RNA, 19 nt, Human
gcucaagugauuuucccac

SEQ ID NO: 238491 - RNA, 22 nt, Human
gcucaagugauuuucccaccuc

SEQ ID NO: 238492 - RNA, 23 nt, Human
gcuggucucgaacuccugaccuc

SEQ ID NO: 238493 - RNA, 21 nt, Human
gcuguauguaagcuccccuca

SEQ ID NO: 238494 - RNA, 22 nt, Human
ggaaacacugaaagaucagccg

SEQ ID NO: 238495 - RNA, 23 nt, Human
ggagucucacucuguugcccagg

SEQ ID NO: 238496 - RNA, 22 nt, Human
ggauuacaggcaacugccacca

SEQ ID NO: 238497 - RNA, 23 nt, Human
ggcacugacaguccuggccugcc

SEQ ID NO: 238498 - RNA, 18 nt, Human
ggccgagccggaagaagc

SEQ ID NO: 238499 - RNA, 24 nt, Human
ggcuggucucgaacuccugaccuc

SEQ ID NO: 238500 - RNA, 19 nt, Human
gggcagauauuccagccuu

SEQ ID NO: 238501 - RNA, 22 nt, Human
gggcucaagugauuuucccacc

SEQ ID NO: 238502 - RNA, 18 nt, Human
gggguuucgccaugcugg

SEQ ID NO: 238503 - RNA, 19 nt, Human
ggucucgaacuccugaccu

SEQ ID NO: 238504 - RNA, 21 nt, Human
guacugggcaagaccacagag

SEQ ID NO: 238505 - RNA, 28 nt, Human
guagaagccagcccagcccccacccaaa

SEQ ID NO: 238506 - RNA, 21 nt, Human
gucacugcagaaagcuccacu

SEQ ID NO: 238507 - RNA, 24 nt, Human
gugauccacccacuucggccuccc

SEQ ID NO: 238508 - RNA, 24 nt, Human
gugauuuucccaccucagccuccu

SEQ ID NO: 238509 - RNA, 21 nt, Human
guggagaugggguuucgucau

SEQ ID NO: 238510 - RNA, 22 nt, Human
guggagaugggguuucgucaug

SEQ ID NO: 238511 - RNA, 21 nt, Human
uaaaacauauuaaaugugcau

SEQ ID NO: 238512 - RNA, 19 nt, Human
uaacacauaccuuagcaug

SEQ ID NO: 238513 - RNA, 22 nt, Human
uaacaugaaauaauuauauauc

SEQ ID NO: 238514 - RNA, 24 nt, Human
uaacuucaguauuuggucuuuuag

SEQ ID NO: 238515 - RNA, 20 nt, Human
uaaguggaagcaguccucca

SEQ ID NO: 238516 - RNA, 24 nt, Human
uaauagagacaggguuucacuaug

SEQ ID NO: 238517 - RNA, 19 nt, Human
uaaugaaucccaccucucc

SEQ ID NO: 238518 - RNA, 24 nt, Human
uaauuuuuugcauuuuuaauagag

SEQ ID NO: 238519 - RNA, 24 nt, Human
uaauuuuuuguauuuuuaguagag

SEQ ID NO: 238520 - RNA, 24 nt, Human
uacaggcaacugccaccaugccca

SEQ ID NO: 238521 - RNA, 23 nt, Human
uacaggugugagccaccacaccc

SEQ ID NO: 238522 - RNA, 19 nt, Human
uaccccagauuaacuucca

SEQ ID NO: 238523 - RNA, 20 nt, Human
uaccugccccgaggggcggg

SEQ ID NO: 238524 - RNA, 23 nt, Human
uacugcaaccucugcuuccuggg

SEQ ID NO: 238525 - RNA, 21 nt, Human
uagagacaggguuucacuaug

SEQ ID NO: 238526 - RNA, 22 nt, Human
uagagacaggguuucacuaugu

SEQ ID NO: 238527 - RNA, 20 nt, Human
uagagaugggguuucgccau

SEQ ID NO: 238528 - RNA, 22 nt, Human
uagccacauguguguggggucc

SEQ ID NO: 238529 - RNA, 21 nt, Human
uaggaacuccuuaucagugug

SEQ ID NO: 238530 - RNA, 21 nt, Human
uaggauuacaggcaacugcca

SEQ ID NO: 238531 - RNA, 22 nt, Human
uaggauuacaggcaacugccac

SEQ ID NO: 238532 - RNA, 24 nt, Human
uaggauuacaggcaacugccacca

SEQ ID NO: 238533 - RNA, 25 nt, Human
uaggauuacaggcaacugccaccau

SEQ ID NO: 238534 - RNA, 24 nt, Human
uaguagagaugggguuucgccaug

SEQ ID NO: 238535 - RNA, 26 nt, Human
uaguagagcuaauaaauuugaauugu

SEQ ID NO: 238536 - RNA, 21 nt, Human
uaucucuacaaacauauucaa

SEQ ID NO: 238537 - RNA, 24 nt, Human
uauguuguuuaggcuggucucgaa

SEQ ID NO: 238538 - RNA, 19 nt, Human
ucaagcaauucuccugccu

SEQ ID NO: 238539 - RNA, 24 nt, Human
ucacccaggcuggagggcaguguc

SEQ ID NO: 238540 - RNA, 22 nt, Human
ucacccaggcuggagugcaguc

SEQ ID NO: 238541 - RNA, 22 nt, Human
ucacuauguuguuuaggcuggu

SEQ ID NO: 238542 - RNA, 24 nt, Human
ucacucuguugcccaggcuggagu

SEQ ID NO: 238543 - RNA, 18 nt, Human
ucacugcaacuccaccuc

SEQ ID NO: 238544 - RNA, 23 nt, Human
ucacugcaacuccaccucccagg

SEQ ID NO: 238545 - RNA, 20 nt, Human
ucagccuccugaguagcugg

SEQ ID NO: 238546 - RNA, 23 nt, Human
ucagccuccugaguagcugggac

SEQ ID NO: 238547 - RNA, 19 nt, Human
ucaggucaaacccaaggcu

SEQ ID NO: 238548 - RNA, 19 nt, Human
uccauggagggagauacuc

SEQ ID NO: 238549 - RNA, 23 nt, Human
uccauggagggagauacucaugu

SEQ ID NO: 238550 - RNA, 22 nt, Human
uccauuacccuacauggccauc

SEQ ID NO: 238551 - RNA, 23 nt, Human
ucccaaagugcugggauuacagg

SEQ ID NO: 238552 - RNA, 24 nt, Human
ucccaaagugcugggauuauaggc

SEQ ID NO: 238553 - RNA, 21 nt, Human
ucccagguucaagcgauucuc

SEQ ID NO: 238554 - RNA, 24 nt, Human
ucccagguucaagcgauucuccug

SEQ ID NO: 238555 - RNA, 23 nt, Human
ucccauagugcugggauuauagg

SEQ ID NO: 238556 - RNA, 19 nt, Human
ucccccaacccccucgcug

SEQ ID NO: 238557 - RNA, 19 nt, Human
uccugaguagcuaggauua

SEQ ID NO: 238558 - RNA, 24 nt, Human
uccugaguagcuaggauuacaggc

SEQ ID NO: 238559 - RNA, 24 nt, Human
uccugaguagcugggaccacaggc

SEQ ID NO: 238560 - RNA, 24 nt, Human
uccugaguagcugggauuacgggu

SEQ ID NO: 238561 - RNA, 18 nt, Human
uccugggcucaaacaacc

SEQ ID NO: 238562 - RNA, 21 nt, Human
uccugggcucaaacaaccugc

SEQ ID NO: 238563 - RNA, 21 nt, Human
uccugggcucaagugauuuuc

SEQ ID NO: 238564 - RNA, 22 nt, Human
uccugggcucaagugauuuucc

SEQ ID NO: 238565 - RNA, 23 nt, Human
uccugggcucaagugauuuuccc

SEQ ID NO: 238566 - RNA, 24 nt, Human
uccugggcucaagugauuuuccca

SEQ ID NO: 238567 - RNA, 20 nt, Human
uccuggguucaagcaauucu

SEQ ID NO: 238568 - RNA, 21 nt, Human
uccuggguucaagcaauucuc

SEQ ID NO: 238569 - RNA, 24 nt, Human
uccuggguucaagcaauucuccug

SEQ ID NO: 238570 - RNA, 19 nt, Human
ucucaaauuccugggcuca

SEQ ID NO: 238571 - RNA, 23 nt, Human
ucucacucugucacccaggcugg

SEQ ID NO: 238572 - RNA, 24 nt, Human
ucucacucugucacccaggcugga

SEQ ID NO: 238573 - RNA, 26 nt, Human
ucucacucugucacccaggcuggagg

SEQ ID NO: 238574 - RNA, 27 nt, Human
ucucacucugucacccaggcuggaggg

SEQ ID NO: 238575 - RNA, 23 nt, Human
ucucacucuguugcccaggcugg

SEQ ID NO: 238576 - RNA, 24 nt, Human
ucucacucuguugcccaggcugga

SEQ ID NO: 238577 - RNA, 26 nt, Human
ucucacucuguugcccaggcuggagu

SEQ ID NO: 238578 - RNA, 27 nt, Human
ucucacucuguugcccaggcuggagug

SEQ ID NO: 238579 - RNA, 24 nt, Human
ucuccugccucagccuccugagua

SEQ ID NO: 238580 - RNA, 24 nt, Human
ucuccugccucagccuccugagua

SEQ ID NO: 238581 - RNA, 21 nt, Human
ucucgaacuccugaccucaug

SEQ ID NO: 238582 - RNA, 20 nt, Human
ucucggccucccaaagugcu

SEQ ID NO: 238583 - RNA, 24 nt, Human
ucucucuuuuuuuuuuugagaugg

SEQ ID NO: 238584 - RNA, 23 nt, Human
ucugcaggucugaaccccagccu

SEQ ID NO: 238585 - RNA, 19 nt, Human
ucuggcucugucacccagg

SEQ ID NO: 238586 - RNA, 23 nt, Human
ucuggcucugucacccaggcugg

SEQ ID NO: 238587 - RNA, 24 nt, Human
ucuggcucugucacccaggcugga

SEQ ID NO: 238588 - RNA, 24 nt, Human
ucugucacccaggcuggagugcag

SEQ ID NO: 238589 - RNA, 21 nt, Human
ucuguccugaccaaguaacac

SEQ ID NO: 238590 - RNA, 18 nt, Human
ucuguugcccaggcugga

SEQ ID NO: 238591 - RNA, 24 nt, Human
ucuguugcccaggcuggagugcaa

SEQ ID NO: 238592 - RNA, 20 nt, Human
ucuucaugugaacuccaucc

SEQ ID NO: 238593 - RNA, 22 nt, Human
ugaaacaagguuuuuaaacaaa

SEQ ID NO: 238594 - RNA, 21 nt, Human
ugaacuccaucccccaacccc

SEQ ID NO: 238595 - RNA, 22 nt, Human
ugacagugaaacaagguuuuua

SEQ ID NO: 238596 - RNA, 21 nt, Human
ugacauaagagcccaaagucu

SEQ ID NO: 238597 - RNA, 21 nt, Human
ugaccaaguaacacauggugc

SEQ ID NO: 238598 - RNA, 22 nt, Human
ugaccaaguaacacauggugcc

SEQ ID NO: 238599 - RNA, 18 nt, Human
ugaccacucaggacugga

SEQ ID NO: 238600 - RNA, 19 nt, Human
ugagaauaaaauguuugga

SEQ ID NO: 238601 - RNA, 20 nt, Human
ugagacagggucucacucug

SEQ ID NO: 238602 - RNA, 22 nt, Human
ugagccaccacacccggccccu

SEQ ID NO: 238603 - RNA, 20 nt, Human
ugauuccugaaaacaaugca

SEQ ID NO: 238604 - RNA, 19 nt, Human
ugcaaccucugcuuccugg

SEQ ID NO: 238605 - RNA, 18 nt, Human
ugcaacuccaccucccag

SEQ ID NO: 238606 - RNA, 18 nt, Human
ugcaauggugggaucuca

SEQ ID NO: 238607 - RNA, 18 nt, Human
ugcauuauuuggaaaaaa

SEQ ID NO: 238608 - RNA, 20 nt, Human
ugccauuuagugcuucuucc

SEQ ID NO: 238609 - RNA, 18 nt, Human
ugcccaaagcaugggcag

SEQ ID NO: 238610 - RNA, 18 nt, Human
ugcccaggcuggagugca

SEQ ID NO: 238611 - RNA, 21 nt, Human
ugcccaggcuggagugcaaug

SEQ ID NO: 238612 - RNA, 24 nt, Human
ugcccaggcuggagugcaauggug

SEQ ID NO: 238613 - RNA, 24 nt, Human
ugccucagccucccauagugcugg

SEQ ID NO: 238614 - RNA, 24 nt, Human
ugccucagccuccugaguagcuag

SEQ ID NO: 238615 - RNA, 24 nt, Human
ugccucagccuccugaguagcugg

SEQ ID NO: 238616 - RNA, 18 nt, Human
ugccuugacccagccagc

SEQ ID NO: 238617 - RNA, 24 nt, Human
ugcugggauuacaggugugagcca

SEQ ID NO: 238618 - RNA, 28 nt, Human
uggagcacucucucaugggaauuuuccc

SEQ ID NO: 238619 - RNA, 24 nt, Human
uggagucucacucuguugcccagg

SEQ ID NO: 238620 - RNA, 20 nt, Human
uggagugcaauggugggauc

SEQ ID NO: 238621 - RNA, 23 nt, Human
uggagugcaauggugggaucuca

SEQ ID NO: 238622 - RNA, 19 nt, Human
uggagugcagucccaugau

SEQ ID NO: 238623 - RNA, 24 nt, Human
uggagugcagucccaugaucucgg

SEQ ID NO: 238624 - RNA, 24 nt, Human
uggcucugucacccaggcuggagu

SEQ ID NO: 238625 - RNA, 21 nt, Human
ugggaccacaggcacaugcca

SEQ ID NO: 238626 - RNA, 24 nt, Human
ugggaccacaggcacaugccacca

SEQ ID NO: 238627 - RNA, 23 nt, Human
ugggaugucaauaauaaccuuuu

SEQ ID NO: 238628 - RNA, 18 nt, Human
ugggauuacaggugugag

SEQ ID NO: 238629 - RNA, 19 nt, Human
ugggauuacaggugugagc

SEQ ID NO: 238630 - RNA, 22 nt, Human
ugggauuacaggugugagccac

SEQ ID NO: 238631 - RNA, 23 nt, Human
ugggauuacaggugugagccacc

SEQ ID NO: 238632 - RNA, 24 nt, Human
ugggauuacaggugugagccacca

SEQ ID NO: 238633 - RNA, 19 nt, Human
ugggauuacgggugcccac

SEQ ID NO: 238634 - RNA, 21 nt, Human
ugggauuacgggugcccacca

SEQ ID NO: 238635 - RNA, 18 nt, Human
ugggauuauaggcgugag

SEQ ID NO: 238636 - RNA, 21 nt, Human
ugggauuauaggcgugaguca

SEQ ID NO: 238637 - RNA, 22 nt, Human
ugggauuauaggcgugagucac

SEQ ID NO: 238638 - RNA, 23 nt, Human
ugggauuauaggcgugagucacc

SEQ ID NO: 238639 - RNA, 24 nt, Human
ugggauuauaggcgugagucaccg

SEQ ID NO: 238640 - RNA, 21 nt, Human
ugggauuauaggugugagcca

SEQ ID NO: 238641 - RNA, 22 nt, Human
ugggauuauaggugugagccac

SEQ ID NO: 238642 - RNA, 23 nt, Human
ugggauuauaggugugagccacc

SEQ ID NO: 238643 - RNA, 23 nt, Human
ugggauuauaggugugagccacc

SEQ ID NO: 238644 - RNA, 24 nt, Human
ugggauuauaggugugagccaccg

SEQ ID NO: 238645 - RNA, 24 nt, Human
ugggcucaagugauuuucccaccu

SEQ ID NO: 238646 - RNA, 19 nt, Human
ugggguuucgccaugcugg

SEQ ID NO: 238647 - RNA, 21 nt, Human
uggguucaagcaauucuccug

SEQ ID NO: 238648 - RNA, 23 nt, Human
uggguucaagcaauucuccugcc

SEQ ID NO: 238649 - RNA, 24 nt, Human
uggguucaagcaauucuccugccu

SEQ ID NO: 238650 - RNA, 18 nt, Human
ugguagccacaugugugu

SEQ ID NO: 238651 - RNA, 24 nt, Human
uggugggaucucagcuuacugcaa

SEQ ID NO: 238652 - RNA, 19 nt, Human
ugugacagugaaacaaggu

SEQ ID NO: 238653 - RNA, 20 nt, Human
uguugcccaggcuggagugc

SEQ ID NO: 238654 - RNA, 24 nt, Human
uguugcuaaacauguagaagccag

SEQ ID NO: 238655 - RNA, 24 nt, Human
uguuuaggcuggucucgaacuccu

SEQ ID NO: 238656 - RNA, 19 nt, Human
uuaaauaguaucucuacaa

SEQ ID NO: 238657 - RNA, 18 nt, Human
uuaaaugugcauuauuug

SEQ ID NO: 238658 - RNA, 21 nt, Human
uuaauagagacaggguuucac

SEQ ID NO: 238659 - RNA, 24 nt, Human
uuaauagagacaggguuucacuau

SEQ ID NO: 238660 - RNA, 19 nt, Human
uuacccuacauggccaucu

SEQ ID NO: 238661 - RNA, 24 nt, Human
uuacugcaaccucugcuuccuggg

SEQ ID NO: 238662 - RNA, 18 nt, Human
uuaguagagaugggguuu

SEQ ID NO: 238663 - RNA, 22 nt, Human
uuaguagagaugggguuucgcc

SEQ ID NO: 238664 - RNA, 24 nt, Human
uuaguagagaugggguuucgccau

SEQ ID NO: 238665 - RNA, 21 nt, Human
uucaagcaauucuccugccuc

SEQ ID NO: 238666 - RNA, 24 nt, Human
uucaagcaauucuccugccucagc

SEQ ID NO: 238667 - RNA, 21 nt, Human
uucaagcgauucuccugccuc

SEQ ID NO: 238668 - RNA, 23 nt, Human
uucaagcgauucuccugccucag

SEQ ID NO: 238669 - RNA, 24 nt, Human
uucaagcgauucuccugccucagc

SEQ ID NO: 238670 - RNA, 20 nt, Human
uucacaaucccuuuaucuuu

SEQ ID NO: 238671 - RNA, 24 nt, Human
uucacaaucccuuuaucuuuuucu

SEQ ID NO: 238672 - RNA, 23 nt, Human
uucccaccucagccuccugagua

SEQ ID NO: 238673 - RNA, 22 nt, Human
uuccucugcaggucugaacccc

SEQ ID NO: 238674 - RNA, 19 nt, Human
uuccugggcucaaacaacc

SEQ ID NO: 238675 - RNA, 23 nt, Human
uuccuucuuagucacaaaagcug

SEQ ID NO: 238676 - RNA, 23 nt, Human
uucuaaguggaagcaguccucca

SEQ ID NO: 238677 - RNA, 19 nt, Human
uugaacauuccuaggcacu

SEQ ID NO: 238678 - RNA, 25 nt, Human
uugagacagagucuggcucugucac

SEQ ID NO: 238679 - RNA, 22 nt, Human
uugagacagggucucacucugu

SEQ ID NO: 238680 - RNA, 18 nt, Human
uugcccaggcuggagugc

SEQ ID NO: 238681 - RNA, 23 nt, Human
uuguauuuuuaguagagaugggg

SEQ ID NO: 238682 - RNA, 24 nt, Human
uuguggagaugggguuucgucaug

SEQ ID NO: 238683 - RNA, 18 nt, Human
uuuacaccgcagaggcug

SEQ ID NO: 238684 - RNA, 19 nt, Human
uuucaaaauaacaaaacac

SEQ ID NO: 238685 - RNA, 19 nt, Human
uuugacauuugaaaaccau

SEQ ID NO: 238686 - RNA, 24 nt, Human
uuuguggagaugggguuucgucau

SEQ ID NO: 238687 - RNA, 24 nt, Human
uuuuuaauagagacaggguuucac

SEQ ID NO: 238688 - RNA, 22 nt, Human
uuuuuaguagagaugggguuuc

SEQ ID NO: 238689 - RNA, 23 nt, Human
uuuuuaguagagaugggguuucg

SEQ ID NO: 238690 - RNA, 21 nt, Human
uuuuuguauuuuuaguagaga

SEQ ID NO: 238691 - RNA, 24 nt, Human
uuuuuuguauuuuuaguagagaug

SEQ ID NO: 238692 - RNA, 23 nt, Human
uuuuuuguggagaugggguuucg

SEQ ID NO: 238693 - RNA, 24 nt, Human
uuuuuuguggagaugggguuucgu

SEQ ID NO: 238694 - RNA, 23 nt, Human
uuuuuuuuugagacagagucugg

SEQ ID NO: 238695 - RNA, 25 nt, Human
uuuuuuuuuuugagacagagucugg

SEQ ID NO: 238696 - RNA, 23 nt, Human
aagaagcggagcuggguggggag

SEQ ID NO: 238697 - RNA, 23 nt, Human
agagaguggaagggcagagaggc

SEQ ID NO: 238698 - RNA, 19 nt, Human
agcccuugaccugcaguuu

SEQ ID NO: 238699 - RNA, 20 nt, Human
cacaggcugugccucaaccu

SEQ ID NO: 238700 - RNA, 18 nt, Human
cagagaggcuaaaggguc

SEQ ID NO: 238701 - RNA, 21 nt, Human
cagcaucaagcauccugcaug

SEQ ID NO: 238702 - RNA, 18 nt, Human
cagcccuugaccugcagu

SEQ ID NO: 238703 - RNA, 19 nt, Human
caggaguuucuuuccuccc

SEQ ID NO: 238704 - RNA, 21 nt, Human
caucaaagaggcgaggguagg

SEQ ID NO: 238705 - RNA, 22 nt, Human
caucaaagaggcgaggguaggu

SEQ ID NO: 238706 - RNA, 18 nt, Human
ccaaguaacaagaagcgg

SEQ ID NO: 238707 - RNA, 22 nt, Human
ccagccggcuggaccugcagac

SEQ ID NO: 238708 - RNA, 22 nt, Human
cccccaaguaacaagaagcgga

SEQ ID NO: 238709 - RNA, 25 nt, Human
ccugcagacccaggaagcgagaugg

SEQ ID NO: 238710 - RNA, 25 nt, Human
ccuugaccugcaguuuccccuuggu

SEQ ID NO: 238711 - RNA, 22 nt, Human
cgggguggggggcggcaagcag

SEQ ID NO: 238712 - RNA, 23 nt, Human
cuggcaacaggaagcaacuucuu

SEQ ID NO: 238713 - RNA, 23 nt, Human
cuggcuggaaucuccccugggua

SEQ ID NO: 238714 - RNA, 21 nt, Human
cugggccccacagggugcugg

SEQ ID NO: 238715 - RNA, 19 nt, Human
gaccugcaguuuccccuug

SEQ ID NO: 238716 - RNA, 21 nt, Human
gagcuggguggggagggcggg

SEQ ID NO: 238717 - RNA, 22 nt, Human
gagcuggguggggagggcgggg

SEQ ID NO: 238718 - RNA, 18 nt, Human
gcuggaaucuccccuggg

SEQ ID NO: 238719 - RNA, 22 nt, Human
gcuggaaucuccccuggguaca

SEQ ID NO: 238720 - RNA, 19 nt, Human
ggagcuggguggggagggc

SEQ ID NO: 238721 - RNA, 18 nt, Human
ggcagagaggcuaaaggg

SEQ ID NO: 238722 - RNA, 18 nt, Human
ggcggcaagcagcggggg

SEQ ID NO: 238723 - RNA, 19 nt, Human
ggggagggcgggggcggug

SEQ ID NO: 238724 - RNA, 20 nt, Human
ggggcggcaagcagcggggg

SEQ ID NO: 238725 - RNA, 21 nt, Human
ggggcggcaagcagcggggga

SEQ ID NO: 238726 - RNA, 21 nt, Human
gucugggccccacagggugcu

SEQ ID NO: 238727 - RNA, 21 nt, Human
gugcuggcagaucccuggagu

SEQ ID NO: 238728 - RNA, 18 nt, Human
uaacuuccuagaaggcac

SEQ ID NO: 238729 - RNA, 19 nt, Human
uccaggagcaaaaggaggu

SEQ ID NO: 238730 - RNA, 19 nt, Human
uccccuuggaucugggggg

SEQ ID NO: 238731 - RNA, 20 nt, Human
uccuagaaggcacuuggccu

SEQ ID NO: 238732 - RNA, 21 nt, Human
ucuuagccagggccggggggc

SEQ ID NO: 238733 - RNA, 20 nt, Human
ugccucaaccuccuaacuuc

SEQ ID NO: 238734 - RNA, 24 nt, Human
ugccucaaccuccuaacuuccuag

SEQ ID NO: 238735 - RNA, 18 nt, Human
ugcuggcaacaggaagca

SEQ ID NO: 238736 - RNA, 22 nt, Human
uggaccugcagacccaggaagc

SEQ ID NO: 238737 - RNA, 18 nt, Human
uggcaacaggaagcaacu

SEQ ID NO: 238738 - RNA, 21 nt, Human
uggcaacaggaagcaacuucu

SEQ ID NO: 238739 - RNA, 19 nt, Human
uggccaaugaucaggaguu

SEQ ID NO: 238740 - RNA, 20 nt, Human
uggggggcggcaagcagcgg

SEQ ID NO: 238741 - RNA, 19 nt, Human
uggguacauggagggugcc

SEQ ID NO: 238742 - RNA, 21 nt, Human
ugucuggcuggaaucuccccu

SEQ ID NO: 238743 - RNA, 18 nt, Human
uguggcuuucuuaauugg

SEQ ID NO: 238744 - RNA, 26 nt, Human
uuggccaaugaucaggaguuucuuuc

SEQ ID NO: 238745 - RNA, 18 nt, Human
aaaaaaccuccuagccuc

SEQ ID NO: 238746 - RNA, 19 nt, Human
acacaggcacagcugcucc

SEQ ID NO: 238747 - RNA, 25 nt, Human
acccacccuguccccaucccugccu

SEQ ID NO: 238748 - RNA, 24 nt, Human
acccagggguaugcggcuccauga

SEQ ID NO: 238749 - RNA, 21 nt, Human
acuacuauaaacccuguagac

SEQ ID NO: 238750 - RNA, 24 nt, Human
acuggaacgcacagacggcaccca

SEQ ID NO: 238751 - RNA, 23 nt, Human
agacaaaaggugcaggagaagcc

SEQ ID NO: 238752 - RNA, 18 nt, Human
agcccagagcccacucga

SEQ ID NO: 238753 - RNA, 21 nt, Human
agccugcccagggccgacccc

SEQ ID NO: 238754 - RNA, 18 nt, Human
aggcaagcucacgaccca

SEQ ID NO: 238755 - RNA, 22 nt, Human
agggccgaccccagcccagagc

SEQ ID NO: 238756 - RNA, 19 nt, Human
agggguuggagcccaagac

SEQ ID NO: 238757 - RNA, 20 nt, Human
aggugcaggagaagccugcc

SEQ ID NO: 238758 - RNA, 22 nt, Human
aguaaaaaucaagagucuaagc

SEQ ID NO: 238759 - RNA, 19 nt, Human
aucaagagucuaagccacc

SEQ ID NO: 238760 - RNA, 21 nt, Human
augcggcuccaugacaccacc

SEQ ID NO: 238761 - RNA, 25 nt, Human
caagcccgacaagcuacuuucagaa

SEQ ID NO: 238762 - RNA, 24 nt, Human
cacaaacagcauuccacgcaggug

SEQ ID NO: 238763 - RNA, 23 nt, Human
cacaggguugcccucgugucccu

SEQ ID NO: 238764 - RNA, 21 nt, Human
cacccacccuguccccauccc

SEQ ID NO: 238765 - RNA, 22 nt, Human
cacccacccuguccccaucccu

SEQ ID NO: 238766 - RNA, 19 nt, Human
cacggcuccugugcccccu

SEQ ID NO: 238767 - RNA, 21 nt, Human
cagaauaucagucuccacacc

SEQ ID NO: 238768 - RNA, 21 nt, Human
cagcugcuccucucccaagaa

SEQ ID NO: 238769 - RNA, 22 nt, Human
caggaccccuuggccucacugg

SEQ ID NO: 238770 - RNA, 22 nt, Human
caggaugcuccaugagcaaccc

SEQ ID NO: 238771 - RNA, 21 nt, Human
caugacaccaccccauacgca

SEQ ID NO: 238772 - RNA, 18 nt, Human
caugacagacccugcaua

SEQ ID NO: 238773 - RNA, 22 nt, Human
caugaggcuccaugacaccacc

SEQ ID NO: 238774 - RNA, 25 nt, Human
cccaacccggccaggaccccuuggc

SEQ ID NO: 238775 - RNA, 20 nt, Human
ccccauacgcaggcaagcuc

SEQ ID NO: 238776 - RNA, 20 nt, Human
ccccauacucaggcgagcuc

SEQ ID NO: 238777 - RNA, 18 nt, Human
cccccuuccucacccaag

SEQ ID NO: 238778 - RNA, 18 nt, Human
ccccgcacugggcuauuc

SEQ ID NO: 238779 - RNA, 22 nt, Human
ccuccagccuggcccccagauu

SEQ ID NO: 238780 - RNA, 18 nt, Human
ccuccuagccucacuacc

SEQ ID NO: 238781 - RNA, 22 nt, Human
ccugcccagggccgaccccagc

SEQ ID NO: 238782 - RNA, 18 nt, Human
ccuggcccccagauucac

SEQ ID NO: 238783 - RNA, 21 nt, Human
ccuugaggccgugcccagagg

SEQ ID NO: 238784 - RNA, 19 nt, Human
cggcuccaugacaccaccc

SEQ ID NO: 238785 - RNA, 21 nt, Human
cggcuccugugcccccuuccu

SEQ ID NO: 238786 - RNA, 19 nt, Human
cucacaaacagcauuccac

SEQ ID NO: 238787 - RNA, 20 nt, Human
cucacaaacagcauuccacg

SEQ ID NO: 238788 - RNA, 22 nt, Human
cucagcccagcagacaaaaggu

SEQ ID NO: 238789 - RNA, 24 nt, Human
cuccagccuggcccccagauucac

SEQ ID NO: 238790 - RNA, 21 nt, Human
cuggcccccagauucacaucu

SEQ ID NO: 238791 - RNA, 21 nt, Human
cuggcccccagauucacaucu

SEQ ID NO: 238792 - RNA, 25 nt, Human
cuugaggccgugcccagagguggcc

SEQ ID NO: 238793 - RNA, 20 nt, Human
gaccccuuggccucacugga

SEQ ID NO: 238794 - RNA, 19 nt, Human
gacggcacccagcagguag

SEQ ID NO: 238795 - RNA, 20 nt, Human
gcagaaggcgcugugccucc

SEQ ID NO: 238796 - RNA, 20 nt, Human
gcugggccacagacuaugug

SEQ ID NO: 238797 - RNA, 22 nt, Human
ggagaagccugcccagggccga

SEQ ID NO: 238798 - RNA, 19 nt, Human
ggugcaggagaagccugcc

SEQ ID NO: 238799 - RNA, 20 nt, Human
guccccaucccugccuccag

SEQ ID NO: 238800 - RNA, 21 nt, Human
uaagccacccacccugucccc

SEQ ID NO: 238801 - RNA, 21 nt, Human
uacaguaaaaaucaagagucu

SEQ ID NO: 238802 - RNA, 23 nt, Human
uacaguaaaaaucaagagucuaa

SEQ ID NO: 238803 - RNA, 21 nt, Human
uaugcggcuccaugacaccac

SEQ ID NO: 238804 - RNA, 18 nt, Human
ucaagagucuaagccacc

SEQ ID NO: 238805 - RNA, 23 nt, Human
ucagaaaaaaccuccuagccuca

SEQ ID NO: 238806 - RNA, 22 nt, Human
ucagcccagcagacaaaaggug

SEQ ID NO: 238807 - RNA, 22 nt, Human
ucaggggucacggcuccugugc

SEQ ID NO: 238808 - RNA, 26 nt, Human
uccaugagcaacccccgcacugggcu

SEQ ID NO: 238809 - RNA, 25 nt, Human
ucccaagaacucagcuauuggucag

SEQ ID NO: 238810 - RNA, 18 nt, Human
uccccaucccugccucca

SEQ ID NO: 238811 - RNA, 18 nt, Human
uccucacccaagcccgac

SEQ ID NO: 238812 - RNA, 22 nt, Human
ugacaccaccccauacgcaggc

SEQ ID NO: 238813 - RNA, 22 nt, Human
ugacaccaccccauacucaggc

SEQ ID NO: 238814 - RNA, 18 nt, Human
ugacagacccugcauaug

SEQ ID NO: 238815 - RNA, 18 nt, Human
ugagauagagguugaggg

SEQ ID NO: 238816 - RNA, 20 nt, Human
ugaggccgugcccagaggug

SEQ ID NO: 238817 - RNA, 25 nt, Human
ugccuccagccuggcccccagauuc

SEQ ID NO: 238818 - RNA, 22 nt, Human
ugcugcacggccucaggaugcu

SEQ ID NO: 238819 - RNA, 19 nt, Human
uggagcccaagacaggguu

SEQ ID NO: 238820 - RNA, 21 nt, Human
uggggcucccugcugcacggc

SEQ ID NO: 238821 - RNA, 18 nt, Human
ugucccaggggcaugggg

SEQ ID NO: 238822 - RNA, 18 nt, Human
uguccccaucccugccuc

SEQ ID NO: 238823 - RNA, 21 nt, Human
uugcugggccacagacuaugu

SEQ ID NO: 238824 - RNA, 18 nt, Human
aaccaaggcccaggccca

SEQ ID NO: 238825 - RNA, 21 nt, Human
aauaguccccucccugccucu

SEQ ID NO: 238826 - RNA, 19 nt, Human
aauggaggcagaaugggga

SEQ ID NO: 238827 - RNA, 23 nt, Human
acgaagcacgggcagcccaagga

SEQ ID NO: 238828 - RNA, 22 nt, Human
acgaccccugaaauggucagaa

SEQ ID NO: 238829 - RNA, 23 nt, Human
agagccuuucccugccuucuggg

SEQ ID NO: 238830 - RNA, 20 nt, Human
aggcagaauggggagaaggu

SEQ ID NO: 238831 - RNA, 23 nt, Human
aggcagaauggggagaaggucuu

SEQ ID NO: 238832 - RNA, 22 nt, Human
aggcagcaggugcaggagggac

SEQ ID NO: 238833 - RNA, 21 nt, Human
aggcaggccggggauccaggc

SEQ ID NO: 238834 - RNA, 19 nt, Human
aggcccaggcaggccgggg

SEQ ID NO: 238835 - RNA, 23 nt, Human
agggaugguucagggaggugugg

SEQ ID NO: 238836 - RNA, 20 nt, Human
agggugcagaugccuccgug

SEQ ID NO: 238837 - RNA, 27 nt, Human
auuauuuuuucuuucuggauuuuucca

SEQ ID NO: 238838 - RNA, 23 nt, Human
caagcuccuccaugugccugcuc

SEQ ID NO: 238839 - RNA, 18 nt, Human
caggagggaccgaggccc

SEQ ID NO: 238840 - RNA, 22 nt, Human
caggagggaccgaggcccaggc

SEQ ID NO: 238841 - RNA, 18 nt, Human
caggccggggauccaggc

SEQ ID NO: 238842 - RNA, 23 nt, Human
caggccggggauccaggcagcag

SEQ ID NO: 238843 - RNA, 18 nt, Human
ccccucucuccauccucc

SEQ ID NO: 238844 - RNA, 18 nt, Human
ccccucucuccauccucc

SEQ ID NO: 238845 - RNA, 22 nt, Human
ccccugaaauggucagaaugga

SEQ ID NO: 238846 - RNA, 23 nt, Human
cuagucaucccccaagcuccucc

SEQ ID NO: 238847 - RNA, 22 nt, Human
cuccuccaugugccugcucuuc

SEQ ID NO: 238848 - RNA, 20 nt, Human
cucuagucaucccccaagcu

SEQ ID NO: 238849 - RNA, 23 nt, Human
cuucuauuauuccccucucucca

SEQ ID NO: 238850 - RNA, 21 nt, Human
gacagaccaacagcuuugggc

SEQ ID NO: 238851 - RNA, 20 nt, Human
gaggcagaauggggagaagg

SEQ ID NO: 238852 - RNA, 18 nt, Human
gcuguuggaauggccaaa

SEQ ID NO: 238853 - RNA, 19 nt, Human
gcuguuggaauggccaaag

SEQ ID NO: 238854 - RNA, 27 nt, Human
ggaccgaggcccaggcagagggcagga

SEQ ID NO: 238855 - RNA, 24 nt, Human
ggagaaccaaggcccaggcccagg

SEQ ID NO: 238856 - RNA, 19 nt, Human
ggcagcaggugcaggaggg

SEQ ID NO: 238857 - RNA, 18 nt, Human
gggcccugugaucccuca

SEQ ID NO: 238858 - RNA, 19 nt, Human
guaguccaaagcacgaagc

SEQ ID NO: 238859 - RNA, 19 nt, Human
uagcuggugggacagacca

SEQ ID NO: 238860 - RNA, 22 nt, Human
ucagagccuuucccugccuucu

SEQ ID NO: 238861 - RNA, 20 nt, Human
uccccucucuccauccucca

SEQ ID NO: 238862 - RNA, 18 nt, Human
ucuaggccccaccuagcu

SEQ ID NO: 238863 - RNA, 19 nt, Human
ucucuugggccugucucug

SEQ ID NO: 238864 - RNA, 22 nt, Human
ucuguuucuccuuggauguucu

SEQ ID NO: 238865 - RNA, 22 nt, Human
ugaaauggucagaauggaggca

SEQ ID NO: 238866 - RNA, 21 nt, Human
uggaauggccaaaggagaggu

SEQ ID NO: 238867 - RNA, 22 nt, Human
uggaauggccaaaggagaggug

SEQ ID NO: 238868 - RNA, 24 nt, Human
uggaggcagaauggggagaagguc

SEQ ID NO: 238869 - RNA, 22 nt, Human
uguggggcucuggucggcagcu

SEQ ID NO: 238870 - RNA, 22 nt, Human
uucuauuauuccccucucucca

SEQ ID NO: 238871 - RNA, 22 nt, Human
uucuggggcccugugaucccuc

SEQ ID NO: 238872 - RNA, 20 nt, Human
uuggaauggccaaaggagag

SEQ ID NO: 238873 - RNA, 21 nt, Human
uugugcgcaugcccucucacu

SEQ ID NO: 238874 - RNA, 24 nt, Human
aaaacaauaaaaagccaaaacuaa

SEQ ID NO: 238875 - RNA, 23 nt, Human
aacaaaacaauaaaaagccaaaa

SEQ ID NO: 238876 - RNA, 24 nt, Human
aacaaaacaauaaaaagccaaaac

SEQ ID NO: 238877 - RNA, 24 nt, Human
aagacaguuuuaauugugagcuga

SEQ ID NO: 238878 - RNA, 22 nt, Human
acaaaacaauaaaaagccaaaa

SEQ ID NO: 238879 - RNA, 22 nt, Human
acaauaaaaagccaaaacuaaa

SEQ ID NO: 238880 - RNA, 18 nt, Human
agcacagcgaccuacagc

SEQ ID NO: 238881 - RNA, 27 nt, Human
cagcacagcgaccuacagcccaacgcu

SEQ ID NO: 238882 - RNA, 25 nt, Human
ccaacaaaacaauaaaaagccaaaa

SEQ ID NO: 238883 - RNA, 20 nt, Human
uaaaaagccaaaacuaaaaa

SEQ ID NO: 238884 - RNA, 26 nt, Human
uaaaaucaccaacaaaacuggagacc

SEQ ID NO: 238885 - RNA, 19 nt, Human
uacagcccaacgcucagcu

SEQ ID NO: 238886 - RNA, 22 nt, Human
uacagcccaacgcucagcuacc

SEQ ID NO: 238887 - RNA, 21 nt, Human
uugugagcugaaguuuuauau

SEQ ID NO: 238888 - RNA, 24 nt, Human
aaacagucuccuacauuuuuccca

SEQ ID NO: 238889 - RNA, 22 nt, Human
acagucuccuacauuuuuccca

SEQ ID NO: 238890 - RNA, 22 nt, Human
acagucuccuacauuuuuccca

SEQ ID NO: 238891 - RNA, 23 nt, Human
acauuuuucccacugccaugggg

SEQ ID NO: 238892 - RNA, 23 nt, Human
acauuuuucccacugccaugggg

SEQ ID NO: 238893 - RNA, 18 nt, Human
agcagcagcucgggagug

SEQ ID NO: 238894 - RNA, 21 nt, Human
agcggcccuggggguccccgc

SEQ ID NO: 238895 - RNA, 18 nt, Human
aucagguucaaaaucaau

SEQ ID NO: 238896 - RNA, 18 nt, Human
aucagguucaaaaucaau

SEQ ID NO: 238897 - RNA, 23 nt, Human
caaacagucuccuacauuuuucc

SEQ ID NO: 238898 - RNA, 23 nt, Human
caaacagucuccuacauuuuucc

SEQ ID NO: 238899 - RNA, 25 nt, Human
caaacagucuccuacauuuuuccca

SEQ ID NO: 238900 - RNA, 23 nt, Human
caccccaccaucacggccccaaa

SEQ ID NO: 238901 - RNA, 19 nt, Human
cagccuagccccugccccu

SEQ ID NO: 238902 - RNA, 21 nt, Human
cagccuagccccugccccuuu

SEQ ID NO: 238903 - RNA, 21 nt, Human
ccccaaagaaggucuucccuc

SEQ ID NO: 238904 - RNA, 24 nt, Human
ccccaauauucacgcacucgcacc

SEQ ID NO: 238905 - RNA, 24 nt, Human
ccccaauauucacgcacucgcacc

SEQ ID NO: 238906 - RNA, 22 nt, Human
cccguaggcgccccccgcccgg

SEQ ID NO: 238907 - RNA, 18 nt, Human
cccucgagcagcagcucg

SEQ ID NO: 238908 - RNA, 21 nt, Human
ccgaaccccacgcucguguac

SEQ ID NO: 238909 - RNA, 24 nt, Human
ccgaaccccacgcucguguaccag

SEQ ID NO: 238910 - RNA, 21 nt, Human
ccgccagggggcgcccggccc

SEQ ID NO: 238911 - RNA, 22 nt, Human
ccuacauuuuucccacugccau

SEQ ID NO: 238912 - RNA, 22 nt, Human
ccuacauuuuucccacugccau

SEQ ID NO: 238913 - RNA, 21 nt, Human
ccuagccccugccccuucagc

SEQ ID NO: 238914 - RNA, 25 nt, Human
ccucaccccaccaucacggccccaa

SEQ ID NO: 238915 - RNA, 20 nt, Human
ccugggcguccgggccccca

SEQ ID NO: 238916 - RNA, 22 nt, Human
cgccuguuccuucgucgucucc

SEQ ID NO: 238917 - RNA, 20 nt, Human
cggcccguaggcgccccccg

SEQ ID NO: 238918 - RNA, 20 nt, Human
cguccgggcccccaauauuc

SEQ ID NO: 238919 - RNA, 20 nt, Human
cguccgggcccccaauauuc

SEQ ID NO: 238920 - RNA, 22 nt, Human
cgucucggcgcccucgagcagc

SEQ ID NO: 238921 - RNA, 19 nt, Human
cguguaccagagaggcccg

SEQ ID NO: 238922 - RNA, 20 nt, Human
cucaccccaccaucacggcc

SEQ ID NO: 238923 - RNA, 20 nt, Human
cugcgucccgcucgucagaa

SEQ ID NO: 238924 - RNA, 19 nt, Human
cuggagucaccgucucggc

SEQ ID NO: 238925 - RNA, 23 nt, Human
gcccguaggcgccccccgcccgg

SEQ ID NO: 238926 - RNA, 22 nt, Human
gggguccugggcguccgggccc

SEQ ID NO: 238927 - RNA, 22 nt, Human
gggguccugggcguccgggccc

SEQ ID NO: 238928 - RNA, 20 nt, Human
uaccagagaggcccguaccc

SEQ ID NO: 238929 - RNA, 23 nt, Human
ucaccccaccaucacggccccaa

SEQ ID NO: 238930 - RNA, 19 nt, Human
ucccagccuagccccugcc

SEQ ID NO: 238931 - RNA, 18 nt, Human
uccugggcguccgggccc

SEQ ID NO: 238932 - RNA, 18 nt, Human
uccugggcguccgggccc

SEQ ID NO: 238933 - RNA, 21 nt, Human
uccugggcguccgggccccca

SEQ ID NO: 238934 - RNA, 21 nt, Human
ucggcagcacugaagcuuucc

SEQ ID NO: 238935 - RNA, 21 nt, Human
ucggcagcacugaagcuuucc

SEQ ID NO: 238936 - RNA, 20 nt, Human
ucggcgcccucgagcagcag

SEQ ID NO: 238937 - RNA, 20 nt, Human
ucguguaccagagaggcccg

SEQ ID NO: 238938 - RNA, 22 nt, Human
ucucccagccuagccccugccc

SEQ ID NO: 238939 - RNA, 33 nt, Human
ugacugauguugacguacacccucucgcccccc

SEQ ID NO: 238940 - RNA, 21 nt, Human
ugcaccaggccgccgaacccc

SEQ ID NO: 238941 - RNA, 23 nt, Human
ugggguccugggcguccgggccc

SEQ ID NO: 238942 - RNA, 23 nt, Human
ugggguccugggcguccgggccc

SEQ ID NO: 238943 - RNA, 19 nt, Human
uuuccaaacagucuccuac

SEQ ID NO: 238944 - RNA, 19 nt, Human
uuuccaaacagucuccuac

SEQ ID NO: 238945 - RNA, 22 nt, Human
aaaaaaaaaagaaacuaaaaag

SEQ ID NO: 238946 - RNA, 21 nt, Human
aaaaaagaaacuaaaaagucc

SEQ ID NO: 238947 - RNA, 20 nt, Human
aaaaagaaacuaaaaagucc

SEQ ID NO: 238948 - RNA, 21 nt, Human
aaaaagaaacuaaaaaguccc

SEQ ID NO: 238949 - RNA, 18 nt, Human
aaaagccagagcagagau

SEQ ID NO: 238950 - RNA, 24 nt, Human
aaacuaaaaaguccuuccuucaau

SEQ ID NO: 238951 - RNA, 19 nt, Human
aacauggugaaaccccguc

SEQ ID NO: 238952 - RNA, 20 nt, Human
aacauggugaaaccccgucu

SEQ ID NO: 238953 - RNA, 21 nt, Human
aacauggugaaaccccgucuc

SEQ ID NO: 238954 - RNA, 21 nt, Human
aagaacugaagucagaguuca

SEQ ID NO: 238955 - RNA, 26 nt, Human
aagagaccaggaaggagcagugggca

SEQ ID NO: 238956 - RNA, 23 nt, Human
aagcaccuaccuugugcuugccc

SEQ ID NO: 238957 - RNA, 23 nt, Human
aagcugccugugggagccaggcu

SEQ ID NO: 238958 - RNA, 20 nt, Human
aaguggaggcugcagugagc

SEQ ID NO: 238959 - RNA, 24 nt, Human
aaguggaggcugcagugagcugag

SEQ ID NO: 238960 - RNA, 19 nt, Human
acagagcagaggacaggga

SEQ ID NO: 238961 - RNA, 24 nt, Human
acagagcgagacuccauuucaaaa

SEQ ID NO: 238962 - RNA, 18 nt, Human
accagcaaugcagaaaug

SEQ ID NO: 238963 - RNA, 21 nt, Human
acccagaaggcaggaggacuc

SEQ ID NO: 238964 - RNA, 24 nt, Human
acccccuuuccuccccuuacuuaa

SEQ ID NO: 238965 - RNA, 24 nt, Human
accccgucucuacuaaaaauacaa

SEQ ID NO: 238966 - RNA, 25 nt, Human
acccguuuccuggacagaggaaugu

SEQ ID NO: 238967 - RNA, 24 nt, Human
acugcacuccagccugaaugacag

SEQ ID NO: 238968 - RNA, 26 nt, Human
acugcacuccagccugaaugacagag

SEQ ID NO: 238969 - RNA, 23 nt, Human
agaaggagguaugguagccagag

SEQ ID NO: 238970 - RNA, 22 nt, Human
agagcccccacuuguucugcuu

SEQ ID NO: 238971 - RNA, 22 nt, Human
agaggaaagaggggugugggga

SEQ ID NO: 238972 - RNA, 23 nt, Human
agaucacuugauguuagcaguuu

SEQ ID NO: 238973 - RNA, 18 nt, Human
agcaagaacugaagucag

SEQ ID NO: 238974 - RNA, 22 nt, Human
agcacuuugggaggcugagggg

SEQ ID NO: 238975 - RNA, 22 nt, Human
agccuggccaacauggugaaac

SEQ ID NO: 238976 - RNA, 24 nt, Human
agccuggccaacauggugaaaccc

SEQ ID NO: 238977 - RNA, 23 nt, Human
agcuggguguaguggcaugugcc

SEQ ID NO: 238978 - RNA, 22 nt, Human
aggaaagagggguguggggagu

SEQ ID NO: 238979 - RNA, 20 nt, Human
aggaaugucuccuuuccuug

SEQ ID NO: 238980 - RNA, 18 nt, Human
aggcaggagaaucaugug

SEQ ID NO: 238981 - RNA, 24 nt, Human
aggcaggagaaucaugugaaccca

SEQ ID NO: 238982 - RNA, 20 nt, Human
aggcugaggcaggagaauca

SEQ ID NO: 238983 - RNA, 22 nt, Human
aggcugaggcaggagaaucaug

SEQ ID NO: 238984 - RNA, 21 nt, Human
aggcugaggggagcagaucac

SEQ ID NO: 238985 - RNA, 22 nt, Human
agggguguggggagugagaagg

SEQ ID NO: 238986 - RNA, 20 nt, Human
aucaguaaaugccgaagggg

SEQ ID NO: 238987 - RNA, 24 nt, Human
aucgcaccacugcacuccagccug

SEQ ID NO: 238988 - RNA, 22 nt, Human
augaggagcaggagugagggag

SEQ ID NO: 238989 - RNA, 21 nt, Human
caaaggccuggccccaggucu

SEQ ID NO: 238990 - RNA, 24 nt, Human
caacauggugaaaccccgucucua

SEQ ID NO: 238991 - RNA, 19 nt, Human
caagcaccuaccuugugcu

SEQ ID NO: 238992 - RNA, 27 nt, Human
caccacugcacuccagccugaaugaca

SEQ ID NO: 238993 - RNA, 19 nt, Human
cacccccuuuccuccccuu

SEQ ID NO: 238994 - RNA, 22 nt, Human
cacccccuuuccuccccuuacu

SEQ ID NO: 238995 - RNA, 21 nt, Human
cacuccacucccgccucccac

SEQ ID NO: 238996 - RNA, 24 nt, Human
cacuccagccugaaugacagagcg

SEQ ID NO: 238997 - RNA, 19 nt, Human
cacugcacuccagccugaa

SEQ ID NO: 238998 - RNA, 19 nt, Human
cacugcacuccagccugaa

SEQ ID NO: 238999 - RNA, 25 nt, Human
cacugcacuccagccugaaugacag

SEQ ID NO: 239000 - RNA, 21 nt, Human
cacuuuagacacacaaaguug

SEQ ID NO: 239001 - RNA, 19 nt, Human
cagaaugccaauuacuucc

SEQ ID NO: 239002 - RNA, 21 nt, Human
cagaaugccaauuacuucccc

SEQ ID NO: 239003 - RNA, 22 nt, Human
cagcacuuugggaggcugaggg

SEQ ID NO: 239004 - RNA, 24 nt, Human
cagcuacuugggaggcugaggcag

SEQ ID NO: 239005 - RNA, 22 nt, Human
caggcugagcaugaggagcagg

SEQ ID NO: 239006 - RNA, 24 nt, Human
cauaccgguaaucccagcacuuug

SEQ ID NO: 239007 - RNA, 24 nt, Human
ccaagcaccuaccuugugcuugcc

SEQ ID NO: 239008 - RNA, 23 nt, Human
ccaauuacuuccccuuuccccaa

SEQ ID NO: 239009 - RNA, 19 nt, Human
ccacuccacucccgccucc

SEQ ID NO: 239010 - RNA, 18 nt, Human
ccacugcacuccagccug

SEQ ID NO: 239011 - RNA, 21 nt, Human
ccacugcacuccagccugaau

SEQ ID NO: 239012 - RNA, 24 nt, Human
ccacugcacuccagccugaaugac

SEQ ID NO: 239013 - RNA, 25 nt, Human
ccacugcacuccagccugaaugaca

SEQ ID NO: 239014 - RNA, 22 nt, Human
ccaggaaguggaggcugcagug

SEQ ID NO: 239015 - RNA, 21 nt, Human
ccaucucucccucuucuucca

SEQ ID NO: 239016 - RNA, 21 nt, Human
cccacccugccaagaggggaa

SEQ ID NO: 239017 - RNA, 21 nt, Human
cccacgcucccacgcccucca

SEQ ID NO: 239018 - RNA, 20 nt, Human
ccccuacccacucccuucac

SEQ ID NO: 239019 - RNA, 22 nt, Human
ccccugcuccuccuccagguac

SEQ ID NO: 239020 - RNA, 21 nt, Human
ccccuuacccguuuccuggac

SEQ ID NO: 239021 - RNA, 22 nt, Human
ccgcagcaagaacugaagucag

SEQ ID NO: 239022 - RNA, 24 nt, Human
ccuacccacucccuucacuaggag

SEQ ID NO: 239023 - RNA, 25 nt, Human
ccucacuuugcuccaucucucccuc

SEQ ID NO: 239024 - RNA, 22 nt, Human
ccuccagguacugaacuggcuc

SEQ ID NO: 239025 - RNA, 22 nt, Human
ccugaaugacagagcgagacuc

SEQ ID NO: 239026 - RNA, 23 nt, Human
ccuggccaacauggugaaacccc

SEQ ID NO: 239027 - RNA, 24 nt, Human
ccuggccaacauggugaaaccccg

SEQ ID NO: 239028 - RNA, 21 nt, Human
ccuguagucucagcuacuugg

SEQ ID NO: 239029 - RNA, 22 nt, Human
cgaagggggcagcacucugucc

SEQ ID NO: 239030 - RNA, 23 nt, Human
cgagacuccauuucaaaaaaaaa

SEQ ID NO: 239031 - RNA, 21 nt, Human
cgcaccacugcacuccagccu

SEQ ID NO: 239032 - RNA, 18 nt, Human
cgcccuccacgccccugc

SEQ ID NO: 239033 - RNA, 23 nt, Human
cuccauuucaaaaaaaaaaaaaa

SEQ ID NO: 239034 - RNA, 23 nt, Human
cucccacgcccuccacgcccucc

SEQ ID NO: 239035 - RNA, 22 nt, Human
cucccacgcucccacgcccucc

SEQ ID NO: 239036 - RNA, 20 nt, Human
cuccugcaaaagcuaaaaac

SEQ ID NO: 239037 - RNA, 21 nt, Human
cugaggggagcagaucacuug

SEQ ID NO: 239038 - RNA, 20 nt, Human
cugcagugagcugagaucgc

SEQ ID NO: 239039 - RNA, 22 nt, Human
cugcagugagcugagaucgcac

SEQ ID NO: 239040 - RNA, 18 nt, Human
cugccaggaggaaagugc

SEQ ID NO: 239041 - RNA, 20 nt, Human
cuggaucugucccacugcca

SEQ ID NO: 239042 - RNA, 21 nt, Human
cuguuuuccagggcaacccag

SEQ ID NO: 239043 - RNA, 27 nt, Human
gaaaccccuacccacucccuucacuag

SEQ ID NO: 239044 - RNA, 18 nt, Human
gaaguggaggcugcagug

SEQ ID NO: 239045 - RNA, 23 nt, Human
gagaaucaugugaacccaggaag

SEQ ID NO: 239046 - RNA, 23 nt, Human
gagaucgcaccacugcacuccag

SEQ ID NO: 239047 - RNA, 20 nt, Human
gagcugugacuagguccugg

SEQ ID NO: 239048 - RNA, 23 nt, Human
gaggcugcagugagcugagaucg

SEQ ID NO: 239049 - RNA, 24 nt, Human
gaucacuugauguuagcaguuuga

SEQ ID NO: 239050 - RNA, 22 nt, Human
gaugagaagagaccaggaagga

SEQ ID NO: 239051 - RNA, 20 nt, Human
gcaccacugcacuccagccu

SEQ ID NO: 239052 - RNA, 24 nt, Human
gcacuccagccugaaugacagagc

SEQ ID NO: 239053 - RNA, 22 nt, Human
gcaggagaaucaugugaaccca

SEQ ID NO: 239054 - RNA, 24 nt, Human
gccaacauggugaaaccccgucuc

SEQ ID NO: 239055 - RNA, 18 nt, Human
gcccaugugguuacccug

SEQ ID NO: 239056 - RNA, 18 nt, Human
gccugugggagccaggcu

SEQ ID NO: 239057 - RNA, 20 nt, Human
gcugagaucgcaccacugca

SEQ ID NO: 239058 - RNA, 21 nt, Human
ggaaagaugcaaaguauaaug

SEQ ID NO: 239059 - RNA, 23 nt, Human
ggaagcugaugccaaucccaggg

SEQ ID NO: 239060 - RNA, 19 nt, Human
ggagccaggcuggagcacg

SEQ ID NO: 239061 - RNA, 18 nt, Human
ggaggcugcagugagcug

SEQ ID NO: 239062 - RNA, 20 nt, Human
ggaggcugcagugagcugag

SEQ ID NO: 239063 - RNA, 24 nt, Human
ggaggcugcagugagcugagaucg

SEQ ID NO: 239064 - RNA, 21 nt, Human
ggguguggggagugagaaggc

SEQ ID NO: 239065 - RNA, 22 nt, Human
gguaucauauaggagaaggagg

SEQ ID NO: 239066 - RNA, 24 nt, Human
ggugggaagagggccaucuuccag

SEQ ID NO: 239067 - RNA, 24 nt, Human
ggugguucauaccgguaaucccag

SEQ ID NO: 239068 - RNA, 25 nt, Human
gguuggagcugugacuagguccugg

SEQ ID NO: 239069 - RNA, 18 nt, Human
gugagggagcaggaacag

SEQ ID NO: 239070 - RNA, 20 nt, Human
gugcgccuccuuccaccagg

SEQ ID NO: 239071 - RNA, 20 nt, Human
guggaggcugcagugagcug

SEQ ID NO: 239072 - RNA, 23 nt, Human
guggggccagaugagaagagacc

SEQ ID NO: 239073 - RNA, 23 nt, Human
gugguucauaccgguaaucccag

SEQ ID NO: 239074 - RNA, 22 nt, Human
uaccacagagcagaggacaggg

SEQ ID NO: 239075 - RNA, 23 nt, Human
uaccgguaaucccagcacuuugg

SEQ ID NO: 239076 - RNA, 24 nt, Human
uaccgguaaucccagcacuuuggg

SEQ ID NO: 239077 - RNA, 19 nt, Human
uagaagccaaaauccaaau

SEQ ID NO: 239078 - RNA, 22 nt, Human
uagcuggguguaguggcaugug

SEQ ID NO: 239079 - RNA, 20 nt, Human
uaggagaaggagguauggua

SEQ ID NO: 239080 - RNA, 19 nt, Human
uaggucaaccaauucucca

SEQ ID NO: 239081 - RNA, 24 nt, Human
uaguggcaugugccuguagucuca

SEQ ID NO: 239082 - RNA, 23 nt, Human
ucauaccgguaaucccagcacuu

SEQ ID NO: 239083 - RNA, 23 nt, Human
uccacuccacucccgccucccac

SEQ ID NO: 239084 - RNA, 24 nt, Human
uccagccugaaugacagagcgaga

SEQ ID NO: 239085 - RNA, 18 nt, Human
uccagggcaacccagaag

SEQ ID NO: 239086 - RNA, 25 nt, Human
uccauuucaaaaaaaaaaaaaagaa

SEQ ID NO: 239087 - RNA, 21 nt, Human
uccuuggcuucaguucaagcu

SEQ ID NO: 239088 - RNA, 21 nt, Human
uccuugguaucacacagaaug

SEQ ID NO: 239089 - RNA, 23 nt, Human
ucgcaccacugcacuccagccug

SEQ ID NO: 239090 - RNA, 20 nt, Human
ucucccucuucuuccacucc

SEQ ID NO: 239091 - RNA, 19 nt, Human
ucuccugcaaaagcuaaaa

SEQ ID NO: 239092 - RNA, 20 nt, Human
ucucuacuaaaaauacaaaa

SEQ ID NO: 239093 - RNA, 21 nt, Human
ucugcuuggagaaaagccaga

SEQ ID NO: 239094 - RNA, 25 nt, Human
ucuuccagcacccccuuuccucccc

SEQ ID NO: 239095 - RNA, 20 nt, Human
ugaaaccccuacccacuccc

SEQ ID NO: 239096 - RNA, 22 nt, Human
ugaccaugggccuuccugcuuc

SEQ ID NO: 239097 - RNA, 20 nt, Human
ugaccgcacgggaugugaga

SEQ ID NO: 239098 - RNA, 20 nt, Human
ugagaaggcuggguguggcc

SEQ ID NO: 239099 - RNA, 23 nt, Human
ugagaccagccuggccaacaugg

SEQ ID NO: 239100 - RNA, 24 nt, Human
ugagaccagccuggccaacauggu

SEQ ID NO: 239101 - RNA, 19 nt, Human
ugagagaggaaagaggggu

SEQ ID NO: 239102 - RNA, 22 nt, Human
ugagcugagaucgcaccacugc

SEQ ID NO: 239103 - RNA, 18 nt, Human
ugaggcaggagaaucaug

SEQ ID NO: 239104 - RNA, 22 nt, Human
ugaggcaggagaaucaugugaa

SEQ ID NO: 239105 - RNA, 24 nt, Human
ugaggcaggagaaucaugugaacc

SEQ ID NO: 239106 - RNA, 25 nt, Human
ugaggcaggagaaucaugugaaccc

SEQ ID NO: 239107 - RNA, 23 nt, Human
ugaggguggggcugaaaccccua

SEQ ID NO: 239108 - RNA, 22 nt, Human
ugccaggaggaaagugcgccuc

SEQ ID NO: 239109 - RNA, 23 nt, Human
ugccuguagucucagcuacuugg

SEQ ID NO: 239110 - RNA, 24 nt, Human
ugccuguagucucagcuacuuggg

SEQ ID NO: 239111 - RNA, 18 nt, Human
ugccugugggagccaggc

SEQ ID NO: 239112 - RNA, 18 nt, Human
ugccugugggagccaggc

SEQ ID NO: 239113 - RNA, 19 nt, Human
ugcgccuccuuccaccagg

SEQ ID NO: 239114 - RNA, 26 nt, Human
ugcuccaucucucccucuucuuccaa

SEQ ID NO: 239115 - RNA, 19 nt, Human
ugcuccuccuccagguacu

SEQ ID NO: 239116 - RNA, 23 nt, Human
ugcuuggagaaaagccagagcag

SEQ ID NO: 239117 - RNA, 22 nt, Human
uggaagcugaugccaaucccag

SEQ ID NO: 239118 - RNA, 18 nt, Human
uggaggcugcagugagcu

SEQ ID NO: 239119 - RNA, 24 nt, Human
uggcaugugccuguagucucagcu

SEQ ID NO: 239120 - RNA, 24 nt, Human
uggccaacauggugaaaccccguc

SEQ ID NO: 239121 - RNA, 19 nt, Human
uggcucagagcuagcauuc

SEQ ID NO: 239122 - RNA, 25 nt, Human
uggcucagagcuagcauucugccag

SEQ ID NO: 239123 - RNA, 19 nt, Human
ugggaggcugaggcaggag

SEQ ID NO: 239124 - RNA, 24 nt, Human
ugggaggcugaggcaggagaauca

SEQ ID NO: 239125 - RNA, 24 nt, Human
ugggaggcugaggggagcagauca

SEQ ID NO: 239126 - RNA, 19 nt, Human
ugggcagaaaccgcagcaa

SEQ ID NO: 239127 - RNA, 23 nt, Human
uggggcugaaaccccuacccacu

SEQ ID NO: 239128 - RNA, 18 nt, Human
uggguguaguggcaugug

SEQ ID NO: 239129 - RNA, 24 nt, Human
uggugguucauaccgguaauccca

SEQ ID NO: 239130 - RNA, 20 nt, Human
ugguuaaagcugccuguggg

SEQ ID NO: 239131 - RNA, 22 nt, Human
ugguucauaccgguaaucccag

SEQ ID NO: 239132 - RNA, 24 nt, Human
ugguucauaccgguaaucccagca

SEQ ID NO: 239133 - RNA, 23 nt, Human
ugugggagccaggcuggagcacg

SEQ ID NO: 239134 - RNA, 22 nt, Human
uguggggagugagaaggcuggg

SEQ ID NO: 239135 - RNA, 19 nt, Human
uguuagcaguuugagacca

SEQ ID NO: 239136 - RNA, 19 nt, Human
uuagcuggguguaguggca

SEQ ID NO: 239137 - RNA, 24 nt, Human
uuagcuggguguaguggcaugugc

SEQ ID NO: 239138 - RNA, 19 nt, Human
uuccugaggguggggcuga

SEQ ID NO: 239139 - RNA, 22 nt, Human
uucugcuuggagaaaagccaga

SEQ ID NO: 239140 - RNA, 25 nt, Human
uugggaggcugaggcaggagaauca

SEQ ID NO: 239141 - RNA, 25 nt, Human
uugggaggcugaggggagcagauca

SEQ ID NO: 239142 - RNA, 24 nt, Human
uuuguuucgcuuuguuuuaagauu

SEQ ID NO: 239143 - RNA, 19 nt, Human
aaaaaaaacaaaacaacau

SEQ ID NO: 239144 - RNA, 27 nt, Human
aaaaacaguagccaaggaacugcacaa

SEQ ID NO: 239145 - RNA, 23 nt, Human
aaaaagaaaagaaaggagcaaga

SEQ ID NO: 239146 - RNA, 20 nt, Human
aacagaaaaaaagaaaagaa

SEQ ID NO: 239147 - RNA, 22 nt, Human
aaggagcaagaggggaaaagag

SEQ ID NO: 239148 - RNA, 23 nt, Human
aaggagcaagaggggaaaagaga

SEQ ID NO: 239149 - RNA, 25 nt, Human
aagguuuaaaaaaacagaaaaaaag

SEQ ID NO: 239150 - RNA, 20 nt, Human
aauuaacaccugcuagcagc

SEQ ID NO: 239151 - RNA, 26 nt, Human
acaaaacaacauaauaauacaaccuu

SEQ ID NO: 239152 - RNA, 18 nt, Human
agaaaagaaaggagcaag

SEQ ID NO: 239153 - RNA, 19 nt, Human
agcaagaggggaaaagaga

SEQ ID NO: 239154 - RNA, 23 nt, Human
agguuuaaaaaaacagaaaaaaa

SEQ ID NO: 239155 - RNA, 22 nt, Human
auuugaauuucaaaaaugcucc

SEQ ID NO: 239156 - RNA, 24 nt, Human
caagaggggaaaagagagagccca

SEQ ID NO: 239157 - RNA, 24 nt, Human
caagcaauaguaaaaaaaacaaaa

SEQ ID NO: 239158 - RNA, 23 nt, Human
caauacuaacguaagcuuauaaa

SEQ ID NO: 239159 - RNA, 27 nt, Human
caguagccaaggaacugcacaaccaaa

SEQ ID NO: 239160 - RNA, 30 nt, Human
ccuguguaacaauacuuauaauacagcuuu

SEQ ID NO: 239161 - RNA, 19 nt, Human
cucucauugucuucagagg

SEQ ID NO: 239162 - RNA, 18 nt, Human
gaaaaacaguagccaagg

SEQ ID NO: 239163 - RNA, 24 nt, Human
gaacugcacaaccaaaaaaugaaa

SEQ ID NO: 239164 - RNA, 18 nt, Human
gagcaagaggggaaaaga

SEQ ID NO: 239165 - RNA, 23 nt, Human
gcaauaguaaaaaaaacaaaaca

SEQ ID NO: 239166 - RNA, 19 nt, Human
uaaaaaaaacaaaacaaca

SEQ ID NO: 239167 - RNA, 22 nt, Human
uaaaaaaacagaaaaaaagaaa

SEQ ID NO: 239168 - RNA, 23 nt, Human
uaaaaaaacagaaaaaaagaaaa

SEQ ID NO: 239169 - RNA, 21 nt, Human
uaaaauaacagcacuguuccc

SEQ ID NO: 239170 - RNA, 25 nt, Human
uaaaugccaaauuuaaucaagcaau

SEQ ID NO: 239171 - RNA, 18 nt, Human
uaauacagcuuaacaaua

SEQ ID NO: 239172 - RNA, 20 nt, Human
uaggugcaaugucucaagua

SEQ ID NO: 239173 - RNA, 23 nt, Human
ucuccaaauguguauacaaaguu

SEQ ID NO: 239174 - RNA, 23 nt, Human
ugaaggaaagggauccaauuaac

SEQ ID NO: 239175 - RNA, 22 nt, Human
uggaacaaaaucacugccugcu

SEQ ID NO: 239176 - RNA, 24 nt, Human
uggaagguuuaaaaaaacagaaaa

SEQ ID NO: 239177 - RNA, 24 nt, Human
uguguauacaaaguuuuggaacaa

SEQ ID NO: 239178 - RNA, 23 nt, Human
uuaaaaaaacagaaaaaaagaaa

SEQ ID NO: 239179 - RNA, 23 nt, Human
uuaaaaaacugaaguaaaagaaa

SEQ ID NO: 239180 - RNA, 20 nt, Human
uuuuggaacaaaaucacugc

SEQ ID NO: 239181 - RNA, 20 nt, Human
aaaccucuggccugauguca

SEQ ID NO: 239182 - RNA, 19 nt, Human
aagcaagggcauggaggca

SEQ ID NO: 239183 - RNA, 21 nt, Human
aggaaaggugguggacagggc

SEQ ID NO: 239184 - RNA, 22 nt, Human
auccacaccaggcccccuccuc

SEQ ID NO: 239185 - RNA, 22 nt, Human
aucguuuucugaagggaaaggg

SEQ ID NO: 239186 - RNA, 24 nt, Human
caaaaucagggcccagaacagauu

SEQ ID NO: 239187 - RNA, 22 nt, Human
cacauuucuuuauuccaccaug

SEQ ID NO: 239188 - RNA, 19 nt, Human
cagaacagauuggcugagu

SEQ ID NO: 239189 - RNA, 19 nt, Human
cagcugggcucgcacggcu

SEQ ID NO: 239190 - RNA, 20 nt, Human
cagugugaggccauggggcc

SEQ ID NO: 239191 - RNA, 18 nt, Human
cauagcaaggccaggaaa

SEQ ID NO: 239192 - RNA, 24 nt, Human
caucauguccucuugcugcuuucu

SEQ ID NO: 239193 - RNA, 21 nt, Human
cauccucaaggccccugccug

SEQ ID NO: 239194 - RNA, 22 nt, Human
cauccucaaggccccugccugu

SEQ ID NO: 239195 - RNA, 21 nt, Human
ccagcuucucugagucuaggg

SEQ ID NO: 239196 - RNA, 18 nt, Human
ccccaaauccuuucuugc

SEQ ID NO: 239197 - RNA, 23 nt, Human
ccccgagccucgaguccgcgcuc

SEQ ID NO: 239198 - RNA, 23 nt, Human
cccggccccgcccggcggccagc

SEQ ID NO: 239199 - RNA, 18 nt, Human
cggccagcuucucugagu

SEQ ID NO: 239200 - RNA, 19 nt, Human
cggccgacugggggcccgg

SEQ ID NO: 239201 - RNA, 24 nt, Human
cuagggcagauguagccucugucc

SEQ ID NO: 239202 - RNA, 20 nt, Human
cucgcacggcugcugcaccu

SEQ ID NO: 239203 - RNA, 18 nt, Human
cuuggcuccccuuucuca

SEQ ID NO: 239204 - RNA, 18 nt, Human
gaaagcaggcaaggcuga

SEQ ID NO: 239205 - RNA, 21 nt, Human
gaacaagaccacacuggaaaa

SEQ ID NO: 239206 - RNA, 23 nt, Human
gaggggaaaaacaacauuggaaa

SEQ ID NO: 239207 - RNA, 23 nt, Human
gcggaacgagggcugcgcgcccc

SEQ ID NO: 239208 - RNA, 18 nt, Human
gcuaauaucagccuugcu

SEQ ID NO: 239209 - RNA, 21 nt, Human
gcucagcccccucauuaccgg

SEQ ID NO: 239210 - RNA, 19 nt, Human
gcucucggcggaacgaggg

SEQ ID NO: 239211 - RNA, 20 nt, Human
gcuuuguggucggcacgcug

SEQ ID NO: 239212 - RNA, 21 nt, Human
ggagaguggugcgcgcgggca

SEQ ID NO: 239213 - RNA, 21 nt, Human
ggcaaaaucagggcccagaac

SEQ ID NO: 239214 - RNA, 19 nt, Human
gggaggguggaugagggcc

SEQ ID NO: 239215 - RNA, 19 nt, Human
gggcauggaggcaaugacc

SEQ ID NO: 239216 - RNA, 20 nt, Human
gggggcucuggagucagucc

SEQ ID NO: 239217 - RNA, 20 nt, Human
gggugcuguaucccauggca

SEQ ID NO: 239218 - RNA, 23 nt, Human
ggugguggacagggccucaugcg

SEQ ID NO: 239219 - RNA, 18 nt, Human
uaaagcgauugguggugc

SEQ ID NO: 239220 - RNA, 22 nt, Human
uaagcugggagagaugaaagca

SEQ ID NO: 239221 - RNA, 21 nt, Human
ucacugggcggauucagcuac

SEQ ID NO: 239222 - RNA, 22 nt, Human
ucagccuugcuucucugaguga

SEQ ID NO: 239223 - RNA, 22 nt, Human
ucccauggcagcccuugcugcu

SEQ ID NO: 239224 - RNA, 19 nt, Human
uccccaaauccuuucuugc

SEQ ID NO: 239225 - RNA, 24 nt, Human
uccccaaauccuuucuugcuccac

SEQ ID NO: 239226 - RNA, 23 nt, Human
uccccuuucucaucaacuccacg

SEQ ID NO: 239227 - RNA, 24 nt, Human
ucccuagggcagauguagccucug

SEQ ID NO: 239228 - RNA, 25 nt, Human
ucuagggggcccugaagcggcccca

SEQ ID NO: 239229 - RNA, 19 nt, Human
ucucugcuuguaaacucag

SEQ ID NO: 239230 - RNA, 23 nt, Human
ucugcagugugaggccauggggc

SEQ ID NO: 239231 - RNA, 21 nt, Human
ugaacaagaccacacuggaaa

SEQ ID NO: 239232 - RNA, 20 nt, Human
ugaauauuuucuuuagacgu

SEQ ID NO: 239233 - RNA, 19 nt, Human
ugacuggaggccauuucca

SEQ ID NO: 239234 - RNA, 22 nt, Human
ugacuggaggccauuuccaggu

SEQ ID NO: 239235 - RNA, 19 nt, Human
ugcuugagccaagcaaggg

SEQ ID NO: 239236 - RNA, 21 nt, Human
ugcuugagccaagcaagggca

SEQ ID NO: 239237 - RNA, 21 nt, Human
uggaaaggggugucugcagug

SEQ ID NO: 239238 - RNA, 21 nt, Human
uggacagggccucaugcggug

SEQ ID NO: 239239 - RNA, 20 nt, Human
uggcagcccuugcugcuggu

SEQ ID NO: 239240 - RNA, 23 nt, Human
uggcagcccuugcugcuggugcc

SEQ ID NO: 239241 - RNA, 19 nt, Human
ugggcucgcacggcugcug

SEQ ID NO: 239242 - RNA, 22 nt, Human
ugggugcuguaucccauggcag

SEQ ID NO: 239243 - RNA, 19 nt, Human
ugucacggugucuucccag

SEQ ID NO: 239244 - RNA, 25 nt, Human
ugucacggugucuucccagcuagga

SEQ ID NO: 239245 - RNA, 22 nt, Human
uguggucggcacgcuggacgcc

SEQ ID NO: 239246 - RNA, 23 nt, Human
uucacaaaaggagaucccagaag

SEQ ID NO: 239247 - RNA, 19 nt, Human
uuggaaaccucccccggcu

SEQ ID NO: 239248 - RNA, 19 nt, Human
uuggguuggagugagucuc

SEQ ID NO: 239249 - RNA, 19 nt, Human
uugguggugcuugagccaa

SEQ ID NO: 239250 - RNA, 22 nt, Human
uuuuuuuuuuuuuuggaccaga

SEQ ID NO: 239251 - RNA, 28 nt, Human
uuuuuuuuuuuuuuuuuuuuuuuggggg

SEQ ID NO: 239252 - RNA, 19 nt, Human
aggccgagcucgcggaaau

SEQ ID NO: 239253 - RNA, 21 nt, Human
caaccgcccgcuaaccgggga

SEQ ID NO: 239254 - RNA, 24 nt, Human
caaggguaaagaggcacgaucuga

SEQ ID NO: 239255 - RNA, 20 nt, Human
caccgaggucugggccgagg

SEQ ID NO: 239256 - RNA, 22 nt, Human
cccgcuaaccggggaggggggc

SEQ ID NO: 239257 - RNA, 19 nt, Human
ccucugggaggaaggcagg

SEQ ID NO: 239258 - RNA, 21 nt, Human
cgcccgccggagaccuuacaa

SEQ ID NO: 239259 - RNA, 23 nt, Human
cgccggagaccuuacaaccgccc

SEQ ID NO: 239260 - RNA, 23 nt, Human
cggggaggggggccgguaggggc

SEQ ID NO: 239261 - RNA, 28 nt, Human
cucgcggaaaucccucagugaucacccc

SEQ ID NO: 239262 - RNA, 18 nt, Human
cugcgggcccugaagguc

SEQ ID NO: 239263 - RNA, 21 nt, Human
gcagcgcccgccggagaccuu

SEQ ID NO: 239264 - RNA, 20 nt, Human
gccucgggucucaaggcgcc

SEQ ID NO: 239265 - RNA, 18 nt, Human
uuuuuuuuuuuuuuuucg

SEQ ID NO: 239266 - RNA, 27 nt, Human
aaagugcccuugugccccccuucuucu

SEQ ID NO: 239267 - RNA, 20 nt, Human
accccaaagggucucugaag

SEQ ID NO: 239268 - RNA, 24 nt, Human
agcaacgugggggccugggaggaa

SEQ ID NO: 239269 - RNA, 19 nt, Human
agcccagagccugggacgg

SEQ ID NO: 239270 - RNA, 29 nt, Human
aggcaggaggcccgacguccugggcagcc

SEQ ID NO: 239271 - RNA, 21 nt, Human
aggcccgacguccugggcagc

SEQ ID NO: 239272 - RNA, 19 nt, Human
agggggugggugggucugc

SEQ ID NO: 239273 - RNA, 20 nt, Human
aguccuguggagggcaccgu

SEQ ID NO: 239274 - RNA, 26 nt, Human
agugcccaccugcucucagagguguc

SEQ ID NO: 239275 - RNA, 21 nt, Human
aucaugugcccuguccgugcc

SEQ ID NO: 239276 - RNA, 20 nt, Human
cagcaguugguaucaugugc

SEQ ID NO: 239277 - RNA, 19 nt, Human
caggcggccagcaacgugg

SEQ ID NO: 239278 - RNA, 21 nt, Human
ccagggccgggagcggccagg

SEQ ID NO: 239279 - RNA, 25 nt, Human
ccauaccuaggaauccuacccaacc

SEQ ID NO: 239280 - RNA, 22 nt, Human
ccauuuuccuccccuuccaaaa

SEQ ID NO: 239281 - RNA, 26 nt, Human
ccccauaccuaggaauccuacccaac

SEQ ID NO: 239282 - RNA, 18 nt, Human
ccccgggcccuacucagg

SEQ ID NO: 239283 - RNA, 21 nt, Human
ccccgggcccuacucaggccc

SEQ ID NO: 239284 - RNA, 22 nt, Human
ccccgggcccuacucaggcccc

SEQ ID NO: 239285 - RNA, 21 nt, Human
cccgagcccagagccugggac

SEQ ID NO: 239286 - RNA, 19 nt, Human
cccuucuucugccuuuucu

SEQ ID NO: 239287 - RNA, 22 nt, Human
ccguacccagccagugcccacc

SEQ ID NO: 239288 - RNA, 19 nt, Human
ccucaagggagaaagugcc

SEQ ID NO: 239289 - RNA, 18 nt, Human
cguccucccuauaauuuc

SEQ ID NO: 239290 - RNA, 18 nt, Human
cucaagggagaaagugcc

SEQ ID NO: 239291 - RNA, 26 nt, Human
cugggcagcgguggcggcggcugccc

SEQ ID NO: 239292 - RNA, 23 nt, Human
cuugccauuuuccuccccuucca

SEQ ID NO: 239293 - RNA, 25 nt, Human
cuugccauuuuccuccccuuccaaa

SEQ ID NO: 239294 - RNA, 19 nt, Human
gaaagugcccuugugcccc

SEQ ID NO: 239295 - RNA, 24 nt, Human
gagcggcacgaguuuaggucccau

SEQ ID NO: 239296 - RNA, 23 nt, Human
gagcggccaggccgggccuccag

SEQ ID NO: 239297 - RNA, 22 nt, Human
gaggggcccgugacguccuugc

SEQ ID NO: 239298 - RNA, 26 nt, Human
gcagccucaagggagaagggaacgcc

SEQ ID NO: 239299 - RNA, 19 nt, Human
ggcaguagggagaguccug

SEQ ID NO: 239300 - RNA, 21 nt, Human
gggcagggcagccucaaggga

SEQ ID NO: 239301 - RNA, 28 nt, Human
gggccgggagcggccaggccgggccucc

SEQ ID NO: 239302 - RNA, 19 nt, Human
guccacgugaaguguggaa

SEQ ID NO: 239303 - RNA, 19 nt, Human
uaaugacucccuuuccucu

SEQ ID NO: 239304 - RNA, 21 nt, Human
uaggaauccuacccaaccccc

SEQ ID NO: 239305 - RNA, 21 nt, Human
uccaaaacucuuccccauacc

SEQ ID NO: 239306 - RNA, 18 nt, Human
uccacgugaaguguggaa

SEQ ID NO: 239307 - RNA, 20 nt, Human
ucccacgugggcagggcagc

SEQ ID NO: 239308 - RNA, 20 nt, Human
uccccgggcccuacucaggc

SEQ ID NO: 239309 - RNA, 25 nt, Human
uccccgggcccuacucaggccccug

SEQ ID NO: 239310 - RNA, 19 nt, Human
ucccuauaauuucaucuuc

SEQ ID NO: 239311 - RNA, 19 nt, Human
uccgugccugaggcugagc

SEQ ID NO: 239312 - RNA, 18 nt, Human
ucggugccgugcuccggu

SEQ ID NO: 239313 - RNA, 18 nt, Human
ucucagaggugucugagc

SEQ ID NO: 239314 - RNA, 22 nt, Human
ucuccucuaggaggggagggaa

SEQ ID NO: 239315 - RNA, 21 nt, Human
ucucugaagcuuggggaugag

SEQ ID NO: 239316 - RNA, 20 nt, Human
ugagcagccccagggggugg

SEQ ID NO: 239317 - RNA, 22 nt, Human
ugccgggaggccucagguuugc

SEQ ID NO: 239318 - RNA, 20 nt, Human
ugccugaggcugagcagccc

SEQ ID NO: 239319 - RNA, 23 nt, Human
ugggaggaaggcaggaggcccga

SEQ ID NO: 239320 - RNA, 22 nt, Human
ugggcagcaguugguaucaugu

SEQ ID NO: 239321 - RNA, 18 nt, Human
ugggugggucugccggga

SEQ ID NO: 239322 - RNA, 21 nt, Human
uuagggcucugcuuccccggg

SEQ ID NO: 239323 - RNA, 21 nt, Human
aagcgagcgccccuccccggg

SEQ ID NO: 239324 - RNA, 18 nt, Human
ccccgucugcugcucaga

SEQ ID NO: 239325 - RNA, 21 nt, Human
cggcucuucuuucccggcucc

SEQ ID NO: 239326 - RNA, 18 nt, Human
cggugugguggcacgggc

SEQ ID NO: 239327 - RNA, 18 nt, Human
cuccggcucuucuuuccc

SEQ ID NO: 239328 - RNA, 18 nt, Human
cucuucuuucccggcucc

SEQ ID NO: 239329 - RNA, 19 nt, Human
gcucagaggacggcccagg

SEQ ID NO: 239330 - RNA, 19 nt, Human
gcuccggcucuucuuuccc

SEQ ID NO: 239331 - RNA, 21 nt, Human
ggaagcgagcgccccuccccg

SEQ ID NO: 239332 - RNA, 18 nt, Human
uccggcucuucuuucccg

SEQ ID NO: 239333 - RNA, 18 nt, Human
uggaggcuccggcucuuc

SEQ ID NO: 239334 - RNA, 20 nt, Human
uggaggcuccggcucuucuu

SEQ ID NO: 239335 - RNA, 21 nt, Human
uuagccccgucugcugcucag

SEQ ID NO: 239336 - RNA, 24 nt, Human
aacacaccuggggagaagagcugg

SEQ ID NO: 239337 - RNA, 23 nt, Human
agacaccccuucccuccccacuc

SEQ ID NO: 239338 - RNA, 18 nt, Human
agccaaggccccaacaca

SEQ ID NO: 239339 - RNA, 24 nt, Human
caauagacaccccuucccucccca

SEQ ID NO: 239340 - RNA, 23 nt, Human
caccccuucccuccccacucccc

SEQ ID NO: 239341 - RNA, 21 nt, Human
cagcaggggagccaaggcccc

SEQ ID NO: 239342 - RNA, 21 nt, Human
caggacaggacuccacaccgc

SEQ ID NO: 239343 - RNA, 18 nt, Human
cagugaauggcugaggcu

SEQ ID NO: 239344 - RNA, 22 nt, Human
cccaccuucagcaggggagcca

SEQ ID NO: 239345 - RNA, 23 nt, Human
cccacuaggucugcaagccccua

SEQ ID NO: 239346 - RNA, 19 nt, Human
ccccuucccuccccacucc

SEQ ID NO: 239347 - RNA, 18 nt, Human
cccuccccacuccccgcg

SEQ ID NO: 239348 - RNA, 23 nt, Human
cccuguugcccaauagacacccc

SEQ ID NO: 239349 - RNA, 23 nt, Human
cgagaggaaagccagccugcacc

SEQ ID NO: 239350 - RNA, 28 nt, Human
cgagaggaaagccagccugcaccucacu

SEQ ID NO: 239351 - RNA, 22 nt, Human
cgcccuguugcccaauagacac

SEQ ID NO: 239352 - RNA, 19 nt, Human
cuccccacuccccgcggcu

SEQ ID NO: 239353 - RNA, 19 nt, Human
cugaggcaggacaggacuu

SEQ ID NO: 239354 - RNA, 21 nt, Human
ggagaagagcugggggcagug

SEQ ID NO: 239355 - RNA, 20 nt, Human
ggagcugggccaucuucuuc

SEQ ID NO: 239356 - RNA, 20 nt, Human
ggccccaacacaccugggga

SEQ ID NO: 239357 - RNA, 20 nt, Human
ggggagaagagcugggggca

SEQ ID NO: 239358 - RNA, 24 nt, Human
gggggcagugaauggcugaggcuu

SEQ ID NO: 239359 - RNA, 21 nt, Human
uccacaccgcgcugcgagagg

SEQ ID NO: 239360 - RNA, 19 nt, Human
uccccacuccccgcggcca

SEQ ID NO: 239361 - RNA, 21 nt, Human
uccccgcggccaggucuacuu

SEQ ID NO: 239362 - RNA, 18 nt, Human
ucuuggggagcugggcca

SEQ ID NO: 239363 - RNA, 20 nt, Human
ugccuggcugcugcgauguu

SEQ ID NO: 239364 - RNA, 21 nt, Human
ugcgauguucuuucucuccca

SEQ ID NO: 239365 - RNA, 23 nt, Human
uggcaaacgaaggcucugcacuu

SEQ ID NO: 239366 - RNA, 21 nt, Human
uucagcaggggagccaaggcc

SEQ ID NO: 239367 - RNA, 19 nt, Human
uucccuccccacuccccgc

SEQ ID NO: 239368 - RNA, 19 nt, Human
aacaggccacccaggagcc

SEQ ID NO: 239369 - RNA, 22 nt, Human
aacaggccacccaggagccuga

SEQ ID NO: 239370 - RNA, 19 nt, Human
aagcaauccagugcucccc

SEQ ID NO: 239371 - RNA, 23 nt, Human
acagcacagacugcagggaacag

SEQ ID NO: 239372 - RNA, 21 nt, Human
agcgcugccaggccagccccg

SEQ ID NO: 239373 - RNA, 19 nt, Human
aggggugugcugccgcugg

SEQ ID NO: 239374 - RNA, 19 nt, Human
aguggcugggcccuucccu

SEQ ID NO: 239375 - RNA, 22 nt, Human
auggacaccuggggugugugua

SEQ ID NO: 239376 - RNA, 22 nt, Human
cagaugaaggacgcucauaaug

SEQ ID NO: 239377 - RNA, 25 nt, Human
cagcauggcaagugcagcgcugcca

SEQ ID NO: 239378 - RNA, 21 nt, Human
cagccccgagacaggcccaga

SEQ ID NO: 239379 - RNA, 23 nt, Human
caggccagccccgagacaggccc

SEQ ID NO: 239380 - RNA, 23 nt, Human
cauaacaggccacccaggagccu

SEQ ID NO: 239381 - RNA, 24 nt, Human
ccaagaucaaaagcuggaaguggc

SEQ ID NO: 239382 - RNA, 27 nt, Human
ccacaccccugucaaccuaaaguugac

SEQ ID NO: 239383 - RNA, 22 nt, Human
ccagccccgagacaggcccaga

SEQ ID NO: 239384 - RNA, 21 nt, Human
ccagugcuccccauggacacc

SEQ ID NO: 239385 - RNA, 19 nt, Human
cccugggaggccugggcug

SEQ ID NO: 239386 - RNA, 18 nt, Human
cccuugcggucgcggcca

SEQ ID NO: 239387 - RNA, 21 nt, Human
ccugaggaguauagggaggga

SEQ ID NO: 239388 - RNA, 19 nt, Human
cuaaagcuggucuggccac

SEQ ID NO: 239389 - RNA, 26 nt, Human
cugcagggaacagaggccgcuggcau

SEQ ID NO: 239390 - RNA, 23 nt, Human
cuggaaguggcugggcccuuccc

SEQ ID NO: 239391 - RNA, 19 nt, Human
gcggucgcggccacacccc

SEQ ID NO: 239392 - RNA, 23 nt, Human
ggccacaccccugucaaccuaaa

SEQ ID NO: 239393 - RNA, 23 nt, Human
ggcugggcccuucccugggaggc

SEQ ID NO: 239394 - RNA, 23 nt, Human
ggcugguuuccagcauggcaagu

SEQ ID NO: 239395 - RNA, 19 nt, Human
uaacaggccacccaggagc

SEQ ID NO: 239396 - RNA, 19 nt, Human
uacaggggugugcugccgc

SEQ ID NO: 239397 - RNA, 20 nt, Human
uacaggggugugcugccgcu

SEQ ID NO: 239398 - RNA, 19 nt, Human
uccccauggacaccugggg

SEQ ID NO: 239399 - RNA, 19 nt, Human
ucccugggaggccugggcu

SEQ ID NO: 239400 - RNA, 20 nt, Human
ucccugggaggccugggcug

SEQ ID NO: 239401 - RNA, 24 nt, Human
ucccugggaggccugggcugguuu

SEQ ID NO: 239402 - RNA, 23 nt, Human
ugagaagagccuuuuauuagaag

SEQ ID NO: 239403 - RNA, 21 nt, Human
ugccacggcagcccuggccac

SEQ ID NO: 239404 - RNA, 19 nt, Human
ugccucaguccuuacccuc

SEQ ID NO: 239405 - RNA, 25 nt, Human
uggcugggcccuucccugggaggcc

SEQ ID NO: 239406 - RNA, 20 nt, Human
ugggguguguguaaggcggc

SEQ ID NO: 239407 - RNA, 23 nt, Human
aaacagcauuuauuccagacucc

SEQ ID NO: 239408 - RNA, 21 nt, Human
aaggcccccucccacccaccc

SEQ ID NO: 239409 - RNA, 23 nt, Human
accaggggcggggugaggggggg

SEQ ID NO: 239410 - RNA, 27 nt, Human
acccacccacccucccucuccuucccu

SEQ ID NO: 239411 - RNA, 23 nt, Human
acccucccucuccuucccucccg

SEQ ID NO: 239412 - RNA, 18 nt, Human
agaggaaggaagggaggg

SEQ ID NO: 239413 - RNA, 31 nt, Human
agaggaaggaagggagggcugggcagggagg

SEQ ID NO: 239414 - RNA, 18 nt, Human
agagggaagagggaaggc

SEQ ID NO: 239415 - RNA, 22 nt, Human
agagggaaggcgggggcgggcc

SEQ ID NO: 239416 - RNA, 22 nt, Human
agcuccagguccagggacagcc

SEQ ID NO: 239417 - RNA, 19 nt, Human
aggaaggaagggagggcug

SEQ ID NO: 239418 - RNA, 21 nt, Human
aggaagggagggcugggcagg

SEQ ID NO: 239419 - RNA, 22 nt, Human
aggagcuauucuggggccuggg

SEQ ID NO: 239420 - RNA, 20 nt, Human
aggcagccacuguggguccc

SEQ ID NO: 239421 - RNA, 27 nt, Human
aggcgggagguaaaaauaggggacccc

SEQ ID NO: 239422 - RNA, 21 nt, Human
aggcgggggcgggcauggcgu

SEQ ID NO: 239423 - RNA, 18 nt, Human
agggcgggggcaggagug

SEQ ID NO: 239424 - RNA, 26 nt, Human
aggggcggggugaggggggggaaucc

SEQ ID NO: 239425 - RNA, 19 nt, Human
agguggggggaccagcagg

SEQ ID NO: 239426 - RNA, 18 nt, Human
cagcaggggaggcgggag

SEQ ID NO: 239427 - RNA, 19 nt, Human
ccacccucccucuccuucc

SEQ ID NO: 239428 - RNA, 22 nt, Human
cccacccacccacccucccucu

SEQ ID NO: 239429 - RNA, 19 nt, Human
cccccucccacccacccac

SEQ ID NO: 239430 - RNA, 20 nt, Human
cccccucccacccacccacc

SEQ ID NO: 239431 - RNA, 20 nt, Human
ccccucccacccacccaccc

SEQ ID NO: 239432 - RNA, 21 nt, Human
cccucccucuccuucccuccc

SEQ ID NO: 239433 - RNA, 25 nt, Human
cccuggaggaaggcccccucccacc

SEQ ID NO: 239434 - RNA, 19 nt, Human
ccucccacccacccacccu

SEQ ID NO: 239435 - RNA, 21 nt, Human
ccucccacccacccacccucc

SEQ ID NO: 239436 - RNA, 20 nt, Human
ccucccggaggcaggcagcu

SEQ ID NO: 239437 - RNA, 22 nt, Human
cuccuucccucccggaggcagg

SEQ ID NO: 239438 - RNA, 18 nt, Human
gccggcagaggaaggaag

SEQ ID NO: 239439 - RNA, 19 nt, Human
ggaagggagggcugggcag

SEQ ID NO: 239440 - RNA, 21 nt, Human
ggagugggaccaggggcgggg

SEQ ID NO: 239441 - RNA, 18 nt, Human
ggcaggagugggaccagg

SEQ ID NO: 239442 - RNA, 19 nt, Human
ggcagggagagggaagagg

SEQ ID NO: 239443 - RNA, 18 nt, Human
ggcuuggguccaggagcu

SEQ ID NO: 239444 - RNA, 20 nt, Human
gggaccagcaggggaggcga

SEQ ID NO: 239445 - RNA, 18 nt, Human
gggcaggagugggaccag

SEQ ID NO: 239446 - RNA, 20 nt, Human
gggcagggagagggaagagg

SEQ ID NO: 239447 - RNA, 21 nt, Human
gggcggagguagggcgggggc

SEQ ID NO: 239448 - RNA, 18 nt, Human
gggcggggugaggggggg

SEQ ID NO: 239449 - RNA, 22 nt, Human
ggggaccagcaggggaggcggg

SEQ ID NO: 239450 - RNA, 23 nt, Human
ggggcaggagugggaccaggggc

SEQ ID NO: 239451 - RNA, 26 nt, Human
ggguggggcggagguagggcgggggc

SEQ ID NO: 239452 - RNA, 18 nt, Human
gugggaccaggggcgggg

SEQ ID NO: 239453 - RNA, 23 nt, Human
ucagguggggggaccagcagggg

SEQ ID NO: 239454 - RNA, 18 nt, Human
uccaguguccacagauga

SEQ ID NO: 239455 - RNA, 19 nt, Human
ucccacccacccacccucc

SEQ ID NO: 239456 - RNA, 22 nt, Human
ucccaggcugggccuugggcuu

SEQ ID NO: 239457 - RNA, 22 nt, Human
ucccggaggcaggcagccacug

SEQ ID NO: 239458 - RNA, 20 nt, Human
ucccugccuugccggcagag

SEQ ID NO: 239459 - RNA, 21 nt, Human
ucccuggaggaaggcccccuc

SEQ ID NO: 239460 - RNA, 22 nt, Human
uggggggaccagcaggggaggc

SEQ ID NO: 239461 - RNA, 18 nt, Human
uucucugaugccugcagc

SEQ ID NO: 239462 - RNA, 22 nt, Human
aaaauauuguuccaggauacag

SEQ ID NO: 239463 - RNA, 21 nt, Human
acagaaaaacauaaccauaaa

SEQ ID NO: 239464 - RNA, 21 nt, Human
acaguaauaaaauauggauac

SEQ ID NO: 239465 - RNA, 18 nt, Human
agaaaaacauaaccauaa

SEQ ID NO: 239466 - RNA, 23 nt, Human
aguagaaauaaaaaaacacuaaa

SEQ ID NO: 239467 - RNA, 24 nt, Human
auuaaacauaacaugcaaauaauc

SEQ ID NO: 239468 - RNA, 21 nt, Human
cacacagaaaaacauaaccau

SEQ ID NO: 239469 - RNA, 20 nt, Human
caggacggaacuggcugcca

SEQ ID NO: 239470 - RNA, 24 nt, Human
cauggaaguaauaaacaguaauaa

SEQ ID NO: 239471 - RNA, 20 nt, Human
cugacacacagaaaaacaua

SEQ ID NO: 239472 - RNA, 26 nt, Human
cuuugaggaacauuaagauuuaagga

SEQ ID NO: 239473 - RNA, 18 nt, Human
gcaagagaguaacaucca

SEQ ID NO: 239474 - RNA, 21 nt, Human
guguucuugugaugaaauagg

SEQ ID NO: 239475 - RNA, 21 nt, Human
uaaagcagaugcacuauggac

SEQ ID NO: 239476 - RNA, 24 nt, Human
uaacaugcaaauaaucaaagagaa

SEQ ID NO: 239477 - RNA, 20 nt, Human
uaauuuggugcaagagagua

SEQ ID NO: 239478 - RNA, 18 nt, Human
uacaaauaaagcauugag

SEQ ID NO: 239479 - RNA, 24 nt, Human
uaucaagauaauuuggugcaagag

SEQ ID NO: 239480 - RNA, 21 nt, Human
uauucguguauaugugugugu

SEQ ID NO: 239481 - RNA, 18 nt, Human
ucugucaggacggaacug

SEQ ID NO: 239482 - RNA, 19 nt, Human
ugaaauaggccugccuuuc

SEQ ID NO: 239483 - RNA, 23 nt, Human
ugaauccuuacugucuugacacu

SEQ ID NO: 239484 - RNA, 22 nt, Human
ugacacacagaaaaacauaacc

SEQ ID NO: 239485 - RNA, 23 nt, Human
ugacacacagaaaaacauaacca

SEQ ID NO: 239486 - RNA, 19 nt, Human
ugcugugaacucugucagg

SEQ ID NO: 239487 - RNA, 24 nt, Human
uggcugccagauucugagugauac

SEQ ID NO: 239488 - RNA, 21 nt, Human
uguuuacaaaacauuucccuc

SEQ ID NO: 239489 - RNA, 19 nt, Human
uuaauucuuaaagcagaug

SEQ ID NO: 239490 - RNA, 24 nt, Human
uucacuagguaaguaugcaaauuc

SEQ ID NO: 239491 - RNA, 24 nt, Human
uucuuggccucaauaucuaccacc

SEQ ID NO: 239492 - RNA, 22 nt, Human
uugcuauguuuuauuuugcuag

SEQ ID NO: 239493 - RNA, 21 nt, Human
uuuggcaaaugguuugaaucc

SEQ ID NO: 239494 - RNA, 22 nt, Human
uuuuuuuuuuuuuuuuucauuu

SEQ ID NO: 239495 - RNA, 22 nt, Human
aaaaaccuucuuuaggagaaag

SEQ ID NO: 239496 - RNA, 21 nt, Human
aaaaagacacucccaggggcu

SEQ ID NO: 239497 - RNA, 19 nt, Human
aaagagcauuggauuuaga

SEQ ID NO: 239498 - RNA, 24 nt, Human
aaagugcugggauuacagguguga

SEQ ID NO: 239499 - RNA, 23 nt, Human
aacccaguucuacucaguucuca

SEQ ID NO: 239500 - RNA, 22 nt, Human
aagcaaaugcagaucaaagaau

SEQ ID NO: 239501 - RNA, 18 nt, Human
aagugcugggauuacagg

SEQ ID NO: 239502 - RNA, 19 nt, Human
aagugcugggauuacaggu

SEQ ID NO: 239503 - RNA, 26 nt, Human
aagugcugggauuacaggugugagcc

SEQ ID NO: 239504 - RNA, 24 nt, Human
accuugugauccgccugccuuggc

SEQ ID NO: 239505 - RNA, 20 nt, Human
accuuucucuuggcaaccac

SEQ ID NO: 239506 - RNA, 19 nt, Human
acgggguuucacuauauug

SEQ ID NO: 239507 - RNA, 24 nt, Human
acgggguuucacuauauuguccag

SEQ ID NO: 239508 - RNA, 24 nt, Human
acuauauuguccaggcuggucuug

SEQ ID NO: 239509 - RNA, 26 nt, Human
agcuaauuuuguauuuuuaguagaga

SEQ ID NO: 239510 - RNA, 20 nt, Human
agcugcucuggcaaaccaag

SEQ ID NO: 239511 - RNA, 18 nt, Human
agggcaccgggccuccuc

SEQ ID NO: 239512 - RNA, 23 nt, Human
aguagcugcgauuacaggcaugu

SEQ ID NO: 239513 - RNA, 22 nt, Human
agucaucugcuuuuuuaaagaa

SEQ ID NO: 239514 - RNA, 24 nt, Human
agugauucuccugccucagccucc

SEQ ID NO: 239515 - RNA, 19 nt, Human
auccgccugccuuggccuc

SEQ ID NO: 239516 - RNA, 18 nt, Human
auguccccucugcggccc

SEQ ID NO: 239517 - RNA, 19 nt, Human
augugccaccacacccagc

SEQ ID NO: 239518 - RNA, 23 nt, Human
auucuaccuuuuuaauauucucc

SEQ ID NO: 239519 - RNA, 18 nt, Human
auucuccugccucagccu

SEQ ID NO: 239520 - RNA, 24 nt, Human
caaagugcugggauuacaggugug

SEQ ID NO: 239521 - RNA, 20 nt, Human
caagugauucuccugccuca

SEQ ID NO: 239522 - RNA, 22 nt, Human
caagugauucuccugccucagc

SEQ ID NO: 239523 - RNA, 19 nt, Human
caccgggccuccuccuguu

SEQ ID NO: 239524 - RNA, 24 nt, Human
cacuauauuguccaggcuggucuu

SEQ ID NO: 239525 - RNA, 24 nt, Human
cacucuuguugcccaggcuggagu

SEQ ID NO: 239526 - RNA, 21 nt, Human
cacugcaaccuccgccuccug

SEQ ID NO: 239527 - RNA, 23 nt, Human
cacugcaaccuccgccuccuggg

SEQ ID NO: 239528 - RNA, 20 nt, Human
cagaaagggcaccgggccuc

SEQ ID NO: 239529 - RNA, 21 nt, Human
cagacagcugucuggggggca

SEQ ID NO: 239530 - RNA, 18 nt, Human
cagccuccugaguagcug

SEQ ID NO: 239531 - RNA, 29 nt, Human
cagcuaauuuuguauuuuuaguagagacg

SEQ ID NO: 239532 - RNA, 19 nt, Human
caggcacacaauacucagg

SEQ ID NO: 239533 - RNA, 21 nt, Human
caucccugagaggccagcagc

SEQ ID NO: 239534 - RNA, 21 nt, Human
ccaaagugcugggauuacagg

SEQ ID NO: 239535 - RNA, 21 nt, Human
ccaaagugcugggauuacagg

SEQ ID NO: 239536 - RNA, 24 nt, Human
ccaaagugcugggauuacaggugu

SEQ ID NO: 239537 - RNA, 20 nt, Human
ccaccacacccagcuaauuu

SEQ ID NO: 239538 - RNA, 22 nt, Human
cccaagcaaaugcagaucaaag

SEQ ID NO: 239539 - RNA, 18 nt, Human
cccaggcagauauucaag

SEQ ID NO: 239540 - RNA, 19 nt, Human
cccaggcuggaguacaaug

SEQ ID NO: 239541 - RNA, 21 nt, Human
cccaucagcugcagcugcuuc

SEQ ID NO: 239542 - RNA, 24 nt, Human
ccccaucagcugcagcugcuucuu

SEQ ID NO: 239543 - RNA, 24 nt, Human
ccgccuccuggguucaagugauuc

SEQ ID NO: 239544 - RNA, 22 nt, Human
ccuccgccuccuggguucaagu

SEQ ID NO: 239545 - RNA, 24 nt, Human
ccuccuggguucaagugauucucc

SEQ ID NO: 239546 - RNA, 19 nt, Human
ccugaguagcugcgauuac

SEQ ID NO: 239547 - RNA, 23 nt, Human
ccugaguagcugcgauuacaggc

SEQ ID NO: 239548 - RNA, 24 nt, Human
ccugaguagcugcgauuacaggca

SEQ ID NO: 239549 - RNA, 23 nt, Human
ccugccucagccuccugaguagc

SEQ ID NO: 239550 - RNA, 22 nt, Human
ccugccuuggccucccaaagug

SEQ ID NO: 239551 - RNA, 23 nt, Human
ccuggguucaagugauucuccuc

SEQ ID NO: 239552 - RNA, 23 nt, Human
ccuggguucaagugauucuccug

SEQ ID NO: 239553 - RNA, 24 nt, Human
cucacugcaaccuccgccuccugg

SEQ ID NO: 239554 - RNA, 24 nt, Human
cuccugaccuugugauccgccugc

SEQ ID NO: 239555 - RNA, 20 nt, Human
cuccuggguucaagugauuc

SEQ ID NO: 239556 - RNA, 21 nt, Human
cuccuggguucaagugauucu

SEQ ID NO: 239557 - RNA, 18 nt, Human
cucuuguugcccaggcug

SEQ ID NO: 239558 - RNA, 18 nt, Human
cugagccucacacucaca

SEQ ID NO: 239559 - RNA, 24 nt, Human
cugaguagcugcgauuacaggcau

SEQ ID NO: 239560 - RNA, 23 nt, Human
cugauaauaugagacagacagcu

SEQ ID NO: 239561 - RNA, 23 nt, Human
cugcaaccuccgccuccuggguu

SEQ ID NO: 239562 - RNA, 24 nt, Human
cugcaaccuccgccuccuggguuc

SEQ ID NO: 239563 - RNA, 23 nt, Human
cugccucagccuccugaguagcu

SEQ ID NO: 239564 - RNA, 23 nt, Human
cugccuuggccucccaaagugcu

SEQ ID NO: 239565 - RNA, 22 nt, Human
cuguucugagggccuacgggga

SEQ ID NO: 239566 - RNA, 22 nt, Human
cuuggcaaccacaaucuucuuu

SEQ ID NO: 239567 - RNA, 21 nt, Human
gaccuugugauccgccugccu

SEQ ID NO: 239568 - RNA, 24 nt, Human
gaccuugugauccgccugccuugg

SEQ ID NO: 239569 - RNA, 18 nt, Human
gagcuccuuuagcugcuc

SEQ ID NO: 239570 - RNA, 22 nt, Human
gaguagcugcgauuacaggcau

SEQ ID NO: 239571 - RNA, 18 nt, Human
gauuacaggcaugugcca

SEQ ID NO: 239572 - RNA, 18 nt, Human
gauuacaggugugagcca

SEQ ID NO: 239573 - RNA, 21 nt, Human
gauuacaggugugagccacca

SEQ ID NO: 239574 - RNA, 22 nt, Human
gauuacaggugugagccaccac

SEQ ID NO: 239575 - RNA, 18 nt, Human
gcagcugcuucuugugcu

SEQ ID NO: 239576 - RNA, 20 nt, Human
gcccagagcuccccaucagc

SEQ ID NO: 239577 - RNA, 19 nt, Human
gcccaggcuggaguacaau

SEQ ID NO: 239578 - RNA, 20 nt, Human
gccgcucagcugccagcgac

SEQ ID NO: 239579 - RNA, 22 nt, Human
gccuuggccucccaaagugcug

SEQ ID NO: 239580 - RNA, 18 nt, Human
gcggccccgaaccgcgcu

SEQ ID NO: 239581 - RNA, 19 nt, Human
gcuccuuuagcugcucugg

SEQ ID NO: 239582 - RNA, 24 nt, Human
gcugcuucuugugcuuuucaugcu

SEQ ID NO: 239583 - RNA, 19 nt, Human
ggagaaaggucaaaccccc

SEQ ID NO: 239584 - RNA, 18 nt, Human
ggagcuccuuuagcugcu

SEQ ID NO: 239585 - RNA, 23 nt, Human
ggcuggucuugaacuccugaccu

SEQ ID NO: 239586 - RNA, 21 nt, Human
gggccuccuccuguugcccag

SEQ ID NO: 239587 - RNA, 20 nt, Human
ggggaugagaaaugguuacc

SEQ ID NO: 239588 - RNA, 23 nt, Human
gggguuucacuauauuguccagg

SEQ ID NO: 239589 - RNA, 22 nt, Human
ggguuucacuauauuguccagg

SEQ ID NO: 239590 - RNA, 20 nt, Human
ggucuugaacuccugaccuu

SEQ ID NO: 239591 - RNA, 20 nt, Human
guagcugcgauuacaggcau

SEQ ID NO: 239592 - RNA, 24 nt, Human
gugauucuccugccucagccuccu

SEQ ID NO: 239593 - RNA, 23 nt, Human
guuucacuauauuguccaggcug

SEQ ID NO: 239594 - RNA, 22 nt, Human
uaaaauaggcccaguguaagcc

SEQ ID NO: 239595 - RNA, 23 nt, Human
uaagaaagguuagcagaguagaa

SEQ ID NO: 239596 - RNA, 19 nt, Human
uaauaucugcccccaggcc

SEQ ID NO: 239597 - RNA, 23 nt, Human
uacaauggugcgaucuuggcucc

SEQ ID NO: 239598 - RNA, 24 nt, Human
uacaggcaugugccaccacaccca

SEQ ID NO: 239599 - RNA, 22 nt, Human
uacaggugugagccaccacgcc

SEQ ID NO: 239600 - RNA, 22 nt, Human
uacaggugugagccaccacgcc

SEQ ID NO: 239601 - RNA, 23 nt, Human
uacaggugugagccaccacgccu

SEQ ID NO: 239602 - RNA, 24 nt, Human
uagaaagagcauuggauuuagaga

SEQ ID NO: 239603 - RNA, 20 nt, Human
uagagacaggaaucuuggau

SEQ ID NO: 239604 - RNA, 26 nt, Human
uagcagaguagaaagagcauuggauu

SEQ ID NO: 239605 - RNA, 19 nt, Human
uaggcccaguguaagcccc

SEQ ID NO: 239606 - RNA, 23 nt, Human
uaguagagacgggguuucacuau

SEQ ID NO: 239607 - RNA, 24 nt, Human
uaguagagacgggguuucacuaua

SEQ ID NO: 239608 - RNA, 22 nt, Human
uaguggguagugaaguacuuuu

SEQ ID NO: 239609 - RNA, 21 nt, Human
uauacugaaccagcccugccc

SEQ ID NO: 239610 - RNA, 24 nt, Human
uauauuguccaggcuggucuugaa

SEQ ID NO: 239611 - RNA, 24 nt, Human
uauuuuguguuucugacccuuagc

SEQ ID NO: 239612 - RNA, 18 nt, Human
ucaaaaagacacucccag

SEQ ID NO: 239613 - RNA, 22 nt, Human
ucaaagaauaacauaggcauga

SEQ ID NO: 239614 - RNA, 19 nt, Human
ucaagugauucuccugccu

SEQ ID NO: 239615 - RNA, 24 nt, Human
ucaauacuuccggcggcucucccu

SEQ ID NO: 239616 - RNA, 20 nt, Human
ucaccuucauauacgagagc

SEQ ID NO: 239617 - RNA, 21 nt, Human
ucacuauauuguccaggcugg

SEQ ID NO: 239618 - RNA, 23 nt, Human
ucacucuuguugcccaggcugga

SEQ ID NO: 239619 - RNA, 23 nt, Human
ucacugcaaccuccgccuccugg

SEQ ID NO: 239620 - RNA, 24 nt, Human
ucacugcaaccuccgccuccuggg

SEQ ID NO: 239621 - RNA, 25 nt, Human
ucacugcaaccuccgccuccugggu

SEQ ID NO: 239622 - RNA, 27 nt, Human
ucacugcaaccuccgccuccuggguuc

SEQ ID NO: 239623 - RNA, 23 nt, Human
ucccaaagugcugggauuacagg

SEQ ID NO: 239624 - RNA, 23 nt, Human
ucccaggggcuucuccagaugcu

SEQ ID NO: 239625 - RNA, 18 nt, Human
ucccugagaggccagcag

SEQ ID NO: 239626 - RNA, 24 nt, Human
uccugaguagcugcgauuacaggc

SEQ ID NO: 239627 - RNA, 21 nt, Human
uccuggguucaagugauucuc

SEQ ID NO: 239628 - RNA, 24 nt, Human
uccuggguucaagugauucuccug

SEQ ID NO: 239629 - RNA, 23 nt, Human
ucgcagucaaaauacaggcacac

SEQ ID NO: 239630 - RNA, 24 nt, Human
ucuccugccucagccuccugagua

SEQ ID NO: 239631 - RNA, 21 nt, Human
ucuccuugguucucccaagca

SEQ ID NO: 239632 - RNA, 30 nt, Human
ucucuaaggaacccaguucuacucaguucu

SEQ ID NO: 239633 - RNA, 23 nt, Human
ucuucgcucuuccaguaauucug

SEQ ID NO: 239634 - RNA, 19 nt, Human
ucuugaacuccugaccuug

SEQ ID NO: 239635 - RNA, 23 nt, Human
ugagaggccagcagccugugaag

SEQ ID NO: 239636 - RNA, 24 nt, Human
ugagaggccagcagccugugaaga

SEQ ID NO: 239637 - RNA, 19 nt, Human
ugaggcggccgagaacuug

SEQ ID NO: 239638 - RNA, 23 nt, Human
ugagggccuacggggagcuccuu

SEQ ID NO: 239639 - RNA, 21 nt, Human
ugcccaggcuggaguacaaug

SEQ ID NO: 239640 - RNA, 24 nt, Human
ugcccaggcuggaguacaauggug

SEQ ID NO: 239641 - RNA, 25 nt, Human
ugccucagccuccugaguagcugcg

SEQ ID NO: 239642 - RNA, 18 nt, Human
ugcgauuacaggcaugug

SEQ ID NO: 239643 - RNA, 22 nt, Human
ugcgauuacaggcaugugccac

SEQ ID NO: 239644 - RNA, 24 nt, Human
ugcgauuacaggcaugugccacca

SEQ ID NO: 239645 - RNA, 22 nt, Human
ugcugaccuggcucccccucac

SEQ ID NO: 239646 - RNA, 24 nt, Human
ugcugccaaaaaccuucuuuagga

SEQ ID NO: 239647 - RNA, 24 nt, Human
ugcugggauuacaggugugagcca

SEQ ID NO: 239648 - RNA, 18 nt, Human
ugcugggugaccuuaggu

SEQ ID NO: 239649 - RNA, 26 nt, Human
ugcuguucugagggccuacggggagc

SEQ ID NO: 239650 - RNA, 18 nt, Human
uggaaaagggauuuugga

SEQ ID NO: 239651 - RNA, 19 nt, Human
uggaaaagggauuuuggaa

SEQ ID NO: 239652 - RNA, 22 nt, Human
uggaaacagucacucacucucu

SEQ ID NO: 239653 - RNA, 24 nt, Human
uggaguacaauggugcgaucuugg

SEQ ID NO: 239654 - RNA, 21 nt, Human
uggcaaaccaagggaagagaa

SEQ ID NO: 239655 - RNA, 19 nt, Human
uggcaaccacaaucuucuu

SEQ ID NO: 239656 - RNA, 18 nt, Human
ugggauuacaggugugag

SEQ ID NO: 239657 - RNA, 19 nt, Human
ugggauuacaggugugagc

SEQ ID NO: 239658 - RNA, 22 nt, Human
ugggauuacaggugugagccac

SEQ ID NO: 239659 - RNA, 23 nt, Human
ugggauuacaggugugagccacc

SEQ ID NO: 239660 - RNA, 24 nt, Human
ugggauuacaggugugagccacca

SEQ ID NO: 239661 - RNA, 24 nt, Human
ugggcuccuagaggcauccaauuc

SEQ ID NO: 239662 - RNA, 18 nt, Human
uggguagugaaguacuuu

SEQ ID NO: 239663 - RNA, 23 nt, Human
uggguucaagugauucuccugcc

SEQ ID NO: 239664 - RNA, 24 nt, Human
uggguucaagugauucuccugccu

SEQ ID NO: 239665 - RNA, 21 nt, Human
uguaaugagcuauacugaacc

SEQ ID NO: 239666 - RNA, 21 nt, Human
uguauuuuuaguagagacggg

SEQ ID NO: 239667 - RNA, 24 nt, Human
uguccaggcuggucuugaacuccu

SEQ ID NO: 239668 - RNA, 18 nt, Human
uguccccucugcggcccc

SEQ ID NO: 239669 - RNA, 19 nt, Human
uguugcccagagcucccca

SEQ ID NO: 239670 - RNA, 22 nt, Human
uuaauauucuccuugguucucc

SEQ ID NO: 239671 - RNA, 18 nt, Human
uuaguagagacgggguuu

SEQ ID NO: 239672 - RNA, 21 nt, Human
uuaguagagacgggguuucac

SEQ ID NO: 239673 - RNA, 21 nt, Human
uuaguagagacgggguuucac

SEQ ID NO: 239674 - RNA, 24 nt, Human
uuaguagagacgggguuucacuau

SEQ ID NO: 239675 - RNA, 21 nt, Human
uucaagugauucuccugccuc

SEQ ID NO: 239676 - RNA, 23 nt, Human
uucaagugauucuccugccucag

SEQ ID NO: 239677 - RNA, 24 nt, Human
uucaagugauucuccugccucagc

SEQ ID NO: 239678 - RNA, 19 nt, Human
uucaauguccccucugcgg

SEQ ID NO: 239679 - RNA, 24 nt, Human
uucacucuuguugcccaggcugga

SEQ ID NO: 239680 - RNA, 19 nt, Human
uuggaaacagucacucacu

SEQ ID NO: 239681 - RNA, 19 nt, Human
uuggaaagugaugcugcca

SEQ ID NO: 239682 - RNA, 18 nt, Human
uuggccucccaaagugcu

SEQ ID NO: 239683 - RNA, 24 nt, Human
uuucacucuuguugcccaggcugg

SEQ ID NO: 239684 - RNA, 20 nt, Human
uuucaucaucacagguuucu

SEQ ID NO: 239685 - RNA, 23 nt, Human
uuucugacccuuagcuucuacau

SEQ ID NO: 239686 - RNA, 19 nt, Human
uuuuguauuuuuaguagag

SEQ ID NO: 239687 - RNA, 20 nt, Human
uuuuguauuuuuaguagaga

SEQ ID NO: 239688 - RNA, 24 nt, Human
uuuuuaguagagacgggguuucac

SEQ ID NO: 239689 - RNA, 18 nt, Human
aaaugcuguugacugcuc

SEQ ID NO: 239690 - RNA, 19 nt, Human
acagugagucccugcccag

SEQ ID NO: 239691 - RNA, 19 nt, Human
caagaaaugcuguugacug

SEQ ID NO: 239692 - RNA, 21 nt, Human
cagacccaagcacaaugcugg

SEQ ID NO: 239693 - RNA, 18 nt, Human
cagcagaugacaguuccu

SEQ ID NO: 239694 - RNA, 18 nt, Human
cagucccucccucugcuu

SEQ ID NO: 239695 - RNA, 23 nt, Human
cagucccucccucugcuuccucc

SEQ ID NO: 239696 - RNA, 21 nt, Human
cagugagucccugcccaguuc

SEQ ID NO: 239697 - RNA, 25 nt, Human
cccagucccucccucugcuuccucc

SEQ ID NO: 239698 - RNA, 22 nt, Human
cccucugcuuccucccacucuu

SEQ ID NO: 239699 - RNA, 24 nt, Human
ccucugcuuccucccacucuucca

SEQ ID NO: 239700 - RNA, 23 nt, Human
cucccugugggagacuccggggc

SEQ ID NO: 239701 - RNA, 20 nt, Human
cugugccucucacagcagca

SEQ ID NO: 239702 - RNA, 21 nt, Human
gcuguaguggggguggguagu

SEQ ID NO: 239703 - RNA, 22 nt, Human
ggaaagggcucugugccucuca

SEQ ID NO: 239704 - RNA, 19 nt, Human
gggcgggguguguggugcu

SEQ ID NO: 239705 - RNA, 20 nt, Human
gguguguggugcugggaggg

SEQ ID NO: 239706 - RNA, 21 nt, Human
gguguguggugcugggaggga

SEQ ID NO: 239707 - RNA, 21 nt, Human
guggguuuaccuaaugcuugg

SEQ ID NO: 239708 - RNA, 19 nt, Human
uaaguuucucaaauggcua

SEQ ID NO: 239709 - RNA, 22 nt, Human
uagugggcuggcuucagcucug

SEQ ID NO: 239710 - RNA, 22 nt, Human
uaguggggguggguagugggcu

SEQ ID NO: 239711 - RNA, 20 nt, Human
uaugcuuuucuuuucuuuuu

SEQ ID NO: 239712 - RNA, 23 nt, Human
uauuaugcuuuucuuuucuuuuu

SEQ ID NO: 239713 - RNA, 22 nt, Human
ucacaggaguaagaagcucaga

SEQ ID NO: 239714 - RNA, 21 nt, Human
ucccacucuuccacaugcgga

SEQ ID NO: 239715 - RNA, 21 nt, Human
ucccugcccagucccucccuc

SEQ ID NO: 239716 - RNA, 18 nt, Human
ucucuggaaaccuucagc

SEQ ID NO: 239717 - RNA, 21 nt, Human
ucugcuuccucccacucuucc

SEQ ID NO: 239718 - RNA, 21 nt, Human
ugcugggagggaugucgguag

SEQ ID NO: 239719 - RNA, 21 nt, Human
ugcugggagggaugucgguag

SEQ ID NO: 239720 - RNA, 19 nt, Human
ugcuuccucccacucuucc

SEQ ID NO: 239721 - RNA, 20 nt, Human
ugggagggaugucgguagua

SEQ ID NO: 239722 - RNA, 20 nt, Human
uggguuuaccuaaugcuugg

SEQ ID NO: 239723 - RNA, 22 nt, Human
ugugaaggcccuggcaauuugg

SEQ ID NO: 239724 - RNA, 18 nt, Human
uuaaaauaaggauugaga

SEQ ID NO: 239725 - RNA, 18 nt, Human
uuacugagaacccagacc

SEQ ID NO: 239726 - RNA, 21 nt, Human
uuuacugagaacccagaccca

SEQ ID NO: 239727 - RNA, 23 nt, Human
aaaccccaacccccaaaggcugc

SEQ ID NO: 239728 - RNA, 19 nt, Human
aaccaaagcagccuguccu

SEQ ID NO: 239729 - RNA, 19 nt, Human
aacccccaaaggcugcccu

SEQ ID NO: 239730 - RNA, 19 nt, Human
aaguggcagaaaccccaac

SEQ ID NO: 239731 - RNA, 22 nt, Human
acagccaggcacacaucccuac

SEQ ID NO: 239732 - RNA, 24 nt, Human
accaaagcagcaggagggcuccag

SEQ ID NO: 239733 - RNA, 28 nt, Human
agaaaccccaacccccaaaggcugcccu

SEQ ID NO: 239734 - RNA, 22 nt, Human
agacccggaaguggcagaaacc

SEQ ID NO: 239735 - RNA, 18 nt, Human
agaggcaggggcuggggc

SEQ ID NO: 239736 - RNA, 19 nt, Human
aggcaggggcuggggcagg

SEQ ID NO: 239737 - RNA, 20 nt, Human
aggcaggggcuggggcaggu

SEQ ID NO: 239738 - RNA, 24 nt, Human
agguaccagcagccuggcggagcu

SEQ ID NO: 239739 - RNA, 20 nt, Human
augcagcugugccagggcag

SEQ ID NO: 239740 - RNA, 26 nt, Human
caaagcagcaggagggcuccaaugug

SEQ ID NO: 239741 - RNA, 21 nt, Human
cacaucccuacugacacgguc

SEQ ID NO: 239742 - RNA, 18 nt, Human
caccucccuccccaaaca

SEQ ID NO: 239743 - RNA, 30 nt, Human
cagaaaccccaacccccaaaggcugcccuu

SEQ ID NO: 239744 - RNA, 21 nt, Human
cagaggcaggggcuggggcag

SEQ ID NO: 239745 - RNA, 18 nt, Human
cagcagccuggcggagcu

SEQ ID NO: 239746 - RNA, 22 nt, Human
caggcacgugaggagucagggg

SEQ ID NO: 239747 - RNA, 21 nt, Human
cagggggugggccugaccugg

SEQ ID NO: 239748 - RNA, 19 nt, Human
cagguaccagcagccuggc

SEQ ID NO: 239749 - RNA, 20 nt, Human
ccaacccccaaaggcugccc

SEQ ID NO: 239750 - RNA, 26 nt, Human
ccaggcacacaucccuacugacacgg

SEQ ID NO: 239751 - RNA, 19 nt, Human
cccacguacacagccaggc

SEQ ID NO: 239752 - RNA, 21 nt, Human
cccacguacacagccaggcac

SEQ ID NO: 239753 - RNA, 23 nt, Human
cccacuugggcagaggcaggggc

SEQ ID NO: 239754 - RNA, 21 nt, Human
ccccaaaggcugcccuugaag

SEQ ID NO: 239755 - RNA, 21 nt, Human
ccccaacccccaaaggcugcc

SEQ ID NO: 239756 - RNA, 22 nt, Human
ccccaacccccaaaggcugccc

SEQ ID NO: 239757 - RNA, 18 nt, Human
ccccagaagccgccacgu

SEQ ID NO: 239758 - RNA, 23 nt, Human
ccccagaagccgccacgugcucu

SEQ ID NO: 239759 - RNA, 23 nt, Human
cccccagaagccgccacgugcuu

SEQ ID NO: 239760 - RNA, 22 nt, Human
cccuacugacacggucucccug

SEQ ID NO: 239761 - RNA, 22 nt, Human
ccuuccgcagucccccaaggaa

SEQ ID NO: 239762 - RNA, 23 nt, Human
cguacacagccaggcacacaucc

SEQ ID NO: 239763 - RNA, 21 nt, Human
cgugcacugcacacccacgua

SEQ ID NO: 239764 - RNA, 21 nt, Human
cuacagggacugaggcucucc

SEQ ID NO: 239765 - RNA, 18 nt, Human
cucgcgcgcucuggaccu

SEQ ID NO: 239766 - RNA, 18 nt, Human
cugacacggucucccugg

SEQ ID NO: 239767 - RNA, 19 nt, Human
gaucgggggacagggucug

SEQ ID NO: 239768 - RNA, 20 nt, Human
gcagguaccagcagccuggc

SEQ ID NO: 239769 - RNA, 19 nt, Human
gcccccagaagccgccacg

SEQ ID NO: 239770 - RNA, 20 nt, Human
ggagggcuccaauguggggg

SEQ ID NO: 239771 - RNA, 20 nt, Human
ggcagaggcaggggcugggg

SEQ ID NO: 239772 - RNA, 21 nt, Human
ggcagaggcaggggcuggggc

SEQ ID NO: 239773 - RNA, 24 nt, Human
ggccugaccugggaccaagggcac

SEQ ID NO: 239774 - RNA, 20 nt, Human
ggcuggauuugggcagggcc

SEQ ID NO: 239775 - RNA, 21 nt, Human
ggcuggggcaggacuggcugg

SEQ ID NO: 239776 - RNA, 18 nt, Human
ggcuggggcagguggagg

SEQ ID NO: 239777 - RNA, 19 nt, Human
gggcaggacuggcuggauu

SEQ ID NO: 239778 - RNA, 22 nt, Human
gggcagggccuagacccggaag

SEQ ID NO: 239779 - RNA, 23 nt, Human
gggcagguggaggugcagggggu

SEQ ID NO: 239780 - RNA, 19 nt, Human
ggggugggcuggggcagga

SEQ ID NO: 239781 - RNA, 18 nt, Human
gggugggcuggggcagga

SEQ ID NO: 239782 - RNA, 21 nt, Human
uacacagccaggcacacaucc

SEQ ID NO: 239783 - RNA, 19 nt, Human
uacacugugggauccagaa

SEQ ID NO: 239784 - RNA, 20 nt, Human
uacugacacggucucccugg

SEQ ID NO: 239785 - RNA, 26 nt, Human
ucagcauguccaugggacuuggucug

SEQ ID NO: 239786 - RNA, 24 nt, Human
uccccaaacauggcccccagaagc

SEQ ID NO: 239787 - RNA, 20 nt, Human
ucccuggggacccugucagg

SEQ ID NO: 239788 - RNA, 22 nt, Human
ugagggcagcuggcccacuugg

SEQ ID NO: 239789 - RNA, 23 nt, Human
ugcagcugugccagggcaggggg

SEQ ID NO: 239790 - RNA, 21 nt, Human
ugcagggggugggccugaccu

SEQ ID NO: 239791 - RNA, 18 nt, Human
ugggaccaagggcacaga

SEQ ID NO: 239792 - RNA, 21 nt, Human
ugggaccaagggcacagauca

SEQ ID NO: 239793 - RNA, 21 nt, Human
ugggauccagaaagggcuggg

SEQ ID NO: 239794 - RNA, 24 nt, Human
ugugggggugggcuggggcaggac

SEQ ID NO: 239795 - RNA, 26 nt, Human
cccuuguucccuugcucccuuguucc

SEQ ID NO: 239796 - RNA, 23 nt, Human
ccuugcucccuuguucccuucuc

SEQ ID NO: 239797 - RNA, 20 nt, Human
cuucucuacuccuacucccc

SEQ ID NO: 239798 - RNA, 27 nt, Human
ucccuuguucccuugcucccuuguucc

SEQ ID NO: 239799 - RNA, 22 nt, Human
ugacucacagaaggauguuucu

SEQ ID NO: 239800 - RNA, 19 nt, Human
ugucccuuguucccuugcu

SEQ ID NO: 239801 - RNA, 26 nt, Human
aaagacaucugaagcccauaggcucc

SEQ ID NO: 239802 - RNA, 18 nt, Human
agaaggagggggaggggc

SEQ ID NO: 239803 - RNA, 18 nt, Human
caaagacaucugaagccc

SEQ ID NO: 239804 - RNA, 23 nt, Human
caagaaggagccugugucugaac

SEQ ID NO: 239805 - RNA, 24 nt, Human
cagcaacauuugaccagucuuggu

SEQ ID NO: 239806 - RNA, 20 nt, Human
caucugaagcccauaggcuc

SEQ ID NO: 239807 - RNA, 24 nt, Human
cccacggucccaggagagaggcag

SEQ ID NO: 239808 - RNA, 24 nt, Human
cgagccccaggccccaugaggucc

SEQ ID NO: 239809 - RNA, 22 nt, Human
cuugugucaugugugacaauuc

SEQ ID NO: 239810 - RNA, 26 nt, Human
gagccccaggccccaugagguccagg

SEQ ID NO: 239811 - RNA, 18 nt, Human
gcuccaagaaggagccug

SEQ ID NO: 239812 - RNA, 23 nt, Human
ggagggggaggggccacauccag

SEQ ID NO: 239813 - RNA, 19 nt, Human
guaaaggacagcuggucca

SEQ ID NO: 239814 - RNA, 22 nt, Human
uaaauaacacugcagugagcau

SEQ ID NO: 239815 - RNA, 24 nt, Human
uagaauuucgaggaggaaacgcua

SEQ ID NO: 239816 - RNA, 24 nt, Human
uauguacaucuugugucaugugug

SEQ ID NO: 239817 - RNA, 19 nt, Human
ugagaaggagggggagggg

SEQ ID NO: 239818 - RNA, 20 nt, Human
ugagaaggugguguaaagga

SEQ ID NO: 239819 - RNA, 18 nt, Human
uuaagggugagaaggagg

SEQ ID NO: 239820 - RNA, 23 nt, Human
uugugucaugugugacaauucuc

SEQ ID NO: 239821 - RNA, 26 nt, Human
aaaguuguguuuccugggguucguaa

SEQ ID NO: 239822 - RNA, 21 nt, Human
agauacugaaaagacugagcc

SEQ ID NO: 239823 - RNA, 18 nt, Human
aggaauauacaaccauuu

SEQ ID NO: 239824 - RNA, 20 nt, Human
auggaaugccagugucccuc

SEQ ID NO: 239825 - RNA, 22 nt, Human
cacccauggccacugugucuca

SEQ ID NO: 239826 - RNA, 19 nt, Human
cacgccgcccaggcucaac

SEQ ID NO: 239827 - RNA, 18 nt, Human
cagcuuucagauccaccc

SEQ ID NO: 239828 - RNA, 25 nt, Human
cagugacucccuccuccgugggucc

SEQ ID NO: 239829 - RNA, 27 nt, Human
ccaggcucaaaaaaaaaaaaaaagaaa

SEQ ID NO: 239830 - RNA, 24 nt, Human
cccaggcucaaaaaaaaaaaaaaa

SEQ ID NO: 239831 - RNA, 19 nt, Human
cgcucugucgcccaggcuc

SEQ ID NO: 239832 - RNA, 23 nt, Human
cucacgccgcccaggcucaacac

SEQ ID NO: 239833 - RNA, 21 nt, Human
cucccacccucugcaucgucc

SEQ ID NO: 239834 - RNA, 19 nt, Human
cucugucgcccaggcucaa

SEQ ID NO: 239835 - RNA, 20 nt, Human
cugaaaagacugagccuaug

SEQ ID NO: 239836 - RNA, 21 nt, Human
cugaaccaguaaagcagauac

SEQ ID NO: 239837 - RNA, 22 nt, Human
cugagccuaugugguuuuuuuu

SEQ ID NO: 239838 - RNA, 20 nt, Human
cugcagugacucccuccucc

SEQ ID NO: 239839 - RNA, 20 nt, Human
cugcagugacucccuccucc

SEQ ID NO: 239840 - RNA, 18 nt, Human
cuuucagauccacccaug

SEQ ID NO: 239841 - RNA, 19 nt, Human
gcccaggcucaacaccagc

SEQ ID NO: 239842 - RNA, 21 nt, Human
guccaacacagagcucacgcc

SEQ ID NO: 239843 - RNA, 21 nt, Human
uaaagcagauacugaaaagac

SEQ ID NO: 239844 - RNA, 22 nt, Human
uaaagugaacaaaauacaguuc

SEQ ID NO: 239845 - RNA, 24 nt, Human
uagcauguaguucucccacccucu

SEQ ID NO: 239846 - RNA, 21 nt, Human
ucaaaaaaaaaaaaaaagaaa

SEQ ID NO: 239847 - RNA, 22 nt, Human
ucaaaaaaaaaaaaaaagaaau

SEQ ID NO: 239848 - RNA, 18 nt, Human
ucucgcucugucgcccag

SEQ ID NO: 239849 - RNA, 19 nt, Human
ucucgcucugucgcccagg

SEQ ID NO: 239850 - RNA, 24 nt, Human
ucucgcucugucgcccaggcucaa

SEQ ID NO: 239851 - RNA, 24 nt, Human
ucucgcucugucgcccaggcucaa

SEQ ID NO: 239852 - RNA, 25 nt, Human
ucucgcucugucgcccaggcucaaa

SEQ ID NO: 239853 - RNA, 18 nt, Human
ucugacaaauggaaugcc

SEQ ID NO: 239854 - RNA, 22 nt, Human
ugagauggagucucgcucuguc

SEQ ID NO: 239855 - RNA, 20 nt, Human
uggaaugccagugucccucu

SEQ ID NO: 239856 - RNA, 24 nt, Human
uggagucucgcucugucgcccagg

SEQ ID NO: 239857 - RNA, 24 nt, Human
ugucgcccaggcucaaaaaaaaaa

SEQ ID NO: 239858 - RNA, 25 nt, Human
uuuuuuuuuuuugagauggagucuc

SEQ ID NO: 239859 - RNA, 22 nt, Human
uuuuuuuuuuuuuugagaugga

SEQ ID NO: 239860 - RNA, 27 nt, Human
uuuuuuuuuuuuuuuuuuuuuuugggg

SEQ ID NO: 239861 - RNA, 24 nt, Human
aaaaaaaaagauaucugcccacgc

SEQ ID NO: 239862 - RNA, 19 nt, Human
aaacaccgugggaaggcug

SEQ ID NO: 239863 - RNA, 19 nt, Human
acccugccacaucccccuc

SEQ ID NO: 239864 - RNA, 24 nt, Human
accucugccuaggaaaaccagaga

SEQ ID NO: 239865 - RNA, 25 nt, Human
accuggagaagacuggggagaggga

SEQ ID NO: 239866 - RNA, 18 nt, Human
agggaccucugccuagga

SEQ ID NO: 239867 - RNA, 33 nt, Human
aucaauaaauacuaaaaaaaaaaaaaaaaaaaa

SEQ ID NO: 239868 - RNA, 21 nt, Human
ccccucuccgagaaacaccca

SEQ ID NO: 239869 - RNA, 20 nt, Human
cccugccacaucccccucuc

SEQ ID NO: 239870 - RNA, 23 nt, Human
ccucuccgagaaacacccaagaa

SEQ ID NO: 239871 - RNA, 23 nt, Human
cuaaaaaaaaaaaaaaaaaagau

SEQ ID NO: 239872 - RNA, 20 nt, Human
cuccgagaaacacccaagaa

SEQ ID NO: 239873 - RNA, 25 nt, Human
cuucucuccacuauuauccuaugac

SEQ ID NO: 239874 - RNA, 19 nt, Human
ggagaagacuggggagagg

SEQ ID NO: 239875 - RNA, 20 nt, Human
ggaggggacaccuggagaag

SEQ ID NO: 239876 - RNA, 18 nt, Human
uccgagaaacacccaaga

SEQ ID NO: 239877 - RNA, 21 nt, Human
ugacccugccacaucccccuc

SEQ ID NO: 239878 - RNA, 20 nt, Human
uggggagagggaauugggag

SEQ ID NO: 239879 - RNA, 24 nt, Human
aaagaagcccagcuuuauaaagag

SEQ ID NO: 239880 - RNA, 21 nt, Human
aagaaaagacaccauugaaag

SEQ ID NO: 239881 - RNA, 23 nt, Human
aagaaaagacaccauugaaagga

SEQ ID NO: 239882 - RNA, 21 nt, Human
acaaggcaagaaaagacacca

SEQ ID NO: 239883 - RNA, 24 nt, Human
accccaccucuccccugcccucag

SEQ ID NO: 239884 - RNA, 21 nt, Human
accugaggcucugaggacagg

SEQ ID NO: 239885 - RNA, 23 nt, Human
aggaaggaggaggcaugaugagg

SEQ ID NO: 239886 - RNA, 26 nt, Human
aggaaggaggaggcaugaugaggggg

SEQ ID NO: 239887 - RNA, 20 nt, Human
aggcagcugcagagacgaac

SEQ ID NO: 239888 - RNA, 22 nt, Human
aggcaugaugagggggagcugg

SEQ ID NO: 239889 - RNA, 19 nt, Human
agggggcguucccaguuac

SEQ ID NO: 239890 - RNA, 19 nt, Human
agggugggcagaccucagg

SEQ ID NO: 239891 - RNA, 21 nt, Human
auaguuccaggguugggccca

SEQ ID NO: 239892 - RNA, 21 nt, Human
caaacccccaaagccccaucu

SEQ ID NO: 239893 - RNA, 24 nt, Human
caaggcaagaaaagacaccauuga

SEQ ID NO: 239894 - RNA, 23 nt, Human
caccauugaaaggaauaguucca

SEQ ID NO: 239895 - RNA, 19 nt, Human
caccccaccucuccccugc

SEQ ID NO: 239896 - RNA, 20 nt, Human
caccucuccccugcccucaa

SEQ ID NO: 239897 - RNA, 24 nt, Human
cagcagcuuccuugcugucagucu

SEQ ID NO: 239898 - RNA, 21 nt, Human
cagcuuuauaaagagggggcg

SEQ ID NO: 239899 - RNA, 20 nt, Human
ccacacagcaacccugacuu

SEQ ID NO: 239900 - RNA, 20 nt, Human
ccagcuuuauaaagaggggg

SEQ ID NO: 239901 - RNA, 21 nt, Human
ccaggcagagggguucccaca

SEQ ID NO: 239902 - RNA, 20 nt, Human
ccaguuacuuaaucuaugcc

SEQ ID NO: 239903 - RNA, 27 nt, Human
ccccaaagccccaucuguagggugggg

SEQ ID NO: 239904 - RNA, 20 nt, Human
ccccaucuguagggugggca

SEQ ID NO: 239905 - RNA, 19 nt, Human
ccuucugaaacaaggcaag

SEQ ID NO: 239906 - RNA, 20 nt, Human
cgggggacacauggggcagg

SEQ ID NO: 239907 - RNA, 19 nt, Human
cugaaacaaggcaagaaaa

SEQ ID NO: 239908 - RNA, 22 nt, Human
cugcagagacgaacccagaucc

SEQ ID NO: 239909 - RNA, 18 nt, Human
cugcgugucugccacccc

SEQ ID NO: 239910 - RNA, 20 nt, Human
gaacugugcaguaagaauga

SEQ ID NO: 239911 - RNA, 20 nt, Human
gagcaaacccccaaagcccc

SEQ ID NO: 239912 - RNA, 21 nt, Human
gagcaaacccccaaagcccca

SEQ ID NO: 239913 - RNA, 20 nt, Human
gcaaacccccaaagccccau

SEQ ID NO: 239914 - RNA, 21 nt, Human
gcaagaaaagacaccauugaa

SEQ ID NO: 239915 - RNA, 23 nt, Human
gcagggguaggcagcugcagaga

SEQ ID NO: 239916 - RNA, 24 nt, Human
gcugucagucuuggcacaagauag

SEQ ID NO: 239917 - RNA, 22 nt, Human
ggagcaaacccccaaagcccca

SEQ ID NO: 239918 - RNA, 21 nt, Human
ggagcuggaaaguucugggug

SEQ ID NO: 239919 - RNA, 18 nt, Human
gggcagggguaggcagcu

SEQ ID NO: 239920 - RNA, 19 nt, Human
ggguucccacacagcaacc

SEQ ID NO: 239921 - RNA, 25 nt, Human
guucuggguguaaauagguacaggu

SEQ ID NO: 239922 - RNA, 21 nt, Human
uaagaaugaguugggcgaggu

SEQ ID NO: 239923 - RNA, 21 nt, Human
uaccugaggcucugaggacag

SEQ ID NO: 239924 - RNA, 22 nt, Human
uagguacaggugagcgauggca

SEQ ID NO: 239925 - RNA, 18 nt, Human
uccaggguugggcccagg

SEQ ID NO: 239926 - RNA, 21 nt, Human
uccaggugccaggcagagggg

SEQ ID NO: 239927 - RNA, 18 nt, Human
uccucagagccuggacca

SEQ ID NO: 239928 - RNA, 26 nt, Human
ucugccaccccaccucuccccugccc

SEQ ID NO: 239929 - RNA, 23 nt, Human
ugaaaacaugaggugggggacau

SEQ ID NO: 239930 - RNA, 21 nt, Human
ugcccucagguuaccuggccc

SEQ ID NO: 239931 - RNA, 22 nt, Human
uggaccauaccugaggcucuga

SEQ ID NO: 239932 - RNA, 22 nt, Human
uggagcaaacccccaaagcccc

SEQ ID NO: 239933 - RNA, 18 nt, Human
uguagggugggcagaccu

SEQ ID NO: 239934 - RNA, 22 nt, Human
acuguucuugcagccuggugag

SEQ ID NO: 239935 - RNA, 23 nt, Human
agaggguugugggugauuuuuuu

SEQ ID NO: 239936 - RNA, 19 nt, Human
cacugcccuuuccuugacg

SEQ ID NO: 239937 - RNA, 20 nt, Human
cagggcuggcagucugggcc

SEQ ID NO: 239938 - RNA, 24 nt, Human
ccaggccccggcguugggccgcgc

SEQ ID NO: 239939 - RNA, 18 nt, Human
cccaccucugccugugcc

SEQ ID NO: 239940 - RNA, 20 nt, Human
cccagugcagauaagggcca

SEQ ID NO: 239941 - RNA, 20 nt, Human
cccccgagaccuugccccug

SEQ ID NO: 239942 - RNA, 25 nt, Human
cccccgagaccuugccccugacguc

SEQ ID NO: 239943 - RNA, 19 nt, Human
ccccgcccccggcggcccg

SEQ ID NO: 239944 - RNA, 19 nt, Human
ccccugggaaggggaccgg

SEQ ID NO: 239945 - RNA, 19 nt, Human
cccgcccccggcggcccgg

SEQ ID NO: 239946 - RNA, 21 nt, Human
cccggcggcccgguuuccucc

SEQ ID NO: 239947 - RNA, 18 nt, Human
ccggcucagaggugcugc

SEQ ID NO: 239948 - RNA, 22 nt, Human
ccuugggggucgaugaucaccc

SEQ ID NO: 239949 - RNA, 20 nt, Human
cgcgccuccucgugggccuc

SEQ ID NO: 239950 - RNA, 19 nt, Human
cggcccugggccgaguccc

SEQ ID NO: 239951 - RNA, 19 nt, Human
cggccggaggaugcuggcc

SEQ ID NO: 239952 - RNA, 20 nt, Human
cucugccauguugcuuugcc

SEQ ID NO: 239953 - RNA, 24 nt, Human
cugacgucuucacugguccuucuu

SEQ ID NO: 239954 - RNA, 23 nt, Human
cuggcggcgcagcggccggagga

SEQ ID NO: 239955 - RNA, 22 nt, Human
cuugcagccuggugagugcccu

SEQ ID NO: 239956 - RNA, 19 nt, Human
cuugccccugacgucuuca

SEQ ID NO: 239957 - RNA, 23 nt, Human
gacccccgagaccuugccccuga

SEQ ID NO: 239958 - RNA, 22 nt, Human
gaggaugcuggcccagugcaga

SEQ ID NO: 239959 - RNA, 18 nt, Human
gagucccuggugcccucc

SEQ ID NO: 239960 - RNA, 18 nt, Human
gcccugggccgagucccu

SEQ ID NO: 239961 - RNA, 19 nt, Human
gggccagggugugguuucc

SEQ ID NO: 239962 - RNA, 21 nt, Human
gugagcggcucccgggccggc

SEQ ID NO: 239963 - RNA, 18 nt, Human
ucagggcuggcagucugg

SEQ ID NO: 239964 - RNA, 19 nt, Human
uccgcguagguccccccca

SEQ ID NO: 239965 - RNA, 21 nt, Human
uccgcguaggucccccccagg

SEQ ID NO: 239966 - RNA, 26 nt, Human
uccuaugacugcucugccauguugcu

SEQ ID NO: 239967 - RNA, 20 nt, Human
uccucgugggccucggaagg

SEQ ID NO: 239968 - RNA, 25 nt, Human
ugacugcucugccauguugcuuugg

SEQ ID NO: 239969 - RNA, 20 nt, Human
ugaggcgggcacauggaccc

SEQ ID NO: 239970 - RNA, 23 nt, Human
ugcagccuggugagugcccuggc

SEQ ID NO: 239971 - RNA, 24 nt, Human
ugccccugacgucuucacuggucc

SEQ ID NO: 239972 - RNA, 21 nt, Human
ugccugugccugaggcgggca

SEQ ID NO: 239973 - RNA, 20 nt, Human
ugcuccaggccccggcguug

SEQ ID NO: 239974 - RNA, 19 nt, Human
ugggccgagucccuggugc

SEQ ID NO: 239975 - RNA, 19 nt, Human
uucuccccgcccccggcgg

SEQ ID NO: 239976 - RNA, 23 nt, Human
uuuccuaugacugcucugccaug

SEQ ID NO: 239977 - RNA, 23 nt, Human
aagccaaagcacaaagaaauguc

SEQ ID NO: 239978 - RNA, 22 nt, Human
accagugaugguuacuuuuccu

SEQ ID NO: 239979 - RNA, 20 nt, Human
agaggaacuggcugucucug

SEQ ID NO: 239980 - RNA, 19 nt, Human
agaguacagaauacuuucc

SEQ ID NO: 239981 - RNA, 30 nt, Human
agaguacagaauacuuucccauuuagaggg

SEQ ID NO: 239982 - RNA, 21 nt, Human
agcggcacgcggcccggcgcg

SEQ ID NO: 239983 - RNA, 21 nt, Human
aggcugcagcgcgucuggccc

SEQ ID NO: 239984 - RNA, 23 nt, Human
ccagugaugguuacuuuuccucu

SEQ ID NO: 239985 - RNA, 23 nt, Human
cgcgacggggcgguccagcagga

SEQ ID NO: 239986 - RNA, 23 nt, Human
cggcgcggcgggagaggaacugg

SEQ ID NO: 239987 - RNA, 25 nt, Human
cucuaaaugaggcagccaccccugc

SEQ ID NO: 239988 - RNA, 19 nt, Human
cugcguauggggaggcugc

SEQ ID NO: 239989 - RNA, 22 nt, Human
gaaaucauaagugcaaccagug

SEQ ID NO: 239990 - RNA, 19 nt, Human
gcaauuauuggggauucau

SEQ ID NO: 239991 - RNA, 22 nt, Human
gcacggcagaugauccccgcac

SEQ ID NO: 239992 - RNA, 24 nt, Human
gccccgcccgcuugccgcgggcug

SEQ ID NO: 239993 - RNA, 25 nt, Human
gcgcggcgaggggcugcuggcgcgg

SEQ ID NO: 239994 - RNA, 19 nt, Human
gcugcagcgcgucuggccc

SEQ ID NO: 239995 - RNA, 20 nt, Human
ggcccggaggcgccacggcc

SEQ ID NO: 239996 - RNA, 18 nt, Human
ggcccggcgcggcgggag

SEQ ID NO: 239997 - RNA, 22 nt, Human
ggccgccccgcccgcuugccgc

SEQ ID NO: 239998 - RNA, 22 nt, Human
ggcugcuggccgggaacgcugg

SEQ ID NO: 239999 - RNA, 19 nt, Human
ggggagcgagcggcacgcg

SEQ ID NO: 240000 - RNA, 18 nt, Human
ggggauucauugcaaugg

SEQ ID NO: 240001 - RNA, 22 nt, Human
uaguugggugcauuuuuggaga

SEQ ID NO: 240002 - RNA, 22 nt, Human
uccacggugacuugaguucaga

SEQ ID NO: 240003 - RNA, 18 nt, Human
ugaaaguuucggggcggc

SEQ ID NO: 240004 - RNA, 20 nt, Human
ugaaaucauaagugcaacca

SEQ ID NO: 240005 - RNA, 20 nt, Human
ugaaaucauaagugcaacca

SEQ ID NO: 240006 - RNA, 20 nt, Human
ugaaaucauaagugcaacca

SEQ ID NO: 240007 - RNA, 22 nt, Human
ugccaaauggacgggucucccu

SEQ ID NO: 240008 - RNA, 19 nt, Human
uggcccggaggcgccacgg

SEQ ID NO: 240009 - RNA, 29 nt, Human
uguaaacauagagcuaguugggugcauuc

SEQ ID NO: 240010 - RNA, 20 nt, Human
uguccauuuguaaacauaga

SEQ ID NO: 240011 - RNA, 21 nt, Human
uuaccagcugcugaggacaag

SEQ ID NO: 240012 - RNA, 20 nt, Human
uuuguaaacauagagcuagu

SEQ ID NO: 240013 - RNA, 23 nt, Human
aaacauuuuaacacugcaaaaca

SEQ ID NO: 240014 - RNA, 20 nt, Human
aacacauauauaaaaauaca

SEQ ID NO: 240015 - RNA, 22 nt, Human
aacauacuagaauaugaucuaa

SEQ ID NO: 240016 - RNA, 26 nt, Human
aacuuuuuuuuuuuucuuggggggcc

SEQ ID NO: 240017 - RNA, 23 nt, Human
aagaaaaaugacauaguaaauga

SEQ ID NO: 240018 - RNA, 20 nt, Human
acaauagauuccucaucuuc

SEQ ID NO: 240019 - RNA, 20 nt, Human
acacuuuaugguauaggguu

SEQ ID NO: 240020 - RNA, 20 nt, Human
acagcauuaucccuauuauu

SEQ ID NO: 240021 - RNA, 19 nt, Human
acaguaguugguuucaaac

SEQ ID NO: 240022 - RNA, 23 nt, Human
acuaaauuauuuccauuaucaau

SEQ ID NO: 240023 - RNA, 22 nt, Human
auaaaaauacagacacugcaug

SEQ ID NO: 240024 - RNA, 25 nt, Human
auagaaaccaugaaaaacauuuaca

SEQ ID NO: 240025 - RNA, 18 nt, Human
caaaacauuuuaacacug

SEQ ID NO: 240026 - RNA, 20 nt, Human
caacgcggccccgcgcuacc

SEQ ID NO: 240027 - RNA, 25 nt, Human
cacaguugagaaauaucaagcauac

SEQ ID NO: 240028 - RNA, 22 nt, Human
cacgcucaggcgcgugcgcgcc

SEQ ID NO: 240029 - RNA, 19 nt, Human
cagcagaaaaauuaacaca

SEQ ID NO: 240030 - RNA, 24 nt, Human
cagcagaaaaauuaacacaguuga

SEQ ID NO: 240031 - RNA, 19 nt, Human
caguaaucuggaaauuuug

SEQ ID NO: 240032 - RNA, 18 nt, Human
ccaggguccgcccugccc

SEQ ID NO: 240033 - RNA, 18 nt, Human
cccauaaguuuguuuuca

SEQ ID NO: 240034 - RNA, 26 nt, Human
cccgcgcuaccuuccgcgcgcgcccg

SEQ ID NO: 240035 - RNA, 19 nt, Human
cgcccggccgcggcccaag

SEQ ID NO: 240036 - RNA, 22 nt, Human
cgcccggccgcggcccaagggc

SEQ ID NO: 240037 - RNA, 20 nt, Human
cgcucaggcgcgugcgcgcc

SEQ ID NO: 240038 - RNA, 26 nt, Human
cggcccaagggcgugcgagcggcgag

SEQ ID NO: 240039 - RNA, 26 nt, Human
cgggcgcacgcucaggcgcgugcgcg

SEQ ID NO: 240040 - RNA, 21 nt, Human
cguccaggguccgcccugccc

SEQ ID NO: 240041 - RNA, 22 nt, Human
gaaggaagagcgggcgcccggc

SEQ ID NO: 240042 - RNA, 19 nt, Human
gccccgcgcuaccuuccgc

SEQ ID NO: 240043 - RNA, 24 nt, Human
gcggccccgcgcuaccuuccgcgc

SEQ ID NO: 240044 - RNA, 24 nt, Human
ggacaauaaagaaaaaacaaacuu

SEQ ID NO: 240045 - RNA, 22 nt, Human
gggcgcacgcucaggcgcgugc

SEQ ID NO: 240046 - RNA, 24 nt, Human
gguaaagaaaaaugacauaguaaa

SEQ ID NO: 240047 - RNA, 18 nt, Human
uaaaaauacagacacugc

SEQ ID NO: 240048 - RNA, 27 nt, Human
uaaaagaucauaaauuucucaugagga

SEQ ID NO: 240049 - RNA, 22 nt, Human
uacagcacaauauuucaaugga

SEQ ID NO: 240050 - RNA, 24 nt, Human
uacagcacaauauuucaauggaau

SEQ ID NO: 240051 - RNA, 19 nt, Human
uauauaugaacacauauau

SEQ ID NO: 240052 - RNA, 18 nt, Human
uauaucugugacccagaa

SEQ ID NO: 240053 - RNA, 22 nt, Human
uauaucugugacccagaauguc

SEQ ID NO: 240054 - RNA, 19 nt, Human
uauaugaacacauauauaa

SEQ ID NO: 240055 - RNA, 22 nt, Human
uauguauauaugaacacauaua

SEQ ID NO: 240056 - RNA, 24 nt, Human
uauguauauaugaacacauauaua

SEQ ID NO: 240057 - RNA, 24 nt, Human
uauuaaucuguaugguaacuacac

SEQ ID NO: 240058 - RNA, 23 nt, Human
ucagucuuaaagauauuucagaa

SEQ ID NO: 240059 - RNA, 18 nt, Human
uccgcgcgcgcccgcgcg

SEQ ID NO: 240060 - RNA, 22 nt, Human
uccgcgcgcgcccgcgcgucca

SEQ ID NO: 240061 - RNA, 23 nt, Human
uccgcgcgcgcccgcgcguccag

SEQ ID NO: 240062 - RNA, 22 nt, Human
uccucaucuucuacaguaguug

SEQ ID NO: 240063 - RNA, 19 nt, Human
ucuguguuauuggcaugua

SEQ ID NO: 240064 - RNA, 24 nt, Human
ugaaaauaaagcaaaaaauuacaa

SEQ ID NO: 240065 - RNA, 24 nt, Human
ugaaggacaauaaagaaaaaacaa

SEQ ID NO: 240066 - RNA, 23 nt, Human
ugacaguagcugucuauugcaga

SEQ ID NO: 240067 - RNA, 18 nt, Human
ugagaaauaucaagcaua

SEQ ID NO: 240068 - RNA, 24 nt, Human
ugaucuaauuauucuuucaguugu

SEQ ID NO: 240069 - RNA, 21 nt, Human
ugcuacauauuaaucuguaug

SEQ ID NO: 240070 - RNA, 20 nt, Human
ugcuauuuuuaugucugcau

SEQ ID NO: 240071 - RNA, 24 nt, Human
uggcuucauuauuaacauccugua

SEQ ID NO: 240072 - RNA, 20 nt, Human
uguagaagugaaauaacagu

SEQ ID NO: 240073 - RNA, 23 nt, Human
uguuauuggcauguauuugcaaa

SEQ ID NO: 240074 - RNA, 21 nt, Human
uuacuaaauuauuuccauuau

SEQ ID NO: 240075 - RNA, 21 nt, Human
uucaaauaauuuuuaccagua

SEQ ID NO: 240076 - RNA, 18 nt, Human
uugcuacauauuaaucug

SEQ ID NO: 240077 - RNA, 24 nt, Human
uuuaacacugcaaaacauuagaaa

SEQ ID NO: 240078 - RNA, 18 nt, Human
uuucuugacaauaaacag

SEQ ID NO: 240079 - RNA, 26 nt, Human
uuuuuuuuucuugagagaaaagaguc

SEQ ID NO: 240080 - RNA, 19 nt, Human
uuuuuuuuuucuugagaga

SEQ ID NO: 240081 - RNA, 25 nt, Human
aaaaaagaacggaauguacuggaga

SEQ ID NO: 240082 - RNA, 19 nt, Human
aaaauaaccacauuaguga

SEQ ID NO: 240083 - RNA, 19 nt, Human
aacacggugaaacccuguc

SEQ ID NO: 240084 - RNA, 20 nt, Human
aacacggugaaacccugucu

SEQ ID NO: 240085 - RNA, 21 nt, Human
aacacggugaaacccugucuc

SEQ ID NO: 240086 - RNA, 21 nt, Human
aaggaacagcaauuuagaaag

SEQ ID NO: 240087 - RNA, 24 nt, Human
aauggcgugaacccgggaggugga

SEQ ID NO: 240088 - RNA, 22 nt, Human
acagagcgagacugucucaaaa

SEQ ID NO: 240089 - RNA, 24 nt, Human
acccugucucuacuaaaaauacaa

SEQ ID NO: 240090 - RNA, 24 nt, Human
acugcacuccagccugggcgacag

SEQ ID NO: 240091 - RNA, 26 nt, Human
acugcacuccagccugggcgacagag

SEQ ID NO: 240092 - RNA, 22 nt, Human
agaaagaaacacacuuuaagaa

SEQ ID NO: 240093 - RNA, 24 nt, Human
agcacuuugggaggccgagguggg

SEQ ID NO: 240094 - RNA, 21 nt, Human
aggcaggagaauggcgugaac

SEQ ID NO: 240095 - RNA, 24 nt, Human
aggcaggagaauggcgugaacccg

SEQ ID NO: 240096 - RNA, 21 nt, Human
aggccgagguggguggaucac

SEQ ID NO: 240097 - RNA, 19 nt, Human
aggcugaggcaggagaaug

SEQ ID NO: 240098 - RNA, 21 nt, Human
agguggagguugcagugagcc

SEQ ID NO: 240099 - RNA, 24 nt, Human
agguggagguugcagugagccgag

SEQ ID NO: 240100 - RNA, 24 nt, Human
agguggguggaucacaaggucagg

SEQ ID NO: 240101 - RNA, 24 nt, Human
aguggcucacgccuguaaucccag

SEQ ID NO: 240102 - RNA, 24 nt, Human
caacaaaaagugguuauuuuuacu

SEQ ID NO: 240103 - RNA, 24 nt, Human
cacgccuguaaucccagcacuuug

SEQ ID NO: 240104 - RNA, 24 nt, Human
cacuccagccugggcgacagagcg

SEQ ID NO: 240105 - RNA, 19 nt, Human
cacugcacuccagccuggg

SEQ ID NO: 240106 - RNA, 20 nt, Human
cacugcacuccagccugggc

SEQ ID NO: 240107 - RNA, 22 nt, Human
cacugcacuccagccugggcga

SEQ ID NO: 240108 - RNA, 23 nt, Human
cacugcacuccagccugggcgac

SEQ ID NO: 240109 - RNA, 24 nt, Human
cacugcacuccagccugggcgaca

SEQ ID NO: 240110 - RNA, 23 nt, Human
cagcaauuuagaaagaaacacac

SEQ ID NO: 240111 - RNA, 21 nt, Human
cagcacuuugggaggccgagg

SEQ ID NO: 240112 - RNA, 24 nt, Human
cagcacuuugggaggccgaggugg

SEQ ID NO: 240113 - RNA, 24 nt, Human
cagcuacucgggaggcugaggcag

SEQ ID NO: 240114 - RNA, 20 nt, Human
ccacugcacuccagccuggg

SEQ ID NO: 240115 - RNA, 21 nt, Human
ccacugcacuccagccugggc

SEQ ID NO: 240116 - RNA, 21 nt, Human
ccacugcacuccagccugggc

SEQ ID NO: 240117 - RNA, 23 nt, Human
ccacugcacuccagccugggcga

SEQ ID NO: 240118 - RNA, 23 nt, Human
ccacugcacuccagccugggcga

SEQ ID NO: 240119 - RNA, 24 nt, Human
ccacugcacuccagccugggcgac

SEQ ID NO: 240120 - RNA, 21 nt, Human
cccgggagguggagguugcag

SEQ ID NO: 240121 - RNA, 22 nt, Human
cccguaaucccagcuacucggg

SEQ ID NO: 240122 - RNA, 23 nt, Human
ccuacucccuuaaugugagagag

SEQ ID NO: 240123 - RNA, 22 nt, Human
ccuggcuaacacggugaaaccc

SEQ ID NO: 240124 - RNA, 24 nt, Human
ccuggcuaacacggugaaacccug

SEQ ID NO: 240125 - RNA, 22 nt, Human
ccuguaaucccagcacuuuggg

SEQ ID NO: 240126 - RNA, 20 nt, Human
ccuucaucagcugguauuuu

SEQ ID NO: 240127 - RNA, 24 nt, Human
cgagaccauccuggcuaacacggu

SEQ ID NO: 240128 - RNA, 26 nt, Human
cgagguggguggaucacaaggucagg

SEQ ID NO: 240129 - RNA, 20 nt, Human
cgccacugcacuccagccug

SEQ ID NO: 240130 - RNA, 23 nt, Human
cgcccguaaucccagcuacucgg

SEQ ID NO: 240131 - RNA, 23 nt, Human
cgcccguaaucccagcuacucgg

SEQ ID NO: 240132 - RNA, 24 nt, Human
cgcccguaaucccagcuacucggg

SEQ ID NO: 240133 - RNA, 29 nt, Human
cgggagguggagguugcagugacaacggu

SEQ ID NO: 240134 - RNA, 24 nt, Human
cgggagguggagguugcagugagc

SEQ ID NO: 240135 - RNA, 26 nt, Human
cuauuugcaaacugaaaaauguugua

SEQ ID NO: 240136 - RNA, 22 nt, Human
cucacgccuguaaucccagcac

SEQ ID NO: 240137 - RNA, 24 nt, Human
cucacgccuguaaucccagcacuu

SEQ ID NO: 240138 - RNA, 30 nt, Human
cugaauguggccgggcgcaguggcucacgg

SEQ ID NO: 240139 - RNA, 18 nt, Human
cuggcuaacacggugaaa

SEQ ID NO: 240140 - RNA, 24 nt, Human
cuggcuaacacggugaaacccugu

SEQ ID NO: 240141 - RNA, 19 nt, Human
cugucucaaaaaaaaaaaa

SEQ ID NO: 240142 - RNA, 19 nt, Human
gaaacccugucucuacuaa

SEQ ID NO: 240143 - RNA, 20 nt, Human
gaauguggccgggcgcagug

SEQ ID NO: 240144 - RNA, 23 nt, Human
gagauugcgccacugcacuccag

SEQ ID NO: 240145 - RNA, 22 nt, Human
gagguggguggaucacaagguc

SEQ ID NO: 240146 - RNA, 23 nt, Human
gagguugcagugagccgagauug

SEQ ID NO: 240147 - RNA, 24 nt, Human
gcacuccagccugggcgacagagc

SEQ ID NO: 240148 - RNA, 22 nt, Human
gccacugcacuccagccugggc

SEQ ID NO: 240149 - RNA, 24 nt, Human
gccacugcacuccagccugggcga

SEQ ID NO: 240150 - RNA, 20 nt, Human
gcgcaguggcucacgccugu

SEQ ID NO: 240151 - RNA, 24 nt, Human
gcuaacacggugaaacccugucuc

SEQ ID NO: 240152 - RNA, 22 nt, Human
gcugaggcaggagaauggcgug

SEQ ID NO: 240153 - RNA, 22 nt, Human
ggagguugcagugagccgagau

SEQ ID NO: 240154 - RNA, 24 nt, Human
ggagguugcagugagccgagauug

SEQ ID NO: 240155 - RNA, 20 nt, Human
ggcgugguggcgggcgcccg

SEQ ID NO: 240156 - RNA, 24 nt, Human
gggcgcaguggcucacgccuguaa

SEQ ID NO: 240157 - RNA, 21 nt, Human
gguggaucacaaggucaggag

SEQ ID NO: 240158 - RNA, 21 nt, Human
gguuauuucuuugauaagaac

SEQ ID NO: 240159 - RNA, 21 nt, Human
guugcagugagccgagauugc

SEQ ID NO: 240160 - RNA, 24 nt, Human
guuugaaggggaaauaaugguagu

SEQ ID NO: 240161 - RNA, 22 nt, Human
uaaaauaaccacauuagugaac

SEQ ID NO: 240162 - RNA, 22 nt, Human
uaacacggugaaacccugucuc

SEQ ID NO: 240163 - RNA, 24 nt, Human
uaacacggugaaacccugucucua

SEQ ID NO: 240164 - RNA, 24 nt, Human
uaagaaaucaaaauucucaauuca

SEQ ID NO: 240165 - RNA, 23 nt, Human
uagaaagaaacacacuuuaagaa

SEQ ID NO: 240166 - RNA, 24 nt, Human
uauucuacuccuuuaaaaauuuca

SEQ ID NO: 240167 - RNA, 23 nt, Human
ucaaaaaaaaaaaagaacggaau

SEQ ID NO: 240168 - RNA, 18 nt, Human
ucacaaggucaggagauc

SEQ ID NO: 240169 - RNA, 24 nt, Human
ucacaaggucaggagaucgagacc

SEQ ID NO: 240170 - RNA, 22 nt, Human
ucagaugccuucaucagcuggu

SEQ ID NO: 240171 - RNA, 23 nt, Human
uccagccugggcgacagagcgag

SEQ ID NO: 240172 - RNA, 24 nt, Human
uccagccugggcgacagagcgaga

SEQ ID NO: 240173 - RNA, 22 nt, Human
ucccuuaaugugagagagacaa

SEQ ID NO: 240174 - RNA, 22 nt, Human
ucucuacuaaaaauacaaaaaa

SEQ ID NO: 240175 - RNA, 23 nt, Human
ugaacccgggagguggagguugc

SEQ ID NO: 240176 - RNA, 19 nt, Human
ugagagagacaaaaugagc

SEQ ID NO: 240177 - RNA, 22 nt, Human
ugagccgagauugcgccacugc

SEQ ID NO: 240178 - RNA, 24 nt, Human
ugaggcaggagaauggcgugaacc

SEQ ID NO: 240179 - RNA, 25 nt, Human
ugaggcaggagaauggcgugaaccc

SEQ ID NO: 240180 - RNA, 24 nt, Human
ugauaagaacugaauguggccggg

SEQ ID NO: 240181 - RNA, 24 nt, Human
ugcaaacugaaaaauguuguaggc

SEQ ID NO: 240182 - RNA, 24 nt, Human
uggcgugaacccgggagguggagg

SEQ ID NO: 240183 - RNA, 22 nt, Human
uggcucacgccuguaaucccag

SEQ ID NO: 240184 - RNA, 24 nt, Human
uggcucacgccuguaaucccagca

SEQ ID NO: 240185 - RNA, 23 nt, Human
ugggaggccgagguggguggauc

SEQ ID NO: 240186 - RNA, 24 nt, Human
ugggaggccgagguggguggauca

SEQ ID NO: 240187 - RNA, 18 nt, Human
uuagccgggcgugguggc

SEQ ID NO: 240188 - RNA, 24 nt, Human
uuagccgggcgugguggcgggcgc

SEQ ID NO: 240189 - RNA, 20 nt, Human
uugaaggggaaauaauggua

SEQ ID NO: 240190 - RNA, 19 nt, Human
uugcagugagccgagauug

SEQ ID NO: 240191 - RNA, 22 nt, Human
uugcagugagccgagauugcgc

SEQ ID NO: 240192 - RNA, 23 nt, Human
uugcgccacugcacuccagccug

SEQ ID NO: 240193 - RNA, 25 nt, Human
uugggaggccgagguggguggauca

SEQ ID NO: 240194 - RNA, 18 nt, Human
uuguauuuuuuacaucau

SEQ ID NO: 240195 - RNA, 26 nt, Human
uuuagaaagaaacacacuuuaagaaa

SEQ ID NO: 240196 - RNA, 23 nt, Human
aaaaaugacaaaccagaaacacu

SEQ ID NO: 240197 - RNA, 24 nt, Human
aaaaggcuacccauaauagaauuc

SEQ ID NO: 240198 - RNA, 22 nt, Human
aaacaaguauaaauauuacauu

SEQ ID NO: 240199 - RNA, 18 nt, Human
aaauaacaacaacaacaa

SEQ ID NO: 240200 - RNA, 19 nt, Human
aauacaugccugaggugag

SEQ ID NO: 240201 - RNA, 20 nt, Human
aaugucaaacagaagaaaac

SEQ ID NO: 240202 - RNA, 23 nt, Human
acaaaaaugacaaaccagaaaca

SEQ ID NO: 240203 - RNA, 22 nt, Human
acaaaagcuccaaaagggcaca

SEQ ID NO: 240204 - RNA, 25 nt, Human
acaacaacaacaaaaaugacaaacc

SEQ ID NO: 240205 - RNA, 19 nt, Human
acaacaacaacaacaacaa

SEQ ID NO: 240206 - RNA, 19 nt, Human
acaacaacaacaacaacaa

SEQ ID NO: 240207 - RNA, 27 nt, Human
acaacaacaacaacaacaaaaaugaca

SEQ ID NO: 240208 - RNA, 22 nt, Human
acaacaacaacaacaacaacaa

SEQ ID NO: 240209 - RNA, 24 nt, Human
acaacaacaacaacaacaacaaaa

SEQ ID NO: 240210 - RNA, 24 nt, Human
acauuguuagcuuauuuaacauuu

SEQ ID NO: 240211 - RNA, 20 nt, Human
acgggagaggccaggcggug

SEQ ID NO: 240212 - RNA, 20 nt, Human
acuaaaaacaauaaaaauuu

SEQ ID NO: 240213 - RNA, 24 nt, Human
agaaacugguaagugaccuaaaua

SEQ ID NO: 240214 - RNA, 19 nt, Human
agaacaucuugguccacag

SEQ ID NO: 240215 - RNA, 19 nt, Human
agagacaggugaggagaaa

SEQ ID NO: 240216 - RNA, 24 nt, Human
aggagaggggauaugacaaaaugc

SEQ ID NO: 240217 - RNA, 18 nt, Human
aggcuuucuuucucaguu

SEQ ID NO: 240218 - RNA, 23 nt, Human
agguuuucucuguuuucaacuag

SEQ ID NO: 240219 - RNA, 18 nt, Human
aguuuaucaucaaauaga

SEQ ID NO: 240220 - RNA, 22 nt, Human
auaacaacaacaacaacaaaac

SEQ ID NO: 240221 - RNA, 27 nt, Human
auaacaacaacaacaacaacaacaaaa

SEQ ID NO: 240222 - RNA, 23 nt, Human
auuuuauucucucccuucucuca

SEQ ID NO: 240223 - RNA, 19 nt, Human
caaaaaaugcugaaccucc

SEQ ID NO: 240224 - RNA, 23 nt, Human
caaaaagucugugcauaacucag

SEQ ID NO: 240225 - RNA, 24 nt, Human
caaaaaugacaaaccagaaacacu

SEQ ID NO: 240226 - RNA, 23 nt, Human
caaaagcuccaaaagggcacaga

SEQ ID NO: 240227 - RNA, 22 nt, Human
caaaagggcacagaaacuggua

SEQ ID NO: 240228 - RNA, 21 nt, Human
caacaaaaaugacaaaccaga

SEQ ID NO: 240229 - RNA, 23 nt, Human
caacaacaaaaaugacaaaccag

SEQ ID NO: 240230 - RNA, 30 nt, Human
caacaacaaaaaugacaaaccagaaacacc

SEQ ID NO: 240231 - RNA, 25 nt, Human
caacaacaacaacaaaaaugacaaa

SEQ ID NO: 240232 - RNA, 20 nt, Human
caacaacaacaacaacaaaa

SEQ ID NO: 240233 - RNA, 23 nt, Human
caaugaauuuauaguuuaucauc

SEQ ID NO: 240234 - RNA, 27 nt, Human
cagaaggauaagccucuucuucccacu

SEQ ID NO: 240235 - RNA, 19 nt, Human
cagcagcaggccugaauua

SEQ ID NO: 240236 - RNA, 24 nt, Human
ccucuucuucccacucuaaaaauc

SEQ ID NO: 240237 - RNA, 23 nt, Human
ccuuauaauugguaaaaaggcua

SEQ ID NO: 240238 - RNA, 23 nt, Human
cggcagccuaaaggaacgggaga

SEQ ID NO: 240239 - RNA, 19 nt, Human
cuaaauauuagaaaaauaa

SEQ ID NO: 240240 - RNA, 24 nt, Human
cuaagacucuggagcacucaguag

SEQ ID NO: 240241 - RNA, 19 nt, Human
cucuguuuucaacuagcug

SEQ ID NO: 240242 - RNA, 21 nt, Human
cuggagcacucaguagagagg

SEQ ID NO: 240243 - RNA, 24 nt, Human
cuuauaauugguaaaaaggcuacc

SEQ ID NO: 240244 - RNA, 18 nt, Human
cuuggaauaaaaucuuca

SEQ ID NO: 240245 - RNA, 19 nt, Human
cuugguccacagacaaugg

SEQ ID NO: 240246 - RNA, 24 nt, Human
gagaaaaccaggccaauacaaaua

SEQ ID NO: 240247 - RNA, 19 nt, Human
gcuccaaaagggcacagaa

SEQ ID NO: 240248 - RNA, 20 nt, Human
ggcuaaagaaauacagggug

SEQ ID NO: 240249 - RNA, 27 nt, Human
gguauagaguaaauaacaacaacaacu

SEQ ID NO: 240250 - RNA, 24 nt, Human
ggugaggagaaaauacauaguaaa

SEQ ID NO: 240251 - RNA, 18 nt, Human
guacagacugccugucug

SEQ ID NO: 240252 - RNA, 18 nt, Human
uaaaaauaacaacaagcc

SEQ ID NO: 240253 - RNA, 19 nt, Human
uaaaaauaacaacaagccc

SEQ ID NO: 240254 - RNA, 24 nt, Human
uaaaauaacauucuggaaacaagu

SEQ ID NO: 240255 - RNA, 30 nt, Human
uaaauuuuccuuauaauugguaaaaaggcc

SEQ ID NO: 240256 - RNA, 21 nt, Human
uaagugaauguucauguucac

SEQ ID NO: 240257 - RNA, 18 nt, Human
uacagggugagaaugaag

SEQ ID NO: 240258 - RNA, 21 nt, Human
uaccaagaaaacaaguacaaa

SEQ ID NO: 240259 - RNA, 21 nt, Human
uagcccuuuagccaagaguuc

SEQ ID NO: 240260 - RNA, 24 nt, Human
uaguauaucacugccuuacauaac

SEQ ID NO: 240261 - RNA, 20 nt, Human
uaugcugcaaaaaaugcuga

SEQ ID NO: 240262 - RNA, 23 nt, Human
ucaaaauacaugccugaggugag

SEQ ID NO: 240263 - RNA, 18 nt, Human
ucacugccuuacauaacu

SEQ ID NO: 240264 - RNA, 23 nt, Human
ucacugccuuacauaacugugga

SEQ ID NO: 240265 - RNA, 20 nt, Human
uccaaaagggcacagaaacu

SEQ ID NO: 240266 - RNA, 21 nt, Human
ucugugcauaacucagcagca

SEQ ID NO: 240267 - RNA, 19 nt, Human
ugaggugagacugcuuggg

SEQ ID NO: 240268 - RNA, 18 nt, Human
ugcugaguuuuauaagac

SEQ ID NO: 240269 - RNA, 24 nt, Human
uggaauaaaaucuucauuugugga

SEQ ID NO: 240270 - RNA, 23 nt, Human
ugguccacagacaauggaaugga

SEQ ID NO: 240271 - RNA, 20 nt, Human
ugucaaacagaagaaaaccc

SEQ ID NO: 240272 - RNA, 25 nt, Human
uuaacauuuguuccuucacuauuuu

SEQ ID NO: 240273 - RNA, 24 nt, Human
uuagaaaaauaaggagaggggaua

SEQ ID NO: 240274 - RNA, 20 nt, Human
uucauuuguggaaauggaau

SEQ ID NO: 240275 - RNA, 23 nt, Human
uugaauaaaaauaacaacaagcc

SEQ ID NO: 240276 - RNA, 24 nt, Human
uuuacaugugaaagaaucaucacg

SEQ ID NO: 240277 - RNA, 22 nt, Human
uuucucuguuuucaacuagcug

SEQ ID NO: 240278 - RNA, 20 nt, Human
aacacgcccaggccacagaa

SEQ ID NO: 240279 - RNA, 24 nt, Human
aacacgcccaggccacagaagcca

SEQ ID NO: 240280 - RNA, 23 nt, Human
aacuugccacucagggcccccca

SEQ ID NO: 240281 - RNA, 19 nt, Human
aagauggggggaucucgcc

SEQ ID NO: 240282 - RNA, 22 nt, Human
aaggggcugaagccagcagugg

SEQ ID NO: 240283 - RNA, 19 nt, Human
acacaccugcauacaccca

SEQ ID NO: 240284 - RNA, 18 nt, Human
acaccguggccccauggg

SEQ ID NO: 240285 - RNA, 23 nt, Human
acacgcccaggccacagaagcca

SEQ ID NO: 240286 - RNA, 18 nt, Human
acaucuuguggaaacugg

SEQ ID NO: 240287 - RNA, 21 nt, Human
accgaccugggagcugaccuc

SEQ ID NO: 240288 - RNA, 20 nt, Human
acucugggccaccuccuccc

SEQ ID NO: 240289 - RNA, 23 nt, Human
acucugggccaccuccucccagc

SEQ ID NO: 240290 - RNA, 24 nt, Human
acugaccuacaucugggguucugc

SEQ ID NO: 240291 - RNA, 21 nt, Human
agagaauacaaacaucuuguc

SEQ ID NO: 240292 - RNA, 22 nt, Human
agagggcagcccuccuuccaca

SEQ ID NO: 240293 - RNA, 19 nt, Human
agcaggucacuuccccaag

SEQ ID NO: 240294 - RNA, 26 nt, Human
agccagcagugguggccgggccagca

SEQ ID NO: 240295 - RNA, 23 nt, Human
agccccugugaaaaccaggccug

SEQ ID NO: 240296 - RNA, 21 nt, Human
agccgguagucuucucaguag

SEQ ID NO: 240297 - RNA, 24 nt, Human
agcgaugcacuguuucgaagggcc

SEQ ID NO: 240298 - RNA, 18 nt, Human
aggagccuugggugacag

SEQ ID NO: 240299 - RNA, 20 nt, Human
aggagccuugggugacaggc

SEQ ID NO: 240300 - RNA, 23 nt, Human
aggaggucauugagcauggucuu

SEQ ID NO: 240301 - RNA, 18 nt, Human
aggcaggaguugacagca

SEQ ID NO: 240302 - RNA, 22 nt, Human
aggcagggcaggcaggcacggc

SEQ ID NO: 240303 - RNA, 20 nt, Human
aggcuucuggguaggccccu

SEQ ID NO: 240304 - RNA, 20 nt, Human
agggagggagggacaggagc

SEQ ID NO: 240305 - RNA, 23 nt, Human
agggcccuuggcauguaauuuca

SEQ ID NO: 240306 - RNA, 18 nt, Human
aggggcaaggcagggcag

SEQ ID NO: 240307 - RNA, 19 nt, Human
agguacucgacacuguccg

SEQ ID NO: 240308 - RNA, 22 nt, Human
aggucguuuuuauucuucaagu

SEQ ID NO: 240309 - RNA, 22 nt, Human
agguuguugguuauuuuggcuc

SEQ ID NO: 240310 - RNA, 21 nt, Human
agugacaagggucagcauaga

SEQ ID NO: 240311 - RNA, 23 nt, Human
auagagacagguaaggccacuga

SEQ ID NO: 240312 - RNA, 18 nt, Human
caagagggcagcccuccu

SEQ ID NO: 240313 - RNA, 20 nt, Human
caagggccucccggcucagc

SEQ ID NO: 240314 - RNA, 19 nt, Human
cacuacaccaggagagggu

SEQ ID NO: 240315 - RNA, 22 nt, Human
cacuccaaaauucaccucaagu

SEQ ID NO: 240316 - RNA, 19 nt, Human
cacuggccaguugcaaacu

SEQ ID NO: 240317 - RNA, 20 nt, Human
cacuguacaccguggcccca

SEQ ID NO: 240318 - RNA, 22 nt, Human
cagcaggugagcucucgguccu

SEQ ID NO: 240319 - RNA, 19 nt, Human
cagccacaacaagaaaggg

SEQ ID NO: 240320 - RNA, 18 nt, Human
cagccccgaucugccccc

SEQ ID NO: 240321 - RNA, 19 nt, Human
cagccccgaucugcccccc

SEQ ID NO: 240322 - RNA, 20 nt, Human
cagccccgaucugccccccc

SEQ ID NO: 240323 - RNA, 23 nt, Human
cagccucugccccagcuccugcu

SEQ ID NO: 240324 - RNA, 22 nt, Human
caggagccaagagcauagugca

SEQ ID NO: 240325 - RNA, 18 nt, Human
caggagggauuuggagga

SEQ ID NO: 240326 - RNA, 19 nt, Human
caggcagauucgcuggugc

SEQ ID NO: 240327 - RNA, 22 nt, Human
caggccacagaagccaggccaa

SEQ ID NO: 240328 - RNA, 18 nt, Human
caggucacuuccccaagg

SEQ ID NO: 240329 - RNA, 23 nt, Human
caggugcugacauauccucccca

SEQ ID NO: 240330 - RNA, 18 nt, Human
caguaggcagggcaggca

SEQ ID NO: 240331 - RNA, 22 nt, Human
caucauggguccccaccacaag

SEQ ID NO: 240332 - RNA, 20 nt, Human
cauccccucagcucucuuug

SEQ ID NO: 240333 - RNA, 22 nt, Human
caucgaaccgcaggaggucauu

SEQ ID NO: 240334 - RNA, 21 nt, Human
ccaaaauucaccucaagucag

SEQ ID NO: 240335 - RNA, 21 nt, Human
ccaaagacaaacaugcugcuc

SEQ ID NO: 240336 - RNA, 22 nt, Human
ccaaagacaaacaugcugcucc

SEQ ID NO: 240337 - RNA, 19 nt, Human
ccacaacacgcccaggcca

SEQ ID NO: 240338 - RNA, 21 nt, Human
ccacaacacgcccaggccaca

SEQ ID NO: 240339 - RNA, 23 nt, Human
ccacacuacaccaggagagggug

SEQ ID NO: 240340 - RNA, 22 nt, Human
ccacagaagccaggccaagccc

SEQ ID NO: 240341 - RNA, 20 nt, Human
ccacauccccucagcucucc

SEQ ID NO: 240342 - RNA, 23 nt, Human
ccacucagggccccccacacacc

SEQ ID NO: 240343 - RNA, 18 nt, Human
ccagcaaagauccacagc

SEQ ID NO: 240344 - RNA, 19 nt, Human
ccaggugcugacauauccu

SEQ ID NO: 240345 - RNA, 21 nt, Human
cccaaagucucuccccacuuc

SEQ ID NO: 240346 - RNA, 22 nt, Human
cccacacaccugcauacaccca

SEQ ID NO: 240347 - RNA, 18 nt, Human
cccacauccccucagcuc

SEQ ID NO: 240348 - RNA, 18 nt, Human
cccagagaauacaaacau

SEQ ID NO: 240349 - RNA, 27 nt, Human
cccagugcugaguccacaagguacccc

SEQ ID NO: 240350 - RNA, 19 nt, Human
cccauacaucauggguccc

SEQ ID NO: 240351 - RNA, 21 nt, Human
cccauacaucaugggucccca

SEQ ID NO: 240352 - RNA, 18 nt, Human
ccccaaagacaaacaugc

SEQ ID NO: 240353 - RNA, 20 nt, Human
ccccaaggagcuguggcuuc

SEQ ID NO: 240354 - RNA, 21 nt, Human
ccccacacaccugcauacacc

SEQ ID NO: 240355 - RNA, 23 nt, Human
ccccacacaccugcauacaccca

SEQ ID NO: 240356 - RNA, 18 nt, Human
ccccagccaugguccugg

SEQ ID NO: 240357 - RNA, 21 nt, Human
ccccagccaugguccugggcc

SEQ ID NO: 240358 - RNA, 20 nt, Human
ccccaggccucaggauuccc

SEQ ID NO: 240359 - RNA, 24 nt, Human
ccccaguguaacccccaaagacaa

SEQ ID NO: 240360 - RNA, 18 nt, Human
cccccgugcugcccgguc

SEQ ID NO: 240361 - RNA, 20 nt, Human
ccccgugcugcccgguccag

SEQ ID NO: 240362 - RNA, 19 nt, Human
cccggcccgagccacuuga

SEQ ID NO: 240363 - RNA, 23 nt, Human
cccggcucagccucugccccagc

SEQ ID NO: 240364 - RNA, 18 nt, Human
cccguagcgccgcugcgg

SEQ ID NO: 240365 - RNA, 23 nt, Human
cccguagcgccgcugcgggggug

SEQ ID NO: 240366 - RNA, 22 nt, Human
cccgugcugcccgguccaggaa

SEQ ID NO: 240367 - RNA, 27 nt, Human
cccuuggccuggcaggugccacccacu

SEQ ID NO: 240368 - RNA, 24 nt, Human
ccgccugccaggccgcagccccga

SEQ ID NO: 240369 - RNA, 19 nt, Human
ccgcgcgccgccugccagg

SEQ ID NO: 240370 - RNA, 20 nt, Human
ccuccccagccaugguccug

SEQ ID NO: 240371 - RNA, 20 nt, Human
ccucccggcucagccucugc

SEQ ID NO: 240372 - RNA, 26 nt, Human
ccucccggcucagccucugccccagc

SEQ ID NO: 240373 - RNA, 21 nt, Human
ccugacccuuggccuggcagg

SEQ ID NO: 240374 - RNA, 22 nt, Human
ccugacccuuggccuggcaggu

SEQ ID NO: 240375 - RNA, 24 nt, Human
ccugccaggccgcagccccgaucu

SEQ ID NO: 240376 - RNA, 19 nt, Human
ccugcuguguccucaccuc

SEQ ID NO: 240377 - RNA, 26 nt, Human
ccuggcccagcacgaccgaccuggga

SEQ ID NO: 240378 - RNA, 25 nt, Human
cgacuggcaaccguccuucaauuuu

SEQ ID NO: 240379 - RNA, 23 nt, Human
cgcccacucugggccaccuccuc

SEQ ID NO: 240380 - RNA, 23 nt, Human
cgguggggucccagugguaaagg

SEQ ID NO: 240381 - RNA, 24 nt, Human
cucagccucugccccagcuccugc

SEQ ID NO: 240382 - RNA, 20 nt, Human
cuccccagccaugguccugg

SEQ ID NO: 240383 - RNA, 19 nt, Human
cucgcauccacacuacacc

SEQ ID NO: 240384 - RNA, 23 nt, Human
cucugagugaaugcaccuggccc

SEQ ID NO: 240385 - RNA, 18 nt, Human
cucugggcacccugaccc

SEQ ID NO: 240386 - RNA, 19 nt, Human
cugcccccccgugcugccc

SEQ ID NO: 240387 - RNA, 18 nt, Human
cuggaggccuucacagcc

SEQ ID NO: 240388 - RNA, 21 nt, Human
cugugugcuucugcgccgggc

SEQ ID NO: 240389 - RNA, 18 nt, Human
cuucacaaugggcaggcg

SEQ ID NO: 240390 - RNA, 19 nt, Human
gaauacaaacaucuugucc

SEQ ID NO: 240391 - RNA, 18 nt, Human
gaccuagcgacuggcaac

SEQ ID NO: 240392 - RNA, 23 nt, Human
gagccacaucuuguggaaacugg

SEQ ID NO: 240393 - RNA, 19 nt, Human
gaggagccuugggugacag

SEQ ID NO: 240394 - RNA, 21 nt, Human
gaggagccuugggugacaggc

SEQ ID NO: 240395 - RNA, 23 nt, Human
gaggcucugggcacccugacccu

SEQ ID NO: 240396 - RNA, 21 nt, Human
gaggcuucuggguaggccccu

SEQ ID NO: 240397 - RNA, 18 nt, Human
gagggggucugcuucauc

SEQ ID NO: 240398 - RNA, 22 nt, Human
gaucucgcccacucugggccac

SEQ ID NO: 240399 - RNA, 19 nt, Human
gcacuccacuuccaggugc

SEQ ID NO: 240400 - RNA, 19 nt, Human
gcagcccaggcagauucgc

SEQ ID NO: 240401 - RNA, 19 nt, Human
gcgcugcagccugcacucc

SEQ ID NO: 240402 - RNA, 20 nt, Human
ggaaggccagccuggaggcc

SEQ ID NO: 240403 - RNA, 23 nt, Human
ggagagggugaugacagggaggg

SEQ ID NO: 240404 - RNA, 22 nt, Human
ggaucucagggagggagggaca

SEQ ID NO: 240405 - RNA, 20 nt, Human
ggauuuggaggaggcugccc

SEQ ID NO: 240406 - RNA, 22 nt, Human
ggcacacaauuuuguaaaauuu

SEQ ID NO: 240407 - RNA, 21 nt, Human
ggccucccggcucagccucug

SEQ ID NO: 240408 - RNA, 22 nt, Human
gggaucucgcccacucugggcc

SEQ ID NO: 240409 - RNA, 18 nt, Human
ggggcaaggcagggcaga

SEQ ID NO: 240410 - RNA, 24 nt, Human
gggggaucucgcccacucugggcc

SEQ ID NO: 240411 - RNA, 24 nt, Human
gggggugguggggagccccggagc

SEQ ID NO: 240412 - RNA, 21 nt, Human
ggugguggggagccccggagc

SEQ ID NO: 240413 - RNA, 24 nt, Human
guccacaacacgcccaggccacag

SEQ ID NO: 240414 - RNA, 23 nt, Human
gugugugguggguagcacugcug

SEQ ID NO: 240415 - RNA, 18 nt, Human
guuuggggcccccacauc

SEQ ID NO: 240416 - RNA, 21 nt, Human
uaaaggcccugcaccaggagc

SEQ ID NO: 240417 - RNA, 23 nt, Human
uaacccccaaagacaaacaugcu

SEQ ID NO: 240418 - RNA, 21 nt, Human
ucaagucaggugagacccaua

SEQ ID NO: 240419 - RNA, 22 nt, Human
ucacugagccguggccucgcau

SEQ ID NO: 240420 - RNA, 19 nt, Human
ucagcucucuuuggaggcu

SEQ ID NO: 240421 - RNA, 18 nt, Human
ucagggagggagggacag

SEQ ID NO: 240422 - RNA, 21 nt, Human
ucagggagggagggacaggag

SEQ ID NO: 240423 - RNA, 23 nt, Human
ucagugacaagggucagcauaga

SEQ ID NO: 240424 - RNA, 18 nt, Human
ucaucauccgcucccugu

SEQ ID NO: 240425 - RNA, 18 nt, Human
uccacaacacgcccaggc

SEQ ID NO: 240426 - RNA, 26 nt, Human
uccacaacacgcccaggccacagaag

SEQ ID NO: 240427 - RNA, 22 nt, Human
uccaggagggauuuggaggagg

SEQ ID NO: 240428 - RNA, 19 nt, Human
uccaggugcugacauaucc

SEQ ID NO: 240429 - RNA, 20 nt, Human
ucccauagacgacggccgag

SEQ ID NO: 240430 - RNA, 19 nt, Human
uccccaaggagcuguggcu

SEQ ID NO: 240431 - RNA, 18 nt, Human
ucccuggaaggccagccu

SEQ ID NO: 240432 - RNA, 18 nt, Human
ucccuguggaccuguguc

SEQ ID NO: 240433 - RNA, 21 nt, Human
uccgagcagcuauggucgaag

SEQ ID NO: 240434 - RNA, 21 nt, Human
uccgcucccuguggaccugug

SEQ ID NO: 240435 - RNA, 26 nt, Human
uccuguucccaguaagggagcgcugg

SEQ ID NO: 240436 - RNA, 19 nt, Human
ucgaaccgcaggaggucau

SEQ ID NO: 240437 - RNA, 18 nt, Human
ucucgcccacucugggcc

SEQ ID NO: 240438 - RNA, 18 nt, Human
ucucucuucccuuguucc

SEQ ID NO: 240439 - RNA, 21 nt, Human
ucugcuaagccuccucccgca

SEQ ID NO: 240440 - RNA, 24 nt, Human
ucuucucaguaggcagggcaggca

SEQ ID NO: 240441 - RNA, 21 nt, Human
ugacagaauacucagcaaggg

SEQ ID NO: 240442 - RNA, 24 nt, Human
ugaccuagcgacuggcaaccgucc

SEQ ID NO: 240443 - RNA, 21 nt, Human
ugagccguggccucgcaucca

SEQ ID NO: 240444 - RNA, 24 nt, Human
ugcagccugcacuccacuuccagg

SEQ ID NO: 240445 - RNA, 18 nt, Human
uggaaacuggguagaugg

SEQ ID NO: 240446 - RNA, 18 nt, Human
uggaauaaauguccccag

SEQ ID NO: 240447 - RNA, 21 nt, Human
uggaggaggcugcccuguggg

SEQ ID NO: 240448 - RNA, 19 nt, Human
uggaggccaauuguccaca

SEQ ID NO: 240449 - RNA, 21 nt, Human
ugggcgcugcagccugcacuc

SEQ ID NO: 240450 - RNA, 23 nt, Human
uggggggaucucgcccacucugg

SEQ ID NO: 240451 - RNA, 21 nt, Human
ugggguucugcuaagccaugg

SEQ ID NO: 240452 - RNA, 19 nt, Human
uggguccccaccacaaguu

SEQ ID NO: 240453 - RNA, 20 nt, Human
uguggaaacuggguagaugg

SEQ ID NO: 240454 - RNA, 19 nt, Human
uuccaggugcugacauauc

SEQ ID NO: 240455 - RNA, 25 nt, Human
uugcagacugguucaaggaggcuuc

SEQ ID NO: 240456 - RNA, 18 nt, Human
uuggaggagccuugggug

SEQ ID NO: 240457 - RNA, 21 nt, Human
uuguccuugaauucaaacugg

SEQ ID NO: 240458 - RNA, 28 nt, Human
aaaagaaaaagaaagaagaauaaaagaa

SEQ ID NO: 240459 - RNA, 19 nt, Human
aaaagacaagaaagcaaaa

SEQ ID NO: 240460 - RNA, 18 nt, Human
aaacaacagagaaacucc

SEQ ID NO: 240461 - RNA, 23 nt, Human
aaacaagaaaccacaaagagaaa

SEQ ID NO: 240462 - RNA, 22 nt, Human
aaacaggggcugggccccaggg

SEQ ID NO: 240463 - RNA, 23 nt, Human
aaaccaaacaagaaaccacaaag

SEQ ID NO: 240464 - RNA, 20 nt, Human
aaaccaaaccaaacaagaaa

SEQ ID NO: 240465 - RNA, 21 nt, Human
aaagguuugccgcuaaaccug

SEQ ID NO: 240466 - RNA, 19 nt, Human
aacacccacaggaagguga

SEQ ID NO: 240467 - RNA, 21 nt, Human
aaccaaagcagacagaccccu

SEQ ID NO: 240468 - RNA, 19 nt, Human
aacccucccuucccagcac

SEQ ID NO: 240469 - RNA, 18 nt, Human
aacccuuggauucucccu

SEQ ID NO: 240470 - RNA, 20 nt, Human
aagaaccaguaaacaggggc

SEQ ID NO: 240471 - RNA, 26 nt, Human
aagaagaauaaaagaaaaaucuggaa

SEQ ID NO: 240472 - RNA, 18 nt, Human
aaguucccagacgcuccc

SEQ ID NO: 240473 - RNA, 19 nt, Human
aauugcugagcagggggga

SEQ ID NO: 240474 - RNA, 20 nt, Human
acaacagagaaacuccaccu

SEQ ID NO: 240475 - RNA, 25 nt, Human
acagagcaagacccugucucauaaa

SEQ ID NO: 240476 - RNA, 22 nt, Human
acagucaaaaauagaacaugga

SEQ ID NO: 240477 - RNA, 20 nt, Human
acaucugggccggccuggga

SEQ ID NO: 240478 - RNA, 24 nt, Human
acauuccagaguagccgccggcca

SEQ ID NO: 240479 - RNA, 22 nt, Human
accaaacaagaaaccacaaaga

SEQ ID NO: 240480 - RNA, 25 nt, Human
accaaaccaaacaagaaaccacaaa

SEQ ID NO: 240481 - RNA, 20 nt, Human
accacaaagagaaaaauaac

SEQ ID NO: 240482 - RNA, 18 nt, Human
accauggcggagcacagc

SEQ ID NO: 240483 - RNA, 18 nt, Human
accccgugacaguccagu

SEQ ID NO: 240484 - RNA, 23 nt, Human
accucggggucucuaagggccag

SEQ ID NO: 240485 - RNA, 23 nt, Human
acuccagccugggggacagagca

SEQ ID NO: 240486 - RNA, 19 nt, Human
acucuggggcgggggcugg

SEQ ID NO: 240487 - RNA, 18 nt, Human
acugcacuccagccuggg

SEQ ID NO: 240488 - RNA, 24 nt, Human
acugcacuccagccugggggacag

SEQ ID NO: 240489 - RNA, 21 nt, Human
acugcccaagcuccugagaaa

SEQ ID NO: 240490 - RNA, 19 nt, Human
acugggaggaaaaacucaa

SEQ ID NO: 240491 - RNA, 19 nt, Human
agaaacccagaacucagcc

SEQ ID NO: 240492 - RNA, 22 nt, Human
agaaccaguaaacaggggcugg

SEQ ID NO: 240493 - RNA, 29 nt, Human
agacaagaaagcaaaaaagaagggacccc

SEQ ID NO: 240494 - RNA, 20 nt, Human
agagagggaaggaaaggcca

SEQ ID NO: 240495 - RNA, 20 nt, Human
agagggaagggcaggaagcc

SEQ ID NO: 240496 - RNA, 22 nt, Human
agauauggagaaggcugcacuc

SEQ ID NO: 240497 - RNA, 21 nt, Human
agcagacagaccccuggaccc

SEQ ID NO: 240498 - RNA, 23 nt, Human
agcagguagggacucccagccuc

SEQ ID NO: 240499 - RNA, 18 nt, Human
agcaucuccccaccccua

SEQ ID NO: 240500 - RNA, 21 nt, Human
agccacuucuucucaggcaac

SEQ ID NO: 240501 - RNA, 24 nt, Human
agccacuucuucucaggcaacguu
